United States Patent 7,655,785 (BIOINFORMATICALLY DETECTABLE GROUP OF NOVEL REGULATORY OLIGONUCLEOTIDES AND USES THEREOF) - sequence listing, part 36

SEQ ID NO: 1479432 - RNA, 21 nt, Homo sapiens
aagaaacacagcaacaaugac

SEQ ID NO: 1479433 - RNA, 12 nt, Homo sapiens
aagaaacauaac

SEQ ID NO: 1479434 - RNA, 14 nt, Homo sapiens
aagaaagaucaaag

SEQ ID NO: 1479435 - RNA, 16 nt, Homo sapiens
aagaaagcugagaaga

SEQ ID NO: 1479436 - RNA, 23 nt, Homo sapiens
aagaaaguuuagaagcugagaca

SEQ ID NO: 1479437 - RNA, 18 nt, Homo sapiens
aagaaauauauacuugag

SEQ ID NO: 1479438 - RNA, 13 nt, Homo sapiens
aagaaauauuccu

SEQ ID NO: 1479439 - RNA, 12 nt, Homo sapiens
aagaaaugaaua

SEQ ID NO: 1479440 - RNA, 11 nt, Homo sapiens
aagaaaugcaa

SEQ ID NO: 1479441 - RNA, 18 nt, Homo sapiens
aagaacauggacuuguau

SEQ ID NO: 1479442 - RNA, 16 nt, Homo sapiens
aagaaccgagcaauuu

SEQ ID NO: 1479443 - RNA, 13 nt, Homo sapiens
aagaaccucucac

SEQ ID NO: 1479444 - RNA, 11 nt, Homo sapiens
aagaagacauu

SEQ ID NO: 1479445 - RNA, 21 nt, Homo sapiens
aagaagacuguugccacuuaa

SEQ ID NO: 1479446 - RNA, 13 nt, Homo sapiens
aagaagagaagcu

SEQ ID NO: 1479447 - RNA, 15 nt, Homo sapiens
aagaagagacuggga

SEQ ID NO: 1479448 - RNA, 23 nt, Homo sapiens
aagaagccacccuccuugcagga

SEQ ID NO: 1479449 - RNA, 21 nt, Homo sapiens
aagaagccauauaugaccaga

SEQ ID NO: 1479450 - RNA, 23 nt, Homo sapiens
aagaagcugguggagcagagugu

SEQ ID NO: 1479451 - RNA, 15 nt, Homo sapiens
aagaaggcaauauua

SEQ ID NO: 1479452 - RNA, 12 nt, Homo sapiens
aagaauaauuca

SEQ ID NO: 1479453 - RNA, 21 nt, Homo sapiens
aagaaucuaaaccuuacaugu

SEQ ID NO: 1479454 - RNA, 16 nt, Homo sapiens
aagaaugaacacuccc

SEQ ID NO: 1479455 - RNA, 23 nt, Homo sapiens
aagaauucaaacuggggccucca

SEQ ID NO: 1479456 - RNA, 22 nt, Homo sapiens
aagaauucuggauaucucagga

SEQ ID NO: 1479457 - RNA, 13 nt, Homo sapiens
aagacaaaccaag

SEQ ID NO: 1479458 - RNA, 17 nt, Homo sapiens
aagacaccagagcagau

SEQ ID NO: 1479459 - RNA, 22 nt, Homo sapiens
aagacauaacguuuuuccuuua

SEQ ID NO: 1479460 - RNA, 24 nt, Homo sapiens
aagacauucuaauuccagucauuu

SEQ ID NO: 1479461 - RNA, 15 nt, Homo sapiens
aagacauucuuccaa

SEQ ID NO: 1479462 - RNA, 19 nt, Homo sapiens
aagacccccagcacuuggg

SEQ ID NO: 1479463 - RNA, 13 nt, Homo sapiens
aagacccucccau

SEQ ID NO: 1479464 - RNA, 22 nt, Homo sapiens
aagacgucucuuuuugguaaua

SEQ ID NO: 1479465 - RNA, 13 nt, Homo sapiens
aagacuacuauac

SEQ ID NO: 1479466 - RNA, 18 nt, Homo sapiens
aagacuagaggcuugcau

SEQ ID NO: 1479467 - RNA, 14 nt, Homo sapiens
aagacuauaccuua

SEQ ID NO: 1479468 - RNA, 15 nt, Homo sapiens
aagacuccaucucaa

SEQ ID NO: 1479469 - RNA, 14 nt, Homo sapiens
aagacuccgucuca

SEQ ID NO: 1479470 - RNA, 22 nt, Homo sapiens
aagacugaauguuuuauuuauc

SEQ ID NO: 1479471 - RNA, 21 nt, Homo sapiens
aagacuggaagcuaauuugca

SEQ ID NO: 1479472 - RNA, 20 nt, Homo sapiens
aagacuggaauauaauuuca

SEQ ID NO: 1479473 - RNA, 18 nt, Homo sapiens
aagacugguuuucugcca

SEQ ID NO: 1479474 - RNA, 13 nt, Homo sapiens
aagacugucucaa

SEQ ID NO: 1479475 - RNA, 19 nt, Homo sapiens
aagacuguugccacuuaac

SEQ ID NO: 1479476 - RNA, 21 nt, Homo sapiens
aagcagaauuuaaguugguaa

SEQ ID NO: 1479477 - RNA, 16 nt, Homo sapiens
aagcagaugcucugaa

SEQ ID NO: 1479478 - RNA, 23 nt, Homo sapiens
aagcagcauggaaaaaugguuga

SEQ ID NO: 1479479 - RNA, 19 nt, Homo sapiens
aagcagucuugcucuguua

SEQ ID NO: 1479480 - RNA, 20 nt, Homo sapiens
aagcaguuacuaauaugccu

SEQ ID NO: 1479481 - RNA, 23 nt, Homo sapiens
aagcaucucagccuaccaugaga

SEQ ID NO: 1479482 - RNA, 18 nt, Homo sapiens
aagcauucuccccagugu

SEQ ID NO: 1479483 - RNA, 18 nt, Homo sapiens
aagcauuucuagcaguga

SEQ ID NO: 1479484 - RNA, 21 nt, Homo sapiens
aagcauuugcaacagcuacag

SEQ ID NO: 1479485 - RNA, 23 nt, Homo sapiens
aagccaaagaaaaauaacccuuu

SEQ ID NO: 1479486 - RNA, 21 nt, Homo sapiens
aagccaauucagacaggcaaa

SEQ ID NO: 1479487 - RNA, 17 nt, Homo sapiens
aagccacaagucuucca

SEQ ID NO: 1479488 - RNA, 20 nt, Homo sapiens
aagccacagcagguccucca

SEQ ID NO: 1479489 - RNA, 21 nt, Homo sapiens
aagccacagcagguccuccau

SEQ ID NO: 1479490 - RNA, 20 nt, Homo sapiens
aagccacucugucccuuccu

SEQ ID NO: 1479491 - RNA, 16 nt, Homo sapiens
aagccacugggcacug

SEQ ID NO: 1479492 - RNA, 21 nt, Homo sapiens
aagccauguauaaaugugaua

SEQ ID NO: 1479493 - RNA, 14 nt, Homo sapiens
aagccauuaugaua

SEQ ID NO: 1479494 - RNA, 17 nt, Homo sapiens
aagcccaagugaaauca

SEQ ID NO: 1479495 - RNA, 20 nt, Homo sapiens
aagccccauccaacacugga

SEQ ID NO: 1479496 - RNA, 18 nt, Homo sapiens
aagccccauuuccucaca

SEQ ID NO: 1479497 - RNA, 23 nt, Homo sapiens
aagcccugauguguccucaggga

SEQ ID NO: 1479498 - RNA, 13 nt, Homo sapiens
aagcccuuugcca

SEQ ID NO: 1479499 - RNA, 15 nt, Homo sapiens
aagccuaagaaucuu

SEQ ID NO: 1479500 - RNA, 12 nt, Homo sapiens
aagccuccucau

SEQ ID NO: 1479501 - RNA, 21 nt, Homo sapiens
aagccucguuuugaugccauu

SEQ ID NO: 1479502 - RNA, 18 nt, Homo sapiens
aagccugucugagacuca

SEQ ID NO: 1479503 - RNA, 17 nt, Homo sapiens
aagcgauucuccugccu

SEQ ID NO: 1479504 - RNA, 21 nt, Homo sapiens
aagcguaauuuugccaaauaa

SEQ ID NO: 1479505 - RNA, 21 nt, Homo sapiens
aagcguuucuuuacuucucac

SEQ ID NO: 1479506 - RNA, 20 nt, Homo sapiens
aagcuaaaauuagaugaacu

SEQ ID NO: 1479507 - RNA, 22 nt, Homo sapiens
aagcuaaaauuagaugaacuca

SEQ ID NO: 1479508 - RNA, 12 nt, Homo sapiens
aagcuaaaucau

SEQ ID NO: 1479509 - RNA, 19 nt, Homo sapiens
aagcuaauaaaauucgcuu

SEQ ID NO: 1479510 - RNA, 18 nt, Homo sapiens
aagcuaguguaccuccuc

SEQ ID NO: 1479511 - RNA, 21 nt, Homo sapiens
aagcuaguguaccuccucuca

SEQ ID NO: 1479512 - RNA, 16 nt, Homo sapiens
aagcuauauaagacaa

SEQ ID NO: 1479513 - RNA, 16 nt, Homo sapiens
aagcucacucuggauu

SEQ ID NO: 1479514 - RNA, 14 nt, Homo sapiens
aagcucaugcauuu

SEQ ID NO: 1479515 - RNA, 12 nt, Homo sapiens
aagcuccacugu

SEQ ID NO: 1479516 - RNA, 15 nt, Homo sapiens
aagcuccacugucac

SEQ ID NO: 1479517 - RNA, 14 nt, Homo sapiens
aagcucugaaguca

SEQ ID NO: 1479518 - RNA, 14 nt, Homo sapiens
aagcugccauauau

SEQ ID NO: 1479519 - RNA, 22 nt, Homo sapiens
aagcugcuaccccuacaucauc

SEQ ID NO: 1479520 - RNA, 20 nt, Homo sapiens
aagcugcuccaggccugcag

SEQ ID NO: 1479521 - RNA, 23 nt, Homo sapiens
aagcuggaagaagugagcagugu

SEQ ID NO: 1479522 - RNA, 20 nt, Homo sapiens
aagcuguccucccaccucag

SEQ ID NO: 1479523 - RNA, 14 nt, Homo sapiens
aagcugucuuagag

SEQ ID NO: 1479524 - RNA, 19 nt, Homo sapiens
aagcuguuuccauagggug

SEQ ID NO: 1479525 - RNA, 18 nt, Homo sapiens
aagcuuaacacuugaccu

SEQ ID NO: 1479526 - RNA, 17 nt, Homo sapiens
accuguccccacccucc

SEQ ID NO: 1479527 - RNA, 13 nt, Homo sapiens
accugucugcucc

SEQ ID NO: 1479528 - RNA, 15 nt, Homo sapiens
accugugagcccagc

SEQ ID NO: 1479529 - RNA, 16 nt, Homo sapiens
accuguuagcagacag

SEQ ID NO: 1479530 - RNA, 20 nt, Homo sapiens
accuguugagacugauucag

SEQ ID NO: 1479531 - RNA, 17 nt, Homo sapiens
accuuauuguaccucuc

SEQ ID NO: 1479532 - RNA, 15 nt, Homo sapiens
accuucaauacuuaa

SEQ ID NO: 1479533 - RNA, 18 nt, Homo sapiens
accuuccccagcguccca

SEQ ID NO: 1479534 - RNA, 16 nt, Homo sapiens
accuucguccuuuuaa

SEQ ID NO: 1479535 - RNA, 20 nt, Homo sapiens
accuucuguggcucacagaa

SEQ ID NO: 1479536 - RNA, 15 nt, Homo sapiens
accuugaaugcugcc

SEQ ID NO: 1479537 - RNA, 21 nt, Homo sapiens
accuugacuugauuagugccu

SEQ ID NO: 1479538 - RNA, 17 nt, Homo sapiens
accuuuggagcaaagcu

SEQ ID NO: 1479539 - RNA, 16 nt, Homo sapiens
accuuuuauguagcac

SEQ ID NO: 1479540 - RNA, 21 nt, Homo sapiens
accuuuuccccaaccacagag

SEQ ID NO: 1479541 - RNA, 22 nt, Homo sapiens
accuuuuggugaaagcugagaa

SEQ ID NO: 1479542 - RNA, 18 nt, Homo sapiens
acgaaaguggaaauggag

SEQ ID NO: 1479543 - RNA, 18 nt, Homo sapiens
acgaagccuuaagccaua

SEQ ID NO: 1479544 - RNA, 22 nt, Homo sapiens
acgaauauagaggguuuugcuc

SEQ ID NO: 1479545 - RNA, 19 nt, Homo sapiens
acgacuaaucaccuacuca

SEQ ID NO: 1479546 - RNA, 13 nt, Homo sapiens
acgacuucagggc

SEQ ID NO: 1479547 - RNA, 19 nt, Homo sapiens
acgaggccacagcugccau

SEQ ID NO: 1479548 - RNA, 13 nt, Homo sapiens
acgauuucagcua

SEQ ID NO: 1479549 - RNA, 14 nt, Homo sapiens
acgcaguucuuucc

SEQ ID NO: 1479550 - RNA, 15 nt, Homo sapiens
acgcccuccccagac

SEQ ID NO: 1479551 - RNA, 16 nt, Homo sapiens
acgccuggcuaauaag

SEQ ID NO: 1479552 - RNA, 13 nt, Homo sapiens
acgccuguagucc

SEQ ID NO: 1479553 - RNA, 19 nt, Homo sapiens
acgccuguaguccuagcca

SEQ ID NO: 1479554 - RNA, 18 nt, Homo sapiens
acgcucugcugugggcac

SEQ ID NO: 1479555 - RNA, 16 nt, Homo sapiens
acggagucuugcucug

SEQ ID NO: 1479556 - RNA, 20 nt, Homo sapiens
acggccuguacggacacugu

SEQ ID NO: 1479557 - RNA, 16 nt, Homo sapiens
acggcgcccccagugu

SEQ ID NO: 1479558 - RNA, 19 nt, Homo sapiens
acgggaauucagacaagcu

SEQ ID NO: 1479559 - RNA, 20 nt, Homo sapiens
acgguggcucacgccuguaa

SEQ ID NO: 1479560 - RNA, 18 nt, Homo sapiens
acguccagcucguucucu

SEQ ID NO: 1479561 - RNA, 19 nt, Homo sapiens
acguccuccguccauauca

SEQ ID NO: 1479562 - RNA, 23 nt, Homo sapiens
acgucgcccgcugagcugagugg

SEQ ID NO: 1479563 - RNA, 16 nt, Homo sapiens
acgugcgcgaugugac

SEQ ID NO: 1479564 - RNA, 14 nt, Homo sapiens
acguggcucagcca

SEQ ID NO: 1479565 - RNA, 19 nt, Homo sapiens
acgugggcaaacaggcagu

SEQ ID NO: 1479566 - RNA, 20 nt, Homo sapiens
acguggucacugugcacugc

SEQ ID NO: 1479567 - RNA, 22 nt, Homo sapiens
acgugucuuccacuuugcauau

SEQ ID NO: 1479568 - RNA, 12 nt, Homo sapiens
acguguguaaau

SEQ ID NO: 1479569 - RNA, 15 nt, Homo sapiens
acguucauaaccaac

SEQ ID NO: 1479570 - RNA, 16 nt, Homo sapiens
acuaaaaauacaaaaa

SEQ ID NO: 1479571 - RNA, 19 nt, Homo sapiens
acuaaaccgauaaugcaug

SEQ ID NO: 1479572 - RNA, 17 nt, Homo sapiens
acuaaaggugcacugcu

SEQ ID NO: 1479573 - RNA, 14 nt, Homo sapiens
acuaaaguuuuaca

SEQ ID NO: 1479574 - RNA, 13 nt, Homo sapiens
acuaaaugaacau

SEQ ID NO: 1479575 - RNA, 13 nt, Homo sapiens
acuaaaugaacua

SEQ ID NO: 1479576 - RNA, 20 nt, Homo sapiens
acuaaccaguaccucuguau

SEQ ID NO: 1479577 - RNA, 18 nt, Homo sapiens
acuaaccuggguucccuu

SEQ ID NO: 1479578 - RNA, 16 nt, Homo sapiens
acugaagcuguucuca

SEQ ID NO: 1479579 - RNA, 19 nt, Homo sapiens
acugaaggacacagcagug

SEQ ID NO: 1479580 - RNA, 19 nt, Homo sapiens
acugaaggcauaugcuggc

SEQ ID NO: 1479581 - RNA, 16 nt, Homo sapiens
acugaaggugauggag

SEQ ID NO: 1479582 - RNA, 16 nt, Homo sapiens
acugaaggugauucac

SEQ ID NO: 1479583 - RNA, 22 nt, Homo sapiens
acugaauauaaaaacauuugua

SEQ ID NO: 1479584 - RNA, 16 nt, Homo sapiens
acugacaaccucaucc

SEQ ID NO: 1479585 - RNA, 19 nt, Homo sapiens
acugacaaccucauccagg

SEQ ID NO: 1479586 - RNA, 21 nt, Homo sapiens
acugacaaccucauccaggcu

SEQ ID NO: 1479587 - RNA, 21 nt, Homo sapiens
acugacucugacucaucccca

SEQ ID NO: 1479588 - RNA, 17 nt, Homo sapiens
acugacugccuugcuaa

SEQ ID NO: 1479589 - RNA, 21 nt, Homo sapiens
acugacuggauucauucucau

SEQ ID NO: 1479590 - RNA, 12 nt, Homo sapiens
acugacuugagg

SEQ ID NO: 1479591 - RNA, 20 nt, Homo sapiens
acugacuuuccgagccucca

SEQ ID NO: 1479592 - RNA, 19 nt, Homo sapiens
acugagaagugcacuuuaa

SEQ ID NO: 1479593 - RNA, 13 nt, Homo sapiens
acugagcugagac

SEQ ID NO: 1479594 - RNA, 18 nt, Homo sapiens
acugauacuucacuacuu

SEQ ID NO: 1479595 - RNA, 15 nt, Homo sapiens
acugaucuuacucac

SEQ ID NO: 1479596 - RNA, 21 nt, Homo sapiens
acugauguuacaucacagugu

SEQ ID NO: 1479597 - RNA, 14 nt, Homo sapiens
acugauuucacaac

SEQ ID NO: 1479598 - RNA, 21 nt, Homo sapiens
acugauuuuguaaaguugccu

SEQ ID NO: 1479599 - RNA, 20 nt, Homo sapiens
acugcaaaccauggugagaa

SEQ ID NO: 1479600 - RNA, 15 nt, Homo sapiens
acugcacacugccug

SEQ ID NO: 1479601 - RNA, 20 nt, Homo sapiens
acugcacacugccuggccca

SEQ ID NO: 1479602 - RNA, 19 nt, Homo sapiens
acugcacagugcaucucag

SEQ ID NO: 1479603 - RNA, 15 nt, Homo sapiens
acugcacucuucagg

SEQ ID NO: 1479604 - RNA, 16 nt, Homo sapiens
acugcagcaccuccag

SEQ ID NO: 1479605 - RNA, 17 nt, Homo sapiens
acugcaggagcaguuug

SEQ ID NO: 1479606 - RNA, 14 nt, Homo sapiens
acugcagucagcau

SEQ ID NO: 1479607 - RNA, 14 nt, Homo sapiens
acugcagugagaau

SEQ ID NO: 1479608 - RNA, 14 nt, Homo sapiens
acugcaguggacag

SEQ ID NO: 1479609 - RNA, 12 nt, Homo sapiens
acugccaagugg

SEQ ID NO: 1479610 - RNA, 16 nt, Homo sapiens
acugccaggcugccuc

SEQ ID NO: 1479611 - RNA, 17 nt, Homo sapiens
acugccaucauuuacuu

SEQ ID NO: 1479612 - RNA, 15 nt, Homo sapiens
acugcccauggacag

SEQ ID NO: 1479613 - RNA, 23 nt, Homo sapiens
acugcccgagcuggugcauuaca

SEQ ID NO: 1479614 - RNA, 22 nt, Homo sapiens
acugccucuggaauugcucaag

SEQ ID NO: 1479615 - RNA, 20 nt, Homo sapiens
acugccugugaaguggaugg

SEQ ID NO: 1479616 - RNA, 13 nt, Homo sapiens
acugccuuugcag

SEQ ID NO: 1479617 - RNA, 14 nt, Homo sapiens
acugcgaacacuga

SEQ ID NO: 1479618 - RNA, 18 nt, Homo sapiens
acugcucuguguuuacag

SEQ ID NO: 1479619 - RNA, 14 nt, Homo sapiens
acugcuuaauucaa

SEQ ID NO: 1479620 - RNA, 15 nt, Homo sapiens
acugcuuaauucaaa

SEQ ID NO: 1479621 - RNA, 17 nt, Homo sapiens
acuggauggucaucucg

SEQ ID NO: 1479622 - RNA, 22 nt, Homo sapiens
acuggauuggccaaacaucaga

SEQ ID NO: 1479623 - RNA, 16 nt, Homo sapiens
acuggcagcaucuuca

SEQ ID NO: 1479624 - RNA, 22 nt, Homo sapiens
acuggccagggccacgcuccag

SEQ ID NO: 1479625 - RNA, 17 nt, Homo sapiens
acuggcugucaguauga

SEQ ID NO: 1479626 - RNA, 22 nt, Homo sapiens
acugggaugagccgcugugagc

SEQ ID NO: 1479627 - RNA, 23 nt, Homo sapiens
acuuuguuugucacaaguggugu

SEQ ID NO: 1479628 - RNA, 17 nt, Homo sapiens
acuuuuaaguugcugau

SEQ ID NO: 1479629 - RNA, 23 nt, Homo sapiens
acuuuuaaguugcugaugaacuc

SEQ ID NO: 1479630 - RNA, 17 nt, Homo sapiens
acuuuucaagcugcuga

SEQ ID NO: 1479631 - RNA, 21 nt, Homo sapiens
acuuuucaagcugcugaagga

SEQ ID NO: 1479632 - RNA, 20 nt, Homo sapiens
acuuuuuuagaaaugcaaaa

SEQ ID NO: 1479633 - RNA, 17 nt, Homo sapiens
agaaaaacaccgcuucu

SEQ ID NO: 1479634 - RNA, 18 nt, Homo sapiens
agaaaaagaaaugaacau

SEQ ID NO: 1479635 - RNA, 18 nt, Homo sapiens
agaaaaaggcaguggccu

SEQ ID NO: 1479636 - RNA, 13 nt, Homo sapiens
agaaaaauacuuu

SEQ ID NO: 1479637 - RNA, 17 nt, Homo sapiens
agaaaaauauauacuaa

SEQ ID NO: 1479638 - RNA, 23 nt, Homo sapiens
agaaaacucugguaaaugaucac

SEQ ID NO: 1479639 - RNA, 16 nt, Homo sapiens
agaaaagaaauuaguu

SEQ ID NO: 1479640 - RNA, 14 nt, Homo sapiens
agaaaagcugccau

SEQ ID NO: 1479641 - RNA, 17 nt, Homo sapiens
agaaaaggaacaguugc

SEQ ID NO: 1479642 - RNA, 19 nt, Homo sapiens
agaaaaggccuucuuccca

SEQ ID NO: 1479643 - RNA, 22 nt, Homo sapiens
agaaaaugccucaauucacaua

SEQ ID NO: 1479644 - RNA, 18 nt, Homo sapiens
agaaaauguguaauucaa

SEQ ID NO: 1479645 - RNA, 16 nt, Homo sapiens
agaaaauguguccuau

SEQ ID NO: 1479646 - RNA, 22 nt, Homo sapiens
agaaaauguucuguuugcugug

SEQ ID NO: 1479647 - RNA, 20 nt, Homo sapiens
agaaaccuuauuguaccucu

SEQ ID NO: 1479648 - RNA, 17 nt, Homo sapiens
agaaacuuugccucaag

SEQ ID NO: 1479649 - RNA, 17 nt, Homo sapiens
agaaagaaguccuuucu

SEQ ID NO: 1479650 - RNA, 18 nt, Homo sapiens
agaaagacucugagaugu

SEQ ID NO: 1479651 - RNA, 21 nt, Homo sapiens
agaaagcauccuaaauauauc

SEQ ID NO: 1479652 - RNA, 15 nt, Homo sapiens
agaaaggguuccaaa

SEQ ID NO: 1479653 - RNA, 18 nt, Homo sapiens
agaaagugaagcaaauca

SEQ ID NO: 1479654 - RNA, 23 nt, Homo sapiens
agaaauaaauguaccugauguac

SEQ ID NO: 1479655 - RNA, 13 nt, Homo sapiens
agaaauacuuuca

SEQ ID NO: 1479656 - RNA, 22 nt, Homo sapiens
agaaauauaugcagcugugaua

SEQ ID NO: 1479657 - RNA, 18 nt, Homo sapiens
agaaauauggacacuuaa

SEQ ID NO: 1479658 - RNA, 14 nt, Homo sapiens
agaaauaugugaga

SEQ ID NO: 1479659 - RNA, 13 nt, Homo sapiens
agaaaucuagaag

SEQ ID NO: 1479660 - RNA, 19 nt, Homo sapiens
agaaaucuagaagacuguc

SEQ ID NO: 1479661 - RNA, 11 nt, Homo sapiens
agaaaugcaaa

SEQ ID NO: 1479662 - RNA, 19 nt, Homo sapiens
agaaaugcugcuggccaaa

SEQ ID NO: 1479663 - RNA, 19 nt, Homo sapiens
agaaaugugucaucaggag

SEQ ID NO: 1479664 - RNA, 23 nt, Homo sapiens
agaaauguuaaagguucacaggg

SEQ ID NO: 1479665 - RNA, 19 nt, Homo sapiens
agaaauuaacaaaugugcu

SEQ ID NO: 1479666 - RNA, 22 nt, Homo sapiens
agaaauuaacaaaugugcugcu

SEQ ID NO: 1479667 - RNA, 14 nt, Homo sapiens
agaaauuaguuuca

SEQ ID NO: 1479668 - RNA, 16 nt, Homo sapiens
agaacaacuacuguga

SEQ ID NO: 1479669 - RNA, 17 nt, Homo sapiens
agaacacguuggcucag

SEQ ID NO: 1479670 - RNA, 16 nt, Homo sapiens
agaacacuacugcuaa

SEQ ID NO: 1479671 - RNA, 13 nt, Homo sapiens
agaacagggucau

SEQ ID NO: 1479672 - RNA, 17 nt, Homo sapiens
agaacauggacuuguau

SEQ ID NO: 1479673 - RNA, 12 nt, Homo sapiens
agaacauuuuaa

SEQ ID NO: 1479674 - RNA, 16 nt, Homo sapiens
agaacauuuuaauuca

SEQ ID NO: 1479675 - RNA, 20 nt, Homo sapiens
agaaccagagaggcucugag

SEQ ID NO: 1479676 - RNA, 18 nt, Homo sapiens
agaaccgagcaaagauca

SEQ ID NO: 1479677 - RNA, 19 nt, Homo sapiens
agaaccucagauucuucau

SEQ ID NO: 1479678 - RNA, 17 nt, Homo sapiens
agaaccuucaacccagu

SEQ ID NO: 1479679 - RNA, 14 nt, Homo sapiens
aagguuacuggaua

SEQ ID NO: 1479680 - RNA, 18 nt, Homo sapiens
aagguucccucugagaau

SEQ ID NO: 1479681 - RNA, 15 nt, Homo sapiens
aagguucugcccuua

SEQ ID NO: 1479682 - RNA, 17 nt, Homo sapiens
aagguugaacuuugcca

SEQ ID NO: 1479683 - RNA, 19 nt, Homo sapiens
aagguuggugaauuucaca

SEQ ID NO: 1479684 - RNA, 21 nt, Homo sapiens
aagguuuuaaccgcacaugca

SEQ ID NO: 1479685 - RNA, 13 nt, Homo sapiens
aaguaaugaauuu

SEQ ID NO: 1479686 - RNA, 13 nt, Homo sapiens
aaguaaugauuaa

SEQ ID NO: 1479687 - RNA, 18 nt, Homo sapiens
aaguaccuugaacucuua

SEQ ID NO: 1479688 - RNA, 23 nt, Homo sapiens
aaguacuccuauugccgccagaa

SEQ ID NO: 1479689 - RNA, 20 nt, Homo sapiens
aaguagaagucauauguugu

SEQ ID NO: 1479690 - RNA, 14 nt, Homo sapiens
aaguagaauccuaa

SEQ ID NO: 1479691 - RNA, 22 nt, Homo sapiens
aaguagauuagaaaacuagauu

SEQ ID NO: 1479692 - RNA, 18 nt, Homo sapiens
aaguagauuuuaaaagau

SEQ ID NO: 1479693 - RNA, 20 nt, Homo sapiens
aaguagcaaaaaguauugaa

SEQ ID NO: 1479694 - RNA, 17 nt, Homo sapiens
aaguagcacccuggauu

SEQ ID NO: 1479695 - RNA, 22 nt, Homo sapiens
aaguagcuuuccacauuuguca

SEQ ID NO: 1479696 - RNA, 18 nt, Homo sapiens
aaguagguuuacauucau

SEQ ID NO: 1479697 - RNA, 19 nt, Homo sapiens
aaguauaaucagcacuuug

SEQ ID NO: 1479698 - RNA, 22 nt, Homo sapiens
aaguauaaucagcacuuugcca

SEQ ID NO: 1479699 - RNA, 21 nt, Homo sapiens
aaguauacuuuuccccuguua

SEQ ID NO: 1479700 - RNA, 13 nt, Homo sapiens
aaguaugagggaa

SEQ ID NO: 1479701 - RNA, 13 nt, Homo sapiens
aaguauguugaua

SEQ ID NO: 1479702 - RNA, 18 nt, Homo sapiens
aaguauuauuuauuugaa

SEQ ID NO: 1479703 - RNA, 19 nt, Homo sapiens
aaguauuauuuauuugaau

SEQ ID NO: 1479704 - RNA, 15 nt, Homo sapiens
aagucaacaaacugc

SEQ ID NO: 1479705 - RNA, 14 nt, Homo sapiens
aagucaacauaugc

SEQ ID NO: 1479706 - RNA, 13 nt, Homo sapiens
aagucacugcaca

SEQ ID NO: 1479707 - RNA, 16 nt, Homo sapiens
aagucagaucuggucu

SEQ ID NO: 1479708 - RNA, 17 nt, Homo sapiens
aagucagcaugccucua

SEQ ID NO: 1479709 - RNA, 20 nt, Homo sapiens
aagucagcucagacccagac

SEQ ID NO: 1479710 - RNA, 13 nt, Homo sapiens
aagucagcuccag

SEQ ID NO: 1479711 - RNA, 23 nt, Homo sapiens
aagucauagguuacagaccucag

SEQ ID NO: 1479712 - RNA, 22 nt, Homo sapiens
aagucaucucauuccacuguug

SEQ ID NO: 1479713 - RNA, 19 nt, Homo sapiens
aaguccuacaagcuaaaau

SEQ ID NO: 1479714 - RNA, 23 nt, Homo sapiens
aaguccugacacuauucauuuga

SEQ ID NO: 1479715 - RNA, 13 nt, Homo sapiens
aaguccuuuguga

SEQ ID NO: 1479716 - RNA, 22 nt, Homo sapiens
aagucuccugucuuauggucca

SEQ ID NO: 1479717 - RNA, 16 nt, Homo sapiens
aagucugcuacccuca

SEQ ID NO: 1479718 - RNA, 21 nt, Homo sapiens
aagugaagaacacuacugcua

SEQ ID NO: 1479719 - RNA, 22 nt, Homo sapiens
aagugaagagugacuaguacaa

SEQ ID NO: 1479720 - RNA, 13 nt, Homo sapiens
aagugacucucac

SEQ ID NO: 1479721 - RNA, 19 nt, Homo sapiens
aagugagaaaaugccucaa

SEQ ID NO: 1479722 - RNA, 19 nt, Homo sapiens
aagugaucaaacuacauau

SEQ ID NO: 1479723 - RNA, 12 nt, Homo sapiens
aagugcugcuau

SEQ ID NO: 1479724 - RNA, 14 nt, Homo sapiens
aaguggacucaggg

SEQ ID NO: 1479725 - RNA, 18 nt, Homo sapiens
aagugguaggaaagccuc

SEQ ID NO: 1479726 - RNA, 19 nt, Homo sapiens
aagugguaggaaagccuca

SEQ ID NO: 1479727 - RNA, 14 nt, Homo sapiens
aaguguacauaugu

SEQ ID NO: 1479728 - RNA, 15 nt, Homo sapiens
aaguguaccugugua

SEQ ID NO: 1479729 - RNA, 20 nt, Homo sapiens
ugaauccuuaaaggugagcc

SEQ ID NO: 1479730 - RNA, 17 nt, Homo sapiens
ugaaucucccacuccag

SEQ ID NO: 1479731 - RNA, 20 nt, Homo sapiens
ugaaucugugccugcacuga

SEQ ID NO: 1479732 - RNA, 16 nt, Homo sapiens
ugaaugaacaaaugaa

SEQ ID NO: 1479733 - RNA, 13 nt, Homo sapiens
ugaaugaagucaa

SEQ ID NO: 1479734 - RNA, 20 nt, Homo sapiens
ugaaugacacgccuaagguc

SEQ ID NO: 1479735 - RNA, 20 nt, Homo sapiens
ugaaugccuccuguggggaa

SEQ ID NO: 1479736 - RNA, 12 nt, Homo sapiens
ugaaugcuuccu

SEQ ID NO: 1479737 - RNA, 16 nt, Homo sapiens
ugaaugguuccaugcc

SEQ ID NO: 1479738 - RNA, 15 nt, Homo sapiens
ugaauguaugugcac

SEQ ID NO: 1479739 - RNA, 23 nt, Homo sapiens
ugaaugugguuacuuccuacugu

SEQ ID NO: 1479740 - RNA, 17 nt, Homo sapiens
ugaauuauugacacuga

SEQ ID NO: 1479741 - RNA, 13 nt, Homo sapiens
ugaauucaagaaa

SEQ ID NO: 1479742 - RNA, 21 nt, Homo sapiens
ugaauucuaccuuuaaggguu

SEQ ID NO: 1479743 - RNA, 18 nt, Homo sapiens
ugaauuucacaagcuauu

SEQ ID NO: 1479744 - RNA, 23 nt, Homo sapiens
ugaauuuuaguuugguucacuua

SEQ ID NO: 1479745 - RNA, 16 nt, Homo sapiens
ugaauuuuuaugauau

SEQ ID NO: 1479746 - RNA, 11 nt, Homo sapiens
ugacaaaaagc

SEQ ID NO: 1479747 - RNA, 19 nt, Homo sapiens
ugacaacaaccuaugcacc

SEQ ID NO: 1479748 - RNA, 13 nt, Homo sapiens
ugacaacaugcua

SEQ ID NO: 1479749 - RNA, 15 nt, Homo sapiens
ugacacaagcacuuu

SEQ ID NO: 1479750 - RNA, 23 nt, Homo sapiens
ugacacccacccugugccaucac

SEQ ID NO: 1479751 - RNA, 22 nt, Homo sapiens
ugacacccuggccugaacugag

SEQ ID NO: 1479752 - RNA, 18 nt, Homo sapiens
ugacacgucugccuaccc

SEQ ID NO: 1479753 - RNA, 19 nt, Homo sapiens
ugacagacaggcucuuagc

SEQ ID NO: 1479754 - RNA, 22 nt, Homo sapiens
ugacagagcucuggguugugca

SEQ ID NO: 1479755 - RNA, 21 nt, Homo sapiens
ugacagcccugaacgugagca

SEQ ID NO: 1479756 - RNA, 12 nt, Homo sapiens
ugacagccuccc

SEQ ID NO: 1479757 - RNA, 17 nt, Homo sapiens
ugacagcugcaagccag

SEQ ID NO: 1479758 - RNA, 16 nt, Homo sapiens
ugacagggaaaacugc

SEQ ID NO: 1479759 - RNA, 17 nt, Homo sapiens
ugacaguaaaucucaca

SEQ ID NO: 1479760 - RNA, 17 nt, Homo sapiens
ugacagugccugggaau

SEQ ID NO: 1479761 - RNA, 16 nt, Homo sapiens
ugacauaagugcuauu

SEQ ID NO: 1479762 - RNA, 16 nt, Homo sapiens
ugacauaauauauucu

SEQ ID NO: 1479763 - RNA, 13 nt, Homo sapiens
ugacauacauauu

SEQ ID NO: 1479764 - RNA, 14 nt, Homo sapiens
ugacaucacagcag

SEQ ID NO: 1479765 - RNA, 19 nt, Homo sapiens
ugacaucucaggggccaga

SEQ ID NO: 1479766 - RNA, 14 nt, Homo sapiens
ugacaugcauuguu

SEQ ID NO: 1479767 - RNA, 13 nt, Homo sapiens
ugacauguagcuu

SEQ ID NO: 1479768 - RNA, 15 nt, Homo sapiens
ugacauguagcuucu

SEQ ID NO: 1479769 - RNA, 18 nt, Homo sapiens
ugacauuuauauauugaa

SEQ ID NO: 1479770 - RNA, 15 nt, Homo sapiens
ugacauuugcucuga

SEQ ID NO: 1479771 - RNA, 17 nt, Homo sapiens
ugaccaaagagcccuca

SEQ ID NO: 1479772 - RNA, 18 nt, Homo sapiens
ugaccaaaggugugcccu

SEQ ID NO: 1479773 - RNA, 22 nt, Homo sapiens
ugaccaauauuauacuaagaaa

SEQ ID NO: 1479774 - RNA, 23 nt, Homo sapiens
ugaccacucuucuuuaagccaua

SEQ ID NO: 1479775 - RNA, 11 nt, Homo sapiens
ugaccaggaac

SEQ ID NO: 1479776 - RNA, 21 nt, Homo sapiens
ugacccaggccuggccaguca

SEQ ID NO: 1479777 - RNA, 14 nt, Homo sapiens
ugaccccaaagagc

SEQ ID NO: 1479778 - RNA, 14 nt, Homo sapiens
ugaccccacugcca

SEQ ID NO: 1479779 - RNA, 21 nt, Homo sapiens
ugaccccauuccugaucccau

SEQ ID NO: 1479780 - RNA, 22 nt, Homo sapiens
ugacccggccucucugccccac

SEQ ID NO: 1479781 - RNA, 15 nt, Homo sapiens
ugaccggaucuacac

SEQ ID NO: 1479782 - RNA, 14 nt, Homo sapiens
ugaccuaaccacuu

SEQ ID NO: 1479783 - RNA, 14 nt, Homo sapiens
ugaccuauuuccag

SEQ ID NO: 1479784 - RNA, 14 nt, Homo sapiens
ugaccucccaguga

SEQ ID NO: 1479785 - RNA, 20 nt, Homo sapiens
ugaccucucauaaauuuacu

SEQ ID NO: 1479786 - RNA, 20 nt, Homo sapiens
ugaccuugcugauggugaca

SEQ ID NO: 1479787 - RNA, 18 nt, Homo sapiens
ugacgcggcucaaaagga

SEQ ID NO: 1479788 - RNA, 20 nt, Homo sapiens
ugacgucaucaucacauuca

SEQ ID NO: 1479789 - RNA, 11 nt, Homo sapiens
ugacuaaagag

SEQ ID NO: 1479790 - RNA, 12 nt, Homo sapiens
ugacuaaagcua

SEQ ID NO: 1479791 - RNA, 19 nt, Homo sapiens
ugacuaauuaggcaaggcu

SEQ ID NO: 1479792 - RNA, 13 nt, Homo sapiens
ugacuaguacaaa

SEQ ID NO: 1479793 - RNA, 19 nt, Homo sapiens
ugacucaacauguuacuga

SEQ ID NO: 1479794 - RNA, 16 nt, Homo sapiens
ugacucaagaagugaa

SEQ ID NO: 1479795 - RNA, 14 nt, Homo sapiens
ugacucagaauauu

SEQ ID NO: 1479796 - RNA, 15 nt, Homo sapiens
ugacucauggcagcu

SEQ ID NO: 1479797 - RNA, 21 nt, Homo sapiens
ugacucugaguccacugcucc

SEQ ID NO: 1479798 - RNA, 18 nt, Homo sapiens
ugacugaaggcugucagg

SEQ ID NO: 1479799 - RNA, 19 nt, Homo sapiens
ugacugcauugccgcugua

SEQ ID NO: 1479800 - RNA, 14 nt, Homo sapiens
ugacugccacccac

SEQ ID NO: 1479801 - RNA, 22 nt, Homo sapiens
ugacugcuaguuuauauagaaa

SEQ ID NO: 1479802 - RNA, 20 nt, Homo sapiens
ugacugcucagaacuugcug

SEQ ID NO: 1479803 - RNA, 14 nt, Homo sapiens
ugacugggccuccc

SEQ ID NO: 1479804 - RNA, 21 nt, Homo sapiens
ugacugguuuacaggcccugc

SEQ ID NO: 1479805 - RNA, 16 nt, Homo sapiens
ugacugugaccaccuu

SEQ ID NO: 1479806 - RNA, 15 nt, Homo sapiens
ugacuuaaguggcau

SEQ ID NO: 1479807 - RNA, 15 nt, Homo sapiens
ugacuuauaguacau

SEQ ID NO: 1479808 - RNA, 23 nt, Homo sapiens
ugagaaaagcuagguguuuaaua

SEQ ID NO: 1479809 - RNA, 23 nt, Homo sapiens
ugagaaaaugccucaauucacau

SEQ ID NO: 1479810 - RNA, 23 nt, Homo sapiens
ugagaaaccuuauuguaccucuc

SEQ ID NO: 1479811 - RNA, 21 nt, Homo sapiens
ugagaagaaugaaaaugcagu

SEQ ID NO: 1479812 - RNA, 13 nt, Homo sapiens
ugagaagugcacu

SEQ ID NO: 1479813 - RNA, 20 nt, Homo sapiens
ugagaagugucuaaaaacac

SEQ ID NO: 1479814 - RNA, 19 nt, Homo sapiens
ugagaaugagggccaagaa

SEQ ID NO: 1479815 - RNA, 14 nt, Homo sapiens
ugagacauuuacau

SEQ ID NO: 1479816 - RNA, 22 nt, Homo sapiens
ugagaccagccugggcagcaua

SEQ ID NO: 1479817 - RNA, 12 nt, Homo sapiens
ugagacccaggc

SEQ ID NO: 1479818 - RNA, 19 nt, Homo sapiens
ugagacccuuuucucagga

SEQ ID NO: 1479819 - RNA, 17 nt, Homo sapiens
ugagaccgagucuugcu

SEQ ID NO: 1479820 - RNA, 14 nt, Homo sapiens
ugagacucacagga

SEQ ID NO: 1479821 - RNA, 16 nt, Homo sapiens
ugagacuccgucacaa

SEQ ID NO: 1479822 - RNA, 18 nt, Homo sapiens
ugagccaagaugacacaa

SEQ ID NO: 1479823 - RNA, 16 nt, Homo sapiens
ugagccaucacuagaa

SEQ ID NO: 1479824 - RNA, 14 nt, Homo sapiens
ugagccaugagaug

SEQ ID NO: 1479825 - RNA, 20 nt, Homo sapiens
ugagccccuggaggcacuga

SEQ ID NO: 1479826 - RNA, 14 nt, Homo sapiens
ugagcgagugucca

SEQ ID NO: 1479827 - RNA, 22 nt, Homo sapiens
ugagcuauuuccauuccagaau

SEQ ID NO: 1479828 - RNA, 20 nt, Homo sapiens
ugagcugcagcugagccuga

SEQ ID NO: 1479829 - RNA, 17 nt, Homo sapiens
ugagcuuagauugccuc

SEQ ID NO: 1479830 - RNA, 20 nt, Homo sapiens
ugagcuucauauaccagcaa

SEQ ID NO: 1479831 - RNA, 18 nt, Homo sapiens
ugagcuuccccaagcacg

SEQ ID NO: 1479832 - RNA, 16 nt, Homo sapiens
ugaggaagucacuuua

SEQ ID NO: 1479833 - RNA, 17 nt, Homo sapiens
ugaggaagucacuuuac

SEQ ID NO: 1479834 - RNA, 13 nt, Homo sapiens
ugaggagcccagg

SEQ ID NO: 1479835 - RNA, 14 nt, Homo sapiens
ugaggcaauaaaaa

SEQ ID NO: 1479836 - RNA, 22 nt, Homo sapiens
ugaggcaggagaauggcgugaa

SEQ ID NO: 1479837 - RNA, 14 nt, Homo sapiens
ugaggcaugauuua

SEQ ID NO: 1479838 - RNA, 17 nt, Homo sapiens
ugaggccaucucaggag

SEQ ID NO: 1479839 - RNA, 19 nt, Homo sapiens
ugaggccaucucaggagau

SEQ ID NO: 1479840 - RNA, 16 nt, Homo sapiens
ugaggcccugcccaau

SEQ ID NO: 1479841 - RNA, 20 nt, Homo sapiens
ugaggcccugcccaaugaga

SEQ ID NO: 1479842 - RNA, 19 nt, Homo sapiens
ugaggccuccagcuucagg

SEQ ID NO: 1479843 - RNA, 21 nt, Homo sapiens
ugaggcggguggaucacuuga

SEQ ID NO: 1479844 - RNA, 15 nt, Homo sapiens
ugagggaaaaugagu

SEQ ID NO: 1479845 - RNA, 16 nt, Homo sapiens
ugagggaaaaugagua

SEQ ID NO: 1479846 - RNA, 15 nt, Homo sapiens
ugagggaaagugcau

SEQ ID NO: 1479847 - RNA, 16 nt, Homo sapiens
ugagggcccagagcag

SEQ ID NO: 1479848 - RNA, 18 nt, Homo sapiens
ugaggggacaggccugug

SEQ ID NO: 1479849 - RNA, 17 nt, Homo sapiens
ugaggggcuggcacuga

SEQ ID NO: 1479850 - RNA, 18 nt, Homo sapiens
ugagggucuuugcaagaa

SEQ ID NO: 1479851 - RNA, 12 nt, Homo sapiens
ugaggguggaag

SEQ ID NO: 1479852 - RNA, 14 nt, Homo sapiens
ugaggucccugugu

SEQ ID NO: 1479853 - RNA, 16 nt, Homo sapiens
ugaggugccuguccca

SEQ ID NO: 1479854 - RNA, 19 nt, Homo sapiens
ugaggugguggaguggagu

SEQ ID NO: 1479855 - RNA, 21 nt, Homo sapiens
ugaguaaauauugaggcuuug

SEQ ID NO: 1479856 - RNA, 15 nt, Homo sapiens
ugaguaacauuugcu

SEQ ID NO: 1479857 - RNA, 16 nt, Homo sapiens
ugaguaccuacugugu

SEQ ID NO: 1479858 - RNA, 23 nt, Homo sapiens
ugaguagcucuccugacuuuuaa

SEQ ID NO: 1479859 - RNA, 15 nt, Homo sapiens
ugagucaaugugcag

SEQ ID NO: 1479860 - RNA, 18 nt, Homo sapiens
ugaguccgacccagacau

SEQ ID NO: 1479861 - RNA, 17 nt, Homo sapiens
ugagucugcaugugcac

SEQ ID NO: 1479862 - RNA, 13 nt, Homo sapiens
ugaguggugccaa

SEQ ID NO: 1479863 - RNA, 23 nt, Homo sapiens
ugagugguguguguuaucagaua

SEQ ID NO: 1479864 - RNA, 16 nt, Homo sapiens
ugaguuacagccuguu

SEQ ID NO: 1479865 - RNA, 18 nt, Homo sapiens
ugaguucuggucaaagaa

SEQ ID NO: 1479866 - RNA, 22 nt, Homo sapiens
ugaguugaugggggccaggaca

SEQ ID NO: 1479867 - RNA, 20 nt, Homo sapiens
ugaguuuuuccucccaguga

SEQ ID NO: 1479868 - RNA, 20 nt, Homo sapiens
ugaguuuuugauagcuuuau

SEQ ID NO: 1479869 - RNA, 18 nt, Homo sapiens
ugauaagcauugacuugc

SEQ ID NO: 1479870 - RNA, 23 nt, Homo sapiens
ugauacaacauuaaggaauuuga

SEQ ID NO: 1479871 - RNA, 14 nt, Homo sapiens
ugauacacuaugaa

SEQ ID NO: 1479872 - RNA, 12 nt, Homo sapiens
ugauacauccaa

SEQ ID NO: 1479873 - RNA, 20 nt, Homo sapiens
ugauagaaccauugcaauau

SEQ ID NO: 1479874 - RNA, 13 nt, Homo sapiens
ugauagcacuuuc

SEQ ID NO: 1479875 - RNA, 13 nt, Homo sapiens
ugauagcuuuauu

SEQ ID NO: 1479876 - RNA, 21 nt, Homo sapiens
ugauaggaagcgucuggcaga

SEQ ID NO: 1479877 - RNA, 20 nt, Homo sapiens
ugauaguuaauuauuucaac

SEQ ID NO: 1479878 - RNA, 22 nt, Homo sapiens
ugauaguucacccccugagauc

SEQ ID NO: 1479879 - RNA, 13 nt, Homo sapiens
ugauauaaauucu

SEQ ID NO: 1479880 - RNA, 19 nt, Homo sapiens
ugauauaucaugagugaau

SEQ ID NO: 1479881 - RNA, 18 nt, Homo sapiens
ugauaucccccagccuca

SEQ ID NO: 1479882 - RNA, 18 nt, Homo sapiens
ugauauguaaacauaauu

SEQ ID NO: 1479883 - RNA, 16 nt, Homo sapiens
ugauauugacacuguc

SEQ ID NO: 1479884 - RNA, 15 nt, Homo sapiens
ugaucaaaaacuauu

SEQ ID NO: 1479885 - RNA, 21 nt, Homo sapiens
ugaucaauauuuuuauaucau

SEQ ID NO: 1479886 - RNA, 16 nt, Homo sapiens
ugaucacccaaugcau

SEQ ID NO: 1479887 - RNA, 15 nt, Homo sapiens
ugaucacuagccugu

SEQ ID NO: 1479888 - RNA, 21 nt, Homo sapiens
ugaucaggcuauguauggaau

SEQ ID NO: 1479889 - RNA, 16 nt, Homo sapiens
ugauccccaaguggug

SEQ ID NO: 1479890 - RNA, 13 nt, Homo sapiens
ugaucuauacaaa

SEQ ID NO: 1479891 - RNA, 15 nt, Homo sapiens
ugaucuauacaaauu

SEQ ID NO: 1479892 - RNA, 12 nt, Homo sapiens
ugaucugggcau

SEQ ID NO: 1479893 - RNA, 17 nt, Homo sapiens
ugaugaaagcugauuac

SEQ ID NO: 1479894 - RNA, 12 nt, Homo sapiens
ugaugaaugaga

SEQ ID NO: 1479895 - RNA, 13 nt, Homo sapiens
ugaugacauuccc

SEQ ID NO: 1479896 - RNA, 14 nt, Homo sapiens
ugaugacauucccu

SEQ ID NO: 1479897 - RNA, 20 nt, Homo sapiens
ugaugagagaauggagacag

SEQ ID NO: 1479898 - RNA, 23 nt, Homo sapiens
ugaugagucgguccucuuuccag

SEQ ID NO: 1479899 - RNA, 18 nt, Homo sapiens
ugaugauuuucauuucau

SEQ ID NO: 1479900 - RNA, 22 nt, Homo sapiens
ugaugcauauugcccuggagaa

SEQ ID NO: 1479901 - RNA, 16 nt, Homo sapiens
ugaugcuauuuaugca

SEQ ID NO: 1479902 - RNA, 14 nt, Homo sapiens
ugaugcugugcuau

SEQ ID NO: 1479903 - RNA, 22 nt, Homo sapiens
ugauggaccuccuucgcuggaa

SEQ ID NO: 1479904 - RNA, 16 nt, Homo sapiens
ugauggccaccagcuu

SEQ ID NO: 1479905 - RNA, 19 nt, Homo sapiens
ugauggcucauuuacacuc

SEQ ID NO: 1479906 - RNA, 20 nt, Homo sapiens
ugauggcucauuuacacuca

SEQ ID NO: 1479907 - RNA, 18 nt, Homo sapiens
ugaugggggccaggacac

SEQ ID NO: 1479908 - RNA, 16 nt, Homo sapiens
ugauggucacaugggg

SEQ ID NO: 1479909 - RNA, 14 nt, Homo sapiens
ugaugguugccagg

SEQ ID NO: 1479910 - RNA, 22 nt, Homo sapiens
ugauguaaaaaugaaaagccaa

SEQ ID NO: 1479911 - RNA, 22 nt, Homo sapiens
ugaugucaagcaccacacccca

SEQ ID NO: 1479912 - RNA, 13 nt, Homo sapiens
ugauguccagaag

SEQ ID NO: 1479913 - RNA, 15 nt, Homo sapiens
ugauguuaaccaaug

SEQ ID NO: 1479914 - RNA, 23 nt, Homo sapiens
ggcgaugcucccucagccucaga

SEQ ID NO: 1479915 - RNA, 15 nt, Homo sapiens
ggcgcaggugcacag

SEQ ID NO: 1479916 - RNA, 20 nt, Homo sapiens
ggcgccccugccaccucccu

SEQ ID NO: 1479917 - RNA, 17 nt, Homo sapiens
ggcggagcuugcaguga

SEQ ID NO: 1479918 - RNA, 16 nt, Homo sapiens
ggcggcccacacccag

SEQ ID NO: 1479919 - RNA, 20 nt, Homo sapiens
ggcuacacucaucugacuca

SEQ ID NO: 1479920 - RNA, 13 nt, Homo sapiens
ggcuaccuacaua

SEQ ID NO: 1479921 - RNA, 14 nt, Homo sapiens
ggcuauagcacaca

SEQ ID NO: 1479922 - RNA, 17 nt, Homo sapiens
ggcuauggaggguccuc

SEQ ID NO: 1479923 - RNA, 18 nt, Homo sapiens
ggcucaacacugugacau

SEQ ID NO: 1479924 - RNA, 20 nt, Homo sapiens
ggcucaagcuguccucccac

SEQ ID NO: 1479925 - RNA, 11 nt, Homo sapiens
ggcucagagau

SEQ ID NO: 1479926 - RNA, 15 nt, Homo sapiens
ggcucaggcucugcu

SEQ ID NO: 1479927 - RNA, 16 nt, Homo sapiens
ggcuccagccaucuca

SEQ ID NO: 1479928 - RNA, 14 nt, Homo sapiens
ggcucccaugacca

SEQ ID NO: 1479929 - RNA, 20 nt, Homo sapiens
ggcucucagcucagcgccag

SEQ ID NO: 1479930 - RNA, 17 nt, Homo sapiens
ggcucucauggggucca

SEQ ID NO: 1479931 - RNA, 20 nt, Homo sapiens
ggcucuccucgcagguguuc

SEQ ID NO: 1479932 - RNA, 19 nt, Homo sapiens
ggcucugcuucuccaagga

SEQ ID NO: 1479933 - RNA, 20 nt, Homo sapiens
ggcucugcuucuccaaggaa

SEQ ID NO: 1479934 - RNA, 20 nt, Homo sapiens
ggcucuuaugugugccuuug

SEQ ID NO: 1479935 - RNA, 15 nt, Homo sapiens
ggcugaaagaugacg

SEQ ID NO: 1479936 - RNA, 13 nt, Homo sapiens
ggcugagcugaac

SEQ ID NO: 1479937 - RNA, 18 nt, Homo sapiens
uacaaaacuacaugagaa

SEQ ID NO: 1479938 - RNA, 18 nt, Homo sapiens
uacaaacuuuguuuguca

SEQ ID NO: 1479939 - RNA, 15 nt, Homo sapiens
uacaacacacacugu

SEQ ID NO: 1479940 - RNA, 17 nt, Homo sapiens
uacaaccugaugucaua

SEQ ID NO: 1479941 - RNA, 18 nt, Homo sapiens
uacaacugauugcaacag

SEQ ID NO: 1479942 - RNA, 14 nt, Homo sapiens
uacaagaaagcaau

SEQ ID NO: 1479943 - RNA, 15 nt, Homo sapiens
uacaagaaguuuauu

SEQ ID NO: 1479944 - RNA, 23 nt, Homo sapiens
uacaagacuguugugaucuugca

SEQ ID NO: 1479945 - RNA, 20 nt, Homo sapiens
uacaagauugaaaaucuugu

SEQ ID NO: 1479946 - RNA, 17 nt, Homo sapiens
uacaagcaggcacugua

SEQ ID NO: 1479947 - RNA, 19 nt, Homo sapiens
uacaaugaaguuaagguua

SEQ ID NO: 1479948 - RNA, 13 nt, Homo sapiens
uacaauguagaug

SEQ ID NO: 1479949 - RNA, 18 nt, Homo sapiens
uacaauuggcacuaaaga

SEQ ID NO: 1479950 - RNA, 11 nt, Homo sapiens
uacaauuguga

SEQ ID NO: 1479951 - RNA, 19 nt, Homo sapiens
uacacaaggaaggcauuug

SEQ ID NO: 1479952 - RNA, 14 nt, Homo sapiens
uacacaauaagcaa

SEQ ID NO: 1479953 - RNA, 15 nt, Homo sapiens
uacacacacacuccc

SEQ ID NO: 1479954 - RNA, 16 nt, Homo sapiens
uacaccgacuagccag

SEQ ID NO: 1479955 - RNA, 20 nt, Homo sapiens
uacacuguuaucuucacuuu

SEQ ID NO: 1479956 - RNA, 15 nt, Homo sapiens
uacagaacuucagaa

SEQ ID NO: 1479957 - RNA, 23 nt, Homo sapiens
uacagaaguccccucuacuuuaa

SEQ ID NO: 1479958 - RNA, 19 nt, Homo sapiens
uacagaauuuccacuguaa

SEQ ID NO: 1479959 - RNA, 18 nt, Homo sapiens
uacagagaagauucuugu

SEQ ID NO: 1479960 - RNA, 18 nt, Homo sapiens
uacagagccgagcaauau

SEQ ID NO: 1479961 - RNA, 19 nt, Homo sapiens
uacagaguuuaugauuuaa

SEQ ID NO: 1479962 - RNA, 21 nt, Homo sapiens
uacagauagaaaauaugauau

SEQ ID NO: 1479963 - RNA, 19 nt, Homo sapiens
uacagauagaguuccauau

SEQ ID NO: 1479964 - RNA, 15 nt, Homo sapiens
uacagauagauauau

SEQ ID NO: 1479965 - RNA, 14 nt, Homo sapiens
uacagccacauccc

SEQ ID NO: 1479966 - RNA, 20 nt, Homo sapiens
uacagcuaucgaacuucaca

SEQ ID NO: 1479967 - RNA, 23 nt, Homo sapiens
uacaggaagcaccccaugccaaa

SEQ ID NO: 1479968 - RNA, 14 nt, Homo sapiens
uacaggcauaaaau

SEQ ID NO: 1479969 - RNA, 14 nt, Homo sapiens
uacaggugaggcaa

SEQ ID NO: 1479970 - RNA, 22 nt, Homo sapiens
uacaggugcucaauaaacacuu

SEQ ID NO: 1479971 - RNA, 18 nt, Homo sapiens
uacaggugugugccacca

SEQ ID NO: 1479972 - RNA, 22 nt, Homo sapiens
uacaguaacaaauaaagugcag

SEQ ID NO: 1479973 - RNA, 23 nt, Homo sapiens
uacagucacuaauauaguagauu

SEQ ID NO: 1479974 - RNA, 16 nt, Homo sapiens
uacagugagccaagau

SEQ ID NO: 1479975 - RNA, 22 nt, Homo sapiens
uacagugagccaagauugcacc

SEQ ID NO: 1479976 - RNA, 12 nt, Homo sapiens
uacagugguuuu

SEQ ID NO: 1479977 - RNA, 21 nt, Homo sapiens
uacaguuauuaaucuggacau

SEQ ID NO: 1479978 - RNA, 20 nt, Homo sapiens
uacauaacuccugucccuuu

SEQ ID NO: 1479979 - RNA, 13 nt, Homo sapiens
uacauaaguaauu

SEQ ID NO: 1479980 - RNA, 23 nt, Homo sapiens
uacauacaggccauacuuuacaa

SEQ ID NO: 1479981 - RNA, 12 nt, Homo sapiens
uacauauacuga

SEQ ID NO: 1479982 - RNA, 15 nt, Homo sapiens
uacauauuaucucau

SEQ ID NO: 1479983 - RNA, 13 nt, Homo sapiens
uacaucaaagagu

SEQ ID NO: 1479984 - RNA, 19 nt, Homo sapiens
uacaucacugcuugaugaa

SEQ ID NO: 1479985 - RNA, 13 nt, Homo sapiens
uacauccaaagca

SEQ ID NO: 1479986 - RNA, 16 nt, Homo sapiens
uacaucuagcaauuuc

SEQ ID NO: 1479987 - RNA, 11 nt, Homo sapiens
uacaucuggcc

SEQ ID NO: 1479988 - RNA, 19 nt, Homo sapiens
uacaugccucagugaagga

SEQ ID NO: 1479989 - RNA, 18 nt, Homo sapiens
uacauggaaaggauuuug

SEQ ID NO: 1479990 - RNA, 15 nt, Homo sapiens
uacauuaauuaccuu

SEQ ID NO: 1479991 - RNA, 19 nt, Homo sapiens
uacauucuuuaucuugaca

SEQ ID NO: 1479992 - RNA, 14 nt, Homo sapiens
uacauuguaaauag

SEQ ID NO: 1479993 - RNA, 19 nt, Homo sapiens
uacauuucuaucaguacuu

SEQ ID NO: 1479994 - RNA, 15 nt, Homo sapiens
uaccaaaagggccau

SEQ ID NO: 1479995 - RNA, 17 nt, Homo sapiens
uaccaaccugaagacac

SEQ ID NO: 1479996 - RNA, 13 nt, Homo sapiens
uaccaaucauuuu

SEQ ID NO: 1479997 - RNA, 15 nt, Homo sapiens
uaccacagacuguac

SEQ ID NO: 1479998 - RNA, 12 nt, Homo sapiens
uaccacaguguc

SEQ ID NO: 1479999 - RNA, 16 nt, Homo sapiens
uaccagcgcucuaaaa

SEQ ID NO: 1480000 - RNA, 19 nt, Homo sapiens
uaccaguucagacacuacc

SEQ ID NO: 1480001 - RNA, 22 nt, Homo sapiens
uaccauccccgaccaucugauu

SEQ ID NO: 1480002 - RNA, 23 nt, Homo sapiens
uaccaucuuguauacacauauau

SEQ ID NO: 1480003 - RNA, 20 nt, Homo sapiens
uacccaggcuggagugcagu

SEQ ID NO: 1480004 - RNA, 16 nt, Homo sapiens
uacccagugggacaga

SEQ ID NO: 1480005 - RNA, 14 nt, Homo sapiens
uacccaugaagauu

SEQ ID NO: 1480006 - RNA, 15 nt, Homo sapiens
uaccccugcucccau

SEQ ID NO: 1480007 - RNA, 23 nt, Homo sapiens
uacccuccuguaaaugguguaca

SEQ ID NO: 1480008 - RNA, 19 nt, Homo sapiens
uacccuuuaagauauccau

SEQ ID NO: 1480009 - RNA, 18 nt, Homo sapiens
uacccuuuuucuccagcu

SEQ ID NO: 1480010 - RNA, 11 nt, Homo sapiens
uaccuaaagac

SEQ ID NO: 1480011 - RNA, 11 nt, Homo sapiens
uaccucaaggg

SEQ ID NO: 1480012 - RNA, 17 nt, Homo sapiens
uaccucaagggggacug

SEQ ID NO: 1480013 - RNA, 23 nt, Homo sapiens
uaccucacagagugcauugugag

SEQ ID NO: 1480014 - RNA, 14 nt, Homo sapiens
uaccuccauccauc

SEQ ID NO: 1480015 - RNA, 20 nt, Homo sapiens
uaccuccuccucuggacaaa

SEQ ID NO: 1480016 - RNA, 16 nt, Homo sapiens
uaccucuaaauuucca

SEQ ID NO: 1480017 - RNA, 17 nt, Homo sapiens
uaccucugauaccucaa

SEQ ID NO: 1480018 - RNA, 22 nt, Homo sapiens
uaccucugcuauuugcuguuau

SEQ ID NO: 1480019 - RNA, 22 nt, Homo sapiens
uaccucuuacuuugcuugagaa

SEQ ID NO: 1480020 - RNA, 20 nt, Homo sapiens
uaccugcuguggaugcuuca

SEQ ID NO: 1480021 - RNA, 15 nt, Homo sapiens
uaccuggaccugucc

SEQ ID NO: 1480022 - RNA, 13 nt, Homo sapiens
uaccugggcauuc

SEQ ID NO: 1480023 - RNA, 19 nt, Homo sapiens
uaccuuaagagacacucca

SEQ ID NO: 1480024 - RNA, 22 nt, Homo sapiens
uaccuuccccacaucugagaga

SEQ ID NO: 1480025 - RNA, 17 nt, Homo sapiens
uaccuugagccaguaau

SEQ ID NO: 1480026 - RNA, 21 nt, Homo sapiens
uacguggcaaauuaacuugag

SEQ ID NO: 1480027 - RNA, 14 nt, Homo sapiens
uacgugucugaauc

SEQ ID NO: 1480028 - RNA, 19 nt, Homo sapiens
uacuaaacuucaccuacau

SEQ ID NO: 1480029 - RNA, 19 nt, Homo sapiens
uagcgacugucaacagcgu

SEQ ID NO: 1480030 - RNA, 13 nt, Homo sapiens
uagcggucaauuu

SEQ ID NO: 1480031 - RNA, 17 nt, Homo sapiens
uagcggucaauuugccu

SEQ ID NO: 1480032 - RNA, 19 nt, Homo sapiens
uagcuaaacggauuccaaa

SEQ ID NO: 1480033 - RNA, 23 nt, Homo sapiens
uagcuaaauaaauggguguauau

SEQ ID NO: 1480034 - RNA, 14 nt, Homo sapiens
uagcuaguaucuuc

SEQ ID NO: 1480035 - RNA, 17 nt, Homo sapiens
uagcuauauccauguac

SEQ ID NO: 1480036 - RNA, 23 nt, Homo sapiens
uagcuauauccauguacuguagu

SEQ ID NO: 1480037 - RNA, 12 nt, Homo sapiens
gggcuggcagau

SEQ ID NO: 1480038 - RNA, 23 nt, Homo sapiens
gggcugugucccagaugggccac

SEQ ID NO: 1480039 - RNA, 13 nt, Homo sapiens
gggcuuacaggca

SEQ ID NO: 1480040 - RNA, 20 nt, Homo sapiens
gggcuuaguauuucucagga

SEQ ID NO: 1480041 - RNA, 16 nt, Homo sapiens
gggcuuucuggggccu

SEQ ID NO: 1480042 - RNA, 18 nt, Homo sapiens
ggggaagaguggucuuga

SEQ ID NO: 1480043 - RNA, 17 nt, Homo sapiens
ggggacucagggaccgg

SEQ ID NO: 1480044 - RNA, 16 nt, Homo sapiens
ggggagaauguaauca

SEQ ID NO: 1480045 - RNA, 14 nt, Homo sapiens
ggggaucccucccc

SEQ ID NO: 1480046 - RNA, 23 nt, Homo sapiens
ggggccaggucacccuuugcugu

SEQ ID NO: 1480047 - RNA, 20 nt, Homo sapiens
ggggcccugcaccugugcag

SEQ ID NO: 1480048 - RNA, 14 nt, Homo sapiens
ggggccuugcugag

SEQ ID NO: 1480049 - RNA, 14 nt, Homo sapiens
ggggcgagcacugu

SEQ ID NO: 1480050 - RNA, 17 nt, Homo sapiens
ggggcgagcacugugag

SEQ ID NO: 1480051 - RNA, 12 nt, Homo sapiens
ggggcugugcau

SEQ ID NO: 1480052 - RNA, 15 nt, Homo sapiens
ggggcuuccagcuca

SEQ ID NO: 1480053 - RNA, 10 nt, Homo sapiens
ggggcuuccu

SEQ ID NO: 1480054 - RNA, 18 nt, Homo sapiens
gggggagaagaagccgag

SEQ ID NO: 1480055 - RNA, 15 nt, Homo sapiens
gggggccgugcccag

SEQ ID NO: 1480056 - RNA, 17 nt, Homo sapiens
gggggucauuguucucc

SEQ ID NO: 1480057 - RNA, 16 nt, Homo sapiens
ggggguuucaccuggg

SEQ ID NO: 1480058 - RNA, 17 nt, Homo sapiens
ggggguuuuuaaucuuu

SEQ ID NO: 1480059 - RNA, 22 nt, Homo sapiens
uauauaauuuuaugguggaaaa

SEQ ID NO: 1480060 - RNA, 13 nt, Homo sapiens
uauauaccaagcu

SEQ ID NO: 1480061 - RNA, 19 nt, Homo sapiens
uauauauuuauaacucauc

SEQ ID NO: 1480062 - RNA, 20 nt, Homo sapiens
uauauauuucuuuguuauca

SEQ ID NO: 1480063 - RNA, 20 nt, Homo sapiens
uauaucauucuacagaauaa

SEQ ID NO: 1480064 - RNA, 15 nt, Homo sapiens
uauauccauguacug

SEQ ID NO: 1480065 - RNA, 12 nt, Homo sapiens
uauuacagugaa

SEQ ID NO: 1480066 - RNA, 17 nt, Homo sapiens
uauuacauuuucaguga

SEQ ID NO: 1480067 - RNA, 14 nt, Homo sapiens
uauuacccuccuaa

SEQ ID NO: 1480068 - RNA, 18 nt, Homo sapiens
uauuacuguugcauuuac

SEQ ID NO: 1480069 - RNA, 22 nt, Homo sapiens
uauuagcaagacagcaugccuu

SEQ ID NO: 1480070 - RNA, 21 nt, Homo sapiens
ucuuuguaagaguggaaccaa

SEQ ID NO: 1480071 - RNA, 23 nt, Homo sapiens
ucuuuguaauacuuucuauguga

SEQ ID NO: 1480072 - RNA, 21 nt, Homo sapiens
ucuuuuaagcuauccacagcu

SEQ ID NO: 1480073 - RNA, 16 nt, Homo sapiens
ucuuuuacauucugca

SEQ ID NO: 1480074 - RNA, 15 nt, Homo sapiens
ucuuuuauccuggga

SEQ ID NO: 1480075 - RNA, 14 nt, Homo sapiens
ucuuuugaguggua

SEQ ID NO: 1480076 - RNA, 19 nt, Homo sapiens
ucuuuuggggaagcuuucu

SEQ ID NO: 1480077 - RNA, 22 nt, Homo sapiens
ugaaaaaagguuguguagcugu

SEQ ID NO: 1480078 - RNA, 23 nt, Homo sapiens
ugaaaaaagguuguguagcugug

SEQ ID NO: 1480079 - RNA, 17 nt, Homo sapiens
ugaaaaaauagauccaa

SEQ ID NO: 1480080 - RNA, 15 nt, Homo sapiens
ugaaaaacaaaaugg

SEQ ID NO: 1480081 - RNA, 19 nt, Homo sapiens
ugaaaaauggcaaagaauu

SEQ ID NO: 1480082 - RNA, 14 nt, Homo sapiens
ugaaaaauguauau

SEQ ID NO: 1480083 - RNA, 12 nt, Homo sapiens
ugaaaacagcua

SEQ ID NO: 1480084 - RNA, 16 nt, Homo sapiens
ugaaaacucuuugcug

SEQ ID NO: 1480085 - RNA, 17 nt, Homo sapiens
ugaaaagguugccugaa

SEQ ID NO: 1480086 - RNA, 23 nt, Homo sapiens
ugaaaaguuuccuaggaugucau

SEQ ID NO: 1480087 - RNA, 22 nt, Homo sapiens
ugaaaauacaacuuaaauaaua

SEQ ID NO: 1480088 - RNA, 16 nt, Homo sapiens
ugaaaaugaaucuuca

SEQ ID NO: 1480089 - RNA, 14 nt, Homo sapiens
ugaaaaugaaugcu

SEQ ID NO: 1480090 - RNA, 15 nt, Homo sapiens
ugaaaaugacauuaa

SEQ ID NO: 1480091 - RNA, 23 nt, Homo sapiens
ugaaaauuuauuuuuagugauaa

SEQ ID NO: 1480092 - RNA, 17 nt, Homo sapiens
ugaaacagccaugucca

SEQ ID NO: 1480093 - RNA, 18 nt, Homo sapiens
ugaaacagccauguccaa

SEQ ID NO: 1480094 - RNA, 21 nt, Homo sapiens
ugaaacauggcuguguuugca

SEQ ID NO: 1480095 - RNA, 18 nt, Homo sapiens
ugaaaccuacacacuguc

SEQ ID NO: 1480096 - RNA, 20 nt, Homo sapiens
ugaaacgucuaggaaaucua

SEQ ID NO: 1480097 - RNA, 14 nt, Homo sapiens
ugaaacuaacagau

SEQ ID NO: 1480098 - RNA, 23 nt, Homo sapiens
ugaaacuaacagauaagcaagag

SEQ ID NO: 1480099 - RNA, 15 nt, Homo sapiens
ugaaagaaccagaga

SEQ ID NO: 1480100 - RNA, 20 nt, Homo sapiens
ugaaagcugauuacugucaa

SEQ ID NO: 1480101 - RNA, 23 nt, Homo sapiens
ugaaaggaagcuccacugucacc

SEQ ID NO: 1480102 - RNA, 16 nt, Homo sapiens
ugaaaguggacaagga

SEQ ID NO: 1480103 - RNA, 17 nt, Homo sapiens
ugaaaguggacaaggag

SEQ ID NO: 1480104 - RNA, 19 nt, Homo sapiens
ugaaauaaaacuacauggu

SEQ ID NO: 1480105 - RNA, 19 nt, Homo sapiens
ugaaauaauguacaucugg

SEQ ID NO: 1480106 - RNA, 15 nt, Homo sapiens
ugaaaugaaaacaug

SEQ ID NO: 1480107 - RNA, 20 nt, Homo sapiens
ugaaaugagcaccuccauua

SEQ ID NO: 1480108 - RNA, 19 nt, Homo sapiens
ugaaaugcuggcauuugca

SEQ ID NO: 1480109 - RNA, 17 nt, Homo sapiens
ugaaauguaugugcucu

SEQ ID NO: 1480110 - RNA, 23 nt, Homo sapiens
ugaaauguaugugcucuuagcaa

SEQ ID NO: 1480111 - RNA, 18 nt, Homo sapiens
ugaaauguuagucauugu

SEQ ID NO: 1480112 - RNA, 18 nt, Homo sapiens
ugaaauguucuguucacc

SEQ ID NO: 1480113 - RNA, 15 nt, Homo sapiens
ugaaauuuauucaca

SEQ ID NO: 1480114 - RNA, 15 nt, Homo sapiens
ugaacaaacaaugaa

SEQ ID NO: 1480115 - RNA, 11 nt, Homo sapiens
ugaacaaagca

SEQ ID NO: 1480116 - RNA, 21 nt, Homo sapiens
ugaacaaagugaggagaauga

SEQ ID NO: 1480117 - RNA, 17 nt, Homo sapiens
ugaacaaccugcucaca

SEQ ID NO: 1480118 - RNA, 20 nt, Homo sapiens
ugaacaccuauugcacuugg

SEQ ID NO: 1480119 - RNA, 18 nt, Homo sapiens
ugaacacuggcuaaagau

SEQ ID NO: 1480120 - RNA, 19 nt, Homo sapiens
ugaacacuuauaagugaag

SEQ ID NO: 1480121 - RNA, 21 nt, Homo sapiens
ugaacagaccggagaggacag

SEQ ID NO: 1480122 - RNA, 16 nt, Homo sapiens
ugaacauccccuccca

SEQ ID NO: 1480123 - RNA, 20 nt, Homo sapiens
ugaacaugcaguucauuauu

SEQ ID NO: 1480124 - RNA, 17 nt, Homo sapiens
ugaacauguucuccauu

SEQ ID NO: 1480125 - RNA, 11 nt, Homo sapiens
ugaacauuuca

SEQ ID NO: 1480126 - RNA, 22 nt, Homo sapiens
ugaaccauccacuuacauauau

SEQ ID NO: 1480127 - RNA, 17 nt, Homo sapiens
ugaaccaugaagucaua

SEQ ID NO: 1480128 - RNA, 13 nt, Homo sapiens
ugaaccuguauaa

SEQ ID NO: 1480129 - RNA, 22 nt, Homo sapiens
ugaacggcaucaaggugcugaa

SEQ ID NO: 1480130 - RNA, 19 nt, Homo sapiens
ugaacuaaucugauguuaa

SEQ ID NO: 1480131 - RNA, 16 nt, Homo sapiens
ugaacucacccuggga

SEQ ID NO: 1480132 - RNA, 15 nt, Homo sapiens
ugaacucuguaaaac

SEQ ID NO: 1480133 - RNA, 17 nt, Homo sapiens
ugaacugaaguuucaca

SEQ ID NO: 1480134 - RNA, 22 nt, Homo sapiens
ugaagaacuggaaccccagcuu

SEQ ID NO: 1480135 - RNA, 20 nt, Homo sapiens
ugaagaagguggaccuuuua

SEQ ID NO: 1480136 - RNA, 21 nt, Homo sapiens
ugaagaagguggaccuuuuaa

SEQ ID NO: 1480137 - RNA, 11 nt, Homo sapiens
ugaagacauaa

SEQ ID NO: 1480138 - RNA, 21 nt, Homo sapiens
ugaagacauuucugcucucag

SEQ ID NO: 1480139 - RNA, 20 nt, Homo sapiens
ugaagacccuggaguucaaa

SEQ ID NO: 1480140 - RNA, 14 nt, Homo sapiens
ugaagaccuaaagu

SEQ ID NO: 1480141 - RNA, 17 nt, Homo sapiens
ugaagacugaggacaaa

SEQ ID NO: 1480142 - RNA, 14 nt, Homo sapiens
ugaagagagauaua

SEQ ID NO: 1480143 - RNA, 15 nt, Homo sapiens
ugaagagcuauuaua

SEQ ID NO: 1480144 - RNA, 19 nt, Homo sapiens
ugaagagcuugcuuugauu

SEQ ID NO: 1480145 - RNA, 23 nt, Homo sapiens
ugaagaguauccuuccuucaggg

SEQ ID NO: 1480146 - RNA, 20 nt, Homo sapiens
ugaagagugacuaguacaaa

SEQ ID NO: 1480147 - RNA, 20 nt, Homo sapiens
ugaagauucuccugugcuag

SEQ ID NO: 1480148 - RNA, 21 nt, Homo sapiens
ugaagcagguggagggcauca

SEQ ID NO: 1480149 - RNA, 19 nt, Homo sapiens
ugaagccaauucagacagg

SEQ ID NO: 1480150 - RNA, 22 nt, Homo sapiens
ugaagccagcugcaggaaucaa

SEQ ID NO: 1480151 - RNA, 15 nt, Homo sapiens
ugaaggaacauuccu

SEQ ID NO: 1480152 - RNA, 16 nt, Homo sapiens
ugaaggauuacucucc

SEQ ID NO: 1480153 - RNA, 15 nt, Homo sapiens
ugaaggcuuacuuca

SEQ ID NO: 1480154 - RNA, 14 nt, Homo sapiens
ugaaggggccauga

SEQ ID NO: 1480155 - RNA, 18 nt, Homo sapiens
ugaaggugauucaccaaa

SEQ ID NO: 1480156 - RNA, 19 nt, Homo sapiens
ugaaggugauucaccaaaa

SEQ ID NO: 1480157 - RNA, 13 nt, Homo sapiens
ugaaguaagcaac

SEQ ID NO: 1480158 - RNA, 23 nt, Homo sapiens
ugaaguaaugaauuuuuaugaua

SEQ ID NO: 1480159 - RNA, 14 nt, Homo sapiens
ugaaguacauauua

SEQ ID NO: 1480160 - RNA, 13 nt, Homo sapiens
ugaaguagaaucc

SEQ ID NO: 1480161 - RNA, 16 nt, Homo sapiens
ugaaguagaauccuaa

SEQ ID NO: 1480162 - RNA, 18 nt, Homo sapiens
ugaagugcccuucccuug

SEQ ID NO: 1480163 - RNA, 17 nt, Homo sapiens
ugaagugucacagccug

SEQ ID NO: 1480164 - RNA, 19 nt, Homo sapiens
uuaaagcauauuggugcua

SEQ ID NO: 1480165 - RNA, 20 nt, Homo sapiens
uuaaaggaacagagugagag

SEQ ID NO: 1480166 - RNA, 19 nt, Homo sapiens
uuaaaguaaugagcaugau

SEQ ID NO: 1480167 - RNA, 22 nt, Homo sapiens
uuaaaguucucaaugcaaccau

SEQ ID NO: 1480168 - RNA, 20 nt, Homo sapiens
uuaaauauauaauguugcca

SEQ ID NO: 1480169 - RNA, 16 nt, Homo sapiens
uuaaauuguaaaugaa

SEQ ID NO: 1480170 - RNA, 18 nt, Homo sapiens
uuaaauuguuucauaucu

SEQ ID NO: 1480171 - RNA, 16 nt, Homo sapiens
uuaaauuuuuuuuaca

SEQ ID NO: 1480172 - RNA, 17 nt, Homo sapiens
uuaacaauaacuacugu

SEQ ID NO: 1480173 - RNA, 21 nt, Homo sapiens
uuaacagagauugaacuccaa

SEQ ID NO: 1480174 - RNA, 21 nt, Homo sapiens
uuaacagaugcaaugugcuac

SEQ ID NO: 1480175 - RNA, 18 nt, Homo sapiens
uuaacaucuacaaucagu

SEQ ID NO: 1480176 - RNA, 13 nt, Homo sapiens
uuaaccugcaaaa

SEQ ID NO: 1480177 - RNA, 20 nt, Homo sapiens
uuaacugacuuaaguggcau

SEQ ID NO: 1480178 - RNA, 19 nt, Homo sapiens
uuaacuguuguagaagaca

SEQ ID NO: 1480179 - RNA, 15 nt, Homo sapiens
uuaacuuaacauucu

SEQ ID NO: 1480180 - RNA, 14 nt, Homo sapiens
uuaagagacacucc

SEQ ID NO: 1480181 - RNA, 15 nt, Homo sapiens
uuaagagacacucca

SEQ ID NO: 1480182 - RNA, 22 nt, Homo sapiens
uuaagagggaacuuagcagaga

SEQ ID NO: 1480183 - RNA, 17 nt, Homo sapiens
uuaagauacaaauuaau

SEQ ID NO: 1480184 - RNA, 13 nt, Homo sapiens
uuaagcacaagca

SEQ ID NO: 1480185 - RNA, 12 nt, Homo sapiens
uuaagcauuguu

SEQ ID NO: 1480186 - RNA, 20 nt, Homo sapiens
uuaagccuuauaaaccaauc

SEQ ID NO: 1480187 - RNA, 21 nt, Homo sapiens
uuaagcuuccgccgucucaac

SEQ ID NO: 1480188 - RNA, 14 nt, Homo sapiens
uuaaggauguugcc

SEQ ID NO: 1480189 - RNA, 16 nt, Homo sapiens
uuaagggaaggaacuc

SEQ ID NO: 1480190 - RNA, 22 nt, Homo sapiens
uuaagggcaugccuugugcugu

SEQ ID NO: 1480191 - RNA, 13 nt, Homo sapiens
uuaagguacuuaa

SEQ ID NO: 1480192 - RNA, 23 nt, Homo sapiens
uuaaguaaagucaacauaugcaa

SEQ ID NO: 1480193 - RNA, 23 nt, Homo sapiens
uuaagugaaagagauuacuuaaa

SEQ ID NO: 1480194 - RNA, 12 nt, Homo sapiens
uuaagugccuuu

SEQ ID NO: 1480195 - RNA, 13 nt, Homo sapiens
uuaaguggcagaa

SEQ ID NO: 1480196 - RNA, 21 nt, Homo sapiens
uuaauaaagaauuaacagaga

SEQ ID NO: 1480197 - RNA, 19 nt, Homo sapiens
uuaauacucaaaugaguaa

SEQ ID NO: 1480198 - RNA, 13 nt, Homo sapiens
uuaauacuguuua

SEQ ID NO: 1480199 - RNA, 19 nt, Homo sapiens
uuaauagaaauaaauuccu

SEQ ID NO: 1480200 - RNA, 17 nt, Homo sapiens
uuaauauaguaacacac

SEQ ID NO: 1480201 - RNA, 17 nt, Homo sapiens
uuaauaugacaaaacaa

SEQ ID NO: 1480202 - RNA, 19 nt, Homo sapiens
uuaauauuguauugcugcu

SEQ ID NO: 1480203 - RNA, 16 nt, Homo sapiens
uuaauauugugcaaac

SEQ ID NO: 1480204 - RNA, 20 nt, Homo sapiens
uuaauccaguguuacugugu

SEQ ID NO: 1480205 - RNA, 18 nt, Homo sapiens
uuaauccuguaccaaauc

SEQ ID NO: 1480206 - RNA, 20 nt, Homo sapiens
uuaaugaaugccuaaauaua

SEQ ID NO: 1480207 - RNA, 15 nt, Homo sapiens
uuaaugagacaugaa

SEQ ID NO: 1480208 - RNA, 17 nt, Homo sapiens
uuaaugagccaucacua

SEQ ID NO: 1480209 - RNA, 14 nt, Homo sapiens
uuaauguaacuagc

SEQ ID NO: 1480210 - RNA, 20 nt, Homo sapiens
uuaauguuuuuuaaacuagu

SEQ ID NO: 1480211 - RNA, 23 nt, Homo sapiens
uuaauguuuuuuaaacuaguuua

SEQ ID NO: 1480212 - RNA, 13 nt, Homo sapiens
uuaauuauugcuu

SEQ ID NO: 1480213 - RNA, 22 nt, Homo sapiens
uuaauucacagaauagcacaaa

SEQ ID NO: 1480214 - RNA, 17 nt, Homo sapiens
uuaauucauaaaucaca

SEQ ID NO: 1480215 - RNA, 20 nt, Homo sapiens
uuaauucucauuuguucuca

SEQ ID NO: 1480216 - RNA, 15 nt, Homo sapiens
uuaauuuucaguaua

SEQ ID NO: 1480217 - RNA, 17 nt, Homo sapiens
uuaauuuucaguauaau

SEQ ID NO: 1480218 - RNA, 23 nt, Homo sapiens
uuacaaaacaugauuguuuacag

SEQ ID NO: 1480219 - RNA, 21 nt, Homo sapiens
uuacaaacuuuguuugucaca

SEQ ID NO: 1480220 - RNA, 18 nt, Homo sapiens
uuacaauauuaugaaauu

SEQ ID NO: 1480221 - RNA, 20 nt, Homo sapiens
uuacaaucagccacauucua

SEQ ID NO: 1480222 - RNA, 12 nt, Homo sapiens
uuacagugcaga

SEQ ID NO: 1480223 - RNA, 22 nt, Homo sapiens
uuacauguaguaguacuugaaa

SEQ ID NO: 1480224 - RNA, 14 nt, Homo sapiens
uuacauucaucuca

SEQ ID NO: 1480225 - RNA, 15 nt, Homo sapiens
uuacauugccugacu

SEQ ID NO: 1480226 - RNA, 17 nt, Homo sapiens
uuaccaugucacugugg

SEQ ID NO: 1480227 - RNA, 15 nt, Homo sapiens
uuaccucacagugau

SEQ ID NO: 1480228 - RNA, 14 nt, Homo sapiens
uuaccuccauccau

SEQ ID NO: 1480229 - RNA, 22 nt, Homo sapiens
uuaccugauuugaugauacauu

SEQ ID NO: 1480230 - RNA, 21 nt, Homo sapiens
uuaccugucacauugcauucu

SEQ ID NO: 1480231 - RNA, 12 nt, Homo sapiens
uuaccuuucaua

SEQ ID NO: 1480232 - RNA, 17 nt, Homo sapiens
uuacgcccaucucagga

SEQ ID NO: 1480233 - RNA, 23 nt, Homo sapiens
uuacuaagcuuugccagcugcug

SEQ ID NO: 1480234 - RNA, 18 nt, Homo sapiens
uuacuaugugccaguucc

SEQ ID NO: 1480235 - RNA, 21 nt, Homo sapiens
uuacugaaagaaaaagaccua

SEQ ID NO: 1480236 - RNA, 12 nt, Homo sapiens
uuacugaaguua

SEQ ID NO: 1480237 - RNA, 17 nt, Homo sapiens
uuacuggacauaacauu

SEQ ID NO: 1480238 - RNA, 24 nt, Homo sapiens
uuacuguuuauuucuguuucucau

SEQ ID NO: 1480239 - RNA, 16 nt, Homo sapiens
uuacuuuuaccacuau

SEQ ID NO: 1480240 - RNA, 14 nt, Homo sapiens
uuagaaaugcaaaa

SEQ ID NO: 1480241 - RNA, 12 nt, Homo sapiens
uuagaaauggau

SEQ ID NO: 1480242 - RNA, 20 nt, Homo sapiens
uuagaauguugaaaaguaau

SEQ ID NO: 1480243 - RNA, 22 nt, Homo sapiens
uuagacaugacugaugacauau

SEQ ID NO: 1480244 - RNA, 16 nt, Homo sapiens
uuagacccgguccugc

SEQ ID NO: 1480245 - RNA, 15 nt, Homo sapiens
uuagagagagaacuu

SEQ ID NO: 1480246 - RNA, 22 nt, Homo sapiens
uuagagcagcuuugggauccca

SEQ ID NO: 1480247 - RNA, 21 nt, Homo sapiens
uuagauaaauuguagggcuuu

SEQ ID NO: 1480248 - RNA, 20 nt, Homo sapiens
uuagaugaggaaaugauccc

SEQ ID NO: 1480249 - RNA, 22 nt, Homo sapiens
uuagaugugccaauaaccaagu

SEQ ID NO: 1480250 - RNA, 21 nt, Homo sapiens
uuagcauaaaauuuucuacuc

SEQ ID NO: 1480251 - RNA, 22 nt, Homo sapiens
uuagcauaaaauuuucuacucu

SEQ ID NO: 1480252 - RNA, 13 nt, Homo sapiens
uuagccaaaggau

SEQ ID NO: 1480253 - RNA, 16 nt, Homo sapiens
uuagccauaaauugcu

SEQ ID NO: 1480254 - RNA, 12 nt, Homo sapiens
uuagccucuugc

SEQ ID NO: 1480255 - RNA, 18 nt, Homo sapiens
uuagcuacacagugcaga

SEQ ID NO: 1480256 - RNA, 12 nt, Homo sapiens
uuagcuguaaac

SEQ ID NO: 1480257 - RNA, 14 nt, Homo sapiens
uuagcuuuacaaau

SEQ ID NO: 1480258 - RNA, 23 nt, Homo sapiens
uuagcuuuguguuugguuuacau

SEQ ID NO: 1480259 - RNA, 17 nt, Homo sapiens
uuaggaaaggagaucaa

SEQ ID NO: 1480260 - RNA, 18 nt, Homo sapiens
uuagguugucuccaggcc

SEQ ID NO: 1480261 - RNA, 16 nt, Homo sapiens
uuaguagagacagggu

SEQ ID NO: 1480262 - RNA, 13 nt, Homo sapiens
uuagucaugugac

SEQ ID NO: 1480263 - RNA, 16 nt, Homo sapiens
uuaguccuaauucaau

SEQ ID NO: 1480264 - RNA, 13 nt, Homo sapiens
uuaguuggcugga

SEQ ID NO: 1480265 - RNA, 23 nt, Homo sapiens
uuaguuguaaaccaagugaucaa

SEQ ID NO: 1480266 - RNA, 13 nt, Homo sapiens
uuauaaaaaaugg

SEQ ID NO: 1480267 - RNA, 21 nt, Homo sapiens
uuauaaauuuuauaacagaau

SEQ ID NO: 1480268 - RNA, 23 nt, Homo sapiens
uuauaagagugccguaacaacug

SEQ ID NO: 1480269 - RNA, 21 nt, Homo sapiens
uuauaagugaagugauacuau

SEQ ID NO: 1480270 - RNA, 15 nt, Homo sapiens
uuauaauaaaaggaa

SEQ ID NO: 1480271 - RNA, 19 nt, Homo sapiens
uuauaauaaaauugguguu

SEQ ID NO: 1480272 - RNA, 12 nt, Homo sapiens
uuauaaucuacu

SEQ ID NO: 1480273 - RNA, 19 nt, Homo sapiens
uuauacauguguaaacaau

SEQ ID NO: 1480274 - RNA, 13 nt, Homo sapiens
uuauacauuugau

SEQ ID NO: 1480275 - RNA, 12 nt, Homo sapiens
uuauacuuucag

SEQ ID NO: 1480276 - RNA, 20 nt, Homo sapiens
uuauagaaaaggaacaguug

SEQ ID NO: 1480277 - RNA, 20 nt, Homo sapiens
uuauagaaguagcaaaaagu

SEQ ID NO: 1480278 - RNA, 20 nt, Homo sapiens
uuauagugaauacugcuaca

SEQ ID NO: 1480279 - RNA, 14 nt, Homo sapiens
uuauauaauucaag

SEQ ID NO: 1480280 - RNA, 16 nt, Homo sapiens
uuauauacaguacaca

SEQ ID NO: 1480281 - RNA, 19 nt, Homo sapiens
uuauauauuuauaacucau

SEQ ID NO: 1480282 - RNA, 15 nt, Homo sapiens
uuauaucagccugag

SEQ ID NO: 1480283 - RNA, 14 nt, Homo sapiens
uuauaucaguuuca

SEQ ID NO: 1480284 - RNA, 16 nt, Homo sapiens
uuauauggaugauuca

SEQ ID NO: 1480285 - RNA, 16 nt, Homo sapiens
uuauauuaaaauaugg

SEQ ID NO: 1480286 - RNA, 22 nt, Homo sapiens
uuauauuuccuuuaugugaauu

SEQ ID NO: 1480287 - RNA, 22 nt, Homo sapiens
uuauauuuggcccaaacucauc

SEQ ID NO: 1480288 - RNA, 20 nt, Homo sapiens
uuaucaaacuucagcuguac

SEQ ID NO: 1480289 - RNA, 21 nt, Homo sapiens
uuaucacuucauucacauuca

SEQ ID NO: 1480290 - RNA, 17 nt, Homo sapiens
uuaucagaauucucaga

SEQ ID NO: 1480291 - RNA, 15 nt, Homo sapiens
uuaucaucaccucaa

SEQ ID NO: 1480292 - RNA, 13 nt, Homo sapiens
uuaucauugcuaa

SEQ ID NO: 1480293 - RNA, 13 nt, Homo sapiens
uuaucauuuauca

SEQ ID NO: 1480294 - RNA, 11 nt, Homo sapiens
uuauccaaauu

SEQ ID NO: 1480295 - RNA, 21 nt, Homo sapiens
uuauccagaggguugugauuu

SEQ ID NO: 1480296 - RNA, 13 nt, Homo sapiens
uuaucccaaucau

SEQ ID NO: 1480297 - RNA, 17 nt, Homo sapiens
uuaucgaaauaacaaug

SEQ ID NO: 1480298 - RNA, 21 nt, Homo sapiens
uuaucuauagcuaaguacaca

SEQ ID NO: 1480299 - RNA, 16 nt, Homo sapiens
uuaucuaucaacuaua

SEQ ID NO: 1480300 - RNA, 21 nt, Homo sapiens
uuaucuggcccucgacacuca

SEQ ID NO: 1480301 - RNA, 12 nt, Homo sapiens
uuaucugucaca

SEQ ID NO: 1480302 - RNA, 15 nt, Homo sapiens
uuaucuugacauuca

SEQ ID NO: 1480303 - RNA, 14 nt, Homo sapiens
uuaugaaaugaccu

SEQ ID NO: 1480304 - RNA, 14 nt, Homo sapiens
uuaugaaauuucac

SEQ ID NO: 1480305 - RNA, 16 nt, Homo sapiens
uuaugaauaagcacuu

SEQ ID NO: 1480306 - RNA, 22 nt, Homo sapiens
uuaugcaguaaauuaucuuggg

SEQ ID NO: 1480307 - RNA, 15 nt, Homo sapiens
uuaugccuucacuuu

SEQ ID NO: 1480308 - RNA, 19 nt, Homo sapiens
uuauggcauuuuucuggga

SEQ ID NO: 1480309 - RNA, 23 nt, Homo sapiens
uuauguauuugaaaacucacaga

SEQ ID NO: 1480310 - RNA, 20 nt, Homo sapiens
uuaugugagagaaaguguga

SEQ ID NO: 1480311 - RNA, 14 nt, Homo sapiens
uuaugugugccuuu

SEQ ID NO: 1480312 - RNA, 14 nt, Homo sapiens
uuauguuagcauug

SEQ ID NO: 1480313 - RNA, 14 nt, Homo sapiens
uuauuaacuuuaau

SEQ ID NO: 1480314 - RNA, 15 nt, Homo sapiens
uuauuaauucuucac

SEQ ID NO: 1480315 - RNA, 16 nt, Homo sapiens
uuauuaccauuagcau

SEQ ID NO: 1480316 - RNA, 15 nt, Homo sapiens
uuauuaccucugaua

SEQ ID NO: 1480317 - RNA, 13 nt, Homo sapiens
uuauuacucucac

SEQ ID NO: 1480318 - RNA, 15 nt, Homo sapiens
uuauuauauugucga

SEQ ID NO: 1480319 - RNA, 22 nt, Homo sapiens
uuauucauccagcaguguugcu

SEQ ID NO: 1480320 - RNA, 15 nt, Homo sapiens
uuauucugcuaaaga

SEQ ID NO: 1480321 - RNA, 13 nt, Homo sapiens
uuauugacacuga

SEQ ID NO: 1480322 - RNA, 20 nt, Homo sapiens
uuauuuagaaauagaacuac

SEQ ID NO: 1480323 - RNA, 21 nt, Homo sapiens
uuauuuaugcacugugggaug

SEQ ID NO: 1480324 - RNA, 19 nt, Homo sapiens
uuauuucugaucuauacaa

SEQ ID NO: 1480325 - RNA, 22 nt, Homo sapiens
uuauuuggaguuagguccucac

SEQ ID NO: 1480326 - RNA, 16 nt, Homo sapiens
uuauuuuacagcucau

SEQ ID NO: 1480327 - RNA, 15 nt, Homo sapiens
uuauuuuaucugcua

SEQ ID NO: 1480328 - RNA, 19 nt, Homo sapiens
uuauuuuuauaucagccug

SEQ ID NO: 1480329 - RNA, 13 nt, Homo sapiens
uucaaaaaaguca

SEQ ID NO: 1480330 - RNA, 15 nt, Homo sapiens
uucaaaaaccacguu

SEQ ID NO: 1480331 - RNA, 18 nt, Homo sapiens
uucaaaagguuauauacc

SEQ ID NO: 1480332 - RNA, 19 nt, Homo sapiens
uucaaaccugaccacagaa

SEQ ID NO: 1480333 - RNA, 12 nt, Homo sapiens
uucaaagugaua

SEQ ID NO: 1480334 - RNA, 13 nt, Homo sapiens
uucaaaguuaaaa

SEQ ID NO: 1480335 - RNA, 19 nt, Homo sapiens
uucaaauuuuuacugagaa

SEQ ID NO: 1480336 - RNA, 13 nt, Homo sapiens
uucaacccagugg

SEQ ID NO: 1480337 - RNA, 18 nt, Homo sapiens
uucaagggacccaugagu

SEQ ID NO: 1480338 - RNA, 17 nt, Homo sapiens
uucaagucugacucucc

SEQ ID NO: 1480339 - RNA, 16 nt, Homo sapiens
uucaagugcacugagc

SEQ ID NO: 1480340 - RNA, 16 nt, Homo sapiens
uucaaguuaaagugaa

SEQ ID NO: 1480341 - RNA, 22 nt, Homo sapiens
uucaaguuaaagugaauaacca

SEQ ID NO: 1480342 - RNA, 19 nt, Homo sapiens
uucaauaaaucuuucaaaa

SEQ ID NO: 1480343 - RNA, 21 nt, Homo sapiens
uucaauagcauaucacagaga

SEQ ID NO: 1480344 - RNA, 14 nt, Homo sapiens
uucaauauugacau

SEQ ID NO: 1480345 - RNA, 20 nt, Homo sapiens
uucaauauuuguuacuguua

SEQ ID NO: 1480346 - RNA, 19 nt, Homo sapiens
uucacaccgcugcacucaa

SEQ ID NO: 1480347 - RNA, 14 nt, Homo sapiens
uucacacuaagaaa

SEQ ID NO: 1480348 - RNA, 13 nt, Homo sapiens
uucacacuaugga

SEQ ID NO: 1480349 - RNA, 19 nt, Homo sapiens
uucagauccugaauuccag

SEQ ID NO: 1480350 - RNA, 22 nt, Homo sapiens
uucagauccugaauuccagcaa

SEQ ID NO: 1480351 - RNA, 18 nt, Homo sapiens
uucagauggugaagcauu

SEQ ID NO: 1480352 - RNA, 20 nt, Homo sapiens
uucagcacuuaacuacuuug

SEQ ID NO: 1480353 - RNA, 15 nt, Homo sapiens
uucagcagucaauac

SEQ ID NO: 1480354 - RNA, 23 nt, Homo sapiens
uucagcccacugcccaaugccug

SEQ ID NO: 1480355 - RNA, 22 nt, Homo sapiens
uucagcuguacuucgucuucua

SEQ ID NO: 1480356 - RNA, 16 nt, Homo sapiens
uucaggacucuaccuc

SEQ ID NO: 1480357 - RNA, 20 nt, Homo sapiens
uucaggacuuaacggcucca

SEQ ID NO: 1480358 - RNA, 14 nt, Homo sapiens
uucaggauacaugu

SEQ ID NO: 1480359 - RNA, 18 nt, Homo sapiens
uucaggcaacgcacaaaa

SEQ ID NO: 1480360 - RNA, 14 nt, Homo sapiens
uucaggcaggccaa

SEQ ID NO: 1480361 - RNA, 17 nt, Homo sapiens
uucaggcuacucauuca

SEQ ID NO: 1480362 - RNA, 20 nt, Homo sapiens
uucagucacacacacauaca

SEQ ID NO: 1480363 - RNA, 19 nt, Homo sapiens
uucaguugccauugacaga

SEQ ID NO: 1480364 - RNA, 15 nt, Homo sapiens
uucauacacuaacca

SEQ ID NO: 1480365 - RNA, 18 nt, Homo sapiens
uucauaugcuguauaucc

SEQ ID NO: 1480366 - RNA, 20 nt, Homo sapiens
uucauauguaccauguacau

SEQ ID NO: 1480367 - RNA, 22 nt, Homo sapiens
uucauccaguuuguucuccggg

SEQ ID NO: 1480368 - RNA, 15 nt, Homo sapiens
uucauccguguaacc

SEQ ID NO: 1480369 - RNA, 19 nt, Homo sapiens
uucaucuacccugcugacc

SEQ ID NO: 1480370 - RNA, 11 nt, Homo sapiens
uucaucucuug

SEQ ID NO: 1480371 - RNA, 19 nt, Homo sapiens
uucaucugaaacccacaga

SEQ ID NO: 1480372 - RNA, 18 nt, Homo sapiens
uucaucuucacugcaauu

SEQ ID NO: 1480373 - RNA, 23 nt, Homo sapiens
uucaugaaacuguccaccaagau

SEQ ID NO: 1480374 - RNA, 12 nt, Homo sapiens
uucauguucacu

SEQ ID NO: 1480375 - RNA, 16 nt, Homo sapiens
uucauguucacuguga

SEQ ID NO: 1480376 - RNA, 21 nt, Homo sapiens
uucauuauagacaacgaugaa

SEQ ID NO: 1480377 - RNA, 14 nt, Homo sapiens
uucauuauguauga

SEQ ID NO: 1480378 - RNA, 13 nt, Homo sapiens
uucauucacauuc

SEQ ID NO: 1480379 - RNA, 14 nt, Homo sapiens
uucauucacauuca

SEQ ID NO: 1480380 - RNA, 13 nt, Homo sapiens
uucauugaugacc

SEQ ID NO: 1480381 - RNA, 13 nt, Homo sapiens
uucauugcacuuu

SEQ ID NO: 1480382 - RNA, 22 nt, Homo sapiens
uucauuuaauggggauuccacu

SEQ ID NO: 1480383 - RNA, 13 nt, Homo sapiens
uucauuucaggaa

SEQ ID NO: 1480384 - RNA, 17 nt, Homo sapiens
uucauuuugagaucaag

SEQ ID NO: 1480385 - RNA, 17 nt, Homo sapiens
uucauuuuuuucacugg

SEQ ID NO: 1480386 - RNA, 15 nt, Homo sapiens
uuccaacaccacaga

SEQ ID NO: 1480387 - RNA, 21 nt, Homo sapiens
uuccaacaccacagacacaca

SEQ ID NO: 1480388 - RNA, 21 nt, Homo sapiens
uuccaacucgaaucuguguga

SEQ ID NO: 1480389 - RNA, 19 nt, Homo sapiens
uuccaaggguacuaaggaa

SEQ ID NO: 1480390 - RNA, 19 nt, Homo sapiens
uuccaaugcacaguugcca

SEQ ID NO: 1480391 - RNA, 13 nt, Homo sapiens
uuccaaugcauug

SEQ ID NO: 1480392 - RNA, 20 nt, Homo sapiens
uuccaauuuacauacucugc

SEQ ID NO: 1480393 - RNA, 20 nt, Homo sapiens
uuccaauuugacaaaaccca

SEQ ID NO: 1480394 - RNA, 14 nt, Homo sapiens
uuccacacugcacu

SEQ ID NO: 1480395 - RNA, 16 nt, Homo sapiens
uuccacacugcacugu

SEQ ID NO: 1480396 - RNA, 21 nt, Homo sapiens
uuccaccaagcguuucccagu

SEQ ID NO: 1480397 - RNA, 20 nt, Homo sapiens
uuccacucccuuugccagug

SEQ ID NO: 1480398 - RNA, 17 nt, Homo sapiens
uuccacuugagugucaa

SEQ ID NO: 1480399 - RNA, 14 nt, Homo sapiens
uuccagaaacaccc

SEQ ID NO: 1480400 - RNA, 19 nt, Homo sapiens
uuccagcccaucuccgggg

SEQ ID NO: 1480401 - RNA, 18 nt, Homo sapiens
uuccaguaguuagcuuuc

SEQ ID NO: 1480402 - RNA, 17 nt, Homo sapiens
uuccauauguuauauca

SEQ ID NO: 1480403 - RNA, 16 nt, Homo sapiens
uuccaucucugacuua

SEQ ID NO: 1480404 - RNA, 15 nt, Homo sapiens
uuccaugaagaccac

SEQ ID NO: 1480405 - RNA, 22 nt, Homo sapiens
uuccaugagaacagcaggguag

SEQ ID NO: 1480406 - RNA, 23 nt, Homo sapiens
uuccaugcaacuggaguuccuua

SEQ ID NO: 1480407 - RNA, 22 nt, Homo sapiens
uuccauguaucuuuugaacugg

SEQ ID NO: 1480408 - RNA, 19 nt, Homo sapiens
uuccauuugaagcagugau

SEQ ID NO: 1480409 - RNA, 23 nt, Homo sapiens
uuccauuuuuauuucaaaauaua

SEQ ID NO: 1480410 - RNA, 18 nt, Homo sapiens
uucccaaaagauugcuga

SEQ ID NO: 1480411 - RNA, 19 nt, Homo sapiens
uucccaagaguauccuacc

SEQ ID NO: 1480412 - RNA, 20 nt, Homo sapiens
uucccaauaaaagugacucu

SEQ ID NO: 1480413 - RNA, 23 nt, Homo sapiens
uucccaauagcaaggcugugcau

SEQ ID NO: 1480414 - RNA, 13 nt, Homo sapiens
uucccacgaggaa

SEQ ID NO: 1480415 - RNA, 11 nt, Homo sapiens
uucccacucac

SEQ ID NO: 1480416 - RNA, 20 nt, Homo sapiens
uucccaguggucaaaccgca

SEQ ID NO: 1480417 - RNA, 12 nt, Homo sapiens
uuccccagagaa

SEQ ID NO: 1480418 - RNA, 21 nt, Homo sapiens
uuccccagcgucccagucucu

SEQ ID NO: 1480419 - RNA, 19 nt, Homo sapiens
uuccccagguuccauacca

SEQ ID NO: 1480420 - RNA, 17 nt, Homo sapiens
uuccccauaacucaaug

SEQ ID NO: 1480421 - RNA, 19 nt, Homo sapiens
uucccccacuacugcagca

SEQ ID NO: 1480422 - RNA, 19 nt, Homo sapiens
uucccccuuuucugcauuu

SEQ ID NO: 1480423 - RNA, 19 nt, Homo sapiens
uuccccucaacaugcugcc

SEQ ID NO: 1480424 - RNA, 14 nt, Homo sapiens
uuccccucacuauc

SEQ ID NO: 1480425 - RNA, 17 nt, Homo sapiens
uuccccugugucauccc

SEQ ID NO: 1480426 - RNA, 22 nt, Homo sapiens
uucccgacacccggagcucuac

SEQ ID NO: 1480427 - RNA, 12 nt, Homo sapiens
uucccuagcuuu

SEQ ID NO: 1480428 - RNA, 20 nt, Homo sapiens
agaacuaaccaguaccucug

SEQ ID NO: 1480429 - RNA, 13 nt, Homo sapiens
agaacuacuucuu

SEQ ID NO: 1480430 - RNA, 15 nt, Homo sapiens
agaacuaucugcauu

SEQ ID NO: 1480431 - RNA, 20 nt, Homo sapiens
agaacuaucugcauuaucua

SEQ ID NO: 1480432 - RNA, 19 nt, Homo sapiens
agaacucaaauggggccag

SEQ ID NO: 1480433 - RNA, 15 nt, Homo sapiens
agaacucacuggggc

SEQ ID NO: 1480434 - RNA, 16 nt, Homo sapiens
agaacuccaauacuca

SEQ ID NO: 1480435 - RNA, 21 nt, Homo sapiens
agaacucuugacuuccugcca

SEQ ID NO: 1480436 - RNA, 14 nt, Homo sapiens
agaacugugccaca

SEQ ID NO: 1480437 - RNA, 23 nt, Homo sapiens
agaacuucugaaaccucuggguc

SEQ ID NO: 1480438 - RNA, 14 nt, Homo sapiens
agaacuugaaugug

SEQ ID NO: 1480439 - RNA, 20 nt, Homo sapiens
agaacuuuaagucucaccca

SEQ ID NO: 1480440 - RNA, 21 nt, Homo sapiens
agaagaccccugacucaucau

SEQ ID NO: 1480441 - RNA, 23 nt, Homo sapiens
agaagacugucagcuuccaaaca

SEQ ID NO: 1480442 - RNA, 15 nt, Homo sapiens
agaagagaagcugcu

SEQ ID NO: 1480443 - RNA, 21 nt, Homo sapiens
agaagauagaugcacuuaugc

SEQ ID NO: 1480444 - RNA, 19 nt, Homo sapiens
agaagauccaagaggcccu

SEQ ID NO: 1480445 - RNA, 14 nt, Homo sapiens
agaagaugccagcu

SEQ ID NO: 1480446 - RNA, 13 nt, Homo sapiens
agaagcaagccag

SEQ ID NO: 1480447 - RNA, 14 nt, Homo sapiens
agaagcaagccaga

SEQ ID NO: 1480448 - RNA, 13 nt, Homo sapiens
agaagcacuacac

SEQ ID NO: 1480449 - RNA, 21 nt, Homo sapiens
agaagccuccaagccugccuc

SEQ ID NO: 1480450 - RNA, 23 nt, Homo sapiens
agaagccugaugcugacauucac

SEQ ID NO: 1480451 - RNA, 15 nt, Homo sapiens
agaagcugagacaca

SEQ ID NO: 1480452 - RNA, 14 nt, Homo sapiens
agaaggaacaauaa

SEQ ID NO: 1480453 - RNA, 14 nt, Homo sapiens
agaaggcaaaaaug

SEQ ID NO: 1480454 - RNA, 14 nt, Homo sapiens
agaaggcagugucc

SEQ ID NO: 1480455 - RNA, 18 nt, Homo sapiens
agaagggaauccuccucc

SEQ ID NO: 1480456 - RNA, 17 nt, Homo sapiens
agaagggcuuacaggca

SEQ ID NO: 1480457 - RNA, 14 nt, Homo sapiens
agaagguaaggugu

SEQ ID NO: 1480458 - RNA, 21 nt, Homo sapiens
agaagguuggugaauuucaca

SEQ ID NO: 1480459 - RNA, 22 nt, Homo sapiens
agaagguuggugaauuucacaa

SEQ ID NO: 1480460 - RNA, 14 nt, Homo sapiens
agaaguaauuugaa

SEQ ID NO: 1480461 - RNA, 12 nt, Homo sapiens
agaagugccagu

SEQ ID NO: 1480462 - RNA, 23 nt, Homo sapiens
agaaguuacacagaaaugcugcu

SEQ ID NO: 1480463 - RNA, 22 nt, Homo sapiens
agaaguucuggcugaacacugg

SEQ ID NO: 1480464 - RNA, 15 nt, Homo sapiens
agaaguuuauucuca

SEQ ID NO: 1480465 - RNA, 17 nt, Homo sapiens
agaaguuucccuuccuc

SEQ ID NO: 1480466 - RNA, 17 nt, Homo sapiens
agaauacuuugcuucau

SEQ ID NO: 1480467 - RNA, 14 nt, Homo sapiens
agaauagcacaaac

SEQ ID NO: 1480468 - RNA, 19 nt, Homo sapiens
agaauaucuguaaugguac

SEQ ID NO: 1480469 - RNA, 23 nt, Homo sapiens
agaaucagcauuuagucuugcca

SEQ ID NO: 1480470 - RNA, 18 nt, Homo sapiens
agaaucaugugaacccgg

SEQ ID NO: 1480471 - RNA, 18 nt, Homo sapiens
agaaucauugaaguauuu

SEQ ID NO: 1480472 - RNA, 11 nt, Homo sapiens
agaauccaaac

SEQ ID NO: 1480473 - RNA, 14 nt, Homo sapiens
agaaucucaaauaa

SEQ ID NO: 1480474 - RNA, 14 nt, Homo sapiens
agaaucugcagcua

SEQ ID NO: 1480475 - RNA, 21 nt, Homo sapiens
agaaucugcagcuaacuuauu

SEQ ID NO: 1480476 - RNA, 12 nt, Homo sapiens
agaaucuugacu

SEQ ID NO: 1480477 - RNA, 19 nt, Homo sapiens
agaaugaaauguaugugcu

SEQ ID NO: 1480478 - RNA, 19 nt, Homo sapiens
aaauuccacacuaccacau

SEQ ID NO: 1480479 - RNA, 20 nt, Homo sapiens
aaauuccacacuaccacauu

SEQ ID NO: 1480480 - RNA, 11 nt, Homo sapiens
aaauuccccaa

SEQ ID NO: 1480481 - RNA, 18 nt, Homo sapiens
aaauuccucuuacuguaa

SEQ ID NO: 1480482 - RNA, 21 nt, Homo sapiens
aaauucuauaggaacauauga

SEQ ID NO: 1480483 - RNA, 16 nt, Homo sapiens
aaauugacgacuucac

SEQ ID NO: 1480484 - RNA, 12 nt, Homo sapiens
aaauugauucau

SEQ ID NO: 1480485 - RNA, 16 nt, Homo sapiens
aaauugggcaugccau

SEQ ID NO: 1480486 - RNA, 13 nt, Homo sapiens
aaauuuaagcauu

SEQ ID NO: 1480487 - RNA, 23 nt, Homo sapiens
aaauuuaauguuuuuuaaacuag

SEQ ID NO: 1480488 - RNA, 15 nt, Homo sapiens
aaauuuaucuuucaa

SEQ ID NO: 1480489 - RNA, 20 nt, Homo sapiens
aaauuucucaucacagggau

SEQ ID NO: 1480490 - RNA, 11 nt, Homo sapiens
aaauuugcaac

SEQ ID NO: 1480491 - RNA, 23 nt, Homo sapiens
aaauuuguaccucuaaguacaua

SEQ ID NO: 1480492 - RNA, 20 nt, Homo sapiens
aaauuuuagaacuuuaccua

SEQ ID NO: 1480493 - RNA, 23 nt, Homo sapiens
aaauuuugucuuuaacucauaaa

SEQ ID NO: 1480494 - RNA, 19 nt, Homo sapiens
aaauuuuucuuuucuugau

SEQ ID NO: 1480495 - RNA, 13 nt, Homo sapiens
aacaaacaaugaa

SEQ ID NO: 1480496 - RNA, 14 nt, Homo sapiens
aacaaacaaugaaa

SEQ ID NO: 1480497 - RNA, 13 nt, Homo sapiens
aacaaaguccaca

SEQ ID NO: 1480498 - RNA, 20 nt, Homo sapiens
aacaacaaagccaacaguca

SEQ ID NO: 1480499 - RNA, 14 nt, Homo sapiens
aacaacaaauaauu

SEQ ID NO: 1480500 - RNA, 19 nt, Homo sapiens
aacaacaauaacacugucu

SEQ ID NO: 1480501 - RNA, 15 nt, Homo sapiens
aacaaccugcucaca

SEQ ID NO: 1480502 - RNA, 17 nt, Homo sapiens
aacaacuguggucaauc

SEQ ID NO: 1480503 - RNA, 19 nt, Homo sapiens
aacaacuguggucaauccg

SEQ ID NO: 1480504 - RNA, 15 nt, Homo sapiens
aacaacuuacacuua

SEQ ID NO: 1480505 - RNA, 16 nt, Homo sapiens
aacaacuuacacuuau

SEQ ID NO: 1480506 - RNA, 12 nt, Homo sapiens
aacaacuuguac

SEQ ID NO: 1480507 - RNA, 21 nt, Homo sapiens
aacaacuuguacuuguuucau

SEQ ID NO: 1480508 - RNA, 21 nt, Homo sapiens
aacaaggucugcucugcuccu

SEQ ID NO: 1480509 - RNA, 15 nt, Homo sapiens
aacaagugaaauaac

SEQ ID NO: 1480510 - RNA, 14 nt, Homo sapiens
aacaauccaucucu

SEQ ID NO: 1480511 - RNA, 21 nt, Homo sapiens
aacaaugacuuguacucugaa

SEQ ID NO: 1480512 - RNA, 22 nt, Homo sapiens
aacaaugucugguuaguuaaaa

SEQ ID NO: 1480513 - RNA, 14 nt, Homo sapiens
aacaauucaaguga

SEQ ID NO: 1480514 - RNA, 15 nt, Homo sapiens
aacaauucaugccuu

SEQ ID NO: 1480515 - RNA, 23 nt, Homo sapiens
aacaauuuuuuuuuuccucuuca

SEQ ID NO: 1480516 - RNA, 16 nt, Homo sapiens
aacacaagagacuuaa

SEQ ID NO: 1480517 - RNA, 13 nt, Homo sapiens
aacacacacuguu

SEQ ID NO: 1480518 - RNA, 12 nt, Homo sapiens
aacacacaugca

SEQ ID NO: 1480519 - RNA, 14 nt, Homo sapiens
aacacacaugcaca

SEQ ID NO: 1480520 - RNA, 22 nt, Homo sapiens
aacacacuuggaugcaggguuu

SEQ ID NO: 1480521 - RNA, 13 nt, Homo sapiens
aacacagaggcag

SEQ ID NO: 1480522 - RNA, 14 nt, Homo sapiens
aacacauacaggaa

SEQ ID NO: 1480523 - RNA, 13 nt, Homo sapiens
aacacaugccuua

SEQ ID NO: 1480524 - RNA, 19 nt, Homo sapiens
aacacauuuuuuaacuaau

SEQ ID NO: 1480525 - RNA, 14 nt, Homo sapiens
aacaccaagcacag

SEQ ID NO: 1480526 - RNA, 21 nt, Homo sapiens
aacaccacgguagugccugaa

SEQ ID NO: 1480527 - RNA, 20 nt, Homo sapiens
aacaccaucgaucaugaugu

SEQ ID NO: 1480528 - RNA, 19 nt, Homo sapiens
aacaccgcuucugccuuuu

SEQ ID NO: 1480529 - RNA, 10 nt, Homo sapiens
aacacugcac

SEQ ID NO: 1480530 - RNA, 19 nt, Homo sapiens
aacacugucacuagucuca

SEQ ID NO: 1480531 - RNA, 18 nt, Homo sapiens
aacagaagacagcugcug

SEQ ID NO: 1480532 - RNA, 13 nt, Homo sapiens
aacagaagccuga

SEQ ID NO: 1480533 - RNA, 19 nt, Homo sapiens
aacagagcaagacuccauc

SEQ ID NO: 1480534 - RNA, 13 nt, Homo sapiens
aacagaggccaug

SEQ ID NO: 1480535 - RNA, 15 nt, Homo sapiens
aacagauaagcaaga

SEQ ID NO: 1480536 - RNA, 13 nt, Homo sapiens
aacagauaauccc

SEQ ID NO: 1480537 - RNA, 14 nt, Homo sapiens
aacagaucugaauu

SEQ ID NO: 1480538 - RNA, 13 nt, Homo sapiens
aacagaucuggaa

SEQ ID NO: 1480539 - RNA, 17 nt, Homo sapiens
aacagauggcacuuuga

SEQ ID NO: 1480540 - RNA, 20 nt, Homo sapiens
aacagauucaggccagccca

SEQ ID NO: 1480541 - RNA, 23 nt, Homo sapiens
aacagccaaaacuccacagucaa

SEQ ID NO: 1480542 - RNA, 12 nt, Homo sapiens
aacaggcaguug

SEQ ID NO: 1480543 - RNA, 13 nt, Homo sapiens
aacaguaaugacu

SEQ ID NO: 1480544 - RNA, 16 nt, Homo sapiens
aacaguuuuugcuaau

SEQ ID NO: 1480545 - RNA, 17 nt, Homo sapiens
aacauaaugcacuuuag

SEQ ID NO: 1480546 - RNA, 18 nt, Homo sapiens
aacauaaugcacuuuaga

SEQ ID NO: 1480547 - RNA, 16 nt, Homo sapiens
aacauaauucacuuuc

SEQ ID NO: 1480548 - RNA, 23 nt, Homo sapiens
aacauacuucaaaaauaaugugc

SEQ ID NO: 1480549 - RNA, 19 nt, Homo sapiens
aacauccuucaagaacucu

SEQ ID NO: 1480550 - RNA, 15 nt, Homo sapiens
aacaucuacaaucag

SEQ ID NO: 1480551 - RNA, 18 nt, Homo sapiens
aacaucuuuuacauucug

SEQ ID NO: 1480552 - RNA, 15 nt, Homo sapiens
aacauggacuuguau

SEQ ID NO: 1480553 - RNA, 18 nt, Homo sapiens
aacauggcuaaauacaau

SEQ ID NO: 1480554 - RNA, 21 nt, Homo sapiens
aacaugguuacaaucauugcu

SEQ ID NO: 1480555 - RNA, 19 nt, Homo sapiens
aacauguaauuaaguacua

SEQ ID NO: 1480556 - RNA, 16 nt, Homo sapiens
aacauguaauugcaga

SEQ ID NO: 1480557 - RNA, 14 nt, Homo sapiens
aacauguaugugca

SEQ ID NO: 1480558 - RNA, 15 nt, Homo sapiens
aacauguccuaauuc

SEQ ID NO: 1480559 - RNA, 17 nt, Homo sapiens
aacauguccuaauucuu

SEQ ID NO: 1480560 - RNA, 23 nt, Homo sapiens
aacaugugagagguuugacuaga

SEQ ID NO: 1480561 - RNA, 19 nt, Homo sapiens
aacauuaccuuacugugga

SEQ ID NO: 1480562 - RNA, 20 nt, Homo sapiens
aacauuggacagugagguca

SEQ ID NO: 1480563 - RNA, 16 nt, Homo sapiens
aacauuuuaucauuaa

SEQ ID NO: 1480564 - RNA, 18 nt, Homo sapiens
aaccaaaagaauuugcac

SEQ ID NO: 1480565 - RNA, 20 nt, Homo sapiens
aaccaagacaaaaagccaca

SEQ ID NO: 1480566 - RNA, 15 nt, Homo sapiens
aaccaccuucaccug

SEQ ID NO: 1480567 - RNA, 22 nt, Homo sapiens
aaccacuaagaauucaaacugg

SEQ ID NO: 1480568 - RNA, 22 nt, Homo sapiens
aaccacuaugaagcuaccucaa

SEQ ID NO: 1480569 - RNA, 21 nt, Homo sapiens
aaccacuucagaaauauaugc

SEQ ID NO: 1480570 - RNA, 19 nt, Homo sapiens
acagcaucccuucccacau

SEQ ID NO: 1480571 - RNA, 15 nt, Homo sapiens
acagcauucuuguca

SEQ ID NO: 1480572 - RNA, 15 nt, Homo sapiens
acagccaagugugac

SEQ ID NO: 1480573 - RNA, 12 nt, Homo sapiens
acagccagugac

SEQ ID NO: 1480574 - RNA, 15 nt, Homo sapiens
acagcccagagccug

SEQ ID NO: 1480575 - RNA, 23 nt, Homo sapiens
acagccucccacccccaucucuc

SEQ ID NO: 1480576 - RNA, 16 nt, Homo sapiens
acagcuacagcuuucu

SEQ ID NO: 1480577 - RNA, 16 nt, Homo sapiens
acagcuccuuuuccag

SEQ ID NO: 1480578 - RNA, 13 nt, Homo sapiens
acagcucucaccu

SEQ ID NO: 1480579 - RNA, 20 nt, Homo sapiens
acagcucuuaaauguagcaa

SEQ ID NO: 1480580 - RNA, 18 nt, Homo sapiens
acagcugcugcuggaaau

SEQ ID NO: 1480581 - RNA, 20 nt, Homo sapiens
acagcugggcaaagccacaa

SEQ ID NO: 1480582 - RNA, 22 nt, Homo sapiens
acagcuuucuugcucccuucag

SEQ ID NO: 1480583 - RNA, 19 nt, Homo sapiens
aagcacuacauaaacugac

SEQ ID NO: 1480584 - RNA, 22 nt, Homo sapiens
aagcacugaaaaacaacaacac

SEQ ID NO: 1480585 - RNA, 22 nt, Homo sapiens
aagcagaaauccugcaaugaaa

SEQ ID NO: 1480586 - RNA, 15 nt, Homo sapiens
aagcagacagucaca

SEQ ID NO: 1480587 - RNA, 20 nt, Homo sapiens
aagcagacccaccucccagc

SEQ ID NO: 1480588 - RNA, 20 nt, Homo sapiens
aagcagaggcaacacuggaa

SEQ ID NO: 1480589 - RNA, 17 nt, Homo sapiens
aagcagauuuaacaauu

SEQ ID NO: 1480590 - RNA, 14 nt, Homo sapiens
aagcagcgggcuaa

SEQ ID NO: 1480591 - RNA, 15 nt, Homo sapiens
aagcaggguacccuu

SEQ ID NO: 1480592 - RNA, 21 nt, Homo sapiens
aagcagguucccaagcucaga

SEQ ID NO: 1480593 - RNA, 16 nt, Homo sapiens
aagcaguuacuaauau

SEQ ID NO: 1480594 - RNA, 19 nt, Homo sapiens
aagcauacaaagcaguuua

SEQ ID NO: 1480595 - RNA, 23 nt, Homo sapiens
aagcauguggaugacacaauccc

SEQ ID NO: 1480596 - RNA, 19 nt, Homo sapiens
aagcauuaccacucaggca

SEQ ID NO: 1480597 - RNA, 21 nt, Homo sapiens
aagcauuccuucuuugauaau

SEQ ID NO: 1480598 - RNA, 13 nt, Homo sapiens
aagcauucuucaa

SEQ ID NO: 1480599 - RNA, 22 nt, Homo sapiens
aagcauuucuagcagugaugaa

SEQ ID NO: 1480600 - RNA, 14 nt, Homo sapiens
aagccaagcaaacc

SEQ ID NO: 1480601 - RNA, 21 nt, Homo sapiens
aagccacauuauuucuagucc

SEQ ID NO: 1480602 - RNA, 15 nt, Homo sapiens
aagccacucuuccaa

SEQ ID NO: 1480603 - RNA, 21 nt, Homo sapiens
aagccacugggcacugggcug

SEQ ID NO: 1480604 - RNA, 23 nt, Homo sapiens
aagccagaugugaaaacaucuca

SEQ ID NO: 1480605 - RNA, 19 nt, Homo sapiens
aagccagcugcaggaauca

SEQ ID NO: 1480606 - RNA, 11 nt, Homo sapiens
aagccagugaa

SEQ ID NO: 1480607 - RNA, 19 nt, Homo sapiens
aagcccccagggccuccag

SEQ ID NO: 1480608 - RNA, 21 nt, Homo sapiens
aagccgaccuucccuccgccu

SEQ ID NO: 1480609 - RNA, 16 nt, Homo sapiens
aagccuuaccuugaaa

SEQ ID NO: 1480610 - RNA, 17 nt, Homo sapiens
aagccuuuaguaucagu

SEQ ID NO: 1480611 - RNA, 18 nt, Homo sapiens
aagccuuuugcucacaaa

SEQ ID NO: 1480612 - RNA, 22 nt, Homo sapiens
aagccuuuuguuucccuugcuu

SEQ ID NO: 1480613 - RNA, 22 nt, Homo sapiens
aagcgacccauucagagacugu

SEQ ID NO: 1480614 - RNA, 20 nt, Homo sapiens
aagcgauccucccaccucag

SEQ ID NO: 1480615 - RNA, 19 nt, Homo sapiens
aagcgauuaugaaagcaac

SEQ ID NO: 1480616 - RNA, 17 nt, Homo sapiens
aagcgcacauucaugug

SEQ ID NO: 1480617 - RNA, 19 nt, Homo sapiens
aagcggaaaguuagugcuu

SEQ ID NO: 1480618 - RNA, 15 nt, Homo sapiens
aagcguaauuuugcc

SEQ ID NO: 1480619 - RNA, 18 nt, Homo sapiens
aagcuaaaaugauuuuau

SEQ ID NO: 1480620 - RNA, 22 nt, Homo sapiens
aagcuaaauccuuuacuguuag

SEQ ID NO: 1480621 - RNA, 14 nt, Homo sapiens
aagcuaaauuccac

SEQ ID NO: 1480622 - RNA, 21 nt, Homo sapiens
aagcuaggguggcccuugcag

SEQ ID NO: 1480623 - RNA, 17 nt, Homo sapiens
aagcuaguggcuucaaa

SEQ ID NO: 1480624 - RNA, 21 nt, Homo sapiens
aagcucacucuggauuccaca

SEQ ID NO: 1480625 - RNA, 17 nt, Homo sapiens
aagcucaugcauuucaa

SEQ ID NO: 1480626 - RNA, 16 nt, Homo sapiens
aagcuccacugucacc

SEQ ID NO: 1480627 - RNA, 21 nt, Homo sapiens
aagcugaucauaagugaauuu

SEQ ID NO: 1480628 - RNA, 19 nt, Homo sapiens
aagcugauuacugucaaua

SEQ ID NO: 1480629 - RNA, 17 nt, Homo sapiens
aagcugccgguucuuaa

SEQ ID NO: 1480630 - RNA, 14 nt, Homo sapiens
aagcugcuuuagaa

SEQ ID NO: 1480631 - RNA, 12 nt, Homo sapiens
aagcuggaagaa

SEQ ID NO: 1480632 - RNA, 14 nt, Homo sapiens
aagcuggcccugcc

SEQ ID NO: 1480633 - RNA, 13 nt, Homo sapiens
aagcuggucucaa

SEQ ID NO: 1480634 - RNA, 19 nt, Homo sapiens
aagcugguuuuaaguggaa

SEQ ID NO: 1480635 - RNA, 21 nt, Homo sapiens
aagcugucccucacuguugaa

SEQ ID NO: 1480636 - RNA, 15 nt, Homo sapiens
aagcugugacuucuc

SEQ ID NO: 1480637 - RNA, 19 nt, Homo sapiens
aagcuguuauuucuucccu

SEQ ID NO: 1480638 - RNA, 19 nt, Homo sapiens
aagcuuaugcuuaaauuca

SEQ ID NO: 1480639 - RNA, 20 nt, Homo sapiens
aagcuuaugcuuaaauucaa

SEQ ID NO: 1480640 - RNA, 22 nt, Homo sapiens
aagcuuccauuccaagccugac

SEQ ID NO: 1480641 - RNA, 18 nt, Homo sapiens
aagcuucccuccaucccc

SEQ ID NO: 1480642 - RNA, 17 nt, Homo sapiens
aagcuugaagcugugga

SEQ ID NO: 1480643 - RNA, 15 nt, Homo sapiens
aagcuuuaaaugucu

SEQ ID NO: 1480644 - RNA, 21 nt, Homo sapiens
aagcuuuauuaccaguggcgu

SEQ ID NO: 1480645 - RNA, 19 nt, Homo sapiens
aagcuuuuuacucaaagag

SEQ ID NO: 1480646 - RNA, 13 nt, Homo sapiens
aaggaaaaauaau

SEQ ID NO: 1480647 - RNA, 20 nt, Homo sapiens
aaggaaaagacugaaucuac

SEQ ID NO: 1480648 - RNA, 14 nt, Homo sapiens
aaggaaaaugacuc

SEQ ID NO: 1480649 - RNA, 19 nt, Homo sapiens
aaggaaacccccaguguaa

SEQ ID NO: 1480650 - RNA, 22 nt, Homo sapiens
aaggaaacuugaaucaaagcag

SEQ ID NO: 1480651 - RNA, 21 nt, Homo sapiens
aaggaacauuccuuagucuca

SEQ ID NO: 1480652 - RNA, 17 nt, Homo sapiens
aaggaaccuuccuuccu

SEQ ID NO: 1480653 - RNA, 18 nt, Homo sapiens
aaggaaguuucaguauua

SEQ ID NO: 1480654 - RNA, 13 nt, Homo sapiens
aaggaaucugugc

SEQ ID NO: 1480655 - RNA, 18 nt, Homo sapiens
aaggacacuagaagauuu

SEQ ID NO: 1480656 - RNA, 21 nt, Homo sapiens
aaggacacuagccugugcacg

SEQ ID NO: 1480657 - RNA, 22 nt, Homo sapiens
aaggacagugucaaagugauaa

SEQ ID NO: 1480658 - RNA, 15 nt, Homo sapiens
aaggacaucagcaaa

SEQ ID NO: 1480659 - RNA, 21 nt, Homo sapiens
aaggacggccuucaacugaaa

SEQ ID NO: 1480660 - RNA, 14 nt, Homo sapiens
aaggacucuuccac

SEQ ID NO: 1480661 - RNA, 18 nt, Homo sapiens
aaggacucuuccaccucc

SEQ ID NO: 1480662 - RNA, 17 nt, Homo sapiens
aaggagcacaagccaca

SEQ ID NO: 1480663 - RNA, 16 nt, Homo sapiens
aaggaguacaaugccc

SEQ ID NO: 1480664 - RNA, 20 nt, Homo sapiens
aaggaguacaaugcccagau

SEQ ID NO: 1480665 - RNA, 17 nt, Homo sapiens
aaggaguacuccaagac

SEQ ID NO: 1480666 - RNA, 11 nt, Homo sapiens
aaggagucaaa

SEQ ID NO: 1480667 - RNA, 19 nt, Homo sapiens
aaggauagcaccgcuuuug

SEQ ID NO: 1480668 - RNA, 17 nt, Homo sapiens
aaggauccucuccacuc

SEQ ID NO: 1480669 - RNA, 20 nt, Homo sapiens
aaggauccucuccacuccau

SEQ ID NO: 1480670 - RNA, 13 nt, Homo sapiens
aaggauggaccac

SEQ ID NO: 1480671 - RNA, 23 nt, Homo sapiens
aaggauggagccagcucugcauu

SEQ ID NO: 1480672 - RNA, 20 nt, Homo sapiens
aaguuaauucaccuauguua

SEQ ID NO: 1480673 - RNA, 17 nt, Homo sapiens
aaguuacaugcuguaua

SEQ ID NO: 1480674 - RNA, 12 nt, Homo sapiens
aaguuacuuuau

SEQ ID NO: 1480675 - RNA, 14 nt, Homo sapiens
aaguuagccuccac

SEQ ID NO: 1480676 - RNA, 23 nt, Homo sapiens
aaguuaggguuuaggcaucauuu

SEQ ID NO: 1480677 - RNA, 22 nt, Homo sapiens
aaguuauacuguggcuaugcaa

SEQ ID NO: 1480678 - RNA, 16 nt, Homo sapiens
aaguuauuuuuguaca

SEQ ID NO: 1480679 - RNA, 21 nt, Homo sapiens
aaguucuaugaagaguauuaa

SEQ ID NO: 1480680 - RNA, 21 nt, Homo sapiens
aaguucuauuuauuugugaga

SEQ ID NO: 1480681 - RNA, 20 nt, Homo sapiens
aaguucuuggugguggauga

SEQ ID NO: 1480682 - RNA, 12 nt, Homo sapiens
aaguugcacaug

SEQ ID NO: 1480683 - RNA, 23 nt, Homo sapiens
aaguuggugcuuuugagaaccaa

SEQ ID NO: 1480684 - RNA, 14 nt, Homo sapiens
aacccaaucugcac

SEQ ID NO: 1480685 - RNA, 16 nt, Homo sapiens
aaccccaaacuguuga

SEQ ID NO: 1480686 - RNA, 21 nt, Homo sapiens
aaccccauguccucagcauuu

SEQ ID NO: 1480687 - RNA, 13 nt, Homo sapiens
aacccggcacugc

SEQ ID NO: 1480688 - RNA, 19 nt, Homo sapiens
aacccuaaucuuucacuug

SEQ ID NO: 1480689 - RNA, 20 nt, Homo sapiens
aacccugggcuauugcugcu

SEQ ID NO: 1480690 - RNA, 14 nt, Homo sapiens
aacccuugcuugca

SEQ ID NO: 1480691 - RNA, 19 nt, Homo sapiens
aaccgaggcccucaaucca

SEQ ID NO: 1480692 - RNA, 21 nt, Homo sapiens
aaccgguggauccucaaacaa

SEQ ID NO: 1480693 - RNA, 22 nt, Homo sapiens
aaccguccccuccuucccucac

SEQ ID NO: 1480694 - RNA, 21 nt, Homo sapiens
aaccuagaaguauuuuugucu

SEQ ID NO: 1480695 - RNA, 13 nt, Homo sapiens
aaccucaaaguga

SEQ ID NO: 1480696 - RNA, 20 nt, Homo sapiens
aaccucagccuggccagaca

SEQ ID NO: 1480697 - RNA, 22 nt, Homo sapiens
aaccucagggcucccagggguc

SEQ ID NO: 1480698 - RNA, 23 nt, Homo sapiens
aaccucagggcucccaggggucu

SEQ ID NO: 1480699 - RNA, 22 nt, Homo sapiens
aaccucauccaggcuaccaucc

SEQ ID NO: 1480700 - RNA, 14 nt, Homo sapiens
aaccucuaugcaau

SEQ ID NO: 1480701 - RNA, 22 nt, Homo sapiens
aaccucugggucaucucucaca

SEQ ID NO: 1480702 - RNA, 16 nt, Homo sapiens
aaccucuucaugagcu

SEQ ID NO: 1480703 - RNA, 20 nt, Homo sapiens
aaccugcaaagaucuguccu

SEQ ID NO: 1480704 - RNA, 14 nt, Homo sapiens
aaccugcugugaua

SEQ ID NO: 1480705 - RNA, 22 nt, Homo sapiens
aaccugggagccggaggcugca

SEQ ID NO: 1480706 - RNA, 17 nt, Homo sapiens
aaccuggugcuggauau

SEQ ID NO: 1480707 - RNA, 17 nt, Homo sapiens
aaccuguugcuguguuu

SEQ ID NO: 1480708 - RNA, 22 nt, Homo sapiens
aaccuuaaagaaccaucagcau

SEQ ID NO: 1480709 - RNA, 18 nt, Homo sapiens
aaccuugucucuaugcca

SEQ ID NO: 1480710 - RNA, 23 nt, Homo sapiens
aaccuuuuuuaagauuuuucuca

SEQ ID NO: 1480711 - RNA, 15 nt, Homo sapiens
aacgagccuuuucac

SEQ ID NO: 1480712 - RNA, 12 nt, Homo sapiens
aacgcacaaaac

SEQ ID NO: 1480713 - RNA, 22 nt, Homo sapiens
aacguaugugguuaucugugaa

SEQ ID NO: 1480714 - RNA, 15 nt, Homo sapiens
aacguccacaugaaa

SEQ ID NO: 1480715 - RNA, 22 nt, Homo sapiens
aacuaaagccaaggguauccaa

SEQ ID NO: 1480716 - RNA, 17 nt, Homo sapiens
aacuaagaaauaugcac

SEQ ID NO: 1480717 - RNA, 16 nt, Homo sapiens
aacuaagacauaugca

SEQ ID NO: 1480718 - RNA, 13 nt, Homo sapiens
aacuaagcacaaa

SEQ ID NO: 1480719 - RNA, 17 nt, Homo sapiens
aacuaauaaaagcauaa

SEQ ID NO: 1480720 - RNA, 13 nt, Homo sapiens
aacuaauucucac

SEQ ID NO: 1480721 - RNA, 13 nt, Homo sapiens
aacuaauuugaau

SEQ ID NO: 1480722 - RNA, 23 nt, Homo sapiens
aacuacauauuguaaagcccauu

SEQ ID NO: 1480723 - RNA, 21 nt, Homo sapiens
aacuacuguguuccuggcaau

SEQ ID NO: 1480724 - RNA, 12 nt, Homo sapiens
aacuacuucuua

SEQ ID NO: 1480725 - RNA, 23 nt, Homo sapiens
aacuaggcucagagaugugcacc

SEQ ID NO: 1480726 - RNA, 15 nt, Homo sapiens
aacuauacacuuaau

SEQ ID NO: 1480727 - RNA, 13 nt, Homo sapiens
aacuauccugacu

SEQ ID NO: 1480728 - RNA, 22 nt, Homo sapiens
aacuaucugcauuaucuaugca

SEQ ID NO: 1480729 - RNA, 19 nt, Homo sapiens
aacuauugauaugugaaua

SEQ ID NO: 1480730 - RNA, 19 nt, Homo sapiens
aacuauuuaguguuaguua

SEQ ID NO: 1480731 - RNA, 15 nt, Homo sapiens
aacucacacauuccc

SEQ ID NO: 1480732 - RNA, 23 nt, Homo sapiens
aacucagaauauugucugccuua

SEQ ID NO: 1480733 - RNA, 13 nt, Homo sapiens
aacucagcugucu

SEQ ID NO: 1480734 - RNA, 19 nt, Homo sapiens
aacucaguccuguacucug

SEQ ID NO: 1480735 - RNA, 15 nt, Homo sapiens
aacuccaauacucac

SEQ ID NO: 1480736 - RNA, 14 nt, Homo sapiens
aacuccuacaugau

SEQ ID NO: 1480737 - RNA, 14 nt, Homo sapiens
aacuccugaccuca

SEQ ID NO: 1480738 - RNA, 11 nt, Homo sapiens
aacuccugacu

SEQ ID NO: 1480739 - RNA, 13 nt, Homo sapiens
aacuccugagaaa

SEQ ID NO: 1480740 - RNA, 21 nt, Homo sapiens
aacucuccaucuuauuuucau

SEQ ID NO: 1480741 - RNA, 21 nt, Homo sapiens
aacucucugguuuacuucaaa

SEQ ID NO: 1480742 - RNA, 18 nt, Homo sapiens
aacucugggcugccaugu

SEQ ID NO: 1480743 - RNA, 16 nt, Homo sapiens
aacucuguaaaaccuc

SEQ ID NO: 1480744 - RNA, 16 nt, Homo sapiens
aacugaaaauggaccu

SEQ ID NO: 1480745 - RNA, 13 nt, Homo sapiens
aacugaaauguua

SEQ ID NO: 1480746 - RNA, 13 nt, Homo sapiens
aacugacaguaaa

SEQ ID NO: 1480747 - RNA, 18 nt, Homo sapiens
aacugacugccuugcuaa

SEQ ID NO: 1480748 - RNA, 14 nt, Homo sapiens
aacugacuuuaucc

SEQ ID NO: 1480749 - RNA, 13 nt, Homo sapiens
aacugauugcaac

SEQ ID NO: 1480750 - RNA, 14 nt, Homo sapiens
aacugcaaaccaug

SEQ ID NO: 1480751 - RNA, 19 nt, Homo sapiens
aacugcaauaacuucugac

SEQ ID NO: 1480752 - RNA, 16 nt, Homo sapiens
aacugcacauugguca

SEQ ID NO: 1480753 - RNA, 17 nt, Homo sapiens
aacugcaccugucauca

SEQ ID NO: 1480754 - RNA, 17 nt, Homo sapiens
aacugcaggagcaguuu

SEQ ID NO: 1480755 - RNA, 21 nt, Homo sapiens
aacugcaggagcaguuugcca

SEQ ID NO: 1480756 - RNA, 23 nt, Homo sapiens
aacugcauaagugaaaaucuuac

SEQ ID NO: 1480757 - RNA, 15 nt, Homo sapiens
aacugcauggaccua

SEQ ID NO: 1480758 - RNA, 13 nt, Homo sapiens
aacugcauuuccu

SEQ ID NO: 1480759 - RNA, 18 nt, Homo sapiens
aacugccaucauuuacuu

SEQ ID NO: 1480760 - RNA, 23 nt, Homo sapiens
aacugcccuacugggagacuggg

SEQ ID NO: 1480761 - RNA, 22 nt, Homo sapiens
aacuggcccguggagacugaga

SEQ ID NO: 1480762 - RNA, 20 nt, Homo sapiens
aacugggggcucuguauaua

SEQ ID NO: 1480763 - RNA, 21 nt, Homo sapiens
aacuguaacguuuucuuucac

SEQ ID NO: 1480764 - RNA, 17 nt, Homo sapiens
aacuguagguaugaucu

SEQ ID NO: 1480765 - RNA, 12 nt, Homo sapiens
aacugugacugu

SEQ ID NO: 1480766 - RNA, 15 nt, Homo sapiens
aacugugcaaggccu

SEQ ID NO: 1480767 - RNA, 12 nt, Homo sapiens
aacugugcucuu

SEQ ID NO: 1480768 - RNA, 17 nt, Homo sapiens
aacuguguauguacaua

SEQ ID NO: 1480769 - RNA, 17 nt, Homo sapiens
aacuguguggacuguga

SEQ ID NO: 1480770 - RNA, 13 nt, Homo sapiens
aacuguuaccuaa

SEQ ID NO: 1480771 - RNA, 14 nt, Homo sapiens
aacuuaagcaaagg

SEQ ID NO: 1480772 - RNA, 16 nt, Homo sapiens
aacuuaauaguauuua

SEQ ID NO: 1480773 - RNA, 13 nt, Homo sapiens
aacuuagugacaa

SEQ ID NO: 1480774 - RNA, 14 nt, Homo sapiens
aacuuagugacaaa

SEQ ID NO: 1480775 - RNA, 11 nt, Homo sapiens
aaaccaaagcc

SEQ ID NO: 1480776 - RNA, 16 nt, Homo sapiens
aaaccaauagcuuuaa

SEQ ID NO: 1480777 - RNA, 22 nt, Homo sapiens
aaaccagcuuguucugggcuca

SEQ ID NO: 1480778 - RNA, 15 nt, Homo sapiens
aaaccaggacauuaa

SEQ ID NO: 1480779 - RNA, 12 nt, Homo sapiens
aaaccaugacug

SEQ ID NO: 1480780 - RNA, 13 nt, Homo sapiens
aaaccccaucucu

SEQ ID NO: 1480781 - RNA, 13 nt, Homo sapiens
aaacccccagugu

SEQ ID NO: 1480782 - RNA, 14 nt, Homo sapiens
aaacccccagugua

SEQ ID NO: 1480783 - RNA, 17 nt, Homo sapiens
aaacccccaguguaaua

SEQ ID NO: 1480784 - RNA, 13 nt, Homo sapiens
aaaccccgucucu

SEQ ID NO: 1480785 - RNA, 22 nt, Homo sapiens
aaacccugccucuuuuccccau

SEQ ID NO: 1480786 - RNA, 17 nt, Homo sapiens
aaaccuccagccucccu

SEQ ID NO: 1480787 - RNA, 20 nt, Homo sapiens
aaaccucugggucaucucuc

SEQ ID NO: 1480788 - RNA, 13 nt, Homo sapiens
aaaccugaccaca

SEQ ID NO: 1480789 - RNA, 22 nt, Homo sapiens
aaaccugauguuaaaauuccau

SEQ ID NO: 1480790 - RNA, 22 nt, Homo sapiens
aaaccuggaaucuacaagccaa

SEQ ID NO: 1480791 - RNA, 17 nt, Homo sapiens
aaaccugugugccauuu

SEQ ID NO: 1480792 - RNA, 13 nt, Homo sapiens
aaaccuucaguga

SEQ ID NO: 1480793 - RNA, 21 nt, Homo sapiens
aaaccuugcuaauuuucucaa

SEQ ID NO: 1480794 - RNA, 19 nt, Homo sapiens
aaacgccgcugacugccac

SEQ ID NO: 1480795 - RNA, 18 nt, Homo sapiens
aaacgguaauacgugaaa

SEQ ID NO: 1480796 - RNA, 17 nt, Homo sapiens
aaacguuucuugaacaa

SEQ ID NO: 1480797 - RNA, 12 nt, Homo sapiens
aaacuaagccag

SEQ ID NO: 1480798 - RNA, 13 nt, Homo sapiens
aaacuacuucuuu

SEQ ID NO: 1480799 - RNA, 17 nt, Homo sapiens
aaacuaugguucccaau

SEQ ID NO: 1480800 - RNA, 11 nt, Homo sapiens
aaacucagugc

SEQ ID NO: 1480801 - RNA, 18 nt, Homo sapiens
aaacucaucuugaucaac

SEQ ID NO: 1480802 - RNA, 19 nt, Homo sapiens
aaacuccacaucugccuua

SEQ ID NO: 1480803 - RNA, 17 nt, Homo sapiens
aaacuccuuuugguuua

SEQ ID NO: 1480804 - RNA, 16 nt, Homo sapiens
aaacucuccuagucaa

SEQ ID NO: 1480805 - RNA, 19 nt, Homo sapiens
aaacugauuuuuagcuuua

SEQ ID NO: 1480806 - RNA, 23 nt, Homo sapiens
aaacugcaggagcaguuugccac

SEQ ID NO: 1480807 - RNA, 20 nt, Homo sapiens
aaacugcucccaucauuccu

SEQ ID NO: 1480808 - RNA, 23 nt, Homo sapiens
aaacugggauuaagaaaccuugc

SEQ ID NO: 1480809 - RNA, 16 nt, Homo sapiens
aaacuguccaccaaga

SEQ ID NO: 1480810 - RNA, 13 nt, Homo sapiens
aaacuuaacuuua

SEQ ID NO: 1480811 - RNA, 13 nt, Homo sapiens
aaacuuagaucau

SEQ ID NO: 1480812 - RNA, 13 nt, Homo sapiens
aaacuuagccaga

SEQ ID NO: 1480813 - RNA, 13 nt, Homo sapiens
aaacuucaaagag

SEQ ID NO: 1480814 - RNA, 21 nt, Homo sapiens
aaacuucaccuacauuaucuc

SEQ ID NO: 1480815 - RNA, 17 nt, Homo sapiens
aaacuuuguaaaauauc

SEQ ID NO: 1480816 - RNA, 15 nt, Homo sapiens
aaagaaagaaggaag

SEQ ID NO: 1480817 - RNA, 23 nt, Homo sapiens
aaagaagacagcuuaauaguagu

SEQ ID NO: 1480818 - RNA, 22 nt, Homo sapiens
aaagaagguuggugaauuucac

SEQ ID NO: 1480819 - RNA, 22 nt, Homo sapiens
aaagaaguaugguaaucuuuac

SEQ ID NO: 1480820 - RNA, 22 nt, Homo sapiens
aaagaauaauaugcugccaaau

SEQ ID NO: 1480821 - RNA, 16 nt, Homo sapiens
aaagaaugcucuuuac

SEQ ID NO: 1480822 - RNA, 14 nt, Homo sapiens
aaagacaacauaac

SEQ ID NO: 1480823 - RNA, 19 nt, Homo sapiens
aaagacacgguugcucuau

SEQ ID NO: 1480824 - RNA, 21 nt, Homo sapiens
aaagacauucuuccaaaaaga

SEQ ID NO: 1480825 - RNA, 14 nt, Homo sapiens
aaagaccuugcuua

SEQ ID NO: 1480826 - RNA, 14 nt, Homo sapiens
aaagacucugacca

SEQ ID NO: 1480827 - RNA, 14 nt, Homo sapiens
aaagacuguagaag

SEQ ID NO: 1480828 - RNA, 18 nt, Homo sapiens
aaagagagucgcaucuca

SEQ ID NO: 1480829 - RNA, 13 nt, Homo sapiens
aaagagcagucag

SEQ ID NO: 1480830 - RNA, 15 nt, Homo sapiens
aaagaggaaccagga

SEQ ID NO: 1480831 - RNA, 17 nt, Homo sapiens
aaagauuuaagcacaaa

SEQ ID NO: 1480832 - RNA, 17 nt, Homo sapiens
aaagauuuguuuuguca

SEQ ID NO: 1480833 - RNA, 18 nt, Homo sapiens
aaagauuuucugguucua

SEQ ID NO: 1480834 - RNA, 14 nt, Homo sapiens
aaagcaauaaccuc

SEQ ID NO: 1480835 - RNA, 19 nt, Homo sapiens
aaagcaguuacuaauaugc

SEQ ID NO: 1480836 - RNA, 12 nt, Homo sapiens
aaagcauaacac

SEQ ID NO: 1480837 - RNA, 21 nt, Homo sapiens
aaagcauauuggugcuagaaa

SEQ ID NO: 1480838 - RNA, 22 nt, Homo sapiens
aaagcauccauguguggacuca

SEQ ID NO: 1480839 - RNA, 13 nt, Homo sapiens
aaagcaugucuca

SEQ ID NO: 1480840 - RNA, 20 nt, Homo sapiens
aaagcauguggcauguucau

SEQ ID NO: 1480841 - RNA, 18 nt, Homo sapiens
aaagcauuugcaacagcu

SEQ ID NO: 1480842 - RNA, 19 nt, Homo sapiens
aaagccaccucucccucaa

SEQ ID NO: 1480843 - RNA, 19 nt, Homo sapiens
aaagccagggucucucccu

SEQ ID NO: 1480844 - RNA, 12 nt, Homo sapiens
aaagccagugaa

SEQ ID NO: 1480845 - RNA, 16 nt, Homo sapiens
aaagcccauugccauu

SEQ ID NO: 1480846 - RNA, 17 nt, Homo sapiens
aaagccuccucaucccg

SEQ ID NO: 1480847 - RNA, 16 nt, Homo sapiens
aaagccugcaauuuca

SEQ ID NO: 1480848 - RNA, 18 nt, Homo sapiens
aaagccugguuuuucuca

SEQ ID NO: 1480849 - RNA, 13 nt, Homo sapiens
aaagccuugugua

SEQ ID NO: 1480850 - RNA, 17 nt, Homo sapiens
aaagcuaguguaccucc

SEQ ID NO: 1480851 - RNA, 19 nt, Homo sapiens
aaagcuaguguaccuccuc

SEQ ID NO: 1480852 - RNA, 15 nt, Homo sapiens
aaagcucacuguagc

SEQ ID NO: 1480853 - RNA, 16 nt, Homo sapiens
aaagcucugucaauaa

SEQ ID NO: 1480854 - RNA, 14 nt, Homo sapiens
aaagcucuguugca

SEQ ID NO: 1480855 - RNA, 18 nt, Homo sapiens
aaagcucuguugcaauua

SEQ ID NO: 1480856 - RNA, 23 nt, Homo sapiens
aaagcugagaagaaugaaaaugc

SEQ ID NO: 1480857 - RNA, 17 nt, Homo sapiens
aaagcugaguguuucac

SEQ ID NO: 1480858 - RNA, 18 nt, Homo sapiens
aaagcugaguguuucaca

SEQ ID NO: 1480859 - RNA, 18 nt, Homo sapiens
aaagcugauuacugucaa

SEQ ID NO: 1480860 - RNA, 23 nt, Homo sapiens
aaagcuucaaauuaaaacagcug

SEQ ID NO: 1480861 - RNA, 18 nt, Homo sapiens
aaagcuucuaucccagga

SEQ ID NO: 1480862 - RNA, 18 nt, Homo sapiens
aaagcuugaagcugugga

SEQ ID NO: 1480863 - RNA, 21 nt, Homo sapiens
aaagcuuguggccccuuuuac

SEQ ID NO: 1480864 - RNA, 15 nt, Homo sapiens
aaagcuuuuuccucc

SEQ ID NO: 1480865 - RNA, 17 nt, Homo sapiens
aaaggaagccuugcuca

SEQ ID NO: 1480866 - RNA, 15 nt, Homo sapiens
aaauuaggacuguau

SEQ ID NO: 1480867 - RNA, 20 nt, Homo sapiens
aaauuaguuucaaauuuacc

SEQ ID NO: 1480868 - RNA, 16 nt, Homo sapiens
aaauuauaucucagua

SEQ ID NO: 1480869 - RNA, 20 nt, Homo sapiens
aaauuaugucuuaguuauaa

SEQ ID NO: 1480870 - RNA, 13 nt, Homo sapiens
aaauuaugugaca

SEQ ID NO: 1480871 - RNA, 16 nt, Homo sapiens
aaauuaugugacauuu

SEQ ID NO: 1480872 - RNA, 15 nt, Homo sapiens
aaauuauucugcccu

SEQ ID NO: 1480873 - RNA, 14 nt, Homo sapiens
aaauuauuugcuaa

SEQ ID NO: 1480874 - RNA, 17 nt, Homo sapiens
aaauucaaccacuguaa

SEQ ID NO: 1480875 - RNA, 16 nt, Homo sapiens
aaauucacaaacuuuu

SEQ ID NO: 1480876 - RNA, 22 nt, Homo sapiens
aaauucauuuuuuucacuggag

SEQ ID NO: 1480877 - RNA, 20 nt, Homo sapiens
gauuacuaucauggcauaua

SEQ ID NO: 1480878 - RNA, 18 nt, Homo sapiens
gauuagcaaggucauuuc

SEQ ID NO: 1480879 - RNA, 14 nt, Homo sapiens
gauucaaaucuaug

SEQ ID NO: 1480880 - RNA, 21 nt, Homo sapiens
gauucacauaguuuauuucaa

SEQ ID NO: 1480881 - RNA, 14 nt, Homo sapiens
gauucaccaaaaua

SEQ ID NO: 1480882 - RNA, 23 nt, Homo sapiens
gauucaccaaaauagucuucuca

SEQ ID NO: 1480883 - RNA, 21 nt, Homo sapiens
gauucagccaaaugcagggag

SEQ ID NO: 1480884 - RNA, 20 nt, Homo sapiens
gauucaggggucugaugaca

SEQ ID NO: 1480885 - RNA, 20 nt, Homo sapiens
gauuccacacugcacuguua

SEQ ID NO: 1480886 - RNA, 14 nt, Homo sapiens
gauuccacuaucuc

SEQ ID NO: 1480887 - RNA, 16 nt, Homo sapiens
gauucccaacugagug

SEQ ID NO: 1480888 - RNA, 20 nt, Homo sapiens
gauucccgggcuuaccaggu

SEQ ID NO: 1480889 - RNA, 16 nt, Homo sapiens
gauuccucacuuugaa

SEQ ID NO: 1480890 - RNA, 14 nt, Homo sapiens
gauuccucaggguu

SEQ ID NO: 1480891 - RNA, 19 nt, Homo sapiens
gauuccugguuugacucag

SEQ ID NO: 1480892 - RNA, 23 nt, Homo sapiens
gauucgcccuccucccugucaua

SEQ ID NO: 1480893 - RNA, 15 nt, Homo sapiens
gauucuaccacacag

SEQ ID NO: 1480894 - RNA, 19 nt, Homo sapiens
gauucuaggaccugugucc

SEQ ID NO: 1480895 - RNA, 20 nt, Homo sapiens
gauucucaccagcugugucc

SEQ ID NO: 1480896 - RNA, 19 nt, Homo sapiens
gauucuccagccaaccuca

SEQ ID NO: 1480897 - RNA, 19 nt, Homo sapiens
gauucucccaaaguaccuu

SEQ ID NO: 1480898 - RNA, 22 nt, Homo sapiens
gauucuguaauagugaacauau

SEQ ID NO: 1480899 - RNA, 23 nt, Homo sapiens
gauugcagcuuuauguucauuug

SEQ ID NO: 1480900 - RNA, 20 nt, Homo sapiens
gauugcauaggaauugcaca

SEQ ID NO: 1480901 - RNA, 20 nt, Homo sapiens
gauugcugaaaaaguagauu

SEQ ID NO: 1480902 - RNA, 21 nt, Homo sapiens
gauuguaaaaaaaaaugccuu

SEQ ID NO: 1480903 - RNA, 20 nt, Homo sapiens
gauugugccacuucacucca

SEQ ID NO: 1480904 - RNA, 22 nt, Homo sapiens
gauuguuaggagugguucucau

SEQ ID NO: 1480905 - RNA, 15 nt, Homo sapiens
gauuuaauacaguuu

SEQ ID NO: 1480906 - RNA, 22 nt, Homo sapiens
gauuuauuuaagggggaaaaag

SEQ ID NO: 1480907 - RNA, 23 nt, Homo sapiens
gauuucaugccuggugcuuccaa

SEQ ID NO: 1480908 - RNA, 12 nt, Homo sapiens
gauuuccaggga

SEQ ID NO: 1480909 - RNA, 12 nt, Homo sapiens
gauuugaacccc

SEQ ID NO: 1480910 - RNA, 13 nt, Homo sapiens
gauuugccugugc

SEQ ID NO: 1480911 - RNA, 16 nt, Homo sapiens
gauuugggugaacaaa

SEQ ID NO: 1480912 - RNA, 15 nt, Homo sapiens
gauuuguacaggagu

SEQ ID NO: 1480913 - RNA, 22 nt, Homo sapiens
gauuugucccuaugcauaucag

SEQ ID NO: 1480914 - RNA, 16 nt, Homo sapiens
gauuuuauuugacaaa

SEQ ID NO: 1480915 - RNA, 23 nt, Homo sapiens
gauuuucaaccagauaacauacc

SEQ ID NO: 1480916 - RNA, 15 nt, Homo sapiens
gauuuucuauuuaug

SEQ ID NO: 1480917 - RNA, 20 nt, Homo sapiens
gauuuugaaauuuuuauuaa

SEQ ID NO: 1480918 - RNA, 17 nt, Homo sapiens
gauuuuuguauguuaug

SEQ ID NO: 1480919 - RNA, 15 nt, Homo sapiens
gauuuuuuauugcua

SEQ ID NO: 1480920 - RNA, 22 nt, Homo sapiens
gcaaaaacauguaugugcauuu

SEQ ID NO: 1480921 - RNA, 16 nt, Homo sapiens
gcaaaaccucauuuaa

SEQ ID NO: 1480922 - RNA, 20 nt, Homo sapiens
gcaaaaucacuuagcagcaa

SEQ ID NO: 1480923 - RNA, 23 nt, Homo sapiens
gcaaaaucuguucuaacauguaa

SEQ ID NO: 1480924 - RNA, 12 nt, Homo sapiens
gcaaaauugcaa

SEQ ID NO: 1480925 - RNA, 21 nt, Homo sapiens
gcaaaauugucuaaaauguca

SEQ ID NO: 1480926 - RNA, 20 nt, Homo sapiens
gcaaacacugggggcaccuu

SEQ ID NO: 1480927 - RNA, 13 nt, Homo sapiens
gcaaacaggcagu

SEQ ID NO: 1480928 - RNA, 20 nt, Homo sapiens
gcaaacaggguuugauagca

SEQ ID NO: 1480929 - RNA, 21 nt, Homo sapiens
gcaaacaggguuugauagcac

SEQ ID NO: 1480930 - RNA, 17 nt, Homo sapiens
gcaaacuuuguauuaau

SEQ ID NO: 1480931 - RNA, 11 nt, Homo sapiens
gcaaagccaaa

SEQ ID NO: 1480932 - RNA, 20 nt, Homo sapiens
gcaaagcugaugacaacuuc

SEQ ID NO: 1480933 - RNA, 21 nt, Homo sapiens
gcaaaggggacagcuguguga

SEQ ID NO: 1480934 - RNA, 15 nt, Homo sapiens
gcaaagugcacauga

SEQ ID NO: 1480935 - RNA, 17 nt, Homo sapiens
gcaaauaguaaucugua

SEQ ID NO: 1480936 - RNA, 19 nt, Homo sapiens
gcaaaucuaugagauuuug

SEQ ID NO: 1480937 - RNA, 22 nt, Homo sapiens
gcaaaugacuaguaaacaugug

SEQ ID NO: 1480938 - RNA, 18 nt, Homo sapiens
gcaacaagaccaccacuu

SEQ ID NO: 1480939 - RNA, 21 nt, Homo sapiens
gagaagugccuucuccuuccc

SEQ ID NO: 1480940 - RNA, 21 nt, Homo sapiens
gagaauaaacuagacucugaa

SEQ ID NO: 1480941 - RNA, 20 nt, Homo sapiens
gagaauauacaugaagaaua

SEQ ID NO: 1480942 - RNA, 21 nt, Homo sapiens
gagaaucccaaauuugauuga

SEQ ID NO: 1480943 - RNA, 20 nt, Homo sapiens
gagaaucucagcgugggcca

SEQ ID NO: 1480944 - RNA, 22 nt, Homo sapiens
gagaaugaucaaggaucuggac

SEQ ID NO: 1480945 - RNA, 14 nt, Homo sapiens
gagaauuggcucaa

SEQ ID NO: 1480946 - RNA, 21 nt, Homo sapiens
gagaauuuccaaaacuuuaau

SEQ ID NO: 1480947 - RNA, 23 nt, Homo sapiens
gagaauuuccaaaacuuuaauga

SEQ ID NO: 1480948 - RNA, 20 nt, Homo sapiens
gagaauuuccuuacucuuga

SEQ ID NO: 1480949 - RNA, 21 nt, Homo sapiens
gagacaaaaucuuaaaugcca

SEQ ID NO: 1480950 - RNA, 19 nt, Homo sapiens
gagacaauguuuucuucaa

SEQ ID NO: 1480951 - RNA, 21 nt, Homo sapiens
gagacacaacuauuuuuccaa

SEQ ID NO: 1480952 - RNA, 21 nt, Homo sapiens
gagacaccaaccgacaggccc

SEQ ID NO: 1480953 - RNA, 22 nt, Homo sapiens
gagacagaagccuggacucugc

SEQ ID NO: 1480954 - RNA, 20 nt, Homo sapiens
gagacagaauagagugauag

SEQ ID NO: 1480955 - RNA, 17 nt, Homo sapiens
gagacaggguuucacug

SEQ ID NO: 1480956 - RNA, 12 nt, Homo sapiens
gagacaguccag

SEQ ID NO: 1480957 - RNA, 12 nt, Homo sapiens
gagacagugacu

SEQ ID NO: 1480958 - RNA, 14 nt, Homo sapiens
gagacaguugcccg

SEQ ID NO: 1480959 - RNA, 11 nt, Homo sapiens
gagacauguga

SEQ ID NO: 1480960 - RNA, 16 nt, Homo sapiens
gagacaugugacauuu

SEQ ID NO: 1480961 - RNA, 22 nt, Homo sapiens
gagacccaccuucaagcagcug

SEQ ID NO: 1480962 - RNA, 13 nt, Homo sapiens
gagaccugagucu

SEQ ID NO: 1480963 - RNA, 13 nt, Homo sapiens
gagacuaauucua

SEQ ID NO: 1480964 - RNA, 20 nt, Homo sapiens
gagacuccgucacaacaaca

SEQ ID NO: 1480965 - RNA, 16 nt, Homo sapiens
gagacuccgucucaaa

SEQ ID NO: 1480966 - RNA, 18 nt, Homo sapiens
gagacucuaggguccagu

SEQ ID NO: 1480967 - RNA, 22 nt, Homo sapiens
gagacugacaaccucauccagg

SEQ ID NO: 1480968 - RNA, 19 nt, Homo sapiens
gagacuuucugcugggauc

SEQ ID NO: 1480969 - RNA, 14 nt, Homo sapiens
gagagagaaggcag

SEQ ID NO: 1480970 - RNA, 22 nt, Homo sapiens
gagagaugggagcuccucuccu

SEQ ID NO: 1480971 - RNA, 16 nt, Homo sapiens
gagagcaaaugcuauu

SEQ ID NO: 1480972 - RNA, 15 nt, Homo sapiens
gagagcagaggucuc

SEQ ID NO: 1480973 - RNA, 17 nt, Homo sapiens
gagagccuggugcugcu

SEQ ID NO: 1480974 - RNA, 14 nt, Homo sapiens
gagaggaagccagc

SEQ ID NO: 1480975 - RNA, 16 nt, Homo sapiens
gagaggcaggcauaga

SEQ ID NO: 1480976 - RNA, 15 nt, Homo sapiens
gagaggcucugagaa

SEQ ID NO: 1480977 - RNA, 18 nt, Homo sapiens
gagagggaggucacugga

SEQ ID NO: 1480978 - RNA, 16 nt, Homo sapiens
gagagucgcaucucag

SEQ ID NO: 1480979 - RNA, 22 nt, Homo sapiens
gagagugaaaccaugacuguga

SEQ ID NO: 1480980 - RNA, 14 nt, Homo sapiens
gagaguuucuguua

SEQ ID NO: 1480981 - RNA, 16 nt, Homo sapiens
gagauaaaccaauaaa

SEQ ID NO: 1480982 - RNA, 16 nt, Homo sapiens
gagauaggaaacugaa

SEQ ID NO: 1480983 - RNA, 13 nt, Homo sapiens
gagauagucucau

SEQ ID NO: 1480984 - RNA, 15 nt, Homo sapiens
gagaucaugucucac

SEQ ID NO: 1480985 - RNA, 21 nt, Homo sapiens
gagauccaaaguccugugguu

SEQ ID NO: 1480986 - RNA, 21 nt, Homo sapiens
gagaucgcaucauugcacucu

SEQ ID NO: 1480987 - RNA, 20 nt, Homo sapiens
gagaugcuucucuccuugcc

SEQ ID NO: 1480988 - RNA, 20 nt, Homo sapiens
gagauggaaguugcagugag

SEQ ID NO: 1480989 - RNA, 16 nt, Homo sapiens
gagauggguccagggg

SEQ ID NO: 1480990 - RNA, 11 nt, Homo sapiens
gagauguaucc

SEQ ID NO: 1480991 - RNA, 23 nt, Homo sapiens
gagauucuccauuacacgaucac

SEQ ID NO: 1480992 - RNA, 14 nt, Homo sapiens
gagauugaacucca

SEQ ID NO: 1480993 - RNA, 20 nt, Homo sapiens
gagauugagcagaagaucaa

SEQ ID NO: 1480994 - RNA, 23 nt, Homo sapiens
gagauuuguaggaaggucucauu

SEQ ID NO: 1480995 - RNA, 21 nt, Homo sapiens
gagauuugucuaauugcaucu

SEQ ID NO: 1480996 - RNA, 22 nt, Homo sapiens
gagcaagacucugucucaaaaa

SEQ ID NO: 1480997 - RNA, 22 nt, Homo sapiens
gagcaauggaguggcugccaug

SEQ ID NO: 1480998 - RNA, 23 nt, Homo sapiens
gagcacaagccacaagucuucca

SEQ ID NO: 1480999 - RNA, 16 nt, Homo sapiens
gagcaccgccugugaa

SEQ ID NO: 1481000 - RNA, 22 nt, Homo sapiens
gagcacuguccaguauucuacc

SEQ ID NO: 1481001 - RNA, 11 nt, Homo sapiens
gagcacuguga

SEQ ID NO: 1481002 - RNA, 16 nt, Homo sapiens
gagcaggaagcauuca

SEQ ID NO: 1481003 - RNA, 17 nt, Homo sapiens
gagcaggaagcauucag

SEQ ID NO: 1481004 - RNA, 20 nt, Homo sapiens
gauacaaugaacacuuauaa

SEQ ID NO: 1481005 - RNA, 19 nt, Homo sapiens
gauacacuaugaagauguu

SEQ ID NO: 1481006 - RNA, 23 nt, Homo sapiens
gauacacugaaguuaacagagac

SEQ ID NO: 1481007 - RNA, 20 nt, Homo sapiens
gauacagugucugacuauaa

SEQ ID NO: 1481008 - RNA, 16 nt, Homo sapiens
gauacauguaauucua

SEQ ID NO: 1481009 - RNA, 14 nt, Homo sapiens
gauaccacugcacu

SEQ ID NO: 1481010 - RNA, 16 nt, Homo sapiens
gauacccagagcauua

SEQ ID NO: 1481011 - RNA, 20 nt, Homo sapiens
gauacccaggaccaagccac

SEQ ID NO: 1481012 - RNA, 15 nt, Homo sapiens
gauaccugcacuguc

SEQ ID NO: 1481013 - RNA, 19 nt, Homo sapiens
gauacuauuuaauuauuuc

SEQ ID NO: 1481014 - RNA, 15 nt, Homo sapiens
gauagauauaugcuc

SEQ ID NO: 1481015 - RNA, 14 nt, Homo sapiens
gauagaugcuggcc

SEQ ID NO: 1481016 - RNA, 18 nt, Homo sapiens
gauagcaaacacuggggg

SEQ ID NO: 1481017 - RNA, 16 nt, Homo sapiens
gauagggaacugggga

SEQ ID NO: 1481018 - RNA, 15 nt, Homo sapiens
gauaguaacaaugaa

SEQ ID NO: 1481019 - RNA, 18 nt, Homo sapiens
gauauaaaaauaauguca

SEQ ID NO: 1481020 - RNA, 23 nt, Homo sapiens
gauauauuuuccagggcaaucaa

SEQ ID NO: 1481021 - RNA, 22 nt, Homo sapiens
gauauuauacaggaaagcaaua

SEQ ID NO: 1481022 - RNA, 13 nt, Homo sapiens
gauauugaugaua

SEQ ID NO: 1481023 - RNA, 16 nt, Homo sapiens
gauauugucagucuuu

SEQ ID NO: 1481024 - RNA, 19 nt, Homo sapiens
gauauuugaagcaucacau

SEQ ID NO: 1481025 - RNA, 21 nt, Homo sapiens
gaucaaaauaaaaagugacac

SEQ ID NO: 1481026 - RNA, 13 nt, Homo sapiens
gaucaaauacuuu

SEQ ID NO: 1481027 - RNA, 14 nt, Homo sapiens
gaucacagcugcuu

SEQ ID NO: 1481028 - RNA, 19 nt, Homo sapiens
gaucagcaaaccggggccu

SEQ ID NO: 1481029 - RNA, 15 nt, Homo sapiens
gaucaucuuugccac

SEQ ID NO: 1481030 - RNA, 23 nt, Homo sapiens
gaucaucuuugccaccaccuggg

SEQ ID NO: 1481031 - RNA, 23 nt, Homo sapiens
gauccaaaagaagcccccagcua

SEQ ID NO: 1481032 - RNA, 13 nt, Homo sapiens
gauccaagacaaa

SEQ ID NO: 1481033 - RNA, 20 nt, Homo sapiens
gauccaagcagccugagcaa

SEQ ID NO: 1481034 - RNA, 21 nt, Homo sapiens
gauccaauggaauacugaaaa

SEQ ID NO: 1481035 - RNA, 21 nt, Homo sapiens
gauccaccugucucagccucc

SEQ ID NO: 1481036 - RNA, 16 nt, Homo sapiens
gauccccacuguccua

SEQ ID NO: 1481037 - RNA, 23 nt, Homo sapiens
gauccccccacagccccugguca

SEQ ID NO: 1481038 - RNA, 15 nt, Homo sapiens
gauccuucaaagagu

SEQ ID NO: 1481039 - RNA, 20 nt, Homo sapiens
gauccuucgggugcuggaag

SEQ ID NO: 1481040 - RNA, 17 nt, Homo sapiens
gaucgcgccacugcacu

SEQ ID NO: 1481041 - RNA, 20 nt, Homo sapiens
gaucgcgccacugcacucca

SEQ ID NO: 1481042 - RNA, 14 nt, Homo sapiens
gaucggacucugcc

SEQ ID NO: 1481043 - RNA, 19 nt, Homo sapiens
gaucuaagccuuuccauaa

SEQ ID NO: 1481044 - RNA, 12 nt, Homo sapiens
gaucuacaccca

SEQ ID NO: 1481045 - RNA, 21 nt, Homo sapiens
gaucuacuucauagcuccuug

SEQ ID NO: 1481046 - RNA, 20 nt, Homo sapiens
gaucucagcagugaaguaua

SEQ ID NO: 1481047 - RNA, 20 nt, Homo sapiens
gaucucgccacugcacucca

SEQ ID NO: 1481048 - RNA, 18 nt, Homo sapiens
gaucucucuagcuuuguc

SEQ ID NO: 1481049 - RNA, 19 nt, Homo sapiens
gaucuggaacccagacuca

SEQ ID NO: 1481050 - RNA, 18 nt, Homo sapiens
gaucuggaaccucagccu

SEQ ID NO: 1481051 - RNA, 15 nt, Homo sapiens
gaucuuugacucuuu

SEQ ID NO: 1481052 - RNA, 23 nt, Homo sapiens
gaugaaaacauagcaucucagga

SEQ ID NO: 1481053 - RNA, 16 nt, Homo sapiens
gaugaaagcugauuac

SEQ ID NO: 1481054 - RNA, 21 nt, Homo sapiens
gaugaagauucuccugugcua

SEQ ID NO: 1481055 - RNA, 18 nt, Homo sapiens
gaugaccagaacaagguu

SEQ ID NO: 1481056 - RNA, 15 nt, Homo sapiens
gaugacccucugacc

SEQ ID NO: 1481057 - RNA, 16 nt, Homo sapiens
gaugagccgcugugag

SEQ ID NO: 1481058 - RNA, 14 nt, Homo sapiens
gaugaggggugcug

SEQ ID NO: 1481059 - RNA, 21 nt, Homo sapiens
gaugaggugguggaguggagu

SEQ ID NO: 1481060 - RNA, 13 nt, Homo sapiens
gaugauacaucca

SEQ ID NO: 1481061 - RNA, 16 nt, Homo sapiens
gaugauggaugccaau

SEQ ID NO: 1481062 - RNA, 13 nt, Homo sapiens
gaugauuguucaa

SEQ ID NO: 1481063 - RNA, 14 nt, Homo sapiens
gaugcaagugcaac

SEQ ID NO: 1481064 - RNA, 21 nt, Homo sapiens
gaugcaucacuggguguugau

SEQ ID NO: 1481065 - RNA, 22 nt, Homo sapiens
gaugccgagguaaaaguucuuu

SEQ ID NO: 1481066 - RNA, 23 nt, Homo sapiens
gaugccgagguaaaaguucuuuu

SEQ ID NO: 1481067 - RNA, 20 nt, Homo sapiens
gagcucuggguugugcacau

SEQ ID NO: 1481068 - RNA, 13 nt, Homo sapiens
gagcucuuggccu

SEQ ID NO: 1481069 - RNA, 20 nt, Homo sapiens
gagcugcagcugagccugag

SEQ ID NO: 1481070 - RNA, 20 nt, Homo sapiens
gagcugcccuccuuguccac

SEQ ID NO: 1481071 - RNA, 16 nt, Homo sapiens
gagcuuagauugccuc

SEQ ID NO: 1481072 - RNA, 12 nt, Homo sapiens
gagcuucugggg

SEQ ID NO: 1481073 - RNA, 13 nt, Homo sapiens
gagcuugcaguga

SEQ ID NO: 1481074 - RNA, 20 nt, Homo sapiens
gagcuuguaauaaauacugc

SEQ ID NO: 1481075 - RNA, 21 nt, Homo sapiens
gagcuugugcuccucuugauu

SEQ ID NO: 1481076 - RNA, 18 nt, Homo sapiens
gagcuuuguccugaagga

SEQ ID NO: 1481077 - RNA, 22 nt, Homo sapiens
gagcuuugugcuugucauucca

SEQ ID NO: 1481078 - RNA, 15 nt, Homo sapiens
gagcuuuucuggaau

SEQ ID NO: 1481079 - RNA, 22 nt, Homo sapiens
gaggaaaaggaaaaaaagcaaa

SEQ ID NO: 1481080 - RNA, 17 nt, Homo sapiens
gaggaaauccuaccuuu

SEQ ID NO: 1481081 - RNA, 13 nt, Homo sapiens
gaggaacacugca

SEQ ID NO: 1481082 - RNA, 15 nt, Homo sapiens
gaggaacucucaagu

SEQ ID NO: 1481083 - RNA, 18 nt, Homo sapiens
gaggaacuguccagagag

SEQ ID NO: 1481084 - RNA, 20 nt, Homo sapiens
gaggaacuuuuucucuguua

SEQ ID NO: 1481085 - RNA, 17 nt, Homo sapiens
gaggagauauggaguga

SEQ ID NO: 1481086 - RNA, 20 nt, Homo sapiens
gaggagcaccuccgccagau

SEQ ID NO: 1481087 - RNA, 12 nt, Homo sapiens
gaggagugcagc

SEQ ID NO: 1481088 - RNA, 24 nt, Homo sapiens
gaggauaugauggucacaugggga

SEQ ID NO: 1481089 - RNA, 21 nt, Homo sapiens
gaggauuccgucuucucucau

SEQ ID NO: 1481090 - RNA, 20 nt, Homo sapiens
gaggcaagagaauugcuuga

SEQ ID NO: 1481091 - RNA, 20 nt, Homo sapiens
gaggcacucagugagccucc

SEQ ID NO: 1481092 - RNA, 12 nt, Homo sapiens
gaggcacuucca

SEQ ID NO: 1481093 - RNA, 21 nt, Homo sapiens
gaggcagcauugcacagugaa

SEQ ID NO: 1481094 - RNA, 21 nt, Homo sapiens
gaggcagcuucaagugccuuu

SEQ ID NO: 1481095 - RNA, 13 nt, Homo sapiens
gaggcaucaguug

SEQ ID NO: 1481096 - RNA, 13 nt, Homo sapiens
gaggccacacgca

SEQ ID NO: 1481097 - RNA, 18 nt, Homo sapiens
gaggccagugggcgggcc

SEQ ID NO: 1481098 - RNA, 17 nt, Homo sapiens
gaggcccaggcugggaa

SEQ ID NO: 1481099 - RNA, 18 nt, Homo sapiens
gaggccccacugaugcug

SEQ ID NO: 1481100 - RNA, 14 nt, Homo sapiens
gaggcccucauucc

SEQ ID NO: 1481101 - RNA, 22 nt, Homo sapiens
gaggccgaaggugccucagacu

SEQ ID NO: 1481102 - RNA, 19 nt, Homo sapiens
gaggcggguggaucacuug

SEQ ID NO: 1481103 - RNA, 18 nt, Homo sapiens
gaggcugagacaggagaa

SEQ ID NO: 1481104 - RNA, 16 nt, Homo sapiens
gaggcugaggcaagag

SEQ ID NO: 1481105 - RNA, 22 nt, Homo sapiens
gaggcugaggcagaaggauuac

SEQ ID NO: 1481106 - RNA, 20 nt, Homo sapiens
gaggcugcacccacccagga

SEQ ID NO: 1481107 - RNA, 13 nt, Homo sapiens
gaggcugcaguga

SEQ ID NO: 1481108 - RNA, 22 nt, Homo sapiens
gaggcuucuccuucuccuuccc

SEQ ID NO: 1481109 - RNA, 12 nt, Homo sapiens
gaggcuuugugu

SEQ ID NO: 1481110 - RNA, 21 nt, Homo sapiens
gagggaagaaugaacacuccc

SEQ ID NO: 1481111 - RNA, 19 nt, Homo sapiens
gagggaagguucuucauga

SEQ ID NO: 1481112 - RNA, 17 nt, Homo sapiens
gagggacuuugcugauu

SEQ ID NO: 1481113 - RNA, 15 nt, Homo sapiens
gagggagaagcauga

SEQ ID NO: 1481114 - RNA, 17 nt, Homo sapiens
gagggaggucacuggaa

SEQ ID NO: 1481115 - RNA, 16 nt, Homo sapiens
gagggccccugcgugg

SEQ ID NO: 1481116 - RNA, 15 nt, Homo sapiens
gaggggcaacgaaga

SEQ ID NO: 1481117 - RNA, 19 nt, Homo sapiens
gagggguaagagaggaugu

SEQ ID NO: 1481118 - RNA, 15 nt, Homo sapiens
gagggucuucuuaca

SEQ ID NO: 1481119 - RNA, 16 nt, Homo sapiens
gaggucacauucagga

SEQ ID NO: 1481120 - RNA, 16 nt, Homo sapiens
gaggucaggaagcagg

SEQ ID NO: 1481121 - RNA, 18 nt, Homo sapiens
gaggucaggaguugaaga

SEQ ID NO: 1481122 - RNA, 23 nt, Homo sapiens
gaggucauuaaaauuacauugag

SEQ ID NO: 1481123 - RNA, 16 nt, Homo sapiens
gaggucucuugaggga

SEQ ID NO: 1481124 - RNA, 21 nt, Homo sapiens
gaggucuguacguuaccucuu

SEQ ID NO: 1481125 - RNA, 22 nt, Homo sapiens
gagguggaaguggagcccagug

SEQ ID NO: 1481126 - RNA, 20 nt, Homo sapiens
gagguggaggcugcagugag

SEQ ID NO: 1481127 - RNA, 18 nt, Homo sapiens
gaggugggugugggugga

SEQ ID NO: 1481128 - RNA, 14 nt, Homo sapiens
gagguguacaggua

SEQ ID NO: 1481129 - RNA, 15 nt, Homo sapiens
gagguguacagguac

SEQ ID NO: 1481130 - RNA, 14 nt, Homo sapiens
gagguuaaggcaua

SEQ ID NO: 1481131 - RNA, 13 nt, Homo sapiens
gaguaacaauaca

SEQ ID NO: 1481132 - RNA, 20 nt, Homo sapiens
gaguaccuacugugugccag

SEQ ID NO: 1481133 - RNA, 17 nt, Homo sapiens
gaguagaauugcauuga

SEQ ID NO: 1481134 - RNA, 12 nt, Homo sapiens
gaguauaugcac

SEQ ID NO: 1481135 - RNA, 14 nt, Homo sapiens
gaguauccuaccca

SEQ ID NO: 1481136 - RNA, 20 nt, Homo sapiens
gaguccacugcuccauuuau

SEQ ID NO: 1481137 - RNA, 14 nt, Homo sapiens
gaguccucacuccc

SEQ ID NO: 1481138 - RNA, 18 nt, Homo sapiens
gagucgggagcacagcug

SEQ ID NO: 1481139 - RNA, 15 nt, Homo sapiens
gagucugaacagcug

SEQ ID NO: 1481140 - RNA, 16 nt, Homo sapiens
gagucugcacgggacc

SEQ ID NO: 1481141 - RNA, 15 nt, Homo sapiens
gagucugcaugugca

SEQ ID NO: 1481142 - RNA, 20 nt, Homo sapiens
gagucuugcucuguugccca

SEQ ID NO: 1481143 - RNA, 16 nt, Homo sapiens
gagugaaaccaugacu

SEQ ID NO: 1481144 - RNA, 15 nt, Homo sapiens
gagugauugcagcuu

SEQ ID NO: 1481145 - RNA, 19 nt, Homo sapiens
gagugcaguuuccaauccc

SEQ ID NO: 1481146 - RNA, 16 nt, Homo sapiens
gagugcucaccgccuc

SEQ ID NO: 1481147 - RNA, 18 nt, Homo sapiens
gagugggguggggagcau

SEQ ID NO: 1481148 - RNA, 12 nt, Homo sapiens
gaguguacuuaa

SEQ ID NO: 1481149 - RNA, 16 nt, Homo sapiens
gaguguccucuucccu

SEQ ID NO: 1481150 - RNA, 12 nt, Homo sapiens
gagugugacagg

SEQ ID NO: 1481151 - RNA, 23 nt, Homo sapiens
gagugugggggaggcgcacagug

SEQ ID NO: 1481152 - RNA, 21 nt, Homo sapiens
gaguucacaggaggccagugg

SEQ ID NO: 1481153 - RNA, 13 nt, Homo sapiens
gaguugaucugga

SEQ ID NO: 1481154 - RNA, 17 nt, Homo sapiens
gaguuugcaaugucaca

SEQ ID NO: 1481155 - RNA, 20 nt, Homo sapiens
gaguuugugucuguugcuug

SEQ ID NO: 1481156 - RNA, 16 nt, Homo sapiens
gauaaaaagauggccu

SEQ ID NO: 1481157 - RNA, 15 nt, Homo sapiens
gauaaaaauaaugca

SEQ ID NO: 1481158 - RNA, 16 nt, Homo sapiens
gauaaagaugcaagga

SEQ ID NO: 1481159 - RNA, 12 nt, Homo sapiens
gauaaagcaccc

SEQ ID NO: 1481160 - RNA, 16 nt, Homo sapiens
gauaaaugauagacaa

SEQ ID NO: 1481161 - RNA, 17 nt, Homo sapiens
gauaaaugauagacaau

SEQ ID NO: 1481162 - RNA, 15 nt, Homo sapiens
gauaacugagaauuu

SEQ ID NO: 1481163 - RNA, 20 nt, Homo sapiens
gauaacuuggggaggcaaga

SEQ ID NO: 1481164 - RNA, 12 nt, Homo sapiens
gauaacuuugac

SEQ ID NO: 1481165 - RNA, 15 nt, Homo sapiens
gauaaguguccccua

SEQ ID NO: 1481166 - RNA, 14 nt, Homo sapiens
gauaauaauggguu

SEQ ID NO: 1481167 - RNA, 24 nt, Homo sapiens
gauaauauccagccucccacaaga

SEQ ID NO: 1481168 - RNA, 16 nt, Homo sapiens
gauaaugaaauaauca

SEQ ID NO: 1481169 - RNA, 15 nt, Homo sapiens
gacauguggggccag

SEQ ID NO: 1481170 - RNA, 23 nt, Homo sapiens
gacauuaacaguuuuccaugaaa

SEQ ID NO: 1481171 - RNA, 13 nt, Homo sapiens
gacauuccagggg

SEQ ID NO: 1481172 - RNA, 14 nt, Homo sapiens
gacauuuauucaaa

SEQ ID NO: 1481173 - RNA, 12 nt, Homo sapiens
gaccacuccugu

SEQ ID NO: 1481174 - RNA, 22 nt, Homo sapiens
gaccacugaagcaccacaggga

SEQ ID NO: 1481175 - RNA, 17 nt, Homo sapiens
gaccacuguuaucaaaa

SEQ ID NO: 1481176 - RNA, 15 nt, Homo sapiens
gaccagaagccuugg

SEQ ID NO: 1481177 - RNA, 13 nt, Homo sapiens
gaccagagaucga

SEQ ID NO: 1481178 - RNA, 14 nt, Homo sapiens
gaccagccugggca

SEQ ID NO: 1481179 - RNA, 13 nt, Homo sapiens
gaccaggaccucc

SEQ ID NO: 1481180 - RNA, 20 nt, Homo sapiens
gaccaguugggagcacugga

SEQ ID NO: 1481181 - RNA, 16 nt, Homo sapiens
gaccauaguauaauca

SEQ ID NO: 1481182 - RNA, 18 nt, Homo sapiens
gaccaugguauauuccua

SEQ ID NO: 1481183 - RNA, 11 nt, Homo sapiens
gacccaaaaca

SEQ ID NO: 1481184 - RNA, 16 nt, Homo sapiens
gacccaaaacacagga

SEQ ID NO: 1481185 - RNA, 14 nt, Homo sapiens
gacccacagacugg

SEQ ID NO: 1481186 - RNA, 13 nt, Homo sapiens
gaccccaauccaa

SEQ ID NO: 1481187 - RNA, 11 nt, Homo sapiens
gaccccagugu

SEQ ID NO: 1481188 - RNA, 21 nt, Homo sapiens
gaccccauuccugaucccaug

SEQ ID NO: 1481189 - RNA, 18 nt, Homo sapiens
gaccccgagaagugcucu

SEQ ID NO: 1481190 - RNA, 13 nt, Homo sapiens
gaccccucuaccu

SEQ ID NO: 1481191 - RNA, 18 nt, Homo sapiens
gacccucgcccaacucca

SEQ ID NO: 1481192 - RNA, 20 nt, Homo sapiens
gacccucugaaugguccagg

SEQ ID NO: 1481193 - RNA, 24 nt, Homo sapiens
gacccuuguggguccaugcuaaca

SEQ ID NO: 1481194 - RNA, 13 nt, Homo sapiens
gacccuuugccuu

SEQ ID NO: 1481195 - RNA, 13 nt, Homo sapiens
gaccguccagggg

SEQ ID NO: 1481196 - RNA, 15 nt, Homo sapiens
gaccuaacauucgau

SEQ ID NO: 1481197 - RNA, 19 nt, Homo sapiens
gaccuacuguucggacaaa

SEQ ID NO: 1481198 - RNA, 15 nt, Homo sapiens
gaccuaggauuucau

SEQ ID NO: 1481199 - RNA, 18 nt, Homo sapiens
gaccuauuagaguauuuu

SEQ ID NO: 1481200 - RNA, 23 nt, Homo sapiens
gaccuauuuccagaaauacaauu

SEQ ID NO: 1481201 - RNA, 15 nt, Homo sapiens
gaccucaagccauca

SEQ ID NO: 1481202 - RNA, 22 nt, Homo sapiens
gaccucacugugaccuugacuu

SEQ ID NO: 1481203 - RNA, 23 nt, Homo sapiens
gaccucuuccuccucgcugccag

SEQ ID NO: 1481204 - RNA, 19 nt, Homo sapiens
gaccugacaagcacugcua

SEQ ID NO: 1481205 - RNA, 22 nt, Homo sapiens
gaccuguucuguugacuggggc

SEQ ID NO: 1481206 - RNA, 22 nt, Homo sapiens
gaccuugcugauggugacauug

SEQ ID NO: 1481207 - RNA, 17 nt, Homo sapiens
gaccuugggguacaauu

SEQ ID NO: 1481208 - RNA, 14 nt, Homo sapiens
gacgacaagugcug

SEQ ID NO: 1481209 - RNA, 18 nt, Homo sapiens
gacgcagggguugcagug

SEQ ID NO: 1481210 - RNA, 15 nt, Homo sapiens
gacgcugacugcccu

SEQ ID NO: 1481211 - RNA, 17 nt, Homo sapiens
gacgcuguccugagaug

SEQ ID NO: 1481212 - RNA, 15 nt, Homo sapiens
gacggaugauuggau

SEQ ID NO: 1481213 - RNA, 22 nt, Homo sapiens
gacggcaccaucuggaaggaca

SEQ ID NO: 1481214 - RNA, 21 nt, Homo sapiens
gacggcccucaucuaugagga

SEQ ID NO: 1481215 - RNA, 15 nt, Homo sapiens
gacggggacugggga

SEQ ID NO: 1481216 - RNA, 21 nt, Homo sapiens
gacggguuggggccgggcaca

SEQ ID NO: 1481217 - RNA, 18 nt, Homo sapiens
gacgugcgcgaugccugg

SEQ ID NO: 1481218 - RNA, 19 nt, Homo sapiens
gacgugugagggaggacag

SEQ ID NO: 1481219 - RNA, 14 nt, Homo sapiens
gacuaaaugaacua

SEQ ID NO: 1481220 - RNA, 13 nt, Homo sapiens
gacuacuauacaa

SEQ ID NO: 1481221 - RNA, 19 nt, Homo sapiens
gacuacuuggaacuaggcu

SEQ ID NO: 1481222 - RNA, 22 nt, Homo sapiens
gacucaagaagugaagaaugca

SEQ ID NO: 1481223 - RNA, 23 nt, Homo sapiens
gacucacauucgacauaccccac

SEQ ID NO: 1481224 - RNA, 11 nt, Homo sapiens
gacucaucccc

SEQ ID NO: 1481225 - RNA, 21 nt, Homo sapiens
gacucccacaacaacaaaagc

SEQ ID NO: 1481226 - RNA, 13 nt, Homo sapiens
gacuccucaaaag

SEQ ID NO: 1481227 - RNA, 15 nt, Homo sapiens
gacuccucaaaagca

SEQ ID NO: 1481228 - RNA, 16 nt, Homo sapiens
gacuccucuaagccac

SEQ ID NO: 1481229 - RNA, 15 nt, Homo sapiens
gacucuauucucaaa

SEQ ID NO: 1481230 - RNA, 20 nt, Homo sapiens
gacucuggaggccugugccu

SEQ ID NO: 1481231 - RNA, 22 nt, Homo sapiens
gacucugggcugucagcccaug

SEQ ID NO: 1481232 - RNA, 21 nt, Homo sapiens
gacucuggggaggugaacugg

SEQ ID NO: 1481233 - RNA, 17 nt, Homo sapiens
gacucuugcagggguag

SEQ ID NO: 1481234 - RNA, 20 nt, Homo sapiens
gacugaagugaacuaugaag

SEQ ID NO: 1481235 - RNA, 13 nt, Homo sapiens
gacugacauuuag

SEQ ID NO: 1481236 - RNA, 19 nt, Homo sapiens
cugagccccagggugccca

SEQ ID NO: 1481237 - RNA, 18 nt, Homo sapiens
cugagccuacagaugaac

SEQ ID NO: 1481238 - RNA, 23 nt, Homo sapiens
cugagcgggaggcagaguuugcc

SEQ ID NO: 1481239 - RNA, 22 nt, Homo sapiens
cugagcuagaauuauucucuua

SEQ ID NO: 1481240 - RNA, 14 nt, Homo sapiens
cugaggacaaagug

SEQ ID NO: 1481241 - RNA, 18 nt, Homo sapiens
cugaggcagaaggauuac

SEQ ID NO: 1481242 - RNA, 20 nt, Homo sapiens
cugaggccacacucagcaca

SEQ ID NO: 1481243 - RNA, 23 nt, Homo sapiens
cugaggccuggggaugugaacaa

SEQ ID NO: 1481244 - RNA, 22 nt, Homo sapiens
cugagggcagaaagguucugcc

SEQ ID NO: 1481245 - RNA, 17 nt, Homo sapiens
cugaggguaucugacaa

SEQ ID NO: 1481246 - RNA, 17 nt, Homo sapiens
cugaggguggcacucaa

SEQ ID NO: 1481247 - RNA, 20 nt, Homo sapiens
cugaggucaauggugcaaag

SEQ ID NO: 1481248 - RNA, 16 nt, Homo sapiens
cugaggucucuugagg

SEQ ID NO: 1481249 - RNA, 14 nt, Homo sapiens
cugagguuaugaac

SEQ ID NO: 1481250 - RNA, 13 nt, Homo sapiens
cugaguccagagc

SEQ ID NO: 1481251 - RNA, 18 nt, Homo sapiens
cugagucugcaugugcac

SEQ ID NO: 1481252 - RNA, 16 nt, Homo sapiens
cugagugagccacaga

SEQ ID NO: 1481253 - RNA, 19 nt, Homo sapiens
cugagugagccacagacca

SEQ ID NO: 1481254 - RNA, 15 nt, Homo sapiens
cugagugcaccacuu

SEQ ID NO: 1481255 - RNA, 22 nt, Homo sapiens
cugagugcaccacuucaaguga

SEQ ID NO: 1481256 - RNA, 14 nt, Homo sapiens
cugaguggaucucc

SEQ ID NO: 1481257 - RNA, 13 nt, Homo sapiens
cugaguguggacu

SEQ ID NO: 1481258 - RNA, 18 nt, Homo sapiens
cugaguuaugauguaauc

SEQ ID NO: 1481259 - RNA, 15 nt, Homo sapiens
cugauaccacugcac

SEQ ID NO: 1481260 - RNA, 16 nt, Homo sapiens
cugauaccacugcacu

SEQ ID NO: 1481261 - RNA, 15 nt, Homo sapiens
cugauacccagagca

SEQ ID NO: 1481262 - RNA, 15 nt, Homo sapiens
cugauauuaaucaaa

SEQ ID NO: 1481263 - RNA, 21 nt, Homo sapiens
cccagaccuguuagcagacag

SEQ ID NO: 1481264 - RNA, 18 nt, Homo sapiens
cccagagacauacuugaa

SEQ ID NO: 1481265 - RNA, 20 nt, Homo sapiens
cccagagcaggaagcauuca

SEQ ID NO: 1481266 - RNA, 18 nt, Homo sapiens
cccagagggucaggguug

SEQ ID NO: 1481267 - RNA, 19 nt, Homo sapiens
cccagagguaacagaacag

SEQ ID NO: 1481268 - RNA, 23 nt, Homo sapiens
cccagagguaacagaacagcuuc

SEQ ID NO: 1481269 - RNA, 22 nt, Homo sapiens
cccagagugcugggauuacaau

SEQ ID NO: 1481270 - RNA, 21 nt, Homo sapiens
cccagauagguggugccagug

SEQ ID NO: 1481271 - RNA, 15 nt, Homo sapiens
cccagaucugguccc

SEQ ID NO: 1481272 - RNA, 13 nt, Homo sapiens
cccagaugcucuc

SEQ ID NO: 1481273 - RNA, 13 nt, Homo sapiens
cccagauuucagg

SEQ ID NO: 1481274 - RNA, 12 nt, Homo sapiens
cccagcaaagag

SEQ ID NO: 1481275 - RNA, 16 nt, Homo sapiens
cccagcaacacaagcu

SEQ ID NO: 1481276 - RNA, 14 nt, Homo sapiens
cccagcacacggcu

SEQ ID NO: 1481277 - RNA, 11 nt, Homo sapiens
cccagcacugu

SEQ ID NO: 1481278 - RNA, 13 nt, Homo sapiens
cccagcacuguga

SEQ ID NO: 1481279 - RNA, 18 nt, Homo sapiens
cccagcacuuuagaucac

SEQ ID NO: 1481280 - RNA, 24 nt, Homo sapiens
cccagccacaguggccaaagaggc

SEQ ID NO: 1481281 - RNA, 16 nt, Homo sapiens
cccagcccacccugcu

SEQ ID NO: 1481282 - RNA, 18 nt, Homo sapiens
cccagccgaaaagcuuuu

SEQ ID NO: 1481283 - RNA, 19 nt, Homo sapiens
cccagccuccccgugccaa

SEQ ID NO: 1481284 - RNA, 14 nt, Homo sapiens
cccagcuaccccuu

SEQ ID NO: 1481285 - RNA, 17 nt, Homo sapiens
cccaggaccaagccaca

SEQ ID NO: 1481286 - RNA, 13 nt, Homo sapiens
cccaggaccagcu

SEQ ID NO: 1481287 - RNA, 18 nt, Homo sapiens
cccaggacccugaagggg

SEQ ID NO: 1481288 - RNA, 23 nt, Homo sapiens
cccaggacccugaaggggccaug

SEQ ID NO: 1481289 - RNA, 15 nt, Homo sapiens
cccaggaccuggcug

SEQ ID NO: 1481290 - RNA, 14 nt, Homo sapiens
cccaggagacagac

SEQ ID NO: 1481291 - RNA, 16 nt, Homo sapiens
cccaggaguguggcca

SEQ ID NO: 1481292 - RNA, 17 nt, Homo sapiens
cccaggcaaacuugcac

SEQ ID NO: 1481293 - RNA, 21 nt, Homo sapiens
cccaggcccugcucuuccuca

SEQ ID NO: 1481294 - RNA, 19 nt, Homo sapiens
cccaggcuggagugcagug

SEQ ID NO: 1481295 - RNA, 16 nt, Homo sapiens
cccaggcugugcagcg

SEQ ID NO: 1481296 - RNA, 22 nt, Homo sapiens
cccaggcuucacccugaauggu

SEQ ID NO: 1481297 - RNA, 15 nt, Homo sapiens
cccagggugugaaca

SEQ ID NO: 1481298 - RNA, 14 nt, Homo sapiens
cccagguaccagcu

SEQ ID NO: 1481299 - RNA, 13 nt, Homo sapiens
cccaguauucuca

SEQ ID NO: 1481300 - RNA, 20 nt, Homo sapiens
cccagugcccccacugacca

SEQ ID NO: 1481301 - RNA, 18 nt, Homo sapiens
cccaguggacucuuccac

SEQ ID NO: 1481302 - RNA, 13 nt, Homo sapiens
cccaguguaauaa

SEQ ID NO: 1481303 - RNA, 19 nt, Homo sapiens
cccaguguaugucuuguau

SEQ ID NO: 1481304 - RNA, 12 nt, Homo sapiens
cccauacugguu

SEQ ID NO: 1481305 - RNA, 14 nt, Homo sapiens
cccauaucugugaa

SEQ ID NO: 1481306 - RNA, 15 nt, Homo sapiens
cccauaucugugaaa

SEQ ID NO: 1481307 - RNA, 17 nt, Homo sapiens
cccauaucugugaaaug

SEQ ID NO: 1481308 - RNA, 21 nt, Homo sapiens
cccauccaggucuugacucau

SEQ ID NO: 1481309 - RNA, 21 nt, Homo sapiens
cccaucggguaagaugcuccu

SEQ ID NO: 1481310 - RNA, 12 nt, Homo sapiens
cccaugagauuc

SEQ ID NO: 1481311 - RNA, 16 nt, Homo sapiens
cccaugcaggcccuuu

SEQ ID NO: 1481312 - RNA, 19 nt, Homo sapiens
cccaugcaggcccuuugaa

SEQ ID NO: 1481313 - RNA, 18 nt, Homo sapiens
cccaugcucaaccacugu

SEQ ID NO: 1481314 - RNA, 20 nt, Homo sapiens
cccaugcucaaccacugugg

SEQ ID NO: 1481315 - RNA, 15 nt, Homo sapiens
cccauggacacucca

SEQ ID NO: 1481316 - RNA, 18 nt, Homo sapiens
cccauguccucagcauuu

SEQ ID NO: 1481317 - RNA, 18 nt, Homo sapiens
cccauuccaaagcuuuau

SEQ ID NO: 1481318 - RNA, 18 nt, Homo sapiens
cccauuccucccuccggc

SEQ ID NO: 1481319 - RNA, 15 nt, Homo sapiens
cccauuucuauuuau

SEQ ID NO: 1481320 - RNA, 17 nt, Homo sapiens
ccccaaaaugugaugcu

SEQ ID NO: 1481321 - RNA, 15 nt, Homo sapiens
ccccaaccaggcuaa

SEQ ID NO: 1481322 - RNA, 13 nt, Homo sapiens
ccccacaacuuua

SEQ ID NO: 1481323 - RNA, 14 nt, Homo sapiens
ccccacaacuuuaa

SEQ ID NO: 1481324 - RNA, 22 nt, Homo sapiens
ccccacacagcuacagcuuucu

SEQ ID NO: 1481325 - RNA, 23 nt, Homo sapiens
ccccacagaaccuucaacccagu

SEQ ID NO: 1481326 - RNA, 12 nt, Homo sapiens
ccccaccacaaa

SEQ ID NO: 1481327 - RNA, 20 nt, Homo sapiens
ccccacccaguuucuggaaa

SEQ ID NO: 1481328 - RNA, 20 nt, Homo sapiens
ccccaccuugccaagcuuuc

SEQ ID NO: 1481329 - RNA, 23 nt, Homo sapiens
ccccacgagggucaggacuguga

SEQ ID NO: 1481330 - RNA, 22 nt, Homo sapiens
ccccacguugccucuacuuuau

SEQ ID NO: 1481331 - RNA, 23 nt, Homo sapiens
ccccacguugccucuacuuuauc

SEQ ID NO: 1481332 - RNA, 12 nt, Homo sapiens
ccccacugacca

SEQ ID NO: 1481333 - RNA, 19 nt, Homo sapiens
ccccagcccagagacauac

SEQ ID NO: 1481334 - RNA, 12 nt, Homo sapiens
ccccagcucaau

SEQ ID NO: 1481335 - RNA, 22 nt, Homo sapiens
ccccaggcccagugggguggcc

SEQ ID NO: 1481336 - RNA, 13 nt, Homo sapiens
ccccagggcccug

SEQ ID NO: 1481337 - RNA, 21 nt, Homo sapiens
ccccagugguauccugugaca

SEQ ID NO: 1481338 - RNA, 13 nt, Homo sapiens
ccccaucccaguu

SEQ ID NO: 1481339 - RNA, 15 nt, Homo sapiens
ccccaugccugucca

SEQ ID NO: 1481340 - RNA, 12 nt, Homo sapiens
cccccaccacaa

SEQ ID NO: 1481341 - RNA, 12 nt, Homo sapiens
cccccuugaggg

SEQ ID NO: 1481342 - RNA, 22 nt, Homo sapiens
ccccgcgcucgcccagcaggag

SEQ ID NO: 1481343 - RNA, 17 nt, Homo sapiens
ccccggggugcccacag

SEQ ID NO: 1481344 - RNA, 21 nt, Homo sapiens
ccccgucgaggggcucucagc

SEQ ID NO: 1481345 - RNA, 15 nt, Homo sapiens
ccccgugacugcaau

SEQ ID NO: 1481346 - RNA, 21 nt, Homo sapiens
ccccguuccugacaucacagc

SEQ ID NO: 1481347 - RNA, 23 nt, Homo sapiens
ccccuacacacacccaggcccau

SEQ ID NO: 1481348 - RNA, 20 nt, Homo sapiens
cuagaugugcaaaugcaagc

SEQ ID NO: 1481349 - RNA, 16 nt, Homo sapiens
cuagcaccaggacuca

SEQ ID NO: 1481350 - RNA, 21 nt, Homo sapiens
cuagcacuuugggagacugaa

SEQ ID NO: 1481351 - RNA, 13 nt, Homo sapiens
cuagcagcaccgu

SEQ ID NO: 1481352 - RNA, 18 nt, Homo sapiens
cuagcaggccuaagacau

SEQ ID NO: 1481353 - RNA, 23 nt, Homo sapiens
cuagcaggccuaagacaugugag

SEQ ID NO: 1481354 - RNA, 13 nt, Homo sapiens
cuagccaauucac

SEQ ID NO: 1481355 - RNA, 20 nt, Homo sapiens
cuagccaggaaguacuucca

SEQ ID NO: 1481356 - RNA, 19 nt, Homo sapiens
cuagcugggacuacaggug

SEQ ID NO: 1481357 - RNA, 14 nt, Homo sapiens
cuagcugugggggu

SEQ ID NO: 1481358 - RNA, 19 nt, Homo sapiens
cuaggaaacucacacuccc

SEQ ID NO: 1481359 - RNA, 16 nt, Homo sapiens
cuaggaaauccauuca

SEQ ID NO: 1481360 - RNA, 18 nt, Homo sapiens
cuaggccucaauuguucc

SEQ ID NO: 1481361 - RNA, 20 nt, Homo sapiens
cuaggcucagagaugugcac

SEQ ID NO: 1481362 - RNA, 19 nt, Homo sapiens
cuaggggaacagaccagug

SEQ ID NO: 1481363 - RNA, 19 nt, Homo sapiens
cuaggguccaccaggaguu

SEQ ID NO: 1481364 - RNA, 22 nt, Homo sapiens
cuagggucuugggggucagggg

SEQ ID NO: 1481365 - RNA, 17 nt, Homo sapiens
cuagguaggggcccacu

SEQ ID NO: 1481366 - RNA, 16 nt, Homo sapiens
cuagguagugaccuaa

SEQ ID NO: 1481367 - RNA, 23 nt, Homo sapiens
cuagguucuaaaaauugugauca

SEQ ID NO: 1481368 - RNA, 17 nt, Homo sapiens
cuaguaagaugcacuga

SEQ ID NO: 1481369 - RNA, 20 nt, Homo sapiens
cuaguaucuucaaacuuuca

SEQ ID NO: 1481370 - RNA, 21 nt, Homo sapiens
cuaguuauuuuauaaucaaug

SEQ ID NO: 1481371 - RNA, 17 nt, Homo sapiens
cuaguucccucugcuca

SEQ ID NO: 1481372 - RNA, 16 nt, Homo sapiens
cuauaaagaagaacuu

SEQ ID NO: 1481373 - RNA, 19 nt, Homo sapiens
cuauaaucccagcacuuug

SEQ ID NO: 1481374 - RNA, 22 nt, Homo sapiens
cuauacacuuaaugauacaugu

SEQ ID NO: 1481375 - RNA, 20 nt, Homo sapiens
cuauacauagagcucuauuu

SEQ ID NO: 1481376 - RNA, 12 nt, Homo sapiens
cuauacaucucu

SEQ ID NO: 1481377 - RNA, 20 nt, Homo sapiens
cuauagcuaaguacacaaua

SEQ ID NO: 1481378 - RNA, 18 nt, Homo sapiens
cuauagcugcuauagcaa

SEQ ID NO: 1481379 - RNA, 19 nt, Homo sapiens
cuauauccauguacuguag

SEQ ID NO: 1481380 - RNA, 12 nt, Homo sapiens
cuauauuugcua

SEQ ID NO: 1481381 - RNA, 12 nt, Homo sapiens
cuauauuugcuu

SEQ ID NO: 1481382 - RNA, 20 nt, Homo sapiens
cuaucaacaccacuaggaau

SEQ ID NO: 1481383 - RNA, 12 nt, Homo sapiens
cuaucacuguac

SEQ ID NO: 1481384 - RNA, 20 nt, Homo sapiens
cuaucauggacuacaccagg

SEQ ID NO: 1481385 - RNA, 15 nt, Homo sapiens
cuauccaaucuguga

SEQ ID NO: 1481386 - RNA, 17 nt, Homo sapiens
cuaucccuaggcacuua

SEQ ID NO: 1481387 - RNA, 16 nt, Homo sapiens
cuaucuccuucccacc

SEQ ID NO: 1481388 - RNA, 15 nt, Homo sapiens
cuaucugcacucuaa

SEQ ID NO: 1481389 - RNA, 21 nt, Homo sapiens
cuaucuuugauauuggcuuaa

SEQ ID NO: 1481390 - RNA, 17 nt, Homo sapiens
cuaugaauuuucaagua

SEQ ID NO: 1481391 - RNA, 14 nt, Homo sapiens
cuaugagccaggca

SEQ ID NO: 1481392 - RNA, 19 nt, Homo sapiens
cuaugcaacagcucucacc

SEQ ID NO: 1481393 - RNA, 14 nt, Homo sapiens
cuaugcaaucugag

SEQ ID NO: 1481394 - RNA, 20 nt, Homo sapiens
cuauggacagcauugccagu

SEQ ID NO: 1481395 - RNA, 21 nt, Homo sapiens
cuauggacagcauugccagua

SEQ ID NO: 1481396 - RNA, 16 nt, Homo sapiens
cuaugggacugcagug

SEQ ID NO: 1481397 - RNA, 13 nt, Homo sapiens
cuauguacuuuaa

SEQ ID NO: 1481398 - RNA, 23 nt, Homo sapiens
cuauguugccuaagcuggucuca

SEQ ID NO: 1481399 - RNA, 14 nt, Homo sapiens
cuauuaccaugaga

SEQ ID NO: 1481400 - RNA, 18 nt, Homo sapiens
cuauuauaaaacuugaau

SEQ ID NO: 1481401 - RNA, 19 nt, Homo sapiens
cuauuauggaaaacugugu

SEQ ID NO: 1481402 - RNA, 16 nt, Homo sapiens
cuauucagacaagcaa

SEQ ID NO: 1481403 - RNA, 18 nt, Homo sapiens
cuauucaggagaguagaa

SEQ ID NO: 1481404 - RNA, 15 nt, Homo sapiens
cuauucaguuuucag

SEQ ID NO: 1481405 - RNA, 14 nt, Homo sapiens
cuauuccaaaaagg

SEQ ID NO: 1481406 - RNA, 19 nt, Homo sapiens
cuauucccuuugacuucag

SEQ ID NO: 1481407 - RNA, 18 nt, Homo sapiens
cuauucucaaaguuuccu

SEQ ID NO: 1481408 - RNA, 21 nt, Homo sapiens
cuauugugggacuuauuacaa

SEQ ID NO: 1481409 - RNA, 22 nt, Homo sapiens
cuauuuaauuauuucacuuuag

SEQ ID NO: 1481410 - RNA, 14 nt, Homo sapiens
cuauuuaucuguag

SEQ ID NO: 1481411 - RNA, 12 nt, Homo sapiens
cuauuuaugcaa

SEQ ID NO: 1481412 - RNA, 11 nt, Homo sapiens
cuauuuccauu

SEQ ID NO: 1481413 - RNA, 15 nt, Homo sapiens
cuauuugccaugggc

SEQ ID NO: 1481414 - RNA, 20 nt, Homo sapiens
cuauuuuugacuguagccac

SEQ ID NO: 1481415 - RNA, 21 nt, Homo sapiens
cuauuuuuguuaagcgugucu

SEQ ID NO: 1481416 - RNA, 17 nt, Homo sapiens
cucaaacuccugaccuc

SEQ ID NO: 1481417 - RNA, 18 nt, Homo sapiens
cucaaacuccugaccuca

SEQ ID NO: 1481418 - RNA, 13 nt, Homo sapiens
cucaaacuugaga

SEQ ID NO: 1481419 - RNA, 15 nt, Homo sapiens
cucaaagaucugaau

SEQ ID NO: 1481420 - RNA, 23 nt, Homo sapiens
cucaaauugucagcaauuuaacu

SEQ ID NO: 1481421 - RNA, 23 nt, Homo sapiens
cucaacagccaagugugacccca

SEQ ID NO: 1481422 - RNA, 14 nt, Homo sapiens
cucaacaugcugcc

SEQ ID NO: 1481423 - RNA, 23 nt, Homo sapiens
cucaacauguuacugaccagcaa

SEQ ID NO: 1481424 - RNA, 20 nt, Homo sapiens
cucaacauugcauggugcua

SEQ ID NO: 1481425 - RNA, 15 nt, Homo sapiens
cuccccacucuaggg

SEQ ID NO: 1481426 - RNA, 23 nt, Homo sapiens
cuccccaguucauugcacuuuga

SEQ ID NO: 1481427 - RNA, 18 nt, Homo sapiens
cuccccaucuguccagcu

SEQ ID NO: 1481428 - RNA, 14 nt, Homo sapiens
cuccccuccagccu

SEQ ID NO: 1481429 - RNA, 18 nt, Homo sapiens
cuccccuccggacuggug

SEQ ID NO: 1481430 - RNA, 19 nt, Homo sapiens
cucccgaguagcugggauu

SEQ ID NO: 1481431 - RNA, 16 nt, Homo sapiens
cucccgaugcugcuau

SEQ ID NO: 1481432 - RNA, 17 nt, Homo sapiens
cucccgccucagggcca

SEQ ID NO: 1481433 - RNA, 17 nt, Homo sapiens
cucccggguucaaguga

SEQ ID NO: 1481434 - RNA, 19 nt, Homo sapiens
cucccucaggcucugugga

SEQ ID NO: 1481435 - RNA, 15 nt, Homo sapiens
cucccuccaccuccu

SEQ ID NO: 1481436 - RNA, 19 nt, Homo sapiens
cucccucccccuggcacug

SEQ ID NO: 1481437 - RNA, 18 nt, Homo sapiens
cucccucugcuacuccau

SEQ ID NO: 1481438 - RNA, 17 nt, Homo sapiens
cucccuguuccccagag

SEQ ID NO: 1481439 - RNA, 17 nt, Homo sapiens
cucccuugcccuagaua

SEQ ID NO: 1481440 - RNA, 17 nt, Homo sapiens
cucccuuggguucugau

SEQ ID NO: 1481441 - RNA, 14 nt, Homo sapiens
cuccgcaacagcca

SEQ ID NO: 1481442 - RNA, 15 nt, Homo sapiens
cuccgcgccuacccu

SEQ ID NO: 1481443 - RNA, 19 nt, Homo sapiens
cuccuacuuacaacccagg

SEQ ID NO: 1481444 - RNA, 19 nt, Homo sapiens
cuccucaccucaugcccac

SEQ ID NO: 1481445 - RNA, 19 nt, Homo sapiens
cuccucagagcgccaggaa

SEQ ID NO: 1481446 - RNA, 18 nt, Homo sapiens
cuccuccaaaggcccccu

SEQ ID NO: 1481447 - RNA, 14 nt, Homo sapiens
cuccucgcugccag

SEQ ID NO: 1481448 - RNA, 22 nt, Homo sapiens
cuccucuggacggcaggcucac

SEQ ID NO: 1481449 - RNA, 16 nt, Homo sapiens
cuccucuucagaggag

SEQ ID NO: 1481450 - RNA, 21 nt, Homo sapiens
cccgccaccucagggcacgca

SEQ ID NO: 1481451 - RNA, 17 nt, Homo sapiens
cccgccaugcucaggag

SEQ ID NO: 1481452 - RNA, 18 nt, Homo sapiens
cccggagagggagucagu

SEQ ID NO: 1481453 - RNA, 23 nt, Homo sapiens
cccggagagggagucagucuuca

SEQ ID NO: 1481454 - RNA, 17 nt, Homo sapiens
cccggccagcgggcaca

SEQ ID NO: 1481455 - RNA, 22 nt, Homo sapiens
cccgucauguuccucaaaagca

SEQ ID NO: 1481456 - RNA, 16 nt, Homo sapiens
cccguguguugcacca

SEQ ID NO: 1481457 - RNA, 10 nt, Homo sapiens
cccuaaggga

SEQ ID NO: 1481458 - RNA, 20 nt, Homo sapiens
cccuaaucuuucacuugaaa

SEQ ID NO: 1481459 - RNA, 13 nt, Homo sapiens
cccuacaaaggcu

SEQ ID NO: 1481460 - RNA, 13 nt, Homo sapiens
cccuacacacaca

SEQ ID NO: 1481461 - RNA, 15 nt, Homo sapiens
cccuacacacaccca

SEQ ID NO: 1481462 - RNA, 12 nt, Homo sapiens
cccuacagaauu

SEQ ID NO: 1481463 - RNA, 14 nt, Homo sapiens
cccuaccugucaac

SEQ ID NO: 1481464 - RNA, 13 nt, Homo sapiens
cccuacugcugug

SEQ ID NO: 1481465 - RNA, 15 nt, Homo sapiens
cccuacugcugugaa

SEQ ID NO: 1481466 - RNA, 20 nt, Homo sapiens
cccuacugggagacugggac

SEQ ID NO: 1481467 - RNA, 17 nt, Homo sapiens
cccucaaaucugaggga

SEQ ID NO: 1481468 - RNA, 22 nt, Homo sapiens
cccucaacagccaagugugacc

SEQ ID NO: 1481469 - RNA, 17 nt, Homo sapiens
cccucacacacacagcu

SEQ ID NO: 1481470 - RNA, 22 nt, Homo sapiens
cccucacagagacccaccuuca

SEQ ID NO: 1481471 - RNA, 17 nt, Homo sapiens
cccucagggaucuugca

SEQ ID NO: 1481472 - RNA, 17 nt, Homo sapiens
cccucauucuacugaaa

SEQ ID NO: 1481473 - RNA, 16 nt, Homo sapiens
cccuccacaccagugg

SEQ ID NO: 1481474 - RNA, 20 nt, Homo sapiens
cccucccuguuccccagaga

SEQ ID NO: 1481475 - RNA, 12 nt, Homo sapiens
cccuccuguaaa

SEQ ID NO: 1481476 - RNA, 13 nt, Homo sapiens
cccucgacacuca

SEQ ID NO: 1481477 - RNA, 17 nt, Homo sapiens
cccucgugcgcaucuca

SEQ ID NO: 1481478 - RNA, 14 nt, Homo sapiens
cccucucucugggc

SEQ ID NO: 1481479 - RNA, 19 nt, Homo sapiens
cccucugcucagccaagcu

SEQ ID NO: 1481480 - RNA, 21 nt, Homo sapiens
cccucugucggcuuuuugcca

SEQ ID NO: 1481481 - RNA, 16 nt, Homo sapiens
cccucuucauggaugg

SEQ ID NO: 1481482 - RNA, 22 nt, Homo sapiens
cccucuuuucugaucugcaguu

SEQ ID NO: 1481483 - RNA, 21 nt, Homo sapiens
cccugacaucuggaaucugga

SEQ ID NO: 1481484 - RNA, 17 nt, Homo sapiens
cccugacuggccaaacc

SEQ ID NO: 1481485 - RNA, 16 nt, Homo sapiens
cccugaguucauccag

SEQ ID NO: 1481486 - RNA, 17 nt, Homo sapiens
cccugcaguuugagaca

SEQ ID NO: 1481487 - RNA, 15 nt, Homo sapiens
cccugcccuggucca

SEQ ID NO: 1481488 - RNA, 21 nt, Homo sapiens
cccugccugccccgacaccca

SEQ ID NO: 1481489 - RNA, 14 nt, Homo sapiens
cccugcuccagucc

SEQ ID NO: 1481490 - RNA, 16 nt, Homo sapiens
cccugcucccauuccu

SEQ ID NO: 1481491 - RNA, 14 nt, Homo sapiens
cccugcuccugcag

SEQ ID NO: 1481492 - RNA, 20 nt, Homo sapiens
cccuggagcccauccagucu

SEQ ID NO: 1481493 - RNA, 14 nt, Homo sapiens
cccuggagugcagu

SEQ ID NO: 1481494 - RNA, 20 nt, Homo sapiens
cccuggcugaccccaaagag

SEQ ID NO: 1481495 - RNA, 16 nt, Homo sapiens
cccuggcugugcucua

SEQ ID NO: 1481496 - RNA, 14 nt, Homo sapiens
cccugggccagggu

SEQ ID NO: 1481497 - RNA, 16 nt, Homo sapiens
cccugggcuggacugg

SEQ ID NO: 1481498 - RNA, 17 nt, Homo sapiens
cccuggggaaggagcca

SEQ ID NO: 1481499 - RNA, 17 nt, Homo sapiens
cccuggggcugugcauu

SEQ ID NO: 1481500 - RNA, 20 nt, Homo sapiens
cccugggggcugugauauua

SEQ ID NO: 1481501 - RNA, 14 nt, Homo sapiens
cccuggugguggau

SEQ ID NO: 1481502 - RNA, 19 nt, Homo sapiens
cccuguaaccugacugguu

SEQ ID NO: 1481503 - RNA, 17 nt, Homo sapiens
cccuguccuaagcacuu

SEQ ID NO: 1481504 - RNA, 22 nt, Homo sapiens
cccuguuuuaauucaacccagc

SEQ ID NO: 1481505 - RNA, 13 nt, Homo sapiens
cccuuaaggacaa

SEQ ID NO: 1481506 - RNA, 14 nt, Homo sapiens
cccuuauacagugg

SEQ ID NO: 1481507 - RNA, 22 nt, Homo sapiens
cccuuauccaggacucugucaa

SEQ ID NO: 1481508 - RNA, 23 nt, Homo sapiens
cccuucaucuuccuguguccuga

SEQ ID NO: 1481509 - RNA, 17 nt, Homo sapiens
cccuuccaugugccuuu

SEQ ID NO: 1481510 - RNA, 19 nt, Homo sapiens
cccuuccugaagaagaucc

SEQ ID NO: 1481511 - RNA, 13 nt, Homo sapiens
cccuucuuugcag

SEQ ID NO: 1481512 - RNA, 20 nt, Homo sapiens
cccuugauuuaaacacacag

SEQ ID NO: 1481513 - RNA, 16 nt, Homo sapiens
cccuuggagccaaugg

SEQ ID NO: 1481514 - RNA, 21 nt, Homo sapiens
cccuugugagagcccauuccc

SEQ ID NO: 1481515 - RNA, 20 nt, Homo sapiens
cccuuuccccagcaucacuc

SEQ ID NO: 1481516 - RNA, 12 nt, Homo sapiens
cccuuuuacuuu

SEQ ID NO: 1481517 - RNA, 14 nt, Homo sapiens
cccuuuuucaauga

SEQ ID NO: 1481518 - RNA, 12 nt, Homo sapiens
ccgaaaugccac

SEQ ID NO: 1481519 - RNA, 12 nt, Homo sapiens
ccgaauccacag

SEQ ID NO: 1481520 - RNA, 16 nt, Homo sapiens
ccgacccacugaccca

SEQ ID NO: 1481521 - RNA, 11 nt, Homo sapiens
ccgacucuggc

SEQ ID NO: 1481522 - RNA, 12 nt, Homo sapiens
ccgagcaaagau

SEQ ID NO: 1481523 - RNA, 15 nt, Homo sapiens
ccgagcaauggcgcc

SEQ ID NO: 1481524 - RNA, 21 nt, Homo sapiens
ccgauacuaguuugcuuugcu

SEQ ID NO: 1481525 - RNA, 12 nt, Homo sapiens
ccgcacaugcac

SEQ ID NO: 1481526 - RNA, 12 nt, Homo sapiens
ccgcacuuccuu

SEQ ID NO: 1481527 - RNA, 17 nt, Homo sapiens
ccgcaggugcugguccc

SEQ ID NO: 1481528 - RNA, 23 nt, Homo sapiens
ccgcauccgggguucaagccauu

SEQ ID NO: 1481529 - RNA, 22 nt, Homo sapiens
ccgcaucguggccuugaccucc

SEQ ID NO: 1481530 - RNA, 18 nt, Homo sapiens
ccgcauuuggauuggaug

SEQ ID NO: 1481531 - RNA, 12 nt, Homo sapiens
ccgccaccucag

SEQ ID NO: 1481532 - RNA, 17 nt, Homo sapiens
ccgcugauaagcauuga

SEQ ID NO: 1481533 - RNA, 15 nt, Homo sapiens
ccggaggcugcagug

SEQ ID NO: 1481534 - RNA, 15 nt, Homo sapiens
cgucagcugcucccu

SEQ ID NO: 1481535 - RNA, 20 nt, Homo sapiens
cguccaccccccacacacac

SEQ ID NO: 1481536 - RNA, 23 nt, Homo sapiens
cgucgaggggcucucagcucagc

SEQ ID NO: 1481537 - RNA, 20 nt, Homo sapiens
cgucucuacuaaaaauacaa

SEQ ID NO: 1481538 - RNA, 18 nt, Homo sapiens
cgucuuucccaaaggcau

SEQ ID NO: 1481539 - RNA, 17 nt, Homo sapiens
cgugaggucccaggaag

SEQ ID NO: 1481540 - RNA, 13 nt, Homo sapiens
cgugauaaugcag

SEQ ID NO: 1481541 - RNA, 20 nt, Homo sapiens
cgugauucaaugaaccacaa

SEQ ID NO: 1481542 - RNA, 23 nt, Homo sapiens
cgugcaguaggggcuacugugac

SEQ ID NO: 1481543 - RNA, 18 nt, Homo sapiens
cgugcccgugugcauguc

SEQ ID NO: 1481544 - RNA, 20 nt, Homo sapiens
cguggaugcgcagugccuug

SEQ ID NO: 1481545 - RNA, 15 nt, Homo sapiens
cgugggccgcacugg

SEQ ID NO: 1481546 - RNA, 20 nt, Homo sapiens
cgugguggcucaugccugua

SEQ ID NO: 1481547 - RNA, 20 nt, Homo sapiens
cgugucucagacugcaugua

SEQ ID NO: 1481548 - RNA, 14 nt, Homo sapiens
cgugugucugucag

SEQ ID NO: 1481549 - RNA, 21 nt, Homo sapiens
cguguguugcaccaggcacug

SEQ ID NO: 1481550 - RNA, 21 nt, Homo sapiens
cguuaaggagaugggccuuuu

SEQ ID NO: 1481551 - RNA, 18 nt, Homo sapiens
cguuaccauuuacauguu

SEQ ID NO: 1481552 - RNA, 13 nt, Homo sapiens
cguuccuauuguc

SEQ ID NO: 1481553 - RNA, 20 nt, Homo sapiens
cguugaagaggaagggcaaa

SEQ ID NO: 1481554 - RNA, 15 nt, Homo sapiens
cguuggcucaguccu

SEQ ID NO: 1481555 - RNA, 21 nt, Homo sapiens
cguuucccagagucaucugau

SEQ ID NO: 1481556 - RNA, 14 nt, Homo sapiens
cuaaaaaacagagg

SEQ ID NO: 1481557 - RNA, 14 nt, Homo sapiens
ccaggcuguucucc

SEQ ID NO: 1481558 - RNA, 16 nt, Homo sapiens
ccagggaguccagggu

SEQ ID NO: 1481559 - RNA, 23 nt, Homo sapiens
ccagggaugggggaugggccagg

SEQ ID NO: 1481560 - RNA, 21 nt, Homo sapiens
ccagggcugccccuaaucucu

SEQ ID NO: 1481561 - RNA, 15 nt, Homo sapiens
ccagggguguagaug

SEQ ID NO: 1481562 - RNA, 14 nt, Homo sapiens
ccagggugugaaca

SEQ ID NO: 1481563 - RNA, 15 nt, Homo sapiens
ccaggugagcucuga

SEQ ID NO: 1481564 - RNA, 22 nt, Homo sapiens
ccagguguucuacacucaucuu

SEQ ID NO: 1481565 - RNA, 22 nt, Homo sapiens
ccaguaaaauacuauugccuca

SEQ ID NO: 1481566 - RNA, 16 nt, Homo sapiens
ccaguacgugcuaaca

SEQ ID NO: 1481567 - RNA, 23 nt, Homo sapiens
ccaguacucugggaagccaaggc

SEQ ID NO: 1481568 - RNA, 23 nt, Homo sapiens
ccagucaugagcguuagacugac

SEQ ID NO: 1481569 - RNA, 14 nt, Homo sapiens
ccaguccaaagccg

SEQ ID NO: 1481570 - RNA, 20 nt, Homo sapiens
ccaguccagauauuucacau

SEQ ID NO: 1481571 - RNA, 12 nt, Homo sapiens
ccaguccaugcu

SEQ ID NO: 1481572 - RNA, 21 nt, Homo sapiens
ccagucccagacaauuccauu

SEQ ID NO: 1481573 - RNA, 15 nt, Homo sapiens
ccagucucaccuuca

SEQ ID NO: 1481574 - RNA, 13 nt, Homo sapiens
ccagucucuggca

SEQ ID NO: 1481575 - RNA, 19 nt, Homo sapiens
ccagucuguugaguuaguu

SEQ ID NO: 1481576 - RNA, 20 nt, Homo sapiens
ccagucuugucauugccagc

SEQ ID NO: 1481577 - RNA, 15 nt, Homo sapiens
ccagugaaaugugaa

SEQ ID NO: 1481578 - RNA, 19 nt, Homo sapiens
ccagugacaaggcccugag

SEQ ID NO: 1481579 - RNA, 13 nt, Homo sapiens
ccagugacacuuc

SEQ ID NO: 1481580 - RNA, 15 nt, Homo sapiens
ccagugagacugugu

SEQ ID NO: 1481581 - RNA, 13 nt, Homo sapiens
ccagugcagccac

SEQ ID NO: 1481582 - RNA, 17 nt, Homo sapiens
ccagugcuuuaauggca

SEQ ID NO: 1481583 - RNA, 22 nt, Homo sapiens
ccaguggauucuuguuuugcuu

SEQ ID NO: 1481584 - RNA, 19 nt, Homo sapiens
ccaguggcagacaaacaga

SEQ ID NO: 1481585 - RNA, 12 nt, Homo sapiens
ccaguguaauaa

SEQ ID NO: 1481586 - RNA, 13 nt, Homo sapiens
ccaguguccucca

SEQ ID NO: 1481587 - RNA, 18 nt, Homo sapiens
ccagugugggcuugacca

SEQ ID NO: 1481588 - RNA, 13 nt, Homo sapiens
ccaguguuuacaa

SEQ ID NO: 1481589 - RNA, 19 nt, Homo sapiens
ccaguucauugcacuuuga

SEQ ID NO: 1481590 - RNA, 23 nt, Homo sapiens
ccaguuucagagaaauacuuuca

SEQ ID NO: 1481591 - RNA, 20 nt, Homo sapiens
ccaguuugcaccugucccca

SEQ ID NO: 1481592 - RNA, 23 nt, Homo sapiens
ccaguuuggguaaaauacuuuua

SEQ ID NO: 1481593 - RNA, 18 nt, Homo sapiens
ccauaaacaguaaugacu

SEQ ID NO: 1481594 - RNA, 13 nt, Homo sapiens
ccauaacagccaa

SEQ ID NO: 1481595 - RNA, 14 nt, Homo sapiens
ccauaauguuacau

SEQ ID NO: 1481596 - RNA, 23 nt, Homo sapiens
ccauaauucuaaguuauuuacuu

SEQ ID NO: 1481597 - RNA, 12 nt, Homo sapiens
ccauaggccauu

SEQ ID NO: 1481598 - RNA, 17 nt, Homo sapiens
ccauauuugauaguaua

SEQ ID NO: 1481599 - RNA, 23 nt, Homo sapiens
ccaucacuagaagaaaagcccau

SEQ ID NO: 1481600 - RNA, 13 nt, Homo sapiens
ccaucaggguucu

SEQ ID NO: 1481601 - RNA, 22 nt, Homo sapiens
ccaucaugcggugggugcugcc

SEQ ID NO: 1481602 - RNA, 23 nt, Homo sapiens
ccaucaugggcuggacauuggac

SEQ ID NO: 1481603 - RNA, 15 nt, Homo sapiens
ccauccaacacugga

SEQ ID NO: 1481604 - RNA, 20 nt, Homo sapiens
ccauccaggucuugacucau

SEQ ID NO: 1481605 - RNA, 13 nt, Homo sapiens
ccauccaguggag

SEQ ID NO: 1481606 - RNA, 15 nt, Homo sapiens
ccauccccaccagcu

SEQ ID NO: 1481607 - RNA, 19 nt, Homo sapiens
ccauccccuggacugggag

SEQ ID NO: 1481608 - RNA, 21 nt, Homo sapiens
ccaucuaaugcuuguuuauga

SEQ ID NO: 1481609 - RNA, 22 nt, Homo sapiens
ccaucucuacugaaaguacaaa

SEQ ID NO: 1481610 - RNA, 14 nt, Homo sapiens
ccaucuuuccaucc

SEQ ID NO: 1481611 - RNA, 15 nt, Homo sapiens
ccaugaagacaggau

SEQ ID NO: 1481612 - RNA, 16 nt, Homo sapiens
ccaugagaaucuuaau

SEQ ID NO: 1481613 - RNA, 11 nt, Homo sapiens
ccaugagacac

SEQ ID NO: 1481614 - RNA, 22 nt, Homo sapiens
ccaugagccugcccgcugcaau

SEQ ID NO: 1481615 - RNA, 19 nt, Homo sapiens
ccaugaggaaggaacagca

SEQ ID NO: 1481616 - RNA, 17 nt, Homo sapiens
ccaugauggcaacagau

SEQ ID NO: 1481617 - RNA, 22 nt, Homo sapiens
ccaugauggcaacagaucugga

SEQ ID NO: 1481618 - RNA, 20 nt, Homo sapiens
ccaugauggccuuacacuga

SEQ ID NO: 1481619 - RNA, 21 nt, Homo sapiens
ccaugccaaggccucccucag

SEQ ID NO: 1481620 - RNA, 20 nt, Homo sapiens
ccaugccacccuguuuucag

SEQ ID NO: 1481621 - RNA, 22 nt, Homo sapiens
ccaugccgacggggacugcuuc

SEQ ID NO: 1481622 - RNA, 22 nt, Homo sapiens
ccauggaaggaagaaaagcugc

SEQ ID NO: 1481623 - RNA, 14 nt, Homo sapiens
ccauggacaggcug

SEQ ID NO: 1481624 - RNA, 22 nt, Homo sapiens
ccauggagacaagggcaucauc

SEQ ID NO: 1481625 - RNA, 13 nt, Homo sapiens
ccauguaucuuuu

SEQ ID NO: 1481626 - RNA, 14 nt, Homo sapiens
ccauguccaaagag

SEQ ID NO: 1481627 - RNA, 20 nt, Homo sapiens
ccaugugccuuucuuugccu

SEQ ID NO: 1481628 - RNA, 15 nt, Homo sapiens
ccauuaucuuaugaa

SEQ ID NO: 1481629 - RNA, 15 nt, Homo sapiens
ccauucagagcuaug

SEQ ID NO: 1481630 - RNA, 21 nt, Homo sapiens
ccauucauacccacacaccca

SEQ ID NO: 1481631 - RNA, 19 nt, Homo sapiens
ccauucauccuuccaucca

SEQ ID NO: 1481632 - RNA, 17 nt, Homo sapiens
ccauugccuagcucuuu

SEQ ID NO: 1481633 - RNA, 19 nt, Homo sapiens
ccauuucucacuaguguca

SEQ ID NO: 1481634 - RNA, 12 nt, Homo sapiens
ccauuugaagca

SEQ ID NO: 1481635 - RNA, 17 nt, Homo sapiens
ccauuugaagcagugau

SEQ ID NO: 1481636 - RNA, 13 nt, Homo sapiens
ccauuuguaauaa

SEQ ID NO: 1481637 - RNA, 19 nt, Homo sapiens
ccauuuuggaaguuuucag

SEQ ID NO: 1481638 - RNA, 14 nt, Homo sapiens
ccauuuugugaaug

SEQ ID NO: 1481639 - RNA, 23 nt, Homo sapiens
cccaaaacgucuuauugugguag

SEQ ID NO: 1481640 - RNA, 13 nt, Homo sapiens
cccaaaaugugau

SEQ ID NO: 1481641 - RNA, 20 nt, Homo sapiens
cccaaauuaagaaucuagga

SEQ ID NO: 1481642 - RNA, 14 nt, Homo sapiens
cccaagcuucccuc

SEQ ID NO: 1481643 - RNA, 20 nt, Homo sapiens
auuuuauuuuuuucuaccuu

SEQ ID NO: 1481644 - RNA, 14 nt, Homo sapiens
auuuucaaguaauu

SEQ ID NO: 1481645 - RNA, 22 nt, Homo sapiens
auuuuccccccacucuccccac

SEQ ID NO: 1481646 - RNA, 20 nt, Homo sapiens
auuuucccccuuuucugcau

SEQ ID NO: 1481647 - RNA, 16 nt, Homo sapiens
auuuuccugaaagugu

SEQ ID NO: 1481648 - RNA, 18 nt, Homo sapiens
auuuucucccuuuaugua

SEQ ID NO: 1481649 - RNA, 22 nt, Homo sapiens
auuuucucuauacauagagcuc

SEQ ID NO: 1481650 - RNA, 16 nt, Homo sapiens
auuuucuuaaaccaac

SEQ ID NO: 1481651 - RNA, 12 nt, Homo sapiens
auuuugacuuaa

SEQ ID NO: 1481652 - RNA, 14 nt, Homo sapiens
auuuugagaucauc

SEQ ID NO: 1481653 - RNA, 20 nt, Homo sapiens
auuuugagaucaucagugau

SEQ ID NO: 1481654 - RNA, 17 nt, Homo sapiens
auuuugaugugacaaua

SEQ ID NO: 1481655 - RNA, 15 nt, Homo sapiens
auuuugcagcaguga

SEQ ID NO: 1481656 - RNA, 18 nt, Homo sapiens
auuuugccauaaagucaa

SEQ ID NO: 1481657 - RNA, 15 nt, Homo sapiens
auuuuggggucucuu

SEQ ID NO: 1481658 - RNA, 19 nt, Homo sapiens
auuuuguaagaaggcaaua

SEQ ID NO: 1481659 - RNA, 15 nt, Homo sapiens
auuuuguaccagugg

SEQ ID NO: 1481660 - RNA, 23 nt, Homo sapiens
auuuugucugcuuaguaucucau

SEQ ID NO: 1481661 - RNA, 21 nt, Homo sapiens
auuuuguugccuucaucuuca

SEQ ID NO: 1481662 - RNA, 19 nt, Homo sapiens
auuuuuaaaauauuacaca

SEQ ID NO: 1481663 - RNA, 16 nt, Homo sapiens
auuuuuaacaccaugg

SEQ ID NO: 1481664 - RNA, 15 nt, Homo sapiens
auuuuuaagaacuuc

SEQ ID NO: 1481665 - RNA, 19 nt, Homo sapiens
auuuuuaccuaaagacguc

SEQ ID NO: 1481666 - RNA, 17 nt, Homo sapiens
auuuuuagacucaucaa

SEQ ID NO: 1481667 - RNA, 15 nt, Homo sapiens
auuuuuaggcaaaga

SEQ ID NO: 1481668 - RNA, 15 nt, Homo sapiens
auuuuuccaguaacu

SEQ ID NO: 1481669 - RNA, 19 nt, Homo sapiens
auuuuuccaguaacuuuuc

SEQ ID NO: 1481670 - RNA, 16 nt, Homo sapiens
auuuuucuaucaaaua

SEQ ID NO: 1481671 - RNA, 14 nt, Homo sapiens
auuuuuucccccac

SEQ ID NO: 1481672 - RNA, 14 nt, Homo sapiens
caaaaaacuacuuc

SEQ ID NO: 1481673 - RNA, 21 nt, Homo sapiens
caaaaacagcagaacuucuga

SEQ ID NO: 1481674 - RNA, 15 nt, Homo sapiens
caaaaacuacacaua

SEQ ID NO: 1481675 - RNA, 22 nt, Homo sapiens
caaaaagggauccguacauuca

SEQ ID NO: 1481676 - RNA, 21 nt, Homo sapiens
caaaaaguuuaucacacagug

SEQ ID NO: 1481677 - RNA, 20 nt, Homo sapiens
caaaaaucuguguaacugua

SEQ ID NO: 1481678 - RNA, 14 nt, Homo sapiens
caaaaaugaacuga

SEQ ID NO: 1481679 - RNA, 21 nt, Homo sapiens
caaaaaugaagcugcucugaa

SEQ ID NO: 1481680 - RNA, 21 nt, Homo sapiens
caaaaauggauauuauuagaa

SEQ ID NO: 1481681 - RNA, 18 nt, Homo sapiens
caaaacagagaugugaua

SEQ ID NO: 1481682 - RNA, 21 nt, Homo sapiens
caaaaccucauuuaaguaaaa

SEQ ID NO: 1481683 - RNA, 17 nt, Homo sapiens
caaaaccugauguuaaa

SEQ ID NO: 1481684 - RNA, 22 nt, Homo sapiens
caaaacucuccuacacuuccau

SEQ ID NO: 1481685 - RNA, 20 nt, Homo sapiens
caaaagaggagcacuuccaa

SEQ ID NO: 1481686 - RNA, 22 nt, Homo sapiens
caaaagaucaaauguauucaga

SEQ ID NO: 1481687 - RNA, 12 nt, Homo sapiens
caaaagauguau

SEQ ID NO: 1481688 - RNA, 14 nt, Homo sapiens
caaaagaugucuga

SEQ ID NO: 1481689 - RNA, 16 nt, Homo sapiens
caaaagccuuguguau

SEQ ID NO: 1481690 - RNA, 18 nt, Homo sapiens
caaaagcuagacagaucc

SEQ ID NO: 1481691 - RNA, 17 nt, Homo sapiens
caaaaggaaaccaagug

SEQ ID NO: 1481692 - RNA, 14 nt, Homo sapiens
caaaaggaccccaa

SEQ ID NO: 1481693 - RNA, 17 nt, Homo sapiens
caaaagggccauguuuc

SEQ ID NO: 1481694 - RNA, 18 nt, Homo sapiens
caaaauagacaauuugca

SEQ ID NO: 1481695 - RNA, 15 nt, Homo sapiens
caaaauauacauuca

SEQ ID NO: 1481696 - RNA, 13 nt, Homo sapiens
caaaaucaauuaa

SEQ ID NO: 1481697 - RNA, 17 nt, Homo sapiens
caaaaugcuucugcaca

SEQ ID NO: 1481698 - RNA, 19 nt, Homo sapiens
caaaaugcuucugcacaca

SEQ ID NO: 1481699 - RNA, 23 nt, Homo sapiens
caaaaugcuucugcacacaaaac

SEQ ID NO: 1481700 - RNA, 13 nt, Homo sapiens
caaaaugcuuuuu

SEQ ID NO: 1481701 - RNA, 15 nt, Homo sapiens
caaaaugucucaguu

SEQ ID NO: 1481702 - RNA, 14 nt, Homo sapiens
caaaaugugaugcu

SEQ ID NO: 1481703 - RNA, 18 nt, Homo sapiens
caaaauucuuaaguaugu

SEQ ID NO: 1481704 - RNA, 13 nt, Homo sapiens
caaacaccuucca

SEQ ID NO: 1481705 - RNA, 16 nt, Homo sapiens
caaacacuuacagaau

SEQ ID NO: 1481706 - RNA, 15 nt, Homo sapiens
caaacaggguuugau

SEQ ID NO: 1481707 - RNA, 16 nt, Homo sapiens
caaaccugaccacaga

SEQ ID NO: 1481708 - RNA, 13 nt, Homo sapiens
caaaccuguagau

SEQ ID NO: 1481709 - RNA, 17 nt, Homo sapiens
caaacucacugcucaag

SEQ ID NO: 1481710 - RNA, 18 nt, Homo sapiens
caaacucacugcucaaga

SEQ ID NO: 1481711 - RNA, 12 nt, Homo sapiens
caaacugcaaua

SEQ ID NO: 1481712 - RNA, 14 nt, Homo sapiens
caaacuuacuauuu

SEQ ID NO: 1481713 - RNA, 15 nt, Homo sapiens
caaacuucaaagagg

SEQ ID NO: 1481714 - RNA, 21 nt, Homo sapiens
caaacuugagaaaauaucuug

SEQ ID NO: 1481715 - RNA, 14 nt, Homo sapiens
caaacuugcuuuau

SEQ ID NO: 1481716 - RNA, 16 nt, Homo sapiens
caaacuuuguuuguca

SEQ ID NO: 1481717 - RNA, 18 nt, Homo sapiens
caaacuuuguuugucaca

SEQ ID NO: 1481718 - RNA, 14 nt, Homo sapiens
caaagaaugggcuu

SEQ ID NO: 1481719 - RNA, 20 nt, Homo sapiens
caaagaauuuuuuuuaacau

SEQ ID NO: 1481720 - RNA, 17 nt, Homo sapiens
caaagaggcugccccuc

SEQ ID NO: 1481721 - RNA, 20 nt, Homo sapiens
caaagaggcugccccucuca

SEQ ID NO: 1481722 - RNA, 18 nt, Homo sapiens
caaagcacgaaauguuau

SEQ ID NO: 1481723 - RNA, 21 nt, Homo sapiens
caaaggaugugauauauaagu

SEQ ID NO: 1481724 - RNA, 23 nt, Homo sapiens
caaaggcccccuacgccaaucaa

SEQ ID NO: 1481725 - RNA, 11 nt, Homo sapiens
caaaguaccuu

SEQ ID NO: 1481726 - RNA, 15 nt, Homo sapiens
caaaguagaagucuu

SEQ ID NO: 1481727 - RNA, 14 nt, Homo sapiens
caaagugcacauga

SEQ ID NO: 1481728 - RNA, 18 nt, Homo sapiens
caaagugcggcugccauu

SEQ ID NO: 1481729 - RNA, 13 nt, Homo sapiens
caaaguggaggag

SEQ ID NO: 1481730 - RNA, 18 nt, Homo sapiens
caaaguguuguguuccug

SEQ ID NO: 1481731 - RNA, 16 nt, Homo sapiens
caaaguuaauucaccu

SEQ ID NO: 1481732 - RNA, 19 nt, Homo sapiens
caaaguucuucauaucauc

SEQ ID NO: 1481733 - RNA, 21 nt, Homo sapiens
caaauacuuagagcagugaag

SEQ ID NO: 1481734 - RNA, 17 nt, Homo sapiens
caaauaguaaucuguaa

SEQ ID NO: 1481735 - RNA, 16 nt, Homo sapiens
caaauauauuuuggaa

SEQ ID NO: 1481736 - RNA, 21 nt, Homo sapiens
caaauauggggaaaaaacugu

SEQ ID NO: 1481737 - RNA, 17 nt, Homo sapiens
caaauauuauucuuaau

SEQ ID NO: 1481738 - RNA, 17 nt, Homo sapiens
caaaucaaaacucacaa

SEQ ID NO: 1481739 - RNA, 21 nt, Homo sapiens
caaaucagcugcuacuacucc

SEQ ID NO: 1481740 - RNA, 13 nt, Homo sapiens
caaaucugaggga

SEQ ID NO: 1481741 - RNA, 20 nt, Homo sapiens
caaaucuggcuccuuuacaa

SEQ ID NO: 1481742 - RNA, 15 nt, Homo sapiens
caaaugacaaaaagc

SEQ ID NO: 1481743 - RNA, 11 nt, Homo sapiens
caaaugagauc

SEQ ID NO: 1481744 - RNA, 16 nt, Homo sapiens
caaaugcuauauugca

SEQ ID NO: 1481745 - RNA, 20 nt, Homo sapiens
auuccgucaccacgacuggc

SEQ ID NO: 1481746 - RNA, 19 nt, Homo sapiens
auuccguugucuguggaug

SEQ ID NO: 1481747 - RNA, 20 nt, Homo sapiens
auuccuacugacaacauuau

SEQ ID NO: 1481748 - RNA, 20 nt, Homo sapiens
auuccuauuggaaacagaga

SEQ ID NO: 1481749 - RNA, 12 nt, Homo sapiens
auuccucagggu

SEQ ID NO: 1481750 - RNA, 16 nt, Homo sapiens
auuccugaucccaugg

SEQ ID NO: 1481751 - RNA, 22 nt, Homo sapiens
auuccugcuggccccuucuggg

SEQ ID NO: 1481752 - RNA, 18 nt, Homo sapiens
auuccugguuugacucag

SEQ ID NO: 1481753 - RNA, 14 nt, Homo sapiens
auuccuuacuguaa

SEQ ID NO: 1481754 - RNA, 18 nt, Homo sapiens
auuccuuucucaucccac

SEQ ID NO: 1481755 - RNA, 16 nt, Homo sapiens
auuccuuugucuucaa

SEQ ID NO: 1481756 - RNA, 16 nt, Homo sapiens
auucgacauaccccac

SEQ ID NO: 1481757 - RNA, 22 nt, Homo sapiens
auucgccaucugauccccaugc

SEQ ID NO: 1481758 - RNA, 22 nt, Homo sapiens
auucgcccuccucccugucaua

SEQ ID NO: 1481759 - RNA, 16 nt, Homo sapiens
auucgggccacagggc

SEQ ID NO: 1481760 - RNA, 17 nt, Homo sapiens
auucgggccacagggcg

SEQ ID NO: 1481761 - RNA, 17 nt, Homo sapiens
auucgugacaacaugcg

SEQ ID NO: 1481762 - RNA, 12 nt, Homo sapiens
auucuaagccag

SEQ ID NO: 1481763 - RNA, 17 nt, Homo sapiens
auucuaaguuauuuacu

SEQ ID NO: 1481764 - RNA, 18 nt, Homo sapiens
auucuaccugaggccagg

SEQ ID NO: 1481765 - RNA, 13 nt, Homo sapiens
auucuaguacuug

SEQ ID NO: 1481766 - RNA, 16 nt, Homo sapiens
auucuaguuuugucaa

SEQ ID NO: 1481767 - RNA, 16 nt, Homo sapiens
auucuaucaagcccag

SEQ ID NO: 1481768 - RNA, 13 nt, Homo sapiens
auucuauugccuu

SEQ ID NO: 1481769 - RNA, 17 nt, Homo sapiens
auucuauuuauauguac

SEQ ID NO: 1481770 - RNA, 17 nt, Homo sapiens
auucucacaucccucua

SEQ ID NO: 1481771 - RNA, 17 nt, Homo sapiens
auucucuuuuaucuguu

SEQ ID NO: 1481772 - RNA, 12 nt, Homo sapiens
auucugacccau

SEQ ID NO: 1481773 - RNA, 16 nt, Homo sapiens
auucugagccauucac

SEQ ID NO: 1481774 - RNA, 23 nt, Homo sapiens
auucugcaguaaaucuuuuacaa

SEQ ID NO: 1481775 - RNA, 17 nt, Homo sapiens
auucugcauugcuagau

SEQ ID NO: 1481776 - RNA, 22 nt, Homo sapiens
auucuggaaaagcaaaacugua

SEQ ID NO: 1481777 - RNA, 23 nt, Homo sapiens
auucuggaggggagagcuuugug

SEQ ID NO: 1481778 - RNA, 18 nt, Homo sapiens
auucugguuuugacauca

SEQ ID NO: 1481779 - RNA, 15 nt, Homo sapiens
auucugucacccaga

SEQ ID NO: 1481780 - RNA, 9 nt, Homo sapiens
auucugucc

SEQ ID NO: 1481781 - RNA, 18 nt, Homo sapiens
auucuuacccuguacaua

SEQ ID NO: 1481782 - RNA, 18 nt, Homo sapiens
auucuucaaccucauuga

SEQ ID NO: 1481783 - RNA, 23 nt, Homo sapiens
auucuucaaccucauugacaaga

SEQ ID NO: 1481784 - RNA, 20 nt, Homo sapiens
auucuucagauacaaacugc

SEQ ID NO: 1481785 - RNA, 19 nt, Homo sapiens
auucuuccagaaugcugaa

SEQ ID NO: 1481786 - RNA, 17 nt, Homo sapiens
auucuuccuaaugucag

SEQ ID NO: 1481787 - RNA, 14 nt, Homo sapiens
auucuucucucuca

SEQ ID NO: 1481788 - RNA, 19 nt, Homo sapiens
auucuuguauauuauggaa

SEQ ID NO: 1481789 - RNA, 17 nt, Homo sapiens
auugaaagcuuuuguua

SEQ ID NO: 1481790 - RNA, 19 nt, Homo sapiens
auugaaauguuugcauaaa

SEQ ID NO: 1481791 - RNA, 15 nt, Homo sapiens
auugaacacaaacug

SEQ ID NO: 1481792 - RNA, 15 nt, Homo sapiens
auugaauuucacugu

SEQ ID NO: 1481793 - RNA, 12 nt, Homo sapiens
auugacacugaa

SEQ ID NO: 1481794 - RNA, 12 nt, Homo sapiens
auugacauuugu

SEQ ID NO: 1481795 - RNA, 22 nt, Homo sapiens
auugaccgcgacuaauuucaaa

SEQ ID NO: 1481796 - RNA, 19 nt, Homo sapiens
auugaccuugaccauuaau

SEQ ID NO: 1481797 - RNA, 19 nt, Homo sapiens
auugacgacaagugcugaa

SEQ ID NO: 1481798 - RNA, 22 nt, Homo sapiens
auugacuuucaguaaacauaaa

SEQ ID NO: 1481799 - RNA, 14 nt, Homo sapiens
auugagacuauuua

SEQ ID NO: 1481800 - RNA, 17 nt, Homo sapiens
auugaggagcugcacug

SEQ ID NO: 1481801 - RNA, 19 nt, Homo sapiens
auugaggagcugcacugau

SEQ ID NO: 1481802 - RNA, 24 nt, Homo sapiens
auugaucauaaacugacuaucaua

SEQ ID NO: 1481803 - RNA, 14 nt, Homo sapiens
auugaugacccucu

SEQ ID NO: 1481804 - RNA, 15 nt, Homo sapiens
auugauuacuaucau

SEQ ID NO: 1481805 - RNA, 15 nt, Homo sapiens
auugcaacagacugu

SEQ ID NO: 1481806 - RNA, 16 nt, Homo sapiens
auugcaagaguuuaau

SEQ ID NO: 1481807 - RNA, 20 nt, Homo sapiens
auugcaauaaccgcuugguu

SEQ ID NO: 1481808 - RNA, 13 nt, Homo sapiens
auugcacaaguuc

SEQ ID NO: 1481809 - RNA, 21 nt, Homo sapiens
auugcaccauacuccuugcuu

SEQ ID NO: 1481810 - RNA, 21 nt, Homo sapiens
auugcacgggagaauauacaa

SEQ ID NO: 1481811 - RNA, 23 nt, Homo sapiens
auugcauuuuuauuaaagcauuu

SEQ ID NO: 1481812 - RNA, 13 nt, Homo sapiens
auugccaaccagu

SEQ ID NO: 1481813 - RNA, 22 nt, Homo sapiens
auugccccuggcuuugccucuu

SEQ ID NO: 1481814 - RNA, 16 nt, Homo sapiens
auugccuagcucuuuu

SEQ ID NO: 1481815 - RNA, 16 nt, Homo sapiens
auugcgugauucaaug

SEQ ID NO: 1481816 - RNA, 15 nt, Homo sapiens
auugcuagauaaaag

SEQ ID NO: 1481817 - RNA, 15 nt, Homo sapiens
auugcuaguuuauuu

SEQ ID NO: 1481818 - RNA, 22 nt, Homo sapiens
auugcucccuaccagcugaaca

SEQ ID NO: 1481819 - RNA, 15 nt, Homo sapiens
auugcuugugccaca

SEQ ID NO: 1481820 - RNA, 13 nt, Homo sapiens
auugcuuugguca

SEQ ID NO: 1481821 - RNA, 16 nt, Homo sapiens
auuggaaucugauaua

SEQ ID NO: 1481822 - RNA, 11 nt, Homo sapiens
auuggcaaagu

SEQ ID NO: 1481823 - RNA, 12 nt, Homo sapiens
auuggcacugug

SEQ ID NO: 1481824 - RNA, 13 nt, Homo sapiens
auuggcacugugg

SEQ ID NO: 1481825 - RNA, 14 nt, Homo sapiens
auuggcacugugga

SEQ ID NO: 1481826 - RNA, 20 nt, Homo sapiens
auuggcugguaacaguucau

SEQ ID NO: 1481827 - RNA, 22 nt, Homo sapiens
auugggcacagccuagggucuu

SEQ ID NO: 1481828 - RNA, 13 nt, Homo sapiens
auugggcaugcca

SEQ ID NO: 1481829 - RNA, 19 nt, Homo sapiens
auuggguacccaguuaaau

SEQ ID NO: 1481830 - RNA, 21 nt, Homo sapiens
auugguccgaucuuugacucu

SEQ ID NO: 1481831 - RNA, 20 nt, Homo sapiens
auugguggcagauuuuacaa

SEQ ID NO: 1481832 - RNA, 23 nt, Homo sapiens
auugguuuuggggaaauguggag

SEQ ID NO: 1481833 - RNA, 20 nt, Homo sapiens
auuguaccaucauuuuauua

SEQ ID NO: 1481834 - RNA, 16 nt, Homo sapiens
auuguaggugcaagau

SEQ ID NO: 1481835 - RNA, 15 nt, Homo sapiens
auuguaguuaaugau

SEQ ID NO: 1481836 - RNA, 21 nt, Homo sapiens
auuguaucaaguggcaugugc

SEQ ID NO: 1481837 - RNA, 15 nt, Homo sapiens
auuguauuacagaug

SEQ ID NO: 1481838 - RNA, 19 nt, Homo sapiens
auugucagcuacuaaugau

SEQ ID NO: 1481839 - RNA, 22 nt, Homo sapiens
auugucuagugaggaagacaag

SEQ ID NO: 1481840 - RNA, 18 nt, Homo sapiens
auugugaucagaccauaa

SEQ ID NO: 1481841 - RNA, 23 nt, Homo sapiens
auugugccgagaaaagcauuuua

SEQ ID NO: 1481842 - RNA, 21 nt, Homo sapiens
auuguggaucuuuucauucuc

SEQ ID NO: 1481843 - RNA, 20 nt, Homo sapiens
auuguuaggagugguucuca

SEQ ID NO: 1481844 - RNA, 18 nt, Homo sapiens
auuguucuccucguccau

SEQ ID NO: 1481845 - RNA, 17 nt, Homo sapiens
auuguugaaauuuugca

SEQ ID NO: 1481846 - RNA, 18 nt, Homo sapiens
auaguuaauuauuucaac

SEQ ID NO: 1481847 - RNA, 13 nt, Homo sapiens
auaguuaugugau

SEQ ID NO: 1481848 - RNA, 23 nt, Homo sapiens
auaguuuucuccuuuuacuucac

SEQ ID NO: 1481849 - RNA, 19 nt, Homo sapiens
auaguuuuucauuguacca

SEQ ID NO: 1481850 - RNA, 20 nt, Homo sapiens
auauaaaaauaaugucauag

SEQ ID NO: 1481851 - RNA, 13 nt, Homo sapiens
auauaaauucugu

SEQ ID NO: 1481852 - RNA, 18 nt, Homo sapiens
auauaacauucaguuccc

SEQ ID NO: 1481853 - RNA, 22 nt, Homo sapiens
auauaaggaaagugauccaaaa

SEQ ID NO: 1481854 - RNA, 13 nt, Homo sapiens
auauaaucaauca

SEQ ID NO: 1481855 - RNA, 16 nt, Homo sapiens
auauaauguugccagc

SEQ ID NO: 1481856 - RNA, 21 nt, Homo sapiens
auauacaccuggaacauugag

SEQ ID NO: 1481857 - RNA, 19 nt, Homo sapiens
auauacagcaggugcucaa

SEQ ID NO: 1481858 - RNA, 10 nt, Homo sapiens
auauacauga

SEQ ID NO: 1481859 - RNA, 23 nt, Homo sapiens
auauaguccagacacuuaacuca

SEQ ID NO: 1481860 - RNA, 16 nt, Homo sapiens
auauauaaguguacau

SEQ ID NO: 1481861 - RNA, 13 nt, Homo sapiens
auauauacaggca

SEQ ID NO: 1481862 - RNA, 12 nt, Homo sapiens
auauaugaccag

SEQ ID NO: 1481863 - RNA, 16 nt, Homo sapiens
auauauuuauaacuca

SEQ ID NO: 1481864 - RNA, 12 nt, Homo sapiens
auauauuuuaga

SEQ ID NO: 1481865 - RNA, 21 nt, Homo sapiens
auauauuuuugguugucaaua

SEQ ID NO: 1481866 - RNA, 15 nt, Homo sapiens
auaucacaguauuau

SEQ ID NO: 1481867 - RNA, 13 nt, Homo sapiens
auaucagaacugu

SEQ ID NO: 1481868 - RNA, 16 nt, Homo sapiens
auaucaguaccucuca

SEQ ID NO: 1481869 - RNA, 13 nt, Homo sapiens
auaucaugaguga

SEQ ID NO: 1481870 - RNA, 19 nt, Homo sapiens
auaucaugcuaaaauucua

SEQ ID NO: 1481871 - RNA, 22 nt, Homo sapiens
auaucauuggaacaacugauac

SEQ ID NO: 1481872 - RNA, 22 nt, Homo sapiens
auaucauuuauuuuuuacauua

SEQ ID NO: 1481873 - RNA, 16 nt, Homo sapiens
auauccaaaccaaaua

SEQ ID NO: 1481874 - RNA, 21 nt, Homo sapiens
auaucccuacauguauugcac

SEQ ID NO: 1481875 - RNA, 18 nt, Homo sapiens
auaucccuuccucucagg

SEQ ID NO: 1481876 - RNA, 15 nt, Homo sapiens
auauccugugacugu

SEQ ID NO: 1481877 - RNA, 18 nt, Homo sapiens
auaucuaauauauaugaa

SEQ ID NO: 1481878 - RNA, 16 nt, Homo sapiens
auaucugaaaauguau

SEQ ID NO: 1481879 - RNA, 17 nt, Homo sapiens
auaucuguggucuucaa

SEQ ID NO: 1481880 - RNA, 23 nt, Homo sapiens
auaucuugcuuucaaauuggcac

SEQ ID NO: 1481881 - RNA, 16 nt, Homo sapiens
auaucuuguaugguuu

SEQ ID NO: 1481882 - RNA, 16 nt, Homo sapiens
auaugaaaacuauaca

SEQ ID NO: 1481883 - RNA, 18 nt, Homo sapiens
auaugaaacuaggguuug

SEQ ID NO: 1481884 - RNA, 13 nt, Homo sapiens
auaugaagacaua

SEQ ID NO: 1481885 - RNA, 16 nt, Homo sapiens
auaugaaucugcucac

SEQ ID NO: 1481886 - RNA, 17 nt, Homo sapiens
auaugaggcuugauaau

SEQ ID NO: 1481887 - RNA, 21 nt, Homo sapiens
auaugaguaauacaucaaaga

SEQ ID NO: 1481888 - RNA, 15 nt, Homo sapiens
auaugaguuacugaa

SEQ ID NO: 1481889 - RNA, 20 nt, Homo sapiens
auaugaugaucuggauccac

SEQ ID NO: 1481890 - RNA, 17 nt, Homo sapiens
auaugauuguuucucaa

SEQ ID NO: 1481891 - RNA, 21 nt, Homo sapiens
auaugcacaauagcaguugaa

SEQ ID NO: 1481892 - RNA, 14 nt, Homo sapiens
auaugcagugauau

SEQ ID NO: 1481893 - RNA, 18 nt, Homo sapiens
auauggggaaaaaacugu

SEQ ID NO: 1481894 - RNA, 16 nt, Homo sapiens
auauguguucauuaaa

SEQ ID NO: 1481895 - RNA, 15 nt, Homo sapiens
auauguucccuccag

SEQ ID NO: 1481896 - RNA, 19 nt, Homo sapiens
auauguuuauauacugggu

SEQ ID NO: 1481897 - RNA, 16 nt, Homo sapiens
auauguuuccaucacu

SEQ ID NO: 1481898 - RNA, 17 nt, Homo sapiens
auauuaaaauauggcua

SEQ ID NO: 1481899 - RNA, 21 nt, Homo sapiens
auauuaacaacaauaacacug

SEQ ID NO: 1481900 - RNA, 13 nt, Homo sapiens
auauuaaucaaaa

SEQ ID NO: 1481901 - RNA, 22 nt, Homo sapiens
auauuaauuuuccaaugcacag

SEQ ID NO: 1481902 - RNA, 22 nt, Homo sapiens
auauucaggcuacucauucagu

SEQ ID NO: 1481903 - RNA, 17 nt, Homo sapiens
auauucauuuccacucu

SEQ ID NO: 1481904 - RNA, 18 nt, Homo sapiens
auauucugguuacugugg

SEQ ID NO: 1481905 - RNA, 20 nt, Homo sapiens
auauucuguaugaacuuuau

SEQ ID NO: 1481906 - RNA, 16 nt, Homo sapiens
auauugagggagacag

SEQ ID NO: 1481907 - RNA, 16 nt, Homo sapiens
auauuguaaagcccau

SEQ ID NO: 1481908 - RNA, 13 nt, Homo sapiens
auauugugcaaac

SEQ ID NO: 1481909 - RNA, 12 nt, Homo sapiens
auauuguugccg

SEQ ID NO: 1481910 - RNA, 16 nt, Homo sapiens
auauuguuuucagugu

SEQ ID NO: 1481911 - RNA, 17 nt, Homo sapiens
auauuuaagcaacaucu

SEQ ID NO: 1481912 - RNA, 16 nt, Homo sapiens
auauuuauaacucauc

SEQ ID NO: 1481913 - RNA, 15 nt, Homo sapiens
auauuuauagcaauc

SEQ ID NO: 1481914 - RNA, 22 nt, Homo sapiens
auauuucagauaucagaaucau

SEQ ID NO: 1481915 - RNA, 14 nt, Homo sapiens
auauuucaggcaua

SEQ ID NO: 1481916 - RNA, 18 nt, Homo sapiens
auauuucaggcauacuga

SEQ ID NO: 1481917 - RNA, 13 nt, Homo sapiens
auauuugaaugaa

SEQ ID NO: 1481918 - RNA, 15 nt, Homo sapiens
auauuugacuugcau

SEQ ID NO: 1481919 - RNA, 23 nt, Homo sapiens
auauuuuaagaauuucacaagcu

SEQ ID NO: 1481920 - RNA, 14 nt, Homo sapiens
auauuuuugccaua

SEQ ID NO: 1481921 - RNA, 19 nt, Homo sapiens
auauuuuugccauaaugac

SEQ ID NO: 1481922 - RNA, 19 nt, Homo sapiens
auauuuuuuaaaaaacacu

SEQ ID NO: 1481923 - RNA, 13 nt, Homo sapiens
aucaaaaggccca

SEQ ID NO: 1481924 - RNA, 21 nt, Homo sapiens
aucaaaauaaaaagugacaca

SEQ ID NO: 1481925 - RNA, 17 nt, Homo sapiens
aucaaagaacaaacauc

SEQ ID NO: 1481926 - RNA, 24 nt, Homo sapiens
aucaacuuuagcuaguaucuucaa

SEQ ID NO: 1481927 - RNA, 18 nt, Homo sapiens
aucaagaaaaacaucuuu

SEQ ID NO: 1481928 - RNA, 13 nt, Homo sapiens
aucaagagcugcc

SEQ ID NO: 1481929 - RNA, 14 nt, Homo sapiens
aucaagagggauaa

SEQ ID NO: 1481930 - RNA, 13 nt, Homo sapiens
aucaagguucagc

SEQ ID NO: 1481931 - RNA, 14 nt, Homo sapiens
aucaaguccuacaa

SEQ ID NO: 1481932 - RNA, 21 nt, Homo sapiens
aucaagugugcuuuagcuuga

SEQ ID NO: 1481933 - RNA, 22 nt, Homo sapiens
aucaauauuuuuauaucaugca

SEQ ID NO: 1481934 - RNA, 24 nt, Homo sapiens
aucaauauuuuuauaucaugcaaa

SEQ ID NO: 1481935 - RNA, 17 nt, Homo sapiens
aucacaguguuugcaau

SEQ ID NO: 1481936 - RNA, 23 nt, Homo sapiens
aucacaugaauauaaaugggaaa

SEQ ID NO: 1481937 - RNA, 14 nt, Homo sapiens
aucacccucugggu

SEQ ID NO: 1481938 - RNA, 16 nt, Homo sapiens
aucaccuggcugagca

SEQ ID NO: 1481939 - RNA, 18 nt, Homo sapiens
aucacgagaucaagagau

SEQ ID NO: 1481940 - RNA, 18 nt, Homo sapiens
aucacgaggucaggagau

SEQ ID NO: 1481941 - RNA, 23 nt, Homo sapiens
aucacgucacugcacuccagcuu

SEQ ID NO: 1481942 - RNA, 19 nt, Homo sapiens
aucacuagguaacuuauua

SEQ ID NO: 1481943 - RNA, 22 nt, Homo sapiens
aucacucuaauuaauuguaauc

SEQ ID NO: 1481944 - RNA, 19 nt, Homo sapiens
aucacugaacuacuaaagu

SEQ ID NO: 1481945 - RNA, 15 nt, Homo sapiens
aucacuucauucaca

SEQ ID NO: 1481946 - RNA, 21 nt, Homo sapiens
aguuacacagaaaugcugcug

SEQ ID NO: 1481947 - RNA, 12 nt, Homo sapiens
aguuacuaccug

SEQ ID NO: 1481948 - RNA, 15 nt, Homo sapiens
aguuagguagcuuua

SEQ ID NO: 1481949 - RNA, 23 nt, Homo sapiens
aguuauaaaguccuuggacuguu

SEQ ID NO: 1481950 - RNA, 21 nt, Homo sapiens
auaacuuaaaaaaaugacaga

SEQ ID NO: 1481951 - RNA, 19 nt, Homo sapiens
auaacuuggggaggcaaga

SEQ ID NO: 1481952 - RNA, 18 nt, Homo sapiens
auaagaaagaucaaagac

SEQ ID NO: 1481953 - RNA, 13 nt, Homo sapiens
auaagacauaacg

SEQ ID NO: 1481954 - RNA, 19 nt, Homo sapiens
auaagagcuggaugcacau

SEQ ID NO: 1481955 - RNA, 18 nt, Homo sapiens
auaagcaacuucacagaa

SEQ ID NO: 1481956 - RNA, 16 nt, Homo sapiens
auaagcaauaccagca

SEQ ID NO: 1481957 - RNA, 12 nt, Homo sapiens
auaagcagagag

SEQ ID NO: 1481958 - RNA, 19 nt, Homo sapiens
auaagcucaugagaugaca

SEQ ID NO: 1481959 - RNA, 22 nt, Homo sapiens
auaagcucuccccaaacuugcu

SEQ ID NO: 1481960 - RNA, 16 nt, Homo sapiens
auaaguuaacuuccaa

SEQ ID NO: 1481961 - RNA, 14 nt, Homo sapiens
auaauaaaaggaaa

SEQ ID NO: 1481962 - RNA, 16 nt, Homo sapiens
auaauaaacaguggaa

SEQ ID NO: 1481963 - RNA, 15 nt, Homo sapiens
auaauaauugaucaa

SEQ ID NO: 1481964 - RNA, 12 nt, Homo sapiens
auaauagucaau

SEQ ID NO: 1481965 - RNA, 21 nt, Homo sapiens
auaauaucaugugcacuucaa

SEQ ID NO: 1481966 - RNA, 15 nt, Homo sapiens
auaauccuuucugcc

SEQ ID NO: 1481967 - RNA, 20 nt, Homo sapiens
auaaucuuuggguaacuuca

SEQ ID NO: 1481968 - RNA, 22 nt, Homo sapiens
auaaugaauacauuuccaaaau

SEQ ID NO: 1481969 - RNA, 15 nt, Homo sapiens
auaaugacucagaau

SEQ ID NO: 1481970 - RNA, 16 nt, Homo sapiens
auaauguuacauuauu

SEQ ID NO: 1481971 - RNA, 17 nt, Homo sapiens
auaauguuacauuauua

SEQ ID NO: 1481972 - RNA, 17 nt, Homo sapiens
auaauuaaaauuuaucu

SEQ ID NO: 1481973 - RNA, 21 nt, Homo sapiens
auaauuaaauuuugaguucua

SEQ ID NO: 1481974 - RNA, 15 nt, Homo sapiens
auaauucagcacuua

SEQ ID NO: 1481975 - RNA, 20 nt, Homo sapiens
auaauucuggagauacuggu

SEQ ID NO: 1481976 - RNA, 18 nt, Homo sapiens
auaauuguaccaaccuca

SEQ ID NO: 1481977 - RNA, 17 nt, Homo sapiens
auacaaaaaaaauuuag

SEQ ID NO: 1481978 - RNA, 13 nt, Homo sapiens
auacaagacuguu

SEQ ID NO: 1481979 - RNA, 13 nt, Homo sapiens
auacaauuccaaa

SEQ ID NO: 1481980 - RNA, 19 nt, Homo sapiens
auacaauuccaaacacaua

SEQ ID NO: 1481981 - RNA, 15 nt, Homo sapiens
auacacagugcugac

SEQ ID NO: 1481982 - RNA, 23 nt, Homo sapiens
auacacauauauacccacaugua

SEQ ID NO: 1481983 - RNA, 19 nt, Homo sapiens
auacaccaccucacuccug

SEQ ID NO: 1481984 - RNA, 15 nt, Homo sapiens
auacacuuaaugaua

SEQ ID NO: 1481985 - RNA, 21 nt, Homo sapiens
auacacuuaaugauacauguu

SEQ ID NO: 1481986 - RNA, 15 nt, Homo sapiens
auacacuuacacuuu

SEQ ID NO: 1481987 - RNA, 23 nt, Homo sapiens
auacagaaguccccucuacuuua

SEQ ID NO: 1481988 - RNA, 19 nt, Homo sapiens
auacagcuguauugucuga

SEQ ID NO: 1481989 - RNA, 15 nt, Homo sapiens
auacaggaaagcaau

SEQ ID NO: 1481990 - RNA, 17 nt, Homo sapiens
auacauaaguuuaggau

SEQ ID NO: 1481991 - RNA, 15 nt, Homo sapiens
auacauaauacauga

SEQ ID NO: 1481992 - RNA, 13 nt, Homo sapiens
auacauacaugua

SEQ ID NO: 1481993 - RNA, 17 nt, Homo sapiens
auacauaucuuuauuaa

SEQ ID NO: 1481994 - RNA, 17 nt, Homo sapiens
auacauauuaucucauu

SEQ ID NO: 1481995 - RNA, 12 nt, Homo sapiens
auacaucaaaga

SEQ ID NO: 1481996 - RNA, 14 nt, Homo sapiens
auacauguaauucu

SEQ ID NO: 1481997 - RNA, 15 nt, Homo sapiens
auacauuuccaaaau

SEQ ID NO: 1481998 - RNA, 13 nt, Homo sapiens
auaccaagcuugu

SEQ ID NO: 1481999 - RNA, 12 nt, Homo sapiens
auaccagcaaua

SEQ ID NO: 1482000 - RNA, 15 nt, Homo sapiens
auaccauuuccucag

SEQ ID NO: 1482001 - RNA, 21 nt, Homo sapiens
auacccuccuuccaccaaguu

SEQ ID NO: 1482002 - RNA, 20 nt, Homo sapiens
auaccucaaacuaucuggcc

SEQ ID NO: 1482003 - RNA, 14 nt, Homo sapiens
auaccugcacuguc

SEQ ID NO: 1482004 - RNA, 18 nt, Homo sapiens
auaccuggcuuuuacuuu

SEQ ID NO: 1482005 - RNA, 15 nt, Homo sapiens
auaccuuuuuguguc

SEQ ID NO: 1482006 - RNA, 16 nt, Homo sapiens
auacuauccaguuacu

SEQ ID NO: 1482007 - RNA, 22 nt, Homo sapiens
auacuauuuaaagccuccucau

SEQ ID NO: 1482008 - RNA, 21 nt, Homo sapiens
auacuauuuaauuauuucacu

SEQ ID NO: 1482009 - RNA, 13 nt, Homo sapiens
auacucagguuaa

SEQ ID NO: 1482010 - RNA, 12 nt, Homo sapiens
auacuccuugcu

SEQ ID NO: 1482011 - RNA, 18 nt, Homo sapiens
auacugaaggaaaaacac

SEQ ID NO: 1482012 - RNA, 17 nt, Homo sapiens
auacugggaaucaagac

SEQ ID NO: 1482013 - RNA, 22 nt, Homo sapiens
auacuggguucuuaguugacaa

SEQ ID NO: 1482014 - RNA, 21 nt, Homo sapiens
auacugugaaguuacaugcau

SEQ ID NO: 1482015 - RNA, 12 nt, Homo sapiens
auacugugcaua

SEQ ID NO: 1482016 - RNA, 13 nt, Homo sapiens
auacuguuuauuu

SEQ ID NO: 1482017 - RNA, 13 nt, Homo sapiens
auacuuuuuacaa

SEQ ID NO: 1482018 - RNA, 13 nt, Homo sapiens
auagaaagcuaua

SEQ ID NO: 1482019 - RNA, 14 nt, Homo sapiens
auagaaauuuugua

SEQ ID NO: 1482020 - RNA, 18 nt, Homo sapiens
auagaagcaaaugacaaa

SEQ ID NO: 1482021 - RNA, 15 nt, Homo sapiens
auagaaguagcaaaa

SEQ ID NO: 1482022 - RNA, 18 nt, Homo sapiens
auagaauaaaauauaauu

SEQ ID NO: 1482023 - RNA, 19 nt, Homo sapiens
auagacuggauggaaagac

SEQ ID NO: 1482024 - RNA, 18 nt, Homo sapiens
auagagauuugucuaauu

SEQ ID NO: 1482025 - RNA, 23 nt, Homo sapiens
auagagcuuuuaaaaauguccug

SEQ ID NO: 1482026 - RNA, 14 nt, Homo sapiens
auagaggcuagcuu

SEQ ID NO: 1482027 - RNA, 20 nt, Homo sapiens
auagauauaugcucugcaug

SEQ ID NO: 1482028 - RNA, 23 nt, Homo sapiens
auagaugcuggcccagggcccag

SEQ ID NO: 1482029 - RNA, 19 nt, Homo sapiens
auagauggguuauuucaac

SEQ ID NO: 1482030 - RNA, 22 nt, Homo sapiens
auagcagccuuucucucuuuau

SEQ ID NO: 1482031 - RNA, 23 nt, Homo sapiens
auagcaguugaaacaagaagcca

SEQ ID NO: 1482032 - RNA, 15 nt, Homo sapiens
auagcauguaauggu

SEQ ID NO: 1482033 - RNA, 14 nt, Homo sapiens
auagcuuccaugag

SEQ ID NO: 1482034 - RNA, 19 nt, Homo sapiens
auagcuugcauagucaaua

SEQ ID NO: 1482035 - RNA, 23 nt, Homo sapiens
auaggaaauauuuuaauguuucu

SEQ ID NO: 1482036 - RNA, 17 nt, Homo sapiens
auaggacauugugucag

SEQ ID NO: 1482037 - RNA, 17 nt, Homo sapiens
auaggcaaaaucugaca

SEQ ID NO: 1482038 - RNA, 21 nt, Homo sapiens
auaggccagggcauguguaug

SEQ ID NO: 1482039 - RNA, 20 nt, Homo sapiens
auagggagacccccaucuuu

SEQ ID NO: 1482040 - RNA, 22 nt, Homo sapiens
auagggagacccccaucuuuac

SEQ ID NO: 1482041 - RNA, 14 nt, Homo sapiens
auaggucacuccug

SEQ ID NO: 1482042 - RNA, 12 nt, Homo sapiens
auaggugcuuau

SEQ ID NO: 1482043 - RNA, 21 nt, Homo sapiens
auagguuuuucucauguaucu

SEQ ID NO: 1482044 - RNA, 19 nt, Homo sapiens
auaguaccauuuauacaaa

SEQ ID NO: 1482045 - RNA, 20 nt, Homo sapiens
auaguacucuuuguagcaaa

SEQ ID NO: 1482046 - RNA, 14 nt, Homo sapiens
auagucacaagagc

SEQ ID NO: 1482047 - RNA, 16 nt, Homo sapiens
auagucgggaugucag

SEQ ID NO: 1482048 - RNA, 22 nt, Homo sapiens
auagucucauucugucacccag

SEQ ID NO: 1482049 - RNA, 20 nt, Homo sapiens
agcucaggucccaggccagc

SEQ ID NO: 1482050 - RNA, 12 nt, Homo sapiens
agcucaguuuau

SEQ ID NO: 1482051 - RNA, 15 nt, Homo sapiens
agcuccaaccugcaa

SEQ ID NO: 1482052 - RNA, 16 nt, Homo sapiens
agcuccuugaguaaaa

SEQ ID NO: 1482053 - RNA, 23 nt, Homo sapiens
agcucguucucugggccuucuca

SEQ ID NO: 1482054 - RNA, 14 nt, Homo sapiens
agcucuacugaggu

SEQ ID NO: 1482055 - RNA, 17 nt, Homo sapiens
agcucuauaagagcugg

SEQ ID NO: 1482056 - RNA, 19 nt, Homo sapiens
agcucuccccaaacuugcu

SEQ ID NO: 1482057 - RNA, 12 nt, Homo sapiens
agcucucuggga

SEQ ID NO: 1482058 - RNA, 14 nt, Homo sapiens
agcucuggggacag

SEQ ID NO: 1482059 - RNA, 21 nt, Homo sapiens
agcucuucaggccucccucuc

SEQ ID NO: 1482060 - RNA, 14 nt, Homo sapiens
agcugaacaauagg

SEQ ID NO: 1482061 - RNA, 20 nt, Homo sapiens
agcugaaugccuccuguggg

SEQ ID NO: 1482062 - RNA, 14 nt, Homo sapiens
agcugacaucucag

SEQ ID NO: 1482063 - RNA, 15 nt, Homo sapiens
agcugaccaucaucc

SEQ ID NO: 1482064 - RNA, 21 nt, Homo sapiens
agcugaccuggagaugcugcc

SEQ ID NO: 1482065 - RNA, 18 nt, Homo sapiens
agcugagaauguggaaua

SEQ ID NO: 1482066 - RNA, 19 nt, Homo sapiens
agcugcacugaugcugccc

SEQ ID NO: 1482067 - RNA, 19 nt, Homo sapiens
agcugccaucgaccuggag

SEQ ID NO: 1482068 - RNA, 10 nt, Homo sapiens
agcugccauu

SEQ ID NO: 1482069 - RNA, 11 nt, Homo sapiens
agcugccauuu

SEQ ID NO: 1482070 - RNA, 14 nt, Homo sapiens
agcugccucacuuc

SEQ ID NO: 1482071 - RNA, 15 nt, Homo sapiens
agcugccucugggcc

SEQ ID NO: 1482072 - RNA, 13 nt, Homo sapiens
agcugcucuggaa

SEQ ID NO: 1482073 - RNA, 19 nt, Homo sapiens
agcugcugucuucuggaca

SEQ ID NO: 1482074 - RNA, 13 nt, Homo sapiens
agcuggccugaga

SEQ ID NO: 1482075 - RNA, 19 nt, Homo sapiens
agcugguuuuaaguggaac

SEQ ID NO: 1482076 - RNA, 16 nt, Homo sapiens
agcuguaaacugaaua

SEQ ID NO: 1482077 - RNA, 16 nt, Homo sapiens
agcuguacaugaugau

SEQ ID NO: 1482078 - RNA, 12 nt, Homo sapiens
agcugucaucac

SEQ ID NO: 1482079 - RNA, 19 nt, Homo sapiens
agcugucccaccugcacac

SEQ ID NO: 1482080 - RNA, 15 nt, Homo sapiens
agcugucgacuucau

SEQ ID NO: 1482081 - RNA, 21 nt, Homo sapiens
agcuguggccuaggcuaccuc

SEQ ID NO: 1482082 - RNA, 22 nt, Homo sapiens
agcuguggccuaggcuaccuca

SEQ ID NO: 1482083 - RNA, 14 nt, Homo sapiens
agcuguuuccauag

SEQ ID NO: 1482084 - RNA, 22 nt, Homo sapiens
agcuuaauaguaguuagcuuaa

SEQ ID NO: 1482085 - RNA, 15 nt, Homo sapiens
agcuuacaaucgcaa

SEQ ID NO: 1482086 - RNA, 22 nt, Homo sapiens
agcuuagccaaugugggagcag

SEQ ID NO: 1482087 - RNA, 12 nt, Homo sapiens
agcuuagcuguc

SEQ ID NO: 1482088 - RNA, 14 nt, Homo sapiens
agcuucaccagagc

SEQ ID NO: 1482089 - RNA, 20 nt, Homo sapiens
agcuucaccagagcauuucc

SEQ ID NO: 1482090 - RNA, 15 nt, Homo sapiens
agcuucagaugguga

SEQ ID NO: 1482091 - RNA, 15 nt, Homo sapiens
agcuucaugccuuug

SEQ ID NO: 1482092 - RNA, 20 nt, Homo sapiens
agcuucauuuuacuaaaaag

SEQ ID NO: 1482093 - RNA, 14 nt, Homo sapiens
agcuucucugugaa

SEQ ID NO: 1482094 - RNA, 12 nt, Homo sapiens
agcuucuuguuu

SEQ ID NO: 1482095 - RNA, 14 nt, Homo sapiens
agcuugcaacaaaa

SEQ ID NO: 1482096 - RNA, 23 nt, Homo sapiens
agcuugccaauggcggacucaaa

SEQ ID NO: 1482097 - RNA, 20 nt, Homo sapiens
agcuuguguccuguccuuuc

SEQ ID NO: 1482098 - RNA, 21 nt, Homo sapiens
agcuuguucugggcucaggga

SEQ ID NO: 1482099 - RNA, 12 nt, Homo sapiens
agcuuucugucc

SEQ ID NO: 1482100 - RNA, 12 nt, Homo sapiens
agcuuugucaua

SEQ ID NO: 1482101 - RNA, 22 nt, Homo sapiens
agcuuugugcuugucauuccag

SEQ ID NO: 1482102 - RNA, 23 nt, Homo sapiens
agcuuuugaggggcugacuucaa

SEQ ID NO: 1482103 - RNA, 17 nt, Homo sapiens
aggaaaaaauuaauacu

SEQ ID NO: 1482104 - RNA, 20 nt, Homo sapiens
aggaaaaaccaauagcuuua

SEQ ID NO: 1482105 - RNA, 20 nt, Homo sapiens
aggaaaaguaaggugcaguu

SEQ ID NO: 1482106 - RNA, 16 nt, Homo sapiens
aggaaacccccagugu

SEQ ID NO: 1482107 - RNA, 17 nt, Homo sapiens
aggaaacccccagugua

SEQ ID NO: 1482108 - RNA, 20 nt, Homo sapiens
aggaaacccccaguguaaua

SEQ ID NO: 1482109 - RNA, 13 nt, Homo sapiens
aggaaacgaugaa

SEQ ID NO: 1482110 - RNA, 23 nt, Homo sapiens
aggaaauaguaccuucaauacuu

SEQ ID NO: 1482111 - RNA, 16 nt, Homo sapiens
aggaacagcaauggug

SEQ ID NO: 1482112 - RNA, 13 nt, Homo sapiens
aggaacagcacug

SEQ ID NO: 1482113 - RNA, 19 nt, Homo sapiens
aggaacagcaguguucuca

SEQ ID NO: 1482114 - RNA, 22 nt, Homo sapiens
aggaacagugugguuugggaaa

SEQ ID NO: 1482115 - RNA, 20 nt, Homo sapiens
aggaacaguugcauuuagcu

SEQ ID NO: 1482116 - RNA, 20 nt, Homo sapiens
aggaacauuccuuagucuca

SEQ ID NO: 1482117 - RNA, 19 nt, Homo sapiens
aggaacucucaagugucuu

SEQ ID NO: 1482118 - RNA, 14 nt, Homo sapiens
aggaagagccaaug

SEQ ID NO: 1482119 - RNA, 17 nt, Homo sapiens
aggaagaugauggcuca

SEQ ID NO: 1482120 - RNA, 16 nt, Homo sapiens
aggaagccagcuggcu

SEQ ID NO: 1482121 - RNA, 19 nt, Homo sapiens
aggaagcuccacugucacc

SEQ ID NO: 1482122 - RNA, 15 nt, Homo sapiens
aggaagcucucuuaa

SEQ ID NO: 1482123 - RNA, 18 nt, Homo sapiens
aggaagcuugucacugga

SEQ ID NO: 1482124 - RNA, 16 nt, Homo sapiens
aggaaggaaaugacac

SEQ ID NO: 1482125 - RNA, 21 nt, Homo sapiens
aggaaggaacagcaauggugu

SEQ ID NO: 1482126 - RNA, 15 nt, Homo sapiens
aggaaggaaccagaa

SEQ ID NO: 1482127 - RNA, 14 nt, Homo sapiens
aggaaguacuucca

SEQ ID NO: 1482128 - RNA, 16 nt, Homo sapiens
aggaaguagaagucau

SEQ ID NO: 1482129 - RNA, 20 nt, Homo sapiens
aggaauauaugugugccuau

SEQ ID NO: 1482130 - RNA, 17 nt, Homo sapiens
aggaaucaaaaauugaa

SEQ ID NO: 1482131 - RNA, 12 nt, Homo sapiens
aggaaucauucc

SEQ ID NO: 1482132 - RNA, 24 nt, Homo sapiens
aggaauccuggaccaagcacaaaa

SEQ ID NO: 1482133 - RNA, 22 nt, Homo sapiens
aggaaucggagcgaagcagaga

SEQ ID NO: 1482134 - RNA, 15 nt, Homo sapiens
aggaauuucugcucu

SEQ ID NO: 1482135 - RNA, 13 nt, Homo sapiens
aggaauuuugcua

SEQ ID NO: 1482136 - RNA, 14 nt, Homo sapiens
aggacacagcagug

SEQ ID NO: 1482137 - RNA, 16 nt, Homo sapiens
aggacagaccacagag

SEQ ID NO: 1482138 - RNA, 13 nt, Homo sapiens
aggacaguauucc

SEQ ID NO: 1482139 - RNA, 15 nt, Homo sapiens
aggacaguggaugcu

SEQ ID NO: 1482140 - RNA, 19 nt, Homo sapiens
aggacaguggaugcugcug

SEQ ID NO: 1482141 - RNA, 18 nt, Homo sapiens
aggacauuuuacugcagu

SEQ ID NO: 1482142 - RNA, 19 nt, Homo sapiens
aggaccagaagcauuucac

SEQ ID NO: 1482143 - RNA, 18 nt, Homo sapiens
agucuggcaacagagcaa

SEQ ID NO: 1482144 - RNA, 20 nt, Homo sapiens
agucuucacuugcacugggg

SEQ ID NO: 1482145 - RNA, 20 nt, Homo sapiens
agucuucucauagcauuaac

SEQ ID NO: 1482146 - RNA, 15 nt, Homo sapiens
agucuugcucuguca

SEQ ID NO: 1482147 - RNA, 18 nt, Homo sapiens
agucuugcucuguugccc

SEQ ID NO: 1482148 - RNA, 14 nt, Homo sapiens
agaacugcagucag

SEQ ID NO: 1482149 - RNA, 16 nt, Homo sapiens
agaacugcagucagca

SEQ ID NO: 1482150 - RNA, 13 nt, Homo sapiens
agaacugugccac

SEQ ID NO: 1482151 - RNA, 16 nt, Homo sapiens
agaacuugauuugcau

SEQ ID NO: 1482152 - RNA, 18 nt, Homo sapiens
agaacuuuucgacauauu

SEQ ID NO: 1482153 - RNA, 14 nt, Homo sapiens
agaagacagcugcu

SEQ ID NO: 1482154 - RNA, 14 nt, Homo sapiens
agaagacucugacc

SEQ ID NO: 1482155 - RNA, 22 nt, Homo sapiens
agaagagugcccugcuuugcaa

SEQ ID NO: 1482156 - RNA, 22 nt, Homo sapiens
agaagauccaagaggcccugca

SEQ ID NO: 1482157 - RNA, 20 nt, Homo sapiens
agaagcccagguuacaaaga

SEQ ID NO: 1482158 - RNA, 12 nt, Homo sapiens
agaagcccugau

SEQ ID NO: 1482159 - RNA, 22 nt, Homo sapiens
agaaggacacuagccugugcac

SEQ ID NO: 1482160 - RNA, 19 nt, Homo sapiens
agaaggacauuuuacugca

SEQ ID NO: 1482161 - RNA, 18 nt, Homo sapiens
agaaggauccaagacaaa

SEQ ID NO: 1482162 - RNA, 22 nt, Homo sapiens
agaaggcagugauuagcacuug

SEQ ID NO: 1482163 - RNA, 15 nt, Homo sapiens
agaaggcaugagaaa

SEQ ID NO: 1482164 - RNA, 21 nt, Homo sapiens
agaagggaauuuauugccucu

SEQ ID NO: 1482165 - RNA, 10 nt, Homo sapiens
agaagggaug

SEQ ID NO: 1482166 - RNA, 24 nt, Homo sapiens
agaaguauuuucuaguucugguca

SEQ ID NO: 1482167 - RNA, 15 nt, Homo sapiens
agaagucaacgccuc

SEQ ID NO: 1482168 - RNA, 19 nt, Homo sapiens
agaaguccccucuacuuua

SEQ ID NO: 1482169 - RNA, 23 nt, Homo sapiens
agaagucugucugucugaugaug

SEQ ID NO: 1482170 - RNA, 16 nt, Homo sapiens
agaagugucuaaaaac

SEQ ID NO: 1482171 - RNA, 23 nt, Homo sapiens
agaaguguggggauuuucacuga

SEQ ID NO: 1482172 - RNA, 14 nt, Homo sapiens
agaauaaauuccca

SEQ ID NO: 1482173 - RNA, 16 nt, Homo sapiens
agaauacuuugcuuca

SEQ ID NO: 1482174 - RNA, 19 nt, Homo sapiens
agaauauaaacauauacag

SEQ ID NO: 1482175 - RNA, 19 nt, Homo sapiens
agaauauacaaauagcaaa

SEQ ID NO: 1482176 - RNA, 23 nt, Homo sapiens
agaauauugucccuuugagcaga

SEQ ID NO: 1482177 - RNA, 19 nt, Homo sapiens
agaauauuuauuaccucug

SEQ ID NO: 1482178 - RNA, 18 nt, Homo sapiens
agaaucauuaauacaaag

SEQ ID NO: 1482179 - RNA, 19 nt, Homo sapiens
agaaucauugaaguauuuu

SEQ ID NO: 1482180 - RNA, 14 nt, Homo sapiens
agaaucgcuuaaac

SEQ ID NO: 1482181 - RNA, 19 nt, Homo sapiens
agaaucgcuugaacccagg

SEQ ID NO: 1482182 - RNA, 23 nt, Homo sapiens
agaaucugcugcauagcucuauu

SEQ ID NO: 1482183 - RNA, 15 nt, Homo sapiens
agaaugaacacuccc

SEQ ID NO: 1482184 - RNA, 21 nt, Homo sapiens
agaaugaauacugggaaucaa

SEQ ID NO: 1482185 - RNA, 20 nt, Homo sapiens
agaaugagcacccauuccaa

SEQ ID NO: 1482186 - RNA, 23 nt, Homo sapiens
agaaugaucagcaucugugaugg

SEQ ID NO: 1482187 - RNA, 16 nt, Homo sapiens
agaaugauuaaucaaa

SEQ ID NO: 1482188 - RNA, 24 nt, Homo sapiens
agaaugcacaagaauggaucacaa

SEQ ID NO: 1482189 - RNA, 13 nt, Homo sapiens
agaaugcauuccc

SEQ ID NO: 1482190 - RNA, 14 nt, Homo sapiens
agaaugcauucccu

SEQ ID NO: 1482191 - RNA, 11 nt, Homo sapiens
agaaugcucuu

SEQ ID NO: 1482192 - RNA, 22 nt, Homo sapiens
agaaugcugcaggacuugagaa

SEQ ID NO: 1482193 - RNA, 20 nt, Homo sapiens
agaauggaacucaagcuggu

SEQ ID NO: 1482194 - RNA, 18 nt, Homo sapiens
agaauuaagauacaaauu

SEQ ID NO: 1482195 - RNA, 23 nt, Homo sapiens
agaauucagaagaccccugacuc

SEQ ID NO: 1482196 - RNA, 22 nt, Homo sapiens
agaauugcucccuaccagcuga

SEQ ID NO: 1482197 - RNA, 12 nt, Homo sapiens
agaauuucacaa

SEQ ID NO: 1482198 - RNA, 15 nt, Homo sapiens
agaauuucacaagcu

SEQ ID NO: 1482199 - RNA, 10 nt, Homo sapiens
agaauuugca

SEQ ID NO: 1482200 - RNA, 18 nt, Homo sapiens
agacaaacaagggagaag

SEQ ID NO: 1482201 - RNA, 19 nt, Homo sapiens
agacaaauucggauguaug

SEQ ID NO: 1482202 - RNA, 16 nt, Homo sapiens
agacaagacauugugu

SEQ ID NO: 1482203 - RNA, 16 nt, Homo sapiens
agacaaguauggcucc

SEQ ID NO: 1482204 - RNA, 15 nt, Homo sapiens
agacacaauauguau

SEQ ID NO: 1482205 - RNA, 23 nt, Homo sapiens
agacacaauauguaugcuuuuua

SEQ ID NO: 1482206 - RNA, 14 nt, Homo sapiens
agacacagcaagac

SEQ ID NO: 1482207 - RNA, 19 nt, Homo sapiens
agacacuggcguuacugcu

SEQ ID NO: 1482208 - RNA, 12 nt, Homo sapiens
agacagacccca

SEQ ID NO: 1482209 - RNA, 11 nt, Homo sapiens
agacagaggaa

SEQ ID NO: 1482210 - RNA, 21 nt, Homo sapiens
agacagcgcaugcuggugcag

SEQ ID NO: 1482211 - RNA, 17 nt, Homo sapiens
agacagcugcuggguca

SEQ ID NO: 1482212 - RNA, 23 nt, Homo sapiens
agacaggcaaauaaaagugaccu

SEQ ID NO: 1482213 - RNA, 19 nt, Homo sapiens
agacaggguuucacugugu

SEQ ID NO: 1482214 - RNA, 19 nt, Homo sapiens
agacaguguuuucugggau

SEQ ID NO: 1482215 - RNA, 15 nt, Homo sapiens
agacauacauuucuc

SEQ ID NO: 1482216 - RNA, 11 nt, Homo sapiens
agacauacucc

SEQ ID NO: 1482217 - RNA, 19 nt, Homo sapiens
agacauacuccuuccauca

SEQ ID NO: 1482218 - RNA, 20 nt, Homo sapiens
agacaucggccuccaugacc

SEQ ID NO: 1482219 - RNA, 21 nt, Homo sapiens
agacaucggccuccaugaccu

SEQ ID NO: 1482220 - RNA, 16 nt, Homo sapiens
agacaugaaugcacac

SEQ ID NO: 1482221 - RNA, 17 nt, Homo sapiens
agacaugauuuccuuga

SEQ ID NO: 1482222 - RNA, 14 nt, Homo sapiens
agacaugugacauu

SEQ ID NO: 1482223 - RNA, 19 nt, Homo sapiens
agacaugugaggaggaaaa

SEQ ID NO: 1482224 - RNA, 18 nt, Homo sapiens
agacauucauugucccug

SEQ ID NO: 1482225 - RNA, 19 nt, Homo sapiens
agacauucuuccaaaaaga

SEQ ID NO: 1482226 - RNA, 14 nt, Homo sapiens
agaccauaauguua

SEQ ID NO: 1482227 - RNA, 15 nt, Homo sapiens
agaccauagugacca

SEQ ID NO: 1482228 - RNA, 17 nt, Homo sapiens
agaccauccuggacuga

SEQ ID NO: 1482229 - RNA, 11 nt, Homo sapiens
agacccagugg

SEQ ID NO: 1482230 - RNA, 15 nt, Homo sapiens
agacccgcucuccau

SEQ ID NO: 1482231 - RNA, 12 nt, Homo sapiens
agaccuacccuc

SEQ ID NO: 1482232 - RNA, 16 nt, Homo sapiens
agaccucugugcacuu

SEQ ID NO: 1482233 - RNA, 15 nt, Homo sapiens
agaccugacaagcac

SEQ ID NO: 1482234 - RNA, 16 nt, Homo sapiens
agaccugacaagcacu

SEQ ID NO: 1482235 - RNA, 13 nt, Homo sapiens
agaccuggugcug

SEQ ID NO: 1482236 - RNA, 14 nt, Homo sapiens
agaccugugcuagu

SEQ ID NO: 1482237 - RNA, 17 nt, Homo sapiens
agcuaugggagccccag

SEQ ID NO: 1482238 - RNA, 16 nt, Homo sapiens
agcuauuagccaggau

SEQ ID NO: 1482239 - RNA, 14 nt, Homo sapiens
agcuauuuccauuc

SEQ ID NO: 1482240 - RNA, 17 nt, Homo sapiens
agcucacacuccagugg

SEQ ID NO: 1482241 - RNA, 20 nt, Homo sapiens
agcucacucuggauuccaca

SEQ ID NO: 1482242 - RNA, 17 nt, Homo sapiens
agcucacugcagccuca

SEQ ID NO: 1482243 - RNA, 19 nt, Homo sapiens
agcucagaggcccaggaau

SEQ ID NO: 1482244 - RNA, 20 nt, Homo sapiens
agcucagcaacaaggcugca

SEQ ID NO: 1482245 - RNA, 23 nt, Homo sapiens
agcucaggaaggggugugcugag

SEQ ID NO: 1482246 - RNA, 20 nt, Homo sapiens
agaacagagugcaacccagu

SEQ ID NO: 1482247 - RNA, 21 nt, Homo sapiens
agaacagggucauguuugcag

SEQ ID NO: 1482248 - RNA, 17 nt, Homo sapiens
agaacagguucuuaaaa

SEQ ID NO: 1482249 - RNA, 19 nt, Homo sapiens
agaacauauguugcaagac

SEQ ID NO: 1482250 - RNA, 20 nt, Homo sapiens
agaacaucauaacccaugaa

SEQ ID NO: 1482251 - RNA, 21 nt, Homo sapiens
agaacauuuauaucaguuuca

SEQ ID NO: 1482252 - RNA, 20 nt, Homo sapiens
agaaccccaggacgcccuca

SEQ ID NO: 1482253 - RNA, 18 nt, Homo sapiens
agaacccuuggagccaau

SEQ ID NO: 1482254 - RNA, 16 nt, Homo sapiens
agaaccgagcaaagau

SEQ ID NO: 1482255 - RNA, 13 nt, Homo sapiens
agaaccucuccau

SEQ ID NO: 1482256 - RNA, 20 nt, Homo sapiens
agaacuaccaugagaugguu

SEQ ID NO: 1482257 - RNA, 16 nt, Homo sapiens
agaacuauguacuuua

SEQ ID NO: 1482258 - RNA, 13 nt, Homo sapiens
agaacucccacaa

SEQ ID NO: 1482259 - RNA, 12 nt, Homo sapiens
agaacucuccau

SEQ ID NO: 1482260 - RNA, 19 nt, Homo sapiens
acuucuggaagucaucuca

SEQ ID NO: 1482261 - RNA, 23 nt, Homo sapiens
acuucuuauggaauugauuugca

SEQ ID NO: 1482262 - RNA, 17 nt, Homo sapiens
acuugaaacagauucag

SEQ ID NO: 1482263 - RNA, 18 nt, Homo sapiens
acuugaaagcauccaugu

SEQ ID NO: 1482264 - RNA, 18 nt, Homo sapiens
acuugaagggccagagcc

SEQ ID NO: 1482265 - RNA, 21 nt, Homo sapiens
acuugacauguagcuucuucu

SEQ ID NO: 1482266 - RNA, 17 nt, Homo sapiens
acuugauguguuaucuc

SEQ ID NO: 1482267 - RNA, 18 nt, Homo sapiens
acuugauuugcauggauu

SEQ ID NO: 1482268 - RNA, 21 nt, Homo sapiens
acuugcuuuaugccuucuuau

SEQ ID NO: 1482269 - RNA, 13 nt, Homo sapiens
acuuggcacuuuu

SEQ ID NO: 1482270 - RNA, 19 nt, Homo sapiens
acuugggccacacuaccca

SEQ ID NO: 1482271 - RNA, 23 nt, Homo sapiens
acuuggggaguuaagaccuggca

SEQ ID NO: 1482272 - RNA, 22 nt, Homo sapiens
acuuggucuggccacuguccca

SEQ ID NO: 1482273 - RNA, 22 nt, Homo sapiens
acuugguuuguuauaucaggga

SEQ ID NO: 1482274 - RNA, 14 nt, Homo sapiens
accugagauggagg

SEQ ID NO: 1482275 - RNA, 20 nt, Homo sapiens
accugagucugcaugugcac

SEQ ID NO: 1482276 - RNA, 18 nt, Homo sapiens
accugauauucaggcuac

SEQ ID NO: 1482277 - RNA, 22 nt, Homo sapiens
accugaucacuagccugucauc

SEQ ID NO: 1482278 - RNA, 13 nt, Homo sapiens
accugauccugga

SEQ ID NO: 1482279 - RNA, 21 nt, Homo sapiens
accugauguaccugaugcuau

SEQ ID NO: 1482280 - RNA, 14 nt, Homo sapiens
accugcacacucca

SEQ ID NO: 1482281 - RNA, 12 nt, Homo sapiens
accugcaggcug

SEQ ID NO: 1482282 - RNA, 18 nt, Homo sapiens
accugcaugugcugucac

SEQ ID NO: 1482283 - RNA, 22 nt, Homo sapiens
accugccccccacucugcacag

SEQ ID NO: 1482284 - RNA, 14 nt, Homo sapiens
accugcucugcuga

SEQ ID NO: 1482285 - RNA, 13 nt, Homo sapiens
accugcuggugag

SEQ ID NO: 1482286 - RNA, 17 nt, Homo sapiens
accugcuucucugccca

SEQ ID NO: 1482287 - RNA, 12 nt, Homo sapiens
accuggauccag

SEQ ID NO: 1482288 - RNA, 17 nt, Homo sapiens
accuggauccagcacug

SEQ ID NO: 1482289 - RNA, 20 nt, Homo sapiens
accuggauccagcacuggug

SEQ ID NO: 1482290 - RNA, 16 nt, Homo sapiens
accuggcacaauggcu

SEQ ID NO: 1482291 - RNA, 19 nt, Homo sapiens
accuggcagcucuggacag

SEQ ID NO: 1482292 - RNA, 20 nt, Homo sapiens
accugggcccaggaccugcc

SEQ ID NO: 1482293 - RNA, 22 nt, Homo sapiens
accuggggagugguuaggcagc

SEQ ID NO: 1482294 - RNA, 16 nt, Homo sapiens
accuguagucccagcu

SEQ ID NO: 1482295 - RNA, 16 nt, Homo sapiens
accugucacauugcau

SEQ ID NO: 1482296 - RNA, 14 nt, Homo sapiens
accugugaccagca

SEQ ID NO: 1482297 - RNA, 17 nt, Homo sapiens
accugugccuccucaga

SEQ ID NO: 1482298 - RNA, 15 nt, Homo sapiens
accuguucaaaaagg

SEQ ID NO: 1482299 - RNA, 19 nt, Homo sapiens
accuguuuucgcaccuacc

SEQ ID NO: 1482300 - RNA, 16 nt, Homo sapiens
accuuauauuuacaau

SEQ ID NO: 1482301 - RNA, 23 nt, Homo sapiens
accuuauauuuacaauaaaugaa

SEQ ID NO: 1482302 - RNA, 23 nt, Homo sapiens
accuuauccauaggcgcaggugc

SEQ ID NO: 1482303 - RNA, 14 nt, Homo sapiens
accuucaccuggau

SEQ ID NO: 1482304 - RNA, 22 nt, Homo sapiens
accuucaucugaaacccacaga

SEQ ID NO: 1482305 - RNA, 12 nt, Homo sapiens
accuuccucauc

SEQ ID NO: 1482306 - RNA, 23 nt, Homo sapiens
accuugcgauucugcagccacaa

SEQ ID NO: 1482307 - RNA, 16 nt, Homo sapiens
accuuggcaccagaca

SEQ ID NO: 1482308 - RNA, 22 nt, Homo sapiens
accuuggcaccagacacccagg

SEQ ID NO: 1482309 - RNA, 19 nt, Homo sapiens
accuuggcucugccagugg

SEQ ID NO: 1482310 - RNA, 16 nt, Homo sapiens
accuuggggucccucc

SEQ ID NO: 1482311 - RNA, 15 nt, Homo sapiens
accuuuaucuuucca

SEQ ID NO: 1482312 - RNA, 23 nt, Homo sapiens
accuuuccaguuuauaagacugg

SEQ ID NO: 1482313 - RNA, 17 nt, Homo sapiens
accuuuuuuaagauuuu

SEQ ID NO: 1482314 - RNA, 14 nt, Homo sapiens
acgaaacacugugc

SEQ ID NO: 1482315 - RNA, 13 nt, Homo sapiens
acgaauugagaua

SEQ ID NO: 1482316 - RNA, 13 nt, Homo sapiens
acgaggugcaaca

SEQ ID NO: 1482317 - RNA, 15 nt, Homo sapiens
acgaucuuccuggcu

SEQ ID NO: 1482318 - RNA, 13 nt, Homo sapiens
acgcacuggugcc

SEQ ID NO: 1482319 - RNA, 21 nt, Homo sapiens
acgcaggccagcaacucccag

SEQ ID NO: 1482320 - RNA, 17 nt, Homo sapiens
acgcauggaaaaguuuc

SEQ ID NO: 1482321 - RNA, 16 nt, Homo sapiens
acgcaugugugcugca

SEQ ID NO: 1482322 - RNA, 17 nt, Homo sapiens
acgcaugugugcugcag

SEQ ID NO: 1482323 - RNA, 17 nt, Homo sapiens
acgccacucccugggac

SEQ ID NO: 1482324 - RNA, 16 nt, Homo sapiens
acgccaucuccacucu

SEQ ID NO: 1482325 - RNA, 19 nt, Homo sapiens
acgccgcucuucacugugg

SEQ ID NO: 1482326 - RNA, 21 nt, Homo sapiens
acgccucacugaaacauggcu

SEQ ID NO: 1482327 - RNA, 15 nt, Homo sapiens
acgccuccuggccag

SEQ ID NO: 1482328 - RNA, 16 nt, Homo sapiens
acgcgcgcgugcacac

SEQ ID NO: 1482329 - RNA, 20 nt, Homo sapiens
acgcgguuccagauguggau

SEQ ID NO: 1482330 - RNA, 17 nt, Homo sapiens
acgcucacccagucacc

SEQ ID NO: 1482331 - RNA, 16 nt, Homo sapiens
acgcuggcaacacaga

SEQ ID NO: 1482332 - RNA, 20 nt, Homo sapiens
acgcuuguagaacucacucu

SEQ ID NO: 1482333 - RNA, 19 nt, Homo sapiens
acgcuuuucuuuguuauac

SEQ ID NO: 1482334 - RNA, 23 nt, Homo sapiens
acggaugauuggauuauucauuu

SEQ ID NO: 1482335 - RNA, 14 nt, Homo sapiens
acggccacaucaaa

SEQ ID NO: 1482336 - RNA, 19 nt, Homo sapiens
acggcguuucaccauguug

SEQ ID NO: 1482337 - RNA, 13 nt, Homo sapiens
acggcucacugua

SEQ ID NO: 1482338 - RNA, 18 nt, Homo sapiens
acgggcaugggcacuccc

SEQ ID NO: 1482339 - RNA, 14 nt, Homo sapiens
acggugggcauuug

SEQ ID NO: 1482340 - RNA, 21 nt, Homo sapiens
acguacaaaauccagcuauga

SEQ ID NO: 1482341 - RNA, 23 nt, Homo sapiens
acguacaaaauccagcuaugaau

SEQ ID NO: 1482342 - RNA, 14 nt, Homo sapiens
acgugagccaggua

SEQ ID NO: 1482343 - RNA, 17 nt, Homo sapiens
acguggccucuugagca

SEQ ID NO: 1482344 - RNA, 20 nt, Homo sapiens
acguggccucuugagcagug

SEQ ID NO: 1482345 - RNA, 16 nt, Homo sapiens
acguggcucagccagc

SEQ ID NO: 1482346 - RNA, 22 nt, Homo sapiens
acuaaagcaaauuuuagaacuu

SEQ ID NO: 1482347 - RNA, 11 nt, Homo sapiens
acuaaagccag

SEQ ID NO: 1482348 - RNA, 20 nt, Homo sapiens
acuaaagcuauguuacaugg

SEQ ID NO: 1482349 - RNA, 16 nt, Homo sapiens
acuaaaucaaucugca

SEQ ID NO: 1482350 - RNA, 15 nt, Homo sapiens
acuaacagauaagca

SEQ ID NO: 1482351 - RNA, 17 nt, Homo sapiens
acuaacagauaagcaag

SEQ ID NO: 1482352 - RNA, 12 nt, Homo sapiens
acuaacauuucc

SEQ ID NO: 1482353 - RNA, 16 nt, Homo sapiens
acuaacuccugagaaa

SEQ ID NO: 1482354 - RNA, 16 nt, Homo sapiens
acuaagaaauauucca

SEQ ID NO: 1482355 - RNA, 14 nt, Homo sapiens
acuaagacaccuga

SEQ ID NO: 1482356 - RNA, 15 nt, Homo sapiens
acuaagcuuugccag

SEQ ID NO: 1482357 - RNA, 19 nt, Homo sapiens
acuaagguggaugccaacc

SEQ ID NO: 1482358 - RNA, 14 nt, Homo sapiens
acuaauuaggcaag

SEQ ID NO: 1482359 - RNA, 23 nt, Homo sapiens
acuaauuaggcaaggcuauguga

SEQ ID NO: 1482360 - RNA, 16 nt, Homo sapiens
acuacaaagcuucuau

SEQ ID NO: 1482361 - RNA, 14 nt, Homo sapiens
acuaccaagcuggc

SEQ ID NO: 1482362 - RNA, 16 nt, Homo sapiens
acuaccccacaccagc

SEQ ID NO: 1482363 - RNA, 16 nt, Homo sapiens
acuaccucaaaggcca

SEQ ID NO: 1482364 - RNA, 21 nt, Homo sapiens
acuacugacauguggggccag

SEQ ID NO: 1482365 - RNA, 21 nt, Homo sapiens
acuacuuggaacuaggcucuu

SEQ ID NO: 1482366 - RNA, 21 nt, Homo sapiens
acuacuuuaauaaagaauuaa

SEQ ID NO: 1482367 - RNA, 23 nt, Homo sapiens
acuagaagaaaagcccauuuuca

SEQ ID NO: 1482368 - RNA, 16 nt, Homo sapiens
acuagccacugagaag

SEQ ID NO: 1482369 - RNA, 14 nt, Homo sapiens
acuaggcacugugg

SEQ ID NO: 1482370 - RNA, 14 nt, Homo sapiens
acuauagcccaggu

SEQ ID NO: 1482371 - RNA, 22 nt, Homo sapiens
acuauccaaucugugaugacau

SEQ ID NO: 1482372 - RNA, 14 nt, Homo sapiens
acuauccuacccca

SEQ ID NO: 1482373 - RNA, 15 nt, Homo sapiens
acuauccuaccccac

SEQ ID NO: 1482374 - RNA, 20 nt, Homo sapiens
acuaucugcauuaucuaugc

SEQ ID NO: 1482375 - RNA, 14 nt, Homo sapiens
acuaucuucuucaa

SEQ ID NO: 1482376 - RNA, 23 nt, Homo sapiens
acccagggugugaacauguucuc

SEQ ID NO: 1482377 - RNA, 19 nt, Homo sapiens
acccaguggacucuuccac

SEQ ID NO: 1482378 - RNA, 13 nt, Homo sapiens
acccaucugcaaa

SEQ ID NO: 1482379 - RNA, 16 nt, Homo sapiens
acccauuaucuggaau

SEQ ID NO: 1482380 - RNA, 18 nt, Homo sapiens
acccauucacuacaggug

SEQ ID NO: 1482381 - RNA, 17 nt, Homo sapiens
acccauucagagacugu

SEQ ID NO: 1482382 - RNA, 20 nt, Homo sapiens
acccauucguggugaucaau

SEQ ID NO: 1482383 - RNA, 18 nt, Homo sapiens
accccacagacacuuaca

SEQ ID NO: 1482384 - RNA, 17 nt, Homo sapiens
accccaccuugccaagc

SEQ ID NO: 1482385 - RNA, 18 nt, Homo sapiens
accccacgcccuguucac

SEQ ID NO: 1482386 - RNA, 13 nt, Homo sapiens
accccacugggca

SEQ ID NO: 1482387 - RNA, 19 nt, Homo sapiens
accccagcugccaaggaaa

SEQ ID NO: 1482388 - RNA, 22 nt, Homo sapiens
accccaggacgcccucacugca

SEQ ID NO: 1482389 - RNA, 14 nt, Homo sapiens
accccaugccaaag

SEQ ID NO: 1482390 - RNA, 14 nt, Homo sapiens
accccauguccuca

SEQ ID NO: 1482391 - RNA, 18 nt, Homo sapiens
accccauguccucagcau

SEQ ID NO: 1482392 - RNA, 20 nt, Homo sapiens
acccccagguggaaggcaga

SEQ ID NO: 1482393 - RNA, 12 nt, Homo sapiens
acccccagugua

SEQ ID NO: 1482394 - RNA, 14 nt, Homo sapiens
acccccaucccucg

SEQ ID NO: 1482395 - RNA, 18 nt, Homo sapiens
acccccgcaaguuugcac

SEQ ID NO: 1482396 - RNA, 15 nt, Homo sapiens
accccuccauuggcu

SEQ ID NO: 1482397 - RNA, 13 nt, Homo sapiens
accccugaccuca

SEQ ID NO: 1482398 - RNA, 18 nt, Homo sapiens
accccugaccucacugug

SEQ ID NO: 1482399 - RNA, 20 nt, Homo sapiens
acccgggggagcccagugaa

SEQ ID NO: 1482400 - RNA, 20 nt, Homo sapiens
acccuaguuucccugaagga

SEQ ID NO: 1482401 - RNA, 21 nt, Homo sapiens
acccuauuuagaaauggauuu

SEQ ID NO: 1482402 - RNA, 19 nt, Homo sapiens
acccuccacucagcugucc

SEQ ID NO: 1482403 - RNA, 15 nt, Homo sapiens
acccuccccuaguca

SEQ ID NO: 1482404 - RNA, 16 nt, Homo sapiens
acccuccccuagucac

SEQ ID NO: 1482405 - RNA, 20 nt, Homo sapiens
acccuccccuagucacucau

SEQ ID NO: 1482406 - RNA, 14 nt, Homo sapiens
acccuccuguaaau

SEQ ID NO: 1482407 - RNA, 20 nt, Homo sapiens
acccuccuugggacugaagg

SEQ ID NO: 1482408 - RNA, 18 nt, Homo sapiens
acccucgcccaacuccac

SEQ ID NO: 1482409 - RNA, 21 nt, Homo sapiens
acccucgggccccauccucau

SEQ ID NO: 1482410 - RNA, 12 nt, Homo sapiens
acccucucacua

SEQ ID NO: 1482411 - RNA, 16 nt, Homo sapiens
acccucucucugaucu

SEQ ID NO: 1482412 - RNA, 16 nt, Homo sapiens
acccugagacuuggcu

SEQ ID NO: 1482413 - RNA, 14 nt, Homo sapiens
acccugcacuuucc

SEQ ID NO: 1482414 - RNA, 21 nt, Homo sapiens
acccugcgcaugaaccuggac

SEQ ID NO: 1482415 - RNA, 22 nt, Homo sapiens
acccugcugaccucccagugac

SEQ ID NO: 1482416 - RNA, 21 nt, Homo sapiens
acccuggagcccauccagucu

SEQ ID NO: 1482417 - RNA, 20 nt, Homo sapiens
acccuggaucaguccuuuga

SEQ ID NO: 1482418 - RNA, 21 nt, Homo sapiens
acccuggugggccaacaaaga

SEQ ID NO: 1482419 - RNA, 20 nt, Homo sapiens
acccuucccgccucccucuc

SEQ ID NO: 1482420 - RNA, 22 nt, Homo sapiens
acccuucccugcacuaaagcca

SEQ ID NO: 1482421 - RNA, 22 nt, Homo sapiens
acccuuugccuuucuucugccc

SEQ ID NO: 1482422 - RNA, 15 nt, Homo sapiens
acccuuugcugugag

SEQ ID NO: 1482423 - RNA, 12 nt, Homo sapiens
accgaacacuac

SEQ ID NO: 1482424 - RNA, 22 nt, Homo sapiens
accgacuagccaggaaguacuu

SEQ ID NO: 1482425 - RNA, 22 nt, Homo sapiens
accgagcgugugccacuggacc

SEQ ID NO: 1482426 - RNA, 16 nt, Homo sapiens
accgaggcgaugccac

SEQ ID NO: 1482427 - RNA, 21 nt, Homo sapiens
accgagucucuucuccacugg

SEQ ID NO: 1482428 - RNA, 16 nt, Homo sapiens
accgcaacucacacau

SEQ ID NO: 1482429 - RNA, 20 nt, Homo sapiens
accgccaacugcagcucucc

SEQ ID NO: 1482430 - RNA, 22 nt, Homo sapiens
accgcccaucaggguucucuua

SEQ ID NO: 1482431 - RNA, 13 nt, Homo sapiens
accgccucagggu

SEQ ID NO: 1482432 - RNA, 17 nt, Homo sapiens
accgcugccagcacaga

SEQ ID NO: 1482433 - RNA, 13 nt, Homo sapiens
accgggcaugucu

SEQ ID NO: 1482434 - RNA, 21 nt, Homo sapiens
accggggccagcaccacuucc

SEQ ID NO: 1482435 - RNA, 15 nt, Homo sapiens
accgugucaccuacg

SEQ ID NO: 1482436 - RNA, 23 nt, Homo sapiens
accguucauucaggcaacgcaca

SEQ ID NO: 1482437 - RNA, 13 nt, Homo sapiens
accguugcuaaga

SEQ ID NO: 1482438 - RNA, 16 nt, Homo sapiens
accuaaauuugguucu

SEQ ID NO: 1482439 - RNA, 14 nt, Homo sapiens
accuaaccacuuag

SEQ ID NO: 1482440 - RNA, 16 nt, Homo sapiens
accuaaccacuuagca

SEQ ID NO: 1482441 - RNA, 19 nt, Homo sapiens
accuaaccacuuagcaugu

SEQ ID NO: 1482442 - RNA, 14 nt, Homo sapiens
accuaauccaggca

SEQ ID NO: 1482443 - RNA, 14 nt, Homo sapiens
accuacauuaucuc

SEQ ID NO: 1482444 - RNA, 15 nt, Homo sapiens
accuacauuaucuca

SEQ ID NO: 1482445 - RNA, 20 nt, Homo sapiens
accuagaaugucagauuucu

SEQ ID NO: 1482446 - RNA, 15 nt, Homo sapiens
accuagccacuuaau

SEQ ID NO: 1482447 - RNA, 15 nt, Homo sapiens
accuauccucacugc

SEQ ID NO: 1482448 - RNA, 13 nt, Homo sapiens
accuaugugccaa

SEQ ID NO: 1482449 - RNA, 15 nt, Homo sapiens
accuauuuuuuucuc

SEQ ID NO: 1482450 - RNA, 16 nt, Homo sapiens
accucaaaaugucuaa

SEQ ID NO: 1482451 - RNA, 16 nt, Homo sapiens
accucaccaguuucca

SEQ ID NO: 1482452 - RNA, 16 nt, Homo sapiens
accucacuccuguuac

SEQ ID NO: 1482453 - RNA, 19 nt, Homo sapiens
accucagccucccaaagug

SEQ ID NO: 1482454 - RNA, 16 nt, Homo sapiens
accucagccuggccag

SEQ ID NO: 1482455 - RNA, 21 nt, Homo sapiens
accucaggugauccaccugcc

SEQ ID NO: 1482456 - RNA, 18 nt, Homo sapiens
accucaugggaagcaugu

SEQ ID NO: 1482457 - RNA, 12 nt, Homo sapiens
accuccacaccc

SEQ ID NO: 1482458 - RNA, 19 nt, Homo sapiens
accuccagccuccugccca

SEQ ID NO: 1482459 - RNA, 12 nt, Homo sapiens
accucccaguga

SEQ ID NO: 1482460 - RNA, 11 nt, Homo sapiens
accucccugac

SEQ ID NO: 1482461 - RNA, 18 nt, Homo sapiens
accuccgccagauccugc

SEQ ID NO: 1482462 - RNA, 20 nt, Homo sapiens
accuccgccagauccugcag

SEQ ID NO: 1482463 - RNA, 23 nt, Homo sapiens
accuccugaccugucaccgugag

SEQ ID NO: 1482464 - RNA, 15 nt, Homo sapiens
accuccuuagcccug

SEQ ID NO: 1482465 - RNA, 20 nt, Homo sapiens
accucggccucccaaagugc

SEQ ID NO: 1482466 - RNA, 21 nt, Homo sapiens
accucggccucccaaagugcu

SEQ ID NO: 1482467 - RNA, 20 nt, Homo sapiens
accucuccugcccugugaua

SEQ ID NO: 1482468 - RNA, 17 nt, Homo sapiens
accucugggucaucucu

SEQ ID NO: 1482469 - RNA, 22 nt, Homo sapiens
accucuuccuccucgcugccag

SEQ ID NO: 1482470 - RNA, 13 nt, Homo sapiens
accucuuugcuca

SEQ ID NO: 1482471 - RNA, 13 nt, Homo sapiens
accugaaagaagc

SEQ ID NO: 1482472 - RNA, 18 nt, Homo sapiens
accugaaagaagcccagg

SEQ ID NO: 1482473 - RNA, 21 nt, Homo sapiens
accugaaauuuauucacauau

SEQ ID NO: 1482474 - RNA, 16 nt, Homo sapiens
accugacucaggccag

SEQ ID NO: 1482475 - RNA, 14 nt, Homo sapiens
accugacucuugca

SEQ ID NO: 1482476 - RNA, 15 nt, Homo sapiens
accugacucuugcag

SEQ ID NO: 1482477 - RNA, 17 nt, Homo sapiens
accugagaaauggccaa

SEQ ID NO: 1482478 - RNA, 15 nt, Homo sapiens
aaaaaacaaucugga

SEQ ID NO: 1482479 - RNA, 18 nt, Homo sapiens
aaaaaaccuucagugaaa

SEQ ID NO: 1482480 - RNA, 13 nt, Homo sapiens
aaaaaacuacuuc

SEQ ID NO: 1482481 - RNA, 13 nt, Homo sapiens
aaaaaacuuggca

SEQ ID NO: 1482482 - RNA, 13 nt, Homo sapiens
aaaaaacuuugac

SEQ ID NO: 1482483 - RNA, 12 nt, Homo sapiens
aaaaaaucugac

SEQ ID NO: 1482484 - RNA, 18 nt, Homo sapiens
aaaaaccaauagcuuuaa

SEQ ID NO: 1482485 - RNA, 17 nt, Homo sapiens
aaaaacguaucuccuaa

SEQ ID NO: 1482486 - RNA, 15 nt, Homo sapiens
aaaaacuagagcaca

SEQ ID NO: 1482487 - RNA, 18 nt, Homo sapiens
aaaaagacauucuuccaa

SEQ ID NO: 1482488 - RNA, 19 nt, Homo sapiens
aaaaagaccuaugagcaca

SEQ ID NO: 1482489 - RNA, 17 nt, Homo sapiens
aaaaagcccuuugcuaa

SEQ ID NO: 1482490 - RNA, 20 nt, Homo sapiens
aaaaagccugguuuuucuca

SEQ ID NO: 1482491 - RNA, 15 nt, Homo sapiens
aaaaaggacucugcu

SEQ ID NO: 1482492 - RNA, 16 nt, Homo sapiens
aaaaaguuaaacauug

SEQ ID NO: 1482493 - RNA, 11 nt, Homo sapiens
aaaaauacuuu

SEQ ID NO: 1482494 - RNA, 19 nt, Homo sapiens
aaaaauagacuuaaaucuc

SEQ ID NO: 1482495 - RNA, 16 nt, Homo sapiens
aaaaauagcaaugccu

SEQ ID NO: 1482496 - RNA, 13 nt, Homo sapiens
aaaaauauuauaa

SEQ ID NO: 1482497 - RNA, 20 nt, Homo sapiens
aauuuucauuaaacuugaag

SEQ ID NO: 1482498 - RNA, 18 nt, Homo sapiens
aauuuucauucauucacu

SEQ ID NO: 1482499 - RNA, 17 nt, Homo sapiens
aauuuugaguugccaca

SEQ ID NO: 1482500 - RNA, 21 nt, Homo sapiens
aauuuugccauaaagucaaau

SEQ ID NO: 1482501 - RNA, 14 nt, Homo sapiens
aauuuuuaauugaa

SEQ ID NO: 1482502 - RNA, 14 nt, Homo sapiens
aauuuuuaggcaaa

SEQ ID NO: 1482503 - RNA, 22 nt, Homo sapiens
aauuuuugaaaaaaguacauau

SEQ ID NO: 1482504 - RNA, 15 nt, Homo sapiens
aauuuuugucucaga

SEQ ID NO: 1482505 - RNA, 21 nt, Homo sapiens
aauuuuuuaaaguuacuuugu

SEQ ID NO: 1482506 - RNA, 16 nt, Homo sapiens
acaaaaagcuucccca

SEQ ID NO: 1482507 - RNA, 22 nt, Homo sapiens
acaaaaaugaaagcaugucuca

SEQ ID NO: 1482508 - RNA, 13 nt, Homo sapiens
acaaaacccacug

SEQ ID NO: 1482509 - RNA, 11 nt, Homo sapiens
acaaaacuaca

SEQ ID NO: 1482510 - RNA, 22 nt, Homo sapiens
acaaaacugacaguaaaucuca

SEQ ID NO: 1482511 - RNA, 11 nt, Homo sapiens
acaaaagcuau

SEQ ID NO: 1482512 - RNA, 22 nt, Homo sapiens
acaaaaggaaaggucucagcuu

SEQ ID NO: 1482513 - RNA, 12 nt, Homo sapiens
acaaaagucugu

SEQ ID NO: 1482514 - RNA, 16 nt, Homo sapiens
acaaaauggucaucca

SEQ ID NO: 1482515 - RNA, 21 nt, Homo sapiens
acaaaauggucauccaaacuc

SEQ ID NO: 1482516 - RNA, 14 nt, Homo sapiens
acaaacccaagggc

SEQ ID NO: 1482517 - RNA, 12 nt, Homo sapiens
acaaacugcaau

SEQ ID NO: 1482518 - RNA, 14 nt, Homo sapiens
acaaagaaauauua

SEQ ID NO: 1482519 - RNA, 16 nt, Homo sapiens
acaaagcagauccuca

SEQ ID NO: 1482520 - RNA, 19 nt, Homo sapiens
acaaagcaguuacuaauau

SEQ ID NO: 1482521 - RNA, 13 nt, Homo sapiens
acaaagcuucuau

SEQ ID NO: 1482522 - RNA, 22 nt, Homo sapiens
acaaaggaguaguagcugaauu

SEQ ID NO: 1482523 - RNA, 14 nt, Homo sapiens
acaaaguauuugcu

SEQ ID NO: 1482524 - RNA, 13 nt, Homo sapiens
acaaaguguauac

SEQ ID NO: 1482525 - RNA, 19 nt, Homo sapiens
acaaauaaagugcaguuua

SEQ ID NO: 1482526 - RNA, 12 nt, Homo sapiens
acaaauaugcaa

SEQ ID NO: 1482527 - RNA, 16 nt, Homo sapiens
acaaaugaugccaugg

SEQ ID NO: 1482528 - RNA, 17 nt, Homo sapiens
acaaauuaauuuuacuc

SEQ ID NO: 1482529 - RNA, 13 nt, Homo sapiens
acaacaaccuaug

SEQ ID NO: 1482530 - RNA, 15 nt, Homo sapiens
acaacacaauaacac

SEQ ID NO: 1482531 - RNA, 19 nt, Homo sapiens
acaacauccuuaagucaaa

SEQ ID NO: 1482532 - RNA, 11 nt, Homo sapiens
acaacauuaag

SEQ ID NO: 1482533 - RNA, 16 nt, Homo sapiens
acaaccaaaaaauucu

SEQ ID NO: 1482534 - RNA, 13 nt, Homo sapiens
acaaccuaugcac

SEQ ID NO: 1482535 - RNA, 14 nt, Homo sapiens
acaaccuuccagcu

SEQ ID NO: 1482536 - RNA, 22 nt, Homo sapiens
acaacgccugucacagaguaga

SEQ ID NO: 1482537 - RNA, 18 nt, Homo sapiens
acaacuaagugauuugua

SEQ ID NO: 1482538 - RNA, 14 nt, Homo sapiens
acaacucuagucag

SEQ ID NO: 1482539 - RNA, 13 nt, Homo sapiens
acaacugauugca

SEQ ID NO: 1482540 - RNA, 17 nt, Homo sapiens
acaacugucuaacuuua

SEQ ID NO: 1482541 - RNA, 13 nt, Homo sapiens
acaacugugacug

SEQ ID NO: 1482542 - RNA, 21 nt, Homo sapiens
acaacuucaguccaacuguca

SEQ ID NO: 1482543 - RNA, 14 nt, Homo sapiens
acaagauaccggug

SEQ ID NO: 1482544 - RNA, 14 nt, Homo sapiens
acaagauugcuuaa

SEQ ID NO: 1482545 - RNA, 19 nt, Homo sapiens
acaagcgaaucucugccuu

SEQ ID NO: 1482546 - RNA, 18 nt, Homo sapiens
acaaggauagaugcuggc

SEQ ID NO: 1482547 - RNA, 20 nt, Homo sapiens
acaagguucccucugagaau

SEQ ID NO: 1482548 - RNA, 12 nt, Homo sapiens
acaagucuucca

SEQ ID NO: 1482549 - RNA, 19 nt, Homo sapiens
acaagugcuguugggauau

SEQ ID NO: 1482550 - RNA, 16 nt, Homo sapiens
acaaguuggaauucac

SEQ ID NO: 1482551 - RNA, 13 nt, Homo sapiens
acaauaaauuauu

SEQ ID NO: 1482552 - RNA, 15 nt, Homo sapiens
acaauaacacugucu

SEQ ID NO: 1482553 - RNA, 18 nt, Homo sapiens
acaauacagauaacauua

SEQ ID NO: 1482554 - RNA, 21 nt, Homo sapiens
acaauaggugcuuauucucaa

SEQ ID NO: 1482555 - RNA, 16 nt, Homo sapiens
acaaucaacaaaaugg

SEQ ID NO: 1482556 - RNA, 19 nt, Homo sapiens
acaaucaugaaauaugcau

SEQ ID NO: 1482557 - RNA, 16 nt, Homo sapiens
acaauccaucucucaa

SEQ ID NO: 1482558 - RNA, 23 nt, Homo sapiens
acaauccaucucucaaguagugu

SEQ ID NO: 1482559 - RNA, 20 nt, Homo sapiens
acaaucugaaucccuugcaa

SEQ ID NO: 1482560 - RNA, 19 nt, Homo sapiens
acaaugcagcaaggcccug

SEQ ID NO: 1482561 - RNA, 21 nt, Homo sapiens
acaaugccuuugaugaacugu

SEQ ID NO: 1482562 - RNA, 15 nt, Homo sapiens
acaaugcugagguua

SEQ ID NO: 1482563 - RNA, 15 nt, Homo sapiens
acaauuauuggcaaa

SEQ ID NO: 1482564 - RNA, 16 nt, Homo sapiens
acaauuugauacauaa

SEQ ID NO: 1482565 - RNA, 17 nt, Homo sapiens
acacaaaaauuagccag

SEQ ID NO: 1482566 - RNA, 18 nt, Homo sapiens
acacaaagacauugauuc

SEQ ID NO: 1482567 - RNA, 13 nt, Homo sapiens
acacaaagcacau

SEQ ID NO: 1482568 - RNA, 17 nt, Homo sapiens
acacaaaggaaguccaa

SEQ ID NO: 1482569 - RNA, 23 nt, Homo sapiens
acacaaaggaaguccaaccugag

SEQ ID NO: 1482570 - RNA, 19 nt, Homo sapiens
acacaaaguguauacaugu

SEQ ID NO: 1482571 - RNA, 13 nt, Homo sapiens
acacaagcacuuu

SEQ ID NO: 1482572 - RNA, 13 nt, Homo sapiens
acacacacacucc

SEQ ID NO: 1482573 - RNA, 15 nt, Homo sapiens
acacacacagguggg

SEQ ID NO: 1482574 - RNA, 14 nt, Homo sapiens
acacacacaucuca

SEQ ID NO: 1482575 - RNA, 22 nt, Homo sapiens
acacacacucuacccuauacaa

SEQ ID NO: 1482576 - RNA, 13 nt, Homo sapiens
acacacagcacuc

SEQ ID NO: 1482577 - RNA, 13 nt, Homo sapiens
acacacgcuuucu

SEQ ID NO: 1482578 - RNA, 20 nt, Homo sapiens
acacacgugagcaacugugc

SEQ ID NO: 1482579 - RNA, 14 nt, Homo sapiens
acacagcacucucu

SEQ ID NO: 1482580 - RNA, 15 nt, Homo sapiens
acacagcagcaguua

SEQ ID NO: 1482581 - RNA, 11 nt, Homo sapiens
acacagcugcc

SEQ ID NO: 1482582 - RNA, 20 nt, Homo sapiens
acacagguggggacugggca

SEQ ID NO: 1482583 - RNA, 23 nt, Homo sapiens
acacaguguuggagguuaaggca

SEQ ID NO: 1482584 - RNA, 19 nt, Homo sapiens
acacauugaaugcgcuuua

SEQ ID NO: 1482585 - RNA, 21 nt, Homo sapiens
acacauugaaugcgcuuuauu

SEQ ID NO: 1482586 - RNA, 13 nt, Homo sapiens
acaccaggcugug

SEQ ID NO: 1482587 - RNA, 14 nt, Homo sapiens
acaccauauacugu

SEQ ID NO: 1482588 - RNA, 22 nt, Homo sapiens
acaccaucaggccgcauccuga

SEQ ID NO: 1482589 - RNA, 17 nt, Homo sapiens
acacccacccugugcca

SEQ ID NO: 1482590 - RNA, 17 nt, Homo sapiens
acaccccucccugccac

SEQ ID NO: 1482591 - RNA, 19 nt, Homo sapiens
acaccggcuuaacacuauc

SEQ ID NO: 1482592 - RNA, 20 nt, Homo sapiens
acaccguacaucugcaauau

SEQ ID NO: 1482593 - RNA, 15 nt, Homo sapiens
acaccuagcuuuauu

SEQ ID NO: 1482594 - RNA, 14 nt, Homo sapiens
acaccuauugcacu

SEQ ID NO: 1482595 - RNA, 17 nt, Homo sapiens
acaccuggaugucuggg

SEQ ID NO: 1482596 - RNA, 22 nt, Homo sapiens
acaccuuuuccccaaccacaga

SEQ ID NO: 1482597 - RNA, 23 nt, Homo sapiens
acacggccuggggcgagcacugu

SEQ ID NO: 1482598 - RNA, 15 nt, Homo sapiens
acacggggcaguggc

SEQ ID NO: 1482599 - RNA, 18 nt, Homo sapiens
acacguacaaaauccagc

SEQ ID NO: 1482600 - RNA, 13 nt, Homo sapiens
acccccagcacuu

SEQ ID NO: 1482601 - RNA, 16 nt, Homo sapiens
acccccaucuuuacaa

SEQ ID NO: 1482602 - RNA, 21 nt, Homo sapiens
acccccaucuuuacaaagaaa

SEQ ID NO: 1482603 - RNA, 23 nt, Homo sapiens
accccggugugccuguggaggaa

SEQ ID NO: 1482604 - RNA, 20 nt, Homo sapiens
accccuacacacacacuccc

SEQ ID NO: 1482605 - RNA, 12 nt, Homo sapiens
accccucuggcc

SEQ ID NO: 1482606 - RNA, 20 nt, Homo sapiens
accccugagauccggcaaca

SEQ ID NO: 1482607 - RNA, 23 nt, Homo sapiens
accccugcccccagccccggggu

SEQ ID NO: 1482608 - RNA, 17 nt, Homo sapiens
accccugcuauauacua

SEQ ID NO: 1482609 - RNA, 14 nt, Homo sapiens
accccugucccaac

SEQ ID NO: 1482610 - RNA, 15 nt, Homo sapiens
accccugucccaugc

SEQ ID NO: 1482611 - RNA, 13 nt, Homo sapiens
accccuuugcacu

SEQ ID NO: 1482612 - RNA, 21 nt, Homo sapiens
acccuaagccuccuuuugcuu

SEQ ID NO: 1482613 - RNA, 17 nt, Homo sapiens
acccuaguuucccugaa

SEQ ID NO: 1482614 - RNA, 21 nt, Homo sapiens
acccuccacucagcuguccug

SEQ ID NO: 1482615 - RNA, 18 nt, Homo sapiens
acccucucucugaucucc

SEQ ID NO: 1482616 - RNA, 19 nt, Homo sapiens
acccugaaggggccaugau

SEQ ID NO: 1482617 - RNA, 18 nt, Homo sapiens
acccugcuacacauacag

SEQ ID NO: 1482618 - RNA, 15 nt, Homo sapiens
acccugcugaccucc

SEQ ID NO: 1482619 - RNA, 16 nt, Homo sapiens
acccugcuucaaauau

SEQ ID NO: 1482620 - RNA, 17 nt, Homo sapiens
acccugggagacagacc

SEQ ID NO: 1482621 - RNA, 12 nt, Homo sapiens
acccuguaccuc

SEQ ID NO: 1482622 - RNA, 19 nt, Homo sapiens
acccuguagguucuugaua

SEQ ID NO: 1482623 - RNA, 19 nt, Homo sapiens
acccugucuaaaaaacaua

SEQ ID NO: 1482624 - RNA, 16 nt, Homo sapiens
acccugucucuacuaa

SEQ ID NO: 1482625 - RNA, 22 nt, Homo sapiens
acccuguuuuaccguugcuaag

SEQ ID NO: 1482626 - RNA, 18 nt, Homo sapiens
acccuucaucuuccugug

SEQ ID NO: 1482627 - RNA, 15 nt, Homo sapiens
acccuugaaccaaua

SEQ ID NO: 1482628 - RNA, 21 nt, Homo sapiens
acccuugacaccugcugagaa

SEQ ID NO: 1482629 - RNA, 16 nt, Homo sapiens
acccuuggacaagaca

SEQ ID NO: 1482630 - RNA, 18 nt, Homo sapiens
acccuuggacaagacaaa

SEQ ID NO: 1482631 - RNA, 14 nt, Homo sapiens
accgacuagccagg

SEQ ID NO: 1482632 - RNA, 13 nt, Homo sapiens
accgagcaauuuu

SEQ ID NO: 1482633 - RNA, 17 nt, Homo sapiens
accgagucuugcucugu

SEQ ID NO: 1482634 - RNA, 18 nt, Homo sapiens
accgagucuugcucuguu

SEQ ID NO: 1482635 - RNA, 20 nt, Homo sapiens
accgagucuugcucuguuac

SEQ ID NO: 1482636 - RNA, 13 nt, Homo sapiens
accgauaaugcau

SEQ ID NO: 1482637 - RNA, 16 nt, Homo sapiens
accgcaaggagcaaac

SEQ ID NO: 1482638 - RNA, 18 nt, Homo sapiens
accgccacgucccagcau

SEQ ID NO: 1482639 - RNA, 18 nt, Homo sapiens
accgcugauaagcauuga

SEQ ID NO: 1482640 - RNA, 18 nt, Homo sapiens
accggcuggcagggcugg

SEQ ID NO: 1482641 - RNA, 18 nt, Homo sapiens
accggggccagcaccacu

SEQ ID NO: 1482642 - RNA, 20 nt, Homo sapiens
accguggacaggcccagcgc

SEQ ID NO: 1482643 - RNA, 18 nt, Homo sapiens
accguguaccucaguucc

SEQ ID NO: 1482644 - RNA, 14 nt, Homo sapiens
accguucugugcac

SEQ ID NO: 1482645 - RNA, 15 nt, Homo sapiens
accguucugugcaca

SEQ ID NO: 1482646 - RNA, 14 nt, Homo sapiens
accguuguuugcaa

SEQ ID NO: 1482647 - RNA, 23 nt, Homo sapiens
accuaaaaggaaaucucacccca

SEQ ID NO: 1482648 - RNA, 19 nt, Homo sapiens
accuaaaauaauugguucu

SEQ ID NO: 1482649 - RNA, 17 nt, Homo sapiens
accuaauucgaugaagg

SEQ ID NO: 1482650 - RNA, 15 nt, Homo sapiens
accuacacacuguca

SEQ ID NO: 1482651 - RNA, 21 nt, Homo sapiens
accuacccuccacaggcacag

SEQ ID NO: 1482652 - RNA, 13 nt, Homo sapiens
accuacgugccac

SEQ ID NO: 1482653 - RNA, 14 nt, Homo sapiens
accuacgugccacu

SEQ ID NO: 1482654 - RNA, 20 nt, Homo sapiens
accuagcuuuauucuucaga

SEQ ID NO: 1482655 - RNA, 13 nt, Homo sapiens
accuaggauuuca

SEQ ID NO: 1482656 - RNA, 21 nt, Homo sapiens
accuauuuuuuucucuauucu

SEQ ID NO: 1482657 - RNA, 18 nt, Homo sapiens
accucaaacuuccaguca

SEQ ID NO: 1482658 - RNA, 12 nt, Homo sapiens
accucaagccau

SEQ ID NO: 1482659 - RNA, 12 nt, Homo sapiens
accucacuguga

SEQ ID NO: 1482660 - RNA, 12 nt, Homo sapiens
accucacuuuag

SEQ ID NO: 1482661 - RNA, 12 nt, Homo sapiens
accucagccucc

SEQ ID NO: 1482662 - RNA, 12 nt, Homo sapiens
accucaggugau

SEQ ID NO: 1482663 - RNA, 22 nt, Homo sapiens
accucagguugaaauaccaggg

SEQ ID NO: 1482664 - RNA, 17 nt, Homo sapiens
accucagugucauuuau

SEQ ID NO: 1482665 - RNA, 20 nt, Homo sapiens
accucaguucccucuugcuc

SEQ ID NO: 1482666 - RNA, 22 nt, Homo sapiens
accucaguuuuaucauuuucaa

SEQ ID NO: 1482667 - RNA, 22 nt, Homo sapiens
accucauaucaguuugcuagca

SEQ ID NO: 1482668 - RNA, 15 nt, Homo sapiens
accucaucccaugag

SEQ ID NO: 1482669 - RNA, 22 nt, Homo sapiens
accucccaggcucaagcugucc

SEQ ID NO: 1482670 - RNA, 19 nt, Homo sapiens
accuccgccagauccugca

SEQ ID NO: 1482671 - RNA, 11 nt, Homo sapiens
accuccucaug

SEQ ID NO: 1482672 - RNA, 16 nt, Homo sapiens
accuccuccucuggac

SEQ ID NO: 1482673 - RNA, 13 nt, Homo sapiens
accuccucuccac

SEQ ID NO: 1482674 - RNA, 15 nt, Homo sapiens
accuccuugcacaaa

SEQ ID NO: 1482675 - RNA, 18 nt, Homo sapiens
accuccuuggguagugag

SEQ ID NO: 1482676 - RNA, 19 nt, Homo sapiens
accucggccucccaaagug

SEQ ID NO: 1482677 - RNA, 22 nt, Homo sapiens
accucgggaaacuuagaucauc

SEQ ID NO: 1482678 - RNA, 13 nt, Homo sapiens
accucgugaucca

SEQ ID NO: 1482679 - RNA, 12 nt, Homo sapiens
accucucagggc

SEQ ID NO: 1482680 - RNA, 13 nt, Homo sapiens
accucucauaaau

SEQ ID NO: 1482681 - RNA, 19 nt, Homo sapiens
accucucuccuuugcugag

SEQ ID NO: 1482682 - RNA, 19 nt, Homo sapiens
accucugggucaucucuca

SEQ ID NO: 1482683 - RNA, 22 nt, Homo sapiens
accucugucauuuguugugaug

SEQ ID NO: 1482684 - RNA, 14 nt, Homo sapiens
accucuguggugug

SEQ ID NO: 1482685 - RNA, 19 nt, Homo sapiens
accucuucaugagcuugaa

SEQ ID NO: 1482686 - RNA, 20 nt, Homo sapiens
accugaaauuuauucacaua

SEQ ID NO: 1482687 - RNA, 13 nt, Homo sapiens
accugaagacacc

SEQ ID NO: 1482688 - RNA, 12 nt, Homo sapiens
accugagcauga

SEQ ID NO: 1482689 - RNA, 22 nt, Homo sapiens
accugauggaaguaaagccuca

SEQ ID NO: 1482690 - RNA, 17 nt, Homo sapiens
accugcaugugcuguca

SEQ ID NO: 1482691 - RNA, 13 nt, Homo sapiens
accugcauugaac

SEQ ID NO: 1482692 - RNA, 21 nt, Homo sapiens
accugcccaaggaugcuguca

SEQ ID NO: 1482693 - RNA, 19 nt, Homo sapiens
accugccccccagccuuca

SEQ ID NO: 1482694 - RNA, 21 nt, Homo sapiens
accugcgcucucagcugacca

SEQ ID NO: 1482695 - RNA, 16 nt, Homo sapiens
accugcuuagcugccu

SEQ ID NO: 1482696 - RNA, 19 nt, Homo sapiens
accuggaggacagcuggac

SEQ ID NO: 1482697 - RNA, 23 nt, Homo sapiens
accuggcauuccuucugaccaca

SEQ ID NO: 1482698 - RNA, 14 nt, Homo sapiens
accuggcuuuuacu

SEQ ID NO: 1482699 - RNA, 16 nt, Homo sapiens
accuggggagagccug

SEQ ID NO: 1482700 - RNA, 23 nt, Homo sapiens
accuggggauccaauugauguau

SEQ ID NO: 1482701 - RNA, 18 nt, Homo sapiens
accuguaaagugccuuac

SEQ ID NO: 1482702 - RNA, 19 nt, Homo sapiens
accuguagccaucugcaca

SEQ ID NO: 1482703 - RNA, 18 nt, Homo sapiens
acugcgaucuucagagca

SEQ ID NO: 1482704 - RNA, 15 nt, Homo sapiens
acugcuaaauccuca

SEQ ID NO: 1482705 - RNA, 22 nt, Homo sapiens
acugcuacagcaauuucuaauu

SEQ ID NO: 1482706 - RNA, 22 nt, Homo sapiens
acugcuccauuuauaaccccag

SEQ ID NO: 1482707 - RNA, 19 nt, Homo sapiens
acugcucccaucauuccuu

SEQ ID NO: 1482708 - RNA, 12 nt, Homo sapiens
acugcuggugcc

SEQ ID NO: 1482709 - RNA, 18 nt, Homo sapiens
acugcuuaauucaaauaa

SEQ ID NO: 1482710 - RNA, 17 nt, Homo sapiens
acugcuucuccaaggac

SEQ ID NO: 1482711 - RNA, 13 nt, Homo sapiens
acuggacccuguu

SEQ ID NO: 1482712 - RNA, 17 nt, Homo sapiens
acuggagcucaucugca

SEQ ID NO: 1482713 - RNA, 14 nt, Homo sapiens
acuggaggugggca

SEQ ID NO: 1482714 - RNA, 11 nt, Homo sapiens
acuggagucag

SEQ ID NO: 1482715 - RNA, 21 nt, Homo sapiens
acuggauggaaagacaaacug

SEQ ID NO: 1482716 - RNA, 16 nt, Homo sapiens
acuggauucauucuca

SEQ ID NO: 1482717 - RNA, 22 nt, Homo sapiens
acuggcaaacauuuuuccagua

SEQ ID NO: 1482718 - RNA, 20 nt, Homo sapiens
acuggggagucuuuguggau

SEQ ID NO: 1482719 - RNA, 20 nt, Homo sapiens
acuggggcuggccccagcca

SEQ ID NO: 1482720 - RNA, 19 nt, Homo sapiens
acugggugcggugacucau

SEQ ID NO: 1482721 - RNA, 18 nt, Homo sapiens
acugggugguccaaagaa

SEQ ID NO: 1482722 - RNA, 16 nt, Homo sapiens
acugggugucauuuca

SEQ ID NO: 1482723 - RNA, 17 nt, Homo sapiens
acugguagguugggaca

SEQ ID NO: 1482724 - RNA, 22 nt, Homo sapiens
acuguaaauaugaaucugcuca

SEQ ID NO: 1482725 - RNA, 17 nt, Homo sapiens
acuguaacugacugccu

SEQ ID NO: 1482726 - RNA, 14 nt, Homo sapiens
acuguaagggauug

SEQ ID NO: 1482727 - RNA, 13 nt, Homo sapiens
acuguacuccucc

SEQ ID NO: 1482728 - RNA, 23 nt, Homo sapiens
acuguacuuguagaguggugcug

SEQ ID NO: 1482729 - RNA, 19 nt, Homo sapiens
acuguauggaaacacugau

SEQ ID NO: 1482730 - RNA, 16 nt, Homo sapiens
acuguauucgugcauu

SEQ ID NO: 1482731 - RNA, 24 nt, Homo sapiens
acuguccagagagcaacucugaga

SEQ ID NO: 1482732 - RNA, 21 nt, Homo sapiens
acuguccuaccaguugcccua

SEQ ID NO: 1482733 - RNA, 14 nt, Homo sapiens
acugucuuccucaa

SEQ ID NO: 1482734 - RNA, 15 nt, Homo sapiens
acugucuuccucaaa

SEQ ID NO: 1482735 - RNA, 12 nt, Homo sapiens
acugucuuucag

SEQ ID NO: 1482736 - RNA, 21 nt, Homo sapiens
acugucuuucagauacauggu

SEQ ID NO: 1482737 - RNA, 13 nt, Homo sapiens
acugugaaacugg

SEQ ID NO: 1482738 - RNA, 12 nt, Homo sapiens
acugugacugua

SEQ ID NO: 1482739 - RNA, 23 nt, Homo sapiens
acugugagcaaggagcacaagcc

SEQ ID NO: 1482740 - RNA, 14 nt, Homo sapiens
acugugccacaaug

SEQ ID NO: 1482741 - RNA, 11 nt, Homo sapiens
acugugcugaa

SEQ ID NO: 1482742 - RNA, 11 nt, Homo sapiens
acugugucagg

SEQ ID NO: 1482743 - RNA, 18 nt, Homo sapiens
acuguguuuaucuugaua

SEQ ID NO: 1482744 - RNA, 17 nt, Homo sapiens
acuguguuucaaguuca

SEQ ID NO: 1482745 - RNA, 17 nt, Homo sapiens
acuguuaacuaugacag

SEQ ID NO: 1482746 - RNA, 16 nt, Homo sapiens
acuguuaggaacagca

SEQ ID NO: 1482747 - RNA, 20 nt, Homo sapiens
acuguuagucauuugcugag

SEQ ID NO: 1482748 - RNA, 18 nt, Homo sapiens
acuguuccaaagccagug

SEQ ID NO: 1482749 - RNA, 19 nt, Homo sapiens
acuguuccaaagccaguga

SEQ ID NO: 1482750 - RNA, 20 nt, Homo sapiens
acuguuccaaagccagugaa

SEQ ID NO: 1482751 - RNA, 22 nt, Homo sapiens
acuguugguauuauauaauuca

SEQ ID NO: 1482752 - RNA, 16 nt, Homo sapiens
acuguuuuuaaguaac

SEQ ID NO: 1482753 - RNA, 17 nt, Homo sapiens
acuuaaaaaaaugacag

SEQ ID NO: 1482754 - RNA, 16 nt, Homo sapiens
acuuaaaaauauccau

SEQ ID NO: 1482755 - RNA, 21 nt, Homo sapiens
acuuaaauaauaaacagugga

SEQ ID NO: 1482756 - RNA, 18 nt, Homo sapiens
acuuaaguacccuuucaa

SEQ ID NO: 1482757 - RNA, 21 nt, Homo sapiens
acuuaauguuugguaacuuuu

SEQ ID NO: 1482758 - RNA, 18 nt, Homo sapiens
acuuaccuagauuuacag

SEQ ID NO: 1482759 - RNA, 23 nt, Homo sapiens
acuuagaucaucagucaccgaag

SEQ ID NO: 1482760 - RNA, 23 nt, Homo sapiens
acuuaguccuuuaucauccuuaa

SEQ ID NO: 1482761 - RNA, 18 nt, Homo sapiens
acuuagucuguacuucau

SEQ ID NO: 1482762 - RNA, 18 nt, Homo sapiens
acuuauaguacaugauaa

SEQ ID NO: 1482763 - RNA, 18 nt, Homo sapiens
acuuauauugaagacaau

SEQ ID NO: 1482764 - RNA, 13 nt, Homo sapiens
acuuaugccauag

SEQ ID NO: 1482765 - RNA, 12 nt, Homo sapiens
acuuauuacaau

SEQ ID NO: 1482766 - RNA, 15 nt, Homo sapiens
acuuauugccaaaaa

SEQ ID NO: 1482767 - RNA, 13 nt, Homo sapiens
acuucaagugacc

SEQ ID NO: 1482768 - RNA, 20 nt, Homo sapiens
acuucaaguuaaagugaaua

SEQ ID NO: 1482769 - RNA, 19 nt, Homo sapiens
acuucacagcccugcagug

SEQ ID NO: 1482770 - RNA, 20 nt, Homo sapiens
acuucaccuacauuaucuca

SEQ ID NO: 1482771 - RNA, 22 nt, Homo sapiens
acuucaguuuuauuuuugccaa

SEQ ID NO: 1482772 - RNA, 18 nt, Homo sapiens
acuucauacuggcaggag

SEQ ID NO: 1482773 - RNA, 11 nt, Homo sapiens
acuucaucugg

SEQ ID NO: 1482774 - RNA, 12 nt, Homo sapiens
acuucauucucg

SEQ ID NO: 1482775 - RNA, 19 nt, Homo sapiens
acuucauucucgugaguca

SEQ ID NO: 1482776 - RNA, 19 nt, Homo sapiens
acuucauuugaugcuaaau

SEQ ID NO: 1482777 - RNA, 19 nt, Homo sapiens
acuuccaagacaagauacc

SEQ ID NO: 1482778 - RNA, 13 nt, Homo sapiens
acuuccacuuugu

SEQ ID NO: 1482779 - RNA, 19 nt, Homo sapiens
acuuccaggggaaccugcc

SEQ ID NO: 1482780 - RNA, 20 nt, Homo sapiens
acuuccaggggaaccugcca

SEQ ID NO: 1482781 - RNA, 13 nt, Homo sapiens
acuuccauuugcu

SEQ ID NO: 1482782 - RNA, 15 nt, Homo sapiens
acuucccuuaagagu

SEQ ID NO: 1482783 - RNA, 14 nt, Homo sapiens
acuuccuacuguag

SEQ ID NO: 1482784 - RNA, 14 nt, Homo sapiens
acuuccucagucug

SEQ ID NO: 1482785 - RNA, 23 nt, Homo sapiens
acuuccucagucuggugcuccag

SEQ ID NO: 1482786 - RNA, 13 nt, Homo sapiens
acuuccugcagua

SEQ ID NO: 1482787 - RNA, 16 nt, Homo sapiens
acuucgaaaccuggga

SEQ ID NO: 1482788 - RNA, 14 nt, Homo sapiens
acuucgagcacugu

SEQ ID NO: 1482789 - RNA, 23 nt, Homo sapiens
acuucuagacucaccuguucuca

SEQ ID NO: 1482790 - RNA, 14 nt, Homo sapiens
acuucucaagauac

SEQ ID NO: 1482791 - RNA, 16 nt, Homo sapiens
acuucuccaggucuca

SEQ ID NO: 1482792 - RNA, 15 nt, Homo sapiens
acuucugacucuucc

SEQ ID NO: 1482793 - RNA, 14 nt, Homo sapiens
acuucugcagcuau

SEQ ID NO: 1482794 - RNA, 13 nt, Homo sapiens
acuucugcucugg

SEQ ID NO: 1482795 - RNA, 15 nt, Homo sapiens
acuucuggcuccuca

SEQ ID NO: 1482796 - RNA, 18 nt, Homo sapiens
acuucuuauacauuugau

SEQ ID NO: 1482797 - RNA, 22 nt, Homo sapiens
acuugaaacagauucaggccag

SEQ ID NO: 1482798 - RNA, 16 nt, Homo sapiens
acuugaauauguagcu

SEQ ID NO: 1482799 - RNA, 13 nt, Homo sapiens
acuugaauuucaa

SEQ ID NO: 1482800 - RNA, 16 nt, Homo sapiens
acuugacagacaaaga

SEQ ID NO: 1482801 - RNA, 18 nt, Homo sapiens
acuugaccuaaacuucua

SEQ ID NO: 1482802 - RNA, 18 nt, Homo sapiens
acuugaguuuuggcaagg

SEQ ID NO: 1482803 - RNA, 15 nt, Homo sapiens
acuugaugauacaau

SEQ ID NO: 1482804 - RNA, 14 nt, Homo sapiens
acuugccuucugau

SEQ ID NO: 1482805 - RNA, 10 nt, Homo sapiens
acuugcugag

SEQ ID NO: 1482806 - RNA, 18 nt, Homo sapiens
agcagagugcacagcugu

SEQ ID NO: 1482807 - RNA, 18 nt, Homo sapiens
agcagauggaaugcugug

SEQ ID NO: 1482808 - RNA, 21 nt, Homo sapiens
agcagauggacagcgaugagg

SEQ ID NO: 1482809 - RNA, 13 nt, Homo sapiens
agcagauuuaaca

SEQ ID NO: 1482810 - RNA, 18 nt, Homo sapiens
agcagcccuaaggaucuc

SEQ ID NO: 1482811 - RNA, 14 nt, Homo sapiens
agcagcgccaguga

SEQ ID NO: 1482812 - RNA, 15 nt, Homo sapiens
agcagcugguggaag

SEQ ID NO: 1482813 - RNA, 19 nt, Homo sapiens
agcagcuuuaaacucaggg

SEQ ID NO: 1482814 - RNA, 18 nt, Homo sapiens
agcagcuuugggauccca

SEQ ID NO: 1482815 - RNA, 15 nt, Homo sapiens
agcaggaaaccugug

SEQ ID NO: 1482816 - RNA, 18 nt, Homo sapiens
agcaggaaccccaggaga

SEQ ID NO: 1482817 - RNA, 19 nt, Homo sapiens
agcaggacuuugaggcaag

SEQ ID NO: 1482818 - RNA, 18 nt, Homo sapiens
agcaggagagacugagca

SEQ ID NO: 1482819 - RNA, 23 nt, Homo sapiens
agcaggaggccaauaaaaaguuc

SEQ ID NO: 1482820 - RNA, 19 nt, Homo sapiens
agcaggcagcgccaagugc

SEQ ID NO: 1482821 - RNA, 22 nt, Homo sapiens
agcaggcagcuucuacuccugc

SEQ ID NO: 1482822 - RNA, 11 nt, Homo sapiens
agcaggcaugg

SEQ ID NO: 1482823 - RNA, 16 nt, Homo sapiens
agcaggggaggugagg

SEQ ID NO: 1482824 - RNA, 17 nt, Homo sapiens
agcaguaaauuugcuag

SEQ ID NO: 1482825 - RNA, 15 nt, Homo sapiens
agcagucaauacaaa

SEQ ID NO: 1482826 - RNA, 16 nt, Homo sapiens
agcagucaauacaaau

SEQ ID NO: 1482827 - RNA, 22 nt, Homo sapiens
agcagucacacuguuacuccac

SEQ ID NO: 1482828 - RNA, 19 nt, Homo sapiens
agcagucccaguauucuca

SEQ ID NO: 1482829 - RNA, 15 nt, Homo sapiens
agcagucgccugccu

SEQ ID NO: 1482830 - RNA, 16 nt, Homo sapiens
agcagugaucucaggg

SEQ ID NO: 1482831 - RNA, 18 nt, Homo sapiens
agcagugaucucagggca

SEQ ID NO: 1482832 - RNA, 13 nt, Homo sapiens
agcagugccucuu

SEQ ID NO: 1482833 - RNA, 17 nt, Homo sapiens
agcagugccuuccauaa

SEQ ID NO: 1482834 - RNA, 14 nt, Homo sapiens
agcaguguucucac

SEQ ID NO: 1482835 - RNA, 22 nt, Homo sapiens
agcaguuacaaaaaccuucccc

SEQ ID NO: 1482836 - RNA, 22 nt, Homo sapiens
agcaguuuaugagacagcugag

SEQ ID NO: 1482837 - RNA, 15 nt, Homo sapiens
agcauaaaucacuuc

SEQ ID NO: 1482838 - RNA, 13 nt, Homo sapiens
agcauaacaccaa

SEQ ID NO: 1482839 - RNA, 13 nt, Homo sapiens
agcauauggaauu

SEQ ID NO: 1482840 - RNA, 12 nt, Homo sapiens
agcaucucagga

SEQ ID NO: 1482841 - RNA, 13 nt, Homo sapiens
agcaucugugaug

SEQ ID NO: 1482842 - RNA, 14 nt, Homo sapiens
agcaugaaagugga

SEQ ID NO: 1482843 - RNA, 17 nt, Homo sapiens
agcaugaagacccugga

SEQ ID NO: 1482844 - RNA, 16 nt, Homo sapiens
agcaugaauccagucc

SEQ ID NO: 1482845 - RNA, 13 nt, Homo sapiens
agcaugagacuuu

SEQ ID NO: 1482846 - RNA, 16 nt, Homo sapiens
agcaugccuucaaauc

SEQ ID NO: 1482847 - RNA, 17 nt, Homo sapiens
agcauggccccagucca

SEQ ID NO: 1482848 - RNA, 20 nt, Homo sapiens
agcaugugccuuaaugcuuc

SEQ ID NO: 1482849 - RNA, 22 nt, Homo sapiens
agcauguggaugacacaauccc

SEQ ID NO: 1482850 - RNA, 21 nt, Homo sapiens
agcauguggucuuauaguguu

SEQ ID NO: 1482851 - RNA, 15 nt, Homo sapiens
agcauguguauuucc

SEQ ID NO: 1482852 - RNA, 18 nt, Homo sapiens
agcauuagucacuuugaa

SEQ ID NO: 1482853 - RNA, 23 nt, Homo sapiens
agcauuccuucuuugauaauguu

SEQ ID NO: 1482854 - RNA, 20 nt, Homo sapiens
agcauucuugucacaauaaa

SEQ ID NO: 1482855 - RNA, 13 nt, Homo sapiens
agcauugccagua

SEQ ID NO: 1482856 - RNA, 14 nt, Homo sapiens
agcauugcuuucug

SEQ ID NO: 1482857 - RNA, 17 nt, Homo sapiens
agcauuuagucuugcca

SEQ ID NO: 1482858 - RNA, 23 nt, Homo sapiens
agcauuuccaacaccacagacac

SEQ ID NO: 1482859 - RNA, 19 nt, Homo sapiens
agcauuucuuuucuggcca

SEQ ID NO: 1482860 - RNA, 15 nt, Homo sapiens
agcauuuucauaucc

SEQ ID NO: 1482861 - RNA, 23 nt, Homo sapiens
agccaaaggauaaguguccccua

SEQ ID NO: 1482862 - RNA, 15 nt, Homo sapiens
agccaaaugcaggga

SEQ ID NO: 1482863 - RNA, 13 nt, Homo sapiens
agccaaauguaau

SEQ ID NO: 1482864 - RNA, 17 nt, Homo sapiens
agccaacacccugucua

SEQ ID NO: 1482865 - RNA, 11 nt, Homo sapiens
agccaaccuca

SEQ ID NO: 1482866 - RNA, 14 nt, Homo sapiens
agccaacuuuugca

SEQ ID NO: 1482867 - RNA, 23 nt, Homo sapiens
agccaacuuuugcauguuuugua

SEQ ID NO: 1482868 - RNA, 23 nt, Homo sapiens
agccaaggaggugaggagcagag

SEQ ID NO: 1482869 - RNA, 19 nt, Homo sapiens
agccaagggaaaggggugc

SEQ ID NO: 1482870 - RNA, 13 nt, Homo sapiens
agccaagggcuga

SEQ ID NO: 1482871 - RNA, 16 nt, Homo sapiens
agccaagggcugagug

SEQ ID NO: 1482872 - RNA, 15 nt, Homo sapiens
agccaauguuuucca

SEQ ID NO: 1482873 - RNA, 22 nt, Homo sapiens
agccaauguuuuccacccauaa

SEQ ID NO: 1482874 - RNA, 17 nt, Homo sapiens
agccaauucacaaguua

SEQ ID NO: 1482875 - RNA, 18 nt, Homo sapiens
agccaauucagacaggca

SEQ ID NO: 1482876 - RNA, 19 nt, Homo sapiens
agccacaaacccugccucu

SEQ ID NO: 1482877 - RNA, 16 nt, Homo sapiens
agccacaagucuucca

SEQ ID NO: 1482878 - RNA, 16 nt, Homo sapiens
agccacaguggccaaa

SEQ ID NO: 1482879 - RNA, 14 nt, Homo sapiens
agccagaggcaucu

SEQ ID NO: 1482880 - RNA, 15 nt, Homo sapiens
agccagcugugcacu

SEQ ID NO: 1482881 - RNA, 18 nt, Homo sapiens
agccagcugugcacuuuc

SEQ ID NO: 1482882 - RNA, 23 nt, Homo sapiens
agccaggcugagugagccacaga

SEQ ID NO: 1482883 - RNA, 19 nt, Homo sapiens
agccaggcuugguggcaca

SEQ ID NO: 1482884 - RNA, 17 nt, Homo sapiens
agccaggugaacuggaa

SEQ ID NO: 1482885 - RNA, 16 nt, Homo sapiens
agccagugagggcagu

SEQ ID NO: 1482886 - RNA, 14 nt, Homo sapiens
agccagugccauuc

SEQ ID NO: 1482887 - RNA, 19 nt, Homo sapiens
agccauauuugauaguaua

SEQ ID NO: 1482888 - RNA, 23 nt, Homo sapiens
agccaucaaauagugaauggucu

SEQ ID NO: 1482889 - RNA, 15 nt, Homo sapiens
agccaucuaaugcuu

SEQ ID NO: 1482890 - RNA, 17 nt, Homo sapiens
agccauugaucauaaac

SEQ ID NO: 1482891 - RNA, 22 nt, Homo sapiens
agccauuuguuggggcaguggu

SEQ ID NO: 1482892 - RNA, 23 nt, Homo sapiens
agcccacugcaccgccucagggu

SEQ ID NO: 1482893 - RNA, 19 nt, Homo sapiens
agcccagacucugagcugc

SEQ ID NO: 1482894 - RNA, 14 nt, Homo sapiens
agcccagagccacc

SEQ ID NO: 1482895 - RNA, 20 nt, Homo sapiens
agcccagaucgcaccacugc

SEQ ID NO: 1482896 - RNA, 22 nt, Homo sapiens
agcccauuuguguacacaguca

SEQ ID NO: 1482897 - RNA, 16 nt, Homo sapiens
agccccaggggacaag

SEQ ID NO: 1482898 - RNA, 19 nt, Homo sapiens
agccccccacaaugaugau

SEQ ID NO: 1482899 - RNA, 16 nt, Homo sapiens
agcccccgccccagag

SEQ ID NO: 1482900 - RNA, 15 nt, Homo sapiens
agccccugguccuga

SEQ ID NO: 1482901 - RNA, 17 nt, Homo sapiens
agccccuucugcucagc

SEQ ID NO: 1482902 - RNA, 22 nt, Homo sapiens
agccccuugcucucagcugcca

SEQ ID NO: 1482903 - RNA, 19 nt, Homo sapiens
agcccggaugcuucuccau

SEQ ID NO: 1482904 - RNA, 13 nt, Homo sapiens
agcccuaaucuca

SEQ ID NO: 1482905 - RNA, 13 nt, Homo sapiens
agcccugacuggu

SEQ ID NO: 1482906 - RNA, 18 nt, Homo sapiens
agcccugucgagacacuu

SEQ ID NO: 1482907 - RNA, 14 nt, Homo sapiens
agcccugucugcua

SEQ ID NO: 1482908 - RNA, 19 nt, Homo sapiens
agcccugugucuguauaca

SEQ ID NO: 1482909 - RNA, 16 nt, Homo sapiens
augacaacuuugccag

SEQ ID NO: 1482910 - RNA, 21 nt, Homo sapiens
augacaaggagcacaagaagu

SEQ ID NO: 1482911 - RNA, 22 nt, Homo sapiens
augacacacaaaucccauuaaa

SEQ ID NO: 1482912 - RNA, 19 nt, Homo sapiens
augacacaggcugacucau

SEQ ID NO: 1482913 - RNA, 21 nt, Homo sapiens
augacacccacccugugccau

SEQ ID NO: 1482914 - RNA, 14 nt, Homo sapiens
augacaucuucaaa

SEQ ID NO: 1482915 - RNA, 22 nt, Homo sapiens
augaccuguuauuaccauuagc

SEQ ID NO: 1482916 - RNA, 21 nt, Homo sapiens
augaccuuggagaagucacuu

SEQ ID NO: 1482917 - RNA, 16 nt, Homo sapiens
augaccuugggguaca

SEQ ID NO: 1482918 - RNA, 18 nt, Homo sapiens
augacugcacccagcucc

SEQ ID NO: 1482919 - RNA, 17 nt, Homo sapiens
augacugugaccaccuu

SEQ ID NO: 1482920 - RNA, 19 nt, Homo sapiens
augacuucccugcuccaac

SEQ ID NO: 1482921 - RNA, 17 nt, Homo sapiens
augagaacaaacagauc

SEQ ID NO: 1482922 - RNA, 15 nt, Homo sapiens
augagaaguacuugg

SEQ ID NO: 1482923 - RNA, 17 nt, Homo sapiens
augagaaguacuugguu

SEQ ID NO: 1482924 - RNA, 17 nt, Homo sapiens
augagaugacauucacc

SEQ ID NO: 1482925 - RNA, 19 nt, Homo sapiens
augagauguuaaauacuuu

SEQ ID NO: 1482926 - RNA, 17 nt, Homo sapiens
augagcacccauuccaa

SEQ ID NO: 1482927 - RNA, 14 nt, Homo sapiens
augagcauucauaa

SEQ ID NO: 1482928 - RNA, 19 nt, Homo sapiens
augagccaucacuagaaga

SEQ ID NO: 1482929 - RNA, 16 nt, Homo sapiens
augagccgcugugagc

SEQ ID NO: 1482930 - RNA, 18 nt, Homo sapiens
augagccgugaacugugc

SEQ ID NO: 1482931 - RNA, 14 nt, Homo sapiens
augagcuauuucca

SEQ ID NO: 1482932 - RNA, 17 nt, Homo sapiens
augagcugacaucucag

SEQ ID NO: 1482933 - RNA, 13 nt, Homo sapiens
augagcuuccuuc

SEQ ID NO: 1482934 - RNA, 18 nt, Homo sapiens
augaggacagaccacaga

SEQ ID NO: 1482935 - RNA, 19 nt, Homo sapiens
augaggauuauugauagua

SEQ ID NO: 1482936 - RNA, 17 nt, Homo sapiens
augaggcagauagcacu

SEQ ID NO: 1482937 - RNA, 20 nt, Homo sapiens
augagguacucuccuggaaa

SEQ ID NO: 1482938 - RNA, 22 nt, Homo sapiens
augaggucaauuuccugaugca

SEQ ID NO: 1482939 - RNA, 24 nt, Homo sapiens
augaggucuguuuaaaguggcaau

SEQ ID NO: 1482940 - RNA, 20 nt, Homo sapiens
augaggugguggaguggagu

SEQ ID NO: 1482941 - RNA, 20 nt, Homo sapiens
augagguguugugcauuugu

SEQ ID NO: 1482942 - RNA, 20 nt, Homo sapiens
augaguaauacaucaaagag

SEQ ID NO: 1482943 - RNA, 11 nt, Homo sapiens
augaguuaaau

SEQ ID NO: 1482944 - RNA, 22 nt, Homo sapiens
augaguuacuugaaauuugccu

SEQ ID NO: 1482945 - RNA, 21 nt, Homo sapiens
augaguuuuugauagcuuuau

SEQ ID NO: 1482946 - RNA, 19 nt, Homo sapiens
augaucagcaucugugaug

SEQ ID NO: 1482947 - RNA, 22 nt, Homo sapiens
augaucaguguuguugcucuag

SEQ ID NO: 1482948 - RNA, 14 nt, Homo sapiens
augaucauuugccc

SEQ ID NO: 1482949 - RNA, 14 nt, Homo sapiens
augauccagaacag

SEQ ID NO: 1482950 - RNA, 17 nt, Homo sapiens
augauccagaacagugg

SEQ ID NO: 1482951 - RNA, 18 nt, Homo sapiens
augauccagaacaguggc

SEQ ID NO: 1482952 - RNA, 18 nt, Homo sapiens
augauccccaagugguga

SEQ ID NO: 1482953 - RNA, 15 nt, Homo sapiens
augaugccauggcaa

SEQ ID NO: 1482954 - RNA, 19 nt, Homo sapiens
augauggcaccacugcacu

SEQ ID NO: 1482955 - RNA, 14 nt, Homo sapiens
augauguaaucucu

SEQ ID NO: 1482956 - RNA, 18 nt, Homo sapiens
augauuacuauaugcaaa

SEQ ID NO: 1482957 - RNA, 21 nt, Homo sapiens
augauucuuuguuacaggcac

SEQ ID NO: 1482958 - RNA, 20 nt, Homo sapiens
augauuguucaaagcacaga

SEQ ID NO: 1482959 - RNA, 17 nt, Homo sapiens
augauuucagcagggau

SEQ ID NO: 1482960 - RNA, 21 nt, Homo sapiens
augauuugggggaggcuuugg

SEQ ID NO: 1482961 - RNA, 23 nt, Homo sapiens
augauuuguaguggaaacauuua

SEQ ID NO: 1482962 - RNA, 18 nt, Homo sapiens
augcaaaguagcaauuuc

SEQ ID NO: 1482963 - RNA, 12 nt, Homo sapiens
augcaagugcaa

SEQ ID NO: 1482964 - RNA, 14 nt, Homo sapiens
augcaaugugcuac

SEQ ID NO: 1482965 - RNA, 17 nt, Homo sapiens
augcacaagaauggauc

SEQ ID NO: 1482966 - RNA, 21 nt, Homo sapiens
augcacacacacacaucucau

SEQ ID NO: 1482967 - RNA, 13 nt, Homo sapiens
augcaccaagaaa

SEQ ID NO: 1482968 - RNA, 18 nt, Homo sapiens
augcaccccugagccagc

SEQ ID NO: 1482969 - RNA, 14 nt, Homo sapiens
augcacguagcuga

SEQ ID NO: 1482970 - RNA, 20 nt, Homo sapiens
augcacugugggauguguuc

SEQ ID NO: 1482971 - RNA, 21 nt, Homo sapiens
augcacuuaaguuagccucca

SEQ ID NO: 1482972 - RNA, 15 nt, Homo sapiens
augcagcccaugccc

SEQ ID NO: 1482973 - RNA, 15 nt, Homo sapiens
augcagugcuuccaa

SEQ ID NO: 1482974 - RNA, 15 nt, Homo sapiens
augcaguucugagca

SEQ ID NO: 1482975 - RNA, 20 nt, Homo sapiens
augcaguugcagugaauuca

SEQ ID NO: 1482976 - RNA, 17 nt, Homo sapiens
augcauaaaagggucaa

SEQ ID NO: 1482977 - RNA, 21 nt, Homo sapiens
augcauucuaucguuauuaua

SEQ ID NO: 1482978 - RNA, 15 nt, Homo sapiens
augcauuucauaaac

SEQ ID NO: 1482979 - RNA, 21 nt, Homo sapiens
augccaaacaggaacaaucca

SEQ ID NO: 1482980 - RNA, 21 nt, Homo sapiens
augccaaccggucacccagga

SEQ ID NO: 1482981 - RNA, 22 nt, Homo sapiens
augccagcucagucccaucaga

SEQ ID NO: 1482982 - RNA, 19 nt, Homo sapiens
augccagggacugacaaaa

SEQ ID NO: 1482983 - RNA, 22 nt, Homo sapiens
augccaguaacgcgucuuccug

SEQ ID NO: 1482984 - RNA, 17 nt, Homo sapiens
augccagugaaacuuca

SEQ ID NO: 1482985 - RNA, 23 nt, Homo sapiens
augccagugaaacuucaagcaaa

SEQ ID NO: 1482986 - RNA, 13 nt, Homo sapiens
augccauucuucc

SEQ ID NO: 1482987 - RNA, 20 nt, Homo sapiens
augccccauuggauuacuuu

SEQ ID NO: 1482988 - RNA, 20 nt, Homo sapiens
augcccucaggggacuugaa

SEQ ID NO: 1482989 - RNA, 21 nt, Homo sapiens
augcccucaggggacuugaau

SEQ ID NO: 1482990 - RNA, 22 nt, Homo sapiens
augccgauauacucuagaugaa

SEQ ID NO: 1482991 - RNA, 19 nt, Homo sapiens
augccucagccuacuuuca

SEQ ID NO: 1482992 - RNA, 13 nt, Homo sapiens
augccugguacca

SEQ ID NO: 1482993 - RNA, 19 nt, Homo sapiens
augccuucacuuuacaaau

SEQ ID NO: 1482994 - RNA, 19 nt, Homo sapiens
augcgacuguaaauuggua

SEQ ID NO: 1482995 - RNA, 14 nt, Homo sapiens
augcuaacaaagac

SEQ ID NO: 1482996 - RNA, 17 nt, Homo sapiens
augcucaaccacugugg

SEQ ID NO: 1482997 - RNA, 13 nt, Homo sapiens
augcucagaaagg

SEQ ID NO: 1482998 - RNA, 12 nt, Homo sapiens
augcucccucag

SEQ ID NO: 1482999 - RNA, 23 nt, Homo sapiens
augcucccuccccugcccugguc

SEQ ID NO: 1483000 - RNA, 17 nt, Homo sapiens
augcucugaacccugag

SEQ ID NO: 1483001 - RNA, 19 nt, Homo sapiens
augcugaaaaaucauccaa

SEQ ID NO: 1483002 - RNA, 13 nt, Homo sapiens
augcugacuguac

SEQ ID NO: 1483003 - RNA, 17 nt, Homo sapiens
augcugagaagaucuga

SEQ ID NO: 1483004 - RNA, 18 nt, Homo sapiens
augcugcucaauuccuuc

SEQ ID NO: 1483005 - RNA, 15 nt, Homo sapiens
augcuggcauuugca

SEQ ID NO: 1483006 - RNA, 23 nt, Homo sapiens
augcuggcauuugcaccuaccuc

SEQ ID NO: 1483007 - RNA, 22 nt, Homo sapiens
augcuguucacuggacacuuca

SEQ ID NO: 1483008 - RNA, 18 nt, Homo sapiens
augcuguuuguagugaaa

SEQ ID NO: 1483009 - RNA, 20 nt, Homo sapiens
augcuucacaucucuucacu

SEQ ID NO: 1483010 - RNA, 18 nt, Homo sapiens
augcuucccagagggagc

SEQ ID NO: 1483011 - RNA, 23 nt, Homo sapiens
augcuugauuuagguagccuugu

SEQ ID NO: 1483012 - RNA, 14 nt, Homo sapiens
augcuuggauguaa

SEQ ID NO: 1483013 - RNA, 23 nt, Homo sapiens
augcuuuugguccagguacugag

SEQ ID NO: 1483014 - RNA, 16 nt, Homo sapiens
auggaaaaaucuugga

SEQ ID NO: 1483015 - RNA, 17 nt, Homo sapiens
auggaaacaauguggag

SEQ ID NO: 1483016 - RNA, 13 nt, Homo sapiens
auggaaacacuga

SEQ ID NO: 1483017 - RNA, 18 nt, Homo sapiens
auggaaacauuacaguuc

SEQ ID NO: 1483018 - RNA, 20 nt, Homo sapiens
auggaaagaaucuaauagag

SEQ ID NO: 1483019 - RNA, 20 nt, Homo sapiens
auggaacacacuuggaugca

SEQ ID NO: 1483020 - RNA, 18 nt, Homo sapiens
auggaaguaaagccucaa

SEQ ID NO: 1483021 - RNA, 20 nt, Homo sapiens
auggaaguuuuccuacacuu

SEQ ID NO: 1483022 - RNA, 12 nt, Homo sapiens
auggacacucca

SEQ ID NO: 1483023 - RNA, 19 nt, Homo sapiens
auggacagcauugccagua

SEQ ID NO: 1483024 - RNA, 16 nt, Homo sapiens
auggacugcuucaucu

SEQ ID NO: 1483025 - RNA, 15 nt, Homo sapiens
auggacuuguauauu

SEQ ID NO: 1483026 - RNA, 21 nt, Homo sapiens
auggagaauauaaacauauac

SEQ ID NO: 1483027 - RNA, 18 nt, Homo sapiens
auggagaaucugcugcau

SEQ ID NO: 1483028 - RNA, 21 nt, Homo sapiens
auggagauauuuacaugaauu

SEQ ID NO: 1483029 - RNA, 18 nt, Homo sapiens
auggagccagcucugcau

SEQ ID NO: 1483030 - RNA, 15 nt, Homo sapiens
auggaggcccuccug

SEQ ID NO: 1483031 - RNA, 16 nt, Homo sapiens
auggaguggcugccau

SEQ ID NO: 1483032 - RNA, 19 nt, Homo sapiens
auggaguggcugccaugga

SEQ ID NO: 1483033 - RNA, 19 nt, Homo sapiens
auggauaaaauaaugcugc

SEQ ID NO: 1483034 - RNA, 17 nt, Homo sapiens
auggauaaacugagccu

SEQ ID NO: 1483035 - RNA, 22 nt, Homo sapiens
auggauccagaacugcacucuu

SEQ ID NO: 1483036 - RNA, 18 nt, Homo sapiens
auggaucuuaaagcauuc

SEQ ID NO: 1483037 - RNA, 17 nt, Homo sapiens
auggaugauucagaaau

SEQ ID NO: 1483038 - RNA, 19 nt, Homo sapiens
auggaugggggaacucaga

SEQ ID NO: 1483039 - RNA, 19 nt, Homo sapiens
auggauuugaaguuugcca

SEQ ID NO: 1483040 - RNA, 22 nt, Homo sapiens
auggauuuugggagugacucaa

SEQ ID NO: 1483041 - RNA, 14 nt, Homo sapiens
auggcagaagggaa

SEQ ID NO: 1483042 - RNA, 14 nt, Homo sapiens
auggcaugcugaaa

SEQ ID NO: 1483043 - RNA, 18 nt, Homo sapiens
auggccccaguccaugcu

SEQ ID NO: 1483044 - RNA, 14 nt, Homo sapiens
augggaaagacaug

SEQ ID NO: 1483045 - RNA, 14 nt, Homo sapiens
augggaacacuggu

SEQ ID NO: 1483046 - RNA, 17 nt, Homo sapiens
augggaaccccuucauc

SEQ ID NO: 1483047 - RNA, 17 nt, Homo sapiens
augggaagcauguggau

SEQ ID NO: 1483048 - RNA, 15 nt, Homo sapiens
augggacuuaacucc

SEQ ID NO: 1483049 - RNA, 19 nt, Homo sapiens
augggagcuuaacuuuaua

SEQ ID NO: 1483050 - RNA, 18 nt, Homo sapiens
augggagugggcaccuca

SEQ ID NO: 1483051 - RNA, 20 nt, Homo sapiens
augggcaaauuaaggcauaa

SEQ ID NO: 1483052 - RNA, 15 nt, Homo sapiens
augggcagcccaaag

SEQ ID NO: 1483053 - RNA, 20 nt, Homo sapiens
auggggauuccacuaucuca

SEQ ID NO: 1483054 - RNA, 14 nt, Homo sapiens
auggggcacccugg

SEQ ID NO: 1483055 - RNA, 22 nt, Homo sapiens
auggggcucagauggacuggga

SEQ ID NO: 1483056 - RNA, 17 nt, Homo sapiens
augggggaacucagauc

SEQ ID NO: 1483057 - RNA, 18 nt, Homo sapiens
auggguccacugcaccag

SEQ ID NO: 1483058 - RNA, 14 nt, Homo sapiens
auggguuccagagg

SEQ ID NO: 1483059 - RNA, 16 nt, Homo sapiens
augguaaaaguuacuu

SEQ ID NO: 1483060 - RNA, 23 nt, Homo sapiens
augguacucuuguugaguucugu

SEQ ID NO: 1483061 - RNA, 14 nt, Homo sapiens
augguagcauuuua

SEQ ID NO: 1483062 - RNA, 21 nt, Homo sapiens
augguaugcuggccagcaccc

SEQ ID NO: 1483063 - RNA, 15 nt, Homo sapiens
auggucacacacuga

SEQ ID NO: 1483064 - RNA, 19 nt, Homo sapiens
auggugaaaccccgucucu

SEQ ID NO: 1483065 - RNA, 22 nt, Homo sapiens
auggugacagcugcaagccagg

SEQ ID NO: 1483066 - RNA, 19 nt, Homo sapiens
auggugaggcgaaggccag

SEQ ID NO: 1483067 - RNA, 16 nt, Homo sapiens
auggugccccaggacc

SEQ ID NO: 1483068 - RNA, 22 nt, Homo sapiens
auggugccccaggaccagcuca

SEQ ID NO: 1483069 - RNA, 19 nt, Homo sapiens
augguggaaaagaacugua

SEQ ID NO: 1483070 - RNA, 19 nt, Homo sapiens
augguguagaacacuaauu

SEQ ID NO: 1483071 - RNA, 17 nt, Homo sapiens
augguugauggaaaaua

SEQ ID NO: 1483072 - RNA, 19 nt, Homo sapiens
augguugauggguucuaau

SEQ ID NO: 1483073 - RNA, 20 nt, Homo sapiens
auguaaacauaauucuugua

SEQ ID NO: 1483074 - RNA, 13 nt, Homo sapiens
auguaaacuacuu

SEQ ID NO: 1483075 - RNA, 17 nt, Homo sapiens
auguaaacuuugucaug

SEQ ID NO: 1483076 - RNA, 16 nt, Homo sapiens
auguaaauauacaaaa

SEQ ID NO: 1483077 - RNA, 17 nt, Homo sapiens
auguaagccaagucaug

SEQ ID NO: 1483078 - RNA, 12 nt, Homo sapiens
auguaagccugg

SEQ ID NO: 1483079 - RNA, 15 nt, Homo sapiens
auguaagcucuacug

SEQ ID NO: 1483080 - RNA, 15 nt, Homo sapiens
auguaauacuggaau

SEQ ID NO: 1483081 - RNA, 22 nt, Homo sapiens
auguaaucucucugcagcugcc

SEQ ID NO: 1483082 - RNA, 23 nt, Homo sapiens
auguacagacauacauuuaugca

SEQ ID NO: 1483083 - RNA, 19 nt, Homo sapiens
auguacaucuggccuugaa

SEQ ID NO: 1483084 - RNA, 11 nt, Homo sapiens
auguacaugag

SEQ ID NO: 1483085 - RNA, 18 nt, Homo sapiens
auguaccguaggcuuugu

SEQ ID NO: 1483086 - RNA, 17 nt, Homo sapiens
auguaccugaugcuaug

SEQ ID NO: 1483087 - RNA, 15 nt, Homo sapiens
auguaccugauguac

SEQ ID NO: 1483088 - RNA, 16 nt, Homo sapiens
auguacuauccaaucu

SEQ ID NO: 1483089 - RNA, 23 nt, Homo sapiens
auguacuauccaaucugugauga

SEQ ID NO: 1483090 - RNA, 16 nt, Homo sapiens
auguagcaaaacgcau

SEQ ID NO: 1483091 - RNA, 19 nt, Homo sapiens
auguagcauuaugcaauua

SEQ ID NO: 1483092 - RNA, 21 nt, Homo sapiens
auguagccagcugugcacuuu

SEQ ID NO: 1483093 - RNA, 19 nt, Homo sapiens
auguauauauauauaugca

SEQ ID NO: 1483094 - RNA, 12 nt, Homo sapiens
auguaugacaag

SEQ ID NO: 1483095 - RNA, 21 nt, Homo sapiens
auguauggaaucccacuguau

SEQ ID NO: 1483096 - RNA, 12 nt, Homo sapiens
auguaugugcac

SEQ ID NO: 1483097 - RNA, 18 nt, Homo sapiens
auguauguuuacauauca

SEQ ID NO: 1483098 - RNA, 20 nt, Homo sapiens
auguauuuguuugcaauuuu

SEQ ID NO: 1483099 - RNA, 18 nt, Homo sapiens
auguauuuucaguuacaa

SEQ ID NO: 1483100 - RNA, 14 nt, Homo sapiens
augucaagccauaa

SEQ ID NO: 1483101 - RNA, 21 nt, Homo sapiens
augucaaggaaugaagaacaa

SEQ ID NO: 1483102 - RNA, 17 nt, Homo sapiens
augucagaaaccaguua

SEQ ID NO: 1483103 - RNA, 16 nt, Homo sapiens
augucagaacagagug

SEQ ID NO: 1483104 - RNA, 21 nt, Homo sapiens
augucagcagacacacauggg

SEQ ID NO: 1483105 - RNA, 12 nt, Homo sapiens
auguccaaagag

SEQ ID NO: 1483106 - RNA, 15 nt, Homo sapiens
auguccuacuaucac

SEQ ID NO: 1483107 - RNA, 16 nt, Homo sapiens
auguccucagcauuuc

SEQ ID NO: 1483108 - RNA, 15 nt, Homo sapiens
auguccugccuuuua

SEQ ID NO: 1483109 - RNA, 16 nt, Homo sapiens
augucucuaaagcacu

SEQ ID NO: 1483110 - RNA, 19 nt, Homo sapiens
augucucuggggcagaucc

SEQ ID NO: 1483111 - RNA, 17 nt, Homo sapiens
augucugauaaugauuu

SEQ ID NO: 1483112 - RNA, 23 nt, Homo sapiens
augucugcuugucaaaagaaaua

SEQ ID NO: 1483113 - RNA, 17 nt, Homo sapiens
caagacuauaccuuauc

SEQ ID NO: 1483114 - RNA, 16 nt, Homo sapiens
caagacucaccucauc

SEQ ID NO: 1483115 - RNA, 19 nt, Homo sapiens
caagacucugucucaaaaa

SEQ ID NO: 1483116 - RNA, 21 nt, Homo sapiens
caagaggggguggaggggugu

SEQ ID NO: 1483117 - RNA, 22 nt, Homo sapiens
caagaguacagaagcuuuagca

SEQ ID NO: 1483118 - RNA, 17 nt, Homo sapiens
caagauacgcucgccac

SEQ ID NO: 1483119 - RNA, 17 nt, Homo sapiens
caagauauugaugauaa

SEQ ID NO: 1483120 - RNA, 20 nt, Homo sapiens
caagauccgagucuacccag

SEQ ID NO: 1483121 - RNA, 13 nt, Homo sapiens
caagaugacacaa

SEQ ID NO: 1483122 - RNA, 16 nt, Homo sapiens
caagauugcaccacug

SEQ ID NO: 1483123 - RNA, 17 nt, Homo sapiens
caagauugcaccacugc

SEQ ID NO: 1483124 - RNA, 15 nt, Homo sapiens
caagcacaaaaacuu

SEQ ID NO: 1483125 - RNA, 12 nt, Homo sapiens
caagcaccugca

SEQ ID NO: 1483126 - RNA, 19 nt, Homo sapiens
caagcaccugcaugugcug

SEQ ID NO: 1483127 - RNA, 14 nt, Homo sapiens
caagcaccugcuca

SEQ ID NO: 1483128 - RNA, 18 nt, Homo sapiens
caagcacuuuaauggccu

SEQ ID NO: 1483129 - RNA, 18 nt, Homo sapiens
caagcagaaacuuuacaa

SEQ ID NO: 1483130 - RNA, 15 nt, Homo sapiens
caagcaggagacgac

SEQ ID NO: 1483131 - RNA, 20 nt, Homo sapiens
caagcauuucuagcagugau

SEQ ID NO: 1483132 - RNA, 21 nt, Homo sapiens
caagccacagcagguccucca

SEQ ID NO: 1483133 - RNA, 18 nt, Homo sapiens
caagccaguacgugcuaa

SEQ ID NO: 1483134 - RNA, 17 nt, Homo sapiens
caagcccaguaacugca

SEQ ID NO: 1483135 - RNA, 20 nt, Homo sapiens
caagccccagcagcccucaa

SEQ ID NO: 1483136 - RNA, 17 nt, Homo sapiens
caagccccauuuccuca

SEQ ID NO: 1483137 - RNA, 19 nt, Homo sapiens
caagcuccuggucuugaga

SEQ ID NO: 1483138 - RNA, 20 nt, Homo sapiens
caagcugaaaacaaacaaga

SEQ ID NO: 1483139 - RNA, 21 nt, Homo sapiens
caagcugccgaaccaaaagaa

SEQ ID NO: 1483140 - RNA, 16 nt, Homo sapiens
caagcuggaagcacau

SEQ ID NO: 1483141 - RNA, 21 nt, Homo sapiens
caagcuguccucccaccucag

SEQ ID NO: 1483142 - RNA, 21 nt, Homo sapiens
caagcuuguuaucagcuuuca

SEQ ID NO: 1483143 - RNA, 22 nt, Homo sapiens
caagcuuguuaucagcuuucag

SEQ ID NO: 1483144 - RNA, 20 nt, Homo sapiens
caagcuuugguuuaugguuu

SEQ ID NO: 1483145 - RNA, 21 nt, Homo sapiens
caaggaaacccccaguguaau

SEQ ID NO: 1483146 - RNA, 23 nt, Homo sapiens
caaggaaacccccaguguaauaa

SEQ ID NO: 1483147 - RNA, 19 nt, Homo sapiens
caaggaaacgcuaccucuc

SEQ ID NO: 1483148 - RNA, 20 nt, Homo sapiens
caaggaaagccccagcacua

SEQ ID NO: 1483149 - RNA, 16 nt, Homo sapiens
caaggaauuucugcuc

SEQ ID NO: 1483150 - RNA, 19 nt, Homo sapiens
caaggacguggaugacccu

SEQ ID NO: 1483151 - RNA, 13 nt, Homo sapiens
caaggacucuucc

SEQ ID NO: 1483152 - RNA, 15 nt, Homo sapiens
caaggagaauaugau

SEQ ID NO: 1483153 - RNA, 20 nt, Homo sapiens
caaggagcaaacacugaaau

SEQ ID NO: 1483154 - RNA, 14 nt, Homo sapiens
caaggaguacaaug

SEQ ID NO: 1483155 - RNA, 18 nt, Homo sapiens
caaggaugcugucaagca

SEQ ID NO: 1483156 - RNA, 22 nt, Homo sapiens
caaggcccauaucugugaaaug

SEQ ID NO: 1483157 - RNA, 21 nt, Homo sapiens
caaggcuggccagcaaggcag

SEQ ID NO: 1483158 - RNA, 18 nt, Homo sapiens
caaggcuggguaauguga

SEQ ID NO: 1483159 - RNA, 13 nt, Homo sapiens
caagggaaaaccc

SEQ ID NO: 1483160 - RNA, 13 nt, Homo sapiens
caagggcaccugg

SEQ ID NO: 1483161 - RNA, 15 nt, Homo sapiens
caaggggacaucuua

SEQ ID NO: 1483162 - RNA, 20 nt, Homo sapiens
caagggggacugucuuucag

SEQ ID NO: 1483163 - RNA, 21 nt, Homo sapiens
caagguccucugucagucaca

SEQ ID NO: 1483164 - RNA, 16 nt, Homo sapiens
caaggugagugugacu

SEQ ID NO: 1483165 - RNA, 19 nt, Homo sapiens
caaggugggccuugcuacc

SEQ ID NO: 1483166 - RNA, 22 nt, Homo sapiens
caagguggugugaucuuaauau

SEQ ID NO: 1483167 - RNA, 17 nt, Homo sapiens
caaguaacugggauuac

SEQ ID NO: 1483168 - RNA, 19 nt, Homo sapiens
caaguagaggcaaugcaaa

SEQ ID NO: 1483169 - RNA, 15 nt, Homo sapiens
caaguagcacccugg

SEQ ID NO: 1483170 - RNA, 13 nt, Homo sapiens
caaguagcuuucc

SEQ ID NO: 1483171 - RNA, 15 nt, Homo sapiens
caaguauaugugaaa

SEQ ID NO: 1483172 - RNA, 19 nt, Homo sapiens
caaguauguugauaaauga

SEQ ID NO: 1483173 - RNA, 19 nt, Homo sapiens
caagucacacagcuaguga

SEQ ID NO: 1483174 - RNA, 14 nt, Homo sapiens
caagucugacucuc

SEQ ID NO: 1483175 - RNA, 18 nt, Homo sapiens
caagucuucucaagaucc

SEQ ID NO: 1483176 - RNA, 19 nt, Homo sapiens
caaguggcaugugcuguga

SEQ ID NO: 1483177 - RNA, 18 nt, Homo sapiens
caagugggaucugucaca

SEQ ID NO: 1483178 - RNA, 21 nt, Homo sapiens
caagugugggccacuguggug

SEQ ID NO: 1483179 - RNA, 13 nt, Homo sapiens
caaguuacaguga

SEQ ID NO: 1483180 - RNA, 14 nt, Homo sapiens
caaguucaauccua

SEQ ID NO: 1483181 - RNA, 17 nt, Homo sapiens
caaguuucaucagucaa

SEQ ID NO: 1483182 - RNA, 13 nt, Homo sapiens
caaguuuccauag

SEQ ID NO: 1483183 - RNA, 18 nt, Homo sapiens
caaguuucuagcuagaaa

SEQ ID NO: 1483184 - RNA, 11 nt, Homo sapiens
caaguuugcac

SEQ ID NO: 1483185 - RNA, 21 nt, Homo sapiens
caauaaacauuucauuuccca

SEQ ID NO: 1483186 - RNA, 16 nt, Homo sapiens
caauaacacugucucc

SEQ ID NO: 1483187 - RNA, 20 nt, Homo sapiens
caauaaccgcuugguuugca

SEQ ID NO: 1483188 - RNA, 20 nt, Homo sapiens
caauaagaaaugaacaaaag

SEQ ID NO: 1483189 - RNA, 21 nt, Homo sapiens
caauaagaaaugaacaaaaga

SEQ ID NO: 1483190 - RNA, 14 nt, Homo sapiens
caauacaaauggau

SEQ ID NO: 1483191 - RNA, 14 nt, Homo sapiens
caauagaucuccag

SEQ ID NO: 1483192 - RNA, 14 nt, Homo sapiens
caauaguaaaagau

SEQ ID NO: 1483193 - RNA, 20 nt, Homo sapiens
caauauaaaccguggucuca

SEQ ID NO: 1483194 - RNA, 22 nt, Homo sapiens
caauauaaaccguggucucaug

SEQ ID NO: 1483195 - RNA, 24 nt, Homo sapiens
caauauaaaccguggucucaugua

SEQ ID NO: 1483196 - RNA, 16 nt, Homo sapiens
caauauuaaauacaga

SEQ ID NO: 1483197 - RNA, 17 nt, Homo sapiens
caauauuugguauuuca

SEQ ID NO: 1483198 - RNA, 17 nt, Homo sapiens
caaucagccacauucua

SEQ ID NO: 1483199 - RNA, 14 nt, Homo sapiens
caauccaacaucca

SEQ ID NO: 1483200 - RNA, 21 nt, Homo sapiens
caaucccuggggcugugcauu

SEQ ID NO: 1483201 - RNA, 19 nt, Homo sapiens
caaucuaaagauacagugu

SEQ ID NO: 1483202 - RNA, 19 nt, Homo sapiens
caaucugugaugacauucc

SEQ ID NO: 1483203 - RNA, 19 nt, Homo sapiens
caaugaauuuuauaaucug

SEQ ID NO: 1483204 - RNA, 15 nt, Homo sapiens
caaugacaucucagg

SEQ ID NO: 1483205 - RNA, 17 nt, Homo sapiens
caaugacaucucagggg

SEQ ID NO: 1483206 - RNA, 22 nt, Homo sapiens
caaugacaucucaggggccaga

SEQ ID NO: 1483207 - RNA, 19 nt, Homo sapiens
caaugacuuaaccauauaa

SEQ ID NO: 1483208 - RNA, 19 nt, Homo sapiens
caaugcaaagauucacaua

SEQ ID NO: 1483209 - RNA, 23 nt, Homo sapiens
caaugcaucacguaccccacugg

SEQ ID NO: 1483210 - RNA, 15 nt, Homo sapiens
caaugccaaucuuca

SEQ ID NO: 1483211 - RNA, 19 nt, Homo sapiens
caauuacuggcucacuggc

SEQ ID NO: 1483212 - RNA, 19 nt, Homo sapiens
caauucagauugucuugca

SEQ ID NO: 1483213 - RNA, 20 nt, Homo sapiens
caauuccaaaggaaucucca

SEQ ID NO: 1483214 - RNA, 23 nt, Homo sapiens
caauucugcccgcuccauggaaa

SEQ ID NO: 1483215 - RNA, 13 nt, Homo sapiens
cagagucaucuga

SEQ ID NO: 1483216 - RNA, 17 nt, Homo sapiens
cagaguccagugcucug

SEQ ID NO: 1483217 - RNA, 17 nt, Homo sapiens
cagaguccuugcaaaau

SEQ ID NO: 1483218 - RNA, 16 nt, Homo sapiens
cagagugagagacauc

SEQ ID NO: 1483219 - RNA, 23 nt, Homo sapiens
cagagugagccagugagggcagu

SEQ ID NO: 1483220 - RNA, 17 nt, Homo sapiens
cagagugagugagacuc

SEQ ID NO: 1483221 - RNA, 12 nt, Homo sapiens
cagagugcaacc

SEQ ID NO: 1483222 - RNA, 18 nt, Homo sapiens
cagagugcacagcugucc

SEQ ID NO: 1483223 - RNA, 15 nt, Homo sapiens
cagaguguucccuga

SEQ ID NO: 1483224 - RNA, 16 nt, Homo sapiens
cagaguguucccugac

SEQ ID NO: 1483225 - RNA, 16 nt, Homo sapiens
cagauaaauagaacua

SEQ ID NO: 1483226 - RNA, 15 nt, Homo sapiens
cagauaaguuugcag

SEQ ID NO: 1483227 - RNA, 15 nt, Homo sapiens
cagauacaucacugc

SEQ ID NO: 1483228 - RNA, 21 nt, Homo sapiens
cagauacuucccauuuuggaa

SEQ ID NO: 1483229 - RNA, 14 nt, Homo sapiens
cagauagagcuggg

SEQ ID NO: 1483230 - RNA, 17 nt, Homo sapiens
cagauagaguuccauau

SEQ ID NO: 1483231 - RNA, 20 nt, Homo sapiens
cagauagcacugggugugag

SEQ ID NO: 1483232 - RNA, 15 nt, Homo sapiens
cagauaucugaaugg

SEQ ID NO: 1483233 - RNA, 15 nt, Homo sapiens
cagaucaauuuguaa

SEQ ID NO: 1483234 - RNA, 15 nt, Homo sapiens
cagaucauauuucac

SEQ ID NO: 1483235 - RNA, 11 nt, Homo sapiens
cagauccugca

SEQ ID NO: 1483236 - RNA, 17 nt, Homo sapiens
cagaucuaucuugucaa

SEQ ID NO: 1483237 - RNA, 17 nt, Homo sapiens
cagaucuuugcugccag

SEQ ID NO: 1483238 - RNA, 21 nt, Homo sapiens
cagaugagcaaggacauugcc

SEQ ID NO: 1483239 - RNA, 16 nt, Homo sapiens
cagaugagcagucaca

SEQ ID NO: 1483240 - RNA, 17 nt, Homo sapiens
cagaugccacacaagga

SEQ ID NO: 1483241 - RNA, 19 nt, Homo sapiens
cagaugccccagagcuguu

SEQ ID NO: 1483242 - RNA, 22 nt, Homo sapiens
cagaugcccuuuggaaagccau

SEQ ID NO: 1483243 - RNA, 20 nt, Homo sapiens
cagaugccuacaaccauccc

SEQ ID NO: 1483244 - RNA, 17 nt, Homo sapiens
cagauggaaaaacugag

SEQ ID NO: 1483245 - RNA, 22 nt, Homo sapiens
cagauggagguucucagagcca

SEQ ID NO: 1483246 - RNA, 16 nt, Homo sapiens
cagauggcacuuugaa

SEQ ID NO: 1483247 - RNA, 17 nt, Homo sapiens
cagauggcacuuugaag

SEQ ID NO: 1483248 - RNA, 15 nt, Homo sapiens
cagaugggucugaua

SEQ ID NO: 1483249 - RNA, 17 nt, Homo sapiens
cagauguauugacugua

SEQ ID NO: 1483250 - RNA, 18 nt, Homo sapiens
cagauguuggaccaacac

SEQ ID NO: 1483251 - RNA, 20 nt, Homo sapiens
cagauucugccucucuggaa

SEQ ID NO: 1483252 - RNA, 17 nt, Homo sapiens
cagauuguuaucuauca

SEQ ID NO: 1483253 - RNA, 13 nt, Homo sapiens
cagcaacaaugac

SEQ ID NO: 1483254 - RNA, 18 nt, Homo sapiens
cagcaaccucuucaugag

SEQ ID NO: 1483255 - RNA, 12 nt, Homo sapiens
cagcaacugaag

SEQ ID NO: 1483256 - RNA, 13 nt, Homo sapiens
cagcaacugaaga

SEQ ID NO: 1483257 - RNA, 23 nt, Homo sapiens
cagcaaggccagaugcacauccc

SEQ ID NO: 1483258 - RNA, 16 nt, Homo sapiens
cagcaaggggacaucu

SEQ ID NO: 1483259 - RNA, 20 nt, Homo sapiens
cagcaaugacaucucagggg

SEQ ID NO: 1483260 - RNA, 20 nt, Homo sapiens
cagcaauuuaaauguuauga

SEQ ID NO: 1483261 - RNA, 12 nt, Homo sapiens
cagcacagccaa

SEQ ID NO: 1483262 - RNA, 23 nt, Homo sapiens
cagcacagggggauucugagcag

SEQ ID NO: 1483263 - RNA, 21 nt, Homo sapiens
cagcacccagguuuugcacuc

SEQ ID NO: 1483264 - RNA, 17 nt, Homo sapiens
cagcacccccacccacc

SEQ ID NO: 1483265 - RNA, 17 nt, Homo sapiens
cagcaccggccucggga

SEQ ID NO: 1483266 - RNA, 12 nt, Homo sapiens
cagcacuggaag

SEQ ID NO: 1483267 - RNA, 13 nt, Homo sapiens
cagcacuggugaa

SEQ ID NO: 1483268 - RNA, 17 nt, Homo sapiens
cagcacuggugaacuga

SEQ ID NO: 1483269 - RNA, 20 nt, Homo sapiens
cagcacuggugaacugagcu

SEQ ID NO: 1483270 - RNA, 11 nt, Homo sapiens
cagcacuuugg

SEQ ID NO: 1483271 - RNA, 16 nt, Homo sapiens
cagcagcccaagcuua

SEQ ID NO: 1483272 - RNA, 20 nt, Homo sapiens
cagcagccgccuuaagcuga

SEQ ID NO: 1483273 - RNA, 12 nt, Homo sapiens
cagcagcugaac

SEQ ID NO: 1483274 - RNA, 22 nt, Homo sapiens
cagcagcuucaccagagcauuu

SEQ ID NO: 1483275 - RNA, 15 nt, Homo sapiens
cagcaggugcucaau

SEQ ID NO: 1483276 - RNA, 13 nt, Homo sapiens
cagcaggugcuga

SEQ ID NO: 1483277 - RNA, 14 nt, Homo sapiens
cagcagugaucuca

SEQ ID NO: 1483278 - RNA, 15 nt, Homo sapiens
cagcagugaucucag

SEQ ID NO: 1483279 - RNA, 17 nt, Homo sapiens
cagcaguguugcucagc

SEQ ID NO: 1483280 - RNA, 13 nt, Homo sapiens
cagcauacgucag

SEQ ID NO: 1483281 - RNA, 15 nt, Homo sapiens
cagcaucacucccca

SEQ ID NO: 1483282 - RNA, 18 nt, Homo sapiens
cagcaucuuuaacacagc

SEQ ID NO: 1483283 - RNA, 23 nt, Homo sapiens
cagcaugaggacagaccacagag

SEQ ID NO: 1483284 - RNA, 13 nt, Homo sapiens
cagcaugccccuu

SEQ ID NO: 1483285 - RNA, 13 nt, Homo sapiens
cagcaugccugaa

SEQ ID NO: 1483286 - RNA, 18 nt, Homo sapiens
cagcauguacggauuuuc

SEQ ID NO: 1483287 - RNA, 17 nt, Homo sapiens
cagcauugcacagugaa

SEQ ID NO: 1483288 - RNA, 11 nt, Homo sapiens
cagcauugcuu

SEQ ID NO: 1483289 - RNA, 16 nt, Homo sapiens
cagcauuuucauaucc

SEQ ID NO: 1483290 - RNA, 17 nt, Homo sapiens
cagccaaaugcagggag

SEQ ID NO: 1483291 - RNA, 18 nt, Homo sapiens
cagccaaccucauugcag

SEQ ID NO: 1483292 - RNA, 19 nt, Homo sapiens
cagccacacccaggcacuu

SEQ ID NO: 1483293 - RNA, 21 nt, Homo sapiens
cagccacaguggccaaagagg

SEQ ID NO: 1483294 - RNA, 13 nt, Homo sapiens
cagccacauucua

SEQ ID NO: 1483295 - RNA, 16 nt, Homo sapiens
cagccaccccugagau

SEQ ID NO: 1483296 - RNA, 14 nt, Homo sapiens
cagccaggacaucu

SEQ ID NO: 1483297 - RNA, 23 nt, Homo sapiens
cagccagugccauuccacuccac

SEQ ID NO: 1483298 - RNA, 17 nt, Homo sapiens
cagccaugcaaugccaa

SEQ ID NO: 1483299 - RNA, 19 nt, Homo sapiens
cagcccaagcuucccucca

SEQ ID NO: 1483300 - RNA, 17 nt, Homo sapiens
cagcccagacccagugg

SEQ ID NO: 1483301 - RNA, 20 nt, Homo sapiens
cagcccaugugcaccugccc

SEQ ID NO: 1483302 - RNA, 17 nt, Homo sapiens
cagccccggcaagccac

SEQ ID NO: 1483303 - RNA, 15 nt, Homo sapiens
cagccccucccccau

SEQ ID NO: 1483304 - RNA, 16 nt, Homo sapiens
cagccccuugcucuca

SEQ ID NO: 1483305 - RNA, 20 nt, Homo sapiens
cagcccugaccccaguguac

SEQ ID NO: 1483306 - RNA, 19 nt, Homo sapiens
cagcccugaggugaaaggg

SEQ ID NO: 1483307 - RNA, 15 nt, Homo sapiens
cagcccugcagugcc

SEQ ID NO: 1483308 - RNA, 22 nt, Homo sapiens
cagccguguguucaaauguaca

SEQ ID NO: 1483309 - RNA, 17 nt, Homo sapiens
cagccuaggcagaggcu

SEQ ID NO: 1483310 - RNA, 13 nt, Homo sapiens
cagccucaagucu

SEQ ID NO: 1483311 - RNA, 14 nt, Homo sapiens
cagccuccaacaca

SEQ ID NO: 1483312 - RNA, 15 nt, Homo sapiens
cagccucccauccag

SEQ ID NO: 1483313 - RNA, 18 nt, Homo sapiens
cagccucccauccagggc

SEQ ID NO: 1483314 - RNA, 16 nt, Homo sapiens
cagccuccccgugcca

SEQ ID NO: 1483315 - RNA, 16 nt, Homo sapiens
cagccugcuuucacac

SEQ ID NO: 1483316 - RNA, 14 nt, Homo sapiens
cagccuggccagac

SEQ ID NO: 1483317 - RNA, 19 nt, Homo sapiens
cagccuggcugguccuccc

SEQ ID NO: 1483318 - RNA, 21 nt, Homo sapiens
ccugagucugcaugugcacgg

SEQ ID NO: 1483319 - RNA, 18 nt, Homo sapiens
ccugaucgccaaccuuuc

SEQ ID NO: 1483320 - RNA, 21 nt, Homo sapiens
ccugcaccccugcaguuugag

SEQ ID NO: 1483321 - RNA, 22 nt, Homo sapiens
ccugcacuaaagccagccugac

SEQ ID NO: 1483322 - RNA, 20 nt, Homo sapiens
ccugcacuguccugaccauc

SEQ ID NO: 1483323 - RNA, 21 nt, Homo sapiens
ccugcagaagcagaagugcaa

SEQ ID NO: 1483324 - RNA, 16 nt, Homo sapiens
ccugcagaauccagcu

SEQ ID NO: 1483325 - RNA, 18 nt, Homo sapiens
ccugcagaccucaagcca

SEQ ID NO: 1483326 - RNA, 20 nt, Homo sapiens
ccugcagcccaaaacccagg

SEQ ID NO: 1483327 - RNA, 17 nt, Homo sapiens
ccugcagcccaccagac

SEQ ID NO: 1483328 - RNA, 16 nt, Homo sapiens
ccugcaugugcuguca

SEQ ID NO: 1483329 - RNA, 14 nt, Homo sapiens
ccugcauugaacag

SEQ ID NO: 1483330 - RNA, 14 nt, Homo sapiens
ccugccacagccag

SEQ ID NO: 1483331 - RNA, 21 nt, Homo sapiens
ccugccccagauuuacuaaau

SEQ ID NO: 1483332 - RNA, 17 nt, Homo sapiens
ccugcccccuuggguga

SEQ ID NO: 1483333 - RNA, 17 nt, Homo sapiens
ccugcccuguccaaaag

SEQ ID NO: 1483334 - RNA, 17 nt, Homo sapiens
ccugccucuuuucccca

SEQ ID NO: 1483335 - RNA, 21 nt, Homo sapiens
ccugccugcaucugugaaaag

SEQ ID NO: 1483336 - RNA, 16 nt, Homo sapiens
ccugccuuccagccac

SEQ ID NO: 1483337 - RNA, 23 nt, Homo sapiens
ccugcgcucucagcugaccauca

SEQ ID NO: 1483338 - RNA, 23 nt, Homo sapiens
ccugcgggugaacaaagcagcca

SEQ ID NO: 1483339 - RNA, 23 nt, Homo sapiens
ccugcucaacauaggccugcuca

SEQ ID NO: 1483340 - RNA, 19 nt, Homo sapiens
ccugcuccacgaagccuua

SEQ ID NO: 1483341 - RNA, 20 nt, Homo sapiens
ccugcucuaaggcaguagaa

SEQ ID NO: 1483342 - RNA, 17 nt, Homo sapiens
ccugcucuacccaugag

SEQ ID NO: 1483343 - RNA, 13 nt, Homo sapiens
ccugcucugcucg

SEQ ID NO: 1483344 - RNA, 22 nt, Homo sapiens
ccugcucuuucuacaugacugg

SEQ ID NO: 1483345 - RNA, 18 nt, Homo sapiens
ccugcuggcucuucugcc

SEQ ID NO: 1483346 - RNA, 15 nt, Homo sapiens
ccugcuuaggccacu

SEQ ID NO: 1483347 - RNA, 13 nt, Homo sapiens
ccugcuuugcauc

SEQ ID NO: 1483348 - RNA, 15 nt, Homo sapiens
ccugcuuugcaucuu

SEQ ID NO: 1483349 - RNA, 18 nt, Homo sapiens
ccugcuuuggcagugcca

SEQ ID NO: 1483350 - RNA, 20 nt, Homo sapiens
ccuggaaagaaaaagcaaua

SEQ ID NO: 1483351 - RNA, 16 nt, Homo sapiens
ccuggaacauccuuug

SEQ ID NO: 1483352 - RNA, 19 nt, Homo sapiens
ccuggaaucuacaagccaa

SEQ ID NO: 1483353 - RNA, 16 nt, Homo sapiens
ccuggacacgcuggug

SEQ ID NO: 1483354 - RNA, 16 nt, Homo sapiens
ccuggacacucagacc

SEQ ID NO: 1483355 - RNA, 14 nt, Homo sapiens
ccuggacuccagua

SEQ ID NO: 1483356 - RNA, 13 nt, Homo sapiens
ccuggacuuuccu

SEQ ID NO: 1483357 - RNA, 15 nt, Homo sapiens
ccuggacuuuccugc

SEQ ID NO: 1483358 - RNA, 15 nt, Homo sapiens
ccuggaggcacugaa

SEQ ID NO: 1483359 - RNA, 23 nt, Homo sapiens
ccuggaucaguccuuugaucagu

SEQ ID NO: 1483360 - RNA, 16 nt, Homo sapiens
ccuggauccagcacug

SEQ ID NO: 1483361 - RNA, 20 nt, Homo sapiens
ccuggcacuggaugcagaaa

SEQ ID NO: 1483362 - RNA, 19 nt, Homo sapiens
ccuggcacugguuuguucc

SEQ ID NO: 1483363 - RNA, 16 nt, Homo sapiens
ccuggcaggccagugu

SEQ ID NO: 1483364 - RNA, 12 nt, Homo sapiens
ccuggcaguuua

SEQ ID NO: 1483365 - RNA, 18 nt, Homo sapiens
ccuggccaacauggcaaa

SEQ ID NO: 1483366 - RNA, 14 nt, Homo sapiens
ccuggccauuucca

SEQ ID NO: 1483367 - RNA, 14 nt, Homo sapiens
ccuggcccaucuca

SEQ ID NO: 1483368 - RNA, 17 nt, Homo sapiens
ccuggcucugcaauggg

SEQ ID NO: 1483369 - RNA, 15 nt, Homo sapiens
ccuggcugagcaguu

SEQ ID NO: 1483370 - RNA, 15 nt, Homo sapiens
ccuggcugagggcag

SEQ ID NO: 1483371 - RNA, 19 nt, Homo sapiens
ccugggaauguauuauucu

SEQ ID NO: 1483372 - RNA, 12 nt, Homo sapiens
ccugggagacag

SEQ ID NO: 1483373 - RNA, 18 nt, Homo sapiens
ccugggaggaaauuugaa

SEQ ID NO: 1483374 - RNA, 17 nt, Homo sapiens
ccugggcaauuccgcau

SEQ ID NO: 1483375 - RNA, 23 nt, Homo sapiens
ccugggcugucugucaccagcua

SEQ ID NO: 1483376 - RNA, 23 nt, Homo sapiens
ccugggcuuggccugcugugauu

SEQ ID NO: 1483377 - RNA, 22 nt, Homo sapiens
ccuggggacuguuccaaagcca

SEQ ID NO: 1483378 - RNA, 20 nt, Homo sapiens
ccuggggcaggucacuuuac

SEQ ID NO: 1483379 - RNA, 20 nt, Homo sapiens
ccuggggguggcaggcacac

SEQ ID NO: 1483380 - RNA, 13 nt, Homo sapiens
ccuggugcugaga

SEQ ID NO: 1483381 - RNA, 12 nt, Homo sapiens
ccugguguuucu

SEQ ID NO: 1483382 - RNA, 21 nt, Homo sapiens
ccugguuaaauuugaauuuca

SEQ ID NO: 1483383 - RNA, 20 nt, Homo sapiens
ccugguuugacucaguucca

SEQ ID NO: 1483384 - RNA, 20 nt, Homo sapiens
ccuguaaucccaacacuuug

SEQ ID NO: 1483385 - RNA, 18 nt, Homo sapiens
ccuguaaucucagcacuu

SEQ ID NO: 1483386 - RNA, 15 nt, Homo sapiens
ccuguaauuccagcu

SEQ ID NO: 1483387 - RNA, 17 nt, Homo sapiens
ccuguagguucuugaua

SEQ ID NO: 1483388 - RNA, 15 nt, Homo sapiens
ccuguagucccagcu

SEQ ID NO: 1483389 - RNA, 23 nt, Homo sapiens
ccuguauaaguggaggcacuuua

SEQ ID NO: 1483390 - RNA, 14 nt, Homo sapiens
ccugucaaauauca

SEQ ID NO: 1483391 - RNA, 15 nt, Homo sapiens
ccuguccaugccccu

SEQ ID NO: 1483392 - RNA, 14 nt, Homo sapiens
ccugucccaugcag

SEQ ID NO: 1483393 - RNA, 13 nt, Homo sapiens
ccugucccaugga

SEQ ID NO: 1483394 - RNA, 19 nt, Homo sapiens
ccugucccauggacacucc

SEQ ID NO: 1483395 - RNA, 16 nt, Homo sapiens
ccuguccuaagcacuu

SEQ ID NO: 1483396 - RNA, 17 nt, Homo sapiens
ccuguccuaagcacuuu

SEQ ID NO: 1483397 - RNA, 23 nt, Homo sapiens
ccuguccuccaacaccaagcaca

SEQ ID NO: 1483398 - RNA, 17 nt, Homo sapiens
ccuguccuuucuugcag

SEQ ID NO: 1483399 - RNA, 19 nt, Homo sapiens
ccugucuggcucaggguca

SEQ ID NO: 1483400 - RNA, 11 nt, Homo sapiens
ccugugacugu

SEQ ID NO: 1483401 - RNA, 17 nt, Homo sapiens
ccugugccaucaccaua

SEQ ID NO: 1483402 - RNA, 15 nt, Homo sapiens
ccugugccuccucag

SEQ ID NO: 1483403 - RNA, 19 nt, Homo sapiens
ccugugcuuguguuugcug

SEQ ID NO: 1483404 - RNA, 17 nt, Homo sapiens
ccugugggugaaacaga

SEQ ID NO: 1483405 - RNA, 22 nt, Homo sapiens
ccuguggguuugguccuugaac

SEQ ID NO: 1483406 - RNA, 15 nt, Homo sapiens
ccuguuagacguccu

SEQ ID NO: 1483407 - RNA, 14 nt, Homo sapiens
ccuguucaaaaagg

SEQ ID NO: 1483408 - RNA, 22 nt, Homo sapiens
ccuguugcuguguuuaauuuga

SEQ ID NO: 1483409 - RNA, 22 nt, Homo sapiens
ccuguuuuaauucaacccagcc

SEQ ID NO: 1483410 - RNA, 19 nt, Homo sapiens
ccuguuuuaccguugcuaa

SEQ ID NO: 1483411 - RNA, 22 nt, Homo sapiens
ccuuaaaauaaugaauacauuu

SEQ ID NO: 1483412 - RNA, 12 nt, Homo sapiens
ccuuaaauuugu

SEQ ID NO: 1483413 - RNA, 15 nt, Homo sapiens
ccuuaacacauucaa

SEQ ID NO: 1483414 - RNA, 16 nt, Homo sapiens
ccuuaacacauucaau

SEQ ID NO: 1483415 - RNA, 19 nt, Homo sapiens
ccuuaagagucauccagcu

SEQ ID NO: 1483416 - RNA, 17 nt, Homo sapiens
ccuuaagucaaaagaga

SEQ ID NO: 1483417 - RNA, 18 nt, Homo sapiens
ccuuaauuuccuuuuuga

SEQ ID NO: 1483418 - RNA, 22 nt, Homo sapiens
ccuuacgcuuugucacacaaaa

SEQ ID NO: 1483419 - RNA, 16 nt, Homo sapiens
ccuuauuguaccucuc

SEQ ID NO: 1483420 - RNA, 12 nt, Homo sapiens
cuagcacuuugg

SEQ ID NO: 1483421 - RNA, 23 nt, Homo sapiens
cuagcagaaaucuagaagacugu

SEQ ID NO: 1483422 - RNA, 19 nt, Homo sapiens
cuagcagaggaaaguguaa

SEQ ID NO: 1483423 - RNA, 15 nt, Homo sapiens
cuagcgcaagaccag

SEQ ID NO: 1483424 - RNA, 17 nt, Homo sapiens
cuagcgcaagaccaguc

SEQ ID NO: 1483425 - RNA, 16 nt, Homo sapiens
cuagcuaauguaauaa

SEQ ID NO: 1483426 - RNA, 14 nt, Homo sapiens
cuagcuuagcuguc

SEQ ID NO: 1483427 - RNA, 21 nt, Homo sapiens
cuaggaaacucacacuccccu

SEQ ID NO: 1483428 - RNA, 18 nt, Homo sapiens
cuaggaagacauuuuucc

SEQ ID NO: 1483429 - RNA, 18 nt, Homo sapiens
cuaggaagagcaggacuc

SEQ ID NO: 1483430 - RNA, 16 nt, Homo sapiens
cuaggggaacagacca

SEQ ID NO: 1483431 - RNA, 15 nt, Homo sapiens
cuagguaggggccca

SEQ ID NO: 1483432 - RNA, 22 nt, Homo sapiens
cuagguaucauucaacucucca

SEQ ID NO: 1483433 - RNA, 16 nt, Homo sapiens
cuaggucacuucucac

SEQ ID NO: 1483434 - RNA, 17 nt, Homo sapiens
cuaggucuccucagggu

SEQ ID NO: 1483435 - RNA, 16 nt, Homo sapiens
cuagguguggcuguga

SEQ ID NO: 1483436 - RNA, 20 nt, Homo sapiens
cuagguucuaaaaauuguga

SEQ ID NO: 1483437 - RNA, 19 nt, Homo sapiens
cuaguaagaugcacugaaa

SEQ ID NO: 1483438 - RNA, 19 nt, Homo sapiens
cuagucugcuagccaggau

SEQ ID NO: 1483439 - RNA, 23 nt, Homo sapiens
cuagugaagaccagagcaguuuc

SEQ ID NO: 1483440 - RNA, 16 nt, Homo sapiens
cuagugacaagcuccu

SEQ ID NO: 1483441 - RNA, 17 nt, Homo sapiens
cuaguggcucucaguua

SEQ ID NO: 1483442 - RNA, 18 nt, Homo sapiens
cuaguguaccuccucuca

SEQ ID NO: 1483443 - RNA, 23 nt, Homo sapiens
cuaguuauuuuauaaucaaugaa

SEQ ID NO: 1483444 - RNA, 20 nt, Homo sapiens
cuaguucagagccaagccuu

SEQ ID NO: 1483445 - RNA, 14 nt, Homo sapiens
cuaguuucccugaa

SEQ ID NO: 1483446 - RNA, 19 nt, Homo sapiens
cuaguuuuuauacaugugu

SEQ ID NO: 1483447 - RNA, 19 nt, Homo sapiens
cuauaaagaagaacuugca

SEQ ID NO: 1483448 - RNA, 20 nt, Homo sapiens
cuauaaagguugacaauaaa

SEQ ID NO: 1483449 - RNA, 16 nt, Homo sapiens
cuauaaaguaaagcua

SEQ ID NO: 1483450 - RNA, 16 nt, Homo sapiens
cuauaaggcugagggc

SEQ ID NO: 1483451 - RNA, 17 nt, Homo sapiens
cuauaauaaaacuaaac

SEQ ID NO: 1483452 - RNA, 17 nt, Homo sapiens
cuauauacuauaugauu

SEQ ID NO: 1483453 - RNA, 18 nt, Homo sapiens
cuauauacuauaugauuc

SEQ ID NO: 1483454 - RNA, 16 nt, Homo sapiens
cuauauagaaugcugc

SEQ ID NO: 1483455 - RNA, 15 nt, Homo sapiens
cuauauccugugacu

SEQ ID NO: 1483456 - RNA, 22 nt, Homo sapiens
cuauauccugugacugucucac

SEQ ID NO: 1483457 - RNA, 17 nt, Homo sapiens
cuauauugcacugugac

SEQ ID NO: 1483458 - RNA, 24 nt, Homo sapiens
cuauauuuuuuguaacauaaugca

SEQ ID NO: 1483459 - RNA, 21 nt, Homo sapiens
cuaucauacuacugaaacaga

SEQ ID NO: 1483460 - RNA, 14 nt, Homo sapiens
cuaucgcaccacug

SEQ ID NO: 1483461 - RNA, 18 nt, Homo sapiens
cuaucuaucuuccaaaug

SEQ ID NO: 1483462 - RNA, 20 nt, Homo sapiens
cuaucugcuguauauggaau

SEQ ID NO: 1483463 - RNA, 19 nt, Homo sapiens
cuaugaaugauacccugaa

SEQ ID NO: 1483464 - RNA, 15 nt, Homo sapiens
cuaugacacugagca

SEQ ID NO: 1483465 - RNA, 21 nt, Homo sapiens
cuaugagaauugggauuacau

SEQ ID NO: 1483466 - RNA, 16 nt, Homo sapiens
cuaugagcacauagga

SEQ ID NO: 1483467 - RNA, 17 nt, Homo sapiens
cuaugagcacauaggac

SEQ ID NO: 1483468 - RNA, 22 nt, Homo sapiens
cuaugcaacagcucucaccuac

SEQ ID NO: 1483469 - RNA, 16 nt, Homo sapiens
cuaugcuguucacugg

SEQ ID NO: 1483470 - RNA, 22 nt, Homo sapiens
cuauggacagcuuuucccaaga

SEQ ID NO: 1483471 - RNA, 21 nt, Homo sapiens
cuaugggaacaauugaaguaa

SEQ ID NO: 1483472 - RNA, 22 nt, Homo sapiens
cuauguauggaauacaguguua

SEQ ID NO: 1483473 - RNA, 16 nt, Homo sapiens
cuauguccauucucau

SEQ ID NO: 1483474 - RNA, 13 nt, Homo sapiens
cuaugugauuaca

SEQ ID NO: 1483475 - RNA, 19 nt, Homo sapiens
cuauuaaaugagcacguuu

SEQ ID NO: 1483476 - RNA, 20 nt, Homo sapiens
cuauuaaucaccucucugua

SEQ ID NO: 1483477 - RNA, 16 nt, Homo sapiens
cuauuacaccaaauaa

SEQ ID NO: 1483478 - RNA, 18 nt, Homo sapiens
cuauucaauucuuuuaac

SEQ ID NO: 1483479 - RNA, 20 nt, Homo sapiens
cuauucccucucucucccag

SEQ ID NO: 1483480 - RNA, 19 nt, Homo sapiens
cuauugacaagucauuuua

SEQ ID NO: 1483481 - RNA, 15 nt, Homo sapiens
cuauuguuacucugg

SEQ ID NO: 1483482 - RNA, 23 nt, Homo sapiens
cuauuguugaugggcacuugaga

SEQ ID NO: 1483483 - RNA, 15 nt, Homo sapiens
cuauuuaaguuauca

SEQ ID NO: 1483484 - RNA, 22 nt, Homo sapiens
cuauuucauguuuuugaucaaa

SEQ ID NO: 1483485 - RNA, 22 nt, Homo sapiens
cuauuucuguauauaaaggugc

SEQ ID NO: 1483486 - RNA, 21 nt, Homo sapiens
cuauuuggggcuugcaugcca

SEQ ID NO: 1483487 - RNA, 23 nt, Homo sapiens
cuauuuggggcuugcaugccaaa

SEQ ID NO: 1483488 - RNA, 20 nt, Homo sapiens
cuauuuguaaaucugccaca

SEQ ID NO: 1483489 - RNA, 14 nt, Homo sapiens
cuauuuuacuuugu

SEQ ID NO: 1483490 - RNA, 24 nt, Homo sapiens
cucaaaaaaaaaaaaaugcacaua

SEQ ID NO: 1483491 - RNA, 13 nt, Homo sapiens
cucaaacuaucug

SEQ ID NO: 1483492 - RNA, 20 nt, Homo sapiens
cucaaacuccugaccucagg

SEQ ID NO: 1483493 - RNA, 16 nt, Homo sapiens
cucaaacuugagaaaa

SEQ ID NO: 1483494 - RNA, 23 nt, Homo sapiens
cucaaaucuauucagacaagcaa

SEQ ID NO: 1483495 - RNA, 20 nt, Homo sapiens
cucaaauggggccagaucca

SEQ ID NO: 1483496 - RNA, 18 nt, Homo sapiens
cucaacagccaaguguga

SEQ ID NO: 1483497 - RNA, 18 nt, Homo sapiens
cucaacguugcuccccau

SEQ ID NO: 1483498 - RNA, 16 nt, Homo sapiens
cucaagaagugaagaa

SEQ ID NO: 1483499 - RNA, 13 nt, Homo sapiens
cucaagacucacc

SEQ ID NO: 1483500 - RNA, 14 nt, Homo sapiens
cucaagaguacaga

SEQ ID NO: 1483501 - RNA, 12 nt, Homo sapiens
cucaagcacuga

SEQ ID NO: 1483502 - RNA, 23 nt, Homo sapiens
cucaagcgauccucccaccucag

SEQ ID NO: 1483503 - RNA, 12 nt, Homo sapiens
cucaagcugucc

SEQ ID NO: 1483504 - RNA, 15 nt, Homo sapiens
cucaaggacuugaaa

SEQ ID NO: 1483505 - RNA, 20 nt, Homo sapiens
cucaaguucauugaugaccc

SEQ ID NO: 1483506 - RNA, 16 nt, Homo sapiens
cucaauaaacauuuca

SEQ ID NO: 1483507 - RNA, 19 nt, Homo sapiens
cucaauaaaugauucuuag

SEQ ID NO: 1483508 - RNA, 14 nt, Homo sapiens
cucaaugccaguaa

SEQ ID NO: 1483509 - RNA, 14 nt, Homo sapiens
cucaauuugcagua

SEQ ID NO: 1483510 - RNA, 14 nt, Homo sapiens
cucacagagugcau

SEQ ID NO: 1483511 - RNA, 20 nt, Homo sapiens
cucacagagugcauugugag

SEQ ID NO: 1483512 - RNA, 19 nt, Homo sapiens
cucacccaccccugcacag

SEQ ID NO: 1483513 - RNA, 14 nt, Homo sapiens
cucacccaucccac

SEQ ID NO: 1483514 - RNA, 21 nt, Homo sapiens
cucacgccuguaauucuagca

SEQ ID NO: 1483515 - RNA, 17 nt, Homo sapiens
cucacucccaccugcau

SEQ ID NO: 1483516 - RNA, 13 nt, Homo sapiens
cucacuccuagga

SEQ ID NO: 1483517 - RNA, 14 nt, Homo sapiens
cucacuccuguuac

SEQ ID NO: 1483518 - RNA, 18 nt, Homo sapiens
cucacugaggguaucuga

SEQ ID NO: 1483519 - RNA, 13 nt, Homo sapiens
cucacugauauau

SEQ ID NO: 1483520 - RNA, 14 nt, Homo sapiens
cucacuguucugca

SEQ ID NO: 1483521 - RNA, 14 nt, Homo sapiens
cucacuuaucccaa

SEQ ID NO: 1483522 - RNA, 16 nt, Homo sapiens
cugcagaauccagcua

SEQ ID NO: 1483523 - RNA, 18 nt, Homo sapiens
cugcagagcaccuuugca

SEQ ID NO: 1483524 - RNA, 13 nt, Homo sapiens
cugcagcaaacac

SEQ ID NO: 1483525 - RNA, 17 nt, Homo sapiens
cugcagcaggaguggug

SEQ ID NO: 1483526 - RNA, 12 nt, Homo sapiens
cugcagccagcu

SEQ ID NO: 1483527 - RNA, 22 nt, Homo sapiens
cugcagccccagaagaaauuag

SEQ ID NO: 1483528 - RNA, 20 nt, Homo sapiens
cugcagccuggcugguccuc

SEQ ID NO: 1483529 - RNA, 14 nt, Homo sapiens
cugcaggaaucaaa

SEQ ID NO: 1483530 - RNA, 21 nt, Homo sapiens
cugcagguuccuuaucuguca

SEQ ID NO: 1483531 - RNA, 15 nt, Homo sapiens
cugcaugugcuguca

SEQ ID NO: 1483532 - RNA, 15 nt, Homo sapiens
cugcauguuacauaa

SEQ ID NO: 1483533 - RNA, 15 nt, Homo sapiens
cugcauuuugcuauu

SEQ ID NO: 1483534 - RNA, 18 nt, Homo sapiens
cugccaaaggaugugaua

SEQ ID NO: 1483535 - RNA, 17 nt, Homo sapiens
cugccacaccagucaca

SEQ ID NO: 1483536 - RNA, 12 nt, Homo sapiens
cugccagccuug

SEQ ID NO: 1483537 - RNA, 16 nt, Homo sapiens
cugccagcugcacuga

SEQ ID NO: 1483538 - RNA, 21 nt, Homo sapiens
cugccauaaauauuucucaac

SEQ ID NO: 1483539 - RNA, 22 nt, Homo sapiens
cugccaucgaccuggagacuga

SEQ ID NO: 1483540 - RNA, 13 nt, Homo sapiens
cugccauguacua

SEQ ID NO: 1483541 - RNA, 22 nt, Homo sapiens
cugccauuggagccaaugugug

SEQ ID NO: 1483542 - RNA, 12 nt, Homo sapiens
cugccauuuccc

SEQ ID NO: 1483543 - RNA, 16 nt, Homo sapiens
cugcccaccuccugga

SEQ ID NO: 1483544 - RNA, 14 nt, Homo sapiens
cugcccagcacagg

SEQ ID NO: 1483545 - RNA, 19 nt, Homo sapiens
cugcccauucaccaaaauu

SEQ ID NO: 1483546 - RNA, 20 nt, Homo sapiens
cugccccaaacaaauaugca

SEQ ID NO: 1483547 - RNA, 19 nt, Homo sapiens
cugccccaccccaccucca

SEQ ID NO: 1483548 - RNA, 13 nt, Homo sapiens
cugccccuagaca

SEQ ID NO: 1483549 - RNA, 18 nt, Homo sapiens
cugccccuagacauggac

SEQ ID NO: 1483550 - RNA, 17 nt, Homo sapiens
cugccccucucaccaaa

SEQ ID NO: 1483551 - RNA, 16 nt, Homo sapiens
cugccccuuaaacaca

SEQ ID NO: 1483552 - RNA, 22 nt, Homo sapiens
cugcccgggaaggucaccagca

SEQ ID NO: 1483553 - RNA, 17 nt, Homo sapiens
cugcccuuuccuaggcc

SEQ ID NO: 1483554 - RNA, 16 nt, Homo sapiens
cugccuucaccccacu

SEQ ID NO: 1483555 - RNA, 19 nt, Homo sapiens
cugccuugcccacuccugc

SEQ ID NO: 1483556 - RNA, 13 nt, Homo sapiens
cugcgaccuugca

SEQ ID NO: 1483557 - RNA, 22 nt, Homo sapiens
cugcgcugguugaaaaauggca

SEQ ID NO: 1483558 - RNA, 15 nt, Homo sapiens
cugcggcgucugucu

SEQ ID NO: 1483559 - RNA, 21 nt, Homo sapiens
cugcguccuccucaccucaug

SEQ ID NO: 1483560 - RNA, 20 nt, Homo sapiens
cugcuaaggcuccuccuugc

SEQ ID NO: 1483561 - RNA, 18 nt, Homo sapiens
cugcuauuugcuguuauu

SEQ ID NO: 1483562 - RNA, 16 nt, Homo sapiens
cugcucaagaagacau

SEQ ID NO: 1483563 - RNA, 16 nt, Homo sapiens
cugcucacaguccuca

SEQ ID NO: 1483564 - RNA, 16 nt, Homo sapiens
cugcucaccaccugcc

SEQ ID NO: 1483565 - RNA, 22 nt, Homo sapiens
cugcuccaccagcagcauggca

SEQ ID NO: 1483566 - RNA, 16 nt, Homo sapiens
cugcuccaguccugga

SEQ ID NO: 1483567 - RNA, 16 nt, Homo sapiens
cugcuccagugcagga

SEQ ID NO: 1483568 - RNA, 19 nt, Homo sapiens
cugcucccccugguggugg

SEQ ID NO: 1483569 - RNA, 20 nt, Homo sapiens
cugcucccuccagaauggaa

SEQ ID NO: 1483570 - RNA, 17 nt, Homo sapiens
cugcuccgcugcuccuu

SEQ ID NO: 1483571 - RNA, 21 nt, Homo sapiens
cugcucuagugggacagccca

SEQ ID NO: 1483572 - RNA, 18 nt, Homo sapiens
cugcucuggaaaauguga

SEQ ID NO: 1483573 - RNA, 22 nt, Homo sapiens
cugcucuggaaaaugugaccca

SEQ ID NO: 1483574 - RNA, 14 nt, Homo sapiens
cugcucuuccucag

SEQ ID NO: 1483575 - RNA, 15 nt, Homo sapiens
cugcucuuucucugc

SEQ ID NO: 1483576 - RNA, 17 nt, Homo sapiens
cugcugaaggaggguca

SEQ ID NO: 1483577 - RNA, 17 nt, Homo sapiens
cugcugcauagcucuau

SEQ ID NO: 1483578 - RNA, 16 nt, Homo sapiens
cugcugcuccagugca

SEQ ID NO: 1483579 - RNA, 17 nt, Homo sapiens
cugcugcuggaucacag

SEQ ID NO: 1483580 - RNA, 19 nt, Homo sapiens
cugcugugauuccacuaca

SEQ ID NO: 1483581 - RNA, 16 nt, Homo sapiens
cugcuguuacuguuaa

SEQ ID NO: 1483582 - RNA, 14 nt, Homo sapiens
cugcuuaauucaaa

SEQ ID NO: 1483583 - RNA, 21 nt, Homo sapiens
cugcuucaguccacaguacau

SEQ ID NO: 1483584 - RNA, 19 nt, Homo sapiens
cugcuuccgagauccccag

SEQ ID NO: 1483585 - RNA, 22 nt, Homo sapiens
cugcuucuguguguggugagca

SEQ ID NO: 1483586 - RNA, 19 nt, Homo sapiens
cugcuugaccguacucuca

SEQ ID NO: 1483587 - RNA, 20 nt, Homo sapiens
cugcuugaccguacucucac

SEQ ID NO: 1483588 - RNA, 20 nt, Homo sapiens
cugcuugaugaagcaaggaa

SEQ ID NO: 1483589 - RNA, 14 nt, Homo sapiens
cugcuuuaucuuuu

SEQ ID NO: 1483590 - RNA, 19 nt, Homo sapiens
cugcuuugaaacuugccug

SEQ ID NO: 1483591 - RNA, 17 nt, Homo sapiens
cugcuuugggaagccgu

SEQ ID NO: 1483592 - RNA, 13 nt, Homo sapiens
cugcuuuguucaa

SEQ ID NO: 1483593 - RNA, 15 nt, Homo sapiens
cuggaaaaauuccag

SEQ ID NO: 1483594 - RNA, 22 nt, Homo sapiens
cuggaaacugcucccaucauuc

SEQ ID NO: 1483595 - RNA, 17 nt, Homo sapiens
cuggaacagaagacagc

SEQ ID NO: 1483596 - RNA, 23 nt, Homo sapiens
cuggaagaaaaaaaccacacaaa

SEQ ID NO: 1483597 - RNA, 20 nt, Homo sapiens
cuggaagaagugagcagugu

SEQ ID NO: 1483598 - RNA, 16 nt, Homo sapiens
cuggaaggcuuccacu

SEQ ID NO: 1483599 - RNA, 23 nt, Homo sapiens
cuggaauaagaagcaaauaaaua

SEQ ID NO: 1483600 - RNA, 18 nt, Homo sapiens
cuggaauauugugauucu

SEQ ID NO: 1483601 - RNA, 17 nt, Homo sapiens
cuggaaucuggagacca

SEQ ID NO: 1483602 - RNA, 13 nt, Homo sapiens
cuggaauugcuca

SEQ ID NO: 1483603 - RNA, 21 nt, Homo sapiens
cuggaauuuggacaagugcug

SEQ ID NO: 1483604 - RNA, 13 nt, Homo sapiens
cuggacaagccaa

SEQ ID NO: 1483605 - RNA, 20 nt, Homo sapiens
cuggaccugccuccugccug

SEQ ID NO: 1483606 - RNA, 18 nt, Homo sapiens
cuggacggggacugggga

SEQ ID NO: 1483607 - RNA, 20 nt, Homo sapiens
cuggagaacuagagaaggac

SEQ ID NO: 1483608 - RNA, 21 nt, Homo sapiens
cuggagaccagggagccuuug

SEQ ID NO: 1483609 - RNA, 13 nt, Homo sapiens
cuggagauaugaa

SEQ ID NO: 1483610 - RNA, 14 nt, Homo sapiens
cuggagaugcugcc

SEQ ID NO: 1483611 - RNA, 20 nt, Homo sapiens
cuggagcccauccagucucc

SEQ ID NO: 1483612 - RNA, 22 nt, Homo sapiens
cuggagcccccagcagaggcag

SEQ ID NO: 1483613 - RNA, 22 nt, Homo sapiens
cuggaggcccaguucacccuga

SEQ ID NO: 1483614 - RNA, 23 nt, Homo sapiens
cuggaggcggcaaagggugaaau

SEQ ID NO: 1483615 - RNA, 17 nt, Homo sapiens
cuggaguccugcucugu

SEQ ID NO: 1483616 - RNA, 21 nt, Homo sapiens
cuggagugcaguggugugauc

SEQ ID NO: 1483617 - RNA, 13 nt, Homo sapiens
cuggagugcaguu

SEQ ID NO: 1483618 - RNA, 20 nt, Homo sapiens
cuggagugcugugcuguguu

SEQ ID NO: 1483619 - RNA, 21 nt, Homo sapiens
cuggaguuucauguacaagau

SEQ ID NO: 1483620 - RNA, 19 nt, Homo sapiens
cuggauccagcacugguga

SEQ ID NO: 1483621 - RNA, 21 nt, Homo sapiens
cuggauccagccaugccugag

SEQ ID NO: 1483622 - RNA, 17 nt, Homo sapiens
cuggaugaaauaacucc

SEQ ID NO: 1483623 - RNA, 17 nt, Homo sapiens
cuggauggcccauagac

SEQ ID NO: 1483624 - RNA, 18 nt, Homo sapiens
cuuccuuccucucugcaa

SEQ ID NO: 1483625 - RNA, 13 nt, Homo sapiens
cuucggauaugau

SEQ ID NO: 1483626 - RNA, 19 nt, Homo sapiens
cuucuaugguugacauugu

SEQ ID NO: 1483627 - RNA, 20 nt, Homo sapiens
cuucuaugguugacauugua

SEQ ID NO: 1483628 - RNA, 18 nt, Homo sapiens
cuucucagaagcacagaa

SEQ ID NO: 1483629 - RNA, 14 nt, Homo sapiens
cuucucauagcauu

SEQ ID NO: 1483630 - RNA, 16 nt, Homo sapiens
cuucuccaaaugagau

SEQ ID NO: 1483631 - RNA, 17 nt, Homo sapiens
cuucuccaccaaagaca

SEQ ID NO: 1483632 - RNA, 15 nt, Homo sapiens
cuucuccaucuccug

SEQ ID NO: 1483633 - RNA, 14 nt, Homo sapiens
cuucuccaugagac

SEQ ID NO: 1483634 - RNA, 16 nt, Homo sapiens
cuucuccuaugcauuu

SEQ ID NO: 1483635 - RNA, 20 nt, Homo sapiens
cuucuccucucugggccuuu

SEQ ID NO: 1483636 - RNA, 10 nt, Homo sapiens
cuucucucac

SEQ ID NO: 1483637 - RNA, 19 nt, Homo sapiens
cuucugacacugaaacuuc

SEQ ID NO: 1483638 - RNA, 21 nt, Homo sapiens
cuucugaccacagcaucauuu

SEQ ID NO: 1483639 - RNA, 21 nt, Homo sapiens
cuucugaggcgcugcuuuguc

SEQ ID NO: 1483640 - RNA, 23 nt, Homo sapiens
cuucugaggcgcugcuuugucaa

SEQ ID NO: 1483641 - RNA, 21 nt, Homo sapiens
cuucugcuaauaccucuuacu

SEQ ID NO: 1483642 - RNA, 16 nt, Homo sapiens
cuucuggggguggugg

SEQ ID NO: 1483643 - RNA, 17 nt, Homo sapiens
cuucuguaguacuccuu

SEQ ID NO: 1483644 - RNA, 12 nt, Homo sapiens
cuucuuacugau

SEQ ID NO: 1483645 - RNA, 15 nt, Homo sapiens
cuucuuacuggugcu

SEQ ID NO: 1483646 - RNA, 21 nt, Homo sapiens
cuucuuagcacuguugagagg

SEQ ID NO: 1483647 - RNA, 14 nt, Homo sapiens
cuucuucauauucu

SEQ ID NO: 1483648 - RNA, 13 nt, Homo sapiens
cuucuugcucccc

SEQ ID NO: 1483649 - RNA, 19 nt, Homo sapiens
cuucuuguaguagucucau

SEQ ID NO: 1483650 - RNA, 22 nt, Homo sapiens
cuucuuugacaccacaccauca

SEQ ID NO: 1483651 - RNA, 21 nt, Homo sapiens
cuugaaacagauucaggccag

SEQ ID NO: 1483652 - RNA, 14 nt, Homo sapiens
cuugaaacauuaua

SEQ ID NO: 1483653 - RNA, 13 nt, Homo sapiens
cuugaaaccaaag

SEQ ID NO: 1483654 - RNA, 16 nt, Homo sapiens
cuugaaauuauaucug

SEQ ID NO: 1483655 - RNA, 13 nt, Homo sapiens
cuugaacccaaga

SEQ ID NO: 1483656 - RNA, 17 nt, Homo sapiens
cuugaacucuguucccc

SEQ ID NO: 1483657 - RNA, 18 nt, Homo sapiens
cuugaagggccagagcca

SEQ ID NO: 1483658 - RNA, 19 nt, Homo sapiens
cuugaagggccagagccag

SEQ ID NO: 1483659 - RNA, 14 nt, Homo sapiens
cuugaagggcuuua

SEQ ID NO: 1483660 - RNA, 14 nt, Homo sapiens
cuugaaugcugcca

SEQ ID NO: 1483661 - RNA, 16 nt, Homo sapiens
cuugaauguggcuuga

SEQ ID NO: 1483662 - RNA, 15 nt, Homo sapiens
cuugaaugugucacu

SEQ ID NO: 1483663 - RNA, 13 nt, Homo sapiens
cuugaauuucaaa

SEQ ID NO: 1483664 - RNA, 15 nt, Homo sapiens
cuugacauguagcuu

SEQ ID NO: 1483665 - RNA, 15 nt, Homo sapiens
cuugaccuguuucuc

SEQ ID NO: 1483666 - RNA, 18 nt, Homo sapiens
cuugacuuccugccaugg

SEQ ID NO: 1483667 - RNA, 15 nt, Homo sapiens
cuugagcuucugggg

SEQ ID NO: 1483668 - RNA, 14 nt, Homo sapiens
cuugaguucccaga

SEQ ID NO: 1483669 - RNA, 19 nt, Homo sapiens
cuugaguuuuuaguggaag

SEQ ID NO: 1483670 - RNA, 19 nt, Homo sapiens
cuugauaggaauucaucuu

SEQ ID NO: 1483671 - RNA, 18 nt, Homo sapiens
cuugauggagauauuuac

SEQ ID NO: 1483672 - RNA, 15 nt, Homo sapiens
cuugaugugccauuu

SEQ ID NO: 1483673 - RNA, 23 nt, Homo sapiens
cuugauuaagauuuuacaaaaga

SEQ ID NO: 1483674 - RNA, 21 nt, Homo sapiens
cuugauugugggauacuauuu

SEQ ID NO: 1483675 - RNA, 20 nt, Homo sapiens
cuugcaccccaaagcuuucc

SEQ ID NO: 1483676 - RNA, 17 nt, Homo sapiens
cuugcaguuaaggguua

SEQ ID NO: 1483677 - RNA, 13 nt, Homo sapiens
cuugcauucauuu

SEQ ID NO: 1483678 - RNA, 13 nt, Homo sapiens
cuugccacagugu

SEQ ID NO: 1483679 - RNA, 17 nt, Homo sapiens
cuugcccagacuacagg

SEQ ID NO: 1483680 - RNA, 20 nt, Homo sapiens
cuugccuaaauacaagggcu

SEQ ID NO: 1483681 - RNA, 17 nt, Homo sapiens
cuugcguauuggcuuuu

SEQ ID NO: 1483682 - RNA, 18 nt, Homo sapiens
cuugcuaauuuucucaaa

SEQ ID NO: 1483683 - RNA, 18 nt, Homo sapiens
cuugcucauaugcaugua

SEQ ID NO: 1483684 - RNA, 21 nt, Homo sapiens
cuugcugauggugacauugca

SEQ ID NO: 1483685 - RNA, 15 nt, Homo sapiens
cuugcugcugcugca

SEQ ID NO: 1483686 - RNA, 22 nt, Homo sapiens
cuugcugcugcugcacccaacu

SEQ ID NO: 1483687 - RNA, 16 nt, Homo sapiens
cuugcuggacggggac

SEQ ID NO: 1483688 - RNA, 23 nt, Homo sapiens
cuugcuggacggggacuggggau

SEQ ID NO: 1483689 - RNA, 16 nt, Homo sapiens
cuugcugugcuucaaa

SEQ ID NO: 1483690 - RNA, 16 nt, Homo sapiens
cuugcuugcaauaggu

SEQ ID NO: 1483691 - RNA, 22 nt, Homo sapiens
cuugcuugucauugacucuugc

SEQ ID NO: 1483692 - RNA, 21 nt, Homo sapiens
cuuggaaauuggaagagcaca

SEQ ID NO: 1483693 - RNA, 20 nt, Homo sapiens
cuuggagacaaaaucuuaaa

SEQ ID NO: 1483694 - RNA, 15 nt, Homo sapiens
cuuggagcaggcaaa

SEQ ID NO: 1483695 - RNA, 13 nt, Homo sapiens
cuuggaugugguu

SEQ ID NO: 1483696 - RNA, 16 nt, Homo sapiens
cuuggauucucuaacc

SEQ ID NO: 1483697 - RNA, 21 nt, Homo sapiens
cuuggcaggaugaugcuguca

SEQ ID NO: 1483698 - RNA, 22 nt, Homo sapiens
cuuggccucccaaagugcuagu

SEQ ID NO: 1483699 - RNA, 13 nt, Homo sapiens
cuuggcugugagg

SEQ ID NO: 1483700 - RNA, 18 nt, Homo sapiens
cuugggcccugcacagau

SEQ ID NO: 1483701 - RNA, 16 nt, Homo sapiens
cuugggggucaggggg

SEQ ID NO: 1483702 - RNA, 21 nt, Homo sapiens
cuugggguacucuugauguga

SEQ ID NO: 1483703 - RNA, 22 nt, Homo sapiens
cuugggucucauuuagaacuug

SEQ ID NO: 1483704 - RNA, 18 nt, Homo sapiens
cuugggugggugaaggcc

SEQ ID NO: 1483705 - RNA, 14 nt, Homo sapiens
cuuguaaagacugu

SEQ ID NO: 1483706 - RNA, 16 nt, Homo sapiens
cuuguaaagacuguag

SEQ ID NO: 1483707 - RNA, 18 nt, Homo sapiens
cuuguaauucuaaaugaa

SEQ ID NO: 1483708 - RNA, 16 nt, Homo sapiens
cuuguaucaacacugu

SEQ ID NO: 1483709 - RNA, 15 nt, Homo sapiens
cuuguauguuuagag

SEQ ID NO: 1483710 - RNA, 15 nt, Homo sapiens
cuugucaaucccaac

SEQ ID NO: 1483711 - RNA, 15 nt, Homo sapiens
cuugucauugccagc

SEQ ID NO: 1483712 - RNA, 20 nt, Homo sapiens
cuugucccuuucccuaccuu

SEQ ID NO: 1483713 - RNA, 23 nt, Homo sapiens
cuuguccgcugggugguacccuc

SEQ ID NO: 1483714 - RNA, 16 nt, Homo sapiens
cuugucucacuugugc

SEQ ID NO: 1483715 - RNA, 13 nt, Homo sapiens
cuugucugaggga

SEQ ID NO: 1483716 - RNA, 17 nt, Homo sapiens
cuugugaaguggaaaug

SEQ ID NO: 1483717 - RNA, 22 nt, Homo sapiens
cuugugauuuuuauaauacaaa

SEQ ID NO: 1483718 - RNA, 22 nt, Homo sapiens
cuuguggcuccacacacacaaa

SEQ ID NO: 1483719 - RNA, 15 nt, Homo sapiens
cuuguguucugagua

SEQ ID NO: 1483720 - RNA, 15 nt, Homo sapiens
cuuguuaucagcuuu

SEQ ID NO: 1483721 - RNA, 16 nt, Homo sapiens
cuuguuccccacugac

SEQ ID NO: 1483722 - RNA, 13 nt, Homo sapiens
cuuguugcucaaa

SEQ ID NO: 1483723 - RNA, 20 nt, Homo sapiens
cuuguuugguaguuagccau

SEQ ID NO: 1483724 - RNA, 13 nt, Homo sapiens
cuuguuuuggaca

SEQ ID NO: 1483725 - RNA, 14 nt, Homo sapiens
cuuuaaaaugccaa

SEQ ID NO: 1483726 - RNA, 15 nt, Homo sapiens
cuuuaaacucaggga

SEQ ID NO: 1483727 - RNA, 19 nt, Homo sapiens
gcccacuguccugggccug

SEQ ID NO: 1483728 - RNA, 12 nt, Homo sapiens
gcccagacuaca

SEQ ID NO: 1483729 - RNA, 14 nt, Homo sapiens
gcccagagcccagc

SEQ ID NO: 1483730 - RNA, 21 nt, Homo sapiens
gcccagauucuaccacacagc

SEQ ID NO: 1483731 - RNA, 20 nt, Homo sapiens
gcccagcagggccucaaagu

SEQ ID NO: 1483732 - RNA, 22 nt, Homo sapiens
gcccagccaggccaacagcacc

SEQ ID NO: 1483733 - RNA, 20 nt, Homo sapiens
gcccaggauggagugcaaug

SEQ ID NO: 1483734 - RNA, 20 nt, Homo sapiens
gcccaggcuggaguggagug

SEQ ID NO: 1483735 - RNA, 16 nt, Homo sapiens
gcccagggaagccaaa

SEQ ID NO: 1483736 - RNA, 20 nt, Homo sapiens
gcccagggaagccaaaagau

SEQ ID NO: 1483737 - RNA, 15 nt, Homo sapiens
gcccagggcaucuug

SEQ ID NO: 1483738 - RNA, 17 nt, Homo sapiens
gcccagguuacaaagac

SEQ ID NO: 1483739 - RNA, 14 nt, Homo sapiens
gcccauaucuguga

SEQ ID NO: 1483740 - RNA, 12 nt, Homo sapiens
gcccauccugcc

SEQ ID NO: 1483741 - RNA, 19 nt, Homo sapiens
gcccaugcccaccugccca

SEQ ID NO: 1483742 - RNA, 23 nt, Homo sapiens
gcccaugggauaugugguguaua

SEQ ID NO: 1483743 - RNA, 16 nt, Homo sapiens
gcccaugugcaccugc

SEQ ID NO: 1483744 - RNA, 22 nt, Homo sapiens
gccccacccaguuucuggaaaa

SEQ ID NO: 1483745 - RNA, 16 nt, Homo sapiens
gccccagucggcccca

SEQ ID NO: 1483746 - RNA, 15 nt, Homo sapiens
gccccaugccugucc

SEQ ID NO: 1483747 - RNA, 21 nt, Homo sapiens
gcccccacguggggaggugga

SEQ ID NO: 1483748 - RNA, 13 nt, Homo sapiens
gcccccacugacc

SEQ ID NO: 1483749 - RNA, 16 nt, Homo sapiens
gcccccgccacaaccc

SEQ ID NO: 1483750 - RNA, 13 nt, Homo sapiens
gcccccugcaucu

SEQ ID NO: 1483751 - RNA, 13 nt, Homo sapiens
gccccuccaaacc

SEQ ID NO: 1483752 - RNA, 19 nt, Homo sapiens
gcccgcagugcugggacca

SEQ ID NO: 1483753 - RNA, 18 nt, Homo sapiens
gcccggaccuccaucaga

SEQ ID NO: 1483754 - RNA, 22 nt, Homo sapiens
gcccguacccagcccugcugca

SEQ ID NO: 1483755 - RNA, 20 nt, Homo sapiens
gcccgucauguuccucaaaa

SEQ ID NO: 1483756 - RNA, 16 nt, Homo sapiens
gcccuaagggacuuaa

SEQ ID NO: 1483757 - RNA, 15 nt, Homo sapiens
gcccuacaaaggcua

SEQ ID NO: 1483758 - RNA, 19 nt, Homo sapiens
gcccuagcccagacucuga

SEQ ID NO: 1483759 - RNA, 19 nt, Homo sapiens
gcccucaggggacuugaau

SEQ ID NO: 1483760 - RNA, 19 nt, Homo sapiens
gcccuccaccuuguuccug

SEQ ID NO: 1483761 - RNA, 16 nt, Homo sapiens
gcccuccccagacucc

SEQ ID NO: 1483762 - RNA, 21 nt, Homo sapiens
gcccuccccuccggacuggug

SEQ ID NO: 1483763 - RNA, 17 nt, Homo sapiens
gcccuccucccugucau

SEQ ID NO: 1483764 - RNA, 15 nt, Homo sapiens
gcccucgacacucac

SEQ ID NO: 1483765 - RNA, 21 nt, Homo sapiens
gcccucucugagucuggacuu

SEQ ID NO: 1483766 - RNA, 20 nt, Homo sapiens
gcccugaauccauaaaggca

SEQ ID NO: 1483767 - RNA, 23 nt, Homo sapiens
gcccugaccuuggcugacugggg

SEQ ID NO: 1483768 - RNA, 21 nt, Homo sapiens
gcccugauguguccucaggga

SEQ ID NO: 1483769 - RNA, 19 nt, Homo sapiens
gcccugcagcccaccagac

SEQ ID NO: 1483770 - RNA, 16 nt, Homo sapiens
gcccugcuuugcaaac

SEQ ID NO: 1483771 - RNA, 16 nt, Homo sapiens
gcccuggcucugcugu

SEQ ID NO: 1483772 - RNA, 20 nt, Homo sapiens
gcccuggcugaccccaaaga

SEQ ID NO: 1483773 - RNA, 16 nt, Homo sapiens
gcccuggcuggguuca

SEQ ID NO: 1483774 - RNA, 22 nt, Homo sapiens
gcccuuacuugcuucucuagcu

SEQ ID NO: 1483775 - RNA, 21 nt, Homo sapiens
gcccuucccacuggaggucac

SEQ ID NO: 1483776 - RNA, 14 nt, Homo sapiens
gcccuugucacugg

SEQ ID NO: 1483777 - RNA, 15 nt, Homo sapiens
gcccuuuccuuccag

SEQ ID NO: 1483778 - RNA, 14 nt, Homo sapiens
gcccuuuucaggaa

SEQ ID NO: 1483779 - RNA, 19 nt, Homo sapiens
gcccuuuucucucacccau

SEQ ID NO: 1483780 - RNA, 13 nt, Homo sapiens
gccgaaugugcag

SEQ ID NO: 1483781 - RNA, 14 nt, Homo sapiens
gccgaaugugcagg

SEQ ID NO: 1483782 - RNA, 19 nt, Homo sapiens
gccgacugccugugaagug

SEQ ID NO: 1483783 - RNA, 21 nt, Homo sapiens
gccgagaucgcgccacugcac

SEQ ID NO: 1483784 - RNA, 19 nt, Homo sapiens
gccgagccugcacuggggc

SEQ ID NO: 1483785 - RNA, 15 nt, Homo sapiens
gccgaguccaagcug

SEQ ID NO: 1483786 - RNA, 14 nt, Homo sapiens
gccgauggagacac

SEQ ID NO: 1483787 - RNA, 16 nt, Homo sapiens
gccgcagacgggcaca

SEQ ID NO: 1483788 - RNA, 17 nt, Homo sapiens
gccggaggcugcaguga

SEQ ID NO: 1483789 - RNA, 18 nt, Homo sapiens
gccggcccccaggacaag

SEQ ID NO: 1483790 - RNA, 19 nt, Homo sapiens
gccgggccuagaccuggug

SEQ ID NO: 1483791 - RNA, 16 nt, Homo sapiens
gccgggcugacugccc

SEQ ID NO: 1483792 - RNA, 19 nt, Homo sapiens
gccgggugugguggcucac

SEQ ID NO: 1483793 - RNA, 23 nt, Homo sapiens
gccgguccuucccucucaugacu

SEQ ID NO: 1483794 - RNA, 19 nt, Homo sapiens
gccgugccuucagcucuac

SEQ ID NO: 1483795 - RNA, 21 nt, Homo sapiens
gccuaaaagugggcuugauuc

SEQ ID NO: 1483796 - RNA, 15 nt, Homo sapiens
gccuaaaaguuacuu

SEQ ID NO: 1483797 - RNA, 16 nt, Homo sapiens
gccuaacuaacuggca

SEQ ID NO: 1483798 - RNA, 20 nt, Homo sapiens
gccuacaaccaucccugcca

SEQ ID NO: 1483799 - RNA, 17 nt, Homo sapiens
gccuacagccacauccc

SEQ ID NO: 1483800 - RNA, 16 nt, Homo sapiens
gccuaccucagccucc

SEQ ID NO: 1483801 - RNA, 14 nt, Homo sapiens
gccuagcgaucucu

SEQ ID NO: 1483802 - RNA, 16 nt, Homo sapiens
gccuauuuaccugcag

SEQ ID NO: 1483803 - RNA, 17 nt, Homo sapiens
gccuauuucucuuugca

SEQ ID NO: 1483804 - RNA, 16 nt, Homo sapiens
gccucaagaacaaaca

SEQ ID NO: 1483805 - RNA, 19 nt, Homo sapiens
gccucaaucucccaucugu

SEQ ID NO: 1483806 - RNA, 13 nt, Homo sapiens
gccucaaugccag

SEQ ID NO: 1483807 - RNA, 15 nt, Homo sapiens
gccucaaugccagua

SEQ ID NO: 1483808 - RNA, 19 nt, Homo sapiens
gccucaaugugaccagggg

SEQ ID NO: 1483809 - RNA, 19 nt, Homo sapiens
gccucacugaaacauggcu

SEQ ID NO: 1483810 - RNA, 19 nt, Homo sapiens
gccucagggcgcucagacg

SEQ ID NO: 1483811 - RNA, 17 nt, Homo sapiens
gccucagugaaggacua

SEQ ID NO: 1483812 - RNA, 11 nt, Homo sapiens
gccuccagggc

SEQ ID NO: 1483813 - RNA, 21 nt, Homo sapiens
gccuccaucucauguaucauc

SEQ ID NO: 1483814 - RNA, 23 nt, Homo sapiens
gccuccaucucauguaucaucug

SEQ ID NO: 1483815 - RNA, 16 nt, Homo sapiens
gccucccaaguagcug

SEQ ID NO: 1483816 - RNA, 16 nt, Homo sapiens
gccucccauccagggc

SEQ ID NO: 1483817 - RNA, 22 nt, Homo sapiens
gccuccccauuucccaucugca

SEQ ID NO: 1483818 - RNA, 21 nt, Homo sapiens
gccucccccucagaugaucuc

SEQ ID NO: 1483819 - RNA, 17 nt, Homo sapiens
gccuccccgugccaaaa

SEQ ID NO: 1483820 - RNA, 22 nt, Homo sapiens
gccuccucccugggcagaaagu

SEQ ID NO: 1483821 - RNA, 13 nt, Homo sapiens
gccuccuggccag

SEQ ID NO: 1483822 - RNA, 20 nt, Homo sapiens
gccucgggacaucaaaaaca

SEQ ID NO: 1483823 - RNA, 18 nt, Homo sapiens
gccucgugccaugaucug

SEQ ID NO: 1483824 - RNA, 13 nt, Homo sapiens
gccucuacuuuau

SEQ ID NO: 1483825 - RNA, 14 nt, Homo sapiens
gccucuacuuuauc

SEQ ID NO: 1483826 - RNA, 17 nt, Homo sapiens
gccucuccaguuugcac

SEQ ID NO: 1483827 - RNA, 16 nt, Homo sapiens
gccucuggacagccag

SEQ ID NO: 1483828 - RNA, 17 nt, Homo sapiens
gccucuggaugcuguga

SEQ ID NO: 1483829 - RNA, 16 nt, Homo sapiens
ggagacaugugacauu

SEQ ID NO: 1483830 - RNA, 17 nt, Homo sapiens
ggagaccagcucagagg

SEQ ID NO: 1483831 - RNA, 13 nt, Homo sapiens
ggagacugagauc

SEQ ID NO: 1483832 - RNA, 15 nt, Homo sapiens
ggagacugauggcca

SEQ ID NO: 1483833 - RNA, 21 nt, Homo sapiens
ggagacugauggccaggcaag

SEQ ID NO: 1483834 - RNA, 16 nt, Homo sapiens
ggagacuuuacaugga

SEQ ID NO: 1483835 - RNA, 13 nt, Homo sapiens
ggagagaaguuuc

SEQ ID NO: 1483836 - RNA, 12 nt, Homo sapiens
ggagaugcugcc

SEQ ID NO: 1483837 - RNA, 15 nt, Homo sapiens
ggagcaggaggccaa

SEQ ID NO: 1483838 - RNA, 19 nt, Homo sapiens
ggagcaugggccuggccac

SEQ ID NO: 1483839 - RNA, 19 nt, Homo sapiens
ggagcccccaccacaaacu

SEQ ID NO: 1483840 - RNA, 21 nt, Homo sapiens
ggagcucuacgugcuccucag

SEQ ID NO: 1483841 - RNA, 14 nt, Homo sapiens
ggagcugauggcag

SEQ ID NO: 1483842 - RNA, 17 nt, Homo sapiens
ggaggaacacugcacuc

SEQ ID NO: 1483843 - RNA, 23 nt, Homo sapiens
ggaggaacuuuucaagcugcuga

SEQ ID NO: 1483844 - RNA, 14 nt, Homo sapiens
ggaggacauuuggu

SEQ ID NO: 1483845 - RNA, 19 nt, Homo sapiens
ggaggacggugcaacccaa

SEQ ID NO: 1483846 - RNA, 20 nt, Homo sapiens
ggaggagaagaaaauguucu

SEQ ID NO: 1483847 - RNA, 15 nt, Homo sapiens
ggaggaucaguuuuu

SEQ ID NO: 1483848 - RNA, 12 nt, Homo sapiens
ggaggcaccugg

SEQ ID NO: 1483849 - RNA, 20 nt, Homo sapiens
ggaggcagagcuugcaguga

SEQ ID NO: 1483850 - RNA, 20 nt, Homo sapiens
ggaggcggagcuugcaguga

SEQ ID NO: 1483851 - RNA, 14 nt, Homo sapiens
ggaggcugggcaca

SEQ ID NO: 1483852 - RNA, 18 nt, Homo sapiens
ggaggcuuccccucacua

SEQ ID NO: 1483853 - RNA, 11 nt, Homo sapiens
ggaggcuuccu

SEQ ID NO: 1483854 - RNA, 15 nt, Homo sapiens
ggagggaagugugag

SEQ ID NO: 1483855 - RNA, 13 nt, Homo sapiens
ggagggacaagug

SEQ ID NO: 1483856 - RNA, 21 nt, Homo sapiens
ggagggacuuuuaaucaguga

SEQ ID NO: 1483857 - RNA, 19 nt, Homo sapiens
ggagggagggcgguggaca

SEQ ID NO: 1483858 - RNA, 21 nt, Homo sapiens
ggagggggucauuguucuccu

SEQ ID NO: 1483859 - RNA, 14 nt, Homo sapiens
ggaggggugguccu

SEQ ID NO: 1483860 - RNA, 16 nt, Homo sapiens
ggaggucauacaugca

SEQ ID NO: 1483861 - RNA, 19 nt, Homo sapiens
ggagguggagauugcagug

SEQ ID NO: 1483862 - RNA, 21 nt, Homo sapiens
ggaggugggcaugccacccuc

SEQ ID NO: 1483863 - RNA, 21 nt, Homo sapiens
ggaguaccuggaccuguccau

SEQ ID NO: 1483864 - RNA, 14 nt, Homo sapiens
ggaguacugaugaa

SEQ ID NO: 1483865 - RNA, 16 nt, Homo sapiens
ggagucagacauuuua

SEQ ID NO: 1483866 - RNA, 23 nt, Homo sapiens
ggagucagucuucacuugcacug

SEQ ID NO: 1483867 - RNA, 21 nt, Homo sapiens
ggagucucugccacccacuca

SEQ ID NO: 1483868 - RNA, 20 nt, Homo sapiens
ggaguguccucuucccucuc

SEQ ID NO: 1483869 - RNA, 18 nt, Homo sapiens
ggaguguggccacguggg

SEQ ID NO: 1483870 - RNA, 17 nt, Homo sapiens
ggaguuacaucuuuauu

SEQ ID NO: 1483871 - RNA, 12 nt, Homo sapiens
ggauaaaagccc

SEQ ID NO: 1483872 - RNA, 18 nt, Homo sapiens
ggauaaaaugacuacuua

SEQ ID NO: 1483873 - RNA, 22 nt, Homo sapiens
ggauaaagaauacuauuuccaa

SEQ ID NO: 1483874 - RNA, 20 nt, Homo sapiens
ggauaaggaggcacugcuga

SEQ ID NO: 1483875 - RNA, 19 nt, Homo sapiens
ggauacccuggagcaagac

SEQ ID NO: 1483876 - RNA, 21 nt, Homo sapiens
ggauauccuuaucagagcuaa

SEQ ID NO: 1483877 - RNA, 20 nt, Homo sapiens
ggauauuaacaacaauaaca

SEQ ID NO: 1483878 - RNA, 22 nt, Homo sapiens
ggauauuaguuaaugagccauc

SEQ ID NO: 1483879 - RNA, 15 nt, Homo sapiens
ggauauuuucuucca

SEQ ID NO: 1483880 - RNA, 17 nt, Homo sapiens
ggaucaugguguaauaa

SEQ ID NO: 1483881 - RNA, 12 nt, Homo sapiens
ggauccaagaca

SEQ ID NO: 1483882 - RNA, 15 nt, Homo sapiens
ggauccagaacugca

SEQ ID NO: 1483883 - RNA, 21 nt, Homo sapiens
ggaucccugcccuucucaaga

SEQ ID NO: 1483884 - RNA, 21 nt, Homo sapiens
ggauccuauucucaccaggaa

SEQ ID NO: 1483885 - RNA, 21 nt, Homo sapiens
ggaucgugggccgcacugggg

SEQ ID NO: 1483886 - RNA, 13 nt, Homo sapiens
ggaucuaccagca

SEQ ID NO: 1483887 - RNA, 17 nt, Homo sapiens
ggaucuaccagcauaaa

SEQ ID NO: 1483888 - RNA, 13 nt, Homo sapiens
ggaucugggcaaa

SEQ ID NO: 1483889 - RNA, 15 nt, Homo sapiens
ggaugacccacuguc

SEQ ID NO: 1483890 - RNA, 10 nt, Homo sapiens
ggaugacccc

SEQ ID NO: 1483891 - RNA, 15 nt, Homo sapiens
ggaugaggggugcug

SEQ ID NO: 1483892 - RNA, 22 nt, Homo sapiens
ggaugcaggguuugagaauguu

SEQ ID NO: 1483893 - RNA, 23 nt, Homo sapiens
ggaugccgagguaaaaguucuuu

SEQ ID NO: 1483894 - RNA, 19 nt, Homo sapiens
ggaugcuggccuuugcucu

SEQ ID NO: 1483895 - RNA, 17 nt, Homo sapiens
ggauggguccucacgca

SEQ ID NO: 1483896 - RNA, 22 nt, Homo sapiens
ggaugggugcuuaguaaguacu

SEQ ID NO: 1483897 - RNA, 18 nt, Homo sapiens
ggaugguuuuaucuuccc

SEQ ID NO: 1483898 - RNA, 22 nt, Homo sapiens
ggaugguuuuaucuucccuuua

SEQ ID NO: 1483899 - RNA, 17 nt, Homo sapiens
ggaugucacagggccaa

SEQ ID NO: 1483900 - RNA, 18 nt, Homo sapiens
ggaugucccugggccagg

SEQ ID NO: 1483901 - RNA, 18 nt, Homo sapiens
ggauguccuacuaucacu

SEQ ID NO: 1483902 - RNA, 22 nt, Homo sapiens
ggaugugaacaaccugcucaca

SEQ ID NO: 1483903 - RNA, 10 nt, Homo sapiens
ggaugugaug

SEQ ID NO: 1483904 - RNA, 10 nt, Homo sapiens
ggauguugcc

SEQ ID NO: 1483905 - RNA, 16 nt, Homo sapiens
ggauuacaggcuugag

SEQ ID NO: 1483906 - RNA, 13 nt, Homo sapiens
ggauuaugaagug

SEQ ID NO: 1483907 - RNA, 18 nt, Homo sapiens
ggauuggccaaacaucag

SEQ ID NO: 1483908 - RNA, 14 nt, Homo sapiens
ggauuuccagggau

SEQ ID NO: 1483909 - RNA, 14 nt, Homo sapiens
ggauuugcagguga

SEQ ID NO: 1483910 - RNA, 19 nt, Homo sapiens
ggcaaagguggcucuccag

SEQ ID NO: 1483911 - RNA, 19 nt, Homo sapiens
ggcaacagagcaagacucc

SEQ ID NO: 1483912 - RNA, 18 nt, Homo sapiens
ggcaacagagcaagaucc

SEQ ID NO: 1483913 - RNA, 20 nt, Homo sapiens
ggcaacaguacuucaaacag

SEQ ID NO: 1483914 - RNA, 12 nt, Homo sapiens
ggcaacaucaac

SEQ ID NO: 1483915 - RNA, 22 nt, Homo sapiens
ggcaaggacggccuucaacuga

SEQ ID NO: 1483916 - RNA, 20 nt, Homo sapiens
ggcaagugugggggguccuu

SEQ ID NO: 1483917 - RNA, 16 nt, Homo sapiens
ggcaauaguguguucu

SEQ ID NO: 1483918 - RNA, 21 nt, Homo sapiens
ggcacaagguugguugcuaag

SEQ ID NO: 1483919 - RNA, 12 nt, Homo sapiens
ggcacacagcua

SEQ ID NO: 1483920 - RNA, 13 nt, Homo sapiens
ggcacacuacaga

SEQ ID NO: 1483921 - RNA, 14 nt, Homo sapiens
ggcaccaaccugca

SEQ ID NO: 1483922 - RNA, 15 nt, Homo sapiens
ggcacccucagggag

SEQ ID NO: 1483923 - RNA, 16 nt, Homo sapiens
ggcaccuaauccaggc

SEQ ID NO: 1483924 - RNA, 18 nt, Homo sapiens
ggcacucagggagcauuu

SEQ ID NO: 1483925 - RNA, 21 nt, Homo sapiens
ggcacugaauuaaucaucuau

SEQ ID NO: 1483926 - RNA, 11 nt, Homo sapiens
ggcacugggau

SEQ ID NO: 1483927 - RNA, 11 nt, Homo sapiens
ggcacuuugaa

SEQ ID NO: 1483928 - RNA, 21 nt, Homo sapiens
ggcagacaucggccuccauga

SEQ ID NO: 1483929 - RNA, 16 nt, Homo sapiens
ggcagacuuucuucuc

SEQ ID NO: 1483930 - RNA, 12 nt, Homo sapiens
ggcagagccaug

SEQ ID NO: 1483931 - RNA, 21 nt, Homo sapiens
ggcagagccuuccacagugaa

SEQ ID NO: 1483932 - RNA, 15 nt, Homo sapiens
gguuuuguacacugc

SEQ ID NO: 1483933 - RNA, 19 nt, Homo sapiens
gguuuuuuucuucuguauu

SEQ ID NO: 1483934 - RNA, 19 nt, Homo sapiens
guaaaauacuuuuacucug

SEQ ID NO: 1483935 - RNA, 14 nt, Homo sapiens
guaaaauauaucau

SEQ ID NO: 1483936 - RNA, 13 nt, Homo sapiens
guaaacauaauuc

SEQ ID NO: 1483937 - RNA, 20 nt, Homo sapiens
guaaagccuuaaguggcaga

SEQ ID NO: 1483938 - RNA, 22 nt, Homo sapiens
guaaaguauuauuuauuugaau

SEQ ID NO: 1483939 - RNA, 13 nt, Homo sapiens
guaaauacugcuu

SEQ ID NO: 1483940 - RNA, 19 nt, Homo sapiens
guaaauccugccauuuaaa

SEQ ID NO: 1483941 - RNA, 13 nt, Homo sapiens
guaacaacugugg

SEQ ID NO: 1483942 - RNA, 17 nt, Homo sapiens
guaacaauacaaaugga

SEQ ID NO: 1483943 - RNA, 13 nt, Homo sapiens
guaacauaaugca

SEQ ID NO: 1483944 - RNA, 21 nt, Homo sapiens
guaacauauucuguaugaacu

SEQ ID NO: 1483945 - RNA, 20 nt, Homo sapiens
guaacccgcucaucacugga

SEQ ID NO: 1483946 - RNA, 15 nt, Homo sapiens
guaacccucacccac

SEQ ID NO: 1483947 - RNA, 20 nt, Homo sapiens
guaaccuguugcuguguuua

SEQ ID NO: 1483948 - RNA, 17 nt, Homo sapiens
guaaccuuauauuuaca

SEQ ID NO: 1483949 - RNA, 22 nt, Homo sapiens
guaacugugccaguucuuucca

SEQ ID NO: 1483950 - RNA, 22 nt, Homo sapiens
guaacuuccugcugcacccugc

SEQ ID NO: 1483951 - RNA, 18 nt, Homo sapiens
guaagaaagugaagcaaa

SEQ ID NO: 1483952 - RNA, 18 nt, Homo sapiens
guaagagcuggugucuga

SEQ ID NO: 1483953 - RNA, 20 nt, Homo sapiens
guaagaugcuccugguggcu

SEQ ID NO: 1483954 - RNA, 15 nt, Homo sapiens
guaagccaagucaug

SEQ ID NO: 1483955 - RNA, 23 nt, Homo sapiens
guaaggauguauguggugaaaac

SEQ ID NO: 1483956 - RNA, 13 nt, Homo sapiens
guaagugcugcua

SEQ ID NO: 1483957 - RNA, 20 nt, Homo sapiens
guaauaaaccuccuucggga

SEQ ID NO: 1483958 - RNA, 22 nt, Homo sapiens
guaauaauaaaucguccuccca

SEQ ID NO: 1483959 - RNA, 15 nt, Homo sapiens
guaauacaucaaaga

SEQ ID NO: 1483960 - RNA, 19 nt, Homo sapiens
guaauacguagcucucuua

SEQ ID NO: 1483961 - RNA, 19 nt, Homo sapiens
guaauauaguuauugcaca

SEQ ID NO: 1483962 - RNA, 16 nt, Homo sapiens
guaaucaagggucauu

SEQ ID NO: 1483963 - RNA, 21 nt, Homo sapiens
guaaucuagguguggcuguga

SEQ ID NO: 1483964 - RNA, 15 nt, Homo sapiens
guaaucucagcacuu

SEQ ID NO: 1483965 - RNA, 16 nt, Homo sapiens
guaaucucagcacuuu

SEQ ID NO: 1483966 - RNA, 17 nt, Homo sapiens
guaaugcugcacagaaa

SEQ ID NO: 1483967 - RNA, 23 nt, Homo sapiens
guaauucuaaaugaauguuuaca

SEQ ID NO: 1483968 - RNA, 14 nt, Homo sapiens
guaauuuaugcaag

SEQ ID NO: 1483969 - RNA, 19 nt, Homo sapiens
guacaaaaaaaaaguuuua

SEQ ID NO: 1483970 - RNA, 21 nt, Homo sapiens
guacaaggcccccacugccug

SEQ ID NO: 1483971 - RNA, 15 nt, Homo sapiens
guacaggaacugcau

SEQ ID NO: 1483972 - RNA, 18 nt, Homo sapiens
guacauauguaaacauaa

SEQ ID NO: 1483973 - RNA, 19 nt, Homo sapiens
guacauuuaaaauugcuau

SEQ ID NO: 1483974 - RNA, 15 nt, Homo sapiens
guaccccacugggcc

SEQ ID NO: 1483975 - RNA, 14 nt, Homo sapiens
guaccucaucccau

SEQ ID NO: 1483976 - RNA, 23 nt, Homo sapiens
guaccucugcuauuugcuguuau

SEQ ID NO: 1483977 - RNA, 20 nt, Homo sapiens
guaccugguggauaucuagc

SEQ ID NO: 1483978 - RNA, 15 nt, Homo sapiens
guacuaguccaucau

SEQ ID NO: 1483979 - RNA, 18 nt, Homo sapiens
guacuauauuugugaaua

SEQ ID NO: 1483980 - RNA, 21 nt, Homo sapiens
guacuauucugagcauacuca

SEQ ID NO: 1483981 - RNA, 18 nt, Homo sapiens
guacucuguccaguuccu

SEQ ID NO: 1483982 - RNA, 16 nt, Homo sapiens
guacugauuuuagcau

SEQ ID NO: 1483983 - RNA, 14 nt, Homo sapiens
guacuuaacauaca

SEQ ID NO: 1483984 - RNA, 16 nt, Homo sapiens
guacuuauguugcaca

SEQ ID NO: 1483985 - RNA, 21 nt, Homo sapiens
guacuucaaguuaaagugaau

SEQ ID NO: 1483986 - RNA, 20 nt, Homo sapiens
guacuuguagaguggugcug

SEQ ID NO: 1483987 - RNA, 18 nt, Homo sapiens
guagaaauaauaugcauu

SEQ ID NO: 1483988 - RNA, 22 nt, Homo sapiens
guagaacagauaaucagugugu

SEQ ID NO: 1483989 - RNA, 22 nt, Homo sapiens
guagaacucacucugggcugua

SEQ ID NO: 1483990 - RNA, 13 nt, Homo sapiens
guagaacugagaa

SEQ ID NO: 1483991 - RNA, 21 nt, Homo sapiens
guagaccuagggaggaccuua

SEQ ID NO: 1483992 - RNA, 17 nt, Homo sapiens
guagacuagugccguag

SEQ ID NO: 1483993 - RNA, 14 nt, Homo sapiens
guagacugugccag

SEQ ID NO: 1483994 - RNA, 13 nt, Homo sapiens
guagaguggugcu

SEQ ID NO: 1483995 - RNA, 22 nt, Homo sapiens
guagaguuugaaggaggugagg

SEQ ID NO: 1483996 - RNA, 15 nt, Homo sapiens
guagauacuagcuau

SEQ ID NO: 1483997 - RNA, 18 nt, Homo sapiens
guagauuuuaaaagauaa

SEQ ID NO: 1483998 - RNA, 18 nt, Homo sapiens
guagcaaguucuagagaa

SEQ ID NO: 1483999 - RNA, 12 nt, Homo sapiens
guagcacugagg

SEQ ID NO: 1484000 - RNA, 14 nt, Homo sapiens
guagcccagcacug

SEQ ID NO: 1484001 - RNA, 17 nt, Homo sapiens
guagcccagcacuguga

SEQ ID NO: 1484002 - RNA, 16 nt, Homo sapiens
guagcccauccuuccc

SEQ ID NO: 1484003 - RNA, 16 nt, Homo sapiens
guagcuacaggacauu

SEQ ID NO: 1484004 - RNA, 12 nt, Homo sapiens
guagcugagacu

SEQ ID NO: 1484005 - RNA, 17 nt, Homo sapiens
guagcuugcucccugug

SEQ ID NO: 1484006 - RNA, 14 nt, Homo sapiens
guaggguugccaga

SEQ ID NO: 1484007 - RNA, 21 nt, Homo sapiens
guagucauacucccuggugua

SEQ ID NO: 1484008 - RNA, 16 nt, Homo sapiens
guagucccagccacuc

SEQ ID NO: 1484009 - RNA, 15 nt, Homo sapiens
guagugaaauuauac

SEQ ID NO: 1484010 - RNA, 17 nt, Homo sapiens
guagugaaauuauacag

SEQ ID NO: 1484011 - RNA, 21 nt, Homo sapiens
guaguguauucucuaaaagcu

SEQ ID NO: 1484012 - RNA, 19 nt, Homo sapiens
guauaaacauaaguugcau

SEQ ID NO: 1484013 - RNA, 18 nt, Homo sapiens
guauaaaugugauaugau

SEQ ID NO: 1484014 - RNA, 20 nt, Homo sapiens
guauaaccccaccuugccaa

SEQ ID NO: 1484015 - RNA, 16 nt, Homo sapiens
guauaagcacugaaaa

SEQ ID NO: 1484016 - RNA, 22 nt, Homo sapiens
guauaagcacugaaaaacaaca

SEQ ID NO: 1484017 - RNA, 17 nt, Homo sapiens
guauacccucuguuucc

SEQ ID NO: 1484018 - RNA, 22 nt, Homo sapiens
guauaugacugagcguagcaua

SEQ ID NO: 1484019 - RNA, 10 nt, Homo sapiens
guauaugcac

SEQ ID NO: 1484020 - RNA, 17 nt, Homo sapiens
guauaugucuuuuaccc

SEQ ID NO: 1484021 - RNA, 17 nt, Homo sapiens
guauauuugguacugua

SEQ ID NO: 1484022 - RNA, 14 nt, Homo sapiens
guaucaaaaucacu

SEQ ID NO: 1484023 - RNA, 14 nt, Homo sapiens
guaucaaugaguaa

SEQ ID NO: 1484024 - RNA, 11 nt, Homo sapiens
guaucacuggu

SEQ ID NO: 1484025 - RNA, 17 nt, Homo sapiens
guaucaugcccugugca

SEQ ID NO: 1484026 - RNA, 16 nt, Homo sapiens
guauccugcccagugu

SEQ ID NO: 1484027 - RNA, 17 nt, Homo sapiens
guauccugugacaugua

SEQ ID NO: 1484028 - RNA, 18 nt, Homo sapiens
guauccugugacauguaa

SEQ ID NO: 1484029 - RNA, 13 nt, Homo sapiens
guaucgcugagac

SEQ ID NO: 1484030 - RNA, 14 nt, Homo sapiens
guaucgcugagacu

SEQ ID NO: 1484031 - RNA, 19 nt, Homo sapiens
guaucuugccuaaggugcg

SEQ ID NO: 1484032 - RNA, 14 nt, Homo sapiens
guaugacuaaagag

SEQ ID NO: 1484033 - RNA, 22 nt, Homo sapiens
guaugcacaguaaaaauggaaa

SEQ ID NO: 1484034 - RNA, 18 nt, Homo sapiens
guaugcuggccagcaccc

SEQ ID NO: 1484035 - RNA, 12 nt, Homo sapiens
guggaugacccu

SEQ ID NO: 1484036 - RNA, 12 nt, Homo sapiens
guggaugcugcu

SEQ ID NO: 1484037 - RNA, 14 nt, Homo sapiens
guggauuguuuaua

SEQ ID NO: 1484038 - RNA, 22 nt, Homo sapiens
guggcaagcugugacuucucca

SEQ ID NO: 1484039 - RNA, 16 nt, Homo sapiens
guggcaccuucaccug

SEQ ID NO: 1484040 - RNA, 18 nt, Homo sapiens
guggcauguuuugugcau

SEQ ID NO: 1484041 - RNA, 13 nt, Homo sapiens
guggccaguauuu

SEQ ID NO: 1484042 - RNA, 16 nt, Homo sapiens
guggccuauuccagga

SEQ ID NO: 1484043 - RNA, 16 nt, Homo sapiens
guggccuguuucugca

SEQ ID NO: 1484044 - RNA, 18 nt, Homo sapiens
guggcgagaaggugggga

SEQ ID NO: 1484045 - RNA, 19 nt, Homo sapiens
guggcuuguaucaacacug

SEQ ID NO: 1484046 - RNA, 15 nt, Homo sapiens
gugggagaaggcagu

SEQ ID NO: 1484047 - RNA, 21 nt, Homo sapiens
gugggagcagcgguuugggga

SEQ ID NO: 1484048 - RNA, 17 nt, Homo sapiens
gugggauaucacuucca

SEQ ID NO: 1484049 - RNA, 21 nt, Homo sapiens
gugggcucugugcagucacug

SEQ ID NO: 1484050 - RNA, 15 nt, Homo sapiens
guggggauuggggga

SEQ ID NO: 1484051 - RNA, 19 nt, Homo sapiens
guggggccuguggaaugag

SEQ ID NO: 1484052 - RNA, 20 nt, Homo sapiens
guggggggugacagugccuu

SEQ ID NO: 1484053 - RNA, 23 nt, Homo sapiens
gugggugaaggccuggcuggaag

SEQ ID NO: 1484054 - RNA, 21 nt, Homo sapiens
gugggugcugcccuguguaca

SEQ ID NO: 1484055 - RNA, 19 nt, Homo sapiens
gugguaggaaagccucacu

SEQ ID NO: 1484056 - RNA, 14 nt, Homo sapiens
gugguaugugacac

SEQ ID NO: 1484057 - RNA, 18 nt, Homo sapiens
guggucaaaccgcacuca

SEQ ID NO: 1484058 - RNA, 23 nt, Homo sapiens
gugguggcauacgccuguagucc

SEQ ID NO: 1484059 - RNA, 17 nt, Homo sapiens
gugguuccucugcucac

SEQ ID NO: 1484060 - RNA, 17 nt, Homo sapiens
gugguucuaucaggggu

SEQ ID NO: 1484061 - RNA, 13 nt, Homo sapiens
guguaaaccaaag

SEQ ID NO: 1484062 - RNA, 21 nt, Homo sapiens
guguaaagcuggcccugccuc

SEQ ID NO: 1484063 - RNA, 14 nt, Homo sapiens
guguacaaugccuu

SEQ ID NO: 1484064 - RNA, 21 nt, Homo sapiens
guguauauuuguauauuacac

SEQ ID NO: 1484065 - RNA, 22 nt, Homo sapiens
guguauuuauuuuacagcucau

SEQ ID NO: 1484066 - RNA, 22 nt, Homo sapiens
guguauuuucgauauuucagga

SEQ ID NO: 1484067 - RNA, 12 nt, Homo sapiens
gugucaggugac

SEQ ID NO: 1484068 - RNA, 13 nt, Homo sapiens
gugucaucaggag

SEQ ID NO: 1484069 - RNA, 15 nt, Homo sapiens
gugucauuucauucc

SEQ ID NO: 1484070 - RNA, 19 nt, Homo sapiens
guguccccucacucuguca

SEQ ID NO: 1484071 - RNA, 16 nt, Homo sapiens
gugucgcgcacacagc

SEQ ID NO: 1484072 - RNA, 22 nt, Homo sapiens
gugucugcuuuaaagggccugc

SEQ ID NO: 1484073 - RNA, 17 nt, Homo sapiens
gugucuuacgugccacc

SEQ ID NO: 1484074 - RNA, 18 nt, Homo sapiens
gugucuuucacagcuccu

SEQ ID NO: 1484075 - RNA, 13 nt, Homo sapiens
gugugauugcaca

SEQ ID NO: 1484076 - RNA, 13 nt, Homo sapiens
guguggcugugaa

SEQ ID NO: 1484077 - RNA, 19 nt, Homo sapiens
guguggggauuuucacuga

SEQ ID NO: 1484078 - RNA, 13 nt, Homo sapiens
guguguguguaug

SEQ ID NO: 1484079 - RNA, 18 nt, Homo sapiens
guguuaagcguucaguga

SEQ ID NO: 1484080 - RNA, 14 nt, Homo sapiens
guguuauuugcaca

SEQ ID NO: 1484081 - RNA, 17 nt, Homo sapiens
guguucugauuagaaau

SEQ ID NO: 1484082 - RNA, 15 nt, Homo sapiens
guguugcaccaggca

SEQ ID NO: 1484083 - RNA, 20 nt, Homo sapiens
guguugcaccaggcacugcu

SEQ ID NO: 1484084 - RNA, 17 nt, Homo sapiens
guguuggggaaaccuuc

SEQ ID NO: 1484085 - RNA, 23 nt, Homo sapiens
guguuggggaaaccuucaucuga

SEQ ID NO: 1484086 - RNA, 22 nt, Homo sapiens
guguuguaucaaagugugauau

SEQ ID NO: 1484087 - RNA, 16 nt, Homo sapiens
guguuguggacacugc

SEQ ID NO: 1484088 - RNA, 12 nt, Homo sapiens
guguuugggaug

SEQ ID NO: 1484089 - RNA, 19 nt, Homo sapiens
guguuugggaugaccagga

SEQ ID NO: 1484090 - RNA, 22 nt, Homo sapiens
guguuuuaaacucuccuaguca

SEQ ID NO: 1484091 - RNA, 22 nt, Homo sapiens
guguuuuugcuaucacacagug

SEQ ID NO: 1484092 - RNA, 20 nt, Homo sapiens
guuaaaacuguacauuuaaa

SEQ ID NO: 1484093 - RNA, 18 nt, Homo sapiens
guuaaaaucuauucugug

SEQ ID NO: 1484094 - RNA, 17 nt, Homo sapiens
guuaaacauugaaguaa

SEQ ID NO: 1484095 - RNA, 19 nt, Homo sapiens
guuaaacccacagccaaac

SEQ ID NO: 1484096 - RNA, 18 nt, Homo sapiens
guuaaagcagacagucac

SEQ ID NO: 1484097 - RNA, 17 nt, Homo sapiens
guuaaagguucacaggg

SEQ ID NO: 1484098 - RNA, 14 nt, Homo sapiens
guuaaauauuguca

SEQ ID NO: 1484099 - RNA, 19 nt, Homo sapiens
guuaaccucagugucauuu

SEQ ID NO: 1484100 - RNA, 13 nt, Homo sapiens
guuaauaacucuc

SEQ ID NO: 1484101 - RNA, 17 nt, Homo sapiens
guuaaucauguauuaaa

SEQ ID NO: 1484102 - RNA, 18 nt, Homo sapiens
guuaauuacaacugcuau

SEQ ID NO: 1484103 - RNA, 13 nt, Homo sapiens
guuacagaccuca

SEQ ID NO: 1484104 - RNA, 16 nt, Homo sapiens
guuacaucacaguguu

SEQ ID NO: 1484105 - RNA, 19 nt, Homo sapiens
guuacaugaaggcagcaga

SEQ ID NO: 1484106 - RNA, 16 nt, Homo sapiens
guuaccacacaucuau

SEQ ID NO: 1484107 - RNA, 17 nt, Homo sapiens
guuaccaugucacugug

SEQ ID NO: 1484108 - RNA, 18 nt, Homo sapiens
guuacuauucuguaucau

SEQ ID NO: 1484109 - RNA, 20 nt, Homo sapiens
guuacucaggguucaucugu

SEQ ID NO: 1484110 - RNA, 21 nt, Homo sapiens
guuacugcuugaccaaagagc

SEQ ID NO: 1484111 - RNA, 13 nt, Homo sapiens
guuacuuccuuau

SEQ ID NO: 1484112 - RNA, 22 nt, Homo sapiens
guuagaagcaaugaauguauau

SEQ ID NO: 1484113 - RNA, 22 nt, Homo sapiens
guuaggaacagcaguguucuca

SEQ ID NO: 1484114 - RNA, 20 nt, Homo sapiens
guuaggggaauggagggaau

SEQ ID NO: 1484115 - RNA, 22 nt, Homo sapiens
guuauaauaauguuaacaugga

SEQ ID NO: 1484116 - RNA, 17 nt, Homo sapiens
guuauaucauauguaua

SEQ ID NO: 1484117 - RNA, 13 nt, Homo sapiens
guuaugaacaaag

SEQ ID NO: 1484118 - RNA, 16 nt, Homo sapiens
guuaugauauuguuua

SEQ ID NO: 1484119 - RNA, 13 nt, Homo sapiens
guuaugugaauga

SEQ ID NO: 1484120 - RNA, 19 nt, Homo sapiens
guuaugugauuuuccuuug

SEQ ID NO: 1484121 - RNA, 15 nt, Homo sapiens
guuauguucagucac

SEQ ID NO: 1484122 - RNA, 16 nt, Homo sapiens
guuauugcacaaguuc

SEQ ID NO: 1484123 - RNA, 17 nt, Homo sapiens
guuauuuaugcacugug

SEQ ID NO: 1484124 - RNA, 13 nt, Homo sapiens
guuauuugcacac

SEQ ID NO: 1484125 - RNA, 15 nt, Homo sapiens
guuauuugcacacug

SEQ ID NO: 1484126 - RNA, 14 nt, Homo sapiens
guuauuuuccauuu

SEQ ID NO: 1484127 - RNA, 19 nt, Homo sapiens
guuauuuugcuauuugccu

SEQ ID NO: 1484128 - RNA, 20 nt, Homo sapiens
guucaaaaaacucuugauau

SEQ ID NO: 1484129 - RNA, 21 nt, Homo sapiens
guucacaaaauggugcccuau

SEQ ID NO: 1484130 - RNA, 12 nt, Homo sapiens
guucacagugca

SEQ ID NO: 1484131 - RNA, 17 nt, Homo sapiens
guucacgcaacuugaaa

SEQ ID NO: 1484132 - RNA, 18 nt, Homo sapiens
guucagacacuaccccau

SEQ ID NO: 1484133 - RNA, 23 nt, Homo sapiens
guucagacacuaccccauauaca

SEQ ID NO: 1484134 - RNA, 11 nt, Homo sapiens
guucagaguuc

SEQ ID NO: 1484135 - RNA, 23 nt, Homo sapiens
guucaucauccuaagcuauucag

SEQ ID NO: 1484136 - RNA, 15 nt, Homo sapiens
guucaugugccucug

SEQ ID NO: 1484137 - RNA, 16 nt, Homo sapiens
guucauuauguaugaa

SEQ ID NO: 1484138 - RNA, 18 nt, Homo sapiens
ucaucgggccagaaggcg

SEQ ID NO: 1484139 - RNA, 17 nt, Homo sapiens
ucaucgggccucugggg

SEQ ID NO: 1484140 - RNA, 20 nt, Homo sapiens
ucaucucauuccaacuuccc

SEQ ID NO: 1484141 - RNA, 18 nt, Homo sapiens
ucaucucccaccuagcag

SEQ ID NO: 1484142 - RNA, 16 nt, Homo sapiens
ucaucucucugcccaa

SEQ ID NO: 1484143 - RNA, 23 nt, Homo sapiens
ucaucuuagugccugagaguauu

SEQ ID NO: 1484144 - RNA, 18 nt, Homo sapiens
ucaucuucacugcaauuu

SEQ ID NO: 1484145 - RNA, 19 nt, Homo sapiens
ucaucuuugccaccaccug

SEQ ID NO: 1484146 - RNA, 15 nt, Homo sapiens
ucaugaaacugucca

SEQ ID NO: 1484147 - RNA, 14 nt, Homo sapiens
ucaugaaauaugca

SEQ ID NO: 1484148 - RNA, 17 nt, Homo sapiens
ucaugagccugcuggaa

SEQ ID NO: 1484149 - RNA, 18 nt, Homo sapiens
ucaugagccugcuggaag

SEQ ID NO: 1484150 - RNA, 17 nt, Homo sapiens
ucaugcccgccagugca

SEQ ID NO: 1484151 - RNA, 19 nt, Homo sapiens
ucaugcccgccagugcaca

SEQ ID NO: 1484152 - RNA, 13 nt, Homo sapiens
ucaugcccugugc

SEQ ID NO: 1484153 - RNA, 23 nt, Homo sapiens
ucaugccuguaaucucagcacuu

SEQ ID NO: 1484154 - RNA, 14 nt, Homo sapiens
ucaugcuucacuua

SEQ ID NO: 1484155 - RNA, 11 nt, Homo sapiens
ucauggcauau

SEQ ID NO: 1484156 - RNA, 15 nt, Homo sapiens
ucauggccaccucca

SEQ ID NO: 1484157 - RNA, 23 nt, Homo sapiens
ucauggccauagcuuuuauucau

SEQ ID NO: 1484158 - RNA, 21 nt, Homo sapiens
ucaugggacuaaaugaacuaa

SEQ ID NO: 1484159 - RNA, 22 nt, Homo sapiens
ucaugggacuaaaugaacuaau

SEQ ID NO: 1484160 - RNA, 17 nt, Homo sapiens
ucaugguagagaaucuc

SEQ ID NO: 1484161 - RNA, 18 nt, Homo sapiens
ucaugguggguucagggg

SEQ ID NO: 1484162 - RNA, 18 nt, Homo sapiens
ucaugucuaauugcuuaa

SEQ ID NO: 1484163 - RNA, 14 nt, Homo sapiens
ucaugucucacuuc

SEQ ID NO: 1484164 - RNA, 17 nt, Homo sapiens
ucaugucucacuucaca

SEQ ID NO: 1484165 - RNA, 18 nt, Homo sapiens
ucaugugaccacucuguc

SEQ ID NO: 1484166 - RNA, 17 nt, Homo sapiens
ucauguggcuguagauc

SEQ ID NO: 1484167 - RNA, 15 nt, Homo sapiens
ucauguucacuguga

SEQ ID NO: 1484168 - RNA, 15 nt, Homo sapiens
ucauguuccucaaaa

SEQ ID NO: 1484169 - RNA, 20 nt, Homo sapiens
ucauguucuugcagucauca

SEQ ID NO: 1484170 - RNA, 16 nt, Homo sapiens
ucauuagcugugauuu

SEQ ID NO: 1484171 - RNA, 20 nt, Homo sapiens
ucauuauaaacgugaugauc

SEQ ID NO: 1484172 - RNA, 14 nt, Homo sapiens
ucauuaugccacuu

SEQ ID NO: 1484173 - RNA, 13 nt, Homo sapiens
ucauuauuggaau

SEQ ID NO: 1484174 - RNA, 18 nt, Homo sapiens
ucauucauucaaguaaua

SEQ ID NO: 1484175 - RNA, 19 nt, Homo sapiens
ucauucauuggugaaguaa

SEQ ID NO: 1484176 - RNA, 21 nt, Homo sapiens
ucauuccaaucuauugcuuca

SEQ ID NO: 1484177 - RNA, 15 nt, Homo sapiens
ucauuccauugccua

SEQ ID NO: 1484178 - RNA, 21 nt, Homo sapiens
ucauuccugaaagaaacaguu

SEQ ID NO: 1484179 - RNA, 22 nt, Homo sapiens
ucauuccugaaagaaacaguua

SEQ ID NO: 1484180 - RNA, 18 nt, Homo sapiens
ucauucuagaaacaggaa

SEQ ID NO: 1484181 - RNA, 17 nt, Homo sapiens
ucauucucauaauuccu

SEQ ID NO: 1484182 - RNA, 16 nt, Homo sapiens
ucauucugcauugcua

SEQ ID NO: 1484183 - RNA, 15 nt, Homo sapiens
ucauugaaguauuuu

SEQ ID NO: 1484184 - RNA, 17 nt, Homo sapiens
ucauugaccucucaggg

SEQ ID NO: 1484185 - RNA, 14 nt, Homo sapiens
ucauugauugaaua

SEQ ID NO: 1484186 - RNA, 19 nt, Homo sapiens
ucauugcccgaaaccagag

SEQ ID NO: 1484187 - RNA, 22 nt, Homo sapiens
ucauugcccgaaaccagagccu

SEQ ID NO: 1484188 - RNA, 21 nt, Homo sapiens
ucauugcuaaacugaugacuu

SEQ ID NO: 1484189 - RNA, 22 nt, Homo sapiens
ucauuggaccuguucaaaaagg

SEQ ID NO: 1484190 - RNA, 18 nt, Homo sapiens
ucauuggugaaguaaauu

SEQ ID NO: 1484191 - RNA, 12 nt, Homo sapiens
ucauuguucucc

SEQ ID NO: 1484192 - RNA, 17 nt, Homo sapiens
ucauuucagauaaacaa

SEQ ID NO: 1484193 - RNA, 12 nt, Homo sapiens
ucauuucauucc

SEQ ID NO: 1484194 - RNA, 13 nt, Homo sapiens
ucauuugaacaac

SEQ ID NO: 1484195 - RNA, 18 nt, Homo sapiens
ucauuuguaguugccuua

SEQ ID NO: 1484196 - RNA, 17 nt, Homo sapiens
ucauuuuuuucacugga

SEQ ID NO: 1484197 - RNA, 20 nt, Homo sapiens
uccaaaaauagcccugcaaa

SEQ ID NO: 1484198 - RNA, 18 nt, Homo sapiens
uccaaacauuaaugcaau

SEQ ID NO: 1484199 - RNA, 12 nt, Homo sapiens
uccaaagaggcu

SEQ ID NO: 1484200 - RNA, 17 nt, Homo sapiens
uccaaauauuguugaca

SEQ ID NO: 1484201 - RNA, 14 nt, Homo sapiens
uccaacaccacaga

SEQ ID NO: 1484202 - RNA, 17 nt, Homo sapiens
uccaaccugcaaagauc

SEQ ID NO: 1484203 - RNA, 17 nt, Homo sapiens
uccaacuguacuuuuaa

SEQ ID NO: 1484204 - RNA, 16 nt, Homo sapiens
uccaacuucccaguuc

SEQ ID NO: 1484205 - RNA, 20 nt, Homo sapiens
uccaagcagaguguuuuauu

SEQ ID NO: 1484206 - RNA, 16 nt, Homo sapiens
uccaaggacauauugc

SEQ ID NO: 1484207 - RNA, 17 nt, Homo sapiens
uccaaggguacuaagga

SEQ ID NO: 1484208 - RNA, 15 nt, Homo sapiens
uccaagucucagugg

SEQ ID NO: 1484209 - RNA, 20 nt, Homo sapiens
uccaagucucucugugaaua

SEQ ID NO: 1484210 - RNA, 19 nt, Homo sapiens
uccaaguuuuaauuuuuaa

SEQ ID NO: 1484211 - RNA, 12 nt, Homo sapiens
uccaauacucag

SEQ ID NO: 1484212 - RNA, 12 nt, Homo sapiens
uccaaucuguga

SEQ ID NO: 1484213 - RNA, 15 nt, Homo sapiens
uccaaucugugauga

SEQ ID NO: 1484214 - RNA, 16 nt, Homo sapiens
uccaaugucaauguga

SEQ ID NO: 1484215 - RNA, 18 nt, Homo sapiens
uccaauuucacgcuuuua

SEQ ID NO: 1484216 - RNA, 14 nt, Homo sapiens
uccacaacagaagu

SEQ ID NO: 1484217 - RNA, 22 nt, Homo sapiens
uccacaaugaugaugauuucag

SEQ ID NO: 1484218 - RNA, 18 nt, Homo sapiens
uccaccaagaucaagcag

SEQ ID NO: 1484219 - RNA, 14 nt, Homo sapiens
uccaccacaucugc

SEQ ID NO: 1484220 - RNA, 21 nt, Homo sapiens
uccacccuuggccugucucau

SEQ ID NO: 1484221 - RNA, 20 nt, Homo sapiens
uccacgaagccuuaagccau

SEQ ID NO: 1484222 - RNA, 14 nt, Homo sapiens
uccacuaaaugagc

SEQ ID NO: 1484223 - RNA, 21 nt, Homo sapiens
uccacuaggguccaccaggag

SEQ ID NO: 1484224 - RNA, 12 nt, Homo sapiens
uccacucagguu

SEQ ID NO: 1484225 - RNA, 20 nt, Homo sapiens
uccacucuugaucucucuug

SEQ ID NO: 1484226 - RNA, 21 nt, Homo sapiens
uccagaagaagagaagcugcu

SEQ ID NO: 1484227 - RNA, 13 nt, Homo sapiens
uccagacaccagu

SEQ ID NO: 1484228 - RNA, 14 nt, Homo sapiens
uccagacacuuaac

SEQ ID NO: 1484229 - RNA, 15 nt, Homo sapiens
uccagacggugugca

SEQ ID NO: 1484230 - RNA, 22 nt, Homo sapiens
uccagacuugggaaacuauuca

SEQ ID NO: 1484231 - RNA, 15 nt, Homo sapiens
uccagagaguggcuc

SEQ ID NO: 1484232 - RNA, 15 nt, Homo sapiens
uccagauauuucaca

SEQ ID NO: 1484233 - RNA, 17 nt, Homo sapiens
uccagauccuucaaaga

SEQ ID NO: 1484234 - RNA, 14 nt, Homo sapiens
uccagcacuggaag

SEQ ID NO: 1484235 - RNA, 20 nt, Homo sapiens
uccagcccagacccagugga

SEQ ID NO: 1484236 - RNA, 17 nt, Homo sapiens
uccagccgccauugcca

SEQ ID NO: 1484237 - RNA, 19 nt, Homo sapiens
uccagccgcugcacaucac

SEQ ID NO: 1484238 - RNA, 17 nt, Homo sapiens
uccagccucuccuccau

SEQ ID NO: 1484239 - RNA, 14 nt, Homo sapiens
uccagcuccuguaa

SEQ ID NO: 1484240 - RNA, 14 nt, Homo sapiens
uccagcugcugucu

SEQ ID NO: 1484241 - RNA, 16 nt, Homo sapiens
ucuacaaaugucuuca

SEQ ID NO: 1484242 - RNA, 12 nt, Homo sapiens
ucuacaacugau

SEQ ID NO: 1484243 - RNA, 13 nt, Homo sapiens
ucuacagugccaa

SEQ ID NO: 1484244 - RNA, 15 nt, Homo sapiens
ucuacauggcuuuga

SEQ ID NO: 1484245 - RNA, 19 nt, Homo sapiens
ucuaccacaagggcucucu

SEQ ID NO: 1484246 - RNA, 17 nt, Homo sapiens
ucuaccaggcaaauuca

SEQ ID NO: 1484247 - RNA, 15 nt, Homo sapiens
ucuacccuggcacua

SEQ ID NO: 1484248 - RNA, 13 nt, Homo sapiens
ucuaccucaggca

SEQ ID NO: 1484249 - RNA, 15 nt, Homo sapiens
ucuaccuguacacau

SEQ ID NO: 1484250 - RNA, 18 nt, Homo sapiens
ucuaccuuuucuggcaaa

SEQ ID NO: 1484251 - RNA, 13 nt, Homo sapiens
ucuacgugcuccu

SEQ ID NO: 1484252 - RNA, 20 nt, Homo sapiens
ucuacuacaaacuucaaaga

SEQ ID NO: 1484253 - RNA, 17 nt, Homo sapiens
ucuacuaccacaaggaa

SEQ ID NO: 1484254 - RNA, 15 nt, Homo sapiens
ucuacugaggugcua

SEQ ID NO: 1484255 - RNA, 22 nt, Homo sapiens
ucuacugcuuuggauccugggu

SEQ ID NO: 1484256 - RNA, 16 nt, Homo sapiens
ucuacuuaaugagaua

SEQ ID NO: 1484257 - RNA, 22 nt, Homo sapiens
ucuacuucuggaagucaucuca

SEQ ID NO: 1484258 - RNA, 13 nt, Homo sapiens
ucuagaagcacau

SEQ ID NO: 1484259 - RNA, 24 nt, Homo sapiens
ucuagaauuauaagucacaaagag

SEQ ID NO: 1484260 - RNA, 14 nt, Homo sapiens
ucuagacuagcaau

SEQ ID NO: 1484261 - RNA, 22 nt, Homo sapiens
ucuagcaccaggacucagagga

SEQ ID NO: 1484262 - RNA, 19 nt, Homo sapiens
ucuagccuauuuaccugca

SEQ ID NO: 1484263 - RNA, 15 nt, Homo sapiens
ucuagcugugggggu

SEQ ID NO: 1484264 - RNA, 17 nt, Homo sapiens
ucuaguaagaugcacug

SEQ ID NO: 1484265 - RNA, 18 nt, Homo sapiens
ucuagugucuuuugccuu

SEQ ID NO: 1484266 - RNA, 15 nt, Homo sapiens
ucuaguucagagcca

SEQ ID NO: 1484267 - RNA, 20 nt, Homo sapiens
ucuauaccaaccaaaccaau

SEQ ID NO: 1484268 - RNA, 23 nt, Homo sapiens
ucuauaccaaccaaaccaauuca

SEQ ID NO: 1484269 - RNA, 13 nt, Homo sapiens
ucuauagcagauu

SEQ ID NO: 1484270 - RNA, 16 nt, Homo sapiens
ucuauaggaacauaug

SEQ ID NO: 1484271 - RNA, 24 nt, Homo sapiens
ucuauauuuuuuguaacauaaugc

SEQ ID NO: 1484272 - RNA, 12 nt, Homo sapiens
ucuaucucucaa

SEQ ID NO: 1484273 - RNA, 14 nt, Homo sapiens
ucuaucucucaaaa

SEQ ID NO: 1484274 - RNA, 13 nt, Homo sapiens
ucuaucuugucaa

SEQ ID NO: 1484275 - RNA, 19 nt, Homo sapiens
ucuaucuugucaaucccaa

SEQ ID NO: 1484276 - RNA, 14 nt, Homo sapiens
ucuaugaaacugca

SEQ ID NO: 1484277 - RNA, 12 nt, Homo sapiens
ucuaugugacau

SEQ ID NO: 1484278 - RNA, 12 nt, Homo sapiens
ucuauguucccc

SEQ ID NO: 1484279 - RNA, 21 nt, Homo sapiens
ucuauuuuaguugguuuguau

SEQ ID NO: 1484280 - RNA, 21 nt, Homo sapiens
ucucaaagauucacacaugcc

SEQ ID NO: 1484281 - RNA, 15 nt, Homo sapiens
ucucaaauuagaaag

SEQ ID NO: 1484282 - RNA, 14 nt, Homo sapiens
ucucaagacuuuag

SEQ ID NO: 1484283 - RNA, 14 nt, Homo sapiens
ucucaauaguaaaa

SEQ ID NO: 1484284 - RNA, 12 nt, Homo sapiens
ucucacaaauga

SEQ ID NO: 1484285 - RNA, 22 nt, Homo sapiens
ucucacaagauggaaaucacau

SEQ ID NO: 1484286 - RNA, 18 nt, Homo sapiens
ucucacaguguugcccag

SEQ ID NO: 1484287 - RNA, 19 nt, Homo sapiens
ucucacccauuaucuggaa

SEQ ID NO: 1484288 - RNA, 21 nt, Homo sapiens
ucucacccgaccggugcauga

SEQ ID NO: 1484289 - RNA, 15 nt, Homo sapiens
ucucacuagugucag

SEQ ID NO: 1484290 - RNA, 14 nt, Homo sapiens
ucucacuugucuca

SEQ ID NO: 1484291 - RNA, 13 nt, Homo sapiens
ucucagaccccac

SEQ ID NO: 1484292 - RNA, 19 nt, Homo sapiens
ucucagacccuuuagccaa

SEQ ID NO: 1484293 - RNA, 19 nt, Homo sapiens
ucucagacugcauguacca

SEQ ID NO: 1484294 - RNA, 14 nt, Homo sapiens
ucucagcaagagaa

SEQ ID NO: 1484295 - RNA, 16 nt, Homo sapiens
ucucagccuaccauga

SEQ ID NO: 1484296 - RNA, 21 nt, Homo sapiens
ucucaggcucuugacuacuug

SEQ ID NO: 1484297 - RNA, 21 nt, Homo sapiens
ucucagguagaagguugacac

SEQ ID NO: 1484298 - RNA, 16 nt, Homo sapiens
ucucagguguugccaa

SEQ ID NO: 1484299 - RNA, 12 nt, Homo sapiens
ucucagugcagg

SEQ ID NO: 1484300 - RNA, 21 nt, Homo sapiens
ucucagugcuucuuacuauua

SEQ ID NO: 1484301 - RNA, 19 nt, Homo sapiens
ucucaguggcuucaucugu

SEQ ID NO: 1484302 - RNA, 18 nt, Homo sapiens
ucucauuuagaacuugca

SEQ ID NO: 1484303 - RNA, 17 nt, Homo sapiens
ucucauuuggucugcca

SEQ ID NO: 1484304 - RNA, 14 nt, Homo sapiens
ucuccaaaugagau

SEQ ID NO: 1484305 - RNA, 15 nt, Homo sapiens
ucuccagccaaccuc

SEQ ID NO: 1484306 - RNA, 16 nt, Homo sapiens
ucuccagccaaccuca

SEQ ID NO: 1484307 - RNA, 22 nt, Homo sapiens
ucuccagccagcaaugaugucc

SEQ ID NO: 1484308 - RNA, 24 nt, Homo sapiens
ucuccagccagcaaugauguccag

SEQ ID NO: 1484309 - RNA, 13 nt, Homo sapiens
ucuccaggucuca

SEQ ID NO: 1484310 - RNA, 20 nt, Homo sapiens
ucuccauggcccugucccag

SEQ ID NO: 1484311 - RNA, 13 nt, Homo sapiens
ucuccauuacacg

SEQ ID NO: 1484312 - RNA, 19 nt, Homo sapiens
ucucccacccuguaccuca

SEQ ID NO: 1484313 - RNA, 18 nt, Homo sapiens
ucucccauuuuggaauuu

SEQ ID NO: 1484314 - RNA, 14 nt, Homo sapiens
ucucccucugauug

SEQ ID NO: 1484315 - RNA, 23 nt, Homo sapiens
ucucccuguuggucgguggguug

SEQ ID NO: 1484316 - RNA, 19 nt, Homo sapiens
ucucccuuugaagaaacua

SEQ ID NO: 1484317 - RNA, 14 nt, Homo sapiens
ucuccucagaagaa

SEQ ID NO: 1484318 - RNA, 16 nt, Homo sapiens
ucuccuuacagucacu

SEQ ID NO: 1484319 - RNA, 16 nt, Homo sapiens
ucuccuuccccaggau

SEQ ID NO: 1484320 - RNA, 12 nt, Homo sapiens
ucucgcaaaaac

SEQ ID NO: 1484321 - RNA, 15 nt, Homo sapiens
ucucgggcacaggcc

SEQ ID NO: 1484322 - RNA, 23 nt, Homo sapiens
ucucuacagugccaacuccucac

SEQ ID NO: 1484323 - RNA, 19 nt, Homo sapiens
ucucuacuaccacaaggaa

SEQ ID NO: 1484324 - RNA, 18 nt, Homo sapiens
ucucuacugaaaguacaa

SEQ ID NO: 1484325 - RNA, 16 nt, Homo sapiens
ucucuaggccucucca

SEQ ID NO: 1484326 - RNA, 17 nt, Homo sapiens
ucucuagugucuuuugc

SEQ ID NO: 1484327 - RNA, 17 nt, Homo sapiens
ucucuauuucuggauga

SEQ ID NO: 1484328 - RNA, 16 nt, Homo sapiens
ucucucccagguccca

SEQ ID NO: 1484329 - RNA, 23 nt, Homo sapiens
ucucucccaggucccagccccuu

SEQ ID NO: 1484330 - RNA, 19 nt, Homo sapiens
ucucuccuuauagacacuu

SEQ ID NO: 1484331 - RNA, 20 nt, Homo sapiens
ucucucggcuccccaugugu

SEQ ID NO: 1484332 - RNA, 21 nt, Homo sapiens
ucucugaacacaggcagcuuu

SEQ ID NO: 1484333 - RNA, 17 nt, Homo sapiens
ucucugccacccacuca

SEQ ID NO: 1484334 - RNA, 12 nt, Homo sapiens
ucucugccagug

SEQ ID NO: 1484335 - RNA, 18 nt, Homo sapiens
ucucugcccucuucucau

SEQ ID NO: 1484336 - RNA, 14 nt, Homo sapiens
ucucugguggugcu

SEQ ID NO: 1484337 - RNA, 12 nt, Homo sapiens
ucucuguacuuu

SEQ ID NO: 1484338 - RNA, 22 nt, Homo sapiens
ucucugucccuugcuguaugcu

SEQ ID NO: 1484339 - RNA, 14 nt, Homo sapiens
ucucuguugucgua

SEQ ID NO: 1484340 - RNA, 15 nt, Homo sapiens
ucucuuagcaacuca

SEQ ID NO: 1484341 - RNA, 18 nt, Homo sapiens
ucucuugcacucaaagcu

SEQ ID NO: 1484342 - RNA, 15 nt, Homo sapiens
ucucuuuauucuaaa

SEQ ID NO: 1484343 - RNA, 20 nt, Homo sapiens
ucucuuucacauuguuugcu

SEQ ID NO: 1484344 - RNA, 17 nt, Homo sapiens
ugacaaccuccauucua

SEQ ID NO: 1484345 - RNA, 18 nt, Homo sapiens
ugacaacgcccuacagca

SEQ ID NO: 1484346 - RNA, 22 nt, Homo sapiens
ugacaacugugacuguacccaa

SEQ ID NO: 1484347 - RNA, 15 nt, Homo sapiens
ugacaaggagcacaa

SEQ ID NO: 1484348 - RNA, 14 nt, Homo sapiens
ugacacaaugaagu

SEQ ID NO: 1484349 - RNA, 19 nt, Homo sapiens
ugacacgccuaaggucaca

SEQ ID NO: 1484350 - RNA, 23 nt, Homo sapiens
ugacacgccuaaggucacagcua

SEQ ID NO: 1484351 - RNA, 21 nt, Homo sapiens
ugacacggccucccucugcua

SEQ ID NO: 1484352 - RNA, 16 nt, Homo sapiens
ugacacugucccucuu

SEQ ID NO: 1484353 - RNA, 17 nt, Homo sapiens
ugacacuuugccagaaa

SEQ ID NO: 1484354 - RNA, 12 nt, Homo sapiens
ugacagaacaag

SEQ ID NO: 1484355 - RNA, 19 nt, Homo sapiens
ugacagaguucacuauaaa

SEQ ID NO: 1484356 - RNA, 19 nt, Homo sapiens
ugacagcucccgggucccc

SEQ ID NO: 1484357 - RNA, 18 nt, Homo sapiens
ugacagcugcaagccagg

SEQ ID NO: 1484358 - RNA, 16 nt, Homo sapiens
ugacaggaaagcccuc

SEQ ID NO: 1484359 - RNA, 17 nt, Homo sapiens
ugacagggaaaacugca

SEQ ID NO: 1484360 - RNA, 20 nt, Homo sapiens
ugacaguaaaucucacaaau

SEQ ID NO: 1484361 - RNA, 15 nt, Homo sapiens
ugacauaagugcuau

SEQ ID NO: 1484362 - RNA, 17 nt, Homo sapiens
ugacauauuaugccuga

SEQ ID NO: 1484363 - RNA, 19 nt, Homo sapiens
ugacaucacagcagccucc

SEQ ID NO: 1484364 - RNA, 18 nt, Homo sapiens
ugacauugcaccuggaug

SEQ ID NO: 1484365 - RNA, 23 nt, Homo sapiens
ugacauugcguuugaccuuuuau

SEQ ID NO: 1484366 - RNA, 16 nt, Homo sapiens
ugaccaagaacugcau

SEQ ID NO: 1484367 - RNA, 19 nt, Homo sapiens
ugaccaauugugcugccau

SEQ ID NO: 1484368 - RNA, 10 nt, Homo sapiens
ugaccacaga

SEQ ID NO: 1484369 - RNA, 15 nt, Homo sapiens
ugaccacagcacagc

SEQ ID NO: 1484370 - RNA, 18 nt, Homo sapiens
ugaccacagcacagccaa

SEQ ID NO: 1484371 - RNA, 18 nt, Homo sapiens
ugaccacgucaucgggcc

SEQ ID NO: 1484372 - RNA, 22 nt, Homo sapiens
ugaccacucuucuuuaagccau

SEQ ID NO: 1484373 - RNA, 21 nt, Homo sapiens
ugaccacugaagcaccacagg

SEQ ID NO: 1484374 - RNA, 12 nt, Homo sapiens
ugaccccagugu

SEQ ID NO: 1484375 - RNA, 13 nt, Homo sapiens
ugaccccauuccu

SEQ ID NO: 1484376 - RNA, 20 nt, Homo sapiens
ugacccccgcaaguuugcac

SEQ ID NO: 1484377 - RNA, 17 nt, Homo sapiens
ugaccgagaacuuuuaa

SEQ ID NO: 1484378 - RNA, 22 nt, Homo sapiens
ugaccuacuuugguaguggaau

SEQ ID NO: 1484379 - RNA, 13 nt, Homo sapiens
ugaccucaucucc

SEQ ID NO: 1484380 - RNA, 21 nt, Homo sapiens
ugaccucucagggccuggcag

SEQ ID NO: 1484381 - RNA, 16 nt, Homo sapiens
ugaccucugccccaga

SEQ ID NO: 1484382 - RNA, 18 nt, Homo sapiens
ugaccuggagaugcugcc

SEQ ID NO: 1484383 - RNA, 21 nt, Homo sapiens
ugaccugucaccgugagcagc

SEQ ID NO: 1484384 - RNA, 23 nt, Homo sapiens
ugaccuguuauuaccauuagcau

SEQ ID NO: 1484385 - RNA, 22 nt, Homo sapiens
ugaccuugcugauggugacauu

SEQ ID NO: 1484386 - RNA, 19 nt, Homo sapiens
ugaccuuggcugacugggg

SEQ ID NO: 1484387 - RNA, 19 nt, Homo sapiens
ugaccuugggguacaauug

SEQ ID NO: 1484388 - RNA, 15 nt, Homo sapiens
ugacgacaagugcug

SEQ ID NO: 1484389 - RNA, 17 nt, Homo sapiens
ugacgacuucacacuau

SEQ ID NO: 1484390 - RNA, 22 nt, Homo sapiens
ugacgcugcaugagacauugac

SEQ ID NO: 1484391 - RNA, 19 nt, Homo sapiens
ugacggcaccaucuggaag

SEQ ID NO: 1484392 - RNA, 20 nt, Homo sapiens
ugacguguaaaugcugguau

SEQ ID NO: 1484393 - RNA, 19 nt, Homo sapiens
ugacuauggcuaccaaaaa

SEQ ID NO: 1484394 - RNA, 23 nt, Homo sapiens
ugacucccaaguuuccauagcaa

SEQ ID NO: 1484395 - RNA, 16 nt, Homo sapiens
ugacuccuccaaggaa

SEQ ID NO: 1484396 - RNA, 21 nt, Homo sapiens
ugacuccuccaaggaaaggga

SEQ ID NO: 1484397 - RNA, 20 nt, Homo sapiens
ugacucgacaccgugucacc

SEQ ID NO: 1484398 - RNA, 14 nt, Homo sapiens
ugacucugacucau

SEQ ID NO: 1484399 - RNA, 19 nt, Homo sapiens
ugacugaagugaacuauga

SEQ ID NO: 1484400 - RNA, 16 nt, Homo sapiens
ugacuggggagucuga

SEQ ID NO: 1484401 - RNA, 15 nt, Homo sapiens
ugacugucucacuua

SEQ ID NO: 1484402 - RNA, 22 nt, Homo sapiens
ugacuuaaaauuggaaauguca

SEQ ID NO: 1484403 - RNA, 15 nt, Homo sapiens
ugacuuaaccauaua

SEQ ID NO: 1484404 - RNA, 18 nt, Homo sapiens
ugacuucagcugccugaa

SEQ ID NO: 1484405 - RNA, 13 nt, Homo sapiens
ugacuucaucugg

SEQ ID NO: 1484406 - RNA, 15 nt, Homo sapiens
ugacuuccugccaug

SEQ ID NO: 1484407 - RNA, 16 nt, Homo sapiens
ugacuuccugccaugg

SEQ ID NO: 1484408 - RNA, 21 nt, Homo sapiens
ugacuuuauauggaugauuca

SEQ ID NO: 1484409 - RNA, 22 nt, Homo sapiens
ugagaaaagaaauuaguuucaa

SEQ ID NO: 1484410 - RNA, 16 nt, Homo sapiens
ugagaaaauaucuugc

SEQ ID NO: 1484411 - RNA, 22 nt, Homo sapiens
ugagaaaauaucuugcuuucaa

SEQ ID NO: 1484412 - RNA, 20 nt, Homo sapiens
ugagaaauauggacacuuaa

SEQ ID NO: 1484413 - RNA, 15 nt, Homo sapiens
ugagaaauggccaaa

SEQ ID NO: 1484414 - RNA, 16 nt, Homo sapiens
ugagaaauuccuuagu

SEQ ID NO: 1484415 - RNA, 17 nt, Homo sapiens
ugagaagaggcugcugc

SEQ ID NO: 1484416 - RNA, 13 nt, Homo sapiens
ugagaagaucuga

SEQ ID NO: 1484417 - RNA, 14 nt, Homo sapiens
ugagaaggacccug

SEQ ID NO: 1484418 - RNA, 16 nt, Homo sapiens
ugagaagugcacuuua

SEQ ID NO: 1484419 - RNA, 22 nt, Homo sapiens
ugagacaaaauuuuaguccaaa

SEQ ID NO: 1484420 - RNA, 23 nt, Homo sapiens
ugagacaggagaccuggcacugg

SEQ ID NO: 1484421 - RNA, 14 nt, Homo sapiens
ugagacauguguca

SEQ ID NO: 1484422 - RNA, 18 nt, Homo sapiens
ugagacauugacaccaga

SEQ ID NO: 1484423 - RNA, 17 nt, Homo sapiens
ugagaccacuguuauca

SEQ ID NO: 1484424 - RNA, 13 nt, Homo sapiens
ugagacuacaggu

SEQ ID NO: 1484425 - RNA, 17 nt, Homo sapiens
ugagacuacuuaagaua

SEQ ID NO: 1484426 - RNA, 17 nt, Homo sapiens
ugagacucuagggucca

SEQ ID NO: 1484427 - RNA, 13 nt, Homo sapiens
ugagaggaugaau

SEQ ID NO: 1484428 - RNA, 19 nt, Homo sapiens
ugagagggaaucgacugua

SEQ ID NO: 1484429 - RNA, 17 nt, Homo sapiens
ugagaguaauugcuuga

SEQ ID NO: 1484430 - RNA, 12 nt, Homo sapiens
ugagaguauuua

SEQ ID NO: 1484431 - RNA, 13 nt, Homo sapiens
ugagagucacuug

SEQ ID NO: 1484432 - RNA, 16 nt, Homo sapiens
ugagaucacagccucc

SEQ ID NO: 1484433 - RNA, 23 nt, Homo sapiens
ugagaucuaaggaugucacaggg

SEQ ID NO: 1484434 - RNA, 17 nt, Homo sapiens
ugagaugauacauccaa

SEQ ID NO: 1484435 - RNA, 20 nt, Homo sapiens
ugagauuuccuccuggccuu

SEQ ID NO: 1484436 - RNA, 22 nt, Homo sapiens
ugagauuuugaaaaucuaccaa

SEQ ID NO: 1484437 - RNA, 14 nt, Homo sapiens
ugagcaaaggugau

SEQ ID NO: 1484438 - RNA, 16 nt, Homo sapiens
ugagcacccauuccaa

SEQ ID NO: 1484439 - RNA, 15 nt, Homo sapiens
ugagcagaagaucaa

SEQ ID NO: 1484440 - RNA, 18 nt, Homo sapiens
ugagcagaaguggagcug

SEQ ID NO: 1484441 - RNA, 22 nt, Homo sapiens
ugagcagccucuggacagccag

SEQ ID NO: 1484442 - RNA, 15 nt, Homo sapiens
ugagcagugccucuu

SEQ ID NO: 1484443 - RNA, 22 nt, Homo sapiens
ugagcccagcugggucaggcag

SEQ ID NO: 1484444 - RNA, 14 nt, Homo sapiens
ugagccgcugugag

SEQ ID NO: 1484445 - RNA, 20 nt, Homo sapiens
ugagccgugaacugugcaua

SEQ ID NO: 1484446 - RNA, 16 nt, Homo sapiens
uggaccugggcaugac

SEQ ID NO: 1484447 - RNA, 15 nt, Homo sapiens
uggaccuguucaaaa

SEQ ID NO: 1484448 - RNA, 15 nt, Homo sapiens
uggacucucagggau

SEQ ID NO: 1484449 - RNA, 15 nt, Homo sapiens
uggacucugccuuca

SEQ ID NO: 1484450 - RNA, 16 nt, Homo sapiens
uggacuguaacugacu

SEQ ID NO: 1484451 - RNA, 19 nt, Homo sapiens
uggacuuccacugccaucc

SEQ ID NO: 1484452 - RNA, 14 nt, Homo sapiens
uggacuugccuaaa

SEQ ID NO: 1484453 - RNA, 12 nt, Homo sapiens
uggacuuguaua

SEQ ID NO: 1484454 - RNA, 23 nt, Homo sapiens
uggacuuuugaaguccacuuguu

SEQ ID NO: 1484455 - RNA, 19 nt, Homo sapiens
uggagaauacuuugcuuca

SEQ ID NO: 1484456 - RNA, 23 nt, Homo sapiens
uggagacccugcaaacagaacag

SEQ ID NO: 1484457 - RNA, 15 nt, Homo sapiens
uggagagcacaccua

SEQ ID NO: 1484458 - RNA, 20 nt, Homo sapiens
uggagagucagaucuuucuc

SEQ ID NO: 1484459 - RNA, 14 nt, Homo sapiens
uggagauagucuca

SEQ ID NO: 1484460 - RNA, 23 nt, Homo sapiens
uggagauucaguuuucauuuggu

SEQ ID NO: 1484461 - RNA, 22 nt, Homo sapiens
uggagccaauguguggcucagu

SEQ ID NO: 1484462 - RNA, 17 nt, Homo sapiens
uggagccccaggggaca

SEQ ID NO: 1484463 - RNA, 17 nt, Homo sapiens
uggaggaauucagcuca

SEQ ID NO: 1484464 - RNA, 17 nt, Homo sapiens
uggaggagaaggacauu

SEQ ID NO: 1484465 - RNA, 12 nt, Homo sapiens
uggaggccugug

SEQ ID NO: 1484466 - RNA, 19 nt, Homo sapiens
uggaggcugcagugagcug

SEQ ID NO: 1484467 - RNA, 16 nt, Homo sapiens
uggagggaaugcucag

SEQ ID NO: 1484468 - RNA, 15 nt, Homo sapiens
uggagggcaucaggc

SEQ ID NO: 1484469 - RNA, 17 nt, Homo sapiens
uggaggguaaaugaugu

SEQ ID NO: 1484470 - RNA, 20 nt, Homo sapiens
uggaguauguuaaguugaag

SEQ ID NO: 1484471 - RNA, 22 nt, Homo sapiens
uggaguccccucaccuccucua

SEQ ID NO: 1484472 - RNA, 15 nt, Homo sapiens
uggauaacuuuacag

SEQ ID NO: 1484473 - RNA, 19 nt, Homo sapiens
uggauaagugcuaccuuaa

SEQ ID NO: 1484474 - RNA, 13 nt, Homo sapiens
uggauccagcacu

SEQ ID NO: 1484475 - RNA, 14 nt, Homo sapiens
uggauccagcacug

SEQ ID NO: 1484476 - RNA, 16 nt, Homo sapiens
uggaucccugcccuuc

SEQ ID NO: 1484477 - RNA, 16 nt, Homo sapiens
uggauccugggucaaa

SEQ ID NO: 1484478 - RNA, 15 nt, Homo sapiens
uggaucuaccagcau

SEQ ID NO: 1484479 - RNA, 20 nt, Homo sapiens
uggaugaaucucccacucca

SEQ ID NO: 1484480 - RNA, 15 nt, Homo sapiens
uggaugacacaaucc

SEQ ID NO: 1484481 - RNA, 19 nt, Homo sapiens
uggaugcagaaacaguuca

SEQ ID NO: 1484482 - RNA, 17 nt, Homo sapiens
uggaugccaaccgguca

SEQ ID NO: 1484483 - RNA, 23 nt, Homo sapiens
uggaugggggaacucagauccag

SEQ ID NO: 1484484 - RNA, 23 nt, Homo sapiens
uggaugugguuuaauuguuuguc

SEQ ID NO: 1484485 - RNA, 22 nt, Homo sapiens
uggauguucugacccugcuuca

SEQ ID NO: 1484486 - RNA, 15 nt, Homo sapiens
uggauuaugaaguga

SEQ ID NO: 1484487 - RNA, 15 nt, Homo sapiens
uggauucaucagcau

SEQ ID NO: 1484488 - RNA, 17 nt, Homo sapiens
uggauucauucucauaa

SEQ ID NO: 1484489 - RNA, 17 nt, Homo sapiens
uggauuccacacugcac

SEQ ID NO: 1484490 - RNA, 16 nt, Homo sapiens
uggauuugauucauuu

SEQ ID NO: 1484491 - RNA, 13 nt, Homo sapiens
uggcaaaugcacu

SEQ ID NO: 1484492 - RNA, 21 nt, Homo sapiens
uggcaaauguaacugugccag

SEQ ID NO: 1484493 - RNA, 18 nt, Homo sapiens
uggcaacaacaaagccaa

SEQ ID NO: 1484494 - RNA, 17 nt, Homo sapiens
uggcaacagagcaagac

SEQ ID NO: 1484495 - RNA, 12 nt, Homo sapiens
uggcaagagccc

SEQ ID NO: 1484496 - RNA, 18 nt, Homo sapiens
uggcaagucuuccaugac

SEQ ID NO: 1484497 - RNA, 20 nt, Homo sapiens
uggcaauauuccuuagucaa

SEQ ID NO: 1484498 - RNA, 20 nt, Homo sapiens
uggcaaugaaaaauucucag

SEQ ID NO: 1484499 - RNA, 17 nt, Homo sapiens
uggcaccccagcuaccc

SEQ ID NO: 1484500 - RNA, 14 nt, Homo sapiens
uggcacuaauauaa

SEQ ID NO: 1484501 - RNA, 17 nt, Homo sapiens
uggcacucaacucugag

SEQ ID NO: 1484502 - RNA, 16 nt, Homo sapiens
uggcacuggaugcaga

SEQ ID NO: 1484503 - RNA, 10 nt, Homo sapiens
uggcacuuug

SEQ ID NO: 1484504 - RNA, 20 nt, Homo sapiens
uggcagaagggaauugcuca

SEQ ID NO: 1484505 - RNA, 13 nt, Homo sapiens
uggcagaagucaa

SEQ ID NO: 1484506 - RNA, 21 nt, Homo sapiens
uggcagcaucuucacuucuaa

SEQ ID NO: 1484507 - RNA, 17 nt, Homo sapiens
uggcaggaaucuaucca

SEQ ID NO: 1484508 - RNA, 16 nt, Homo sapiens
uggcaggccagugucu

SEQ ID NO: 1484509 - RNA, 14 nt, Homo sapiens
uggcaggugccuug

SEQ ID NO: 1484510 - RNA, 15 nt, Homo sapiens
uggccaccaguauga

SEQ ID NO: 1484511 - RNA, 23 nt, Homo sapiens
uggccaccuccagggacaaagag

SEQ ID NO: 1484512 - RNA, 16 nt, Homo sapiens
uggccagccagugcca

SEQ ID NO: 1484513 - RNA, 19 nt, Homo sapiens
uggccaggacccugaccuc

SEQ ID NO: 1484514 - RNA, 13 nt, Homo sapiens
uggcccagccaaa

SEQ ID NO: 1484515 - RNA, 22 nt, Homo sapiens
uggccuauccgcugccagccuu

SEQ ID NO: 1484516 - RNA, 20 nt, Homo sapiens
uggccucccugcugugccau

SEQ ID NO: 1484517 - RNA, 14 nt, Homo sapiens
uggccugcacuggu

SEQ ID NO: 1484518 - RNA, 14 nt, Homo sapiens
uggccugucuuugg

SEQ ID NO: 1484519 - RNA, 16 nt, Homo sapiens
uggccuuacacugaaa

SEQ ID NO: 1484520 - RNA, 18 nt, Homo sapiens
uggccuugaaaccaccuu

SEQ ID NO: 1484521 - RNA, 19 nt, Homo sapiens
uggcgcuuagagaggacaa

SEQ ID NO: 1484522 - RNA, 14 nt, Homo sapiens
uggcguuacugcuu

SEQ ID NO: 1484523 - RNA, 14 nt, Homo sapiens
uggcuaauucccag

SEQ ID NO: 1484524 - RNA, 22 nt, Homo sapiens
uggcuaauucccagagugugaa

SEQ ID NO: 1484525 - RNA, 22 nt, Homo sapiens
uggcuacacucaucugacucau

SEQ ID NO: 1484526 - RNA, 20 nt, Homo sapiens
uggcucugcaugacaaacac

SEQ ID NO: 1484527 - RNA, 22 nt, Homo sapiens
uggcucugcuguccccuuggca

SEQ ID NO: 1484528 - RNA, 19 nt, Homo sapiens
uggcugaugauccagaaca

SEQ ID NO: 1484529 - RNA, 16 nt, Homo sapiens
uggcuggccugagcaa

SEQ ID NO: 1484530 - RNA, 12 nt, Homo sapiens
uggcuggcugcc

SEQ ID NO: 1484531 - RNA, 19 nt, Homo sapiens
uggcugguaacaguucaug

SEQ ID NO: 1484532 - RNA, 15 nt, Homo sapiens
uggcugugaaauuca

SEQ ID NO: 1484533 - RNA, 11 nt, Homo sapiens
uggcugugagg

SEQ ID NO: 1484534 - RNA, 22 nt, Homo sapiens
uggcuguggagagggucaagga

SEQ ID NO: 1484535 - RNA, 23 nt, Homo sapiens
uggcuuaccugaccucuugcugu

SEQ ID NO: 1484536 - RNA, 22 nt, Homo sapiens
uggcuuccagguaucuccagga

SEQ ID NO: 1484537 - RNA, 21 nt, Homo sapiens
uggcuuggguucacagugcau

SEQ ID NO: 1484538 - RNA, 15 nt, Homo sapiens
uggcuuuuuccucug

SEQ ID NO: 1484539 - RNA, 14 nt, Homo sapiens
ugggaaaaccagac

SEQ ID NO: 1484540 - RNA, 12 nt, Homo sapiens
ugggaaagacau

SEQ ID NO: 1484541 - RNA, 18 nt, Homo sapiens
ugggaaaucaguguuuua

SEQ ID NO: 1484542 - RNA, 18 nt, Homo sapiens
ugggaagacuauggugcu

SEQ ID NO: 1484543 - RNA, 22 nt, Homo sapiens
ugggaaggcuugggauuugcug

SEQ ID NO: 1484544 - RNA, 22 nt, Homo sapiens
ugggaauagggagacaggguag

SEQ ID NO: 1484545 - RNA, 23 nt, Homo sapiens
ugggaaugucucuuuggcgaccu

SEQ ID NO: 1484546 - RNA, 20 nt, Homo sapiens
ugggacccaaaacacaggaa

SEQ ID NO: 1484547 - RNA, 12 nt, Homo sapiens
ugggaccccaaa

SEQ ID NO: 1484548 - RNA, 23 nt, Homo sapiens
ugggaccucaguuuuaucauuuu

SEQ ID NO: 1484549 - RNA, 16 nt, Homo sapiens
uuugaggggcugacuu

SEQ ID NO: 1484550 - RNA, 23 nt, Homo sapiens
uuugagugugugugugcaugugu

SEQ ID NO: 1484551 - RNA, 14 nt, Homo sapiens
uuugauagaaccau

SEQ ID NO: 1484552 - RNA, 13 nt, Homo sapiens
uuugaugaacugu

SEQ ID NO: 1484553 - RNA, 14 nt, Homo sapiens
uuugauucuccagc

SEQ ID NO: 1484554 - RNA, 22 nt, Homo sapiens
uuugauugaggagcugcacuga

SEQ ID NO: 1484555 - RNA, 23 nt, Homo sapiens
uuugauugaggagcugcacugau

SEQ ID NO: 1484556 - RNA, 13 nt, Homo sapiens
uuugcaacuuaau

SEQ ID NO: 1484557 - RNA, 18 nt, Homo sapiens
uuugcacacugcacuguu

SEQ ID NO: 1484558 - RNA, 13 nt, Homo sapiens
uuugcacaggaug

SEQ ID NO: 1484559 - RNA, 18 nt, Homo sapiens
uuugcauauuucaauguc

SEQ ID NO: 1484560 - RNA, 23 nt, Homo sapiens
uuugcauuugcucuuucaucucu

SEQ ID NO: 1484561 - RNA, 18 nt, Homo sapiens
uuugccaccccuguccag

SEQ ID NO: 1484562 - RNA, 22 nt, Homo sapiens
uuugcccugcccucucccaaaa

SEQ ID NO: 1484563 - RNA, 23 nt, Homo sapiens
uuugcgcugguggaccacaggca

SEQ ID NO: 1484564 - RNA, 14 nt, Homo sapiens
uuugcuacauucua

SEQ ID NO: 1484565 - RNA, 23 nt, Homo sapiens
uuugcuacuaaguucacauuaga

SEQ ID NO: 1484566 - RNA, 17 nt, Homo sapiens
uuugcucaacagaacau

SEQ ID NO: 1484567 - RNA, 15 nt, Homo sapiens
uuugcuccagaacac

SEQ ID NO: 1484568 - RNA, 16 nt, Homo sapiens
uuugcuuuucaggguu

SEQ ID NO: 1484569 - RNA, 14 nt, Homo sapiens
uuuggaaagccauu

SEQ ID NO: 1484570 - RNA, 22 nt, Homo sapiens
uuuggaaucuucucuuugacaa

SEQ ID NO: 1484571 - RNA, 12 nt, Homo sapiens
uuuggcuaaaau

SEQ ID NO: 1484572 - RNA, 11 nt, Homo sapiens
uuugggguccu

SEQ ID NO: 1484573 - RNA, 23 nt, Homo sapiens
uuuggguggaauggacuacucca

SEQ ID NO: 1484574 - RNA, 19 nt, Homo sapiens
uuuggugggcuuuggagcu

SEQ ID NO: 1484575 - RNA, 17 nt, Homo sapiens
uuuguaaacgacaagaa

SEQ ID NO: 1484576 - RNA, 13 nt, Homo sapiens
uuuguaacauaau

SEQ ID NO: 1484577 - RNA, 14 nt, Homo sapiens
uuuguaagugcugc

SEQ ID NO: 1484578 - RNA, 22 nt, Homo sapiens
uuuguaaugggaacugccucuu

SEQ ID NO: 1484579 - RNA, 20 nt, Homo sapiens
uuuguaccucuaaguacaua

SEQ ID NO: 1484580 - RNA, 13 nt, Homo sapiens
uuuguagcacuga

SEQ ID NO: 1484581 - RNA, 22 nt, Homo sapiens
uuugucccggggcuccacugaa

SEQ ID NO: 1484582 - RNA, 13 nt, Homo sapiens
uuugucucugcag

SEQ ID NO: 1484583 - RNA, 22 nt, Homo sapiens
uuugucucuuagaaauacuugu

SEQ ID NO: 1484584 - RNA, 17 nt, Homo sapiens
uuugugaauauuuucaa

SEQ ID NO: 1484585 - RNA, 14 nt, Homo sapiens
uuugugauucccuc

SEQ ID NO: 1484586 - RNA, 19 nt, Homo sapiens
uuuguguaucguaaccagc

SEQ ID NO: 1484587 - RNA, 23 nt, Homo sapiens
uuuuaaaaugagagucacuugau

SEQ ID NO: 1484588 - RNA, 13 nt, Homo sapiens
uuuuaaacauaag

SEQ ID NO: 1484589 - RNA, 23 nt, Homo sapiens
uuuuaaauaaaaauaaguguaca

SEQ ID NO: 1484590 - RNA, 18 nt, Homo sapiens
uuuuaaauguauacuaua

SEQ ID NO: 1484591 - RNA, 20 nt, Homo sapiens
uuuuaaauguauacuauagu

SEQ ID NO: 1484592 - RNA, 13 nt, Homo sapiens
uuuuaacauucca

SEQ ID NO: 1484593 - RNA, 12 nt, Homo sapiens
uuuuaauggugu

SEQ ID NO: 1484594 - RNA, 21 nt, Homo sapiens
uuuuaauuuaaacaccuccuc

SEQ ID NO: 1484595 - RNA, 19 nt, Homo sapiens
uuuuaauuuauuucaucca

SEQ ID NO: 1484596 - RNA, 13 nt, Homo sapiens
uuuuaauuuucac

SEQ ID NO: 1484597 - RNA, 19 nt, Homo sapiens
uuuuacauaacugccuuga

SEQ ID NO: 1484598 - RNA, 18 nt, Homo sapiens
uuuuacuaaaacacugaa

SEQ ID NO: 1484599 - RNA, 18 nt, Homo sapiens
uuuuagccauaaauugcu

SEQ ID NO: 1484600 - RNA, 14 nt, Homo sapiens
uuuuagcuuuacaa

SEQ ID NO: 1484601 - RNA, 18 nt, Homo sapiens
uuuuaguagagacagggu

SEQ ID NO: 1484602 - RNA, 22 nt, Homo sapiens
uuuuaguauaaguacauuauug

SEQ ID NO: 1484603 - RNA, 14 nt, Homo sapiens
uuuuauacuuucag

SEQ ID NO: 1484604 - RNA, 18 nt, Homo sapiens
uuuuaugauuugucucug

SEQ ID NO: 1484605 - RNA, 21 nt, Homo sapiens
uuuuaugccuucacuuuacaa

SEQ ID NO: 1484606 - RNA, 11 nt, Homo sapiens
uuuuaugcugg

SEQ ID NO: 1484607 - RNA, 21 nt, Homo sapiens
uuuucaaaauauuacucaguu

SEQ ID NO: 1484608 - RNA, 18 nt, Homo sapiens
uuuucaaagauguguugc

SEQ ID NO: 1484609 - RNA, 21 nt, Homo sapiens
uuuucaaagauguguugcuau

SEQ ID NO: 1484610 - RNA, 14 nt, Homo sapiens
uuuucaacauaacu

SEQ ID NO: 1484611 - RNA, 21 nt, Homo sapiens
uuuucaaucauaauaccugcu

SEQ ID NO: 1484612 - RNA, 17 nt, Homo sapiens
uuuucaggaauacauuu

SEQ ID NO: 1484613 - RNA, 18 nt, Homo sapiens
uuuucagucuaguugcca

SEQ ID NO: 1484614 - RNA, 13 nt, Homo sapiens
uuuuccacuuaga

SEQ ID NO: 1484615 - RNA, 17 nt, Homo sapiens
uuuuccaucauuuuaca

SEQ ID NO: 1484616 - RNA, 11 nt, Homo sapiens
uuuucccaaag

SEQ ID NO: 1484617 - RNA, 19 nt, Homo sapiens
uuuuccccaaccacagaga

SEQ ID NO: 1484618 - RNA, 18 nt, Homo sapiens
uuuuccuagcuguguuau

SEQ ID NO: 1484619 - RNA, 12 nt, Homo sapiens
uuuuccuauaau

SEQ ID NO: 1484620 - RNA, 23 nt, Homo sapiens
uuuucgaacaccaaaaaugaugc

SEQ ID NO: 1484621 - RNA, 22 nt, Homo sapiens
uuuucgcaccuaccaucaggga

SEQ ID NO: 1484622 - RNA, 21 nt, Homo sapiens
uuuucuaagguucucauagga

SEQ ID NO: 1484623 - RNA, 14 nt, Homo sapiens
uuuucucaauugua

SEQ ID NO: 1484624 - RNA, 13 nt, Homo sapiens
uuuucugaagaca

SEQ ID NO: 1484625 - RNA, 13 nt, Homo sapiens
uuuucugguucua

SEQ ID NO: 1484626 - RNA, 19 nt, Homo sapiens
uuuucuguaaauaaccuau

SEQ ID NO: 1484627 - RNA, 20 nt, Homo sapiens
uuuucuguaaauaaccuauu

SEQ ID NO: 1484628 - RNA, 12 nt, Homo sapiens
uuuugaaggcaa

SEQ ID NO: 1484629 - RNA, 15 nt, Homo sapiens
uuuugacacugguau

SEQ ID NO: 1484630 - RNA, 14 nt, Homo sapiens
uuuugauagcuuua

SEQ ID NO: 1484631 - RNA, 16 nt, Homo sapiens
uuuugcaacuagguau

SEQ ID NO: 1484632 - RNA, 15 nt, Homo sapiens
uuuugccaaucucaa

SEQ ID NO: 1484633 - RNA, 15 nt, Homo sapiens
uuuugccaguauuau

SEQ ID NO: 1484634 - RNA, 17 nt, Homo sapiens
uuuugccucaccuaaua

SEQ ID NO: 1484635 - RNA, 15 nt, Homo sapiens
uuuugcuacauucua

SEQ ID NO: 1484636 - RNA, 13 nt, Homo sapiens
uuuugcuuuccaa

SEQ ID NO: 1484637 - RNA, 15 nt, Homo sapiens
uuuuggaacuguccu

SEQ ID NO: 1484638 - RNA, 13 nt, Homo sapiens
uuuuggccaaagu

SEQ ID NO: 1484639 - RNA, 18 nt, Homo sapiens
uuuuggguguuccuggca

SEQ ID NO: 1484640 - RNA, 21 nt, Homo sapiens
uuuugguagaugcaugacuug

SEQ ID NO: 1484641 - RNA, 19 nt, Homo sapiens
uuuuguaacauaaugcacu

SEQ ID NO: 1484642 - RNA, 14 nt, Homo sapiens
uuuuguauauacag

SEQ ID NO: 1484643 - RNA, 12 nt, Homo sapiens
uuuugucucaga

SEQ ID NO: 1484644 - RNA, 22 nt, Homo sapiens
uuuugugggggugaagucuugc

SEQ ID NO: 1484645 - RNA, 18 nt, Homo sapiens
uuuuguuccacaaguuaa

SEQ ID NO: 1484646 - RNA, 14 nt, Homo sapiens
uuuuguugccuuca

SEQ ID NO: 1484647 - RNA, 16 nt, Homo sapiens
uuuuuaaguaacuuaa

SEQ ID NO: 1484648 - RNA, 18 nt, Homo sapiens
uuuuuaauauaaagccug

SEQ ID NO: 1484649 - RNA, 17 nt, Homo sapiens
uuuuuacuccaguggug

SEQ ID NO: 1484650 - RNA, 12 nt, Homo sapiens
uuuuuagcuuua

SEQ ID NO: 1484651 - RNA, 13 nt, Homo sapiens
uuuuuauuuauga

SEQ ID NO: 1484652 - RNA, 20 nt, Homo sapiens
cuaauuuguaggaaaaagca

SEQ ID NO: 1484653 - RNA, 19 nt, Homo sapiens
cuaauuuuaguauucauuc

SEQ ID NO: 1484654 - RNA, 20 nt, Homo sapiens
cuaauuuuaguauucauucu

SEQ ID NO: 1484655 - RNA, 15 nt, Homo sapiens
cuaauuuucucaaaa

SEQ ID NO: 1484656 - RNA, 15 nt, Homo sapiens
cuacaaaaaacaaca

SEQ ID NO: 1484657 - RNA, 15 nt, Homo sapiens
cuacaaaaaugaagc

SEQ ID NO: 1484658 - RNA, 14 nt, Homo sapiens
cuacaaacacugca

SEQ ID NO: 1484659 - RNA, 15 nt, Homo sapiens
cuacaaccagagccc

SEQ ID NO: 1484660 - RNA, 17 nt, Homo sapiens
cuacaacugauugcaac

SEQ ID NO: 1484661 - RNA, 14 nt, Homo sapiens
cuacacaauuuaau

SEQ ID NO: 1484662 - RNA, 14 nt, Homo sapiens
cuacacacaaacca

SEQ ID NO: 1484663 - RNA, 16 nt, Homo sapiens
cuacacacacacuccc

SEQ ID NO: 1484664 - RNA, 14 nt, Homo sapiens
cuacacacugucau

SEQ ID NO: 1484665 - RNA, 14 nt, Homo sapiens
cuacacucuugacu

SEQ ID NO: 1484666 - RNA, 23 nt, Homo sapiens
cuacacuuugcuccucuggccca

SEQ ID NO: 1484667 - RNA, 21 nt, Homo sapiens
cuacagagcagcuccccagga

SEQ ID NO: 1484668 - RNA, 20 nt, Homo sapiens
cuacagcucuuaaauguagc

SEQ ID NO: 1484669 - RNA, 11 nt, Homo sapiens
cuacagcuuuc

SEQ ID NO: 1484670 - RNA, 15 nt, Homo sapiens
cuacauaacuuccua

SEQ ID NO: 1484671 - RNA, 14 nt, Homo sapiens
cuacaugacugggc

SEQ ID NO: 1484672 - RNA, 21 nt, Homo sapiens
cuacaugccucagugaaggac

SEQ ID NO: 1484673 - RNA, 19 nt, Homo sapiens
cuacauggaguauauguca

SEQ ID NO: 1484674 - RNA, 15 nt, Homo sapiens
cuacauucuaaugca

SEQ ID NO: 1484675 - RNA, 16 nt, Homo sapiens
cuaccaguugcccuag

SEQ ID NO: 1484676 - RNA, 17 nt, Homo sapiens
cuacccaugacuuuaua

SEQ ID NO: 1484677 - RNA, 14 nt, Homo sapiens
cuaccccauauaca

SEQ ID NO: 1484678 - RNA, 14 nt, Homo sapiens
cuacccugcugacc

SEQ ID NO: 1484679 - RNA, 15 nt, Homo sapiens
cuaccguaaaugucc

SEQ ID NO: 1484680 - RNA, 15 nt, Homo sapiens
cuaccguuguuugca

SEQ ID NO: 1484681 - RNA, 10 nt, Homo sapiens
cuaccucagc

SEQ ID NO: 1484682 - RNA, 14 nt, Homo sapiens
cuaccucagccucc

SEQ ID NO: 1484683 - RNA, 22 nt, Homo sapiens
cuaccugauggaaguaaagccu

SEQ ID NO: 1484684 - RNA, 19 nt, Homo sapiens
cuaccuuuuaccuagccac

SEQ ID NO: 1484685 - RNA, 22 nt, Homo sapiens
cuacgguuuuauaaaagccuug

SEQ ID NO: 1484686 - RNA, 14 nt, Homo sapiens
cuacguauccugca

SEQ ID NO: 1484687 - RNA, 14 nt, Homo sapiens
cuacuaaaaacaca

SEQ ID NO: 1484688 - RNA, 22 nt, Homo sapiens
cuacuaugugcugggugccucc

SEQ ID NO: 1484689 - RNA, 12 nt, Homo sapiens
cuacucuggaau

SEQ ID NO: 1484690 - RNA, 17 nt, Homo sapiens
cuacugcagcaccucca

SEQ ID NO: 1484691 - RNA, 18 nt, Homo sapiens
cuacugcagcaccuccag

SEQ ID NO: 1484692 - RNA, 18 nt, Homo sapiens
cuacugcucuguguuuac

SEQ ID NO: 1484693 - RNA, 21 nt, Homo sapiens
cuacuguuaggaacagcagug

SEQ ID NO: 1484694 - RNA, 15 nt, Homo sapiens
cuacuuaaugagaua

SEQ ID NO: 1484695 - RNA, 14 nt, Homo sapiens
cuacuugaccuaag

SEQ ID NO: 1484696 - RNA, 19 nt, Homo sapiens
cuacuugggaggcugaggc

SEQ ID NO: 1484697 - RNA, 15 nt, Homo sapiens
cuacuuuguggcaau

SEQ ID NO: 1484698 - RNA, 18 nt, Homo sapiens
cuacuuuuggugcuuaaa

SEQ ID NO: 1484699 - RNA, 19 nt, Homo sapiens
cuagaaaacaggcaaauuc

SEQ ID NO: 1484700 - RNA, 18 nt, Homo sapiens
cuagaaaaggcagcuaaa

SEQ ID NO: 1484701 - RNA, 21 nt, Homo sapiens
cuagaaaauuagacugugauu

SEQ ID NO: 1484702 - RNA, 18 nt, Homo sapiens
cuagaacaacgccuguca

SEQ ID NO: 1484703 - RNA, 14 nt, Homo sapiens
cuagaacucuccau

SEQ ID NO: 1484704 - RNA, 19 nt, Homo sapiens
cuagaacucuccaucuuau

SEQ ID NO: 1484705 - RNA, 13 nt, Homo sapiens
ucucagaugcagu

SEQ ID NO: 1484706 - RNA, 12 nt, Homo sapiens
ucucagcacuuu

SEQ ID NO: 1484707 - RNA, 16 nt, Homo sapiens
ucucaggaccucugua

SEQ ID NO: 1484708 - RNA, 17 nt, Homo sapiens
ucucaggaccucuguag

SEQ ID NO: 1484709 - RNA, 14 nt, Homo sapiens
ucucagugcuucuu

SEQ ID NO: 1484710 - RNA, 23 nt, Homo sapiens
ucucaucaacaaagaaauauuau

SEQ ID NO: 1484711 - RNA, 15 nt, Homo sapiens
ucucaucccaaccuc

SEQ ID NO: 1484712 - RNA, 22 nt, Homo sapiens
ucucauccuccaguaccuugcu

SEQ ID NO: 1484713 - RNA, 15 nt, Homo sapiens
ucucauguccugcug

SEQ ID NO: 1484714 - RNA, 21 nt, Homo sapiens
ucucauuuggucugccagaau

SEQ ID NO: 1484715 - RNA, 21 nt, Homo sapiens
ucucauuuuuaucccauugag

SEQ ID NO: 1484716 - RNA, 13 nt, Homo sapiens
ucuccaaacauua

SEQ ID NO: 1484717 - RNA, 18 nt, Homo sapiens
ucuccacucuugugguca

SEQ ID NO: 1484718 - RNA, 13 nt, Homo sapiens
ucuccaggcuuca

SEQ ID NO: 1484719 - RNA, 13 nt, Homo sapiens
ucuccaucuucca

SEQ ID NO: 1484720 - RNA, 22 nt, Homo sapiens
ucuccauguuugauguaucuga

SEQ ID NO: 1484721 - RNA, 16 nt, Homo sapiens
ucucccaccaccucac

SEQ ID NO: 1484722 - RNA, 19 nt, Homo sapiens
ucuccccaguguaugucuu

SEQ ID NO: 1484723 - RNA, 22 nt, Homo sapiens
ucuccccaguguaugucuugua

SEQ ID NO: 1484724 - RNA, 20 nt, Homo sapiens
ucuccccugaccugugagcc

SEQ ID NO: 1484725 - RNA, 20 nt, Homo sapiens
ucucccgaauucgcuguuac

SEQ ID NO: 1484726 - RNA, 23 nt, Homo sapiens
ucucccucucuccaacaaaugga

SEQ ID NO: 1484727 - RNA, 23 nt, Homo sapiens
ucucccuuccuaugcuguucacu

SEQ ID NO: 1484728 - RNA, 22 nt, Homo sapiens
ucuccgcaacagccaaguggaa

SEQ ID NO: 1484729 - RNA, 14 nt, Homo sapiens
ucuccugcccagau

SEQ ID NO: 1484730 - RNA, 17 nt, Homo sapiens
ucuccuuugcacugagg

SEQ ID NO: 1484731 - RNA, 18 nt, Homo sapiens
ucuccuuugcacugaggg

SEQ ID NO: 1484732 - RNA, 15 nt, Homo sapiens
ucuccuuuuacuuca

SEQ ID NO: 1484733 - RNA, 17 nt, Homo sapiens
ucucgaaugcugagaag

SEQ ID NO: 1484734 - RNA, 18 nt, Homo sapiens
ucucgcuuuguugcccag

SEQ ID NO: 1484735 - RNA, 14 nt, Homo sapiens
ucucuaacauuucc

SEQ ID NO: 1484736 - RNA, 17 nt, Homo sapiens
ucucuacuaaaaguaca

SEQ ID NO: 1484737 - RNA, 20 nt, Homo sapiens
ucucuagacaacuaccccuu

SEQ ID NO: 1484738 - RNA, 17 nt, Homo sapiens
ucucuagcuuugucaua

SEQ ID NO: 1484739 - RNA, 23 nt, Homo sapiens
ucucuaugccagcucagucccau

SEQ ID NO: 1484740 - RNA, 21 nt, Homo sapiens
ucucuccacgguagcacuuga

SEQ ID NO: 1484741 - RNA, 23 nt, Homo sapiens
ucucuccccauccccacccaguc

SEQ ID NO: 1484742 - RNA, 13 nt, Homo sapiens
ucucucuuuauac

SEQ ID NO: 1484743 - RNA, 16 nt, Homo sapiens
ucucugaacacaggca

SEQ ID NO: 1484744 - RNA, 23 nt, Homo sapiens
ucucugaagaugaucauuugccc

SEQ ID NO: 1484745 - RNA, 20 nt, Homo sapiens
ucucuggagcauucugaaaa

SEQ ID NO: 1484746 - RNA, 19 nt, Homo sapiens
ucucugugcccuccagcaa

SEQ ID NO: 1484747 - RNA, 24 nt, Homo sapiens
ucucuguguaaucaucugaagaaa

SEQ ID NO: 1484748 - RNA, 24 nt, Homo sapiens
ucucuguguaugagugugaaugau

SEQ ID NO: 1484749 - RNA, 18 nt, Homo sapiens
ucucuucagaaaacccuu

SEQ ID NO: 1484750 - RNA, 14 nt, Homo sapiens
ucucuucucaccuu

SEQ ID NO: 1484751 - RNA, 14 nt, Homo sapiens
ucugaaaauuccag

SEQ ID NO: 1484752 - RNA, 16 nt, Homo sapiens
ucugaaacugcauaag

SEQ ID NO: 1484753 - RNA, 17 nt, Homo sapiens
ucugaaaggauguggaa

SEQ ID NO: 1484754 - RNA, 20 nt, Homo sapiens
ucugaaauuuuaauugaacu

SEQ ID NO: 1484755 - RNA, 14 nt, Homo sapiens
ucugaacacaggca

SEQ ID NO: 1484756 - RNA, 15 nt, Homo sapiens
ucugaacucucaaaa

SEQ ID NO: 1484757 - RNA, 20 nt, Homo sapiens
ucugaagucacaucacagga

SEQ ID NO: 1484758 - RNA, 23 nt, Homo sapiens
ucugaagucacaucacaggacac

SEQ ID NO: 1484759 - RNA, 18 nt, Homo sapiens
ucugaauggaagaguguu

SEQ ID NO: 1484760 - RNA, 18 nt, Homo sapiens
ucugacaguccuuggggu

SEQ ID NO: 1484761 - RNA, 14 nt, Homo sapiens
ucugaccacagcau

SEQ ID NO: 1484762 - RNA, 22 nt, Homo sapiens
ucugacccagugcccccacuga

SEQ ID NO: 1484763 - RNA, 20 nt, Homo sapiens
ucugacuauaaccuuguucc

SEQ ID NO: 1484764 - RNA, 21 nt, Homo sapiens
ucugacucauccccacagcug

SEQ ID NO: 1484765 - RNA, 17 nt, Homo sapiens
ucugagaaggugagaua

SEQ ID NO: 1484766 - RNA, 13 nt, Homo sapiens
ucugagaccagug

SEQ ID NO: 1484767 - RNA, 17 nt, Homo sapiens
ucugagggaaagugcau

SEQ ID NO: 1484768 - RNA, 17 nt, Homo sapiens
ucugagggagcugagua

SEQ ID NO: 1484769 - RNA, 16 nt, Homo sapiens
ucugauaccacugcac

SEQ ID NO: 1484770 - RNA, 17 nt, Homo sapiens
ucugauaccacugcacu

SEQ ID NO: 1484771 - RNA, 17 nt, Homo sapiens
ucugaucguuuauucuc

SEQ ID NO: 1484772 - RNA, 19 nt, Homo sapiens
ucugaugucccagugcuca

SEQ ID NO: 1484773 - RNA, 16 nt, Homo sapiens
ucugcaacauuugaca

SEQ ID NO: 1484774 - RNA, 14 nt, Homo sapiens
ucugcaaguccacu

SEQ ID NO: 1484775 - RNA, 16 nt, Homo sapiens
ucugcacacaaaacuc

SEQ ID NO: 1484776 - RNA, 20 nt, Homo sapiens
ucugcacccacgugcauuca

SEQ ID NO: 1484777 - RNA, 16 nt, Homo sapiens
ucugcagguacuuccu

SEQ ID NO: 1484778 - RNA, 17 nt, Homo sapiens
ucugcaguacagucuua

SEQ ID NO: 1484779 - RNA, 19 nt, Homo sapiens
ucugccacccacucaggau

SEQ ID NO: 1484780 - RNA, 16 nt, Homo sapiens
ucugcccgcuccaugg

SEQ ID NO: 1484781 - RNA, 19 nt, Homo sapiens
ucugcccugccuacuuuua

SEQ ID NO: 1484782 - RNA, 20 nt, Homo sapiens
ucugcccuuauggagcucac

SEQ ID NO: 1484783 - RNA, 14 nt, Homo sapiens
ucugcccuuuccua

SEQ ID NO: 1484784 - RNA, 14 nt, Homo sapiens
ucugccgcuaccuc

SEQ ID NO: 1484785 - RNA, 23 nt, Homo sapiens
ucugccggcccccaggacaagug

SEQ ID NO: 1484786 - RNA, 22 nt, Homo sapiens
ucugccuggagugcugugcugu

SEQ ID NO: 1484787 - RNA, 14 nt, Homo sapiens
ucugccuucaaaca

SEQ ID NO: 1484788 - RNA, 18 nt, Homo sapiens
ucugccuuguccugaugc

SEQ ID NO: 1484789 - RNA, 19 nt, Homo sapiens
ucugcggggcagggccuuc

SEQ ID NO: 1484790 - RNA, 13 nt, Homo sapiens
ucugcucacuuua

SEQ ID NO: 1484791 - RNA, 14 nt, Homo sapiens
ucugcucacuuuaa

SEQ ID NO: 1484792 - RNA, 16 nt, Homo sapiens
ucugcuucuccaagga

SEQ ID NO: 1484793 - RNA, 18 nt, Homo sapiens
ucuggaacccagacucag

SEQ ID NO: 1484794 - RNA, 17 nt, Homo sapiens
ucuggaagaccugaaag

SEQ ID NO: 1484795 - RNA, 13 nt, Homo sapiens
ucuggaaguccaa

SEQ ID NO: 1484796 - RNA, 13 nt, Homo sapiens
ucuggacacugag

SEQ ID NO: 1484797 - RNA, 14 nt, Homo sapiens
ucuggacacugcca

SEQ ID NO: 1484798 - RNA, 21 nt, Homo sapiens
ucuggaccauauaccaucucc

SEQ ID NO: 1484799 - RNA, 12 nt, Homo sapiens
ucuggaggucau

SEQ ID NO: 1484800 - RNA, 18 nt, Homo sapiens
ucuggauccagccaugcc

SEQ ID NO: 1484801 - RNA, 15 nt, Homo sapiens
ucuggaugcugugaa

SEQ ID NO: 1484802 - RNA, 20 nt, Homo sapiens
ucuggcaacccuagucugcu

SEQ ID NO: 1484803 - RNA, 15 nt, Homo sapiens
ugauuuuagcauauu

SEQ ID NO: 1484804 - RNA, 15 nt, Homo sapiens
ugauuuuagccaugc

SEQ ID NO: 1484805 - RNA, 16 nt, Homo sapiens
ugauuuuauaugcuau

SEQ ID NO: 1484806 - RNA, 16 nt, Homo sapiens
ugcaaaaaacucagag

SEQ ID NO: 1484807 - RNA, 14 nt, Homo sapiens
ugcaaaacacuaaa

SEQ ID NO: 1484808 - RNA, 17 nt, Homo sapiens
ugcaaaacacuaaagau

SEQ ID NO: 1484809 - RNA, 20 nt, Homo sapiens
ugcaaaagggcuuccuaaaa

SEQ ID NO: 1484810 - RNA, 22 nt, Homo sapiens
ugcaaacccgaaaauaaaagac

SEQ ID NO: 1484811 - RNA, 12 nt, Homo sapiens
ugcaacagcuac

SEQ ID NO: 1484812 - RNA, 13 nt, Homo sapiens
ugcaacagcuuuc

SEQ ID NO: 1484813 - RNA, 16 nt, Homo sapiens
ugcaaccucacuaugg

SEQ ID NO: 1484814 - RNA, 22 nt, Homo sapiens
ugcaacugggucugacaugaac

SEQ ID NO: 1484815 - RNA, 16 nt, Homo sapiens
ugcaacuucaugucaa

SEQ ID NO: 1484816 - RNA, 18 nt, Homo sapiens
ugcaagagugauugcagc

SEQ ID NO: 1484817 - RNA, 22 nt, Homo sapiens
ugcaauaaaucugacccagugc

SEQ ID NO: 1484818 - RNA, 12 nt, Homo sapiens
ugcaaugucaca

SEQ ID NO: 1484819 - RNA, 19 nt, Homo sapiens
ugcaauuuucuaagcaauu

SEQ ID NO: 1484820 - RNA, 20 nt, Homo sapiens
ugcacacacacacaucucau

SEQ ID NO: 1484821 - RNA, 21 nt, Homo sapiens
ugcacacucacuuguaagaaa

SEQ ID NO: 1484822 - RNA, 15 nt, Homo sapiens
ugcacacugcacugu

SEQ ID NO: 1484823 - RNA, 21 nt, Homo sapiens
ugcacacugccuggcccaaaa

SEQ ID NO: 1484824 - RNA, 18 nt, Homo sapiens
ugcacagggggaggccau

SEQ ID NO: 1484825 - RNA, 19 nt, Homo sapiens
ugcacagggggaggccaua

SEQ ID NO: 1484826 - RNA, 22 nt, Homo sapiens
ugcacagugaagugcuggcaac

SEQ ID NO: 1484827 - RNA, 15 nt, Homo sapiens
ugcacaucacaacau

SEQ ID NO: 1484828 - RNA, 14 nt, Homo sapiens
ugcacaugaaaguu

SEQ ID NO: 1484829 - RNA, 16 nt, Homo sapiens
ugcacaugaaugcagu

SEQ ID NO: 1484830 - RNA, 11 nt, Homo sapiens
ugcacauugua

SEQ ID NO: 1484831 - RNA, 15 nt, Homo sapiens
ugcaccaacgagcug

SEQ ID NO: 1484832 - RNA, 14 nt, Homo sapiens
ugcaccagagcaac

SEQ ID NO: 1484833 - RNA, 19 nt, Homo sapiens
ugcaccaggcacugcugca

SEQ ID NO: 1484834 - RNA, 17 nt, Homo sapiens
ugcaccagugugacauc

SEQ ID NO: 1484835 - RNA, 20 nt, Homo sapiens
ugcaccccaaagcuuuccug

SEQ ID NO: 1484836 - RNA, 15 nt, Homo sapiens
ugcaccgccucaggg

SEQ ID NO: 1484837 - RNA, 14 nt, Homo sapiens
ugcaccuggaugua

SEQ ID NO: 1484838 - RNA, 17 nt, Homo sapiens
ugcacucaccucacugu

SEQ ID NO: 1484839 - RNA, 20 nt, Homo sapiens
ugcacuccagccugggcaac

SEQ ID NO: 1484840 - RNA, 22 nt, Homo sapiens
ugcacuccagccugggggacag

SEQ ID NO: 1484841 - RNA, 18 nt, Homo sapiens
ugcacuccagucuggcaa

SEQ ID NO: 1484842 - RNA, 18 nt, Homo sapiens
ugcacucuaaacugcaaa

SEQ ID NO: 1484843 - RNA, 15 nt, Homo sapiens
ugcacugcccuguuc

SEQ ID NO: 1484844 - RNA, 16 nt, Homo sapiens
ugcacuguccugacca

SEQ ID NO: 1484845 - RNA, 15 nt, Homo sapiens
ugcacuuauucaaua

SEQ ID NO: 1484846 - RNA, 20 nt, Homo sapiens
ugcacuuguggcaacagaua

SEQ ID NO: 1484847 - RNA, 21 nt, Homo sapiens
ugcagaaaauucugugccuug

SEQ ID NO: 1484848 - RNA, 13 nt, Homo sapiens
ugcagaagcagaa

SEQ ID NO: 1484849 - RNA, 20 nt, Homo sapiens
ugcagaagcagaagugcaau

SEQ ID NO: 1484850 - RNA, 16 nt, Homo sapiens
ugcagaaguacuccua

SEQ ID NO: 1484851 - RNA, 18 nt, Homo sapiens
ugcagaauaaugacugac

SEQ ID NO: 1484852 - RNA, 17 nt, Homo sapiens
ugcagaauccaaaguaa

SEQ ID NO: 1484853 - RNA, 18 nt, Homo sapiens
ugcagaauccaaaguaaa

SEQ ID NO: 1484854 - RNA, 14 nt, Homo sapiens
ugcagacaggccau

SEQ ID NO: 1484855 - RNA, 23 nt, Homo sapiens
ugcagacaggccaugugagccac

SEQ ID NO: 1484856 - RNA, 12 nt, Homo sapiens
ugcagacuuccc

SEQ ID NO: 1484857 - RNA, 17 nt, Homo sapiens
ugcagagcccauagcca

SEQ ID NO: 1484858 - RNA, 16 nt, Homo sapiens
ugcagaggcaccucaa

SEQ ID NO: 1484859 - RNA, 19 nt, Homo sapiens
ugcagagguaaaaguguga

SEQ ID NO: 1484860 - RNA, 15 nt, Homo sapiens
ugcagcacgucucag

SEQ ID NO: 1484861 - RNA, 13 nt, Homo sapiens
ugcagccagcuca

SEQ ID NO: 1484862 - RNA, 18 nt, Homo sapiens
ugcagcuagaggcaucuu

SEQ ID NO: 1484863 - RNA, 16 nt, Homo sapiens
ugcaggacuugagaag

SEQ ID NO: 1484864 - RNA, 17 nt, Homo sapiens
ugcagggacuccaugcu

SEQ ID NO: 1484865 - RNA, 19 nt, Homo sapiens
ugcagggguccccccucaa

SEQ ID NO: 1484866 - RNA, 20 nt, Homo sapiens
ugcaggguggauuguuacag

SEQ ID NO: 1484867 - RNA, 17 nt, Homo sapiens
ugcagguacuuccucag

SEQ ID NO: 1484868 - RNA, 22 nt, Homo sapiens
ugcagguuccuuaucugucaca

SEQ ID NO: 1484869 - RNA, 19 nt, Homo sapiens
ugcaguacaagaaccucuc

SEQ ID NO: 1484870 - RNA, 16 nt, Homo sapiens
ugcaguagacugcagu

SEQ ID NO: 1484871 - RNA, 15 nt, Homo sapiens
ugcagugaauucaua

SEQ ID NO: 1484872 - RNA, 17 nt, Homo sapiens
ugcagugagcccagauc

SEQ ID NO: 1484873 - RNA, 13 nt, Homo sapiens
ugcagugcuucca

SEQ ID NO: 1484874 - RNA, 16 nt, Homo sapiens
ugcaguugacagcagg

SEQ ID NO: 1484875 - RNA, 15 nt, Homo sapiens
ugcaguugcagugaa

SEQ ID NO: 1484876 - RNA, 22 nt, Homo sapiens
ugcaguuuccaaucccauagau

SEQ ID NO: 1484877 - RNA, 22 nt, Homo sapiens
ugcauaagugaaaaucuuacaa

SEQ ID NO: 1484878 - RNA, 18 nt, Homo sapiens
ugcauaauaagcuaaaga

SEQ ID NO: 1484879 - RNA, 21 nt, Homo sapiens
ugcauagcagaugguuuccac

SEQ ID NO: 1484880 - RNA, 16 nt, Homo sapiens
ugcauaggaauugcac

SEQ ID NO: 1484881 - RNA, 17 nt, Homo sapiens
ugcauaggaauugcaca

SEQ ID NO: 1484882 - RNA, 22 nt, Homo sapiens
ugcauaggaauugcacaaucca

SEQ ID NO: 1484883 - RNA, 13 nt, Homo sapiens
ugcaucacugggu

SEQ ID NO: 1484884 - RNA, 15 nt, Homo sapiens
ugcaucauccuugca

SEQ ID NO: 1484885 - RNA, 15 nt, Homo sapiens
ugcaugcaugcccuc

SEQ ID NO: 1484886 - RNA, 11 nt, Homo sapiens
ugcauggauuu

SEQ ID NO: 1484887 - RNA, 15 nt, Homo sapiens
ugcauguaagccaag

SEQ ID NO: 1484888 - RNA, 21 nt, Homo sapiens
ugcaugucaucuucuaggcca

SEQ ID NO: 1484889 - RNA, 15 nt, Homo sapiens
ugcauguggcuuuuu

SEQ ID NO: 1484890 - RNA, 11 nt, Homo sapiens
ugcauguguau

SEQ ID NO: 1484891 - RNA, 22 nt, Homo sapiens
ugcauucauuuuuauagcaaca

SEQ ID NO: 1484892 - RNA, 15 nt, Homo sapiens
ugcauucuucucugu

SEQ ID NO: 1484893 - RNA, 16 nt, Homo sapiens
ugcauugugaggguua

SEQ ID NO: 1484894 - RNA, 12 nt, Homo sapiens
ugcauuuagcuu

SEQ ID NO: 1484895 - RNA, 13 nt, Homo sapiens
ugcauuuagcuuc

SEQ ID NO: 1484896 - RNA, 20 nt, Homo sapiens
ugcauuuauggucaacacuu

SEQ ID NO: 1484897 - RNA, 21 nt, Homo sapiens
ugcauuuccagcugugcagca

SEQ ID NO: 1484898 - RNA, 15 nt, Homo sapiens
ugcauuuugcuauug

SEQ ID NO: 1484899 - RNA, 17 nt, Homo sapiens
ugcauuuuuaaauacaa

SEQ ID NO: 1484900 - RNA, 16 nt, Homo sapiens
ugcauuuuuagaccau

SEQ ID NO: 1484901 - RNA, 16 nt, Homo sapiens
ugccaaaaacaaaaaa

SEQ ID NO: 1484902 - RNA, 20 nt, Homo sapiens
ugccaaaucuggcuccuuua

SEQ ID NO: 1484903 - RNA, 12 nt, Homo sapiens
ugccaaccaguu

SEQ ID NO: 1484904 - RNA, 20 nt, Homo sapiens
ugccaaccggucacccagga

SEQ ID NO: 1484905 - RNA, 17 nt, Homo sapiens
ugccaagacagugaagu

SEQ ID NO: 1484906 - RNA, 22 nt, Homo sapiens
ugccaaggaaacccccagugua

SEQ ID NO: 1484907 - RNA, 15 nt, Homo sapiens
ugccaaggcaaaaaa

SEQ ID NO: 1484908 - RNA, 19 nt, Homo sapiens
ugccaauggcggacucaaa

SEQ ID NO: 1484909 - RNA, 20 nt, Homo sapiens
ugccacauacaggugcucaa

SEQ ID NO: 1484910 - RNA, 20 nt, Homo sapiens
ugccaccauguauucaucca

SEQ ID NO: 1484911 - RNA, 15 nt, Homo sapiens
ugccaccuucaaguu

SEQ ID NO: 1484912 - RNA, 16 nt, Homo sapiens
ugccacuaaacuacau

SEQ ID NO: 1484913 - RNA, 20 nt, Homo sapiens
ugccagaauacuggguucuu

SEQ ID NO: 1484914 - RNA, 19 nt, Homo sapiens
ugccagcaaugacaucuca

SEQ ID NO: 1484915 - RNA, 15 nt, Homo sapiens
ugccaggcugcuaaa

SEQ ID NO: 1484916 - RNA, 15 nt, Homo sapiens
ugccagugccucuca

SEQ ID NO: 1484917 - RNA, 14 nt, Homo sapiens
ugccaguugaucaa

SEQ ID NO: 1484918 - RNA, 18 nt, Homo sapiens
ugccauacuuuccuguau

SEQ ID NO: 1484919 - RNA, 16 nt, Homo sapiens
ugccauggcagacagu

SEQ ID NO: 1484920 - RNA, 13 nt, Homo sapiens
ugccaugugaaga

SEQ ID NO: 1484921 - RNA, 15 nt, Homo sapiens
ugccauugcacucca

SEQ ID NO: 1484922 - RNA, 18 nt, Homo sapiens
ugcccaaugagacucuag

SEQ ID NO: 1484923 - RNA, 21 nt, Homo sapiens
ugcccacuuccccuuccccaa

SEQ ID NO: 1484924 - RNA, 13 nt, Homo sapiens
ugcccagaucaac

SEQ ID NO: 1484925 - RNA, 15 nt, Homo sapiens
ugcccagaucaacag

SEQ ID NO: 1484926 - RNA, 21 nt, Homo sapiens
ugcccagcccggaccuuggca

SEQ ID NO: 1484927 - RNA, 23 nt, Homo sapiens
ugcccaggagaaaagaagacauu

SEQ ID NO: 1484928 - RNA, 17 nt, Homo sapiens
ugcccaggcuggucuca

SEQ ID NO: 1484929 - RNA, 21 nt, Homo sapiens
ugcccagugagacuguguugu

SEQ ID NO: 1484930 - RNA, 22 nt, Homo sapiens
ugcccaguguuguuuguaaaua

SEQ ID NO: 1484931 - RNA, 20 nt, Homo sapiens
ugcccauccugccauccuca

SEQ ID NO: 1484932 - RNA, 14 nt, Homo sapiens
ugccccacacuccc

SEQ ID NO: 1484933 - RNA, 15 nt, Homo sapiens
ugccccacacucccc

SEQ ID NO: 1484934 - RNA, 22 nt, Homo sapiens
ugccccacccaguuucuggaaa

SEQ ID NO: 1484935 - RNA, 20 nt, Homo sapiens
ugccccacgcuguggcccug

SEQ ID NO: 1484936 - RNA, 18 nt, Homo sapiens
ugccccagaaaaauaacu

SEQ ID NO: 1484937 - RNA, 18 nt, Homo sapiens
ugcccccagccccggggu

SEQ ID NO: 1484938 - RNA, 18 nt, Homo sapiens
ugccccgucuacagcucc

SEQ ID NO: 1484939 - RNA, 14 nt, Homo sapiens
ugccccucucacca

SEQ ID NO: 1484940 - RNA, 16 nt, Homo sapiens
ugccccucuguaacaa

SEQ ID NO: 1484941 - RNA, 17 nt, Homo sapiens
ugccccuggaccaguac

SEQ ID NO: 1484942 - RNA, 19 nt, Homo sapiens
ugcccucauuacugggccu

SEQ ID NO: 1484943 - RNA, 14 nt, Homo sapiens
ugcccucucugagu

SEQ ID NO: 1484944 - RNA, 23 nt, Homo sapiens
ugcccugaguggaucuccaagga

SEQ ID NO: 1484945 - RNA, 17 nt, Homo sapiens
ugcccuguaaccugacu

SEQ ID NO: 1484946 - RNA, 18 nt, Homo sapiens
ugcccuguguacauauaa

SEQ ID NO: 1484947 - RNA, 16 nt, Homo sapiens
ugcccuguguacuucc

SEQ ID NO: 1484948 - RNA, 17 nt, Homo sapiens
ugcccuuaaacauugga

SEQ ID NO: 1484949 - RNA, 20 nt, Homo sapiens
ugcccuuaaacauuggacag

SEQ ID NO: 1484950 - RNA, 20 nt, Homo sapiens
ugcccuuuggaaagccauug

SEQ ID NO: 1484951 - RNA, 14 nt, Homo sapiens
ugcccuuugggguc

SEQ ID NO: 1484952 - RNA, 20 nt, Homo sapiens
ugccgcagacgggcacagac

SEQ ID NO: 1484953 - RNA, 18 nt, Homo sapiens
ugccgcaggugggugcug

SEQ ID NO: 1484954 - RNA, 13 nt, Homo sapiens
ugccgcuaccucc

SEQ ID NO: 1484955 - RNA, 21 nt, Homo sapiens
ugccguaacaacuguggucaa

SEQ ID NO: 1484956 - RNA, 20 nt, Homo sapiens
ugccgugugagugugacagg

SEQ ID NO: 1484957 - RNA, 22 nt, Homo sapiens
ugccuaaaauauauuccugaga

SEQ ID NO: 1484958 - RNA, 21 nt, Homo sapiens
ugccuagauuagguagacuuu

SEQ ID NO: 1484959 - RNA, 23 nt, Homo sapiens
ugccuaucaaagaguauguugua

SEQ ID NO: 1484960 - RNA, 18 nt, Homo sapiens
ugccuauuuguguggaca

SEQ ID NO: 1484961 - RNA, 17 nt, Homo sapiens
ugccucaaugugaccag

SEQ ID NO: 1484962 - RNA, 16 nt, Homo sapiens
ugccucacuuccuaca

SEQ ID NO: 1484963 - RNA, 22 nt, Homo sapiens
ugccucagccucccaauuagcu

SEQ ID NO: 1484964 - RNA, 12 nt, Homo sapiens
ugccucagcuga

SEQ ID NO: 1484965 - RNA, 18 nt, Homo sapiens
ugccucccaagguccucu

SEQ ID NO: 1484966 - RNA, 16 nt, Homo sapiens
ugccucccagguucca

SEQ ID NO: 1484967 - RNA, 16 nt, Homo sapiens
ugccuccugccugccc

SEQ ID NO: 1484968 - RNA, 16 nt, Homo sapiens
ugccucuugucugagg

SEQ ID NO: 1484969 - RNA, 15 nt, Homo sapiens
ugccugccaccuuca

SEQ ID NO: 1484970 - RNA, 23 nt, Homo sapiens
ugccugccccaaacaaauaugca

SEQ ID NO: 1484971 - RNA, 11 nt, Homo sapiens
ugccugggaag

SEQ ID NO: 1484972 - RNA, 15 nt, Homo sapiens
ugccugguaccagag

SEQ ID NO: 1484973 - RNA, 13 nt, Homo sapiens
ugccuggugaaug

SEQ ID NO: 1484974 - RNA, 23 nt, Homo sapiens
ugccugguggggaucagacagag

SEQ ID NO: 1484975 - RNA, 14 nt, Homo sapiens
ugccuguaauccca

SEQ ID NO: 1484976 - RNA, 14 nt, Homo sapiens
ugccuguaaucuca

SEQ ID NO: 1484977 - RNA, 20 nt, Homo sapiens
ugccuguaaucucagcacuu

SEQ ID NO: 1484978 - RNA, 22 nt, Homo sapiens
ugccuguaaucucagcacuuug

SEQ ID NO: 1484979 - RNA, 22 nt, Homo sapiens
ugccugugcagcgggugcugcu

SEQ ID NO: 1484980 - RNA, 14 nt, Homo sapiens
ugccuucacccaua

SEQ ID NO: 1484981 - RNA, 18 nt, Homo sapiens
ugccuucuaggucacuuc

SEQ ID NO: 1484982 - RNA, 14 nt, Homo sapiens
ugccuucugaaaug

SEQ ID NO: 1484983 - RNA, 16 nt, Homo sapiens
ugccuugcagccacau

SEQ ID NO: 1484984 - RNA, 18 nt, Homo sapiens
ugccuugcuaaaagauua

SEQ ID NO: 1484985 - RNA, 17 nt, Homo sapiens
ugccuuguccucagggc

SEQ ID NO: 1484986 - RNA, 17 nt, Homo sapiens
ugccuuucuucugcccu

SEQ ID NO: 1484987 - RNA, 12 nt, Homo sapiens
ugcgaacacuga

SEQ ID NO: 1484988 - RNA, 19 nt, Homo sapiens
ugcgauucugcagccacaa

SEQ ID NO: 1484989 - RNA, 15 nt, Homo sapiens
ugcgcaauguggcau

SEQ ID NO: 1484990 - RNA, 16 nt, Homo sapiens
ugcgccaaucccgcca

SEQ ID NO: 1484991 - RNA, 14 nt, Homo sapiens
ugcgcgucaucucu

SEQ ID NO: 1484992 - RNA, 18 nt, Homo sapiens
ugcggggggcaccagagg

SEQ ID NO: 1484993 - RNA, 16 nt, Homo sapiens
ugcgguagaugggagg

SEQ ID NO: 1484994 - RNA, 22 nt, Homo sapiens
ugcgugcucccgaugcugcuau

SEQ ID NO: 1484995 - RNA, 21 nt, Homo sapiens
ugcguggugcucuuugcugca

SEQ ID NO: 1484996 - RNA, 17 nt, Homo sapiens
ugcuaacaaagacaaaa

SEQ ID NO: 1484997 - RNA, 21 nt, Homo sapiens
ugcuacagcaauuucuaauuu

SEQ ID NO: 1484998 - RNA, 19 nt, Homo sapiens
ugcuacguuccuauuguca

SEQ ID NO: 1484999 - RNA, 24 nt, Homo sapiens
ugcuacugauuguuucauugcgaa

SEQ ID NO: 1485000 - RNA, 12 nt, Homo sapiens
ugcuacuugacc

SEQ ID NO: 1485001 - RNA, 23 nt, Homo sapiens
ugcuagaaaguuaggggguucuu

SEQ ID NO: 1485002 - RNA, 19 nt, Homo sapiens
ugcuagacucuagacaaga

SEQ ID NO: 1485003 - RNA, 13 nt, Homo sapiens
ugcuagcaguaaa

SEQ ID NO: 1485004 - RNA, 16 nt, Homo sapiens
ugcuaguuuauauaga

SEQ ID NO: 1485005 - RNA, 11 nt, Homo sapiens
ugcuauggaag

SEQ ID NO: 1485006 - RNA, 16 nt, Homo sapiens
ugcuauuugcuguuau

SEQ ID NO: 1485007 - RNA, 23 nt, Homo sapiens
ugcucagaccgagcgugugccac

SEQ ID NO: 1485008 - RNA, 20 nt, Homo sapiens
ugcucagagaaggaaaagac

SEQ ID NO: 1485009 - RNA, 14 nt, Homo sapiens
ugcucauaugcaug

SEQ ID NO: 1485010 - RNA, 18 nt, Homo sapiens
ugcucauugaacuuuaag

SEQ ID NO: 1485011 - RNA, 21 nt, Homo sapiens
ugcucauuuuuucuucuccua

SEQ ID NO: 1485012 - RNA, 22 nt, Homo sapiens
ugcuccaacccccgccaccuca

SEQ ID NO: 1485013 - RNA, 23 nt, Homo sapiens
ugcuccaacccccgccaccucag

SEQ ID NO: 1485014 - RNA, 12 nt, Homo sapiens
ugcuccaccagc

SEQ ID NO: 1485015 - RNA, 14 nt, Homo sapiens
ugcuccagugcagg

SEQ ID NO: 1485016 - RNA, 17 nt, Homo sapiens
ugcuccauuaauccagg

SEQ ID NO: 1485017 - RNA, 13 nt, Homo sapiens
ugcucccacagaa

SEQ ID NO: 1485018 - RNA, 13 nt, Homo sapiens
ugcucccaucauu

SEQ ID NO: 1485019 - RNA, 21 nt, Homo sapiens
ugcucccucagccucagagga

SEQ ID NO: 1485020 - RNA, 14 nt, Homo sapiens
ugcuccgcaagagc

SEQ ID NO: 1485021 - RNA, 16 nt, Homo sapiens
ugcuccgcugcuccuu

SEQ ID NO: 1485022 - RNA, 13 nt, Homo sapiens
ugcuccucagggg

SEQ ID NO: 1485023 - RNA, 17 nt, Homo sapiens
ugcuccugaagcccuau

SEQ ID NO: 1485024 - RNA, 16 nt, Homo sapiens
ugcucuggaagaccug

SEQ ID NO: 1485025 - RNA, 19 nt, Homo sapiens
ugcucuggaagaccugaaa

SEQ ID NO: 1485026 - RNA, 14 nt, Homo sapiens
ugcucuguuaccca

SEQ ID NO: 1485027 - RNA, 18 nt, Homo sapiens
ugcucuuucaucucugcu

SEQ ID NO: 1485028 - RNA, 13 nt, Homo sapiens
ugcugaaaaagua

SEQ ID NO: 1485029 - RNA, 21 nt, Homo sapiens
ugcugaaaaaguagauugagu

SEQ ID NO: 1485030 - RNA, 17 nt, Homo sapiens
ugcugaaaaaucaucca

SEQ ID NO: 1485031 - RNA, 18 nt, Homo sapiens
ugcugaacuccuuguuag

SEQ ID NO: 1485032 - RNA, 22 nt, Homo sapiens
ugcugaaggagggucaccgcau

SEQ ID NO: 1485033 - RNA, 18 nt, Homo sapiens
ugcugagccuccuugucu

SEQ ID NO: 1485034 - RNA, 22 nt, Homo sapiens
ugcugaguaacaggugccuucc

SEQ ID NO: 1485035 - RNA, 23 nt, Homo sapiens
ugcugagugaaugaacaaaugaa

SEQ ID NO: 1485036 - RNA, 23 nt, Homo sapiens
ugcugagugcaccacuucaagug

SEQ ID NO: 1485037 - RNA, 23 nt, Homo sapiens
ugcugauggcuugacaugugcaa

SEQ ID NO: 1485038 - RNA, 15 nt, Homo sapiens
ugcugauuuggugac

SEQ ID NO: 1485039 - RNA, 23 nt, Homo sapiens
ugcugcacagaaauuuucaauuu

SEQ ID NO: 1485040 - RNA, 18 nt, Homo sapiens
ugcugcaggcguacaggu

SEQ ID NO: 1485041 - RNA, 15 nt, Homo sapiens
ugcugcagucaucua

SEQ ID NO: 1485042 - RNA, 17 nt, Homo sapiens
ugcugccaugacagagg

SEQ ID NO: 1485043 - RNA, 17 nt, Homo sapiens
ugcugcccauguuucaa

SEQ ID NO: 1485044 - RNA, 17 nt, Homo sapiens
ugcugcuccagugcagg

SEQ ID NO: 1485045 - RNA, 19 nt, Homo sapiens
ugcugcuggaucacagcug

SEQ ID NO: 1485046 - RNA, 13 nt, Homo sapiens
ugcuggacucugg

SEQ ID NO: 1485047 - RNA, 13 nt, Homo sapiens
ugcuggacuugcc

SEQ ID NO: 1485048 - RNA, 14 nt, Homo sapiens
ugcuggagacacuc

SEQ ID NO: 1485049 - RNA, 18 nt, Homo sapiens
ugcuggcagccauggcca

SEQ ID NO: 1485050 - RNA, 20 nt, Homo sapiens
ugcuggccaaauagcaaaga

SEQ ID NO: 1485051 - RNA, 18 nt, Homo sapiens
ugcuggccuggaucuccc

SEQ ID NO: 1485052 - RNA, 14 nt, Homo sapiens
ugcuggcugccuua

SEQ ID NO: 1485053 - RNA, 23 nt, Homo sapiens
ugcugggaagacgccugagcuca

SEQ ID NO: 1485054 - RNA, 15 nt, Homo sapiens
ugcugggaccagagc

SEQ ID NO: 1485055 - RNA, 14 nt, Homo sapiens
ugcugggauuucca

SEQ ID NO: 1485056 - RNA, 17 nt, Homo sapiens
ugcugggcccaccaccu

SEQ ID NO: 1485057 - RNA, 15 nt, Homo sapiens
ugcuggugcagcgua

SEQ ID NO: 1485058 - RNA, 16 nt, Homo sapiens
ugcuggugccugccac

SEQ ID NO: 1485059 - RNA, 17 nt, Homo sapiens
ugcugucaagcaccugc

SEQ ID NO: 1485060 - RNA, 22 nt, Homo sapiens
ugcugucauuaguauuucacaa

SEQ ID NO: 1485061 - RNA, 14 nt, Homo sapiens
ugcugugauuccac

SEQ ID NO: 1485062 - RNA, 13 nt, Homo sapiens
ugcugugcugugu

SEQ ID NO: 1485063 - RNA, 14 nt, Homo sapiens
ugcuguugggauau

SEQ ID NO: 1485064 - RNA, 16 nt, Homo sapiens
ugcuguuuuaaacauu

SEQ ID NO: 1485065 - RNA, 19 nt, Homo sapiens
ugcuuaccuacauacgugu

SEQ ID NO: 1485066 - RNA, 18 nt, Homo sapiens
ugcuuaguaucucaucaa

SEQ ID NO: 1485067 - RNA, 21 nt, Homo sapiens
ugcuuauaauaaagaaaaccu

SEQ ID NO: 1485068 - RNA, 23 nt, Homo sapiens
ugcuuccccuuuugccaaucuca

SEQ ID NO: 1485069 - RNA, 23 nt, Homo sapiens
ugcuucccggcgucccuaccucc

SEQ ID NO: 1485070 - RNA, 12 nt, Homo sapiens
ugcuuccuccca

SEQ ID NO: 1485071 - RNA, 18 nt, Homo sapiens
ugcuucucuagcucucua

SEQ ID NO: 1485072 - RNA, 15 nt, Homo sapiens
ugcuucugcacacaa

SEQ ID NO: 1485073 - RNA, 19 nt, Homo sapiens
ugcuugaacccagaaggca

SEQ ID NO: 1485074 - RNA, 20 nt, Homo sapiens
ugcuugacaacaaccuaugc

SEQ ID NO: 1485075 - RNA, 13 nt, Homo sapiens
ugcuugcacuuug

SEQ ID NO: 1485076 - RNA, 12 nt, Homo sapiens
ugcuuggaugua

SEQ ID NO: 1485077 - RNA, 15 nt, Homo sapiens
ugcuugggacauugc

SEQ ID NO: 1485078 - RNA, 17 nt, Homo sapiens
ugcuugggacauugcaa

SEQ ID NO: 1485079 - RNA, 15 nt, Homo sapiens
ugcuuguuauauuaa

SEQ ID NO: 1485080 - RNA, 17 nt, Homo sapiens
ugcuuuaaaaaaauaca

SEQ ID NO: 1485081 - RNA, 15 nt, Homo sapiens
ugcuuucuguuccaa

SEQ ID NO: 1485082 - RNA, 11 nt, Homo sapiens
ugcuuuggacu

SEQ ID NO: 1485083 - RNA, 22 nt, Homo sapiens
ugcuuugggauuuaauuuccag

SEQ ID NO: 1485084 - RNA, 18 nt, Homo sapiens
ugcuuuugaggaacauua

SEQ ID NO: 1485085 - RNA, 23 nt, Homo sapiens
ugcuuuuguguaaggaaggugcu

SEQ ID NO: 1485086 - RNA, 17 nt, Homo sapiens
uggaaaagaagaaacuu

SEQ ID NO: 1485087 - RNA, 21 nt, Homo sapiens
uggaaaagaagaaacuuugcc

SEQ ID NO: 1485088 - RNA, 19 nt, Homo sapiens
uggaaaagcaaaacuguag

SEQ ID NO: 1485089 - RNA, 20 nt, Homo sapiens
uggaaaauaaacaucaguuu

SEQ ID NO: 1485090 - RNA, 14 nt, Homo sapiens
uggaaacaggacca

SEQ ID NO: 1485091 - RNA, 20 nt, Homo sapiens
uggaaaccucuggaggucau

SEQ ID NO: 1485092 - RNA, 20 nt, Homo sapiens
uggaaacgcaaaugaguauu

SEQ ID NO: 1485093 - RNA, 14 nt, Homo sapiens
uggaaagcugcuuc

SEQ ID NO: 1485094 - RNA, 21 nt, Homo sapiens
uggaaauauguaaugcuucca

SEQ ID NO: 1485095 - RNA, 23 nt, Homo sapiens
uggaaaugaaacugcugugaaug

SEQ ID NO: 1485096 - RNA, 19 nt, Homo sapiens
uggaaaugcugacuuuuaa

SEQ ID NO: 1485097 - RNA, 20 nt, Homo sapiens
uggaaaugucaucuaaccau

SEQ ID NO: 1485098 - RNA, 13 nt, Homo sapiens
uggaacaagcaca

SEQ ID NO: 1485099 - RNA, 12 nt, Homo sapiens
uggaacacggcc

SEQ ID NO: 1485100 - RNA, 15 nt, Homo sapiens
uggaacacggccaca

SEQ ID NO: 1485101 - RNA, 19 nt, Homo sapiens
uggaacacggccacaucaa

SEQ ID NO: 1485102 - RNA, 21 nt, Homo sapiens
uggaacagcgggagaccugug

SEQ ID NO: 1485103 - RNA, 16 nt, Homo sapiens
uggaacauccuuugca

SEQ ID NO: 1485104 - RNA, 21 nt, Homo sapiens
uggaaccaaucccgugaaaga

SEQ ID NO: 1485105 - RNA, 18 nt, Homo sapiens
uggaacucagcugucugu

SEQ ID NO: 1485106 - RNA, 22 nt, Homo sapiens
uggaacuguccuucccucaaag

SEQ ID NO: 1485107 - RNA, 23 nt, Homo sapiens
uggaagaggaacagcacugggga

SEQ ID NO: 1485108 - RNA, 19 nt, Homo sapiens
uggaagcaguuucagagaa

SEQ ID NO: 1485109 - RNA, 15 nt, Homo sapiens
uggaagcucugaagu

SEQ ID NO: 1485110 - RNA, 16 nt, Homo sapiens
uggaagcuugcuuuuu

SEQ ID NO: 1485111 - RNA, 19 nt, Homo sapiens
uggaaggggccuugcugag

SEQ ID NO: 1485112 - RNA, 13 nt, Homo sapiens
uggaaggggucca

SEQ ID NO: 1485113 - RNA, 15 nt, Homo sapiens
uggaagggguccagc

SEQ ID NO: 1485114 - RNA, 16 nt, Homo sapiens
uggaagucuccaugaa

SEQ ID NO: 1485115 - RNA, 20 nt, Homo sapiens
uggaauaaagucacagaauu

SEQ ID NO: 1485116 - RNA, 16 nt, Homo sapiens
uggaauaccuaaggau

SEQ ID NO: 1485117 - RNA, 22 nt, Homo sapiens
uggaauauaaggaaagcaauaa

SEQ ID NO: 1485118 - RNA, 21 nt, Homo sapiens
uggaauauaauuucaaaccac

SEQ ID NO: 1485119 - RNA, 16 nt, Homo sapiens
uggaauauugugauuc

SEQ ID NO: 1485120 - RNA, 15 nt, Homo sapiens
uggaauggagauuca

SEQ ID NO: 1485121 - RNA, 19 nt, Homo sapiens
uggacaccccugcuauaua

SEQ ID NO: 1485122 - RNA, 11 nt, Homo sapiens
uggacacugag

SEQ ID NO: 1485123 - RNA, 15 nt, Homo sapiens
uggacagccagugac

SEQ ID NO: 1485124 - RNA, 22 nt, Homo sapiens
uggacagugggcaucagcagca

SEQ ID NO: 1485125 - RNA, 18 nt, Homo sapiens
uggacaguuuuaagcaga

SEQ ID NO: 1485126 - RNA, 14 nt, Homo sapiens
uggaccaagcacaa

SEQ ID NO: 1485127 - RNA, 13 nt, Homo sapiens
uggaccacaggca

SEQ ID NO: 1485128 - RNA, 22 nt, Homo sapiens
uggacucucauguggccaagca

SEQ ID NO: 1485129 - RNA, 17 nt, Homo sapiens
uggacuuccagugcuca

SEQ ID NO: 1485130 - RNA, 21 nt, Homo sapiens
uggacuugauagcaaacacug

SEQ ID NO: 1485131 - RNA, 22 nt, Homo sapiens
uggacuuguauauuuguacaaa

SEQ ID NO: 1485132 - RNA, 20 nt, Homo sapiens
uggacuuuugaaaagcuuuu

SEQ ID NO: 1485133 - RNA, 13 nt, Homo sapiens
uggagaaaaucaa

SEQ ID NO: 1485134 - RNA, 14 nt, Homo sapiens
uggagaaaaugggc

SEQ ID NO: 1485135 - RNA, 22 nt, Homo sapiens
uggagacccugccacagccaga

SEQ ID NO: 1485136 - RNA, 19 nt, Homo sapiens
uggagacguggaaccucug

SEQ ID NO: 1485137 - RNA, 12 nt, Homo sapiens
uggagacugaca

SEQ ID NO: 1485138 - RNA, 17 nt, Homo sapiens
uggagacugacaaccuc

SEQ ID NO: 1485139 - RNA, 15 nt, Homo sapiens
uggagagaagcucuu

SEQ ID NO: 1485140 - RNA, 18 nt, Homo sapiens
uggagagaagcucuucaa

SEQ ID NO: 1485141 - RNA, 16 nt, Homo sapiens
uggagaggaacccaga

SEQ ID NO: 1485142 - RNA, 19 nt, Homo sapiens
uggagagucagaucuuucu

SEQ ID NO: 1485143 - RNA, 21 nt, Homo sapiens
uggagauucaguuuucauuug

SEQ ID NO: 1485144 - RNA, 19 nt, Homo sapiens
uggagcaggagccccgcca

SEQ ID NO: 1485145 - RNA, 19 nt, Homo sapiens
uggagcccauccagucucc

SEQ ID NO: 1485146 - RNA, 21 nt, Homo sapiens
uggagcggagaggaagccagc

SEQ ID NO: 1485147 - RNA, 16 nt, Homo sapiens
uggagcuacugaugaa

SEQ ID NO: 1485148 - RNA, 13 nt, Homo sapiens
uggagcugucuac

SEQ ID NO: 1485149 - RNA, 18 nt, Homo sapiens
uggaggaaagugauaucc

SEQ ID NO: 1485150 - RNA, 19 nt, Homo sapiens
uggaggaacaacucuccag

SEQ ID NO: 1485151 - RNA, 14 nt, Homo sapiens
uggaggauugcuau

SEQ ID NO: 1485152 - RNA, 22 nt, Homo sapiens
uggaggcccaguucacccugau

SEQ ID NO: 1485153 - RNA, 15 nt, Homo sapiens
uggagggcauuugcu

SEQ ID NO: 1485154 - RNA, 20 nt, Homo sapiens
uggagggguguggcuccuuc

SEQ ID NO: 1485155 - RNA, 20 nt, Homo sapiens
uggaggucauacaugcauac

SEQ ID NO: 1485156 - RNA, 19 nt, Homo sapiens
uggaguacuauauuuacaa

SEQ ID NO: 1485157 - RNA, 18 nt, Homo sapiens
uggagugcaguggcauga

SEQ ID NO: 1485158 - RNA, 17 nt, Homo sapiens
uggagugcccacccugg

SEQ ID NO: 1485159 - RNA, 15 nt, Homo sapiens
uggauaaaaugaggu

SEQ ID NO: 1485160 - RNA, 20 nt, Homo sapiens
uggauaaaucauuucaguau

SEQ ID NO: 1485161 - RNA, 22 nt, Homo sapiens
uggauauuaaaaaucuguaaau

SEQ ID NO: 1485162 - RNA, 16 nt, Homo sapiens
uggaucuguccaagga

SEQ ID NO: 1485163 - RNA, 20 nt, Homo sapiens
uggaugaaugcccagugaga

SEQ ID NO: 1485164 - RNA, 19 nt, Homo sapiens
uggaugaggagacagaaua

SEQ ID NO: 1485165 - RNA, 14 nt, Homo sapiens
uggaugcaggguuu

SEQ ID NO: 1485166 - RNA, 16 nt, Homo sapiens
uggauggggcuuccag

SEQ ID NO: 1485167 - RNA, 20 nt, Homo sapiens
uggauggggcuuccagcuca

SEQ ID NO: 1485168 - RNA, 16 nt, Homo sapiens
uggaugggggaacuca

SEQ ID NO: 1485169 - RNA, 16 nt, Homo sapiens
uggauuccucacuuug

SEQ ID NO: 1485170 - RNA, 15 nt, Homo sapiens
uggauucgugacaac

SEQ ID NO: 1485171 - RNA, 22 nt, Homo sapiens
uggauugcacguggccucuuga

SEQ ID NO: 1485172 - RNA, 18 nt, Homo sapiens
uggauuuauaaaugcuau

SEQ ID NO: 1485173 - RNA, 23 nt, Homo sapiens
uggauuugaucacuacaaguauu

SEQ ID NO: 1485174 - RNA, 14 nt, Homo sapiens
uggauuuucuacug

SEQ ID NO: 1485175 - RNA, 19 nt, Homo sapiens
uggauuuucuacuguaaga

SEQ ID NO: 1485176 - RNA, 22 nt, Homo sapiens
uggauuuugggagugacucaag

SEQ ID NO: 1485177 - RNA, 14 nt, Homo sapiens
uggcaaaaaugcaa

SEQ ID NO: 1485178 - RNA, 17 nt, Homo sapiens
uggcaaagguggcucuc

SEQ ID NO: 1485179 - RNA, 19 nt, Homo sapiens
uggcaacagagcaagacuc

SEQ ID NO: 1485180 - RNA, 23 nt, Homo sapiens
uggcaagucuagagucucagaaa

SEQ ID NO: 1485181 - RNA, 23 nt, Homo sapiens
uggcaaucucagaugcaguuugg

SEQ ID NO: 1485182 - RNA, 19 nt, Homo sapiens
uggcaauuucacugaugua

SEQ ID NO: 1485183 - RNA, 23 nt, Homo sapiens
uggcacaugacaacuuugccagc

SEQ ID NO: 1485184 - RNA, 14 nt, Homo sapiens
uggcaccugcacac

SEQ ID NO: 1485185 - RNA, 18 nt, Homo sapiens
uggcaccugcacacucca

SEQ ID NO: 1485186 - RNA, 19 nt, Homo sapiens
uggcacucagggagcauuu

SEQ ID NO: 1485187 - RNA, 19 nt, Homo sapiens
uggcacugguuuguucccu

SEQ ID NO: 1485188 - RNA, 17 nt, Homo sapiens
uggcacuguggagcuca

SEQ ID NO: 1485189 - RNA, 18 nt, Homo sapiens
uggcacuguggagcucag

SEQ ID NO: 1485190 - RNA, 19 nt, Homo sapiens
uggcacuguggagcucagu

SEQ ID NO: 1485191 - RNA, 19 nt, Homo sapiens
uggcagaaccaaagcucaa

SEQ ID NO: 1485192 - RNA, 21 nt, Homo sapiens
uggcagaagggaauugcucag

SEQ ID NO: 1485193 - RNA, 18 nt, Homo sapiens
uggcagagagaucuuccc

SEQ ID NO: 1485194 - RNA, 12 nt, Homo sapiens
uggcagaugucu

SEQ ID NO: 1485195 - RNA, 14 nt, Homo sapiens
uggcagauuuuaca

SEQ ID NO: 1485196 - RNA, 17 nt, Homo sapiens
uggcagcauacacagau

SEQ ID NO: 1485197 - RNA, 20 nt, Homo sapiens
uggcagcauacacagaugaa

SEQ ID NO: 1485198 - RNA, 15 nt, Homo sapiens
uggcagccauggcca

SEQ ID NO: 1485199 - RNA, 16 nt, Homo sapiens
uggcagccauggccau

SEQ ID NO: 1485200 - RNA, 21 nt, Homo sapiens
uggcagcggguggcauccagg

SEQ ID NO: 1485201 - RNA, 17 nt, Homo sapiens
uggcagcuagugccuuu

SEQ ID NO: 1485202 - RNA, 16 nt, Homo sapiens
uggcaggaugaugcug

SEQ ID NO: 1485203 - RNA, 17 nt, Homo sapiens
uggcagucccuuauaau

SEQ ID NO: 1485204 - RNA, 19 nt, Homo sapiens
uggcauuccuucugaccac

SEQ ID NO: 1485205 - RNA, 16 nt, Homo sapiens
uggccaacaugaugaa

SEQ ID NO: 1485206 - RNA, 19 nt, Homo sapiens
uggccacccgcccacagcc

SEQ ID NO: 1485207 - RNA, 23 nt, Homo sapiens
uggccacucagcuuccuacccac

SEQ ID NO: 1485208 - RNA, 23 nt, Homo sapiens
uggccagagagccuggugcugcu

SEQ ID NO: 1485209 - RNA, 18 nt, Homo sapiens
uggccagccagugccauu

SEQ ID NO: 1485210 - RNA, 22 nt, Homo sapiens
uggccagccagugccauuccac

SEQ ID NO: 1485211 - RNA, 16 nt, Homo sapiens
uggccaggcacugccu

SEQ ID NO: 1485212 - RNA, 13 nt, Homo sapiens
uggcccagaugau

SEQ ID NO: 1485213 - RNA, 13 nt, Homo sapiens
uggcccagccuug

SEQ ID NO: 1485214 - RNA, 17 nt, Homo sapiens
uggcccagggaagccaa

SEQ ID NO: 1485215 - RNA, 19 nt, Homo sapiens
uggcccagggaagccaaaa

SEQ ID NO: 1485216 - RNA, 17 nt, Homo sapiens
uggccccaucccaguug

SEQ ID NO: 1485217 - RNA, 22 nt, Homo sapiens
uggccccuucuggggguggugg

SEQ ID NO: 1485218 - RNA, 17 nt, Homo sapiens
uggcccuuacacacuca

SEQ ID NO: 1485219 - RNA, 16 nt, Homo sapiens
uggccggauguccuca

SEQ ID NO: 1485220 - RNA, 22 nt, Homo sapiens
uggccgggugcgguggcucacg

SEQ ID NO: 1485221 - RNA, 23 nt, Homo sapiens
uggccgucccuaagcaugugucc

SEQ ID NO: 1485222 - RNA, 21 nt, Homo sapiens
uggccuacagucaucugccac

SEQ ID NO: 1485223 - RNA, 20 nt, Homo sapiens
uggccucagcugaaugccuc

SEQ ID NO: 1485224 - RNA, 17 nt, Homo sapiens
uggccucuggcucucau

SEQ ID NO: 1485225 - RNA, 21 nt, Homo sapiens
uggccucugugccuucuuuug

SEQ ID NO: 1485226 - RNA, 14 nt, Homo sapiens
uggccuggccauuu

SEQ ID NO: 1485227 - RNA, 17 nt, Homo sapiens
uggccuugaaaccaccu

SEQ ID NO: 1485228 - RNA, 22 nt, Homo sapiens
uggcgccccuuccuaggucaug

SEQ ID NO: 1485229 - RNA, 16 nt, Homo sapiens
uggcgggcaccuguag

SEQ ID NO: 1485230 - RNA, 15 nt, Homo sapiens
uggcguuacugcuug

SEQ ID NO: 1485231 - RNA, 23 nt, Homo sapiens
uggcguuacugcuugaccaaaga

SEQ ID NO: 1485232 - RNA, 19 nt, Homo sapiens
uggcuacacacaaaccagu

SEQ ID NO: 1485233 - RNA, 17 nt, Homo sapiens
uggcucagccagcacuu

SEQ ID NO: 1485234 - RNA, 19 nt, Homo sapiens
uggcuccaacacugcugcu

SEQ ID NO: 1485235 - RNA, 15 nt, Homo sapiens
uggcuccaccacuga

SEQ ID NO: 1485236 - RNA, 15 nt, Homo sapiens
uggcucccaugacca

SEQ ID NO: 1485237 - RNA, 14 nt, Homo sapiens
uggcucuucugccc

SEQ ID NO: 1485238 - RNA, 17 nt, Homo sapiens
uggcugaccccaaagag

SEQ ID NO: 1485239 - RNA, 13 nt, Homo sapiens
uggcugacugggg

SEQ ID NO: 1485240 - RNA, 14 nt, Homo sapiens
uggcugacuggggc

SEQ ID NO: 1485241 - RNA, 14 nt, Homo sapiens
uggcugccuuagaa

SEQ ID NO: 1485242 - RNA, 17 nt, Homo sapiens
uggcuggaaggggucca

SEQ ID NO: 1485243 - RNA, 16 nt, Homo sapiens
uggcugggaacaacuu

SEQ ID NO: 1485244 - RNA, 21 nt, Homo sapiens
uggcuuaauguuuauuccuga

SEQ ID NO: 1485245 - RNA, 22 nt, Homo sapiens
uggcuuugccuuggcuuugcca

SEQ ID NO: 1485246 - RNA, 22 nt, Homo sapiens
ugggaaaaauucagagaguuag

SEQ ID NO: 1485247 - RNA, 12 nt, Homo sapiens
ugggaagugaag

SEQ ID NO: 1485248 - RNA, 15 nt, Homo sapiens
ugggaaugucucuuu

SEQ ID NO: 1485249 - RNA, 13 nt, Homo sapiens
ugggacagaggag

SEQ ID NO: 1485250 - RNA, 15 nt, Homo sapiens
ugggacauugcaauu

SEQ ID NO: 1485251 - RNA, 15 nt, Homo sapiens
ugggaccacaugcca

SEQ ID NO: 1485252 - RNA, 13 nt, Homo sapiens
ugggagacuggaa

SEQ ID NO: 1485253 - RNA, 20 nt, Homo sapiens
ugggagaguaaaccuugaag

SEQ ID NO: 1485254 - RNA, 21 nt, Homo sapiens
ugggaggcccugagacaggga

SEQ ID NO: 1485255 - RNA, 14 nt, Homo sapiens
ugggaggcuucccc

SEQ ID NO: 1485256 - RNA, 14 nt, Homo sapiens
ugggagggagguaa

SEQ ID NO: 1485257 - RNA, 20 nt, Homo sapiens
ugggagggagguaacgggug

SEQ ID NO: 1485258 - RNA, 15 nt, Homo sapiens
ugggauaucacuucc

SEQ ID NO: 1485259 - RNA, 15 nt, Homo sapiens
ugggauuacaggugu

SEQ ID NO: 1485260 - RNA, 18 nt, Homo sapiens
ugggcaacagagcaagac

SEQ ID NO: 1485261 - RNA, 11 nt, Homo sapiens
ugggcacagug

SEQ ID NO: 1485262 - RNA, 14 nt, Homo sapiens
ugggcaccagcuca

SEQ ID NO: 1485263 - RNA, 12 nt, Homo sapiens
ugggcaccucag

SEQ ID NO: 1485264 - RNA, 22 nt, Homo sapiens
ugggcacucccuugguggcaag

SEQ ID NO: 1485265 - RNA, 13 nt, Homo sapiens
ugggcacugggau

SEQ ID NO: 1485266 - RNA, 22 nt, Homo sapiens
ugggcagggucuguuuggacug

SEQ ID NO: 1485267 - RNA, 13 nt, Homo sapiens
ugggcaugacauc

SEQ ID NO: 1485268 - RNA, 16 nt, Homo sapiens
ugggcaugccauuaca

SEQ ID NO: 1485269 - RNA, 19 nt, Homo sapiens
ugggccagacaugccacaa

SEQ ID NO: 1485270 - RNA, 14 nt, Homo sapiens
ugggcccagaucug

SEQ ID NO: 1485271 - RNA, 17 nt, Homo sapiens
ugggcccugcacagaua

SEQ ID NO: 1485272 - RNA, 15 nt, Homo sapiens
ugggccucaguucaa

SEQ ID NO: 1485273 - RNA, 17 nt, Homo sapiens
ugggccucugacucuga

SEQ ID NO: 1485274 - RNA, 20 nt, Homo sapiens
ugggccucugcuucucucac

SEQ ID NO: 1485275 - RNA, 20 nt, Homo sapiens
ugggcuccuggggcaauggg

SEQ ID NO: 1485276 - RNA, 21 nt, Homo sapiens
ugggcugagugacacaagcac

SEQ ID NO: 1485277 - RNA, 12 nt, Homo sapiens
ugggcugcugca

SEQ ID NO: 1485278 - RNA, 21 nt, Homo sapiens
ugggcugucagcccaugugca

SEQ ID NO: 1485279 - RNA, 14 nt, Homo sapiens
ugggcugucuguca

SEQ ID NO: 1485280 - RNA, 21 nt, Homo sapiens
ugggcuuaguauuucucagga

SEQ ID NO: 1485281 - RNA, 15 nt, Homo sapiens
ugggcuucaguaagu

SEQ ID NO: 1485282 - RNA, 13 nt, Homo sapiens
ugggcuugaccag

SEQ ID NO: 1485283 - RNA, 15 nt, Homo sapiens
uggggaaaaaacugu

SEQ ID NO: 1485284 - RNA, 17 nt, Homo sapiens
uggggaaaaaacugugc

SEQ ID NO: 1485285 - RNA, 15 nt, Homo sapiens
uggggaaaaaagcac

SEQ ID NO: 1485286 - RNA, 15 nt, Homo sapiens
uggggacacagauca

SEQ ID NO: 1485287 - RNA, 14 nt, Homo sapiens
uggggaguccaggg

SEQ ID NO: 1485288 - RNA, 15 nt, Homo sapiens
uggggaucagacaga

SEQ ID NO: 1485289 - RNA, 19 nt, Homo sapiens
uggggauuccacuaucuca

SEQ ID NO: 1485290 - RNA, 16 nt, Homo sapiens
uggggccuguggaaug

SEQ ID NO: 1485291 - RNA, 18 nt, Homo sapiens
uggggcuccuuucuccag

SEQ ID NO: 1485292 - RNA, 23 nt, Homo sapiens
ugggggaaaguguugaccacaga

SEQ ID NO: 1485293 - RNA, 15 nt, Homo sapiens
ugggggaacugugaa

SEQ ID NO: 1485294 - RNA, 13 nt, Homo sapiens
ugggggacugggg

SEQ ID NO: 1485295 - RNA, 22 nt, Homo sapiens
ugggggcaccuuaagauuuugc

SEQ ID NO: 1485296 - RNA, 21 nt, Homo sapiens
ugggggccuuguggcacucca

SEQ ID NO: 1485297 - RNA, 21 nt, Homo sapiens
uggggucuuugugguagcuua

SEQ ID NO: 1485298 - RNA, 17 nt, Homo sapiens
ugggguggccaccagua

SEQ ID NO: 1485299 - RNA, 19 nt, Homo sapiens
uggguacugaaagccuuag

SEQ ID NO: 1485300 - RNA, 15 nt, Homo sapiens
uggguacuucuugaa

SEQ ID NO: 1485301 - RNA, 21 nt, Homo sapiens
uggguaucgcugagacuaagu

SEQ ID NO: 1485302 - RNA, 18 nt, Homo sapiens
ugggucaaguacaccagc

SEQ ID NO: 1485303 - RNA, 19 nt, Homo sapiens
ugggucagagcuaaacucc

SEQ ID NO: 1485304 - RNA, 15 nt, Homo sapiens
uggguccaugcuaac

SEQ ID NO: 1485305 - RNA, 16 nt, Homo sapiens
ugggucccauucuugg

SEQ ID NO: 1485306 - RNA, 19 nt, Homo sapiens
ugggucuaccacucagaga

SEQ ID NO: 1485307 - RNA, 20 nt, Homo sapiens
ugggucucauuuagaacuug

SEQ ID NO: 1485308 - RNA, 22 nt, Homo sapiens
ugggugcuuaguaaguacuuaa

SEQ ID NO: 1485309 - RNA, 14 nt, Homo sapiens
uggguguacauuuu

SEQ ID NO: 1485310 - RNA, 23 nt, Homo sapiens
uggguguagccagguauggcucu

SEQ ID NO: 1485311 - RNA, 17 nt, Homo sapiens
uggguuguguguuuauu

SEQ ID NO: 1485312 - RNA, 18 nt, Homo sapiens
ugguaaaacucacuguga

SEQ ID NO: 1485313 - RNA, 23 nt, Homo sapiens
ugguaaacaguuuggaaaagugg

SEQ ID NO: 1485314 - RNA, 14 nt, Homo sapiens
ugguaaaugaucac

SEQ ID NO: 1485315 - RNA, 16 nt, Homo sapiens
ugguaaauuaguauuu

SEQ ID NO: 1485316 - RNA, 19 nt, Homo sapiens
ugguaacugcuuucuguuc

SEQ ID NO: 1485317 - RNA, 19 nt, Homo sapiens
ugguaaucauaugugucuu

SEQ ID NO: 1485318 - RNA, 18 nt, Homo sapiens
ugguaauuuuugcuuuuu

SEQ ID NO: 1485319 - RNA, 23 nt, Homo sapiens
ugguacuuagaguuucuguuuga

SEQ ID NO: 1485320 - RNA, 12 nt, Homo sapiens
ugguagcacuug

SEQ ID NO: 1485321 - RNA, 20 nt, Homo sapiens
ugguaguggaauagugaaua

SEQ ID NO: 1485322 - RNA, 15 nt, Homo sapiens
ugguauacuuuugcu

SEQ ID NO: 1485323 - RNA, 14 nt, Homo sapiens
ugguaucacugaac

SEQ ID NO: 1485324 - RNA, 22 nt, Homo sapiens
ugguauccugugacauguaaca

SEQ ID NO: 1485325 - RNA, 15 nt, Homo sapiens
ugguaucucagaaag

SEQ ID NO: 1485326 - RNA, 19 nt, Homo sapiens
ugguauguaauuuaugcaa

SEQ ID NO: 1485327 - RNA, 19 nt, Homo sapiens
ugguaugugacaccaaagc

SEQ ID NO: 1485328 - RNA, 15 nt, Homo sapiens
uggucaacacuuaag

SEQ ID NO: 1485329 - RNA, 19 nt, Homo sapiens
uggucaauccgaaguauga

SEQ ID NO: 1485330 - RNA, 18 nt, Homo sapiens
uggucacagccuccucug

SEQ ID NO: 1485331 - RNA, 13 nt, Homo sapiens
uggucaccaaauc

SEQ ID NO: 1485332 - RNA, 14 nt, Homo sapiens
uggucagauuugaa

SEQ ID NO: 1485333 - RNA, 21 nt, Homo sapiens
uggucauaacucagcccuuug

SEQ ID NO: 1485334 - RNA, 14 nt, Homo sapiens
uggucaucauggcc

SEQ ID NO: 1485335 - RNA, 15 nt, Homo sapiens
uggucauugugaaua

SEQ ID NO: 1485336 - RNA, 11 nt, Homo sapiens
ugguccagaau

SEQ ID NO: 1485337 - RNA, 16 nt, Homo sapiens
ugguccauauuuacau

SEQ ID NO: 1485338 - RNA, 17 nt, Homo sapiens
uggucccaagacaugaa

SEQ ID NO: 1485339 - RNA, 20 nt, Homo sapiens
ugguccugacucaacauguu

SEQ ID NO: 1485340 - RNA, 14 nt, Homo sapiens
uggucgagugacac

SEQ ID NO: 1485341 - RNA, 22 nt, Homo sapiens
uggucucaaacuccugaccuca

SEQ ID NO: 1485342 - RNA, 20 nt, Homo sapiens
uggucugcugaguaacaggu

SEQ ID NO: 1485343 - RNA, 17 nt, Homo sapiens
uggucuggccacugucc

SEQ ID NO: 1485344 - RNA, 20 nt, Homo sapiens
uggugaaaccccgucucuac

SEQ ID NO: 1485345 - RNA, 12 nt, Homo sapiens
uggugaaugaca

SEQ ID NO: 1485346 - RNA, 14 nt, Homo sapiens
uggugaaugacacg

SEQ ID NO: 1485347 - RNA, 14 nt, Homo sapiens
uggugccaaacaaa

SEQ ID NO: 1485348 - RNA, 16 nt, Homo sapiens
uggugccccacagcua

SEQ ID NO: 1485349 - RNA, 17 nt, Homo sapiens
uggugcgcccugucucu

SEQ ID NO: 1485350 - RNA, 14 nt, Homo sapiens
ugguggaccacagg

SEQ ID NO: 1485351 - RNA, 15 nt, Homo sapiens
ugguggagcagagug

SEQ ID NO: 1485352 - RNA, 14 nt, Homo sapiens
ugguggcaccagau

SEQ ID NO: 1485353 - RNA, 13 nt, Homo sapiens
uggugguucucag

SEQ ID NO: 1485354 - RNA, 21 nt, Homo sapiens
ugguguaguuucuucauuuca

SEQ ID NO: 1485355 - RNA, 20 nt, Homo sapiens
ugguguggccagcacucuga

SEQ ID NO: 1485356 - RNA, 16 nt, Homo sapiens
uggugugugccuguag

SEQ ID NO: 1485357 - RNA, 21 nt, Homo sapiens
ugguguucaaaaaaacacuag

SEQ ID NO: 1485358 - RNA, 14 nt, Homo sapiens
ugguuaacaucuca

SEQ ID NO: 1485359 - RNA, 13 nt, Homo sapiens
ugguuaacgccuu

SEQ ID NO: 1485360 - RNA, 17 nt, Homo sapiens
ugguuacaaucauugcu

SEQ ID NO: 1485361 - RNA, 19 nt, Homo sapiens
ugguuacaaucauugcuga

SEQ ID NO: 1485362 - RNA, 13 nt, Homo sapiens
ugguuaugaacuu

SEQ ID NO: 1485363 - RNA, 19 nt, Homo sapiens
ugguucacauccuaccccu

SEQ ID NO: 1485364 - RNA, 14 nt, Homo sapiens
ugguucacugcaac

SEQ ID NO: 1485365 - RNA, 20 nt, Homo sapiens
ugguuggccgugguccagcu

SEQ ID NO: 1485366 - RNA, 16 nt, Homo sapiens
ugguuucucucuacag

SEQ ID NO: 1485367 - RNA, 19 nt, Homo sapiens
uguaaaaaugaaaagccaa

SEQ ID NO: 1485368 - RNA, 21 nt, Homo sapiens
uguaaaaaugaaagugacuuu

SEQ ID NO: 1485369 - RNA, 22 nt, Homo sapiens
uguaaaaaugaaagugacuuua

SEQ ID NO: 1485370 - RNA, 22 nt, Homo sapiens
uguaaaaugugaagugaaugaa

SEQ ID NO: 1485371 - RNA, 12 nt, Homo sapiens
uguaaaccaaag

SEQ ID NO: 1485372 - RNA, 18 nt, Homo sapiens
uguaaauacacauagcau

SEQ ID NO: 1485373 - RNA, 23 nt, Homo sapiens
uguaaauauuuauuuauguguuc

SEQ ID NO: 1485374 - RNA, 16 nt, Homo sapiens
uguaaaugcauuggaa

SEQ ID NO: 1485375 - RNA, 15 nt, Homo sapiens
uguaaauuucucaaa

SEQ ID NO: 1485376 - RNA, 21 nt, Homo sapiens
uguaacacagucauucuagga

SEQ ID NO: 1485377 - RNA, 15 nt, Homo sapiens
uguaacauaaugcac

SEQ ID NO: 1485378 - RNA, 23 nt, Homo sapiens
uguaacugugccaguucuuucca

SEQ ID NO: 1485379 - RNA, 14 nt, Homo sapiens
uguaagccaaguca

SEQ ID NO: 1485380 - RNA, 17 nt, Homo sapiens
uguaaggaaggugcuca

SEQ ID NO: 1485381 - RNA, 18 nt, Homo sapiens
uguaauaauaaaucgucc

SEQ ID NO: 1485382 - RNA, 23 nt, Homo sapiens
uguaauaauugcucauaagcaau

SEQ ID NO: 1485383 - RNA, 14 nt, Homo sapiens
uguaauacuggaau

SEQ ID NO: 1485384 - RNA, 14 nt, Homo sapiens
uguaauaugcacaa

SEQ ID NO: 1485385 - RNA, 19 nt, Homo sapiens
uguaaucccagcuacuugg

SEQ ID NO: 1485386 - RNA, 16 nt, Homo sapiens
uguaaucucagcacuu

SEQ ID NO: 1485387 - RNA, 21 nt, Homo sapiens
uguaaucucucugcagcugcc

SEQ ID NO: 1485388 - RNA, 13 nt, Homo sapiens
uguaaugcuucca

SEQ ID NO: 1485389 - RNA, 14 nt, Homo sapiens
uguaauuccagcua

SEQ ID NO: 1485390 - RNA, 18 nt, Homo sapiens
uguacaaaauaacucucc

SEQ ID NO: 1485391 - RNA, 21 nt, Homo sapiens
uguacagaaaguaucacaaau

SEQ ID NO: 1485392 - RNA, 18 nt, Homo sapiens
uguacagugucugugcca

SEQ ID NO: 1485393 - RNA, 23 nt, Homo sapiens
uguacaucuauuuuggauuguau

SEQ ID NO: 1485394 - RNA, 17 nt, Homo sapiens
uguacauggaauaacau

SEQ ID NO: 1485395 - RNA, 16 nt, Homo sapiens
uguaccauuugcaugg

SEQ ID NO: 1485396 - RNA, 17 nt, Homo sapiens
uguacccccagguggaa

SEQ ID NO: 1485397 - RNA, 15 nt, Homo sapiens
uguaccugaugcuau

SEQ ID NO: 1485398 - RNA, 14 nt, Homo sapiens
uguacggacacugu

SEQ ID NO: 1485399 - RNA, 16 nt, Homo sapiens
uguacuaccuguguau

SEQ ID NO: 1485400 - RNA, 23 nt, Homo sapiens
uguacuguucugugucuuucaca

SEQ ID NO: 1485401 - RNA, 15 nt, Homo sapiens
uguacuuccaccucc

SEQ ID NO: 1485402 - RNA, 21 nt, Homo sapiens
uguacuuccaccuccaccaca

SEQ ID NO: 1485403 - RNA, 17 nt, Homo sapiens
cggagcugcugcugcuc

SEQ ID NO: 1485404 - RNA, 14 nt, Homo sapiens
cggaggcugcagug

SEQ ID NO: 1485405 - RNA, 18 nt, Homo sapiens
cggagugagcaauggagu

SEQ ID NO: 1485406 - RNA, 14 nt, Homo sapiens
cggauacaaacugg

SEQ ID NO: 1485407 - RNA, 16 nt, Homo sapiens
cggauccagcaauucc

SEQ ID NO: 1485408 - RNA, 20 nt, Homo sapiens
cggauccagcaauuccugag

SEQ ID NO: 1485409 - RNA, 16 nt, Homo sapiens
cggauguaugaucucu

SEQ ID NO: 1485410 - RNA, 19 nt, Homo sapiens
cggcaaugcccugugcaug

SEQ ID NO: 1485411 - RNA, 12 nt, Homo sapiens
cggcacauuccc

SEQ ID NO: 1485412 - RNA, 19 nt, Homo sapiens
cggcaggugcucuguggau

SEQ ID NO: 1485413 - RNA, 16 nt, Homo sapiens
cggccccaucucucau

SEQ ID NO: 1485414 - RNA, 14 nt, Homo sapiens
cggccucccaaagu

SEQ ID NO: 1485415 - RNA, 21 nt, Homo sapiens
cggccuccucuccuacuuugg

SEQ ID NO: 1485416 - RNA, 18 nt, Homo sapiens
cggcugcggggggcacca

SEQ ID NO: 1485417 - RNA, 13 nt, Homo sapiens
cggcuguggagca

SEQ ID NO: 1485418 - RNA, 19 nt, Homo sapiens
cggcuugugggcuggugcc

SEQ ID NO: 1485419 - RNA, 15 nt, Homo sapiens
cgggagcagugucuu

SEQ ID NO: 1485420 - RNA, 15 nt, Homo sapiens
cgggaggcugagaca

SEQ ID NO: 1485421 - RNA, 21 nt, Homo sapiens
cgggcgcggccagccccggcc

SEQ ID NO: 1485422 - RNA, 18 nt, Homo sapiens
cgggcuccagccaucuca

SEQ ID NO: 1485423 - RNA, 21 nt, Homo sapiens
cggggaagugcucuaacuuuu

SEQ ID NO: 1485424 - RNA, 14 nt, Homo sapiens
cggggacccuguga

SEQ ID NO: 1485425 - RNA, 12 nt, Homo sapiens
cggggugcuccu

SEQ ID NO: 1485426 - RNA, 13 nt, Homo sapiens
cggggugcuccug

SEQ ID NO: 1485427 - RNA, 21 nt, Homo sapiens
cggguccccaaaccuguuccc

SEQ ID NO: 1485428 - RNA, 11 nt, Homo sapiens
cgggucccugc

SEQ ID NO: 1485429 - RNA, 19 nt, Homo sapiens
cggguguguacaccaaggu

SEQ ID NO: 1485430 - RNA, 14 nt, Homo sapiens
cgguagugccugaa

SEQ ID NO: 1485431 - RNA, 18 nt, Homo sapiens
cggugacucaugccugua

SEQ ID NO: 1485432 - RNA, 17 nt, Homo sapiens
cgguggcugccccggcc

SEQ ID NO: 1485433 - RNA, 15 nt, Homo sapiens
cguaacaacuguggu

SEQ ID NO: 1485434 - RNA, 16 nt, Homo sapiens
cguaagggaucuuccu

SEQ ID NO: 1485435 - RNA, 14 nt, Homo sapiens
cguaauuuugccaa

SEQ ID NO: 1485436 - RNA, 12 nt, Homo sapiens
cguacauucaau

SEQ ID NO: 1485437 - RNA, 18 nt, Homo sapiens
cguaccucuucccaugac

SEQ ID NO: 1485438 - RNA, 19 nt, Homo sapiens
cguacugauucuaaugggg

SEQ ID NO: 1485439 - RNA, 20 nt, Homo sapiens
cguaugguggcucaugucua

SEQ ID NO: 1485440 - RNA, 20 nt, Homo sapiens
cgucaguccaagucuucuca

SEQ ID NO: 1485441 - RNA, 19 nt, Homo sapiens
cguccccuccuucccucac

SEQ ID NO: 1485442 - RNA, 12 nt, Homo sapiens
cgucccuaagca

SEQ ID NO: 1485443 - RNA, 12 nt, Homo sapiens
cgucccuaccuc

SEQ ID NO: 1485444 - RNA, 17 nt, Homo sapiens
cgucuccgaagauuugg

SEQ ID NO: 1485445 - RNA, 16 nt, Homo sapiens
cgucuguuuuugcaac

SEQ ID NO: 1485446 - RNA, 17 nt, Homo sapiens
cgugagcagcuuuggaa

SEQ ID NO: 1485447 - RNA, 20 nt, Homo sapiens
cgugauaaugcagacuuccu

SEQ ID NO: 1485448 - RNA, 12 nt, Homo sapiens
cgugcacucugc

SEQ ID NO: 1485449 - RNA, 22 nt, Homo sapiens
cgugcauucacauugaccgcaa

SEQ ID NO: 1485450 - RNA, 19 nt, Homo sapiens
cgugcuacugcacuccagc

SEQ ID NO: 1485451 - RNA, 21 nt, Homo sapiens
cgugcuuuuaaggaaaggcaa

SEQ ID NO: 1485452 - RNA, 12 nt, Homo sapiens
cguggacuuggc

SEQ ID NO: 1485453 - RNA, 16 nt, Homo sapiens
cguggauugcacgugg

SEQ ID NO: 1485454 - RNA, 20 nt, Homo sapiens
cguggggaacugcguggugc

SEQ ID NO: 1485455 - RNA, 17 nt, Homo sapiens
cgugguauaaucuccau

SEQ ID NO: 1485456 - RNA, 19 nt, Homo sapiens
uguagaauauauuuccuua

SEQ ID NO: 1485457 - RNA, 17 nt, Homo sapiens
uguagauggcggugaug

SEQ ID NO: 1485458 - RNA, 16 nt, Homo sapiens
uguagcccauccuucc

SEQ ID NO: 1485459 - RNA, 17 nt, Homo sapiens
uguagcuccucaacuca

SEQ ID NO: 1485460 - RNA, 21 nt, Homo sapiens
uguaggaauggaagcuucagg

SEQ ID NO: 1485461 - RNA, 19 nt, Homo sapiens
uguagguaauauuguucua

SEQ ID NO: 1485462 - RNA, 16 nt, Homo sapiens
uguaguaaacuauuua

SEQ ID NO: 1485463 - RNA, 14 nt, Homo sapiens
uguaguaauugaca

SEQ ID NO: 1485464 - RNA, 15 nt, Homo sapiens
uguagucaggugcuc

SEQ ID NO: 1485465 - RNA, 17 nt, Homo sapiens
uguagucaggugcucaa

SEQ ID NO: 1485466 - RNA, 20 nt, Homo sapiens
uguagucccagcuacuugag

SEQ ID NO: 1485467 - RNA, 18 nt, Homo sapiens
uguaguucugccaggcaa

SEQ ID NO: 1485468 - RNA, 16 nt, Homo sapiens
uguauaaaauagacaa

SEQ ID NO: 1485469 - RNA, 14 nt, Homo sapiens
uguauaagcacuga

SEQ ID NO: 1485470 - RNA, 14 nt, Homo sapiens
uguauacacauaua

SEQ ID NO: 1485471 - RNA, 15 nt, Homo sapiens
uguauacauacaugu

SEQ ID NO: 1485472 - RNA, 17 nt, Homo sapiens
uguauauaaaugaacaa

SEQ ID NO: 1485473 - RNA, 13 nt, Homo sapiens
uguauauacaguu

SEQ ID NO: 1485474 - RNA, 16 nt, Homo sapiens
uguaucaguguccuuu

SEQ ID NO: 1485475 - RNA, 18 nt, Homo sapiens
uguaugaaaaauugggga

SEQ ID NO: 1485476 - RNA, 16 nt, Homo sapiens
uguauggaaaaaccau

SEQ ID NO: 1485477 - RNA, 20 nt, Homo sapiens
uguauguauuuucaguuaca

SEQ ID NO: 1485478 - RNA, 19 nt, Homo sapiens
uguauguuaugaacaugca

SEQ ID NO: 1485479 - RNA, 23 nt, Homo sapiens
uguauuaauguguuaagugcagg

SEQ ID NO: 1485480 - RNA, 14 nt, Homo sapiens
uguauucgugcauu

SEQ ID NO: 1485481 - RNA, 15 nt, Homo sapiens
uguauucgugcauuu

SEQ ID NO: 1485482 - RNA, 19 nt, Homo sapiens
uguauucuagcuaauguaa

SEQ ID NO: 1485483 - RNA, 16 nt, Homo sapiens
uguauucuucaaccuc

SEQ ID NO: 1485484 - RNA, 20 nt, Homo sapiens
uguauugugcugauugugga

SEQ ID NO: 1485485 - RNA, 18 nt, Homo sapiens
uguauuuauggagugccu

SEQ ID NO: 1485486 - RNA, 20 nt, Homo sapiens
ugucaagcugcucugagcca

SEQ ID NO: 1485487 - RNA, 16 nt, Homo sapiens
ugucaaugacaguuuc

SEQ ID NO: 1485488 - RNA, 12 nt, Homo sapiens
ugucacaaagau

SEQ ID NO: 1485489 - RNA, 20 nt, Homo sapiens
ugucacagaagcagcuaaac

SEQ ID NO: 1485490 - RNA, 12 nt, Homo sapiens
ugucacagccug

SEQ ID NO: 1485491 - RNA, 23 nt, Homo sapiens
ugucaccaaauuuguaccucuaa

SEQ ID NO: 1485492 - RNA, 22 nt, Homo sapiens
ugucacccuuguccuugagugc

SEQ ID NO: 1485493 - RNA, 20 nt, Homo sapiens
ugucaccggucagugccuuu

SEQ ID NO: 1485494 - RNA, 15 nt, Homo sapiens
ugucacuagucucac

SEQ ID NO: 1485495 - RNA, 17 nt, Homo sapiens
ugucacuagucucacca

SEQ ID NO: 1485496 - RNA, 16 nt, Homo sapiens
ugucagcuacuaauga

SEQ ID NO: 1485497 - RNA, 20 nt, Homo sapiens
ugucagcuacuaaugauguu

SEQ ID NO: 1485498 - RNA, 16 nt, Homo sapiens
ugucaggauucuucaa

SEQ ID NO: 1485499 - RNA, 13 nt, Homo sapiens
ugucaguucuugg

SEQ ID NO: 1485500 - RNA, 14 nt, Homo sapiens
ugucauccucaugc

SEQ ID NO: 1485501 - RNA, 18 nt, Homo sapiens
ugucauccucaugcugcu

SEQ ID NO: 1485502 - RNA, 21 nt, Homo sapiens
ugucauccucaugcugcucaa

SEQ ID NO: 1485503 - RNA, 14 nt, Homo sapiens
ugucauuccagagu

SEQ ID NO: 1485504 - RNA, 13 nt, Homo sapiens
ugucauucuagaa

SEQ ID NO: 1485505 - RNA, 21 nt, Homo sapiens
uguccagauuauuggcugcuu

SEQ ID NO: 1485506 - RNA, 19 nt, Homo sapiens
ugucccacgugucuuccac

SEQ ID NO: 1485507 - RNA, 12 nt, Homo sapiens
ugucccaugcag

SEQ ID NO: 1485508 - RNA, 21 nt, Homo sapiens
uguccccagcccuguccuggu

SEQ ID NO: 1485509 - RNA, 18 nt, Homo sapiens
uguccccguguugcauga

SEQ ID NO: 1485510 - RNA, 15 nt, Homo sapiens
uguccccuccacugu

SEQ ID NO: 1485511 - RNA, 14 nt, Homo sapiens
ugucccucugcuac

SEQ ID NO: 1485512 - RNA, 14 nt, Homo sapiens
uguccuaagcacuu

SEQ ID NO: 1485513 - RNA, 15 nt, Homo sapiens
uguccuaagcacuuu

SEQ ID NO: 1485514 - RNA, 18 nt, Homo sapiens
uguccucagccuugccag

SEQ ID NO: 1485515 - RNA, 16 nt, Homo sapiens
uguccucuugcucaaa

SEQ ID NO: 1485516 - RNA, 22 nt, Homo sapiens
uguccugagcaccacacccagu

SEQ ID NO: 1485517 - RNA, 17 nt, Homo sapiens
uguccugaucugugaua

SEQ ID NO: 1485518 - RNA, 18 nt, Homo sapiens
uguccugcuggcuuccag

SEQ ID NO: 1485519 - RNA, 13 nt, Homo sapiens
uguccugggguau

SEQ ID NO: 1485520 - RNA, 14 nt, Homo sapiens
uguccuguccugcu

SEQ ID NO: 1485521 - RNA, 19 nt, Homo sapiens
uguccuuaauugaugcaaa

SEQ ID NO: 1485522 - RNA, 21 nt, Homo sapiens
uguccuuuuggcacugagaua

SEQ ID NO: 1485523 - RNA, 15 nt, Homo sapiens
ugucucagaagugaa

SEQ ID NO: 1485524 - RNA, 14 nt, Homo sapiens
ugucucagccuccc

SEQ ID NO: 1485525 - RNA, 15 nt, Homo sapiens
ugucuccuacuccug

SEQ ID NO: 1485526 - RNA, 21 nt, Homo sapiens
ugucucggagggauuccccua

SEQ ID NO: 1485527 - RNA, 15 nt, Homo sapiens
ugucucuaaaagccc

SEQ ID NO: 1485528 - RNA, 15 nt, Homo sapiens
ugucugucaccagcu

SEQ ID NO: 1485529 - RNA, 16 nt, Homo sapiens
ugucuucaaacuguga

SEQ ID NO: 1485530 - RNA, 18 nt, Homo sapiens
ugucuucauagcagauuu

SEQ ID NO: 1485531 - RNA, 23 nt, Homo sapiens
ugucuuguugcggauggauggaa

SEQ ID NO: 1485532 - RNA, 18 nt, Homo sapiens
ugucuuuucaaaauauua

SEQ ID NO: 1485533 - RNA, 22 nt, Homo sapiens
ugucuuuucuuggcaaaagccu

SEQ ID NO: 1485534 - RNA, 21 nt, Homo sapiens
ugugaaaggaagcuccacugu

SEQ ID NO: 1485535 - RNA, 21 nt, Homo sapiens
ugugaacacauaaggacgugu

SEQ ID NO: 1485536 - RNA, 21 nt, Homo sapiens
ugugaacagaaguuuaauuca

SEQ ID NO: 1485537 - RNA, 14 nt, Homo sapiens
ugugaaguacauau

SEQ ID NO: 1485538 - RNA, 22 nt, Homo sapiens
ugugaaucucuucucccuuuga

SEQ ID NO: 1485539 - RNA, 22 nt, Homo sapiens
ugugacaauaauauuguuguau

SEQ ID NO: 1485540 - RNA, 12 nt, Homo sapiens
ugugacauacau

SEQ ID NO: 1485541 - RNA, 13 nt, Homo sapiens
ugugacauacaua

SEQ ID NO: 1485542 - RNA, 13 nt, Homo sapiens
ugugaccuugacu

SEQ ID NO: 1485543 - RNA, 22 nt, Homo sapiens
ugugacucuaagcucagugcuc

SEQ ID NO: 1485544 - RNA, 20 nt, Homo sapiens
ugugacuucuccaggucuca

SEQ ID NO: 1485545 - RNA, 23 nt, Homo sapiens
ugugagacuguaaguuacaugaa

SEQ ID NO: 1485546 - RNA, 19 nt, Homo sapiens
ugugaguaagagcuggugu

SEQ ID NO: 1485547 - RNA, 18 nt, Homo sapiens
ugugauacgaugcuucaa

SEQ ID NO: 1485548 - RNA, 18 nt, Homo sapiens
ugugaugaugcugugaca

SEQ ID NO: 1485549 - RNA, 20 nt, Homo sapiens
ugugaugucuuuucuuggca

SEQ ID NO: 1485550 - RNA, 18 nt, Homo sapiens
ugugauugcacagaauuu

SEQ ID NO: 1485551 - RNA, 19 nt, Homo sapiens
ugugauuuuggacuagcca

SEQ ID NO: 1485552 - RNA, 17 nt, Homo sapiens
ugugcacugucacuuug

SEQ ID NO: 1485553 - RNA, 13 nt, Homo sapiens
ugugcaugccaug

SEQ ID NO: 1485554 - RNA, 19 nt, Homo sapiens
ugugccaguucuuuccaua

SEQ ID NO: 1485555 - RNA, 16 nt, Homo sapiens
ugugccccaugccugu

SEQ ID NO: 1485556 - RNA, 16 nt, Homo sapiens
ugugccgaaugugcag

SEQ ID NO: 1485557 - RNA, 22 nt, Homo sapiens
ugugccuggaagaguuggucuc

SEQ ID NO: 1485558 - RNA, 20 nt, Homo sapiens
uguggucaauccgaaguaug

SEQ ID NO: 1485559 - RNA, 14 nt, Homo sapiens
uguggucaucaugg

SEQ ID NO: 1485560 - RNA, 13 nt, Homo sapiens
uguggucugggga

SEQ ID NO: 1485561 - RNA, 17 nt, Homo sapiens
ugugguuaacaucucag

SEQ ID NO: 1485562 - RNA, 14 nt, Homo sapiens
ugugguuacuuccu

SEQ ID NO: 1485563 - RNA, 21 nt, Homo sapiens
uguguacaguugguucauccc

SEQ ID NO: 1485564 - RNA, 23 nt, Homo sapiens
ugugugaaaggaagcuccacugu

SEQ ID NO: 1485565 - RNA, 18 nt, Homo sapiens
ugugugacauuccagggg

SEQ ID NO: 1485566 - RNA, 13 nt, Homo sapiens
ugugugccacuca

SEQ ID NO: 1485567 - RNA, 14 nt, Homo sapiens
ugugugccacucag

SEQ ID NO: 1485568 - RNA, 19 nt, Homo sapiens
ugugugccuuuguuuccca

SEQ ID NO: 1485569 - RNA, 18 nt, Homo sapiens
uguguguauguuugcaca

SEQ ID NO: 1485570 - RNA, 15 nt, Homo sapiens
uguguuaagugcagg

SEQ ID NO: 1485571 - RNA, 14 nt, Homo sapiens
uguguucugucacc

SEQ ID NO: 1485572 - RNA, 15 nt, Homo sapiens
uguguuggcacaugc

SEQ ID NO: 1485573 - RNA, 15 nt, Homo sapiens
uguuaaggaaacucu

SEQ ID NO: 1485574 - RNA, 16 nt, Homo sapiens
uguuaauuacaccaua

SEQ ID NO: 1485575 - RNA, 16 nt, Homo sapiens
uguuacagcuucgcug

SEQ ID NO: 1485576 - RNA, 15 nt, Homo sapiens
uguuaccuccuauaa

SEQ ID NO: 1485577 - RNA, 21 nt, Homo sapiens
uguuaguauuuuaauccugua

SEQ ID NO: 1485578 - RNA, 23 nt, Homo sapiens
uguuauauagggaucaaccagcu

SEQ ID NO: 1485579 - RNA, 20 nt, Homo sapiens
uguuaucuguguagcaagcu

SEQ ID NO: 1485580 - RNA, 18 nt, Homo sapiens
uguuaugauauuguuuaa

SEQ ID NO: 1485581 - RNA, 22 nt, Homo sapiens
uguuauuuucuguugaaguuua

SEQ ID NO: 1485582 - RNA, 12 nt, Homo sapiens
uguucaaagcac

SEQ ID NO: 1485583 - RNA, 18 nt, Homo sapiens
uguucaaguguccccaga

SEQ ID NO: 1485584 - RNA, 18 nt, Homo sapiens
uguucagaauggauuuau

SEQ ID NO: 1485585 - RNA, 16 nt, Homo sapiens
uguucccagagcacuu

SEQ ID NO: 1485586 - RNA, 17 nt, Homo sapiens
uguucccagguaccuca

SEQ ID NO: 1485587 - RNA, 14 nt, Homo sapiens
uguuccccacugac

SEQ ID NO: 1485588 - RNA, 14 nt, Homo sapiens
uguucccuuacugu

SEQ ID NO: 1485589 - RNA, 19 nt, Homo sapiens
uguuccucuuggugucaua

SEQ ID NO: 1485590 - RNA, 19 nt, Homo sapiens
uguucuccucguccaucag

SEQ ID NO: 1485591 - RNA, 20 nt, Homo sapiens
uguucugcugggaguucuag

SEQ ID NO: 1485592 - RNA, 19 nt, Homo sapiens
uguucugggggacagagaa

SEQ ID NO: 1485593 - RNA, 19 nt, Homo sapiens
uguucuguuugcuguggaa

SEQ ID NO: 1485594 - RNA, 19 nt, Homo sapiens
uguucuugcagucaucaga

SEQ ID NO: 1485595 - RNA, 13 nt, Homo sapiens
uguucuugcuacc

SEQ ID NO: 1485596 - RNA, 12 nt, Homo sapiens
uguucuuuggaa

SEQ ID NO: 1485597 - RNA, 21 nt, Homo sapiens
uguugaaucuauuucacuuau

SEQ ID NO: 1485598 - RNA, 19 nt, Homo sapiens
uguugacaaaauuuucuca

SEQ ID NO: 1485599 - RNA, 14 nt, Homo sapiens
uguugacauacauu

SEQ ID NO: 1485600 - RNA, 13 nt, Homo sapiens
uguugacuggggc

SEQ ID NO: 1485601 - RNA, 21 nt, Homo sapiens
uguugagacugauucagagga

SEQ ID NO: 1485602 - RNA, 22 nt, Homo sapiens
uguugaguucuguagagccuuc

SEQ ID NO: 1485603 - RNA, 14 nt, Homo sapiens
uguugauaaaugac

SEQ ID NO: 1485604 - RNA, 20 nt, Homo sapiens
uguugcaaacucagugcaaa

SEQ ID NO: 1485605 - RNA, 21 nt, Homo sapiens
uguugcccaggcuggucucaa

SEQ ID NO: 1485606 - RNA, 23 nt, Homo sapiens
uguugcuauagagccuaccugua

SEQ ID NO: 1485607 - RNA, 19 nt, Homo sapiens
uguuggagguuaaggcaua

SEQ ID NO: 1485608 - RNA, 17 nt, Homo sapiens
uguuggcaaaucagaug

SEQ ID NO: 1485609 - RNA, 15 nt, Homo sapiens
uguugggaaaguauu

SEQ ID NO: 1485610 - RNA, 17 nt, Homo sapiens
uguugguauuauauaau

SEQ ID NO: 1485611 - RNA, 17 nt, Homo sapiens
uguuguaagaaagacaa

SEQ ID NO: 1485612 - RNA, 19 nt, Homo sapiens
uguuguagugaaauuauac

SEQ ID NO: 1485613 - RNA, 18 nt, Homo sapiens
uguuguuugguucaggga

SEQ ID NO: 1485614 - RNA, 16 nt, Homo sapiens
uguuuaagaaaaguau

SEQ ID NO: 1485615 - RNA, 18 nt, Homo sapiens
uguuuacagacgugugca

SEQ ID NO: 1485616 - RNA, 14 nt, Homo sapiens
uguuuacagugaug

SEQ ID NO: 1485617 - RNA, 18 nt, Homo sapiens
uguuuacguuugauacaa

SEQ ID NO: 1485618 - RNA, 12 nt, Homo sapiens
uguuuaguugca

SEQ ID NO: 1485619 - RNA, 14 nt, Homo sapiens
uguuuaugagccag

SEQ ID NO: 1485620 - RNA, 14 nt, Homo sapiens
uguuuauucuucca

SEQ ID NO: 1485621 - RNA, 14 nt, Homo sapiens
uguuuauugcaaua

SEQ ID NO: 1485622 - RNA, 16 nt, Homo sapiens
uguuucauuuaccucu

SEQ ID NO: 1485623 - RNA, 19 nt, Homo sapiens
uguuuccaauuauccuuuu

SEQ ID NO: 1485624 - RNA, 13 nt, Homo sapiens
uguuucuuccaaa

SEQ ID NO: 1485625 - RNA, 14 nt, Homo sapiens
uguuugcauaaagu

SEQ ID NO: 1485626 - RNA, 14 nt, Homo sapiens
uguuugcuggguau

SEQ ID NO: 1485627 - RNA, 20 nt, Homo sapiens
uguuugcuggguauuagcca

SEQ ID NO: 1485628 - RNA, 16 nt, Homo sapiens
uguuuguuucauauau

SEQ ID NO: 1485629 - RNA, 19 nt, Homo sapiens
uguuuuaaguacuacacau

SEQ ID NO: 1485630 - RNA, 14 nt, Homo sapiens
uguuuuccuauaau

SEQ ID NO: 1485631 - RNA, 20 nt, Homo sapiens
uguuuuuagcugguggcaau

SEQ ID NO: 1485632 - RNA, 20 nt, Homo sapiens
uguuuuuccuuuaauccagu

SEQ ID NO: 1485633 - RNA, 23 nt, Homo sapiens
uguuuuuugccacagcuuuugca

SEQ ID NO: 1485634 - RNA, 18 nt, Homo sapiens
uuaaaaaaaaaauucaau

SEQ ID NO: 1485635 - RNA, 13 nt, Homo sapiens
uuaaaaaacagag

SEQ ID NO: 1485636 - RNA, 12 nt, Homo sapiens
uuaaaaaagccu

SEQ ID NO: 1485637 - RNA, 13 nt, Homo sapiens
uuaaaaaaucuca

SEQ ID NO: 1485638 - RNA, 17 nt, Homo sapiens
uuaaaaagucuucacuc

SEQ ID NO: 1485639 - RNA, 22 nt, Homo sapiens
uuaaaaauacggacguacuuug

SEQ ID NO: 1485640 - RNA, 21 nt, Homo sapiens
uuaaaaaugggaguacugaug

SEQ ID NO: 1485641 - RNA, 23 nt, Homo sapiens
uuaaaacacauuauguaucuuag

SEQ ID NO: 1485642 - RNA, 23 nt, Homo sapiens
uuucaucguaaacauacuucuaa

SEQ ID NO: 1485643 - RNA, 17 nt, Homo sapiens
uuucaugcccuugccua

SEQ ID NO: 1485644 - RNA, 16 nt, Homo sapiens
uuucaugggacuaaau

SEQ ID NO: 1485645 - RNA, 22 nt, Homo sapiens
uuucauugccuguguauggaaa

SEQ ID NO: 1485646 - RNA, 14 nt, Homo sapiens
uuuccaaaacuuua

SEQ ID NO: 1485647 - RNA, 20 nt, Homo sapiens
uuuccagaacuaccaugaga

SEQ ID NO: 1485648 - RNA, 17 nt, Homo sapiens
uuuccagcagaagacaa

SEQ ID NO: 1485649 - RNA, 10 nt, Homo sapiens
uuuccaggga

SEQ ID NO: 1485650 - RNA, 12 nt, Homo sapiens
uuuccaggguug

SEQ ID NO: 1485651 - RNA, 14 nt, Homo sapiens
uuuccauagucaca

SEQ ID NO: 1485652 - RNA, 18 nt, Homo sapiens
uuuccauauggauuuucu

SEQ ID NO: 1485653 - RNA, 22 nt, Homo sapiens
uuucccacgaggaaucuguggg

SEQ ID NO: 1485654 - RNA, 19 nt, Homo sapiens
uuucccaucagacugucaa

SEQ ID NO: 1485655 - RNA, 15 nt, Homo sapiens
uuuccccagucccag

SEQ ID NO: 1485656 - RNA, 23 nt, Homo sapiens
uuucccugcagaccucaagccau

SEQ ID NO: 1485657 - RNA, 13 nt, Homo sapiens
uuuccuccaccuc

SEQ ID NO: 1485658 - RNA, 15 nt, Homo sapiens
uuuccuccaggcaaa

SEQ ID NO: 1485659 - RNA, 14 nt, Homo sapiens
uuuccuucauucau

SEQ ID NO: 1485660 - RNA, 12 nt, Homo sapiens
uuuccuuccaga

SEQ ID NO: 1485661 - RNA, 16 nt, Homo sapiens
uuuccuuucugccacc

SEQ ID NO: 1485662 - RNA, 19 nt, Homo sapiens
uuucuaaagcugaauguca

SEQ ID NO: 1485663 - RNA, 13 nt, Homo sapiens
uuucuaaauuccu

SEQ ID NO: 1485664 - RNA, 21 nt, Homo sapiens
uuucuaaccuugaaugcugcc

SEQ ID NO: 1485665 - RNA, 17 nt, Homo sapiens
uuucuaagauacauaua

SEQ ID NO: 1485666 - RNA, 20 nt, Homo sapiens
uuucuacaaugugaacuuua

SEQ ID NO: 1485667 - RNA, 17 nt, Homo sapiens
uuucuacagugaauuua

SEQ ID NO: 1485668 - RNA, 16 nt, Homo sapiens
uuucuaucacauauuu

SEQ ID NO: 1485669 - RNA, 21 nt, Homo sapiens
uuucuauuauggaaaacugug

SEQ ID NO: 1485670 - RNA, 15 nt, Homo sapiens
uuuguugcagccaaa

SEQ ID NO: 1485671 - RNA, 12 nt, Homo sapiens
uuuguugcccag

SEQ ID NO: 1485672 - RNA, 16 nt, Homo sapiens
uuuguuucauauauac

SEQ ID NO: 1485673 - RNA, 13 nt, Homo sapiens
uuuguuuuaaucc

SEQ ID NO: 1485674 - RNA, 15 nt, Homo sapiens
uuuuaagaacuucau

SEQ ID NO: 1485675 - RNA, 14 nt, Homo sapiens
uuuuaauaugacaa

SEQ ID NO: 1485676 - RNA, 22 nt, Homo sapiens
uuuuaaucaaaugcuuuggacu

SEQ ID NO: 1485677 - RNA, 23 nt, Homo sapiens
uuuuacaauaaaacuuugcugcc

SEQ ID NO: 1485678 - RNA, 14 nt, Homo sapiens
uuuuacacauuaga

SEQ ID NO: 1485679 - RNA, 17 nt, Homo sapiens
uuuuacagugcuauuua

SEQ ID NO: 1485680 - RNA, 20 nt, Homo sapiens
uuuuacccuauacauccaca

SEQ ID NO: 1485681 - RNA, 20 nt, Homo sapiens
uuuuacugugaaacuggcac

SEQ ID NO: 1485682 - RNA, 18 nt, Homo sapiens
uuuuagggagaacgggaa

SEQ ID NO: 1485683 - RNA, 15 nt, Homo sapiens
uuuuaguggaagcuu

SEQ ID NO: 1485684 - RNA, 20 nt, Homo sapiens
uuuuauaaaauuaagcaaug

SEQ ID NO: 1485685 - RNA, 14 nt, Homo sapiens
uuuuauaauacaaa

SEQ ID NO: 1485686 - RNA, 16 nt, Homo sapiens
uuuuauaucaugcaaa

SEQ ID NO: 1485687 - RNA, 23 nt, Homo sapiens
uuuuaucuucagaaauucucugc

SEQ ID NO: 1485688 - RNA, 21 nt, Homo sapiens
uuuuaucuuuaaucuccucuu

SEQ ID NO: 1485689 - RNA, 16 nt, Homo sapiens
uuuucaaagauuuaaa

SEQ ID NO: 1485690 - RNA, 13 nt, Homo sapiens
uuuucaccccacc

SEQ ID NO: 1485691 - RNA, 10 nt, Homo sapiens
uuuucacugc

SEQ ID NO: 1485692 - RNA, 21 nt, Homo sapiens
uuuucacugcuggcugccuua

SEQ ID NO: 1485693 - RNA, 21 nt, Homo sapiens
uuuucagcacccccacccacc

SEQ ID NO: 1485694 - RNA, 23 nt, Homo sapiens
uuuuccauuuuuauuucaaaaua

SEQ ID NO: 1485695 - RNA, 20 nt, Homo sapiens
uuuucggaggccccacugau

SEQ ID NO: 1485696 - RNA, 16 nt, Homo sapiens
uuuucuauauggggau

SEQ ID NO: 1485697 - RNA, 17 nt, Homo sapiens
uuuucucuaaugcuuga

SEQ ID NO: 1485698 - RNA, 15 nt, Homo sapiens
uuuucucucacccau

SEQ ID NO: 1485699 - RNA, 15 nt, Homo sapiens
aaacucacugcucaa

SEQ ID NO: 1485700 - RNA, 11 nt, Homo sapiens
aaacucaggga

SEQ ID NO: 1485701 - RNA, 12 nt, Homo sapiens
aaacucagggac

SEQ ID NO: 1485702 - RNA, 16 nt, Homo sapiens
aaacucauuuuugcca

SEQ ID NO: 1485703 - RNA, 18 nt, Homo sapiens
aaacuccugggcucaggc

SEQ ID NO: 1485704 - RNA, 19 nt, Homo sapiens
aaacuccuguuucuccuua

SEQ ID NO: 1485705 - RNA, 20 nt, Homo sapiens
aaacucucugguuuacuuca

SEQ ID NO: 1485706 - RNA, 23 nt, Homo sapiens
aaacugaacuucagagcaugaaa

SEQ ID NO: 1485707 - RNA, 18 nt, Homo sapiens
aaacugacuaaacuuaca

SEQ ID NO: 1485708 - RNA, 14 nt, Homo sapiens
aaacugaugacuua

SEQ ID NO: 1485709 - RNA, 20 nt, Homo sapiens
aaacugcaaagcucggugcu

SEQ ID NO: 1485710 - RNA, 16 nt, Homo sapiens
aaacugcgaggccagu

SEQ ID NO: 1485711 - RNA, 19 nt, Homo sapiens
aaacugcucuguaggucau

SEQ ID NO: 1485712 - RNA, 17 nt, Homo sapiens
aaacugcuuacuuaugc

SEQ ID NO: 1485713 - RNA, 22 nt, Homo sapiens
aaacuggcugcuuuguucaaug

SEQ ID NO: 1485714 - RNA, 18 nt, Homo sapiens
aaacugguuuguugcagc

SEQ ID NO: 1485715 - RNA, 15 nt, Homo sapiens
aaacuguuacugaaa

SEQ ID NO: 1485716 - RNA, 22 nt, Homo sapiens
aaacuuaacaaaagugauguaa

SEQ ID NO: 1485717 - RNA, 15 nt, Homo sapiens
aaacuuaacauucau

SEQ ID NO: 1485718 - RNA, 15 nt, Homo sapiens
aaacuuaauguucuu

SEQ ID NO: 1485719 - RNA, 19 nt, Homo sapiens
aaacuuagugacaaaauag

SEQ ID NO: 1485720 - RNA, 23 nt, Homo sapiens
aaacuucaccuacauuaucucac

SEQ ID NO: 1485721 - RNA, 13 nt, Homo sapiens
aaacuuccaguca

SEQ ID NO: 1485722 - RNA, 23 nt, Homo sapiens
aaacuugaaguagguagcaacgu

SEQ ID NO: 1485723 - RNA, 20 nt, Homo sapiens
aaacuugaaucaaagcaguu

SEQ ID NO: 1485724 - RNA, 11 nt, Homo sapiens
aaacuugccug

SEQ ID NO: 1485725 - RNA, 22 nt, Homo sapiens
aaacuugccuggggucugagca

SEQ ID NO: 1485726 - RNA, 23 nt, Homo sapiens
aaacuuggaauuuguaaccucag

SEQ ID NO: 1485727 - RNA, 19 nt, Homo sapiens
aaacuuguaaaugcuguca

SEQ ID NO: 1485728 - RNA, 13 nt, Homo sapiens
aaacuuguuuaca

SEQ ID NO: 1485729 - RNA, 16 nt, Homo sapiens
aaacuuuaaugaacua

SEQ ID NO: 1485730 - RNA, 17 nt, Homo sapiens
aaacuuuagaguagcau

SEQ ID NO: 1485731 - RNA, 23 nt, Homo sapiens
aaacuuuaggguaaaaauugcca

SEQ ID NO: 1485732 - RNA, 17 nt, Homo sapiens
aaacuuuggcuuauaaa

SEQ ID NO: 1485733 - RNA, 17 nt, Homo sapiens
aaacuuuguuugucaca

SEQ ID NO: 1485734 - RNA, 16 nt, Homo sapiens
aaagaaauuccccaag

SEQ ID NO: 1485735 - RNA, 17 nt, Homo sapiens
aaagaaggaagugaaga

SEQ ID NO: 1485736 - RNA, 21 nt, Homo sapiens
aaagaagguuggugaauuuca

SEQ ID NO: 1485737 - RNA, 14 nt, Homo sapiens
aaagaauacagaaa

SEQ ID NO: 1485738 - RNA, 15 nt, Homo sapiens
aaagaauuauuugcc

SEQ ID NO: 1485739 - RNA, 16 nt, Homo sapiens
aaagaauuuuaccauu

SEQ ID NO: 1485740 - RNA, 21 nt, Homo sapiens
aaagacaaauucggauguaug

SEQ ID NO: 1485741 - RNA, 14 nt, Homo sapiens
aaagacaagacauu

SEQ ID NO: 1485742 - RNA, 12 nt, Homo sapiens
aaagacaugggg

SEQ ID NO: 1485743 - RNA, 19 nt, Homo sapiens
aaagacauucuuccaaaaa

SEQ ID NO: 1485744 - RNA, 14 nt, Homo sapiens
aaagaccuaugagc

SEQ ID NO: 1485745 - RNA, 23 nt, Homo sapiens
aaagacugaaucuaccugcccua

SEQ ID NO: 1485746 - RNA, 23 nt, Homo sapiens
aaugaaauuugcaaaaucacuua

SEQ ID NO: 1485747 - RNA, 22 nt, Homo sapiens
aaugaacacucuuuugcuuuau

SEQ ID NO: 1485748 - RNA, 15 nt, Homo sapiens
aaugaacccaagagc

SEQ ID NO: 1485749 - RNA, 15 nt, Homo sapiens
aaugaagaugucuaa

SEQ ID NO: 1485750 - RNA, 16 nt, Homo sapiens
aaugaagcagcuuuaa

SEQ ID NO: 1485751 - RNA, 21 nt, Homo sapiens
aaugaagguuaggauuuaaca

SEQ ID NO: 1485752 - RNA, 18 nt, Homo sapiens
aaugaaucuucacaaaac

SEQ ID NO: 1485753 - RNA, 14 nt, Homo sapiens
aaugaaugccuaaa

SEQ ID NO: 1485754 - RNA, 20 nt, Homo sapiens
aaugacaucucaggggccag

SEQ ID NO: 1485755 - RNA, 18 nt, Homo sapiens
aaugacuauauaauuuau

SEQ ID NO: 1485756 - RNA, 17 nt, Homo sapiens
aaugacuucuaauuuau

SEQ ID NO: 1485757 - RNA, 16 nt, Homo sapiens
aaugagccaucacuag

SEQ ID NO: 1485758 - RNA, 17 nt, Homo sapiens
aaugagccaucacuaga

SEQ ID NO: 1485759 - RNA, 17 nt, Homo sapiens
aaugagccgagaucacg

SEQ ID NO: 1485760 - RNA, 19 nt, Homo sapiens
aaugaguuagaacuauuaa

SEQ ID NO: 1485761 - RNA, 14 nt, Homo sapiens
aaugauaguuauaa

SEQ ID NO: 1485762 - RNA, 21 nt, Homo sapiens
aaugauauugacacugucccu

SEQ ID NO: 1485763 - RNA, 20 nt, Homo sapiens
aaugaucaaguccuuuguga

SEQ ID NO: 1485764 - RNA, 20 nt, Homo sapiens
aaugaucagcaucugugaug

SEQ ID NO: 1485765 - RNA, 16 nt, Homo sapiens
aaugaugggacaauaa

SEQ ID NO: 1485766 - RNA, 23 nt, Homo sapiens
aaugauuaacaguuaugugguca

SEQ ID NO: 1485767 - RNA, 13 nt, Homo sapiens
aaugcaguccuga

SEQ ID NO: 1485768 - RNA, 15 nt, Homo sapiens
aaugccaaauugcag

SEQ ID NO: 1485769 - RNA, 23 nt, Homo sapiens
aaugccacaaaacugacaguaaa

SEQ ID NO: 1485770 - RNA, 21 nt, Homo sapiens
aaugcccucaggggacuugaa

SEQ ID NO: 1485771 - RNA, 22 nt, Homo sapiens
aaugcccucaggggacuugaau

SEQ ID NO: 1485772 - RNA, 21 nt, Homo sapiens
aaugccuaaauauaauuaucc

SEQ ID NO: 1485773 - RNA, 16 nt, Homo sapiens
aaugccugguaccaga

SEQ ID NO: 1485774 - RNA, 22 nt, Homo sapiens
aaugccugguaccagaggaugg

SEQ ID NO: 1485775 - RNA, 17 nt, Homo sapiens
aaugcugagguuaugaa

SEQ ID NO: 1485776 - RNA, 20 nt, Homo sapiens
aaugcugcaggacuugagaa

SEQ ID NO: 1485777 - RNA, 21 nt, Homo sapiens
aaugcugcgcuucgcuuggug

SEQ ID NO: 1485778 - RNA, 20 nt, Homo sapiens
aaugcuuacggccaucucuu

SEQ ID NO: 1485779 - RNA, 14 nt, Homo sapiens
aaugcuucauucaa

SEQ ID NO: 1485780 - RNA, 15 nt, Homo sapiens
aaugcuucugcacac

SEQ ID NO: 1485781 - RNA, 18 nt, Homo sapiens
aaugcuuuggacuuuuga

SEQ ID NO: 1485782 - RNA, 21 nt, Homo sapiens
aauggaagaguguuucuucca

SEQ ID NO: 1485783 - RNA, 12 nt, Homo sapiens
aauggacuggag

SEQ ID NO: 1485784 - RNA, 22 nt, Homo sapiens
aauggagaauuaaaaauaccaa

SEQ ID NO: 1485785 - RNA, 12 nt, Homo sapiens
aauggagcucag

SEQ ID NO: 1485786 - RNA, 15 nt, Homo sapiens
aauggcacuguugca

SEQ ID NO: 1485787 - RNA, 19 nt, Homo sapiens
aauggcagcuagugccuuu

SEQ ID NO: 1485788 - RNA, 15 nt, Homo sapiens
aauggcaguauuuca

SEQ ID NO: 1485789 - RNA, 21 nt, Homo sapiens
aauggcuacacucaucugacu

SEQ ID NO: 1485790 - RNA, 15 nt, Homo sapiens
aaugggaaaucagug

SEQ ID NO: 1485791 - RNA, 24 nt, Homo sapiens
aaugggaauauuuuauacugacag

SEQ ID NO: 1485792 - RNA, 14 nt, Homo sapiens
aaugggcucuucca

SEQ ID NO: 1485793 - RNA, 15 nt, Homo sapiens
aaugggcucuuccaa

SEQ ID NO: 1485794 - RNA, 15 nt, Homo sapiens
aauggguuacuugau

SEQ ID NO: 1485795 - RNA, 22 nt, Homo sapiens
aaugguauggaacucucuccac

SEQ ID NO: 1485796 - RNA, 15 nt, Homo sapiens
aauuuuaguauucau

SEQ ID NO: 1485797 - RNA, 15 nt, Homo sapiens
aauuuuaucaugcca

SEQ ID NO: 1485798 - RNA, 14 nt, Homo sapiens
aauuuucacaaaau

SEQ ID NO: 1485799 - RNA, 20 nt, Homo sapiens
aauuuucugaaacugcauaa

SEQ ID NO: 1485800 - RNA, 12 nt, Homo sapiens
aauuuugcugga

SEQ ID NO: 1485801 - RNA, 20 nt, Homo sapiens
aauuuugguuuaugacucuu

SEQ ID NO: 1485802 - RNA, 18 nt, Homo sapiens
aauuuuuaagcugcaaau

SEQ ID NO: 1485803 - RNA, 14 nt, Homo sapiens
aauuuuuacauuca

SEQ ID NO: 1485804 - RNA, 13 nt, Homo sapiens
aauuuuuaggcaa

SEQ ID NO: 1485805 - RNA, 23 nt, Homo sapiens
aauuuuuuaguauaaguacauua

SEQ ID NO: 1485806 - RNA, 16 nt, Homo sapiens
acaaaaaaaccucuau

SEQ ID NO: 1485807 - RNA, 18 nt, Homo sapiens
acaaaaaacaacaaauaa

SEQ ID NO: 1485808 - RNA, 13 nt, Homo sapiens
acaaaaaauacuu

SEQ ID NO: 1485809 - RNA, 15 nt, Homo sapiens
acaaaaaauacuuua

SEQ ID NO: 1485810 - RNA, 22 nt, Homo sapiens
acaaaaacagguauauacuuug

SEQ ID NO: 1485811 - RNA, 16 nt, Homo sapiens
acaaaaaugaacugaa

SEQ ID NO: 1485812 - RNA, 14 nt, Homo sapiens
acaaaaauguacaa

SEQ ID NO: 1485813 - RNA, 13 nt, Homo sapiens
acaaaaauugaga

SEQ ID NO: 1485814 - RNA, 14 nt, Homo sapiens
acaaaagauguauc

SEQ ID NO: 1485815 - RNA, 15 nt, Homo sapiens
acaaaagucugucuu

SEQ ID NO: 1485816 - RNA, 22 nt, Homo sapiens
acaaaauaacucuccaguaaca

SEQ ID NO: 1485817 - RNA, 16 nt, Homo sapiens
acaaaauggacauggu

SEQ ID NO: 1485818 - RNA, 12 nt, Homo sapiens
acaaaaugguca

SEQ ID NO: 1485819 - RNA, 21 nt, Homo sapiens
acaaaauuuuauuuugugcuc

SEQ ID NO: 1485820 - RNA, 18 nt, Homo sapiens
acaaacaagaggacugug

SEQ ID NO: 1485821 - RNA, 23 nt, Homo sapiens
acaaacaagaggacuguguugug

SEQ ID NO: 1485822 - RNA, 15 nt, Homo sapiens
acaaaccuagaauuu

SEQ ID NO: 1485823 - RNA, 15 nt, Homo sapiens
acaaagugacauucc

SEQ ID NO: 1485824 - RNA, 17 nt, Homo sapiens
acaaaguguauacaugu

SEQ ID NO: 1485825 - RNA, 17 nt, Homo sapiens
acaaauaaagugcaguu

SEQ ID NO: 1485826 - RNA, 22 nt, Homo sapiens
acaaauaauuuuuaaauauaag

SEQ ID NO: 1485827 - RNA, 21 nt, Homo sapiens
acaaaugaucgcuaucuagca

SEQ ID NO: 1485828 - RNA, 17 nt, Homo sapiens
acaaauuauguuacauc

SEQ ID NO: 1485829 - RNA, 21 nt, Homo sapiens
acaaauucggauguaugaucu

SEQ ID NO: 1485830 - RNA, 14 nt, Homo sapiens
acaacaaaaagcuu

SEQ ID NO: 1485831 - RNA, 23 nt, Homo sapiens
acaacaaaggcaaguuaagagaa

SEQ ID NO: 1485832 - RNA, 23 nt, Homo sapiens
acaacagaaguauuucuguggau

SEQ ID NO: 1485833 - RNA, 14 nt, Homo sapiens
acaacagaagucau

SEQ ID NO: 1485834 - RNA, 19 nt, Homo sapiens
acaaccaauuccaaguuuu

SEQ ID NO: 1485835 - RNA, 14 nt, Homo sapiens
acaaccaucccugc

SEQ ID NO: 1485836 - RNA, 21 nt, Homo sapiens
acaaccaugagaccacuguua

SEQ ID NO: 1485837 - RNA, 16 nt, Homo sapiens
acaacucaaugaaaau

SEQ ID NO: 1485838 - RNA, 18 nt, Homo sapiens
acaacucuagucagcaca

SEQ ID NO: 1485839 - RNA, 14 nt, Homo sapiens
acaacugauugcaa

SEQ ID NO: 1485840 - RNA, 12 nt, Homo sapiens
acaacugugguc

SEQ ID NO: 1485841 - RNA, 16 nt, Homo sapiens
acaacuuaguguaaua

SEQ ID NO: 1485842 - RNA, 17 nt, Homo sapiens
acaacuuaguguaauau

SEQ ID NO: 1485843 - RNA, 21 nt, Homo sapiens
acaacuuccagagaagccaug

SEQ ID NO: 1485844 - RNA, 11 nt, Homo sapiens
acaacuuccuc

SEQ ID NO: 1485845 - RNA, 12 nt, Homo sapiens
acaagaagccac

SEQ ID NO: 1485846 - RNA, 22 nt, Homo sapiens
acaagaagccacagaccuagga

SEQ ID NO: 1485847 - RNA, 16 nt, Homo sapiens
acaagaaugcauuccc

SEQ ID NO: 1485848 - RNA, 18 nt, Homo sapiens
acaagaaugcauucccug

SEQ ID NO: 1485849 - RNA, 18 nt, Homo sapiens
acaagacccccagcacuu

SEQ ID NO: 1485850 - RNA, 19 nt, Homo sapiens
acaagacccccagcacuug

SEQ ID NO: 1485851 - RNA, 17 nt, Homo sapiens
acaagaccccgucucaa

SEQ ID NO: 1485852 - RNA, 22 nt, Homo sapiens
acaagaguggagagaagcucuu

SEQ ID NO: 1485853 - RNA, 17 nt, Homo sapiens
acaagauaacugagaau

SEQ ID NO: 1485854 - RNA, 19 nt, Homo sapiens
acaagauauuguacauaaa

SEQ ID NO: 1485855 - RNA, 20 nt, Homo sapiens
acaagauuugcugcauuucc

SEQ ID NO: 1485856 - RNA, 19 nt, Homo sapiens
acaagccacaagucuucca

SEQ ID NO: 1485857 - RNA, 12 nt, Homo sapiens
acaaggccaucu

SEQ ID NO: 1485858 - RNA, 16 nt, Homo sapiens
acaaggcuccaagacc

SEQ ID NO: 1485859 - RNA, 23 nt, Homo sapiens
acaagggagaagagugucagaau

SEQ ID NO: 1485860 - RNA, 19 nt, Homo sapiens
acaagguuggcaccccagc

SEQ ID NO: 1485861 - RNA, 14 nt, Homo sapiens
acaagucuuccaga

SEQ ID NO: 1485862 - RNA, 20 nt, Homo sapiens
acaagugguguuuauugcaa

SEQ ID NO: 1485863 - RNA, 21 nt, Homo sapiens
acaagugguguuuauugcaau

SEQ ID NO: 1485864 - RNA, 21 nt, Homo sapiens
acaaguugcgacggagagaaa

SEQ ID NO: 1485865 - RNA, 21 nt, Homo sapiens
acaaguuucugauaccacugc

SEQ ID NO: 1485866 - RNA, 23 nt, Homo sapiens
acaaguuucugauaccacugcac

SEQ ID NO: 1485867 - RNA, 15 nt, Homo sapiens
acaauaaaacauuaa

SEQ ID NO: 1485868 - RNA, 14 nt, Homo sapiens
acaauaaauguauu

SEQ ID NO: 1485869 - RNA, 14 nt, Homo sapiens
acaauaacacuaaa

SEQ ID NO: 1485870 - RNA, 16 nt, Homo sapiens
acaaucaaggccacug

SEQ ID NO: 1485871 - RNA, 18 nt, Homo sapiens
acaaucaugaaauaugca

SEQ ID NO: 1485872 - RNA, 15 nt, Homo sapiens
acaauccaucucuca

SEQ ID NO: 1485873 - RNA, 24 nt, Homo sapiens
acaauccaucucucaaguagugua

SEQ ID NO: 1485874 - RNA, 20 nt, Homo sapiens
acaauccaugaacagcauua

SEQ ID NO: 1485875 - RNA, 16 nt, Homo sapiens
acaauccuugccacag

SEQ ID NO: 1485876 - RNA, 18 nt, Homo sapiens
acaaugcugagguuauga

SEQ ID NO: 1485877 - RNA, 11 nt, Homo sapiens
acaaugcugau

SEQ ID NO: 1485878 - RNA, 13 nt, Homo sapiens
acaaugucccuuc

SEQ ID NO: 1485879 - RNA, 13 nt, Homo sapiens
acaaugugcugga

SEQ ID NO: 1485880 - RNA, 18 nt, Homo sapiens
acaauuaucaaccacgug

SEQ ID NO: 1485881 - RNA, 14 nt, Homo sapiens
acaauucaugccuu

SEQ ID NO: 1485882 - RNA, 23 nt, Homo sapiens
acaauucugugacauacauauua

SEQ ID NO: 1485883 - RNA, 15 nt, Homo sapiens
acacaaaacucucug

SEQ ID NO: 1485884 - RNA, 15 nt, Homo sapiens
acacaaauuugccug

SEQ ID NO: 1485885 - RNA, 20 nt, Homo sapiens
acacaaggauagaugcuggc

SEQ ID NO: 1485886 - RNA, 19 nt, Homo sapiens
acacaauuguuuuaccugu

SEQ ID NO: 1485887 - RNA, 12 nt, Homo sapiens
acacacacaaac

SEQ ID NO: 1485888 - RNA, 12 nt, Homo sapiens
acacacacuccc

SEQ ID NO: 1485889 - RNA, 12 nt, Homo sapiens
acacacccaggc

SEQ ID NO: 1485890 - RNA, 16 nt, Homo sapiens
acacacccaggcccau

SEQ ID NO: 1485891 - RNA, 10 nt, Homo sapiens
acacacuccc

SEQ ID NO: 1485892 - RNA, 17 nt, Homo sapiens
acacagcaacaaugacu

SEQ ID NO: 1485893 - RNA, 18 nt, Homo sapiens
acacagcaagacuccguc

SEQ ID NO: 1485894 - RNA, 23 nt, Homo sapiens
acacagcccugcuucugacauaa

SEQ ID NO: 1485895 - RNA, 19 nt, Homo sapiens
acacagccguguguucaaa

SEQ ID NO: 1485896 - RNA, 13 nt, Homo sapiens
acacaggcuucau

SEQ ID NO: 1485897 - RNA, 19 nt, Homo sapiens
acacaguugggacccaaaa

SEQ ID NO: 1485898 - RNA, 14 nt, Homo sapiens
aaaagauuauagaa

SEQ ID NO: 1485899 - RNA, 23 nt, Homo sapiens
aaaagcugaucauaagugaauuu

SEQ ID NO: 1485900 - RNA, 21 nt, Homo sapiens
aaaaggaaaccaaguggucag

SEQ ID NO: 1485901 - RNA, 22 nt, Homo sapiens
aaaaggacucugcuucagucca

SEQ ID NO: 1485902 - RNA, 20 nt, Homo sapiens
aaaaggaguagggaguucau

SEQ ID NO: 1485903 - RNA, 20 nt, Homo sapiens
aaaagggcagggcaucuccu

SEQ ID NO: 1485904 - RNA, 18 nt, Homo sapiens
aaaaguaaauucauguaa

SEQ ID NO: 1485905 - RNA, 20 nt, Homo sapiens
aaaaguagagcaaaacuaua

SEQ ID NO: 1485906 - RNA, 19 nt, Homo sapiens
aaaaguagguuuacauuca

SEQ ID NO: 1485907 - RNA, 15 nt, Homo sapiens
aaaaguauaugugag

SEQ ID NO: 1485908 - RNA, 18 nt, Homo sapiens
aaaagucaacaaacugca

SEQ ID NO: 1485909 - RNA, 16 nt, Homo sapiens
aaaagucccucccugc

SEQ ID NO: 1485910 - RNA, 20 nt, Homo sapiens
aaaagucccucccugccuga

SEQ ID NO: 1485911 - RNA, 14 nt, Homo sapiens
aaaagucuucacuc

SEQ ID NO: 1485912 - RNA, 19 nt, Homo sapiens
aaaaguuacuaccugucaa

SEQ ID NO: 1485913 - RNA, 13 nt, Homo sapiens
aaaaguuacuuau

SEQ ID NO: 1485914 - RNA, 23 nt, Homo sapiens
aaaaguucagggaccguccaggg

SEQ ID NO: 1485915 - RNA, 19 nt, Homo sapiens
aaaaguucuuuuugcucua

SEQ ID NO: 1485916 - RNA, 18 nt, Homo sapiens
aaaaguuuacaacuugau

SEQ ID NO: 1485917 - RNA, 22 nt, Homo sapiens
aaaaguuuggccgggugcggug

SEQ ID NO: 1485918 - RNA, 22 nt, Homo sapiens
aaaaguuuuuuuuuuguuuguu

SEQ ID NO: 1485919 - RNA, 19 nt, Homo sapiens
aaaauaauuauaaauauca

SEQ ID NO: 1485920 - RNA, 13 nt, Homo sapiens
aaaauacuguaca

SEQ ID NO: 1485921 - RNA, 19 nt, Homo sapiens
aaaauacuuuuacucugcc

SEQ ID NO: 1485922 - RNA, 10 nt, Homo sapiens
aaaauaugcc

SEQ ID NO: 1485923 - RNA, 21 nt, Homo sapiens
aaaauauuuuuagaacuccaa

SEQ ID NO: 1485924 - RNA, 15 nt, Homo sapiens
aaaaucacacugucu

SEQ ID NO: 1485925 - RNA, 16 nt, Homo sapiens
aaaaucuuggaaguac

SEQ ID NO: 1485926 - RNA, 21 nt, Homo sapiens
aaaaucuuggaaguacaugaa

SEQ ID NO: 1485927 - RNA, 13 nt, Homo sapiens
aaaaugaacugaa

SEQ ID NO: 1485928 - RNA, 24 nt, Homo sapiens
aaaaugaacugaaguuucacauga

SEQ ID NO: 1485929 - RNA, 14 nt, Homo sapiens
aaaaugaauaucua

SEQ ID NO: 1485930 - RNA, 17 nt, Homo sapiens
aaaaugaaucuucacaa

SEQ ID NO: 1485931 - RNA, 16 nt, Homo sapiens
aaaauggucucuaaca

SEQ ID NO: 1485932 - RNA, 17 nt, Homo sapiens
aaaaugguuuguccuga

SEQ ID NO: 1485933 - RNA, 14 nt, Homo sapiens
aaaauguacucagc

SEQ ID NO: 1485934 - RNA, 23 nt, Homo sapiens
aaaauguacucagcuaucagcuc

SEQ ID NO: 1485935 - RNA, 21 nt, Homo sapiens
aaaaugucaguguuugggaaa

SEQ ID NO: 1485936 - RNA, 15 nt, Homo sapiens
aaaauguccugccuu

SEQ ID NO: 1485937 - RNA, 12 nt, Homo sapiens
aaaaugucucag

SEQ ID NO: 1485938 - RNA, 12 nt, Homo sapiens
aaaauguucaca

SEQ ID NO: 1485939 - RNA, 22 nt, Homo sapiens
aaaauguucuguuugcugugga

SEQ ID NO: 1485940 - RNA, 23 nt, Homo sapiens
aaaauguucuguuugcuguggaa

SEQ ID NO: 1485941 - RNA, 16 nt, Homo sapiens
aaaauuaaaaccaauu

SEQ ID NO: 1485942 - RNA, 15 nt, Homo sapiens
aaaauuagacuguga

SEQ ID NO: 1485943 - RNA, 21 nt, Homo sapiens
aaaauuagccgggcauggugg

SEQ ID NO: 1485944 - RNA, 15 nt, Homo sapiens
acagccuggaccacc

SEQ ID NO: 1485945 - RNA, 14 nt, Homo sapiens
acagccuggcacag

SEQ ID NO: 1485946 - RNA, 18 nt, Homo sapiens
acagcgagaggcagagaa

SEQ ID NO: 1485947 - RNA, 17 nt, Homo sapiens
acagcuacucuccccac

SEQ ID NO: 1485948 - RNA, 21 nt, Homo sapiens
acagcuacucuccccacgagg

SEQ ID NO: 1485949 - RNA, 15 nt, Homo sapiens
acagcugaguuauga

SEQ ID NO: 1485950 - RNA, 21 nt, Homo sapiens
acagcugccaucgaccuggag

SEQ ID NO: 1485951 - RNA, 23 nt, Homo sapiens
acagcugcuuucuguugucauug

SEQ ID NO: 1485952 - RNA, 23 nt, Homo sapiens
acagcuuuugcaacuuaauacuc

SEQ ID NO: 1485953 - RNA, 18 nt, Homo sapiens
acaggaaggaaccagaag

SEQ ID NO: 1485954 - RNA, 15 nt, Homo sapiens
acaggaggccagugg

SEQ ID NO: 1485955 - RNA, 23 nt, Homo sapiens
acaggaggcccccaucuaugagc

SEQ ID NO: 1485956 - RNA, 22 nt, Homo sapiens
acaggcagauguuugccucaua

SEQ ID NO: 1485957 - RNA, 22 nt, Homo sapiens
acaggccauggugcacaaaagg

SEQ ID NO: 1485958 - RNA, 13 nt, Homo sapiens
acaggcccagcgc

SEQ ID NO: 1485959 - RNA, 16 nt, Homo sapiens
acaggcccuuccucuc

SEQ ID NO: 1485960 - RNA, 15 nt, Homo sapiens
acagggcauggccag

SEQ ID NO: 1485961 - RNA, 18 nt, Homo sapiens
acagggucauguuugcag

SEQ ID NO: 1485962 - RNA, 17 nt, Homo sapiens
acagggucuugcucugu

SEQ ID NO: 1485963 - RNA, 23 nt, Homo sapiens
acagguaauauaaaaagcuucca

SEQ ID NO: 1485964 - RNA, 14 nt, Homo sapiens
acagguccccagau

SEQ ID NO: 1485965 - RNA, 17 nt, Homo sapiens
acaggugccuucccaga

SEQ ID NO: 1485966 - RNA, 17 nt, Homo sapiens
acagguggggacugggc

SEQ ID NO: 1485967 - RNA, 17 nt, Homo sapiens
acagguucuuaaaaagg

SEQ ID NO: 1485968 - RNA, 14 nt, Homo sapiens
acaguaaaucucac

SEQ ID NO: 1485969 - RNA, 14 nt, Homo sapiens
acaguacagcaugu

SEQ ID NO: 1485970 - RNA, 18 nt, Homo sapiens
acaguaggauaagccacu

SEQ ID NO: 1485971 - RNA, 23 nt, Homo sapiens
acaguauuucauugccuguguau

SEQ ID NO: 1485972 - RNA, 20 nt, Homo sapiens
acagucaccgacaacaugcu

SEQ ID NO: 1485973 - RNA, 20 nt, Homo sapiens
acaguccucauuuacuggau

SEQ ID NO: 1485974 - RNA, 13 nt, Homo sapiens
acagugaauuuaa

SEQ ID NO: 1485975 - RNA, 17 nt, Homo sapiens
acagugccaacuccuca

SEQ ID NO: 1485976 - RNA, 19 nt, Homo sapiens
acagugccgacagcucucc

SEQ ID NO: 1485977 - RNA, 21 nt, Homo sapiens
acaguggaggaagagggacag

SEQ ID NO: 1485978 - RNA, 18 nt, Homo sapiens
acaguguacaaugccuuu

SEQ ID NO: 1485979 - RNA, 14 nt, Homo sapiens
acaguguugcccag

SEQ ID NO: 1485980 - RNA, 23 nt, Homo sapiens
acaguguuggagguuaaggcaua

SEQ ID NO: 1485981 - RNA, 22 nt, Homo sapiens
acaguguuuuaauaaaugguuu

SEQ ID NO: 1485982 - RNA, 21 nt, Homo sapiens
acaguuauugcaagaguuuaa

SEQ ID NO: 1485983 - RNA, 16 nt, Homo sapiens
acaguucugucauaug

SEQ ID NO: 1485984 - RNA, 21 nt, Homo sapiens
acaguucuuugggccagacau

SEQ ID NO: 1485985 - RNA, 18 nt, Homo sapiens
acaguugguucaucccuu

SEQ ID NO: 1485986 - RNA, 15 nt, Homo sapiens
acaguuuuaagcaga

SEQ ID NO: 1485987 - RNA, 13 nt, Homo sapiens
acauaaacccagu

SEQ ID NO: 1485988 - RNA, 22 nt, Homo sapiens
acauaacacuauaaagguugac

SEQ ID NO: 1485989 - RNA, 23 nt, Homo sapiens
acauaacuaguggcucucaguua

SEQ ID NO: 1485990 - RNA, 13 nt, Homo sapiens
acauaacucugua

SEQ ID NO: 1485991 - RNA, 20 nt, Homo sapiens
acauaagaccauaacagcca

SEQ ID NO: 1485992 - RNA, 13 nt, Homo sapiens
acauaaggaugaa

SEQ ID NO: 1485993 - RNA, 15 nt, Homo sapiens
acauaaguaauucaa

SEQ ID NO: 1485994 - RNA, 22 nt, Homo sapiens
accuccuuagcccugucugcua

SEQ ID NO: 1485995 - RNA, 22 nt, Homo sapiens
accuccuuucaucacacugggu

SEQ ID NO: 1485996 - RNA, 17 nt, Homo sapiens
accucuggacuggcuag

SEQ ID NO: 1485997 - RNA, 14 nt, Homo sapiens
accucuggcaccca

SEQ ID NO: 1485998 - RNA, 17 nt, Homo sapiens
accucuggggaccccaa

SEQ ID NO: 1485999 - RNA, 22 nt, Homo sapiens
accucuggggaccccaaccuca

SEQ ID NO: 1486000 - RNA, 19 nt, Homo sapiens
accucuguauagaaaucua

SEQ ID NO: 1486001 - RNA, 20 nt, Homo sapiens
accucugucauuuguuguga

SEQ ID NO: 1486002 - RNA, 22 nt, Homo sapiens
accucuucaugagcuugaacaa

SEQ ID NO: 1486003 - RNA, 23 nt, Homo sapiens
accugacaggugaggucuguucc

SEQ ID NO: 1486004 - RNA, 16 nt, Homo sapiens
accugaccccauuccu

SEQ ID NO: 1486005 - RNA, 18 nt, Homo sapiens
accugagaaauggccaaa

SEQ ID NO: 1486006 - RNA, 20 nt, Homo sapiens
accugauggaaguaaagccu

SEQ ID NO: 1486007 - RNA, 15 nt, Homo sapiens
accugauuugaugau

SEQ ID NO: 1486008 - RNA, 22 nt, Homo sapiens
accugcaaagaucuguccucag

SEQ ID NO: 1486009 - RNA, 15 nt, Homo sapiens
accugcacaccuacg

SEQ ID NO: 1486010 - RNA, 13 nt, Homo sapiens
accugcacacucc

SEQ ID NO: 1486011 - RNA, 13 nt, Homo sapiens
accugcacugucc

SEQ ID NO: 1486012 - RNA, 21 nt, Homo sapiens
accugcagggacuccaugcug

SEQ ID NO: 1486013 - RNA, 19 nt, Homo sapiens
accugccaggcaggggugg

SEQ ID NO: 1486014 - RNA, 13 nt, Homo sapiens
accugccaugcca

SEQ ID NO: 1486015 - RNA, 22 nt, Homo sapiens
accugcccaaggaugcugucaa

SEQ ID NO: 1486016 - RNA, 16 nt, Homo sapiens
accugcccugggccac

SEQ ID NO: 1486017 - RNA, 23 nt, Homo sapiens
accugcccugggccacacugacc

SEQ ID NO: 1486018 - RNA, 17 nt, Homo sapiens
accugccgucuucacuu

SEQ ID NO: 1486019 - RNA, 20 nt, Homo sapiens
accugccugcaucugugaaa

SEQ ID NO: 1486020 - RNA, 14 nt, Homo sapiens
accugcgcucucag

SEQ ID NO: 1486021 - RNA, 18 nt, Homo sapiens
accugcucacaguccuca

SEQ ID NO: 1486022 - RNA, 12 nt, Homo sapiens
accugcucugcu

SEQ ID NO: 1486023 - RNA, 16 nt, Homo sapiens
accugcugaagggcag

SEQ ID NO: 1486024 - RNA, 23 nt, Homo sapiens
accugcugagaaaacaugccucu

SEQ ID NO: 1486025 - RNA, 20 nt, Homo sapiens
accuggaaucuacaagccaa

SEQ ID NO: 1486026 - RNA, 16 nt, Homo sapiens
accuggagaugcugcc

SEQ ID NO: 1486027 - RNA, 23 nt, Homo sapiens
accuggagcaucauaauggacuc

SEQ ID NO: 1486028 - RNA, 20 nt, Homo sapiens
accuggcagacuugcccagg

SEQ ID NO: 1486029 - RNA, 19 nt, Homo sapiens
accuggcccuugcaaucuu

SEQ ID NO: 1486030 - RNA, 17 nt, Homo sapiens
accuggcuuuuacuuua

SEQ ID NO: 1486031 - RNA, 14 nt, Homo sapiens
accugggaggucaa

SEQ ID NO: 1486032 - RNA, 15 nt, Homo sapiens
accugggcaugacau

SEQ ID NO: 1486033 - RNA, 21 nt, Homo sapiens
accuggggagugguuaggcag

SEQ ID NO: 1486034 - RNA, 19 nt, Homo sapiens
accugguacccuccuggcu

SEQ ID NO: 1486035 - RNA, 23 nt, Homo sapiens
accugguggcuacgaaucuuccg

SEQ ID NO: 1486036 - RNA, 16 nt, Homo sapiens
accuguaaagugccuu

SEQ ID NO: 1486037 - RNA, 13 nt, Homo sapiens
accuguaguccca

SEQ ID NO: 1486038 - RNA, 22 nt, Homo sapiens
accuguagucccagcuacucag

SEQ ID NO: 1486039 - RNA, 18 nt, Homo sapiens
accuguauacagugcaga

SEQ ID NO: 1486040 - RNA, 21 nt, Homo sapiens
accugucacauugcauucuau

SEQ ID NO: 1486041 - RNA, 13 nt, Homo sapiens
accugucauucua

SEQ ID NO: 1486042 - RNA, 17 nt, Homo sapiens
accugucauucuagaaa

SEQ ID NO: 1486043 - RNA, 22 nt, Homo sapiens
agaaugcacaagaauggaucac

SEQ ID NO: 1486044 - RNA, 12 nt, Homo sapiens
agaauggaucac

SEQ ID NO: 1486045 - RNA, 15 nt, Homo sapiens
agaauguaacuccag

SEQ ID NO: 1486046 - RNA, 13 nt, Homo sapiens
agaauguuacagu

SEQ ID NO: 1486047 - RNA, 15 nt, Homo sapiens
agaauguuccuacuc

SEQ ID NO: 1486048 - RNA, 16 nt, Homo sapiens
agaauuauaagucaca

SEQ ID NO: 1486049 - RNA, 21 nt, Homo sapiens
agaauucuggauaucucagga

SEQ ID NO: 1486050 - RNA, 13 nt, Homo sapiens
agaauuguaucau

SEQ ID NO: 1486051 - RNA, 23 nt, Homo sapiens
agacaacgaugaauuucuucuaa

SEQ ID NO: 1486052 - RNA, 18 nt, Homo sapiens
agacaagauauuguacau

SEQ ID NO: 1486053 - RNA, 12 nt, Homo sapiens
agacaagcauuu

SEQ ID NO: 1486054 - RNA, 21 nt, Homo sapiens
agacaaguauggcuccuccau

SEQ ID NO: 1486055 - RNA, 22 nt, Homo sapiens
agacaaugauauugacacuguc

SEQ ID NO: 1486056 - RNA, 17 nt, Homo sapiens
agacacaucuccuccau

SEQ ID NO: 1486057 - RNA, 22 nt, Homo sapiens
agacacaucuccuccauacuca

SEQ ID NO: 1486058 - RNA, 18 nt, Homo sapiens
agacaccaaguuccguca

SEQ ID NO: 1486059 - RNA, 22 nt, Homo sapiens
agacacggagcccagcccuccc

SEQ ID NO: 1486060 - RNA, 14 nt, Homo sapiens
agacagaacuugaa

SEQ ID NO: 1486061 - RNA, 20 nt, Homo sapiens
agacagauccccguuccuga

SEQ ID NO: 1486062 - RNA, 23 nt, Homo sapiens
agacaguaugagucaaugugcag

SEQ ID NO: 1486063 - RNA, 16 nt, Homo sapiens
agacauacauuucuca

SEQ ID NO: 1486064 - RNA, 17 nt, Homo sapiens
agacauacuccuuccau

SEQ ID NO: 1486065 - RNA, 13 nt, Homo sapiens
agacauacuugaa

SEQ ID NO: 1486066 - RNA, 21 nt, Homo sapiens
agacauacuugaagggccaga

SEQ ID NO: 1486067 - RNA, 12 nt, Homo sapiens
agacaucaucaa

SEQ ID NO: 1486068 - RNA, 21 nt, Homo sapiens
agacaucuuauccauccucac

SEQ ID NO: 1486069 - RNA, 14 nt, Homo sapiens
agacaugaaccaag

SEQ ID NO: 1486070 - RNA, 18 nt, Homo sapiens
agacauuggcaccuaauc

SEQ ID NO: 1486071 - RNA, 21 nt, Homo sapiens
agacauuggcaccuaauccag

SEQ ID NO: 1486072 - RNA, 11 nt, Homo sapiens
agaccagugac

SEQ ID NO: 1486073 - RNA, 16 nt, Homo sapiens
agaccauaauguuaca

SEQ ID NO: 1486074 - RNA, 15 nt, Homo sapiens
agacccccagcacuu

SEQ ID NO: 1486075 - RNA, 15 nt, Homo sapiens
agaccucaagccauc

SEQ ID NO: 1486076 - RNA, 21 nt, Homo sapiens
agaccuggcuccacucuugau

SEQ ID NO: 1486077 - RNA, 17 nt, Homo sapiens
agacgaaauagugacau

SEQ ID NO: 1486078 - RNA, 23 nt, Homo sapiens
agacgaggccacagcugccaucg

SEQ ID NO: 1486079 - RNA, 15 nt, Homo sapiens
agacggagucuugcu

SEQ ID NO: 1486080 - RNA, 15 nt, Homo sapiens
agacgggcacagaca

SEQ ID NO: 1486081 - RNA, 16 nt, Homo sapiens
agacguccuccgucca

SEQ ID NO: 1486082 - RNA, 18 nt, Homo sapiens
agacgugcgcgaugugac

SEQ ID NO: 1486083 - RNA, 11 nt, Homo sapiens
agacuacaggg

SEQ ID NO: 1486084 - RNA, 16 nt, Homo sapiens
agacuacauuugugaa

SEQ ID NO: 1486085 - RNA, 18 nt, Homo sapiens
agacucaagagaauuuau

SEQ ID NO: 1486086 - RNA, 19 nt, Homo sapiens
agacucaccuguucucacu

SEQ ID NO: 1486087 - RNA, 19 nt, Homo sapiens
agacucagacauuggcacc

SEQ ID NO: 1486088 - RNA, 17 nt, Homo sapiens
agacucaguuugucaga

SEQ ID NO: 1486089 - RNA, 14 nt, Homo sapiens
agacuccaucucaa

SEQ ID NO: 1486090 - RNA, 15 nt, Homo sapiens
agacuccgcccuccu

SEQ ID NO: 1486091 - RNA, 10 nt, Homo sapiens
agacucugac

SEQ ID NO: 1486092 - RNA, 13 nt, Homo sapiens
agacucugucuca

SEQ ID NO: 1486093 - RNA, 22 nt, Homo sapiens
agacugcauguaccauuugcau

SEQ ID NO: 1486094 - RNA, 22 nt, Homo sapiens
agacuggaauauaauuucaaac

SEQ ID NO: 1486095 - RNA, 13 nt, Homo sapiens
agagcuggaugca

SEQ ID NO: 1486096 - RNA, 22 nt, Homo sapiens
agagcuuguaauaaauacugca

SEQ ID NO: 1486097 - RNA, 22 nt, Homo sapiens
agaggaaaaguaaggugcaguu

SEQ ID NO: 1486098 - RNA, 16 nt, Homo sapiens
agaggaacagcacugg

SEQ ID NO: 1486099 - RNA, 12 nt, Homo sapiens
agaggagcauga

SEQ ID NO: 1486100 - RNA, 13 nt, Homo sapiens
agaggagccagac

SEQ ID NO: 1486101 - RNA, 15 nt, Homo sapiens
agaggagccagacag

SEQ ID NO: 1486102 - RNA, 17 nt, Homo sapiens
agaggagccagacagac

SEQ ID NO: 1486103 - RNA, 23 nt, Homo sapiens
agaggaugaauguaugugcacug

SEQ ID NO: 1486104 - RNA, 22 nt, Homo sapiens
agaggcaaugauuguuaauuua

SEQ ID NO: 1486105 - RNA, 13 nt, Homo sapiens
agaggcacucagu

SEQ ID NO: 1486106 - RNA, 13 nt, Homo sapiens
agaggcucugaga

SEQ ID NO: 1486107 - RNA, 13 nt, Homo sapiens
agaggcugagaca

SEQ ID NO: 1486108 - RNA, 19 nt, Homo sapiens
agaggcugaggcuggcaca

SEQ ID NO: 1486109 - RNA, 21 nt, Homo sapiens
agaggcugccccucucaccaa

SEQ ID NO: 1486110 - RNA, 11 nt, Homo sapiens
agaggcugcug

SEQ ID NO: 1486111 - RNA, 13 nt, Homo sapiens
agaggcugcugca

SEQ ID NO: 1486112 - RNA, 15 nt, Homo sapiens
agagggaggucacug

SEQ ID NO: 1486113 - RNA, 16 nt, Homo sapiens
agagggaggucacugg

SEQ ID NO: 1486114 - RNA, 18 nt, Homo sapiens
agagggaggucacuggaa

SEQ ID NO: 1486115 - RNA, 23 nt, Homo sapiens
agaggggcagccaggacaucucu

SEQ ID NO: 1486116 - RNA, 22 nt, Homo sapiens
agagggguggaguuuuaacugu

SEQ ID NO: 1486117 - RNA, 18 nt, Homo sapiens
agaggucagacuaagaaa

SEQ ID NO: 1486118 - RNA, 22 nt, Homo sapiens
agagguggagugucacaucucu

SEQ ID NO: 1486119 - RNA, 22 nt, Homo sapiens
agaguagaacagauaaucagug

SEQ ID NO: 1486120 - RNA, 21 nt, Homo sapiens
agagucgcaucucagugcagg

SEQ ID NO: 1486121 - RNA, 11 nt, Homo sapiens
agaguggugcu

SEQ ID NO: 1486122 - RNA, 14 nt, Homo sapiens
agagugucucaggg

SEQ ID NO: 1486123 - RNA, 17 nt, Homo sapiens
agagugucucugauaaa

SEQ ID NO: 1486124 - RNA, 14 nt, Homo sapiens
agaguuuuaucaac

SEQ ID NO: 1486125 - RNA, 17 nt, Homo sapiens
agauaaacaacaaauaa

SEQ ID NO: 1486126 - RNA, 16 nt, Homo sapiens
agauaaauagaacuau

SEQ ID NO: 1486127 - RNA, 14 nt, Homo sapiens
agauaaaugugcug

SEQ ID NO: 1486128 - RNA, 14 nt, Homo sapiens
agauaagacauauc

SEQ ID NO: 1486129 - RNA, 13 nt, Homo sapiens
agauaauuugcau

SEQ ID NO: 1486130 - RNA, 17 nt, Homo sapiens
agauaauuugcauauuc

SEQ ID NO: 1486131 - RNA, 12 nt, Homo sapiens
agauacaaacug

SEQ ID NO: 1486132 - RNA, 16 nt, Homo sapiens
agauacauauacugau

SEQ ID NO: 1486133 - RNA, 14 nt, Homo sapiens
agauacaucacugc

SEQ ID NO: 1486134 - RNA, 14 nt, Homo sapiens
agauacuagcuauc

SEQ ID NO: 1486135 - RNA, 15 nt, Homo sapiens
agauagcuacagugu

SEQ ID NO: 1486136 - RNA, 17 nt, Homo sapiens
agauagguggugccagu

SEQ ID NO: 1486137 - RNA, 20 nt, Homo sapiens
agauaguagcauacauuuau

SEQ ID NO: 1486138 - RNA, 21 nt, Homo sapiens
agauagucucauucugucacc

SEQ ID NO: 1486139 - RNA, 17 nt, Homo sapiens
agauaguguaacuugcu

SEQ ID NO: 1486140 - RNA, 23 nt, Homo sapiens
agauaguuguguuuuuauuguua

SEQ ID NO: 1486141 - RNA, 11 nt, Homo sapiens
agauaugauau

SEQ ID NO: 1486142 - RNA, 17 nt, Homo sapiens
agauauucagaaguaua

SEQ ID NO: 1486143 - RNA, 18 nt, Homo sapiens
agauauucagaaguauau

SEQ ID NO: 1486144 - RNA, 20 nt, Homo sapiens
agauauugaugauaacacuu

SEQ ID NO: 1486145 - RNA, 14 nt, Homo sapiens
agauauugauuacu

SEQ ID NO: 1486146 - RNA, 17 nt, Homo sapiens
agauauugauuacuauc

SEQ ID NO: 1486147 - RNA, 17 nt, Homo sapiens
agcagauccucaauaaa

SEQ ID NO: 1486148 - RNA, 16 nt, Homo sapiens
agcagauuguguaaca

SEQ ID NO: 1486149 - RNA, 22 nt, Homo sapiens
agcagcagaggcggucuucaac

SEQ ID NO: 1486150 - RNA, 13 nt, Homo sapiens
agcagcagcacca

SEQ ID NO: 1486151 - RNA, 14 nt, Homo sapiens
agcagcaucuuuaa

SEQ ID NO: 1486152 - RNA, 16 nt, Homo sapiens
agcagccacaaccaaa

SEQ ID NO: 1486153 - RNA, 18 nt, Homo sapiens
agcagccacaaccaaaaa

SEQ ID NO: 1486154 - RNA, 19 nt, Homo sapiens
agcagccauuggcacugug

SEQ ID NO: 1486155 - RNA, 18 nt, Homo sapiens
agcagccuaacacggugc

SEQ ID NO: 1486156 - RNA, 23 nt, Homo sapiens
agcagcugguggaagaccuggac

SEQ ID NO: 1486157 - RNA, 14 nt, Homo sapiens
agcagcuuuaaaca

SEQ ID NO: 1486158 - RNA, 21 nt, Homo sapiens
agcagcuuuaaacaaauucau

SEQ ID NO: 1486159 - RNA, 23 nt, Homo sapiens
agcaggaauauaugugugccuau

SEQ ID NO: 1486160 - RNA, 14 nt, Homo sapiens
agcaggaguggugc

SEQ ID NO: 1486161 - RNA, 14 nt, Homo sapiens
agcaggcaauuuca

SEQ ID NO: 1486162 - RNA, 17 nt, Homo sapiens
agcaggcacccacuucc

SEQ ID NO: 1486163 - RNA, 23 nt, Homo sapiens
agcaggcagcgccaagugcgugc

SEQ ID NO: 1486164 - RNA, 15 nt, Homo sapiens
agcaggccggaacca

SEQ ID NO: 1486165 - RNA, 22 nt, Homo sapiens
agcaggccggaaccacagggcc

SEQ ID NO: 1486166 - RNA, 19 nt, Homo sapiens
agcagggauuaaccucugc

SEQ ID NO: 1486167 - RNA, 19 nt, Homo sapiens
agcaggugguccugagacc

SEQ ID NO: 1486168 - RNA, 19 nt, Homo sapiens
agcaguaaauuugcuagca

SEQ ID NO: 1486169 - RNA, 17 nt, Homo sapiens
agcagucagaguccagu

SEQ ID NO: 1486170 - RNA, 17 nt, Homo sapiens
agcagucccaguauucu

SEQ ID NO: 1486171 - RNA, 14 nt, Homo sapiens
agcauacagguuaa

SEQ ID NO: 1486172 - RNA, 20 nt, Homo sapiens
agcauacagguuaaccugca

SEQ ID NO: 1486173 - RNA, 13 nt, Homo sapiens
agcauauacugaa

SEQ ID NO: 1486174 - RNA, 22 nt, Homo sapiens
agcauaugggugggauuuugca

SEQ ID NO: 1486175 - RNA, 23 nt, Homo sapiens
agcaucacuccccaaggaagagc

SEQ ID NO: 1486176 - RNA, 21 nt, Homo sapiens
agcaucuccuuacagucacua

SEQ ID NO: 1486177 - RNA, 22 nt, Homo sapiens
agcaucuucacuucuaaaugca

SEQ ID NO: 1486178 - RNA, 21 nt, Homo sapiens
agcaugaaaaucacacugucu

SEQ ID NO: 1486179 - RNA, 20 nt, Homo sapiens
agcaugaaaguggacaagga

SEQ ID NO: 1486180 - RNA, 15 nt, Homo sapiens
agcaugccugaacua

SEQ ID NO: 1486181 - RNA, 13 nt, Homo sapiens
agcaugcuacagu

SEQ ID NO: 1486182 - RNA, 17 nt, Homo sapiens
agcaugcuucccagagg

SEQ ID NO: 1486183 - RNA, 21 nt, Homo sapiens
agcauggccccaguccaugcu

SEQ ID NO: 1486184 - RNA, 20 nt, Homo sapiens
agcaugucucaauaguaaaa

SEQ ID NO: 1486185 - RNA, 22 nt, Homo sapiens
agcauguguauuuccagugcaa

SEQ ID NO: 1486186 - RNA, 23 nt, Homo sapiens
agcauucuggaggggagagcuuu

SEQ ID NO: 1486187 - RNA, 19 nt, Homo sapiens
agcauucuugucacaauaa

SEQ ID NO: 1486188 - RNA, 22 nt, Homo sapiens
agcauuuccaacaccacagaca

SEQ ID NO: 1486189 - RNA, 18 nt, Homo sapiens
agcauuuuucaaaugauc

SEQ ID NO: 1486190 - RNA, 14 nt, Homo sapiens
agccaaacccauga

SEQ ID NO: 1486191 - RNA, 15 nt, Homo sapiens
agccaaaugcauggu

SEQ ID NO: 1486192 - RNA, 19 nt, Homo sapiens
agccaagaucuugccacug

SEQ ID NO: 1486193 - RNA, 21 nt, Homo sapiens
agccaagcaaaccaaugguga

SEQ ID NO: 1486194 - RNA, 19 nt, Homo sapiens
agccaagcugguccuggga

SEQ ID NO: 1486195 - RNA, 22 nt, Homo sapiens
agccaagcuuguuaucagcuuu

SEQ ID NO: 1486196 - RNA, 16 nt, Homo sapiens
agcuaguguaccuccu

SEQ ID NO: 1486197 - RNA, 17 nt, Homo sapiens
agcuaguguaccuccuc

SEQ ID NO: 1486198 - RNA, 16 nt, Homo sapiens
agcuaguuugagccag

SEQ ID NO: 1486199 - RNA, 19 nt, Homo sapiens
agcuauugccaaccaguuu

SEQ ID NO: 1486200 - RNA, 16 nt, Homo sapiens
agcuauuuaucuguag

SEQ ID NO: 1486201 - RNA, 17 nt, Homo sapiens
agcucacuacccuauuc

SEQ ID NO: 1486202 - RNA, 16 nt, Homo sapiens
agcucagcgccagccu

SEQ ID NO: 1486203 - RNA, 23 nt, Homo sapiens
agcucagcgccagccugucccau

SEQ ID NO: 1486204 - RNA, 19 nt, Homo sapiens
agcucagugcucucuccac

SEQ ID NO: 1486205 - RNA, 16 nt, Homo sapiens
agcucaguguguucug

SEQ ID NO: 1486206 - RNA, 21 nt, Homo sapiens
agcuccacccuggccgagucc

SEQ ID NO: 1486207 - RNA, 17 nt, Homo sapiens
agcuccgccucccgggu

SEQ ID NO: 1486208 - RNA, 21 nt, Homo sapiens
agcuccucccacaaugcugaa

SEQ ID NO: 1486209 - RNA, 14 nt, Homo sapiens
agcucucccaguga

SEQ ID NO: 1486210 - RNA, 22 nt, Homo sapiens
agcucugagacccuuuucucag

SEQ ID NO: 1486211 - RNA, 23 nt, Homo sapiens
agcucugcagcacucuuaucuac

SEQ ID NO: 1486212 - RNA, 23 nt, Homo sapiens
agcucuggacagccccacccugg

SEQ ID NO: 1486213 - RNA, 17 nt, Homo sapiens
agcucuucaggccuccc

SEQ ID NO: 1486214 - RNA, 19 nt, Homo sapiens
agcugaagugcauccaaag

SEQ ID NO: 1486215 - RNA, 20 nt, Homo sapiens
agcugaauuugauucuccag

SEQ ID NO: 1486216 - RNA, 18 nt, Homo sapiens
agcugagaagggcaggga

SEQ ID NO: 1486217 - RNA, 20 nt, Homo sapiens
agcugagaucgugcuacugc

SEQ ID NO: 1486218 - RNA, 15 nt, Homo sapiens
agcugagauuccugg

SEQ ID NO: 1486219 - RNA, 16 nt, Homo sapiens
agcugauauaaauucu

SEQ ID NO: 1486220 - RNA, 13 nt, Homo sapiens
agcugauccugcg

SEQ ID NO: 1486221 - RNA, 23 nt, Homo sapiens
agcugcaccagagcaaccucuca

SEQ ID NO: 1486222 - RNA, 12 nt, Homo sapiens
agcugcaucauc

SEQ ID NO: 1486223 - RNA, 23 nt, Homo sapiens
agcugccaaggaaacccccagug

SEQ ID NO: 1486224 - RNA, 11 nt, Homo sapiens
agcugcccuag

SEQ ID NO: 1486225 - RNA, 22 nt, Homo sapiens
agcugccuuggcucagacaugu

SEQ ID NO: 1486226 - RNA, 19 nt, Homo sapiens
agcugcucugcaagcagaa

SEQ ID NO: 1486227 - RNA, 23 nt, Homo sapiens
agcugcugucuucuggacaggcu

SEQ ID NO: 1486228 - RNA, 14 nt, Homo sapiens
agcuggaaaaccuc

SEQ ID NO: 1486229 - RNA, 15 nt, Homo sapiens
agcuggaaaaccucc

SEQ ID NO: 1486230 - RNA, 22 nt, Homo sapiens
agcugggcaaagccacaaggcu

SEQ ID NO: 1486231 - RNA, 17 nt, Homo sapiens
agcugggcucugcaauu

SEQ ID NO: 1486232 - RNA, 20 nt, Homo sapiens
agcugggucaggcagggugc

SEQ ID NO: 1486233 - RNA, 15 nt, Homo sapiens
agcugguggcaauaa

SEQ ID NO: 1486234 - RNA, 21 nt, Homo sapiens
agcugguggcaauaaauauua

SEQ ID NO: 1486235 - RNA, 19 nt, Homo sapiens
agcugucccucacuguuga

SEQ ID NO: 1486236 - RNA, 19 nt, Homo sapiens
agcuguccucccaccucag

SEQ ID NO: 1486237 - RNA, 19 nt, Homo sapiens
agcugucgacuucaugaca

SEQ ID NO: 1486238 - RNA, 16 nt, Homo sapiens
agcugugacuucucca

SEQ ID NO: 1486239 - RNA, 19 nt, Homo sapiens
agcuguggccagcuuguua

SEQ ID NO: 1486240 - RNA, 16 nt, Homo sapiens
agcuguuuucccugac

SEQ ID NO: 1486241 - RNA, 22 nt, Homo sapiens
agcuuaaaauaaacaguuguga

SEQ ID NO: 1486242 - RNA, 17 nt, Homo sapiens
agcuuaucucuuuuaua

SEQ ID NO: 1486243 - RNA, 14 nt, Homo sapiens
agcuuaugucagac

SEQ ID NO: 1486244 - RNA, 17 nt, Homo sapiens
agcuuccgccgucucaa

SEQ ID NO: 1486245 - RNA, 20 nt, Homo sapiens
agcuuccuuaaguauaucau

SEQ ID NO: 1486246 - RNA, 19 nt, Homo sapiens
agcuucuuaauuaauuuga

SEQ ID NO: 1486247 - RNA, 16 nt, Homo sapiens
agcuucuucacaggca

SEQ ID NO: 1486248 - RNA, 12 nt, Homo sapiens
acauuaucucac

SEQ ID NO: 1486249 - RNA, 14 nt, Homo sapiens
acauuaugccuuaa

SEQ ID NO: 1486250 - RNA, 12 nt, Homo sapiens
acauuaugugga

SEQ ID NO: 1486251 - RNA, 21 nt, Homo sapiens
acauucaaggcauuucuauca

SEQ ID NO: 1486252 - RNA, 20 nt, Homo sapiens
acauucaauagcauaucaca

SEQ ID NO: 1486253 - RNA, 15 nt, Homo sapiens
acauucagaaguaau

SEQ ID NO: 1486254 - RNA, 20 nt, Homo sapiens
acauuccaaugcauugcuaa

SEQ ID NO: 1486255 - RNA, 12 nt, Homo sapiens
acauuccagggg

SEQ ID NO: 1486256 - RNA, 24 nt, Homo sapiens
acauuccuuagucucaagggcuag

SEQ ID NO: 1486257 - RNA, 19 nt, Homo sapiens
acauucuggaaaagcaaaa

SEQ ID NO: 1486258 - RNA, 21 nt, Homo sapiens
acauucuuguuuuaagugccu

SEQ ID NO: 1486259 - RNA, 14 nt, Homo sapiens
acauugcauucuau

SEQ ID NO: 1486260 - RNA, 17 nt, Homo sapiens
acauuggcaccuaaucc

SEQ ID NO: 1486261 - RNA, 13 nt, Homo sapiens
acauuguauauau

SEQ ID NO: 1486262 - RNA, 21 nt, Homo sapiens
acauugugaacagaaguuuaa

SEQ ID NO: 1486263 - RNA, 16 nt, Homo sapiens
acauuuaaaauucaau

SEQ ID NO: 1486264 - RNA, 17 nt, Homo sapiens
acauuuccucagucaag

SEQ ID NO: 1486265 - RNA, 17 nt, Homo sapiens
acauuucuaugccaaac

SEQ ID NO: 1486266 - RNA, 13 nt, Homo sapiens
acauuuggugggc

SEQ ID NO: 1486267 - RNA, 15 nt, Homo sapiens
acauuuuacauuaaa

SEQ ID NO: 1486268 - RNA, 15 nt, Homo sapiens
acauuuugacacaaa

SEQ ID NO: 1486269 - RNA, 15 nt, Homo sapiens
acauuuuuugggcag

SEQ ID NO: 1486270 - RNA, 16 nt, Homo sapiens
accaaagaaauuauaa

SEQ ID NO: 1486271 - RNA, 18 nt, Homo sapiens
accaaaggauagugcgau

SEQ ID NO: 1486272 - RNA, 23 nt, Homo sapiens
accaaaucuucuccuaugcauuu

SEQ ID NO: 1486273 - RNA, 14 nt, Homo sapiens
accaacacugaccc

SEQ ID NO: 1486274 - RNA, 11 nt, Homo sapiens
accaaccaaac

SEQ ID NO: 1486275 - RNA, 15 nt, Homo sapiens
accaacccucagagc

SEQ ID NO: 1486276 - RNA, 19 nt, Homo sapiens
accaagaaagcucacugua

SEQ ID NO: 1486277 - RNA, 17 nt, Homo sapiens
accaagaacauaagaau

SEQ ID NO: 1486278 - RNA, 19 nt, Homo sapiens
accaagcauuccugcucaa

SEQ ID NO: 1486279 - RNA, 14 nt, Homo sapiens
accaaggaagcagc

SEQ ID NO: 1486280 - RNA, 15 nt, Homo sapiens
accaaggacugagca

SEQ ID NO: 1486281 - RNA, 16 nt, Homo sapiens
accaagggcaccugga

SEQ ID NO: 1486282 - RNA, 23 nt, Homo sapiens
accaaggggugggccacagccau

SEQ ID NO: 1486283 - RNA, 13 nt, Homo sapiens
accaaggucuuca

SEQ ID NO: 1486284 - RNA, 19 nt, Homo sapiens
accaaguaaaacaaaacca

SEQ ID NO: 1486285 - RNA, 18 nt, Homo sapiens
accaauuccaaguuuuaa

SEQ ID NO: 1486286 - RNA, 16 nt, Homo sapiens
accaauugugcugcca

SEQ ID NO: 1486287 - RNA, 17 nt, Homo sapiens
accaauugugcugccau

SEQ ID NO: 1486288 - RNA, 18 nt, Homo sapiens
accaauugugcugccauu

SEQ ID NO: 1486289 - RNA, 20 nt, Homo sapiens
accaauugugcugccauuug

SEQ ID NO: 1486290 - RNA, 14 nt, Homo sapiens
accacaccaucagg

SEQ ID NO: 1486291 - RNA, 18 nt, Homo sapiens
accacagagccucgggac

SEQ ID NO: 1486292 - RNA, 14 nt, Homo sapiens
accacaggcaucua

SEQ ID NO: 1486293 - RNA, 17 nt, Homo sapiens
accacagguucaugcca

SEQ ID NO: 1486294 - RNA, 19 nt, Homo sapiens
accaccgaaucccuagucc

SEQ ID NO: 1486295 - RNA, 13 nt, Homo sapiens
accaccucaccag

SEQ ID NO: 1486296 - RNA, 13 nt, Homo sapiens
accacgacuggcc

SEQ ID NO: 1486297 - RNA, 15 nt, Homo sapiens
accacuaacuccuga

SEQ ID NO: 1486298 - RNA, 23 nt, Homo sapiens
accacuacaugcagcccaugccc

SEQ ID NO: 1486299 - RNA, 20 nt, Homo sapiens
aggccugucccuugccucug

SEQ ID NO: 1486300 - RNA, 16 nt, Homo sapiens
aggccuuccagcugcu

SEQ ID NO: 1486301 - RNA, 15 nt, Homo sapiens
aggcgcacaguguga

SEQ ID NO: 1486302 - RNA, 20 nt, Homo sapiens
aggcgccugccaucaugccu

SEQ ID NO: 1486303 - RNA, 23 nt, Homo sapiens
aggcggccucgugccaugaucug

SEQ ID NO: 1486304 - RNA, 17 nt, Homo sapiens
aggcggcuacaugccuc

SEQ ID NO: 1486305 - RNA, 17 nt, Homo sapiens
aggcgggagcaucucuu

SEQ ID NO: 1486306 - RNA, 17 nt, Homo sapiens
aggcggggugcuguggu

SEQ ID NO: 1486307 - RNA, 16 nt, Homo sapiens
aggcuaucaacaaaga

SEQ ID NO: 1486308 - RNA, 13 nt, Homo sapiens
aggcuaugccauc

SEQ ID NO: 1486309 - RNA, 19 nt, Homo sapiens
aggcuaugggguaggagaa

SEQ ID NO: 1486310 - RNA, 17 nt, Homo sapiens
aggcucagagaugugca

SEQ ID NO: 1486311 - RNA, 16 nt, Homo sapiens
aggcucugcuucucca

SEQ ID NO: 1486312 - RNA, 17 nt, Homo sapiens
aggcucugcuucuccaa

SEQ ID NO: 1486313 - RNA, 13 nt, Homo sapiens
aggcucuguggag

SEQ ID NO: 1486314 - RNA, 20 nt, Homo sapiens
aggcucuuagcagcuuccag

SEQ ID NO: 1486315 - RNA, 20 nt, Homo sapiens
aggcucuuaugugugccuuu

SEQ ID NO: 1486316 - RNA, 17 nt, Homo sapiens
aggcugaagucagcuca

SEQ ID NO: 1486317 - RNA, 17 nt, Homo sapiens
aggcugaccacagcaca

SEQ ID NO: 1486318 - RNA, 19 nt, Homo sapiens
aggcugaccacagcacagc

SEQ ID NO: 1486319 - RNA, 23 nt, Homo sapiens
aggcugaggcuggcacaggacau

SEQ ID NO: 1486320 - RNA, 14 nt, Homo sapiens
aggcugaguguccg

SEQ ID NO: 1486321 - RNA, 18 nt, Homo sapiens
aggcugcagucccuggaa

SEQ ID NO: 1486322 - RNA, 15 nt, Homo sapiens
aggcugccccucuca

SEQ ID NO: 1486323 - RNA, 14 nt, Homo sapiens
aggcuggagugcag

SEQ ID NO: 1486324 - RNA, 16 nt, Homo sapiens
aggcuggagugcagug

SEQ ID NO: 1486325 - RNA, 20 nt, Homo sapiens
aggcuggagugcaguggcgu

SEQ ID NO: 1486326 - RNA, 15 nt, Homo sapiens
aggcugggaggaaca

SEQ ID NO: 1486327 - RNA, 20 nt, Homo sapiens
aggcugggcagccccagaga

SEQ ID NO: 1486328 - RNA, 12 nt, Homo sapiens
aggcugucacag

SEQ ID NO: 1486329 - RNA, 23 nt, Homo sapiens
aggcuguggguagaugugcaaua

SEQ ID NO: 1486330 - RNA, 14 nt, Homo sapiens
aggcuguucuccag

SEQ ID NO: 1486331 - RNA, 15 nt, Homo sapiens
aggcuucaucaaggu

SEQ ID NO: 1486332 - RNA, 11 nt, Homo sapiens
aggcuuggcac

SEQ ID NO: 1486333 - RNA, 19 nt, Homo sapiens
aggcuuugaguuaacucac

SEQ ID NO: 1486334 - RNA, 18 nt, Homo sapiens
agggaaaaggaguaggga

SEQ ID NO: 1486335 - RNA, 14 nt, Homo sapiens
agggaaaaugagua

SEQ ID NO: 1486336 - RNA, 16 nt, Homo sapiens
agggaaaggggugcuu

SEQ ID NO: 1486337 - RNA, 13 nt, Homo sapiens
agggaaagugcau

SEQ ID NO: 1486338 - RNA, 18 nt, Homo sapiens
agggaagcugucccucac

SEQ ID NO: 1486339 - RNA, 21 nt, Homo sapiens
agggaagcugucccucacugu

SEQ ID NO: 1486340 - RNA, 13 nt, Homo sapiens
agggaagugugag

SEQ ID NO: 1486341 - RNA, 14 nt, Homo sapiens
agggaauccagcuc

SEQ ID NO: 1486342 - RNA, 13 nt, Homo sapiens
agggaauccuccu

SEQ ID NO: 1486343 - RNA, 16 nt, Homo sapiens
agggaauggagcucag

SEQ ID NO: 1486344 - RNA, 14 nt, Homo sapiens
agggaauugcucag

SEQ ID NO: 1486345 - RNA, 17 nt, Homo sapiens
agggaccacccucccug

SEQ ID NO: 1486346 - RNA, 20 nt, Homo sapiens
agggagaaacuucugcucag

SEQ ID NO: 1486347 - RNA, 14 nt, Homo sapiens
agggagaacgggaa

SEQ ID NO: 1486348 - RNA, 20 nt, Homo sapiens
agggagaacuugaaacagau

SEQ ID NO: 1486349 - RNA, 14 nt, Homo sapiens
agggagaagggaug

SEQ ID NO: 1486350 - RNA, 14 nt, Homo sapiens
agggagagccagcu

SEQ ID NO: 1486351 - RNA, 19 nt, Homo sapiens
agggagcaggccggaacca

SEQ ID NO: 1486352 - RNA, 19 nt, Homo sapiens
auuacccccuccuucagac

SEQ ID NO: 1486353 - RNA, 12 nt, Homo sapiens
auuacccuccua

SEQ ID NO: 1486354 - RNA, 16 nt, Homo sapiens
auuacccugagcugca

SEQ ID NO: 1486355 - RNA, 14 nt, Homo sapiens
auuacuauaugcaa

SEQ ID NO: 1486356 - RNA, 21 nt, Homo sapiens
auuacuguugcauuuacuuuu

SEQ ID NO: 1486357 - RNA, 19 nt, Homo sapiens
auuagaaaauuuuauggac

SEQ ID NO: 1486358 - RNA, 22 nt, Homo sapiens
auuagaagccugcagaauccag

SEQ ID NO: 1486359 - RNA, 13 nt, Homo sapiens
auuagacuccucc

SEQ ID NO: 1486360 - RNA, 15 nt, Homo sapiens
auuagaugcacuuaa

SEQ ID NO: 1486361 - RNA, 21 nt, Homo sapiens
auuagaugugccaauaaccaa

SEQ ID NO: 1486362 - RNA, 22 nt, Homo sapiens
auuagauguuucaacugugcuc

SEQ ID NO: 1486363 - RNA, 22 nt, Homo sapiens
auuagcaaguuacagugaugcu

SEQ ID NO: 1486364 - RNA, 12 nt, Homo sapiens
auuagcugugau

SEQ ID NO: 1486365 - RNA, 18 nt, Homo sapiens
auuaggucccucacucca

SEQ ID NO: 1486366 - RNA, 18 nt, Homo sapiens
auuaguacuuauguugca

SEQ ID NO: 1486367 - RNA, 20 nt, Homo sapiens
auuaguacuuauguugcaca

SEQ ID NO: 1486368 - RNA, 23 nt, Homo sapiens
auuaguuaaugagccaucacuag

SEQ ID NO: 1486369 - RNA, 19 nt, Homo sapiens
auuauaaaugaaauuugca

SEQ ID NO: 1486370 - RNA, 24 nt, Homo sapiens
auuauacgcuggcaacacagaggc

SEQ ID NO: 1486371 - RNA, 23 nt, Homo sapiens
auuauauaaagggugacuuacau

SEQ ID NO: 1486372 - RNA, 20 nt, Homo sapiens
auuauauugucgaauuccua

SEQ ID NO: 1486373 - RNA, 14 nt, Homo sapiens
auuaucaagcuuuu

SEQ ID NO: 1486374 - RNA, 21 nt, Homo sapiens
auuaucccccaaaaugcauuu

SEQ ID NO: 1486375 - RNA, 21 nt, Homo sapiens
auuaucgggagcagugucuuc

SEQ ID NO: 1486376 - RNA, 15 nt, Homo sapiens
auuaucugugucaaa

SEQ ID NO: 1486377 - RNA, 18 nt, Homo sapiens
auuaucuuaugaauaagc

SEQ ID NO: 1486378 - RNA, 22 nt, Homo sapiens
auuaugaagugacucucacaag

SEQ ID NO: 1486379 - RNA, 21 nt, Homo sapiens
auuaugcauauauaaguuuac

SEQ ID NO: 1486380 - RNA, 15 nt, Homo sapiens
auuauguauguuuac

SEQ ID NO: 1486381 - RNA, 14 nt, Homo sapiens
auuauucaaaaaca

SEQ ID NO: 1486382 - RNA, 13 nt, Homo sapiens
auuauugacacug

SEQ ID NO: 1486383 - RNA, 14 nt, Homo sapiens
auuauugacacuga

SEQ ID NO: 1486384 - RNA, 14 nt, Homo sapiens
auuauuuccagugu

SEQ ID NO: 1486385 - RNA, 14 nt, Homo sapiens
auuauuucuaaucc

SEQ ID NO: 1486386 - RNA, 16 nt, Homo sapiens
auuauuuuacaaucaa

SEQ ID NO: 1486387 - RNA, 17 nt, Homo sapiens
auuauuuuacaaucaac

SEQ ID NO: 1486388 - RNA, 22 nt, Homo sapiens
auuauuuugggaagaaaaccug

SEQ ID NO: 1486389 - RNA, 20 nt, Homo sapiens
auucaaaagguuauauacca

SEQ ID NO: 1486390 - RNA, 19 nt, Homo sapiens
auucaaauugacugaagca

SEQ ID NO: 1486391 - RNA, 21 nt, Homo sapiens
auucaaauugacugaagcaaa

SEQ ID NO: 1486392 - RNA, 13 nt, Homo sapiens
auucaacaaauau

SEQ ID NO: 1486393 - RNA, 14 nt, Homo sapiens
auucaaccacugua

SEQ ID NO: 1486394 - RNA, 21 nt, Homo sapiens
auucaaggagaauaugauaaa

SEQ ID NO: 1486395 - RNA, 15 nt, Homo sapiens
auucaaguuuaguuu

SEQ ID NO: 1486396 - RNA, 23 nt, Homo sapiens
auucaaucuuuggaggcuuuuaa

SEQ ID NO: 1486397 - RNA, 18 nt, Homo sapiens
auucaaugugaacacugg

SEQ ID NO: 1486398 - RNA, 21 nt, Homo sapiens
auucaauucuuuuaacuguug

SEQ ID NO: 1486399 - RNA, 21 nt, Homo sapiens
auucacaauagaaacucacca

SEQ ID NO: 1486400 - RNA, 13 nt, Homo sapiens
auucacagaauag

SEQ ID NO: 1486401 - RNA, 19 nt, Homo sapiens
auucacagaauagcacaaa

SEQ ID NO: 1486402 - RNA, 17 nt, Homo sapiens
auucacauauaucaaag

SEQ ID NO: 1486403 - RNA, 17 nt, Homo sapiens
auuguccucuuugacua

SEQ ID NO: 1486404 - RNA, 19 nt, Homo sapiens
auugugaagcaccuacuau

SEQ ID NO: 1486405 - RNA, 15 nt, Homo sapiens
auugugagccaccac

SEQ ID NO: 1486406 - RNA, 19 nt, Homo sapiens
auugugccacuucacucca

SEQ ID NO: 1486407 - RNA, 16 nt, Homo sapiens
auugugcuucgaguga

SEQ ID NO: 1486408 - RNA, 20 nt, Homo sapiens
auugugcuucgagugacuga

SEQ ID NO: 1486409 - RNA, 12 nt, Homo sapiens
auuguggcugca

SEQ ID NO: 1486410 - RNA, 14 nt, Homo sapiens
auuguucccaguga

SEQ ID NO: 1486411 - RNA, 23 nt, Homo sapiens
auuguuugaacccgggaggcaga

SEQ ID NO: 1486412 - RNA, 16 nt, Homo sapiens
auuguuuuugaauuua

SEQ ID NO: 1486413 - RNA, 22 nt, Homo sapiens
auuuaaaauuacguuuguuauu

SEQ ID NO: 1486414 - RNA, 16 nt, Homo sapiens
auuuaaacaccuccuc

SEQ ID NO: 1486415 - RNA, 15 nt, Homo sapiens
auuuaaagccuccuc

SEQ ID NO: 1486416 - RNA, 19 nt, Homo sapiens
auuuaaagcuuacucuguc

SEQ ID NO: 1486417 - RNA, 17 nt, Homo sapiens
auuuaacagucauuuaa

SEQ ID NO: 1486418 - RNA, 20 nt, Homo sapiens
auuuaacaugaacacccuua

SEQ ID NO: 1486419 - RNA, 13 nt, Homo sapiens
auuuaagccuuau

SEQ ID NO: 1486420 - RNA, 15 nt, Homo sapiens
auuuaauuuccaggg

SEQ ID NO: 1486421 - RNA, 19 nt, Homo sapiens
auuuacaaaauuacacagu

SEQ ID NO: 1486422 - RNA, 20 nt, Homo sapiens
auuuacagaaacgcauccag

SEQ ID NO: 1486423 - RNA, 17 nt, Homo sapiens
auuuacaggaacuucau

SEQ ID NO: 1486424 - RNA, 21 nt, Homo sapiens
auuuacaugaauugcauuuua

SEQ ID NO: 1486425 - RNA, 14 nt, Homo sapiens
auuuacgcuuugau

SEQ ID NO: 1486426 - RNA, 13 nt, Homo sapiens
auuuacuggaccc

SEQ ID NO: 1486427 - RNA, 21 nt, Homo sapiens
auuuagacuuacuauuacaua

SEQ ID NO: 1486428 - RNA, 17 nt, Homo sapiens
auuuagauauaacacua

SEQ ID NO: 1486429 - RNA, 22 nt, Homo sapiens
auuuagauccugguuucauaac

SEQ ID NO: 1486430 - RNA, 13 nt, Homo sapiens
auuuagcuguaaa

SEQ ID NO: 1486431 - RNA, 19 nt, Homo sapiens
auuuaggagaagccaggaa

SEQ ID NO: 1486432 - RNA, 15 nt, Homo sapiens
auuuagucaugugac

SEQ ID NO: 1486433 - RNA, 21 nt, Homo sapiens
auuuaguuuguagcucauuaa

SEQ ID NO: 1486434 - RNA, 13 nt, Homo sapiens
auuuauaacucau

SEQ ID NO: 1486435 - RNA, 20 nt, Homo sapiens
auuuauaauaaaucaguaua

SEQ ID NO: 1486436 - RNA, 12 nt, Homo sapiens
auuuauauaugu

SEQ ID NO: 1486437 - RNA, 16 nt, Homo sapiens
auuuauaucaguuuca

SEQ ID NO: 1486438 - RNA, 12 nt, Homo sapiens
auuuaucaagga

SEQ ID NO: 1486439 - RNA, 23 nt, Homo sapiens
auuuaugaguuuuugauagcuuu

SEQ ID NO: 1486440 - RNA, 22 nt, Homo sapiens
auuuauguggcuuguuuauccu

SEQ ID NO: 1486441 - RNA, 14 nt, Homo sapiens
auuuauuaccucug

SEQ ID NO: 1486442 - RNA, 12 nt, Homo sapiens
auuuauugccuc

SEQ ID NO: 1486443 - RNA, 19 nt, Homo sapiens
auuucaaaauauacauuca

SEQ ID NO: 1486444 - RNA, 18 nt, Homo sapiens
auuucaaaccauugcucu

SEQ ID NO: 1486445 - RNA, 13 nt, Homo sapiens
auuucaacugaag

SEQ ID NO: 1486446 - RNA, 18 nt, Homo sapiens
auuucaauaaaaguaaag

SEQ ID NO: 1486447 - RNA, 13 nt, Homo sapiens
auuucacaagcua

SEQ ID NO: 1486448 - RNA, 23 nt, Homo sapiens
auuucacuugaugauacaaugaa

SEQ ID NO: 1486449 - RNA, 18 nt, Homo sapiens
auuucaguaucaucucca

SEQ ID NO: 1486450 - RNA, 18 nt, Homo sapiens
auuucaguccagaagaau

SEQ ID NO: 1486451 - RNA, 22 nt, Homo sapiens
auuucaugaaaaugacauuaaa

SEQ ID NO: 1486452 - RNA, 22 nt, Homo sapiens
auuucauguuuuugaucaaaaa

SEQ ID NO: 1486453 - RNA, 14 nt, Homo sapiens
caccugugaguuua

SEQ ID NO: 1486454 - RNA, 18 nt, Homo sapiens
caccuuaagauuuugcac

SEQ ID NO: 1486455 - RNA, 19 nt, Homo sapiens
caccuuaucuauguagaau

SEQ ID NO: 1486456 - RNA, 15 nt, Homo sapiens
caccuucaagcagcu

SEQ ID NO: 1486457 - RNA, 20 nt, Homo sapiens
caccuugaucccaauccuua

SEQ ID NO: 1486458 - RNA, 16 nt, Homo sapiens
caccuuugcacaggau

SEQ ID NO: 1486459 - RNA, 17 nt, Homo sapiens
caccuuuuauugacaca

SEQ ID NO: 1486460 - RNA, 12 nt, Homo sapiens
cacgagaucaag

SEQ ID NO: 1486461 - RNA, 18 nt, Homo sapiens
cacgcaugugugcugcag

SEQ ID NO: 1486462 - RNA, 14 nt, Homo sapiens
cacgcgaaaaccuu

SEQ ID NO: 1486463 - RNA, 21 nt, Homo sapiens
cacggccuguacggacacugu

SEQ ID NO: 1486464 - RNA, 18 nt, Homo sapiens
cacggcguuguaccugua

SEQ ID NO: 1486465 - RNA, 16 nt, Homo sapiens
cacgguagugccugaa

SEQ ID NO: 1486466 - RNA, 14 nt, Homo sapiens
cacggucacacggc

SEQ ID NO: 1486467 - RNA, 15 nt, Homo sapiens
cacguuagauuugcc

SEQ ID NO: 1486468 - RNA, 19 nt, Homo sapiens
cacuaaaccgauaaugcau

SEQ ID NO: 1486469 - RNA, 22 nt, Homo sapiens
cacuaagggguauguucccucu

SEQ ID NO: 1486470 - RNA, 13 nt, Homo sapiens
cacuaaugcuuua

SEQ ID NO: 1486471 - RNA, 20 nt, Homo sapiens
cacuacaucugggacugacu

SEQ ID NO: 1486472 - RNA, 16 nt, Homo sapiens
cacuaccguaaauguc

SEQ ID NO: 1486473 - RNA, 17 nt, Homo sapiens
cacuaccguaaaugucc

SEQ ID NO: 1486474 - RNA, 21 nt, Homo sapiens
cacuaccguaaauguccauuu

SEQ ID NO: 1486475 - RNA, 19 nt, Homo sapiens
cacuagaggaaaccaguuu

SEQ ID NO: 1486476 - RNA, 17 nt, Homo sapiens
cacuagucacauucuug

SEQ ID NO: 1486477 - RNA, 21 nt, Homo sapiens
cacuaucauggacuacaccag

SEQ ID NO: 1486478 - RNA, 19 nt, Homo sapiens
cacuaugaagauguuucaa

SEQ ID NO: 1486479 - RNA, 14 nt, Homo sapiens
cacuauguauauac

SEQ ID NO: 1486480 - RNA, 17 nt, Homo sapiens
cacuauguauauacaua

SEQ ID NO: 1486481 - RNA, 16 nt, Homo sapiens
cacucaccucacuguu

SEQ ID NO: 1486482 - RNA, 21 nt, Homo sapiens
cacucacuccacaacccaaga

SEQ ID NO: 1486483 - RNA, 13 nt, Homo sapiens
cacucagguucuu

SEQ ID NO: 1486484 - RNA, 15 nt, Homo sapiens
cacuccacucagguu

SEQ ID NO: 1486485 - RNA, 21 nt, Homo sapiens
cacuccaggauauugacaaga

SEQ ID NO: 1486486 - RNA, 15 nt, Homo sapiens
cacuccauguuugca

SEQ ID NO: 1486487 - RNA, 17 nt, Homo sapiens
cacucccucugccuuca

SEQ ID NO: 1486488 - RNA, 16 nt, Homo sapiens
cacucccuggcucuca

SEQ ID NO: 1486489 - RNA, 13 nt, Homo sapiens
cacuccugaaccc

SEQ ID NO: 1486490 - RNA, 13 nt, Homo sapiens
cacucuacccuau

SEQ ID NO: 1486491 - RNA, 19 nt, Homo sapiens
cacucuacccuauacaacu

SEQ ID NO: 1486492 - RNA, 22 nt, Homo sapiens
cacucuuaucuacauaaggaug

SEQ ID NO: 1486493 - RNA, 23 nt, Homo sapiens
cacugaaaaaucuaagugauaua

SEQ ID NO: 1486494 - RNA, 21 nt, Homo sapiens
cacugaaaaugucacauucua

SEQ ID NO: 1486495 - RNA, 17 nt, Homo sapiens
cacugaagcaccacagg

SEQ ID NO: 1486496 - RNA, 22 nt, Homo sapiens
cacugagaagucaaacauuuca

SEQ ID NO: 1486497 - RNA, 15 nt, Homo sapiens
cacugagagggcaau

SEQ ID NO: 1486498 - RNA, 10 nt, Homo sapiens
cacugagaua

SEQ ID NO: 1486499 - RNA, 13 nt, Homo sapiens
cacugauauccuc

SEQ ID NO: 1486500 - RNA, 22 nt, Homo sapiens
cacugaugcuuagauguuccag

SEQ ID NO: 1486501 - RNA, 13 nt, Homo sapiens
cacugcacuccag

SEQ ID NO: 1486502 - RNA, 14 nt, Homo sapiens
cacugcacugucug

SEQ ID NO: 1486503 - RNA, 18 nt, Homo sapiens
cacugcacugucugagaa

SEQ ID NO: 1486504 - RNA, 16 nt, Homo sapiens
cacuggaagccagaga

SEQ ID NO: 1486505 - RNA, 21 nt, Homo sapiens
cagacuguuagaaaauggaca

SEQ ID NO: 1486506 - RNA, 19 nt, Homo sapiens
cagacuucaagaccauccu

SEQ ID NO: 1486507 - RNA, 14 nt, Homo sapiens
cagacuucuccaga

SEQ ID NO: 1486508 - RNA, 13 nt, Homo sapiens
cagagaaaagagu

SEQ ID NO: 1486509 - RNA, 21 nt, Homo sapiens
cagagaaaauaauuaauuuca

SEQ ID NO: 1486510 - RNA, 16 nt, Homo sapiens
cagagaaacccaggga

SEQ ID NO: 1486511 - RNA, 17 nt, Homo sapiens
cagagaaagaagagaca

SEQ ID NO: 1486512 - RNA, 21 nt, Homo sapiens
cagagaagauucuuguauuua

SEQ ID NO: 1486513 - RNA, 18 nt, Homo sapiens
cagagaagcggauuucca

SEQ ID NO: 1486514 - RNA, 21 nt, Homo sapiens
cagagaaggaaaagacugaau

SEQ ID NO: 1486515 - RNA, 20 nt, Homo sapiens
cagagaagguaaggugugaa

SEQ ID NO: 1486516 - RNA, 21 nt, Homo sapiens
cagagaaguucuggcugaaca

SEQ ID NO: 1486517 - RNA, 14 nt, Homo sapiens
cagagaccuaugua

SEQ ID NO: 1486518 - RNA, 18 nt, Homo sapiens
cagagacugcaagcugcu

SEQ ID NO: 1486519 - RNA, 20 nt, Homo sapiens
cagagacugggaugggaaca

SEQ ID NO: 1486520 - RNA, 16 nt, Homo sapiens
cagagacugucccuga

SEQ ID NO: 1486521 - RNA, 17 nt, Homo sapiens
cagagagacagacuuga

SEQ ID NO: 1486522 - RNA, 21 nt, Homo sapiens
cagagagcagcuuuaaacuca

SEQ ID NO: 1486523 - RNA, 19 nt, Homo sapiens
cagagaggcacucagugag

SEQ ID NO: 1486524 - RNA, 17 nt, Homo sapiens
cagagaggcucugagaa

SEQ ID NO: 1486525 - RNA, 16 nt, Homo sapiens
cagagauaaagaccuu

SEQ ID NO: 1486526 - RNA, 17 nt, Homo sapiens
cagagauugaacuccaa

SEQ ID NO: 1486527 - RNA, 20 nt, Homo sapiens
cagagcagagguggaaaaac

SEQ ID NO: 1486528 - RNA, 18 nt, Homo sapiens
cagagcaggaagcauuca

SEQ ID NO: 1486529 - RNA, 23 nt, Homo sapiens
cagagcaggaagcauucagagag

SEQ ID NO: 1486530 - RNA, 23 nt, Homo sapiens
cagagcauuuccaacaccacaga

SEQ ID NO: 1486531 - RNA, 21 nt, Homo sapiens
cagagccaccugacucuugca

SEQ ID NO: 1486532 - RNA, 22 nt, Homo sapiens
cagagcccugugucuguauaca

SEQ ID NO: 1486533 - RNA, 22 nt, Homo sapiens
cagagccguggccacccaggaa

SEQ ID NO: 1486534 - RNA, 20 nt, Homo sapiens
cagagcgccaggaagccaga

SEQ ID NO: 1486535 - RNA, 21 nt, Homo sapiens
cagagcgccaggaagccagag

SEQ ID NO: 1486536 - RNA, 21 nt, Homo sapiens
cagagcucuggguugugcaca

SEQ ID NO: 1486537 - RNA, 21 nt, Homo sapiens
cagagcuguggaggauugcua

SEQ ID NO: 1486538 - RNA, 19 nt, Homo sapiens
cagaggaacuguccagaga

SEQ ID NO: 1486539 - RNA, 23 nt, Homo sapiens
cagaggaauaacaucaccacugu

SEQ ID NO: 1486540 - RNA, 20 nt, Homo sapiens
cagaggaauuuauaccucaa

SEQ ID NO: 1486541 - RNA, 13 nt, Homo sapiens
cagaggagccaug

SEQ ID NO: 1486542 - RNA, 23 nt, Homo sapiens
cagaggagcggccagaagaucua

SEQ ID NO: 1486543 - RNA, 20 nt, Homo sapiens
cagaggaggggaaaguccag

SEQ ID NO: 1486544 - RNA, 23 nt, Homo sapiens
cagaggaggggaaaguccagggc

SEQ ID NO: 1486545 - RNA, 20 nt, Homo sapiens
cagaggauaaggaggcacug

SEQ ID NO: 1486546 - RNA, 21 nt, Homo sapiens
cagaggcagcucgugugccug

SEQ ID NO: 1486547 - RNA, 19 nt, Homo sapiens
cagaggcaguaaccaugcc

SEQ ID NO: 1486548 - RNA, 15 nt, Homo sapiens
cagaggccauggcag

SEQ ID NO: 1486549 - RNA, 14 nt, Homo sapiens
cagaggcccugugg

SEQ ID NO: 1486550 - RNA, 21 nt, Homo sapiens
cagaggcgcccuggguggugg

SEQ ID NO: 1486551 - RNA, 23 nt, Homo sapiens
cagagggaaaguaaauauuucag

SEQ ID NO: 1486552 - RNA, 23 nt, Homo sapiens
cagagggccccgcccagugcagu

SEQ ID NO: 1486553 - RNA, 19 nt, Homo sapiens
cagagggggaguagccaag

SEQ ID NO: 1486554 - RNA, 21 nt, Homo sapiens
cagcugugcacuuucuucucu

SEQ ID NO: 1486555 - RNA, 18 nt, Homo sapiens
cagcugugggacaauuau

SEQ ID NO: 1486556 - RNA, 23 nt, Homo sapiens
cagcugugugggucauaccgugu

SEQ ID NO: 1486557 - RNA, 12 nt, Homo sapiens
cagcuuaucucu

SEQ ID NO: 1486558 - RNA, 16 nt, Homo sapiens
cagcuucaagugccuu

SEQ ID NO: 1486559 - RNA, 20 nt, Homo sapiens
cagcuucaccagagcauuuc

SEQ ID NO: 1486560 - RNA, 21 nt, Homo sapiens
cagcuucaccagagcauuucc

SEQ ID NO: 1486561 - RNA, 20 nt, Homo sapiens
cagcuucaggcaccagcauc

SEQ ID NO: 1486562 - RNA, 13 nt, Homo sapiens
cagcuucagguua

SEQ ID NO: 1486563 - RNA, 23 nt, Homo sapiens
cagcuucuggggguagaucucaa

SEQ ID NO: 1486564 - RNA, 18 nt, Homo sapiens
cagcuuugggguuccuuu

SEQ ID NO: 1486565 - RNA, 23 nt, Homo sapiens
caggaaaauuguuugaacccagg

SEQ ID NO: 1486566 - RNA, 20 nt, Homo sapiens
caggaaaguuuacccaugaa

SEQ ID NO: 1486567 - RNA, 15 nt, Homo sapiens
caggaacucccagca

SEQ ID NO: 1486568 - RNA, 17 nt, Homo sapiens
caggaagcucucuuaaa

SEQ ID NO: 1486569 - RNA, 15 nt, Homo sapiens
caggaagguagaaau

SEQ ID NO: 1486570 - RNA, 18 nt, Homo sapiens
caggaagucuucagggaa

SEQ ID NO: 1486571 - RNA, 16 nt, Homo sapiens
caggaauguguggccu

SEQ ID NO: 1486572 - RNA, 23 nt, Homo sapiens
caggaauuaugucguaagucacu

SEQ ID NO: 1486573 - RNA, 20 nt, Homo sapiens
caggacaacuuuacaaaaca

SEQ ID NO: 1486574 - RNA, 15 nt, Homo sapiens
caggacagguggugc

SEQ ID NO: 1486575 - RNA, 12 nt, Homo sapiens
caggaccaauaa

SEQ ID NO: 1486576 - RNA, 14 nt, Homo sapiens
caggacgcccucac

SEQ ID NO: 1486577 - RNA, 20 nt, Homo sapiens
caggacugggugguccaaag

SEQ ID NO: 1486578 - RNA, 20 nt, Homo sapiens
caggacuugagaagaccuca

SEQ ID NO: 1486579 - RNA, 21 nt, Homo sapiens
caggagauuccagucuacuug

SEQ ID NO: 1486580 - RNA, 16 nt, Homo sapiens
caggagcaguuugcca

SEQ ID NO: 1486581 - RNA, 18 nt, Homo sapiens
caggagcaguuugccacc

SEQ ID NO: 1486582 - RNA, 18 nt, Homo sapiens
caggagcugauggcagcu

SEQ ID NO: 1486583 - RNA, 22 nt, Homo sapiens
caggaggccaauaaaaaguuca

SEQ ID NO: 1486584 - RNA, 23 nt, Homo sapiens
caggagggcagaccacauugcuu

SEQ ID NO: 1486585 - RNA, 21 nt, Homo sapiens
caggagggguuaaagcugccg

SEQ ID NO: 1486586 - RNA, 23 nt, Homo sapiens
caggagguggaggcugcagugag

SEQ ID NO: 1486587 - RNA, 17 nt, Homo sapiens
caggaguaccuggaccu

SEQ ID NO: 1486588 - RNA, 23 nt, Homo sapiens
caggaguucucccaccaccucac

SEQ ID NO: 1486589 - RNA, 12 nt, Homo sapiens
caggaugacccc

SEQ ID NO: 1486590 - RNA, 18 nt, Homo sapiens
caggaugaguuacuugaa

SEQ ID NO: 1486591 - RNA, 20 nt, Homo sapiens
caggauggucucgaucuccu

SEQ ID NO: 1486592 - RNA, 12 nt, Homo sapiens
caggauucauug

SEQ ID NO: 1486593 - RNA, 17 nt, Homo sapiens
caggauucucaccagcu

SEQ ID NO: 1486594 - RNA, 15 nt, Homo sapiens
caggcacacacagcc

SEQ ID NO: 1486595 - RNA, 18 nt, Homo sapiens
caggcacacagcuacucu

SEQ ID NO: 1486596 - RNA, 19 nt, Homo sapiens
caggcacagguccccagau

SEQ ID NO: 1486597 - RNA, 16 nt, Homo sapiens
caggcacccucaggga

SEQ ID NO: 1486598 - RNA, 15 nt, Homo sapiens
caggcagauccagga

SEQ ID NO: 1486599 - RNA, 13 nt, Homo sapiens
caggcagcucaag

SEQ ID NO: 1486600 - RNA, 18 nt, Homo sapiens
caggcauagaggcuucuc

SEQ ID NO: 1486601 - RNA, 14 nt, Homo sapiens
caggcauugaggaa

SEQ ID NO: 1486602 - RNA, 22 nt, Homo sapiens
caggcauuuguucacugaaggu

SEQ ID NO: 1486603 - RNA, 14 nt, Homo sapiens
caggccaccaggau

SEQ ID NO: 1486604 - RNA, 12 nt, Homo sapiens
caggcccauuca

SEQ ID NO: 1486605 - RNA, 23 nt, Homo sapiens
caggccgagagcagacaccagca

SEQ ID NO: 1486606 - RNA, 21 nt, Homo sapiens
caggccgcauccugaacugcu

SEQ ID NO: 1486607 - RNA, 19 nt, Homo sapiens
caggccggaaccacagggc

SEQ ID NO: 1486608 - RNA, 18 nt, Homo sapiens
caggccgggguggagcau

SEQ ID NO: 1486609 - RNA, 19 nt, Homo sapiens
caggccgugugucugucag

SEQ ID NO: 1486610 - RNA, 18 nt, Homo sapiens
caggcugagugagccaca

SEQ ID NO: 1486611 - RNA, 18 nt, Homo sapiens
caggcugggccaugucca

SEQ ID NO: 1486612 - RNA, 19 nt, Homo sapiens
caggcugggccauguccaa

SEQ ID NO: 1486613 - RNA, 22 nt, Homo sapiens
caggcugggccauguccaaaga

SEQ ID NO: 1486614 - RNA, 22 nt, Homo sapiens
caggcuguucuccaggcuucac

SEQ ID NO: 1486615 - RNA, 17 nt, Homo sapiens
caggcuuaugaauauau

SEQ ID NO: 1486616 - RNA, 15 nt, Homo sapiens
caggcuucacagucu

SEQ ID NO: 1486617 - RNA, 22 nt, Homo sapiens
cagggaauccagccaugacccc

SEQ ID NO: 1486618 - RNA, 23 nt, Homo sapiens
cagggaauggagcucagguccca

SEQ ID NO: 1486619 - RNA, 17 nt, Homo sapiens
cagggaccguccagggg

SEQ ID NO: 1486620 - RNA, 20 nt, Homo sapiens
cagggacuccaugcugccag

SEQ ID NO: 1486621 - RNA, 17 nt, Homo sapiens
cagggagggaaguguga

SEQ ID NO: 1486622 - RNA, 15 nt, Homo sapiens
cagggaguccagggu

SEQ ID NO: 1486623 - RNA, 13 nt, Homo sapiens
cagggaucuugca

SEQ ID NO: 1486624 - RNA, 14 nt, Homo sapiens
cagggcaaucaaug

SEQ ID NO: 1486625 - RNA, 17 nt, Homo sapiens
cagggcagcauuuucau

SEQ ID NO: 1486626 - RNA, 22 nt, Homo sapiens
cagggcagcauuuucauaucca

SEQ ID NO: 1486627 - RNA, 13 nt, Homo sapiens
cagggccaacuug

SEQ ID NO: 1486628 - RNA, 14 nt, Homo sapiens
cagggccacuggaa

SEQ ID NO: 1486629 - RNA, 13 nt, Homo sapiens
cagggccaguccu

SEQ ID NO: 1486630 - RNA, 15 nt, Homo sapiens
cagggccaguccucc

SEQ ID NO: 1486631 - RNA, 16 nt, Homo sapiens
cagggcccaccccagc

SEQ ID NO: 1486632 - RNA, 14 nt, Homo sapiens
cagggcccagugac

SEQ ID NO: 1486633 - RNA, 20 nt, Homo sapiens
cagggcgagacuccgucuca

SEQ ID NO: 1486634 - RNA, 21 nt, Homo sapiens
cagggcucgggagccauguca

SEQ ID NO: 1486635 - RNA, 17 nt, Homo sapiens
cagggcuggcucugcac

SEQ ID NO: 1486636 - RNA, 16 nt, Homo sapiens
cagggcugguuuguuc

SEQ ID NO: 1486637 - RNA, 18 nt, Homo sapiens
cagggggagaaacccuuc

SEQ ID NO: 1486638 - RNA, 22 nt, Homo sapiens
cagggggauucugagcagugcc

SEQ ID NO: 1486639 - RNA, 23 nt, Homo sapiens
cagggguggggguggaggcuucc

SEQ ID NO: 1486640 - RNA, 16 nt, Homo sapiens
cagggucugugugaau

SEQ ID NO: 1486641 - RNA, 17 nt, Homo sapiens
cagggucuugcucuguc

SEQ ID NO: 1486642 - RNA, 12 nt, Homo sapiens
cagggugagcuc

SEQ ID NO: 1486643 - RNA, 14 nt, Homo sapiens
cagggugucccagg

SEQ ID NO: 1486644 - RNA, 15 nt, Homo sapiens
caggguuaucugcaa

SEQ ID NO: 1486645 - RNA, 15 nt, Homo sapiens
caggguucucuuagc

SEQ ID NO: 1486646 - RNA, 13 nt, Homo sapiens
caggguuuuuacc

SEQ ID NO: 1486647 - RNA, 13 nt, Homo sapiens
caggguuuuuaga

SEQ ID NO: 1486648 - RNA, 13 nt, Homo sapiens
cagguaccucaug

SEQ ID NO: 1486649 - RNA, 12 nt, Homo sapiens
cagguccuccau

SEQ ID NO: 1486650 - RNA, 22 nt, Homo sapiens
cagguccucuacuuaaugagau

SEQ ID NO: 1486651 - RNA, 20 nt, Homo sapiens
cagguccuuuccacccugag

SEQ ID NO: 1486652 - RNA, 21 nt, Homo sapiens
caggucucacgggcaugggca

SEQ ID NO: 1486653 - RNA, 21 nt, Homo sapiens
caggucuugacucauggcagc

SEQ ID NO: 1486654 - RNA, 22 nt, Homo sapiens
caggucuugacucauggcagcu

SEQ ID NO: 1486655 - RNA, 12 nt, Homo sapiens
cauaaagaucaa

SEQ ID NO: 1486656 - RNA, 12 nt, Homo sapiens
cauaaaucacaa

SEQ ID NO: 1486657 - RNA, 13 nt, Homo sapiens
cauaaaucacaaa

SEQ ID NO: 1486658 - RNA, 14 nt, Homo sapiens
cauaaaugaaucau

SEQ ID NO: 1486659 - RNA, 12 nt, Homo sapiens
cauaacugccuu

SEQ ID NO: 1486660 - RNA, 20 nt, Homo sapiens
cauaagccuccauuuaguuc

SEQ ID NO: 1486661 - RNA, 22 nt, Homo sapiens
cauaaguauacaguucaauaaa

SEQ ID NO: 1486662 - RNA, 12 nt, Homo sapiens
cauaauacauga

SEQ ID NO: 1486663 - RNA, 22 nt, Homo sapiens
cauaauagucaauuucuacuuc

SEQ ID NO: 1486664 - RNA, 16 nt, Homo sapiens
cauaauccuuucugcc

SEQ ID NO: 1486665 - RNA, 18 nt, Homo sapiens
cauaauggauucacugag

SEQ ID NO: 1486666 - RNA, 18 nt, Homo sapiens
cauaauguuacauuauua

SEQ ID NO: 1486667 - RNA, 16 nt, Homo sapiens
cauaauucagcacuua

SEQ ID NO: 1486668 - RNA, 17 nt, Homo sapiens
cauaauucagcacuuaa

SEQ ID NO: 1486669 - RNA, 15 nt, Homo sapiens
cauaauucuaaguua

SEQ ID NO: 1486670 - RNA, 21 nt, Homo sapiens
cauaauuuucuucaugcaaug

SEQ ID NO: 1486671 - RNA, 15 nt, Homo sapiens
cauacacagaaacca

SEQ ID NO: 1486672 - RNA, 18 nt, Homo sapiens
cauacagguuaaccugca

SEQ ID NO: 1486673 - RNA, 15 nt, Homo sapiens
cauacauauuaucuc

SEQ ID NO: 1486674 - RNA, 14 nt, Homo sapiens
cauacaugcauaca

SEQ ID NO: 1486675 - RNA, 22 nt, Homo sapiens
cauacauucccucuaauuugaa

SEQ ID NO: 1486676 - RNA, 17 nt, Homo sapiens
cauacccacacacccag

SEQ ID NO: 1486677 - RNA, 18 nt, Homo sapiens
cauaccccacugggcaca

SEQ ID NO: 1486678 - RNA, 17 nt, Homo sapiens
cauacucugcuuagaau

SEQ ID NO: 1486679 - RNA, 18 nt, Homo sapiens
cauacuggccuggacugu

SEQ ID NO: 1486680 - RNA, 13 nt, Homo sapiens
cauacuuaucucu

SEQ ID NO: 1486681 - RNA, 23 nt, Homo sapiens
cauagaaaaauucagcaaaccau

SEQ ID NO: 1486682 - RNA, 13 nt, Homo sapiens
cauagaggcuucu

SEQ ID NO: 1486683 - RNA, 16 nt, Homo sapiens
cauagccauggaaccc

SEQ ID NO: 1486684 - RNA, 14 nt, Homo sapiens
cauagcugaucaug

SEQ ID NO: 1486685 - RNA, 15 nt, Homo sapiens
cauaggaauugcaca

SEQ ID NO: 1486686 - RNA, 16 nt, Homo sapiens
cauaggacauacugca

SEQ ID NO: 1486687 - RNA, 19 nt, Homo sapiens
cauaggcgcaggugcacag

SEQ ID NO: 1486688 - RNA, 14 nt, Homo sapiens
cauaggcucuuaag

SEQ ID NO: 1486689 - RNA, 20 nt, Homo sapiens
cauagguauauauaugccau

SEQ ID NO: 1486690 - RNA, 13 nt, Homo sapiens
cauaguaauuuca

SEQ ID NO: 1486691 - RNA, 15 nt, Homo sapiens
cauaguaauuucacu

SEQ ID NO: 1486692 - RNA, 22 nt, Homo sapiens
cauagugaccaacauagugaaa

SEQ ID NO: 1486693 - RNA, 15 nt, Homo sapiens
cauaguuuauuucaa

SEQ ID NO: 1486694 - RNA, 22 nt, Homo sapiens
cauauaacuaagacauaugcau

SEQ ID NO: 1486695 - RNA, 13 nt, Homo sapiens
cauauaccagcaa

SEQ ID NO: 1486696 - RNA, 16 nt, Homo sapiens
cauauaccaucuccag

SEQ ID NO: 1486697 - RNA, 16 nt, Homo sapiens
cauauagaaugcagag

SEQ ID NO: 1486698 - RNA, 19 nt, Homo sapiens
cauauaggugauguuugcu

SEQ ID NO: 1486699 - RNA, 17 nt, Homo sapiens
cauauauaaguuuacac

SEQ ID NO: 1486700 - RNA, 16 nt, Homo sapiens
cauauauauuaauacu

SEQ ID NO: 1486701 - RNA, 15 nt, Homo sapiens
cauauaugaccagaa

SEQ ID NO: 1486702 - RNA, 21 nt, Homo sapiens
cauaucccuuccucucaggcu

SEQ ID NO: 1486703 - RNA, 16 nt, Homo sapiens
cauaugacuugaucuu

SEQ ID NO: 1486704 - RNA, 22 nt, Homo sapiens
cauaugaggacgaggaguaaug

SEQ ID NO: 1486705 - RNA, 18 nt, Homo sapiens
cauaugaucuguuuugua

SEQ ID NO: 1486706 - RNA, 18 nt, Homo sapiens
cauaugcaaaauacugua

SEQ ID NO: 1486707 - RNA, 12 nt, Homo sapiens
cccccagcacuu

SEQ ID NO: 1486708 - RNA, 13 nt, Homo sapiens
cccccaguguaau

SEQ ID NO: 1486709 - RNA, 17 nt, Homo sapiens
ccccccaacuccaggaa

SEQ ID NO: 1486710 - RNA, 14 nt, Homo sapiens
cccccuggagagaa

SEQ ID NO: 1486711 - RNA, 16 nt, Homo sapiens
cccccuguucuaaggg

SEQ ID NO: 1486712 - RNA, 22 nt, Homo sapiens
ccccgucucuauaccaaccaaa

SEQ ID NO: 1486713 - RNA, 14 nt, Homo sapiens
ccccuacagaauuu

SEQ ID NO: 1486714 - RNA, 15 nt, Homo sapiens
ccccucacucuguca

SEQ ID NO: 1486715 - RNA, 13 nt, Homo sapiens
ccccucaucucau

SEQ ID NO: 1486716 - RNA, 20 nt, Homo sapiens
ccccucauuguuuauuaaca

SEQ ID NO: 1486717 - RNA, 21 nt, Homo sapiens
ccccucccaucauuacccuuc

SEQ ID NO: 1486718 - RNA, 15 nt, Homo sapiens
ccccucccccaucuc

SEQ ID NO: 1486719 - RNA, 15 nt, Homo sapiens
ccccuccuccaggga

SEQ ID NO: 1486720 - RNA, 13 nt, Homo sapiens
ccccucucaccaa

SEQ ID NO: 1486721 - RNA, 15 nt, Homo sapiens
ccccucuucugcuaa

SEQ ID NO: 1486722 - RNA, 18 nt, Homo sapiens
ccccugcuccaccagcag

SEQ ID NO: 1486723 - RNA, 17 nt, Homo sapiens
ccccuggcugugcucua

SEQ ID NO: 1486724 - RNA, 14 nt, Homo sapiens
ccccuggcuuuuca

SEQ ID NO: 1486725 - RNA, 14 nt, Homo sapiens
ccccuguaccuuuu

SEQ ID NO: 1486726 - RNA, 23 nt, Homo sapiens
ccccugucauccucaugcugcuc

SEQ ID NO: 1486727 - RNA, 15 nt, Homo sapiens
ccccuucggcagcua

SEQ ID NO: 1486728 - RNA, 14 nt, Homo sapiens
ccccuuggcuguga

SEQ ID NO: 1486729 - RNA, 14 nt, Homo sapiens
ccccuugggugacc

SEQ ID NO: 1486730 - RNA, 17 nt, Homo sapiens
cccgaaacuaagccagg

SEQ ID NO: 1486731 - RNA, 15 nt, Homo sapiens
cccgcaucaagguca

SEQ ID NO: 1486732 - RNA, 20 nt, Homo sapiens
cccgccagagggcuugugaa

SEQ ID NO: 1486733 - RNA, 22 nt, Homo sapiens
cccggccagcgggcacagggca

SEQ ID NO: 1486734 - RNA, 23 nt, Homo sapiens
cccgggacgcagggguugcagug

SEQ ID NO: 1486735 - RNA, 21 nt, Homo sapiens
cccgggccagggcugccccua

SEQ ID NO: 1486736 - RNA, 16 nt, Homo sapiens
cccggggccagcacuu

SEQ ID NO: 1486737 - RNA, 17 nt, Homo sapiens
cccggggcuggugggcc

SEQ ID NO: 1486738 - RNA, 18 nt, Homo sapiens
cccgucgaggggcucuca

SEQ ID NO: 1486739 - RNA, 22 nt, Homo sapiens
cccgucucuauaccaaccaaac

SEQ ID NO: 1486740 - RNA, 18 nt, Homo sapiens
cccuaagcgcacauucau

SEQ ID NO: 1486741 - RNA, 20 nt, Homo sapiens
cccuacacacacacucccug

SEQ ID NO: 1486742 - RNA, 11 nt, Homo sapiens
cccuacaugga

SEQ ID NO: 1486743 - RNA, 22 nt, Homo sapiens
cccuaccccagggcccuggcca

SEQ ID NO: 1486744 - RNA, 18 nt, Homo sapiens
cccuacuauucaguggcg

SEQ ID NO: 1486745 - RNA, 12 nt, Homo sapiens
cccuacugggag

SEQ ID NO: 1486746 - RNA, 16 nt, Homo sapiens
cccuagccaauucaca

SEQ ID NO: 1486747 - RNA, 13 nt, Homo sapiens
cccuagcugaccc

SEQ ID NO: 1486748 - RNA, 18 nt, Homo sapiens
cccuaucuccuucccacc

SEQ ID NO: 1486749 - RNA, 14 nt, Homo sapiens
cccucaaaucugag

SEQ ID NO: 1486750 - RNA, 21 nt, Homo sapiens
cccucaccuguagcagccagu

SEQ ID NO: 1486751 - RNA, 15 nt, Homo sapiens
cccucacuguugaau

SEQ ID NO: 1486752 - RNA, 17 nt, Homo sapiens
cccucaggcucugugga

SEQ ID NO: 1486753 - RNA, 11 nt, Homo sapiens
cccucagggau

SEQ ID NO: 1486754 - RNA, 19 nt, Homo sapiens
cccucaucgggccucuggg

SEQ ID NO: 1486755 - RNA, 17 nt, Homo sapiens
cccucaucuaugaggaa

SEQ ID NO: 1486756 - RNA, 18 nt, Homo sapiens
cccuccaaaccuccagcc

SEQ ID NO: 1486757 - RNA, 14 nt, Homo sapiens
cccuccacauccca

SEQ ID NO: 1486758 - RNA, 15 nt, Homo sapiens
cccuccaccuuccau

SEQ ID NO: 1486759 - RNA, 14 nt, Homo sapiens
cccuccgaccacuu

SEQ ID NO: 1486760 - RNA, 18 nt, Homo sapiens
cccuccuggcucuugaua

SEQ ID NO: 1486761 - RNA, 19 nt, Homo sapiens
cccucgggccccauccuca

SEQ ID NO: 1486762 - RNA, 13 nt, Homo sapiens
cccugaauucuuc

SEQ ID NO: 1486763 - RNA, 19 nt, Homo sapiens
cccugaccucacugugacc

SEQ ID NO: 1486764 - RNA, 22 nt, Homo sapiens
cccugaccugugagcccagcug

SEQ ID NO: 1486765 - RNA, 15 nt, Homo sapiens
cccugacucaucauu

SEQ ID NO: 1486766 - RNA, 15 nt, Homo sapiens
cccugauugaccugc

SEQ ID NO: 1486767 - RNA, 21 nt, Homo sapiens
cccugcagggcuggucagggu

SEQ ID NO: 1486768 - RNA, 17 nt, Homo sapiens
cccugcauuucugaguu

SEQ ID NO: 1486769 - RNA, 14 nt, Homo sapiens
cccugccacucuca

SEQ ID NO: 1486770 - RNA, 11 nt, Homo sapiens
cccugccuugu

SEQ ID NO: 1486771 - RNA, 20 nt, Homo sapiens
cccugcgcaugaaccuggac

SEQ ID NO: 1486772 - RNA, 20 nt, Homo sapiens
cccugcuccacgaagccuua

SEQ ID NO: 1486773 - RNA, 14 nt, Homo sapiens
cccugcucuugcag

SEQ ID NO: 1486774 - RNA, 13 nt, Homo sapiens
cccugcugaccuc

SEQ ID NO: 1486775 - RNA, 22 nt, Homo sapiens
cccugcugaccucccagugacc

SEQ ID NO: 1486776 - RNA, 16 nt, Homo sapiens
cccugcuugcacuuug

SEQ ID NO: 1486777 - RNA, 14 nt, Homo sapiens
cccugcuuugcaaa

SEQ ID NO: 1486778 - RNA, 15 nt, Homo sapiens
cccuggcccaucuca

SEQ ID NO: 1486779 - RNA, 21 nt, Homo sapiens
cccuggcugaccccaaagagc

SEQ ID NO: 1486780 - RNA, 13 nt, Homo sapiens
cccuggggcacuu

SEQ ID NO: 1486781 - RNA, 20 nt, Homo sapiens
cccugggguggccaccagua

SEQ ID NO: 1486782 - RNA, 19 nt, Homo sapiens
cccuguagacuagugccgu

SEQ ID NO: 1486783 - RNA, 15 nt, Homo sapiens
cccugucccaugcag

SEQ ID NO: 1486784 - RNA, 17 nt, Homo sapiens
cccugucucuacuaaaa

SEQ ID NO: 1486785 - RNA, 18 nt, Homo sapiens
cccuguggcccuggccac

SEQ ID NO: 1486786 - RNA, 23 nt, Homo sapiens
cccugugguccccgagacacagg

SEQ ID NO: 1486787 - RNA, 15 nt, Homo sapiens
cccugugucauuuca

SEQ ID NO: 1486788 - RNA, 20 nt, Homo sapiens
cccugugucauuucaaacag

SEQ ID NO: 1486789 - RNA, 20 nt, Homo sapiens
cccuguguccaccugugggu

SEQ ID NO: 1486790 - RNA, 21 nt, Homo sapiens
cccuuaaacauuggacaguga

SEQ ID NO: 1486791 - RNA, 14 nt, Homo sapiens
cccuuagugacucu

SEQ ID NO: 1486792 - RNA, 17 nt, Homo sapiens
cccuuauaauuggugca

SEQ ID NO: 1486793 - RNA, 12 nt, Homo sapiens
cccuucacccca

SEQ ID NO: 1486794 - RNA, 15 nt, Homo sapiens
cccuucccugcacua

SEQ ID NO: 1486795 - RNA, 13 nt, Homo sapiens
cccuugcagcuag

SEQ ID NO: 1486796 - RNA, 14 nt, Homo sapiens
cccuugccacccca

SEQ ID NO: 1486797 - RNA, 19 nt, Homo sapiens
cccuugcugaacacacaca

SEQ ID NO: 1486798 - RNA, 22 nt, Homo sapiens
cccuugcuguaugcugaucauc

SEQ ID NO: 1486799 - RNA, 22 nt, Homo sapiens
cccuuggaauaaaaacauuucu

SEQ ID NO: 1486800 - RNA, 15 nt, Homo sapiens
cccuuggcugugagg

SEQ ID NO: 1486801 - RNA, 21 nt, Homo sapiens
cccuuuacagcaccaccuugc

SEQ ID NO: 1486802 - RNA, 22 nt, Homo sapiens
cccuuuauuacaagaaggaaca

SEQ ID NO: 1486803 - RNA, 19 nt, Homo sapiens
cccuuuccuacucucagga

SEQ ID NO: 1486804 - RNA, 21 nt, Homo sapiens
cccuuuccuccucaggcacac

SEQ ID NO: 1486805 - RNA, 19 nt, Homo sapiens
cccuuugaagccucagcua

SEQ ID NO: 1486806 - RNA, 21 nt, Homo sapiens
cccuuuggagaacgccagucu

SEQ ID NO: 1486807 - RNA, 15 nt, Homo sapiens
cccuuuucucaggac

SEQ ID NO: 1486808 - RNA, 19 nt, Homo sapiens
cccuuuuucuccagcuggg

SEQ ID NO: 1486809 - RNA, 22 nt, Homo sapiens
auucaccaaaauagucuucuca

SEQ ID NO: 1486810 - RNA, 15 nt, Homo sapiens
auucaccuauguuau

SEQ ID NO: 1486811 - RNA, 23 nt, Homo sapiens
auucacuuauggcagaggaauau

SEQ ID NO: 1486812 - RNA, 17 nt, Homo sapiens
auucagaguccuugcaa

SEQ ID NO: 1486813 - RNA, 20 nt, Homo sapiens
auucagauggcaauuucacu

SEQ ID NO: 1486814 - RNA, 18 nt, Homo sapiens
auucagcgggagcacugc

SEQ ID NO: 1486815 - RNA, 16 nt, Homo sapiens
auucaggauuacaugc

SEQ ID NO: 1486816 - RNA, 17 nt, Homo sapiens
auucaggcaacgcacaa

SEQ ID NO: 1486817 - RNA, 15 nt, Homo sapiens
auucagucucugugu

SEQ ID NO: 1486818 - RNA, 17 nt, Homo sapiens
auucagugauuacuguc

SEQ ID NO: 1486819 - RNA, 17 nt, Homo sapiens
auucaguuuucauuugg

SEQ ID NO: 1486820 - RNA, 21 nt, Homo sapiens
auucauaaaaacugcuuacuu

SEQ ID NO: 1486821 - RNA, 17 nt, Homo sapiens
auucauauuuacuucuu

SEQ ID NO: 1486822 - RNA, 22 nt, Homo sapiens
auucauauuuacuucuuauaca

SEQ ID NO: 1486823 - RNA, 18 nt, Homo sapiens
auucauccuuccauccau

SEQ ID NO: 1486824 - RNA, 22 nt, Homo sapiens
auucaugugggcauuucuugcg

SEQ ID NO: 1486825 - RNA, 16 nt, Homo sapiens
auucauuagcugugau

SEQ ID NO: 1486826 - RNA, 22 nt, Homo sapiens
auucauuauuuuuccacuuugu

SEQ ID NO: 1486827 - RNA, 12 nt, Homo sapiens
auucauucucau

SEQ ID NO: 1486828 - RNA, 22 nt, Homo sapiens
auucauugaucaaauauuucaa

SEQ ID NO: 1486829 - RNA, 14 nt, Homo sapiens
auucauuguucaaa

SEQ ID NO: 1486830 - RNA, 18 nt, Homo sapiens
auucauuuucaucacugg

SEQ ID NO: 1486831 - RNA, 20 nt, Homo sapiens
auucauuuuuuucacuggag

SEQ ID NO: 1486832 - RNA, 14 nt, Homo sapiens
auuccacuccacuc

SEQ ID NO: 1486833 - RNA, 18 nt, Homo sapiens
auuccacuccacucaggu

SEQ ID NO: 1486834 - RNA, 23 nt, Homo sapiens
auuccagcugucacucugugccu

SEQ ID NO: 1486835 - RNA, 20 nt, Homo sapiens
auuccaggggucguuugcuu

SEQ ID NO: 1486836 - RNA, 12 nt, Homo sapiens
auuccaguauca

SEQ ID NO: 1486837 - RNA, 16 nt, Homo sapiens
auuccagucauuuugg

SEQ ID NO: 1486838 - RNA, 13 nt, Homo sapiens
auucccaccaagg

SEQ ID NO: 1486839 - RNA, 19 nt, Homo sapiens
auucccuaucuuuuaguuu

SEQ ID NO: 1486840 - RNA, 13 nt, Homo sapiens
auucccuccauuu

SEQ ID NO: 1486841 - RNA, 14 nt, Homo sapiens
auuccgauacaaag

SEQ ID NO: 1486842 - RNA, 14 nt, Homo sapiens
auuccgucuuaaaa

SEQ ID NO: 1486843 - RNA, 14 nt, Homo sapiens
auuccuacaaagau

SEQ ID NO: 1486844 - RNA, 19 nt, Homo sapiens
auuccuauauccugugacu

SEQ ID NO: 1486845 - RNA, 13 nt, Homo sapiens
auuccugauaaua

SEQ ID NO: 1486846 - RNA, 20 nt, Homo sapiens
auuccugauaauaauugauc

SEQ ID NO: 1486847 - RNA, 19 nt, Homo sapiens
auuccuuagacucuuuucc

SEQ ID NO: 1486848 - RNA, 15 nt, Homo sapiens
auuccuuagucucaa

SEQ ID NO: 1486849 - RNA, 16 nt, Homo sapiens
auuccuucucugaaca

SEQ ID NO: 1486850 - RNA, 21 nt, Homo sapiens
auucgcccuccucccugucau

SEQ ID NO: 1486851 - RNA, 16 nt, Homo sapiens
auucuaacaagucaua

SEQ ID NO: 1486852 - RNA, 19 nt, Homo sapiens
auucuaagcccuuugccau

SEQ ID NO: 1486853 - RNA, 21 nt, Homo sapiens
auucuacuuuaagcacuacau

SEQ ID NO: 1486854 - RNA, 17 nt, Homo sapiens
auucuagaaacaggaaa

SEQ ID NO: 1486855 - RNA, 15 nt, Homo sapiens
auucuaucaagccca

SEQ ID NO: 1486856 - RNA, 13 nt, Homo sapiens
auucucaccagga

SEQ ID NO: 1486857 - RNA, 20 nt, Homo sapiens
auucucccaaaguaccuuga

SEQ ID NO: 1486858 - RNA, 21 nt, Homo sapiens
auucucccaaaguaccuugaa

SEQ ID NO: 1486859 - RNA, 20 nt, Homo sapiens
ccuaaucaggcugagguguc

SEQ ID NO: 1486860 - RNA, 20 nt, Homo sapiens
ccuaauucaauccuacuuuu

SEQ ID NO: 1486861 - RNA, 22 nt, Homo sapiens
ccuacaaccaucccugccacau

SEQ ID NO: 1486862 - RNA, 19 nt, Homo sapiens
ccuacacccagaccccagg

SEQ ID NO: 1486863 - RNA, 15 nt, Homo sapiens
ccuacagggccacaa

SEQ ID NO: 1486864 - RNA, 21 nt, Homo sapiens
ccuacauguauugcacauugu

SEQ ID NO: 1486865 - RNA, 13 nt, Homo sapiens
ccuacauuaucuc

SEQ ID NO: 1486866 - RNA, 20 nt, Homo sapiens
ccuacauuaucucacuuagu

SEQ ID NO: 1486867 - RNA, 15 nt, Homo sapiens
ccuaccacagugucu

SEQ ID NO: 1486868 - RNA, 15 nt, Homo sapiens
ccuacugaaugcucu

SEQ ID NO: 1486869 - RNA, 14 nt, Homo sapiens
ccuagaaagacaga

SEQ ID NO: 1486870 - RNA, 22 nt, Homo sapiens
ccuagauuagguagacuuugcu

SEQ ID NO: 1486871 - RNA, 20 nt, Homo sapiens
ccuagcagaggaaaguguaa

SEQ ID NO: 1486872 - RNA, 23 nt, Homo sapiens
ccuagcagcaccguucugugcac

SEQ ID NO: 1486873 - RNA, 17 nt, Homo sapiens
ccuagcaggcuguucca

SEQ ID NO: 1486874 - RNA, 15 nt, Homo sapiens
ccuagccaauucaca

SEQ ID NO: 1486875 - RNA, 15 nt, Homo sapiens
ccuaggaacucaguc

SEQ ID NO: 1486876 - RNA, 19 nt, Homo sapiens
ccuaggggaacagaccagu

SEQ ID NO: 1486877 - RNA, 20 nt, Homo sapiens
ccuaguagcugggaugacag

SEQ ID NO: 1486878 - RNA, 17 nt, Homo sapiens
ccuaguggaugacuguu

SEQ ID NO: 1486879 - RNA, 22 nt, Homo sapiens
ccuauaugaauaugagaucuga

SEQ ID NO: 1486880 - RNA, 19 nt, Homo sapiens
ccuauauguaguauaaaga

SEQ ID NO: 1486881 - RNA, 18 nt, Homo sapiens
ccuaucaguuauuaauuu

SEQ ID NO: 1486882 - RNA, 22 nt, Homo sapiens
ccuauguccuaaggacacacua

SEQ ID NO: 1486883 - RNA, 17 nt, Homo sapiens
ccuauuaaaacacagcu

SEQ ID NO: 1486884 - RNA, 21 nt, Homo sapiens
ccuauucccucucucucccag

SEQ ID NO: 1486885 - RNA, 16 nt, Homo sapiens
ccucaacagccaagug

SEQ ID NO: 1486886 - RNA, 22 nt, Homo sapiens
ccucaacauugcauggugcuag

SEQ ID NO: 1486887 - RNA, 23 nt, Homo sapiens
ccucaagaaauaaaaggaagcca

SEQ ID NO: 1486888 - RNA, 17 nt, Homo sapiens
ccucaagacucaccuca

SEQ ID NO: 1486889 - RNA, 15 nt, Homo sapiens
ccucaauucacauag

SEQ ID NO: 1486890 - RNA, 20 nt, Homo sapiens
ccucacagagugcauuguga

SEQ ID NO: 1486891 - RNA, 22 nt, Homo sapiens
ccucaccucuccaggugcucau

SEQ ID NO: 1486892 - RNA, 12 nt, Homo sapiens
ccucacugaaaa

SEQ ID NO: 1486893 - RNA, 17 nt, Homo sapiens
ccucacugaaugccuca

SEQ ID NO: 1486894 - RNA, 22 nt, Homo sapiens
ccucagccucccaaagugcugg

SEQ ID NO: 1486895 - RNA, 19 nt, Homo sapiens
ccucagccuugccagagau

SEQ ID NO: 1486896 - RNA, 18 nt, Homo sapiens
ccucagcuucuucacagg

SEQ ID NO: 1486897 - RNA, 19 nt, Homo sapiens
ccucaggggaaaacuguua

SEQ ID NO: 1486898 - RNA, 15 nt, Homo sapiens
ccucaggugcugucc

SEQ ID NO: 1486899 - RNA, 17 nt, Homo sapiens
ccucaguuuuaucauuu

SEQ ID NO: 1486900 - RNA, 17 nt, Homo sapiens
ccucauccaggcuacca

SEQ ID NO: 1486901 - RNA, 18 nt, Homo sapiens
ccucaucugagaggcucu

SEQ ID NO: 1486902 - RNA, 23 nt, Homo sapiens
ccucauggcucuggcacagugua

SEQ ID NO: 1486903 - RNA, 21 nt, Homo sapiens
ccucauuacugggccuuagug

SEQ ID NO: 1486904 - RNA, 20 nt, Homo sapiens
ccucauucccucgucuuucc

SEQ ID NO: 1486905 - RNA, 13 nt, Homo sapiens
ccucauuccugaa

SEQ ID NO: 1486906 - RNA, 22 nt, Homo sapiens
ccucauuuaaguaaaagguuag

SEQ ID NO: 1486907 - RNA, 11 nt, Homo sapiens
ccugugccauc

SEQ ID NO: 1486908 - RNA, 16 nt, Homo sapiens
ccugugcccaccaguu

SEQ ID NO: 1486909 - RNA, 19 nt, Homo sapiens
ccugugccccuggaugcac

SEQ ID NO: 1486910 - RNA, 16 nt, Homo sapiens
ccuguggaaaggccaa

SEQ ID NO: 1486911 - RNA, 20 nt, Homo sapiens
ccuguggccccaccgagcug

SEQ ID NO: 1486912 - RNA, 18 nt, Homo sapiens
ccugugguuaacaucuca

SEQ ID NO: 1486913 - RNA, 21 nt, Homo sapiens
ccuguguccaccugugggugu

SEQ ID NO: 1486914 - RNA, 17 nt, Homo sapiens
ccugugugccauuuuaa

SEQ ID NO: 1486915 - RNA, 21 nt, Homo sapiens
ccuguguugucucuagagcag

SEQ ID NO: 1486916 - RNA, 12 nt, Homo sapiens
ccuguuccccaa

SEQ ID NO: 1486917 - RNA, 23 nt, Homo sapiens
ccuguuccccagagaaaggggag

SEQ ID NO: 1486918 - RNA, 16 nt, Homo sapiens
ccuuaaaaccaaagag

SEQ ID NO: 1486919 - RNA, 15 nt, Homo sapiens
ccuuaaaccuaccuc

SEQ ID NO: 1486920 - RNA, 21 nt, Homo sapiens
ccuuaagggacaacauccuua

SEQ ID NO: 1486921 - RNA, 16 nt, Homo sapiens
ccuuaauugaugcaaa

SEQ ID NO: 1486922 - RNA, 13 nt, Homo sapiens
ccuuaccuugaaa

SEQ ID NO: 1486923 - RNA, 15 nt, Homo sapiens
ccuuagucucaaggg

SEQ ID NO: 1486924 - RNA, 14 nt, Homo sapiens
ccuuaucugucaca

SEQ ID NO: 1486925 - RNA, 19 nt, Homo sapiens
ccuuaugauuaaacuuccu

SEQ ID NO: 1486926 - RNA, 18 nt, Homo sapiens
ccuuauucagaauuucua

SEQ ID NO: 1486927 - RNA, 16 nt, Homo sapiens
ccuucagacacccuca

SEQ ID NO: 1486928 - RNA, 21 nt, Homo sapiens
ccuucaucuuccuguguccug

SEQ ID NO: 1486929 - RNA, 18 nt, Homo sapiens
ccuucauuuauagaugag

SEQ ID NO: 1486930 - RNA, 14 nt, Homo sapiens
ccuuccacagugaa

SEQ ID NO: 1486931 - RNA, 14 nt, Homo sapiens
ccuuccagccacau

SEQ ID NO: 1486932 - RNA, 17 nt, Homo sapiens
ccuuccagcuccuguaa

SEQ ID NO: 1486933 - RNA, 14 nt, Homo sapiens
ccuuccagcugcug

SEQ ID NO: 1486934 - RNA, 11 nt, Homo sapiens
ccuucccucau

SEQ ID NO: 1486935 - RNA, 17 nt, Homo sapiens
ccuuccuuucuccagga

SEQ ID NO: 1486936 - RNA, 15 nt, Homo sapiens
ccuucggcagcuacu

SEQ ID NO: 1486937 - RNA, 18 nt, Homo sapiens
ccuucggcagcuacucag

SEQ ID NO: 1486938 - RNA, 15 nt, Homo sapiens
ccuucuaggucacuu

SEQ ID NO: 1486939 - RNA, 12 nt, Homo sapiens
ccuucuccaaau

SEQ ID NO: 1486940 - RNA, 18 nt, Homo sapiens
ccuucuccacacccacuu

SEQ ID NO: 1486941 - RNA, 22 nt, Homo sapiens
ccuucuccaccaaagacaguug

SEQ ID NO: 1486942 - RNA, 23 nt, Homo sapiens
ccuucucugaacacaggcagcuu

SEQ ID NO: 1486943 - RNA, 20 nt, Homo sapiens
ccuucucugcuccaccacau

SEQ ID NO: 1486944 - RNA, 21 nt, Homo sapiens
ccuucuggacacugagagggc

SEQ ID NO: 1486945 - RNA, 20 nt, Homo sapiens
ccuucuggccucugcugaau

SEQ ID NO: 1486946 - RNA, 20 nt, Homo sapiens
ccuucuuugauaauguuaaa

SEQ ID NO: 1486947 - RNA, 19 nt, Homo sapiens
ccuugaaggucacucuucc

SEQ ID NO: 1486948 - RNA, 11 nt, Homo sapiens
ccuugagaaac

SEQ ID NO: 1486949 - RNA, 20 nt, Homo sapiens
ccuugagugcucuugcuauu

SEQ ID NO: 1486950 - RNA, 20 nt, Homo sapiens
ccuugcgauucugcagccac

SEQ ID NO: 1486951 - RNA, 22 nt, Homo sapiens
ccuugcgauucugcagccacaa

SEQ ID NO: 1486952 - RNA, 17 nt, Homo sapiens
ccuugcuaaaagauuau

SEQ ID NO: 1486953 - RNA, 11 nt, Homo sapiens
ccuugcucccc

SEQ ID NO: 1486954 - RNA, 20 nt, Homo sapiens
ccuugcucuccucaucucca

SEQ ID NO: 1486955 - RNA, 21 nt, Homo sapiens
ccuugcuggacggggacuggg

SEQ ID NO: 1486956 - RNA, 13 nt, Homo sapiens
ucuccuuuuccua

SEQ ID NO: 1486957 - RNA, 20 nt, Homo sapiens
ucucgaagugcugagauuac

SEQ ID NO: 1486958 - RNA, 15 nt, Homo sapiens
ucucgacaguaucca

SEQ ID NO: 1486959 - RNA, 17 nt, Homo sapiens
ucucgagcccagaugga

SEQ ID NO: 1486960 - RNA, 18 nt, Homo sapiens
ucucguaacugguuucau

SEQ ID NO: 1486961 - RNA, 13 nt, Homo sapiens
ucucguucccaaa

SEQ ID NO: 1486962 - RNA, 17 nt, Homo sapiens
ucucuaacauuuccuua

SEQ ID NO: 1486963 - RNA, 15 nt, Homo sapiens
ucucuaaugcuugau

SEQ ID NO: 1486964 - RNA, 21 nt, Homo sapiens
ucucuacuaaaaacacaaaag

SEQ ID NO: 1486965 - RNA, 12 nt, Homo sapiens
ucucuacugcuu

SEQ ID NO: 1486966 - RNA, 16 nt, Homo sapiens
ucucuagcuuugucau

SEQ ID NO: 1486967 - RNA, 14 nt, Homo sapiens
ucucucuccagggu

SEQ ID NO: 1486968 - RNA, 11 nt, Homo sapiens
ucucucugugg

SEQ ID NO: 1486969 - RNA, 15 nt, Homo sapiens
ucucugccagugaca

SEQ ID NO: 1486970 - RNA, 18 nt, Homo sapiens
ucucugcuccaccacauc

SEQ ID NO: 1486971 - RNA, 19 nt, Homo sapiens
ucucuggagcauucugaaa

SEQ ID NO: 1486972 - RNA, 19 nt, Homo sapiens
ucucuuaaaguuggaauuu

SEQ ID NO: 1486973 - RNA, 23 nt, Homo sapiens
ucucuucauuauucucugcuaua

SEQ ID NO: 1486974 - RNA, 13 nt, Homo sapiens
ucucuuccccaga

SEQ ID NO: 1486975 - RNA, 23 nt, Homo sapiens
ucucuucccugcgccugugaugc

SEQ ID NO: 1486976 - RNA, 23 nt, Homo sapiens
ucugaaacugcauaagugaaaau

SEQ ID NO: 1486977 - RNA, 22 nt, Homo sapiens
ucugaacacaggcagcuuucua

SEQ ID NO: 1486978 - RNA, 12 nt, Homo sapiens
aaaaaacagagg

SEQ ID NO: 1486979 - RNA, 14 nt, Homo sapiens
aaaaacaaauggga

SEQ ID NO: 1486980 - RNA, 21 nt, Homo sapiens
aaaaacauagaaaaauucagc

SEQ ID NO: 1486981 - RNA, 17 nt, Homo sapiens
aaaaaccccaaacuguu

SEQ ID NO: 1486982 - RNA, 22 nt, Homo sapiens
aaaaaccucuaugcaaucugag

SEQ ID NO: 1486983 - RNA, 18 nt, Homo sapiens
aaaaacuaacacccaguc

SEQ ID NO: 1486984 - RNA, 12 nt, Homo sapiens
aaaaacuacuuc

SEQ ID NO: 1486985 - RNA, 18 nt, Homo sapiens
aaaaacugcuuacuuaug

SEQ ID NO: 1486986 - RNA, 12 nt, Homo sapiens
aaaaacuuccau

SEQ ID NO: 1486987 - RNA, 15 nt, Homo sapiens
aaaaagccugucauu

SEQ ID NO: 1486988 - RNA, 23 nt, Homo sapiens
aaaaaggagccuuuugcucucug

SEQ ID NO: 1486989 - RNA, 21 nt, Homo sapiens
aaaaaggauaugguagcauuu

SEQ ID NO: 1486990 - RNA, 23 nt, Homo sapiens
aaaaaguccuugauuuagcacua

SEQ ID NO: 1486991 - RNA, 20 nt, Homo sapiens
aaaaagucuacauacuuuca

SEQ ID NO: 1486992 - RNA, 16 nt, Homo sapiens
aaaaauaaaacuucac

SEQ ID NO: 1486993 - RNA, 12 nt, Homo sapiens
aaaaauaaugug

SEQ ID NO: 1486994 - RNA, 10 nt, Homo sapiens
aaaaauacuu

SEQ ID NO: 1486995 - RNA, 11 nt, Homo sapiens
aaaaauacuug

SEQ ID NO: 1486996 - RNA, 20 nt, Homo sapiens
aaaaauagcuuucaaaagaa

SEQ ID NO: 1486997 - RNA, 22 nt, Homo sapiens
aaaaauauaaaguacaucucua

SEQ ID NO: 1486998 - RNA, 23 nt, Homo sapiens
aaaaauauuguuucugcauucau

SEQ ID NO: 1486999 - RNA, 16 nt, Homo sapiens
aaaaauauuugcugag

SEQ ID NO: 1487000 - RNA, 20 nt, Homo sapiens
aaaaaucuuuucauuaaaga

SEQ ID NO: 1487001 - RNA, 17 nt, Homo sapiens
aaaaauuagccaggugu

SEQ ID NO: 1487002 - RNA, 19 nt, Homo sapiens
aaaaauuauacuaacuuau

SEQ ID NO: 1487003 - RNA, 14 nt, Homo sapiens
aaaaauuuacuuga

SEQ ID NO: 1487004 - RNA, 18 nt, Homo sapiens
aaaaauuugaacacuggc

SEQ ID NO: 1487005 - RNA, 22 nt, Homo sapiens
aaaacacacacaaagcacauug

SEQ ID NO: 1487006 - RNA, 19 nt, Homo sapiens
aaaacaccgcuucugccuu

SEQ ID NO: 1487007 - RNA, 17 nt, Homo sapiens
aaaacaccuagcuuuau

SEQ ID NO: 1487008 - RNA, 18 nt, Homo sapiens
aaaacacugcccucuugu

SEQ ID NO: 1487009 - RNA, 13 nt, Homo sapiens
aaaacagaaagca

SEQ ID NO: 1487010 - RNA, 18 nt, Homo sapiens
aaaacagagaugugauaa

SEQ ID NO: 1487011 - RNA, 19 nt, Homo sapiens
aaaacagguauauacuuug

SEQ ID NO: 1487012 - RNA, 15 nt, Homo sapiens
aaaacaggucuucau

SEQ ID NO: 1487013 - RNA, 17 nt, Homo sapiens
aaaaccacuagaacucu

SEQ ID NO: 1487014 - RNA, 18 nt, Homo sapiens
aaaaccugugugccauuu

SEQ ID NO: 1487015 - RNA, 13 nt, Homo sapiens
aaaaccuucccca

SEQ ID NO: 1487016 - RNA, 15 nt, Homo sapiens
aaaacucacugugau

SEQ ID NO: 1487017 - RNA, 20 nt, Homo sapiens
aaaacucuugauaugaccug

SEQ ID NO: 1487018 - RNA, 19 nt, Homo sapiens
aaaacugauugaaugauau

SEQ ID NO: 1487019 - RNA, 21 nt, Homo sapiens
aaaacugcuuacuuaugccau

SEQ ID NO: 1487020 - RNA, 16 nt, Homo sapiens
aaaacuuaugaccucu

SEQ ID NO: 1487021 - RNA, 21 nt, Homo sapiens
aaaacuuuggaguccccucac

SEQ ID NO: 1487022 - RNA, 18 nt, Homo sapiens
aaaagaaccgagcaauuu

SEQ ID NO: 1487023 - RNA, 15 nt, Homo sapiens
aaaagaagacauucu

SEQ ID NO: 1487024 - RNA, 16 nt, Homo sapiens
aaaagaagacucugac

SEQ ID NO: 1487025 - RNA, 16 nt, Homo sapiens
aaaagaauacagaaag

SEQ ID NO: 1487026 - RNA, 15 nt, Homo sapiens
aaaagaaugacuaua

SEQ ID NO: 1487027 - RNA, 14 nt, Homo sapiens
aaaagaauuaccaa

SEQ ID NO: 1487028 - RNA, 20 nt, Homo sapiens
aaaagacguucauuauguau

SEQ ID NO: 1487029 - RNA, 19 nt, Homo sapiens
aaaagacucugaccagaga

SEQ ID NO: 1487030 - RNA, 17 nt, Homo sapiens
aaaagagcuauugccaa

SEQ ID NO: 1487031 - RNA, 22 nt, Homo sapiens
aaaagcaaaaggcauuucccac

SEQ ID NO: 1487032 - RNA, 22 nt, Homo sapiens
aaaagcaagacuguugcucaaa

SEQ ID NO: 1487033 - RNA, 14 nt, Homo sapiens
aaaagccuugugua

SEQ ID NO: 1487034 - RNA, 16 nt, Homo sapiens
aaaagccuuuuccaga

SEQ ID NO: 1487035 - RNA, 16 nt, Homo sapiens
aaaagcgacccauuca

SEQ ID NO: 1487036 - RNA, 14 nt, Homo sapiens
aaaagcuguggaau

SEQ ID NO: 1487037 - RNA, 20 nt, Homo sapiens
aaaagcuuauucaucuguuu

SEQ ID NO: 1487038 - RNA, 21 nt, Homo sapiens
aaaagcuuuaaaugucugcau

SEQ ID NO: 1487039 - RNA, 21 nt, Homo sapiens
aaaaggacucugcuucagucc

SEQ ID NO: 1487040 - RNA, 21 nt, Homo sapiens
aaaagggucaaaccuguagau

SEQ ID NO: 1487041 - RNA, 15 nt, Homo sapiens
aaaagguuauauacc

SEQ ID NO: 1487042 - RNA, 23 nt, Homo sapiens
aaaaguaaccugaacuaaucuga

SEQ ID NO: 1487043 - RNA, 17 nt, Homo sapiens
aaaaguaaggugcaguu

SEQ ID NO: 1487044 - RNA, 14 nt, Homo sapiens
aaaagucacuuacu

SEQ ID NO: 1487045 - RNA, 19 nt, Homo sapiens
aaaaguugguguugacaua

SEQ ID NO: 1487046 - RNA, 14 nt, Homo sapiens
aaaaguuucacagg

SEQ ID NO: 1487047 - RNA, 20 nt, Homo sapiens
aaaauaauuauaaauaucau

SEQ ID NO: 1487048 - RNA, 17 nt, Homo sapiens
aaaauacauaucgcuga

SEQ ID NO: 1487049 - RNA, 19 nt, Homo sapiens
aaaauacuguacauuguga

SEQ ID NO: 1487050 - RNA, 10 nt, Homo sapiens
aaaauacuug

SEQ ID NO: 1487051 - RNA, 16 nt, Homo sapiens
aaaauaguaaagccaa

SEQ ID NO: 1487052 - RNA, 14 nt, Homo sapiens
aaaauagucuucca

SEQ ID NO: 1487053 - RNA, 13 nt, Homo sapiens
aaaauauaaucua

SEQ ID NO: 1487054 - RNA, 12 nt, Homo sapiens
aaaauauuuagu

SEQ ID NO: 1487055 - RNA, 16 nt, Homo sapiens
aaaauauuucagauau

SEQ ID NO: 1487056 - RNA, 16 nt, Homo sapiens
aaaaucauaguacucu

SEQ ID NO: 1487057 - RNA, 21 nt, Homo sapiens
aaaaucucuacugcuuuggau

SEQ ID NO: 1487058 - RNA, 22 nt, Homo sapiens
aaaaucugcucuuuguaugaca

SEQ ID NO: 1487059 - RNA, 16 nt, Homo sapiens
aaaaugaaaagccaaa

SEQ ID NO: 1487060 - RNA, 19 nt, Homo sapiens
aaaaugaaagcaugucuca

SEQ ID NO: 1487061 - RNA, 16 nt, Homo sapiens
aaaaugaaucuucaca

SEQ ID NO: 1487062 - RNA, 21 nt, Homo sapiens
aaaaugaaucuucacaaaaca

SEQ ID NO: 1487063 - RNA, 13 nt, Homo sapiens
aaaaugacauuaa

SEQ ID NO: 1487064 - RNA, 21 nt, Homo sapiens
aaaaugacauuaaaugcaaua

SEQ ID NO: 1487065 - RNA, 20 nt, Homo sapiens
aaaaugagacuuacugggug

SEQ ID NO: 1487066 - RNA, 22 nt, Homo sapiens
aaaaugagguucaacuguugau

SEQ ID NO: 1487067 - RNA, 19 nt, Homo sapiens
aaaaugcaguccugaggag

SEQ ID NO: 1487068 - RNA, 18 nt, Homo sapiens
aaaaugccucaauucaca

SEQ ID NO: 1487069 - RNA, 21 nt, Homo sapiens
aaaauggcaaagaauucaaac

SEQ ID NO: 1487070 - RNA, 14 nt, Homo sapiens
aaaauggucaucca

SEQ ID NO: 1487071 - RNA, 19 nt, Homo sapiens
aaaauguccaugauggaau

SEQ ID NO: 1487072 - RNA, 19 nt, Homo sapiens
aaaauguugagaaucccaa

SEQ ID NO: 1487073 - RNA, 14 nt, Homo sapiens
aaaauucagaugcu

SEQ ID NO: 1487074 - RNA, 13 nt, Homo sapiens
aaaauucauuucu

SEQ ID NO: 1487075 - RNA, 18 nt, Homo sapiens
aaaauuccucuuacugua

SEQ ID NO: 1487076 - RNA, 17 nt, Homo sapiens
aaaauugcuauguuacu

SEQ ID NO: 1487077 - RNA, 22 nt, Homo sapiens
aaaauugcuucuuuaccaagga

SEQ ID NO: 1487078 - RNA, 20 nt, Homo sapiens
aaaauuuaaaggguguacuu

SEQ ID NO: 1487079 - RNA, 16 nt, Homo sapiens
aaaauuugagacuauu

SEQ ID NO: 1487080 - RNA, 18 nt, Homo sapiens
aaaauuuguuuugacgga

SEQ ID NO: 1487081 - RNA, 13 nt, Homo sapiens
aaaauuuuacuuc

SEQ ID NO: 1487082 - RNA, 21 nt, Homo sapiens
aaaauuuuuuuuguaacugga

SEQ ID NO: 1487083 - RNA, 18 nt, Homo sapiens
aaacaaaaaucuguguaa

SEQ ID NO: 1487084 - RNA, 16 nt, Homo sapiens
aaacaaaugugauaca

SEQ ID NO: 1487085 - RNA, 20 nt, Homo sapiens
aaacaacuucaauauccaaa

SEQ ID NO: 1487086 - RNA, 18 nt, Homo sapiens
aaacaacuuccucccuua

SEQ ID NO: 1487087 - RNA, 16 nt, Homo sapiens
aaacaauaucauauca

SEQ ID NO: 1487088 - RNA, 12 nt, Homo sapiens
aaacacagagaa

SEQ ID NO: 1487089 - RNA, 16 nt, Homo sapiens
aaacacagcuuuacaa

SEQ ID NO: 1487090 - RNA, 22 nt, Homo sapiens
aaacacaucuggccuaauguuc

SEQ ID NO: 1487091 - RNA, 17 nt, Homo sapiens
aaacaccaaaaagggau

SEQ ID NO: 1487092 - RNA, 19 nt, Homo sapiens
aaagggaaguaguccuugg

SEQ ID NO: 1487093 - RNA, 16 nt, Homo sapiens
aaagggccauguuuca

SEQ ID NO: 1487094 - RNA, 17 nt, Homo sapiens
aaagggccuugacauca

SEQ ID NO: 1487095 - RNA, 17 nt, Homo sapiens
aaagggcugaaagccau

SEQ ID NO: 1487096 - RNA, 22 nt, Homo sapiens
aaagguugacaauaaaugugcu

SEQ ID NO: 1487097 - RNA, 22 nt, Homo sapiens
aaagguuucauguucacuguga

SEQ ID NO: 1487098 - RNA, 15 nt, Homo sapiens
aaaguaaacgauaaa

SEQ ID NO: 1487099 - RNA, 18 nt, Homo sapiens
aaaguaaccugaacuaau

SEQ ID NO: 1487100 - RNA, 22 nt, Homo sapiens
aaaguaaccugaacuaaucuga

SEQ ID NO: 1487101 - RNA, 19 nt, Homo sapiens
aaaguaaguuaauaaugua

SEQ ID NO: 1487102 - RNA, 20 nt, Homo sapiens
aaaguaauuucuuugaucug

SEQ ID NO: 1487103 - RNA, 22 nt, Homo sapiens
aaaguaauuucuuugaucugga

SEQ ID NO: 1487104 - RNA, 19 nt, Homo sapiens
aaaguacaucucuacuaaa

SEQ ID NO: 1487105 - RNA, 19 nt, Homo sapiens
aaaguagguuuacauucau

SEQ ID NO: 1487106 - RNA, 22 nt, Homo sapiens
aaaguagucucuccccuggcca

SEQ ID NO: 1487107 - RNA, 21 nt, Homo sapiens
aaaguauuuugaaguuuacau

SEQ ID NO: 1487108 - RNA, 13 nt, Homo sapiens
aaagucaaaaaua

SEQ ID NO: 1487109 - RNA, 12 nt, Homo sapiens
aaagucacuuac

SEQ ID NO: 1487110 - RNA, 12 nt, Homo sapiens
aaaguccugaca

SEQ ID NO: 1487111 - RNA, 22 nt, Homo sapiens
aaaguccugugguuaacgccuu

SEQ ID NO: 1487112 - RNA, 19 nt, Homo sapiens
aaagucugucuuuccugaa

SEQ ID NO: 1487113 - RNA, 14 nt, Homo sapiens
aaagugacacagca

SEQ ID NO: 1487114 - RNA, 21 nt, Homo sapiens
aaagugcauaugaaauccuug

SEQ ID NO: 1487115 - RNA, 18 nt, Homo sapiens
aaagugcauauuuaucca

SEQ ID NO: 1487116 - RNA, 19 nt, Homo sapiens
aaagugcuaguauuauggg

SEQ ID NO: 1487117 - RNA, 16 nt, Homo sapiens
aaaguggacaaggagu

SEQ ID NO: 1487118 - RNA, 23 nt, Homo sapiens
aaaguguaacaauuguguagccu

SEQ ID NO: 1487119 - RNA, 14 nt, Homo sapiens
aaagugugagcaaa

SEQ ID NO: 1487120 - RNA, 17 nt, Homo sapiens
aaaguguugaccacaga

SEQ ID NO: 1487121 - RNA, 19 nt, Homo sapiens
aaaguuacuugaauuucaa

SEQ ID NO: 1487122 - RNA, 22 nt, Homo sapiens
aaaguucagggaccguccaggg

SEQ ID NO: 1487123 - RNA, 16 nt, Homo sapiens
aaaguucucaaugcaa

SEQ ID NO: 1487124 - RNA, 17 nt, Homo sapiens
aaaguucuucauaucau

SEQ ID NO: 1487125 - RNA, 20 nt, Homo sapiens
aaaguuuccuaggaugucau

SEQ ID NO: 1487126 - RNA, 21 nt, Homo sapiens
aaaguuuuaggguacaguuug

SEQ ID NO: 1487127 - RNA, 19 nt, Homo sapiens
aaauaaaaauauuguguug

SEQ ID NO: 1487128 - RNA, 13 nt, Homo sapiens
aaauaaacacaca

SEQ ID NO: 1487129 - RNA, 15 nt, Homo sapiens
aaauaacaaguacca

SEQ ID NO: 1487130 - RNA, 19 nt, Homo sapiens
aaauaauuucuacucuguc

SEQ ID NO: 1487131 - RNA, 14 nt, Homo sapiens
aaauacacauagca

SEQ ID NO: 1487132 - RNA, 17 nt, Homo sapiens
aaauacagauagauaua

SEQ ID NO: 1487133 - RNA, 16 nt, Homo sapiens
aaauaccaacuguaca

SEQ ID NO: 1487134 - RNA, 22 nt, Homo sapiens
aaauacgaacccaaucugcaca

SEQ ID NO: 1487135 - RNA, 20 nt, Homo sapiens
aaauacgguaaggauacuuu

SEQ ID NO: 1487136 - RNA, 9 nt, Homo sapiens
aaauacuug

SEQ ID NO: 1487137 - RNA, 19 nt, Homo sapiens
aaauacuuuuacucugccu

SEQ ID NO: 1487138 - RNA, 17 nt, Homo sapiens
aaauagaaccacuauga

SEQ ID NO: 1487139 - RNA, 22 nt, Homo sapiens
aaauagagcuuuuaaaaauguc

SEQ ID NO: 1487140 - RNA, 13 nt, Homo sapiens
aaauagauccaau

SEQ ID NO: 1487141 - RNA, 22 nt, Homo sapiens
aaauagaugugucuuaacauaa

SEQ ID NO: 1487142 - RNA, 21 nt, Homo sapiens
aaauaguaccuucaauacuua

SEQ ID NO: 1487143 - RNA, 22 nt, Homo sapiens
aaauagugacaagugaagaaca

SEQ ID NO: 1487144 - RNA, 23 nt, Homo sapiens
aaauaguguucccagagcacuuu

SEQ ID NO: 1487145 - RNA, 14 nt, Homo sapiens
aaauauacauucaa

SEQ ID NO: 1487146 - RNA, 21 nt, Homo sapiens
aaauaucacaguauuaucugu

SEQ ID NO: 1487147 - RNA, 19 nt, Homo sapiens
aaauaucucccucucucca

SEQ ID NO: 1487148 - RNA, 16 nt, Homo sapiens
aaauaucuugcuuuca

SEQ ID NO: 1487149 - RNA, 18 nt, Homo sapiens
aaauaugaaauuccagca

SEQ ID NO: 1487150 - RNA, 12 nt, Homo sapiens
aaauaugcagug

SEQ ID NO: 1487151 - RNA, 13 nt, Homo sapiens
aaauaugcaguga

SEQ ID NO: 1487152 - RNA, 16 nt, Homo sapiens
aaauauggaacuuaca

SEQ ID NO: 1487153 - RNA, 18 nt, Homo sapiens
aaauauguauuuuccuaa

SEQ ID NO: 1487154 - RNA, 22 nt, Homo sapiens
aaauauguccgcagaauggacu

SEQ ID NO: 1487155 - RNA, 14 nt, Homo sapiens
aaauauguccuggg

SEQ ID NO: 1487156 - RNA, 15 nt, Homo sapiens
aaauauuauuugcua

SEQ ID NO: 1487157 - RNA, 20 nt, Homo sapiens
aaauauuuccuuaaacugug

SEQ ID NO: 1487158 - RNA, 13 nt, Homo sapiens
aaauauuucucaa

SEQ ID NO: 1487159 - RNA, 20 nt, Homo sapiens
aaauauuuuguaaugcugca

SEQ ID NO: 1487160 - RNA, 15 nt, Homo sapiens
aaauauuuuugccau

SEQ ID NO: 1487161 - RNA, 23 nt, Homo sapiens
aaaucaaucuguaaaacuaagaa

SEQ ID NO: 1487162 - RNA, 14 nt, Homo sapiens
aaaucacacuguaa

SEQ ID NO: 1487163 - RNA, 21 nt, Homo sapiens
aaaucauggcaacauaauuca

SEQ ID NO: 1487164 - RNA, 13 nt, Homo sapiens
aaauccaguucua

SEQ ID NO: 1487165 - RNA, 21 nt, Homo sapiens
aaaucccauggaauauuucca

SEQ ID NO: 1487166 - RNA, 22 nt, Homo sapiens
aaauccccuuaugacuugcuac

SEQ ID NO: 1487167 - RNA, 13 nt, Homo sapiens
aaauccucaggug

SEQ ID NO: 1487168 - RNA, 13 nt, Homo sapiens
aaaucguccuccc

SEQ ID NO: 1487169 - RNA, 16 nt, Homo sapiens
aaaucuagaagacugu

SEQ ID NO: 1487170 - RNA, 17 nt, Homo sapiens
aaaucuagaagacuguc

SEQ ID NO: 1487171 - RNA, 22 nt, Homo sapiens
aaaucucaaugaagccagcuca

SEQ ID NO: 1487172 - RNA, 19 nt, Homo sapiens
aaaucucuacugcuuugga

SEQ ID NO: 1487173 - RNA, 23 nt, Homo sapiens
aaaucucuacugcuuuggauccu

SEQ ID NO: 1487174 - RNA, 19 nt, Homo sapiens
aaaucucuucaaauucuuc

SEQ ID NO: 1487175 - RNA, 22 nt, Homo sapiens
aaaucugacauauuaugccuga

SEQ ID NO: 1487176 - RNA, 20 nt, Homo sapiens
aaaucugagggagcugagua

SEQ ID NO: 1487177 - RNA, 18 nt, Homo sapiens
aaaucugauggccuuaau

SEQ ID NO: 1487178 - RNA, 23 nt, Homo sapiens
aaaucuggcuccuuuacaaaaga

SEQ ID NO: 1487179 - RNA, 20 nt, Homo sapiens
aaaucugguccauauuuaca

SEQ ID NO: 1487180 - RNA, 18 nt, Homo sapiens
aaaucuguguaacuguaa

SEQ ID NO: 1487181 - RNA, 13 nt, Homo sapiens
aaaucuuccuugu

SEQ ID NO: 1487182 - RNA, 15 nt, Homo sapiens
aaaugaauuuuccac

SEQ ID NO: 1487183 - RNA, 15 nt, Homo sapiens
aaaugagaaguacuu

SEQ ID NO: 1487184 - RNA, 22 nt, Homo sapiens
aaaugagaauuuuauauucuaa

SEQ ID NO: 1487185 - RNA, 16 nt, Homo sapiens
aaaugagagugguuag

SEQ ID NO: 1487186 - RNA, 19 nt, Homo sapiens
aaaugaugcgcaucaaugu

SEQ ID NO: 1487187 - RNA, 16 nt, Homo sapiens
aaaugauuuuaucugu

SEQ ID NO: 1487188 - RNA, 14 nt, Homo sapiens
aaaugcagugaauu

SEQ ID NO: 1487189 - RNA, 20 nt, Homo sapiens
aaaugcauauccugagccau

SEQ ID NO: 1487190 - RNA, 13 nt, Homo sapiens
aaaugcauggugc

SEQ ID NO: 1487191 - RNA, 17 nt, Homo sapiens
aaaugcauggugcaguu

SEQ ID NO: 1487192 - RNA, 11 nt, Homo sapiens
aaaugcauucg

SEQ ID NO: 1487193 - RNA, 20 nt, Homo sapiens
aaaugccacguggucacugu

SEQ ID NO: 1487194 - RNA, 16 nt, Homo sapiens
acuuucaaaauuaaau

SEQ ID NO: 1487195 - RNA, 16 nt, Homo sapiens
acuuucaauugucacu

SEQ ID NO: 1487196 - RNA, 12 nt, Homo sapiens
acuuuccuccac

SEQ ID NO: 1487197 - RNA, 19 nt, Homo sapiens
acuuucuucucuuucccaa

SEQ ID NO: 1487198 - RNA, 11 nt, Homo sapiens
acuuugcucuc

SEQ ID NO: 1487199 - RNA, 12 nt, Homo sapiens
acuuugcugauu

SEQ ID NO: 1487200 - RNA, 12 nt, Homo sapiens
acuuugcuucau

SEQ ID NO: 1487201 - RNA, 22 nt, Homo sapiens
acuuuggaauguacucuguuca

SEQ ID NO: 1487202 - RNA, 11 nt, Homo sapiens
acuuugggacg

SEQ ID NO: 1487203 - RNA, 19 nt, Homo sapiens
acuuugggcuuaguauuuc

SEQ ID NO: 1487204 - RNA, 16 nt, Homo sapiens
acuuugguaguggaau

SEQ ID NO: 1487205 - RNA, 21 nt, Homo sapiens
acuuugguaguggaauaguga

SEQ ID NO: 1487206 - RNA, 22 nt, Homo sapiens
acuuugucaugguuuccauuua

SEQ ID NO: 1487207 - RNA, 19 nt, Homo sapiens
acuuuguggcaaucugugg

SEQ ID NO: 1487208 - RNA, 18 nt, Homo sapiens
acuuuguggucgacauca

SEQ ID NO: 1487209 - RNA, 18 nt, Homo sapiens
accuuaagagacacucca

SEQ ID NO: 1487210 - RNA, 17 nt, Homo sapiens
accuuaagauuuugcac

SEQ ID NO: 1487211 - RNA, 21 nt, Homo sapiens
accuuaagauuuugcaccugu

SEQ ID NO: 1487212 - RNA, 17 nt, Homo sapiens
accuuacauguguaaag

SEQ ID NO: 1487213 - RNA, 13 nt, Homo sapiens
accuuagaauaca

SEQ ID NO: 1487214 - RNA, 14 nt, Homo sapiens
accuucagugaaag

SEQ ID NO: 1487215 - RNA, 18 nt, Homo sapiens
accuuccaaggacauauu

SEQ ID NO: 1487216 - RNA, 18 nt, Homo sapiens
accuugaucccaauccuu

SEQ ID NO: 1487217 - RNA, 14 nt, Homo sapiens
accuugcuguccug

SEQ ID NO: 1487218 - RNA, 17 nt, Homo sapiens
accuuggcaccagacac

SEQ ID NO: 1487219 - RNA, 22 nt, Homo sapiens
accuuugggucuacaaguauau

SEQ ID NO: 1487220 - RNA, 14 nt, Homo sapiens
accuuuuacucuuc

SEQ ID NO: 1487221 - RNA, 20 nt, Homo sapiens
accuuuugggaauguuuuaa

SEQ ID NO: 1487222 - RNA, 13 nt, Homo sapiens
acgaaaguggaaa

SEQ ID NO: 1487223 - RNA, 21 nt, Homo sapiens
acgaacccaaucugcacacuc

SEQ ID NO: 1487224 - RNA, 18 nt, Homo sapiens
acgacaagugcugaacag

SEQ ID NO: 1487225 - RNA, 18 nt, Homo sapiens
acgacuggccagggccac

SEQ ID NO: 1487226 - RNA, 22 nt, Homo sapiens
acgagccuauuucucuuugcac

SEQ ID NO: 1487227 - RNA, 17 nt, Homo sapiens
acgaggccacagcugcc

SEQ ID NO: 1487228 - RNA, 14 nt, Homo sapiens
acgcaccugccuca

SEQ ID NO: 1487229 - RNA, 16 nt, Homo sapiens
acgcacuggugccaaa

SEQ ID NO: 1487230 - RNA, 16 nt, Homo sapiens
acgcauccagcaagaa

SEQ ID NO: 1487231 - RNA, 14 nt, Homo sapiens
acgccgagaaggcc

SEQ ID NO: 1487232 - RNA, 22 nt, Homo sapiens
acgccucgguggcauacagacu

SEQ ID NO: 1487233 - RNA, 14 nt, Homo sapiens
acgccugagcucac

SEQ ID NO: 1487234 - RNA, 15 nt, Homo sapiens
acgccuguaauccca

SEQ ID NO: 1487235 - RNA, 17 nt, Homo sapiens
acgccuguaaucccagc

SEQ ID NO: 1487236 - RNA, 21 nt, Homo sapiens
acgccuguaaucccagcacuu

SEQ ID NO: 1487237 - RNA, 18 nt, Homo sapiens
acgcgcguacagaucucu

SEQ ID NO: 1487238 - RNA, 17 nt, Homo sapiens
acgcuaaagagcccuug

SEQ ID NO: 1487239 - RNA, 23 nt, Homo sapiens
acgcuccuuugugugugugucag

SEQ ID NO: 1487240 - RNA, 18 nt, Homo sapiens
acgcugaaggcuuacuuc

SEQ ID NO: 1487241 - RNA, 21 nt, Homo sapiens
acgcuggggcucucugagacu

SEQ ID NO: 1487242 - RNA, 17 nt, Homo sapiens
acgcuguccugagauga

SEQ ID NO: 1487243 - RNA, 16 nt, Homo sapiens
acgcuguuuguuucau

SEQ ID NO: 1487244 - RNA, 19 nt, Homo sapiens
acgcuugcuuuagcacagg

SEQ ID NO: 1487245 - RNA, 20 nt, Homo sapiens
acggagucucacucugucac

SEQ ID NO: 1487246 - RNA, 18 nt, Homo sapiens
acggagucuugcucuguc

SEQ ID NO: 1487247 - RNA, 20 nt, Homo sapiens
acggagucuugcucugucac

SEQ ID NO: 1487248 - RNA, 18 nt, Homo sapiens
acggcaacugaagcggcu

SEQ ID NO: 1487249 - RNA, 18 nt, Homo sapiens
acggccagggagaagcuc

SEQ ID NO: 1487250 - RNA, 21 nt, Homo sapiens
acggcccucaucuaugaggaa

SEQ ID NO: 1487251 - RNA, 20 nt, Homo sapiens
acggcucacgcuuaccucaa

SEQ ID NO: 1487252 - RNA, 13 nt, Homo sapiens
acggggacugggg

SEQ ID NO: 1487253 - RNA, 17 nt, Homo sapiens
acggggcucagcaaugc

SEQ ID NO: 1487254 - RNA, 14 nt, Homo sapiens
acggugcugugagg

SEQ ID NO: 1487255 - RNA, 16 nt, Homo sapiens
acggugugcaccaaca

SEQ ID NO: 1487256 - RNA, 14 nt, Homo sapiens
acgguuaacuguaa

SEQ ID NO: 1487257 - RNA, 12 nt, Homo sapiens
acguaacuauuu

SEQ ID NO: 1487258 - RNA, 16 nt, Homo sapiens
acguaccccacugggc

SEQ ID NO: 1487259 - RNA, 14 nt, Homo sapiens
acgucaagucuccu

SEQ ID NO: 1487260 - RNA, 16 nt, Homo sapiens
acguccugccuggcac

SEQ ID NO: 1487261 - RNA, 18 nt, Homo sapiens
acgucgcccgcugagcug

SEQ ID NO: 1487262 - RNA, 15 nt, Homo sapiens
acguggagaaaauca

SEQ ID NO: 1487263 - RNA, 13 nt, Homo sapiens
acguggcacuggu

SEQ ID NO: 1487264 - RNA, 12 nt, Homo sapiens
acguggccucuu

SEQ ID NO: 1487265 - RNA, 13 nt, Homo sapiens
acgugggcauuuu

SEQ ID NO: 1487266 - RNA, 15 nt, Homo sapiens
acgugucuuccacuu

SEQ ID NO: 1487267 - RNA, 16 nt, Homo sapiens
acgugugcaguuguag

SEQ ID NO: 1487268 - RNA, 22 nt, Homo sapiens
acguugccuaauaaacauccuu

SEQ ID NO: 1487269 - RNA, 15 nt, Homo sapiens
acuaaaacacugaaa

SEQ ID NO: 1487270 - RNA, 17 nt, Homo sapiens
acuaaaacugcauuucc

SEQ ID NO: 1487271 - RNA, 22 nt, Homo sapiens
acuaaaauuuuaggcacucuua

SEQ ID NO: 1487272 - RNA, 16 nt, Homo sapiens
acuaaacauaugauuu

SEQ ID NO: 1487273 - RNA, 17 nt, Homo sapiens
acuaaacuucaccuaca

SEQ ID NO: 1487274 - RNA, 18 nt, Homo sapiens
acuaaaggugcacugcuu

SEQ ID NO: 1487275 - RNA, 12 nt, Homo sapiens
acuaaaguuaac

SEQ ID NO: 1487276 - RNA, 23 nt, Homo sapiens
acuaaaucaaucugcaguuuaac

SEQ ID NO: 1487277 - RNA, 14 nt, Homo sapiens
acuaaaugaacuaa

SEQ ID NO: 1487278 - RNA, 22 nt, Homo sapiens
acuaacaagaauguaacuccag

SEQ ID NO: 1487279 - RNA, 19 nt, Homo sapiens
acuaacuaugcauggugcc

SEQ ID NO: 1487280 - RNA, 15 nt, Homo sapiens
acuaagaaauaugca

SEQ ID NO: 1487281 - RNA, 22 nt, Homo sapiens
acuaaucaagaaaaacaucuuu

SEQ ID NO: 1487282 - RNA, 17 nt, Homo sapiens
acuaaucgaaugaacaa

SEQ ID NO: 1487283 - RNA, 22 nt, Homo sapiens
acuaaucugauguuaaccaaug

SEQ ID NO: 1487284 - RNA, 16 nt, Homo sapiens
acuaaugauguuuucc

SEQ ID NO: 1487285 - RNA, 21 nt, Homo sapiens
acuacaccuggcugagguucc

SEQ ID NO: 1487286 - RNA, 13 nt, Homo sapiens
acuacacugagga

SEQ ID NO: 1487287 - RNA, 16 nt, Homo sapiens
acuacauaacuuccua

SEQ ID NO: 1487288 - RNA, 15 nt, Homo sapiens
acuacaucugggacu

SEQ ID NO: 1487289 - RNA, 13 nt, Homo sapiens
acuaccuguguau

SEQ ID NO: 1487290 - RNA, 17 nt, Homo sapiens
acuacuuuuggugcuua

SEQ ID NO: 1487291 - RNA, 20 nt, Homo sapiens
acuagaaaauuagacuguga

SEQ ID NO: 1487292 - RNA, 15 nt, Homo sapiens
acuagaacucuccau

SEQ ID NO: 1487293 - RNA, 18 nt, Homo sapiens
acuagagggauacacuga

SEQ ID NO: 1487294 - RNA, 23 nt, Homo sapiens
acuagagucugaacagcuguaau

SEQ ID NO: 1487295 - RNA, 16 nt, Homo sapiens
aagcaauaaccucaaa

SEQ ID NO: 1487296 - RNA, 13 nt, Homo sapiens
aagcaaucugauu

SEQ ID NO: 1487297 - RNA, 12 nt, Homo sapiens
aagcacaagcag

SEQ ID NO: 1487298 - RNA, 12 nt, Homo sapiens
aagcaccaggac

SEQ ID NO: 1487299 - RNA, 20 nt, Homo sapiens
aagcaccuuccccuccauuc

SEQ ID NO: 1487300 - RNA, 16 nt, Homo sapiens
aagcacgugcaaggac

SEQ ID NO: 1487301 - RNA, 19 nt, Homo sapiens
aagcacuacaccuugccuu

SEQ ID NO: 1487302 - RNA, 23 nt, Homo sapiens
aagcacucuggaugauggauucc

SEQ ID NO: 1487303 - RNA, 22 nt, Homo sapiens
aagcacucuuaaagcaaaaaau

SEQ ID NO: 1487304 - RNA, 17 nt, Homo sapiens
aagcagagaaaauaauu

SEQ ID NO: 1487305 - RNA, 14 nt, Homo sapiens
aagcagaugcucug

SEQ ID NO: 1487306 - RNA, 21 nt, Homo sapiens
aagcagccacgaggugcaaca

SEQ ID NO: 1487307 - RNA, 21 nt, Homo sapiens
aagcagccauuggcacugugg

SEQ ID NO: 1487308 - RNA, 14 nt, Homo sapiens
aagcagccuccuua

SEQ ID NO: 1487309 - RNA, 22 nt, Homo sapiens
aagcagcgaccgcccccuccuc

SEQ ID NO: 1487310 - RNA, 16 nt, Homo sapiens
aagcagucaguuugca

SEQ ID NO: 1487311 - RNA, 11 nt, Homo sapiens
aagcagucuca

SEQ ID NO: 1487312 - RNA, 18 nt, Homo sapiens
aagcagugccuuccauaa

SEQ ID NO: 1487313 - RNA, 18 nt, Homo sapiens
aagcauacaaagcaguuu

SEQ ID NO: 1487314 - RNA, 24 nt, Homo sapiens
aagcaucucagccuaccaugagaa

SEQ ID NO: 1487315 - RNA, 15 nt, Homo sapiens
aagcaugaaaaagca

SEQ ID NO: 1487316 - RNA, 22 nt, Homo sapiens
aagcauguggaugacacaaucc

SEQ ID NO: 1487317 - RNA, 17 nt, Homo sapiens
aagcauuccugcucaag

SEQ ID NO: 1487318 - RNA, 15 nt, Homo sapiens
aagcauuucaccuuu

SEQ ID NO: 1487319 - RNA, 15 nt, Homo sapiens
aagccacucuguccc

SEQ ID NO: 1487320 - RNA, 17 nt, Homo sapiens
aagccagccagaggcau

SEQ ID NO: 1487321 - RNA, 23 nt, Homo sapiens
aagccaggccuggcuggaggagc

SEQ ID NO: 1487322 - RNA, 12 nt, Homo sapiens
aagccagggucu

SEQ ID NO: 1487323 - RNA, 13 nt, Homo sapiens
aagccaguuuuca

SEQ ID NO: 1487324 - RNA, 18 nt, Homo sapiens
aagcccuccccaucccau

SEQ ID NO: 1487325 - RNA, 14 nt, Homo sapiens
aagccuaauuccag

SEQ ID NO: 1487326 - RNA, 20 nt, Homo sapiens
aagccucgggccacaugggu

SEQ ID NO: 1487327 - RNA, 20 nt, Homo sapiens
aagccugaugcugacauuca

SEQ ID NO: 1487328 - RNA, 17 nt, Homo sapiens
aagccuggacucugccc

SEQ ID NO: 1487329 - RNA, 16 nt, Homo sapiens
aagccugggugacauu

SEQ ID NO: 1487330 - RNA, 23 nt, Homo sapiens
aagccuuaaguggcagaauauaa

SEQ ID NO: 1487331 - RNA, 12 nt, Homo sapiens
aagccuuaggga

SEQ ID NO: 1487332 - RNA, 17 nt, Homo sapiens
aagcggauuuccaggga

SEQ ID NO: 1487333 - RNA, 19 nt, Homo sapiens
aagcguaauuuugccaaau

SEQ ID NO: 1487334 - RNA, 15 nt, Homo sapiens
aagcuaaaaugauuu

SEQ ID NO: 1487335 - RNA, 20 nt, Homo sapiens
aagcuauuagccaggaucau

SEQ ID NO: 1487336 - RNA, 22 nt, Homo sapiens
aagcuauuauaaaacuugaauu

SEQ ID NO: 1487337 - RNA, 21 nt, Homo sapiens
aagcucagaggcgcacuguga

SEQ ID NO: 1487338 - RNA, 15 nt, Homo sapiens
aagcucaugagauga

SEQ ID NO: 1487339 - RNA, 14 nt, Homo sapiens
aagcuccacuguca

SEQ ID NO: 1487340 - RNA, 14 nt, Homo sapiens
aagcucuguugcaa

SEQ ID NO: 1487341 - RNA, 14 nt, Homo sapiens
aagcugaagugcau

SEQ ID NO: 1487342 - RNA, 20 nt, Homo sapiens
aagcugacucuuugcucuaa

SEQ ID NO: 1487343 - RNA, 16 nt, Homo sapiens
aagcugagauugagca

SEQ ID NO: 1487344 - RNA, 22 nt, Homo sapiens
aagcugcuccaggccugcagca

SEQ ID NO: 1487345 - RNA, 14 nt, Homo sapiens
aagcuggaagcaca

SEQ ID NO: 1487346 - RNA, 15 nt, Homo sapiens
aagcugguccuggga

SEQ ID NO: 1487347 - RNA, 14 nt, Homo sapiens
aagcuguccuccca

SEQ ID NO: 1487348 - RNA, 17 nt, Homo sapiens
aagcuuccgccgucuca

SEQ ID NO: 1487349 - RNA, 22 nt, Homo sapiens
aagcuuuuggagggugauauaa

SEQ ID NO: 1487350 - RNA, 21 nt, Homo sapiens
aagcuuuuuccuccuggaaca

SEQ ID NO: 1487351 - RNA, 19 nt, Homo sapiens
aaggaaagaaaacaucuuu

SEQ ID NO: 1487352 - RNA, 15 nt, Homo sapiens
aaggaaaucucaccc

SEQ ID NO: 1487353 - RNA, 22 nt, Homo sapiens
aaggaacauuccuuagucucaa

SEQ ID NO: 1487354 - RNA, 18 nt, Homo sapiens
aaggaagaagaguauuaa

SEQ ID NO: 1487355 - RNA, 12 nt, Homo sapiens
aaggaagcucca

SEQ ID NO: 1487356 - RNA, 16 nt, Homo sapiens
aaggaagcuccacugu

SEQ ID NO: 1487357 - RNA, 19 nt, Homo sapiens
aaggaagcuccacugucac

SEQ ID NO: 1487358 - RNA, 14 nt, Homo sapiens
aaggaaggcauuug

SEQ ID NO: 1487359 - RNA, 21 nt, Homo sapiens
aaggacaucagcaaacaggau

SEQ ID NO: 1487360 - RNA, 13 nt, Homo sapiens
aaggaccagguua

SEQ ID NO: 1487361 - RNA, 22 nt, Homo sapiens
aaggacucccggagccugugca

SEQ ID NO: 1487362 - RNA, 23 nt, Homo sapiens
aaggacucccggagccugugcag

SEQ ID NO: 1487363 - RNA, 17 nt, Homo sapiens
aaggacucuuccaccuc

SEQ ID NO: 1487364 - RNA, 15 nt, Homo sapiens
aaggagcagcauuga

SEQ ID NO: 1487365 - RNA, 22 nt, Homo sapiens
aaggaguacaaugcccagauca

SEQ ID NO: 1487366 - RNA, 17 nt, Homo sapiens
aaggauaaugaaauaau

SEQ ID NO: 1487367 - RNA, 15 nt, Homo sapiens
aaggauagugcgaug

SEQ ID NO: 1487368 - RNA, 21 nt, Homo sapiens
aaggaugcggcaggugcucug

SEQ ID NO: 1487369 - RNA, 23 nt, Homo sapiens
aaggaugcugucaagcaccugca

SEQ ID NO: 1487370 - RNA, 21 nt, Homo sapiens
aaggaugguuuuaucuucccu

SEQ ID NO: 1487371 - RNA, 23 nt, Homo sapiens
aaggcaaaaaacucuuaaucugu

SEQ ID NO: 1487372 - RNA, 19 nt, Homo sapiens
aaggcagcugguauauuca

SEQ ID NO: 1487373 - RNA, 20 nt, Homo sapiens
aaggcaggcagaucacuuga

SEQ ID NO: 1487374 - RNA, 19 nt, Homo sapiens
aaggcaucuacacaauuua

SEQ ID NO: 1487375 - RNA, 16 nt, Homo sapiens
aaggcccacuguaaua

SEQ ID NO: 1487376 - RNA, 15 nt, Homo sapiens
aaucagaacuaacca

SEQ ID NO: 1487377 - RNA, 23 nt, Homo sapiens
aaucagaauaaauuaauauugua

SEQ ID NO: 1487378 - RNA, 14 nt, Homo sapiens
aaucagaugcagcu

SEQ ID NO: 1487379 - RNA, 20 nt, Homo sapiens
aaucagauucuucucucuca

SEQ ID NO: 1487380 - RNA, 13 nt, Homo sapiens
aaucagcauuuag

SEQ ID NO: 1487381 - RNA, 16 nt, Homo sapiens
aaucagcauuuagucu

SEQ ID NO: 1487382 - RNA, 20 nt, Homo sapiens
aaucagcugcuacuacuccu

SEQ ID NO: 1487383 - RNA, 22 nt, Homo sapiens
aaucaggacagguggugcaaau

SEQ ID NO: 1487384 - RNA, 18 nt, Homo sapiens
aaucaguaagagguguua

SEQ ID NO: 1487385 - RNA, 19 nt, Homo sapiens
aaucauauaauaaauguac

SEQ ID NO: 1487386 - RNA, 16 nt, Homo sapiens
aaucauauugaugaaa

SEQ ID NO: 1487387 - RNA, 18 nt, Homo sapiens
aaucauccaagacaguua

SEQ ID NO: 1487388 - RNA, 21 nt, Homo sapiens
aaucaugaaauaugcaucuca

SEQ ID NO: 1487389 - RNA, 16 nt, Homo sapiens
aaucauuucaguauca

SEQ ID NO: 1487390 - RNA, 19 nt, Homo sapiens
aaucauuucuagauuauaa

SEQ ID NO: 1487391 - RNA, 16 nt, Homo sapiens
aaucauuuugccucuu

SEQ ID NO: 1487392 - RNA, 14 nt, Homo sapiens
aauccaacccgggg

SEQ ID NO: 1487393 - RNA, 13 nt, Homo sapiens
aauccagccauga

SEQ ID NO: 1487394 - RNA, 11 nt, Homo sapiens
aauccagcucc

SEQ ID NO: 1487395 - RNA, 17 nt, Homo sapiens
aauguuaugacuaugua

SEQ ID NO: 1487396 - RNA, 21 nt, Homo sapiens
aauguuauuuuuuaauuauua

SEQ ID NO: 1487397 - RNA, 22 nt, Homo sapiens
aauguuauuuuuuaauuauuau

SEQ ID NO: 1487398 - RNA, 21 nt, Homo sapiens
aauguucauuguaauguuacu

SEQ ID NO: 1487399 - RNA, 15 nt, Homo sapiens
aauguuguaauucau

SEQ ID NO: 1487400 - RNA, 16 nt, Homo sapiens
aauguuuaaagaucau

SEQ ID NO: 1487401 - RNA, 15 nt, Homo sapiens
aauguuuaccagugu

SEQ ID NO: 1487402 - RNA, 19 nt, Homo sapiens
aauuaaaaaguuaaucuuc

SEQ ID NO: 1487403 - RNA, 11 nt, Homo sapiens
aauuaaaggaa

SEQ ID NO: 1487404 - RNA, 19 nt, Homo sapiens
aauuacuuauuguauuuau

SEQ ID NO: 1487405 - RNA, 22 nt, Homo sapiens
aauuagcauuuuucaaaugauc

SEQ ID NO: 1487406 - RNA, 14 nt, Homo sapiens
aauuagccaggugu

SEQ ID NO: 1487407 - RNA, 10 nt, Homo sapiens
aauuaggcag

SEQ ID NO: 1487408 - RNA, 21 nt, Homo sapiens
aauuagggguuaaagcagaca

SEQ ID NO: 1487409 - RNA, 13 nt, Homo sapiens
aauuaguauuuau

SEQ ID NO: 1487410 - RNA, 15 nt, Homo sapiens
aauuauauagcugcu

SEQ ID NO: 1487411 - RNA, 17 nt, Homo sapiens
aauuauauuuuguugcu

SEQ ID NO: 1487412 - RNA, 18 nt, Homo sapiens
aauuaucggaagcagugc

SEQ ID NO: 1487413 - RNA, 13 nt, Homo sapiens
aauuaugaccaug

SEQ ID NO: 1487414 - RNA, 15 nt, Homo sapiens
aauuauugacacuga

SEQ ID NO: 1487415 - RNA, 16 nt, Homo sapiens
aauuauugacacugaa

SEQ ID NO: 1487416 - RNA, 14 nt, Homo sapiens
aauucaaacugggg

SEQ ID NO: 1487417 - RNA, 14 nt, Homo sapiens
aauucaagccuuag

SEQ ID NO: 1487418 - RNA, 17 nt, Homo sapiens
aauucacucaagcacug

SEQ ID NO: 1487419 - RNA, 22 nt, Homo sapiens
aauucagacaagcugcauuuca

SEQ ID NO: 1487420 - RNA, 14 nt, Homo sapiens
aauucagcacuuaa

SEQ ID NO: 1487421 - RNA, 21 nt, Homo sapiens
aauucauuuucaucacuggga

SEQ ID NO: 1487422 - RNA, 20 nt, Homo sapiens
aauucauuuuuuucacugga

SEQ ID NO: 1487423 - RNA, 15 nt, Homo sapiens
aauucccaagcuuuu

SEQ ID NO: 1487424 - RNA, 17 nt, Homo sapiens
aauucccuuuuaaucaa

SEQ ID NO: 1487425 - RNA, 22 nt, Homo sapiens
aauuccuacugacaacauuaua

SEQ ID NO: 1487426 - RNA, 16 nt, Homo sapiens
aauuccucuuacugua

SEQ ID NO: 1487427 - RNA, 17 nt, Homo sapiens
aauucuaaagagcacuu

SEQ ID NO: 1487428 - RNA, 18 nt, Homo sapiens
aauucuaaagagcacuua

SEQ ID NO: 1487429 - RNA, 21 nt, Homo sapiens
aauucuauaggaacauaugaa

SEQ ID NO: 1487430 - RNA, 17 nt, Homo sapiens
aauucuauucugaucuu

SEQ ID NO: 1487431 - RNA, 19 nt, Homo sapiens
aauucuccugccucagccu

SEQ ID NO: 1487432 - RNA, 14 nt, Homo sapiens
aauucucuuucaaa

SEQ ID NO: 1487433 - RNA, 17 nt, Homo sapiens
aauucuguaucuguaga

SEQ ID NO: 1487434 - RNA, 11 nt, Homo sapiens
aauucugugac

SEQ ID NO: 1487435 - RNA, 16 nt, Homo sapiens
aauucugugacauaca

SEQ ID NO: 1487436 - RNA, 20 nt, Homo sapiens
aauucugugacauacauauu

SEQ ID NO: 1487437 - RNA, 21 nt, Homo sapiens
aauucuuacccuguacauaug

SEQ ID NO: 1487438 - RNA, 18 nt, Homo sapiens
aauucuucuguccugaga

SEQ ID NO: 1487439 - RNA, 15 nt, Homo sapiens
aauugacaacacagc

SEQ ID NO: 1487440 - RNA, 22 nt, Homo sapiens
aauugacuaccguuguuugcaa

SEQ ID NO: 1487441 - RNA, 22 nt, Homo sapiens
aauugauuuuccuuugugcaug

SEQ ID NO: 1487442 - RNA, 16 nt, Homo sapiens
aauugcaaaucuugaa

SEQ ID NO: 1487443 - RNA, 12 nt, Homo sapiens
aauugcauuucc

SEQ ID NO: 1487444 - RNA, 11 nt, Homo sapiens
aauugcucaag

SEQ ID NO: 1487445 - RNA, 21 nt, Homo sapiens
aauugcucccuaccagcugaa

SEQ ID NO: 1487446 - RNA, 15 nt, Homo sapiens
aauuggcacuaaaga

SEQ ID NO: 1487447 - RNA, 20 nt, Homo sapiens
aauuggucccaagacaugaa

SEQ ID NO: 1487448 - RNA, 19 nt, Homo sapiens
aauugucuaaaaugucagu

SEQ ID NO: 1487449 - RNA, 16 nt, Homo sapiens
aauugucuuuugucau

SEQ ID NO: 1487450 - RNA, 17 nt, Homo sapiens
aauugugaucagaccau

SEQ ID NO: 1487451 - RNA, 19 nt, Homo sapiens
aauugugaucagaccauaa

SEQ ID NO: 1487452 - RNA, 23 nt, Homo sapiens
aauugugugugaugugaagccaa

SEQ ID NO: 1487453 - RNA, 12 nt, Homo sapiens
aauuguguuucc

SEQ ID NO: 1487454 - RNA, 19 nt, Homo sapiens
aauuuaaacuuguuuacaa

SEQ ID NO: 1487455 - RNA, 19 nt, Homo sapiens
aauuuaaagggaaaacccu

SEQ ID NO: 1487456 - RNA, 18 nt, Homo sapiens
aauuuaacaaacuaaaaa

SEQ ID NO: 1487457 - RNA, 16 nt, Homo sapiens
aauuuaacauguguau

SEQ ID NO: 1487458 - RNA, 14 nt, Homo sapiens
aauuuaauuccucu

SEQ ID NO: 1487459 - RNA, 17 nt, Homo sapiens
aauuuacccauuucuau

SEQ ID NO: 1487460 - RNA, 14 nt, Homo sapiens
aauuuagggagaaa

SEQ ID NO: 1487461 - RNA, 22 nt, Homo sapiens
aauuuauaguuaaggcuaaaaa

SEQ ID NO: 1487462 - RNA, 14 nt, Homo sapiens
aauuuaucuuucaa

SEQ ID NO: 1487463 - RNA, 19 nt, Homo sapiens
aauuuauuaacuaaucaag

SEQ ID NO: 1487464 - RNA, 20 nt, Homo sapiens
aauuuauucacauauaucaa

SEQ ID NO: 1487465 - RNA, 22 nt, Homo sapiens
aauuuauuuauuaagauggauu

SEQ ID NO: 1487466 - RNA, 19 nt, Homo sapiens
aauuuauuuccacuaaaaa

SEQ ID NO: 1487467 - RNA, 20 nt, Homo sapiens
aauuucacucucugcauuga

SEQ ID NO: 1487468 - RNA, 15 nt, Homo sapiens
aauuucaguaaacaa

SEQ ID NO: 1487469 - RNA, 15 nt, Homo sapiens
aauuuccaguaccuu

SEQ ID NO: 1487470 - RNA, 13 nt, Homo sapiens
aauuuccugaugc

SEQ ID NO: 1487471 - RNA, 18 nt, Homo sapiens
aauuuccuuacucuugau

SEQ ID NO: 1487472 - RNA, 20 nt, Homo sapiens
aauuuccuuuuugacacuga

SEQ ID NO: 1487473 - RNA, 13 nt, Homo sapiens
aauuucgagauuu

SEQ ID NO: 1487474 - RNA, 19 nt, Homo sapiens
aauuucuaaaaaacagagg

SEQ ID NO: 1487475 - RNA, 19 nt, Homo sapiens
aauuucuccucccuuccuu

SEQ ID NO: 1487476 - RNA, 14 nt, Homo sapiens
aauuugaauguggu

SEQ ID NO: 1487477 - RNA, 15 nt, Homo sapiens
aauuugaugccagga

SEQ ID NO: 1487478 - RNA, 17 nt, Homo sapiens
aauuugcuagcaguaaa

SEQ ID NO: 1487479 - RNA, 16 nt, Homo sapiens
aauaaaguguaacaau

SEQ ID NO: 1487480 - RNA, 17 nt, Homo sapiens
aauaaaucugacccagu

SEQ ID NO: 1487481 - RNA, 15 nt, Homo sapiens
aauaaauguauucaa

SEQ ID NO: 1487482 - RNA, 16 nt, Homo sapiens
aauaaaugucuugccu

SEQ ID NO: 1487483 - RNA, 13 nt, Homo sapiens
aauaaauuguaaa

SEQ ID NO: 1487484 - RNA, 16 nt, Homo sapiens
aauaaauuguguuucc

SEQ ID NO: 1487485 - RNA, 20 nt, Homo sapiens
aauaaauuuauuucaauauu

SEQ ID NO: 1487486 - RNA, 16 nt, Homo sapiens
aauaacaucaccacug

SEQ ID NO: 1487487 - RNA, 23 nt, Homo sapiens
aauaacuaaaagguaugcaauca

SEQ ID NO: 1487488 - RNA, 13 nt, Homo sapiens
aauaacugugaag

SEQ ID NO: 1487489 - RNA, 23 nt, Homo sapiens
aauaacuuagcuugcacaugaau

SEQ ID NO: 1487490 - RNA, 17 nt, Homo sapiens
aauaagagauccuuuag

SEQ ID NO: 1487491 - RNA, 18 nt, Homo sapiens
aauaaggaaacgaugaaa

SEQ ID NO: 1487492 - RNA, 20 nt, Homo sapiens
aauaaguuugcuccuucaua

SEQ ID NO: 1487493 - RNA, 14 nt, Homo sapiens
aauaauaguuauua

SEQ ID NO: 1487494 - RNA, 14 nt, Homo sapiens
aauaaugacacucc

SEQ ID NO: 1487495 - RNA, 21 nt, Homo sapiens
aauaaugaguuagaacuauua

SEQ ID NO: 1487496 - RNA, 20 nt, Homo sapiens
aauaauggcaucaauauaca

SEQ ID NO: 1487497 - RNA, 14 nt, Homo sapiens
aauaauguacaucu

SEQ ID NO: 1487498 - RNA, 16 nt, Homo sapiens
aauaauguacaucugg

SEQ ID NO: 1487499 - RNA, 14 nt, Homo sapiens
aagaaaacaacuuc

SEQ ID NO: 1487500 - RNA, 20 nt, Homo sapiens
aagaaaaggacaaauaucuu

SEQ ID NO: 1487501 - RNA, 14 nt, Homo sapiens
aagaaaauccauua

SEQ ID NO: 1487502 - RNA, 13 nt, Homo sapiens
aagaaaauggauu

SEQ ID NO: 1487503 - RNA, 15 nt, Homo sapiens
aagaaacgucuucua

SEQ ID NO: 1487504 - RNA, 14 nt, Homo sapiens
aagaaagacuaucu

SEQ ID NO: 1487505 - RNA, 16 nt, Homo sapiens
aagaaagaucaaagac

SEQ ID NO: 1487506 - RNA, 14 nt, Homo sapiens
aagaaagcugagaa

SEQ ID NO: 1487507 - RNA, 17 nt, Homo sapiens
aagaaaguguuggcuaa

SEQ ID NO: 1487508 - RNA, 15 nt, Homo sapiens
aagaaauaugugaga

SEQ ID NO: 1487509 - RNA, 23 nt, Homo sapiens
aagaaaucuacuauaucccuuaa

SEQ ID NO: 1487510 - RNA, 12 nt, Homo sapiens
aagaaaugcaaa

SEQ ID NO: 1487511 - RNA, 18 nt, Homo sapiens
aagaacaacugccaagaa

SEQ ID NO: 1487512 - RNA, 18 nt, Homo sapiens
aagaacacuacugcuaaa

SEQ ID NO: 1487513 - RNA, 12 nt, Homo sapiens
aagaacauguga

SEQ ID NO: 1487514 - RNA, 12 nt, Homo sapiens
aagaaccagaga

SEQ ID NO: 1487515 - RNA, 22 nt, Homo sapiens
aagaaccagagaggcucugaga

SEQ ID NO: 1487516 - RNA, 23 nt, Homo sapiens
aagaacuggaaccccagcuuccc

SEQ ID NO: 1487517 - RNA, 13 nt, Homo sapiens
aagaaggaacaau

SEQ ID NO: 1487518 - RNA, 11 nt, Homo sapiens
aagaaggcauu

SEQ ID NO: 1487519 - RNA, 13 nt, Homo sapiens
aagaaggcauuug

SEQ ID NO: 1487520 - RNA, 19 nt, Homo sapiens
aagaaguguccgagaacua

SEQ ID NO: 1487521 - RNA, 13 nt, Homo sapiens
aagaauaauucaa

SEQ ID NO: 1487522 - RNA, 21 nt, Homo sapiens
aagaaucagaaacaggugcau

SEQ ID NO: 1487523 - RNA, 16 nt, Homo sapiens
aagaaugaacccaaga

SEQ ID NO: 1487524 - RNA, 17 nt, Homo sapiens
aagaaugaauaauaauu

SEQ ID NO: 1487525 - RNA, 13 nt, Homo sapiens
aagaaugaucagc

SEQ ID NO: 1487526 - RNA, 23 nt, Homo sapiens
aagaauuaaugacuuacuuuaau

SEQ ID NO: 1487527 - RNA, 18 nt, Homo sapiens
aagaauucaaaccugacc

SEQ ID NO: 1487528 - RNA, 12 nt, Homo sapiens
aagaauugccaa

SEQ ID NO: 1487529 - RNA, 13 nt, Homo sapiens
aagaauuggccag

SEQ ID NO: 1487530 - RNA, 12 nt, Homo sapiens
aagaauuucaca

SEQ ID NO: 1487531 - RNA, 17 nt, Homo sapiens
aagaauuucacaagcua

SEQ ID NO: 1487532 - RNA, 22 nt, Homo sapiens
aagaauuuuuuuuaacauucca

SEQ ID NO: 1487533 - RNA, 15 nt, Homo sapiens
aagacaaacugcaca

SEQ ID NO: 1487534 - RNA, 13 nt, Homo sapiens
aagacaacauaac

SEQ ID NO: 1487535 - RNA, 18 nt, Homo sapiens
aagacagaaaagugccug

SEQ ID NO: 1487536 - RNA, 16 nt, Homo sapiens
aagacagcugcugggu

SEQ ID NO: 1487537 - RNA, 20 nt, Homo sapiens
aagacauacuccuuccauca

SEQ ID NO: 1487538 - RNA, 15 nt, Homo sapiens
aagacauacugcuug

SEQ ID NO: 1487539 - RNA, 20 nt, Homo sapiens
aagacaugauuuccuugaau

SEQ ID NO: 1487540 - RNA, 18 nt, Homo sapiens
aagaccagagcaguuuca

SEQ ID NO: 1487541 - RNA, 14 nt, Homo sapiens
aagaccgauugcau

SEQ ID NO: 1487542 - RNA, 13 nt, Homo sapiens
aagaccuggaccg

SEQ ID NO: 1487543 - RNA, 15 nt, Homo sapiens
aagacuacuauacaa

SEQ ID NO: 1487544 - RNA, 13 nt, Homo sapiens
aagacucaccuca

SEQ ID NO: 1487545 - RNA, 15 nt, Homo sapiens
aagacucuauucuca

SEQ ID NO: 1487546 - RNA, 11 nt, Homo sapiens
aagacucugac

SEQ ID NO: 1487547 - RNA, 17 nt, Homo sapiens
aagacucugaccagaga

SEQ ID NO: 1487548 - RNA, 23 nt, Homo sapiens
aagacugaaucuaccugcccuaa

SEQ ID NO: 1487549 - RNA, 15 nt, Homo sapiens
aagacuguugcucaa

SEQ ID NO: 1487550 - RNA, 15 nt, Homo sapiens
aagacuuugauccag

SEQ ID NO: 1487551 - RNA, 14 nt, Homo sapiens
aagagacacuccaa

SEQ ID NO: 1487552 - RNA, 14 nt, Homo sapiens
aagagacugggaag

SEQ ID NO: 1487553 - RNA, 23 nt, Homo sapiens
aagagagucgcaucucagugcag

SEQ ID NO: 1487554 - RNA, 22 nt, Homo sapiens
aagagcccccuugacaccgggg

SEQ ID NO: 1487555 - RNA, 20 nt, Homo sapiens
aagagcgagacucugucuca

SEQ ID NO: 1487556 - RNA, 19 nt, Homo sapiens
aagagcuauggcccagaaa

SEQ ID NO: 1487557 - RNA, 14 nt, Homo sapiens
aagagcuggaugca

SEQ ID NO: 1487558 - RNA, 22 nt, Homo sapiens
aagagcuggcaaagguggcucu

SEQ ID NO: 1487559 - RNA, 15 nt, Homo sapiens
aagaggaacuugacc

SEQ ID NO: 1487560 - RNA, 13 nt, Homo sapiens
aagaggacugugu

SEQ ID NO: 1487561 - RNA, 19 nt, Homo sapiens
aagaggcaccacuaaaaga

SEQ ID NO: 1487562 - RNA, 15 nt, Homo sapiens
aagaggcugcugcag

SEQ ID NO: 1487563 - RNA, 13 nt, Homo sapiens
aagagggcuuccu

SEQ ID NO: 1487564 - RNA, 14 nt, Homo sapiens
aagaguaguaauag

SEQ ID NO: 1487565 - RNA, 17 nt, Homo sapiens
aagaguccauaaaaauc

SEQ ID NO: 1487566 - RNA, 17 nt, Homo sapiens
aagaguccuuguuccag

SEQ ID NO: 1487567 - RNA, 19 nt, Homo sapiens
aagagucuggccuggaccc

SEQ ID NO: 1487568 - RNA, 14 nt, Homo sapiens
aagaguuacuuaau

SEQ ID NO: 1487569 - RNA, 19 nt, Homo sapiens
aagauaacaagaucuuuca

SEQ ID NO: 1487570 - RNA, 16 nt, Homo sapiens
aagauaauuguugaaa

SEQ ID NO: 1487571 - RNA, 15 nt, Homo sapiens
aagauaauuuacuua

SEQ ID NO: 1487572 - RNA, 12 nt, Homo sapiens
aagauacagugu

SEQ ID NO: 1487573 - RNA, 18 nt, Homo sapiens
aagauaccggugcuucug

SEQ ID NO: 1487574 - RNA, 19 nt, Homo sapiens
aagauagaugcacuuaugc

SEQ ID NO: 1487575 - RNA, 16 nt, Homo sapiens
aagauauaacauucag

SEQ ID NO: 1487576 - RNA, 19 nt, Homo sapiens
aagauauauuucacuuuug

SEQ ID NO: 1487577 - RNA, 22 nt, Homo sapiens
aagaucaaaauaaaaagugaca

SEQ ID NO: 1487578 - RNA, 23 nt, Homo sapiens
aagaucaauucccucucucagca

SEQ ID NO: 1487579 - RNA, 18 nt, Homo sapiens
aagauccuccugcugcag

SEQ ID NO: 1487580 - RNA, 16 nt, Homo sapiens
uuccuaauaugcuuua

SEQ ID NO: 1487581 - RNA, 21 nt, Homo sapiens
uuccuagggaugugugagaau

SEQ ID NO: 1487582 - RNA, 17 nt, Homo sapiens
uuccucaagaacacagc

SEQ ID NO: 1487583 - RNA, 20 nt, Homo sapiens
uuccucacuaugacacugag

SEQ ID NO: 1487584 - RNA, 18 nt, Homo sapiens
uucuuggugguggaugac

SEQ ID NO: 1487585 - RNA, 22 nt, Homo sapiens
uucuuuaagcagcgccagugac

SEQ ID NO: 1487586 - RNA, 14 nt, Homo sapiens
uucuuuaccugaga

SEQ ID NO: 1487587 - RNA, 15 nt, Homo sapiens
uucuuuaucuugaca

SEQ ID NO: 1487588 - RNA, 16 nt, Homo sapiens
uucuuugcugcaguca

SEQ ID NO: 1487589 - RNA, 20 nt, Homo sapiens
uucuuugcugcagucaucua

SEQ ID NO: 1487590 - RNA, 20 nt, Homo sapiens
uucuuugggauugcuaugaa

SEQ ID NO: 1487591 - RNA, 17 nt, Homo sapiens
uucuuugggccagacau

SEQ ID NO: 1487592 - RNA, 14 nt, Homo sapiens
uucuuugugccuuu

SEQ ID NO: 1487593 - RNA, 14 nt, Homo sapiens
uucuuuuacuugaa

SEQ ID NO: 1487594 - RNA, 13 nt, Homo sapiens
uucuuuuauguga

SEQ ID NO: 1487595 - RNA, 17 nt, Homo sapiens
uugaaaaaauagaucca

SEQ ID NO: 1487596 - RNA, 18 nt, Homo sapiens
uugaaaaauggcaaagaa

SEQ ID NO: 1487597 - RNA, 20 nt, Homo sapiens
uugaaacagauucaggccag

SEQ ID NO: 1487598 - RNA, 13 nt, Homo sapiens
uugaaacuaguua

SEQ ID NO: 1487599 - RNA, 20 nt, Homo sapiens
uugaaagaucaaaagguuaa

SEQ ID NO: 1487600 - RNA, 16 nt, Homo sapiens
uugaaauagucugugu

SEQ ID NO: 1487601 - RNA, 19 nt, Homo sapiens
uugaaauuauaucuguggu

SEQ ID NO: 1487602 - RNA, 15 nt, Homo sapiens
uugaacccaggagau

SEQ ID NO: 1487603 - RNA, 11 nt, Homo sapiens
uugaagccaaa

SEQ ID NO: 1487604 - RNA, 12 nt, Homo sapiens
uugaagccucag

SEQ ID NO: 1487605 - RNA, 20 nt, Homo sapiens
uugaaggugcugacggccag

SEQ ID NO: 1487606 - RNA, 21 nt, Homo sapiens
uugaaguuuuagcggucaauu

SEQ ID NO: 1487607 - RNA, 14 nt, Homo sapiens
uugaauacaaguuu

SEQ ID NO: 1487608 - RNA, 17 nt, Homo sapiens
uugaaucaaagcaguua

SEQ ID NO: 1487609 - RNA, 12 nt, Homo sapiens
uugaaucaguuu

SEQ ID NO: 1487610 - RNA, 17 nt, Homo sapiens
uugaaugcugccagugu

SEQ ID NO: 1487611 - RNA, 21 nt, Homo sapiens
uugaaugugguuacuuccuac

SEQ ID NO: 1487612 - RNA, 14 nt, Homo sapiens
uugaauuucacugu

SEQ ID NO: 1487613 - RNA, 14 nt, Homo sapiens
uugacaacacagcc

SEQ ID NO: 1487614 - RNA, 17 nt, Homo sapiens
uugacaaccaugagacc

SEQ ID NO: 1487615 - RNA, 17 nt, Homo sapiens
uugacaacugcacauga

SEQ ID NO: 1487616 - RNA, 15 nt, Homo sapiens
uugacaacugugacu

SEQ ID NO: 1487617 - RNA, 11 nt, Homo sapiens
uugacaccugc

SEQ ID NO: 1487618 - RNA, 13 nt, Homo sapiens
uugacaugugcaa

SEQ ID NO: 1487619 - RNA, 13 nt, Homo sapiens
uugaccacccacc

SEQ ID NO: 1487620 - RNA, 20 nt, Homo sapiens
uugaccucaucucccgagca

SEQ ID NO: 1487621 - RNA, 16 nt, Homo sapiens
uugaccucucauaaau

SEQ ID NO: 1487622 - RNA, 22 nt, Homo sapiens
uugacuagaugauggaugccaa

SEQ ID NO: 1487623 - RNA, 19 nt, Homo sapiens
uugacuuccugccauggau

SEQ ID NO: 1487624 - RNA, 14 nt, Homo sapiens
uugagaaucccaaa

SEQ ID NO: 1487625 - RNA, 16 nt, Homo sapiens
uugagccaguggugcu

SEQ ID NO: 1487626 - RNA, 18 nt, Homo sapiens
uugagccaguggugcuaa

SEQ ID NO: 1487627 - RNA, 12 nt, Homo sapiens
uugaggagcauu

SEQ ID NO: 1487628 - RNA, 20 nt, Homo sapiens
uugaggccugcccucaggga

SEQ ID NO: 1487629 - RNA, 18 nt, Homo sapiens
uugaggggcugacuucaa

SEQ ID NO: 1487630 - RNA, 22 nt, Homo sapiens
uugagguaauaaugacacuccu

SEQ ID NO: 1487631 - RNA, 16 nt, Homo sapiens
uugaguaaugugacua

SEQ ID NO: 1487632 - RNA, 15 nt, Homo sapiens
uugaguaccuacugu

SEQ ID NO: 1487633 - RNA, 21 nt, Homo sapiens
uugaguaccuacugugugcca

SEQ ID NO: 1487634 - RNA, 19 nt, Homo sapiens
uugaguagaguugaucaaa

SEQ ID NO: 1487635 - RNA, 20 nt, Homo sapiens
uugagugacucgaggguugg

SEQ ID NO: 1487636 - RNA, 22 nt, Homo sapiens
uugauaaaugacacaaugaagu

SEQ ID NO: 1487637 - RNA, 17 nt, Homo sapiens
uugauagaaccauugca

SEQ ID NO: 1487638 - RNA, 20 nt, Homo sapiens
uugauaguuaauuauuucaa

SEQ ID NO: 1487639 - RNA, 16 nt, Homo sapiens
uugaucaaauauuuca

SEQ ID NO: 1487640 - RNA, 17 nt, Homo sapiens
uugaucaaauauuucaa

SEQ ID NO: 1487641 - RNA, 16 nt, Homo sapiens
uugaucaaccaaaaac

SEQ ID NO: 1487642 - RNA, 13 nt, Homo sapiens
uugaucacuacaa

SEQ ID NO: 1487643 - RNA, 14 nt, Homo sapiens
uugaucacuacaag

SEQ ID NO: 1487644 - RNA, 22 nt, Homo sapiens
uugaucauaaacugacuaucau

SEQ ID NO: 1487645 - RNA, 22 nt, Homo sapiens
uugaucuggaacccagacucag

SEQ ID NO: 1487646 - RNA, 22 nt, Homo sapiens
uugauguacauaacuccugucc

SEQ ID NO: 1487647 - RNA, 15 nt, Homo sapiens
uugauuucauuaaua

SEQ ID NO: 1487648 - RNA, 19 nt, Homo sapiens
uugauuugcauggauuuug

SEQ ID NO: 1487649 - RNA, 14 nt, Homo sapiens
uugauuuugugaua

SEQ ID NO: 1487650 - RNA, 20 nt, Homo sapiens
uugcaacagcuuucugagaa

SEQ ID NO: 1487651 - RNA, 17 nt, Homo sapiens
uugcaagaugugaauua

SEQ ID NO: 1487652 - RNA, 16 nt, Homo sapiens
uugcaaucuucuacuu

SEQ ID NO: 1487653 - RNA, 18 nt, Homo sapiens
uugcacaauccaugaaca

SEQ ID NO: 1487654 - RNA, 23 nt, Homo sapiens
uugcaccaggcacugcugcacaa

SEQ ID NO: 1487655 - RNA, 20 nt, Homo sapiens
uugcaccuguccccacccuc

SEQ ID NO: 1487656 - RNA, 18 nt, Homo sapiens
uugcagaaaauucugugc

SEQ ID NO: 1487657 - RNA, 20 nt, Homo sapiens
uugcagcagugagucucuuc

SEQ ID NO: 1487658 - RNA, 13 nt, Homo sapiens
uugcagggguccc

SEQ ID NO: 1487659 - RNA, 14 nt, Homo sapiens
uugcaggugacauu

SEQ ID NO: 1487660 - RNA, 17 nt, Homo sapiens
uugcagugaauucauau

SEQ ID NO: 1487661 - RNA, 20 nt, Homo sapiens
uugcagugagcugagaucac

SEQ ID NO: 1487662 - RNA, 18 nt, Homo sapiens
uugcauggcuccagaaau

SEQ ID NO: 1487663 - RNA, 13 nt, Homo sapiens
uugcauuccagaa

SEQ ID NO: 1487664 - RNA, 14 nt, Homo sapiens
uugcauuccagaau

SEQ ID NO: 1487665 - RNA, 21 nt, Homo sapiens
uugcauuuugauaaaauuaau

SEQ ID NO: 1487666 - RNA, 19 nt, Homo sapiens
uugccacugcugugugauu

SEQ ID NO: 1487667 - RNA, 18 nt, Homo sapiens
uugccagaugcaauacaa

SEQ ID NO: 1487668 - RNA, 16 nt, Homo sapiens
uugccagcugcugcug

SEQ ID NO: 1487669 - RNA, 15 nt, Homo sapiens
uugccauaaagucaa

SEQ ID NO: 1487670 - RNA, 18 nt, Homo sapiens
uugcccagacuacagggc

SEQ ID NO: 1487671 - RNA, 12 nt, Homo sapiens
uugccccaagau

SEQ ID NO: 1487672 - RNA, 19 nt, Homo sapiens
uugccccacucaucugccg

SEQ ID NO: 1487673 - RNA, 17 nt, Homo sapiens
uugcccccagacuuccu

SEQ ID NO: 1487674 - RNA, 20 nt, Homo sapiens
uugcccgaaacuaagccagg

SEQ ID NO: 1487675 - RNA, 12 nt, Homo sapiens
uugccgcuguau

SEQ ID NO: 1487676 - RNA, 18 nt, Homo sapiens
uugccuaacuaacuggca

SEQ ID NO: 1487677 - RNA, 23 nt, Homo sapiens
uugccuaaggugcguaguccaac

SEQ ID NO: 1487678 - RNA, 14 nt, Homo sapiens
uugccucaccuaau

SEQ ID NO: 1487679 - RNA, 17 nt, Homo sapiens
uugccuggagugugaac

SEQ ID NO: 1487680 - RNA, 16 nt, Homo sapiens
uugccuucuaggucac

SEQ ID NO: 1487681 - RNA, 17 nt, Homo sapiens
uugccuuucuucugccc

SEQ ID NO: 1487682 - RNA, 20 nt, Homo sapiens
uugcgagccucgcagccucc

SEQ ID NO: 1487683 - RNA, 19 nt, Homo sapiens
uugcgauucugcagccaca

SEQ ID NO: 1487684 - RNA, 15 nt, Homo sapiens
uugcgugauucaaug

SEQ ID NO: 1487685 - RNA, 15 nt, Homo sapiens
uugcuaaaauauuau

SEQ ID NO: 1487686 - RNA, 17 nt, Homo sapiens
uugcuaacaaugcucug

SEQ ID NO: 1487687 - RNA, 16 nt, Homo sapiens
uuuaaaaaaaagcaua

SEQ ID NO: 1487688 - RNA, 22 nt, Homo sapiens
uuuaaaacccaacucuuacucu

SEQ ID NO: 1487689 - RNA, 14 nt, Homo sapiens
uuuaaaauauuuag

SEQ ID NO: 1487690 - RNA, 16 nt, Homo sapiens
ucaggccccgccccau

SEQ ID NO: 1487691 - RNA, 16 nt, Homo sapiens
ucaggccgcauccuga

SEQ ID NO: 1487692 - RNA, 17 nt, Homo sapiens
ucagggaaaaggaguag

SEQ ID NO: 1487693 - RNA, 17 nt, Homo sapiens
ucagggccaguccuccu

SEQ ID NO: 1487694 - RNA, 19 nt, Homo sapiens
ucagggccuggggccugag

SEQ ID NO: 1487695 - RNA, 16 nt, Homo sapiens
ucaggggauacaggcc

SEQ ID NO: 1487696 - RNA, 20 nt, Homo sapiens
ucagggggauaacuaccaga

SEQ ID NO: 1487697 - RNA, 15 nt, Homo sapiens
ucaggggugcauucu

SEQ ID NO: 1487698 - RNA, 16 nt, Homo sapiens
ucagggugucuggggc

SEQ ID NO: 1487699 - RNA, 22 nt, Homo sapiens
ucagguagaagguugacacagu

SEQ ID NO: 1487700 - RNA, 17 nt, Homo sapiens
ucaggucccaggccagc

SEQ ID NO: 1487701 - RNA, 13 nt, Homo sapiens
ucaggugauccac

SEQ ID NO: 1487702 - RNA, 15 nt, Homo sapiens
ucagguucuucaggg

SEQ ID NO: 1487703 - RNA, 18 nt, Homo sapiens
ucaguauaauuuaacuuc

SEQ ID NO: 1487704 - RNA, 20 nt, Homo sapiens
ucaguauuucaguguaguua

SEQ ID NO: 1487705 - RNA, 21 nt, Homo sapiens
ucagucaacaacuuacacuua

SEQ ID NO: 1487706 - RNA, 17 nt, Homo sapiens
ucagucauuagacuccu

SEQ ID NO: 1487707 - RNA, 17 nt, Homo sapiens
ucaguccuguacucugg

SEQ ID NO: 1487708 - RNA, 20 nt, Homo sapiens
ucagugaaagccagauucaa

SEQ ID NO: 1487709 - RNA, 18 nt, Homo sapiens
ucagugaagaugcaauca

SEQ ID NO: 1487710 - RNA, 22 nt, Homo sapiens
ucagugaagaugcaaucagaca

SEQ ID NO: 1487711 - RNA, 16 nt, Homo sapiens
ucagugauuacuguca

SEQ ID NO: 1487712 - RNA, 19 nt, Homo sapiens
ucaguguccucuugcucaa

SEQ ID NO: 1487713 - RNA, 14 nt, Homo sapiens
ucaguguugagaug

SEQ ID NO: 1487714 - RNA, 19 nt, Homo sapiens
ucaguguuuuaaauucuga

SEQ ID NO: 1487715 - RNA, 16 nt, Homo sapiens
ucaguugccauugaca

SEQ ID NO: 1487716 - RNA, 16 nt, Homo sapiens
ucaguuuucagcuaua

SEQ ID NO: 1487717 - RNA, 14 nt, Homo sapiens
uauuccucuaggca

SEQ ID NO: 1487718 - RNA, 17 nt, Homo sapiens
uauucugguuacugugg

SEQ ID NO: 1487719 - RNA, 15 nt, Homo sapiens
uauucugugcgcuac

SEQ ID NO: 1487720 - RNA, 15 nt, Homo sapiens
uauucuugugcuuuu

SEQ ID NO: 1487721 - RNA, 19 nt, Homo sapiens
uauugacacugaacuuaau

SEQ ID NO: 1487722 - RNA, 21 nt, Homo sapiens
uauugagauaauuuauuuaau

SEQ ID NO: 1487723 - RNA, 19 nt, Homo sapiens
uauugaugauaacacuuaa

SEQ ID NO: 1487724 - RNA, 14 nt, Homo sapiens
uauugcgcugcuac

SEQ ID NO: 1487725 - RNA, 21 nt, Homo sapiens
uauuggagccccaggggacaa

SEQ ID NO: 1487726 - RNA, 22 nt, Homo sapiens
uauugggguuggaacauuucag

SEQ ID NO: 1487727 - RNA, 13 nt, Homo sapiens
uauuggugcuaga

SEQ ID NO: 1487728 - RNA, 12 nt, Homo sapiens
uauuguacauaa

SEQ ID NO: 1487729 - RNA, 15 nt, Homo sapiens
uauuguauugcugcu

SEQ ID NO: 1487730 - RNA, 17 nt, Homo sapiens
uauugugaaguacauau

SEQ ID NO: 1487731 - RNA, 15 nt, Homo sapiens
uauuguuacacauua

SEQ ID NO: 1487732 - RNA, 17 nt, Homo sapiens
uauuguuccaagacauu

SEQ ID NO: 1487733 - RNA, 23 nt, Homo sapiens
uauuguuccaagacauugucaau

SEQ ID NO: 1487734 - RNA, 18 nt, Homo sapiens
uauuguugacaacuguga

SEQ ID NO: 1487735 - RNA, 23 nt, Homo sapiens
uauuuaaauaaagucucucugac

SEQ ID NO: 1487736 - RNA, 14 nt, Homo sapiens
uauuuaaguucaua

SEQ ID NO: 1487737 - RNA, 17 nt, Homo sapiens
uauuuaauuaaaucuca

SEQ ID NO: 1487738 - RNA, 17 nt, Homo sapiens
uauuuaugccucuguau

SEQ ID NO: 1487739 - RNA, 13 nt, Homo sapiens
uauuuauuuacug

SEQ ID NO: 1487740 - RNA, 13 nt, Homo sapiens
uauuucacaagaa

SEQ ID NO: 1487741 - RNA, 13 nt, Homo sapiens
uauuucacuuuag

SEQ ID NO: 1487742 - RNA, 20 nt, Homo sapiens
uauuuccuuuaugugaauuu

SEQ ID NO: 1487743 - RNA, 17 nt, Homo sapiens
uauuucuagaagcacau

SEQ ID NO: 1487744 - RNA, 16 nt, Homo sapiens
uauuucucugaauuca

SEQ ID NO: 1487745 - RNA, 17 nt, Homo sapiens
uauuucuuccuaccaag

SEQ ID NO: 1487746 - RNA, 15 nt, Homo sapiens
uauuucuugcuuuca

SEQ ID NO: 1487747 - RNA, 18 nt, Homo sapiens
uauuugaccggaucuaca

SEQ ID NO: 1487748 - RNA, 13 nt, Homo sapiens
uauuugcaauauu

SEQ ID NO: 1487749 - RNA, 15 nt, Homo sapiens
uauuugccuucugaa

SEQ ID NO: 1487750 - RNA, 13 nt, Homo sapiens
uauuugguacugu

SEQ ID NO: 1487751 - RNA, 18 nt, Homo sapiens
uauuuguaaaucugccac

SEQ ID NO: 1487752 - RNA, 16 nt, Homo sapiens
uauuuuaagcacucuu

SEQ ID NO: 1487753 - RNA, 18 nt, Homo sapiens
uauuuuaagcacucuuaa

SEQ ID NO: 1487754 - RNA, 16 nt, Homo sapiens
uauuuuaucugcuaug

SEQ ID NO: 1487755 - RNA, 21 nt, Homo sapiens
uauuuucccccuuuucugcau

SEQ ID NO: 1487756 - RNA, 19 nt, Homo sapiens
uauuuuccccuagcuuucc

SEQ ID NO: 1487757 - RNA, 13 nt, Homo sapiens
uauuuucuguuga

SEQ ID NO: 1487758 - RNA, 14 nt, Homo sapiens
uauuuucuuuauca

SEQ ID NO: 1487759 - RNA, 13 nt, Homo sapiens
uauuuugcauucc

SEQ ID NO: 1487760 - RNA, 14 nt, Homo sapiens
uauuuuuauacuga

SEQ ID NO: 1487761 - RNA, 23 nt, Homo sapiens
uauuuuucaaagauguguugcua

SEQ ID NO: 1487762 - RNA, 12 nt, Homo sapiens
uauuuuugccaa

SEQ ID NO: 1487763 - RNA, 12 nt, Homo sapiens
uauuuuuugcaa

SEQ ID NO: 1487764 - RNA, 20 nt, Homo sapiens
ucaaaaaaucugaccaaaac

SEQ ID NO: 1487765 - RNA, 13 nt, Homo sapiens
ucaaaaauacaaa

SEQ ID NO: 1487766 - RNA, 16 nt, Homo sapiens
ucaaaaauauuugcug

SEQ ID NO: 1487767 - RNA, 17 nt, Homo sapiens
ucaaaacagagauguga

SEQ ID NO: 1487768 - RNA, 17 nt, Homo sapiens
ucaaaacucaaauguga

SEQ ID NO: 1487769 - RNA, 13 nt, Homo sapiens
ucaaaagaucaaa

SEQ ID NO: 1487770 - RNA, 23 nt, Homo sapiens
ucaaaaguugguguugacauaca

SEQ ID NO: 1487771 - RNA, 16 nt, Homo sapiens
ucaaaauauacauuca

SEQ ID NO: 1487772 - RNA, 15 nt, Homo sapiens
ucaaaauccuuccaa

SEQ ID NO: 1487773 - RNA, 18 nt, Homo sapiens
ucaaaauccuuccaaaga

SEQ ID NO: 1487774 - RNA, 19 nt, Homo sapiens
ucaaaauccuuccaaagaa

SEQ ID NO: 1487775 - RNA, 15 nt, Homo sapiens
ucaaacccauucccu

SEQ ID NO: 1487776 - RNA, 15 nt, Homo sapiens
ucaaaccuguagaug

SEQ ID NO: 1487777 - RNA, 20 nt, Homo sapiens
ucaaacgccgcugacugcca

SEQ ID NO: 1487778 - RNA, 18 nt, Homo sapiens
ucaaacucauuggcuuaa

SEQ ID NO: 1487779 - RNA, 19 nt, Homo sapiens
ucaaacuccugaccucagg

SEQ ID NO: 1487780 - RNA, 12 nt, Homo sapiens
ucaaacugugaa

SEQ ID NO: 1487781 - RNA, 19 nt, Homo sapiens
ucaaagagguauauuugaa

SEQ ID NO: 1487782 - RNA, 18 nt, Homo sapiens
ucaaagauccagugcagu

SEQ ID NO: 1487783 - RNA, 20 nt, Homo sapiens
ucaaagaugccccauuccuu

SEQ ID NO: 1487784 - RNA, 21 nt, Homo sapiens
ucaaagcacagaauuugucag

SEQ ID NO: 1487785 - RNA, 22 nt, Homo sapiens
ucaaagcaggaauugguggcag

SEQ ID NO: 1487786 - RNA, 21 nt, Homo sapiens
ucaaagcuaaauuccacacua

SEQ ID NO: 1487787 - RNA, 20 nt, Homo sapiens
ucaaaggaaaauaguaaugu

SEQ ID NO: 1487788 - RNA, 22 nt, Homo sapiens
ucaaagugagaaaaugccucaa

SEQ ID NO: 1487789 - RNA, 14 nt, Homo sapiens
ucacccccugagau

SEQ ID NO: 1487790 - RNA, 14 nt, Homo sapiens
ucacccggccucuu

SEQ ID NO: 1487791 - RNA, 20 nt, Homo sapiens
ucacccugccuuaucuugca

SEQ ID NO: 1487792 - RNA, 12 nt, Homo sapiens
ucacccugcuac

SEQ ID NO: 1487793 - RNA, 17 nt, Homo sapiens
ucacccugucaaguuaa

SEQ ID NO: 1487794 - RNA, 14 nt, Homo sapiens
ucaccgacaacaug

SEQ ID NO: 1487795 - RNA, 18 nt, Homo sapiens
ucaccggccgauggagac

SEQ ID NO: 1487796 - RNA, 18 nt, Homo sapiens
ucaccggucagugccuuu

SEQ ID NO: 1487797 - RNA, 21 nt, Homo sapiens
ucaccucucccuccaccuccu

SEQ ID NO: 1487798 - RNA, 16 nt, Homo sapiens
ucaccucuugccuucu

SEQ ID NO: 1487799 - RNA, 15 nt, Homo sapiens
ucaccuggaugugca

SEQ ID NO: 1487800 - RNA, 15 nt, Homo sapiens
ucaccuguuauguau

SEQ ID NO: 1487801 - RNA, 15 nt, Homo sapiens
ucaccuucuagucuu

SEQ ID NO: 1487802 - RNA, 19 nt, Homo sapiens
ucaccuuggcaccagacac

SEQ ID NO: 1487803 - RNA, 16 nt, Homo sapiens
ucacgcaggcugaguc

SEQ ID NO: 1487804 - RNA, 18 nt, Homo sapiens
ucacgcaugugugcugca

SEQ ID NO: 1487805 - RNA, 15 nt, Homo sapiens
ucacggcucacugua

SEQ ID NO: 1487806 - RNA, 18 nt, Homo sapiens
ucacuacuuuaauaaaga

SEQ ID NO: 1487807 - RNA, 15 nt, Homo sapiens
ucacuauguugccua

SEQ ID NO: 1487808 - RNA, 16 nt, Homo sapiens
ucacucaagcacugau

SEQ ID NO: 1487809 - RNA, 19 nt, Homo sapiens
ucacucaagcacugauauc

SEQ ID NO: 1487810 - RNA, 14 nt, Homo sapiens
ucacucauccaucc

SEQ ID NO: 1487811 - RNA, 14 nt, Homo sapiens
ucacucauugcuga

SEQ ID NO: 1487812 - RNA, 17 nt, Homo sapiens
ucacuccaaugucugcu

SEQ ID NO: 1487813 - RNA, 19 nt, Homo sapiens
ucacuccacaacccaagaa

SEQ ID NO: 1487814 - RNA, 20 nt, Homo sapiens
ucacuccaggauauugacaa

SEQ ID NO: 1487815 - RNA, 12 nt, Homo sapiens
ucacuccccaag

SEQ ID NO: 1487816 - RNA, 21 nt, Homo sapiens
ucacucccucugccuucaggc

SEQ ID NO: 1487817 - RNA, 19 nt, Homo sapiens
uacaagucagcuccagcuu

SEQ ID NO: 1487818 - RNA, 19 nt, Homo sapiens
uacaaucagccacauucua

SEQ ID NO: 1487819 - RNA, 15 nt, Homo sapiens
uacaaucauugcuga

SEQ ID NO: 1487820 - RNA, 17 nt, Homo sapiens
uacaaucugcacuuuaa

SEQ ID NO: 1487821 - RNA, 20 nt, Homo sapiens
uacaaugugaacuuuauuaa

SEQ ID NO: 1487822 - RNA, 20 nt, Homo sapiens
uacaauuaaaacuaagcaca

SEQ ID NO: 1487823 - RNA, 20 nt, Homo sapiens
uacaauuucacuuagucugu

SEQ ID NO: 1487824 - RNA, 16 nt, Homo sapiens
uacacacacacucccu

SEQ ID NO: 1487825 - RNA, 23 nt, Homo sapiens
uacacacucaggccugugcccac

SEQ ID NO: 1487826 - RNA, 18 nt, Homo sapiens
uacacagaaaugcugcug

SEQ ID NO: 1487827 - RNA, 18 nt, Homo sapiens
uacacauacaggauuuga

SEQ ID NO: 1487828 - RNA, 17 nt, Homo sapiens
uacacauuagauuuuau

SEQ ID NO: 1487829 - RNA, 15 nt, Homo sapiens
uacacccaccagagu

SEQ ID NO: 1487830 - RNA, 12 nt, Homo sapiens
uacacuaugaag

SEQ ID NO: 1487831 - RNA, 17 nt, Homo sapiens
uacacugaggagagauu

SEQ ID NO: 1487832 - RNA, 13 nt, Homo sapiens
uacacugccaucu

SEQ ID NO: 1487833 - RNA, 20 nt, Homo sapiens
uacacuuauuuuacuaguuu

SEQ ID NO: 1487834 - RNA, 13 nt, Homo sapiens
uacacuugugauu

SEQ ID NO: 1487835 - RNA, 18 nt, Homo sapiens
uacagaaaagacucugac

SEQ ID NO: 1487836 - RNA, 17 nt, Homo sapiens
uacagaaaguagugcug

SEQ ID NO: 1487837 - RNA, 16 nt, Homo sapiens
uacagaacuacuucuu

SEQ ID NO: 1487838 - RNA, 12 nt, Homo sapiens
uacagacauaca

SEQ ID NO: 1487839 - RNA, 13 nt, Homo sapiens
uacagacugggga

SEQ ID NO: 1487840 - RNA, 13 nt, Homo sapiens
uacagagaagauu

SEQ ID NO: 1487841 - RNA, 20 nt, Homo sapiens
uacagagauuacuuugcugc

SEQ ID NO: 1487842 - RNA, 13 nt, Homo sapiens
uacagaugaacuc

SEQ ID NO: 1487843 - RNA, 16 nt, Homo sapiens
uacagcaggugcucaa

SEQ ID NO: 1487844 - RNA, 15 nt, Homo sapiens
uacagccuggaccac

SEQ ID NO: 1487845 - RNA, 12 nt, Homo sapiens
uacagccuuccg

SEQ ID NO: 1487846 - RNA, 19 nt, Homo sapiens
uacagcuguauugucugaa

SEQ ID NO: 1487847 - RNA, 15 nt, Homo sapiens
uacaggaaagcaaua

SEQ ID NO: 1487848 - RNA, 24 nt, Homo sapiens
uaggaaucccagaggugggauccu

SEQ ID NO: 1487849 - RNA, 13 nt, Homo sapiens
uaggagagccaac

SEQ ID NO: 1487850 - RNA, 22 nt, Homo sapiens
uaggagcuuccagcucuaauaa

SEQ ID NO: 1487851 - RNA, 15 nt, Homo sapiens
uaggauuaauaaaga

SEQ ID NO: 1487852 - RNA, 21 nt, Homo sapiens
uaggccacucgagcaucagag

SEQ ID NO: 1487853 - RNA, 23 nt, Homo sapiens
uaggccccuggggcucccgaaga

SEQ ID NO: 1487854 - RNA, 14 nt, Homo sapiens
uaggccuaccugau

SEQ ID NO: 1487855 - RNA, 16 nt, Homo sapiens
uaggcgcaggugcaca

SEQ ID NO: 1487856 - RNA, 22 nt, Homo sapiens
uagggcagccgaguggaggaaa

SEQ ID NO: 1487857 - RNA, 21 nt, Homo sapiens
uagggucaggcggggugcugu

SEQ ID NO: 1487858 - RNA, 16 nt, Homo sapiens
uagguggcaagcugug

SEQ ID NO: 1487859 - RNA, 16 nt, Homo sapiens
uagguguggcugugaa

SEQ ID NO: 1487860 - RNA, 17 nt, Homo sapiens
uagguuacagaccucag

SEQ ID NO: 1487861 - RNA, 13 nt, Homo sapiens
uagguuggcagua

SEQ ID NO: 1487862 - RNA, 14 nt, Homo sapiens
uagguuuacauuca

SEQ ID NO: 1487863 - RNA, 16 nt, Homo sapiens
uaguaagaugcacuga

SEQ ID NO: 1487864 - RNA, 21 nt, Homo sapiens
uaguaauguuuuauacuguuu

SEQ ID NO: 1487865 - RNA, 17 nt, Homo sapiens
uaguaccuucaauacuu

SEQ ID NO: 1487866 - RNA, 16 nt, Homo sapiens
uaguauuggagcacau

SEQ ID NO: 1487867 - RNA, 20 nt, Homo sapiens
uaguauugguguauguauga

SEQ ID NO: 1487868 - RNA, 16 nt, Homo sapiens
uaguauuucucaggaa

SEQ ID NO: 1487869 - RNA, 21 nt, Homo sapiens
uagucaauauuugguauuuca

SEQ ID NO: 1487870 - RNA, 20 nt, Homo sapiens
uagucaauuucuacuucugg

SEQ ID NO: 1487871 - RNA, 23 nt, Homo sapiens
uagucauacucccugguguagug

SEQ ID NO: 1487872 - RNA, 14 nt, Homo sapiens
uagucauuuacuaa

SEQ ID NO: 1487873 - RNA, 14 nt, Homo sapiens
uagucucaccagcc

SEQ ID NO: 1487874 - RNA, 13 nt, Homo sapiens
uagucucuuuaaa

SEQ ID NO: 1487875 - RNA, 15 nt, Homo sapiens
uagugaacauaugga

SEQ ID NO: 1487876 - RNA, 18 nt, Homo sapiens
uagugccugaaauuucac

SEQ ID NO: 1487877 - RNA, 13 nt, Homo sapiens
uaguggucuuugu

SEQ ID NO: 1487878 - RNA, 20 nt, Homo sapiens
uaguguugagacccaggccu

SEQ ID NO: 1487879 - RNA, 18 nt, Homo sapiens
uaguguuuggacagcuga

SEQ ID NO: 1487880 - RNA, 13 nt, Homo sapiens
uaguuaaaguaau

SEQ ID NO: 1487881 - RNA, 13 nt, Homo sapiens
uaguuaauggauu

SEQ ID NO: 1487882 - RNA, 11 nt, Homo sapiens
uaguuagcuuu

SEQ ID NO: 1487883 - RNA, 13 nt, Homo sapiens
uaguuaugugauu

SEQ ID NO: 1487884 - RNA, 22 nt, Homo sapiens
uaguucaauauuuguuacuguu

SEQ ID NO: 1487885 - RNA, 15 nt, Homo sapiens
uaguugucuuuccug

SEQ ID NO: 1487886 - RNA, 19 nt, Homo sapiens
uaguuuaggagaaaccagc

SEQ ID NO: 1487887 - RNA, 22 nt, Homo sapiens
uaguuugauacucccagucuug

SEQ ID NO: 1487888 - RNA, 19 nt, Homo sapiens
uaguuugcaguuacacuaa

SEQ ID NO: 1487889 - RNA, 14 nt, Homo sapiens
uauaaaaaacacua

SEQ ID NO: 1487890 - RNA, 17 nt, Homo sapiens
uauaaaccguggucuca

SEQ ID NO: 1487891 - RNA, 21 nt, Homo sapiens
uauaaagaagaacuugcaugg

SEQ ID NO: 1487892 - RNA, 16 nt, Homo sapiens
uauaaauauaagccuu

SEQ ID NO: 1487893 - RNA, 20 nt, Homo sapiens
uauaaaugggaaaucagugu

SEQ ID NO: 1487894 - RNA, 19 nt, Homo sapiens
uauaaccauaugauacuau

SEQ ID NO: 1487895 - RNA, 18 nt, Homo sapiens
uauaaccccagccugacc

SEQ ID NO: 1487896 - RNA, 22 nt, Homo sapiens
uauaacuaagacauaugcauuu

SEQ ID NO: 1487897 - RNA, 18 nt, Homo sapiens
uauaagaaagaucaaaga

SEQ ID NO: 1487898 - RNA, 14 nt, Homo sapiens
uauaagcaacuuca

SEQ ID NO: 1487899 - RNA, 22 nt, Homo sapiens
uauaagcccacuguuaauauuc

SEQ ID NO: 1487900 - RNA, 12 nt, Homo sapiens
uauaaucuacuc

SEQ ID NO: 1487901 - RNA, 15 nt, Homo sapiens
uauaaucugaagaua

SEQ ID NO: 1487902 - RNA, 16 nt, Homo sapiens
uauaauguaagcucua

SEQ ID NO: 1487903 - RNA, 17 nt, Homo sapiens
uauaauucacucaagca

SEQ ID NO: 1487904 - RNA, 21 nt, Homo sapiens
uauacaaauuagaaaauguua

SEQ ID NO: 1487905 - RNA, 13 nt, Homo sapiens
uauacacauauau

SEQ ID NO: 1487906 - RNA, 15 nt, Homo sapiens
uauacaccauauacu

SEQ ID NO: 1487907 - RNA, 21 nt, Homo sapiens
uauacacuauuugugagcaaa

SEQ ID NO: 1487908 - RNA, 23 nt, Homo sapiens
uauacacuuacacuuuaugcaca

SEQ ID NO: 1487909 - RNA, 12 nt, Homo sapiens
uauacagaggaa

SEQ ID NO: 1487910 - RNA, 23 nt, Homo sapiens
uauacagauagaguuccauauau

SEQ ID NO: 1487911 - RNA, 11 nt, Homo sapiens
uauacagugcc

SEQ ID NO: 1487912 - RNA, 13 nt, Homo sapiens
uauaccaaaaggg

SEQ ID NO: 1487913 - RNA, 19 nt, Homo sapiens
uauaccagcuuguaugcaa

SEQ ID NO: 1487914 - RNA, 20 nt, Homo sapiens
uauacccacauguacagaca

SEQ ID NO: 1487915 - RNA, 22 nt, Homo sapiens
uauacccccccaugcagucuaa

SEQ ID NO: 1487916 - RNA, 20 nt, Homo sapiens
uauaccuaccugugugguac

SEQ ID NO: 1487917 - RNA, 14 nt, Homo sapiens
uauacugccaaaga

SEQ ID NO: 1487918 - RNA, 14 nt, Homo sapiens
uauacuguuuacug

SEQ ID NO: 1487919 - RNA, 14 nt, Homo sapiens
uauagaaguagcaa

SEQ ID NO: 1487920 - RNA, 12 nt, Homo sapiens
uauagacagucc

SEQ ID NO: 1487921 - RNA, 22 nt, Homo sapiens
ggguucaagcaauugucugccu

SEQ ID NO: 1487922 - RNA, 22 nt, Homo sapiens
ggguucuuauuuugcauuccag

SEQ ID NO: 1487923 - RNA, 19 nt, Homo sapiens
ggguuucacuauguugccu

SEQ ID NO: 1487924 - RNA, 17 nt, Homo sapiens
gguaaaacucacuguga

SEQ ID NO: 1487925 - RNA, 15 nt, Homo sapiens
gguaaaaguuacuua

SEQ ID NO: 1487926 - RNA, 22 nt, Homo sapiens
gguaaaaguucuuuuugcucua

SEQ ID NO: 1487927 - RNA, 18 nt, Homo sapiens
gguaaauaaaauuuaacu

SEQ ID NO: 1487928 - RNA, 19 nt, Homo sapiens
gguaacugcuuucuguucc

SEQ ID NO: 1487929 - RNA, 15 nt, Homo sapiens
gguaaugugaauaaa

SEQ ID NO: 1487930 - RNA, 21 nt, Homo sapiens
gguaauugccuaaaucuccag

SEQ ID NO: 1487931 - RNA, 14 nt, Homo sapiens
gguacaauuguaaa

SEQ ID NO: 1487932 - RNA, 18 nt, Homo sapiens
gguaccucuggcacccau

SEQ ID NO: 1487933 - RNA, 16 nt, Homo sapiens
gguacuacaaccaauu

SEQ ID NO: 1487934 - RNA, 20 nt, Homo sapiens
gguacuauuuagauauaaca

SEQ ID NO: 1487935 - RNA, 21 nt, Homo sapiens
gguacuauuuagauauaacac

SEQ ID NO: 1487936 - RNA, 21 nt, Homo sapiens
gguacuuuuaugauguauauu

SEQ ID NO: 1487937 - RNA, 11 nt, Homo sapiens
gguagccagca

SEQ ID NO: 1487938 - RNA, 20 nt, Homo sapiens
gguagccagcacacagggca

SEQ ID NO: 1487939 - RNA, 15 nt, Homo sapiens
gguagguugggacac

SEQ ID NO: 1487940 - RNA, 23 nt, Homo sapiens
gguaguaaauaugaaacuagggu

SEQ ID NO: 1487941 - RNA, 13 nt, Homo sapiens
gguauaauguuua

SEQ ID NO: 1487942 - RNA, 16 nt, Homo sapiens
gguauauacuuugaaa

SEQ ID NO: 1487943 - RNA, 14 nt, Homo sapiens
gguaucuccaggau

SEQ ID NO: 1487944 - RNA, 17 nt, Homo sapiens
gguauguggguggcacu

SEQ ID NO: 1487945 - RNA, 22 nt, Homo sapiens
gguauguguggaugaugcugcc

SEQ ID NO: 1487946 - RNA, 17 nt, Homo sapiens
gguauuuaccacagcag

SEQ ID NO: 1487947 - RNA, 21 nt, Homo sapiens
ggucaagagaguucugaccug

SEQ ID NO: 1487948 - RNA, 17 nt, Homo sapiens
ggucaauggugcaaagg

SEQ ID NO: 1487949 - RNA, 12 nt, Homo sapiens
ggucacccagga

SEQ ID NO: 1487950 - RNA, 20 nt, Homo sapiens
ggucacucaggacagcccag

SEQ ID NO: 1487951 - RNA, 18 nt, Homo sapiens
ggucaggcagggugcagu

SEQ ID NO: 1487952 - RNA, 14 nt, Homo sapiens
ggucaguuacaaag

SEQ ID NO: 1487953 - RNA, 16 nt, Homo sapiens
ggucauccugccccug

SEQ ID NO: 1487954 - RNA, 21 nt, Homo sapiens
ggucauuggccacugucucca

SEQ ID NO: 1487955 - RNA, 13 nt, Homo sapiens
ggucccggggcca

SEQ ID NO: 1487956 - RNA, 21 nt, Homo sapiens
gguccucuacuuaaugagaua

SEQ ID NO: 1487957 - RNA, 21 nt, Homo sapiens
gguccuucccucucaugacuu

SEQ ID NO: 1487958 - RNA, 15 nt, Homo sapiens
gguccuuccuaccuc

SEQ ID NO: 1487959 - RNA, 21 nt, Homo sapiens
ggucucauuuagaacuugcag

SEQ ID NO: 1487960 - RNA, 14 nt, Homo sapiens
ggucucccaaacgc

SEQ ID NO: 1487961 - RNA, 16 nt, Homo sapiens
ggucugcucuuucucu

SEQ ID NO: 1487962 - RNA, 13 nt, Homo sapiens
ggucuucuuacau

SEQ ID NO: 1487963 - RNA, 11 nt, Homo sapiens
ggucuugacuc

SEQ ID NO: 1487964 - RNA, 18 nt, Homo sapiens
ggucuuuguaucuuccau

SEQ ID NO: 1487965 - RNA, 17 nt, Homo sapiens
ggugaaaauccaucuca

SEQ ID NO: 1487966 - RNA, 20 nt, Homo sapiens
ggugaacaaagcagccacga

SEQ ID NO: 1487967 - RNA, 13 nt, Homo sapiens
ggugaaguaaauu

SEQ ID NO: 1487968 - RNA, 15 nt, Homo sapiens
ggugaaucaccuggc

SEQ ID NO: 1487969 - RNA, 14 nt, Homo sapiens
ggugacagagcaag

SEQ ID NO: 1487970 - RNA, 13 nt, Homo sapiens
ggugaggaccacu

SEQ ID NO: 1487971 - RNA, 14 nt, Homo sapiens
ggugaggcaauaaa

SEQ ID NO: 1487972 - RNA, 17 nt, Homo sapiens
ggugaggggcuggcacu

SEQ ID NO: 1487973 - RNA, 17 nt, Homo sapiens
ggugauucgcccaccuc

SEQ ID NO: 1487974 - RNA, 21 nt, Homo sapiens
ggugcccagaacuucccugau

SEQ ID NO: 1487975 - RNA, 20 nt, Homo sapiens
ggugcuaucgcaccacugug

SEQ ID NO: 1487976 - RNA, 16 nt, Homo sapiens
gguggaaggcagacag

SEQ ID NO: 1487977 - RNA, 19 nt, Homo sapiens
gguggaaggcagacagcag

SEQ ID NO: 1487978 - RNA, 17 nt, Homo sapiens
gguggagauugcaguga

SEQ ID NO: 1487979 - RNA, 15 nt, Homo sapiens
gguggauauggugca

SEQ ID NO: 1487980 - RNA, 17 nt, Homo sapiens
gguggcccacgccugua

SEQ ID NO: 1487981 - RNA, 19 nt, Homo sapiens
gguggcccuugcaguucag

SEQ ID NO: 1487982 - RNA, 22 nt, Homo sapiens
ggugggcccucugaacuugccu

SEQ ID NO: 1487983 - RNA, 14 nt, Homo sapiens
gguguauguaugag

SEQ ID NO: 1487984 - RNA, 21 nt, Homo sapiens
ggugucaguauccaggcuuug

SEQ ID NO: 1487985 - RNA, 14 nt, Homo sapiens
ggugugaacauguu

SEQ ID NO: 1487986 - RNA, 15 nt, Homo sapiens
ggugugauugcacag

SEQ ID NO: 1487987 - RNA, 16 nt, Homo sapiens
gguguuuuaagacuga

SEQ ID NO: 1487988 - RNA, 19 nt, Homo sapiens
gguuaacgccuucauuuau

SEQ ID NO: 1487989 - RNA, 15 nt, Homo sapiens
gguuaaggccugaau

SEQ ID NO: 1487990 - RNA, 12 nt, Homo sapiens
gguuacaaagac

SEQ ID NO: 1487991 - RNA, 18 nt, Homo sapiens
gguuaucaaaaauuucau

SEQ ID NO: 1487992 - RNA, 18 nt, Homo sapiens
gguuauucuaagcccuuu

SEQ ID NO: 1487993 - RNA, 23 nt, Homo sapiens
gguucucuuagcaacucagagaa

SEQ ID NO: 1487994 - RNA, 20 nt, Homo sapiens
gguucuuaaaaaggaacaaa

SEQ ID NO: 1487995 - RNA, 17 nt, Homo sapiens
gguucuucagggccagu

SEQ ID NO: 1487996 - RNA, 22 nt, Homo sapiens
gguugaaaaauggcaaagaauu

SEQ ID NO: 1487997 - RNA, 22 nt, Homo sapiens
gguugaagaaaggaaccuggga

SEQ ID NO: 1487998 - RNA, 20 nt, Homo sapiens
cucucccaaaaaacuacuuc

SEQ ID NO: 1487999 - RNA, 21 nt, Homo sapiens
cucuccuuauagacacuugcu

SEQ ID NO: 1488000 - RNA, 15 nt, Homo sapiens
cucucuccacccuau

SEQ ID NO: 1488001 - RNA, 12 nt, Homo sapiens
cucucuccuuau

SEQ ID NO: 1488002 - RNA, 18 nt, Homo sapiens
cucucugagacugcuaag

SEQ ID NO: 1488003 - RNA, 20 nt, Homo sapiens
cucucugaugucccagugcu

SEQ ID NO: 1488004 - RNA, 13 nt, Homo sapiens
cucucugcagcug

SEQ ID NO: 1488005 - RNA, 15 nt, Homo sapiens
cucucuucugcucca

SEQ ID NO: 1488006 - RNA, 19 nt, Homo sapiens
cucucuuuccuccacccau

SEQ ID NO: 1488007 - RNA, 17 nt, Homo sapiens
cucugaaacggauccag

SEQ ID NO: 1488008 - RNA, 13 nt, Homo sapiens
cucugaacuggau

SEQ ID NO: 1488009 - RNA, 16 nt, Homo sapiens
cucugacccuagcucu

SEQ ID NO: 1488010 - RNA, 15 nt, Homo sapiens
cucugagaucuaagg

SEQ ID NO: 1488011 - RNA, 22 nt, Homo sapiens
cucugagcgggaggcagaguuu

SEQ ID NO: 1488012 - RNA, 23 nt, Homo sapiens
cucugcaaugggcacugggauga

SEQ ID NO: 1488013 - RNA, 20 nt, Homo sapiens
cucugccacccacucaggau

SEQ ID NO: 1488014 - RNA, 11 nt, Homo sapiens
cucugccagug

SEQ ID NO: 1488015 - RNA, 17 nt, Homo sapiens
cucugccgcuaccuccc

SEQ ID NO: 1488016 - RNA, 20 nt, Homo sapiens
cucugccuuucuaagacuca

SEQ ID NO: 1488017 - RNA, 17 nt, Homo sapiens
cucuggaaaaugugacc

SEQ ID NO: 1488018 - RNA, 19 nt, Homo sapiens
cucuggauuccacacugca

SEQ ID NO: 1488019 - RNA, 23 nt, Homo sapiens
cucuggccucagccgacugcaca

SEQ ID NO: 1488020 - RNA, 21 nt, Homo sapiens
cucugguggcaggugccuugu

SEQ ID NO: 1488021 - RNA, 16 nt, Homo sapiens
cucuggugugugguga

SEQ ID NO: 1488022 - RNA, 19 nt, Homo sapiens
cucuguaaaaacacugaaa

SEQ ID NO: 1488023 - RNA, 19 nt, Homo sapiens
cucuguauuccgauacaaa

SEQ ID NO: 1488024 - RNA, 14 nt, Homo sapiens
cucugucaacauca

SEQ ID NO: 1488025 - RNA, 18 nt, Homo sapiens
cucugucaacaucaaaga

SEQ ID NO: 1488026 - RNA, 19 nt, Homo sapiens
cucugucuuaaaugagaag

SEQ ID NO: 1488027 - RNA, 17 nt, Homo sapiens
cucugugcccuccagca

SEQ ID NO: 1488028 - RNA, 17 nt, Homo sapiens
cucuuaaucaaauagca

SEQ ID NO: 1488029 - RNA, 20 nt, Homo sapiens
cucuuaguuauugcugaaga

SEQ ID NO: 1488030 - RNA, 17 nt, Homo sapiens
cucuuauccaacaucaa

SEQ ID NO: 1488031 - RNA, 21 nt, Homo sapiens
cucuuaucucagucaugcaua

SEQ ID NO: 1488032 - RNA, 16 nt, Homo sapiens
cucuucacaccauuca

SEQ ID NO: 1488033 - RNA, 22 nt, Homo sapiens
cucuucagguucuuagugucac

SEQ ID NO: 1488034 - RNA, 13 nt, Homo sapiens
cucuucccaugac

SEQ ID NO: 1488035 - RNA, 22 nt, Homo sapiens
cucuuccccagagaggcacuca

SEQ ID NO: 1488036 - RNA, 14 nt, Homo sapiens
cucuucuccacugg

SEQ ID NO: 1488037 - RNA, 14 nt, Homo sapiens
cucuugaaccacag

SEQ ID NO: 1488038 - RNA, 19 nt, Homo sapiens
cucuugaaguacuuaacau

SEQ ID NO: 1488039 - RNA, 12 nt, Homo sapiens
cucuugacuacu

SEQ ID NO: 1488040 - RNA, 13 nt, Homo sapiens
cucuugcacucaa

SEQ ID NO: 1488041 - RNA, 17 nt, Homo sapiens
cucuugcuugucauuga

SEQ ID NO: 1488042 - RNA, 15 nt, Homo sapiens
cucuuggagcuguga

SEQ ID NO: 1488043 - RNA, 19 nt, Homo sapiens
cucuuggccuuugcauuua

SEQ ID NO: 1488044 - RNA, 15 nt, Homo sapiens
cucuuggcugacccc

SEQ ID NO: 1488045 - RNA, 23 nt, Homo sapiens
cucuugggcccaggacuguugau

SEQ ID NO: 1488046 - RNA, 19 nt, Homo sapiens
cucuuggugugauugcaca

SEQ ID NO: 1488047 - RNA, 18 nt, Homo sapiens
cucuuguauaugaugauc

SEQ ID NO: 1488048 - RNA, 16 nt, Homo sapiens
cucuuguccuagcuug

SEQ ID NO: 1488049 - RNA, 17 nt, Homo sapiens
cucuuguggugcauuga

SEQ ID NO: 1488050 - RNA, 12 nt, Homo sapiens
cucuuuaacuuc

SEQ ID NO: 1488051 - RNA, 16 nt, Homo sapiens
cucuuucgcuuggcag

SEQ ID NO: 1488052 - RNA, 18 nt, Homo sapiens
cucuuucucucuucccuc

SEQ ID NO: 1488053 - RNA, 18 nt, Homo sapiens
cucuuucuguauauacuu

SEQ ID NO: 1488054 - RNA, 16 nt, Homo sapiens
cucuuugaaagcuuug

SEQ ID NO: 1488055 - RNA, 15 nt, Homo sapiens
cucuuugcugcacua

SEQ ID NO: 1488056 - RNA, 19 nt, Homo sapiens
cucuuuggcaguugcauua

SEQ ID NO: 1488057 - RNA, 13 nt, Homo sapiens
cucuuuugcacau

SEQ ID NO: 1488058 - RNA, 15 nt, Homo sapiens
cugaaaacuggaaua

SEQ ID NO: 1488059 - RNA, 16 nt, Homo sapiens
cugaaagccuuaggga

SEQ ID NO: 1488060 - RNA, 13 nt, Homo sapiens
cugaaaguacaaa

SEQ ID NO: 1488061 - RNA, 17 nt, Homo sapiens
cugaaauuuauucacau

SEQ ID NO: 1488062 - RNA, 23 nt, Homo sapiens
cugaaauuuuaauugaacuaaca

SEQ ID NO: 1488063 - RNA, 14 nt, Homo sapiens
cugaacaaacuaaa

SEQ ID NO: 1488064 - RNA, 23 nt, Homo sapiens
cugaacaaacuaaaggugcacug

SEQ ID NO: 1488065 - RNA, 18 nt, Homo sapiens
cugaacaccuauugcacu

SEQ ID NO: 1488066 - RNA, 12 nt, Homo sapiens
cugaacagccaa

SEQ ID NO: 1488067 - RNA, 18 nt, Homo sapiens
cugaaccauguggauaac

SEQ ID NO: 1488068 - RNA, 16 nt, Homo sapiens
cugaacguggcacucu

SEQ ID NO: 1488069 - RNA, 15 nt, Homo sapiens
cugaacuacuaaagu

SEQ ID NO: 1488070 - RNA, 12 nt, Homo sapiens
cugaagauauau

SEQ ID NO: 1488071 - RNA, 15 nt, Homo sapiens
cugaagcuguucuca

SEQ ID NO: 1488072 - RNA, 17 nt, Homo sapiens
cugaaggggaggucaca

SEQ ID NO: 1488073 - RNA, 19 nt, Homo sapiens
cugaagggggacacuccau

SEQ ID NO: 1488074 - RNA, 16 nt, Homo sapiens
cugaagucacaucaca

SEQ ID NO: 1488075 - RNA, 18 nt, Homo sapiens
cugaagugcauccaaagg

SEQ ID NO: 1488076 - RNA, 14 nt, Homo sapiens
cugaaguggcuaaa

SEQ ID NO: 1488077 - RNA, 14 nt, Homo sapiens
cugaaguuucacau

SEQ ID NO: 1488078 - RNA, 20 nt, Homo sapiens
cugaaguuucacaugagcua

SEQ ID NO: 1488079 - RNA, 17 nt, Homo sapiens
cugaaguuugugggggc

SEQ ID NO: 1488080 - RNA, 20 nt, Homo sapiens
cugaaguuugugggggccaa

SEQ ID NO: 1488081 - RNA, 20 nt, Homo sapiens
cugaauaaagcacgugcaag

SEQ ID NO: 1488082 - RNA, 21 nt, Homo sapiens
cugaauaaagcacgugcaagg

SEQ ID NO: 1488083 - RNA, 20 nt, Homo sapiens
cugaauauaaagcuuaauaa

SEQ ID NO: 1488084 - RNA, 12 nt, Homo sapiens
ggagacuggaaa

SEQ ID NO: 1488085 - RNA, 16 nt, Homo sapiens
ggagacugucucaaga

SEQ ID NO: 1488086 - RNA, 14 nt, Homo sapiens
ggagagaaaaaaga

SEQ ID NO: 1488087 - RNA, 22 nt, Homo sapiens
ggagagaagcucuucaauagcu

SEQ ID NO: 1488088 - RNA, 21 nt, Homo sapiens
ggagaggauggcccaggguga

SEQ ID NO: 1488089 - RNA, 18 nt, Homo sapiens
ggagaggggaagggccag

SEQ ID NO: 1488090 - RNA, 21 nt, Homo sapiens
ggagaugcuucucuccuugcc

SEQ ID NO: 1488091 - RNA, 20 nt, Homo sapiens
ggagauuccagucuacuuga

SEQ ID NO: 1488092 - RNA, 14 nt, Homo sapiens
ggagcaaaccagcu

SEQ ID NO: 1488093 - RNA, 23 nt, Homo sapiens
ggagcacugcguuuuccuagcug

SEQ ID NO: 1488094 - RNA, 19 nt, Homo sapiens
ggagcagaguguucccuga

SEQ ID NO: 1488095 - RNA, 13 nt, Homo sapiens
ggagcaggaccua

SEQ ID NO: 1488096 - RNA, 18 nt, Homo sapiens
ggagcaggaccuacuagg

SEQ ID NO: 1488097 - RNA, 15 nt, Homo sapiens
ggagcaguuugccac

SEQ ID NO: 1488098 - RNA, 12 nt, Homo sapiens
ggagcccaguga

SEQ ID NO: 1488099 - RNA, 20 nt, Homo sapiens
ggagcccccaccacaaacuu

SEQ ID NO: 1488100 - RNA, 19 nt, Homo sapiens
ggagccccuucugcucagc

SEQ ID NO: 1488101 - RNA, 13 nt, Homo sapiens
ggagccugugcag

SEQ ID NO: 1488102 - RNA, 17 nt, Homo sapiens
ggagcucaggucccagg

SEQ ID NO: 1488103 - RNA, 15 nt, Homo sapiens
ggagcugcggccacu

SEQ ID NO: 1488104 - RNA, 22 nt, Homo sapiens
ggagcuugcagugagccgagau

SEQ ID NO: 1488105 - RNA, 16 nt, Homo sapiens
ggcaucuugcuggcua

SEQ ID NO: 1488106 - RNA, 13 nt, Homo sapiens
ggcauggauccag

SEQ ID NO: 1488107 - RNA, 20 nt, Homo sapiens
ggcauggcccugggguccca

SEQ ID NO: 1488108 - RNA, 12 nt, Homo sapiens
ggcaugggagac

SEQ ID NO: 1488109 - RNA, 12 nt, Homo sapiens
ggcauuuggacc

SEQ ID NO: 1488110 - RNA, 22 nt, Homo sapiens
ggccaacauggugaaacccugu

SEQ ID NO: 1488111 - RNA, 14 nt, Homo sapiens
ggccaagccacuca

SEQ ID NO: 1488112 - RNA, 22 nt, Homo sapiens
ggccaaggggugggccugugaa

SEQ ID NO: 1488113 - RNA, 14 nt, Homo sapiens
ggccaagguccugc

SEQ ID NO: 1488114 - RNA, 12 nt, Homo sapiens
ggccagcacuuc

SEQ ID NO: 1488115 - RNA, 15 nt, Homo sapiens
ggccagcacuuccau

SEQ ID NO: 1488116 - RNA, 18 nt, Homo sapiens
ggccagccagugccauuc

SEQ ID NO: 1488117 - RNA, 14 nt, Homo sapiens
ggccagcccagcca

SEQ ID NO: 1488118 - RNA, 15 nt, Homo sapiens
ggccaggcacagggc

SEQ ID NO: 1488119 - RNA, 20 nt, Homo sapiens
ggccagggucugugugaaug

SEQ ID NO: 1488120 - RNA, 23 nt, Homo sapiens
ggccaggugguugucuuauugca

SEQ ID NO: 1488121 - RNA, 23 nt, Homo sapiens
ggccaguauuuuuauuucuuuaa

SEQ ID NO: 1488122 - RNA, 22 nt, Homo sapiens
ggccaguggggccuguggaaug

SEQ ID NO: 1488123 - RNA, 14 nt, Homo sapiens
ggccauauuuacua

SEQ ID NO: 1488124 - RNA, 23 nt, Homo sapiens
ggccaugauggcaacagaucugg

SEQ ID NO: 1488125 - RNA, 15 nt, Homo sapiens
ggccaugauggccuu

SEQ ID NO: 1488126 - RNA, 16 nt, Homo sapiens
ggccauguccaaagag

SEQ ID NO: 1488127 - RNA, 13 nt, Homo sapiens
ggcccagugacaa

SEQ ID NO: 1488128 - RNA, 18 nt, Homo sapiens
ggcccaguucacccugau

SEQ ID NO: 1488129 - RNA, 23 nt, Homo sapiens
ggcccauucagagcuauggugcu

SEQ ID NO: 1488130 - RNA, 17 nt, Homo sapiens
ggccccaguucaaucuc

SEQ ID NO: 1488131 - RNA, 21 nt, Homo sapiens
ggccccgugaggcaaugggag

SEQ ID NO: 1488132 - RNA, 17 nt, Homo sapiens
ggcccgcaccccggccu

SEQ ID NO: 1488133 - RNA, 23 nt, Homo sapiens
ggcccgcaccgcugggagucuga

SEQ ID NO: 1488134 - RNA, 19 nt, Homo sapiens
ggcccuaaguuaagcaaaa

SEQ ID NO: 1488135 - RNA, 13 nt, Homo sapiens
ggcccugcugagu

SEQ ID NO: 1488136 - RNA, 22 nt, Homo sapiens
ggcccugggcugggugcuggga

SEQ ID NO: 1488137 - RNA, 21 nt, Homo sapiens
ggcccuucuugccuacuaugc

SEQ ID NO: 1488138 - RNA, 17 nt, Homo sapiens
ggcccuuugaagccuca

SEQ ID NO: 1488139 - RNA, 13 nt, Homo sapiens
ggccgagagcaga

SEQ ID NO: 1488140 - RNA, 13 nt, Homo sapiens
ggccgcacugggg

SEQ ID NO: 1488141 - RNA, 22 nt, Homo sapiens
ggccgggccuagaccuggugcu

SEQ ID NO: 1488142 - RNA, 15 nt, Homo sapiens
ggccuagaccuggug

SEQ ID NO: 1488143 - RNA, 21 nt, Homo sapiens
ggccuauuccaggaauuccuc

SEQ ID NO: 1488144 - RNA, 10 nt, Homo sapiens
ggccucagaa

SEQ ID NO: 1488145 - RNA, 16 nt, Homo sapiens
ggccucagaccaacuc

SEQ ID NO: 1488146 - RNA, 19 nt, Homo sapiens
ggccucccaaagugcuagu

SEQ ID NO: 1488147 - RNA, 22 nt, Homo sapiens
ggccucccaccagagacuggga

SEQ ID NO: 1488148 - RNA, 22 nt, Homo sapiens
ggccuccuuggcaaugcauuug

SEQ ID NO: 1488149 - RNA, 15 nt, Homo sapiens
ggccucugacucuga

SEQ ID NO: 1488150 - RNA, 16 nt, Homo sapiens
ggccugacugcucaga

SEQ ID NO: 1488151 - RNA, 15 nt, Homo sapiens
ggccugagagucagc

SEQ ID NO: 1488152 - RNA, 16 nt, Homo sapiens
ggccugcccucaggga

SEQ ID NO: 1488153 - RNA, 16 nt, Homo sapiens
ggccuggccaccucuc

SEQ ID NO: 1488154 - RNA, 14 nt, Homo sapiens
ggccuuguggcacu

SEQ ID NO: 1488155 - RNA, 15 nt, Homo sapiens
ggccuuucugugucc

SEQ ID NO: 1488156 - RNA, 20 nt, Homo sapiens
ggcgacagagcgagacuccg

SEQ ID NO: 1488157 - RNA, 21 nt, Homo sapiens
ggcgagagguggagugucaca

SEQ ID NO: 1488158 - RNA, 21 nt, Homo sapiens
ggcgagcacugugagcaccug

SEQ ID NO: 1488159 - RNA, 17 nt, Homo sapiens
ggcgccaucgccaagua

SEQ ID NO: 1488160 - RNA, 12 nt, Homo sapiens
ggcgcccagugg

SEQ ID NO: 1488161 - RNA, 22 nt, Homo sapiens
ggcgccccugccaccucccuga

SEQ ID NO: 1488162 - RNA, 13 nt, Homo sapiens
ggcgccuguaauu

SEQ ID NO: 1488163 - RNA, 15 nt, Homo sapiens
ggcggccaggcacag

SEQ ID NO: 1488164 - RNA, 14 nt, Homo sapiens
ggcggccucuugcu

SEQ ID NO: 1488165 - RNA, 16 nt, Homo sapiens
ggcgucccuaccuccu

SEQ ID NO: 1488166 - RNA, 13 nt, Homo sapiens
ggcguuacugcuu

SEQ ID NO: 1488167 - RNA, 13 nt, Homo sapiens
ggcuaaauacaau

SEQ ID NO: 1488168 - RNA, 22 nt, Homo sapiens
ggcuaaaugcaccaagaaagcu

SEQ ID NO: 1488169 - RNA, 11 nt, Homo sapiens
ggcuaacggga

SEQ ID NO: 1488170 - RNA, 23 nt, Homo sapiens
ggcuacaaagcguuucuuuacuu

SEQ ID NO: 1488171 - RNA, 20 nt, Homo sapiens
ggcucaagcgauccucccac

SEQ ID NO: 1488172 - RNA, 14 nt, Homo sapiens
ggcucaagcugucc

SEQ ID NO: 1488173 - RNA, 17 nt, Homo sapiens
ggcucacgccuguaauu

SEQ ID NO: 1488174 - RNA, 19 nt, Homo sapiens
ggcucacuguagucucgac

SEQ ID NO: 1488175 - RNA, 13 nt, Homo sapiens
ggcucagccagca

SEQ ID NO: 1488176 - RNA, 15 nt, Homo sapiens
ggcuccaagaccuag

SEQ ID NO: 1488177 - RNA, 19 nt, Homo sapiens
ggcuccacucuugaucucu

SEQ ID NO: 1488178 - RNA, 18 nt, Homo sapiens
ggcuccagaugcagggca

SEQ ID NO: 1488179 - RNA, 20 nt, Homo sapiens
ggcuccagaugcagggcagu

SEQ ID NO: 1488180 - RNA, 21 nt, Homo sapiens
ggcuccccuccucggcuuccu

SEQ ID NO: 1488181 - RNA, 20 nt, Homo sapiens
ggcucccugaugacacccac

SEQ ID NO: 1488182 - RNA, 18 nt, Homo sapiens
ggcucuccucgcaggugu

SEQ ID NO: 1488183 - RNA, 14 nt, Homo sapiens
ggcucugcacccac

SEQ ID NO: 1488184 - RNA, 19 nt, Homo sapiens
gcaaccucuucaugagcuu

SEQ ID NO: 1488185 - RNA, 14 nt, Homo sapiens
gcaaccucuuugcu

SEQ ID NO: 1488186 - RNA, 13 nt, Homo sapiens
gcaaccugacuca

SEQ ID NO: 1488187 - RNA, 16 nt, Homo sapiens
gcaacucacacauucc

SEQ ID NO: 1488188 - RNA, 17 nt, Homo sapiens
gcaacucacacauuccc

SEQ ID NO: 1488189 - RNA, 15 nt, Homo sapiens
gcaacuccauuuacc

SEQ ID NO: 1488190 - RNA, 17 nt, Homo sapiens
gcaacuggaguuccuua

SEQ ID NO: 1488191 - RNA, 18 nt, Homo sapiens
gcaagagaggaugacaca

SEQ ID NO: 1488192 - RNA, 17 nt, Homo sapiens
gcaagaucuugucucca

SEQ ID NO: 1488193 - RNA, 15 nt, Homo sapiens
gcaagcuaacugcuu

SEQ ID NO: 1488194 - RNA, 21 nt, Homo sapiens
gcaaggacauugccccaagau

SEQ ID NO: 1488195 - RNA, 21 nt, Homo sapiens
gcaaggacggccuucaacuga

SEQ ID NO: 1488196 - RNA, 18 nt, Homo sapiens
gcaagucuuccaugaccc

SEQ ID NO: 1488197 - RNA, 14 nt, Homo sapiens
gcaauaaauauuag

SEQ ID NO: 1488198 - RNA, 20 nt, Homo sapiens
gcaggaagcuugucacugga

SEQ ID NO: 1488199 - RNA, 21 nt, Homo sapiens
gcaggacuugagaagaccuca

SEQ ID NO: 1488200 - RNA, 17 nt, Homo sapiens
gcaggagaacuacuuga

SEQ ID NO: 1488201 - RNA, 19 nt, Homo sapiens
gcaggagaaucacuggaac

SEQ ID NO: 1488202 - RNA, 17 nt, Homo sapiens
gcaggagaauugcuuga

SEQ ID NO: 1488203 - RNA, 13 nt, Homo sapiens
gcaggagcaguuu

SEQ ID NO: 1488204 - RNA, 17 nt, Homo sapiens
gcaggaggauugcuuga

SEQ ID NO: 1488205 - RNA, 16 nt, Homo sapiens
gcaggaguggugcaga

SEQ ID NO: 1488206 - RNA, 24 nt, Homo sapiens
gcaggauucuguaauagugaacau

SEQ ID NO: 1488207 - RNA, 15 nt, Homo sapiens
gcaggcaauuucacc

SEQ ID NO: 1488208 - RNA, 14 nt, Homo sapiens
gcaggcugggccau

SEQ ID NO: 1488209 - RNA, 14 nt, Homo sapiens
gcagggaaugcaau

SEQ ID NO: 1488210 - RNA, 15 nt, Homo sapiens
gcagggacuccaugc

SEQ ID NO: 1488211 - RNA, 15 nt, Homo sapiens
gcagggccacuggaa

SEQ ID NO: 1488212 - RNA, 19 nt, Homo sapiens
gcagggcccacccauguca

SEQ ID NO: 1488213 - RNA, 18 nt, Homo sapiens
gcagggcccagugacaag

SEQ ID NO: 1488214 - RNA, 13 nt, Homo sapiens
gcaggggagacag

SEQ ID NO: 1488215 - RNA, 18 nt, Homo sapiens
gcagggggaaggcuugga

SEQ ID NO: 1488216 - RNA, 21 nt, Homo sapiens
gcagggugcaguaucaugccc

SEQ ID NO: 1488217 - RNA, 18 nt, Homo sapiens
gcagguacuuccucaguc

SEQ ID NO: 1488218 - RNA, 16 nt, Homo sapiens
gcaggugacauuugcu

SEQ ID NO: 1488219 - RNA, 22 nt, Homo sapiens
gcaggugcugacuucaucuccc

SEQ ID NO: 1488220 - RNA, 20 nt, Homo sapiens
gcagguuccuuaucugucac

SEQ ID NO: 1488221 - RNA, 21 nt, Homo sapiens
gcagguuccuuaucugucaca

SEQ ID NO: 1488222 - RNA, 18 nt, Homo sapiens
gcaguaaaagaugaaguu

SEQ ID NO: 1488223 - RNA, 12 nt, Homo sapiens
gcagucacugga

SEQ ID NO: 1488224 - RNA, 21 nt, Homo sapiens
gcaguccuuuguaaacagugu

SEQ ID NO: 1488225 - RNA, 21 nt, Homo sapiens
gcagucgaugcguucacucca

SEQ ID NO: 1488226 - RNA, 21 nt, Homo sapiens
gcagucggugguaccugagau

SEQ ID NO: 1488227 - RNA, 16 nt, Homo sapiens
gcagugagcugagauc

SEQ ID NO: 1488228 - RNA, 15 nt, Homo sapiens
gcagugcuaaagccu

SEQ ID NO: 1488229 - RNA, 16 nt, Homo sapiens
gcaguggaagcaguuu

SEQ ID NO: 1488230 - RNA, 14 nt, Homo sapiens
gcaguguugcucag

SEQ ID NO: 1488231 - RNA, 21 nt, Homo sapiens
gcaguuccccuggagccccuu

SEQ ID NO: 1488232 - RNA, 22 nt, Homo sapiens
gcaguugaaacaagaagccaca

SEQ ID NO: 1488233 - RNA, 19 nt, Homo sapiens
gcaguuuaugagacagcug

SEQ ID NO: 1488234 - RNA, 13 nt, Homo sapiens
gcaguuugccacc

SEQ ID NO: 1488235 - RNA, 22 nt, Homo sapiens
gcaguuugccaccccuguccag

SEQ ID NO: 1488236 - RNA, 22 nt, Homo sapiens
gcaguuuuacuaaaacacugaa

SEQ ID NO: 1488237 - RNA, 16 nt, Homo sapiens
gcauaaauaugcagug

SEQ ID NO: 1488238 - RNA, 20 nt, Homo sapiens
gcauaaauaugcagugauau

SEQ ID NO: 1488239 - RNA, 19 nt, Homo sapiens
gcauaagaaaacuaagaaa

SEQ ID NO: 1488240 - RNA, 21 nt, Homo sapiens
gcauaaguuucugggaccuca

SEQ ID NO: 1488241 - RNA, 14 nt, Homo sapiens
gcauaggcucuuaa

SEQ ID NO: 1488242 - RNA, 18 nt, Homo sapiens
gcauaguaccucugcuau

SEQ ID NO: 1488243 - RNA, 24 nt, Homo sapiens
gcauauauaaguuuacaccuuuau

SEQ ID NO: 1488244 - RNA, 21 nt, Homo sapiens
gcauauccaccaccucccuca

SEQ ID NO: 1488245 - RNA, 20 nt, Homo sapiens
gcauaugggugggauuuugc

SEQ ID NO: 1488246 - RNA, 18 nt, Homo sapiens
gcauauuaagcacuuuaa

SEQ ID NO: 1488247 - RNA, 19 nt, Homo sapiens
gcauauuaagcacuuuaag

SEQ ID NO: 1488248 - RNA, 17 nt, Homo sapiens
gcaucaaacagggcaaa

SEQ ID NO: 1488249 - RNA, 13 nt, Homo sapiens
gcaucaaggucag

SEQ ID NO: 1488250 - RNA, 16 nt, Homo sapiens
gcaucaaggugcugaa

SEQ ID NO: 1488251 - RNA, 20 nt, Homo sapiens
gcaucacguaccccacuggg

SEQ ID NO: 1488252 - RNA, 14 nt, Homo sapiens
gcaucagaugaauu

SEQ ID NO: 1488253 - RNA, 15 nt, Homo sapiens
gcaucauaauggacu

SEQ ID NO: 1488254 - RNA, 19 nt, Homo sapiens
gcaucaucaaaaacuuugg

SEQ ID NO: 1488255 - RNA, 19 nt, Homo sapiens
gcauccccuuggcugugag

SEQ ID NO: 1488256 - RNA, 20 nt, Homo sapiens
gcauccccuuggcugugagg

SEQ ID NO: 1488257 - RNA, 20 nt, Homo sapiens
gcauccuggccaacauggug

SEQ ID NO: 1488258 - RNA, 21 nt, Homo sapiens
gcaucucaaaauuauucugcc

SEQ ID NO: 1488259 - RNA, 13 nt, Homo sapiens
gcaucuccugugc

SEQ ID NO: 1488260 - RNA, 22 nt, Homo sapiens
gcaucuggcuguuuagcagaac

SEQ ID NO: 1488261 - RNA, 20 nt, Homo sapiens
gcaugacaaacacacaucca

SEQ ID NO: 1488262 - RNA, 22 nt, Homo sapiens
gcaugagacuuucugcugggau

SEQ ID NO: 1488263 - RNA, 20 nt, Homo sapiens
gcaugagagaauuguaucau

SEQ ID NO: 1488264 - RNA, 15 nt, Homo sapiens
gcaugauaagagcau

SEQ ID NO: 1488265 - RNA, 17 nt, Homo sapiens
gcaugcagugcccucac

SEQ ID NO: 1488266 - RNA, 19 nt, Homo sapiens
gcaugccuugugcuguuaa

SEQ ID NO: 1488267 - RNA, 23 nt, Homo sapiens
gcauggaaaaaugguugauggaa

SEQ ID NO: 1488268 - RNA, 22 nt, Homo sapiens
gcauggauccagaacugcacuc

SEQ ID NO: 1488269 - RNA, 15 nt, Homo sapiens
gcauggguccagggc

SEQ ID NO: 1488270 - RNA, 14 nt, Homo sapiens
gcauggugcaguug

SEQ ID NO: 1488271 - RNA, 18 nt, Homo sapiens
gcauguaagccaagucau

SEQ ID NO: 1488272 - RNA, 21 nt, Homo sapiens
gcaugucagacagaacuugaa

SEQ ID NO: 1488273 - RNA, 13 nt, Homo sapiens
gcauguccuuugc

SEQ ID NO: 1488274 - RNA, 15 nt, Homo sapiens
gcauuaaacauuuga

SEQ ID NO: 1488275 - RNA, 15 nt, Homo sapiens
gcauucacauugacc

SEQ ID NO: 1488276 - RNA, 22 nt, Homo sapiens
gcauugaauauauuauaaucuu

SEQ ID NO: 1488277 - RNA, 20 nt, Homo sapiens
gcauugagccaguggugcua

SEQ ID NO: 1488278 - RNA, 18 nt, Homo sapiens
gcauuuagucuugccagg

SEQ ID NO: 1488279 - RNA, 22 nt, Homo sapiens
gcauuugacugaagaugcagcu

SEQ ID NO: 1488280 - RNA, 10 nt, Homo sapiens
gcauuuugcu

SEQ ID NO: 1488281 - RNA, 14 nt, Homo sapiens
gccaacauggugaa

SEQ ID NO: 1488282 - RNA, 22 nt, Homo sapiens
gccaacccggcacugcccucag

SEQ ID NO: 1488283 - RNA, 15 nt, Homo sapiens
gaugaguuacuugaa

SEQ ID NO: 1488284 - RNA, 19 nt, Homo sapiens
gaugauacgaaugauguca

SEQ ID NO: 1488285 - RNA, 14 nt, Homo sapiens
gaugaugaugacuc

SEQ ID NO: 1488286 - RNA, 15 nt, Homo sapiens
gaugcaauacaagau

SEQ ID NO: 1488287 - RNA, 19 nt, Homo sapiens
gaugcaguagacugcagug

SEQ ID NO: 1488288 - RNA, 19 nt, Homo sapiens
gaugccagcauauacugaa

SEQ ID NO: 1488289 - RNA, 21 nt, Homo sapiens
gaugccauggcaacuuagaga

SEQ ID NO: 1488290 - RNA, 20 nt, Homo sapiens
gaugcgggacugcuggcaug

SEQ ID NO: 1488291 - RNA, 14 nt, Homo sapiens
gaugcugugcuaug

SEQ ID NO: 1488292 - RNA, 16 nt, Homo sapiens
gauggaaacucuuuaa

SEQ ID NO: 1488293 - RNA, 19 nt, Homo sapiens
gauggaaguaaagccucaa

SEQ ID NO: 1488294 - RNA, 17 nt, Homo sapiens
gauggaauaacucugug

SEQ ID NO: 1488295 - RNA, 22 nt, Homo sapiens
gauggaccuccuucgcuggaag

SEQ ID NO: 1488296 - RNA, 16 nt, Homo sapiens
gauggcaccacugcac

SEQ ID NO: 1488297 - RNA, 18 nt, Homo sapiens
gauggcaccacugcacuc

SEQ ID NO: 1488298 - RNA, 19 nt, Homo sapiens
gauggcagaacucccacaa

SEQ ID NO: 1488299 - RNA, 14 nt, Homo sapiens
gaugggagaguaaa

SEQ ID NO: 1488300 - RNA, 13 nt, Homo sapiens
gaugguccacugu

SEQ ID NO: 1488301 - RNA, 12 nt, Homo sapiens
gaugguccugca

SEQ ID NO: 1488302 - RNA, 18 nt, Homo sapiens
gauggugacauugcaccu

SEQ ID NO: 1488303 - RNA, 19 nt, Homo sapiens
gaugguuuuaucuucccuu

SEQ ID NO: 1488304 - RNA, 21 nt, Homo sapiens
gauguaaucucucugcagcug

SEQ ID NO: 1488305 - RNA, 22 nt, Homo sapiens
gauguaaugucccuuucagaga

SEQ ID NO: 1488306 - RNA, 18 nt, Homo sapiens
gauguaugaucucucuag

SEQ ID NO: 1488307 - RNA, 14 nt, Homo sapiens
gaugucacaaagau

SEQ ID NO: 1488308 - RNA, 17 nt, Homo sapiens
gaugucccugggccagg

SEQ ID NO: 1488309 - RNA, 17 nt, Homo sapiens
gaugucugggugaccuc

SEQ ID NO: 1488310 - RNA, 21 nt, Homo sapiens
gaugugaauugccugcagaga

SEQ ID NO: 1488311 - RNA, 18 nt, Homo sapiens
gauguggccugcauguac

SEQ ID NO: 1488312 - RNA, 14 nt, Homo sapiens
gauguuuccagacu

SEQ ID NO: 1488313 - RNA, 20 nt, Homo sapiens
gauguuuugucccauuuccu

SEQ ID NO: 1488314 - RNA, 17 nt, Homo sapiens
gauuaaaaucacucuca

SEQ ID NO: 1488315 - RNA, 17 nt, Homo sapiens
gauuaacaacaggaaau

SEQ ID NO: 1488316 - RNA, 22 nt, Homo sapiens
gauuaagauauucagaaguaua

SEQ ID NO: 1488317 - RNA, 23 nt, Homo sapiens
gauuacaaggcuuuaucucaggg

SEQ ID NO: 1488318 - RNA, 16 nt, Homo sapiens
gauuacucuccauauc

SEQ ID NO: 1488319 - RNA, 23 nt, Homo sapiens
gauuacucuccauaucccuuccu

SEQ ID NO: 1488320 - RNA, 13 nt, Homo sapiens
gauuauaaacuga

SEQ ID NO: 1488321 - RNA, 22 nt, Homo sapiens
gauuauuagccagguaauguga

SEQ ID NO: 1488322 - RNA, 23 nt, Homo sapiens
gauuauuggcugcuuugccucua

SEQ ID NO: 1488323 - RNA, 22 nt, Homo sapiens
gauuauuuaauaacauuaccuu

SEQ ID NO: 1488324 - RNA, 17 nt, Homo sapiens
gauuauuugcucagggg

SEQ ID NO: 1488325 - RNA, 19 nt, Homo sapiens
gauucaacugcaucuccaa

SEQ ID NO: 1488326 - RNA, 20 nt, Homo sapiens
gauucagaaaauguucuguu

SEQ ID NO: 1488327 - RNA, 21 nt, Homo sapiens
gauucauauuuacuucuuaua

SEQ ID NO: 1488328 - RNA, 15 nt, Homo sapiens
gauucccaccaaggu

SEQ ID NO: 1488329 - RNA, 20 nt, Homo sapiens
gauucgugacaacaugcgac

SEQ ID NO: 1488330 - RNA, 20 nt, Homo sapiens
gauucuccagccaaccucau

SEQ ID NO: 1488331 - RNA, 23 nt, Homo sapiens
gauucugugaucuuuuaaagugu

SEQ ID NO: 1488332 - RNA, 17 nt, Homo sapiens
gauugaggagcugcacu

SEQ ID NO: 1488333 - RNA, 19 nt, Homo sapiens
gauugaggagcugcacuga

SEQ ID NO: 1488334 - RNA, 15 nt, Homo sapiens
gauugcacagaauuu

SEQ ID NO: 1488335 - RNA, 20 nt, Homo sapiens
gauugcacguggccucuuga

SEQ ID NO: 1488336 - RNA, 17 nt, Homo sapiens
gauugccucucuagaca

SEQ ID NO: 1488337 - RNA, 12 nt, Homo sapiens
gauugcugccau

SEQ ID NO: 1488338 - RNA, 19 nt, Homo sapiens
gauugcuuucuucuuaacc

SEQ ID NO: 1488339 - RNA, 13 nt, Homo sapiens
gauuggcacagac

SEQ ID NO: 1488340 - RNA, 18 nt, Homo sapiens
gauuguauaagcaugcuu

SEQ ID NO: 1488341 - RNA, 19 nt, Homo sapiens
gauugugggauacuauuua

SEQ ID NO: 1488342 - RNA, 19 nt, Homo sapiens
gauuuaaagggacaccccu

SEQ ID NO: 1488343 - RNA, 17 nt, Homo sapiens
gauuuaauuuccagggu

SEQ ID NO: 1488344 - RNA, 22 nt, Homo sapiens
gauuuaugaugcacuuauucaa

SEQ ID NO: 1488345 - RNA, 21 nt, Homo sapiens
gauuucagaucauauuucaca

SEQ ID NO: 1488346 - RNA, 15 nt, Homo sapiens
gauuucagcagggau

SEQ ID NO: 1488347 - RNA, 22 nt, Homo sapiens
gauuucaggauacucugucaga

SEQ ID NO: 1488348 - RNA, 21 nt, Homo sapiens
gauuucauaguucagaauuua

SEQ ID NO: 1488349 - RNA, 17 nt, Homo sapiens
gauuuccuccuggccuu

SEQ ID NO: 1488350 - RNA, 13 nt, Homo sapiens
gauuuccuugaau

SEQ ID NO: 1488351 - RNA, 23 nt, Homo sapiens
gauuuccuugaauguggcuugag

SEQ ID NO: 1488352 - RNA, 21 nt, Homo sapiens
gauuuccuuuauacugugaag

SEQ ID NO: 1488353 - RNA, 14 nt, Homo sapiens
gauuucuccaggau

SEQ ID NO: 1488354 - RNA, 20 nt, Homo sapiens
gauuugguacuuuugagugu

SEQ ID NO: 1488355 - RNA, 15 nt, Homo sapiens
gauuuggugaccaac

SEQ ID NO: 1488356 - RNA, 18 nt, Homo sapiens
gauuugguggaugugaug

SEQ ID NO: 1488357 - RNA, 20 nt, Homo sapiens
gauuuuaaaaagucuucacu

SEQ ID NO: 1488358 - RNA, 15 nt, Homo sapiens
gauuuuaaagacaaa

SEQ ID NO: 1488359 - RNA, 19 nt, Homo sapiens
gauuuuaaguaacauaacu

SEQ ID NO: 1488360 - RNA, 18 nt, Homo sapiens
gauuuuacaaaagaugua

SEQ ID NO: 1488361 - RNA, 16 nt, Homo sapiens
gauuuuaucugugaau

SEQ ID NO: 1488362 - RNA, 17 nt, Homo sapiens
gauuuuuagcuuuacaa

SEQ ID NO: 1488363 - RNA, 22 nt, Homo sapiens
gauuuuuugcauuccugacaaa

SEQ ID NO: 1488364 - RNA, 19 nt, Homo sapiens
gauuuuuuuaauagugcuu

SEQ ID NO: 1488365 - RNA, 20 nt, Homo sapiens
gauuuuuuucccaauugaga

SEQ ID NO: 1488366 - RNA, 23 nt, Homo sapiens
gcaaaaacaaaugggaaaauguc

SEQ ID NO: 1488367 - RNA, 13 nt, Homo sapiens
gcaaaaaguauug

SEQ ID NO: 1488368 - RNA, 20 nt, Homo sapiens
gcaaaaagucuacauacuuu

SEQ ID NO: 1488369 - RNA, 19 nt, Homo sapiens
gcaaaacaaaaauuaggua

SEQ ID NO: 1488370 - RNA, 20 nt, Homo sapiens
gcaaaaccucaucauuacua

SEQ ID NO: 1488371 - RNA, 14 nt, Homo sapiens
gcaaaauacuguac

SEQ ID NO: 1488372 - RNA, 18 nt, Homo sapiens
gcaaaaucuguucuaaca

SEQ ID NO: 1488373 - RNA, 20 nt, Homo sapiens
gcaaaaugaaaaugucaaua

SEQ ID NO: 1488374 - RNA, 14 nt, Homo sapiens
gcaaacaucaaccu

SEQ ID NO: 1488375 - RNA, 18 nt, Homo sapiens
gcaaacucacugcucaag

SEQ ID NO: 1488376 - RNA, 20 nt, Homo sapiens
gcaaagcaaauguugggaaa

SEQ ID NO: 1488377 - RNA, 19 nt, Homo sapiens
gcaaauggcagaaccaaag

SEQ ID NO: 1488378 - RNA, 16 nt, Homo sapiens
gcaaauguaacugugc

SEQ ID NO: 1488379 - RNA, 21 nt, Homo sapiens
gcaacaagaccaccacuucga

SEQ ID NO: 1488380 - RNA, 22 nt, Homo sapiens
gcaacaagaccaccacuucgaa

SEQ ID NO: 1488381 - RNA, 12 nt, Homo sapiens
gcaacagacugu

SEQ ID NO: 1488382 - RNA, 20 nt, Homo sapiens
gcaacaggaaggaaccagaa

SEQ ID NO: 1488383 - RNA, 17 nt, Homo sapiens
gcaacauuuguauggau

SEQ ID NO: 1488384 - RNA, 19 nt, Homo sapiens
gagucuagcacucauuuuc

SEQ ID NO: 1488385 - RNA, 18 nt, Homo sapiens
gagucucuucuccacugg

SEQ ID NO: 1488386 - RNA, 21 nt, Homo sapiens
gagucugugcaguuucugaca

SEQ ID NO: 1488387 - RNA, 14 nt, Homo sapiens
gagugaggagccca

SEQ ID NO: 1488388 - RNA, 14 nt, Homo sapiens
gagugauccuccaa

SEQ ID NO: 1488389 - RNA, 23 nt, Homo sapiens
gagugauugacacacagcacucu

SEQ ID NO: 1488390 - RNA, 14 nt, Homo sapiens
gagugcaacccagu

SEQ ID NO: 1488391 - RNA, 13 nt, Homo sapiens
gagugcacagcug

SEQ ID NO: 1488392 - RNA, 19 nt, Homo sapiens
gagugcaggggggcaauca

SEQ ID NO: 1488393 - RNA, 20 nt, Homo sapiens
gagugcaguggcaugaucau

SEQ ID NO: 1488394 - RNA, 19 nt, Homo sapiens
gagugcauugugaggguua

SEQ ID NO: 1488395 - RNA, 13 nt, Homo sapiens
gagugcccugucc

SEQ ID NO: 1488396 - RNA, 22 nt, Homo sapiens
gagugccguaacaacugugguc

SEQ ID NO: 1488397 - RNA, 11 nt, Homo sapiens
gaguggcugca

SEQ ID NO: 1488398 - RNA, 13 nt, Homo sapiens
gagugggaccaac

SEQ ID NO: 1488399 - RNA, 19 nt, Homo sapiens
gaguguccuuaguguauaa

SEQ ID NO: 1488400 - RNA, 21 nt, Homo sapiens
gagugugugacauuccagggg

SEQ ID NO: 1488401 - RNA, 21 nt, Homo sapiens
gaguguuauuugcacacugca

SEQ ID NO: 1488402 - RNA, 21 nt, Homo sapiens
gaguguugggcaugugaucac

SEQ ID NO: 1488403 - RNA, 13 nt, Homo sapiens
gaguuagugccau

SEQ ID NO: 1488404 - RNA, 22 nt, Homo sapiens
gaguuauggugaacccacaacu

SEQ ID NO: 1488405 - RNA, 21 nt, Homo sapiens
gaguuauuuuuauuuauuuaa

SEQ ID NO: 1488406 - RNA, 23 nt, Homo sapiens
gaguuccaugaagaccacaucca

SEQ ID NO: 1488407 - RNA, 23 nt, Homo sapiens
gaguucuagaaccacuuccugcu

SEQ ID NO: 1488408 - RNA, 14 nt, Homo sapiens
gaguuggcaaaaug

SEQ ID NO: 1488409 - RNA, 15 nt, Homo sapiens
gaguugguuacuuca

SEQ ID NO: 1488410 - RNA, 14 nt, Homo sapiens
gaguugugaugaau

SEQ ID NO: 1488411 - RNA, 20 nt, Homo sapiens
gaguuguuucugacccacug

SEQ ID NO: 1488412 - RNA, 22 nt, Homo sapiens
gaguuuagcuguaacaguucuu

SEQ ID NO: 1488413 - RNA, 23 nt, Homo sapiens
gaguuugaaggaggugagggaug

SEQ ID NO: 1488414 - RNA, 22 nt, Homo sapiens
gaguuuuccucuauacaucucu

SEQ ID NO: 1488415 - RNA, 17 nt, Homo sapiens
gauaaaaauaaugcauu

SEQ ID NO: 1488416 - RNA, 14 nt, Homo sapiens
gauaaaauuaauuu

SEQ ID NO: 1488417 - RNA, 20 nt, Homo sapiens
gauaaauauuugacuugcau

SEQ ID NO: 1488418 - RNA, 22 nt, Homo sapiens
gauaacaugcuuuggguggaau

SEQ ID NO: 1488419 - RNA, 19 nt, Homo sapiens
gauaacccuacacccagac

SEQ ID NO: 1488420 - RNA, 19 nt, Homo sapiens
gauaagccacucugucccu

SEQ ID NO: 1488421 - RNA, 14 nt, Homo sapiens
gauaagccacuggg

SEQ ID NO: 1488422 - RNA, 15 nt, Homo sapiens
gauaagccacugggc

SEQ ID NO: 1488423 - RNA, 20 nt, Homo sapiens
gauaaguaaguuugauuuca

SEQ ID NO: 1488424 - RNA, 13 nt, Homo sapiens
gauaauaguuuac

SEQ ID NO: 1488425 - RNA, 20 nt, Homo sapiens
gauacaugguugugaccuga

SEQ ID NO: 1488426 - RNA, 13 nt, Homo sapiens
gauacauguaauu

SEQ ID NO: 1488427 - RNA, 21 nt, Homo sapiens
gauacaugugccgaaugugca

SEQ ID NO: 1488428 - RNA, 15 nt, Homo sapiens
gauaccacugcacug

SEQ ID NO: 1488429 - RNA, 13 nt, Homo sapiens
gauacccagagca

SEQ ID NO: 1488430 - RNA, 16 nt, Homo sapiens
gauaccugcacugucc

SEQ ID NO: 1488431 - RNA, 22 nt, Homo sapiens
gauaccugcacuguccugacca

SEQ ID NO: 1488432 - RNA, 17 nt, Homo sapiens
gauagcaaacacugggg

SEQ ID NO: 1488433 - RNA, 14 nt, Homo sapiens
gauagcuacagugu

SEQ ID NO: 1488434 - RNA, 18 nt, Homo sapiens
gauagcuuggagggaugg

SEQ ID NO: 1488435 - RNA, 12 nt, Homo sapiens
gauagcuuuauu

SEQ ID NO: 1488436 - RNA, 14 nt, Homo sapiens
gauaggaaugugaa

SEQ ID NO: 1488437 - RNA, 16 nt, Homo sapiens
gauagguggugccagu

SEQ ID NO: 1488438 - RNA, 13 nt, Homo sapiens
gauaguucccaaa

SEQ ID NO: 1488439 - RNA, 20 nt, Homo sapiens
gauauaauuuaacuguguuu

SEQ ID NO: 1488440 - RNA, 15 nt, Homo sapiens
gauauauacaaggug

SEQ ID NO: 1488441 - RNA, 16 nt, Homo sapiens
gauauauacacaggau

SEQ ID NO: 1488442 - RNA, 15 nt, Homo sapiens
gauaucaugccccug

SEQ ID NO: 1488443 - RNA, 12 nt, Homo sapiens
gauaucucagga

SEQ ID NO: 1488444 - RNA, 13 nt, Homo sapiens
gauauguggugua

SEQ ID NO: 1488445 - RNA, 15 nt, Homo sapiens
gauauuaacugagaa

SEQ ID NO: 1488446 - RNA, 16 nt, Homo sapiens
gauauucagaaguaua

SEQ ID NO: 1488447 - RNA, 21 nt, Homo sapiens
gauauugaugauaacacuuaa

SEQ ID NO: 1488448 - RNA, 17 nt, Homo sapiens
gauauugauuacuauca

SEQ ID NO: 1488449 - RNA, 16 nt, Homo sapiens
gaucaaacuacauauu

SEQ ID NO: 1488450 - RNA, 18 nt, Homo sapiens
gaucacuagccugucauc

SEQ ID NO: 1488451 - RNA, 16 nt, Homo sapiens
gaucacuggcaaugaa

SEQ ID NO: 1488452 - RNA, 21 nt, Homo sapiens
gaucauauuucacaauccugu

SEQ ID NO: 1488453 - RNA, 13 nt, Homo sapiens
gaucaucagucac

SEQ ID NO: 1488454 - RNA, 18 nt, Homo sapiens
gaucaugauguagagugu

SEQ ID NO: 1488455 - RNA, 20 nt, Homo sapiens
gaucaugccacuacacucca

SEQ ID NO: 1488456 - RNA, 19 nt, Homo sapiens
gaucauugaaauucugaga

SEQ ID NO: 1488457 - RNA, 15 nt, Homo sapiens
gauccagaacugcac

SEQ ID NO: 1488458 - RNA, 20 nt, Homo sapiens
gauccauccaucuccaggga

SEQ ID NO: 1488459 - RNA, 21 nt, Homo sapiens
gauccccacuguccuaccagu

SEQ ID NO: 1488460 - RNA, 12 nt, Homo sapiens
gaucccugacau

SEQ ID NO: 1488461 - RNA, 16 nt, Homo sapiens
gauccucccucauggc

SEQ ID NO: 1488462 - RNA, 14 nt, Homo sapiens
gauccuucaaagag

SEQ ID NO: 1488463 - RNA, 20 nt, Homo sapiens
gauccuucaaagagucauau

SEQ ID NO: 1488464 - RNA, 14 nt, Homo sapiens
gaucgcaccacugc

SEQ ID NO: 1488465 - RNA, 20 nt, Homo sapiens
gaucgcgccacugcacuccg

SEQ ID NO: 1488466 - RNA, 20 nt, Homo sapiens
gaucgugccauugcacucca

SEQ ID NO: 1488467 - RNA, 21 nt, Homo sapiens
gaucgugggccgcacuggggc

SEQ ID NO: 1488468 - RNA, 20 nt, Homo sapiens
gaucuaagccuuuccauaag

SEQ ID NO: 1488469 - RNA, 18 nt, Homo sapiens
gaucuccaaggaccaggu

SEQ ID NO: 1488470 - RNA, 15 nt, Homo sapiens
gaucuccugaccucg

SEQ ID NO: 1488471 - RNA, 18 nt, Homo sapiens
gaucucggcucacugcaa

SEQ ID NO: 1488472 - RNA, 17 nt, Homo sapiens
gaucugcuuguugcauu

SEQ ID NO: 1488473 - RNA, 17 nt, Homo sapiens
gaucuggucccuugcag

SEQ ID NO: 1488474 - RNA, 10 nt, Homo sapiens
gaucugugau

SEQ ID NO: 1488475 - RNA, 16 nt, Homo sapiens
gaucuuaaagcauucc

SEQ ID NO: 1488476 - RNA, 14 nt, Homo sapiens
gaucuucacucugg

SEQ ID NO: 1488477 - RNA, 22 nt, Homo sapiens
gaucuucuucauccaacuucca

SEQ ID NO: 1488478 - RNA, 14 nt, Homo sapiens
gaucuugguucacu

SEQ ID NO: 1488479 - RNA, 18 nt, Homo sapiens
gaucuuucugcaggaaau

SEQ ID NO: 1488480 - RNA, 16 nt, Homo sapiens
gaugaaauaacuccuu

SEQ ID NO: 1488481 - RNA, 12 nt, Homo sapiens
gaugacauuccc

SEQ ID NO: 1488482 - RNA, 13 nt, Homo sapiens
gaugacauucccu

SEQ ID NO: 1488483 - RNA, 14 nt, Homo sapiens
gaugacccacuguc

SEQ ID NO: 1488484 - RNA, 22 nt, Homo sapiens
gaugaggaccaagggcaccugg

SEQ ID NO: 1488485 - RNA, 17 nt, Homo sapiens
gaugaggcuggccaagc

SEQ ID NO: 1488486 - RNA, 18 nt, Homo sapiens
gaauaaauaaauguaucu

SEQ ID NO: 1488487 - RNA, 15 nt, Homo sapiens
gaauaaaugucuugc

SEQ ID NO: 1488488 - RNA, 12 nt, Homo sapiens
gaauaaccacuu

SEQ ID NO: 1488489 - RNA, 12 nt, Homo sapiens
gaauaaggccuu

SEQ ID NO: 1488490 - RNA, 22 nt, Homo sapiens
gaauaauccaguauugcugauu

SEQ ID NO: 1488491 - RNA, 21 nt, Homo sapiens
gaauacaguuuugaguagagu

SEQ ID NO: 1488492 - RNA, 18 nt, Homo sapiens
gaauacugcuacagcaau

SEQ ID NO: 1488493 - RNA, 14 nt, Homo sapiens
gaauacugugcaua

SEQ ID NO: 1488494 - RNA, 15 nt, Homo sapiens
gaauacuugaacucu

SEQ ID NO: 1488495 - RNA, 23 nt, Homo sapiens
gaauagaaauaaaggaugugauu

SEQ ID NO: 1488496 - RNA, 20 nt, Homo sapiens
gaauagauggguuauuucaa

SEQ ID NO: 1488497 - RNA, 17 nt, Homo sapiens
gaauagccuggccacca

SEQ ID NO: 1488498 - RNA, 18 nt, Homo sapiens
gaauauaaggaaagcaau

SEQ ID NO: 1488499 - RNA, 20 nt, Homo sapiens
gaauauaauuucaaaccaca

SEQ ID NO: 1488500 - RNA, 21 nt, Homo sapiens
gaauauauuauaaucuuccau

SEQ ID NO: 1488501 - RNA, 18 nt, Homo sapiens
gaauaucugggauucuac

SEQ ID NO: 1488502 - RNA, 15 nt, Homo sapiens
gaauauugugcccca

SEQ ID NO: 1488503 - RNA, 20 nt, Homo sapiens
gaauauuuuaagaauuucac

SEQ ID NO: 1488504 - RNA, 12 nt, Homo sapiens
gaaucacuggaa

SEQ ID NO: 1488505 - RNA, 15 nt, Homo sapiens
gaaucagaccugguu

SEQ ID NO: 1488506 - RNA, 14 nt, Homo sapiens
gaaucagcaugaaa

SEQ ID NO: 1488507 - RNA, 23 nt, Homo sapiens
gaaucagugaagaugccagugaa

SEQ ID NO: 1488508 - RNA, 14 nt, Homo sapiens
gaaucauggagaaa

SEQ ID NO: 1488509 - RNA, 22 nt, Homo sapiens
gaauccaguccagauauuucac

SEQ ID NO: 1488510 - RNA, 22 nt, Homo sapiens
gaauccuggaccaagcacaaaa

SEQ ID NO: 1488511 - RNA, 20 nt, Homo sapiens
gaaucggagcgaagcagaga

SEQ ID NO: 1488512 - RNA, 17 nt, Homo sapiens
gaaucuacuaauuccac

SEQ ID NO: 1488513 - RNA, 17 nt, Homo sapiens
gaaucuauuucacuuau

SEQ ID NO: 1488514 - RNA, 11 nt, Homo sapiens
gaaucuucucu

SEQ ID NO: 1488515 - RNA, 14 nt, Homo sapiens
gaaugaacacuccc

SEQ ID NO: 1488516 - RNA, 18 nt, Homo sapiens
gaaugagagguuccuaag

SEQ ID NO: 1488517 - RNA, 19 nt, Homo sapiens
gaaugagcacccauuccaa

SEQ ID NO: 1488518 - RNA, 17 nt, Homo sapiens
gaaugaggcaauuucaa

SEQ ID NO: 1488519 - RNA, 22 nt, Homo sapiens
gaaugauuaaucaaaggcauau

SEQ ID NO: 1488520 - RNA, 14 nt, Homo sapiens
gaaugcccagugag

SEQ ID NO: 1488521 - RNA, 14 nt, Homo sapiens
gaaugcuguguuaa

SEQ ID NO: 1488522 - RNA, 21 nt, Homo sapiens
gaauggagggaaugcucagaa

SEQ ID NO: 1488523 - RNA, 15 nt, Homo sapiens
gaauggcaugcugaa

SEQ ID NO: 1488524 - RNA, 21 nt, Homo sapiens
gaaugggcuugaaacauuaua

SEQ ID NO: 1488525 - RNA, 16 nt, Homo sapiens
gaauggguuugcuaga

SEQ ID NO: 1488526 - RNA, 20 nt, Homo sapiens
gaaugguacaugucuuccau

SEQ ID NO: 1488527 - RNA, 11 nt, Homo sapiens
gaaugguggag

SEQ ID NO: 1488528 - RNA, 15 nt, Homo sapiens
gaaugugauauuuga

SEQ ID NO: 1488529 - RNA, 17 nt, Homo sapiens
gaaugugguuacuuccu

SEQ ID NO: 1488530 - RNA, 17 nt, Homo sapiens
gaauguuuacacucuuu

SEQ ID NO: 1488531 - RNA, 15 nt, Homo sapiens
gaauuaacagagauu

SEQ ID NO: 1488532 - RNA, 23 nt, Homo sapiens
gaauuaucccccaaaaugcauuu

SEQ ID NO: 1488533 - RNA, 17 nt, Homo sapiens
gaauuauuguaccauuu

SEQ ID NO: 1488534 - RNA, 20 nt, Homo sapiens
gaauuauuuaaacaaaaacu

SEQ ID NO: 1488535 - RNA, 13 nt, Homo sapiens
gaauuauuugccu

SEQ ID NO: 1488536 - RNA, 13 nt, Homo sapiens
gaauucaaacugg

SEQ ID NO: 1488537 - RNA, 12 nt, Homo sapiens
gaauucagcuca

SEQ ID NO: 1488538 - RNA, 15 nt, Homo sapiens
gaauucagcucagcu

SEQ ID NO: 1488539 - RNA, 14 nt, Homo sapiens
gaauuccagcaaaa

SEQ ID NO: 1488540 - RNA, 18 nt, Homo sapiens
gaauucuaacaagucaua

SEQ ID NO: 1488541 - RNA, 14 nt, Homo sapiens
gaauucuaagugaa

SEQ ID NO: 1488542 - RNA, 19 nt, Homo sapiens
gaauucuuuuucauuugag

SEQ ID NO: 1488543 - RNA, 18 nt, Homo sapiens
gaauuggccgcugucacu

SEQ ID NO: 1488544 - RNA, 13 nt, Homo sapiens
gaauuguuuagaa

SEQ ID NO: 1488545 - RNA, 20 nt, Homo sapiens
gaauuuauuauuuaccguug

SEQ ID NO: 1488546 - RNA, 10 nt, Homo sapiens
gaauuucaca

SEQ ID NO: 1488547 - RNA, 14 nt, Homo sapiens
gaauuucacaagcu

SEQ ID NO: 1488548 - RNA, 18 nt, Homo sapiens
gaauuucaguaaacaaug

SEQ ID NO: 1488549 - RNA, 20 nt, Homo sapiens
gaauuucuaaaaaacagagg

SEQ ID NO: 1488550 - RNA, 13 nt, Homo sapiens
gaauuugaggcag

SEQ ID NO: 1488551 - RNA, 14 nt, Homo sapiens
gaauuugguaaauu

SEQ ID NO: 1488552 - RNA, 15 nt, Homo sapiens
gaauuuuauaaucug

SEQ ID NO: 1488553 - RNA, 20 nt, Homo sapiens
gaauuuuugcuaugcuguaa

SEQ ID NO: 1488554 - RNA, 22 nt, Homo sapiens
gaauuuuuuuguaauaagcaau

SEQ ID NO: 1488555 - RNA, 23 nt, Homo sapiens
gacaaaaagccuuuuccagaaga

SEQ ID NO: 1488556 - RNA, 13 nt, Homo sapiens
gacaacgaugaau

SEQ ID NO: 1488557 - RNA, 17 nt, Homo sapiens
gacaacuucaaaauaca

SEQ ID NO: 1488558 - RNA, 22 nt, Homo sapiens
gacaacuuccagagaagccaug

SEQ ID NO: 1488559 - RNA, 20 nt, Homo sapiens
gacaagacccccagcacuug

SEQ ID NO: 1488560 - RNA, 17 nt, Homo sapiens
gacaagcugcauuucag

SEQ ID NO: 1488561 - RNA, 21 nt, Homo sapiens
gacaaggagugugaccacuga

SEQ ID NO: 1488562 - RNA, 18 nt, Homo sapiens
gacaaguggacucagggc

SEQ ID NO: 1488563 - RNA, 12 nt, Homo sapiens
gacaauuacuuu

SEQ ID NO: 1488564 - RNA, 18 nt, Homo sapiens
gacaauuaucaaccacgu

SEQ ID NO: 1488565 - RNA, 18 nt, Homo sapiens
gacacaacuauuuuucca

SEQ ID NO: 1488566 - RNA, 13 nt, Homo sapiens
gacacagaaaaug

SEQ ID NO: 1488567 - RNA, 18 nt, Homo sapiens
gacacagacaaagugaca

SEQ ID NO: 1488568 - RNA, 17 nt, Homo sapiens
gacacagucaauucuga

SEQ ID NO: 1488569 - RNA, 17 nt, Homo sapiens
gacaccaguccagguag

SEQ ID NO: 1488570 - RNA, 16 nt, Homo sapiens
gacacgaagccuuauu

SEQ ID NO: 1488571 - RNA, 22 nt, Homo sapiens
gacacuccaugagugucuguga

SEQ ID NO: 1488572 - RNA, 19 nt, Homo sapiens
gacacuccccgaagucuuu

SEQ ID NO: 1488573 - RNA, 15 nt, Homo sapiens
gacacugcaaaggcg

SEQ ID NO: 1488574 - RNA, 15 nt, Homo sapiens
gacacugcagacuug

SEQ ID NO: 1488575 - RNA, 20 nt, Homo sapiens
gacacugccacucuccccau

SEQ ID NO: 1488576 - RNA, 19 nt, Homo sapiens
gacacuggcguuacugcuu

SEQ ID NO: 1488577 - RNA, 20 nt, Homo sapiens
gacacuuaauacuaccuuga

SEQ ID NO: 1488578 - RNA, 14 nt, Homo sapiens
gacagacauacauu

SEQ ID NO: 1488579 - RNA, 16 nt, Homo sapiens
gacagagggcucaccu

SEQ ID NO: 1488580 - RNA, 18 nt, Homo sapiens
gacagcuuguggcuuuuu

SEQ ID NO: 1488581 - RNA, 19 nt, Homo sapiens
gacaggaggaaucauguca

SEQ ID NO: 1488582 - RNA, 11 nt, Homo sapiens
gacagggccag

SEQ ID NO: 1488583 - RNA, 15 nt, Homo sapiens
gacaguaaaucucac

SEQ ID NO: 1488584 - RNA, 15 nt, Homo sapiens
gacaguauccacaau

SEQ ID NO: 1488585 - RNA, 15 nt, Homo sapiens
gacagugaggcugca

SEQ ID NO: 1488586 - RNA, 18 nt, Homo sapiens
gacagugauaggcccaag

SEQ ID NO: 1488587 - RNA, 21 nt, Homo sapiens
gacagugccugggaauguauu

SEQ ID NO: 1488588 - RNA, 15 nt, Homo sapiens
cuggccucugcugaa

SEQ ID NO: 1488589 - RNA, 17 nt, Homo sapiens
cuggccuuugcucuuac

SEQ ID NO: 1488590 - RNA, 16 nt, Homo sapiens
cuggcgcccaguggag

SEQ ID NO: 1488591 - RNA, 23 nt, Homo sapiens
cuggcuaaagauaauugcuauuu

SEQ ID NO: 1488592 - RNA, 22 nt, Homo sapiens
cuggcuagaguccucacuccca

SEQ ID NO: 1488593 - RNA, 15 nt, Homo sapiens
cuggcucacaguaca

SEQ ID NO: 1488594 - RNA, 19 nt, Homo sapiens
cuggcugaugauccagaac

SEQ ID NO: 1488595 - RNA, 20 nt, Homo sapiens
cuggcugggaacaacuucag

SEQ ID NO: 1488596 - RNA, 15 nt, Homo sapiens
cuggcugguccuccc

SEQ ID NO: 1488597 - RNA, 23 nt, Homo sapiens
cuggcuuccagguaucuccagga

SEQ ID NO: 1488598 - RNA, 14 nt, Homo sapiens
cuggcuugccugaa

SEQ ID NO: 1488599 - RNA, 22 nt, Homo sapiens
cuggcuuugcacuugaccucau

SEQ ID NO: 1488600 - RNA, 14 nt, Homo sapiens
cuggcuuugccucu

SEQ ID NO: 1488601 - RNA, 18 nt, Homo sapiens
cugaaugccucaauguga

SEQ ID NO: 1488602 - RNA, 20 nt, Homo sapiens
cugaaugccucaaugugacc

SEQ ID NO: 1488603 - RNA, 13 nt, Homo sapiens
cugaaugcuccau

SEQ ID NO: 1488604 - RNA, 18 nt, Homo sapiens
cugaaugcugcuacuuaa

SEQ ID NO: 1488605 - RNA, 14 nt, Homo sapiens
cugacaagcacugc

SEQ ID NO: 1488606 - RNA, 22 nt, Homo sapiens
cugacacggccucccucugcua

SEQ ID NO: 1488607 - RNA, 22 nt, Homo sapiens
cugacagaaagcagauaccuca

SEQ ID NO: 1488608 - RNA, 18 nt, Homo sapiens
cugacagaaggacucagg

SEQ ID NO: 1488609 - RNA, 21 nt, Homo sapiens
cugacaguuguuuugcuucuu

SEQ ID NO: 1488610 - RNA, 16 nt, Homo sapiens
cugacaucacagcagc

SEQ ID NO: 1488611 - RNA, 20 nt, Homo sapiens
cugaccaauugugcugccau

SEQ ID NO: 1488612 - RNA, 11 nt, Homo sapiens
cugaccacaga

SEQ ID NO: 1488613 - RNA, 17 nt, Homo sapiens
cugaccacagcacagcc

SEQ ID NO: 1488614 - RNA, 14 nt, Homo sapiens
cugaccaggcuucu

SEQ ID NO: 1488615 - RNA, 13 nt, Homo sapiens
cugaccccaaaga

SEQ ID NO: 1488616 - RNA, 13 nt, Homo sapiens
cugacccuagcuc

SEQ ID NO: 1488617 - RNA, 16 nt, Homo sapiens
cugccgcugcaccacg

SEQ ID NO: 1488618 - RNA, 20 nt, Homo sapiens
cugccggcccccaggacaag

SEQ ID NO: 1488619 - RNA, 18 nt, Homo sapiens
cugccgucuucacuuccc

SEQ ID NO: 1488620 - RNA, 21 nt, Homo sapiens
cugccuacuuuuaguugacuc

SEQ ID NO: 1488621 - RNA, 18 nt, Homo sapiens
cugccuagcugccuagca

SEQ ID NO: 1488622 - RNA, 17 nt, Homo sapiens
cugccucagacguugcc

SEQ ID NO: 1488623 - RNA, 14 nt, Homo sapiens
cugccucagccucc

SEQ ID NO: 1488624 - RNA, 20 nt, Homo sapiens
cugccucuggaauugcucaa

SEQ ID NO: 1488625 - RNA, 18 nt, Homo sapiens
cugccucuuucccuagga

SEQ ID NO: 1488626 - RNA, 21 nt, Homo sapiens
cugccugccuuccagccacau

SEQ ID NO: 1488627 - RNA, 20 nt, Homo sapiens
cugccuggcccccaaccuca

SEQ ID NO: 1488628 - RNA, 18 nt, Homo sapiens
cugccuuaucuugcaccc

SEQ ID NO: 1488629 - RNA, 15 nt, Homo sapiens
cugccuuccagccac

SEQ ID NO: 1488630 - RNA, 16 nt, Homo sapiens
cugccuuggacugugu

SEQ ID NO: 1488631 - RNA, 17 nt, Homo sapiens
cugccuuguccugaugc

SEQ ID NO: 1488632 - RNA, 14 nt, Homo sapiens
cugccuuguguaca

SEQ ID NO: 1488633 - RNA, 21 nt, Homo sapiens
cugcuacaggaggggucucau

SEQ ID NO: 1488634 - RNA, 23 nt, Homo sapiens
cugcuagcaaauggcagaaccaa

SEQ ID NO: 1488635 - RNA, 17 nt, Homo sapiens
cugcuaggcgcugggga

SEQ ID NO: 1488636 - RNA, 19 nt, Homo sapiens
cugcuaguuuauauagaaa

SEQ ID NO: 1488637 - RNA, 13 nt, Homo sapiens
cugcucacagucc

SEQ ID NO: 1488638 - RNA, 14 nt, Homo sapiens
cugcucacaguccu

SEQ ID NO: 1488639 - RNA, 14 nt, Homo sapiens
cugcuccaccacau

SEQ ID NO: 1488640 - RNA, 18 nt, Homo sapiens
cugcuccacgaagccuua

SEQ ID NO: 1488641 - RNA, 15 nt, Homo sapiens
cugcuccagaccuga

SEQ ID NO: 1488642 - RNA, 14 nt, Homo sapiens
cugcuccagugcag

SEQ ID NO: 1488643 - RNA, 16 nt, Homo sapiens
cugcucuacccaugag

SEQ ID NO: 1488644 - RNA, 13 nt, Homo sapiens
cugcucugagcca

SEQ ID NO: 1488645 - RNA, 22 nt, Homo sapiens
cugcucuugcaguugcucugac

SEQ ID NO: 1488646 - RNA, 22 nt, Homo sapiens
cugcucuuucucugccagugac

SEQ ID NO: 1488647 - RNA, 22 nt, Homo sapiens
cugcugaccucccagugacccc

SEQ ID NO: 1488648 - RNA, 12 nt, Homo sapiens
cugcugccagua

SEQ ID NO: 1488649 - RNA, 21 nt, Homo sapiens
cugcugcccccaccccgggga

SEQ ID NO: 1488650 - RNA, 18 nt, Homo sapiens
cugcugcuccagugcagg

SEQ ID NO: 1488651 - RNA, 16 nt, Homo sapiens
cugcuggcugcucccc

SEQ ID NO: 1488652 - RNA, 11 nt, Homo sapiens
cugcuggugag

SEQ ID NO: 1488653 - RNA, 15 nt, Homo sapiens
cugcuggugcuaaaa

SEQ ID NO: 1488654 - RNA, 18 nt, Homo sapiens
cugcuguccccuuggcag

SEQ ID NO: 1488655 - RNA, 14 nt, Homo sapiens
cugcugucuuguug

SEQ ID NO: 1488656 - RNA, 11 nt, Homo sapiens
cugcugugaau

SEQ ID NO: 1488657 - RNA, 14 nt, Homo sapiens
cugcuuaguaucuc

SEQ ID NO: 1488658 - RNA, 16 nt, Homo sapiens
cugcuucaaauauuuc

SEQ ID NO: 1488659 - RNA, 18 nt, Homo sapiens
cugcuuccgguagggagg

SEQ ID NO: 1488660 - RNA, 20 nt, Homo sapiens
cugcuugauuuuaauacauu

SEQ ID NO: 1488661 - RNA, 13 nt, Homo sapiens
cugcuugguuaaa

SEQ ID NO: 1488662 - RNA, 16 nt, Homo sapiens
cugcuuugucaaaagg

SEQ ID NO: 1488663 - RNA, 14 nt, Homo sapiens
cuggaagaagugag

SEQ ID NO: 1488664 - RNA, 22 nt, Homo sapiens
cuggaagaucagcacccuaaga

SEQ ID NO: 1488665 - RNA, 15 nt, Homo sapiens
cuggaaggacaucua

SEQ ID NO: 1488666 - RNA, 13 nt, Homo sapiens
cuggaaggcuucc

SEQ ID NO: 1488667 - RNA, 19 nt, Homo sapiens
cuggaauaagaagcaaaua

SEQ ID NO: 1488668 - RNA, 23 nt, Homo sapiens
cuggaauuaaggucaaacuaauu

SEQ ID NO: 1488669 - RNA, 22 nt, Homo sapiens
cuggaauuacaaaacucagaga

SEQ ID NO: 1488670 - RNA, 22 nt, Homo sapiens
cuggacaaaugaugccauggca

SEQ ID NO: 1488671 - RNA, 13 nt, Homo sapiens
cuggacacuucac

SEQ ID NO: 1488672 - RNA, 17 nt, Homo sapiens
cuggacagcagaagccu

SEQ ID NO: 1488673 - RNA, 16 nt, Homo sapiens
cuggacauucgaggaa

SEQ ID NO: 1488674 - RNA, 21 nt, Homo sapiens
cuggaccugcccugggccaca

SEQ ID NO: 1488675 - RNA, 21 nt, Homo sapiens
cuggacgugcgcgaugccugg

SEQ ID NO: 1488676 - RNA, 15 nt, Homo sapiens
cuggacuugccuaaa

SEQ ID NO: 1488677 - RNA, 12 nt, Homo sapiens
cuggacuuuccu

SEQ ID NO: 1488678 - RNA, 17 nt, Homo sapiens
cuggagacguggaaccu

SEQ ID NO: 1488679 - RNA, 21 nt, Homo sapiens
cuggagagguuaaggugcaau

SEQ ID NO: 1488680 - RNA, 20 nt, Homo sapiens
cuggagauggacaacucaau

SEQ ID NO: 1488681 - RNA, 22 nt, Homo sapiens
cuggagauggacaacucaauga

SEQ ID NO: 1488682 - RNA, 17 nt, Homo sapiens
cuggagccuccacugcc

SEQ ID NO: 1488683 - RNA, 19 nt, Homo sapiens
cuggagccuccacugccuc

SEQ ID NO: 1488684 - RNA, 23 nt, Homo sapiens
cuggaggcccaguucacccugau

SEQ ID NO: 1488685 - RNA, 17 nt, Homo sapiens
cuggagguugaagccaa

SEQ ID NO: 1488686 - RNA, 16 nt, Homo sapiens
cuggaucacagcugcu

SEQ ID NO: 1488687 - RNA, 21 nt, Homo sapiens
cuggauccccucugucuacaa

SEQ ID NO: 1488688 - RNA, 21 nt, Homo sapiens
cuggaucuaccagcauaaaua

SEQ ID NO: 1488689 - RNA, 24 nt, Homo sapiens
cuggaugauacgaaugaugucaga

SEQ ID NO: 1488690 - RNA, 18 nt, Homo sapiens
cuggaugggggucccugu

SEQ ID NO: 1488691 - RNA, 22 nt, Homo sapiens
cuggauguacuauccaaucugu

SEQ ID NO: 1488692 - RNA, 15 nt, Homo sapiens
cuggcaacacagagg

SEQ ID NO: 1488693 - RNA, 18 nt, Homo sapiens
cuggcaagucuuccauga

SEQ ID NO: 1488694 - RNA, 21 nt, Homo sapiens
cuggcaagucuuccaugaccc

SEQ ID NO: 1488695 - RNA, 19 nt, Homo sapiens
cuggcacugaauuaaucau

SEQ ID NO: 1488696 - RNA, 21 nt, Homo sapiens
cuggcagccauggccauggca

SEQ ID NO: 1488697 - RNA, 19 nt, Homo sapiens
cuggcagccgugccuucag

SEQ ID NO: 1488698 - RNA, 17 nt, Homo sapiens
cuggcagggcccaguga

SEQ ID NO: 1488699 - RNA, 17 nt, Homo sapiens
cuggcccucgacacuca

SEQ ID NO: 1488700 - RNA, 16 nt, Homo sapiens
cuggcccuuacacacu

SEQ ID NO: 1488701 - RNA, 13 nt, Homo sapiens
cuggcccuugcaa

SEQ ID NO: 1488702 - RNA, 21 nt, Homo sapiens
cuggccgggggaggugggugu

SEQ ID NO: 1488703 - RNA, 19 nt, Homo sapiens
cuggccuccuaugccucau

SEQ ID NO: 1488704 - RNA, 13 nt, Homo sapiens
cuaucaacaaaga

SEQ ID NO: 1488705 - RNA, 13 nt, Homo sapiens
cuaucaguacuuu

SEQ ID NO: 1488706 - RNA, 19 nt, Homo sapiens
cuaucauaauucagcacuu

SEQ ID NO: 1488707 - RNA, 16 nt, Homo sapiens
cuaucauggcauauaa

SEQ ID NO: 1488708 - RNA, 14 nt, Homo sapiens
cuaucgaacuucac

SEQ ID NO: 1488709 - RNA, 14 nt, Homo sapiens
cuaucuacuacaaa

SEQ ID NO: 1488710 - RNA, 21 nt, Homo sapiens
cuaucuacuacaaacuucaaa

SEQ ID NO: 1488711 - RNA, 23 nt, Homo sapiens
cuaucuacuacaaacuucaaaga

SEQ ID NO: 1488712 - RNA, 21 nt, Homo sapiens
cuaucugcacucuaaacugca

SEQ ID NO: 1488713 - RNA, 17 nt, Homo sapiens
cuaucuuuuaguuuuag

SEQ ID NO: 1488714 - RNA, 20 nt, Homo sapiens
cuaugaaaacagcuaucuca

SEQ ID NO: 1488715 - RNA, 21 nt, Homo sapiens
cuaugaaaacagcuaucucac

SEQ ID NO: 1488716 - RNA, 18 nt, Homo sapiens
cuaugaaaauuauaucuc

SEQ ID NO: 1488717 - RNA, 16 nt, Homo sapiens
cuaugaagaguauuaa

SEQ ID NO: 1488718 - RNA, 19 nt, Homo sapiens
cuauggauuugaaguuugc

SEQ ID NO: 1488719 - RNA, 18 nt, Homo sapiens
cuaugggacugcagugcc

SEQ ID NO: 1488720 - RNA, 20 nt, Homo sapiens
cuaugggguggggugggugu

SEQ ID NO: 1488721 - RNA, 13 nt, Homo sapiens
cuccacaucugcc

SEQ ID NO: 1488722 - RNA, 14 nt, Homo sapiens
cuccaccccacaga

SEQ ID NO: 1488723 - RNA, 22 nt, Homo sapiens
cuccaccgaccaacugcccuaa

SEQ ID NO: 1488724 - RNA, 16 nt, Homo sapiens
cuccaccuagacugua

SEQ ID NO: 1488725 - RNA, 18 nt, Homo sapiens
cuccaccuagacuguaaa

SEQ ID NO: 1488726 - RNA, 15 nt, Homo sapiens
cuccacgaagccuua

SEQ ID NO: 1488727 - RNA, 21 nt, Homo sapiens
cuccacgaagccuuaagccau

SEQ ID NO: 1488728 - RNA, 13 nt, Homo sapiens
cuccacucagguu

SEQ ID NO: 1488729 - RNA, 18 nt, Homo sapiens
cuccacucagguucuuca

SEQ ID NO: 1488730 - RNA, 14 nt, Homo sapiens
cuccagacaccagu

SEQ ID NO: 1488731 - RNA, 20 nt, Homo sapiens
cuccagccaaccucauugca

SEQ ID NO: 1488732 - RNA, 19 nt, Homo sapiens
cuccagcccagacccagug

SEQ ID NO: 1488733 - RNA, 21 nt, Homo sapiens
cuccagccugggggacagaaa

SEQ ID NO: 1488734 - RNA, 22 nt, Homo sapiens
cuccagcugggagacacagcaa

SEQ ID NO: 1488735 - RNA, 12 nt, Homo sapiens
cuccaggcuuca

SEQ ID NO: 1488736 - RNA, 18 nt, Homo sapiens
cuccagucuggcaacaga

SEQ ID NO: 1488737 - RNA, 19 nt, Homo sapiens
cuccagucuggcaacagag

SEQ ID NO: 1488738 - RNA, 13 nt, Homo sapiens
cuccagugccagc

SEQ ID NO: 1488739 - RNA, 19 nt, Homo sapiens
cuccaguggcagacaaaca

SEQ ID NO: 1488740 - RNA, 14 nt, Homo sapiens
cuccaguguacaua

SEQ ID NO: 1488741 - RNA, 15 nt, Homo sapiens
cuccaucagcuccug

SEQ ID NO: 1488742 - RNA, 16 nt, Homo sapiens
cuccaucucaaaaaag

SEQ ID NO: 1488743 - RNA, 17 nt, Homo sapiens
cuccaucucucauccuc

SEQ ID NO: 1488744 - RNA, 18 nt, Homo sapiens
cuccaucucuucugcaag

SEQ ID NO: 1488745 - RNA, 13 nt, Homo sapiens
cuccauucauccu

SEQ ID NO: 1488746 - RNA, 18 nt, Homo sapiens
cuccauucauccuuccau

SEQ ID NO: 1488747 - RNA, 15 nt, Homo sapiens
cuccauugugccuaa

SEQ ID NO: 1488748 - RNA, 15 nt, Homo sapiens
cuccauuuaccagua

SEQ ID NO: 1488749 - RNA, 20 nt, Homo sapiens
cuccauuuaccaguaacuua

SEQ ID NO: 1488750 - RNA, 12 nt, Homo sapiens
cuccauuuucaa

SEQ ID NO: 1488751 - RNA, 15 nt, Homo sapiens
cucccaaaguaccuu

SEQ ID NO: 1488752 - RNA, 16 nt, Homo sapiens
cucccaaagugcuagu

SEQ ID NO: 1488753 - RNA, 14 nt, Homo sapiens
cucccaagguccuc

SEQ ID NO: 1488754 - RNA, 19 nt, Homo sapiens
cucccacaacaacaaaagc

SEQ ID NO: 1488755 - RNA, 19 nt, Homo sapiens
cucccaccaccucaccagu

SEQ ID NO: 1488756 - RNA, 18 nt, Homo sapiens
cucccaccagagacuggg

SEQ ID NO: 1488757 - RNA, 19 nt, Homo sapiens
cucccacccuguaccucau

SEQ ID NO: 1488758 - RNA, 15 nt, Homo sapiens
cucccagcauaggau

SEQ ID NO: 1488759 - RNA, 21 nt, Homo sapiens
cucccauccuugaugcaagug

SEQ ID NO: 1488760 - RNA, 20 nt, Homo sapiens
cuccccacuuguccgcuggg

SEQ ID NO: 1488761 - RNA, 18 nt, Homo sapiens
cuccccagaaucaagcuu

SEQ ID NO: 1488762 - RNA, 16 nt, Homo sapiens
cuccccagcccagaga

SEQ ID NO: 1488763 - RNA, 23 nt, Homo sapiens
cuccccagcccuggcucugcaau

SEQ ID NO: 1488764 - RNA, 21 nt, Homo sapiens
cuccccaguucauugcacuuu

SEQ ID NO: 1488765 - RNA, 16 nt, Homo sapiens
cuccccuaacaggugc

SEQ ID NO: 1488766 - RNA, 15 nt, Homo sapiens
cuccccucccagucc

SEQ ID NO: 1488767 - RNA, 15 nt, Homo sapiens
cuccccuguaccuuu

SEQ ID NO: 1488768 - RNA, 20 nt, Homo sapiens
cucccgaguagcugggauua

SEQ ID NO: 1488769 - RNA, 15 nt, Homo sapiens
cucccucagcucucu

SEQ ID NO: 1488770 - RNA, 20 nt, Homo sapiens
cucccucaggcucuguggag

SEQ ID NO: 1488771 - RNA, 21 nt, Homo sapiens
cucccugaagccuuugcauuu

SEQ ID NO: 1488772 - RNA, 17 nt, Homo sapiens
cucccugcugugccaug

SEQ ID NO: 1488773 - RNA, 20 nt, Homo sapiens
cucccugucauagagcugca

SEQ ID NO: 1488774 - RNA, 20 nt, Homo sapiens
cucccuugcugaacacacac

SEQ ID NO: 1488775 - RNA, 14 nt, Homo sapiens
cucccuuugaugau

SEQ ID NO: 1488776 - RNA, 15 nt, Homo sapiens
cuccgcaacagccaa

SEQ ID NO: 1488777 - RNA, 16 nt, Homo sapiens
cuccgucucaaaagaa

SEQ ID NO: 1488778 - RNA, 18 nt, Homo sapiens
cuccguuuggcagugcaa

SEQ ID NO: 1488779 - RNA, 14 nt, Homo sapiens
cuccuacaugaugu

SEQ ID NO: 1488780 - RNA, 12 nt, Homo sapiens
cuccucaaaagc

SEQ ID NO: 1488781 - RNA, 18 nt, Homo sapiens
cuccucaguaaauguaca

SEQ ID NO: 1488782 - RNA, 15 nt, Homo sapiens
cuccucaucuccaag

SEQ ID NO: 1488783 - RNA, 12 nt, Homo sapiens
cuccuccaggga

SEQ ID NO: 1488784 - RNA, 13 nt, Homo sapiens
cuccuccagggaa

SEQ ID NO: 1488785 - RNA, 15 nt, Homo sapiens
cuccuccauucccua

SEQ ID NO: 1488786 - RNA, 15 nt, Homo sapiens
cuccucccugucaua

SEQ ID NO: 1488787 - RNA, 19 nt, Homo sapiens
cuccucucccauccuugau

SEQ ID NO: 1488788 - RNA, 15 nt, Homo sapiens
cuccucucugagacu

SEQ ID NO: 1488789 - RNA, 14 nt, Homo sapiens
cuccugcaucucau

SEQ ID NO: 1488790 - RNA, 15 nt, Homo sapiens
cuccugcugccagua

SEQ ID NO: 1488791 - RNA, 14 nt, Homo sapiens
cuccuggaaccuug

SEQ ID NO: 1488792 - RNA, 19 nt, Homo sapiens
cuccugggcucaagcaauc

SEQ ID NO: 1488793 - RNA, 20 nt, Homo sapiens
cuccugggcucaagcgaucc

SEQ ID NO: 1488794 - RNA, 13 nt, Homo sapiens
cuccugggcucag

SEQ ID NO: 1488795 - RNA, 19 nt, Homo sapiens
cuccuguggccugccaguc

SEQ ID NO: 1488796 - RNA, 22 nt, Homo sapiens
cuccuuacgcuuugucacacaa

SEQ ID NO: 1488797 - RNA, 14 nt, Homo sapiens
cuccuuugcacuga

SEQ ID NO: 1488798 - RNA, 16 nt, Homo sapiens
cucgacguugccuuua

SEQ ID NO: 1488799 - RNA, 16 nt, Homo sapiens
cucgccacgaacuagg

SEQ ID NO: 1488800 - RNA, 23 nt, Homo sapiens
cucggaaauggaaugugccccug

SEQ ID NO: 1488801 - RNA, 13 nt, Homo sapiens
cucggaggcugcc

SEQ ID NO: 1488802 - RNA, 21 nt, Homo sapiens
cucgggugcauuugagagaag

SEQ ID NO: 1488803 - RNA, 24 nt, Homo sapiens
cucgguggcauacagacuggggac

SEQ ID NO: 1488804 - RNA, 21 nt, Homo sapiens
cucguaucccaaaucugucag

SEQ ID NO: 1488805 - RNA, 16 nt, Homo sapiens
cucgugccaugaucug

SEQ ID NO: 1488806 - RNA, 12 nt, Homo sapiens
cuaagccuccuu

SEQ ID NO: 1488807 - RNA, 20 nt, Homo sapiens
cuaagcugccgguucuuaaa

SEQ ID NO: 1488808 - RNA, 19 nt, Homo sapiens
cuaagcuuugccagcugcu

SEQ ID NO: 1488809 - RNA, 23 nt, Homo sapiens
cuaaggaaaaaacuaguauuccc

SEQ ID NO: 1488810 - RNA, 16 nt, Homo sapiens
cuaaguuggugcuuuu

SEQ ID NO: 1488811 - RNA, 18 nt, Homo sapiens
cuaauaaaauauaaucua

SEQ ID NO: 1488812 - RNA, 15 nt, Homo sapiens
cuaauaaguauauaa

SEQ ID NO: 1488813 - RNA, 14 nt, Homo sapiens
cuaaucaccaaagg

SEQ ID NO: 1488814 - RNA, 23 nt, Homo sapiens
cuaauuaaaaaacacaucuggcc

SEQ ID NO: 1488815 - RNA, 22 nt, Homo sapiens
cuaauuaaaaaguuaaucuuca

SEQ ID NO: 1488816 - RNA, 21 nt, Homo sapiens
cuaauuaaucuggaauaugca

SEQ ID NO: 1488817 - RNA, 16 nt, Homo sapiens
cuaauuccauccauaa

SEQ ID NO: 1488818 - RNA, 18 nt, Homo sapiens
cuaauucccagaguguga

SEQ ID NO: 1488819 - RNA, 18 nt, Homo sapiens
cuaauuggccucuuuaag

SEQ ID NO: 1488820 - RNA, 14 nt, Homo sapiens
cuaauuguguacau

SEQ ID NO: 1488821 - RNA, 21 nt, Homo sapiens
cuaauuugcauuaaauucaca

SEQ ID NO: 1488822 - RNA, 20 nt, Homo sapiens
cuaauuuucuagauuuucua

SEQ ID NO: 1488823 - RNA, 18 nt, Homo sapiens
ccaaugagacucuagggu

SEQ ID NO: 1488824 - RNA, 13 nt, Homo sapiens
ccaaugaugguca

SEQ ID NO: 1488825 - RNA, 19 nt, Homo sapiens
ccaauggugauccucuauu

SEQ ID NO: 1488826 - RNA, 22 nt, Homo sapiens
ccaauuauuguuacacauuaag

SEQ ID NO: 1488827 - RNA, 18 nt, Homo sapiens
ccaauugugcugccauuu

SEQ ID NO: 1488828 - RNA, 14 nt, Homo sapiens
ccacaaaucuauaa

SEQ ID NO: 1488829 - RNA, 21 nt, Homo sapiens
ccacaaaugggaaaaccagac

SEQ ID NO: 1488830 - RNA, 21 nt, Homo sapiens
ccacaaccaccuucaccugga

SEQ ID NO: 1488831 - RNA, 22 nt, Homo sapiens
ccacaacccaagcaacauuugu

SEQ ID NO: 1488832 - RNA, 18 nt, Homo sapiens
ccacaaguccuuguucca

SEQ ID NO: 1488833 - RNA, 15 nt, Homo sapiens
ccacaagucuuccag

SEQ ID NO: 1488834 - RNA, 15 nt, Homo sapiens
ccacacagcagcagu

SEQ ID NO: 1488835 - RNA, 15 nt, Homo sapiens
ccacacccacuuugu

SEQ ID NO: 1488836 - RNA, 18 nt, Homo sapiens
ccacacccacuuugucca

SEQ ID NO: 1488837 - RNA, 22 nt, Homo sapiens
ccacacccuggaggauuucauc

SEQ ID NO: 1488838 - RNA, 22 nt, Homo sapiens
ccacaccuggcccuugcaaucu

SEQ ID NO: 1488839 - RNA, 12 nt, Homo sapiens
ccacacucagca

SEQ ID NO: 1488840 - RNA, 20 nt, Homo sapiens
ccacagaccuaggauuucau

SEQ ID NO: 1488841 - RNA, 21 nt, Homo sapiens
ccacagagagggagagcagag

SEQ ID NO: 1488842 - RNA, 19 nt, Homo sapiens
ccacagagugagccaguga

SEQ ID NO: 1488843 - RNA, 16 nt, Homo sapiens
ccacagcaaccccagg

SEQ ID NO: 1488844 - RNA, 21 nt, Homo sapiens
ccacagcaaccccaggcugaa

SEQ ID NO: 1488845 - RNA, 23 nt, Homo sapiens
ccacagcaucauuuugcauucaa

SEQ ID NO: 1488846 - RNA, 22 nt, Homo sapiens
ccacagcaucgggagcacccag

SEQ ID NO: 1488847 - RNA, 14 nt, Homo sapiens
ccacagcugccauc

SEQ ID NO: 1488848 - RNA, 23 nt, Homo sapiens
ccacagggcgagacuccgucuca

SEQ ID NO: 1488849 - RNA, 16 nt, Homo sapiens
ccacaguaauugguca

SEQ ID NO: 1488850 - RNA, 22 nt, Homo sapiens
ccacaguccuucuuugacacca

SEQ ID NO: 1488851 - RNA, 23 nt, Homo sapiens
ccacaucugccuuaaaaccaaag

SEQ ID NO: 1488852 - RNA, 20 nt, Homo sapiens
ccacauguacagacauacau

SEQ ID NO: 1488853 - RNA, 16 nt, Homo sapiens
ccaccaccucaccagu

SEQ ID NO: 1488854 - RNA, 17 nt, Homo sapiens
ccaccaccucaccaguu

SEQ ID NO: 1488855 - RNA, 19 nt, Homo sapiens
ccaccauaugaauuguaca

SEQ ID NO: 1488856 - RNA, 22 nt, Homo sapiens
ccacccucauucuacugaaaag

SEQ ID NO: 1488857 - RNA, 14 nt, Homo sapiens
ccacccugggagac

SEQ ID NO: 1488858 - RNA, 22 nt, Homo sapiens
ccaccgaaguggacuggccccu

SEQ ID NO: 1488859 - RNA, 13 nt, Homo sapiens
ccaccgcacucca

SEQ ID NO: 1488860 - RNA, 15 nt, Homo sapiens
ccaccuaugugccaa

SEQ ID NO: 1488861 - RNA, 16 nt, Homo sapiens
ccaccugacucuugca

SEQ ID NO: 1488862 - RNA, 20 nt, Homo sapiens
ccacgaccuuugaagagcuu

SEQ ID NO: 1488863 - RNA, 24 nt, Homo sapiens
ccacgucuggccaggcacugccuu

SEQ ID NO: 1488864 - RNA, 21 nt, Homo sapiens
ccacgugggcaaacaggcagu

SEQ ID NO: 1488865 - RNA, 19 nt, Homo sapiens
ccacguugccucuacuuua

SEQ ID NO: 1488866 - RNA, 20 nt, Homo sapiens
ccacguugccucuacuuuau

SEQ ID NO: 1488867 - RNA, 17 nt, Homo sapiens
ccacuaaaaauauuguu

SEQ ID NO: 1488868 - RNA, 12 nt, Homo sapiens
ccacuaaacuac

SEQ ID NO: 1488869 - RNA, 17 nt, Homo sapiens
ccacuaacuccugagaa

SEQ ID NO: 1488870 - RNA, 17 nt, Homo sapiens
ccacuauccuucgugaa

SEQ ID NO: 1488871 - RNA, 16 nt, Homo sapiens
ccacucagcucaccuc

SEQ ID NO: 1488872 - RNA, 16 nt, Homo sapiens
ccacucccugcuccac

SEQ ID NO: 1488873 - RNA, 15 nt, Homo sapiens
ccacucccugggaca

SEQ ID NO: 1488874 - RNA, 24 nt, Homo sapiens
ccacucuuguggucaucauggcca

SEQ ID NO: 1488875 - RNA, 21 nt, Homo sapiens
ccacugagaagugcacuuuaa

SEQ ID NO: 1488876 - RNA, 20 nt, Homo sapiens
ccacugaucucuacuaccac

SEQ ID NO: 1488877 - RNA, 17 nt, Homo sapiens
ccacugaugcuguucuc

SEQ ID NO: 1488878 - RNA, 20 nt, Homo sapiens
ccacuggcaaauguaacugu

SEQ ID NO: 1488879 - RNA, 10 nt, Homo sapiens
ccacugggag

SEQ ID NO: 1488880 - RNA, 20 nt, Homo sapiens
ccacugggcacacgcacaaa

SEQ ID NO: 1488881 - RNA, 13 nt, Homo sapiens
ccacugggcacug

SEQ ID NO: 1488882 - RNA, 13 nt, Homo sapiens
ccacuggucugua

SEQ ID NO: 1488883 - RNA, 19 nt, Homo sapiens
ccacuuagaaauugcauuu

SEQ ID NO: 1488884 - RNA, 15 nt, Homo sapiens
ccacuuagcaugugu

SEQ ID NO: 1488885 - RNA, 16 nt, Homo sapiens
ccacuucuaaauagca

SEQ ID NO: 1488886 - RNA, 18 nt, Homo sapiens
ccagaagaagagaagcug

SEQ ID NO: 1488887 - RNA, 21 nt, Homo sapiens
ccagaagaauauucaggacuu

SEQ ID NO: 1488888 - RNA, 19 nt, Homo sapiens
ccagaagauccccucagga

SEQ ID NO: 1488889 - RNA, 15 nt, Homo sapiens
ccagaagcugggaaa

SEQ ID NO: 1488890 - RNA, 17 nt, Homo sapiens
ccagaaggcgugcuggc

SEQ ID NO: 1488891 - RNA, 16 nt, Homo sapiens
ccagaaucuugacuuu

SEQ ID NO: 1488892 - RNA, 19 nt, Homo sapiens
ccagaaugcugcaggacuu

SEQ ID NO: 1488893 - RNA, 16 nt, Homo sapiens
ccagaauggaacucaa

SEQ ID NO: 1488894 - RNA, 17 nt, Homo sapiens
ccagaauggagccugcu

SEQ ID NO: 1488895 - RNA, 19 nt, Homo sapiens
ccagacaccagugcgugcu

SEQ ID NO: 1488896 - RNA, 15 nt, Homo sapiens
ccagagaguggcucc

SEQ ID NO: 1488897 - RNA, 18 nt, Homo sapiens
ccagagauggucacauga

SEQ ID NO: 1488898 - RNA, 11 nt, Homo sapiens
ccagagcaguu

SEQ ID NO: 1488899 - RNA, 21 nt, Homo sapiens
ccagagcauuuccaacaccac

SEQ ID NO: 1488900 - RNA, 20 nt, Homo sapiens
ccagagcggcuucaccugcg

SEQ ID NO: 1488901 - RNA, 16 nt, Homo sapiens
ccagagcuacugacua

SEQ ID NO: 1488902 - RNA, 23 nt, Homo sapiens
ccagagcuugugcuccucuugau

SEQ ID NO: 1488903 - RNA, 23 nt, Homo sapiens
agaagguggaccuuuuaaagugu

SEQ ID NO: 1488904 - RNA, 13 nt, Homo sapiens
agaaguagcuuca

SEQ ID NO: 1488905 - RNA, 14 nt, Homo sapiens
agaagucaacgccu

SEQ ID NO: 1488906 - RNA, 22 nt, Homo sapiens
agaagucaugaagcccaaguga

SEQ ID NO: 1488907 - RNA, 14 nt, Homo sapiens
agaagucuccucaa

SEQ ID NO: 1488908 - RNA, 15 nt, Homo sapiens
agaagugaguggugu

SEQ ID NO: 1488909 - RNA, 19 nt, Homo sapiens
agaagugcaauccagccca

SEQ ID NO: 1488910 - RNA, 22 nt, Homo sapiens
agaaguggcuacugacuacccu

SEQ ID NO: 1488911 - RNA, 22 nt, Homo sapiens
agaaguucucaaaguuaauuca

SEQ ID NO: 1488912 - RNA, 14 nt, Homo sapiens
agaaguuuaauuca

SEQ ID NO: 1488913 - RNA, 22 nt, Homo sapiens
agaauaaauucccaacuucucu

SEQ ID NO: 1488914 - RNA, 19 nt, Homo sapiens
agaauaauggaaacauuac

SEQ ID NO: 1488915 - RNA, 22 nt, Homo sapiens
agaauacuauuuccaaacucau

SEQ ID NO: 1488916 - RNA, 14 nt, Homo sapiens
agaauagcuuugaa

SEQ ID NO: 1488917 - RNA, 16 nt, Homo sapiens
agauccaguucuugaa

SEQ ID NO: 1488918 - RNA, 22 nt, Homo sapiens
agauccaguucuugaaaacacu

SEQ ID NO: 1488919 - RNA, 22 nt, Homo sapiens
agauccucaauaaacauuucau

SEQ ID NO: 1488920 - RNA, 23 nt, Homo sapiens
agauccuuuuuccaucauuuuac

SEQ ID NO: 1488921 - RNA, 20 nt, Homo sapiens
agaucgagaccauccuggcu

SEQ ID NO: 1488922 - RNA, 18 nt, Homo sapiens
agaucgcaccacugcacu

SEQ ID NO: 1488923 - RNA, 19 nt, Homo sapiens
agaucgcaucauugcacuc

SEQ ID NO: 1488924 - RNA, 17 nt, Homo sapiens
agaucgcgccacugcac

SEQ ID NO: 1488925 - RNA, 18 nt, Homo sapiens
agaucgcgccacugcacu

SEQ ID NO: 1488926 - RNA, 21 nt, Homo sapiens
agaucgugccauugcacucca

SEQ ID NO: 1488927 - RNA, 21 nt, Homo sapiens
agaucuaaggaugucacaggg

SEQ ID NO: 1488928 - RNA, 17 nt, Homo sapiens
agaucuaucuugucaau

SEQ ID NO: 1488929 - RNA, 24 nt, Homo sapiens
agaucucccacugcggggagacag

SEQ ID NO: 1488930 - RNA, 16 nt, Homo sapiens
caugaagagcuugugu

SEQ ID NO: 1488931 - RNA, 21 nt, Homo sapiens
caugaaggauaaaagccccaa

SEQ ID NO: 1488932 - RNA, 23 nt, Homo sapiens
caugacuuuauauggaugauuca

SEQ ID NO: 1488933 - RNA, 21 nt, Homo sapiens
caugagagaauuguaucauuu

SEQ ID NO: 1488934 - RNA, 17 nt, Homo sapiens
caugagguguugugcau

SEQ ID NO: 1488935 - RNA, 15 nt, Homo sapiens
caugaucauagcuca

SEQ ID NO: 1488936 - RNA, 22 nt, Homo sapiens
caugaucccuguguugucucua

SEQ ID NO: 1488937 - RNA, 17 nt, Homo sapiens
caugaugaaaccccauc

SEQ ID NO: 1488938 - RNA, 19 nt, Homo sapiens
caugauggccuuacacuga

SEQ ID NO: 1488939 - RNA, 16 nt, Homo sapiens
caugaugucaacucac

SEQ ID NO: 1488940 - RNA, 11 nt, Homo sapiens
caugauuuaga

SEQ ID NO: 1488941 - RNA, 16 nt, Homo sapiens
caugauuucauuucaa

SEQ ID NO: 1488942 - RNA, 13 nt, Homo sapiens
caugcaaugacau

SEQ ID NO: 1488943 - RNA, 14 nt, Homo sapiens
caugcacacacaca

SEQ ID NO: 1488944 - RNA, 21 nt, Homo sapiens
caugcacacacacacaucuca

SEQ ID NO: 1488945 - RNA, 18 nt, Homo sapiens
caugcacccucauacaca

SEQ ID NO: 1488946 - RNA, 21 nt, Homo sapiens
caugcagccagccaucaaaua

SEQ ID NO: 1488947 - RNA, 19 nt, Homo sapiens
caugcauaaauaugcagug

SEQ ID NO: 1488948 - RNA, 11 nt, Homo sapiens
caugcauuuga

SEQ ID NO: 1488949 - RNA, 12 nt, Homo sapiens
caugccaagaca

SEQ ID NO: 1488950 - RNA, 19 nt, Homo sapiens
caugccacccuguuuucag

SEQ ID NO: 1488951 - RNA, 16 nt, Homo sapiens
caugccccuggaccag

SEQ ID NO: 1488952 - RNA, 14 nt, Homo sapiens
caugcccugugcaa

SEQ ID NO: 1488953 - RNA, 22 nt, Homo sapiens
caugccuguaaucucagcacuu

SEQ ID NO: 1488954 - RNA, 14 nt, Homo sapiens
caugccuugugcug

SEQ ID NO: 1488955 - RNA, 20 nt, Homo sapiens
caugccuugugcuguuaaua

SEQ ID NO: 1488956 - RNA, 13 nt, Homo sapiens
caugcuccucacc

SEQ ID NO: 1488957 - RNA, 15 nt, Homo sapiens
caugcugugugcugg

SEQ ID NO: 1488958 - RNA, 22 nt, Homo sapiens
cauggaacucagcugucugugg

SEQ ID NO: 1488959 - RNA, 21 nt, Homo sapiens
cauggacacuccagugccagc

SEQ ID NO: 1488960 - RNA, 17 nt, Homo sapiens
cauggacuguugccacc

SEQ ID NO: 1488961 - RNA, 23 nt, Homo sapiens
cauggcaccuuuugcacauaaca

SEQ ID NO: 1488962 - RNA, 18 nt, Homo sapiens
cauggcagcuguuucuca

SEQ ID NO: 1488963 - RNA, 14 nt, Homo sapiens
cauggccauggcag

SEQ ID NO: 1488964 - RNA, 20 nt, Homo sapiens
cauggccccaguccaugcuu

SEQ ID NO: 1488965 - RNA, 23 nt, Homo sapiens
cauggcucuggcacaguguaauc

SEQ ID NO: 1488966 - RNA, 17 nt, Homo sapiens
cauggcuguguuugcag

SEQ ID NO: 1488967 - RNA, 18 nt, Homo sapiens
caugggaagcauguggau

SEQ ID NO: 1488968 - RNA, 23 nt, Homo sapiens
caugggagggggcuugaagccaa

SEQ ID NO: 1488969 - RNA, 21 nt, Homo sapiens
caugggcaccaaccugcauuu

SEQ ID NO: 1488970 - RNA, 16 nt, Homo sapiens
cauggguccacugcac

SEQ ID NO: 1488971 - RNA, 22 nt, Homo sapiens
cauggugcaguuuuggugugua

SEQ ID NO: 1488972 - RNA, 16 nt, Homo sapiens
cauggugccccaggac

SEQ ID NO: 1488973 - RNA, 16 nt, Homo sapiens
cauguaagccaaguca

SEQ ID NO: 1488974 - RNA, 17 nt, Homo sapiens
cauguaagccaagucau

SEQ ID NO: 1488975 - RNA, 17 nt, Homo sapiens
cauguaguaguacuuga

SEQ ID NO: 1488976 - RNA, 21 nt, Homo sapiens
cauguauucauccagaguucu

SEQ ID NO: 1488977 - RNA, 14 nt, Homo sapiens
cauguauugcacau

SEQ ID NO: 1488978 - RNA, 12 nt, Homo sapiens
caugucacugug

SEQ ID NO: 1488979 - RNA, 15 nt, Homo sapiens
caugucaugugagug

SEQ ID NO: 1488980 - RNA, 22 nt, Homo sapiens
cauguccauacacuuuguugca

SEQ ID NO: 1488981 - RNA, 21 nt, Homo sapiens
cauguccugcugcuucugcaa

SEQ ID NO: 1488982 - RNA, 16 nt, Homo sapiens
caugucugcuugucaa

SEQ ID NO: 1488983 - RNA, 15 nt, Homo sapiens
caugugacaagcaca

SEQ ID NO: 1488984 - RNA, 21 nt, Homo sapiens
caugugacauuuauauauuga

SEQ ID NO: 1488985 - RNA, 11 nt, Homo sapiens
caugugccuuu

SEQ ID NO: 1488986 - RNA, 15 nt, Homo sapiens
caugugcugccugca

SEQ ID NO: 1488987 - RNA, 16 nt, Homo sapiens
cauguggcuuuuuuaa

SEQ ID NO: 1488988 - RNA, 24 nt, Homo sapiens
cauguguuuauucauccagcagug

SEQ ID NO: 1488989 - RNA, 17 nt, Homo sapiens
cauguuacugaccagca

SEQ ID NO: 1488990 - RNA, 15 nt, Homo sapiens
cauguucacugugag

SEQ ID NO: 1488991 - RNA, 14 nt, Homo sapiens
cauguuccucaaaa

SEQ ID NO: 1488992 - RNA, 22 nt, Homo sapiens
cauguuguugaggcugucacag

SEQ ID NO: 1488993 - RNA, 17 nt, Homo sapiens
cauguuugcagggguga

SEQ ID NO: 1488994 - RNA, 21 nt, Homo sapiens
cauguuuuccgugaaaacgga

SEQ ID NO: 1488995 - RNA, 23 nt, Homo sapiens
cauguuuugauuuguagcacuga

SEQ ID NO: 1488996 - RNA, 15 nt, Homo sapiens
cauuaaacuuaccug

SEQ ID NO: 1488997 - RNA, 13 nt, Homo sapiens
cauuaacacaaag

SEQ ID NO: 1488998 - RNA, 16 nt, Homo sapiens
cauuaaguaaucaaua

SEQ ID NO: 1488999 - RNA, 13 nt, Homo sapiens
cauuaaugcaaug

SEQ ID NO: 1489000 - RNA, 13 nt, Homo sapiens
cauuaauguuucu

SEQ ID NO: 1489001 - RNA, 15 nt, Homo sapiens
cauuagcagcaucuu

SEQ ID NO: 1489002 - RNA, 19 nt, Homo sapiens
cauuagcuuccugccccag

SEQ ID NO: 1489003 - RNA, 20 nt, Homo sapiens
cauuaggucccucacuccac

SEQ ID NO: 1489004 - RNA, 16 nt, Homo sapiens
cauuagucacuuugaa

SEQ ID NO: 1489005 - RNA, 17 nt, Homo sapiens
cauuauaaacgugauga

SEQ ID NO: 1489006 - RNA, 14 nt, Homo sapiens
cauuauaacuguau

SEQ ID NO: 1489007 - RNA, 19 nt, Homo sapiens
cauuaucgagcagcauuuu

SEQ ID NO: 1489008 - RNA, 16 nt, Homo sapiens
cauuaugagaggcaau

SEQ ID NO: 1489009 - RNA, 16 nt, Homo sapiens
cauuaugccacuuccu

SEQ ID NO: 1489010 - RNA, 18 nt, Homo sapiens
cauuauguaucuuaguua

SEQ ID NO: 1489011 - RNA, 23 nt, Homo sapiens
cccugagcuuuguccugaaggaa

SEQ ID NO: 1489012 - RNA, 17 nt, Homo sapiens
cccugauacaggcaugg

SEQ ID NO: 1489013 - RNA, 15 nt, Homo sapiens
cccugaugacaccca

SEQ ID NO: 1489014 - RNA, 17 nt, Homo sapiens
cccugcaaacagaacag

SEQ ID NO: 1489015 - RNA, 17 nt, Homo sapiens
cccugcacuaaagccag

SEQ ID NO: 1489016 - RNA, 17 nt, Homo sapiens
cccugcccucucccaaa

SEQ ID NO: 1489017 - RNA, 19 nt, Homo sapiens
cccugcgcaugaaccugga

SEQ ID NO: 1489018 - RNA, 21 nt, Homo sapiens
cccugcgggugaacaaagcag

SEQ ID NO: 1489019 - RNA, 13 nt, Homo sapiens
cccugcucccaca

SEQ ID NO: 1489020 - RNA, 19 nt, Homo sapiens
cccugcuugcacuuuguaa

SEQ ID NO: 1489021 - RNA, 16 nt, Homo sapiens
cccuggccgaguccaa

SEQ ID NO: 1489022 - RNA, 20 nt, Homo sapiens
cccuggcuccucuacuguuu

SEQ ID NO: 1489023 - RNA, 16 nt, Homo sapiens
cccugggcuuugucau

SEQ ID NO: 1489024 - RNA, 16 nt, Homo sapiens
cccuggggcugugcau

SEQ ID NO: 1489025 - RNA, 14 nt, Homo sapiens
cccuguaugauucc

SEQ ID NO: 1489026 - RNA, 21 nt, Homo sapiens
cccuguccuaagcacuuuaua

SEQ ID NO: 1489027 - RNA, 12 nt, Homo sapiens
cccugugcaacc

SEQ ID NO: 1489028 - RNA, 11 nt, Homo sapiens
cccugugcaua

SEQ ID NO: 1489029 - RNA, 20 nt, Homo sapiens
gcacacacacacgcuuucuu

SEQ ID NO: 1489030 - RNA, 19 nt, Homo sapiens
gcacacagcugagcacuua

SEQ ID NO: 1489031 - RNA, 21 nt, Homo sapiens
gcacaccggcuuaacacuauc

SEQ ID NO: 1489032 - RNA, 13 nt, Homo sapiens
gcacacugcacug

SEQ ID NO: 1489033 - RNA, 13 nt, Homo sapiens
gcacagaauuugu

SEQ ID NO: 1489034 - RNA, 15 nt, Homo sapiens
gcacagaggucagga

SEQ ID NO: 1489035 - RNA, 13 nt, Homo sapiens
gcacagauggauu

SEQ ID NO: 1489036 - RNA, 19 nt, Homo sapiens
gcacagcucuucacaccau

SEQ ID NO: 1489037 - RNA, 19 nt, Homo sapiens
gcacaggccauggugcaca

SEQ ID NO: 1489038 - RNA, 17 nt, Homo sapiens
gcacaguaaaaauggaa

SEQ ID NO: 1489039 - RNA, 18 nt, Homo sapiens
gcacauagcuaucaagug

SEQ ID NO: 1489040 - RNA, 22 nt, Homo sapiens
gcacaucugcauuuucacccca

SEQ ID NO: 1489041 - RNA, 17 nt, Homo sapiens
gcaccaacaucuacaag

SEQ ID NO: 1489042 - RNA, 21 nt, Homo sapiens
gcaccaaccacagcaucggga

SEQ ID NO: 1489043 - RNA, 14 nt, Homo sapiens
gcaccacugcacuc

SEQ ID NO: 1489044 - RNA, 16 nt, Homo sapiens
gcaccacugcacucca

SEQ ID NO: 1489045 - RNA, 19 nt, Homo sapiens
gcaccacuguguauuuaac

SEQ ID NO: 1489046 - RNA, 19 nt, Homo sapiens
gcaccagagcaaccucuca

SEQ ID NO: 1489047 - RNA, 10 nt, Homo sapiens
gcaccagagg

SEQ ID NO: 1489048 - RNA, 17 nt, Homo sapiens
gcaccaggcacugcugc

SEQ ID NO: 1489049 - RNA, 20 nt, Homo sapiens
gcaccauucuccugccucag

SEQ ID NO: 1489050 - RNA, 19 nt, Homo sapiens
gcaccauugcacuccagcu

SEQ ID NO: 1489051 - RNA, 18 nt, Homo sapiens
gcacccaaaucacaucuc

SEQ ID NO: 1489052 - RNA, 20 nt, Homo sapiens
gcacccaacuacugagcuga

SEQ ID NO: 1489053 - RNA, 12 nt, Homo sapiens
gcacccauucca

SEQ ID NO: 1489054 - RNA, 17 nt, Homo sapiens
gcacccccacccaccuc

SEQ ID NO: 1489055 - RNA, 20 nt, Homo sapiens
gcacccugcgccuccagagg

SEQ ID NO: 1489056 - RNA, 15 nt, Homo sapiens
gcaccuaauccaggc

SEQ ID NO: 1489057 - RNA, 19 nt, Homo sapiens
gcaccuaccaucagggaca

SEQ ID NO: 1489058 - RNA, 12 nt, Homo sapiens
gcaccuaccuca

SEQ ID NO: 1489059 - RNA, 16 nt, Homo sapiens
gcaccuggauguacua

SEQ ID NO: 1489060 - RNA, 17 nt, Homo sapiens
gcaccuguaaagugccu

SEQ ID NO: 1489061 - RNA, 21 nt, Homo sapiens
gcaccuguagucccagcuacu

SEQ ID NO: 1489062 - RNA, 13 nt, Homo sapiens
gcaccugugcugg

SEQ ID NO: 1489063 - RNA, 21 nt, Homo sapiens
gcaccuuaagauuuugcaccu

SEQ ID NO: 1489064 - RNA, 16 nt, Homo sapiens
gcaccuuugcacagga

SEQ ID NO: 1489065 - RNA, 16 nt, Homo sapiens
gcacguucauaaccaa

SEQ ID NO: 1489066 - RNA, 20 nt, Homo sapiens
gcacuaaagaauacauuuaa

SEQ ID NO: 1489067 - RNA, 13 nt, Homo sapiens
gcacuauguauau

SEQ ID NO: 1489068 - RNA, 13 nt, Homo sapiens
gcacuauuugccg

SEQ ID NO: 1489069 - RNA, 14 nt, Homo sapiens
gcacucuaaacugc

SEQ ID NO: 1489070 - RNA, 22 nt, Homo sapiens
gcacugaauaaagcacgugcaa

SEQ ID NO: 1489071 - RNA, 15 nt, Homo sapiens
gcacugacugggcau

SEQ ID NO: 1489072 - RNA, 14 nt, Homo sapiens
gcacugaucaccca

SEQ ID NO: 1489073 - RNA, 17 nt, Homo sapiens
gcacugcucccuacccc

SEQ ID NO: 1489074 - RNA, 22 nt, Homo sapiens
gcacuggggagcccgucucagu

SEQ ID NO: 1489075 - RNA, 13 nt, Homo sapiens
gcacuggggccac

SEQ ID NO: 1489076 - RNA, 19 nt, Homo sapiens
gcacuggggccacccagcc

SEQ ID NO: 1489077 - RNA, 15 nt, Homo sapiens
gcacugucacuuugc

SEQ ID NO: 1489078 - RNA, 20 nt, Homo sapiens
gcacugugaccgagaacuuu

SEQ ID NO: 1489079 - RNA, 16 nt, Homo sapiens
gcacugugagcaccug

SEQ ID NO: 1489080 - RNA, 17 nt, Homo sapiens
gcacuuccuugccaguc

SEQ ID NO: 1489081 - RNA, 18 nt, Homo sapiens
gcacuugcugaggccaag

SEQ ID NO: 1489082 - RNA, 15 nt, Homo sapiens
gcacuuuaacugacu

SEQ ID NO: 1489083 - RNA, 15 nt, Homo sapiens
gcacuuuagaucacu

SEQ ID NO: 1489084 - RNA, 19 nt, Homo sapiens
gcacuuuagaucacuugag

SEQ ID NO: 1489085 - RNA, 21 nt, Homo sapiens
gcacuuugaaggggccucacc

SEQ ID NO: 1489086 - RNA, 16 nt, Homo sapiens
gcagaaacaguacuua

SEQ ID NO: 1489087 - RNA, 20 nt, Homo sapiens
gcagaaauccugcaaugaaa

SEQ ID NO: 1489088 - RNA, 19 nt, Homo sapiens
gcagaaauuuaucuuucaa

SEQ ID NO: 1489089 - RNA, 23 nt, Homo sapiens
gcagaaauuuaucuuucaaagag

SEQ ID NO: 1489090 - RNA, 22 nt, Homo sapiens
gcagaacagaucuuuuacuuug

SEQ ID NO: 1489091 - RNA, 14 nt, Homo sapiens
aaguuacuuuguaa

SEQ ID NO: 1489092 - RNA, 22 nt, Homo sapiens
aaguuagccuccaccacccuuu

SEQ ID NO: 1489093 - RNA, 18 nt, Homo sapiens
aaguuauacuguggcuau

SEQ ID NO: 1489094 - RNA, 22 nt, Homo sapiens
aaguuauccagaggguugugau

SEQ ID NO: 1489095 - RNA, 14 nt, Homo sapiens
aaguuauugauguu

SEQ ID NO: 1489096 - RNA, 22 nt, Homo sapiens
aaguuccaguguucucucuuau

SEQ ID NO: 1489097 - RNA, 16 nt, Homo sapiens
aaguugagacuucuga

SEQ ID NO: 1489098 - RNA, 17 nt, Homo sapiens
aaguugcugaugaacuc

SEQ ID NO: 1489099 - RNA, 13 nt, Homo sapiens
aaguuuucaggac

SEQ ID NO: 1489100 - RNA, 21 nt, Homo sapiens
aaguuuuguaaaagaaaucau

SEQ ID NO: 1489101 - RNA, 12 nt, Homo sapiens
aauaaaacugaa

SEQ ID NO: 1489102 - RNA, 15 nt, Homo sapiens
aauaaaaguaaagac

SEQ ID NO: 1489103 - RNA, 12 nt, Homo sapiens
aauaaaagugga

SEQ ID NO: 1489104 - RNA, 19 nt, Homo sapiens
aauaaaauuucuaagagag

SEQ ID NO: 1489105 - RNA, 12 nt, Homo sapiens
aauaaacauaau

SEQ ID NO: 1489106 - RNA, 12 nt, Homo sapiens
aauaaacugugc

SEQ ID NO: 1489107 - RNA, 20 nt, Homo sapiens
aauaaacuguguuuacucag

SEQ ID NO: 1489108 - RNA, 20 nt, Homo sapiens
aauaaagaauuaacagagau

SEQ ID NO: 1489109 - RNA, 19 nt, Homo sapiens
aauaaagcaaucugauuca

SEQ ID NO: 1489110 - RNA, 16 nt, Homo sapiens
aauaaagcacugagca

SEQ ID NO: 1489111 - RNA, 14 nt, Homo sapiens
aauaaagcuugcaa

SEQ ID NO: 1489112 - RNA, 13 nt, Homo sapiens
aauaaaggaagca

SEQ ID NO: 1489113 - RNA, 20 nt, Homo sapiens
aauaaaggaugugauugugg

SEQ ID NO: 1489114 - RNA, 14 nt, Homo sapiens
aauaaaguccugac

SEQ ID NO: 1489115 - RNA, 13 nt, Homo sapiens
aauaaagugcagu

SEQ ID NO: 1489116 - RNA, 16 nt, Homo sapiens
aauaaaguuacuugaa

SEQ ID NO: 1489117 - RNA, 15 nt, Homo sapiens
aauaaauaaacgagc

SEQ ID NO: 1489118 - RNA, 22 nt, Homo sapiens
aauaaauagcuauauccaugua

SEQ ID NO: 1489119 - RNA, 17 nt, Homo sapiens
aauaaaucguccuccca

SEQ ID NO: 1489120 - RNA, 23 nt, Homo sapiens
aauaaaugagagggaaucgacug

SEQ ID NO: 1489121 - RNA, 14 nt, Homo sapiens
aauaaaugugcuua

SEQ ID NO: 1489122 - RNA, 18 nt, Homo sapiens
aauaaauucccaacuucu

SEQ ID NO: 1489123 - RNA, 13 nt, Homo sapiens
aauaacacuaaaa

SEQ ID NO: 1489124 - RNA, 23 nt, Homo sapiens
aauaagacuuagauugugcuccu

SEQ ID NO: 1489125 - RNA, 18 nt, Homo sapiens
aauaagcaaucaagguua

SEQ ID NO: 1489126 - RNA, 14 nt, Homo sapiens
aauaauaaacagug

SEQ ID NO: 1489127 - RNA, 20 nt, Homo sapiens
aauaauaaaucguccuccca

SEQ ID NO: 1489128 - RNA, 14 nt, Homo sapiens
aauaauaccuaagc

SEQ ID NO: 1489129 - RNA, 12 nt, Homo sapiens
aauaauaugcau

SEQ ID NO: 1489130 - RNA, 13 nt, Homo sapiens
aauaaucuuauua

SEQ ID NO: 1489131 - RNA, 17 nt, Homo sapiens
aauaaugaauacauuuc

SEQ ID NO: 1489132 - RNA, 22 nt, Homo sapiens
aauaaugaguuagaacuauuaa

SEQ ID NO: 1489133 - RNA, 20 nt, Homo sapiens
aauaaugcugcaaacuuaau

SEQ ID NO: 1489134 - RNA, 22 nt, Homo sapiens
aauaaugugacgaaaguggaaa

SEQ ID NO: 1489135 - RNA, 20 nt, Homo sapiens
aauaauguuguaauucaugc

SEQ ID NO: 1489136 - RNA, 12 nt, Homo sapiens
aauaauugcuca

SEQ ID NO: 1489137 - RNA, 16 nt, Homo sapiens
aauacacaacacacac

SEQ ID NO: 1489138 - RNA, 22 nt, Homo sapiens
aauacagaaguccccucuacuu

SEQ ID NO: 1489139 - RNA, 20 nt, Homo sapiens
aauacagauagauauaugcu

SEQ ID NO: 1489140 - RNA, 17 nt, Homo sapiens
aauacagggcaugcauu

SEQ ID NO: 1489141 - RNA, 13 nt, Homo sapiens
aauacaguucugc

SEQ ID NO: 1489142 - RNA, 14 nt, Homo sapiens
aauacaucaaagag

SEQ ID NO: 1489143 - RNA, 18 nt, Homo sapiens
aauacgguaaggauacuu

SEQ ID NO: 1489144 - RNA, 14 nt, Homo sapiens
aauacguacauguu

SEQ ID NO: 1489145 - RNA, 21 nt, Homo sapiens
aauacuugaacucuguucccc

SEQ ID NO: 1489146 - RNA, 14 nt, Homo sapiens
aauacuuugcuuca

SEQ ID NO: 1489147 - RNA, 16 nt, Homo sapiens
aauagaaauaaauucc

SEQ ID NO: 1489148 - RNA, 16 nt, Homo sapiens
aauagaaccacuauga

SEQ ID NO: 1489149 - RNA, 20 nt, Homo sapiens
aauagaaccacuaugaagcu

SEQ ID NO: 1489150 - RNA, 23 nt, Homo sapiens
aauagaucaaaguccagcaggca

SEQ ID NO: 1489151 - RNA, 19 nt, Homo sapiens
aauagcauaucacagagag

SEQ ID NO: 1489152 - RNA, 15 nt, Homo sapiens
aauagccacauuugg

SEQ ID NO: 1489153 - RNA, 15 nt, Homo sapiens
aauagcuaagcaucu

SEQ ID NO: 1489154 - RNA, 21 nt, Homo sapiens
aauaggaaucuucacuagaag

SEQ ID NO: 1489155 - RNA, 24 nt, Homo sapiens
aauaggagaggaugagagcccaga

SEQ ID NO: 1489156 - RNA, 17 nt, Homo sapiens
aauaggugcuuauucuc

SEQ ID NO: 1489157 - RNA, 17 nt, Homo sapiens
aauaguaccuucaauac

SEQ ID NO: 1489158 - RNA, 12 nt, Homo sapiens
aauaguauuuau

SEQ ID NO: 1489159 - RNA, 21 nt, Homo sapiens
aauaguauuugagaguucuaa

SEQ ID NO: 1489160 - RNA, 15 nt, Homo sapiens
aauagugacaaguga

SEQ ID NO: 1489161 - RNA, 15 nt, Homo sapiens
aauagugcaacuaug

SEQ ID NO: 1489162 - RNA, 16 nt, Homo sapiens
aauauaaaaugaguag

SEQ ID NO: 1489163 - RNA, 14 nt, Homo sapiens
aauauaaacauaua

SEQ ID NO: 1489164 - RNA, 18 nt, Homo sapiens
aauauaagcugccauaua

SEQ ID NO: 1489165 - RNA, 16 nt, Homo sapiens
aauauaauuugaucuu

SEQ ID NO: 1489166 - RNA, 17 nt, Homo sapiens
aauauaguuauugcaca

SEQ ID NO: 1489167 - RNA, 20 nt, Homo sapiens
aauauauauaaccuuguuau

SEQ ID NO: 1489168 - RNA, 15 nt, Homo sapiens
aauaucacaguauua

SEQ ID NO: 1489169 - RNA, 16 nt, Homo sapiens
aauaucacaguauuau

SEQ ID NO: 1489170 - RNA, 23 nt, Homo sapiens
aauaucauucacuagcuuugccu

SEQ ID NO: 1489171 - RNA, 22 nt, Homo sapiens
aauauccagccucccacaagaa

SEQ ID NO: 1489172 - RNA, 17 nt, Homo sapiens
aauaucccuacauguau

SEQ ID NO: 1489173 - RNA, 17 nt, Homo sapiens
aauauccgaacuuuaau

SEQ ID NO: 1489174 - RNA, 15 nt, Homo sapiens
aauaucuuaucuucc

SEQ ID NO: 1489175 - RNA, 16 nt, Homo sapiens
aauaucuuugugauaa

SEQ ID NO: 1489176 - RNA, 20 nt, Homo sapiens
aauaugacggaagaacauag

SEQ ID NO: 1489177 - RNA, 21 nt, Homo sapiens
aauaugaguaauacaucaaag

SEQ ID NO: 1489178 - RNA, 20 nt, Homo sapiens
aauaugaguacaaaugccuu

SEQ ID NO: 1489179 - RNA, 16 nt, Homo sapiens
aauaugcuuuacaauc

SEQ ID NO: 1489180 - RNA, 13 nt, Homo sapiens
aauauuacaauac

SEQ ID NO: 1489181 - RNA, 16 nt, Homo sapiens
aauauuauguguuucc

SEQ ID NO: 1489182 - RNA, 18 nt, Homo sapiens
aauauuguguugugaaug

SEQ ID NO: 1489183 - RNA, 17 nt, Homo sapiens
aauauuuaucugauuaa

SEQ ID NO: 1489184 - RNA, 20 nt, Homo sapiens
aauauuuauuaccucugaua

SEQ ID NO: 1489185 - RNA, 20 nt, Homo sapiens
aauauuucccucaccuuucc

SEQ ID NO: 1489186 - RNA, 15 nt, Homo sapiens
aauauuuuaucuuuc

SEQ ID NO: 1489187 - RNA, 22 nt, Homo sapiens
aauauuuuuauauuuccuuuau

SEQ ID NO: 1489188 - RNA, 16 nt, Homo sapiens
aauauuuuuuacagau

SEQ ID NO: 1489189 - RNA, 18 nt, Homo sapiens
aauauuuuuuuuuugcca

SEQ ID NO: 1489190 - RNA, 21 nt, Homo sapiens
aaucaaaauugucucuucuga

SEQ ID NO: 1489191 - RNA, 22 nt, Homo sapiens
aaucaaaggaaaauaguaaugu

SEQ ID NO: 1489192 - RNA, 21 nt, Homo sapiens
aaucaacaaaauggucaucca

SEQ ID NO: 1489193 - RNA, 12 nt, Homo sapiens
aaucaagggcaa

SEQ ID NO: 1489194 - RNA, 14 nt, Homo sapiens
acacuaacauauaa

SEQ ID NO: 1489195 - RNA, 14 nt, Homo sapiens
acacuaacuaugca

SEQ ID NO: 1489196 - RNA, 12 nt, Homo sapiens
acacuaccacau

SEQ ID NO: 1489197 - RNA, 21 nt, Homo sapiens
acacuaguuuugugccagccg

SEQ ID NO: 1489198 - RNA, 19 nt, Homo sapiens
acacuauaaagguugacaa

SEQ ID NO: 1489199 - RNA, 15 nt, Homo sapiens
acacuaucauggacu

SEQ ID NO: 1489200 - RNA, 16 nt, Homo sapiens
acacuaucauggacua

SEQ ID NO: 1489201 - RNA, 22 nt, Homo sapiens
acacuaucauggacuacaccag

SEQ ID NO: 1489202 - RNA, 13 nt, Homo sapiens
acacuauuuacaa

SEQ ID NO: 1489203 - RNA, 23 nt, Homo sapiens
acacuccaucuccugcucaccac

SEQ ID NO: 1489204 - RNA, 17 nt, Homo sapiens
acacucccugcuugcag

SEQ ID NO: 1489205 - RNA, 22 nt, Homo sapiens
acacucccugcuugcaggaggc

SEQ ID NO: 1489206 - RNA, 13 nt, Homo sapiens
acacucgccagcu

SEQ ID NO: 1489207 - RNA, 14 nt, Homo sapiens
acacugaacuuaau

SEQ ID NO: 1489208 - RNA, 23 nt, Homo sapiens
acacugagagggcaaucuuugcc

SEQ ID NO: 1489209 - RNA, 20 nt, Homo sapiens
acacugagauauucagccca

SEQ ID NO: 1489210 - RNA, 12 nt, Homo sapiens
acacugcacugu

SEQ ID NO: 1489211 - RNA, 13 nt, Homo sapiens
acacugcaguuuc

SEQ ID NO: 1489212 - RNA, 19 nt, Homo sapiens
acacugcugcuccagugca

SEQ ID NO: 1489213 - RNA, 21 nt, Homo sapiens
acacugcugcuccagugcagg

SEQ ID NO: 1489214 - RNA, 17 nt, Homo sapiens
acacugcuguacccaga

SEQ ID NO: 1489215 - RNA, 15 nt, Homo sapiens
acacuggauggucau

SEQ ID NO: 1489216 - RNA, 18 nt, Homo sapiens
acacuggcguuacugcuu

SEQ ID NO: 1489217 - RNA, 23 nt, Homo sapiens
acacuggugugaccugagggcag

SEQ ID NO: 1489218 - RNA, 21 nt, Homo sapiens
acacugguuuggucaguuaca

SEQ ID NO: 1489219 - RNA, 16 nt, Homo sapiens
acacuguuaucuucac

SEQ ID NO: 1489220 - RNA, 22 nt, Homo sapiens
acacuguucugaaagugacuca

SEQ ID NO: 1489221 - RNA, 14 nt, Homo sapiens
acacuuaacagaug

SEQ ID NO: 1489222 - RNA, 16 nt, Homo sapiens
acacuuccauuaacuu

SEQ ID NO: 1489223 - RNA, 17 nt, Homo sapiens
acagaaaagacucugac

SEQ ID NO: 1489224 - RNA, 20 nt, Homo sapiens
acagaaagagacuccgucuc

SEQ ID NO: 1489225 - RNA, 19 nt, Homo sapiens
acagaaaguaucacaaaug

SEQ ID NO: 1489226 - RNA, 23 nt, Homo sapiens
acagaaccuucaacccagugggu

SEQ ID NO: 1489227 - RNA, 18 nt, Homo sapiens
acagaacuauguacuuua

SEQ ID NO: 1489228 - RNA, 21 nt, Homo sapiens
acagaacugcagucagcauga

SEQ ID NO: 1489229 - RNA, 13 nt, Homo sapiens
acagaacuucaga

SEQ ID NO: 1489230 - RNA, 16 nt, Homo sapiens
acagaagacagcugcu

SEQ ID NO: 1489231 - RNA, 22 nt, Homo sapiens
acagaagcuuaaaaucugugaa

SEQ ID NO: 1489232 - RNA, 22 nt, Homo sapiens
acagaagcuuuagcaagugugc

SEQ ID NO: 1489233 - RNA, 21 nt, Homo sapiens
acagaaguccccucuacuuua

SEQ ID NO: 1489234 - RNA, 16 nt, Homo sapiens
acagaagucuccucaa

SEQ ID NO: 1489235 - RNA, 15 nt, Homo sapiens
acagaauagcacaaa

SEQ ID NO: 1489236 - RNA, 9 nt, Homo sapiens
acagaauuu

SEQ ID NO: 1489237 - RNA, 20 nt, Homo sapiens
acagacacaauauguaugcu

SEQ ID NO: 1489238 - RNA, 16 nt, Homo sapiens
acagacauacauuucu

SEQ ID NO: 1489239 - RNA, 16 nt, Homo sapiens
acagaccacuugccac

SEQ ID NO: 1489240 - RNA, 15 nt, Homo sapiens
acagaccccuaggga

SEQ ID NO: 1489241 - RNA, 13 nt, Homo sapiens
acagagagacaga

SEQ ID NO: 1489242 - RNA, 16 nt, Homo sapiens
acagagauugaacucc

SEQ ID NO: 1489243 - RNA, 18 nt, Homo sapiens
acagagcaagacugucuc

SEQ ID NO: 1489244 - RNA, 12 nt, Homo sapiens
acagauaaaaca

SEQ ID NO: 1489245 - RNA, 23 nt, Homo sapiens
acagauccaaugggaguccaugg

SEQ ID NO: 1489246 - RNA, 20 nt, Homo sapiens
acagaucugaauucugcccu

SEQ ID NO: 1489247 - RNA, 18 nt, Homo sapiens
acagaugccacacaagga

SEQ ID NO: 1489248 - RNA, 17 nt, Homo sapiens
acagcaaccucuucaug

SEQ ID NO: 1489249 - RNA, 21 nt, Homo sapiens
acagcaaccucuucaugagcu

SEQ ID NO: 1489250 - RNA, 18 nt, Homo sapiens
acagcaagacuccgucuc

SEQ ID NO: 1489251 - RNA, 20 nt, Homo sapiens
acagcaagacuccgucucaa

SEQ ID NO: 1489252 - RNA, 17 nt, Homo sapiens
acagcaauggugucagu

SEQ ID NO: 1489253 - RNA, 13 nt, Homo sapiens
acagcacagccaa

SEQ ID NO: 1489254 - RNA, 16 nt, Homo sapiens
acagcacuggggaguc

SEQ ID NO: 1489255 - RNA, 21 nt, Homo sapiens
acagcacuggggagucuuugu

SEQ ID NO: 1489256 - RNA, 12 nt, Homo sapiens
acagcagguggg

SEQ ID NO: 1489257 - RNA, 15 nt, Homo sapiens
acagcagugaucuca

SEQ ID NO: 1489258 - RNA, 15 nt, Homo sapiens
acagcaguguucuca

SEQ ID NO: 1489259 - RNA, 17 nt, Homo sapiens
acagcauucuugucaca

SEQ ID NO: 1489260 - RNA, 12 nt, Homo sapiens
acagcauugcuu

SEQ ID NO: 1489261 - RNA, 14 nt, Homo sapiens
acagccaaguguga

SEQ ID NO: 1489262 - RNA, 18 nt, Homo sapiens
acagcccuccgacccuca

SEQ ID NO: 1489263 - RNA, 17 nt, Homo sapiens
acagccguuuguucuac

SEQ ID NO: 1489264 - RNA, 21 nt, Homo sapiens
acagccucccacccccaucuc

SEQ ID NO: 1489265 - RNA, 21 nt, Homo sapiens
acagccuccucugucugcccu

SEQ ID NO: 1489266 - RNA, 18 nt, Homo sapiens
acagcgcaugcuggugca

SEQ ID NO: 1489267 - RNA, 17 nt, Homo sapiens
acagcgcuaaggauggu

SEQ ID NO: 1489268 - RNA, 21 nt, Homo sapiens
acagcggaggagaccagcuca

SEQ ID NO: 1489269 - RNA, 20 nt, Homo sapiens
acagcuaucgaacuucacaa

SEQ ID NO: 1489270 - RNA, 19 nt, Homo sapiens
acagcucuacguggcaaau

SEQ ID NO: 1489271 - RNA, 15 nt, Homo sapiens
acagcugaacuauuu

SEQ ID NO: 1489272 - RNA, 22 nt, Homo sapiens
acagcugagugcccuguccuca

SEQ ID NO: 1489273 - RNA, 16 nt, Homo sapiens
acagcugauacuucau

SEQ ID NO: 1489274 - RNA, 22 nt, Homo sapiens
acagcuugggaauccugcuaaa

SEQ ID NO: 1489275 - RNA, 23 nt, Homo sapiens
acagcuugggaauccugcuaaag

SEQ ID NO: 1489276 - RNA, 18 nt, Homo sapiens
acagcuuuugcaacuuaa

SEQ ID NO: 1489277 - RNA, 23 nt, Homo sapiens
acaggaaaaaaaaaaaucuaucc

SEQ ID NO: 1489278 - RNA, 22 nt, Homo sapiens
acaggaagccugcaguccugga

SEQ ID NO: 1489279 - RNA, 17 nt, Homo sapiens
acaggaaggaaccagaa

SEQ ID NO: 1489280 - RNA, 19 nt, Homo sapiens
acaggaaucgguggucucc

SEQ ID NO: 1489281 - RNA, 20 nt, Homo sapiens
acaggaauggaacacacuug

SEQ ID NO: 1489282 - RNA, 20 nt, Homo sapiens
acaggacaggaaaguggcac

SEQ ID NO: 1489283 - RNA, 12 nt, Homo sapiens
acaggacuuuua

SEQ ID NO: 1489284 - RNA, 13 nt, Homo sapiens
acaggagauucca

SEQ ID NO: 1489285 - RNA, 22 nt, Homo sapiens
acaggaggaggagauggccaua

SEQ ID NO: 1489286 - RNA, 17 nt, Homo sapiens
acaggaggccagugggc

SEQ ID NO: 1489287 - RNA, 17 nt, Homo sapiens
acaggagucagugucug

SEQ ID NO: 1489288 - RNA, 15 nt, Homo sapiens
acaggauaacccuug

SEQ ID NO: 1489289 - RNA, 14 nt, Homo sapiens
acaggcaaauuccu

SEQ ID NO: 1489290 - RNA, 14 nt, Homo sapiens
acaggcaccugcca

SEQ ID NO: 1489291 - RNA, 20 nt, Homo sapiens
acaggccagguggugggcau

SEQ ID NO: 1489292 - RNA, 18 nt, Homo sapiens
acaggccauacuuuacaa

SEQ ID NO: 1489293 - RNA, 21 nt, Homo sapiens
acaggcccuggagaagcagcu

SEQ ID NO: 1489294 - RNA, 17 nt, Homo sapiens
acagggccacaacugcc

SEQ ID NO: 1489295 - RNA, 23 nt, Homo sapiens
acagggccaguggggccugugga

SEQ ID NO: 1489296 - RNA, 21 nt, Homo sapiens
accugucaucauggaggucau

SEQ ID NO: 1489297 - RNA, 22 nt, Homo sapiens
accugucuuccaaggagaccaa

SEQ ID NO: 1489298 - RNA, 22 nt, Homo sapiens
accugugagcccagcuggguca

SEQ ID NO: 1489299 - RNA, 14 nt, Homo sapiens
accugugugcuugg

SEQ ID NO: 1489300 - RNA, 19 nt, Homo sapiens
accuguuagcagacaggcc

SEQ ID NO: 1489301 - RNA, 20 nt, Homo sapiens
accuuaaagaaccaucagca

SEQ ID NO: 1489302 - RNA, 17 nt, Homo sapiens
accuuaagagacacucc

SEQ ID NO: 1489303 - RNA, 18 nt, Homo sapiens
accuuaagauuuugcacc

SEQ ID NO: 1489304 - RNA, 16 nt, Homo sapiens
accuuaucugugcgug

SEQ ID NO: 1489305 - RNA, 13 nt, Homo sapiens
accuucaauacuu

SEQ ID NO: 1489306 - RNA, 19 nt, Homo sapiens
accuuccagcuccuguaac

SEQ ID NO: 1489307 - RNA, 19 nt, Homo sapiens
accuugaagaaccucucac

SEQ ID NO: 1489308 - RNA, 22 nt, Homo sapiens
accuugacuugauuagugccuu

SEQ ID NO: 1489309 - RNA, 23 nt, Homo sapiens
accuuggcaccagacacccagga

SEQ ID NO: 1489310 - RNA, 15 nt, Homo sapiens
accuuggcucugcca

SEQ ID NO: 1489311 - RNA, 14 nt, Homo sapiens
accuuuauauuugg

SEQ ID NO: 1489312 - RNA, 15 nt, Homo sapiens
accuuuggagcaaag

SEQ ID NO: 1489313 - RNA, 13 nt, Homo sapiens
accuuuuccccaa

SEQ ID NO: 1489314 - RNA, 20 nt, Homo sapiens
accuuuuccccaaccacaga

SEQ ID NO: 1489315 - RNA, 22 nt, Homo sapiens
accuuuuccccaaccacagaga

SEQ ID NO: 1489316 - RNA, 19 nt, Homo sapiens
accuuuuccugcggcauca

SEQ ID NO: 1489317 - RNA, 22 nt, Homo sapiens
accuuuugaggagccccagcua

SEQ ID NO: 1489318 - RNA, 14 nt, Homo sapiens
acgaaaauaaagua

SEQ ID NO: 1489319 - RNA, 13 nt, Homo sapiens
acgaaaucuaggu

SEQ ID NO: 1489320 - RNA, 22 nt, Homo sapiens
acgaagccuuauuucuagaagc

SEQ ID NO: 1489321 - RNA, 21 nt, Homo sapiens
acgaauggcagcauacacaga

SEQ ID NO: 1489322 - RNA, 23 nt, Homo sapiens
acgacaggcgagagaggagccag

SEQ ID NO: 1489323 - RNA, 22 nt, Homo sapiens
acgaccggggccagcaccacuu

SEQ ID NO: 1489324 - RNA, 16 nt, Homo sapiens
acgacgauuucagcua

SEQ ID NO: 1489325 - RNA, 16 nt, Homo sapiens
acgauaaaauuacaaa

SEQ ID NO: 1489326 - RNA, 16 nt, Homo sapiens
acgcacugguaugugu

SEQ ID NO: 1489327 - RNA, 14 nt, Homo sapiens
acgcugguggugcu

SEQ ID NO: 1489328 - RNA, 16 nt, Homo sapiens
acgcuguccugagaug

SEQ ID NO: 1489329 - RNA, 21 nt, Homo sapiens
acgcuuugucacacaaaaagu

SEQ ID NO: 1489330 - RNA, 16 nt, Homo sapiens
acgcuuuuaauucuca

SEQ ID NO: 1489331 - RNA, 16 nt, Homo sapiens
acggaagaggcugcug

SEQ ID NO: 1489332 - RNA, 22 nt, Homo sapiens
acggaagaggcugcugagaaag

SEQ ID NO: 1489333 - RNA, 20 nt, Homo sapiens
acggaauaaugaguuagaac

SEQ ID NO: 1489334 - RNA, 14 nt, Homo sapiens
acggacucccgggc

SEQ ID NO: 1489335 - RNA, 16 nt, Homo sapiens
acggcaucaaggugcu

SEQ ID NO: 1489336 - RNA, 20 nt, Homo sapiens
acggcugccugacacugagc

SEQ ID NO: 1489337 - RNA, 14 nt, Homo sapiens
acgggaagcaagau

SEQ ID NO: 1489338 - RNA, 17 nt, Homo sapiens
acgggagaauauacaaa

SEQ ID NO: 1489339 - RNA, 16 nt, Homo sapiens
acgggaggcugggcac

SEQ ID NO: 1489340 - RNA, 18 nt, Homo sapiens
acggggaagccgagcucc

SEQ ID NO: 1489341 - RNA, 20 nt, Homo sapiens
acgguagugccugaaauuuc

SEQ ID NO: 1489342 - RNA, 12 nt, Homo sapiens
acgguccaugaa

SEQ ID NO: 1489343 - RNA, 17 nt, Homo sapiens
acggugcccauccugcc

SEQ ID NO: 1489344 - RNA, 20 nt, Homo sapiens
acgguuuuauaaaagccuug

SEQ ID NO: 1489345 - RNA, 16 nt, Homo sapiens
acguaugguggcucau

SEQ ID NO: 1489346 - RNA, 14 nt, Homo sapiens
acgucacugcacuc

SEQ ID NO: 1489347 - RNA, 18 nt, Homo sapiens
acgucauguguuuugcca

SEQ ID NO: 1489348 - RNA, 19 nt, Homo sapiens
acguggaaccucugucuca

SEQ ID NO: 1489349 - RNA, 24 nt, Homo sapiens
acguggagaaaaucaaaccgagca

SEQ ID NO: 1489350 - RNA, 17 nt, Homo sapiens
acguggcucagccagca

SEQ ID NO: 1489351 - RNA, 18 nt, Homo sapiens
acgugucuuccacuuugc

SEQ ID NO: 1489352 - RNA, 19 nt, Homo sapiens
acgugucuuccacuuugca

SEQ ID NO: 1489353 - RNA, 22 nt, Homo sapiens
acguuagauuugccguaccaau

SEQ ID NO: 1489354 - RNA, 18 nt, Homo sapiens
acguugccucuacuuuau

SEQ ID NO: 1489355 - RNA, 12 nt, Homo sapiens
acguuugauaca

SEQ ID NO: 1489356 - RNA, 15 nt, Homo sapiens
acguuuucuuucaca

SEQ ID NO: 1489357 - RNA, 18 nt, Homo sapiens
acuaaaaaggaaacuuca

SEQ ID NO: 1489358 - RNA, 14 nt, Homo sapiens
acuaaaaauauuau

SEQ ID NO: 1489359 - RNA, 14 nt, Homo sapiens
acuaaaacacugaa

SEQ ID NO: 1489360 - RNA, 20 nt, Homo sapiens
acuaaaagcagcgucacucu

SEQ ID NO: 1489361 - RNA, 19 nt, Homo sapiens
acuaaaagguaugcaauca

SEQ ID NO: 1489362 - RNA, 16 nt, Homo sapiens
acuaaaaggugaccaa

SEQ ID NO: 1489363 - RNA, 19 nt, Homo sapiens
acuaaaauuaggacuguau

SEQ ID NO: 1489364 - RNA, 20 nt, Homo sapiens
acuaaaauuuuaggcacucu

SEQ ID NO: 1489365 - RNA, 12 nt, Homo sapiens
acuaaacuuuca

SEQ ID NO: 1489366 - RNA, 18 nt, Homo sapiens
acuaaaugcacauuuuau

SEQ ID NO: 1489367 - RNA, 23 nt, Homo sapiens
acuaacauuucccccgagcucuu

SEQ ID NO: 1489368 - RNA, 14 nt, Homo sapiens
acuaagcaauuucc

SEQ ID NO: 1489369 - RNA, 12 nt, Homo sapiens
acuaagcacaaa

SEQ ID NO: 1489370 - RNA, 13 nt, Homo sapiens
acuaagcacaaag

SEQ ID NO: 1489371 - RNA, 12 nt, Homo sapiens
acuaagcucuuu

SEQ ID NO: 1489372 - RNA, 16 nt, Homo sapiens
acuaaggaaucuuucu

SEQ ID NO: 1489373 - RNA, 22 nt, Homo sapiens
acuaagugauuuguaugucuau

SEQ ID NO: 1489374 - RNA, 13 nt, Homo sapiens
acuaaucaagaaa

SEQ ID NO: 1489375 - RNA, 13 nt, Homo sapiens
acuaauucucaca

SEQ ID NO: 1489376 - RNA, 14 nt, Homo sapiens
acuacagcucuuaa

SEQ ID NO: 1489377 - RNA, 19 nt, Homo sapiens
acuacauuugugaacaaaa

SEQ ID NO: 1489378 - RNA, 14 nt, Homo sapiens
acuacuauauugau

SEQ ID NO: 1489379 - RNA, 18 nt, Homo sapiens
acuagaccuguaacuuuu

SEQ ID NO: 1489380 - RNA, 18 nt, Homo sapiens
acuagaggcuugcauaau

SEQ ID NO: 1489381 - RNA, 19 nt, Homo sapiens
acuagagucugaacagcug

SEQ ID NO: 1489382 - RNA, 21 nt, Homo sapiens
acuagccaggaaguacuucca

SEQ ID NO: 1489383 - RNA, 16 nt, Homo sapiens
acuagccugugcacgc

SEQ ID NO: 1489384 - RNA, 21 nt, Homo sapiens
acuagcuuuugccaguauuau

SEQ ID NO: 1489385 - RNA, 13 nt, Homo sapiens
acuaggacacucc

SEQ ID NO: 1489386 - RNA, 23 nt, Homo sapiens
acuaggcacuguggcucugcaug

SEQ ID NO: 1489387 - RNA, 14 nt, Homo sapiens
acuaggcucagaga

SEQ ID NO: 1489388 - RNA, 23 nt, Homo sapiens
acuaggcucuuaugugugccuuu

SEQ ID NO: 1489389 - RNA, 19 nt, Homo sapiens
acuaguaguuccugcuaca

SEQ ID NO: 1489390 - RNA, 14 nt, Homo sapiens
acuagugcagggua

SEQ ID NO: 1489391 - RNA, 12 nt, Homo sapiens
acuaguuuauuu

SEQ ID NO: 1489392 - RNA, 16 nt, Homo sapiens
acuaguuuucaaucau

SEQ ID NO: 1489393 - RNA, 17 nt, Homo sapiens
acuaguuuuuauuccuu

SEQ ID NO: 1489394 - RNA, 17 nt, Homo sapiens
acuauaagcccacuguu

SEQ ID NO: 1489395 - RNA, 18 nt, Homo sapiens
acuauaauguaagcucua

SEQ ID NO: 1489396 - RNA, 14 nt, Homo sapiens
acuauacacuuaau

SEQ ID NO: 1489397 - RNA, 20 nt, Homo sapiens
acuauagaaugcaacuccau

SEQ ID NO: 1489398 - RNA, 15 nt, Homo sapiens
agaagccgugggaag

SEQ ID NO: 1489399 - RNA, 20 nt, Homo sapiens
agaagccugaugcugacauu

SEQ ID NO: 1489400 - RNA, 19 nt, Homo sapiens
agaagcggauuuccaggga

SEQ ID NO: 1489401 - RNA, 13 nt, Homo sapiens
agaagcucuuacu

SEQ ID NO: 1489402 - RNA, 22 nt, Homo sapiens
agaagcuugcugguagcacuug

SEQ ID NO: 1489403 - RNA, 18 nt, Homo sapiens
agaaggcagccaccagcg

SEQ ID NO: 1489404 - RNA, 20 nt, Homo sapiens
agaaggcuucuuagcgcagu

SEQ ID NO: 1489405 - RNA, 20 nt, Homo sapiens
agaagggaauuuauugccuc

SEQ ID NO: 1489406 - RNA, 16 nt, Homo sapiens
agaagggauaacccua

SEQ ID NO: 1489407 - RNA, 14 nt, Homo sapiens
agaaguacuccuau

SEQ ID NO: 1489408 - RNA, 19 nt, Homo sapiens
agaagucauauguugucuu

SEQ ID NO: 1489409 - RNA, 16 nt, Homo sapiens
agaagugccaguugau

SEQ ID NO: 1489410 - RNA, 14 nt, Homo sapiens
agaauaaaguccaa

SEQ ID NO: 1489411 - RNA, 15 nt, Homo sapiens
agaauaaauucccaa

SEQ ID NO: 1489412 - RNA, 18 nt, Homo sapiens
agaauaaggaacaacguu

SEQ ID NO: 1489413 - RNA, 17 nt, Homo sapiens
agaauaaggcaggcauu

SEQ ID NO: 1489414 - RNA, 16 nt, Homo sapiens
agaaucacuggaaccu

SEQ ID NO: 1489415 - RNA, 21 nt, Homo sapiens
agaauccagcuacgaauauag

SEQ ID NO: 1489416 - RNA, 18 nt, Homo sapiens
agaaucucuugaaccugg

SEQ ID NO: 1489417 - RNA, 17 nt, Homo sapiens
agaaucugcagcuaacu

SEQ ID NO: 1489418 - RNA, 15 nt, Homo sapiens
agaaucugcugcaua

SEQ ID NO: 1489419 - RNA, 16 nt, Homo sapiens
agaauggugaucacuc

SEQ ID NO: 1489420 - RNA, 17 nt, Homo sapiens
agaaugugauauuugaa

SEQ ID NO: 1489421 - RNA, 13 nt, Homo sapiens
agaauuauucucu

SEQ ID NO: 1489422 - RNA, 20 nt, Homo sapiens
agaauucuggauaucucagg

SEQ ID NO: 1489423 - RNA, 16 nt, Homo sapiens
agaauucuuauacaca

SEQ ID NO: 1489424 - RNA, 19 nt, Homo sapiens
agaauugcuugaacccagg

SEQ ID NO: 1489425 - RNA, 14 nt, Homo sapiens
agaauuguaucauu

SEQ ID NO: 1489426 - RNA, 21 nt, Homo sapiens
agaauuuauucaauuccucug

SEQ ID NO: 1489427 - RNA, 18 nt, Homo sapiens
agaauuucacaagcuauu

SEQ ID NO: 1489428 - RNA, 23 nt, Homo sapiens
agaauuugguaaauuaguauuua

SEQ ID NO: 1489429 - RNA, 15 nt, Homo sapiens
agaauuugucagaaa

SEQ ID NO: 1489430 - RNA, 19 nt, Homo sapiens
agacaaaaucuuaaaugcc

SEQ ID NO: 1489431 - RNA, 17 nt, Homo sapiens
agacaaauucggaugua

SEQ ID NO: 1489432 - RNA, 16 nt, Homo sapiens
agacaagguucugccc

SEQ ID NO: 1489433 - RNA, 13 nt, Homo sapiens
agacaauauacaa

SEQ ID NO: 1489434 - RNA, 20 nt, Homo sapiens
agacaauauacaagccaaag

SEQ ID NO: 1489435 - RNA, 19 nt, Homo sapiens
agacaauguuuucuucaac

SEQ ID NO: 1489436 - RNA, 20 nt, Homo sapiens
agacacaacuauuuuuccaa

SEQ ID NO: 1489437 - RNA, 22 nt, Homo sapiens
agacaccagagcagaugcagag

SEQ ID NO: 1489438 - RNA, 18 nt, Homo sapiens
agacaccuguucacagaa

SEQ ID NO: 1489439 - RNA, 20 nt, Homo sapiens
agacacuaccccauauacac

SEQ ID NO: 1489440 - RNA, 22 nt, Homo sapiens
agacacugaaaaaucuaaguga

SEQ ID NO: 1489441 - RNA, 20 nt, Homo sapiens
agacacuggcguuacugcuu

SEQ ID NO: 1489442 - RNA, 15 nt, Homo sapiens
agacacuuaacucaa

SEQ ID NO: 1489443 - RNA, 14 nt, Homo sapiens
agacagaagccugg

SEQ ID NO: 1489444 - RNA, 18 nt, Homo sapiens
agacagacuugagaacuu

SEQ ID NO: 1489445 - RNA, 20 nt, Homo sapiens
agacaggccaugugagccac

SEQ ID NO: 1489446 - RNA, 16 nt, Homo sapiens
agacaggcucuuagca

SEQ ID NO: 1489447 - RNA, 14 nt, Homo sapiens
agacagugacuggu

SEQ ID NO: 1489448 - RNA, 15 nt, Homo sapiens
agacagugacuggug

SEQ ID NO: 1489449 - RNA, 16 nt, Homo sapiens
agacaguuauugcaag

SEQ ID NO: 1489450 - RNA, 20 nt, Homo sapiens
agacauacauuuaugcacau

SEQ ID NO: 1489451 - RNA, 13 nt, Homo sapiens
agacauacauuuc

SEQ ID NO: 1489452 - RNA, 19 nt, Homo sapiens
agacaucggccuccaugac

SEQ ID NO: 1489453 - RNA, 17 nt, Homo sapiens
agacaugugacauuuau

SEQ ID NO: 1489454 - RNA, 14 nt, Homo sapiens
agacauucuuccaa

SEQ ID NO: 1489455 - RNA, 17 nt, Homo sapiens
agaccaaguccuggcua

SEQ ID NO: 1489456 - RNA, 13 nt, Homo sapiens
agaccacauccac

SEQ ID NO: 1489457 - RNA, 15 nt, Homo sapiens
agaccacuguuauca

SEQ ID NO: 1489458 - RNA, 16 nt, Homo sapiens
agaccagagcaguuuc

SEQ ID NO: 1489459 - RNA, 19 nt, Homo sapiens
agaccagggugguugggac

SEQ ID NO: 1489460 - RNA, 17 nt, Homo sapiens
agaccaguguaucaggu

SEQ ID NO: 1489461 - RNA, 18 nt, Homo sapiens
agaccaguugggagcacu

SEQ ID NO: 1489462 - RNA, 19 nt, Homo sapiens
agaccaguugggagcacug

SEQ ID NO: 1489463 - RNA, 15 nt, Homo sapiens
agaccauaauguuac

SEQ ID NO: 1489464 - RNA, 20 nt, Homo sapiens
agaccauuuaucugggauua

SEQ ID NO: 1489465 - RNA, 17 nt, Homo sapiens
agacccaccacaccgca

SEQ ID NO: 1489466 - RNA, 19 nt, Homo sapiens
agacccaguggacucuucc

SEQ ID NO: 1489467 - RNA, 17 nt, Homo sapiens
agacccccacaccucag

SEQ ID NO: 1489468 - RNA, 17 nt, Homo sapiens
agacccuuuucucagga

SEQ ID NO: 1489469 - RNA, 13 nt, Homo sapiens
agaccuacccucc

SEQ ID NO: 1489470 - RNA, 19 nt, Homo sapiens
agaccucuaggaggagcua

SEQ ID NO: 1489471 - RNA, 22 nt, Homo sapiens
agaccugagucugcaugugcac

SEQ ID NO: 1489472 - RNA, 21 nt, Homo sapiens
agaccuggcacuggaugcaga

SEQ ID NO: 1489473 - RNA, 20 nt, Homo sapiens
agaccugguucccgccuccc

SEQ ID NO: 1489474 - RNA, 19 nt, Homo sapiens
agaccuguaaucauauaau

SEQ ID NO: 1489475 - RNA, 23 nt, Homo sapiens
agacggcggccaggcacagggcc

SEQ ID NO: 1489476 - RNA, 21 nt, Homo sapiens
agacguccuccguccauauca

SEQ ID NO: 1489477 - RNA, 19 nt, Homo sapiens
agacgugcgcgaugugaca

SEQ ID NO: 1489478 - RNA, 24 nt, Homo sapiens
agacuaagcccugucgagacacuu

SEQ ID NO: 1489479 - RNA, 15 nt, Homo sapiens
agacuacacaggaug

SEQ ID NO: 1489480 - RNA, 13 nt, Homo sapiens
agacuagugccgu

SEQ ID NO: 1489481 - RNA, 23 nt, Homo sapiens
agacuauuaauaaauaagacugu

SEQ ID NO: 1489482 - RNA, 12 nt, Homo sapiens
agacucaccuca

SEQ ID NO: 1489483 - RNA, 17 nt, Homo sapiens
agacuccucaucaugau

SEQ ID NO: 1489484 - RNA, 19 nt, Homo sapiens
agacucugagcugcucacc

SEQ ID NO: 1489485 - RNA, 22 nt, Homo sapiens
agacugacuuguuugucuucca

SEQ ID NO: 1489486 - RNA, 23 nt, Homo sapiens
agacugacuuguuugucuuccau

SEQ ID NO: 1489487 - RNA, 18 nt, Homo sapiens
agacuggauucgugacaa

SEQ ID NO: 1489488 - RNA, 19 nt, Homo sapiens
agacuggcugaaaaaccua

SEQ ID NO: 1489489 - RNA, 19 nt, Homo sapiens
agacuggggcauccugugc

SEQ ID NO: 1489490 - RNA, 17 nt, Homo sapiens
agacugguuuucugcca

SEQ ID NO: 1489491 - RNA, 19 nt, Homo sapiens
agacugguuuucugccaau

SEQ ID NO: 1489492 - RNA, 23 nt, Homo sapiens
agacuguugcucaaaucuauuca

SEQ ID NO: 1489493 - RNA, 11 nt, Homo sapiens
agacuucccag

SEQ ID NO: 1489494 - RNA, 23 nt, Homo sapiens
agacuuccccucaacaugcugcc

SEQ ID NO: 1489495 - RNA, 15 nt, Homo sapiens
agacuucguaauuaa

SEQ ID NO: 1489496 - RNA, 21 nt, Homo sapiens
agacuucuuccucuagacuug

SEQ ID NO: 1489497 - RNA, 19 nt, Homo sapiens
agacuuggcuccaccacug

SEQ ID NO: 1489498 - RNA, 22 nt, Homo sapiens
agacuuggcuccaccacugaua

SEQ ID NO: 1489499 - RNA, 23 nt, Homo sapiens
agacuuggcuccaccacugauau

SEQ ID NO: 1489500 - RNA, 19 nt, Homo sapiens
auccuucgugaacaucccc

SEQ ID NO: 1489501 - RNA, 14 nt, Homo sapiens
auccuuuaccacuc

SEQ ID NO: 1489502 - RNA, 13 nt, Homo sapiens
auccuuuacuguu

SEQ ID NO: 1489503 - RNA, 15 nt, Homo sapiens
auccuuuacuguuag

SEQ ID NO: 1489504 - RNA, 16 nt, Homo sapiens
aucgaaucuacuaauu

SEQ ID NO: 1489505 - RNA, 12 nt, Homo sapiens
aucgaccuggag

SEQ ID NO: 1489506 - RNA, 13 nt, Homo sapiens
aucgagaccaucc

SEQ ID NO: 1489507 - RNA, 17 nt, Homo sapiens
aucgaugcagugcuucc

SEQ ID NO: 1489508 - RNA, 13 nt, Homo sapiens
aucgcacacuggg

SEQ ID NO: 1489509 - RNA, 15 nt, Homo sapiens
aucgcaccacugcac

SEQ ID NO: 1489510 - RNA, 20 nt, Homo sapiens
aucgcaggagucucugccac

SEQ ID NO: 1489511 - RNA, 16 nt, Homo sapiens
aucggaagcagugccu

SEQ ID NO: 1489512 - RNA, 17 nt, Homo sapiens
aucggagacagugaucu

SEQ ID NO: 1489513 - RNA, 23 nt, Homo sapiens
aucggaucuggggcucugggaua

SEQ ID NO: 1489514 - RNA, 16 nt, Homo sapiens
aucgggagcagugucu

SEQ ID NO: 1489515 - RNA, 23 nt, Homo sapiens
aucuaaaagaauuuuaccauuca

SEQ ID NO: 1489516 - RNA, 18 nt, Homo sapiens
aucuaagccuuuccauaa

SEQ ID NO: 1489517 - RNA, 14 nt, Homo sapiens
aucuaagugauaua

SEQ ID NO: 1489518 - RNA, 18 nt, Homo sapiens
aucuacaaaaaacaacaa

SEQ ID NO: 1489519 - RNA, 22 nt, Homo sapiens
aucuacaaaaaacaacaaauaa

SEQ ID NO: 1489520 - RNA, 13 nt, Homo sapiens
aucuacacccacc

SEQ ID NO: 1489521 - RNA, 14 nt, Homo sapiens
aucuaccagcauaa

SEQ ID NO: 1489522 - RNA, 17 nt, Homo sapiens
aucuagaagacugucag

SEQ ID NO: 1489523 - RNA, 13 nt, Homo sapiens
aucuagcaauuuc

SEQ ID NO: 1489524 - RNA, 10 nt, Homo sapiens
aucuauccaa

SEQ ID NO: 1489525 - RNA, 15 nt, Homo sapiens
aucuauucuguguug

SEQ ID NO: 1489526 - RNA, 21 nt, Homo sapiens
aucuauucuguguugcauuau

SEQ ID NO: 1489527 - RNA, 21 nt, Homo sapiens
aucucacuggaugcaaagaaa

SEQ ID NO: 1489528 - RNA, 15 nt, Homo sapiens
aucucagccuaccau

SEQ ID NO: 1489529 - RNA, 18 nt, Homo sapiens
aucucagcgugggccaga

SEQ ID NO: 1489530 - RNA, 22 nt, Homo sapiens
aucucaugccccuggcugggac

SEQ ID NO: 1489531 - RNA, 15 nt, Homo sapiens
aucuccacugauaag

SEQ ID NO: 1489532 - RNA, 21 nt, Homo sapiens
aucuccaggauugaagagcau

SEQ ID NO: 1489533 - RNA, 20 nt, Homo sapiens
aucuccaucugucaacaggg

SEQ ID NO: 1489534 - RNA, 19 nt, Homo sapiens
aucucgccacugcacucca

SEQ ID NO: 1489535 - RNA, 22 nt, Homo sapiens
aucucggcucacugcaaccucu

SEQ ID NO: 1489536 - RNA, 19 nt, Homo sapiens
aucucuacugaaaguacaa

SEQ ID NO: 1489537 - RNA, 19 nt, Homo sapiens
aucucucacacauuccagg

SEQ ID NO: 1489538 - RNA, 15 nt, Homo sapiens
aucucuuccccagag

SEQ ID NO: 1489539 - RNA, 13 nt, Homo sapiens
aucugacccagug

SEQ ID NO: 1489540 - RNA, 17 nt, Homo sapiens
aucugcacucaccucac

SEQ ID NO: 1489541 - RNA, 19 nt, Homo sapiens
aucugcacucuaaacugca

SEQ ID NO: 1489542 - RNA, 13 nt, Homo sapiens
aucugcaguuuaa

SEQ ID NO: 1489543 - RNA, 18 nt, Homo sapiens
aucugcauuuucacccca

SEQ ID NO: 1489544 - RNA, 16 nt, Homo sapiens
aucugccagaccuuaa

SEQ ID NO: 1489545 - RNA, 22 nt, Homo sapiens
aucugccggcccccaggacaag

SEQ ID NO: 1489546 - RNA, 23 nt, Homo sapiens
aucugccggcccccaggacaagu

SEQ ID NO: 1489547 - RNA, 14 nt, Homo sapiens
aucugcgugacaau

SEQ ID NO: 1489548 - RNA, 14 nt, Homo sapiens
aucuggaacccaga

SEQ ID NO: 1489549 - RNA, 19 nt, Homo sapiens
aucuggcccucgacacuca

SEQ ID NO: 1489550 - RNA, 15 nt, Homo sapiens
aucugggauucccac

SEQ ID NO: 1489551 - RNA, 16 nt, Homo sapiens
aucuguaaaacuaaga

SEQ ID NO: 1489552 - RNA, 14 nt, Homo sapiens
aucuguacauauua

SEQ ID NO: 1489553 - RNA, 15 nt, Homo sapiens
aucugucaucucucu

SEQ ID NO: 1489554 - RNA, 15 nt, Homo sapiens
aucugugcagggcug

SEQ ID NO: 1489555 - RNA, 21 nt, Homo sapiens
aucuguuugaucccuguuacc

SEQ ID NO: 1489556 - RNA, 23 nt, Homo sapiens
aucuuaaacauaauaaaucacac

SEQ ID NO: 1489557 - RNA, 14 nt, Homo sapiens
aucuuaagauccac

SEQ ID NO: 1489558 - RNA, 20 nt, Homo sapiens
aucuuacaagguugcaagag

SEQ ID NO: 1489559 - RNA, 17 nt, Homo sapiens
aucuuagauguuucaca

SEQ ID NO: 1489560 - RNA, 23 nt, Homo sapiens
aucuuaguuacauuucuaucagu

SEQ ID NO: 1489561 - RNA, 12 nt, Homo sapiens
aucuucacaaaa

SEQ ID NO: 1489562 - RNA, 13 nt, Homo sapiens
aucuucacugcaa

SEQ ID NO: 1489563 - RNA, 23 nt, Homo sapiens
aucuucacuucuaaaugcauauc

SEQ ID NO: 1489564 - RNA, 14 nt, Homo sapiens
aucuuccugugucc

SEQ ID NO: 1489565 - RNA, 22 nt, Homo sapiens
aucuugaaauuaagaaggcaaa

SEQ ID NO: 1489566 - RNA, 16 nt, Homo sapiens
aucuugccacauuucu

SEQ ID NO: 1489567 - RNA, 20 nt, Homo sapiens
aucuuggagacccugcaaac

SEQ ID NO: 1489568 - RNA, 19 nt, Homo sapiens
aucuuggauuaugaaguga

SEQ ID NO: 1489569 - RNA, 13 nt, Homo sapiens
aucuugugcucag

SEQ ID NO: 1489570 - RNA, 13 nt, Homo sapiens
aucuugugugauu

SEQ ID NO: 1489571 - RNA, 21 nt, Homo sapiens
aucuuuacaaaacuacaugag

SEQ ID NO: 1489572 - RNA, 22 nt, Homo sapiens
aucuuuacucccaagacuucau

SEQ ID NO: 1489573 - RNA, 12 nt, Homo sapiens
aucuuucaggaa

SEQ ID NO: 1489574 - RNA, 16 nt, Homo sapiens
aucuuucuccuugaau

SEQ ID NO: 1489575 - RNA, 18 nt, Homo sapiens
aucuuucuuuaccugaga

SEQ ID NO: 1489576 - RNA, 15 nt, Homo sapiens
aucuuuggauuugau

SEQ ID NO: 1489577 - RNA, 23 nt, Homo sapiens
aucuuuuaguuuuaguugcagaa

SEQ ID NO: 1489578 - RNA, 16 nt, Homo sapiens
aucuuuucauuaaaga

SEQ ID NO: 1489579 - RNA, 15 nt, Homo sapiens
aucuuuucauucuca

SEQ ID NO: 1489580 - RNA, 23 nt, Homo sapiens
augaaaaauauugcugaacuacu

SEQ ID NO: 1489581 - RNA, 21 nt, Homo sapiens
augaaaacauagcaucucagg

SEQ ID NO: 1489582 - RNA, 12 nt, Homo sapiens
augaaacuaaga

SEQ ID NO: 1489583 - RNA, 23 nt, Homo sapiens
augaaagguacuauauuugcuag

SEQ ID NO: 1489584 - RNA, 13 nt, Homo sapiens
augaaauaugcau

SEQ ID NO: 1489585 - RNA, 18 nt, Homo sapiens
augaaauguaugugcucu

SEQ ID NO: 1489586 - RNA, 14 nt, Homo sapiens
augaaauuaacaca

SEQ ID NO: 1489587 - RNA, 13 nt, Homo sapiens
augaaauuugcaa

SEQ ID NO: 1489588 - RNA, 18 nt, Homo sapiens
augaacaugugaaguuau

SEQ ID NO: 1489589 - RNA, 16 nt, Homo sapiens
augaacucuuaaucaa

SEQ ID NO: 1489590 - RNA, 21 nt, Homo sapiens
augaagaugucuaauaguuau

SEQ ID NO: 1489591 - RNA, 21 nt, Homo sapiens
augaagauucuccugugcuag

SEQ ID NO: 1489592 - RNA, 12 nt, Homo sapiens
augaagccagcu

SEQ ID NO: 1489593 - RNA, 20 nt, Homo sapiens
augaagcuaccucaaacuuc

SEQ ID NO: 1489594 - RNA, 23 nt, Homo sapiens
augaagcugcucugaaaucuccu

SEQ ID NO: 1489595 - RNA, 15 nt, Homo sapiens
augaagggcuccgug

SEQ ID NO: 1489596 - RNA, 17 nt, Homo sapiens
augaagugacucucaca

SEQ ID NO: 1489597 - RNA, 15 nt, Homo sapiens
augaauaagcacuug

SEQ ID NO: 1489598 - RNA, 18 nt, Homo sapiens
augaaucucccacuccag

SEQ ID NO: 1489599 - RNA, 12 nt, Homo sapiens
augaaugaaacu

SEQ ID NO: 1489600 - RNA, 12 nt, Homo sapiens
augaaugcacac

SEQ ID NO: 1489601 - RNA, 14 nt, Homo sapiens
augaaugcccagug

SEQ ID NO: 1489602 - RNA, 23 nt, Homo sapiens
augaauguuuacacucuuuguaa

SEQ ID NO: 1489603 - RNA, 16 nt, Homo sapiens
auugugaaguacauau

SEQ ID NO: 1489604 - RNA, 18 nt, Homo sapiens
auugugauauuuuuacuu

SEQ ID NO: 1489605 - RNA, 13 nt, Homo sapiens
auugugcugccau

SEQ ID NO: 1489606 - RNA, 15 nt, Homo sapiens
auuguuaauuaucua

SEQ ID NO: 1489607 - RNA, 16 nt, Homo sapiens
auuguuaucuaucaac

SEQ ID NO: 1489608 - RNA, 17 nt, Homo sapiens
auuguucaaagcacaga

SEQ ID NO: 1489609 - RNA, 15 nt, Homo sapiens
auuguuccaagacau

SEQ ID NO: 1489610 - RNA, 10 nt, Homo sapiens
auuguucucc

SEQ ID NO: 1489611 - RNA, 13 nt, Homo sapiens
auuuaaaagacua

SEQ ID NO: 1489612 - RNA, 20 nt, Homo sapiens
auuuaaaauuccauuaucuu

SEQ ID NO: 1489613 - RNA, 18 nt, Homo sapiens
auuuaaacaccuccucau

SEQ ID NO: 1489614 - RNA, 23 nt, Homo sapiens
auuuaaauguguacaauguacac

SEQ ID NO: 1489615 - RNA, 16 nt, Homo sapiens
auuuaacuaaaguuaa

SEQ ID NO: 1489616 - RNA, 19 nt, Homo sapiens
auuuaaugaauacuugcua

SEQ ID NO: 1489617 - RNA, 12 nt, Homo sapiens
auuuacacucag

SEQ ID NO: 1489618 - RNA, 18 nt, Homo sapiens
auuuacagccucacuuga

SEQ ID NO: 1489619 - RNA, 20 nt, Homo sapiens
auuuacagccucacuugaau

SEQ ID NO: 1489620 - RNA, 21 nt, Homo sapiens
auuuacugaaguuauuuauua

SEQ ID NO: 1489621 - RNA, 19 nt, Homo sapiens
auuuacuuaacagaacagu

SEQ ID NO: 1489622 - RNA, 19 nt, Homo sapiens
auuuacuuuuaccacuauu

SEQ ID NO: 1489623 - RNA, 21 nt, Homo sapiens
auuuagaaacugauuucuuca

SEQ ID NO: 1489624 - RNA, 15 nt, Homo sapiens
auuuagaaaucaagc

SEQ ID NO: 1489625 - RNA, 18 nt, Homo sapiens
auuuagaaaucaagcaua

SEQ ID NO: 1489626 - RNA, 12 nt, Homo sapiens
auuuagaacuug

SEQ ID NO: 1489627 - RNA, 17 nt, Homo sapiens
auuuauaaaacuucuca

SEQ ID NO: 1489628 - RNA, 21 nt, Homo sapiens
auuuauaaaacuucucaagau

SEQ ID NO: 1489629 - RNA, 22 nt, Homo sapiens
auuuauauaugaaaacuauaca

SEQ ID NO: 1489630 - RNA, 18 nt, Homo sapiens
auuuauauuuagcaaaau

SEQ ID NO: 1489631 - RNA, 13 nt, Homo sapiens
auuuaucauucuu

SEQ ID NO: 1489632 - RNA, 22 nt, Homo sapiens
auuuaucguauagguugaugaa

SEQ ID NO: 1489633 - RNA, 16 nt, Homo sapiens
auuuaugaugcacuua

SEQ ID NO: 1489634 - RNA, 19 nt, Homo sapiens
auuuauggucaacacuuaa

SEQ ID NO: 1489635 - RNA, 13 nt, Homo sapiens
auuuauguguaua

SEQ ID NO: 1489636 - RNA, 13 nt, Homo sapiens
auuuauguuuauu

SEQ ID NO: 1489637 - RNA, 16 nt, Homo sapiens
auuuauuaacuaauca

SEQ ID NO: 1489638 - RNA, 17 nt, Homo sapiens
auuuauuaccucugaua

SEQ ID NO: 1489639 - RNA, 19 nt, Homo sapiens
auuuauuaguccuaauuca

SEQ ID NO: 1489640 - RNA, 12 nt, Homo sapiens
auuuauucacau

SEQ ID NO: 1489641 - RNA, 20 nt, Homo sapiens
auuuauugccuggaguguga

SEQ ID NO: 1489642 - RNA, 16 nt, Homo sapiens
auuuauuuaagcauca

SEQ ID NO: 1489643 - RNA, 15 nt, Homo sapiens
auuuauuuaagcuua

SEQ ID NO: 1489644 - RNA, 16 nt, Homo sapiens
auuuauuucauccagu

SEQ ID NO: 1489645 - RNA, 15 nt, Homo sapiens
auuucaauauuagca

SEQ ID NO: 1489646 - RNA, 16 nt, Homo sapiens
auuucacaagcuauuc

SEQ ID NO: 1489647 - RNA, 15 nt, Homo sapiens
auuucaccaccaaau

SEQ ID NO: 1489648 - RNA, 22 nt, Homo sapiens
auuucacgcuuuuaauucucau

SEQ ID NO: 1489649 - RNA, 22 nt, Homo sapiens
auuucacuagaaaagcugauca

SEQ ID NO: 1489650 - RNA, 15 nt, Homo sapiens
auuucagaagccuaa

SEQ ID NO: 1489651 - RNA, 18 nt, Homo sapiens
auuucagauaaacaacaa

SEQ ID NO: 1489652 - RNA, 15 nt, Homo sapiens
auuucagauauucca

SEQ ID NO: 1489653 - RNA, 19 nt, Homo sapiens
auuucagaucauauuucac

SEQ ID NO: 1489654 - RNA, 18 nt, Homo sapiens
auuucaggaagacugaca

SEQ ID NO: 1489655 - RNA, 23 nt, Homo sapiens
auuuccaaaacuuuaaugaacua

SEQ ID NO: 1489656 - RNA, 14 nt, Homo sapiens
auuuccaacaccac

SEQ ID NO: 1489657 - RNA, 16 nt, Homo sapiens
auuuccaacaccacag

SEQ ID NO: 1489658 - RNA, 18 nt, Homo sapiens
auuuccagaaauacaauu

SEQ ID NO: 1489659 - RNA, 18 nt, Homo sapiens
auuuccagcugugcagca

SEQ ID NO: 1489660 - RNA, 17 nt, Homo sapiens
auuucccccgagcucuu

SEQ ID NO: 1489661 - RNA, 21 nt, Homo sapiens
auuuccgugaacucuggugcu

SEQ ID NO: 1489662 - RNA, 13 nt, Homo sapiens
auuuccugacaga

SEQ ID NO: 1489663 - RNA, 21 nt, Homo sapiens
auuuccugacagaaggacuca

SEQ ID NO: 1489664 - RNA, 20 nt, Homo sapiens
auuuccuuacagaacuacuu

SEQ ID NO: 1489665 - RNA, 22 nt, Homo sapiens
auuuccuuacagaacuacuucu

SEQ ID NO: 1489666 - RNA, 13 nt, Homo sapiens
auuuccuuuaugu

SEQ ID NO: 1489667 - RNA, 15 nt, Homo sapiens
auuuccuuuuugaca

SEQ ID NO: 1489668 - RNA, 11 nt, Homo sapiens
auuucuaaucc

SEQ ID NO: 1489669 - RNA, 18 nt, Homo sapiens
auuucuagaggaacuuuu

SEQ ID NO: 1489670 - RNA, 14 nt, Homo sapiens
auuucucacugaga

SEQ ID NO: 1489671 - RNA, 13 nt, Homo sapiens
auuucucuugcaa

SEQ ID NO: 1489672 - RNA, 20 nt, Homo sapiens
auuucugagagugaaaccau

SEQ ID NO: 1489673 - RNA, 19 nt, Homo sapiens
auuucugaucuauacaaau

SEQ ID NO: 1489674 - RNA, 19 nt, Homo sapiens
auuucuggagggcaauuug

SEQ ID NO: 1489675 - RNA, 23 nt, Homo sapiens
auuucuguggauggcaucaaaca

SEQ ID NO: 1489676 - RNA, 15 nt, Homo sapiens
auuucuucuacugcu

SEQ ID NO: 1489677 - RNA, 15 nt, Homo sapiens
auuucuuuguuauca

SEQ ID NO: 1489678 - RNA, 17 nt, Homo sapiens
auuugaagaacauguga

SEQ ID NO: 1489679 - RNA, 15 nt, Homo sapiens
auuugaaguuugcca

SEQ ID NO: 1489680 - RNA, 20 nt, Homo sapiens
auuugagagaagccacgcug

SEQ ID NO: 1489681 - RNA, 16 nt, Homo sapiens
auuugauacauaauaa

SEQ ID NO: 1489682 - RNA, 13 nt, Homo sapiens
auuugcaaaauca

SEQ ID NO: 1489683 - RNA, 15 nt, Homo sapiens
auuugcaacagcuac

SEQ ID NO: 1489684 - RNA, 23 nt, Homo sapiens
auuugcauuugcucuuucaucuc

SEQ ID NO: 1489685 - RNA, 12 nt, Homo sapiens
auuugccuguuu

SEQ ID NO: 1489686 - RNA, 18 nt, Homo sapiens
auuugcucuuucaucucu

SEQ ID NO: 1489687 - RNA, 15 nt, Homo sapiens
auuuggaaucuucuc

SEQ ID NO: 1489688 - RNA, 14 nt, Homo sapiens
auuuggagugacca

SEQ ID NO: 1489689 - RNA, 15 nt, Homo sapiens
auuuggccugcacua

SEQ ID NO: 1489690 - RNA, 17 nt, Homo sapiens
auuugggagacauguga

SEQ ID NO: 1489691 - RNA, 16 nt, Homo sapiens
auuuguaaaucugcca

SEQ ID NO: 1489692 - RNA, 22 nt, Homo sapiens
auuuguaaaucugccacaaaaa

SEQ ID NO: 1489693 - RNA, 16 nt, Homo sapiens
auuuguagcacugagg

SEQ ID NO: 1489694 - RNA, 18 nt, Homo sapiens
auuuguuaaaauuaucaa

SEQ ID NO: 1489695 - RNA, 12 nt, Homo sapiens
auuuguucucac

SEQ ID NO: 1489696 - RNA, 16 nt, Homo sapiens
auuuguuugcaauuuu

SEQ ID NO: 1489697 - RNA, 17 nt, Homo sapiens
auuuuaaaaagucuuca

SEQ ID NO: 1489698 - RNA, 15 nt, Homo sapiens
auuuuaaagacaaaa

SEQ ID NO: 1489699 - RNA, 13 nt, Homo sapiens
auuuuaagugcuu

SEQ ID NO: 1489700 - RNA, 23 nt, Homo sapiens
auuuuacuauuggaaucugauau

SEQ ID NO: 1489701 - RNA, 16 nt, Homo sapiens
auuuuagcauauuaau

SEQ ID NO: 1489702 - RNA, 18 nt, Homo sapiens
auuuuauaacagaauuaa

SEQ ID NO: 1489703 - RNA, 14 nt, Homo sapiens
auuuuauacugaca

SEQ ID NO: 1489704 - RNA, 14 nt, Homo sapiens
auuuuaucugcuau

SEQ ID NO: 1489705 - RNA, 21 nt, Homo sapiens
auuuuaugcuggacucuggac

SEQ ID NO: 1489706 - RNA, 15 nt, Homo sapiens
caccagcaccaacac

SEQ ID NO: 1489707 - RNA, 20 nt, Homo sapiens
caccagcccugaccccagug

SEQ ID NO: 1489708 - RNA, 16 nt, Homo sapiens
caccagcuaucuguca

SEQ ID NO: 1489709 - RNA, 22 nt, Homo sapiens
caccaguguccccuccacuguc

SEQ ID NO: 1489710 - RNA, 23 nt, Homo sapiens
caccauacuccuugcuuccugau

SEQ ID NO: 1489711 - RNA, 13 nt, Homo sapiens
caccaucuggaag

SEQ ID NO: 1489712 - RNA, 14 nt, Homo sapiens
cacccacccaggag

SEQ ID NO: 1489713 - RNA, 13 nt, Homo sapiens
cacccacucagga

SEQ ID NO: 1489714 - RNA, 18 nt, Homo sapiens
cacccacuucccugcagg

SEQ ID NO: 1489715 - RNA, 16 nt, Homo sapiens
cacccagacuggagug

SEQ ID NO: 1489716 - RNA, 13 nt, Homo sapiens
cacccagcaaaga

SEQ ID NO: 1489717 - RNA, 16 nt, Homo sapiens
cacccccaccauccag

SEQ ID NO: 1489718 - RNA, 21 nt, Homo sapiens
caccccggggacccugugaca

SEQ ID NO: 1489719 - RNA, 15 nt, Homo sapiens
caccccuaaagagau

SEQ ID NO: 1489720 - RNA, 16 nt, Homo sapiens
caccccugcacaguug

SEQ ID NO: 1489721 - RNA, 17 nt, Homo sapiens
cacccgcccacagccag

SEQ ID NO: 1489722 - RNA, 13 nt, Homo sapiens
cacccgugagaaa

SEQ ID NO: 1489723 - RNA, 20 nt, Homo sapiens
cacccucauucuacugaaaa

SEQ ID NO: 1489724 - RNA, 15 nt, Homo sapiens
cacccuccuacaggu

SEQ ID NO: 1489725 - RNA, 14 nt, Homo sapiens
cacccugggagcca

SEQ ID NO: 1489726 - RNA, 14 nt, Homo sapiens
cacccugugccauc

SEQ ID NO: 1489727 - RNA, 21 nt, Homo sapiens
cacccuuguccuugagugcuc

SEQ ID NO: 1489728 - RNA, 22 nt, Homo sapiens
caccguacaucugcaauaugaa

SEQ ID NO: 1489729 - RNA, 22 nt, Homo sapiens
caccuaauccaggcagauccag

SEQ ID NO: 1489730 - RNA, 17 nt, Homo sapiens
caccuacauuaucucac

SEQ ID NO: 1489731 - RNA, 13 nt, Homo sapiens
caccuagacugua

SEQ ID NO: 1489732 - RNA, 16 nt, Homo sapiens
caccuagacuguaaac

SEQ ID NO: 1489733 - RNA, 12 nt, Homo sapiens
caccuagcuuua

SEQ ID NO: 1489734 - RNA, 17 nt, Homo sapiens
caccuaugugguccaga

SEQ ID NO: 1489735 - RNA, 22 nt, Homo sapiens
caccuauuuaagagggaacuua

SEQ ID NO: 1489736 - RNA, 18 nt, Homo sapiens
caccuccaccacaucugc

SEQ ID NO: 1489737 - RNA, 19 nt, Homo sapiens
caccuccaccacaucugcc

SEQ ID NO: 1489738 - RNA, 13 nt, Homo sapiens
caccuccauuaaa

SEQ ID NO: 1489739 - RNA, 15 nt, Homo sapiens
caccuccucuaaggu

SEQ ID NO: 1489740 - RNA, 14 nt, Homo sapiens
caccucuccaggug

SEQ ID NO: 1489741 - RNA, 15 nt, Homo sapiens
caccucuuccuugau

SEQ ID NO: 1489742 - RNA, 15 nt, Homo sapiens
caccugacucuugca

SEQ ID NO: 1489743 - RNA, 13 nt, Homo sapiens
caccugagcauga

SEQ ID NO: 1489744 - RNA, 15 nt, Homo sapiens
caccugcacacucca

SEQ ID NO: 1489745 - RNA, 22 nt, Homo sapiens
caccuggaugggggucccugug

SEQ ID NO: 1489746 - RNA, 21 nt, Homo sapiens
caccuggaugucugggugacc

SEQ ID NO: 1489747 - RNA, 17 nt, Homo sapiens
caccuggcccuugcaau

SEQ ID NO: 1489748 - RNA, 15 nt, Homo sapiens
caccuggggauuuua

SEQ ID NO: 1489749 - RNA, 20 nt, Homo sapiens
caccuuccuaauaugcuuua

SEQ ID NO: 1489750 - RNA, 14 nt, Homo sapiens
caccuuuuaacuca

SEQ ID NO: 1489751 - RNA, 21 nt, Homo sapiens
caccuuuuccccaaccacaga

SEQ ID NO: 1489752 - RNA, 21 nt, Homo sapiens
cacgaaaugggccauuccagu

SEQ ID NO: 1489753 - RNA, 16 nt, Homo sapiens
cacgagaucaagagau

SEQ ID NO: 1489754 - RNA, 21 nt, Homo sapiens
cacgaucucggcucacugcac

SEQ ID NO: 1489755 - RNA, 20 nt, Homo sapiens
cacgcacacacacaaacaca

SEQ ID NO: 1489756 - RNA, 12 nt, Homo sapiens
cacgcacgcaca

SEQ ID NO: 1489757 - RNA, 22 nt, Homo sapiens
cacgccuaaggucacagcuagu

SEQ ID NO: 1489758 - RNA, 16 nt, Homo sapiens
cacgccuguaauccca

SEQ ID NO: 1489759 - RNA, 13 nt, Homo sapiens
cacgcugaaggcu

SEQ ID NO: 1489760 - RNA, 15 nt, Homo sapiens
cacgcugaaggcuua

SEQ ID NO: 1489761 - RNA, 18 nt, Homo sapiens
cacgcuuuuaauucucau

SEQ ID NO: 1489762 - RNA, 22 nt, Homo sapiens
cacggagggggacggggcucag

SEQ ID NO: 1489763 - RNA, 22 nt, Homo sapiens
cacggaguggcuugagcuucug

SEQ ID NO: 1489764 - RNA, 18 nt, Homo sapiens
cacggaugacuuaacugc

SEQ ID NO: 1489765 - RNA, 21 nt, Homo sapiens
cacguaugguggcucaugucu

SEQ ID NO: 1489766 - RNA, 20 nt, Homo sapiens
cacgucucagagauucuuga

SEQ ID NO: 1489767 - RNA, 17 nt, Homo sapiens
cacguggcagaccguga

SEQ ID NO: 1489768 - RNA, 16 nt, Homo sapiens
cacgugucucagacug

SEQ ID NO: 1489769 - RNA, 20 nt, Homo sapiens
cacuaagaauucaaacuggg

SEQ ID NO: 1489770 - RNA, 12 nt, Homo sapiens
cacuaaugcuuu

SEQ ID NO: 1489771 - RNA, 15 nt, Homo sapiens
cacuagaaugcaagu

SEQ ID NO: 1489772 - RNA, 11 nt, Homo sapiens
cacuaucuuuc

SEQ ID NO: 1489773 - RNA, 23 nt, Homo sapiens
cacuauucuuggaccaugccaga

SEQ ID NO: 1489774 - RNA, 14 nt, Homo sapiens
cacuauuuacauac

SEQ ID NO: 1489775 - RNA, 21 nt, Homo sapiens
cacucaauaaauugcaacaua

SEQ ID NO: 1489776 - RNA, 16 nt, Homo sapiens
cacucagggagcauuu

SEQ ID NO: 1489777 - RNA, 16 nt, Homo sapiens
cacuccagcgcugagu

SEQ ID NO: 1489778 - RNA, 17 nt, Homo sapiens
cacucccgccucagggc

SEQ ID NO: 1489779 - RNA, 20 nt, Homo sapiens
cacucccgccucagggccag

SEQ ID NO: 1489780 - RNA, 16 nt, Homo sapiens
cacucuuuugcuuuau

SEQ ID NO: 1489781 - RNA, 20 nt, Homo sapiens
cacucuuuugcuuuauucca

SEQ ID NO: 1489782 - RNA, 21 nt, Homo sapiens
cacugaaaaauauuccaagcu

SEQ ID NO: 1489783 - RNA, 22 nt, Homo sapiens
cacugaaaaaucuaagugauau

SEQ ID NO: 1489784 - RNA, 18 nt, Homo sapiens
cacugaauuaaucaucua

SEQ ID NO: 1489785 - RNA, 16 nt, Homo sapiens
cacugaggguggcacu

SEQ ID NO: 1489786 - RNA, 18 nt, Homo sapiens
cacugaggguggcacuca

SEQ ID NO: 1489787 - RNA, 20 nt, Homo sapiens
cacugaucacccaaugcauc

SEQ ID NO: 1489788 - RNA, 21 nt, Homo sapiens
cacugaucacccaaugcauca

SEQ ID NO: 1489789 - RNA, 16 nt, Homo sapiens
cacugaugcuguucuc

SEQ ID NO: 1489790 - RNA, 22 nt, Homo sapiens
cacugauguaaguguuguggaa

SEQ ID NO: 1489791 - RNA, 16 nt, Homo sapiens
cacugcaagcucugcc

SEQ ID NO: 1489792 - RNA, 19 nt, Homo sapiens
cacugcaccgccucagggu

SEQ ID NO: 1489793 - RNA, 16 nt, Homo sapiens
cacugcacuguuuuca

SEQ ID NO: 1489794 - RNA, 18 nt, Homo sapiens
cacugcagacuuguccag

SEQ ID NO: 1489795 - RNA, 17 nt, Homo sapiens
cacugcccgagcuggug

SEQ ID NO: 1489796 - RNA, 20 nt, Homo sapiens
cacugcugcuccagugcagg

SEQ ID NO: 1489797 - RNA, 14 nt, Homo sapiens
cacuggaggucaca

SEQ ID NO: 1489798 - RNA, 17 nt, Homo sapiens
cacuggcguuacugcuu

SEQ ID NO: 1489799 - RNA, 21 nt, Homo sapiens
cacuggcuguuaaucuuucaa

SEQ ID NO: 1489800 - RNA, 17 nt, Homo sapiens
cacugggaggagucuau

SEQ ID NO: 1489801 - RNA, 22 nt, Homo sapiens
cacugggaugagccgcugugag

SEQ ID NO: 1489802 - RNA, 15 nt, Homo sapiens
cacuguauguuuacu

SEQ ID NO: 1489803 - RNA, 12 nt, Homo sapiens
cacuguccagua

SEQ ID NO: 1489804 - RNA, 16 nt, Homo sapiens
cacugucugacuuuag

SEQ ID NO: 1489805 - RNA, 18 nt, Homo sapiens
cacugucuuuaauucugu

SEQ ID NO: 1489806 - RNA, 19 nt, Homo sapiens
cacuguuaucuucacuuuu

SEQ ID NO: 1489807 - RNA, 18 nt, Homo sapiens
cacuguucuuguauugua

SEQ ID NO: 1489808 - RNA, 14 nt, Homo sapiens
cacuuacagaauua

SEQ ID NO: 1489809 - RNA, 21 nt, Homo sapiens
ccuagcugguagcauaaauaa

SEQ ID NO: 1489810 - RNA, 16 nt, Homo sapiens
ccuaggaacucagucc

SEQ ID NO: 1489811 - RNA, 18 nt, Homo sapiens
ccuaggaugucaugucug

SEQ ID NO: 1489812 - RNA, 17 nt, Homo sapiens
ccuaggucaugccuccu

SEQ ID NO: 1489813 - RNA, 15 nt, Homo sapiens
ccuauacauccacag

SEQ ID NO: 1489814 - RNA, 15 nt, Homo sapiens
ccuauggacaacuua

SEQ ID NO: 1489815 - RNA, 20 nt, Homo sapiens
ccuauguagcucugcaucuc

SEQ ID NO: 1489816 - RNA, 15 nt, Homo sapiens
ccuauguccuaagga

SEQ ID NO: 1489817 - RNA, 12 nt, Homo sapiens
ccuauuccagga

SEQ ID NO: 1489818 - RNA, 14 nt, Homo sapiens
ccuauugucauuaa

SEQ ID NO: 1489819 - RNA, 22 nt, Homo sapiens
ccuauuuccugaacucagcuga

SEQ ID NO: 1489820 - RNA, 16 nt, Homo sapiens
ccucaaagaggccuua

SEQ ID NO: 1489821 - RNA, 22 nt, Homo sapiens
ccucaaaguuggggcaggcugg

SEQ ID NO: 1489822 - RNA, 21 nt, Homo sapiens
ccucaacauugcauggugcua

SEQ ID NO: 1489823 - RNA, 13 nt, Homo sapiens
ccucaauucacau

SEQ ID NO: 1489824 - RNA, 19 nt, Homo sapiens
ccucaauuuuugucucaga

SEQ ID NO: 1489825 - RNA, 23 nt, Homo sapiens
ccucacagagugcauugugaggg

SEQ ID NO: 1489826 - RNA, 21 nt, Homo sapiens
ccucacaggagcuuacuggca

SEQ ID NO: 1489827 - RNA, 23 nt, Homo sapiens
ccucaccaggagcccggcuucca

SEQ ID NO: 1489828 - RNA, 23 nt, Homo sapiens
ccucacuaaaaaggaaacuucag

SEQ ID NO: 1489829 - RNA, 21 nt, Homo sapiens
ccucacuaugacacugagcaa

SEQ ID NO: 1489830 - RNA, 11 nt, Homo sapiens
ccucacuuuag

SEQ ID NO: 1489831 - RNA, 19 nt, Homo sapiens
ccucagaaagucaccagga

SEQ ID NO: 1489832 - RNA, 17 nt, Homo sapiens
ccucagaauugaucauu

SEQ ID NO: 1489833 - RNA, 21 nt, Homo sapiens
ccucagccuuccaacuagcug

SEQ ID NO: 1489834 - RNA, 15 nt, Homo sapiens
ccucagccuugccag

SEQ ID NO: 1489835 - RNA, 11 nt, Homo sapiens
ccucagggugg

SEQ ID NO: 1489836 - RNA, 21 nt, Homo sapiens
ccucagguggccccaguucaa

SEQ ID NO: 1489837 - RNA, 23 nt, Homo sapiens
ccucaguaaauguacaacugcac

SEQ ID NO: 1489838 - RNA, 18 nt, Homo sapiens
ccucaucucucugcccaa

SEQ ID NO: 1489839 - RNA, 18 nt, Homo sapiens
ccucauggcucuggcaca

SEQ ID NO: 1489840 - RNA, 22 nt, Homo sapiens
ccucauugcagcuagaggcauc

SEQ ID NO: 1489841 - RNA, 14 nt, Homo sapiens
ccuccaacgggugg

SEQ ID NO: 1489842 - RNA, 12 nt, Homo sapiens
ccuccaagcaca

SEQ ID NO: 1489843 - RNA, 19 nt, Homo sapiens
ccuccacugccucuggaau

SEQ ID NO: 1489844 - RNA, 17 nt, Homo sapiens
ccuccagcuucaggcag

SEQ ID NO: 1489845 - RNA, 22 nt, Homo sapiens
ccuccaggaugaguuacuugaa

SEQ ID NO: 1489846 - RNA, 10 nt, Homo sapiens
ccuccaggga

SEQ ID NO: 1489847 - RNA, 16 nt, Homo sapiens
ccuccaucagagccag

SEQ ID NO: 1489848 - RNA, 11 nt, Homo sapiens
ccuccaucuca

SEQ ID NO: 1489849 - RNA, 11 nt, Homo sapiens
ccuccaugacc

SEQ ID NO: 1489850 - RNA, 14 nt, Homo sapiens
ccuccauuccccac

SEQ ID NO: 1489851 - RNA, 20 nt, Homo sapiens
ccucccaaagugcugagauu

SEQ ID NO: 1489852 - RNA, 18 nt, Homo sapiens
ccucccaaaugagccaug

SEQ ID NO: 1489853 - RNA, 14 nt, Homo sapiens
ccucccaagguccu

SEQ ID NO: 1489854 - RNA, 19 nt, Homo sapiens
ccucccaagguccucucag

SEQ ID NO: 1489855 - RNA, 17 nt, Homo sapiens
ccucccaggccaggcuc

SEQ ID NO: 1489856 - RNA, 23 nt, Homo sapiens
ccucccagugaccccugaccuca

SEQ ID NO: 1489857 - RNA, 17 nt, Homo sapiens
ccucccugccaccaggc

SEQ ID NO: 1489858 - RNA, 18 nt, Homo sapiens
ccucccuggcucccauga

SEQ ID NO: 1489859 - RNA, 15 nt, Homo sapiens
ccucccuggucccuu

SEQ ID NO: 1489860 - RNA, 19 nt, Homo sapiens
ccucccuguuccccagaga

SEQ ID NO: 1489861 - RNA, 20 nt, Homo sapiens
ccucccuguuccccagagaa

SEQ ID NO: 1489862 - RNA, 18 nt, Homo sapiens
ccuccgccagauccugca

SEQ ID NO: 1489863 - RNA, 13 nt, Homo sapiens
ccuccguccagcc

SEQ ID NO: 1489864 - RNA, 17 nt, Homo sapiens
ccuccgugauccaucca

SEQ ID NO: 1489865 - RNA, 21 nt, Homo sapiens
ccuccuagcucucccagugaa

SEQ ID NO: 1489866 - RNA, 16 nt, Homo sapiens
ccuccucaggcacaca

SEQ ID NO: 1489867 - RNA, 14 nt, Homo sapiens
ccuccuccagggaa

SEQ ID NO: 1489868 - RNA, 20 nt, Homo sapiens
ccuccugcccagcacaggaa

SEQ ID NO: 1489869 - RNA, 15 nt, Homo sapiens
ccuccuuuugcuuga

SEQ ID NO: 1489870 - RNA, 19 nt, Homo sapiens
ccucgcugccagaugauug

SEQ ID NO: 1489871 - RNA, 20 nt, Homo sapiens
ccucggagagcagcagcacc

SEQ ID NO: 1489872 - RNA, 20 nt, Homo sapiens
ccucgggaagccccauccaa

SEQ ID NO: 1489873 - RNA, 21 nt, Homo sapiens
ccucuacuuuaacuuuuacaa

SEQ ID NO: 1489874 - RNA, 14 nt, Homo sapiens
ccucuagaagccaa

SEQ ID NO: 1489875 - RNA, 21 nt, Homo sapiens
ccucuaguaagaugcacugaa

SEQ ID NO: 1489876 - RNA, 16 nt, Homo sapiens
ccucucacuagugcca

SEQ ID NO: 1489877 - RNA, 16 nt, Homo sapiens
ccucucaugacuugca

SEQ ID NO: 1489878 - RNA, 22 nt, Homo sapiens
ccucuccccaagaggaacugaa

SEQ ID NO: 1489879 - RNA, 16 nt, Homo sapiens
ccucuccgcaguuccu

SEQ ID NO: 1489880 - RNA, 19 nt, Homo sapiens
ccucucucccggagguugg

SEQ ID NO: 1489881 - RNA, 12 nt, Homo sapiens
ccucucuggaaa

SEQ ID NO: 1489882 - RNA, 16 nt, Homo sapiens
ccucucuuauagaaua

SEQ ID NO: 1489883 - RNA, 16 nt, Homo sapiens
ccucugaacuugccuu

SEQ ID NO: 1489884 - RNA, 19 nt, Homo sapiens
ccucugacccuagcucuuu

SEQ ID NO: 1489885 - RNA, 23 nt, Homo sapiens
ccucugccaaaggaugugauaua

SEQ ID NO: 1489886 - RNA, 24 nt, Homo sapiens
ccucugcccuccgaggccgugcag

SEQ ID NO: 1489887 - RNA, 16 nt, Homo sapiens
ccucugcuacuccauc

SEQ ID NO: 1489888 - RNA, 15 nt, Homo sapiens
ccucuggacagccag

SEQ ID NO: 1489889 - RNA, 19 nt, Homo sapiens
ccucuggacagccagugac

SEQ ID NO: 1489890 - RNA, 23 nt, Homo sapiens
ccucuggauccagccaugccuga

SEQ ID NO: 1489891 - RNA, 15 nt, Homo sapiens
ccucuucccaugacu

SEQ ID NO: 1489892 - RNA, 24 nt, Homo sapiens
ccucuuccccagaaaggagacuag

SEQ ID NO: 1489893 - RNA, 19 nt, Homo sapiens
ccucuucuuugugccuuug

SEQ ID NO: 1489894 - RNA, 16 nt, Homo sapiens
ccucuuuuccccauga

SEQ ID NO: 1489895 - RNA, 15 nt, Homo sapiens
ccugaaaauucugua

SEQ ID NO: 1489896 - RNA, 21 nt, Homo sapiens
ccugaaacaacuuggaaagau

SEQ ID NO: 1489897 - RNA, 18 nt, Homo sapiens
ccugaaauuuauucacau

SEQ ID NO: 1489898 - RNA, 21 nt, Homo sapiens
ccugaacuacauaacuuccua

SEQ ID NO: 1489899 - RNA, 13 nt, Homo sapiens
ccugaagacugag

SEQ ID NO: 1489900 - RNA, 18 nt, Homo sapiens
ccugaaugguuccaugcc

SEQ ID NO: 1489901 - RNA, 14 nt, Homo sapiens
ccugacacuauuca

SEQ ID NO: 1489902 - RNA, 20 nt, Homo sapiens
ccugaccaucgcacaccggc

SEQ ID NO: 1489903 - RNA, 22 nt, Homo sapiens
ccugaccucaggugauccaccc

SEQ ID NO: 1489904 - RNA, 17 nt, Homo sapiens
ccugacuuuuaauguca

SEQ ID NO: 1489905 - RNA, 13 nt, Homo sapiens
ccugagaccaguu

SEQ ID NO: 1489906 - RNA, 21 nt, Homo sapiens
ccugagaggaaccagagcaga

SEQ ID NO: 1489907 - RNA, 12 nt, Homo sapiens
ccugagaucccc

SEQ ID NO: 1489908 - RNA, 21 nt, Homo sapiens
ccugagauccggcaacaucaa

SEQ ID NO: 1489909 - RNA, 22 nt, Homo sapiens
ccugagccaagaggaacuugac

SEQ ID NO: 1489910 - RNA, 21 nt, Homo sapiens
ccugagcgaguguccagccaa

SEQ ID NO: 1489911 - RNA, 22 nt, Homo sapiens
cuaaagguuuuaaccgcacaug

SEQ ID NO: 1489912 - RNA, 12 nt, Homo sapiens
cuaaaguuuuag

SEQ ID NO: 1489913 - RNA, 20 nt, Homo sapiens
cuaaauaauguuaucugugu

SEQ ID NO: 1489914 - RNA, 15 nt, Homo sapiens
cuaaaucaaucugca

SEQ ID NO: 1489915 - RNA, 20 nt, Homo sapiens
cuaaaucauauuaguauuaa

SEQ ID NO: 1489916 - RNA, 15 nt, Homo sapiens
cuaaaugcaccaaga

SEQ ID NO: 1489917 - RNA, 22 nt, Homo sapiens
cuaaauggugcugcagauuuga

SEQ ID NO: 1489918 - RNA, 23 nt, Homo sapiens
cuaacacccagucuguuccccau

SEQ ID NO: 1489919 - RNA, 21 nt, Homo sapiens
cuaacagcaacagcaagaaau

SEQ ID NO: 1489920 - RNA, 17 nt, Homo sapiens
cuaacauguaauugcag

SEQ ID NO: 1489921 - RNA, 12 nt, Homo sapiens
cuaacauuuccu

SEQ ID NO: 1489922 - RNA, 19 nt, Homo sapiens
cuaaccaguaccucuguau

SEQ ID NO: 1489923 - RNA, 15 nt, Homo sapiens
cuaaccauuaaguca

SEQ ID NO: 1489924 - RNA, 21 nt, Homo sapiens
cuaacuaugcauggugcccca

SEQ ID NO: 1489925 - RNA, 15 nt, Homo sapiens
cuaacugacagcuuc

SEQ ID NO: 1489926 - RNA, 20 nt, Homo sapiens
cuaacuuauuuuauuuccau

SEQ ID NO: 1489927 - RNA, 17 nt, Homo sapiens
cuaagauaauuuacuua

SEQ ID NO: 1489928 - RNA, 17 nt, Homo sapiens
cuaagccacucuuccaa

SEQ ID NO: 1489929 - RNA, 15 nt, Homo sapiens
cuaagccaguuuuca

SEQ ID NO: 1489930 - RNA, 16 nt, Homo sapiens
cuaagcccuuugccau

SEQ ID NO: 1489931 - RNA, 16 nt, Homo sapiens
cuaagcgcacauucau

SEQ ID NO: 1489932 - RNA, 14 nt, Homo sapiens
cuaagcuggucuca

SEQ ID NO: 1489933 - RNA, 13 nt, Homo sapiens
cuaaggaaccuuc

SEQ ID NO: 1489934 - RNA, 14 nt, Homo sapiens
cuaaggacauuucc

SEQ ID NO: 1489935 - RNA, 21 nt, Homo sapiens
cuaaggaugguuuuaucuucc

SEQ ID NO: 1489936 - RNA, 21 nt, Homo sapiens
cuaaggaugucacagggccaa

SEQ ID NO: 1489937 - RNA, 22 nt, Homo sapiens
cuaagguccaacaagaaugcau

SEQ ID NO: 1489938 - RNA, 15 nt, Homo sapiens
cuaaguacacaauaa

SEQ ID NO: 1489939 - RNA, 17 nt, Homo sapiens
cuaaguccaguguuucu

SEQ ID NO: 1489940 - RNA, 17 nt, Homo sapiens
cuaaguuauuuacuuuu

SEQ ID NO: 1489941 - RNA, 19 nt, Homo sapiens
cuaaucaaagccagggucu

SEQ ID NO: 1489942 - RNA, 16 nt, Homo sapiens
cuaaucagcauucuca

SEQ ID NO: 1489943 - RNA, 21 nt, Homo sapiens
cuaaucugauguuaaccaaug

SEQ ID NO: 1489944 - RNA, 22 nt, Homo sapiens
cuaaugucucacuguucugcaa

SEQ ID NO: 1489945 - RNA, 23 nt, Homo sapiens
cuaauuaaaaaguuaaucuucau

SEQ ID NO: 1489946 - RNA, 23 nt, Homo sapiens
cuaauuaaucuggaauaugcaac

SEQ ID NO: 1489947 - RNA, 13 nt, Homo sapiens
cuaauuaggguac

SEQ ID NO: 1489948 - RNA, 19 nt, Homo sapiens
cuaauuaggguacauuuau

SEQ ID NO: 1489949 - RNA, 21 nt, Homo sapiens
cuaauucccauuuugcaaaau

SEQ ID NO: 1489950 - RNA, 19 nt, Homo sapiens
cuaauucuucuguccugag

SEQ ID NO: 1489951 - RNA, 22 nt, Homo sapiens
cuaauuucugaaaugugcagcu

SEQ ID NO: 1489952 - RNA, 18 nt, Homo sapiens
cuaauuugauguuuacag

SEQ ID NO: 1489953 - RNA, 16 nt, Homo sapiens
cuaauuuuaguauuca

SEQ ID NO: 1489954 - RNA, 14 nt, Homo sapiens
cuacaaaggccaug

SEQ ID NO: 1489955 - RNA, 18 nt, Homo sapiens
cuacaaccaauuuacacu

SEQ ID NO: 1489956 - RNA, 11 nt, Homo sapiens
cuacaagccaa

SEQ ID NO: 1489957 - RNA, 12 nt, Homo sapiens
cuacacacaaac

SEQ ID NO: 1489958 - RNA, 15 nt, Homo sapiens
cuacacacacacucc

SEQ ID NO: 1489959 - RNA, 17 nt, Homo sapiens
cuacacccagaccccag

SEQ ID NO: 1489960 - RNA, 14 nt, Homo sapiens
cuacagauagaaaa

SEQ ID NO: 1489961 - RNA, 20 nt, Homo sapiens
cuacagcaguagggagguca

SEQ ID NO: 1489962 - RNA, 20 nt, Homo sapiens
cuacaggaagcaccccaugc

SEQ ID NO: 1489963 - RNA, 17 nt, Homo sapiens
cuacaggccagcaccuu

SEQ ID NO: 1489964 - RNA, 19 nt, Homo sapiens
cuacaggugaaggcucuca

SEQ ID NO: 1489965 - RNA, 20 nt, Homo sapiens
cuacagugccaacuccucac

SEQ ID NO: 1489966 - RNA, 22 nt, Homo sapiens
cuacaucaucuccaaccgguca

SEQ ID NO: 1489967 - RNA, 23 nt, Homo sapiens
cuacaucuucugccuuagucuca

SEQ ID NO: 1489968 - RNA, 16 nt, Homo sapiens
cuacauguauugcaca

SEQ ID NO: 1489969 - RNA, 14 nt, Homo sapiens
cuacauuaucucac

SEQ ID NO: 1489970 - RNA, 17 nt, Homo sapiens
cuaccaaauaauuucau

SEQ ID NO: 1489971 - RNA, 15 nt, Homo sapiens
cuaccacagugucug

SEQ ID NO: 1489972 - RNA, 13 nt, Homo sapiens
cuaccagagcucu

SEQ ID NO: 1489973 - RNA, 13 nt, Homo sapiens
cuaccagcauaaa

SEQ ID NO: 1489974 - RNA, 14 nt, Homo sapiens
cuaccaucagggac

SEQ ID NO: 1489975 - RNA, 15 nt, Homo sapiens
cuacccugcucccug

SEQ ID NO: 1489976 - RNA, 16 nt, Homo sapiens
cuaccucaaacuucca

SEQ ID NO: 1489977 - RNA, 23 nt, Homo sapiens
cuaccuuuauauuugggguccuu

SEQ ID NO: 1489978 - RNA, 17 nt, Homo sapiens
cuacgccacuccacaaa

SEQ ID NO: 1489979 - RNA, 19 nt, Homo sapiens
cuacgccacuccacaaaug

SEQ ID NO: 1489980 - RNA, 20 nt, Homo sapiens
cuacuacaaacuucaaagag

SEQ ID NO: 1489981 - RNA, 15 nt, Homo sapiens
cuacuagggaaaaau

SEQ ID NO: 1489982 - RNA, 21 nt, Homo sapiens
cuacuaucacugaacaaacua

SEQ ID NO: 1489983 - RNA, 22 nt, Homo sapiens
cuacucaaugccuggagacaga

SEQ ID NO: 1489984 - RNA, 21 nt, Homo sapiens
cuacuccccuuaaucuaaucu

SEQ ID NO: 1489985 - RNA, 12 nt, Homo sapiens
cuacuccugacu

SEQ ID NO: 1489986 - RNA, 12 nt, Homo sapiens
cuacucuuugau

SEQ ID NO: 1489987 - RNA, 19 nt, Homo sapiens
cuacugggagacugggaca

SEQ ID NO: 1489988 - RNA, 19 nt, Homo sapiens
cuacugggugucauuucau

SEQ ID NO: 1489989 - RNA, 16 nt, Homo sapiens
cuacuuacaacccagg

SEQ ID NO: 1489990 - RNA, 20 nt, Homo sapiens
cuacuugggaggcugaggca

SEQ ID NO: 1489991 - RNA, 21 nt, Homo sapiens
cuacuuuaagcacuacauaaa

SEQ ID NO: 1489992 - RNA, 17 nt, Homo sapiens
cuagaaaacaggcaaau

SEQ ID NO: 1489993 - RNA, 13 nt, Homo sapiens
cuagaaacaaaca

SEQ ID NO: 1489994 - RNA, 19 nt, Homo sapiens
cuagaaacaaacaucuaau

SEQ ID NO: 1489995 - RNA, 16 nt, Homo sapiens
cuagaaagacagaagc

SEQ ID NO: 1489996 - RNA, 16 nt, Homo sapiens
cuagaaaucuauuuau

SEQ ID NO: 1489997 - RNA, 15 nt, Homo sapiens
cuagaagccaaggga

SEQ ID NO: 1489998 - RNA, 13 nt, Homo sapiens
cuagacacacaaa

SEQ ID NO: 1489999 - RNA, 15 nt, Homo sapiens
cuagacagauccccg

SEQ ID NO: 1490000 - RNA, 18 nt, Homo sapiens
cuagaccuauuacaaaga

SEQ ID NO: 1490001 - RNA, 16 nt, Homo sapiens
cuagacucuagacaag

SEQ ID NO: 1490002 - RNA, 19 nt, Homo sapiens
cuagacucuucacuguuag

SEQ ID NO: 1490003 - RNA, 21 nt, Homo sapiens
cuagacuucccaacagccuua

SEQ ID NO: 1490004 - RNA, 22 nt, Homo sapiens
cuagacuucccaacagccuuag

SEQ ID NO: 1490005 - RNA, 20 nt, Homo sapiens
cuagagcugacagcuuuguu

SEQ ID NO: 1490006 - RNA, 15 nt, Homo sapiens
cuagagggggucuca

SEQ ID NO: 1490007 - RNA, 12 nt, Homo sapiens
cuagaguuuuau

SEQ ID NO: 1490008 - RNA, 16 nt, Homo sapiens
cuagaugcaucacugg

SEQ ID NO: 1490009 - RNA, 20 nt, Homo sapiens
cuagauuuauuaguccuaau

SEQ ID NO: 1490010 - RNA, 16 nt, Homo sapiens
cuagauuuucuacuuu

SEQ ID NO: 1490011 - RNA, 18 nt, Homo sapiens
cuagauuuucuacuuuau

SEQ ID NO: 1490012 - RNA, 24 nt, Homo sapiens
cuagcaaauaguaaucuguaagca

SEQ ID NO: 1490013 - RNA, 22 nt, Homo sapiens
cucuuggugugauugcacagaa

SEQ ID NO: 1490014 - RNA, 23 nt, Homo sapiens
cucuuguauuaaacucuucacaa

SEQ ID NO: 1490015 - RNA, 13 nt, Homo sapiens
cucuuguuauuau

SEQ ID NO: 1490016 - RNA, 21 nt, Homo sapiens
cucuuuaguauaauugaccua

SEQ ID NO: 1490017 - RNA, 15 nt, Homo sapiens
cucuuucccaacccc

SEQ ID NO: 1490018 - RNA, 16 nt, Homo sapiens
cucuuucccuuccagu

SEQ ID NO: 1490019 - RNA, 16 nt, Homo sapiens
cucuuuccuauuucag

SEQ ID NO: 1490020 - RNA, 18 nt, Homo sapiens
cucuuugacaauuccuag

SEQ ID NO: 1490021 - RNA, 18 nt, Homo sapiens
cucuuuggcaguugcauu

SEQ ID NO: 1490022 - RNA, 22 nt, Homo sapiens
cucuuuggcuccccuguaccuu

SEQ ID NO: 1490023 - RNA, 19 nt, Homo sapiens
cugaaaagacucaguguuc

SEQ ID NO: 1490024 - RNA, 16 nt, Homo sapiens
cugaaaauauaaccag

SEQ ID NO: 1490025 - RNA, 15 nt, Homo sapiens
cugaaaggaugugga

SEQ ID NO: 1490026 - RNA, 18 nt, Homo sapiens
cugaaaggggcagauuaa

SEQ ID NO: 1490027 - RNA, 12 nt, Homo sapiens
cugaaaugugac

SEQ ID NO: 1490028 - RNA, 22 nt, Homo sapiens
cugaacagaagcucuuacucuu

SEQ ID NO: 1490029 - RNA, 12 nt, Homo sapiens
cugaacagugga

SEQ ID NO: 1490030 - RNA, 20 nt, Homo sapiens
cugaacuacauaacuuccua

SEQ ID NO: 1490031 - RNA, 20 nt, Homo sapiens
cugaacucuacgccacucca

SEQ ID NO: 1490032 - RNA, 17 nt, Homo sapiens
cugaacuuuguggucga

SEQ ID NO: 1490033 - RNA, 18 nt, Homo sapiens
cugaagaaauugguccca

SEQ ID NO: 1490034 - RNA, 20 nt, Homo sapiens
cugaagauugcgguuuacag

SEQ ID NO: 1490035 - RNA, 13 nt, Homo sapiens
cugaagcagguuc

SEQ ID NO: 1490036 - RNA, 22 nt, Homo sapiens
cugaaggaaaaacacaagcaaa

SEQ ID NO: 1490037 - RNA, 14 nt, Homo sapiens
cugaaggggaaccc

SEQ ID NO: 1490038 - RNA, 20 nt, Homo sapiens
cugaaggugauucaccaaaa

SEQ ID NO: 1490039 - RNA, 14 nt, Homo sapiens
cugaagucacauca

SEQ ID NO: 1490040 - RNA, 21 nt, Homo sapiens
cugaagucaccucuugguuac

SEQ ID NO: 1490041 - RNA, 19 nt, Homo sapiens
cugaaguuugugggggcca

SEQ ID NO: 1490042 - RNA, 17 nt, Homo sapiens
cugaauauaaagcuuaa

SEQ ID NO: 1490043 - RNA, 19 nt, Homo sapiens
cugaaugcuccauuaaucc

SEQ ID NO: 1490044 - RNA, 17 nt, Homo sapiens
cugaaugcugcuacuua

SEQ ID NO: 1490045 - RNA, 12 nt, Homo sapiens
cugacaaccuca

SEQ ID NO: 1490046 - RNA, 16 nt, Homo sapiens
cugacagcuucaugaa

SEQ ID NO: 1490047 - RNA, 15 nt, Homo sapiens
cugacaguaaaucuc

SEQ ID NO: 1490048 - RNA, 23 nt, Homo sapiens
cugaccaaacagccaacuagccc

SEQ ID NO: 1490049 - RNA, 18 nt, Homo sapiens
cugaccaucgcacaccgg

SEQ ID NO: 1490050 - RNA, 17 nt, Homo sapiens
cugaccucacugugacc

SEQ ID NO: 1490051 - RNA, 19 nt, Homo sapiens
cugaccucaggugauccac

SEQ ID NO: 1490052 - RNA, 19 nt, Homo sapiens
cugaccuggagaugcugcc

SEQ ID NO: 1490053 - RNA, 16 nt, Homo sapiens
cugacuaauuaggcaa

SEQ ID NO: 1490054 - RNA, 23 nt, Homo sapiens
cugacuaauuuuuguauuuuuag

SEQ ID NO: 1490055 - RNA, 20 nt, Homo sapiens
cugacuagaagggccagucc

SEQ ID NO: 1490056 - RNA, 20 nt, Homo sapiens
cugacuggauucauucucau

SEQ ID NO: 1490057 - RNA, 18 nt, Homo sapiens
cugacuuguuugucuucc

SEQ ID NO: 1490058 - RNA, 17 nt, Homo sapiens
cugacuuuuaaugucau

SEQ ID NO: 1490059 - RNA, 20 nt, Homo sapiens
cugagaacuccugacuguaa

SEQ ID NO: 1490060 - RNA, 19 nt, Homo sapiens
cugagaagucaaacauuuc

SEQ ID NO: 1490061 - RNA, 18 nt, Homo sapiens
cugagaagugcacuuuaa

SEQ ID NO: 1490062 - RNA, 16 nt, Homo sapiens
cugagaauuccaagga

SEQ ID NO: 1490063 - RNA, 13 nt, Homo sapiens
cugagaccagugu

SEQ ID NO: 1490064 - RNA, 18 nt, Homo sapiens
cugagaccaguguaucag

SEQ ID NO: 1490065 - RNA, 20 nt, Homo sapiens
cugagacccuuuucucagga

SEQ ID NO: 1490066 - RNA, 20 nt, Homo sapiens
cugagcgggaggcagaguuu

SEQ ID NO: 1490067 - RNA, 18 nt, Homo sapiens
cugagcuccccagaucuc

SEQ ID NO: 1490068 - RNA, 16 nt, Homo sapiens
cugaggauucaggggc

SEQ ID NO: 1490069 - RNA, 16 nt, Homo sapiens
cugaggggcaucugcc

SEQ ID NO: 1490070 - RNA, 21 nt, Homo sapiens
cugaggggggccgugcccagg

SEQ ID NO: 1490071 - RNA, 21 nt, Homo sapiens
cugaggguccccaccugggac

SEQ ID NO: 1490072 - RNA, 16 nt, Homo sapiens
cugaggugaaagggag

SEQ ID NO: 1490073 - RNA, 23 nt, Homo sapiens
cugaggugugugccacucagaga

SEQ ID NO: 1490074 - RNA, 19 nt, Homo sapiens
cugagugaaugaacaaaug

SEQ ID NO: 1490075 - RNA, 20 nt, Homo sapiens
cugagugaguguuuggccga

SEQ ID NO: 1490076 - RNA, 19 nt, Homo sapiens
cugaguggaucuccaagga

SEQ ID NO: 1490077 - RNA, 15 nt, Homo sapiens
cugaguggugccaaa

SEQ ID NO: 1490078 - RNA, 18 nt, Homo sapiens
cugaguucuggucaaaga

SEQ ID NO: 1490079 - RNA, 21 nt, Homo sapiens
cugauauugccgcacuagggg

SEQ ID NO: 1490080 - RNA, 22 nt, Homo sapiens
cugaucccccauagguggcuga

SEQ ID NO: 1490081 - RNA, 14 nt, Homo sapiens
cugaucgugcuaaa

SEQ ID NO: 1490082 - RNA, 20 nt, Homo sapiens
cugaugauccagaacagugg

SEQ ID NO: 1490083 - RNA, 23 nt, Homo sapiens
cugaugcuuugcuucaaauccau

SEQ ID NO: 1490084 - RNA, 21 nt, Homo sapiens
cugauggaaguaaagccucaa

SEQ ID NO: 1490085 - RNA, 14 nt, Homo sapiens
cugauggcuugaca

SEQ ID NO: 1490086 - RNA, 21 nt, Homo sapiens
cugauggcuugacaugugcaa

SEQ ID NO: 1490087 - RNA, 14 nt, Homo sapiens
cugauggugacauu

SEQ ID NO: 1490088 - RNA, 19 nt, Homo sapiens
cugaugucccagugcucac

SEQ ID NO: 1490089 - RNA, 18 nt, Homo sapiens
cugauguuaaaauuccau

SEQ ID NO: 1490090 - RNA, 20 nt, Homo sapiens
cugauucauaauaaauaucu

SEQ ID NO: 1490091 - RNA, 15 nt, Homo sapiens
cugauuggugauuca

SEQ ID NO: 1490092 - RNA, 16 nt, Homo sapiens
cugauuggugauucaa

SEQ ID NO: 1490093 - RNA, 22 nt, Homo sapiens
cugauuuaggagaagccaggaa

SEQ ID NO: 1490094 - RNA, 17 nt, Homo sapiens
cugauuuuaacaauaac

SEQ ID NO: 1490095 - RNA, 16 nt, Homo sapiens
cugauuuuuagcuuua

SEQ ID NO: 1490096 - RNA, 19 nt, Homo sapiens
cugauuuuuagcuuuacaa

SEQ ID NO: 1490097 - RNA, 20 nt, Homo sapiens
cugcaaagaucuguccucag

SEQ ID NO: 1490098 - RNA, 17 nt, Homo sapiens
cugcaagccugucugag

SEQ ID NO: 1490099 - RNA, 18 nt, Homo sapiens
cugcaagcugcuugccca

SEQ ID NO: 1490100 - RNA, 16 nt, Homo sapiens
cugcaagcuucuugcu

SEQ ID NO: 1490101 - RNA, 20 nt, Homo sapiens
cugcacagaaauuuucaauu

SEQ ID NO: 1490102 - RNA, 13 nt, Homo sapiens
cugcacagugaag

SEQ ID NO: 1490103 - RNA, 18 nt, Homo sapiens
cugcacagugcaucucag

SEQ ID NO: 1490104 - RNA, 21 nt, Homo sapiens
cugcaccagagcaaccucuca

SEQ ID NO: 1490105 - RNA, 20 nt, Homo sapiens
cugcaccagugugacaucua

SEQ ID NO: 1490106 - RNA, 16 nt, Homo sapiens
cugcacccacccagga

SEQ ID NO: 1490107 - RNA, 17 nt, Homo sapiens
cugcaccgccucagggu

SEQ ID NO: 1490108 - RNA, 15 nt, Homo sapiens
cugcacuaagagaaa

SEQ ID NO: 1490109 - RNA, 19 nt, Homo sapiens
cugcacuccagucuggcaa

SEQ ID NO: 1490110 - RNA, 17 nt, Homo sapiens
cugcacugaucacccaa

SEQ ID NO: 1490111 - RNA, 22 nt, Homo sapiens
cugcacugaugcugccccucau

SEQ ID NO: 1490112 - RNA, 16 nt, Homo sapiens
cugcacuggggccacc

SEQ ID NO: 1490113 - RNA, 17 nt, Homo sapiens
cugcacuguccugacca

SEQ ID NO: 1490114 - RNA, 16 nt, Homo sapiens
cugcagaaacaguacu

SEQ ID NO: 1490115 - RNA, 19 nt, Homo sapiens
cugucccuugcuguaugcu

SEQ ID NO: 1490116 - RNA, 14 nt, Homo sapiens
cuguccuaagcacu

SEQ ID NO: 1490117 - RNA, 15 nt, Homo sapiens
cuguccuaagcacuu

SEQ ID NO: 1490118 - RNA, 18 nt, Homo sapiens
cuguccugaccaucgcac

SEQ ID NO: 1490119 - RNA, 23 nt, Homo sapiens
cuguccuuuuccccuacagaauu

SEQ ID NO: 1490120 - RNA, 17 nt, Homo sapiens
cugucuauaagagaauu

SEQ ID NO: 1490121 - RNA, 20 nt, Homo sapiens
cugucucccccauugcucua

SEQ ID NO: 1490122 - RNA, 13 nt, Homo sapiens
cugucucuacuaa

SEQ ID NO: 1490123 - RNA, 20 nt, Homo sapiens
cugucugagaauuuccaaaa

SEQ ID NO: 1490124 - RNA, 19 nt, Homo sapiens
cugucugagacucacagga

SEQ ID NO: 1490125 - RNA, 23 nt, Homo sapiens
cugucuuagagugggaccaacuu

SEQ ID NO: 1490126 - RNA, 18 nt, Homo sapiens
cugugaaauucacaguaa

SEQ ID NO: 1490127 - RNA, 20 nt, Homo sapiens
cugugaaauucacaguaaua

SEQ ID NO: 1490128 - RNA, 21 nt, Homo sapiens
cugugaagucaagaaucacuu

SEQ ID NO: 1490129 - RNA, 15 nt, Homo sapiens
cugugaauacuugaa

SEQ ID NO: 1490130 - RNA, 21 nt, Homo sapiens
cugugacauacauauuaucuc

SEQ ID NO: 1490131 - RNA, 22 nt, Homo sapiens
cugugacauacauauuaucuca

SEQ ID NO: 1490132 - RNA, 18 nt, Homo sapiens
cugugaccaggaaggaag

SEQ ID NO: 1490133 - RNA, 13 nt, Homo sapiens
cugugaccauuua

SEQ ID NO: 1490134 - RNA, 18 nt, Homo sapiens
cugugaggccccuggaca

SEQ ID NO: 1490135 - RNA, 14 nt, Homo sapiens
cugugaggugcuga

SEQ ID NO: 1490136 - RNA, 14 nt, Homo sapiens
cugugauacuugua

SEQ ID NO: 1490137 - RNA, 12 nt, Homo sapiens
cugugaugacau

SEQ ID NO: 1490138 - RNA, 18 nt, Homo sapiens
cugugcacugcccaugga

SEQ ID NO: 1490139 - RNA, 18 nt, Homo sapiens
cugugcagcgggugcugc

SEQ ID NO: 1490140 - RNA, 13 nt, Homo sapiens
cugugcauuccca

SEQ ID NO: 1490141 - RNA, 22 nt, Homo sapiens
cugugccaucaccauaaccucu

SEQ ID NO: 1490142 - RNA, 17 nt, Homo sapiens
cugugcguggaaaaaga

SEQ ID NO: 1490143 - RNA, 14 nt, Homo sapiens
cugugcguuacuaa

SEQ ID NO: 1490144 - RNA, 14 nt, Homo sapiens
cuguggaacauaaa

SEQ ID NO: 1490145 - RNA, 16 nt, Homo sapiens
cuguggaacauaaaaa

SEQ ID NO: 1490146 - RNA, 18 nt, Homo sapiens
cuguggaacauaaaaagg

SEQ ID NO: 1490147 - RNA, 13 nt, Homo sapiens
cuguggaaugagu

SEQ ID NO: 1490148 - RNA, 20 nt, Homo sapiens
cuguggaaugagugugcaug

SEQ ID NO: 1490149 - RNA, 15 nt, Homo sapiens
cuguggagggcauuu

SEQ ID NO: 1490150 - RNA, 16 nt, Homo sapiens
cuguggauacccuuac

SEQ ID NO: 1490151 - RNA, 17 nt, Homo sapiens
cuguggcuagugacaaa

SEQ ID NO: 1490152 - RNA, 20 nt, Homo sapiens
cuguggcucugcaugacaaa

SEQ ID NO: 1490153 - RNA, 21 nt, Homo sapiens
cugugggccccucaacagcca

SEQ ID NO: 1490154 - RNA, 16 nt, Homo sapiens
cugugggggugagggu

SEQ ID NO: 1490155 - RNA, 21 nt, Homo sapiens
cugugggucugggagucacac

SEQ ID NO: 1490156 - RNA, 17 nt, Homo sapiens
cuguggugagccaagau

SEQ ID NO: 1490157 - RNA, 16 nt, Homo sapiens
cugugguuaacaucuc

SEQ ID NO: 1490158 - RNA, 20 nt, Homo sapiens
cugugguuccucugcucacc

SEQ ID NO: 1490159 - RNA, 15 nt, Homo sapiens
cuguguauucuaguu

SEQ ID NO: 1490160 - RNA, 18 nt, Homo sapiens
cuguguccuacuccuugc

SEQ ID NO: 1490161 - RNA, 19 nt, Homo sapiens
cuguguccuacuccuugca

SEQ ID NO: 1490162 - RNA, 15 nt, Homo sapiens
cugugucuguauaca

SEQ ID NO: 1490163 - RNA, 20 nt, Homo sapiens
cugugugaaugugggcacug

SEQ ID NO: 1490164 - RNA, 22 nt, Homo sapiens
cuguguggacugugaugccaca

SEQ ID NO: 1490165 - RNA, 23 nt, Homo sapiens
cuguguggacugugaugccacac

SEQ ID NO: 1490166 - RNA, 22 nt, Homo sapiens
cugugugugaaaggaagcucca

SEQ ID NO: 1490167 - RNA, 21 nt, Homo sapiens
cuguguuauucuuugcgugua

SEQ ID NO: 1490168 - RNA, 17 nt, Homo sapiens
cuguguuccuggcaaua

SEQ ID NO: 1490169 - RNA, 14 nt, Homo sapiens
cuguguugccacag

SEQ ID NO: 1490170 - RNA, 19 nt, Homo sapiens
cuguuacugaaauugguau

SEQ ID NO: 1490171 - RNA, 16 nt, Homo sapiens
cuguuaucuucacuuu

SEQ ID NO: 1490172 - RNA, 18 nt, Homo sapiens
cuguuaucuucacuuuua

SEQ ID NO: 1490173 - RNA, 23 nt, Homo sapiens
cuguuccccaaggacucuuccac

SEQ ID NO: 1490174 - RNA, 14 nt, Homo sapiens
cuguuccccagaga

SEQ ID NO: 1490175 - RNA, 15 nt, Homo sapiens
cuguucccuugcagg

SEQ ID NO: 1490176 - RNA, 16 nt, Homo sapiens
cuguucugggggacag

SEQ ID NO: 1490177 - RNA, 20 nt, Homo sapiens
cuguucugggggacagagaa

SEQ ID NO: 1490178 - RNA, 22 nt, Homo sapiens
cuguucuugcuacccaugacuu

SEQ ID NO: 1490179 - RNA, 17 nt, Homo sapiens
cuguucuuguauuguau

SEQ ID NO: 1490180 - RNA, 18 nt, Homo sapiens
cuguugaauuucccacau

SEQ ID NO: 1490181 - RNA, 19 nt, Homo sapiens
cuguugagacugauucaga

SEQ ID NO: 1490182 - RNA, 18 nt, Homo sapiens
cuguugcaaacucagugc

SEQ ID NO: 1490183 - RNA, 22 nt, Homo sapiens
cuguugcaaacucagugcaaac

SEQ ID NO: 1490184 - RNA, 15 nt, Homo sapiens
cuguugcauuuacuu

SEQ ID NO: 1490185 - RNA, 17 nt, Homo sapiens
cuguuuaaaguggcaau

SEQ ID NO: 1490186 - RNA, 16 nt, Homo sapiens
cuguuucucaugaagc

SEQ ID NO: 1490187 - RNA, 16 nt, Homo sapiens
cuguuucuucuuguga

SEQ ID NO: 1490188 - RNA, 14 nt, Homo sapiens
cuguuugaugcuau

SEQ ID NO: 1490189 - RNA, 14 nt, Homo sapiens
cuguuugcugugga

SEQ ID NO: 1490190 - RNA, 15 nt, Homo sapiens
cuguuuucucucggc

SEQ ID NO: 1490191 - RNA, 19 nt, Homo sapiens
cuguuuuguaagugcugcu

SEQ ID NO: 1490192 - RNA, 15 nt, Homo sapiens
cuguuuuugcaacua

SEQ ID NO: 1490193 - RNA, 20 nt, Homo sapiens
cuuaaaaaagcccuuugcua

SEQ ID NO: 1490194 - RNA, 23 nt, Homo sapiens
cuuaaaaaagcccuuugcuaaaa

SEQ ID NO: 1490195 - RNA, 15 nt, Homo sapiens
cuuaaaaaaugucca

SEQ ID NO: 1490196 - RNA, 16 nt, Homo sapiens
cuuaaaccuaccuccc

SEQ ID NO: 1490197 - RNA, 23 nt, Homo sapiens
cuuaaacuguguggacugugaug

SEQ ID NO: 1490198 - RNA, 20 nt, Homo sapiens
cuuaaagcauuccccaaaga

SEQ ID NO: 1490199 - RNA, 22 nt, Homo sapiens
cuuaaaguuuaaaguugcacau

SEQ ID NO: 1490200 - RNA, 15 nt, Homo sapiens
cuuaaauuuuaguuc

SEQ ID NO: 1490201 - RNA, 15 nt, Homo sapiens
cuuaacacauucaau

SEQ ID NO: 1490202 - RNA, 16 nt, Homo sapiens
cuuaacacauucaaua

SEQ ID NO: 1490203 - RNA, 21 nt, Homo sapiens
cuuaacacauucaauagcaua

SEQ ID NO: 1490204 - RNA, 14 nt, Homo sapiens
cuuaaccuuuccag

SEQ ID NO: 1490205 - RNA, 17 nt, Homo sapiens
cuuaacggcuccaggau

SEQ ID NO: 1490206 - RNA, 18 nt, Homo sapiens
cuuaacuaauuugaaugu

SEQ ID NO: 1490207 - RNA, 17 nt, Homo sapiens
cuuaacucugaugguuc

SEQ ID NO: 1490208 - RNA, 18 nt, Homo sapiens
cuuaacugcauuuuuaga

SEQ ID NO: 1490209 - RNA, 22 nt, Homo sapiens
cuuaagcaaaggggacagcugu

SEQ ID NO: 1490210 - RNA, 22 nt, Homo sapiens
cuuaauaaacuguggugcuuuu

SEQ ID NO: 1490211 - RNA, 22 nt, Homo sapiens
cuuaauaaaggcccccacuucu

SEQ ID NO: 1490212 - RNA, 20 nt, Homo sapiens
cuuaauaaauauuacaguga

SEQ ID NO: 1490213 - RNA, 18 nt, Homo sapiens
cuuaauacuaccuugaaa

SEQ ID NO: 1490214 - RNA, 14 nt, Homo sapiens
cuuaauaguaguua

SEQ ID NO: 1490215 - RNA, 14 nt, Homo sapiens
cuuaauaguauuua

SEQ ID NO: 1490216 - RNA, 14 nt, Homo sapiens
cuuaauucaaauaa

SEQ ID NO: 1490217 - RNA, 20 nt, Homo sapiens
gcacuaccacgccaagcuaa

SEQ ID NO: 1490218 - RNA, 18 nt, Homo sapiens
gcacuacugggugucauu

SEQ ID NO: 1490219 - RNA, 20 nt, Homo sapiens
gcacucaccucacuguucaa

SEQ ID NO: 1490220 - RNA, 20 nt, Homo sapiens
gcacucacgcccuaagcgca

SEQ ID NO: 1490221 - RNA, 17 nt, Homo sapiens
gcacucagggagcauuu

SEQ ID NO: 1490222 - RNA, 11 nt, Homo sapiens
gcacugaccug

SEQ ID NO: 1490223 - RNA, 14 nt, Homo sapiens
gcacugagggccac

SEQ ID NO: 1490224 - RNA, 13 nt, Homo sapiens
gcacugaugcugc

SEQ ID NO: 1490225 - RNA, 17 nt, Homo sapiens
gcacuggugccaaaacc

SEQ ID NO: 1490226 - RNA, 15 nt, Homo sapiens
gcacuguccugacca

SEQ ID NO: 1490227 - RNA, 19 nt, Homo sapiens
gcacugugacccccagcuc

SEQ ID NO: 1490228 - RNA, 17 nt, Homo sapiens
gcacugugagcaccuga

SEQ ID NO: 1490229 - RNA, 23 nt, Homo sapiens
gcacuuauaagaaagaucaaaga

SEQ ID NO: 1490230 - RNA, 13 nt, Homo sapiens
gcacuugaccuca

SEQ ID NO: 1490231 - RNA, 23 nt, Homo sapiens
gcacuugcugaggccaagccacu

SEQ ID NO: 1490232 - RNA, 16 nt, Homo sapiens
gcacuugugcuuucag

SEQ ID NO: 1490233 - RNA, 13 nt, Homo sapiens
gcacuuuccacuu

SEQ ID NO: 1490234 - RNA, 20 nt, Homo sapiens
gcacuuuuguuauuccauca

SEQ ID NO: 1490235 - RNA, 21 nt, Homo sapiens
gcacuuuuguuauuccaucaa

SEQ ID NO: 1490236 - RNA, 15 nt, Homo sapiens
gcagaaaauuacauu

SEQ ID NO: 1490237 - RNA, 14 nt, Homo sapiens
gcagaacagcauca

SEQ ID NO: 1490238 - RNA, 22 nt, Homo sapiens
gcagaacucuugacuuccugcc

SEQ ID NO: 1490239 - RNA, 16 nt, Homo sapiens
gcagaagcccugaugu

SEQ ID NO: 1490240 - RNA, 22 nt, Homo sapiens
gcagaagugcaauccagcccau

SEQ ID NO: 1490241 - RNA, 21 nt, Homo sapiens
gcagaauuuaaguugguaaua

SEQ ID NO: 1490242 - RNA, 13 nt, Homo sapiens
gcagacaccagca

SEQ ID NO: 1490243 - RNA, 14 nt, Homo sapiens
gcagacaccagcag

SEQ ID NO: 1490244 - RNA, 21 nt, Homo sapiens
gcagacaccagcagcccuguc

SEQ ID NO: 1490245 - RNA, 22 nt, Homo sapiens
gcagacaggaggaaucauguca

SEQ ID NO: 1490246 - RNA, 17 nt, Homo sapiens
gcagacaggccauguga

SEQ ID NO: 1490247 - RNA, 18 nt, Homo sapiens
gcagaccccucuaccucc

SEQ ID NO: 1490248 - RNA, 22 nt, Homo sapiens
gcagagagccauuuugugaaug

SEQ ID NO: 1490249 - RNA, 15 nt, Homo sapiens
gcagaggcuguggug

SEQ ID NO: 1490250 - RNA, 17 nt, Homo sapiens
gcagagguguaggggug

SEQ ID NO: 1490251 - RNA, 16 nt, Homo sapiens
gcagagugcacagcug

SEQ ID NO: 1490252 - RNA, 15 nt, Homo sapiens
gcagaguuugccuuc

SEQ ID NO: 1490253 - RNA, 17 nt, Homo sapiens
gcagaguuugccuuccu

SEQ ID NO: 1490254 - RNA, 20 nt, Homo sapiens
gcagauacuguccguggacu

SEQ ID NO: 1490255 - RNA, 21 nt, Homo sapiens
gcagaugagcagucacacugu

SEQ ID NO: 1490256 - RNA, 16 nt, Homo sapiens
gcagauggggcacuga

SEQ ID NO: 1490257 - RNA, 22 nt, Homo sapiens
gcagcacuccgcaucaccucac

SEQ ID NO: 1490258 - RNA, 20 nt, Homo sapiens
gcagcauuuuuaauuuucac

SEQ ID NO: 1490259 - RNA, 18 nt, Homo sapiens
gcagccaaacccaugagg

SEQ ID NO: 1490260 - RNA, 16 nt, Homo sapiens
gcagccagccaucaaa

SEQ ID NO: 1490261 - RNA, 14 nt, Homo sapiens
gcagcccaugccca

SEQ ID NO: 1490262 - RNA, 24 nt, Homo sapiens
gcagccucagaguggucgagugac

SEQ ID NO: 1490263 - RNA, 19 nt, Homo sapiens
gcagccugagcaacucuug

SEQ ID NO: 1490264 - RNA, 20 nt, Homo sapiens
gcagccuggcugguccuccc

SEQ ID NO: 1490265 - RNA, 15 nt, Homo sapiens
gcagcgccagugaca

SEQ ID NO: 1490266 - RNA, 17 nt, Homo sapiens
gcagcgggcuaacggga

SEQ ID NO: 1490267 - RNA, 19 nt, Homo sapiens
gcagcuaaaggaagugaau

SEQ ID NO: 1490268 - RNA, 20 nt, Homo sapiens
gcagcuaaaggaagugaauc

SEQ ID NO: 1490269 - RNA, 15 nt, Homo sapiens
gcagcucacuacccu

SEQ ID NO: 1490270 - RNA, 20 nt, Homo sapiens
gcagcugagccugagccaau

SEQ ID NO: 1490271 - RNA, 20 nt, Homo sapiens
gcagcuucaccagagcauuu

SEQ ID NO: 1490272 - RNA, 21 nt, Homo sapiens
gcagcuucaccagagcauuuc

SEQ ID NO: 1490273 - RNA, 20 nt, Homo sapiens
gcagcuuuauguucauuugu

SEQ ID NO: 1490274 - RNA, 21 nt, Homo sapiens
gcaggaaaguuuacccaugaa

SEQ ID NO: 1490275 - RNA, 22 nt, Homo sapiens
gcaggaacucccagcaacacaa

SEQ ID NO: 1490276 - RNA, 15 nt, Homo sapiens
gcaggaagcuuguca

SEQ ID NO: 1490277 - RNA, 15 nt, Homo sapiens
gcaggaagggagaac

SEQ ID NO: 1490278 - RNA, 12 nt, Homo sapiens
gcaggaccagga

SEQ ID NO: 1490279 - RNA, 14 nt, Homo sapiens
gcaggaguggugca

SEQ ID NO: 1490280 - RNA, 21 nt, Homo sapiens
gcaggcugggacggaccagca

SEQ ID NO: 1490281 - RNA, 18 nt, Homo sapiens
gcaggcugggccaugucc

SEQ ID NO: 1490282 - RNA, 23 nt, Homo sapiens
gcaggcugggccauguccaaaga

SEQ ID NO: 1490283 - RNA, 13 nt, Homo sapiens
gcaggcuuucaag

SEQ ID NO: 1490284 - RNA, 23 nt, Homo sapiens
gcagggguccuuggugugacccu

SEQ ID NO: 1490285 - RNA, 15 nt, Homo sapiens
gcagguauggaaggg

SEQ ID NO: 1490286 - RNA, 12 nt, Homo sapiens
gcaggugccaac

SEQ ID NO: 1490287 - RNA, 16 nt, Homo sapiens
gcaggugggcacugga

SEQ ID NO: 1490288 - RNA, 16 nt, Homo sapiens
gcagguucccaagcuc

SEQ ID NO: 1490289 - RNA, 22 nt, Homo sapiens
gcagguuccuuaucugucacac

SEQ ID NO: 1490290 - RNA, 20 nt, Homo sapiens
gcaguagaaauaauaugcau

SEQ ID NO: 1490291 - RNA, 19 nt, Homo sapiens
gcaguaggggcuacuguga

SEQ ID NO: 1490292 - RNA, 19 nt, Homo sapiens
gcaguaucaugcccugugc

SEQ ID NO: 1490293 - RNA, 20 nt, Homo sapiens
gcagucacacuguuacucca

SEQ ID NO: 1490294 - RNA, 13 nt, Homo sapiens
gcagucacuggag

SEQ ID NO: 1490295 - RNA, 13 nt, Homo sapiens
gcagucagggaca

SEQ ID NO: 1490296 - RNA, 19 nt, Homo sapiens
gcagucccaguauucucag

SEQ ID NO: 1490297 - RNA, 19 nt, Homo sapiens
gcagugagcccagaucgca

SEQ ID NO: 1490298 - RNA, 16 nt, Homo sapiens
gcagugauuagcacuu

SEQ ID NO: 1490299 - RNA, 18 nt, Homo sapiens
gcagugcuaaagccugug

SEQ ID NO: 1490300 - RNA, 17 nt, Homo sapiens
gcagugugaaaaguccu

SEQ ID NO: 1490301 - RNA, 12 nt, Homo sapiens
gcaguguucuca

SEQ ID NO: 1490302 - RNA, 17 nt, Homo sapiens
gcaguuccugucccuuc

SEQ ID NO: 1490303 - RNA, 19 nt, Homo sapiens
gcaguuggacucucaggga

SEQ ID NO: 1490304 - RNA, 21 nt, Homo sapiens
gcaguuugcuuuguaugcacu

SEQ ID NO: 1490305 - RNA, 21 nt, Homo sapiens
gcaguuugguccuggggacca

SEQ ID NO: 1490306 - RNA, 19 nt, Homo sapiens
gcauaaauaugcagugaua

SEQ ID NO: 1490307 - RNA, 18 nt, Homo sapiens
gcauaaguuaacuuccaa

SEQ ID NO: 1490308 - RNA, 16 nt, Homo sapiens
gcauaaguuucuggga

SEQ ID NO: 1490309 - RNA, 23 nt, Homo sapiens
gcauacaaagagguguacaggua

SEQ ID NO: 1490310 - RNA, 20 nt, Homo sapiens
gcauagcaaaugacauaagc

SEQ ID NO: 1490311 - RNA, 16 nt, Homo sapiens
gcauagcucuauuuua

SEQ ID NO: 1490312 - RNA, 15 nt, Homo sapiens
gcauaggaauugcac

SEQ ID NO: 1490313 - RNA, 14 nt, Homo sapiens
gcauaucacagaga

SEQ ID NO: 1490314 - RNA, 15 nt, Homo sapiens
gcauauguugaauac

SEQ ID NO: 1490315 - RNA, 15 nt, Homo sapiens
gcaucaaauauuugu

SEQ ID NO: 1490316 - RNA, 23 nt, Homo sapiens
gcaucaauauacauaauacauga

SEQ ID NO: 1490317 - RNA, 11 nt, Homo sapiens
gcaucacuggg

SEQ ID NO: 1490318 - RNA, 13 nt, Homo sapiens
gcaucacugggug

SEQ ID NO: 1490319 - RNA, 22 nt, Homo sapiens
gcucaaccacuguggcguucug

SEQ ID NO: 1490320 - RNA, 20 nt, Homo sapiens
gcucaagcaauccuccugcc

SEQ ID NO: 1490321 - RNA, 20 nt, Homo sapiens
gcucacaugggacugggaua

SEQ ID NO: 1490322 - RNA, 17 nt, Homo sapiens
gcucaccgcccaucagg

SEQ ID NO: 1490323 - RNA, 16 nt, Homo sapiens
gcucagagaugugcac

SEQ ID NO: 1490324 - RNA, 18 nt, Homo sapiens
gcucagaggcccaggaau

SEQ ID NO: 1490325 - RNA, 21 nt, Homo sapiens
gcucagaggcgcacugugacc

SEQ ID NO: 1490326 - RNA, 22 nt, Homo sapiens
gcucagccagcacuuguccagc

SEQ ID NO: 1490327 - RNA, 21 nt, Homo sapiens
gcucagcuucuuccuaggucc

SEQ ID NO: 1490328 - RNA, 19 nt, Homo sapiens
gcucaggacagaugccaca

SEQ ID NO: 1490329 - RNA, 16 nt, Homo sapiens
gcucaggugguugugg

SEQ ID NO: 1490330 - RNA, 16 nt, Homo sapiens
gcucagugccuggaca

SEQ ID NO: 1490331 - RNA, 20 nt, Homo sapiens
gcucagugcucucuccacua

SEQ ID NO: 1490332 - RNA, 14 nt, Homo sapiens
gcucaucacuggau

SEQ ID NO: 1490333 - RNA, 15 nt, Homo sapiens
gcucaucugcaaaag

SEQ ID NO: 1490334 - RNA, 15 nt, Homo sapiens
gcucauugaacuuua

SEQ ID NO: 1490335 - RNA, 21 nt, Homo sapiens
gcucauuuacacucagcugcu

SEQ ID NO: 1490336 - RNA, 16 nt, Homo sapiens
gcucauuuuugcuguu

SEQ ID NO: 1490337 - RNA, 20 nt, Homo sapiens
gcuccacccuggccgagucc

SEQ ID NO: 1490338 - RNA, 14 nt, Homo sapiens
gcuccaggccugca

SEQ ID NO: 1490339 - RNA, 21 nt, Homo sapiens
gcuccccacaccuuccagggc

SEQ ID NO: 1490340 - RNA, 18 nt, Homo sapiens
gcuccccggacauacucu

SEQ ID NO: 1490341 - RNA, 17 nt, Homo sapiens
gcucccuaggagaccaa

SEQ ID NO: 1490342 - RNA, 14 nt, Homo sapiens
gcucccuccuccag

SEQ ID NO: 1490343 - RNA, 22 nt, Homo sapiens
gcucccucuauuuauguuugca

SEQ ID NO: 1490344 - RNA, 20 nt, Homo sapiens
gcuccucagagcgccaggaa

SEQ ID NO: 1490345 - RNA, 15 nt, Homo sapiens
gcuccuccagggugu

SEQ ID NO: 1490346 - RNA, 23 nt, Homo sapiens
gcuccugcagcauggucccugcc

SEQ ID NO: 1490347 - RNA, 14 nt, Homo sapiens
gcuccugcaucuca

SEQ ID NO: 1490348 - RNA, 22 nt, Homo sapiens
gcuccugccccuuucaggccua

SEQ ID NO: 1490349 - RNA, 18 nt, Homo sapiens
gcuccugggggaugcucu

SEQ ID NO: 1490350 - RNA, 17 nt, Homo sapiens
gcuccuuggcuuaccug

SEQ ID NO: 1490351 - RNA, 19 nt, Homo sapiens
gcuccuuggcuuaccugac

SEQ ID NO: 1490352 - RNA, 14 nt, Homo sapiens
gcucuacaucuucu

SEQ ID NO: 1490353 - RNA, 22 nt, Homo sapiens
gcucuacguggcaaauuaacuu

SEQ ID NO: 1490354 - RNA, 15 nt, Homo sapiens
gcucucaagaccaga

SEQ ID NO: 1490355 - RNA, 20 nt, Homo sapiens
gcucucaguuaaaaugugag

SEQ ID NO: 1490356 - RNA, 16 nt, Homo sapiens
gcucucauggggucca

SEQ ID NO: 1490357 - RNA, 20 nt, Homo sapiens
gcucugagaaaccucgggaa

SEQ ID NO: 1490358 - RNA, 23 nt, Homo sapiens
gcucugagacccuuuucucagga

SEQ ID NO: 1490359 - RNA, 19 nt, Homo sapiens
gcucugagccacaguggga

SEQ ID NO: 1490360 - RNA, 23 nt, Homo sapiens
gcucugcaccccucugcccucau

SEQ ID NO: 1490361 - RNA, 13 nt, Homo sapiens
gcucugccucaga

SEQ ID NO: 1490362 - RNA, 18 nt, Homo sapiens
gcucugcuucuccaagga

SEQ ID NO: 1490363 - RNA, 18 nt, Homo sapiens
gcucuggaaaaugugacc

SEQ ID NO: 1490364 - RNA, 12 nt, Homo sapiens
gcucuggaagac

SEQ ID NO: 1490365 - RNA, 17 nt, Homo sapiens
gcucuggguugugcaca

SEQ ID NO: 1490366 - RNA, 16 nt, Homo sapiens
gcucugguuagaaaaa

SEQ ID NO: 1490367 - RNA, 16 nt, Homo sapiens
gcucuguggagggcau

SEQ ID NO: 1490368 - RNA, 20 nt, Homo sapiens
gcucuguucccaguaguuau

SEQ ID NO: 1490369 - RNA, 10 nt, Homo sapiens
gcucuuccaa

SEQ ID NO: 1490370 - RNA, 22 nt, Homo sapiens
gcucuugcucagugaagaggaa

SEQ ID NO: 1490371 - RNA, 21 nt, Homo sapiens
gcucuuucaucucugcuugga

SEQ ID NO: 1490372 - RNA, 16 nt, Homo sapiens
gcucuuucucugccag

SEQ ID NO: 1490373 - RNA, 18 nt, Homo sapiens
gcucuuucucugccagug

SEQ ID NO: 1490374 - RNA, 15 nt, Homo sapiens
gcugaaaaaacaccu

SEQ ID NO: 1490375 - RNA, 22 nt, Homo sapiens
gcugaaaaaacaccuagcuuua

SEQ ID NO: 1490376 - RNA, 17 nt, Homo sapiens
gcugaacaauaggcugu

SEQ ID NO: 1490377 - RNA, 16 nt, Homo sapiens
gcugaagcuggugcgc

SEQ ID NO: 1490378 - RNA, 14 nt, Homo sapiens
gcugagaccacuga

SEQ ID NO: 1490379 - RNA, 22 nt, Homo sapiens
gcugagauugagcagaagauca

SEQ ID NO: 1490380 - RNA, 21 nt, Homo sapiens
gcugaggcuggcacaggacau

SEQ ID NO: 1490381 - RNA, 18 nt, Homo sapiens
gcugagguuccucugccu

SEQ ID NO: 1490382 - RNA, 19 nt, Homo sapiens
gcugagugcaccacuucaa

SEQ ID NO: 1490383 - RNA, 14 nt, Homo sapiens
gcugagugggagaa

SEQ ID NO: 1490384 - RNA, 20 nt, Homo sapiens
gcugagugggagaaggcagu

SEQ ID NO: 1490385 - RNA, 22 nt, Homo sapiens
gcugaguguccagcacaccugc

SEQ ID NO: 1490386 - RNA, 21 nt, Homo sapiens
gcugaugaacucuuaaucaaa

SEQ ID NO: 1490387 - RNA, 24 nt, Homo sapiens
gcugaugagugauugacacacagc

SEQ ID NO: 1490388 - RNA, 18 nt, Homo sapiens
gcugaugauuuugcaaaa

SEQ ID NO: 1490389 - RNA, 21 nt, Homo sapiens
gcugauggaccaggaagcccu

SEQ ID NO: 1490390 - RNA, 21 nt, Homo sapiens
gcugcacaucacaacauuuac

SEQ ID NO: 1490391 - RNA, 22 nt, Homo sapiens
gcugcacccugcgccuccagag

SEQ ID NO: 1490392 - RNA, 16 nt, Homo sapiens
gcugcaccugauuagu

SEQ ID NO: 1490393 - RNA, 21 nt, Homo sapiens
gcugcacucaagcuuggguga

SEQ ID NO: 1490394 - RNA, 21 nt, Homo sapiens
gcugcacugaucacccaaugc

SEQ ID NO: 1490395 - RNA, 17 nt, Homo sapiens
gcugcacugaugcugcc

SEQ ID NO: 1490396 - RNA, 19 nt, Homo sapiens
gcugcagacaaguggacag

SEQ ID NO: 1490397 - RNA, 14 nt, Homo sapiens
gcugcaggaaucaa

SEQ ID NO: 1490398 - RNA, 16 nt, Homo sapiens
gcugcaggaaucaaaa

SEQ ID NO: 1490399 - RNA, 22 nt, Homo sapiens
gcugcaggccgugugucuguca

SEQ ID NO: 1490400 - RNA, 16 nt, Homo sapiens
gcugcagucccuggaa

SEQ ID NO: 1490401 - RNA, 14 nt, Homo sapiens
gcugccacaaccag

SEQ ID NO: 1490402 - RNA, 19 nt, Homo sapiens
gcugccagaugauuguuca

SEQ ID NO: 1490403 - RNA, 16 nt, Homo sapiens
gcugccagccuucucc

SEQ ID NO: 1490404 - RNA, 20 nt, Homo sapiens
gcugccccaaccugcugaag

SEQ ID NO: 1490405 - RNA, 22 nt, Homo sapiens
gcugccccaaccugcugaaggg

SEQ ID NO: 1490406 - RNA, 18 nt, Homo sapiens
gcugcccuagcugacccc

SEQ ID NO: 1490407 - RNA, 22 nt, Homo sapiens
gcugcccuccuuguccacccac

SEQ ID NO: 1490408 - RNA, 15 nt, Homo sapiens
gcugccuaccagggg

SEQ ID NO: 1490409 - RNA, 20 nt, Homo sapiens
gcugccucugggccaugcca

SEQ ID NO: 1490410 - RNA, 15 nt, Homo sapiens
gcugccugacacuga

SEQ ID NO: 1490411 - RNA, 20 nt, Homo sapiens
gcugccugcuuggcccggcc

SEQ ID NO: 1490412 - RNA, 14 nt, Homo sapiens
gcugcgacugauga

SEQ ID NO: 1490413 - RNA, 17 nt, Homo sapiens
gcugcgcaccaaugccc

SEQ ID NO: 1490414 - RNA, 20 nt, Homo sapiens
gcugcggggggcaccagagg

SEQ ID NO: 1490415 - RNA, 13 nt, Homo sapiens
gcugcuccagugc

SEQ ID NO: 1490416 - RNA, 14 nt, Homo sapiens
gcugcucuggaaaa

SEQ ID NO: 1490417 - RNA, 19 nt, Homo sapiens
gcugcugcccauguuucaa

SEQ ID NO: 1490418 - RNA, 19 nt, Homo sapiens
gcugcuucugcaaaaaacu

SEQ ID NO: 1490419 - RNA, 21 nt, Homo sapiens
gcugcuucuguguguggugag

SEQ ID NO: 1490420 - RNA, 17 nt, Homo sapiens
ggcagagggagaaucca

SEQ ID NO: 1490421 - RNA, 23 nt, Homo sapiens
ggcagauggggcacugacccagg

SEQ ID NO: 1490422 - RNA, 18 nt, Homo sapiens
ggcagcauagcaagacac

SEQ ID NO: 1490423 - RNA, 14 nt, Homo sapiens
ggcagccaccagcg

SEQ ID NO: 1490424 - RNA, 22 nt, Homo sapiens
ggcagcggguggcauccaggcu

SEQ ID NO: 1490425 - RNA, 14 nt, Homo sapiens
ggcagcuacucaga

SEQ ID NO: 1490426 - RNA, 20 nt, Homo sapiens
ggcaggagaacuacuugaac

SEQ ID NO: 1490427 - RNA, 16 nt, Homo sapiens
ggcaggagccggcugc

SEQ ID NO: 1490428 - RNA, 13 nt, Homo sapiens
ggcaggccagugu

SEQ ID NO: 1490429 - RNA, 22 nt, Homo sapiens
ggcaggcucacugccaggccag

SEQ ID NO: 1490430 - RNA, 14 nt, Homo sapiens
ggcagggcccagug

SEQ ID NO: 1490431 - RNA, 15 nt, Homo sapiens
ggcagggcugugcuu

SEQ ID NO: 1490432 - RNA, 17 nt, Homo sapiens
ggcaggugccuguugaa

SEQ ID NO: 1490433 - RNA, 13 nt, Homo sapiens
ggcaggugccuug

SEQ ID NO: 1490434 - RNA, 16 nt, Homo sapiens
ggcaguagaacuccag

SEQ ID NO: 1490435 - RNA, 15 nt, Homo sapiens
ggcagucugggcacu

SEQ ID NO: 1490436 - RNA, 15 nt, Homo sapiens
ggcaguucucacucc

SEQ ID NO: 1490437 - RNA, 21 nt, Homo sapiens
ggcaucagucccccugugcau

SEQ ID NO: 1490438 - RNA, 16 nt, Homo sapiens
ggcaucuccugugcau

SEQ ID NO: 1490439 - RNA, 22 nt, Homo sapiens
ggcaucuuugccuugggcugcu

SEQ ID NO: 1490440 - RNA, 18 nt, Homo sapiens
ggcauggccagguggcca

SEQ ID NO: 1490441 - RNA, 15 nt, Homo sapiens
ggcauggcuggggug

SEQ ID NO: 1490442 - RNA, 16 nt, Homo sapiens
ggcauggguccagggc

SEQ ID NO: 1490443 - RNA, 14 nt, Homo sapiens
ggcaugugcuguga

SEQ ID NO: 1490444 - RNA, 15 nt, Homo sapiens
ggcauuguaguuaau

SEQ ID NO: 1490445 - RNA, 12 nt, Homo sapiens
ggccaacaaaga

SEQ ID NO: 1490446 - RNA, 23 nt, Homo sapiens
ggccaacauggugaaacccuguc

SEQ ID NO: 1490447 - RNA, 14 nt, Homo sapiens
ggccacaacagggc

SEQ ID NO: 1490448 - RNA, 14 nt, Homo sapiens
ggccacacuaccca

SEQ ID NO: 1490449 - RNA, 11 nt, Homo sapiens
ggccacagggc

SEQ ID NO: 1490450 - RNA, 13 nt, Homo sapiens
ggccacccaggaa

SEQ ID NO: 1490451 - RNA, 21 nt, Homo sapiens
ggccacccaggaacuccugac

SEQ ID NO: 1490452 - RNA, 11 nt, Homo sapiens
ggccacugucc

SEQ ID NO: 1490453 - RNA, 16 nt, Homo sapiens
ggccagcccugcagcc

SEQ ID NO: 1490454 - RNA, 15 nt, Homo sapiens
ggccagcgggcacag

SEQ ID NO: 1490455 - RNA, 17 nt, Homo sapiens
ggccaggcaagugggac

SEQ ID NO: 1490456 - RNA, 20 nt, Homo sapiens
ggccaggcacccccaaauca

SEQ ID NO: 1490457 - RNA, 19 nt, Homo sapiens
ggccagggcugcccugaga

SEQ ID NO: 1490458 - RNA, 23 nt, Homo sapiens
ggccagggucugugugaaugugg

SEQ ID NO: 1490459 - RNA, 18 nt, Homo sapiens
ggccagucaggcugcaga

SEQ ID NO: 1490460 - RNA, 17 nt, Homo sapiens
ggccaugccacccuguu

SEQ ID NO: 1490461 - RNA, 14 nt, Homo sapiens
ggccauggggcccu

SEQ ID NO: 1490462 - RNA, 22 nt, Homo sapiens
ggccauuuccaagaggcuguag

SEQ ID NO: 1490463 - RNA, 19 nt, Homo sapiens
ggcccagagcccagcucca

SEQ ID NO: 1490464 - RNA, 13 nt, Homo sapiens
ggcccagccuugu

SEQ ID NO: 1490465 - RNA, 16 nt, Homo sapiens
ggcccauaucugugaa

SEQ ID NO: 1490466 - RNA, 12 nt, Homo sapiens
ggccccaucucu

SEQ ID NO: 1490467 - RNA, 19 nt, Homo sapiens
ggccccucuuauuccucua

SEQ ID NO: 1490468 - RNA, 19 nt, Homo sapiens
ggccccugcgugggggcca

SEQ ID NO: 1490469 - RNA, 20 nt, Homo sapiens
ggccccuucucucccugcca

SEQ ID NO: 1490470 - RNA, 20 nt, Homo sapiens
ggcccuaaaggacucuccag

SEQ ID NO: 1490471 - RNA, 18 nt, Homo sapiens
ggcccuccucucccaucc

SEQ ID NO: 1490472 - RNA, 16 nt, Homo sapiens
ggcccugccuccccau

SEQ ID NO: 1490473 - RNA, 19 nt, Homo sapiens
ggcccugggccucaguuca

SEQ ID NO: 1490474 - RNA, 20 nt, Homo sapiens
ggcccuguccuaagcacuuu

SEQ ID NO: 1490475 - RNA, 18 nt, Homo sapiens
ggcccuguuccccaagga

SEQ ID NO: 1490476 - RNA, 12 nt, Homo sapiens
ggccgcacuggg

SEQ ID NO: 1490477 - RNA, 13 nt, Homo sapiens
ggccgugcagugg

SEQ ID NO: 1490478 - RNA, 16 nt, Homo sapiens
ggccuagaccuggugc

SEQ ID NO: 1490479 - RNA, 15 nt, Homo sapiens
ggccuauuccugcug

SEQ ID NO: 1490480 - RNA, 11 nt, Homo sapiens
ggccuccagaa

SEQ ID NO: 1490481 - RNA, 12 nt, Homo sapiens
ggccuccaugac

SEQ ID NO: 1490482 - RNA, 15 nt, Homo sapiens
ggccuccaugaccug

SEQ ID NO: 1490483 - RNA, 20 nt, Homo sapiens
ggccucccaaagugcugaga

SEQ ID NO: 1490484 - RNA, 20 nt, Homo sapiens
ggccucccaaaugagccaug

SEQ ID NO: 1490485 - RNA, 23 nt, Homo sapiens
ggccucccucugcuacuccaucc

SEQ ID NO: 1490486 - RNA, 20 nt, Homo sapiens
ggccucuggcucucaugggg

SEQ ID NO: 1490487 - RNA, 22 nt, Homo sapiens
ggccugaggugugugccacuca

SEQ ID NO: 1490488 - RNA, 17 nt, Homo sapiens
ggccuggacuuccagug

SEQ ID NO: 1490489 - RNA, 15 nt, Homo sapiens
ggccuggccagucaa

SEQ ID NO: 1490490 - RNA, 18 nt, Homo sapiens
ggccuguacggacacugu

SEQ ID NO: 1490491 - RNA, 19 nt, Homo sapiens
ggccugugcgugccaucca

SEQ ID NO: 1490492 - RNA, 22 nt, Homo sapiens
ggccuuaauuuucaguauaauu

SEQ ID NO: 1490493 - RNA, 19 nt, Homo sapiens
ggccuuccucucuccagau

SEQ ID NO: 1490494 - RNA, 16 nt, Homo sapiens
ggccuugcuaccucaa

SEQ ID NO: 1490495 - RNA, 21 nt, Homo sapiens
ggcgaccuccuuucaucacac

SEQ ID NO: 1490496 - RNA, 15 nt, Homo sapiens
ggcgagcacugugag

SEQ ID NO: 1490497 - RNA, 13 nt, Homo sapiens
ggcgcagugcuuc

SEQ ID NO: 1490498 - RNA, 17 nt, Homo sapiens
ggcgcuagcacagcucc

SEQ ID NO: 1490499 - RNA, 13 nt, Homo sapiens
ggcgcugacucug

SEQ ID NO: 1490500 - RNA, 18 nt, Homo sapiens
ggcgcugcuuugucaaaa

SEQ ID NO: 1490501 - RNA, 15 nt, Homo sapiens
ggcggcccacaccca

SEQ ID NO: 1490502 - RNA, 22 nt, Homo sapiens
ggcggcccggccagcgggcaca

SEQ ID NO: 1490503 - RNA, 22 nt, Homo sapiens
ggcguuacugcuugaccaaaga

SEQ ID NO: 1490504 - RNA, 21 nt, Homo sapiens
ggcuaacuauauuugcuuuuu

SEQ ID NO: 1490505 - RNA, 21 nt, Homo sapiens
ggcuaauucccagagugugaa

SEQ ID NO: 1490506 - RNA, 16 nt, Homo sapiens
ggcuacacucaucuga

SEQ ID NO: 1490507 - RNA, 16 nt, Homo sapiens
ggcuacugacuacccu

SEQ ID NO: 1490508 - RNA, 20 nt, Homo sapiens
ggcuauggaggguccuccuc

SEQ ID NO: 1490509 - RNA, 19 nt, Homo sapiens
ggcuauuuaaaacuuguaa

SEQ ID NO: 1490510 - RNA, 17 nt, Homo sapiens
ggcuauuuggacucagg

SEQ ID NO: 1490511 - RNA, 16 nt, Homo sapiens
ggcuccaacacugcug

SEQ ID NO: 1490512 - RNA, 13 nt, Homo sapiens
ggcucccaaguca

SEQ ID NO: 1490513 - RNA, 20 nt, Homo sapiens
ggcucccaagucacacccac

SEQ ID NO: 1490514 - RNA, 19 nt, Homo sapiens
ggcuccgacuugugcacag

SEQ ID NO: 1490515 - RNA, 19 nt, Homo sapiens
ggcucugacagaaagcaga

SEQ ID NO: 1490516 - RNA, 21 nt, Homo sapiens
ggcucugcaaugggcacuggg

SEQ ID NO: 1490517 - RNA, 22 nt, Homo sapiens
ggcucuguaccacgcuggccau

SEQ ID NO: 1490518 - RNA, 19 nt, Homo sapiens
ggcucuuagcagcuuccag

SEQ ID NO: 1490519 - RNA, 11 nt, Homo sapiens
ggcucuuccaa

SEQ ID NO: 1490520 - RNA, 15 nt, Homo sapiens
ggcugagcugagcuu

SEQ ID NO: 1490521 - RNA, 16 nt, Homo sapiens
ggcugaggcuggcaca

SEQ ID NO: 1490522 - RNA, 18 nt, Homo sapiens
ggcugagggcugccagca

SEQ ID NO: 1490523 - RNA, 15 nt, Homo sapiens
guauggaaacacuga

SEQ ID NO: 1490524 - RNA, 18 nt, Homo sapiens
guauggaauacaguguua

SEQ ID NO: 1490525 - RNA, 22 nt, Homo sapiens
guauuaauguguuaagugcagg

SEQ ID NO: 1490526 - RNA, 22 nt, Homo sapiens
guauuauccacaauuauuggca

SEQ ID NO: 1490527 - RNA, 21 nt, Homo sapiens
guauuccuuuauacacagugg

SEQ ID NO: 1490528 - RNA, 21 nt, Homo sapiens
guauucucuaaaagcuuuaaa

SEQ ID NO: 1490529 - RNA, 18 nt, Homo sapiens
guauugaaauguuugcau

SEQ ID NO: 1490530 - RNA, 17 nt, Homo sapiens
guauuuaggcagauuga

SEQ ID NO: 1490531 - RNA, 19 nt, Homo sapiens
guauuuauuacaacucuau

SEQ ID NO: 1490532 - RNA, 21 nt, Homo sapiens
guauuucaacugaaguucuau

SEQ ID NO: 1490533 - RNA, 19 nt, Homo sapiens
guauuuccagugcaauugu

SEQ ID NO: 1490534 - RNA, 19 nt, Homo sapiens
guauuuuaacucauaccuu

SEQ ID NO: 1490535 - RNA, 18 nt, Homo sapiens
guauuuugaaguuuacau

SEQ ID NO: 1490536 - RNA, 19 nt, Homo sapiens
guauuuuguagaugugauu

SEQ ID NO: 1490537 - RNA, 20 nt, Homo sapiens
gucaaaccgcacucacccau

SEQ ID NO: 1490538 - RNA, 11 nt, Homo sapiens
gucaaacugua

SEQ ID NO: 1490539 - RNA, 13 nt, Homo sapiens
gucaaacuguaga

SEQ ID NO: 1490540 - RNA, 17 nt, Homo sapiens
gucaaagugaugaauau

SEQ ID NO: 1490541 - RNA, 11 nt, Homo sapiens
gucaacaaacu

SEQ ID NO: 1490542 - RNA, 12 nt, Homo sapiens
gucaacaucaaa

SEQ ID NO: 1490543 - RNA, 15 nt, Homo sapiens
gucaacaucaaagag

SEQ ID NO: 1490544 - RNA, 17 nt, Homo sapiens
gucaagcugaaaacaaa

SEQ ID NO: 1490545 - RNA, 18 nt, Homo sapiens
gucaagugggaucuguca

SEQ ID NO: 1490546 - RNA, 12 nt, Homo sapiens
gucaaugugcag

SEQ ID NO: 1490547 - RNA, 21 nt, Homo sapiens
gucacaauccuaacacauuau

SEQ ID NO: 1490548 - RNA, 19 nt, Homo sapiens
gucacagccuccucugucu

SEQ ID NO: 1490549 - RNA, 11 nt, Homo sapiens
gucacagucca

SEQ ID NO: 1490550 - RNA, 19 nt, Homo sapiens
gucacaucucugccuggaa

SEQ ID NO: 1490551 - RNA, 17 nt, Homo sapiens
gucaccuacgugccacu

SEQ ID NO: 1490552 - RNA, 16 nt, Homo sapiens
gucaccugcuccagaa

SEQ ID NO: 1490553 - RNA, 19 nt, Homo sapiens
gucacguuaccauuuacau

SEQ ID NO: 1490554 - RNA, 14 nt, Homo sapiens
gucacuagucucac

SEQ ID NO: 1490555 - RNA, 15 nt, Homo sapiens
gucacuagucucacc

SEQ ID NO: 1490556 - RNA, 21 nt, Homo sapiens
gucacugugcacugcccuguu

SEQ ID NO: 1490557 - RNA, 21 nt, Homo sapiens
gucacuuuuguucccagguac

SEQ ID NO: 1490558 - RNA, 21 nt, Homo sapiens
gucagcacaggccauggugca

SEQ ID NO: 1490559 - RNA, 16 nt, Homo sapiens
gucagcaugccucuag

SEQ ID NO: 1490560 - RNA, 14 nt, Homo sapiens
gucagcccaugugc

SEQ ID NO: 1490561 - RNA, 17 nt, Homo sapiens
gucagcccaugugcacc

SEQ ID NO: 1490562 - RNA, 14 nt, Homo sapiens
gucaggaacagaag

SEQ ID NO: 1490563 - RNA, 23 nt, Homo sapiens
gucaggaacagaaggaugaauga

SEQ ID NO: 1490564 - RNA, 15 nt, Homo sapiens
gucaggauucuucaa

SEQ ID NO: 1490565 - RNA, 16 nt, Homo sapiens
gucagucaugauggca

SEQ ID NO: 1490566 - RNA, 20 nt, Homo sapiens
gucagugcuucgugccucga

SEQ ID NO: 1490567 - RNA, 21 nt, Homo sapiens
gucauaguggguggauuuguu

SEQ ID NO: 1490568 - RNA, 21 nt, Homo sapiens
gucauauauuuuuugcuacuu

SEQ ID NO: 1490569 - RNA, 14 nt, Homo sapiens
gucaucaucacauu

SEQ ID NO: 1490570 - RNA, 22 nt, Homo sapiens
gucauccaaacucaaacuugag

SEQ ID NO: 1490571 - RNA, 15 nt, Homo sapiens
gucaucgggccagaa

SEQ ID NO: 1490572 - RNA, 21 nt, Homo sapiens
gucaucucucacacauuccag

SEQ ID NO: 1490573 - RNA, 21 nt, Homo sapiens
gucaugcauaaauaugcagug

SEQ ID NO: 1490574 - RNA, 18 nt, Homo sapiens
gucauggacuguugccac

SEQ ID NO: 1490575 - RNA, 13 nt, Homo sapiens
gucauguuugcag

SEQ ID NO: 1490576 - RNA, 21 nt, Homo sapiens
gucauguuugcaggggugacg

SEQ ID NO: 1490577 - RNA, 13 nt, Homo sapiens
gucauucauucaa

SEQ ID NO: 1490578 - RNA, 22 nt, Homo sapiens
gucauucuaggauguggagcua

SEQ ID NO: 1490579 - RNA, 14 nt, Homo sapiens
gucauuucauucca

SEQ ID NO: 1490580 - RNA, 21 nt, Homo sapiens
guccaagucuucucaagaucc

SEQ ID NO: 1490581 - RNA, 17 nt, Homo sapiens
guccagauauuucacau

SEQ ID NO: 1490582 - RNA, 13 nt, Homo sapiens
guccagcacugga

SEQ ID NO: 1490583 - RNA, 17 nt, Homo sapiens
guccaggguugaucaca

SEQ ID NO: 1490584 - RNA, 14 nt, Homo sapiens
guccaguauucuac

SEQ ID NO: 1490585 - RNA, 14 nt, Homo sapiens
gucccaaccccagu

SEQ ID NO: 1490586 - RNA, 15 nt, Homo sapiens
gucccaccugcacac

SEQ ID NO: 1490587 - RNA, 15 nt, Homo sapiens
gucccagaguggcug

SEQ ID NO: 1490588 - RNA, 16 nt, Homo sapiens
gucccaggagcaggac

SEQ ID NO: 1490589 - RNA, 21 nt, Homo sapiens
guccccacccuccacucagcu

SEQ ID NO: 1490590 - RNA, 15 nt, Homo sapiens
guccccuccacuguc

SEQ ID NO: 1490591 - RNA, 17 nt, Homo sapiens
guccccuccacugucac

SEQ ID NO: 1490592 - RNA, 18 nt, Homo sapiens
guccccuccuucccucac

SEQ ID NO: 1490593 - RNA, 17 nt, Homo sapiens
guccccucuugacccau

SEQ ID NO: 1490594 - RNA, 19 nt, Homo sapiens
gucccggggccagcacuuc

SEQ ID NO: 1490595 - RNA, 16 nt, Homo sapiens
gucccggguguguaca

SEQ ID NO: 1490596 - RNA, 13 nt, Homo sapiens
gucccgguuuguc

SEQ ID NO: 1490597 - RNA, 13 nt, Homo sapiens
gucccucccugcc

SEQ ID NO: 1490598 - RNA, 13 nt, Homo sapiens
gucccuuggagac

SEQ ID NO: 1490599 - RNA, 18 nt, Homo sapiens
guccuaaggacacacuaa

SEQ ID NO: 1490600 - RNA, 17 nt, Homo sapiens
guccucacucccagucc

SEQ ID NO: 1490601 - RNA, 21 nt, Homo sapiens
guccucagccuugccagagau

SEQ ID NO: 1490602 - RNA, 19 nt, Homo sapiens
guccuccagaccaccagcc

SEQ ID NO: 1490603 - RNA, 20 nt, Homo sapiens
guccucccaauuucagacuc

SEQ ID NO: 1490604 - RNA, 16 nt, Homo sapiens
guccucccaggccagg

SEQ ID NO: 1490605 - RNA, 23 nt, Homo sapiens
guccuccccuauugcgcucucaa

SEQ ID NO: 1490606 - RNA, 18 nt, Homo sapiens
guccucccucugauuuuu

SEQ ID NO: 1490607 - RNA, 18 nt, Homo sapiens
guccuccugcugccagua

SEQ ID NO: 1490608 - RNA, 19 nt, Homo sapiens
guccucuacuuaaugagau

SEQ ID NO: 1490609 - RNA, 22 nt, Homo sapiens
guccucugucagucacagccac

SEQ ID NO: 1490610 - RNA, 15 nt, Homo sapiens
guccucuugcucaaa

SEQ ID NO: 1490611 - RNA, 20 nt, Homo sapiens
guccugaaggaaaaugacuc

SEQ ID NO: 1490612 - RNA, 16 nt, Homo sapiens
guccugaccaucgcac

SEQ ID NO: 1490613 - RNA, 13 nt, Homo sapiens
guccugaugcugu

SEQ ID NO: 1490614 - RNA, 17 nt, Homo sapiens
guccugccucagccucc

SEQ ID NO: 1490615 - RNA, 22 nt, Homo sapiens
guccugggcauggguccagggc

SEQ ID NO: 1490616 - RNA, 17 nt, Homo sapiens
guccuggggaccauuca

SEQ ID NO: 1490617 - RNA, 21 nt, Homo sapiens
guccuuccuaccucuguggug

SEQ ID NO: 1490618 - RNA, 12 nt, Homo sapiens
guccuugaacaa

SEQ ID NO: 1490619 - RNA, 23 nt, Homo sapiens
guccuuucccuucaguacccucu

SEQ ID NO: 1490620 - RNA, 15 nt, Homo sapiens
guccuuugugaauau

SEQ ID NO: 1490621 - RNA, 21 nt, Homo sapiens
guccuuuuuuauacaggaaaa

SEQ ID NO: 1490622 - RNA, 16 nt, Homo sapiens
gucgaggggcucucag

SEQ ID NO: 1490623 - RNA, 14 nt, Homo sapiens
gucguaagucacug

SEQ ID NO: 1490624 - RNA, 16 nt, Homo sapiens
gucuaaaaacaccaaa

SEQ ID NO: 1490625 - RNA, 14 nt, Homo sapiens
gucuaaaagcagaa

SEQ ID NO: 1490626 - RNA, 18 nt, Homo sapiens
ucaagcaauugucugccu

SEQ ID NO: 1490627 - RNA, 18 nt, Homo sapiens
ucaagcugagauugagca

SEQ ID NO: 1490628 - RNA, 18 nt, Homo sapiens
ucaagcugcucugagcca

SEQ ID NO: 1490629 - RNA, 18 nt, Homo sapiens
ucaaggcugcagugagcc

SEQ ID NO: 1490630 - RNA, 19 nt, Homo sapiens
ucaaggcuuccacugcaaa

SEQ ID NO: 1490631 - RNA, 21 nt, Homo sapiens
ucaaggucagcaugaggacag

SEQ ID NO: 1490632 - RNA, 23 nt, Homo sapiens
ucaaggugggccuugcuaccuca

SEQ ID NO: 1490633 - RNA, 16 nt, Homo sapiens
ucaaguacaccagcca

SEQ ID NO: 1490634 - RNA, 20 nt, Homo sapiens
ucaaguaguguaucacagua

SEQ ID NO: 1490635 - RNA, 17 nt, Homo sapiens
ucaagucugacucucca

SEQ ID NO: 1490636 - RNA, 18 nt, Homo sapiens
ucaaguggagagaaauca

SEQ ID NO: 1490637 - RNA, 19 nt, Homo sapiens
ucaagugggaucugucaca

SEQ ID NO: 1490638 - RNA, 16 nt, Homo sapiens
ucaaguuaacaaggaa

SEQ ID NO: 1490639 - RNA, 17 nt, Homo sapiens
ucaaguuaacaaggaau

SEQ ID NO: 1490640 - RNA, 18 nt, Homo sapiens
ucaaguuugaacucugua

SEQ ID NO: 1490641 - RNA, 16 nt, Homo sapiens
ucaauaaaaugugauu

SEQ ID NO: 1490642 - RNA, 22 nt, Homo sapiens
ucaauaaacaacagcugaagca

SEQ ID NO: 1490643 - RNA, 19 nt, Homo sapiens
ucaauaccaauuacaugga

SEQ ID NO: 1490644 - RNA, 17 nt, Homo sapiens
ucaauauacauaauaca

SEQ ID NO: 1490645 - RNA, 14 nt, Homo sapiens
ucaauauuccugaa

SEQ ID NO: 1490646 - RNA, 18 nt, Homo sapiens
ucaauccugggcaaucag

SEQ ID NO: 1490647 - RNA, 21 nt, Homo sapiens
ucaauccugggcaaucagaca

SEQ ID NO: 1490648 - RNA, 20 nt, Homo sapiens
ucaaucuuuagaaaaggcau

SEQ ID NO: 1490649 - RNA, 19 nt, Homo sapiens
ucaaugccuggagacagau

SEQ ID NO: 1490650 - RNA, 18 nt, Homo sapiens
ucaaugggcucuuccaac

SEQ ID NO: 1490651 - RNA, 13 nt, Homo sapiens
ucaaugugcagug

SEQ ID NO: 1490652 - RNA, 15 nt, Homo sapiens
ucaauuuccugaugc

SEQ ID NO: 1490653 - RNA, 14 nt, Homo sapiens
ucaauuucuacuuc

SEQ ID NO: 1490654 - RNA, 14 nt, Homo sapiens
ucacaaaaauuuga

SEQ ID NO: 1490655 - RNA, 23 nt, Homo sapiens
ucacaaagaguucuggaaaagaa

SEQ ID NO: 1490656 - RNA, 17 nt, Homo sapiens
ucacaaauuucacuuau

SEQ ID NO: 1490657 - RNA, 18 nt, Homo sapiens
ucacaaccaccuaaucag

SEQ ID NO: 1490658 - RNA, 12 nt, Homo sapiens
ucacaagcuauu

SEQ ID NO: 1490659 - RNA, 24 nt, Homo sapiens
ucacaaugucccuucagcaccuga

SEQ ID NO: 1490660 - RNA, 15 nt, Homo sapiens
ucacaccaacagugu

SEQ ID NO: 1490661 - RNA, 11 nt, Homo sapiens
ucacaccagcc

SEQ ID NO: 1490662 - RNA, 16 nt, Homo sapiens
ucacacugucuucuga

SEQ ID NO: 1490663 - RNA, 17 nt, Homo sapiens
ucacagaauagcacaaa

SEQ ID NO: 1490664 - RNA, 13 nt, Homo sapiens
ucacagacuggca

SEQ ID NO: 1490665 - RNA, 19 nt, Homo sapiens
ucacagagacccaccuuca

SEQ ID NO: 1490666 - RNA, 16 nt, Homo sapiens
ucacagcugcuuucug

SEQ ID NO: 1490667 - RNA, 12 nt, Homo sapiens
ucacaguauuau

SEQ ID NO: 1490668 - RNA, 22 nt, Homo sapiens
ucacaguccucauuuacuggau

SEQ ID NO: 1490669 - RNA, 14 nt, Homo sapiens
ucacaugaccugau

SEQ ID NO: 1490670 - RNA, 20 nt, Homo sapiens
ucacauuuuucuacagugaa

SEQ ID NO: 1490671 - RNA, 18 nt, Homo sapiens
ucaccaaaucagcugcua

SEQ ID NO: 1490672 - RNA, 23 nt, Homo sapiens
ucaccaacacaguugggacccaa

SEQ ID NO: 1490673 - RNA, 21 nt, Homo sapiens
ucaccagaauauuucuuucau

SEQ ID NO: 1490674 - RNA, 14 nt, Homo sapiens
ucaccagagcauuu

SEQ ID NO: 1490675 - RNA, 15 nt, Homo sapiens
ucaccagagcauuuc

SEQ ID NO: 1490676 - RNA, 19 nt, Homo sapiens
ucaccaguguccccuccac

SEQ ID NO: 1490677 - RNA, 16 nt, Homo sapiens
ucaccaguuuccaggu

SEQ ID NO: 1490678 - RNA, 16 nt, Homo sapiens
ucaccauugcugucaa

SEQ ID NO: 1490679 - RNA, 22 nt, Homo sapiens
ucaccauugcugucaaguuccu

SEQ ID NO: 1490680 - RNA, 15 nt, Homo sapiens
ucaccauugugaagc

SEQ ID NO: 1490681 - RNA, 20 nt, Homo sapiens
ucaccauugugaagcaccua

SEQ ID NO: 1490682 - RNA, 22 nt, Homo sapiens
ucacccaccccugcacaguuga

SEQ ID NO: 1490683 - RNA, 14 nt, Homo sapiens
ucacccaggaggau

SEQ ID NO: 1490684 - RNA, 18 nt, Homo sapiens
ucaccccaacuaguagcu

SEQ ID NO: 1490685 - RNA, 13 nt, Homo sapiens
ucacccugccuua

SEQ ID NO: 1490686 - RNA, 16 nt, Homo sapiens
ucacccuguauguuag

SEQ ID NO: 1490687 - RNA, 16 nt, Homo sapiens
ucacccuuguccuuga

SEQ ID NO: 1490688 - RNA, 16 nt, Homo sapiens
ucaccgacaacaugcu

SEQ ID NO: 1490689 - RNA, 23 nt, Homo sapiens
ucaccuccgaacuguucaagugu

SEQ ID NO: 1490690 - RNA, 18 nt, Homo sapiens
ucaccucuccaggugcuc

SEQ ID NO: 1490691 - RNA, 14 nt, Homo sapiens
ucaccuuccagugu

SEQ ID NO: 1490692 - RNA, 21 nt, Homo sapiens
ucaccuucuagucuuggccag

SEQ ID NO: 1490693 - RNA, 22 nt, Homo sapiens
ucaccuuggcaccagacaccca

SEQ ID NO: 1490694 - RNA, 17 nt, Homo sapiens
ucaccuuuucuguggcu

SEQ ID NO: 1490695 - RNA, 19 nt, Homo sapiens
ucacgcaacuugaaauuau

SEQ ID NO: 1490696 - RNA, 11 nt, Homo sapiens
ucacgcugggg

SEQ ID NO: 1490697 - RNA, 14 nt, Homo sapiens
ucacggccaagugu

SEQ ID NO: 1490698 - RNA, 20 nt, Homo sapiens
ucacuaaaaaggaaacuuca

SEQ ID NO: 1490699 - RNA, 23 nt, Homo sapiens
ucacuaaagcaguagaaauaaua

SEQ ID NO: 1490700 - RNA, 12 nt, Homo sapiens
ucacuacaggug

SEQ ID NO: 1490701 - RNA, 19 nt, Homo sapiens
ucacuacuuaaagugcuau

SEQ ID NO: 1490702 - RNA, 20 nt, Homo sapiens
ucacuagaagaaaagcccau

SEQ ID NO: 1490703 - RNA, 13 nt, Homo sapiens
ucacuagucucac

SEQ ID NO: 1490704 - RNA, 13 nt, Homo sapiens
ucacucaagcacu

SEQ ID NO: 1490705 - RNA, 13 nt, Homo sapiens
ucacucagaggaa

SEQ ID NO: 1490706 - RNA, 22 nt, Homo sapiens
ucacuccccaaggaagagccaa

SEQ ID NO: 1490707 - RNA, 20 nt, Homo sapiens
ucacucucugcauugacuua

SEQ ID NO: 1490708 - RNA, 18 nt, Homo sapiens
ucacucuuccugcaagga

SEQ ID NO: 1490709 - RNA, 11 nt, Homo sapiens
ucacugagcuc

SEQ ID NO: 1490710 - RNA, 14 nt, Homo sapiens
ucacugcaaccucc

SEQ ID NO: 1490711 - RNA, 13 nt, Homo sapiens
ucacugcacucca

SEQ ID NO: 1490712 - RNA, 14 nt, Homo sapiens
ucacugcucaagaa

SEQ ID NO: 1490713 - RNA, 16 nt, Homo sapiens
ucacuggcuggccuga

SEQ ID NO: 1490714 - RNA, 20 nt, Homo sapiens
ucacuggcuguuaaucuuuc

SEQ ID NO: 1490715 - RNA, 15 nt, Homo sapiens
ucacuuaauccuuug

SEQ ID NO: 1490716 - RNA, 23 nt, Homo sapiens
ucacuucacagcccugcagugcc

SEQ ID NO: 1490717 - RNA, 14 nt, Homo sapiens
ucacuucauucaca

SEQ ID NO: 1490718 - RNA, 19 nt, Homo sapiens
ucacuucauucacauucag

SEQ ID NO: 1490719 - RNA, 15 nt, Homo sapiens
ucacuugcacugggg

SEQ ID NO: 1490720 - RNA, 20 nt, Homo sapiens
ucacuugugcaguguugaca

SEQ ID NO: 1490721 - RNA, 22 nt, Homo sapiens
ucagaaaauguucuguuugcug

SEQ ID NO: 1490722 - RNA, 20 nt, Homo sapiens
ucagaaacaggugcaucugg

SEQ ID NO: 1490723 - RNA, 17 nt, Homo sapiens
ucagaaagucaccagga

SEQ ID NO: 1490724 - RNA, 19 nt, Homo sapiens
ucagaaauucucugcgauu

SEQ ID NO: 1490725 - RNA, 19 nt, Homo sapiens
ucagaagaccccugacuca

SEQ ID NO: 1490726 - RNA, 17 nt, Homo sapiens
ucagaauccacucuucu

SEQ ID NO: 1490727 - RNA, 17 nt, Homo sapiens
ucagacaccuguucaca

SEQ ID NO: 1490728 - RNA, 16 nt, Homo sapiens
ucagacauuggcaccu

SEQ ID NO: 1490729 - RNA, 18 nt, Homo sapiens
ucccggggccagcacuuc

SEQ ID NO: 1490730 - RNA, 17 nt, Homo sapiens
ucccuaaaauacauuua

SEQ ID NO: 1490731 - RNA, 13 nt, Homo sapiens
ucccuacauguau

SEQ ID NO: 1490732 - RNA, 13 nt, Homo sapiens
ucccuaccccagg

SEQ ID NO: 1490733 - RNA, 12 nt, Homo sapiens
ucccuaccucag

SEQ ID NO: 1490734 - RNA, 12 nt, Homo sapiens
ucccuaccuccu

SEQ ID NO: 1490735 - RNA, 16 nt, Homo sapiens
ucccuaggaaacucac

SEQ ID NO: 1490736 - RNA, 22 nt, Homo sapiens
ucccuaggaaacucacacuccc

SEQ ID NO: 1490737 - RNA, 17 nt, Homo sapiens
ucccucacccccagcac

SEQ ID NO: 1490738 - RNA, 18 nt, Homo sapiens
ucccucacuguugaauuu

SEQ ID NO: 1490739 - RNA, 17 nt, Homo sapiens
ucccucagcucucuggg

SEQ ID NO: 1490740 - RNA, 20 nt, Homo sapiens
ucccuccauucauccuucca

SEQ ID NO: 1490741 - RNA, 19 nt, Homo sapiens
ucccucuaauuuaucuugu

SEQ ID NO: 1490742 - RNA, 19 nt, Homo sapiens
ucccucucaugacuugcag

SEQ ID NO: 1490743 - RNA, 22 nt, Homo sapiens
ucccucucuuccccuucccuua

SEQ ID NO: 1490744 - RNA, 21 nt, Homo sapiens
ucccucugagaauuccaagga

SEQ ID NO: 1490745 - RNA, 19 nt, Homo sapiens
ucccucugauugguuuugg

SEQ ID NO: 1490746 - RNA, 18 nt, Homo sapiens
ucccucugccuucaggcu

SEQ ID NO: 1490747 - RNA, 14 nt, Homo sapiens
ucccucuucacucc

SEQ ID NO: 1490748 - RNA, 21 nt, Homo sapiens
ucccugaaucccccuugccac

SEQ ID NO: 1490749 - RNA, 24 nt, Homo sapiens
ucccugcacuaaagccagccugac

SEQ ID NO: 1490750 - RNA, 14 nt, Homo sapiens
ucccugccaccagg

SEQ ID NO: 1490751 - RNA, 22 nt, Homo sapiens
ucccugccagaggggaaggagg

SEQ ID NO: 1490752 - RNA, 17 nt, Homo sapiens
ucccuggggcugugcau

SEQ ID NO: 1490753 - RNA, 20 nt, Homo sapiens
ucccuggggcugugcauucc

SEQ ID NO: 1490754 - RNA, 15 nt, Homo sapiens
ucccuguccucauga

SEQ ID NO: 1490755 - RNA, 19 nt, Homo sapiens
ucccugucuccagcugccu

SEQ ID NO: 1490756 - RNA, 15 nt, Homo sapiens
ucccuuacuguuuca

SEQ ID NO: 1490757 - RNA, 13 nt, Homo sapiens
ucccuucaaugcu

SEQ ID NO: 1490758 - RNA, 23 nt, Homo sapiens
ucccuugcuguaugcugaucauc

SEQ ID NO: 1490759 - RNA, 16 nt, Homo sapiens
ucccuuggguucugau

SEQ ID NO: 1490760 - RNA, 16 nt, Homo sapiens
ucccuuucuuggccag

SEQ ID NO: 1490761 - RNA, 13 nt, Homo sapiens
ucccuuugccagu

SEQ ID NO: 1490762 - RNA, 16 nt, Homo sapiens
ucccuuuggagaugcu

SEQ ID NO: 1490763 - RNA, 23 nt, Homo sapiens
ucccuuuggagauuuuuuaaucc

SEQ ID NO: 1490764 - RNA, 17 nt, Homo sapiens
ucccuuuguugcacacu

SEQ ID NO: 1490765 - RNA, 15 nt, Homo sapiens
ucccuuuucuguucu

SEQ ID NO: 1490766 - RNA, 23 nt, Homo sapiens
ucccuuuuuauaucccauuuuua

SEQ ID NO: 1490767 - RNA, 16 nt, Homo sapiens
uccgaggcugaggcag

SEQ ID NO: 1490768 - RNA, 23 nt, Homo sapiens
uccgcacccaguuugauaccugc

SEQ ID NO: 1490769 - RNA, 11 nt, Homo sapiens
uccgcacuuuc

SEQ ID NO: 1490770 - RNA, 22 nt, Homo sapiens
uccgcaggcagacuacacagga

SEQ ID NO: 1490771 - RNA, 13 nt, Homo sapiens
uccgccuaccuca

SEQ ID NO: 1490772 - RNA, 13 nt, Homo sapiens
uccguacauucaa

SEQ ID NO: 1490773 - RNA, 12 nt, Homo sapiens
uccguguaaaau

SEQ ID NO: 1490774 - RNA, 15 nt, Homo sapiens
uccguuaugccaccu

SEQ ID NO: 1490775 - RNA, 20 nt, Homo sapiens
uccuaaauaaaaaaagacaa

SEQ ID NO: 1490776 - RNA, 16 nt, Homo sapiens
uccuaaaugcagugaa

SEQ ID NO: 1490777 - RNA, 13 nt, Homo sapiens
uccuaacaaaaga

SEQ ID NO: 1490778 - RNA, 13 nt, Homo sapiens
uccuaagcacuuu

SEQ ID NO: 1490779 - RNA, 16 nt, Homo sapiens
uccuaagguccaacaa

SEQ ID NO: 1490780 - RNA, 14 nt, Homo sapiens
uccuaauacguauu

SEQ ID NO: 1490781 - RNA, 15 nt, Homo sapiens
uccuaauaugcuuua

SEQ ID NO: 1490782 - RNA, 23 nt, Homo sapiens
uccuacacguuagauuugccgua

SEQ ID NO: 1490783 - RNA, 16 nt, Homo sapiens
uccuacagggccacaa

SEQ ID NO: 1490784 - RNA, 17 nt, Homo sapiens
uccuaccaguugcccua

SEQ ID NO: 1490785 - RNA, 19 nt, Homo sapiens
uccuacgauacgcuacuau

SEQ ID NO: 1490786 - RNA, 19 nt, Homo sapiens
uccuagccaacaucgugaa

SEQ ID NO: 1490787 - RNA, 19 nt, Homo sapiens
uccuagcucucccagugaa

SEQ ID NO: 1490788 - RNA, 19 nt, Homo sapiens
uccuagcuguguuauuccu

SEQ ID NO: 1490789 - RNA, 18 nt, Homo sapiens
uccuaucaccuauuucca

SEQ ID NO: 1490790 - RNA, 22 nt, Homo sapiens
uccucaaauuuuuugacuuuuu

SEQ ID NO: 1490791 - RNA, 19 nt, Homo sapiens
uccucaauaaauauuuauu

SEQ ID NO: 1490792 - RNA, 20 nt, Homo sapiens
uccucaauuuuugucucaga

SEQ ID NO: 1490793 - RNA, 20 nt, Homo sapiens
uccucaccucuggacuggcu

SEQ ID NO: 1490794 - RNA, 13 nt, Homo sapiens
uccucaugcugcu

SEQ ID NO: 1490795 - RNA, 14 nt, Homo sapiens
uccucaugcugcuc

SEQ ID NO: 1490796 - RNA, 21 nt, Homo sapiens
uccucauucccucgucuuucc

SEQ ID NO: 1490797 - RNA, 21 nt, Homo sapiens
uccucauuuacuggauuugac

SEQ ID NO: 1490798 - RNA, 15 nt, Homo sapiens
uccuccaagcucacg

SEQ ID NO: 1490799 - RNA, 20 nt, Homo sapiens
uccuccagaagccucuggcu

SEQ ID NO: 1490800 - RNA, 22 nt, Homo sapiens
uccuccagcccagacccagugg

SEQ ID NO: 1490801 - RNA, 12 nt, Homo sapiens
uccuccaggcaa

SEQ ID NO: 1490802 - RNA, 13 nt, Homo sapiens
uccuccaggguga

SEQ ID NO: 1490803 - RNA, 20 nt, Homo sapiens
uccuccagggugugugcucg

SEQ ID NO: 1490804 - RNA, 13 nt, Homo sapiens
uccuccaucccaa

SEQ ID NO: 1490805 - RNA, 23 nt, Homo sapiens
uccuccauccuauccacugggca

SEQ ID NO: 1490806 - RNA, 17 nt, Homo sapiens
uccuccccuauugcgcu

SEQ ID NO: 1490807 - RNA, 14 nt, Homo sapiens
uccuccuacuuaca

SEQ ID NO: 1490808 - RNA, 14 nt, Homo sapiens
uccucgcugccaga

SEQ ID NO: 1490809 - RNA, 22 nt, Homo sapiens
uccucgggccgaggcccagcgg

SEQ ID NO: 1490810 - RNA, 17 nt, Homo sapiens
uccucuacuguuuaaca

SEQ ID NO: 1490811 - RNA, 22 nt, Homo sapiens
uccucuagcaggccuaagacau

SEQ ID NO: 1490812 - RNA, 19 nt, Homo sapiens
uccucuagcugugggggug

SEQ ID NO: 1490813 - RNA, 13 nt, Homo sapiens
uccucuccacugc

SEQ ID NO: 1490814 - RNA, 18 nt, Homo sapiens
uccucuccacugccuucg

SEQ ID NO: 1490815 - RNA, 19 nt, Homo sapiens
uccucucgagcccagaugg

SEQ ID NO: 1490816 - RNA, 21 nt, Homo sapiens
uccucuggcuuucccaggaga

SEQ ID NO: 1490817 - RNA, 14 nt, Homo sapiens
uccucuugcucaaa

SEQ ID NO: 1490818 - RNA, 14 nt, Homo sapiens
uccucuugugauuu

SEQ ID NO: 1490819 - RNA, 13 nt, Homo sapiens
uccugaaaguguu

SEQ ID NO: 1490820 - RNA, 16 nt, Homo sapiens
uccugaacucagcuga

SEQ ID NO: 1490821 - RNA, 22 nt, Homo sapiens
uccugaaggaaaauaaacugac

SEQ ID NO: 1490822 - RNA, 13 nt, Homo sapiens
uccugacaucaca

SEQ ID NO: 1490823 - RNA, 18 nt, Homo sapiens
uccugacaucacagcagc

SEQ ID NO: 1490824 - RNA, 19 nt, Homo sapiens
uccugaccuugugauccac

SEQ ID NO: 1490825 - RNA, 20 nt, Homo sapiens
uccugacugaaaguaggggg

SEQ ID NO: 1490826 - RNA, 13 nt, Homo sapiens
uccugacuguaac

SEQ ID NO: 1490827 - RNA, 23 nt, Homo sapiens
uccugaggcuuuggauuugacau

SEQ ID NO: 1490828 - RNA, 20 nt, Homo sapiens
uccugaucgccaaccuuucc

SEQ ID NO: 1490829 - RNA, 23 nt, Homo sapiens
uccugcagaagcagaagugcaau

SEQ ID NO: 1490830 - RNA, 18 nt, Homo sapiens
uccugcagccccagaaga

SEQ ID NO: 1490831 - RNA, 18 nt, Homo sapiens
ucuuaagcagcauggaaa

SEQ ID NO: 1490832 - RNA, 22 nt, Homo sapiens
ucuuaagcuuccgccgucucaa

SEQ ID NO: 1490833 - RNA, 13 nt, Homo sapiens
ucuuaauguucac

SEQ ID NO: 1490834 - RNA, 19 nt, Homo sapiens
ucuuacccuguacauaugu

SEQ ID NO: 1490835 - RNA, 13 nt, Homo sapiens
ucuuagugucacu

SEQ ID NO: 1490836 - RNA, 13 nt, Homo sapiens
ucuuaguucucac

SEQ ID NO: 1490837 - RNA, 17 nt, Homo sapiens
ucuuaugauuacuauca

SEQ ID NO: 1490838 - RNA, 16 nt, Homo sapiens
ucuuauuuaacuuaac

SEQ ID NO: 1490839 - RNA, 15 nt, Homo sapiens
ucuuauuuucucaau

SEQ ID NO: 1490840 - RNA, 16 nt, Homo sapiens
ucuuauuuugcauucc

SEQ ID NO: 1490841 - RNA, 22 nt, Homo sapiens
ucuucaaacugugaagcauuua

SEQ ID NO: 1490842 - RNA, 17 nt, Homo sapiens
ucuucaaccucauugac

SEQ ID NO: 1490843 - RNA, 18 nt, Homo sapiens
ucuucaaggagaaugaau

SEQ ID NO: 1490844 - RNA, 14 nt, Homo sapiens
ucuucaauagcuaa

SEQ ID NO: 1490845 - RNA, 19 nt, Homo sapiens
ucuucaccaggugcaugca

SEQ ID NO: 1490846 - RNA, 18 nt, Homo sapiens
ucuucaccccccacucac

SEQ ID NO: 1490847 - RNA, 20 nt, Homo sapiens
ucuucaccucuauccaaaga

SEQ ID NO: 1490848 - RNA, 16 nt, Homo sapiens
ucuucacucucugaag

SEQ ID NO: 1490849 - RNA, 20 nt, Homo sapiens
ucuucacuuccccacaggcu

SEQ ID NO: 1490850 - RNA, 18 nt, Homo sapiens
ucuucacuucuaaaugca

SEQ ID NO: 1490851 - RNA, 13 nt, Homo sapiens
ucuucacuugcac

SEQ ID NO: 1490852 - RNA, 18 nt, Homo sapiens
ucuucagaggagaaagaa

SEQ ID NO: 1490853 - RNA, 11 nt, Homo sapiens
ucuucagccau

SEQ ID NO: 1490854 - RNA, 21 nt, Homo sapiens
ucuucauauucuaaaaccauu

SEQ ID NO: 1490855 - RNA, 13 nt, Homo sapiens
ucuucaugagcuu

SEQ ID NO: 1490856 - RNA, 22 nt, Homo sapiens
ucuucccacacagaauauacau

SEQ ID NO: 1490857 - RNA, 14 nt, Homo sapiens
ucuucccuaccuca

SEQ ID NO: 1490858 - RNA, 15 nt, Homo sapiens
ucuucuaaacuuccc

SEQ ID NO: 1490859 - RNA, 17 nt, Homo sapiens
ucuucucauagcauuaa

SEQ ID NO: 1490860 - RNA, 15 nt, Homo sapiens
ucuucucccuuugaa

SEQ ID NO: 1490861 - RNA, 20 nt, Homo sapiens
ucuucuccuaaaacuuuaaa

SEQ ID NO: 1490862 - RNA, 16 nt, Homo sapiens
ucuucugguguugacu

SEQ ID NO: 1490863 - RNA, 19 nt, Homo sapiens
ucuucuuacaugcauuuga

SEQ ID NO: 1490864 - RNA, 17 nt, Homo sapiens
ucuucuuacuggugcua

SEQ ID NO: 1490865 - RNA, 20 nt, Homo sapiens
ucuucuugugauugcugcca

SEQ ID NO: 1490866 - RNA, 14 nt, Homo sapiens
ucuugaaggugcug

SEQ ID NO: 1490867 - RNA, 15 nt, Homo sapiens
ucuugaaguacuuaa

SEQ ID NO: 1490868 - RNA, 21 nt, Homo sapiens
ucuugaauguggucucaggau

SEQ ID NO: 1490869 - RNA, 21 nt, Homo sapiens
ucuugaauuguaggugacuau

SEQ ID NO: 1490870 - RNA, 17 nt, Homo sapiens
ucuugacauucaaggca

SEQ ID NO: 1490871 - RNA, 20 nt, Homo sapiens
ucuugacauucaaggcauuu

SEQ ID NO: 1490872 - RNA, 15 nt, Homo sapiens
ucuugacuagugcaa

SEQ ID NO: 1490873 - RNA, 16 nt, Homo sapiens
ucuugagcaguggcug

SEQ ID NO: 1490874 - RNA, 11 nt, Homo sapiens
ucuugaucucc

SEQ ID NO: 1490875 - RNA, 15 nt, Homo sapiens
ucuugcucagugaag

SEQ ID NO: 1490876 - RNA, 17 nt, Homo sapiens
ucuugcucuaucucuca

SEQ ID NO: 1490877 - RNA, 17 nt, Homo sapiens
ucuuggaaguacaugaa

SEQ ID NO: 1490878 - RNA, 13 nt, Homo sapiens
ucuuggcaaaagc

SEQ ID NO: 1490879 - RNA, 16 nt, Homo sapiens
ucuuggcaaaagccuu

SEQ ID NO: 1490880 - RNA, 16 nt, Homo sapiens
ucuuggcugaccccuc

SEQ ID NO: 1490881 - RNA, 21 nt, Homo sapiens
ucuugggccccagaccccagg

SEQ ID NO: 1490882 - RNA, 19 nt, Homo sapiens
ucuugggucccccacguga

SEQ ID NO: 1490883 - RNA, 12 nt, Homo sapiens
ucuugguauuau

SEQ ID NO: 1490884 - RNA, 21 nt, Homo sapiens
ucuuggugugauugcacagaa

SEQ ID NO: 1490885 - RNA, 17 nt, Homo sapiens
ucuugucccuuucccua

SEQ ID NO: 1490886 - RNA, 14 nt, Homo sapiens
ucuuguggugcauu

SEQ ID NO: 1490887 - RNA, 14 nt, Homo sapiens
ucuuguugcucaaa

SEQ ID NO: 1490888 - RNA, 22 nt, Homo sapiens
ucuuguuucaauuccaccugca

SEQ ID NO: 1490889 - RNA, 18 nt, Homo sapiens
ucuuguuuuaagugccuu

SEQ ID NO: 1490890 - RNA, 14 nt, Homo sapiens
ucuuuaaaggcauc

SEQ ID NO: 1490891 - RNA, 18 nt, Homo sapiens
ucuuuaaaggcaucuaca

SEQ ID NO: 1490892 - RNA, 20 nt, Homo sapiens
ucuuuaaaggcaucuacaca

SEQ ID NO: 1490893 - RNA, 20 nt, Homo sapiens
ucuuuacaaaacuacaugag

SEQ ID NO: 1490894 - RNA, 23 nt, Homo sapiens
ucuuuacaagcaggcacuguauu

SEQ ID NO: 1490895 - RNA, 17 nt, Homo sapiens
ucuuuagcaugcuacag

SEQ ID NO: 1490896 - RNA, 18 nt, Homo sapiens
ucuuuauaaucuacuccu

SEQ ID NO: 1490897 - RNA, 16 nt, Homo sapiens
ucuuucacacggcaca

SEQ ID NO: 1490898 - RNA, 20 nt, Homo sapiens
ucuuucacauuguuugcugc

SEQ ID NO: 1490899 - RNA, 20 nt, Homo sapiens
ucuuucaggacucuaccuca

SEQ ID NO: 1490900 - RNA, 22 nt, Homo sapiens
ucuuucggggugcuccuguggg

SEQ ID NO: 1490901 - RNA, 19 nt, Homo sapiens
ucuuugacaauuccuagau

SEQ ID NO: 1490902 - RNA, 18 nt, Homo sapiens
ucuuugaucuggacagaa

SEQ ID NO: 1490903 - RNA, 18 nt, Homo sapiens
ucuuugcugccagccacu

SEQ ID NO: 1490904 - RNA, 17 nt, Homo sapiens
ucuuuggaggcuuuuaa

SEQ ID NO: 1490905 - RNA, 19 nt, Homo sapiens
ucuuuggcaguugcauuag

SEQ ID NO: 1490906 - RNA, 22 nt, Homo sapiens
ucuuugggccagacaugccaca

SEQ ID NO: 1490907 - RNA, 13 nt, Homo sapiens
ucuuugugccuuu

SEQ ID NO: 1490908 - RNA, 22 nt, Homo sapiens
ucuuuuacccggcacauucccc

SEQ ID NO: 1490909 - RNA, 16 nt, Homo sapiens
ucuuuuauguuugaau

SEQ ID NO: 1490910 - RNA, 19 nt, Homo sapiens
ucuuuuccugaccaaucuu

SEQ ID NO: 1490911 - RNA, 21 nt, Homo sapiens
ucuuuucuggaauguaaucaa

SEQ ID NO: 1490912 - RNA, 18 nt, Homo sapiens
ucuuuugaaggacuccuu

SEQ ID NO: 1490913 - RNA, 21 nt, Homo sapiens
ucuuuuuuaauaaacuacucu

SEQ ID NO: 1490914 - RNA, 17 nt, Homo sapiens
ugaaaaaaaaaacuauc

SEQ ID NO: 1490915 - RNA, 18 nt, Homo sapiens
ugaaaaacaaaaauaaca

SEQ ID NO: 1490916 - RNA, 15 nt, Homo sapiens
ugaaaaaucauccaa

SEQ ID NO: 1490917 - RNA, 18 nt, Homo sapiens
ugaaaaaucggcuuacca

SEQ ID NO: 1490918 - RNA, 22 nt, Homo sapiens
ugaaaaauucucagucaguaau

SEQ ID NO: 1490919 - RNA, 18 nt, Homo sapiens
ugaaaacauagcaucuca

SEQ ID NO: 1490920 - RNA, 17 nt, Homo sapiens
ugaaaacuuagccagag

SEQ ID NO: 1490921 - RNA, 16 nt, Homo sapiens
ugaaaagaaucagcau

SEQ ID NO: 1490922 - RNA, 15 nt, Homo sapiens
ugaaaagucacuuac

SEQ ID NO: 1490923 - RNA, 16 nt, Homo sapiens
ugaaaauaauguugua

SEQ ID NO: 1490924 - RNA, 19 nt, Homo sapiens
ugaaaauauuuuguugccu

SEQ ID NO: 1490925 - RNA, 14 nt, Homo sapiens
ugaaaaugaaagga

SEQ ID NO: 1490926 - RNA, 14 nt, Homo sapiens
ugaaaaugaaucuu

SEQ ID NO: 1490927 - RNA, 21 nt, Homo sapiens
ugaaaaugucagaaaccaguu

SEQ ID NO: 1490928 - RNA, 19 nt, Homo sapiens
ugaaaauguuuuucugcca

SEQ ID NO: 1490929 - RNA, 20 nt, Homo sapiens
ugaaaauugggcaugccauu

SEQ ID NO: 1490930 - RNA, 16 nt, Homo sapiens
ugaaaauuuuacuucc

SEQ ID NO: 1490931 - RNA, 14 nt, Homo sapiens
ugaaaccaugacug

SEQ ID NO: 1490932 - RNA, 15 nt, Homo sapiens
ugaaaccccaucucu

SEQ ID NO: 1490933 - RNA, 15 nt, Homo sapiens
ugaaaccccgucucu

SEQ ID NO: 1490934 - RNA, 10 nt, Homo sapiens
ugcucucagc

SEQ ID NO: 1490935 - RNA, 18 nt, Homo sapiens
ugcucuccaagucucagu

SEQ ID NO: 1490936 - RNA, 21 nt, Homo sapiens
ugcucuccccuccucggagga

SEQ ID NO: 1490937 - RNA, 23 nt, Homo sapiens
ugcucugguuguuucuguuccaa

SEQ ID NO: 1490938 - RNA, 19 nt, Homo sapiens
ugcucuguccccaaaggac

SEQ ID NO: 1490939 - RNA, 23 nt, Homo sapiens
ugcucuuuaugaaugaaaaaaca

SEQ ID NO: 1490940 - RNA, 16 nt, Homo sapiens
ugcucuuucucugcca

SEQ ID NO: 1490941 - RNA, 15 nt, Homo sapiens
ugcucuuugcugcac

SEQ ID NO: 1490942 - RNA, 18 nt, Homo sapiens
ugcucuuugcugcacuau

SEQ ID NO: 1490943 - RNA, 23 nt, Homo sapiens
ugcugaaaaaucauccaagacag

SEQ ID NO: 1490944 - RNA, 13 nt, Homo sapiens
ugcugaagggcag

SEQ ID NO: 1490945 - RNA, 19 nt, Homo sapiens
ugcugaccucccagugacc

SEQ ID NO: 1490946 - RNA, 15 nt, Homo sapiens
ugcugagcauguacu

SEQ ID NO: 1490947 - RNA, 15 nt, Homo sapiens
ugcugaucgugcuaa

SEQ ID NO: 1490948 - RNA, 16 nt, Homo sapiens
ugcugauggcuugaca

SEQ ID NO: 1490949 - RNA, 19 nt, Homo sapiens
ugcugcacccaacuacuga

SEQ ID NO: 1490950 - RNA, 17 nt, Homo sapiens
ugcugcaccuggucaua

SEQ ID NO: 1490951 - RNA, 20 nt, Homo sapiens
ugcugcagacaaguggacag

SEQ ID NO: 1490952 - RNA, 13 nt, Homo sapiens
ugcugcagagaaa

SEQ ID NO: 1490953 - RNA, 23 nt, Homo sapiens
ugcugcaggccgugugucuguca

SEQ ID NO: 1490954 - RNA, 12 nt, Homo sapiens
ugcugccugaau

SEQ ID NO: 1490955 - RNA, 14 nt, Homo sapiens
ugcugcgcaccaau

SEQ ID NO: 1490956 - RNA, 10 nt, Homo sapiens
ugcugcuaug

SEQ ID NO: 1490957 - RNA, 18 nt, Homo sapiens
ugcugcuuuaauucauaa

SEQ ID NO: 1490958 - RNA, 19 nt, Homo sapiens
ugcuggagaggaacccaga

SEQ ID NO: 1490959 - RNA, 22 nt, Homo sapiens
ugcuggagagguuaaggugcaa

SEQ ID NO: 1490960 - RNA, 23 nt, Homo sapiens
ugcuggcagccauggccauggca

SEQ ID NO: 1490961 - RNA, 20 nt, Homo sapiens
ugcugggcacuucaucugau

SEQ ID NO: 1490962 - RNA, 19 nt, Homo sapiens
ugcuggguauaagcagaga

SEQ ID NO: 1490963 - RNA, 13 nt, Homo sapiens
ugcuguacccaga

SEQ ID NO: 1490964 - RNA, 14 nt, Homo sapiens
ugcuguaugcugau

SEQ ID NO: 1490965 - RNA, 20 nt, Homo sapiens
ugcuguguuuaaucagggga

SEQ ID NO: 1490966 - RNA, 16 nt, Homo sapiens
ugcuguuaacuguuaa

SEQ ID NO: 1490967 - RNA, 22 nt, Homo sapiens
ugcuguugucccucugcuacgu

SEQ ID NO: 1490968 - RNA, 16 nt, Homo sapiens
ugcuuaaacaaaguga

SEQ ID NO: 1490969 - RNA, 12 nt, Homo sapiens
ugcuuacauuuu

SEQ ID NO: 1490970 - RNA, 23 nt, Homo sapiens
ugcuuacuaagcuuugccagcug

SEQ ID NO: 1490971 - RNA, 17 nt, Homo sapiens
ugcuuagagacuaucaa

SEQ ID NO: 1490972 - RNA, 16 nt, Homo sapiens
ugcuuaguauugacaa

SEQ ID NO: 1490973 - RNA, 16 nt, Homo sapiens
ugcuucaguacuugug

SEQ ID NO: 1490974 - RNA, 14 nt, Homo sapiens
ugcuucaugcucag

SEQ ID NO: 1490975 - RNA, 16 nt, Homo sapiens
ugcuucauuccaaucu

SEQ ID NO: 1490976 - RNA, 19 nt, Homo sapiens
ugcuucauuguacuaccug

SEQ ID NO: 1490977 - RNA, 16 nt, Homo sapiens
ugcuuccugacaauca

SEQ ID NO: 1490978 - RNA, 13 nt, Homo sapiens
ugcuucuccauga

SEQ ID NO: 1490979 - RNA, 21 nt, Homo sapiens
ugcuugacaacaaccuaugca

SEQ ID NO: 1490980 - RNA, 19 nt, Homo sapiens
ugcuugaucauuauaucau

SEQ ID NO: 1490981 - RNA, 18 nt, Homo sapiens
ugcuugguuaaaauggcu

SEQ ID NO: 1490982 - RNA, 18 nt, Homo sapiens
ugcuuguaguuauaguga

SEQ ID NO: 1490983 - RNA, 12 nt, Homo sapiens
ugcuuguucccu

SEQ ID NO: 1490984 - RNA, 18 nt, Homo sapiens
ugcuuuagcacaggacaa

SEQ ID NO: 1490985 - RNA, 12 nt, Homo sapiens
ugcuuucaaguc

SEQ ID NO: 1490986 - RNA, 22 nt, Homo sapiens
ugcuuucaagucugacucucca

SEQ ID NO: 1490987 - RNA, 15 nt, Homo sapiens
ugcuuucaauuacaa

SEQ ID NO: 1490988 - RNA, 18 nt, Homo sapiens
ugcuuuccaucuccagga

SEQ ID NO: 1490989 - RNA, 16 nt, Homo sapiens
ugcuuucugaaauuca

SEQ ID NO: 1490990 - RNA, 16 nt, Homo sapiens
ugcuuugcugaccaaa

SEQ ID NO: 1490991 - RNA, 13 nt, Homo sapiens
ugcuuuucagggu

SEQ ID NO: 1490992 - RNA, 14 nt, Homo sapiens
ugcuuuucaggguu

SEQ ID NO: 1490993 - RNA, 18 nt, Homo sapiens
ugcuuuuguuccaauguc

SEQ ID NO: 1490994 - RNA, 16 nt, Homo sapiens
uggaaaaagucacauu

SEQ ID NO: 1490995 - RNA, 14 nt, Homo sapiens
uggaaaacuguguu

SEQ ID NO: 1490996 - RNA, 14 nt, Homo sapiens
uggaaaaggaagac

SEQ ID NO: 1490997 - RNA, 19 nt, Homo sapiens
uggaaaaggaagacuagag

SEQ ID NO: 1490998 - RNA, 14 nt, Homo sapiens
uggaaaaugugacc

SEQ ID NO: 1490999 - RNA, 16 nt, Homo sapiens
uggaaacaacauauua

SEQ ID NO: 1491000 - RNA, 17 nt, Homo sapiens
uggaaauaaacugugca

SEQ ID NO: 1491001 - RNA, 15 nt, Homo sapiens
uggaaauauguaaug

SEQ ID NO: 1491002 - RNA, 21 nt, Homo sapiens
uggaaaugaaacugcugugaa

SEQ ID NO: 1491003 - RNA, 17 nt, Homo sapiens
uggaacaagcacagaug

SEQ ID NO: 1491004 - RNA, 18 nt, Homo sapiens
uggaacagaagacagcug

SEQ ID NO: 1491005 - RNA, 20 nt, Homo sapiens
uggaacauauagaaugcaga

SEQ ID NO: 1491006 - RNA, 20 nt, Homo sapiens
uggaaccucagccuggccag

SEQ ID NO: 1491007 - RNA, 14 nt, Homo sapiens
uggaaccuugcugu

SEQ ID NO: 1491008 - RNA, 15 nt, Homo sapiens
uggaacuaaagcaaa

SEQ ID NO: 1491009 - RNA, 12 nt, Homo sapiens
uggaagaaggga

SEQ ID NO: 1491010 - RNA, 14 nt, Homo sapiens
uggaagaccuggac

SEQ ID NO: 1491011 - RNA, 16 nt, Homo sapiens
uggaagagcacaagag

SEQ ID NO: 1491012 - RNA, 13 nt, Homo sapiens
uggaagcaacagg

SEQ ID NO: 1491013 - RNA, 13 nt, Homo sapiens
uggaagcaguuuc

SEQ ID NO: 1491014 - RNA, 14 nt, Homo sapiens
uggaagcauacaaa

SEQ ID NO: 1491015 - RNA, 16 nt, Homo sapiens
uggaaggaacauggag

SEQ ID NO: 1491016 - RNA, 14 nt, Homo sapiens
uggaaguaaagccu

SEQ ID NO: 1491017 - RNA, 21 nt, Homo sapiens
uggaauauaaggaaagcaaua

SEQ ID NO: 1491018 - RNA, 20 nt, Homo sapiens
uggaauauaucaguaccucu

SEQ ID NO: 1491019 - RNA, 17 nt, Homo sapiens
uggaauccuauauagaa

SEQ ID NO: 1491020 - RNA, 17 nt, Homo sapiens
uggaaucuacaagccaa

SEQ ID NO: 1491021 - RNA, 19 nt, Homo sapiens
uggaaucuucucuuugaca

SEQ ID NO: 1491022 - RNA, 22 nt, Homo sapiens
uggaauuacaaaacucagagaa

SEQ ID NO: 1491023 - RNA, 20 nt, Homo sapiens
uggaauucuaacaagucaua

SEQ ID NO: 1491024 - RNA, 12 nt, Homo sapiens
uggaauucuucu

SEQ ID NO: 1491025 - RNA, 20 nt, Homo sapiens
uggaauuugccugcugggau

SEQ ID NO: 1491026 - RNA, 20 nt, Homo sapiens
uggacaaggagugugaccac

SEQ ID NO: 1491027 - RNA, 21 nt, Homo sapiens
uggacaagugcuguugggaua

SEQ ID NO: 1491028 - RNA, 22 nt, Homo sapiens
uggacaaucaugaaauaugcau

SEQ ID NO: 1491029 - RNA, 22 nt, Homo sapiens
uggacacucaaacacaucauaa

SEQ ID NO: 1491030 - RNA, 13 nt, Homo sapiens
uggacacugagag

SEQ ID NO: 1491031 - RNA, 12 nt, Homo sapiens
uggacagccagu

SEQ ID NO: 1491032 - RNA, 19 nt, Homo sapiens
uggacaggagucagugucu

SEQ ID NO: 1491033 - RNA, 14 nt, Homo sapiens
uggacauuugccuu

SEQ ID NO: 1491034 - RNA, 15 nt, Homo sapiens
uggaccaugccagau

SEQ ID NO: 1491035 - RNA, 17 nt, Homo sapiens
uggacccccacccugca

SEQ ID NO: 1491036 - RNA, 19 nt, Homo sapiens
uggaccuauguccuaagga

SEQ ID NO: 1491037 - RNA, 12 nt, Homo sapiens
uuuaagucucac

SEQ ID NO: 1491038 - RNA, 18 nt, Homo sapiens
uuuaagugcguguguaga

SEQ ID NO: 1491039 - RNA, 22 nt, Homo sapiens
uuuaauaaaugguuuauucugc

SEQ ID NO: 1491040 - RNA, 15 nt, Homo sapiens
uuuaauacaggguag

SEQ ID NO: 1491041 - RNA, 13 nt, Homo sapiens
uuuaaucagugaa

SEQ ID NO: 1491042 - RNA, 19 nt, Homo sapiens
uuuaauccuuaacacauuc

SEQ ID NO: 1491043 - RNA, 20 nt, Homo sapiens
uuuaauccuuaacacauuca

SEQ ID NO: 1491044 - RNA, 21 nt, Homo sapiens
uuuaaugaugccauggcaacu

SEQ ID NO: 1491045 - RNA, 14 nt, Homo sapiens
uuuaauuaaaucuc

SEQ ID NO: 1491046 - RNA, 16 nt, Homo sapiens
uuuacaaaagauguau

SEQ ID NO: 1491047 - RNA, 15 nt, Homo sapiens
uuuacacaaagggaa

SEQ ID NO: 1491048 - RNA, 19 nt, Homo sapiens
uuuacagauaucugaaugg

SEQ ID NO: 1491049 - RNA, 15 nt, Homo sapiens
uuuacagcaagaaca

SEQ ID NO: 1491050 - RNA, 18 nt, Homo sapiens
uuuacagugcuauuuacu

SEQ ID NO: 1491051 - RNA, 20 nt, Homo sapiens
uuuacauaucaccucauggc

SEQ ID NO: 1491052 - RNA, 10 nt, Homo sapiens
uuuacauuca

SEQ ID NO: 1491053 - RNA, 11 nt, Homo sapiens
uuuacauucau

SEQ ID NO: 1491054 - RNA, 14 nt, Homo sapiens
uuuacauucaucaa

SEQ ID NO: 1491055 - RNA, 14 nt, Homo sapiens
uuuacauucugcaa

SEQ ID NO: 1491056 - RNA, 10 nt, Homo sapiens
uuuacauuua

SEQ ID NO: 1491057 - RNA, 20 nt, Homo sapiens
uuuacccuauacauccacag

SEQ ID NO: 1491058 - RNA, 17 nt, Homo sapiens
uuuaccugagaccaguu

SEQ ID NO: 1491059 - RNA, 17 nt, Homo sapiens
uuuaccuuauguuuaau

SEQ ID NO: 1491060 - RNA, 18 nt, Homo sapiens
uuuagauaugacauuuau

SEQ ID NO: 1491061 - RNA, 18 nt, Homo sapiens
uuuagauuaaacaaacaa

SEQ ID NO: 1491062 - RNA, 18 nt, Homo sapiens
uuuagcagaggagccaug

SEQ ID NO: 1491063 - RNA, 23 nt, Homo sapiens
uuuagcauaguaccucugcuauu

SEQ ID NO: 1491064 - RNA, 21 nt, Homo sapiens
uuuaggugaauuaauuaaaca

SEQ ID NO: 1491065 - RNA, 23 nt, Homo sapiens
uuuagucaacaugccauaucuca

SEQ ID NO: 1491066 - RNA, 17 nt, Homo sapiens
uuuaguccuguacugua

SEQ ID NO: 1491067 - RNA, 16 nt, Homo sapiens
uuuauaaaauuuugcu

SEQ ID NO: 1491068 - RNA, 15 nt, Homo sapiens
uuuauaaccaugaga

SEQ ID NO: 1491069 - RNA, 14 nt, Homo sapiens
uuuauaauacccuu

SEQ ID NO: 1491070 - RNA, 19 nt, Homo sapiens
uuuauaggacgaaugccaa

SEQ ID NO: 1491071 - RNA, 14 nt, Homo sapiens
uuuauaucaugcaa

SEQ ID NO: 1491072 - RNA, 13 nt, Homo sapiens
uuuauauguugcu

SEQ ID NO: 1491073 - RNA, 13 nt, Homo sapiens
uuuaugagacagc

SEQ ID NO: 1491074 - RNA, 11 nt, Homo sapiens
uuuaugcacau

SEQ ID NO: 1491075 - RNA, 16 nt, Homo sapiens
uuuauuaccucugaua

SEQ ID NO: 1491076 - RNA, 18 nt, Homo sapiens
uuuauuauaugauuauca

SEQ ID NO: 1491077 - RNA, 17 nt, Homo sapiens
uuuauuaugcaaccagu

SEQ ID NO: 1491078 - RNA, 22 nt, Homo sapiens
uuuauuucugguaacucacuca

SEQ ID NO: 1491079 - RNA, 16 nt, Homo sapiens
uuucaaaaaaucugac

SEQ ID NO: 1491080 - RNA, 21 nt, Homo sapiens
uuucaaagagguauauuugaa

SEQ ID NO: 1491081 - RNA, 15 nt, Homo sapiens
uuucaaauuggcacu

SEQ ID NO: 1491082 - RNA, 19 nt, Homo sapiens
uuucaacugucuuccucaa

SEQ ID NO: 1491083 - RNA, 17 nt, Homo sapiens
uuucaacugugcucuug

SEQ ID NO: 1491084 - RNA, 12 nt, Homo sapiens
uuucaagucaaa

SEQ ID NO: 1491085 - RNA, 13 nt, Homo sapiens
uuucaauuacaaa

SEQ ID NO: 1491086 - RNA, 18 nt, Homo sapiens
uuucaauuugagauucua

SEQ ID NO: 1491087 - RNA, 12 nt, Homo sapiens
uuucacacuguc

SEQ ID NO: 1491088 - RNA, 21 nt, Homo sapiens
uuucacauuguuugcugcuau

SEQ ID NO: 1491089 - RNA, 20 nt, Homo sapiens
uuucaccccacagacacuua

SEQ ID NO: 1491090 - RNA, 21 nt, Homo sapiens
uuucaccuguuuuuaagcugu

SEQ ID NO: 1491091 - RNA, 20 nt, Homo sapiens
uuucacgcaugugugcugca

SEQ ID NO: 1491092 - RNA, 17 nt, Homo sapiens
uuucagaagcaagccag

SEQ ID NO: 1491093 - RNA, 18 nt, Homo sapiens
uuucaggaagacugacag

SEQ ID NO: 1491094 - RNA, 15 nt, Homo sapiens
uuucaguuuauuuga

SEQ ID NO: 1491095 - RNA, 18 nt, Homo sapiens
uuucauccaggccugcca

SEQ ID NO: 1491096 - RNA, 19 nt, Homo sapiens
uuucauccugacucugccc

SEQ ID NO: 1491097 - RNA, 14 nt, Homo sapiens
uuucauucauccca

SEQ ID NO: 1491098 - RNA, 17 nt, Homo sapiens
uuucauuuaauggggau

SEQ ID NO: 1491099 - RNA, 21 nt, Homo sapiens
uuucauuugguucauuaauuc

SEQ ID NO: 1491100 - RNA, 16 nt, Homo sapiens
uuuccaguguuuacaa

SEQ ID NO: 1491101 - RNA, 13 nt, Homo sapiens
uuuccauuuacua

SEQ ID NO: 1491102 - RNA, 17 nt, Homo sapiens
uuucccacgaggaaucu

SEQ ID NO: 1491103 - RNA, 16 nt, Homo sapiens
uuucccccgagcucuu

SEQ ID NO: 1491104 - RNA, 20 nt, Homo sapiens
uuuccgagccuccaguccaa

SEQ ID NO: 1491105 - RNA, 16 nt, Homo sapiens
uuuccucaccaggagc

SEQ ID NO: 1491106 - RNA, 16 nt, Homo sapiens
uuuccuuuaugugaau

SEQ ID NO: 1491107 - RNA, 15 nt, Homo sapiens
uuuccuuucugccac

SEQ ID NO: 1491108 - RNA, 16 nt, Homo sapiens
uuucgugcacucugcu

SEQ ID NO: 1491109 - RNA, 14 nt, Homo sapiens
uuucuaaaaacaca

SEQ ID NO: 1491110 - RNA, 22 nt, Homo sapiens
uuucuaagauacauauacugau

SEQ ID NO: 1491111 - RNA, 18 nt, Homo sapiens
uuucuaccuugaggucuu

SEQ ID NO: 1491112 - RNA, 21 nt, Homo sapiens
uuucuagaagcacauguguau

SEQ ID NO: 1491113 - RNA, 15 nt, Homo sapiens
uuucucaaaagcauu

SEQ ID NO: 1491114 - RNA, 13 nt, Homo sapiens
uuucucauuaaau

SEQ ID NO: 1491115 - RNA, 15 nt, Homo sapiens
uuucuccucuccauc

SEQ ID NO: 1491116 - RNA, 17 nt, Homo sapiens
uuucuccuuuuacuuca

SEQ ID NO: 1491117 - RNA, 13 nt, Homo sapiens
uuucucuaaugcu

SEQ ID NO: 1491118 - RNA, 15 nt, Homo sapiens
uuucugacacaguca

SEQ ID NO: 1491119 - RNA, 23 nt, Homo sapiens
uuucugacacagucaauucugau

SEQ ID NO: 1491120 - RNA, 22 nt, Homo sapiens
uuucuggaugaaugcccaguga

SEQ ID NO: 1491121 - RNA, 20 nt, Homo sapiens
uuucuggccaaaagcaguaa

SEQ ID NO: 1491122 - RNA, 15 nt, Homo sapiens
uuucuggccugccuu

SEQ ID NO: 1491123 - RNA, 12 nt, Homo sapiens
uuucugugaaua

SEQ ID NO: 1491124 - RNA, 14 nt, Homo sapiens
uuucuuacauuagc

SEQ ID NO: 1491125 - RNA, 19 nt, Homo sapiens
uuucuucuacaaccagagc

SEQ ID NO: 1491126 - RNA, 20 nt, Homo sapiens
uuucuugggguacucuugau

SEQ ID NO: 1491127 - RNA, 24 nt, Homo sapiens
uuucuuguuucaucguaaacauac

SEQ ID NO: 1491128 - RNA, 22 nt, Homo sapiens
uuucuuuaauaguuuugauccu

SEQ ID NO: 1491129 - RNA, 19 nt, Homo sapiens
uuucuuuaccugagaccag

SEQ ID NO: 1491130 - RNA, 18 nt, Homo sapiens
uuucuuuagcaugcuaca

SEQ ID NO: 1491131 - RNA, 17 nt, Homo sapiens
uuucuuuuccuucauuc

SEQ ID NO: 1491132 - RNA, 13 nt, Homo sapiens
uuugaaacaguug

SEQ ID NO: 1491133 - RNA, 13 nt, Homo sapiens
uuugaagcaaagc

SEQ ID NO: 1491134 - RNA, 20 nt, Homo sapiens
uuugaagcagucuugcucug

SEQ ID NO: 1491135 - RNA, 22 nt, Homo sapiens
uuugaagcuacuguguguguga

SEQ ID NO: 1491136 - RNA, 20 nt, Homo sapiens
uuugaaggcaaaauugcaaa

SEQ ID NO: 1491137 - RNA, 15 nt, Homo sapiens
uuugaaguccacuug

SEQ ID NO: 1491138 - RNA, 23 nt, Homo sapiens
uuugacuuugguuguguuuaaau

SEQ ID NO: 1491139 - RNA, 20 nt, Homo sapiens
uuugaggaacauuauuuaau

SEQ ID NO: 1491140 - RNA, 18 nt, Homo sapiens
ucuggcaucuuagaccuc

SEQ ID NO: 1491141 - RNA, 20 nt, Homo sapiens
ucuggcaucuuagaccucca

SEQ ID NO: 1491142 - RNA, 23 nt, Homo sapiens
ucuggccauauuuacuaccuuau

SEQ ID NO: 1491143 - RNA, 18 nt, Homo sapiens
ucuggcccucgacacuca

SEQ ID NO: 1491144 - RNA, 19 nt, Homo sapiens
ucuggcccuuacacacuca

SEQ ID NO: 1491145 - RNA, 15 nt, Homo sapiens
ucucagaagcacaga

SEQ ID NO: 1491146 - RNA, 20 nt, Homo sapiens
ucucagaccugcgcacucca

SEQ ID NO: 1491147 - RNA, 17 nt, Homo sapiens
ucucagagcauguguca

SEQ ID NO: 1491148 - RNA, 13 nt, Homo sapiens
aaaugaguauuuc

SEQ ID NO: 1491149 - RNA, 17 nt, Homo sapiens
aaaugaucgcuaucuag

SEQ ID NO: 1491150 - RNA, 17 nt, Homo sapiens
aaaugcaguccugagga

SEQ ID NO: 1491151 - RNA, 22 nt, Homo sapiens
aaaugccacguggucacugugc

SEQ ID NO: 1491152 - RNA, 16 nt, Homo sapiens
aaaugcccauuugccu

SEQ ID NO: 1491153 - RNA, 19 nt, Homo sapiens
aaaugccugguaccagagg

SEQ ID NO: 1491154 - RNA, 18 nt, Homo sapiens
aaaugcuguuaguaaauu

SEQ ID NO: 1491155 - RNA, 15 nt, Homo sapiens
aaaugcuucugcaca

SEQ ID NO: 1491156 - RNA, 16 nt, Homo sapiens
aaauggaaaguaacuc

SEQ ID NO: 1491157 - RNA, 16 nt, Homo sapiens
aaauggcaaaugcacu

SEQ ID NO: 1491158 - RNA, 20 nt, Homo sapiens
aaauggcuacacucaucuga

SEQ ID NO: 1491159 - RNA, 20 nt, Homo sapiens
aaaugggaguacugaugaaa

SEQ ID NO: 1491160 - RNA, 15 nt, Homo sapiens
aaauggguuacuuga

SEQ ID NO: 1491161 - RNA, 18 nt, Homo sapiens
aaaugguaggcauuuccu

SEQ ID NO: 1491162 - RNA, 14 nt, Homo sapiens
aaauggugcugcag

SEQ ID NO: 1491163 - RNA, 15 nt, Homo sapiens
aaauguacaacugca

SEQ ID NO: 1491164 - RNA, 22 nt, Homo sapiens
aaauguacucagcuaucagcuc

SEQ ID NO: 1491165 - RNA, 18 nt, Homo sapiens
aaauguagcgacugucaa

SEQ ID NO: 1491166 - RNA, 17 nt, Homo sapiens
aaauguagguaugaaua

SEQ ID NO: 1491167 - RNA, 17 nt, Homo sapiens
aaauguauacuauagua

SEQ ID NO: 1491168 - RNA, 13 nt, Homo sapiens
aaauguaugugcu

SEQ ID NO: 1491169 - RNA, 17 nt, Homo sapiens
aaauguaugugcucuua

SEQ ID NO: 1491170 - RNA, 14 nt, Homo sapiens
aaauguauuuuaca

SEQ ID NO: 1491171 - RNA, 19 nt, Homo sapiens
aaauguauuuugacacugg

SEQ ID NO: 1491172 - RNA, 22 nt, Homo sapiens
aaaugugaagggucaacuccaa

SEQ ID NO: 1491173 - RNA, 14 nt, Homo sapiens
aaaugugauacauu

SEQ ID NO: 1491174 - RNA, 19 nt, Homo sapiens
aaaugugcagcucccauuu

SEQ ID NO: 1491175 - RNA, 21 nt, Homo sapiens
aaauguuuuuaaaaaggucau

SEQ ID NO: 1491176 - RNA, 22 nt, Homo sapiens
aaauuaaagccuuuaguaucag

SEQ ID NO: 1491177 - RNA, 15 nt, Homo sapiens
aaauuaacacaaagg

SEQ ID NO: 1491178 - RNA, 17 nt, Homo sapiens
aaauuaauacugaagga

SEQ ID NO: 1491179 - RNA, 19 nt, Homo sapiens
aaauuacagcuucacccug

SEQ ID NO: 1491180 - RNA, 18 nt, Homo sapiens
aaauuacuggaaggcuuc

SEQ ID NO: 1491181 - RNA, 13 nt, Homo sapiens
aaauuacugugua

SEQ ID NO: 1491182 - RNA, 14 nt, Homo sapiens
aaauuacuguguaa

SEQ ID NO: 1491183 - RNA, 19 nt, Homo sapiens
aaauuagcugggcauggug

SEQ ID NO: 1491184 - RNA, 17 nt, Homo sapiens
aaauuaggacuguauaa

SEQ ID NO: 1491185 - RNA, 14 nt, Homo sapiens
aaauuauaguuuca

SEQ ID NO: 1491186 - RNA, 23 nt, Homo sapiens
aaauuauguuuuaaacacaugcc

SEQ ID NO: 1491187 - RNA, 22 nt, Homo sapiens
aaauuauugacgcuuaaccuuu

SEQ ID NO: 1491188 - RNA, 14 nt, Homo sapiens
aaauuauuugucau

SEQ ID NO: 1491189 - RNA, 23 nt, Homo sapiens
aaauuccagaagaagagaagcug

SEQ ID NO: 1491190 - RNA, 18 nt, Homo sapiens
aaauuccuacaacuuaau

SEQ ID NO: 1491191 - RNA, 15 nt, Homo sapiens
aaauucuaagccaua

SEQ ID NO: 1491192 - RNA, 24 nt, Homo sapiens
aaauucucagucaguaauugccaa

SEQ ID NO: 1491193 - RNA, 12 nt, Homo sapiens
aaauucuuucag

SEQ ID NO: 1491194 - RNA, 15 nt, Homo sapiens
aaauuuaaaauuacg

SEQ ID NO: 1491195 - RNA, 15 nt, Homo sapiens
aaauuuaucaaagca

SEQ ID NO: 1491196 - RNA, 17 nt, Homo sapiens
aaauuuauucacauaua

SEQ ID NO: 1491197 - RNA, 23 nt, Homo sapiens
aaauuucaccauugcugucaagu

SEQ ID NO: 1491198 - RNA, 23 nt, Homo sapiens
aauacugcuugaccguacucuca

SEQ ID NO: 1491199 - RNA, 20 nt, Homo sapiens
aauacuguaaaugcauugga

SEQ ID NO: 1491200 - RNA, 20 nt, Homo sapiens
aauacugugcauaagccauu

SEQ ID NO: 1491201 - RNA, 17 nt, Homo sapiens
aauagacugagucagau

SEQ ID NO: 1491202 - RNA, 22 nt, Homo sapiens
aauagacuuaaaucucauugcu

SEQ ID NO: 1491203 - RNA, 15 nt, Homo sapiens
aauagagacuguaga

SEQ ID NO: 1491204 - RNA, 18 nt, Homo sapiens
aauagaucuuagggugaa

SEQ ID NO: 1491205 - RNA, 15 nt, Homo sapiens
aauagauuucucaag

SEQ ID NO: 1491206 - RNA, 16 nt, Homo sapiens
aauagccacauuugga

SEQ ID NO: 1491207 - RNA, 16 nt, Homo sapiens
aauagcuaagcaucuc

SEQ ID NO: 1491208 - RNA, 18 nt, Homo sapiens
aauagcuauauccaugua

SEQ ID NO: 1491209 - RNA, 20 nt, Homo sapiens
aauagcuauauccauguacu

SEQ ID NO: 1491210 - RNA, 23 nt, Homo sapiens
aauaguaaaagauaacaagaucu

SEQ ID NO: 1491211 - RNA, 12 nt, Homo sapiens
aauaguaaucug

SEQ ID NO: 1491212 - RNA, 17 nt, Homo sapiens
aauaguaguuagcuuaa

SEQ ID NO: 1491213 - RNA, 13 nt, Homo sapiens
aauagucuucuca

SEQ ID NO: 1491214 - RNA, 15 nt, Homo sapiens
aauaguguucugcaa

SEQ ID NO: 1491215 - RNA, 22 nt, Homo sapiens
aauaguuuaacugaaaguuuaa

SEQ ID NO: 1491216 - RNA, 16 nt, Homo sapiens
aauaguuuacauguag

SEQ ID NO: 1491217 - RNA, 19 nt, Homo sapiens
aauaguuuugauccuaaau

SEQ ID NO: 1491218 - RNA, 14 nt, Homo sapiens
aauauaaaccgugg

SEQ ID NO: 1491219 - RNA, 19 nt, Homo sapiens
aauauaaaccguggucuca

SEQ ID NO: 1491220 - RNA, 20 nt, Homo sapiens
aauauaaauuuaucauuuag

SEQ ID NO: 1491221 - RNA, 12 nt, Homo sapiens
aauauaagccuu

SEQ ID NO: 1491222 - RNA, 22 nt, Homo sapiens
aauauaauuguaccaaccucau

SEQ ID NO: 1491223 - RNA, 12 nt, Homo sapiens
aauauacauuca

SEQ ID NO: 1491224 - RNA, 14 nt, Homo sapiens
aauauacauucaaa

SEQ ID NO: 1491225 - RNA, 17 nt, Homo sapiens
aauauauuccugagauu

SEQ ID NO: 1491226 - RNA, 19 nt, Homo sapiens
aauaucaugugcacuucaa

SEQ ID NO: 1491227 - RNA, 16 nt, Homo sapiens
aauaucccuacaugua

SEQ ID NO: 1491228 - RNA, 22 nt, Homo sapiens
aauaucccuacauguauugcac

SEQ ID NO: 1491229 - RNA, 12 nt, Homo sapiens
aauaucuaaaaa

SEQ ID NO: 1491230 - RNA, 19 nt, Homo sapiens
aauaucugggauucuacuu

SEQ ID NO: 1491231 - RNA, 15 nt, Homo sapiens
aauaucuugcuuuca

SEQ ID NO: 1491232 - RNA, 16 nt, Homo sapiens
aauaugaaucugcuca

SEQ ID NO: 1491233 - RNA, 22 nt, Homo sapiens
aauaugaguaauacaucaaaga

SEQ ID NO: 1491234 - RNA, 22 nt, Homo sapiens
aauaugggaaagacaugcagcu

SEQ ID NO: 1491235 - RNA, 13 nt, Homo sapiens
aauauuaaauaca

SEQ ID NO: 1491236 - RNA, 22 nt, Homo sapiens
aauauuagguugucacgaugaa

SEQ ID NO: 1491237 - RNA, 19 nt, Homo sapiens
aauauucuauaugaauuua

SEQ ID NO: 1491238 - RNA, 18 nt, Homo sapiens
aauauugucugccuuaaa

SEQ ID NO: 1491239 - RNA, 23 nt, Homo sapiens
aauauuguucuauuuguauauau

SEQ ID NO: 1491240 - RNA, 14 nt, Homo sapiens
aauauuguugacaa

SEQ ID NO: 1491241 - RNA, 18 nt, Homo sapiens
aauauuuaaacagcagug

SEQ ID NO: 1491242 - RNA, 20 nt, Homo sapiens
aauauuuaagacacugaaaa

SEQ ID NO: 1491243 - RNA, 20 nt, Homo sapiens
aauauuuaauggaaguguau

SEQ ID NO: 1491244 - RNA, 20 nt, Homo sapiens
aauauuuuguaacuauuaca

SEQ ID NO: 1491245 - RNA, 15 nt, Homo sapiens
aaucaaaacucacaa

SEQ ID NO: 1491246 - RNA, 14 nt, Homo sapiens
aaucaaacauauuc

SEQ ID NO: 1491247 - RNA, 18 nt, Homo sapiens
aaucaacaaaauggucau

SEQ ID NO: 1491248 - RNA, 13 nt, Homo sapiens
aauucagcacuga

SEQ ID NO: 1491249 - RNA, 19 nt, Homo sapiens
aauucagcacugauuucac

SEQ ID NO: 1491250 - RNA, 23 nt, Homo sapiens
aauucauucucugugguauccaa

SEQ ID NO: 1491251 - RNA, 11 nt, Homo sapiens
aauuccagcua

SEQ ID NO: 1491252 - RNA, 18 nt, Homo sapiens
aauuccaucccaucaucu

SEQ ID NO: 1491253 - RNA, 14 nt, Homo sapiens
aauucccaagcuuu

SEQ ID NO: 1491254 - RNA, 18 nt, Homo sapiens
aauucccauuuugcaaaa

SEQ ID NO: 1491255 - RNA, 13 nt, Homo sapiens
aauuccgcauuua

SEQ ID NO: 1491256 - RNA, 21 nt, Homo sapiens
aauuccuacaacuuaauggaa

SEQ ID NO: 1491257 - RNA, 20 nt, Homo sapiens
aauuccuacacucuugacua

SEQ ID NO: 1491258 - RNA, 13 nt, Homo sapiens
aauucuacuuuga

SEQ ID NO: 1491259 - RNA, 14 nt, Homo sapiens
aauucuacuuugag

SEQ ID NO: 1491260 - RNA, 15 nt, Homo sapiens
aauucuagagccagc

SEQ ID NO: 1491261 - RNA, 22 nt, Homo sapiens
aauucucagucaguaauugcca

SEQ ID NO: 1491262 - RNA, 20 nt, Homo sapiens
aauucuuauuuuuccuaaca

SEQ ID NO: 1491263 - RNA, 18 nt, Homo sapiens
aauucuuuaaaauuacaa

SEQ ID NO: 1491264 - RNA, 13 nt, Homo sapiens
aauugacaaugau

SEQ ID NO: 1491265 - RNA, 13 nt, Homo sapiens
aauugacaugugc

SEQ ID NO: 1491266 - RNA, 21 nt, Homo sapiens
aauugaccuuuugacuuaaag

SEQ ID NO: 1491267 - RNA, 15 nt, Homo sapiens
aauugacgacuucac

SEQ ID NO: 1491268 - RNA, 21 nt, Homo sapiens
aauugauucuuagacauugca

SEQ ID NO: 1491269 - RNA, 16 nt, Homo sapiens
aauugauuugcauuga

SEQ ID NO: 1491270 - RNA, 17 nt, Homo sapiens
aauugcucauaagcaau

SEQ ID NO: 1491271 - RNA, 19 nt, Homo sapiens
aauuggggggaggugcugu

SEQ ID NO: 1491272 - RNA, 19 nt, Homo sapiens
aauugugaacucauugcuc

SEQ ID NO: 1491273 - RNA, 23 nt, Homo sapiens
aauuguguugucuucagcaguca

SEQ ID NO: 1491274 - RNA, 15 nt, Homo sapiens
aauuuaaacagucuc

SEQ ID NO: 1491275 - RNA, 13 nt, Homo sapiens
aauuuaacugugu

SEQ ID NO: 1491276 - RNA, 12 nt, Homo sapiens
aauuuacuugau

SEQ ID NO: 1491277 - RNA, 13 nt, Homo sapiens
aauuuagcccuuu

SEQ ID NO: 1491278 - RNA, 22 nt, Homo sapiens
aauuuagugaucuuagcauagc

SEQ ID NO: 1491279 - RNA, 20 nt, Homo sapiens
aauuuauuucaaaaagggaa

SEQ ID NO: 1491280 - RNA, 20 nt, Homo sapiens
aauuucaaaaauauaacuua

SEQ ID NO: 1491281 - RNA, 15 nt, Homo sapiens
aauuucaaaccacac

SEQ ID NO: 1491282 - RNA, 18 nt, Homo sapiens
aauuucaauuucucccuu

SEQ ID NO: 1491283 - RNA, 12 nt, Homo sapiens
aauuucacaagc

SEQ ID NO: 1491284 - RNA, 16 nt, Homo sapiens
aauuucacaagcuauu

SEQ ID NO: 1491285 - RNA, 20 nt, Homo sapiens
aauuucaccaccaaaugcca

SEQ ID NO: 1491286 - RNA, 20 nt, Homo sapiens
aauuucauuaucaucaagca

SEQ ID NO: 1491287 - RNA, 12 nt, Homo sapiens
aauuuccagggu

SEQ ID NO: 1491288 - RNA, 23 nt, Homo sapiens
aauuuccaggguugcuugaucau

SEQ ID NO: 1491289 - RNA, 22 nt, Homo sapiens
aauuuccugaugcauauugccc

SEQ ID NO: 1491290 - RNA, 17 nt, Homo sapiens
aauuucuuaugugacau

SEQ ID NO: 1491291 - RNA, 14 nt, Homo sapiens
aauuugaaauuuag

SEQ ID NO: 1491292 - RNA, 15 nt, Homo sapiens
aauuugacaaaaccc

SEQ ID NO: 1491293 - RNA, 18 nt, Homo sapiens
aauuugacaaaacccacu

SEQ ID NO: 1491294 - RNA, 14 nt, Homo sapiens
aauuugauacauaa

SEQ ID NO: 1491295 - RNA, 19 nt, Homo sapiens
aauuuguaauugcuuacau

SEQ ID NO: 1491296 - RNA, 19 nt, Homo sapiens
aauuuuaaauuauaacuua

SEQ ID NO: 1491297 - RNA, 13 nt, Homo sapiens
aauuuuaauugaa

SEQ ID NO: 1491298 - RNA, 15 nt, Homo sapiens
aauuuuacuuaucau

SEQ ID NO: 1491299 - RNA, 20 nt, Homo sapiens
acacauugcauuuugauaaa

SEQ ID NO: 1491300 - RNA, 13 nt, Homo sapiens
acaccaaaccaaa

SEQ ID NO: 1491301 - RNA, 14 nt, Homo sapiens
acaccaaccgacag

SEQ ID NO: 1491302 - RNA, 14 nt, Homo sapiens
acaccagcagcccu

SEQ ID NO: 1491303 - RNA, 20 nt, Homo sapiens
acaccaggcugugggccuca

SEQ ID NO: 1491304 - RNA, 15 nt, Homo sapiens
acacccacagaagga

SEQ ID NO: 1491305 - RNA, 20 nt, Homo sapiens
acacccacccugugccauca

SEQ ID NO: 1491306 - RNA, 20 nt, Homo sapiens
acacccacucccuuccccau

SEQ ID NO: 1491307 - RNA, 19 nt, Homo sapiens
acacccagcccagcuugcc

SEQ ID NO: 1491308 - RNA, 13 nt, Homo sapiens
acacccaguggga

SEQ ID NO: 1491309 - RNA, 19 nt, Homo sapiens
acaccguacaucugcaaua

SEQ ID NO: 1491310 - RNA, 20 nt, Homo sapiens
acaccguguuuucugacaca

SEQ ID NO: 1491311 - RNA, 14 nt, Homo sapiens
acaccguucauuca

SEQ ID NO: 1491312 - RNA, 16 nt, Homo sapiens
acaccucaguucccuu

SEQ ID NO: 1491313 - RNA, 23 nt, Homo sapiens
acaccuccgagacaguccagugu

SEQ ID NO: 1491314 - RNA, 21 nt, Homo sapiens
acaccugggcaaacuuucuuc

SEQ ID NO: 1491315 - RNA, 15 nt, Homo sapiens
acaccuguaguccca

SEQ ID NO: 1491316 - RNA, 18 nt, Homo sapiens
acaccuguagucccagcu

SEQ ID NO: 1491317 - RNA, 20 nt, Homo sapiens
acaccuuuuccccaaccaca

SEQ ID NO: 1491318 - RNA, 21 nt, Homo sapiens
acacgaucaccugcaucacag

SEQ ID NO: 1491319 - RNA, 21 nt, Homo sapiens
acacgcccuccccagacucca

SEQ ID NO: 1491320 - RNA, 22 nt, Homo sapiens
acacgcccuccccagacuccac

SEQ ID NO: 1491321 - RNA, 22 nt, Homo sapiens
acacgccuaaggucacagcuag

SEQ ID NO: 1491322 - RNA, 14 nt, Homo sapiens
acacgcucaguuga

SEQ ID NO: 1491323 - RNA, 20 nt, Homo sapiens
acacggaggucucuguaaaa

SEQ ID NO: 1491324 - RNA, 16 nt, Homo sapiens
acacggaucugacaga

SEQ ID NO: 1491325 - RNA, 21 nt, Homo sapiens
acacggaugacuuaacugcau

SEQ ID NO: 1491326 - RNA, 17 nt, Homo sapiens
acacguaccucucauca

SEQ ID NO: 1491327 - RNA, 15 nt, Homo sapiens
acacuaaaaggugac

SEQ ID NO: 1491328 - RNA, 11 nt, Homo sapiens
acacuaaugca

SEQ ID NO: 1491329 - RNA, 12 nt, Homo sapiens
acacuaccccau

SEQ ID NO: 1491330 - RNA, 14 nt, Homo sapiens
acacuacugcuaaa

SEQ ID NO: 1491331 - RNA, 20 nt, Homo sapiens
acacuacugcuaaauccuca

SEQ ID NO: 1491332 - RNA, 20 nt, Homo sapiens
acacucacuccacaacccaa

SEQ ID NO: 1491333 - RNA, 15 nt, Homo sapiens
acacuccagugccag

SEQ ID NO: 1491334 - RNA, 22 nt, Homo sapiens
acacuccagugccagcaaugac

SEQ ID NO: 1491335 - RNA, 19 nt, Homo sapiens
acacugaaaaauauuccaa

SEQ ID NO: 1491336 - RNA, 17 nt, Homo sapiens
acacugaaguuaacaga

SEQ ID NO: 1491337 - RNA, 19 nt, Homo sapiens
acacugcaguuuccuggaa

SEQ ID NO: 1491338 - RNA, 18 nt, Homo sapiens
acacugcugcuccagugc

SEQ ID NO: 1491339 - RNA, 16 nt, Homo sapiens
acacuggugugaccug

SEQ ID NO: 1491340 - RNA, 19 nt, Homo sapiens
acacugugcccagcccgga

SEQ ID NO: 1491341 - RNA, 18 nt, Homo sapiens
acacuguuaucuucacuu

SEQ ID NO: 1491342 - RNA, 15 nt, Homo sapiens
acacuguucugaaag

SEQ ID NO: 1491343 - RNA, 15 nt, Homo sapiens
acacuuaaugauaca

SEQ ID NO: 1491344 - RNA, 15 nt, Homo sapiens
acacuuacacuuuau

SEQ ID NO: 1491345 - RNA, 16 nt, Homo sapiens
acacuuacagaauuau

SEQ ID NO: 1491346 - RNA, 19 nt, Homo sapiens
acacuucugugagaccccc

SEQ ID NO: 1491347 - RNA, 23 nt, Homo sapiens
acacuugugugugggcugugagu

SEQ ID NO: 1491348 - RNA, 23 nt, Homo sapiens
acacuuugcuccucuggcccaag

SEQ ID NO: 1491349 - RNA, 23 nt, Homo sapiens
acagaaaagacucugaccagaga

SEQ ID NO: 1491350 - RNA, 21 nt, Homo sapiens
acauaaguguugguagcacuu

SEQ ID NO: 1491351 - RNA, 22 nt, Homo sapiens
acauaaguguugguagcacuua

SEQ ID NO: 1491352 - RNA, 19 nt, Homo sapiens
acauacaggccauacuuua

SEQ ID NO: 1491353 - RNA, 16 nt, Homo sapiens
acauaccccacugggc

SEQ ID NO: 1491354 - RNA, 16 nt, Homo sapiens
acauacuccuuccauc

SEQ ID NO: 1491355 - RNA, 22 nt, Homo sapiens
acauacuuucauccugacucug

SEQ ID NO: 1491356 - RNA, 17 nt, Homo sapiens
acauauaucaaagugag

SEQ ID NO: 1491357 - RNA, 14 nt, Homo sapiens
acauaugacuugau

SEQ ID NO: 1491358 - RNA, 19 nt, Homo sapiens
acauaugauuucacuagaa

SEQ ID NO: 1491359 - RNA, 15 nt, Homo sapiens
acauaugugcuggaa

SEQ ID NO: 1491360 - RNA, 16 nt, Homo sapiens
acauauguugcaagac

SEQ ID NO: 1491361 - RNA, 23 nt, Homo sapiens
acauauuacuguugcauuuacuu

SEQ ID NO: 1491362 - RNA, 18 nt, Homo sapiens
acauauuguaaagcccau

SEQ ID NO: 1491363 - RNA, 18 nt, Homo sapiens
acaucaauccuuuaccac

SEQ ID NO: 1491364 - RNA, 19 nt, Homo sapiens
acauccaaagcagacagcu

SEQ ID NO: 1491365 - RNA, 14 nt, Homo sapiens
acauccagcccagg

SEQ ID NO: 1491366 - RNA, 15 nt, Homo sapiens
acauccagucacuuu

SEQ ID NO: 1491367 - RNA, 22 nt, Homo sapiens
acauccaucccuccauucaucc

SEQ ID NO: 1491368 - RNA, 15 nt, Homo sapiens
acauccucacuuugc

SEQ ID NO: 1491369 - RNA, 21 nt, Homo sapiens
acauccuguauaagcacugaa

SEQ ID NO: 1491370 - RNA, 17 nt, Homo sapiens
acaucuacaaucaggag

SEQ ID NO: 1491371 - RNA, 22 nt, Homo sapiens
acaucuauuuuggauuguauau

SEQ ID NO: 1491372 - RNA, 17 nt, Homo sapiens
acaucucaggggccaga

SEQ ID NO: 1491373 - RNA, 14 nt, Homo sapiens
acaucugagcagug

SEQ ID NO: 1491374 - RNA, 15 nt, Homo sapiens
acaucugcauuuuca

SEQ ID NO: 1491375 - RNA, 22 nt, Homo sapiens
acaucuggccuugaaaccaccu

SEQ ID NO: 1491376 - RNA, 23 nt, Homo sapiens
acaucuuggucagauuugaacuc

SEQ ID NO: 1491377 - RNA, 15 nt, Homo sapiens
acaucuuuaaacagu

SEQ ID NO: 1491378 - RNA, 22 nt, Homo sapiens
acaucuuugaccacgucaucgg

SEQ ID NO: 1491379 - RNA, 17 nt, Homo sapiens
acaucuuuuacauucug

SEQ ID NO: 1491380 - RNA, 15 nt, Homo sapiens
acaugaaaguuuugc

SEQ ID NO: 1491381 - RNA, 19 nt, Homo sapiens
acaugaacacuuuuuauca

SEQ ID NO: 1491382 - RNA, 13 nt, Homo sapiens
acaugaaugcagu

SEQ ID NO: 1491383 - RNA, 18 nt, Homo sapiens
acaugaaugcagucaugc

SEQ ID NO: 1491384 - RNA, 15 nt, Homo sapiens
acaugacaacuuugc

SEQ ID NO: 1491385 - RNA, 20 nt, Homo sapiens
acaugacccaggccuggcca

SEQ ID NO: 1491386 - RNA, 16 nt, Homo sapiens
acaugaggccaucuca

SEQ ID NO: 1491387 - RNA, 23 nt, Homo sapiens
acaugcacacacacacaucucau

SEQ ID NO: 1491388 - RNA, 15 nt, Homo sapiens
acaugcgaccgugac

SEQ ID NO: 1491389 - RNA, 22 nt, Homo sapiens
acaugcucaccucuagccuuaa

SEQ ID NO: 1491390 - RNA, 14 nt, Homo sapiens
acauggaacuuuag

SEQ ID NO: 1491391 - RNA, 18 nt, Homo sapiens
acauggaauaacauguaa

SEQ ID NO: 1491392 - RNA, 17 nt, Homo sapiens
acauggagcugucauca

SEQ ID NO: 1491393 - RNA, 18 nt, Homo sapiens
acauggucaaaauuucac

SEQ ID NO: 1491394 - RNA, 19 nt, Homo sapiens
acauguaguaguacuugaa

SEQ ID NO: 1491395 - RNA, 15 nt, Homo sapiens
acauguauugcacau

SEQ ID NO: 1491396 - RNA, 17 nt, Homo sapiens
acauguauugcacauug

SEQ ID NO: 1491397 - RNA, 18 nt, Homo sapiens
acauguauugcacauugu

SEQ ID NO: 1491398 - RNA, 15 nt, Homo sapiens
acauguggcaaaaua

SEQ ID NO: 1491399 - RNA, 18 nt, Homo sapiens
acauuaccuuacugugga

SEQ ID NO: 1491400 - RNA, 23 nt, Homo sapiens
acauuauagauuuucauguucuu

SEQ ID NO: 1491401 - RNA, 12 nt, Homo sapiens
accacucugucu

SEQ ID NO: 1491402 - RNA, 21 nt, Homo sapiens
accacucuucuuuaagccaua

SEQ ID NO: 1491403 - RNA, 11 nt, Homo sapiens
accacugcacu

SEQ ID NO: 1491404 - RNA, 17 nt, Homo sapiens
accagaagcauuucacc

SEQ ID NO: 1491405 - RNA, 12 nt, Homo sapiens
accagagcaguu

SEQ ID NO: 1491406 - RNA, 13 nt, Homo sapiens
accagagcugucu

SEQ ID NO: 1491407 - RNA, 16 nt, Homo sapiens
accagaggugcuucug

SEQ ID NO: 1491408 - RNA, 13 nt, Homo sapiens
accagcagcaugg

SEQ ID NO: 1491409 - RNA, 11 nt, Homo sapiens
accaggcuucu

SEQ ID NO: 1491410 - RNA, 22 nt, Homo sapiens
accaguaaaggcugcugcuaca

SEQ ID NO: 1491411 - RNA, 19 nt, Homo sapiens
accagugguuuccagucau

SEQ ID NO: 1491412 - RNA, 21 nt, Homo sapiens
accaguguagcauuggaucaa

SEQ ID NO: 1491413 - RNA, 23 nt, Homo sapiens
accaguguccccuccacugucac

SEQ ID NO: 1491414 - RNA, 15 nt, Homo sapiens
accaguuaugugaau

SEQ ID NO: 1491415 - RNA, 13 nt, Homo sapiens
accaguugcccua

SEQ ID NO: 1491416 - RNA, 14 nt, Homo sapiens
accauacugaggga

SEQ ID NO: 1491417 - RNA, 15 nt, Homo sapiens
accauaguaccauuu

SEQ ID NO: 1491418 - RNA, 17 nt, Homo sapiens
accaucagggacaggau

SEQ ID NO: 1491419 - RNA, 22 nt, Homo sapiens
accaucauuauaaacgugauga

SEQ ID NO: 1491420 - RNA, 16 nt, Homo sapiens
accaucccugauggca

SEQ ID NO: 1491421 - RNA, 23 nt, Homo sapiens
accaucuccccaggcuaugccau

SEQ ID NO: 1491422 - RNA, 14 nt, Homo sapiens
accaucuugcugac

SEQ ID NO: 1491423 - RNA, 11 nt, Homo sapiens
accaugaagcg

SEQ ID NO: 1491424 - RNA, 12 nt, Homo sapiens
accaugaaguca

SEQ ID NO: 1491425 - RNA, 22 nt, Homo sapiens
accaugagaccacuguuaucaa

SEQ ID NO: 1491426 - RNA, 20 nt, Homo sapiens
accauguacaugaagaagcu

SEQ ID NO: 1491427 - RNA, 16 nt, Homo sapiens
accauguauucaucca

SEQ ID NO: 1491428 - RNA, 18 nt, Homo sapiens
accaugugccaucuguac

SEQ ID NO: 1491429 - RNA, 19 nt, Homo sapiens
accauucagaucacugaau

SEQ ID NO: 1491430 - RNA, 20 nt, Homo sapiens
accauugcugucaaguuccu

SEQ ID NO: 1491431 - RNA, 23 nt, Homo sapiens
accauuugauagggaacugggga

SEQ ID NO: 1491432 - RNA, 19 nt, Homo sapiens
acccaaaucacaucucacc

SEQ ID NO: 1491433 - RNA, 23 nt, Homo sapiens
acccaacagcagugaucucaggg

SEQ ID NO: 1491434 - RNA, 17 nt, Homo sapiens
acccaacugacuuguau

SEQ ID NO: 1491435 - RNA, 16 nt, Homo sapiens
acccaagggcaggggc

SEQ ID NO: 1491436 - RNA, 19 nt, Homo sapiens
acccaaguugaagacuuug

SEQ ID NO: 1491437 - RNA, 20 nt, Homo sapiens
acccaaucugcacacuccag

SEQ ID NO: 1491438 - RNA, 11 nt, Homo sapiens
acccaccauug

SEQ ID NO: 1491439 - RNA, 12 nt, Homo sapiens
acccacccagga

SEQ ID NO: 1491440 - RNA, 16 nt, Homo sapiens
acccacccugugccau

SEQ ID NO: 1491441 - RNA, 23 nt, Homo sapiens
acccacucggauggaccaaccug

SEQ ID NO: 1491442 - RNA, 14 nt, Homo sapiens
acccacugacccac

SEQ ID NO: 1491443 - RNA, 15 nt, Homo sapiens
acccagaaaucauuu

SEQ ID NO: 1491444 - RNA, 19 nt, Homo sapiens
acccagaaaucauuuuacc

SEQ ID NO: 1491445 - RNA, 12 nt, Homo sapiens
acccagccaggc

SEQ ID NO: 1491446 - RNA, 18 nt, Homo sapiens
acccagcccagcuugcca

SEQ ID NO: 1491447 - RNA, 15 nt, Homo sapiens
acccagcuccagggg

SEQ ID NO: 1491448 - RNA, 18 nt, Homo sapiens
acccaggaccaagccaca

SEQ ID NO: 1491449 - RNA, 20 nt, Homo sapiens
acccaggacuuccauuugcu

SEQ ID NO: 1491450 - RNA, 18 nt, Homo sapiens
acccaggcccaugccaag

SEQ ID NO: 1491451 - RNA, 19 nt, Homo sapiens
acccagggaggaagacugu

SEQ ID NO: 1491452 - RNA, 22 nt, Homo sapiens
acccagggugugaacauguucu

SEQ ID NO: 1491453 - RNA, 16 nt, Homo sapiens
agauuuuuuauugcua

SEQ ID NO: 1491454 - RNA, 23 nt, Homo sapiens
agauuuuuuauugcuaguauuug

SEQ ID NO: 1491455 - RNA, 15 nt, Homo sapiens
agcaaaaggcagcuc

SEQ ID NO: 1491456 - RNA, 21 nt, Homo sapiens
agcaaaaggcagcucaccccu

SEQ ID NO: 1491457 - RNA, 17 nt, Homo sapiens
agcaaaaugcuucugca

SEQ ID NO: 1491458 - RNA, 13 nt, Homo sapiens
agcaaacaaguug

SEQ ID NO: 1491459 - RNA, 13 nt, Homo sapiens
agcaaacacuggg

SEQ ID NO: 1491460 - RNA, 12 nt, Homo sapiens
agcaaaccagcu

SEQ ID NO: 1491461 - RNA, 14 nt, Homo sapiens
agcaaagagugggc

SEQ ID NO: 1491462 - RNA, 15 nt, Homo sapiens
agcaaagcaaaacaa

SEQ ID NO: 1491463 - RNA, 21 nt, Homo sapiens
agcaaagcugaugacaacuuc

SEQ ID NO: 1491464 - RNA, 14 nt, Homo sapiens
agcaaaucuaugag

SEQ ID NO: 1491465 - RNA, 20 nt, Homo sapiens
agcaaauggcagaaccaaag

SEQ ID NO: 1491466 - RNA, 15 nt, Homo sapiens
agcaacacagaggaa

SEQ ID NO: 1491467 - RNA, 17 nt, Homo sapiens
agcaacccuaacaguaa

SEQ ID NO: 1491468 - RNA, 21 nt, Homo sapiens
agcaacucugagaucuaagga

SEQ ID NO: 1491469 - RNA, 13 nt, Homo sapiens
agcaacugaagac

SEQ ID NO: 1491470 - RNA, 13 nt, Homo sapiens
agcaacugugcaa

SEQ ID NO: 1491471 - RNA, 22 nt, Homo sapiens
agcaagaucccauggguugugu

SEQ ID NO: 1491472 - RNA, 15 nt, Homo sapiens
agcaagccagaccua

SEQ ID NO: 1491473 - RNA, 22 nt, Homo sapiens
agcaagcuuugguuuaugguuu

SEQ ID NO: 1491474 - RNA, 15 nt, Homo sapiens
agcaaggucauuucu

SEQ ID NO: 1491475 - RNA, 18 nt, Homo sapiens
agcaaguuacagugaugc

SEQ ID NO: 1491476 - RNA, 19 nt, Homo sapiens
agcaaguuucaucagucaa

SEQ ID NO: 1491477 - RNA, 23 nt, Homo sapiens
agcaauauuuauggaugcaacac

SEQ ID NO: 1491478 - RNA, 18 nt, Homo sapiens
agcaaugacaucucaggg

SEQ ID NO: 1491479 - RNA, 15 nt, Homo sapiens
agcaaugccauuuca

SEQ ID NO: 1491480 - RNA, 21 nt, Homo sapiens
agcaauggaguggcugccaug

SEQ ID NO: 1491481 - RNA, 14 nt, Homo sapiens
agcaauuucuaauu

SEQ ID NO: 1491482 - RNA, 22 nt, Homo sapiens
agcacaaacuuuaggguaaaaa

SEQ ID NO: 1491483 - RNA, 13 nt, Homo sapiens
agcacaagccaca

SEQ ID NO: 1491484 - RNA, 11 nt, Homo sapiens
agcacagccaa

SEQ ID NO: 1491485 - RNA, 21 nt, Homo sapiens
agcacaucuuugaccacguca

SEQ ID NO: 1491486 - RNA, 19 nt, Homo sapiens
agcaccacacccaguggga

SEQ ID NO: 1491487 - RNA, 22 nt, Homo sapiens
agcacccucuggauucugaauc

SEQ ID NO: 1491488 - RNA, 20 nt, Homo sapiens
agcaccgugucaagcugcuc

SEQ ID NO: 1491489 - RNA, 14 nt, Homo sapiens
agcaccugcucaac

SEQ ID NO: 1491490 - RNA, 13 nt, Homo sapiens
agcacgugucuca

SEQ ID NO: 1491491 - RNA, 24 nt, Homo sapiens
agcacgugucucagacugcaugua

SEQ ID NO: 1491492 - RNA, 12 nt, Homo sapiens
agcacucugaaa

SEQ ID NO: 1491493 - RNA, 11 nt, Homo sapiens
agcacugagca

SEQ ID NO: 1491494 - RNA, 14 nt, Homo sapiens
agcacuggguguga

SEQ ID NO: 1491495 - RNA, 19 nt, Homo sapiens
agcacuggugaacugagcu

SEQ ID NO: 1491496 - RNA, 17 nt, Homo sapiens
agcacugugagcaccug

SEQ ID NO: 1491497 - RNA, 20 nt, Homo sapiens
agcacuuagcaggcaccgcc

SEQ ID NO: 1491498 - RNA, 20 nt, Homo sapiens
agcacuuugggagacugaag

SEQ ID NO: 1491499 - RNA, 22 nt, Homo sapiens
agcacuuuuuggcugacuucau

SEQ ID NO: 1491500 - RNA, 23 nt, Homo sapiens
agcagaaaucuagaagacuguca

SEQ ID NO: 1491501 - RNA, 20 nt, Homo sapiens
agcagaacagaucuuuuacu

SEQ ID NO: 1491502 - RNA, 21 nt, Homo sapiens
agcagacucuggaggccugug

SEQ ID NO: 1491503 - RNA, 17 nt, Homo sapiens
agcagaggcggucuuca

SEQ ID NO: 1491504 - RNA, 21 nt, Homo sapiens
agcagaguguucccugacucc

SEQ ID NO: 1491505 - RNA, 12 nt, Homo sapiens
agccgcugugag

SEQ ID NO: 1491506 - RNA, 19 nt, Homo sapiens
agccgggguguaacuuccu

SEQ ID NO: 1491507 - RNA, 23 nt, Homo sapiens
agccuaaaguacagccuggacca

SEQ ID NO: 1491508 - RNA, 21 nt, Homo sapiens
agccuacuuucacacuaagaa

SEQ ID NO: 1491509 - RNA, 19 nt, Homo sapiens
agccuagaagagcuucuga

SEQ ID NO: 1491510 - RNA, 15 nt, Homo sapiens
agccuagcggagccc

SEQ ID NO: 1491511 - RNA, 21 nt, Homo sapiens
agccuaggaggacugggguaa

SEQ ID NO: 1491512 - RNA, 23 nt, Homo sapiens
agccucaagucuuauuuccucaa

SEQ ID NO: 1491513 - RNA, 24 nt, Homo sapiens
agccucaguuuccucaucugcaga

SEQ ID NO: 1491514 - RNA, 15 nt, Homo sapiens
agccuccacugccuc

SEQ ID NO: 1491515 - RNA, 19 nt, Homo sapiens
agccucccaaguagcugag

SEQ ID NO: 1491516 - RNA, 21 nt, Homo sapiens
agccucccccucagaugaucu

SEQ ID NO: 1491517 - RNA, 19 nt, Homo sapiens
agccucucgaagugcugag

SEQ ID NO: 1491518 - RNA, 16 nt, Homo sapiens
agccucuggcuagagg

SEQ ID NO: 1491519 - RNA, 17 nt, Homo sapiens
agccugaggcagccacu

SEQ ID NO: 1491520 - RNA, 18 nt, Homo sapiens
agccugcucuaaggcagu

SEQ ID NO: 1491521 - RNA, 14 nt, Homo sapiens
agccugcuuucaca

SEQ ID NO: 1491522 - RNA, 21 nt, Homo sapiens
agccuggcacagggcaguggg

SEQ ID NO: 1491523 - RNA, 18 nt, Homo sapiens
agccuggccaccagccau

SEQ ID NO: 1491524 - RNA, 20 nt, Homo sapiens
agccuggccagacacaggcc

SEQ ID NO: 1491525 - RNA, 21 nt, Homo sapiens
agccuggcugcccaucaugug

SEQ ID NO: 1491526 - RNA, 23 nt, Homo sapiens
agccuggcugguccucccauuuc

SEQ ID NO: 1491527 - RNA, 14 nt, Homo sapiens
agccugggcaacau

SEQ ID NO: 1491528 - RNA, 18 nt, Homo sapiens
agccugggcagcauagca

SEQ ID NO: 1491529 - RNA, 21 nt, Homo sapiens
agccugggcagcauagcaaga

SEQ ID NO: 1491530 - RNA, 13 nt, Homo sapiens
agccugggggcca

SEQ ID NO: 1491531 - RNA, 15 nt, Homo sapiens
agccuggugcugcug

SEQ ID NO: 1491532 - RNA, 21 nt, Homo sapiens
agccugugguuacagugcaga

SEQ ID NO: 1491533 - RNA, 21 nt, Homo sapiens
agccuuauuucuagaagcaca

SEQ ID NO: 1491534 - RNA, 13 nt, Homo sapiens
agccuuuccauaa

SEQ ID NO: 1491535 - RNA, 16 nt, Homo sapiens
agccuuuuauacugau

SEQ ID NO: 1491536 - RNA, 18 nt, Homo sapiens
agcggaggagaccagcuc

SEQ ID NO: 1491537 - RNA, 14 nt, Homo sapiens
agcggcuguucccc

SEQ ID NO: 1491538 - RNA, 18 nt, Homo sapiens
agcgucacggccaagugu

SEQ ID NO: 1491539 - RNA, 22 nt, Homo sapiens
agcgucacucuaccuaaugucu

SEQ ID NO: 1491540 - RNA, 19 nt, Homo sapiens
agcgucccagucucuggca

SEQ ID NO: 1491541 - RNA, 14 nt, Homo sapiens
agcgugugccacug

SEQ ID NO: 1491542 - RNA, 20 nt, Homo sapiens
agcguuuuuuaaauguauac

SEQ ID NO: 1491543 - RNA, 22 nt, Homo sapiens
agcuaaauuuucugaaacugca

SEQ ID NO: 1491544 - RNA, 16 nt, Homo sapiens
agcuaacuuauuuucc

SEQ ID NO: 1491545 - RNA, 17 nt, Homo sapiens
agcuaaguacacaauaa

SEQ ID NO: 1491546 - RNA, 12 nt, Homo sapiens
agcuaagugaaa

SEQ ID NO: 1491547 - RNA, 12 nt, Homo sapiens
agcuaauuugca

SEQ ID NO: 1491548 - RNA, 11 nt, Homo sapiens
agcuacagugu

SEQ ID NO: 1491549 - RNA, 23 nt, Homo sapiens
agcuaccagguguucuacacuca

SEQ ID NO: 1491550 - RNA, 16 nt, Homo sapiens
agcuaccucaaacuuc

SEQ ID NO: 1491551 - RNA, 13 nt, Homo sapiens
agcuacuaaugau

SEQ ID NO: 1491552 - RNA, 15 nt, Homo sapiens
agcuagugagcaaaa

SEQ ID NO: 1491553 - RNA, 17 nt, Homo sapiens
agcuaguggcuucaaaa

SEQ ID NO: 1491554 - RNA, 23 nt, Homo sapiens
aggcaaggaguuugagaccagcu

SEQ ID NO: 1491555 - RNA, 15 nt, Homo sapiens
aggcaagugggacca

SEQ ID NO: 1491556 - RNA, 18 nt, Homo sapiens
aggcaccucuuccuugau

SEQ ID NO: 1491557 - RNA, 14 nt, Homo sapiens
aggcacgaggcagu

SEQ ID NO: 1491558 - RNA, 14 nt, Homo sapiens
aggcagagaaucau

SEQ ID NO: 1491559 - RNA, 15 nt, Homo sapiens
aggcagaguuugccu

SEQ ID NO: 1491560 - RNA, 19 nt, Homo sapiens
aggcagaguuugccuuccu

SEQ ID NO: 1491561 - RNA, 21 nt, Homo sapiens
aggcagaguuugccuuccuuu

SEQ ID NO: 1491562 - RNA, 12 nt, Homo sapiens
aggcagaucugu

SEQ ID NO: 1491563 - RNA, 23 nt, Homo sapiens
aggcagaucugugccccaugccu

SEQ ID NO: 1491564 - RNA, 13 nt, Homo sapiens
aggcagccuccag

SEQ ID NO: 1491565 - RNA, 23 nt, Homo sapiens
aggcagcugguauauucagucuc

SEQ ID NO: 1491566 - RNA, 19 nt, Homo sapiens
aggcagcuucuacuccugc

SEQ ID NO: 1491567 - RNA, 20 nt, Homo sapiens
aggcaggagaacuacuugaa

SEQ ID NO: 1491568 - RNA, 20 nt, Homo sapiens
aggcaggagaaucacuggaa

SEQ ID NO: 1491569 - RNA, 17 nt, Homo sapiens
aggcaggagaaucucuu

SEQ ID NO: 1491570 - RNA, 20 nt, Homo sapiens
aggcaggaggauugcuugag

SEQ ID NO: 1491571 - RNA, 23 nt, Homo sapiens
aggcagggugagcuccagcugcu

SEQ ID NO: 1491572 - RNA, 16 nt, Homo sapiens
aggcagguccacagag

SEQ ID NO: 1491573 - RNA, 14 nt, Homo sapiens
aggcaguaaccaug

SEQ ID NO: 1491574 - RNA, 22 nt, Homo sapiens
aggcagugacagcagucaggga

SEQ ID NO: 1491575 - RNA, 18 nt, Homo sapiens
aggcagugauuagcacuu

SEQ ID NO: 1491576 - RNA, 13 nt, Homo sapiens
aggcagugucccu

SEQ ID NO: 1491577 - RNA, 17 nt, Homo sapiens
aggcaguuggccagaga

SEQ ID NO: 1491578 - RNA, 18 nt, Homo sapiens
aggcauacacacagcagu

SEQ ID NO: 1491579 - RNA, 19 nt, Homo sapiens
aggcauaggccugggugcu

SEQ ID NO: 1491580 - RNA, 20 nt, Homo sapiens
aggcaucauacuaaacuuca

SEQ ID NO: 1491581 - RNA, 13 nt, Homo sapiens
aggcaugcacauc

SEQ ID NO: 1491582 - RNA, 21 nt, Homo sapiens
aggcauggcuggggugggggu

SEQ ID NO: 1491583 - RNA, 21 nt, Homo sapiens
aggcauguagcuacaggacau

SEQ ID NO: 1491584 - RNA, 19 nt, Homo sapiens
aggccaagggccaagagaa

SEQ ID NO: 1491585 - RNA, 18 nt, Homo sapiens
aggccaauaaaaaguuca

SEQ ID NO: 1491586 - RNA, 21 nt, Homo sapiens
aggccaauaaaaaguucagag

SEQ ID NO: 1491587 - RNA, 20 nt, Homo sapiens
aggccacccccuauccucug

SEQ ID NO: 1491588 - RNA, 15 nt, Homo sapiens
aggccagaugcacau

SEQ ID NO: 1491589 - RNA, 22 nt, Homo sapiens
aggccagugccagcaccugccc

SEQ ID NO: 1491590 - RNA, 17 nt, Homo sapiens
aggccagugugucucug

SEQ ID NO: 1491591 - RNA, 16 nt, Homo sapiens
aggccauggugcacaa

SEQ ID NO: 1491592 - RNA, 17 nt, Homo sapiens
aggccauggugcacaaa

SEQ ID NO: 1491593 - RNA, 15 nt, Homo sapiens
aggcccaugccaagg

SEQ ID NO: 1491594 - RNA, 15 nt, Homo sapiens
aggcccccacuucuc

SEQ ID NO: 1491595 - RNA, 16 nt, Homo sapiens
aggcccugcugaguca

SEQ ID NO: 1491596 - RNA, 21 nt, Homo sapiens
aggcccuguccuaagcacuuu

SEQ ID NO: 1491597 - RNA, 20 nt, Homo sapiens
aggccgggcgcgguggcuca

SEQ ID NO: 1491598 - RNA, 14 nt, Homo sapiens
aggccgugccuugu

SEQ ID NO: 1491599 - RNA, 15 nt, Homo sapiens
aggccucaagaacaa

SEQ ID NO: 1491600 - RNA, 10 nt, Homo sapiens
aggccugaag

SEQ ID NO: 1491601 - RNA, 13 nt, Homo sapiens
aggccugaagcca

SEQ ID NO: 1491602 - RNA, 22 nt, Homo sapiens
aggccuggguuuguacuuccac

SEQ ID NO: 1491603 - RNA, 21 nt, Homo sapiens
aucaggcuauguauggaauac

SEQ ID NO: 1491604 - RNA, 21 nt, Homo sapiens
aucagggaaaaggaguaggga

SEQ ID NO: 1491605 - RNA, 15 nt, Homo sapiens
aucagucaacaacuu

SEQ ID NO: 1491606 - RNA, 13 nt, Homo sapiens
aucagucaugugu

SEQ ID NO: 1491607 - RNA, 18 nt, Homo sapiens
aucagucccccugugcau

SEQ ID NO: 1491608 - RNA, 16 nt, Homo sapiens
aucaguguaccauuug

SEQ ID NO: 1491609 - RNA, 20 nt, Homo sapiens
aucaguguccucuugcucaa

SEQ ID NO: 1491610 - RNA, 12 nt, Homo sapiens
aucaguugcuau

SEQ ID NO: 1491611 - RNA, 17 nt, Homo sapiens
aucaguuuccagucuca

SEQ ID NO: 1491612 - RNA, 16 nt, Homo sapiens
aucauaaaacuugaug

SEQ ID NO: 1491613 - RNA, 20 nt, Homo sapiens
aucauaauggauucacugag

SEQ ID NO: 1491614 - RNA, 23 nt, Homo sapiens
aucauauaauaaauguacauuaa

SEQ ID NO: 1491615 - RNA, 14 nt, Homo sapiens
aucauaugccugac

SEQ ID NO: 1491616 - RNA, 20 nt, Homo sapiens
aucaucaaagcucacaccaa

SEQ ID NO: 1491617 - RNA, 23 nt, Homo sapiens
aucaucacauugagcugauauaa

SEQ ID NO: 1491618 - RNA, 18 nt, Homo sapiens
aucauccugccuucaugg

SEQ ID NO: 1491619 - RNA, 14 nt, Homo sapiens
aucaugcauuguug

SEQ ID NO: 1491620 - RNA, 18 nt, Homo sapiens
aucaugcccugugcaacc

SEQ ID NO: 1491621 - RNA, 11 nt, Homo sapiens
aucauggaaua

SEQ ID NO: 1491622 - RNA, 14 nt, Homo sapiens
aucaugucauaaac

SEQ ID NO: 1491623 - RNA, 20 nt, Homo sapiens
aucaugugggugagccagug

SEQ ID NO: 1491624 - RNA, 14 nt, Homo sapiens
aucauuauaucauu

SEQ ID NO: 1491625 - RNA, 17 nt, Homo sapiens
aucauuccuucuggccu

SEQ ID NO: 1491626 - RNA, 13 nt, Homo sapiens
auccaacuuccaa

SEQ ID NO: 1491627 - RNA, 12 nt, Homo sapiens
auccaagaccug

SEQ ID NO: 1491628 - RNA, 15 nt, Homo sapiens
auccacacugcacac

SEQ ID NO: 1491629 - RNA, 15 nt, Homo sapiens
auccaccaccucccu

SEQ ID NO: 1491630 - RNA, 22 nt, Homo sapiens
auccagaaacuuguucuuccaa

SEQ ID NO: 1491631 - RNA, 14 nt, Homo sapiens
auccagaacagugg

SEQ ID NO: 1491632 - RNA, 14 nt, Homo sapiens
auccagaacugcac

SEQ ID NO: 1491633 - RNA, 18 nt, Homo sapiens
auccagagucaucucagc

SEQ ID NO: 1491634 - RNA, 13 nt, Homo sapiens
auccagcacuggu

SEQ ID NO: 1491635 - RNA, 14 nt, Homo sapiens
auccagcacuggug

SEQ ID NO: 1491636 - RNA, 19 nt, Homo sapiens
auccagccaugccugaggu

SEQ ID NO: 1491637 - RNA, 16 nt, Homo sapiens
auccagccucauaaag

SEQ ID NO: 1491638 - RNA, 19 nt, Homo sapiens
auccagccucccacaagaa

SEQ ID NO: 1491639 - RNA, 16 nt, Homo sapiens
auccagcuaugaauau

SEQ ID NO: 1491640 - RNA, 22 nt, Homo sapiens
auccagcucuugcucagugaag

SEQ ID NO: 1491641 - RNA, 16 nt, Homo sapiens
auccaggcagauccag

SEQ ID NO: 1491642 - RNA, 20 nt, Homo sapiens
auccaggccugccaagguga

SEQ ID NO: 1491643 - RNA, 14 nt, Homo sapiens
auccaggcuuugua

SEQ ID NO: 1491644 - RNA, 15 nt, Homo sapiens
auccagucuauucac

SEQ ID NO: 1491645 - RNA, 15 nt, Homo sapiens
auccauaaugcauuc

SEQ ID NO: 1491646 - RNA, 22 nt, Homo sapiens
auccauaggcgcaggugcacag

SEQ ID NO: 1491647 - RNA, 14 nt, Homo sapiens
auccauuaccucca

SEQ ID NO: 1491648 - RNA, 18 nt, Homo sapiens
auccauugaacuaaaaua

SEQ ID NO: 1491649 - RNA, 22 nt, Homo sapiens
auccauuugccuuucugggagc

SEQ ID NO: 1491650 - RNA, 13 nt, Homo sapiens
aucccaacuuccu

SEQ ID NO: 1491651 - RNA, 16 nt, Homo sapiens
aucccacccuggggac

SEQ ID NO: 1491652 - RNA, 20 nt, Homo sapiens
aucccagcagcccaagcuua

SEQ ID NO: 1491653 - RNA, 16 nt, Homo sapiens
aucccauggaaccacu

SEQ ID NO: 1491654 - RNA, 18 nt, Homo sapiens
aucuacccugcugaccuc

SEQ ID NO: 1491655 - RNA, 21 nt, Homo sapiens
aucuacuacaaacuucaaaga

SEQ ID NO: 1491656 - RNA, 14 nt, Homo sapiens
aucuagaagacugu

SEQ ID NO: 1491657 - RNA, 19 nt, Homo sapiens
aucuauagcuaaguacaca

SEQ ID NO: 1491658 - RNA, 19 nt, Homo sapiens
aucuaugagcugacaucuc

SEQ ID NO: 1491659 - RNA, 17 nt, Homo sapiens
aucucaaagaaggcauu

SEQ ID NO: 1491660 - RNA, 15 nt, Homo sapiens
aucucaauaacaaac

SEQ ID NO: 1491661 - RNA, 19 nt, Homo sapiens
aucucacuuaguccuuuau

SEQ ID NO: 1491662 - RNA, 15 nt, Homo sapiens
aucucagaugcaguu

SEQ ID NO: 1491663 - RNA, 12 nt, Homo sapiens
aucucagcacuu

SEQ ID NO: 1491664 - RNA, 14 nt, Homo sapiens
aucucagcacuuug

SEQ ID NO: 1491665 - RNA, 15 nt, Homo sapiens
aucucauuccacugu

SEQ ID NO: 1491666 - RNA, 22 nt, Homo sapiens
aucucauuuuacacaaagggaa

SEQ ID NO: 1491667 - RNA, 12 nt, Homo sapiens
aucuccaaggac

SEQ ID NO: 1491668 - RNA, 17 nt, Homo sapiens
aucuccauauguuacac

SEQ ID NO: 1491669 - RNA, 19 nt, Homo sapiens
aucuccaucauaugccuga

SEQ ID NO: 1491670 - RNA, 20 nt, Homo sapiens
aucuccaucauaugccugac

SEQ ID NO: 1491671 - RNA, 17 nt, Homo sapiens
aucucggcucacugcaa

SEQ ID NO: 1491672 - RNA, 19 nt, Homo sapiens
aucucggcuguuccugaga

SEQ ID NO: 1491673 - RNA, 19 nt, Homo sapiens
aucucuauuauaucuugua

SEQ ID NO: 1491674 - RNA, 14 nt, Homo sapiens
aucucucuccugua

SEQ ID NO: 1491675 - RNA, 14 nt, Homo sapiens
aucugaacucucaa

SEQ ID NO: 1491676 - RNA, 13 nt, Homo sapiens
aucugaccaaaac

SEQ ID NO: 1491677 - RNA, 21 nt, Homo sapiens
aucugagcugcagccuggcug

SEQ ID NO: 1491678 - RNA, 15 nt, Homo sapiens
aucugcacacuccag

SEQ ID NO: 1491679 - RNA, 23 nt, Homo sapiens
aucugcagaauaaugacugacuu

SEQ ID NO: 1491680 - RNA, 15 nt, Homo sapiens
aucugccacaaaaac

SEQ ID NO: 1491681 - RNA, 15 nt, Homo sapiens
aucugcugcauagcu

SEQ ID NO: 1491682 - RNA, 15 nt, Homo sapiens
aucuggaaccucagc

SEQ ID NO: 1491683 - RNA, 14 nt, Homo sapiens
aucuggaaggacau

SEQ ID NO: 1491684 - RNA, 17 nt, Homo sapiens
aucuggaaggacaucua

SEQ ID NO: 1491685 - RNA, 19 nt, Homo sapiens
aucugggcaaaugaaaaug

SEQ ID NO: 1491686 - RNA, 17 nt, Homo sapiens
aucuggguaucuuucca

SEQ ID NO: 1491687 - RNA, 16 nt, Homo sapiens
aucuggucccuugcag

SEQ ID NO: 1491688 - RNA, 16 nt, Homo sapiens
aucugucacaccagcc

SEQ ID NO: 1491689 - RNA, 14 nt, Homo sapiens
aucuguccaaggaa

SEQ ID NO: 1491690 - RNA, 17 nt, Homo sapiens
aucugugaugacauucc

SEQ ID NO: 1491691 - RNA, 23 nt, Homo sapiens
aucugugcacugcccauggacag

SEQ ID NO: 1491692 - RNA, 16 nt, Homo sapiens
aucuguggucuucaaa

SEQ ID NO: 1491693 - RNA, 20 nt, Homo sapiens
aucugugucaaaagccagau

SEQ ID NO: 1491694 - RNA, 19 nt, Homo sapiens
aucuguucuaacauguaau

SEQ ID NO: 1491695 - RNA, 15 nt, Homo sapiens
aucuguucuugcuac

SEQ ID NO: 1491696 - RNA, 13 nt, Homo sapiens
aucuuaaaacuaa

SEQ ID NO: 1491697 - RNA, 15 nt, Homo sapiens
aucuuaaagcauucc

SEQ ID NO: 1491698 - RNA, 14 nt, Homo sapiens
aucuuaaaugccag

SEQ ID NO: 1491699 - RNA, 16 nt, Homo sapiens
aucuuaagauccacaa

SEQ ID NO: 1491700 - RNA, 20 nt, Homo sapiens
aucuuagacccgguccugcc

SEQ ID NO: 1491701 - RNA, 23 nt, Homo sapiens
aucuuagcuucuauuauagccac

SEQ ID NO: 1491702 - RNA, 18 nt, Homo sapiens
aucuucaaacuuucacuu

SEQ ID NO: 1491703 - RNA, 13 nt, Homo sapiens
aucuucaacagac

SEQ ID NO: 1491704 - RNA, 15 nt, Homo sapiens
aucuucacugcaauu

SEQ ID NO: 1491705 - RNA, 17 nt, Homo sapiens
auguggauuugauucau

SEQ ID NO: 1491706 - RNA, 17 nt, Homo sapiens
augugguuacuuccuac

SEQ ID NO: 1491707 - RNA, 21 nt, Homo sapiens
augugucacuacucacagucu

SEQ ID NO: 1491708 - RNA, 21 nt, Homo sapiens
auguguccccucacucuguca

SEQ ID NO: 1491709 - RNA, 20 nt, Homo sapiens
augugugagaauaaacuaga

SEQ ID NO: 1491710 - RNA, 14 nt, Homo sapiens
auguguggacucaa

SEQ ID NO: 1491711 - RNA, 22 nt, Homo sapiens
auguguggcucagugccuggac

SEQ ID NO: 1491712 - RNA, 16 nt, Homo sapiens
auguguuaagugcagg

SEQ ID NO: 1491713 - RNA, 21 nt, Homo sapiens
auguguucauuaaagcaugaa

SEQ ID NO: 1491714 - RNA, 15 nt, Homo sapiens
auguuaaccaaugua

SEQ ID NO: 1491715 - RNA, 16 nt, Homo sapiens
auguuaaccaauguau

SEQ ID NO: 1491716 - RNA, 18 nt, Homo sapiens
auguuaauguuauaucau

SEQ ID NO: 1491717 - RNA, 14 nt, Homo sapiens
auguuauaucauau

SEQ ID NO: 1491718 - RNA, 14 nt, Homo sapiens
auguucagcacugu

SEQ ID NO: 1491719 - RNA, 21 nt, Homo sapiens
auguucauuguaauguuacug

SEQ ID NO: 1491720 - RNA, 13 nt, Homo sapiens
auguucuccauuu

SEQ ID NO: 1491721 - RNA, 13 nt, Homo sapiens
auguucuuuggaa

SEQ ID NO: 1491722 - RNA, 23 nt, Homo sapiens
auguucuuuuaaaugauugaauu

SEQ ID NO: 1491723 - RNA, 15 nt, Homo sapiens
auguugcucagucuc

SEQ ID NO: 1491724 - RNA, 16 nt, Homo sapiens
auguugggaaaguauu

SEQ ID NO: 1491725 - RNA, 21 nt, Homo sapiens
auguugggggggacccugccu

SEQ ID NO: 1491726 - RNA, 18 nt, Homo sapiens
auguuguaauucaugcca

SEQ ID NO: 1491727 - RNA, 16 nt, Homo sapiens
auguuuaccaguguag

SEQ ID NO: 1491728 - RNA, 12 nt, Homo sapiens
auguuuacuucu

SEQ ID NO: 1491729 - RNA, 15 nt, Homo sapiens
auguuuaugagccag

SEQ ID NO: 1491730 - RNA, 19 nt, Homo sapiens
auguuuauguucuuauaga

SEQ ID NO: 1491731 - RNA, 22 nt, Homo sapiens
auguuugcuauugacaagucau

SEQ ID NO: 1491732 - RNA, 23 nt, Homo sapiens
auguuugucuuuuaaugcuucau

SEQ ID NO: 1491733 - RNA, 17 nt, Homo sapiens
auguuuguggccucaga

SEQ ID NO: 1491734 - RNA, 22 nt, Homo sapiens
auguuuugucccauuuccuugg

SEQ ID NO: 1491735 - RNA, 16 nt, Homo sapiens
auuaaaacacuuucaa

SEQ ID NO: 1491736 - RNA, 17 nt, Homo sapiens
auuaaaacuaagcacaa

SEQ ID NO: 1491737 - RNA, 15 nt, Homo sapiens
auuaaaacuucuuaa

SEQ ID NO: 1491738 - RNA, 18 nt, Homo sapiens
auuaaaaucacucucagu

SEQ ID NO: 1491739 - RNA, 16 nt, Homo sapiens
auuaaagcauuuccua

SEQ ID NO: 1491740 - RNA, 19 nt, Homo sapiens
auuaacaaaugugcugcuu

SEQ ID NO: 1491741 - RNA, 22 nt, Homo sapiens
auuaaccucugcacuacugaca

SEQ ID NO: 1491742 - RNA, 14 nt, Homo sapiens
auuaagcacuuuaa

SEQ ID NO: 1491743 - RNA, 12 nt, Homo sapiens
auuaagcaugaa

SEQ ID NO: 1491744 - RNA, 14 nt, Homo sapiens
auuaagugacuaua

SEQ ID NO: 1491745 - RNA, 22 nt, Homo sapiens
auuaagugacuauagaaugcaa

SEQ ID NO: 1491746 - RNA, 14 nt, Homo sapiens
auuaaucaaaggca

SEQ ID NO: 1491747 - RNA, 17 nt, Homo sapiens
auuaaucaucuauaaag

SEQ ID NO: 1491748 - RNA, 18 nt, Homo sapiens
auuaaugccauuaucccu

SEQ ID NO: 1491749 - RNA, 19 nt, Homo sapiens
auuaauuccaacuguacuu

SEQ ID NO: 1491750 - RNA, 19 nt, Homo sapiens
auuacaaggcuuuaucuca

SEQ ID NO: 1491751 - RNA, 12 nt, Homo sapiens
auuacaggugug

SEQ ID NO: 1491752 - RNA, 18 nt, Homo sapiens
auuacauggggucuagaa

SEQ ID NO: 1491753 - RNA, 21 nt, Homo sapiens
auuaccacucaggcauuugac

SEQ ID NO: 1491754 - RNA, 16 nt, Homo sapiens
auuaccagacaaaaaa

SEQ ID NO: 1491755 - RNA, 18 nt, Homo sapiens
auucugagacauguguca

SEQ ID NO: 1491756 - RNA, 18 nt, Homo sapiens
auucugccacuccugaca

SEQ ID NO: 1491757 - RNA, 17 nt, Homo sapiens
auucuggaaaagcaaaa

SEQ ID NO: 1491758 - RNA, 20 nt, Homo sapiens
auucuggcccagggaaucca

SEQ ID NO: 1491759 - RNA, 23 nt, Homo sapiens
auucugggcuccuggaaccaauc

SEQ ID NO: 1491760 - RNA, 22 nt, Homo sapiens
auucugucacccagacuggagu

SEQ ID NO: 1491761 - RNA, 18 nt, Homo sapiens
auucuguuuauucuucca

SEQ ID NO: 1491762 - RNA, 22 nt, Homo sapiens
auucuuaaaauauauuucagau

SEQ ID NO: 1491763 - RNA, 21 nt, Homo sapiens
auucuucagcguaaaauggug

SEQ ID NO: 1491764 - RNA, 13 nt, Homo sapiens
auucuuccagaau

SEQ ID NO: 1491765 - RNA, 22 nt, Homo sapiens
auucuuccuaaugucagaacag

SEQ ID NO: 1491766 - RNA, 14 nt, Homo sapiens
auucuugaaugagg

SEQ ID NO: 1491767 - RNA, 20 nt, Homo sapiens
auucuuuuuuaauaaacuac

SEQ ID NO: 1491768 - RNA, 19 nt, Homo sapiens
auucuuuuuuuuuugucua

SEQ ID NO: 1491769 - RNA, 16 nt, Homo sapiens
auugaaagaaccagag

SEQ ID NO: 1491770 - RNA, 17 nt, Homo sapiens
auugaaaucaagcuuau

SEQ ID NO: 1491771 - RNA, 12 nt, Homo sapiens
auugaaguaaug

SEQ ID NO: 1491772 - RNA, 21 nt, Homo sapiens
auugaaugauuacuauaugca

SEQ ID NO: 1491773 - RNA, 12 nt, Homo sapiens
auugaaugcgcu

SEQ ID NO: 1491774 - RNA, 21 nt, Homo sapiens
auugaauuauauguucagauu

SEQ ID NO: 1491775 - RNA, 17 nt, Homo sapiens
auugacacacagcacuc

SEQ ID NO: 1491776 - RNA, 21 nt, Homo sapiens
auugacacacagcacucucua

SEQ ID NO: 1491777 - RNA, 22 nt, Homo sapiens
auugacgacuucacacuaugga

SEQ ID NO: 1491778 - RNA, 18 nt, Homo sapiens
auugacuauagugugagc

SEQ ID NO: 1491779 - RNA, 19 nt, Homo sapiens
auugagauaauaucuguga

SEQ ID NO: 1491780 - RNA, 18 nt, Homo sapiens
auugagcagaagaucaag

SEQ ID NO: 1491781 - RNA, 16 nt, Homo sapiens
auugagccaguggugc

SEQ ID NO: 1491782 - RNA, 20 nt, Homo sapiens
auugaguucgaggacuacaa

SEQ ID NO: 1491783 - RNA, 17 nt, Homo sapiens
auugauuuuuacuucaa

SEQ ID NO: 1491784 - RNA, 16 nt, Homo sapiens
auugcaccuggaugua

SEQ ID NO: 1491785 - RNA, 20 nt, Homo sapiens
auugcagauaacuuugacuu

SEQ ID NO: 1491786 - RNA, 23 nt, Homo sapiens
auugcaugcagugccggcugcca

SEQ ID NO: 1491787 - RNA, 15 nt, Homo sapiens
auugcauuuauaugu

SEQ ID NO: 1491788 - RNA, 16 nt, Homo sapiens
auugcccgaaaccaga

SEQ ID NO: 1491789 - RNA, 18 nt, Homo sapiens
auugccuaaaucuccagu

SEQ ID NO: 1491790 - RNA, 13 nt, Homo sapiens
auugcgcucucaa

SEQ ID NO: 1491791 - RNA, 22 nt, Homo sapiens
auugcuaugaaugauacccuga

SEQ ID NO: 1491792 - RNA, 19 nt, Homo sapiens
auugcuauuuauuuuuaca

SEQ ID NO: 1491793 - RNA, 17 nt, Homo sapiens
auugcucagagaaggaa

SEQ ID NO: 1491794 - RNA, 13 nt, Homo sapiens
auugcugccaaga

SEQ ID NO: 1491795 - RNA, 18 nt, Homo sapiens
auuggaaauuuguuauaa

SEQ ID NO: 1491796 - RNA, 15 nt, Homo sapiens
auuggaccuguucaa

SEQ ID NO: 1491797 - RNA, 20 nt, Homo sapiens
auuggaccuguucaaaaagg

SEQ ID NO: 1491798 - RNA, 22 nt, Homo sapiens
auuggagaauacuuugcuucau

SEQ ID NO: 1491799 - RNA, 23 nt, Homo sapiens
auuggcucccaagucacacccac

SEQ ID NO: 1491800 - RNA, 20 nt, Homo sapiens
auugggacaacagugcuuug

SEQ ID NO: 1491801 - RNA, 18 nt, Homo sapiens
auuggucauaacucagcc

SEQ ID NO: 1491802 - RNA, 13 nt, Homo sapiens
auuguaacgacuu

SEQ ID NO: 1491803 - RNA, 14 nt, Homo sapiens
auuguacauaaaag

SEQ ID NO: 1491804 - RNA, 23 nt, Homo sapiens
auugucauggggaucaauuuuca

SEQ ID NO: 1491805 - RNA, 20 nt, Homo sapiens
auugucccugaaugcuccau

SEQ ID NO: 1491806 - RNA, 18 nt, Homo sapiens
caccaggcacugcugcac

SEQ ID NO: 1491807 - RNA, 14 nt, Homo sapiens
caccaucugauuaa

SEQ ID NO: 1491808 - RNA, 15 nt, Homo sapiens
caccaucugauuaaa

SEQ ID NO: 1491809 - RNA, 23 nt, Homo sapiens
caccauggcaccuuuugcacaua

SEQ ID NO: 1491810 - RNA, 16 nt, Homo sapiens
caccauguauucaucc

SEQ ID NO: 1491811 - RNA, 21 nt, Homo sapiens
cacccaaguugaagacuuugu

SEQ ID NO: 1491812 - RNA, 24 nt, Homo sapiens
cacccacgugcauucacauugacc

SEQ ID NO: 1491813 - RNA, 15 nt, Homo sapiens
cacccacuuugucca

SEQ ID NO: 1491814 - RNA, 20 nt, Homo sapiens
cacccaggcuggaguacagc

SEQ ID NO: 1491815 - RNA, 20 nt, Homo sapiens
cacccaggcuggagugcagu

SEQ ID NO: 1491816 - RNA, 20 nt, Homo sapiens
cacccagugggaagagugug

SEQ ID NO: 1491817 - RNA, 20 nt, Homo sapiens
cacccaguuugauaccugca

SEQ ID NO: 1491818 - RNA, 14 nt, Homo sapiens
cacccaugugccaa

SEQ ID NO: 1491819 - RNA, 18 nt, Homo sapiens
caccccacccucccugga

SEQ ID NO: 1491820 - RNA, 19 nt, Homo sapiens
cacccccaccauccaggug

SEQ ID NO: 1491821 - RNA, 22 nt, Homo sapiens
cacccccacccaccuccaccca

SEQ ID NO: 1491822 - RNA, 16 nt, Homo sapiens
caccccucacucuggc

SEQ ID NO: 1491823 - RNA, 13 nt, Homo sapiens
caccccucugcca

SEQ ID NO: 1491824 - RNA, 16 nt, Homo sapiens
cacccgacuccucaaa

SEQ ID NO: 1491825 - RNA, 17 nt, Homo sapiens
cacccgacuccucaaaa

SEQ ID NO: 1491826 - RNA, 15 nt, Homo sapiens
cacccgggaacuuuu

SEQ ID NO: 1491827 - RNA, 22 nt, Homo sapiens
cacccucacacacacagcuggg

SEQ ID NO: 1491828 - RNA, 18 nt, Homo sapiens
cacccuccaccucuucac

SEQ ID NO: 1491829 - RNA, 17 nt, Homo sapiens
cacccuccaugcuccuc

SEQ ID NO: 1491830 - RNA, 20 nt, Homo sapiens
cacccuccugccccacacuc

SEQ ID NO: 1491831 - RNA, 18 nt, Homo sapiens
cacccucuccuccagugu

SEQ ID NO: 1491832 - RNA, 18 nt, Homo sapiens
cacccugcauuacaugug

SEQ ID NO: 1491833 - RNA, 21 nt, Homo sapiens
cacccuggaggauuucaucuc

SEQ ID NO: 1491834 - RNA, 15 nt, Homo sapiens
cacccugggagacag

SEQ ID NO: 1491835 - RNA, 20 nt, Homo sapiens
cacccuguagguucuugaua

SEQ ID NO: 1491836 - RNA, 21 nt, Homo sapiens
cacccuuccccuccuucuccc

SEQ ID NO: 1491837 - RNA, 15 nt, Homo sapiens
caccgacaacaugcu

SEQ ID NO: 1491838 - RNA, 15 nt, Homo sapiens
caccgcagucaccac

SEQ ID NO: 1491839 - RNA, 18 nt, Homo sapiens
caccgcugccagcacaga

SEQ ID NO: 1491840 - RNA, 17 nt, Homo sapiens
caccguucugugcacaa

SEQ ID NO: 1491841 - RNA, 12 nt, Homo sapiens
caccuaauccag

SEQ ID NO: 1491842 - RNA, 16 nt, Homo sapiens
caccuacauuaucuca

SEQ ID NO: 1491843 - RNA, 22 nt, Homo sapiens
caccuaccaucagggacaggau

SEQ ID NO: 1491844 - RNA, 23 nt, Homo sapiens
caccucacacuccuccaaggcac

SEQ ID NO: 1491845 - RNA, 13 nt, Homo sapiens
caccucauccuua

SEQ ID NO: 1491846 - RNA, 11 nt, Homo sapiens
caccuccucau

SEQ ID NO: 1491847 - RNA, 16 nt, Homo sapiens
caccuccucauguaca

SEQ ID NO: 1491848 - RNA, 14 nt, Homo sapiens
caccuccuggagaa

SEQ ID NO: 1491849 - RNA, 22 nt, Homo sapiens
caccucucuccuuugcugaggc

SEQ ID NO: 1491850 - RNA, 14 nt, Homo sapiens
caccucuuccuuga

SEQ ID NO: 1491851 - RNA, 15 nt, Homo sapiens
caccugcaugugcug

SEQ ID NO: 1491852 - RNA, 22 nt, Homo sapiens
caccugccugcaucugugaaaa

SEQ ID NO: 1491853 - RNA, 12 nt, Homo sapiens
caccugccuugg

SEQ ID NO: 1491854 - RNA, 22 nt, Homo sapiens
caccugcguguccccgugcagu

SEQ ID NO: 1491855 - RNA, 16 nt, Homo sapiens
caccugcuucugaacu

SEQ ID NO: 1491856 - RNA, 22 nt, Homo sapiens
cagaaaauauuauguguuucca

SEQ ID NO: 1491857 - RNA, 16 nt, Homo sapiens
cagaaaauguucuguu

SEQ ID NO: 1491858 - RNA, 13 nt, Homo sapiens
cagaaaauucugu

SEQ ID NO: 1491859 - RNA, 19 nt, Homo sapiens
cagaaacaguucaccuuga

SEQ ID NO: 1491860 - RNA, 22 nt, Homo sapiens
cagaaaccugcagggacuccau

SEQ ID NO: 1491861 - RNA, 22 nt, Homo sapiens
cagaaacuagaaaugugaauga

SEQ ID NO: 1491862 - RNA, 20 nt, Homo sapiens
cagaaacuugugaaguggaa

SEQ ID NO: 1491863 - RNA, 20 nt, Homo sapiens
cagaaagagacuccgucuca

SEQ ID NO: 1491864 - RNA, 16 nt, Homo sapiens
cagaaagcauccuaaa

SEQ ID NO: 1491865 - RNA, 18 nt, Homo sapiens
cagaaaguggccaugcca

SEQ ID NO: 1491866 - RNA, 19 nt, Homo sapiens
cagaaaguggccaugccac

SEQ ID NO: 1491867 - RNA, 23 nt, Homo sapiens
cagaaauauaugcagcugugaua

SEQ ID NO: 1491868 - RNA, 16 nt, Homo sapiens
cagaaauccugcaaug

SEQ ID NO: 1491869 - RNA, 19 nt, Homo sapiens
cagaaaucuagaagacugu

SEQ ID NO: 1491870 - RNA, 21 nt, Homo sapiens
cagaaaugucuaaaugcugaa

SEQ ID NO: 1491871 - RNA, 20 nt, Homo sapiens
cagaacaagaccccgucuca

SEQ ID NO: 1491872 - RNA, 21 nt, Homo sapiens
cagaacagagugcaacccagu

SEQ ID NO: 1491873 - RNA, 19 nt, Homo sapiens
cagaacagcuucagguuau

SEQ ID NO: 1491874 - RNA, 22 nt, Homo sapiens
cagaacagggucauguuugcag

SEQ ID NO: 1491875 - RNA, 20 nt, Homo sapiens
cagaacaucgauauguauau

SEQ ID NO: 1491876 - RNA, 16 nt, Homo sapiens
cagaaccaaagcucaa

SEQ ID NO: 1491877 - RNA, 16 nt, Homo sapiens
cagaacccaucccucu

SEQ ID NO: 1491878 - RNA, 12 nt, Homo sapiens
cagaacuacuuc

SEQ ID NO: 1491879 - RNA, 20 nt, Homo sapiens
cagaacuuaaggauggagcc

SEQ ID NO: 1491880 - RNA, 22 nt, Homo sapiens
cagaagacccgcucuccaucuu

SEQ ID NO: 1491881 - RNA, 13 nt, Homo sapiens
cagaagaucugaa

SEQ ID NO: 1491882 - RNA, 15 nt, Homo sapiens
cagaagcauuucacc

SEQ ID NO: 1491883 - RNA, 13 nt, Homo sapiens
cagaaggacucag

SEQ ID NO: 1491884 - RNA, 16 nt, Homo sapiens
cagaagggaauugcuc

SEQ ID NO: 1491885 - RNA, 19 nt, Homo sapiens
cagaaguagcuuugcacuu

SEQ ID NO: 1491886 - RNA, 19 nt, Homo sapiens
cagaaguauuucuguggau

SEQ ID NO: 1491887 - RNA, 18 nt, Homo sapiens
cagaaguauuuucuaguu

SEQ ID NO: 1491888 - RNA, 14 nt, Homo sapiens
cagaaguccagagu

SEQ ID NO: 1491889 - RNA, 12 nt, Homo sapiens
cagaagugcaau

SEQ ID NO: 1491890 - RNA, 12 nt, Homo sapiens
cagaauccagcu

SEQ ID NO: 1491891 - RNA, 15 nt, Homo sapiens
cagaaucucaaauaa

SEQ ID NO: 1491892 - RNA, 18 nt, Homo sapiens
cagaaugcugcaggacuu

SEQ ID NO: 1491893 - RNA, 17 nt, Homo sapiens
cagaauuuccacuguaa

SEQ ID NO: 1491894 - RNA, 19 nt, Homo sapiens
cagacacacacacacacaa

SEQ ID NO: 1491895 - RNA, 22 nt, Homo sapiens
cagacacacacacgcacgcaca

SEQ ID NO: 1491896 - RNA, 23 nt, Homo sapiens
cagacacugaccauccacucuac

SEQ ID NO: 1491897 - RNA, 12 nt, Homo sapiens
cagacagagauu

SEQ ID NO: 1491898 - RNA, 20 nt, Homo sapiens
cagacauacauuucucauac

SEQ ID NO: 1491899 - RNA, 20 nt, Homo sapiens
cagacaucggccuccaugac

SEQ ID NO: 1491900 - RNA, 17 nt, Homo sapiens
cagacaugccacaagga

SEQ ID NO: 1491901 - RNA, 20 nt, Homo sapiens
cagacauucauugucccuga

SEQ ID NO: 1491902 - RNA, 18 nt, Homo sapiens
cagaccacagagcuguca

SEQ ID NO: 1491903 - RNA, 22 nt, Homo sapiens
cagacccagaggauaagccacu

SEQ ID NO: 1491904 - RNA, 11 nt, Homo sapiens
cagacccagug

SEQ ID NO: 1491905 - RNA, 16 nt, Homo sapiens
cagacgggaggggaaa

SEQ ID NO: 1491906 - RNA, 16 nt, Homo sapiens
cagacggugugcacca

SEQ ID NO: 1491907 - RNA, 21 nt, Homo sapiens
cagccaaccucauugcagcua

SEQ ID NO: 1491908 - RNA, 17 nt, Homo sapiens
cagccacgaggugcaac

SEQ ID NO: 1491909 - RNA, 22 nt, Homo sapiens
cagccacuucggccaggucaca

SEQ ID NO: 1491910 - RNA, 15 nt, Homo sapiens
cagccagauggcccc

SEQ ID NO: 1491911 - RNA, 16 nt, Homo sapiens
cagccaggacaucucu

SEQ ID NO: 1491912 - RNA, 14 nt, Homo sapiens
cagccaggccgaga

SEQ ID NO: 1491913 - RNA, 14 nt, Homo sapiens
cagccaggcugcca

SEQ ID NO: 1491914 - RNA, 13 nt, Homo sapiens
cagccagugccau

SEQ ID NO: 1491915 - RNA, 18 nt, Homo sapiens
cagccagugccauuccac

SEQ ID NO: 1491916 - RNA, 15 nt, Homo sapiens
cagccaucaaauagu

SEQ ID NO: 1491917 - RNA, 22 nt, Homo sapiens
cagccaugcaaugccaaauaau

SEQ ID NO: 1491918 - RNA, 13 nt, Homo sapiens
cagcccagagcca

SEQ ID NO: 1491919 - RNA, 22 nt, Homo sapiens
cagcccagcccuccucugucaa

SEQ ID NO: 1491920 - RNA, 16 nt, Homo sapiens
cagcccaggacucuaa

SEQ ID NO: 1491921 - RNA, 14 nt, Homo sapiens
cagcccaugugcac

SEQ ID NO: 1491922 - RNA, 15 nt, Homo sapiens
cagcccaugugcacc

SEQ ID NO: 1491923 - RNA, 18 nt, Homo sapiens
cagccccggcaagccaca

SEQ ID NO: 1491924 - RNA, 14 nt, Homo sapiens
cagcccugcugcag

SEQ ID NO: 1491925 - RNA, 20 nt, Homo sapiens
cagccuacuuucacacuaag

SEQ ID NO: 1491926 - RNA, 18 nt, Homo sapiens
cagccuagacauccaggu

SEQ ID NO: 1491927 - RNA, 17 nt, Homo sapiens
cagccuccccgugccaa

SEQ ID NO: 1491928 - RNA, 19 nt, Homo sapiens
cagccucccuaguagcugg

SEQ ID NO: 1491929 - RNA, 12 nt, Homo sapiens
cagccugaaccc

SEQ ID NO: 1491930 - RNA, 18 nt, Homo sapiens
cagccugggcaacagagc

SEQ ID NO: 1491931 - RNA, 20 nt, Homo sapiens
cagccugggcaacagagcaa

SEQ ID NO: 1491932 - RNA, 19 nt, Homo sapiens
cagccugggcagcauagca

SEQ ID NO: 1491933 - RNA, 23 nt, Homo sapiens
cagccugucccauggacacucca

SEQ ID NO: 1491934 - RNA, 22 nt, Homo sapiens
cagccugugguuacagugcaga

SEQ ID NO: 1491935 - RNA, 23 nt, Homo sapiens
cagccuugccagagauccaaaag

SEQ ID NO: 1491936 - RNA, 23 nt, Homo sapiens
cagccuuuggccuuggcuuuucu

SEQ ID NO: 1491937 - RNA, 20 nt, Homo sapiens
cagcgcagcuggacucugca

SEQ ID NO: 1491938 - RNA, 21 nt, Homo sapiens
cagcgccaggcugaccacagc

SEQ ID NO: 1491939 - RNA, 15 nt, Homo sapiens
cagcgggagcacugc

SEQ ID NO: 1491940 - RNA, 14 nt, Homo sapiens
cagcgggugcugcu

SEQ ID NO: 1491941 - RNA, 21 nt, Homo sapiens
cagcggucagauagcaucaga

SEQ ID NO: 1491942 - RNA, 18 nt, Homo sapiens
cagcgucacucuaccuaa

SEQ ID NO: 1491943 - RNA, 12 nt, Homo sapiens
cagcuacucaga

SEQ ID NO: 1491944 - RNA, 17 nt, Homo sapiens
cagcuaucugcacucua

SEQ ID NO: 1491945 - RNA, 23 nt, Homo sapiens
cagcuauuuucaacauaacugaa

SEQ ID NO: 1491946 - RNA, 22 nt, Homo sapiens
cagcucagcuucuuccuagguc

SEQ ID NO: 1491947 - RNA, 12 nt, Homo sapiens
cagcucaugcca

SEQ ID NO: 1491948 - RNA, 14 nt, Homo sapiens
cagcugaacagcca

SEQ ID NO: 1491949 - RNA, 16 nt, Homo sapiens
cagcugacccggccuc

SEQ ID NO: 1491950 - RNA, 15 nt, Homo sapiens
cagcugaggacacac

SEQ ID NO: 1491951 - RNA, 19 nt, Homo sapiens
cagcuggaagggucaacau

SEQ ID NO: 1491952 - RNA, 14 nt, Homo sapiens
cagcuggcucugac

SEQ ID NO: 1491953 - RNA, 13 nt, Homo sapiens
cagcugggagcac

SEQ ID NO: 1491954 - RNA, 13 nt, Homo sapiens
cagcugggcagca

SEQ ID NO: 1491955 - RNA, 20 nt, Homo sapiens
cagcuguccacugggccauu

SEQ ID NO: 1491956 - RNA, 16 nt, Homo sapiens
cagcuguccugcagca

SEQ ID NO: 1491957 - RNA, 19 nt, Homo sapiens
caggugaaaauccaucuca

SEQ ID NO: 1491958 - RNA, 21 nt, Homo sapiens
caggugauucgcccaccucag

SEQ ID NO: 1491959 - RNA, 17 nt, Homo sapiens
caggugccuucccagac

SEQ ID NO: 1491960 - RNA, 16 nt, Homo sapiens
cagguggagggcacag

SEQ ID NO: 1491961 - RNA, 22 nt, Homo sapiens
cagguggccccaguucaaucuc

SEQ ID NO: 1491962 - RNA, 13 nt, Homo sapiens
caggugggcugua

SEQ ID NO: 1491963 - RNA, 14 nt, Homo sapiens
caggugggugcugc

SEQ ID NO: 1491964 - RNA, 13 nt, Homo sapiens
caggugguugugg

SEQ ID NO: 1491965 - RNA, 17 nt, Homo sapiens
cagguguguguggaccc

SEQ ID NO: 1491966 - RNA, 22 nt, Homo sapiens
cagguguucuacacucaucuua

SEQ ID NO: 1491967 - RNA, 14 nt, Homo sapiens
cagguguugccaaa

SEQ ID NO: 1491968 - RNA, 21 nt, Homo sapiens
cagguuccuuaucugucacac

SEQ ID NO: 1491969 - RNA, 16 nt, Homo sapiens
cagguuuagacaguau

SEQ ID NO: 1491970 - RNA, 19 nt, Homo sapiens
cagguuuugaaaauguaca

SEQ ID NO: 1491971 - RNA, 15 nt, Homo sapiens
caguaaaaauggaaa

SEQ ID NO: 1491972 - RNA, 16 nt, Homo sapiens
caguaaaauacuauug

SEQ ID NO: 1491973 - RNA, 19 nt, Homo sapiens
caguaaaauacuauugccu

SEQ ID NO: 1491974 - RNA, 22 nt, Homo sapiens
caguaagagguguuauuuggaa

SEQ ID NO: 1491975 - RNA, 14 nt, Homo sapiens
caguacuuuuauua

SEQ ID NO: 1491976 - RNA, 18 nt, Homo sapiens
caguagaaauaauaugca

SEQ ID NO: 1491977 - RNA, 12 nt, Homo sapiens
caguagacagaa

SEQ ID NO: 1491978 - RNA, 19 nt, Homo sapiens
caguagagcaaaucuauga

SEQ ID NO: 1491979 - RNA, 23 nt, Homo sapiens
caguagagcaaaucuaugagauu

SEQ ID NO: 1491980 - RNA, 19 nt, Homo sapiens
caguaggggcuacugugac

SEQ ID NO: 1491981 - RNA, 21 nt, Homo sapiens
caguauaggccaucaauauca

SEQ ID NO: 1491982 - RNA, 20 nt, Homo sapiens
caguauauuuauagucacaa

SEQ ID NO: 1491983 - RNA, 20 nt, Homo sapiens
caguauccacaauagcugac

SEQ ID NO: 1491984 - RNA, 20 nt, Homo sapiens
caguauccaggcuuuguaca

SEQ ID NO: 1491985 - RNA, 22 nt, Homo sapiens
caguaucuacuugcauguguau

SEQ ID NO: 1491986 - RNA, 22 nt, Homo sapiens
caguaugagucaaugugcagug

SEQ ID NO: 1491987 - RNA, 16 nt, Homo sapiens
caguauucucagagca

SEQ ID NO: 1491988 - RNA, 21 nt, Homo sapiens
caguauuucauugccugugua

SEQ ID NO: 1491989 - RNA, 17 nt, Homo sapiens
caguauuuuguguccuc

SEQ ID NO: 1491990 - RNA, 13 nt, Homo sapiens
cagucaauucuga

SEQ ID NO: 1491991 - RNA, 12 nt, Homo sapiens
cagucaccacca

SEQ ID NO: 1491992 - RNA, 17 nt, Homo sapiens
cagucaccuaugugguc

SEQ ID NO: 1491993 - RNA, 15 nt, Homo sapiens
cagucacugacucaa

SEQ ID NO: 1491994 - RNA, 22 nt, Homo sapiens
cagucaguuugcacaacaagau

SEQ ID NO: 1491995 - RNA, 21 nt, Homo sapiens
cagucauaacuaaauaaagcu

SEQ ID NO: 1491996 - RNA, 14 nt, Homo sapiens
cagucaucuacuuu

SEQ ID NO: 1491997 - RNA, 16 nt, Homo sapiens
caguccaauaggugua

SEQ ID NO: 1491998 - RNA, 17 nt, Homo sapiens
cagucccagacaauucc

SEQ ID NO: 1491999 - RNA, 18 nt, Homo sapiens
caguccucauuuacugga

SEQ ID NO: 1492000 - RNA, 23 nt, Homo sapiens
caguccuggagggaguggguuaa

SEQ ID NO: 1492001 - RNA, 20 nt, Homo sapiens
cagucgaugcguucacucca

SEQ ID NO: 1492002 - RNA, 21 nt, Homo sapiens
cagucgaugcguucacuccaa

SEQ ID NO: 1492003 - RNA, 17 nt, Homo sapiens
cagucggccccaucucu

SEQ ID NO: 1492004 - RNA, 14 nt, Homo sapiens
cagucuauucacag

SEQ ID NO: 1492005 - RNA, 14 nt, Homo sapiens
cagugaaagccaga

SEQ ID NO: 1492006 - RNA, 19 nt, Homo sapiens
cagugaagaugcaaucaga

SEQ ID NO: 1492007 - RNA, 17 nt, Homo sapiens
cagugaagaugccagug

SEQ ID NO: 1492008 - RNA, 15 nt, Homo sapiens
auggaacucagagau

SEQ ID NO: 1492009 - RNA, 21 nt, Homo sapiens
auggaaggaagaaaagcugcc

SEQ ID NO: 1492010 - RNA, 23 nt, Homo sapiens
auggaaguugcagugagcugaua

SEQ ID NO: 1492011 - RNA, 17 nt, Homo sapiens
auggaaugcuguguuaa

SEQ ID NO: 1492012 - RNA, 14 nt, Homo sapiens
auggaauuacaugu

SEQ ID NO: 1492013 - RNA, 16 nt, Homo sapiens
auggaauugauuugca

SEQ ID NO: 1492014 - RNA, 12 nt, Homo sapiens
auggacaacuua

SEQ ID NO: 1492015 - RNA, 14 nt, Homo sapiens
auggacagcgauga

SEQ ID NO: 1492016 - RNA, 18 nt, Homo sapiens
auggaccagugguuucca

SEQ ID NO: 1492017 - RNA, 17 nt, Homo sapiens
auggacucuguggugcc

SEQ ID NO: 1492018 - RNA, 23 nt, Homo sapiens
auggacuggagcucaucugcaaa

SEQ ID NO: 1492019 - RNA, 21 nt, Homo sapiens
auggagacaagggcaucaucu

SEQ ID NO: 1492020 - RNA, 17 nt, Homo sapiens
auggagcaggacucuau

SEQ ID NO: 1492021 - RNA, 17 nt, Homo sapiens
auggagcaugaauggua

SEQ ID NO: 1492022 - RNA, 14 nt, Homo sapiens
auggaggcccuccu

SEQ ID NO: 1492023 - RNA, 16 nt, Homo sapiens
auggaguauaugucaa

SEQ ID NO: 1492024 - RNA, 22 nt, Homo sapiens
auggauaaaauaaugcugcaaa

SEQ ID NO: 1492025 - RNA, 17 nt, Homo sapiens
auggaucuuaaagcauu

SEQ ID NO: 1492026 - RNA, 17 nt, Homo sapiens
auggaugggggaacuca

SEQ ID NO: 1492027 - RNA, 17 nt, Homo sapiens
auggcaauuucacugau

SEQ ID NO: 1492028 - RNA, 20 nt, Homo sapiens
auggcaccuuuugcacauaa

SEQ ID NO: 1492029 - RNA, 15 nt, Homo sapiens
auggcagaaccaaag

SEQ ID NO: 1492030 - RNA, 21 nt, Homo sapiens
auggcagaagggaauugcuca

SEQ ID NO: 1492031 - RNA, 12 nt, Homo sapiens
auggcaguauuu

SEQ ID NO: 1492032 - RNA, 13 nt, Homo sapiens
auggccacuguga

SEQ ID NO: 1492033 - RNA, 15 nt, Homo sapiens
auggcuaaauacaau

SEQ ID NO: 1492034 - RNA, 14 nt, Homo sapiens
auggcuccagaaau

SEQ ID NO: 1492035 - RNA, 19 nt, Homo sapiens
auggcugcccaggagacag

SEQ ID NO: 1492036 - RNA, 16 nt, Homo sapiens
auggcuguguuugcag

SEQ ID NO: 1492037 - RNA, 22 nt, Homo sapiens
auggcuuaauguuuauuccuga

SEQ ID NO: 1492038 - RNA, 19 nt, Homo sapiens
augggacucauuguagaaa

SEQ ID NO: 1492039 - RNA, 14 nt, Homo sapiens
augggagcuccucu

SEQ ID NO: 1492040 - RNA, 17 nt, Homo sapiens
augggagcuuaacuuua

SEQ ID NO: 1492041 - RNA, 14 nt, Homo sapiens
augggcacuugaga

SEQ ID NO: 1492042 - RNA, 18 nt, Homo sapiens
augggcuucacuguauaa

SEQ ID NO: 1492043 - RNA, 16 nt, Homo sapiens
auggggacacagauca

SEQ ID NO: 1492044 - RNA, 21 nt, Homo sapiens
auggggacacagaucauggua

SEQ ID NO: 1492045 - RNA, 13 nt, Homo sapiens
auggggccagauc

SEQ ID NO: 1492046 - RNA, 19 nt, Homo sapiens
auggguaugcucaggucaa

SEQ ID NO: 1492047 - RNA, 13 nt, Homo sapiens
auggguccagggc

SEQ ID NO: 1492048 - RNA, 18 nt, Homo sapiens
auggguccauuuugcccu

SEQ ID NO: 1492049 - RNA, 22 nt, Homo sapiens
augggucuggcugagcugaacc

SEQ ID NO: 1492050 - RNA, 22 nt, Homo sapiens
augggugcuuaguaaguacuua

SEQ ID NO: 1492051 - RNA, 16 nt, Homo sapiens
augguaaauccuuuug

SEQ ID NO: 1492052 - RNA, 15 nt, Homo sapiens
augguacuacaacca

SEQ ID NO: 1492053 - RNA, 21 nt, Homo sapiens
augguacuaguguuuuuuaga

SEQ ID NO: 1492054 - RNA, 20 nt, Homo sapiens
augguauggaacucucucca

SEQ ID NO: 1492055 - RNA, 16 nt, Homo sapiens
auggugaaugaaguca

SEQ ID NO: 1492056 - RNA, 19 nt, Homo sapiens
augguggcgcaugccugua

SEQ ID NO: 1492057 - RNA, 20 nt, Homo sapiens
augguggcgcaugccuguag

SEQ ID NO: 1492058 - RNA, 14 nt, Homo sapiens
cauauguacauaaa

SEQ ID NO: 1492059 - RNA, 17 nt, Homo sapiens
cauauguaccauguaca

SEQ ID NO: 1492060 - RNA, 19 nt, Homo sapiens
cauauguugcucagucucc

SEQ ID NO: 1492061 - RNA, 13 nt, Homo sapiens
cauauuaucucau

SEQ ID NO: 1492062 - RNA, 18 nt, Homo sapiens
caucaaagaacaaacauc

SEQ ID NO: 1492063 - RNA, 21 nt, Homo sapiens
caucaaagcucacaccaaauu

SEQ ID NO: 1492064 - RNA, 19 nt, Homo sapiens
caucaauuggaaaucaauc

SEQ ID NO: 1492065 - RNA, 12 nt, Homo sapiens
caucacaacauu

SEQ ID NO: 1492066 - RNA, 16 nt, Homo sapiens
caucacagcagccucc

SEQ ID NO: 1492067 - RNA, 14 nt, Homo sapiens
caucacuuugccaa

SEQ ID NO: 1492068 - RNA, 19 nt, Homo sapiens
caucagacugucaagaaga

SEQ ID NO: 1492069 - RNA, 18 nt, Homo sapiens
caucagagccagucucac

SEQ ID NO: 1492070 - RNA, 15 nt, Homo sapiens
caucagauaagacau

SEQ ID NO: 1492071 - RNA, 12 nt, Homo sapiens
caucagcaaaca

SEQ ID NO: 1492072 - RNA, 15 nt, Homo sapiens
caucagggacaggau

SEQ ID NO: 1492073 - RNA, 16 nt, Homo sapiens
caucagucaacaacuu

SEQ ID NO: 1492074 - RNA, 14 nt, Homo sapiens
caucauaauggacu

SEQ ID NO: 1492075 - RNA, 23 nt, Homo sapiens
caucauggaggucauacaugcau

SEQ ID NO: 1492076 - RNA, 15 nt, Homo sapiens
cauccaacacuggau

SEQ ID NO: 1492077 - RNA, 13 nt, Homo sapiens
cauccagugacaa

SEQ ID NO: 1492078 - RNA, 14 nt, Homo sapiens
cauccagugacaaa

SEQ ID NO: 1492079 - RNA, 15 nt, Homo sapiens
cauccauaccagcuc

SEQ ID NO: 1492080 - RNA, 14 nt, Homo sapiens
cauccaucuuucca

SEQ ID NO: 1492081 - RNA, 17 nt, Homo sapiens
cauccaucuuuccaucc

SEQ ID NO: 1492082 - RNA, 24 nt, Homo sapiens
cauccaucuuuccauccauuaccu

SEQ ID NO: 1492083 - RNA, 18 nt, Homo sapiens
caucccacgcuugcuuua

SEQ ID NO: 1492084 - RNA, 17 nt, Homo sapiens
caucccuuuuucugcua

SEQ ID NO: 1492085 - RNA, 20 nt, Homo sapiens
cauccuggccaacaugguga

SEQ ID NO: 1492086 - RNA, 21 nt, Homo sapiens
cauccuguauaagcacugaaa

SEQ ID NO: 1492087 - RNA, 13 nt, Homo sapiens
cauccugugccac

SEQ ID NO: 1492088 - RNA, 23 nt, Homo sapiens
cauccuuaaaacaauucugugac

SEQ ID NO: 1492089 - RNA, 11 nt, Homo sapiens
cauccuuccaa

SEQ ID NO: 1492090 - RNA, 15 nt, Homo sapiens
cauccuuucuuuuaa

SEQ ID NO: 1492091 - RNA, 22 nt, Homo sapiens
cauccuuucuuuuaaugaugcc

SEQ ID NO: 1492092 - RNA, 16 nt, Homo sapiens
caucggccuccaugac

SEQ ID NO: 1492093 - RNA, 12 nt, Homo sapiens
caucgggagcac

SEQ ID NO: 1492094 - RNA, 19 nt, Homo sapiens
caucuaauaaguauauaau

SEQ ID NO: 1492095 - RNA, 17 nt, Homo sapiens
caucuacccugcugacc

SEQ ID NO: 1492096 - RNA, 21 nt, Homo sapiens
caucuacccugcugaccuccc

SEQ ID NO: 1492097 - RNA, 21 nt, Homo sapiens
caucuauuuuggauuguauau

SEQ ID NO: 1492098 - RNA, 21 nt, Homo sapiens
caucucagaaaacucugguaa

SEQ ID NO: 1492099 - RNA, 15 nt, Homo sapiens
caucucaggggccag

SEQ ID NO: 1492100 - RNA, 13 nt, Homo sapiens
caucucauuccaa

SEQ ID NO: 1492101 - RNA, 16 nt, Homo sapiens
caucucauuccaacuu

SEQ ID NO: 1492102 - RNA, 11 nt, Homo sapiens
caucucccacc

SEQ ID NO: 1492103 - RNA, 20 nt, Homo sapiens
caucucuacugaaaguacaa

SEQ ID NO: 1492104 - RNA, 15 nt, Homo sapiens
caucucugccuggaa

SEQ ID NO: 1492105 - RNA, 14 nt, Homo sapiens
caucucuuguauau

SEQ ID NO: 1492106 - RNA, 17 nt, Homo sapiens
caucugaaacccacaga

SEQ ID NO: 1492107 - RNA, 21 nt, Homo sapiens
caucugaagaaauugguccca

SEQ ID NO: 1492108 - RNA, 12 nt, Homo sapiens
caucugcaaaag

SEQ ID NO: 1492109 - RNA, 21 nt, Homo sapiens
caugcauuuugcagcagugag

SEQ ID NO: 1492110 - RNA, 16 nt, Homo sapiens
caugccacaaggacuu

SEQ ID NO: 1492111 - RNA, 19 nt, Homo sapiens
caugccauugaaacuaaga

SEQ ID NO: 1492112 - RNA, 18 nt, Homo sapiens
caugccccuggaccagua

SEQ ID NO: 1492113 - RNA, 14 nt, Homo sapiens
caugccccuggcug

SEQ ID NO: 1492114 - RNA, 21 nt, Homo sapiens
caugccuuucauaguuuauua

SEQ ID NO: 1492115 - RNA, 22 nt, Homo sapiens
caugcuaaaauucuauagagau

SEQ ID NO: 1492116 - RNA, 16 nt, Homo sapiens
caugcuacaguuauua

SEQ ID NO: 1492117 - RNA, 16 nt, Homo sapiens
caugcucaggagccac

SEQ ID NO: 1492118 - RNA, 21 nt, Homo sapiens
caugcucaggagccaccagca

SEQ ID NO: 1492119 - RNA, 12 nt, Homo sapiens
caugcugcucaa

SEQ ID NO: 1492120 - RNA, 17 nt, Homo sapiens
caugcugggauuuccaa

SEQ ID NO: 1492121 - RNA, 13 nt, Homo sapiens
cauggaaccacua

SEQ ID NO: 1492122 - RNA, 15 nt, Homo sapiens
cauggaauauuucca

SEQ ID NO: 1492123 - RNA, 12 nt, Homo sapiens
cauggacaugca

SEQ ID NO: 1492124 - RNA, 15 nt, Homo sapiens
cauggacuguugcca

SEQ ID NO: 1492125 - RNA, 15 nt, Homo sapiens
cauggagcugucauc

SEQ ID NO: 1492126 - RNA, 14 nt, Homo sapiens
cauggaggccagug

SEQ ID NO: 1492127 - RNA, 19 nt, Homo sapiens
cauggcaccuuuugcacau

SEQ ID NO: 1492128 - RNA, 14 nt, Homo sapiens
cauggccaccucca

SEQ ID NO: 1492129 - RNA, 15 nt, Homo sapiens
cauggcuaaauacaa

SEQ ID NO: 1492130 - RNA, 18 nt, Homo sapiens
cauggcuaaauacaaugg

SEQ ID NO: 1492131 - RNA, 20 nt, Homo sapiens
cauggcuccagaaaugucua

SEQ ID NO: 1492132 - RNA, 17 nt, Homo sapiens
caugggaagcaugugga

SEQ ID NO: 1492133 - RNA, 19 nt, Homo sapiens
caugggacuaaaugaacua

SEQ ID NO: 1492134 - RNA, 13 nt, Homo sapiens
caugggcucugac

SEQ ID NO: 1492135 - RNA, 18 nt, Homo sapiens
cauggguaaaaauauuuc

SEQ ID NO: 1492136 - RNA, 16 nt, Homo sapiens
caugguacuaguguuu

SEQ ID NO: 1492137 - RNA, 20 nt, Homo sapiens
cauggugaaaccccgucucu

SEQ ID NO: 1492138 - RNA, 20 nt, Homo sapiens
caugguuacaaucauugcug

SEQ ID NO: 1492139 - RNA, 21 nt, Homo sapiens
cauguaauguuaauguuauau

SEQ ID NO: 1492140 - RNA, 19 nt, Homo sapiens
cauguaauuaaguacuaug

SEQ ID NO: 1492141 - RNA, 20 nt, Homo sapiens
cauguacagacauacauuua

SEQ ID NO: 1492142 - RNA, 16 nt, Homo sapiens
cauguacauacccugg

SEQ ID NO: 1492143 - RNA, 17 nt, Homo sapiens
cauguagagaaaagcac

SEQ ID NO: 1492144 - RNA, 21 nt, Homo sapiens
cauguagcccccuggccucug

SEQ ID NO: 1492145 - RNA, 19 nt, Homo sapiens
cauguagguaggaagcacu

SEQ ID NO: 1492146 - RNA, 23 nt, Homo sapiens
cauguagguaggaagcacugaaa

SEQ ID NO: 1492147 - RNA, 17 nt, Homo sapiens
cauguauguuaugauau

SEQ ID NO: 1492148 - RNA, 15 nt, Homo sapiens
cauguauugcacauu

SEQ ID NO: 1492149 - RNA, 17 nt, Homo sapiens
cauguccuaauucuucu

SEQ ID NO: 1492150 - RNA, 20 nt, Homo sapiens
caugucucugguggugcugg

SEQ ID NO: 1492151 - RNA, 16 nt, Homo sapiens
caugugccgaaugugc

SEQ ID NO: 1492152 - RNA, 16 nt, Homo sapiens
cauguggaagcacuuu

SEQ ID NO: 1492153 - RNA, 19 nt, Homo sapiens
cauguggaugacacaaucc

SEQ ID NO: 1492154 - RNA, 19 nt, Homo sapiens
cauguggcuaaaugccuaa

SEQ ID NO: 1492155 - RNA, 14 nt, Homo sapiens
cauguguaaagguu

SEQ ID NO: 1492156 - RNA, 21 nt, Homo sapiens
cauguguaugugucugcuaau

SEQ ID NO: 1492157 - RNA, 12 nt, Homo sapiens
cauguguggaag

SEQ ID NO: 1492158 - RNA, 18 nt, Homo sapiens
cauguuacugaccagcaa

SEQ ID NO: 1492159 - RNA, 14 nt, Homo sapiens
cauguucacuguga

SEQ ID NO: 1492160 - RNA, 14 nt, Homo sapiens
gaaauuauuauuca

SEQ ID NO: 1492161 - RNA, 17 nt, Homo sapiens
gaaauuccagcaauaag

SEQ ID NO: 1492162 - RNA, 15 nt, Homo sapiens
gaaauucucugcgau

SEQ ID NO: 1492163 - RNA, 16 nt, Homo sapiens
gaaauuuauucacaua

SEQ ID NO: 1492164 - RNA, 14 nt, Homo sapiens
gaaauuucacuuca

SEQ ID NO: 1492165 - RNA, 17 nt, Homo sapiens
gaaauuuuguaagaagg

SEQ ID NO: 1492166 - RNA, 18 nt, Homo sapiens
gaaauuuuuaaaaauaca

SEQ ID NO: 1492167 - RNA, 15 nt, Homo sapiens
gaacaaacacugcag

SEQ ID NO: 1492168 - RNA, 17 nt, Homo sapiens
gaacaaagcagccacga

SEQ ID NO: 1492169 - RNA, 22 nt, Homo sapiens
gaacaacuaggcuucagcauau

SEQ ID NO: 1492170 - RNA, 19 nt, Homo sapiens
gaacaccuauugcacuugg

SEQ ID NO: 1492171 - RNA, 12 nt, Homo sapiens
gaacacugcacu

SEQ ID NO: 1492172 - RNA, 16 nt, Homo sapiens
gaacagacaacagaag

SEQ ID NO: 1492173 - RNA, 21 nt, Homo sapiens
gaacagacaacagaagucaug

SEQ ID NO: 1492174 - RNA, 18 nt, Homo sapiens
gaacagagugcaacccag

SEQ ID NO: 1492175 - RNA, 15 nt, Homo sapiens
gaacagcacugggga

SEQ ID NO: 1492176 - RNA, 19 nt, Homo sapiens
gaacagcaguguucucaca

SEQ ID NO: 1492177 - RNA, 17 nt, Homo sapiens
gaacagcuguaaucuau

SEQ ID NO: 1492178 - RNA, 14 nt, Homo sapiens
gaacaggugguggu

SEQ ID NO: 1492179 - RNA, 17 nt, Homo sapiens
gaacaguuuuggcauaa

SEQ ID NO: 1492180 - RNA, 17 nt, Homo sapiens
gaacauaaaaaggacau

SEQ ID NO: 1492181 - RNA, 20 nt, Homo sapiens
gaacauaaaaaggacaucag

SEQ ID NO: 1492182 - RNA, 20 nt, Homo sapiens
gaacauauggaaaguauuag

SEQ ID NO: 1492183 - RNA, 15 nt, Homo sapiens
gaacauauguugcaa

SEQ ID NO: 1492184 - RNA, 12 nt, Homo sapiens
gaacauggagcu

SEQ ID NO: 1492185 - RNA, 21 nt, Homo sapiens
gaacauuucaguugccauuga

SEQ ID NO: 1492186 - RNA, 19 nt, Homo sapiens
gaacauuuuaauucauccc

SEQ ID NO: 1492187 - RNA, 17 nt, Homo sapiens
gaaccaaucccgugaaa

SEQ ID NO: 1492188 - RNA, 18 nt, Homo sapiens
gaaccauaguugacaguu

SEQ ID NO: 1492189 - RNA, 23 nt, Homo sapiens
gaaccaucauuggaaaugaaacu

SEQ ID NO: 1492190 - RNA, 21 nt, Homo sapiens
gaaccauguggauaacuuuac

SEQ ID NO: 1492191 - RNA, 15 nt, Homo sapiens
gaacccaagagcaag

SEQ ID NO: 1492192 - RNA, 22 nt, Homo sapiens
gaacccaagcuuagaacuuuaa

SEQ ID NO: 1492193 - RNA, 15 nt, Homo sapiens
gaacccagacucaga

SEQ ID NO: 1492194 - RNA, 14 nt, Homo sapiens
gaaccccaggagau

SEQ ID NO: 1492195 - RNA, 19 nt, Homo sapiens
gaacccugccaggcugcua

SEQ ID NO: 1492196 - RNA, 21 nt, Homo sapiens
gaaccgagcaauuuucugcua

SEQ ID NO: 1492197 - RNA, 23 nt, Homo sapiens
gaaccgugguaugucugccaugu

SEQ ID NO: 1492198 - RNA, 21 nt, Homo sapiens
gaaccugcccugcucccacag

SEQ ID NO: 1492199 - RNA, 16 nt, Homo sapiens
gaacuaugaacuacaa

SEQ ID NO: 1492200 - RNA, 14 nt, Homo sapiens
gaacucacuggggc

SEQ ID NO: 1492201 - RNA, 13 nt, Homo sapiens
gaacucagaucca

SEQ ID NO: 1492202 - RNA, 23 nt, Homo sapiens
gaaugaaagauuaaacagaugau

SEQ ID NO: 1492203 - RNA, 16 nt, Homo sapiens
gaaugaacaaagucca

SEQ ID NO: 1492204 - RNA, 13 nt, Homo sapiens
gaaugaacacucc

SEQ ID NO: 1492205 - RNA, 19 nt, Homo sapiens
gaaugaacccaagagcaag

SEQ ID NO: 1492206 - RNA, 17 nt, Homo sapiens
gaaugaauacugggaau

SEQ ID NO: 1492207 - RNA, 22 nt, Homo sapiens
gaaugcaaaguagcaauuucca

SEQ ID NO: 1492208 - RNA, 18 nt, Homo sapiens
gaaugcaacuccauuuac

SEQ ID NO: 1492209 - RNA, 16 nt, Homo sapiens
gaaugccuccuguggg

SEQ ID NO: 1492210 - RNA, 18 nt, Homo sapiens
gaaugcuccauuaaucca

SEQ ID NO: 1492211 - RNA, 12 nt, Homo sapiens
gaaugcugccag

SEQ ID NO: 1492212 - RNA, 17 nt, Homo sapiens
gaauggagcucaggucc

SEQ ID NO: 1492213 - RNA, 20 nt, Homo sapiens
gaaugggcuugaaacauuau

SEQ ID NO: 1492214 - RNA, 20 nt, Homo sapiens
gaauggguguuguaugggga

SEQ ID NO: 1492215 - RNA, 22 nt, Homo sapiens
gaaugguggaguguagccucca

SEQ ID NO: 1492216 - RNA, 14 nt, Homo sapiens
gaauguacucuguu

SEQ ID NO: 1492217 - RNA, 15 nt, Homo sapiens
gaauguggucucagg

SEQ ID NO: 1492218 - RNA, 13 nt, Homo sapiens
gaauguuacagua

SEQ ID NO: 1492219 - RNA, 16 nt, Homo sapiens
gaauuaaaacuucuua

SEQ ID NO: 1492220 - RNA, 17 nt, Homo sapiens
gaauuauaagucacaaa

SEQ ID NO: 1492221 - RNA, 16 nt, Homo sapiens
gaauuauugacacuga

SEQ ID NO: 1492222 - RNA, 14 nt, Homo sapiens
gaauucgcuguuac

SEQ ID NO: 1492223 - RNA, 22 nt, Homo sapiens
gaauucuggauaucucaggagc

SEQ ID NO: 1492224 - RNA, 14 nt, Homo sapiens
gaauuuauugccuc

SEQ ID NO: 1492225 - RNA, 17 nt, Homo sapiens
gaauuucacaagcuauu

SEQ ID NO: 1492226 - RNA, 19 nt, Homo sapiens
gaauuucacaagcuauuuu

SEQ ID NO: 1492227 - RNA, 15 nt, Homo sapiens
gaauuucacacuguc

SEQ ID NO: 1492228 - RNA, 12 nt, Homo sapiens
gaauuuccuuac

SEQ ID NO: 1492229 - RNA, 21 nt, Homo sapiens
gaauuuuauauucuaagccag

SEQ ID NO: 1492230 - RNA, 23 nt, Homo sapiens
gaauuuucucccuuuauguaucu

SEQ ID NO: 1492231 - RNA, 19 nt, Homo sapiens
gaauuuucucuaacuucaa

SEQ ID NO: 1492232 - RNA, 18 nt, Homo sapiens
gaauuuuguuuguugaug

SEQ ID NO: 1492233 - RNA, 17 nt, Homo sapiens
gacaaaaauauuuacac

SEQ ID NO: 1492234 - RNA, 21 nt, Homo sapiens
gacaaaggaguaguagcugaa

SEQ ID NO: 1492235 - RNA, 14 nt, Homo sapiens
gacaaagugacauu

SEQ ID NO: 1492236 - RNA, 19 nt, Homo sapiens
gacaaauaucuuuuuugga

SEQ ID NO: 1492237 - RNA, 16 nt, Homo sapiens
gacaacagugcuuugu

SEQ ID NO: 1492238 - RNA, 19 nt, Homo sapiens
gacaacauuauaacuguau

SEQ ID NO: 1492239 - RNA, 22 nt, Homo sapiens
gacaaccaacggccgacugccu

SEQ ID NO: 1492240 - RNA, 23 nt, Homo sapiens
gacaaccaacggccgacugccug

SEQ ID NO: 1492241 - RNA, 18 nt, Homo sapiens
gacaaccucauccaggcu

SEQ ID NO: 1492242 - RNA, 15 nt, Homo sapiens
gacaacugugacugu

SEQ ID NO: 1492243 - RNA, 13 nt, Homo sapiens
gacaagacaauga

SEQ ID NO: 1492244 - RNA, 19 nt, Homo sapiens
gacaagacccccagcacuu

SEQ ID NO: 1492245 - RNA, 18 nt, Homo sapiens
gacaagguucugcccuua

SEQ ID NO: 1492246 - RNA, 14 nt, Homo sapiens
gacaauacuggggu

SEQ ID NO: 1492247 - RNA, 13 nt, Homo sapiens
gacaaucacuaca

SEQ ID NO: 1492248 - RNA, 18 nt, Homo sapiens
gacaaucacuacaaguca

SEQ ID NO: 1492249 - RNA, 22 nt, Homo sapiens
gacaaugcugagguuaugaaca

SEQ ID NO: 1492250 - RNA, 21 nt, Homo sapiens
gacacagcagcuucaccagag

SEQ ID NO: 1492251 - RNA, 19 nt, Homo sapiens
gacacaggcccucccuguu

SEQ ID NO: 1492252 - RNA, 19 nt, Homo sapiens
gacacauuggaaugccuug

SEQ ID NO: 1492253 - RNA, 19 nt, Homo sapiens
gacacccacccugugccau

SEQ ID NO: 1492254 - RNA, 17 nt, Homo sapiens
gacacgccuaaggucac

SEQ ID NO: 1492255 - RNA, 18 nt, Homo sapiens
gacacuagccugugcacg

SEQ ID NO: 1492256 - RNA, 16 nt, Homo sapiens
gacacuauucauuuga

SEQ ID NO: 1492257 - RNA, 16 nt, Homo sapiens
gacacugaaaaaucua

SEQ ID NO: 1492258 - RNA, 21 nt, Homo sapiens
gacacugaaaguuuuguaaaa

SEQ ID NO: 1492259 - RNA, 20 nt, Homo sapiens
gacacuugccuucuucaccc

SEQ ID NO: 1492260 - RNA, 17 nt, Homo sapiens
gacagacaggcucuuag

SEQ ID NO: 1492261 - RNA, 22 nt, Homo sapiens
gacagaccacagagcugucacu

SEQ ID NO: 1492262 - RNA, 19 nt, Homo sapiens
gacagagaaggcgcuuccc

SEQ ID NO: 1492263 - RNA, 17 nt, Homo sapiens
gacagagaauaacucag

SEQ ID NO: 1492264 - RNA, 19 nt, Homo sapiens
gacagauccccguuccuga

SEQ ID NO: 1492265 - RNA, 19 nt, Homo sapiens
gacagaugccacacaagga

SEQ ID NO: 1492266 - RNA, 17 nt, Homo sapiens
gacagcagaagccucca

SEQ ID NO: 1492267 - RNA, 19 nt, Homo sapiens
gacagcaucuuccucccuc

SEQ ID NO: 1492268 - RNA, 15 nt, Homo sapiens
gacagccugcagcag

SEQ ID NO: 1492269 - RNA, 14 nt, Homo sapiens
gacagcuucaugaa

SEQ ID NO: 1492270 - RNA, 20 nt, Homo sapiens
gacagcuucaugaaacuguc

SEQ ID NO: 1492271 - RNA, 14 nt, Homo sapiens
gacagcuuccucac

SEQ ID NO: 1492272 - RNA, 16 nt, Homo sapiens
gacagcuuccuuuccu

SEQ ID NO: 1492273 - RNA, 22 nt, Homo sapiens
gacagcuuuucccaagauguca

SEQ ID NO: 1492274 - RNA, 16 nt, Homo sapiens
gacaggaggcggcccg

SEQ ID NO: 1492275 - RNA, 23 nt, Homo sapiens
gacaggcgagagaggagccagac

SEQ ID NO: 1492276 - RNA, 13 nt, Homo sapiens
gacaggcucuuag

SEQ ID NO: 1492277 - RNA, 17 nt, Homo sapiens
gacagggucggccugua

SEQ ID NO: 1492278 - RNA, 10 nt, Homo sapiens
gacagucauc

SEQ ID NO: 1492279 - RNA, 23 nt, Homo sapiens
gacagugacuggugccaguguca

SEQ ID NO: 1492280 - RNA, 20 nt, Homo sapiens
gacagugggcaucagcagca

SEQ ID NO: 1492281 - RNA, 17 nt, Homo sapiens
gacaguguuuucuggga

SEQ ID NO: 1492282 - RNA, 16 nt, Homo sapiens
gacaguuacacuugac

SEQ ID NO: 1492283 - RNA, 13 nt, Homo sapiens
gacauaacauuuu

SEQ ID NO: 1492284 - RNA, 17 nt, Homo sapiens
gacauacauauuaucuc

SEQ ID NO: 1492285 - RNA, 14 nt, Homo sapiens
gacauacauuucuc

SEQ ID NO: 1492286 - RNA, 18 nt, Homo sapiens
gacaucggccuccaugac

SEQ ID NO: 1492287 - RNA, 18 nt, Homo sapiens
gacaugauuuccuugaau

SEQ ID NO: 1492288 - RNA, 23 nt, Homo sapiens
gacauguagguaggaagcacuga

SEQ ID NO: 1492289 - RNA, 15 nt, Homo sapiens
gacaugugacauuua

SEQ ID NO: 1492290 - RNA, 16 nt, Homo sapiens
gacauguggggccagg

SEQ ID NO: 1492291 - RNA, 19 nt, Homo sapiens
gacauuaaaaauguuagua

SEQ ID NO: 1492292 - RNA, 20 nt, Homo sapiens
gacauucuggaaaagcaaaa

SEQ ID NO: 1492293 - RNA, 16 nt, Homo sapiens
gacauuggacuuccuc

SEQ ID NO: 1492294 - RNA, 19 nt, Homo sapiens
gacauuggcaccuaaucca

SEQ ID NO: 1492295 - RNA, 22 nt, Homo sapiens
gacauuuauccaagaccugaaa

SEQ ID NO: 1492296 - RNA, 21 nt, Homo sapiens
gacauuugggagacaugugac

SEQ ID NO: 1492297 - RNA, 22 nt, Homo sapiens
gacauuugggagacaugugaca

SEQ ID NO: 1492298 - RNA, 23 nt, Homo sapiens
gacauuuggugggcuuuggagcu

SEQ ID NO: 1492299 - RNA, 14 nt, Homo sapiens
gaccaaaacaaaca

SEQ ID NO: 1492300 - RNA, 17 nt, Homo sapiens
gaccaaagagcccucaa

SEQ ID NO: 1492301 - RNA, 24 nt, Homo sapiens
gaccaaaugccugguaccagagga

SEQ ID NO: 1492302 - RNA, 15 nt, Homo sapiens
gaccaacugggccca

SEQ ID NO: 1492303 - RNA, 18 nt, Homo sapiens
gcaccagugugacaucua

SEQ ID NO: 1492304 - RNA, 22 nt, Homo sapiens
gcaccaucuggaaggacaucua

SEQ ID NO: 1492305 - RNA, 17 nt, Homo sapiens
gcaccccaaagcuuucc

SEQ ID NO: 1492306 - RNA, 13 nt, Homo sapiens
gcaccccaugcca

SEQ ID NO: 1492307 - RNA, 15 nt, Homo sapiens
gcacccccuggagag

SEQ ID NO: 1492308 - RNA, 13 nt, Homo sapiens
gcaccccggccuc

SEQ ID NO: 1492309 - RNA, 21 nt, Homo sapiens
gcacccuggauugaucggagc

SEQ ID NO: 1492310 - RNA, 15 nt, Homo sapiens
gcaccggccucggga

SEQ ID NO: 1492311 - RNA, 18 nt, Homo sapiens
gcaccguucugugcacaa

SEQ ID NO: 1492312 - RNA, 18 nt, Homo sapiens
gcaccuaccaucagggac

SEQ ID NO: 1492313 - RNA, 13 nt, Homo sapiens
gcaccuaccucac

SEQ ID NO: 1492314 - RNA, 23 nt, Homo sapiens
gcaccugccuccucguuccuuuc

SEQ ID NO: 1492315 - RNA, 13 nt, Homo sapiens
gcaccugcucaac

SEQ ID NO: 1492316 - RNA, 18 nt, Homo sapiens
gcaccuuaagauuuugca

SEQ ID NO: 1492317 - RNA, 20 nt, Homo sapiens
gcaccuuaagauuuugcacc

SEQ ID NO: 1492318 - RNA, 15 nt, Homo sapiens
gcaccuuuugcacau

SEQ ID NO: 1492319 - RNA, 22 nt, Homo sapiens
gcacuacugggugucauuucau

SEQ ID NO: 1492320 - RNA, 21 nt, Homo sapiens
gcacuauaauguaagcucuac

SEQ ID NO: 1492321 - RNA, 17 nt, Homo sapiens
gcacuauugagucuuca

SEQ ID NO: 1492322 - RNA, 18 nt, Homo sapiens
gcacucacccaugugcca

SEQ ID NO: 1492323 - RNA, 13 nt, Homo sapiens
gcacucacgcccu

SEQ ID NO: 1492324 - RNA, 22 nt, Homo sapiens
gcacucugaguuuaccauuugu

SEQ ID NO: 1492325 - RNA, 16 nt, Homo sapiens
gcacugaucacccaau

SEQ ID NO: 1492326 - RNA, 20 nt, Homo sapiens
gcacugaugcugccccucau

SEQ ID NO: 1492327 - RNA, 12 nt, Homo sapiens
gcacugggauga

SEQ ID NO: 1492328 - RNA, 14 nt, Homo sapiens
gcacuggugccaaa

SEQ ID NO: 1492329 - RNA, 21 nt, Homo sapiens
gcacugguggccguggugggg

SEQ ID NO: 1492330 - RNA, 12 nt, Homo sapiens
gcacuguuuuca

SEQ ID NO: 1492331 - RNA, 14 nt, Homo sapiens
gcacuuaacuacuu

SEQ ID NO: 1492332 - RNA, 20 nt, Homo sapiens
gcacuuacagcucuggccac

SEQ ID NO: 1492333 - RNA, 13 nt, Homo sapiens
gcacuucaucuga

SEQ ID NO: 1492334 - RNA, 14 nt, Homo sapiens
gcacuuucuucucu

SEQ ID NO: 1492335 - RNA, 22 nt, Homo sapiens
gcacuuugggaggcugaggcag

SEQ ID NO: 1492336 - RNA, 14 nt, Homo sapiens
gcagaaacuuuaca

SEQ ID NO: 1492337 - RNA, 19 nt, Homo sapiens
gcagaacagcaucauguca

SEQ ID NO: 1492338 - RNA, 17 nt, Homo sapiens
gcagaaccaaagcucaa

SEQ ID NO: 1492339 - RNA, 17 nt, Homo sapiens
gcagaaguuaggcacga

SEQ ID NO: 1492340 - RNA, 18 nt, Homo sapiens
gcagaauaaugacugacu

SEQ ID NO: 1492341 - RNA, 22 nt, Homo sapiens
gcagacagccguuuguucuaca

SEQ ID NO: 1492342 - RNA, 14 nt, Homo sapiens
gcagacaguagaca

SEQ ID NO: 1492343 - RNA, 13 nt, Homo sapiens
gcagacagucaca

SEQ ID NO: 1492344 - RNA, 13 nt, Homo sapiens
gcagacgggcaca

SEQ ID NO: 1492345 - RNA, 21 nt, Homo sapiens
gcagagagggauggguuccug

SEQ ID NO: 1492346 - RNA, 23 nt, Homo sapiens
gcagagagguggagaacugggau

SEQ ID NO: 1492347 - RNA, 24 nt, Homo sapiens
gcagagcgaucucggcucacugca

SEQ ID NO: 1492348 - RNA, 23 nt, Homo sapiens
gcagaggcuccgcggcaggagga

SEQ ID NO: 1492349 - RNA, 20 nt, Homo sapiens
gcagagguaaaagugugagc

SEQ ID NO: 1492350 - RNA, 17 nt, Homo sapiens
gcagaggucagacuaag

SEQ ID NO: 1492351 - RNA, 14 nt, Homo sapiens
gcagaggucuccca

SEQ ID NO: 1492352 - RNA, 15 nt, Homo sapiens
gcagagguugcagug

SEQ ID NO: 1492353 - RNA, 16 nt, Homo sapiens
gcagauagcacugggu

SEQ ID NO: 1492354 - RNA, 17 nt, Homo sapiens
gcagaucugugccccau

SEQ ID NO: 1492355 - RNA, 14 nt, Homo sapiens
gcagcaggcagcuu

SEQ ID NO: 1492356 - RNA, 21 nt, Homo sapiens
gcagcaggcagcuucuacucc

SEQ ID NO: 1492357 - RNA, 15 nt, Homo sapiens
gcagcauacacagau

SEQ ID NO: 1492358 - RNA, 17 nt, Homo sapiens
gcagcauggucccugcc

SEQ ID NO: 1492359 - RNA, 16 nt, Homo sapiens
gcagccacaaccaaaa

SEQ ID NO: 1492360 - RNA, 12 nt, Homo sapiens
gcagccaccagc

SEQ ID NO: 1492361 - RNA, 19 nt, Homo sapiens
gcagccccacaacuuuaaa

SEQ ID NO: 1492362 - RNA, 21 nt, Homo sapiens
gcagcccuugggcaguucuca

SEQ ID NO: 1492363 - RNA, 21 nt, Homo sapiens
gcagccuaacacggugcucau

SEQ ID NO: 1492364 - RNA, 15 nt, Homo sapiens
gcagcuaacaauguc

SEQ ID NO: 1492365 - RNA, 15 nt, Homo sapiens
gcagcuagugccuuu

SEQ ID NO: 1492366 - RNA, 23 nt, Homo sapiens
gcagcuccccaggagcucaggug

SEQ ID NO: 1492367 - RNA, 15 nt, Homo sapiens
gcagcuucaccagag

SEQ ID NO: 1492368 - RNA, 19 nt, Homo sapiens
gcagcuuuaaacucaggga

SEQ ID NO: 1492369 - RNA, 23 nt, Homo sapiens
gcaggacaggaggcggcccggcc

SEQ ID NO: 1492370 - RNA, 16 nt, Homo sapiens
gcaggacaguauuccu

SEQ ID NO: 1492371 - RNA, 18 nt, Homo sapiens
gcaggagaacuacuugaa

SEQ ID NO: 1492372 - RNA, 17 nt, Homo sapiens
gcaggagaaucgcuuga

SEQ ID NO: 1492373 - RNA, 15 nt, Homo sapiens
gcaggaugaugcugu

SEQ ID NO: 1492374 - RNA, 18 nt, Homo sapiens
gcaggcauggauccagaa

SEQ ID NO: 1492375 - RNA, 16 nt, Homo sapiens
gcaggcccuguccuaa

SEQ ID NO: 1492376 - RNA, 21 nt, Homo sapiens
gcaggcccuuugaagccucag

SEQ ID NO: 1492377 - RNA, 19 nt, Homo sapiens
gcaggccggaaccacaggg

SEQ ID NO: 1492378 - RNA, 20 nt, Homo sapiens
gcaggccgugugucugucag

SEQ ID NO: 1492379 - RNA, 15 nt, Homo sapiens
gcaggcguacagguu

SEQ ID NO: 1492380 - RNA, 21 nt, Homo sapiens
gcaggcuaugaaguugcaaug

SEQ ID NO: 1492381 - RNA, 16 nt, Homo sapiens
gcaggcugcagucccu

SEQ ID NO: 1492382 - RNA, 19 nt, Homo sapiens
gcaggcugggccaugucca

SEQ ID NO: 1492383 - RNA, 16 nt, Homo sapiens
gcagggacuccaugcu

SEQ ID NO: 1492384 - RNA, 13 nt, Homo sapiens
gcagggcucugau

SEQ ID NO: 1492385 - RNA, 20 nt, Homo sapiens
gcagggcugguuuguucuga

SEQ ID NO: 1492386 - RNA, 19 nt, Homo sapiens
gcagggguccuugguguga

SEQ ID NO: 1492387 - RNA, 12 nt, Homo sapiens
gcaggugccuug

SEQ ID NO: 1492388 - RNA, 15 nt, Homo sapiens
gcagguguucugggc

SEQ ID NO: 1492389 - RNA, 11 nt, Homo sapiens
gcagguugaga

SEQ ID NO: 1492390 - RNA, 19 nt, Homo sapiens
gcaguagaaauaauaugca

SEQ ID NO: 1492391 - RNA, 20 nt, Homo sapiens
gcaguaggggcuacugugac

SEQ ID NO: 1492392 - RNA, 21 nt, Homo sapiens
gcagucagccaagaucuugcc

SEQ ID NO: 1492393 - RNA, 22 nt, Homo sapiens
gcagucauuaugagaggcaaug

SEQ ID NO: 1492394 - RNA, 19 nt, Homo sapiens
gcaguccugccucagccuc

SEQ ID NO: 1492395 - RNA, 20 nt, Homo sapiens
gcagucggugguaccugaga

SEQ ID NO: 1492396 - RNA, 13 nt, Homo sapiens
gcagugaaguaua

SEQ ID NO: 1492397 - RNA, 13 nt, Homo sapiens
gcagugagcagaa

SEQ ID NO: 1492398 - RNA, 21 nt, Homo sapiens
gcagugagcugauaucaugcc

SEQ ID NO: 1492399 - RNA, 14 nt, Homo sapiens
gcagugccuugcau

SEQ ID NO: 1492400 - RNA, 17 nt, Homo sapiens
gcaguggcgugaucucg

SEQ ID NO: 1492401 - RNA, 16 nt, Homo sapiens
gcagugugaauagccu

SEQ ID NO: 1492402 - RNA, 13 nt, Homo sapiens
gcaguguucucac

SEQ ID NO: 1492403 - RNA, 20 nt, Homo sapiens
gcaguucuggaauggaaggg

SEQ ID NO: 1492404 - RNA, 14 nt, Homo sapiens
gcaguuggacucuc

SEQ ID NO: 1492405 - RNA, 13 nt, Homo sapiens
gcccugcacagau

SEQ ID NO: 1492406 - RNA, 17 nt, Homo sapiens
gcccugcacgucauggg

SEQ ID NO: 1492407 - RNA, 15 nt, Homo sapiens
gcccugcagccagcu

SEQ ID NO: 1492408 - RNA, 15 nt, Homo sapiens
gcccugcagugcccu

SEQ ID NO: 1492409 - RNA, 16 nt, Homo sapiens
gcccugcgggugaaca

SEQ ID NO: 1492410 - RNA, 20 nt, Homo sapiens
gcccugcugcccaaucucca

SEQ ID NO: 1492411 - RNA, 14 nt, Homo sapiens
gcccuggccaggac

SEQ ID NO: 1492412 - RNA, 23 nt, Homo sapiens
gcccugggcugggugcugggaag

SEQ ID NO: 1492413 - RNA, 15 nt, Homo sapiens
gcccuggugcugcca

SEQ ID NO: 1492414 - RNA, 15 nt, Homo sapiens
gcccuguguccugag

SEQ ID NO: 1492415 - RNA, 22 nt, Homo sapiens
gcccuuaaacauuggacaguga

SEQ ID NO: 1492416 - RNA, 18 nt, Homo sapiens
gcccuuaaggacaaaaau

SEQ ID NO: 1492417 - RNA, 14 nt, Homo sapiens
gcccuuacacacuc

SEQ ID NO: 1492418 - RNA, 16 nt, Homo sapiens
gcccuucaagugcacu

SEQ ID NO: 1492419 - RNA, 18 nt, Homo sapiens
gcccuuccaugugccuuu

SEQ ID NO: 1492420 - RNA, 15 nt, Homo sapiens
gcccuucccacugga

SEQ ID NO: 1492421 - RNA, 15 nt, Homo sapiens
gcccuuccugaagaa

SEQ ID NO: 1492422 - RNA, 20 nt, Homo sapiens
gcccuuucauggucugcuga

SEQ ID NO: 1492423 - RNA, 16 nt, Homo sapiens
gcccuuuccuuccaga

SEQ ID NO: 1492424 - RNA, 17 nt, Homo sapiens
gcccuuuggaaagccau

SEQ ID NO: 1492425 - RNA, 18 nt, Homo sapiens
gcccuuuggaaagccauu

SEQ ID NO: 1492426 - RNA, 16 nt, Homo sapiens
gccgacagcucuccaa

SEQ ID NO: 1492427 - RNA, 19 nt, Homo sapiens
gccgagagcagacaccagc

SEQ ID NO: 1492428 - RNA, 23 nt, Homo sapiens
gccgagcguucccagcaggggga

SEQ ID NO: 1492429 - RNA, 17 nt, Homo sapiens
gccgcagacgggcacag

SEQ ID NO: 1492430 - RNA, 21 nt, Homo sapiens
gccggaaaaggcgcaucuaac

SEQ ID NO: 1492431 - RNA, 17 nt, Homo sapiens
gccggcaggccuggacu

SEQ ID NO: 1492432 - RNA, 13 nt, Homo sapiens
gccgggaaccaag

SEQ ID NO: 1492433 - RNA, 14 nt, Homo sapiens
gccgggcgcagugg

SEQ ID NO: 1492434 - RNA, 16 nt, Homo sapiens
gccggugcucuggaag

SEQ ID NO: 1492435 - RNA, 17 nt, Homo sapiens
gccgucuccucccucag

SEQ ID NO: 1492436 - RNA, 12 nt, Homo sapiens
gccgugccuugu

SEQ ID NO: 1492437 - RNA, 20 nt, Homo sapiens
gccuaaaagugggcuugauu

SEQ ID NO: 1492438 - RNA, 19 nt, Homo sapiens
gccuaaaauauauuccuga

SEQ ID NO: 1492439 - RNA, 12 nt, Homo sapiens
gccuacagccag

SEQ ID NO: 1492440 - RNA, 23 nt, Homo sapiens
gccuagacuucccaacagccuua

SEQ ID NO: 1492441 - RNA, 21 nt, Homo sapiens
gccuauguugugguccaucag

SEQ ID NO: 1492442 - RNA, 12 nt, Homo sapiens
gccuauuccagg

SEQ ID NO: 1492443 - RNA, 15 nt, Homo sapiens
gccucaagacuauag

SEQ ID NO: 1492444 - RNA, 19 nt, Homo sapiens
gccucaagaugaaggcaaa

SEQ ID NO: 1492445 - RNA, 14 nt, Homo sapiens
gccucaaugugacc

SEQ ID NO: 1492446 - RNA, 14 nt, Homo sapiens
gccucaauucacau

SEQ ID NO: 1492447 - RNA, 20 nt, Homo sapiens
gccucccccucagaugaucu

SEQ ID NO: 1492448 - RNA, 18 nt, Homo sapiens
gccuccccgugccaaaaa

SEQ ID NO: 1492449 - RNA, 19 nt, Homo sapiens
gccuccccgugccaaaaau

SEQ ID NO: 1492450 - RNA, 21 nt, Homo sapiens
gccuccucucucaaacugggg

SEQ ID NO: 1492451 - RNA, 20 nt, Homo sapiens
gccuccugcccagcacagga

SEQ ID NO: 1492452 - RNA, 20 nt, Homo sapiens
gccuccuggcuucacgccau

SEQ ID NO: 1492453 - RNA, 21 nt, Homo sapiens
gccuccuguggccugccaguc

SEQ ID NO: 1492454 - RNA, 18 nt, Homo sapiens
gccuccuuuugcuugaaa

SEQ ID NO: 1492455 - RNA, 15 nt, Homo sapiens
gccucucccaucacu

SEQ ID NO: 1492456 - RNA, 22 nt, Homo sapiens
gccucugcggggcagggccuuc

SEQ ID NO: 1492457 - RNA, 23 nt, Homo sapiens
gccucugcggggcagggccuucc

SEQ ID NO: 1492458 - RNA, 18 nt, Homo sapiens
gccucuggcucucauggg

SEQ ID NO: 1492459 - RNA, 14 nt, Homo sapiens
gccucugugccuuc

SEQ ID NO: 1492460 - RNA, 15 nt, Homo sapiens
gccucuuuuccccau

SEQ ID NO: 1492461 - RNA, 16 nt, Homo sapiens
gccugacaaccacugg

SEQ ID NO: 1492462 - RNA, 21 nt, Homo sapiens
gccugagccaaugggacaguu

SEQ ID NO: 1492463 - RNA, 22 nt, Homo sapiens
gccugagcuggccuccuaugcc

SEQ ID NO: 1492464 - RNA, 19 nt, Homo sapiens
gccugaggucaauggugca

SEQ ID NO: 1492465 - RNA, 23 nt, Homo sapiens
gccugaggugugugccacucaga

SEQ ID NO: 1492466 - RNA, 18 nt, Homo sapiens
gccugagucuccugugcc

SEQ ID NO: 1492467 - RNA, 14 nt, Homo sapiens
gccugaugcugaca

SEQ ID NO: 1492468 - RNA, 22 nt, Homo sapiens
gccugcaaacucacugcucaag

SEQ ID NO: 1492469 - RNA, 21 nt, Homo sapiens
gccugcaauuucauaugcugu

SEQ ID NO: 1492470 - RNA, 21 nt, Homo sapiens
gccugcacagugaagugcugg

SEQ ID NO: 1492471 - RNA, 22 nt, Homo sapiens
gccugccccccucaucucauuc

SEQ ID NO: 1492472 - RNA, 18 nt, Homo sapiens
gccugcccgcugcaaugc

SEQ ID NO: 1492473 - RNA, 18 nt, Homo sapiens
gccugcuggccgacccac

SEQ ID NO: 1492474 - RNA, 23 nt, Homo sapiens
gccugcuuggcccggccggccug

SEQ ID NO: 1492475 - RNA, 15 nt, Homo sapiens
gccugcuuugcuuua

SEQ ID NO: 1492476 - RNA, 19 nt, Homo sapiens
gccuggcaagugggugaaa

SEQ ID NO: 1492477 - RNA, 17 nt, Homo sapiens
gccuggcaggccagugu

SEQ ID NO: 1492478 - RNA, 16 nt, Homo sapiens
gccuggccaccagcca

SEQ ID NO: 1492479 - RNA, 22 nt, Homo sapiens
gccuggcuggaagagggugaaa

SEQ ID NO: 1492480 - RNA, 17 nt, Homo sapiens
gccuggggaccaggugc

SEQ ID NO: 1492481 - RNA, 21 nt, Homo sapiens
gccuggggcgagcacugugag

SEQ ID NO: 1492482 - RNA, 18 nt, Homo sapiens
gccugggggcagccucuc

SEQ ID NO: 1492483 - RNA, 21 nt, Homo sapiens
gccugggugacagagugagug

SEQ ID NO: 1492484 - RNA, 16 nt, Homo sapiens
gccugggugacauuug

SEQ ID NO: 1492485 - RNA, 13 nt, Homo sapiens
gccuggguuugua

SEQ ID NO: 1492486 - RNA, 13 nt, Homo sapiens
gccuguaauccca

SEQ ID NO: 1492487 - RNA, 19 nt, Homo sapiens
gccuguaaucucagcacuu

SEQ ID NO: 1492488 - RNA, 21 nt, Homo sapiens
gccuguaaucucagcacuuug

SEQ ID NO: 1492489 - RNA, 14 nt, Homo sapiens
gccugugaugcugg

SEQ ID NO: 1492490 - RNA, 20 nt, Homo sapiens
gccuguggaaugagugugca

SEQ ID NO: 1492491 - RNA, 21 nt, Homo sapiens
gccuguggaggaacuuuucaa

SEQ ID NO: 1492492 - RNA, 11 nt, Homo sapiens
gccuguggcau

SEQ ID NO: 1492493 - RNA, 18 nt, Homo sapiens
gccugugguuaacaucuc

SEQ ID NO: 1492494 - RNA, 19 nt, Homo sapiens
gccugugguuacagugcag

SEQ ID NO: 1492495 - RNA, 14 nt, Homo sapiens
gccuguuccaugaa

SEQ ID NO: 1492496 - RNA, 20 nt, Homo sapiens
gccuguuccgcauccuggag

SEQ ID NO: 1492497 - RNA, 23 nt, Homo sapiens
gccuguuucuggauuugcaggug

SEQ ID NO: 1492498 - RNA, 19 nt, Homo sapiens
gccuuaaguaauguuaauu

SEQ ID NO: 1492499 - RNA, 21 nt, Homo sapiens
gccuuaaguggcagaauauaa

SEQ ID NO: 1492500 - RNA, 18 nt, Homo sapiens
gccuuaaugacauucccc

SEQ ID NO: 1492501 - RNA, 15 nt, Homo sapiens
gccuuaaugcuucau

SEQ ID NO: 1492502 - RNA, 16 nt, Homo sapiens
gccuuaaugcuucaua

SEQ ID NO: 1492503 - RNA, 13 nt, Homo sapiens
gccuuacacugaa

SEQ ID NO: 1492504 - RNA, 15 nt, Homo sapiens
gccuuacacugaaaa

SEQ ID NO: 1492505 - RNA, 14 nt, Homo sapiens
gccuuaccuugaaa

SEQ ID NO: 1492506 - RNA, 18 nt, Homo sapiens
gccuuagucucaguuugu

SEQ ID NO: 1492507 - RNA, 12 nt, Homo sapiens
gccuuagugggc

SEQ ID NO: 1492508 - RNA, 15 nt, Homo sapiens
gccuuagugggccag

SEQ ID NO: 1492509 - RNA, 14 nt, Homo sapiens
gccuucacugacag

SEQ ID NO: 1492510 - RNA, 15 nt, Homo sapiens
gccuucacuuuacaa

SEQ ID NO: 1492511 - RNA, 18 nt, Homo sapiens
gccuucagcuguugcaga

SEQ ID NO: 1492512 - RNA, 20 nt, Homo sapiens
gccuuccacagugaaugugu

SEQ ID NO: 1492513 - RNA, 19 nt, Homo sapiens
gccuucugauaguauuccu

SEQ ID NO: 1492514 - RNA, 12 nt, Homo sapiens
gccuugaccucc

SEQ ID NO: 1492515 - RNA, 20 nt, Homo sapiens
gccuugagucaucuauucaa

SEQ ID NO: 1492516 - RNA, 17 nt, Homo sapiens
gccuugcugcugcugca

SEQ ID NO: 1492517 - RNA, 16 nt, Homo sapiens
gccuuggaaccagccc

SEQ ID NO: 1492518 - RNA, 16 nt, Homo sapiens
gccuugggccuugcug

SEQ ID NO: 1492519 - RNA, 13 nt, Homo sapiens
gccuuguggcacu

SEQ ID NO: 1492520 - RNA, 21 nt, Homo sapiens
gccuuuaguuuuaacaguuca

SEQ ID NO: 1492521 - RNA, 18 nt, Homo sapiens
gccuuuauuugcuguuaa

SEQ ID NO: 1492522 - RNA, 15 nt, Homo sapiens
gccuuuucacugugu

SEQ ID NO: 1492523 - RNA, 13 nt, Homo sapiens
gccuuuuuguaua

SEQ ID NO: 1492524 - RNA, 21 nt, Homo sapiens
gcgaaaguucuugguggugga

SEQ ID NO: 1492525 - RNA, 19 nt, Homo sapiens
gcgagacuccgucucaaaa

SEQ ID NO: 1492526 - RNA, 13 nt, Homo sapiens
gcgagcacuguga

SEQ ID NO: 1492527 - RNA, 17 nt, Homo sapiens
gcgcaguuguucagagc

SEQ ID NO: 1492528 - RNA, 16 nt, Homo sapiens
gcgcauugagccagug

SEQ ID NO: 1492529 - RNA, 16 nt, Homo sapiens
gcgcccuggguggugg

SEQ ID NO: 1492530 - RNA, 15 nt, Homo sapiens
gcgcccuuaccuucc

SEQ ID NO: 1492531 - RNA, 15 nt, Homo sapiens
gcgccuccagagguc

SEQ ID NO: 1492532 - RNA, 11 nt, Homo sapiens
gcgcgcugagc

SEQ ID NO: 1492533 - RNA, 19 nt, Homo sapiens
gcgcuaccggccgggccua

SEQ ID NO: 1492534 - RNA, 14 nt, Homo sapiens
gcgcucgcccagca

SEQ ID NO: 1492535 - RNA, 13 nt, Homo sapiens
gcggaagugacca

SEQ ID NO: 1492536 - RNA, 13 nt, Homo sapiens
gcggaggcugugu

SEQ ID NO: 1492537 - RNA, 19 nt, Homo sapiens
ggacaccccuuauccagga

SEQ ID NO: 1492538 - RNA, 19 nt, Homo sapiens
ggacacuccaugagugucu

SEQ ID NO: 1492539 - RNA, 12 nt, Homo sapiens
ggacagagccau

SEQ ID NO: 1492540 - RNA, 16 nt, Homo sapiens
ggacaguggaugcugc

SEQ ID NO: 1492541 - RNA, 13 nt, Homo sapiens
ggaccacauuuua

SEQ ID NO: 1492542 - RNA, 23 nt, Homo sapiens
ggaccaccccugguguguagcua

SEQ ID NO: 1492543 - RNA, 19 nt, Homo sapiens
ggaccagaagcauuucacc

SEQ ID NO: 1492544 - RNA, 13 nt, Homo sapiens
ggaccauguguca

SEQ ID NO: 1492545 - RNA, 20 nt, Homo sapiens
ggaccaugugucacuugugc

SEQ ID NO: 1492546 - RNA, 12 nt, Homo sapiens
ggacccaaaaca

SEQ ID NO: 1492547 - RNA, 22 nt, Homo sapiens
ggacguggcucagccagcacuu

SEQ ID NO: 1492548 - RNA, 12 nt, Homo sapiens
ggacuacuccaa

SEQ ID NO: 1492549 - RNA, 17 nt, Homo sapiens
ggacucccgggccacgc

SEQ ID NO: 1492550 - RNA, 21 nt, Homo sapiens
ggacucugcaucccagcaccu

SEQ ID NO: 1492551 - RNA, 19 nt, Homo sapiens
ggacucuuacugcuaacuu

SEQ ID NO: 1492552 - RNA, 19 nt, Homo sapiens
ggacucuuccaccucccaa

SEQ ID NO: 1492553 - RNA, 15 nt, Homo sapiens
ggacugcuggcaugc

SEQ ID NO: 1492554 - RNA, 20 nt, Homo sapiens
ggacugggugcggugacuca

SEQ ID NO: 1492555 - RNA, 14 nt, Homo sapiens
ggacuguaagggau

SEQ ID NO: 1492556 - RNA, 11 nt, Homo sapiens
ggacuguguug

SEQ ID NO: 1492557 - RNA, 20 nt, Homo sapiens
ggacuuccagugcucagagg

SEQ ID NO: 1492558 - RNA, 16 nt, Homo sapiens
ggacuucugcagcuau

SEQ ID NO: 1492559 - RNA, 17 nt, Homo sapiens
ggagaaacuucugcuca

SEQ ID NO: 1492560 - RNA, 18 nt, Homo sapiens
ggagaagcucacccaaua

SEQ ID NO: 1492561 - RNA, 22 nt, Homo sapiens
ggagaaucgcuugaacccagga

SEQ ID NO: 1492562 - RNA, 15 nt, Homo sapiens
gcuguuguuccauug

SEQ ID NO: 1492563 - RNA, 22 nt, Homo sapiens
gcuguuuguuucauauauacag

SEQ ID NO: 1492564 - RNA, 17 nt, Homo sapiens
gcuuaaaaucugugaag

SEQ ID NO: 1492565 - RNA, 16 nt, Homo sapiens
gcuuaaaguugucacu

SEQ ID NO: 1492566 - RNA, 14 nt, Homo sapiens
gcuuaauguuuauu

SEQ ID NO: 1492567 - RNA, 21 nt, Homo sapiens
gcuuaccauuaaaguucucaa

SEQ ID NO: 1492568 - RNA, 22 nt, Homo sapiens
gcuuaccauuaaaguucucaau

SEQ ID NO: 1492569 - RNA, 16 nt, Homo sapiens
gcuuacuuaugccaua

SEQ ID NO: 1492570 - RNA, 15 nt, Homo sapiens
gcuuagagacuauca

SEQ ID NO: 1492571 - RNA, 21 nt, Homo sapiens
gcuucaaauaaaguccugaca

SEQ ID NO: 1492572 - RNA, 23 nt, Homo sapiens
gcuucaaauaaaguccugacacu

SEQ ID NO: 1492573 - RNA, 12 nt, Homo sapiens
gcuucaguccac

SEQ ID NO: 1492574 - RNA, 19 nt, Homo sapiens
gcuucaguugcauaucuua

SEQ ID NO: 1492575 - RNA, 23 nt, Homo sapiens
gcuucauaaaugaagcagcuuua

SEQ ID NO: 1492576 - RNA, 16 nt, Homo sapiens
gcuucauauaccagca

SEQ ID NO: 1492577 - RNA, 20 nt, Homo sapiens
gcuucauauaccagcaauau

SEQ ID NO: 1492578 - RNA, 15 nt, Homo sapiens
gcuuccagcuucagg

SEQ ID NO: 1492579 - RNA, 21 nt, Homo sapiens
gcuucccagcaccaacaugua

SEQ ID NO: 1492580 - RNA, 23 nt, Homo sapiens
gcuuccccuuuugccaaucucaa

SEQ ID NO: 1492581 - RNA, 23 nt, Homo sapiens
gcuuccgagaauagcuccacugg

SEQ ID NO: 1492582 - RNA, 14 nt, Homo sapiens
gcuuccuaacugcu

SEQ ID NO: 1492583 - RNA, 18 nt, Homo sapiens
gcuuccucuagaagccaa

SEQ ID NO: 1492584 - RNA, 12 nt, Homo sapiens
gcuucgcuggaa

SEQ ID NO: 1492585 - RNA, 12 nt, Homo sapiens
gcuucuccuucu

SEQ ID NO: 1492586 - RNA, 23 nt, Homo sapiens
gcuucuccuucuccuucccauuu

SEQ ID NO: 1492587 - RNA, 20 nt, Homo sapiens
gcuucugaaugcugcuacuu

SEQ ID NO: 1492588 - RNA, 18 nt, Homo sapiens
gguuuuuguuaccuuuau

SEQ ID NO: 1492589 - RNA, 21 nt, Homo sapiens
guaaaacugaacuucagagca

SEQ ID NO: 1492590 - RNA, 18 nt, Homo sapiens
guaaaagaugaaguuuua

SEQ ID NO: 1492591 - RNA, 14 nt, Homo sapiens
guaaaaucuuggca

SEQ ID NO: 1492592 - RNA, 13 nt, Homo sapiens
guaaaaugaaauu

SEQ ID NO: 1492593 - RNA, 12 nt, Homo sapiens
guaaacaaugaa

SEQ ID NO: 1492594 - RNA, 13 nt, Homo sapiens
guaaaccuugaag

SEQ ID NO: 1492595 - RNA, 22 nt, Homo sapiens
guaaaccuugaagggcuuuauu

SEQ ID NO: 1492596 - RNA, 14 nt, Homo sapiens
guaaacgacacucu

SEQ ID NO: 1492597 - RNA, 13 nt, Homo sapiens
guaaacuuuguca

SEQ ID NO: 1492598 - RNA, 18 nt, Homo sapiens
guaaagacugguuuucug

SEQ ID NO: 1492599 - RNA, 13 nt, Homo sapiens
guaaagugccuua

SEQ ID NO: 1492600 - RNA, 15 nt, Homo sapiens
guaaaguugccuuua

SEQ ID NO: 1492601 - RNA, 21 nt, Homo sapiens
guaaaucauauuuuagcugca

SEQ ID NO: 1492602 - RNA, 23 nt, Homo sapiens
guaaauccuuuuggaacauauag

SEQ ID NO: 1492603 - RNA, 20 nt, Homo sapiens
guaaaugcuagguuaauucc

SEQ ID NO: 1492604 - RNA, 21 nt, Homo sapiens
guaaaugguguacauaaugua

SEQ ID NO: 1492605 - RNA, 15 nt, Homo sapiens
guaaauuaguauuua

SEQ ID NO: 1492606 - RNA, 20 nt, Homo sapiens
guaaauugaaucaguauaaa

SEQ ID NO: 1492607 - RNA, 17 nt, Homo sapiens
guaaauuuuuaggcaaa

SEQ ID NO: 1492608 - RNA, 23 nt, Homo sapiens
guaacauacuggccuggacuguu

SEQ ID NO: 1492609 - RNA, 18 nt, Homo sapiens
guaacaucuguuaucaaa

SEQ ID NO: 1492610 - RNA, 16 nt, Homo sapiens
guaacauuugcuguuu

SEQ ID NO: 1492611 - RNA, 16 nt, Homo sapiens
guaaccaaauguuggc

SEQ ID NO: 1492612 - RNA, 20 nt, Homo sapiens
guaacuuauuuuaaauaugc

SEQ ID NO: 1492613 - RNA, 15 nt, Homo sapiens
guaagaaguuuuaaa

SEQ ID NO: 1492614 - RNA, 14 nt, Homo sapiens
guaagagguguuau

SEQ ID NO: 1492615 - RNA, 15 nt, Homo sapiens
guaagaugcacugaa

SEQ ID NO: 1492616 - RNA, 14 nt, Homo sapiens
guaagcucuacuga

SEQ ID NO: 1492617 - RNA, 22 nt, Homo sapiens
guaagcucuacugaggugcuau

SEQ ID NO: 1492618 - RNA, 20 nt, Homo sapiens
guaaggcaggcccauucaga

SEQ ID NO: 1492619 - RNA, 13 nt, Homo sapiens
guaaggugcaguu

SEQ ID NO: 1492620 - RNA, 22 nt, Homo sapiens
guaaguaaauugccugauuugu

SEQ ID NO: 1492621 - RNA, 15 nt, Homo sapiens
guaagugcugcuaua

SEQ ID NO: 1492622 - RNA, 15 nt, Homo sapiens
guaauaacugugaag

SEQ ID NO: 1492623 - RNA, 13 nt, Homo sapiens
guaauaagcaauc

SEQ ID NO: 1492624 - RNA, 23 nt, Homo sapiens
guaauaauaaaucguccucccag

SEQ ID NO: 1492625 - RNA, 16 nt, Homo sapiens
guaauacaucaaagag

SEQ ID NO: 1492626 - RNA, 18 nt, Homo sapiens
guaauagugaacauaugg

SEQ ID NO: 1492627 - RNA, 15 nt, Homo sapiens
guaauccucaagaaa

SEQ ID NO: 1492628 - RNA, 20 nt, Homo sapiens
guaauguuuuauacuguuua

SEQ ID NO: 1492629 - RNA, 13 nt, Homo sapiens
guaauuuaugcaa

SEQ ID NO: 1492630 - RNA, 20 nt, Homo sapiens
guaauuuuaguagagacagg

SEQ ID NO: 1492631 - RNA, 22 nt, Homo sapiens
guaauuuuuggggaaaaaagca

SEQ ID NO: 1492632 - RNA, 20 nt, Homo sapiens
guacaaacacaggauuugua

SEQ ID NO: 1492633 - RNA, 17 nt, Homo sapiens
guacaaauguauuuuga

SEQ ID NO: 1492634 - RNA, 17 nt, Homo sapiens
guacacaauaagcaaaa

SEQ ID NO: 1492635 - RNA, 19 nt, Homo sapiens
guacacacugguacuuaga

SEQ ID NO: 1492636 - RNA, 23 nt, Homo sapiens
guacacauuccugcauucaugua

SEQ ID NO: 1492637 - RNA, 15 nt, Homo sapiens
guacacugcuguacc

SEQ ID NO: 1492638 - RNA, 21 nt, Homo sapiens
guacaguauguuuuacaugua

SEQ ID NO: 1492639 - RNA, 17 nt, Homo sapiens
guacagugucugugcca

SEQ ID NO: 1492640 - RNA, 22 nt, Homo sapiens
guaccacccuucagaccccagu

SEQ ID NO: 1492641 - RNA, 14 nt, Homo sapiens
guacccucucagcu

SEQ ID NO: 1492642 - RNA, 21 nt, Homo sapiens
guacccuuucaaacuauuuau

SEQ ID NO: 1492643 - RNA, 16 nt, Homo sapiens
guacuccuuaagaaca

SEQ ID NO: 1492644 - RNA, 13 nt, Homo sapiens
guacucuccugga

SEQ ID NO: 1492645 - RNA, 17 nt, Homo sapiens
guacugacuuugcuugc

SEQ ID NO: 1492646 - RNA, 15 nt, Homo sapiens
guacugagggacaag

SEQ ID NO: 1492647 - RNA, 21 nt, Homo sapiens
guacuguauggaaacacugau

SEQ ID NO: 1492648 - RNA, 22 nt, Homo sapiens
guacuuauaaagaagguuggug

SEQ ID NO: 1492649 - RNA, 14 nt, Homo sapiens
guacuuguuugcaa

SEQ ID NO: 1492650 - RNA, 14 nt, Homo sapiens
guacuuuugagugu

SEQ ID NO: 1492651 - RNA, 22 nt, Homo sapiens
guacuuuuucuaccuguacaca

SEQ ID NO: 1492652 - RNA, 23 nt, Homo sapiens
guagaaagauccuucgggugcug

SEQ ID NO: 1492653 - RNA, 15 nt, Homo sapiens
guagaauugcauuga

SEQ ID NO: 1492654 - RNA, 15 nt, Homo sapiens
guagagaagcaagua

SEQ ID NO: 1492655 - RNA, 17 nt, Homo sapiens
guagagaagcaaguaaa

SEQ ID NO: 1492656 - RNA, 18 nt, Homo sapiens
guagagaggggacugggg

SEQ ID NO: 1492657 - RNA, 12 nt, Homo sapiens
guagaguggugc

SEQ ID NO: 1492658 - RNA, 14 nt, Homo sapiens
guagaguggugcug

SEQ ID NO: 1492659 - RNA, 17 nt, Homo sapiens
guagaguggugcugcuu

SEQ ID NO: 1492660 - RNA, 20 nt, Homo sapiens
guagcguguuuacaugugua

SEQ ID NO: 1492661 - RNA, 18 nt, Homo sapiens
guagcuaaccaucacccc

SEQ ID NO: 1492662 - RNA, 20 nt, Homo sapiens
guagcuaagugaaaagguca

SEQ ID NO: 1492663 - RNA, 14 nt, Homo sapiens
guagcuacaggaca

SEQ ID NO: 1492664 - RNA, 20 nt, Homo sapiens
guagcugggauuacaggugu

SEQ ID NO: 1492665 - RNA, 22 nt, Homo sapiens
guagcuuuccacauuugucaca

SEQ ID NO: 1492666 - RNA, 13 nt, Homo sapiens
guaggacauacca

SEQ ID NO: 1492667 - RNA, 21 nt, Homo sapiens
guaggcuuuguauucaaaaau

SEQ ID NO: 1492668 - RNA, 15 nt, Homo sapiens
guaggggcagugaug

SEQ ID NO: 1492669 - RNA, 19 nt, Homo sapiens
guagguaggaagcacugaa

SEQ ID NO: 1492670 - RNA, 11 nt, Homo sapiens
guauccaaaaa

SEQ ID NO: 1492671 - RNA, 13 nt, Homo sapiens
guauccugcagcg

SEQ ID NO: 1492672 - RNA, 20 nt, Homo sapiens
guaucugacaaugcugaggu

SEQ ID NO: 1492673 - RNA, 17 nt, Homo sapiens
guaucuuccauauuugg

SEQ ID NO: 1492674 - RNA, 18 nt, Homo sapiens
guaucuuccauauuugga

SEQ ID NO: 1492675 - RNA, 14 nt, Homo sapiens
guaugcaauggauu

SEQ ID NO: 1492676 - RNA, 21 nt, Homo sapiens
guauggggaggcaaguguggg

SEQ ID NO: 1492677 - RNA, 16 nt, Homo sapiens
guauguauauauacac

SEQ ID NO: 1492678 - RNA, 14 nt, Homo sapiens
guauuaaaagcuaa

SEQ ID NO: 1492679 - RNA, 20 nt, Homo sapiens
guauuaggugucauuuccau

SEQ ID NO: 1492680 - RNA, 18 nt, Homo sapiens
guauuccuuuuguguaca

SEQ ID NO: 1492681 - RNA, 15 nt, Homo sapiens
guauucuuauuuaau

SEQ ID NO: 1492682 - RNA, 21 nt, Homo sapiens
guauuuauuuuacagcucauu

SEQ ID NO: 1492683 - RNA, 17 nt, Homo sapiens
guauuuuaauccuguac

SEQ ID NO: 1492684 - RNA, 12 nt, Homo sapiens
guauuuuuggca

SEQ ID NO: 1492685 - RNA, 19 nt, Homo sapiens
guauuuuuguuaguuuaca

SEQ ID NO: 1492686 - RNA, 21 nt, Homo sapiens
guauuuuuguuaguuuacaau

SEQ ID NO: 1492687 - RNA, 17 nt, Homo sapiens
gucaaaagaaauaaucc

SEQ ID NO: 1492688 - RNA, 19 nt, Homo sapiens
gucaaaaggaagucucuag

SEQ ID NO: 1492689 - RNA, 16 nt, Homo sapiens
gucaaaaggacauuua

SEQ ID NO: 1492690 - RNA, 18 nt, Homo sapiens
gucaaagaagucauucuu

SEQ ID NO: 1492691 - RNA, 12 nt, Homo sapiens
gucaacauaugc

SEQ ID NO: 1492692 - RNA, 13 nt, Homo sapiens
gucaacauaugca

SEQ ID NO: 1492693 - RNA, 17 nt, Homo sapiens
gucaacuuauucuuuga

SEQ ID NO: 1492694 - RNA, 18 nt, Homo sapiens
gucaacuuauucuuugag

SEQ ID NO: 1492695 - RNA, 20 nt, Homo sapiens
gucaagaagaggaaagggag

SEQ ID NO: 1492696 - RNA, 13 nt, Homo sapiens
gucaagcaccugc

SEQ ID NO: 1492697 - RNA, 16 nt, Homo sapiens
gucaagcugcucugag

SEQ ID NO: 1492698 - RNA, 18 nt, Homo sapiens
gucaagguuuguguuacc

SEQ ID NO: 1492699 - RNA, 18 nt, Homo sapiens
gucaauaaacaacagcug

SEQ ID NO: 1492700 - RNA, 18 nt, Homo sapiens
gucaauccgaaguaugag

SEQ ID NO: 1492701 - RNA, 12 nt, Homo sapiens
gucacacacuga

SEQ ID NO: 1492702 - RNA, 17 nt, Homo sapiens
gucacagaagcagcuaa

SEQ ID NO: 1492703 - RNA, 18 nt, Homo sapiens
gucacagaagcagcuaaa

SEQ ID NO: 1492704 - RNA, 19 nt, Homo sapiens
gucacagaagcagcuaaac

SEQ ID NO: 1492705 - RNA, 21 nt, Homo sapiens
gucacagggccaacuugaggg

SEQ ID NO: 1492706 - RNA, 19 nt, Homo sapiens
gucacagugauaccaguuc

SEQ ID NO: 1492707 - RNA, 11 nt, Homo sapiens
gucacaugacc

SEQ ID NO: 1492708 - RNA, 18 nt, Homo sapiens
gucacauuguaacugaac

SEQ ID NO: 1492709 - RNA, 22 nt, Homo sapiens
gucaccaaaucagcugcuacua

SEQ ID NO: 1492710 - RNA, 16 nt, Homo sapiens
gucaccacgacuggcc

SEQ ID NO: 1492711 - RNA, 18 nt, Homo sapiens
gucaccggucagugccuu

SEQ ID NO: 1492712 - RNA, 21 nt, Homo sapiens
gucacgcacaagggcacguga

SEQ ID NO: 1492713 - RNA, 15 nt, Homo sapiens
gucacucauugcuga

SEQ ID NO: 1492714 - RNA, 10 nt, Homo sapiens
gucacuggaa

SEQ ID NO: 1492715 - RNA, 15 nt, Homo sapiens
gucacuucucacaau

SEQ ID NO: 1492716 - RNA, 23 nt, Homo sapiens
gucagaacagagugcaacccagu

SEQ ID NO: 1492717 - RNA, 14 nt, Homo sapiens
gucagcugcucccu

SEQ ID NO: 1492718 - RNA, 22 nt, Homo sapiens
gucagcuguaacccucacccac

SEQ ID NO: 1492719 - RNA, 14 nt, Homo sapiens
gucaggacugugac

SEQ ID NO: 1492720 - RNA, 18 nt, Homo sapiens
gucagggaaggugccucu

SEQ ID NO: 1492721 - RNA, 21 nt, Homo sapiens
gucaguauuucaguguaguua

SEQ ID NO: 1492722 - RNA, 15 nt, Homo sapiens
gucagucacagccac

SEQ ID NO: 1492723 - RNA, 22 nt, Homo sapiens
gucauagcaagcuuuugcucaa

SEQ ID NO: 1492724 - RNA, 17 nt, Homo sapiens
gucauaguuaugugauu

SEQ ID NO: 1492725 - RNA, 17 nt, Homo sapiens
gucaucaucacauucag

SEQ ID NO: 1492726 - RNA, 23 nt, Homo sapiens
gucauccagucuauucacagaag

SEQ ID NO: 1492727 - RNA, 22 nt, Homo sapiens
gucaucgggaggagcagccuga

SEQ ID NO: 1492728 - RNA, 20 nt, Homo sapiens
gucaucuccaucagcuguaa

SEQ ID NO: 1492729 - RNA, 14 nt, Homo sapiens
gucaucugugcacu

SEQ ID NO: 1492730 - RNA, 23 nt, Homo sapiens
gucaugauggcaccacugcacuc

SEQ ID NO: 1492731 - RNA, 17 nt, Homo sapiens
gucauggacuguugcca

SEQ ID NO: 1492732 - RNA, 19 nt, Homo sapiens
gucauggcuaauuuaacac

SEQ ID NO: 1492733 - RNA, 16 nt, Homo sapiens
gucauguguuuugcca

SEQ ID NO: 1492734 - RNA, 20 nt, Homo sapiens
gucauucagcgggagcacug

SEQ ID NO: 1492735 - RNA, 13 nt, Homo sapiens
gucauuguucucc

SEQ ID NO: 1492736 - RNA, 21 nt, Homo sapiens
gucauuucauuccauugccua

SEQ ID NO: 1492737 - RNA, 20 nt, Homo sapiens
guccaacugucaaccuagaa

SEQ ID NO: 1492738 - RNA, 15 nt, Homo sapiens
guccagaauucacuu

SEQ ID NO: 1492739 - RNA, 21 nt, Homo sapiens
guccagagcggaggcugugug

SEQ ID NO: 1492740 - RNA, 13 nt, Homo sapiens
guccagcacagaa

SEQ ID NO: 1492741 - RNA, 23 nt, Homo sapiens
guccagccgccauugccaccagg

SEQ ID NO: 1492742 - RNA, 18 nt, Homo sapiens
guccagggcuagugacuu

SEQ ID NO: 1492743 - RNA, 13 nt, Homo sapiens
guccauauuuaca

SEQ ID NO: 1492744 - RNA, 23 nt, Homo sapiens
guccaugaaaucuuuaugugaua

SEQ ID NO: 1492745 - RNA, 15 nt, Homo sapiens
guccaugcugaugau

SEQ ID NO: 1492746 - RNA, 19 nt, Homo sapiens
guccauuuauccacaggaa

SEQ ID NO: 1492747 - RNA, 14 nt, Homo sapiens
guccauuuugcccu

SEQ ID NO: 1492748 - RNA, 14 nt, Homo sapiens
gucccacacuggug

SEQ ID NO: 1492749 - RNA, 20 nt, Homo sapiens
gucccacgugucuuccacuu

SEQ ID NO: 1492750 - RNA, 19 nt, Homo sapiens
gucccauggacacuccagu

SEQ ID NO: 1492751 - RNA, 20 nt, Homo sapiens
guccccaaaaugugaugcuu

SEQ ID NO: 1492752 - RNA, 14 nt, Homo sapiens
guccccaccuggga

SEQ ID NO: 1492753 - RNA, 15 nt, Homo sapiens
gugauuucagagagg

SEQ ID NO: 1492754 - RNA, 20 nt, Homo sapiens
gugauuuuccuuuguagcua

SEQ ID NO: 1492755 - RNA, 23 nt, Homo sapiens
gugauuuuccuuuguagcuacuu

SEQ ID NO: 1492756 - RNA, 17 nt, Homo sapiens
gugcacauuucuuugca

SEQ ID NO: 1492757 - RNA, 18 nt, Homo sapiens
gugcacugcuuugggauu

SEQ ID NO: 1492758 - RNA, 23 nt, Homo sapiens
gugcagaugagcagucacacugu

SEQ ID NO: 1492759 - RNA, 21 nt, Homo sapiens
gugcagccccuuccuggugac

SEQ ID NO: 1492760 - RNA, 17 nt, Homo sapiens
gugcagcgggugcugcu

SEQ ID NO: 1492761 - RNA, 23 nt, Homo sapiens
gugcaguaucaugcccugugcaa

SEQ ID NO: 1492762 - RNA, 21 nt, Homo sapiens
gugcauaugaaauccuugacu

SEQ ID NO: 1492763 - RNA, 13 nt, Homo sapiens
gugcaugaugcug

SEQ ID NO: 1492764 - RNA, 16 nt, Homo sapiens
gugcaugcaugcccuc

SEQ ID NO: 1492765 - RNA, 23 nt, Homo sapiens
gugcauuuuuacuauuguuacau

SEQ ID NO: 1492766 - RNA, 14 nt, Homo sapiens
gugccaauaaccaa

SEQ ID NO: 1492767 - RNA, 16 nt, Homo sapiens
gugccacuggaccuca

SEQ ID NO: 1492768 - RNA, 17 nt, Homo sapiens
gugccagcaaugacauc

SEQ ID NO: 1492769 - RNA, 17 nt, Homo sapiens
gugccaguggcuuauua

SEQ ID NO: 1492770 - RNA, 13 nt, Homo sapiens
gugccaugaucug

SEQ ID NO: 1492771 - RNA, 14 nt, Homo sapiens
gugccauuccacuc

SEQ ID NO: 1492772 - RNA, 21 nt, Homo sapiens
gugcccaggggcccacaggga

SEQ ID NO: 1492773 - RNA, 18 nt, Homo sapiens
gugccguaacaacugugg

SEQ ID NO: 1492774 - RNA, 19 nt, Homo sapiens
gugccuccucagaggacag

SEQ ID NO: 1492775 - RNA, 20 nt, Homo sapiens
gugccuccuuccaccucccu

SEQ ID NO: 1492776 - RNA, 17 nt, Homo sapiens
gugccuggcgcccagug

SEQ ID NO: 1492777 - RNA, 15 nt, Homo sapiens
gugcggcugccauug

SEQ ID NO: 1492778 - RNA, 23 nt, Homo sapiens
gugcgugcucccgaugcugcuau

SEQ ID NO: 1492779 - RNA, 18 nt, Homo sapiens
gugcuagcuugacacagu

SEQ ID NO: 1492780 - RNA, 20 nt, Homo sapiens
gugcuaucgcaccacugugu

SEQ ID NO: 1492781 - RNA, 13 nt, Homo sapiens
gugcucaccagcc

SEQ ID NO: 1492782 - RNA, 19 nt, Homo sapiens
gugcucccgaugcugcuau

SEQ ID NO: 1492783 - RNA, 22 nt, Homo sapiens
gugcucuuguuuugucuugaaa

SEQ ID NO: 1492784 - RNA, 12 nt, Homo sapiens
gugcucuuugcu

SEQ ID NO: 1492785 - RNA, 15 nt, Homo sapiens
gugcuguugggauau

SEQ ID NO: 1492786 - RNA, 15 nt, Homo sapiens
gugcuugucauucca

SEQ ID NO: 1492787 - RNA, 22 nt, Homo sapiens
gugcuuucccagucccauuccu

SEQ ID NO: 1492788 - RNA, 18 nt, Homo sapiens
guggaaaacuuaugcuga

SEQ ID NO: 1492789 - RNA, 18 nt, Homo sapiens
guggaaagugaauuugaa

SEQ ID NO: 1492790 - RNA, 15 nt, Homo sapiens
guggaacaagcacag

SEQ ID NO: 1492791 - RNA, 18 nt, Homo sapiens
guggaaccaacacuaaca

SEQ ID NO: 1492792 - RNA, 15 nt, Homo sapiens
guggaagcuucuaaa

SEQ ID NO: 1492793 - RNA, 23 nt, Homo sapiens
guggacaaacagggaacaaagaa

SEQ ID NO: 1492794 - RNA, 23 nt, Homo sapiens
guggacccugucuucugggcaca

SEQ ID NO: 1492795 - RNA, 18 nt, Homo sapiens
guggacucucauguggcc

SEQ ID NO: 1492796 - RNA, 17 nt, Homo sapiens
guggagaugcagaggua

SEQ ID NO: 1492797 - RNA, 13 nt, Homo sapiens
guggagcucagcc

SEQ ID NO: 1492798 - RNA, 13 nt, Homo sapiens
guggagcucagug

SEQ ID NO: 1492799 - RNA, 23 nt, Homo sapiens
guggaguaauuuaugccuuaguc

SEQ ID NO: 1492800 - RNA, 14 nt, Homo sapiens
guggaugacuguug

SEQ ID NO: 1492801 - RNA, 15 nt, Homo sapiens
guggaugaugcugcc

SEQ ID NO: 1492802 - RNA, 12 nt, Homo sapiens
guggaugugaug

SEQ ID NO: 1492803 - RNA, 20 nt, Homo sapiens
guggcagacaucggccucca

SEQ ID NO: 1492804 - RNA, 22 nt, Homo sapiens
guggccaccaguaugacaguau

SEQ ID NO: 1492805 - RNA, 18 nt, Homo sapiens
guggcccagggaagccaa

SEQ ID NO: 1492806 - RNA, 17 nt, Homo sapiens
guggccuugaccuccaa

SEQ ID NO: 1492807 - RNA, 17 nt, Homo sapiens
guggcuaaaugccuaau

SEQ ID NO: 1492808 - RNA, 19 nt, Homo sapiens
guggcugcaccacuuccag

SEQ ID NO: 1492809 - RNA, 21 nt, Homo sapiens
guggcuggcucuaccuuccug

SEQ ID NO: 1492810 - RNA, 17 nt, Homo sapiens
gugggaagaauuggaag

SEQ ID NO: 1492811 - RNA, 20 nt, Homo sapiens
gugggauggggacauuugaa

SEQ ID NO: 1492812 - RNA, 14 nt, Homo sapiens
gugggauuuugcaa

SEQ ID NO: 1492813 - RNA, 17 nt, Homo sapiens
gugggcagagccuucca

SEQ ID NO: 1492814 - RNA, 11 nt, Homo sapiens
gugggccacag

SEQ ID NO: 1492815 - RNA, 12 nt, Homo sapiens
guggguaaucca

SEQ ID NO: 1492816 - RNA, 22 nt, Homo sapiens
guggguaccucuggcacccauc

SEQ ID NO: 1492817 - RNA, 17 nt, Homo sapiens
guggguggcacugaccu

SEQ ID NO: 1492818 - RNA, 21 nt, Homo sapiens
gugguagagaagcaaguaaaa

SEQ ID NO: 1492819 - RNA, 24 nt, Homo sapiens
guggucaguaaauaacaggcauuu

SEQ ID NO: 1492820 - RNA, 17 nt, Homo sapiens
gugguccuuccuaccuc

SEQ ID NO: 1492821 - RNA, 22 nt, Homo sapiens
guggugcucuuugcugcacuau

SEQ ID NO: 1492822 - RNA, 22 nt, Homo sapiens
gugguuaggcagcaagcuuugg

SEQ ID NO: 1492823 - RNA, 14 nt, Homo sapiens
guguaaguaauuau

SEQ ID NO: 1492824 - RNA, 14 nt, Homo sapiens
guguaauaugcaca

SEQ ID NO: 1492825 - RNA, 23 nt, Homo sapiens
guguaccucaguucccucuugcu

SEQ ID NO: 1492826 - RNA, 23 nt, Homo sapiens
guguaguuucuucauuucaggaa

SEQ ID NO: 1492827 - RNA, 12 nt, Homo sapiens
guguauacaugu

SEQ ID NO: 1492828 - RNA, 16 nt, Homo sapiens
gugucaaaagccagau

SEQ ID NO: 1492829 - RNA, 22 nt, Homo sapiens
gugucacuacucacagucucuu

SEQ ID NO: 1492830 - RNA, 22 nt, Homo sapiens
gugucaucuuucuuguuucauc

SEQ ID NO: 1492831 - RNA, 15 nt, Homo sapiens
gugucauggacuguu

SEQ ID NO: 1492832 - RNA, 19 nt, Homo sapiens
gugucauggacuguugcca

SEQ ID NO: 1492833 - RNA, 14 nt, Homo sapiens
guguccagcacaga

SEQ ID NO: 1492834 - RNA, 17 nt, Homo sapiens
guguccccuccacuguc

SEQ ID NO: 1492835 - RNA, 21 nt, Homo sapiens
guguccuguccuuucuugcag

SEQ ID NO: 1492836 - RNA, 13 nt, Homo sapiens
guguggcucagug

SEQ ID NO: 1492837 - RNA, 13 nt, Homo sapiens
gugugucagcuga

SEQ ID NO: 1492838 - RNA, 22 nt, Homo sapiens
guguguccaccugggcauaucc

SEQ ID NO: 1492839 - RNA, 13 nt, Homo sapiens
gugugugugcaug

SEQ ID NO: 1492840 - RNA, 18 nt, Homo sapiens
guguucccagagcacuuu

SEQ ID NO: 1492841 - RNA, 20 nt, Homo sapiens
guguugagaacuaccuggau

SEQ ID NO: 1492842 - RNA, 21 nt, Homo sapiens
guguugcaccaggcacugcug

SEQ ID NO: 1492843 - RNA, 22 nt, Homo sapiens
guguugcaccaggcacugcugc

SEQ ID NO: 1492844 - RNA, 16 nt, Homo sapiens
guguuggcacaugccu

SEQ ID NO: 1492845 - RNA, 14 nt, Homo sapiens
guguuuauugcaau

SEQ ID NO: 1492846 - RNA, 17 nt, Homo sapiens
guguuuccacagccugc

SEQ ID NO: 1492847 - RNA, 18 nt, Homo sapiens
guuaaagguucacagggg

SEQ ID NO: 1492848 - RNA, 18 nt, Homo sapiens
guuaaauaauauggcuau

SEQ ID NO: 1492849 - RNA, 20 nt, Homo sapiens
guuaaauagaguauaugcac

SEQ ID NO: 1492850 - RNA, 13 nt, Homo sapiens
guuaacuguguau

SEQ ID NO: 1492851 - RNA, 11 nt, Homo sapiens
guuaacuuaau

SEQ ID NO: 1492852 - RNA, 19 nt, Homo sapiens
guuaacuuaauaguauuua

SEQ ID NO: 1492853 - RNA, 12 nt, Homo sapiens
guuaagugcagg

SEQ ID NO: 1492854 - RNA, 24 nt, Homo sapiens
guuaaguugaaguaaaagcaagua

SEQ ID NO: 1492855 - RNA, 13 nt, Homo sapiens
guuaaugccacaa

SEQ ID NO: 1492856 - RNA, 22 nt, Homo sapiens
uaagagaaacuuuauacauuag

SEQ ID NO: 1492857 - RNA, 19 nt, Homo sapiens
uaagagacacuccaaaccu

SEQ ID NO: 1492858 - RNA, 18 nt, Homo sapiens
uaagaguaaaauuccucu

SEQ ID NO: 1492859 - RNA, 21 nt, Homo sapiens
uaagauaucccuaaggaauuu

SEQ ID NO: 1492860 - RNA, 13 nt, Homo sapiens
uaagauccacaaa

SEQ ID NO: 1492861 - RNA, 14 nt, Homo sapiens
uaagaugcacugaa

SEQ ID NO: 1492862 - RNA, 16 nt, Homo sapiens
uaagaugccagcauau

SEQ ID NO: 1492863 - RNA, 15 nt, Homo sapiens
uaagcauauuuucuc

SEQ ID NO: 1492864 - RNA, 16 nt, Homo sapiens
uaagcugacucuuugc

SEQ ID NO: 1492865 - RNA, 15 nt, Homo sapiens
uaagcuuaugcuuaa

SEQ ID NO: 1492866 - RNA, 16 nt, Homo sapiens
uaaggaaacgaugaaa

SEQ ID NO: 1492867 - RNA, 14 nt, Homo sapiens
uaaggaaagcaaua

SEQ ID NO: 1492868 - RNA, 13 nt, Homo sapiens
uaauuuauuucca

SEQ ID NO: 1492869 - RNA, 17 nt, Homo sapiens
uaauuuauuuuguccau

SEQ ID NO: 1492870 - RNA, 13 nt, Homo sapiens
uaauuuccagggu

SEQ ID NO: 1492871 - RNA, 21 nt, Homo sapiens
uaauuuccuuuuugacacuga

SEQ ID NO: 1492872 - RNA, 20 nt, Homo sapiens
uaauuucuacucugucuuaa

SEQ ID NO: 1492873 - RNA, 13 nt, Homo sapiens
uaauuugaugaaa

SEQ ID NO: 1492874 - RNA, 15 nt, Homo sapiens
uaauuuucacaaaau

SEQ ID NO: 1492875 - RNA, 19 nt, Homo sapiens
uaauuuuccaaugcacagu

SEQ ID NO: 1492876 - RNA, 23 nt, Homo sapiens
uaauuuuguuuauauuuucccau

SEQ ID NO: 1492877 - RNA, 20 nt, Homo sapiens
uaauuuuuaaggauguugcc

SEQ ID NO: 1492878 - RNA, 17 nt, Homo sapiens
uaauuuuugaaaacugg

SEQ ID NO: 1492879 - RNA, 12 nt, Homo sapiens
ucaacacuuaag

SEQ ID NO: 1492880 - RNA, 20 nt, Homo sapiens
ucaacagaaacuaaaugaac

SEQ ID NO: 1492881 - RNA, 23 nt, Homo sapiens
ucaacagccaagugugaccccac

SEQ ID NO: 1492882 - RNA, 11 nt, Homo sapiens
ucaacauaugc

SEQ ID NO: 1492883 - RNA, 20 nt, Homo sapiens
ucaacaucuuuuacauucug

SEQ ID NO: 1492884 - RNA, 19 nt, Homo sapiens
ucaacauuccugccccaga

SEQ ID NO: 1492885 - RNA, 19 nt, Homo sapiens
ucaaccaaaaacauguuuc

SEQ ID NO: 1492886 - RNA, 21 nt, Homo sapiens
ucaaccugguggcaccagaug

SEQ ID NO: 1492887 - RNA, 19 nt, Homo sapiens
ucaacucguuuuuauauua

SEQ ID NO: 1492888 - RNA, 23 nt, Homo sapiens
ucaacucuccaauguucuauuaa

SEQ ID NO: 1492889 - RNA, 17 nt, Homo sapiens
ucaacugaaaagacuca

SEQ ID NO: 1492890 - RNA, 16 nt, Homo sapiens
ucaacugguuguauau

SEQ ID NO: 1492891 - RNA, 20 nt, Homo sapiens
ucaacuuuggugaacaguuu

SEQ ID NO: 1492892 - RNA, 20 nt, Homo sapiens
ucaagaaacagccagcaaga

SEQ ID NO: 1492893 - RNA, 19 nt, Homo sapiens
ucaagaaacuuuguaaaau

SEQ ID NO: 1492894 - RNA, 23 nt, Homo sapiens
ucaagaaauaaaaggaagccaaa

SEQ ID NO: 1492895 - RNA, 17 nt, Homo sapiens
ucaagaacaaacacugc

SEQ ID NO: 1492896 - RNA, 13 nt, Homo sapiens
ucaagaagaggaa

SEQ ID NO: 1492897 - RNA, 18 nt, Homo sapiens
ucaagcauaaaucacuuc

SEQ ID NO: 1492898 - RNA, 15 nt, Homo sapiens
ucaagccccauuucc

SEQ ID NO: 1492899 - RNA, 22 nt, Homo sapiens
ucaagcuuuuaaaaacuagagc

SEQ ID NO: 1492900 - RNA, 23 nt, Homo sapiens
ucaaggaguacuccaagacagag

SEQ ID NO: 1492901 - RNA, 20 nt, Homo sapiens
ucaaggcaguagaacuccag

SEQ ID NO: 1492902 - RNA, 17 nt, Homo sapiens
ucaagggcuuacuauuu

SEQ ID NO: 1492903 - RNA, 13 nt, Homo sapiens
ucaagucaaggaa

SEQ ID NO: 1492904 - RNA, 13 nt, Homo sapiens
ucaagugucuuag

SEQ ID NO: 1492905 - RNA, 15 nt, Homo sapiens
ucaauaaacacuugu

SEQ ID NO: 1492906 - RNA, 14 nt, Homo sapiens
ucaauaaagcacug

SEQ ID NO: 1492907 - RNA, 16 nt, Homo sapiens
ucaauaaaucuuucaa

SEQ ID NO: 1492908 - RNA, 12 nt, Homo sapiens
ucaauagcuguc

SEQ ID NO: 1492909 - RNA, 20 nt, Homo sapiens
ucaauauccaccccauccaa

SEQ ID NO: 1492910 - RNA, 20 nt, Homo sapiens
ucaauaucuuaauacccuaa

SEQ ID NO: 1492911 - RNA, 21 nt, Homo sapiens
ucaauauuugguauuucaaua

SEQ ID NO: 1492912 - RNA, 13 nt, Homo sapiens
ucaaucuacaggc

SEQ ID NO: 1492913 - RNA, 22 nt, Homo sapiens
ucaaucugcaguuuaacaaaau

SEQ ID NO: 1492914 - RNA, 15 nt, Homo sapiens
ucaaugccugucuua

SEQ ID NO: 1492915 - RNA, 15 nt, Homo sapiens
ucaauggacuggaag

SEQ ID NO: 1492916 - RNA, 23 nt, Homo sapiens
ucaauguuuguaauaauugcuca

SEQ ID NO: 1492917 - RNA, 15 nt, Homo sapiens
ucaauuauuugcaua

SEQ ID NO: 1492918 - RNA, 17 nt, Homo sapiens
ucaauuucccugacucc

SEQ ID NO: 1492919 - RNA, 18 nt, Homo sapiens
ucaauuuguaauugcuua

SEQ ID NO: 1492920 - RNA, 15 nt, Homo sapiens
ucaauuuugacuuaa

SEQ ID NO: 1492921 - RNA, 15 nt, Homo sapiens
ucacaaaaauuugaa

SEQ ID NO: 1492922 - RNA, 13 nt, Homo sapiens
ucacaaagaucau

SEQ ID NO: 1492923 - RNA, 16 nt, Homo sapiens
ucacaaauaaaagcca

SEQ ID NO: 1492924 - RNA, 14 nt, Homo sapiens
ucacaacagaucaa

SEQ ID NO: 1492925 - RNA, 17 nt, Homo sapiens
ucacaacauuuacuuaa

SEQ ID NO: 1492926 - RNA, 18 nt, Homo sapiens
ucacaaccccugcuccag

SEQ ID NO: 1492927 - RNA, 17 nt, Homo sapiens
ucacaaccucucugauc

SEQ ID NO: 1492928 - RNA, 19 nt, Homo sapiens
ucacaaccucucugaucuu

SEQ ID NO: 1492929 - RNA, 18 nt, Homo sapiens
ucacaauagauuucucaa

SEQ ID NO: 1492930 - RNA, 15 nt, Homo sapiens
ucacaaugagauuga

SEQ ID NO: 1492931 - RNA, 19 nt, Homo sapiens
ucacaaugucaguauuuca

SEQ ID NO: 1492932 - RNA, 15 nt, Homo sapiens
ucacacacacagcug

SEQ ID NO: 1492933 - RNA, 21 nt, Homo sapiens
ucacacacacagcugggcaaa

SEQ ID NO: 1492934 - RNA, 12 nt, Homo sapiens
ucacacauucca

SEQ ID NO: 1492935 - RNA, 19 nt, Homo sapiens
ucacagaacuauguacuuu

SEQ ID NO: 1492936 - RNA, 16 nt, Homo sapiens
ucacagaauagcacaa

SEQ ID NO: 1492937 - RNA, 19 nt, Homo sapiens
ucacagacuggcaacaaga

SEQ ID NO: 1492938 - RNA, 18 nt, Homo sapiens
ucacagaguagaaacuca

SEQ ID NO: 1492939 - RNA, 16 nt, Homo sapiens
ucacagagugcauugu

SEQ ID NO: 1492940 - RNA, 18 nt, Homo sapiens
ucacagagugcauuguga

SEQ ID NO: 1492941 - RNA, 14 nt, Homo sapiens
ucacagcagccucc

SEQ ID NO: 1492942 - RNA, 16 nt, Homo sapiens
ucacagcuaguuugag

SEQ ID NO: 1492943 - RNA, 11 nt, Homo sapiens
ucacagcugcu

SEQ ID NO: 1492944 - RNA, 16 nt, Homo sapiens
ucacaguguugcccag

SEQ ID NO: 1492945 - RNA, 15 nt, Homo sapiens
ucacauagugaaaua

SEQ ID NO: 1492946 - RNA, 19 nt, Homo sapiens
ucacauaguuuauuucaac

SEQ ID NO: 1492947 - RNA, 13 nt, Homo sapiens
ucacauccauccc

SEQ ID NO: 1492948 - RNA, 16 nt, Homo sapiens
ucacaucugcaucuua

SEQ ID NO: 1492949 - RNA, 17 nt, Homo sapiens
ucacaugaccugaucac

SEQ ID NO: 1492950 - RNA, 14 nt, Homo sapiens
ucacauucaggaag

SEQ ID NO: 1492951 - RNA, 20 nt, Homo sapiens
ucacauucgacauaccccac

SEQ ID NO: 1492952 - RNA, 23 nt, Homo sapiens
ucacauucuauuuuggguauuaa

SEQ ID NO: 1492953 - RNA, 17 nt, Homo sapiens
ucacauuggagucacug

SEQ ID NO: 1492954 - RNA, 21 nt, Homo sapiens
ucacauuguuugcugcuauug

SEQ ID NO: 1492955 - RNA, 16 nt, Homo sapiens
ucacauuucuaugcca

SEQ ID NO: 1492956 - RNA, 20 nt, Homo sapiens
ucaccaacugaaguggcuaa

SEQ ID NO: 1492957 - RNA, 21 nt, Homo sapiens
ucaccaaggaaacgcuaccuc

SEQ ID NO: 1492958 - RNA, 17 nt, Homo sapiens
ucaccaccaaaugccaa

SEQ ID NO: 1492959 - RNA, 23 nt, Homo sapiens
ucaccacugaaacccugcacuua

SEQ ID NO: 1492960 - RNA, 18 nt, Homo sapiens
ucaccagagcauuuccaa

SEQ ID NO: 1492961 - RNA, 18 nt, Homo sapiens
ucaccagcuaucugucau

SEQ ID NO: 1492962 - RNA, 18 nt, Homo sapiens
ucaccaugcccagcuaau

SEQ ID NO: 1492963 - RNA, 23 nt, Homo sapiens
ucacccaaugcaucacguacccc

SEQ ID NO: 1492964 - RNA, 19 nt, Homo sapiens
ucacccaccucuugugcaa

SEQ ID NO: 1492965 - RNA, 17 nt, Homo sapiens
ucacccgacccgugcac

SEQ ID NO: 1492966 - RNA, 17 nt, Homo sapiens
ucacccuuggacaagac

SEQ ID NO: 1492967 - RNA, 14 nt, Homo sapiens
ucaccgugagcagc

SEQ ID NO: 1492968 - RNA, 16 nt, Homo sapiens
ucaccuaaaaaaagag

SEQ ID NO: 1492969 - RNA, 17 nt, Homo sapiens
ucaccuacauuaucuca

SEQ ID NO: 1492970 - RNA, 23 nt, Homo sapiens
ucaccuauguuauuuuguguaca

SEQ ID NO: 1492971 - RNA, 18 nt, Homo sapiens
ucaccucacacuccucca

SEQ ID NO: 1492972 - RNA, 14 nt, Homo sapiens
ucaccucucaaggu

SEQ ID NO: 1492973 - RNA, 19 nt, Homo sapiens
ucaccucuccaggugcuca

SEQ ID NO: 1492974 - RNA, 18 nt, Homo sapiens
ucaccuggaugugcagcc

SEQ ID NO: 1492975 - RNA, 12 nt, Homo sapiens
ucaccuuauuca

SEQ ID NO: 1492976 - RNA, 15 nt, Homo sapiens
ucacgcaggagccau

SEQ ID NO: 1492977 - RNA, 14 nt, Homo sapiens
ucacuaauauagua

SEQ ID NO: 1492978 - RNA, 15 nt, Homo sapiens
ucacuaauauaguag

SEQ ID NO: 1492979 - RNA, 21 nt, Homo sapiens
ucacuagaaaagcugaucaua

SEQ ID NO: 1492980 - RNA, 14 nt, Homo sapiens
ucacucaccaucug

SEQ ID NO: 1492981 - RNA, 17 nt, Homo sapiens
ucacucaccaucuggaa

SEQ ID NO: 1492982 - RNA, 16 nt, Homo sapiens
ucacucaggacagccc

SEQ ID NO: 1492983 - RNA, 23 nt, Homo sapiens
ucacucucugaagaugaucauuu

SEQ ID NO: 1492984 - RNA, 22 nt, Homo sapiens
ucacucugggcggcuccccaua

SEQ ID NO: 1492985 - RNA, 12 nt, Homo sapiens
ucacucugucag

SEQ ID NO: 1492986 - RNA, 17 nt, Homo sapiens
ucacucugucagccagc

SEQ ID NO: 1492987 - RNA, 18 nt, Homo sapiens
ucacugacucugacucau

SEQ ID NO: 1492988 - RNA, 12 nt, Homo sapiens
ucacugagcucc

SEQ ID NO: 1492989 - RNA, 15 nt, Homo sapiens
ucacuggaaagggga

SEQ ID NO: 1492990 - RNA, 13 nt, Homo sapiens
ucacuggaugaaa

SEQ ID NO: 1492991 - RNA, 18 nt, Homo sapiens
ucacuucucacaaugucc

SEQ ID NO: 1492992 - RNA, 19 nt, Homo sapiens
ucacuuuuuacagugcuau

SEQ ID NO: 1492993 - RNA, 16 nt, Homo sapiens
ucagaaacgaaaucua

SEQ ID NO: 1492994 - RNA, 16 nt, Homo sapiens
ucagaacugugccaca

SEQ ID NO: 1492995 - RNA, 16 nt, Homo sapiens
ucagaccaacucucuc

SEQ ID NO: 1492996 - RNA, 21 nt, Homo sapiens
ucagagaaggugcaggugaca

SEQ ID NO: 1492997 - RNA, 16 nt, Homo sapiens
ucagagccaagccuua

SEQ ID NO: 1492998 - RNA, 12 nt, Homo sapiens
ucagagcuaaac

SEQ ID NO: 1492999 - RNA, 20 nt, Homo sapiens
ucagaggagcggccagaaga

SEQ ID NO: 1493000 - RNA, 23 nt, Homo sapiens
ucagaggccugcugccagugcag

SEQ ID NO: 1493001 - RNA, 17 nt, Homo sapiens
ucagaggcgcacuguga

SEQ ID NO: 1493002 - RNA, 23 nt, Homo sapiens
ucagagugggguggggagcaugu

SEQ ID NO: 1493003 - RNA, 20 nt, Homo sapiens
ucagaugggucugauauuaa

SEQ ID NO: 1493004 - RNA, 18 nt, Homo sapiens
ucagcaaccugacucagg

SEQ ID NO: 1493005 - RNA, 17 nt, Homo sapiens
ucagcaagaauuugauc

SEQ ID NO: 1493006 - RNA, 20 nt, Homo sapiens
ucagcaagcccuacagagcu

SEQ ID NO: 1493007 - RNA, 20 nt, Homo sapiens
ucagcacuuaacuacuuugu

SEQ ID NO: 1493008 - RNA, 15 nt, Homo sapiens
ucagcagcaggguuu

SEQ ID NO: 1493009 - RNA, 22 nt, Homo sapiens
ucagcagccgccuuaagcugau

SEQ ID NO: 1493010 - RNA, 14 nt, Homo sapiens
ucagcaggcaaaga

SEQ ID NO: 1493011 - RNA, 15 nt, Homo sapiens
ucagcaggcaaagac

SEQ ID NO: 1493012 - RNA, 22 nt, Homo sapiens
ucagcaucacccgggaacuuuu

SEQ ID NO: 1493013 - RNA, 16 nt, Homo sapiens
ucagcauuuggaccaa

SEQ ID NO: 1493014 - RNA, 23 nt, Homo sapiens
ucagcauuuucuucucugcacuu

SEQ ID NO: 1493015 - RNA, 15 nt, Homo sapiens
ucagccaagcuuguu

SEQ ID NO: 1493016 - RNA, 17 nt, Homo sapiens
ucagccccucacauucc

SEQ ID NO: 1493017 - RNA, 19 nt, Homo sapiens
ucagccgcuucugacugcu

SEQ ID NO: 1493018 - RNA, 19 nt, Homo sapiens
ucagccuccugagccugug

SEQ ID NO: 1493019 - RNA, 14 nt, Homo sapiens
ucagccugagucuc

SEQ ID NO: 1493020 - RNA, 21 nt, Homo sapiens
ucagccuugccagagauccaa

SEQ ID NO: 1493021 - RNA, 14 nt, Homo sapiens
ucagcucagcuucu

SEQ ID NO: 1493022 - RNA, 13 nt, Homo sapiens
ucagcucugggcc

SEQ ID NO: 1493023 - RNA, 12 nt, Homo sapiens
ucagcugaccau

SEQ ID NO: 1493024 - RNA, 18 nt, Homo sapiens
ucagcugcucugcaagca

SEQ ID NO: 1493025 - RNA, 13 nt, Homo sapiens
ucagcuuaucucu

SEQ ID NO: 1493026 - RNA, 19 nt, Homo sapiens
ucagcuuugggguuccuuu

SEQ ID NO: 1493027 - RNA, 16 nt, Homo sapiens
ucaggacagaugccac

SEQ ID NO: 1493028 - RNA, 17 nt, Homo sapiens
ucaggacagaugccaca

SEQ ID NO: 1493029 - RNA, 17 nt, Homo sapiens
ucaggagaucgagacca

SEQ ID NO: 1493030 - RNA, 20 nt, Homo sapiens
ucaggagcuugggcagugcc

SEQ ID NO: 1493031 - RNA, 13 nt, Homo sapiens
ucaggagucccaa

SEQ ID NO: 1493032 - RNA, 18 nt, Homo sapiens
ucaggaguuccuaaccag

SEQ ID NO: 1493033 - RNA, 16 nt, Homo sapiens
ucaggauacucuguca

SEQ ID NO: 1493034 - RNA, 19 nt, Homo sapiens
ucaggaucaagaaaguguu

SEQ ID NO: 1493035 - RNA, 19 nt, Homo sapiens
ucaggcaaagcuugaauca

SEQ ID NO: 1493036 - RNA, 16 nt, Homo sapiens
ucaggcggggugcugu

SEQ ID NO: 1493037 - RNA, 23 nt, Homo sapiens
ucaggcucuguggagggcauuug

SEQ ID NO: 1493038 - RNA, 23 nt, Homo sapiens
ucaggcugggcagccccagagag

SEQ ID NO: 1493039 - RNA, 14 nt, Homo sapiens
ucagggacagagcc

SEQ ID NO: 1493040 - RNA, 15 nt, Homo sapiens
ucagggccaugccug

SEQ ID NO: 1493041 - RNA, 14 nt, Homo sapiens
ucaggggacucagc

SEQ ID NO: 1493042 - RNA, 18 nt, Homo sapiens
ucaggguuggugugcuga

SEQ ID NO: 1493043 - RNA, 21 nt, Homo sapiens
ucaggguuuuuagauuaaaca

SEQ ID NO: 1493044 - RNA, 19 nt, Homo sapiens
ucagguggggaguccaggg

SEQ ID NO: 1493045 - RNA, 15 nt, Homo sapiens
ucaguaauaacucua

SEQ ID NO: 1493046 - RNA, 23 nt, Homo sapiens
ucaguacuugugaaacacagcug

SEQ ID NO: 1493047 - RNA, 14 nt, Homo sapiens
ucagucacagccac

SEQ ID NO: 1493048 - RNA, 22 nt, Homo sapiens
ucagucacagccaccccugaga

SEQ ID NO: 1493049 - RNA, 17 nt, Homo sapiens
ucagucuaguugccaaa

SEQ ID NO: 1493050 - RNA, 15 nt, Homo sapiens
ucagucucuguguaa

SEQ ID NO: 1493051 - RNA, 10 nt, Homo sapiens
ucagucuuca

SEQ ID NO: 1493052 - RNA, 17 nt, Homo sapiens
ucagucuucacuugcac

SEQ ID NO: 1493053 - RNA, 15 nt, Homo sapiens
ucagugaaagccaga

SEQ ID NO: 1493054 - RNA, 23 nt, Homo sapiens
ucagugaguaauuuuggauuuug

SEQ ID NO: 1493055 - RNA, 13 nt, Homo sapiens
ucaguugacuuua

SEQ ID NO: 1493056 - RNA, 21 nt, Homo sapiens
ucaguugccaaggaucccuga

SEQ ID NO: 1493057 - RNA, 24 nt, Homo sapiens
ucaguuguuuguuuuugcuuguua

SEQ ID NO: 1493058 - RNA, 16 nt, Homo sapiens
ucaguuucacuuucac

SEQ ID NO: 1493059 - RNA, 22 nt, Homo sapiens
ucaguuuuaucuuuaaucuccu

SEQ ID NO: 1493060 - RNA, 13 nt, Homo sapiens
ucauaaauuuacu

SEQ ID NO: 1493061 - RNA, 23 nt, Homo sapiens
ucauaauguggugauggcccuaa

SEQ ID NO: 1493062 - RNA, 17 nt, Homo sapiens
ucauaauucagcacuua

SEQ ID NO: 1493063 - RNA, 20 nt, Homo sapiens
ucauacaugcauacaaagag

SEQ ID NO: 1493064 - RNA, 17 nt, Homo sapiens
ucauagagacggagauc

SEQ ID NO: 1493065 - RNA, 15 nt, Homo sapiens
ucauagcugagauuc

SEQ ID NO: 1493066 - RNA, 19 nt, Homo sapiens
ucauaguauuggagcacau

SEQ ID NO: 1493067 - RNA, 13 nt, Homo sapiens
ucauauaccagca

SEQ ID NO: 1493068 - RNA, 18 nt, Homo sapiens
ucauauaguaaacacuca

SEQ ID NO: 1493069 - RNA, 18 nt, Homo sapiens
ucauauucaagcuucaga

SEQ ID NO: 1493070 - RNA, 15 nt, Homo sapiens
ucaucaaucaaauaa

SEQ ID NO: 1493071 - RNA, 22 nt, Homo sapiens
ucaucagaagauaacuugagca

SEQ ID NO: 1493072 - RNA, 12 nt, Homo sapiens
ucaucauucccu

SEQ ID NO: 1493073 - RNA, 21 nt, Homo sapiens
ucaucauuuguggcagucccu

SEQ ID NO: 1493074 - RNA, 13 nt, Homo sapiens
ucauccaccccau

SEQ ID NO: 1493075 - RNA, 18 nt, Homo sapiens
ucauccagcaguguugcu

SEQ ID NO: 1493076 - RNA, 18 nt, Homo sapiens
ucaucccuuuuucugcua

SEQ ID NO: 1493077 - RNA, 15 nt, Homo sapiens
ucauccucaugcugc

SEQ ID NO: 1493078 - RNA, 23 nt, Homo sapiens
ucaucgggaggagcagccugaac

SEQ ID NO: 1493079 - RNA, 20 nt, Homo sapiens
ucaucuauagaaagcuauau

SEQ ID NO: 1493080 - RNA, 13 nt, Homo sapiens
ucaucugacucau

SEQ ID NO: 1493081 - RNA, 21 nt, Homo sapiens
ucaucugccggcccccaggac

SEQ ID NO: 1493082 - RNA, 13 nt, Homo sapiens
ucaucuguagaua

SEQ ID NO: 1493083 - RNA, 18 nt, Homo sapiens
ucaucuuucuuguuucau

SEQ ID NO: 1493084 - RNA, 15 nt, Homo sapiens
ucaugaaauaugcau

SEQ ID NO: 1493085 - RNA, 13 nt, Homo sapiens
ucaugagcuugaa

SEQ ID NO: 1493086 - RNA, 15 nt, Homo sapiens
ucaugagcuugaaca

SEQ ID NO: 1493087 - RNA, 13 nt, Homo sapiens
ucaugccaagaca

SEQ ID NO: 1493088 - RNA, 21 nt, Homo sapiens
ucaugcccgccagugcacagg

SEQ ID NO: 1493089 - RNA, 11 nt, Homo sapiens
ucaugccugua

SEQ ID NO: 1493090 - RNA, 21 nt, Homo sapiens
ucaugccuucacgugucuguu

SEQ ID NO: 1493091 - RNA, 12 nt, Homo sapiens
ucauggaacuca

SEQ ID NO: 1493092 - RNA, 18 nt, Homo sapiens
ucauguaacacauaaaca

SEQ ID NO: 1493093 - RNA, 14 nt, Homo sapiens
ucauguauauaccu

SEQ ID NO: 1493094 - RNA, 23 nt, Homo sapiens
ucaugucuauaaucccagcacuu

SEQ ID NO: 1493095 - RNA, 19 nt, Homo sapiens
ucaugucucacuucacagc

SEQ ID NO: 1493096 - RNA, 14 nt, Homo sapiens
ucaugugaacccgg

SEQ ID NO: 1493097 - RNA, 20 nt, Homo sapiens
ucaugugagugggugggaug

SEQ ID NO: 1493098 - RNA, 13 nt, Homo sapiens
ucauguuacucag

SEQ ID NO: 1493099 - RNA, 22 nt, Homo sapiens
ucauguuguugaggcugucaca

SEQ ID NO: 1493100 - RNA, 13 nt, Homo sapiens
ucauuagcuguga

SEQ ID NO: 1493101 - RNA, 14 nt, Homo sapiens
ucauuagcugugau

SEQ ID NO: 1493102 - RNA, 16 nt, Homo sapiens
ucauuaguauuucaca

SEQ ID NO: 1493103 - RNA, 17 nt, Homo sapiens
ucauuauaucauuggaa

SEQ ID NO: 1493104 - RNA, 13 nt, Homo sapiens
ucauuauguauga

SEQ ID NO: 1493105 - RNA, 13 nt, Homo sapiens
ucauucacauuca

SEQ ID NO: 1493106 - RNA, 22 nt, Homo sapiens
ucauuccaaucuauugcuucac

SEQ ID NO: 1493107 - RNA, 22 nt, Homo sapiens
ucauucccucucaucucaggua

SEQ ID NO: 1493108 - RNA, 21 nt, Homo sapiens
ucauugacuuccugaacaacc

SEQ ID NO: 1493109 - RNA, 15 nt, Homo sapiens
ucauugcacuuugau

SEQ ID NO: 1493110 - RNA, 17 nt, Homo sapiens
ucauuggccacugucuc

SEQ ID NO: 1493111 - RNA, 22 nt, Homo sapiens
ucauugucccucuucacucccc

SEQ ID NO: 1493112 - RNA, 22 nt, Homo sapiens
ucauugucccugaaugcuccau

SEQ ID NO: 1493113 - RNA, 20 nt, Homo sapiens
ucauuguuuauuaacaaauu

SEQ ID NO: 1493114 - RNA, 17 nt, Homo sapiens
ucauuuagucaugugac

SEQ ID NO: 1493115 - RNA, 18 nt, Homo sapiens
ucauuuccccauaacuca

SEQ ID NO: 1493116 - RNA, 14 nt, Homo sapiens
ucauuugaugcuaa

SEQ ID NO: 1493117 - RNA, 19 nt, Homo sapiens
ucauuuuacacaaagggaa

SEQ ID NO: 1493118 - RNA, 18 nt, Homo sapiens
ucauuuuuuucacuggag

SEQ ID NO: 1493119 - RNA, 14 nt, Homo sapiens
uccaaaacuuuaau

SEQ ID NO: 1493120 - RNA, 23 nt, Homo sapiens
uccaaagaguagaauugcauuga

SEQ ID NO: 1493121 - RNA, 15 nt, Homo sapiens
uccaaagccagugaa

SEQ ID NO: 1493122 - RNA, 18 nt, Homo sapiens
uccaaagccggcuugauu

SEQ ID NO: 1493123 - RNA, 13 nt, Homo sapiens
uccaaagucagau

SEQ ID NO: 1493124 - RNA, 17 nt, Homo sapiens
uccaaauucaguuucau

SEQ ID NO: 1493125 - RNA, 18 nt, Homo sapiens
uccaacaagaaugcauuc

SEQ ID NO: 1493126 - RNA, 17 nt, Homo sapiens
uccaacaccaagcacag

SEQ ID NO: 1493127 - RNA, 13 nt, Homo sapiens
uccaaccaggcag

SEQ ID NO: 1493128 - RNA, 22 nt, Homo sapiens
uccaacucagauugagcccuac

SEQ ID NO: 1493129 - RNA, 16 nt, Homo sapiens
uccaagagguggguaa

SEQ ID NO: 1493130 - RNA, 18 nt, Homo sapiens
uccaagcaaguagcuuuc

SEQ ID NO: 1493131 - RNA, 15 nt, Homo sapiens
uccaagcacagagcc

SEQ ID NO: 1493132 - RNA, 14 nt, Homo sapiens
uccaaggguacuaa

SEQ ID NO: 1493133 - RNA, 16 nt, Homo sapiens
uccaauaaauugucaa

SEQ ID NO: 1493134 - RNA, 13 nt, Homo sapiens
uccaaucugugau

SEQ ID NO: 1493135 - RNA, 16 nt, Homo sapiens
uccaaugcauugcuaa

SEQ ID NO: 1493136 - RNA, 18 nt, Homo sapiens
uccaaugucaaugugaac

SEQ ID NO: 1493137 - RNA, 19 nt, Homo sapiens
uccaauuuggaaucuucuc

SEQ ID NO: 1493138 - RNA, 22 nt, Homo sapiens
uccacacccacuuuguccauuu

SEQ ID NO: 1493139 - RNA, 10 nt, Homo sapiens
uccacagcaa

SEQ ID NO: 1493140 - RNA, 22 nt, Homo sapiens
uccacagcuuacagcaauuuga

SEQ ID NO: 1493141 - RNA, 12 nt, Homo sapiens
uccaccaagaaa

SEQ ID NO: 1493142 - RNA, 17 nt, Homo sapiens
uccaccacaucugccag

SEQ ID NO: 1493143 - RNA, 19 nt, Homo sapiens
uccaccccauccaauuuau

SEQ ID NO: 1493144 - RNA, 21 nt, Homo sapiens
uccaccgaccaacugcccuaa

SEQ ID NO: 1493145 - RNA, 16 nt, Homo sapiens
uccaccgucagcugua

SEQ ID NO: 1493146 - RNA, 22 nt, Homo sapiens
uccaccuccaccacaucugcca

SEQ ID NO: 1493147 - RNA, 17 nt, Homo sapiens
uccaccuccuaccccau

SEQ ID NO: 1493148 - RNA, 12 nt, Homo sapiens
uccaccuguggg

SEQ ID NO: 1493149 - RNA, 12 nt, Homo sapiens
uccaccuuccau

SEQ ID NO: 1493150 - RNA, 19 nt, Homo sapiens
uccacuaggguccaccagg

SEQ ID NO: 1493151 - RNA, 17 nt, Homo sapiens
uccacuccacucagguu

SEQ ID NO: 1493152 - RNA, 19 nt, Homo sapiens
uccacucuuguggucauca

SEQ ID NO: 1493153 - RNA, 15 nt, Homo sapiens
uccacugucaagaaa

SEQ ID NO: 1493154 - RNA, 11 nt, Homo sapiens
uccacuuagaa

SEQ ID NO: 1493155 - RNA, 20 nt, Homo sapiens
uccacuuagaaauugcauuu

SEQ ID NO: 1493156 - RNA, 23 nt, Homo sapiens
uccacuucuuguuccccacugac

SEQ ID NO: 1493157 - RNA, 14 nt, Homo sapiens
uccagaacacggcu

SEQ ID NO: 1493158 - RNA, 21 nt, Homo sapiens
uccagaaggauccaagacaaa

SEQ ID NO: 1493159 - RNA, 17 nt, Homo sapiens
uccagaauggaacucaa

SEQ ID NO: 1493160 - RNA, 16 nt, Homo sapiens
uccagagaagccaugg

SEQ ID NO: 1493161 - RNA, 15 nt, Homo sapiens
uccagagauggucac

SEQ ID NO: 1493162 - RNA, 19 nt, Homo sapiens
uccagaggagacuuugagu

SEQ ID NO: 1493163 - RNA, 16 nt, Homo sapiens
uccagaggguugugau

SEQ ID NO: 1493164 - RNA, 18 nt, Homo sapiens
uccagaggguugugauuu

SEQ ID NO: 1493165 - RNA, 17 nt, Homo sapiens
uccagagucaucucagc

SEQ ID NO: 1493166 - RNA, 20 nt, Homo sapiens
uccagcaauuccugagccaa

SEQ ID NO: 1493167 - RNA, 19 nt, Homo sapiens
uccagcagaagacaaaaag

SEQ ID NO: 1493168 - RNA, 20 nt, Homo sapiens
uccagccaaccucauugcag

SEQ ID NO: 1493169 - RNA, 11 nt, Homo sapiens
uccagccauga

SEQ ID NO: 1493170 - RNA, 14 nt, Homo sapiens
uccagccugaacag

SEQ ID NO: 1493171 - RNA, 16 nt, Homo sapiens
uccagccugggggaca

SEQ ID NO: 1493172 - RNA, 22 nt, Homo sapiens
uccagccuuuggccuuggcuuu

SEQ ID NO: 1493173 - RNA, 18 nt, Homo sapiens
uccagcuccaaccugcaa

SEQ ID NO: 1493174 - RNA, 23 nt, Homo sapiens
uccagcuggaagggucaacaucu

SEQ ID NO: 1493175 - RNA, 23 nt, Homo sapiens
uccaggaagguagcccagcacug

SEQ ID NO: 1493176 - RNA, 20 nt, Homo sapiens
uccaggaugaguuacuugaa

SEQ ID NO: 1493177 - RNA, 16 nt, Homo sapiens
uccaggccugcagcag

SEQ ID NO: 1493178 - RNA, 17 nt, Homo sapiens
uccagggccccccaaau

SEQ ID NO: 1493179 - RNA, 16 nt, Homo sapiens
uccaggucuugacuca

SEQ ID NO: 1493180 - RNA, 21 nt, Homo sapiens
uccaggugguaagcaccagga

SEQ ID NO: 1493181 - RNA, 17 nt, Homo sapiens
uccagguguuacuguaa

SEQ ID NO: 1493182 - RNA, 20 nt, Homo sapiens
uccagugccagcaaugacau

SEQ ID NO: 1493183 - RNA, 19 nt, Homo sapiens
uccagugguucugcuucaa

SEQ ID NO: 1493184 - RNA, 17 nt, Homo sapiens
uccaguguuugggauga

SEQ ID NO: 1493185 - RNA, 15 nt, Homo sapiens
uccauacacuuuguu

SEQ ID NO: 1493186 - RNA, 13 nt, Homo sapiens
uccauauguuaua

SEQ ID NO: 1493187 - RNA, 15 nt, Homo sapiens
uccaucaacucccaa

SEQ ID NO: 1493188 - RNA, 17 nt, Homo sapiens
uccaucagcuguaagaa

SEQ ID NO: 1493189 - RNA, 14 nt, Homo sapiens
uccaucauaugccu

SEQ ID NO: 1493190 - RNA, 16 nt, Homo sapiens
uccauccauccuucca

SEQ ID NO: 1493191 - RNA, 16 nt, Homo sapiens
uccauccuuccaacau

SEQ ID NO: 1493192 - RNA, 20 nt, Homo sapiens
uccauccuuuacguguuuaa

SEQ ID NO: 1493193 - RNA, 14 nt, Homo sapiens
uccaucuccaggag

SEQ ID NO: 1493194 - RNA, 13 nt, Homo sapiens
uccaucucucauc

SEQ ID NO: 1493195 - RNA, 17 nt, Homo sapiens
uccaucuuuccauccau

SEQ ID NO: 1493196 - RNA, 20 nt, Homo sapiens
uccaugauuuuaaauuguga

SEQ ID NO: 1493197 - RNA, 23 nt, Homo sapiens
uccaugcaacuggaguuccuuau

SEQ ID NO: 1493198 - RNA, 18 nt, Homo sapiens
uccaugcugccagccuuc

SEQ ID NO: 1493199 - RNA, 13 nt, Homo sapiens
uccaugugccuuu

SEQ ID NO: 1493200 - RNA, 15 nt, Homo sapiens
uccauuaucuuauga

SEQ ID NO: 1493201 - RNA, 15 nt, Homo sapiens
uccauugauucaggg

SEQ ID NO: 1493202 - RNA, 19 nt, Homo sapiens
uccauuucccacaucuuuc

SEQ ID NO: 1493203 - RNA, 16 nt, Homo sapiens
uccauuugcaaauaua

SEQ ID NO: 1493204 - RNA, 16 nt, Homo sapiens
ucccaaauuugauuga

SEQ ID NO: 1493205 - RNA, 13 nt, Homo sapiens
ucccaagcucaga

SEQ ID NO: 1493206 - RNA, 21 nt, Homo sapiens
ucccaagucacacccacuccc

SEQ ID NO: 1493207 - RNA, 21 nt, Homo sapiens
ucccaauaaaagugacucuca

SEQ ID NO: 1493208 - RNA, 22 nt, Homo sapiens
ucccaauaaaagugacucucag

SEQ ID NO: 1493209 - RNA, 12 nt, Homo sapiens
ucccaauuagcu

SEQ ID NO: 1493210 - RNA, 23 nt, Homo sapiens
ucccacacagaauauacauuguc

SEQ ID NO: 1493211 - RNA, 16 nt, Homo sapiens
ucccacaugaggccau

SEQ ID NO: 1493212 - RNA, 13 nt, Homo sapiens
ucccaccagagac

SEQ ID NO: 1493213 - RNA, 23 nt, Homo sapiens
ucccacccacacagcugcccuag

SEQ ID NO: 1493214 - RNA, 18 nt, Homo sapiens
ucccacccccaucucucc

SEQ ID NO: 1493215 - RNA, 23 nt, Homo sapiens
ucccaccucuccuuuugaggcuu

SEQ ID NO: 1493216 - RNA, 14 nt, Homo sapiens
ucccaccugcaucu

SEQ ID NO: 1493217 - RNA, 22 nt, Homo sapiens
ucccacguacuuauaaagaagg

SEQ ID NO: 1493218 - RNA, 20 nt, Homo sapiens
ucccacgucuggccaggcac

SEQ ID NO: 1493219 - RNA, 16 nt, Homo sapiens
ucccacuaaaacugca

SEQ ID NO: 1493220 - RNA, 21 nt, Homo sapiens
ucccacugcggggagacagaa

SEQ ID NO: 1493221 - RNA, 22 nt, Homo sapiens
ucccacuuggaggccuuucauc

SEQ ID NO: 1493222 - RNA, 13 nt, Homo sapiens
ucccagacacugg

SEQ ID NO: 1493223 - RNA, 17 nt, Homo sapiens
ucccagacauucauugu

SEQ ID NO: 1493224 - RNA, 17 nt, Homo sapiens
ucccagauggcuggaag

SEQ ID NO: 1493225 - RNA, 17 nt, Homo sapiens
ucccagccacucgggag

SEQ ID NO: 1493226 - RNA, 20 nt, Homo sapiens
ucccagccccggcaagccac

SEQ ID NO: 1493227 - RNA, 22 nt, Homo sapiens
ucccagccugggggccaguggg

SEQ ID NO: 1493228 - RNA, 15 nt, Homo sapiens
ucccagcuacuagag

SEQ ID NO: 1493229 - RNA, 13 nt, Homo sapiens
ucccagcuacuca

SEQ ID NO: 1493230 - RNA, 17 nt, Homo sapiens
ucccagcuacucgggag

SEQ ID NO: 1493231 - RNA, 15 nt, Homo sapiens
ucccagcuacuuggg

SEQ ID NO: 1493232 - RNA, 14 nt, Homo sapiens
ucccaggacccuga

SEQ ID NO: 1493233 - RNA, 14 nt, Homo sapiens
ucccaguggucaaa

SEQ ID NO: 1493234 - RNA, 15 nt, Homo sapiens
ucccaucauuacccu

SEQ ID NO: 1493235 - RNA, 14 nt, Homo sapiens
ucccauccuugaug

SEQ ID NO: 1493236 - RNA, 16 nt, Homo sapiens
ucccaucgcugucaca

SEQ ID NO: 1493237 - RNA, 18 nt, Homo sapiens
ucccaucuccccgcugaa

SEQ ID NO: 1493238 - RNA, 14 nt, Homo sapiens
ucccaucuuuacuc

SEQ ID NO: 1493239 - RNA, 15 nt, Homo sapiens
ucccaugacugcacc

SEQ ID NO: 1493240 - RNA, 18 nt, Homo sapiens
ucccauguuagcuacaca

SEQ ID NO: 1493241 - RNA, 21 nt, Homo sapiens
ucccauucgggagaucauguc

SEQ ID NO: 1493242 - RNA, 17 nt, Homo sapiens
uccccaagcccaccagg

SEQ ID NO: 1493243 - RNA, 20 nt, Homo sapiens
uccccacuucucucucccca

SEQ ID NO: 1493244 - RNA, 15 nt, Homo sapiens
uccccagacuccacc

SEQ ID NO: 1493245 - RNA, 18 nt, Homo sapiens
uccccaggggaaaaugaa

SEQ ID NO: 1493246 - RNA, 17 nt, Homo sapiens
uccccaggugugugcuu

SEQ ID NO: 1493247 - RNA, 13 nt, Homo sapiens
uccccagucccag

SEQ ID NO: 1493248 - RNA, 17 nt, Homo sapiens
uccccagucccagacaa

SEQ ID NO: 1493249 - RNA, 21 nt, Homo sapiens
uccccaguucauugcacuuug

SEQ ID NO: 1493250 - RNA, 16 nt, Homo sapiens
uccccauaggccauuu

SEQ ID NO: 1493251 - RNA, 23 nt, Homo sapiens
uccccauccaggucuugacucau

SEQ ID NO: 1493252 - RNA, 23 nt, Homo sapiens
uccccauccccacccagucucau

SEQ ID NO: 1493253 - RNA, 16 nt, Homo sapiens
ucccccaccagcugca

SEQ ID NO: 1493254 - RNA, 20 nt, Homo sapiens
ucccccagcuuucccgacac

SEQ ID NO: 1493255 - RNA, 15 nt, Homo sapiens
ucccccgccacuccu

SEQ ID NO: 1493256 - RNA, 16 nt, Homo sapiens
ucccccgccacuccug

SEQ ID NO: 1493257 - RNA, 21 nt, Homo sapiens
ucccccucaauagaucuccag

SEQ ID NO: 1493258 - RNA, 14 nt, Homo sapiens
uccccgugccaaaa

SEQ ID NO: 1493259 - RNA, 21 nt, Homo sapiens
uccccgugccaaaaaucuuuu

SEQ ID NO: 1493260 - RNA, 22 nt, Homo sapiens
uccccuagcuuuccccagacac

SEQ ID NO: 1493261 - RNA, 16 nt, Homo sapiens
uccccuagucacucau

SEQ ID NO: 1493262 - RNA, 22 nt, Homo sapiens
uccccuccacugucacauugua

SEQ ID NO: 1493263 - RNA, 14 nt, Homo sapiens
uccccucccagaug

SEQ ID NO: 1493264 - RNA, 16 nt, Homo sapiens
uccccucucagcauuu

SEQ ID NO: 1493265 - RNA, 18 nt, Homo sapiens
uccccucucagcauuucc

SEQ ID NO: 1493266 - RNA, 19 nt, Homo sapiens
uccccucuggaaugcacug

SEQ ID NO: 1493267 - RNA, 16 nt, Homo sapiens
uccccuggacugggag

SEQ ID NO: 1493268 - RNA, 22 nt, Homo sapiens
uccccuggggguuucaccuggg

SEQ ID NO: 1493269 - RNA, 18 nt, Homo sapiens
ucccgaauucgcuguuac

SEQ ID NO: 1493270 - RNA, 20 nt, Homo sapiens
ucccggcgucccuaccuccu

SEQ ID NO: 1493271 - RNA, 17 nt, Homo sapiens
ucccggggccagcacuu

SEQ ID NO: 1493272 - RNA, 22 nt, Homo sapiens
ucccggguucaagugauucucc

SEQ ID NO: 1493273 - RNA, 19 nt, Homo sapiens
ucccucagccucagaggag

SEQ ID NO: 1493274 - RNA, 20 nt, Homo sapiens
ucccuccagaauggaacuca

SEQ ID NO: 1493275 - RNA, 18 nt, Homo sapiens
ucccucccccccaugcac

SEQ ID NO: 1493276 - RNA, 16 nt, Homo sapiens
ucccuccccugccauu

SEQ ID NO: 1493277 - RNA, 22 nt, Homo sapiens
ucccucuaaaaguaaacuacug

SEQ ID NO: 1493278 - RNA, 23 nt, Homo sapiens
ucccucucagaggccugcugcca

SEQ ID NO: 1493279 - RNA, 22 nt, Homo sapiens
ucccucuuuggcuccccuguac

SEQ ID NO: 1493280 - RNA, 23 nt, Homo sapiens
ucccugaaaauguuuuucugcca

SEQ ID NO: 1493281 - RNA, 17 nt, Homo sapiens
ucccugaaaccuaguac

SEQ ID NO: 1493282 - RNA, 14 nt, Homo sapiens
ucccugacuccucc

SEQ ID NO: 1493283 - RNA, 17 nt, Homo sapiens
ucccugaggauggguca

SEQ ID NO: 1493284 - RNA, 15 nt, Homo sapiens
ucccugcagaccuca

SEQ ID NO: 1493285 - RNA, 15 nt, Homo sapiens
ucccugcucuugcag

SEQ ID NO: 1493286 - RNA, 15 nt, Homo sapiens
ucccugcuuugcauc

SEQ ID NO: 1493287 - RNA, 13 nt, Homo sapiens
ucccugggcauug

SEQ ID NO: 1493288 - RNA, 13 nt, Homo sapiens
ucccugggggccu

SEQ ID NO: 1493289 - RNA, 20 nt, Homo sapiens
ucccuguaauauuuagcugu

SEQ ID NO: 1493290 - RNA, 19 nt, Homo sapiens
ucccugucauagagcugca

SEQ ID NO: 1493291 - RNA, 16 nt, Homo sapiens
ucccugucauuugaac

SEQ ID NO: 1493292 - RNA, 20 nt, Homo sapiens
ucccugucccucuagugccu

SEQ ID NO: 1493293 - RNA, 18 nt, Homo sapiens
ucccuguguugucucuag

SEQ ID NO: 1493294 - RNA, 19 nt, Homo sapiens
ucccuuaagagucauccag

SEQ ID NO: 1493295 - RNA, 19 nt, Homo sapiens
ucccuuagugacucuugaa

SEQ ID NO: 1493296 - RNA, 17 nt, Homo sapiens
ucccuuccugaaggggg

SEQ ID NO: 1493297 - RNA, 19 nt, Homo sapiens
ucccuucucuuaauuuaau

SEQ ID NO: 1493298 - RNA, 21 nt, Homo sapiens
ucccuugcuggaaaacccaaa

SEQ ID NO: 1493299 - RNA, 15 nt, Homo sapiens
ucccuugcuguaugc

SEQ ID NO: 1493300 - RNA, 16 nt, Homo sapiens
ucccuugcuguaugcu

SEQ ID NO: 1493301 - RNA, 20 nt, Homo sapiens
ucccuugcuguaugcugauc

SEQ ID NO: 1493302 - RNA, 22 nt, Homo sapiens
ucccuuggaauaaaaacauuuc

SEQ ID NO: 1493303 - RNA, 17 nt, Homo sapiens
ucccuuuacagcaccac

SEQ ID NO: 1493304 - RNA, 21 nt, Homo sapiens
ucccuuuugcuagagcugaca

SEQ ID NO: 1493305 - RNA, 17 nt, Homo sapiens
uccgaggccgugcagug

SEQ ID NO: 1493306 - RNA, 17 nt, Homo sapiens
uccgcacccaguuugau

SEQ ID NO: 1493307 - RNA, 20 nt, Homo sapiens
uccgcagaauggacuugaua

SEQ ID NO: 1493308 - RNA, 14 nt, Homo sapiens
uccgccagauccug

SEQ ID NO: 1493309 - RNA, 16 nt, Homo sapiens
uccgccagauccugca

SEQ ID NO: 1493310 - RNA, 14 nt, Homo sapiens
uccgcgcaggugcc

SEQ ID NO: 1493311 - RNA, 17 nt, Homo sapiens
uccggaggcugaggcag

SEQ ID NO: 1493312 - RNA, 21 nt, Homo sapiens
uccggcaaugcccugugcaug

SEQ ID NO: 1493313 - RNA, 20 nt, Homo sapiens
uccuaacaaguagcacccug

SEQ ID NO: 1493314 - RNA, 16 nt, Homo sapiens
uccuaaggacacacua

SEQ ID NO: 1493315 - RNA, 22 nt, Homo sapiens
uccuaauaugcuuuacaaucug

SEQ ID NO: 1493316 - RNA, 14 nt, Homo sapiens
uccuacaagcuaaa

SEQ ID NO: 1493317 - RNA, 12 nt, Homo sapiens
uccuacacuuga

SEQ ID NO: 1493318 - RNA, 13 nt, Homo sapiens
uccuacacuugag

SEQ ID NO: 1493319 - RNA, 16 nt, Homo sapiens
uccuacccacaccucu

SEQ ID NO: 1493320 - RNA, 17 nt, Homo sapiens
uccuacccacaccucug

SEQ ID NO: 1493321 - RNA, 17 nt, Homo sapiens
uccuaccccuuugcacu

SEQ ID NO: 1493322 - RNA, 21 nt, Homo sapiens
uccuaggggaacagaccagug

SEQ ID NO: 1493323 - RNA, 18 nt, Homo sapiens
uccuaguggaugacuguu

SEQ ID NO: 1493324 - RNA, 21 nt, Homo sapiens
uccuaugcccagguaccaccc

SEQ ID NO: 1493325 - RNA, 16 nt, Homo sapiens
uccuaugggaacaauu

SEQ ID NO: 1493326 - RNA, 22 nt, Homo sapiens
uccuauucugaugaaucucaaa

SEQ ID NO: 1493327 - RNA, 22 nt, Homo sapiens
uccuauuuauaagagugccgua

SEQ ID NO: 1493328 - RNA, 22 nt, Homo sapiens
uccucacgcagacacacccaca

SEQ ID NO: 1493329 - RNA, 16 nt, Homo sapiens
uccucacuuugcugcc

SEQ ID NO: 1493330 - RNA, 19 nt, Homo sapiens
uccucagccuugccagaga

SEQ ID NO: 1493331 - RNA, 22 nt, Homo sapiens
uccucaggcacacagcuacucu

SEQ ID NO: 1493332 - RNA, 16 nt, Homo sapiens
uccuccaacaccaagc

SEQ ID NO: 1493333 - RNA, 22 nt, Homo sapiens
uccuccaacaccaagcacagca

SEQ ID NO: 1493334 - RNA, 13 nt, Homo sapiens
uccucccagugag

SEQ ID NO: 1493335 - RNA, 17 nt, Homo sapiens
uccucccccagcuaucu

SEQ ID NO: 1493336 - RNA, 14 nt, Homo sapiens
uccucccucugauu

SEQ ID NO: 1493337 - RNA, 16 nt, Homo sapiens
uccucccugucauaga

SEQ ID NO: 1493338 - RNA, 17 nt, Homo sapiens
uccuccguccauaucag

SEQ ID NO: 1493339 - RNA, 14 nt, Homo sapiens
uccuccugccucag

SEQ ID NO: 1493340 - RNA, 14 nt, Homo sapiens
uccuccugcugcag

SEQ ID NO: 1493341 - RNA, 20 nt, Homo sapiens
uccucgaggcccuagcauuu

SEQ ID NO: 1493342 - RNA, 13 nt, Homo sapiens
uccucgcugccag

SEQ ID NO: 1493343 - RNA, 20 nt, Homo sapiens
uccucuaagccacucuucca

SEQ ID NO: 1493344 - RNA, 19 nt, Homo sapiens
uccucucccauccuugaug

SEQ ID NO: 1493345 - RNA, 19 nt, Homo sapiens
uccucuccuccagcccaga

SEQ ID NO: 1493346 - RNA, 17 nt, Homo sapiens
uccucucuuaaaugcaa

SEQ ID NO: 1493347 - RNA, 21 nt, Homo sapiens
uccucugucagucacagccac

SEQ ID NO: 1493348 - RNA, 21 nt, Homo sapiens
uccucuguucuaaccacuuca

SEQ ID NO: 1493349 - RNA, 16 nt, Homo sapiens
uccugaaacaacuugg

SEQ ID NO: 1493350 - RNA, 19 nt, Homo sapiens
uccugaacucuucugcaaa

SEQ ID NO: 1493351 - RNA, 19 nt, Homo sapiens
uccugacuuuuaaugucau

SEQ ID NO: 1493352 - RNA, 16 nt, Homo sapiens
uccugagccaaggagg

SEQ ID NO: 1493353 - RNA, 14 nt, Homo sapiens
uccugaucugugau

SEQ ID NO: 1493354 - RNA, 15 nt, Homo sapiens
uccugaucugugaua

SEQ ID NO: 1493355 - RNA, 16 nt, Homo sapiens
uccugcaacucaagga

SEQ ID NO: 1493356 - RNA, 19 nt, Homo sapiens
uccugcagcaaacacucca

SEQ ID NO: 1493357 - RNA, 20 nt, Homo sapiens
uccugccagccccacacagc

SEQ ID NO: 1493358 - RNA, 14 nt, Homo sapiens
uccugccuggccag

SEQ ID NO: 1493359 - RNA, 15 nt, Homo sapiens
uccugcggcaucaga

SEQ ID NO: 1493360 - RNA, 22 nt, Homo sapiens
uccugcuacaacuucagcagua

SEQ ID NO: 1493361 - RNA, 11 nt, Homo sapiens
uccuggaccaa

SEQ ID NO: 1493362 - RNA, 19 nt, Homo sapiens
uccuggcacuaacguugag

SEQ ID NO: 1493363 - RNA, 15 nt, Homo sapiens
uccugggagcacugc

SEQ ID NO: 1493364 - RNA, 20 nt, Homo sapiens
uccugggagcccccaccaca

SEQ ID NO: 1493365 - RNA, 16 nt, Homo sapiens
uccugggccugcagaa

SEQ ID NO: 1493366 - RNA, 22 nt, Homo sapiens
uccuggguacugaaagccuuag

SEQ ID NO: 1493367 - RNA, 18 nt, Homo sapiens
uccugggucuaccacuca

SEQ ID NO: 1493368 - RNA, 22 nt, Homo sapiens
uccuggugccccccaccccugg

SEQ ID NO: 1493369 - RNA, 23 nt, Homo sapiens
uccugguuaaauuugaauuucag

SEQ ID NO: 1493370 - RNA, 17 nt, Homo sapiens
uccugguuccuuccuau

SEQ ID NO: 1493371 - RNA, 21 nt, Homo sapiens
uccugucuuaugguccagaaa

SEQ ID NO: 1493372 - RNA, 13 nt, Homo sapiens
uccugugccacua

SEQ ID NO: 1493373 - RNA, 20 nt, Homo sapiens
uccuguguguacucugucca

SEQ ID NO: 1493374 - RNA, 14 nt, Homo sapiens
uccuuaaaaacugg

SEQ ID NO: 1493375 - RNA, 23 nt, Homo sapiens
uccuuaaagcauuugcaacagcu

SEQ ID NO: 1493376 - RNA, 14 nt, Homo sapiens
uccuuaccagagac

SEQ ID NO: 1493377 - RNA, 14 nt, Homo sapiens
uccuuacucuugau

SEQ ID NO: 1493378 - RNA, 19 nt, Homo sapiens
uccuuagucucaagggcua

SEQ ID NO: 1493379 - RNA, 22 nt, Homo sapiens
uccuuauauuuggcccaaacuc

SEQ ID NO: 1493380 - RNA, 19 nt, Homo sapiens
uccuucccauuucucuaca

SEQ ID NO: 1493381 - RNA, 22 nt, Homo sapiens
uccuucccucaaagaggccuua

SEQ ID NO: 1493382 - RNA, 19 nt, Homo sapiens
uccuucccucucaugacuu

SEQ ID NO: 1493383 - RNA, 14 nt, Homo sapiens
uccuuccuaccucu

SEQ ID NO: 1493384 - RNA, 14 nt, Homo sapiens
uccuuccucaagaa

SEQ ID NO: 1493385 - RNA, 11 nt, Homo sapiens
uccuuccucuc

SEQ ID NO: 1493386 - RNA, 17 nt, Homo sapiens
uccuucgggugcuggaa

SEQ ID NO: 1493387 - RNA, 15 nt, Homo sapiens
uccuucucacacaca

SEQ ID NO: 1493388 - RNA, 21 nt, Homo sapiens
uccuucucugaacacaggcag

SEQ ID NO: 1493389 - RNA, 16 nt, Homo sapiens
uccuucugaccacagc

SEQ ID NO: 1493390 - RNA, 14 nt, Homo sapiens
uccuucugugaaag

SEQ ID NO: 1493391 - RNA, 21 nt, Homo sapiens
uccuucuuguaguagucucau

SEQ ID NO: 1493392 - RNA, 11 nt, Homo sapiens
uccuugcaaau

SEQ ID NO: 1493393 - RNA, 18 nt, Homo sapiens
uccuugcacaaauggagg

SEQ ID NO: 1493394 - RNA, 21 nt, Homo sapiens
uccuuggcgcugccaccugcc

SEQ ID NO: 1493395 - RNA, 15 nt, Homo sapiens
uccuuggcuuaccug

SEQ ID NO: 1493396 - RNA, 20 nt, Homo sapiens
uccuuggcuuaccugaccuc

SEQ ID NO: 1493397 - RNA, 17 nt, Homo sapiens
uccuuguaaagacugua

SEQ ID NO: 1493398 - RNA, 23 nt, Homo sapiens
uccuuuaaaaaacuuagugacaa

SEQ ID NO: 1493399 - RNA, 14 nt, Homo sapiens
uccuuuaccagaug

SEQ ID NO: 1493400 - RNA, 20 nt, Homo sapiens
uccuuucugugcccuacuca

SEQ ID NO: 1493401 - RNA, 20 nt, Homo sapiens
uccuuucuuuuaaugaugcc

SEQ ID NO: 1493402 - RNA, 15 nt, Homo sapiens
uccuuugcugcugag

SEQ ID NO: 1493403 - RNA, 14 nt, Homo sapiens
uccuuugugaauau

SEQ ID NO: 1493404 - RNA, 20 nt, Homo sapiens
uccuuuuaaaaaccuagguc

SEQ ID NO: 1493405 - RNA, 16 nt, Homo sapiens
uccuuuuaacugccaa

SEQ ID NO: 1493406 - RNA, 13 nt, Homo sapiens
uccuuuuccuuau

SEQ ID NO: 1493407 - RNA, 17 nt, Homo sapiens
uccuuuuugacacugaa

SEQ ID NO: 1493408 - RNA, 16 nt, Homo sapiens
ucgaaagaaaaugggc

SEQ ID NO: 1493409 - RNA, 17 nt, Homo sapiens
ucgaaauacaagccauu

SEQ ID NO: 1493410 - RNA, 15 nt, Homo sapiens
ucgaacuucacaacu

SEQ ID NO: 1493411 - RNA, 19 nt, Homo sapiens
ucgaagcuccgugagugaa

SEQ ID NO: 1493412 - RNA, 18 nt, Homo sapiens
ucgcaccacugcacucca

SEQ ID NO: 1493413 - RNA, 12 nt, Homo sapiens
ucgcaccuacca

SEQ ID NO: 1493414 - RNA, 20 nt, Homo sapiens
ucgcaccuaccaucagggac

SEQ ID NO: 1493415 - RNA, 21 nt, Homo sapiens
ucgcaggccucccugccagua

SEQ ID NO: 1493416 - RNA, 16 nt, Homo sapiens
ucgccacugcacucca

SEQ ID NO: 1493417 - RNA, 18 nt, Homo sapiens
ucgcccaggagacauccg

SEQ ID NO: 1493418 - RNA, 21 nt, Homo sapiens
ucgcuauugauuuuuacuuca

SEQ ID NO: 1493419 - RNA, 22 nt, Homo sapiens
ucgcuauugauuuuuacuucaa

SEQ ID NO: 1493420 - RNA, 23 nt, Homo sapiens
ucgcuauugauuuuuacuucaau

SEQ ID NO: 1493421 - RNA, 19 nt, Homo sapiens
ucgcugcccucucugccag

SEQ ID NO: 1493422 - RNA, 23 nt, Homo sapiens
ucggaacagcagauaacaaugca

SEQ ID NO: 1493423 - RNA, 16 nt, Homo sapiens
ucggagagcagcagca

SEQ ID NO: 1493424 - RNA, 21 nt, Homo sapiens
ucggauacccuggagcaagac

SEQ ID NO: 1493425 - RNA, 19 nt, Homo sapiens
ucggcagcuacucagagga

SEQ ID NO: 1493426 - RNA, 18 nt, Homo sapiens
ucggcccuguuccccaag

SEQ ID NO: 1493427 - RNA, 15 nt, Homo sapiens
ucggccuccaugacc

SEQ ID NO: 1493428 - RNA, 14 nt, Homo sapiens
ucgggaacaguguu

SEQ ID NO: 1493429 - RNA, 17 nt, Homo sapiens
ucgggaggcugagacag

SEQ ID NO: 1493430 - RNA, 15 nt, Homo sapiens
ucggugguaccugag

SEQ ID NO: 1493431 - RNA, 19 nt, Homo sapiens
ucgugaaaccccaucucua

SEQ ID NO: 1493432 - RNA, 23 nt, Homo sapiens
ucguuuuucagcacccccaccca

SEQ ID NO: 1493433 - RNA, 15 nt, Homo sapiens
ucuaaaaacuuagaa

SEQ ID NO: 1493434 - RNA, 22 nt, Homo sapiens
ucuaaaaagauuagcaagguca

SEQ ID NO: 1493435 - RNA, 16 nt, Homo sapiens
ucuaacaaaaacuaca

SEQ ID NO: 1493436 - RNA, 24 nt, Homo sapiens
ucuaacccaacugacuuguaucug

SEQ ID NO: 1493437 - RNA, 16 nt, Homo sapiens
ucuaacucagaauuau

SEQ ID NO: 1493438 - RNA, 17 nt, Homo sapiens
ucuaagauaguaacaau

SEQ ID NO: 1493439 - RNA, 20 nt, Homo sapiens
ucuaaguggaaaaaguauua

SEQ ID NO: 1493440 - RNA, 14 nt, Homo sapiens
ucuaauauggccac

SEQ ID NO: 1493441 - RNA, 13 nt, Homo sapiens
ucuaaucaaaagg

SEQ ID NO: 1493442 - RNA, 21 nt, Homo sapiens
ucuaaucaaaagggaaaagaa

SEQ ID NO: 1493443 - RNA, 20 nt, Homo sapiens
ucuacaagauccuccugcug

SEQ ID NO: 1493444 - RNA, 19 nt, Homo sapiens
ucuacacccaccagaguga

SEQ ID NO: 1493445 - RNA, 16 nt, Homo sapiens
ucuacagaauaaucca

SEQ ID NO: 1493446 - RNA, 23 nt, Homo sapiens
ucuacagauccuuuuuccaucau

SEQ ID NO: 1493447 - RNA, 17 nt, Homo sapiens
ucuacauaaguaauuca

SEQ ID NO: 1493448 - RNA, 21 nt, Homo sapiens
ucuacauaaguaauucaagaa

SEQ ID NO: 1493449 - RNA, 15 nt, Homo sapiens
ucuacccuauacaac

SEQ ID NO: 1493450 - RNA, 19 nt, Homo sapiens
ucuacccugcugaccuccc

SEQ ID NO: 1493451 - RNA, 20 nt, Homo sapiens
ucuaccucaggcagcucaag

SEQ ID NO: 1493452 - RNA, 15 nt, Homo sapiens
ucuacuaauuccaca

SEQ ID NO: 1493453 - RNA, 16 nt, Homo sapiens
ucuacuaccacaagga

SEQ ID NO: 1493454 - RNA, 12 nt, Homo sapiens
ucuagaagccaa

SEQ ID NO: 1493455 - RNA, 22 nt, Homo sapiens
ucuagaauguggauuugauuca

SEQ ID NO: 1493456 - RNA, 20 nt, Homo sapiens
ucuagaauuauaagucacaa

SEQ ID NO: 1493457 - RNA, 18 nt, Homo sapiens
ucuagacaacuaccccuu

SEQ ID NO: 1493458 - RNA, 15 nt, Homo sapiens
ucuagaggcaaggag

SEQ ID NO: 1493459 - RNA, 18 nt, Homo sapiens
ucuagauuauggagcuuu

SEQ ID NO: 1493460 - RNA, 15 nt, Homo sapiens
ucuagcaccaggacu

SEQ ID NO: 1493461 - RNA, 16 nt, Homo sapiens
ucuagcaccaggacuc

SEQ ID NO: 1493462 - RNA, 18 nt, Homo sapiens
ucuaguaagaugcacuga

SEQ ID NO: 1493463 - RNA, 21 nt, Homo sapiens
ucuagucuccuuugcacugag

SEQ ID NO: 1493464 - RNA, 19 nt, Homo sapiens
ucuaguugccaaaucuggc

SEQ ID NO: 1493465 - RNA, 15 nt, Homo sapiens
ucuaguuuugucaaa

SEQ ID NO: 1493466 - RNA, 13 nt, Homo sapiens
ucuauaaauaacc

SEQ ID NO: 1493467 - RNA, 14 nt, Homo sapiens
ucuauaaggccaua

SEQ ID NO: 1493468 - RNA, 13 nt, Homo sapiens
ucuauacaacagg

SEQ ID NO: 1493469 - RNA, 19 nt, Homo sapiens
ucuauagcugcuauagcaa

SEQ ID NO: 1493470 - RNA, 19 nt, Homo sapiens
ucuauccaaagaacuugau

SEQ ID NO: 1493471 - RNA, 12 nt, Homo sapiens
ucuauccaaauc

SEQ ID NO: 1493472 - RNA, 17 nt, Homo sapiens
ucuaugaagaguauuaa

SEQ ID NO: 1493473 - RNA, 23 nt, Homo sapiens
ucuaugaccucgcccuccacaaa

SEQ ID NO: 1493474 - RNA, 14 nt, Homo sapiens
ucuaugguugacau

SEQ ID NO: 1493475 - RNA, 13 nt, Homo sapiens
ucuauguuugcac

SEQ ID NO: 1493476 - RNA, 15 nt, Homo sapiens
ucuauucaagcacuu

SEQ ID NO: 1493477 - RNA, 20 nt, Homo sapiens
ucuauugagugaacagaauu

SEQ ID NO: 1493478 - RNA, 15 nt, Homo sapiens
ucuauuuuacuuugu

SEQ ID NO: 1493479 - RNA, 20 nt, Homo sapiens
ucucaaacuccugggcucaa

SEQ ID NO: 1493480 - RNA, 16 nt, Homo sapiens
ucucaaagauucacac

SEQ ID NO: 1493481 - RNA, 12 nt, Homo sapiens
ucucaacugagg

SEQ ID NO: 1493482 - RNA, 15 nt, Homo sapiens
ucucaagcuaguguu

SEQ ID NO: 1493483 - RNA, 23 nt, Homo sapiens
ucucaauaacaaacuggcugcuu

SEQ ID NO: 1493484 - RNA, 15 nt, Homo sapiens
ucucacacauuccag

SEQ ID NO: 1493485 - RNA, 14 nt, Homo sapiens
ucucacauguggca

SEQ ID NO: 1493486 - RNA, 15 nt, Homo sapiens
ucucacccauuaucu

SEQ ID NO: 1493487 - RNA, 16 nt, Homo sapiens
ucucaccuggacucca

SEQ ID NO: 1493488 - RNA, 23 nt, Homo sapiens
ucucacgggcaugggcacucccu

SEQ ID NO: 1493489 - RNA, 14 nt, Homo sapiens
ucucacuagugcca

SEQ ID NO: 1493490 - RNA, 18 nt, Homo sapiens
ucucacuugugcaguguu

SEQ ID NO: 1493491 - RNA, 23 nt, Homo sapiens
ucucagaacccaucgguaggcaa

SEQ ID NO: 1493492 - RNA, 13 nt, Homo sapiens
accugcaugugcu

SEQ ID NO: 1493493 - RNA, 17 nt, Homo sapiens
accugcccaaggaugcu

SEQ ID NO: 1493494 - RNA, 19 nt, Homo sapiens
accugcccaaggaugcugu

SEQ ID NO: 1493495 - RNA, 14 nt, Homo sapiens
accugcugugauac

SEQ ID NO: 1493496 - RNA, 17 nt, Homo sapiens
accugcuuagcugccuu

SEQ ID NO: 1493497 - RNA, 21 nt, Homo sapiens
accuggagcggcuauuccagg

SEQ ID NO: 1493498 - RNA, 16 nt, Homo sapiens
accuggcccuugcaau

SEQ ID NO: 1493499 - RNA, 16 nt, Homo sapiens
accuguaaucauauaa

SEQ ID NO: 1493500 - RNA, 15 nt, Homo sapiens
accuguaaucccagc

SEQ ID NO: 1493501 - RNA, 19 nt, Homo sapiens
accuguagucccaguuacu

SEQ ID NO: 1493502 - RNA, 18 nt, Homo sapiens
accugucuaggucuccuc

SEQ ID NO: 1493503 - RNA, 18 nt, Homo sapiens
accugucuauaagagaau

SEQ ID NO: 1493504 - RNA, 22 nt, Homo sapiens
accuguuuucgcaccuaccauc

SEQ ID NO: 1493505 - RNA, 19 nt, Homo sapiens
accuguuuuuaagcuguuu

SEQ ID NO: 1493506 - RNA, 21 nt, Homo sapiens
accuguuuuuuuuucauuuau

SEQ ID NO: 1493507 - RNA, 14 nt, Homo sapiens
accuuaaacaagcu

SEQ ID NO: 1493508 - RNA, 22 nt, Homo sapiens
acuagccaggaaguacuuccac

SEQ ID NO: 1493509 - RNA, 15 nt, Homo sapiens
acuagggaagcucag

SEQ ID NO: 1493510 - RNA, 13 nt, Homo sapiens
acuaguagucaua

SEQ ID NO: 1493511 - RNA, 19 nt, Homo sapiens
acuagucacauucuuguuu

SEQ ID NO: 1493512 - RNA, 19 nt, Homo sapiens
acuagugacacauuguaca

SEQ ID NO: 1493513 - RNA, 16 nt, Homo sapiens
acuagugacagcuugu

SEQ ID NO: 1493514 - RNA, 16 nt, Homo sapiens
acuagugcaggguaug

SEQ ID NO: 1493515 - RNA, 22 nt, Homo sapiens
acuaguuugcuuugcugaccaa

SEQ ID NO: 1493516 - RNA, 22 nt, Homo sapiens
acuauaaauaauauucuauuca

SEQ ID NO: 1493517 - RNA, 22 nt, Homo sapiens
acuauaaauacaaaucuguaua

SEQ ID NO: 1493518 - RNA, 13 nt, Homo sapiens
acuauaccuuauc

SEQ ID NO: 1493519 - RNA, 23 nt, Homo sapiens
acuaugagccaggcaucauacua

SEQ ID NO: 1493520 - RNA, 20 nt, Homo sapiens
acuaugguuuucauuuacuc

SEQ ID NO: 1493521 - RNA, 15 nt, Homo sapiens
acuauguugccuaag

SEQ ID NO: 1493522 - RNA, 15 nt, Homo sapiens
acuauuaagcaguaa

SEQ ID NO: 1493523 - RNA, 22 nt, Homo sapiens
acuuuuacacgaccauuugaua

SEQ ID NO: 1493524 - RNA, 16 nt, Homo sapiens
acuuuuacucugccua

SEQ ID NO: 1493525 - RNA, 15 nt, Homo sapiens
acuuuucgacauauu

SEQ ID NO: 1493526 - RNA, 20 nt, Homo sapiens
acuuuucuaacauaugucua

SEQ ID NO: 1493527 - RNA, 15 nt, Homo sapiens
acuuuucugcugaua

SEQ ID NO: 1493528 - RNA, 23 nt, Homo sapiens
acuuuucuuuuuuucaaaugaau

SEQ ID NO: 1493529 - RNA, 18 nt, Homo sapiens
acuuuuggcuccucuagu

SEQ ID NO: 1493530 - RNA, 16 nt, Homo sapiens
acuuuuguguaaugaa

SEQ ID NO: 1493531 - RNA, 22 nt, Homo sapiens
acuuuuguguaucguaaccagc

SEQ ID NO: 1493532 - RNA, 18 nt, Homo sapiens
acuuuuuacagugcuauu

SEQ ID NO: 1493533 - RNA, 21 nt, Homo sapiens
acuuuuuuagaaaugcaaaau

SEQ ID NO: 1493534 - RNA, 17 nt, Homo sapiens
agaaaaauaaaucuguu

SEQ ID NO: 1493535 - RNA, 12 nt, Homo sapiens
agaaaacaucuu

SEQ ID NO: 1493536 - RNA, 17 nt, Homo sapiens
agaaaaccuagaucugc

SEQ ID NO: 1493537 - RNA, 14 nt, Homo sapiens
agaaaaccuguauu

SEQ ID NO: 1493538 - RNA, 21 nt, Homo sapiens
agaaaacuugacauguagcuu

SEQ ID NO: 1493539 - RNA, 15 nt, Homo sapiens
agaaaagacucugac

SEQ ID NO: 1493540 - RNA, 14 nt, Homo sapiens
agaaaagugcauau

SEQ ID NO: 1493541 - RNA, 21 nt, Homo sapiens
agaaaagugcauauuuaucca

SEQ ID NO: 1493542 - RNA, 15 nt, Homo sapiens
agaaaaguugcagau

SEQ ID NO: 1493543 - RNA, 15 nt, Homo sapiens
agaaaauaauuaauu

SEQ ID NO: 1493544 - RNA, 15 nt, Homo sapiens
agaaaauacaauaaa

SEQ ID NO: 1493545 - RNA, 22 nt, Homo sapiens
agaaaaugauguguacccaaac

SEQ ID NO: 1493546 - RNA, 13 nt, Homo sapiens
agaaaaugccuca

SEQ ID NO: 1493547 - RNA, 16 nt, Homo sapiens
agaaacaaacaucuaa

SEQ ID NO: 1493548 - RNA, 20 nt, Homo sapiens
agaaacagauaacaccaaac

SEQ ID NO: 1493549 - RNA, 12 nt, Homo sapiens
agaaacccaggg

SEQ ID NO: 1493550 - RNA, 16 nt, Homo sapiens
agaaacccuucacacc

SEQ ID NO: 1493551 - RNA, 15 nt, Homo sapiens
agaaaccuaaaauaa

SEQ ID NO: 1493552 - RNA, 21 nt, Homo sapiens
agaaaccuuauuguaccucuc

SEQ ID NO: 1493553 - RNA, 17 nt, Homo sapiens
agaaacuugcugaucca

SEQ ID NO: 1493554 - RNA, 14 nt, Homo sapiens
agaaagaagccaua

SEQ ID NO: 1493555 - RNA, 19 nt, Homo sapiens
agaaagaauuggccaggca

SEQ ID NO: 1493556 - RNA, 15 nt, Homo sapiens
agaaagacuaucuaa

SEQ ID NO: 1493557 - RNA, 19 nt, Homo sapiens
agaaagagacuccgucuca

SEQ ID NO: 1493558 - RNA, 12 nt, Homo sapiens
agaaagccaaau

SEQ ID NO: 1493559 - RNA, 18 nt, Homo sapiens
agaaaguaaaaaguugcu

SEQ ID NO: 1493560 - RNA, 16 nt, Homo sapiens
agaaaguuaaccccau

SEQ ID NO: 1493561 - RNA, 14 nt, Homo sapiens
agaaauaauaugca

SEQ ID NO: 1493562 - RNA, 21 nt, Homo sapiens
agaaauacaauuuuagauauc

SEQ ID NO: 1493563 - RNA, 23 nt, Homo sapiens
agaaauacaauuuuagauaucau

SEQ ID NO: 1493564 - RNA, 15 nt, Homo sapiens
agaaauauauauaac

SEQ ID NO: 1493565 - RNA, 14 nt, Homo sapiens
agaaauauaugcag

SEQ ID NO: 1493566 - RNA, 19 nt, Homo sapiens
agaaauaucugaaaaugua

SEQ ID NO: 1493567 - RNA, 14 nt, Homo sapiens
agaaauauggacac

SEQ ID NO: 1493568 - RNA, 12 nt, Homo sapiens
agaaaugaauau

SEQ ID NO: 1493569 - RNA, 13 nt, Homo sapiens
agaaaugcaaaac

SEQ ID NO: 1493570 - RNA, 13 nt, Homo sapiens
agaaaugcugcug

SEQ ID NO: 1493571 - RNA, 20 nt, Homo sapiens
agaaauggacuggagcucau

SEQ ID NO: 1493572 - RNA, 14 nt, Homo sapiens
agaaauuagcugug

SEQ ID NO: 1493573 - RNA, 23 nt, Homo sapiens
agaaauuaguuucaaauuuaccu

SEQ ID NO: 1493574 - RNA, 11 nt, Homo sapiens
agaaauucugu

SEQ ID NO: 1493575 - RNA, 22 nt, Homo sapiens
agaaauugacacaaguggaccu

SEQ ID NO: 1493576 - RNA, 15 nt, Homo sapiens
agaacaacuacugug

SEQ ID NO: 1493577 - RNA, 21 nt, Homo sapiens
agaacaguggcucguauccca

SEQ ID NO: 1493578 - RNA, 23 nt, Homo sapiens
agaacauuuuaauucaucccaac

SEQ ID NO: 1493579 - RNA, 13 nt, Homo sapiens
agaaccacuuccu

SEQ ID NO: 1493580 - RNA, 14 nt, Homo sapiens
agaaccacuuccug

SEQ ID NO: 1493581 - RNA, 14 nt, Homo sapiens
agaaccgagcaaag

SEQ ID NO: 1493582 - RNA, 19 nt, Homo sapiens
agaaccucagcauuuccuu

SEQ ID NO: 1493583 - RNA, 13 nt, Homo sapiens
agaaccuggaaaa

SEQ ID NO: 1493584 - RNA, 14 nt, Homo sapiens
agaaccuucaaccc

SEQ ID NO: 1493585 - RNA, 15 nt, Homo sapiens
agaaccuucaaccca

SEQ ID NO: 1493586 - RNA, 16 nt, Homo sapiens
agaacuacagcucuua

SEQ ID NO: 1493587 - RNA, 15 nt, Homo sapiens
agaacucacucuggg

SEQ ID NO: 1493588 - RNA, 18 nt, Homo sapiens
agaacucugggcugcuac

SEQ ID NO: 1493589 - RNA, 18 nt, Homo sapiens
agaacucuugacuuccug

SEQ ID NO: 1493590 - RNA, 14 nt, Homo sapiens
agaacugucuguga

SEQ ID NO: 1493591 - RNA, 14 nt, Homo sapiens
agaacuugaccccc

SEQ ID NO: 1493592 - RNA, 17 nt, Homo sapiens
agaacuuuucgacauau

SEQ ID NO: 1493593 - RNA, 15 nt, Homo sapiens
agaagaaacuuugcc

SEQ ID NO: 1493594 - RNA, 15 nt, Homo sapiens
agaagacucugaccu

SEQ ID NO: 1493595 - RNA, 14 nt, Homo sapiens
agaagagacuggga

SEQ ID NO: 1493596 - RNA, 16 nt, Homo sapiens
agaagaggaaagggag

SEQ ID NO: 1493597 - RNA, 13 nt, Homo sapiens
agaagaggcugcu

SEQ ID NO: 1493598 - RNA, 16 nt, Homo sapiens
agaagaggcuggugcu

SEQ ID NO: 1493599 - RNA, 19 nt, Homo sapiens
agaagaggcuggugcugug

SEQ ID NO: 1493600 - RNA, 15 nt, Homo sapiens
agaagauagauccaa

SEQ ID NO: 1493601 - RNA, 18 nt, Homo sapiens
agaagauagaugcacuua

SEQ ID NO: 1493602 - RNA, 20 nt, Homo sapiens
agaagcacccaggacuucca

SEQ ID NO: 1493603 - RNA, 20 nt, Homo sapiens
agaagccacgcuguccucuc

SEQ ID NO: 1493604 - RNA, 18 nt, Homo sapiens
agaagccaguggacaguu

SEQ ID NO: 1493605 - RNA, 19 nt, Homo sapiens
agaagccuccaagcacaga

SEQ ID NO: 1493606 - RNA, 23 nt, Homo sapiens
agaagcuaaauccuuuacuguua

SEQ ID NO: 1493607 - RNA, 20 nt, Homo sapiens
agaagcuguuguacauuuau

SEQ ID NO: 1493608 - RNA, 20 nt, Homo sapiens
agaagcuuaaaaucugugaa

SEQ ID NO: 1493609 - RNA, 13 nt, Homo sapiens
agaaggauuaccu

SEQ ID NO: 1493610 - RNA, 17 nt, Homo sapiens
agaagggauaacccuac

SEQ ID NO: 1493611 - RNA, 15 nt, Homo sapiens
agggcuagugacuug

SEQ ID NO: 1493612 - RNA, 13 nt, Homo sapiens
agggcugacauuu

SEQ ID NO: 1493613 - RNA, 15 nt, Homo sapiens
agggcugagugucca

SEQ ID NO: 1493614 - RNA, 16 nt, Homo sapiens
agggcuggucagggug

SEQ ID NO: 1493615 - RNA, 15 nt, Homo sapiens
aggggacaggccugu

SEQ ID NO: 1493616 - RNA, 20 nt, Homo sapiens
aggggacucagcccugaggu

SEQ ID NO: 1493617 - RNA, 12 nt, Homo sapiens
aggggacugggg

SEQ ID NO: 1493618 - RNA, 23 nt, Homo sapiens
aggggagcaaaaucgaugcagug

SEQ ID NO: 1493619 - RNA, 20 nt, Homo sapiens
aggggccuuagggcacuggg

SEQ ID NO: 1493620 - RNA, 15 nt, Homo sapiens
aggggcuacugugac

SEQ ID NO: 1493621 - RNA, 23 nt, Homo sapiens
aggggcugcagggccacuggaag

SEQ ID NO: 1493622 - RNA, 21 nt, Homo sapiens
aggggcuguggccgucuccuc

SEQ ID NO: 1493623 - RNA, 15 nt, Homo sapiens
agggggagaaugggu

SEQ ID NO: 1493624 - RNA, 18 nt, Homo sapiens
agggggagaauggguguu

SEQ ID NO: 1493625 - RNA, 21 nt, Homo sapiens
agggggaugccacuccucccu

SEQ ID NO: 1493626 - RNA, 18 nt, Homo sapiens
agggggcugcccucucca

SEQ ID NO: 1493627 - RNA, 23 nt, Homo sapiens
aggggguucuuauuuugcauucc

SEQ ID NO: 1493628 - RNA, 13 nt, Homo sapiens
agaauauauuucc

SEQ ID NO: 1493629 - RNA, 15 nt, Homo sapiens
agaauauauuuccuu

SEQ ID NO: 1493630 - RNA, 13 nt, Homo sapiens
agaauaucuggga

SEQ ID NO: 1493631 - RNA, 14 nt, Homo sapiens
agaauaucugggau

SEQ ID NO: 1493632 - RNA, 19 nt, Homo sapiens
agaauauugucugccuuaa

SEQ ID NO: 1493633 - RNA, 21 nt, Homo sapiens
agaauauuuuaagaauuucac

SEQ ID NO: 1493634 - RNA, 15 nt, Homo sapiens
agaaucauggagaaa

SEQ ID NO: 1493635 - RNA, 15 nt, Homo sapiens
agaaucccugccugu

SEQ ID NO: 1493636 - RNA, 19 nt, Homo sapiens
agaaucccuuaaaauuacc

SEQ ID NO: 1493637 - RNA, 16 nt, Homo sapiens
agaaugaaauguaugu

SEQ ID NO: 1493638 - RNA, 18 nt, Homo sapiens
agaaugaaauguaugugc

SEQ ID NO: 1493639 - RNA, 20 nt, Homo sapiens
agaaugaaauguaugugcuc

SEQ ID NO: 1493640 - RNA, 18 nt, Homo sapiens
agaaugaauaauaauuau

SEQ ID NO: 1493641 - RNA, 15 nt, Homo sapiens
agaauuaacagagau

SEQ ID NO: 1493642 - RNA, 18 nt, Homo sapiens
agaauuauaagucacaaa

SEQ ID NO: 1493643 - RNA, 15 nt, Homo sapiens
agaauuauuugcacu

SEQ ID NO: 1493644 - RNA, 23 nt, Homo sapiens
agaauuccuuuucuaacucuccc

SEQ ID NO: 1493645 - RNA, 15 nt, Homo sapiens
agaauuuccacugua

SEQ ID NO: 1493646 - RNA, 11 nt, Homo sapiens
agaauuugcac

SEQ ID NO: 1493647 - RNA, 20 nt, Homo sapiens
agacaaagggagccgagacc

SEQ ID NO: 1493648 - RNA, 18 nt, Homo sapiens
agacaaagugacauuccu

SEQ ID NO: 1493649 - RNA, 16 nt, Homo sapiens
agacaacagaagucau

SEQ ID NO: 1493650 - RNA, 16 nt, Homo sapiens
agacaagcugcauuuc

SEQ ID NO: 1493651 - RNA, 14 nt, Homo sapiens
agacaauaugugag

SEQ ID NO: 1493652 - RNA, 13 nt, Homo sapiens
agacaauuugcac

SEQ ID NO: 1493653 - RNA, 17 nt, Homo sapiens
agacaccagcagcccug

SEQ ID NO: 1493654 - RNA, 19 nt, Homo sapiens
agacacccaggacuuauuu

SEQ ID NO: 1493655 - RNA, 16 nt, Homo sapiens
agacacccucuccuua

SEQ ID NO: 1493656 - RNA, 14 nt, Homo sapiens
agacacuaccccau

SEQ ID NO: 1493657 - RNA, 13 nt, Homo sapiens
agacagaagcuua

SEQ ID NO: 1493658 - RNA, 14 nt, Homo sapiens
agacagaagcuuaa

SEQ ID NO: 1493659 - RNA, 16 nt, Homo sapiens
agacagacuugagaac

SEQ ID NO: 1493660 - RNA, 23 nt, Homo sapiens
agacagcaggcagcgccaagugc

SEQ ID NO: 1493661 - RNA, 20 nt, Homo sapiens
agacaggaugguuacucuug

SEQ ID NO: 1493662 - RNA, 19 nt, Homo sapiens
agacaggccccgugaggca

SEQ ID NO: 1493663 - RNA, 18 nt, Homo sapiens
agacaguaugagucaaug

SEQ ID NO: 1493664 - RNA, 14 nt, Homo sapiens
agacauaucucuaa

SEQ ID NO: 1493665 - RNA, 14 nt, Homo sapiens
agacaugaaugcac

SEQ ID NO: 1493666 - RNA, 21 nt, Homo sapiens
agacaugauuuccuugaaugu

SEQ ID NO: 1493667 - RNA, 15 nt, Homo sapiens
agacaugcagcuuuc

SEQ ID NO: 1493668 - RNA, 18 nt, Homo sapiens
agacauggagacuccugc

SEQ ID NO: 1493669 - RNA, 16 nt, Homo sapiens
agacauguaucacugu

SEQ ID NO: 1493670 - RNA, 20 nt, Homo sapiens
agaccaacucucuccuguau

SEQ ID NO: 1493671 - RNA, 22 nt, Homo sapiens
agaccaaggcgggagcaucucu

SEQ ID NO: 1493672 - RNA, 22 nt, Homo sapiens
agacccaacagcagugaucuca

SEQ ID NO: 1493673 - RNA, 13 nt, Homo sapiens
agacccacagacu

SEQ ID NO: 1493674 - RNA, 14 nt, Homo sapiens
agacccaguggacu

SEQ ID NO: 1493675 - RNA, 21 nt, Homo sapiens
agacccaguggacucuuccac

SEQ ID NO: 1493676 - RNA, 16 nt, Homo sapiens
agacccccagcacuug

SEQ ID NO: 1493677 - RNA, 21 nt, Homo sapiens
agacccugagaaggacccugg

SEQ ID NO: 1493678 - RNA, 23 nt, Homo sapiens
agacccuugacaccugcugagaa

SEQ ID NO: 1493679 - RNA, 16 nt, Homo sapiens
agaccuaggauuucau

SEQ ID NO: 1493680 - RNA, 14 nt, Homo sapiens
agaccucaagccau

SEQ ID NO: 1493681 - RNA, 23 nt, Homo sapiens
agaccugaaagaugggcaaaaga

SEQ ID NO: 1493682 - RNA, 19 nt, Homo sapiens
agaccugacaagcacugcu

SEQ ID NO: 1493683 - RNA, 14 nt, Homo sapiens
agaccugacguccc

SEQ ID NO: 1493684 - RNA, 14 nt, Homo sapiens
agaccugauccugg

SEQ ID NO: 1493685 - RNA, 21 nt, Homo sapiens
agaccuggagcggcuauucca

SEQ ID NO: 1493686 - RNA, 15 nt, Homo sapiens
agaccuggcacugga

SEQ ID NO: 1493687 - RNA, 20 nt, Homo sapiens
agaccuuccaaggacauauu

SEQ ID NO: 1493688 - RNA, 21 nt, Homo sapiens
agacgggaauucaugcaaaug

SEQ ID NO: 1493689 - RNA, 18 nt, Homo sapiens
agacuaauucuaaugugg

SEQ ID NO: 1493690 - RNA, 18 nt, Homo sapiens
agacuacacaggaugagg

SEQ ID NO: 1493691 - RNA, 14 nt, Homo sapiens
agacuagugccgua

SEQ ID NO: 1493692 - RNA, 14 nt, Homo sapiens
agacuauagccauc

SEQ ID NO: 1493693 - RNA, 16 nt, Homo sapiens
agacuccaucucuucu

SEQ ID NO: 1493694 - RNA, 18 nt, Homo sapiens
agacuccgucucaaaaga

SEQ ID NO: 1493695 - RNA, 14 nt, Homo sapiens
agacucuauucuca

SEQ ID NO: 1493696 - RNA, 12 nt, Homo sapiens
agacucugaccu

SEQ ID NO: 1493697 - RNA, 18 nt, Homo sapiens
agacucugggcugucagc

SEQ ID NO: 1493698 - RNA, 17 nt, Homo sapiens
agacugaaucuaccugc

SEQ ID NO: 1493699 - RNA, 17 nt, Homo sapiens
agacuggggacccugga

SEQ ID NO: 1493700 - RNA, 20 nt, Homo sapiens
agacugugacaacugucuaa

SEQ ID NO: 1493701 - RNA, 18 nt, Homo sapiens
agacuguugccacuuaac

SEQ ID NO: 1493702 - RNA, 15 nt, Homo sapiens
agacuguugcucaaa

SEQ ID NO: 1493703 - RNA, 15 nt, Homo sapiens
agacuuauugccaaa

SEQ ID NO: 1493704 - RNA, 16 nt, Homo sapiens
agacuucaccuaacua

SEQ ID NO: 1493705 - RNA, 17 nt, Homo sapiens
agacuucagcuguuccu

SEQ ID NO: 1493706 - RNA, 16 nt, Homo sapiens
agacuucgacucagga

SEQ ID NO: 1493707 - RNA, 21 nt, Homo sapiens
agacuuggcuccaccacugau

SEQ ID NO: 1493708 - RNA, 19 nt, Homo sapiens
agacuuggggaaauugcuu

SEQ ID NO: 1493709 - RNA, 15 nt, Homo sapiens
agacuuucuucucua

SEQ ID NO: 1493710 - RNA, 16 nt, Homo sapiens
agagaaauacuuucag

SEQ ID NO: 1493711 - RNA, 14 nt, Homo sapiens
agagaaucauacuu

SEQ ID NO: 1493712 - RNA, 22 nt, Homo sapiens
agagaaugagaagaggcugcug

SEQ ID NO: 1493713 - RNA, 14 nt, Homo sapiens
agagaccugagucu

SEQ ID NO: 1493714 - RNA, 16 nt, Homo sapiens
agagacugucccugaa

SEQ ID NO: 1493715 - RNA, 22 nt, Homo sapiens
agagagaacuuuucgacauauu

SEQ ID NO: 1493716 - RNA, 23 nt, Homo sapiens
aguaaguacuuaauaaacugugg

SEQ ID NO: 1493717 - RNA, 17 nt, Homo sapiens
aguaauacaucaaagag

SEQ ID NO: 1493718 - RNA, 14 nt, Homo sapiens
aguacaaugcccag

SEQ ID NO: 1493719 - RNA, 16 nt, Homo sapiens
aguacagccuggacca

SEQ ID NO: 1493720 - RNA, 17 nt, Homo sapiens
aguacaucucuacuaaa

SEQ ID NO: 1493721 - RNA, 18 nt, Homo sapiens
aguacaucucuacuaaaa

SEQ ID NO: 1493722 - RNA, 21 nt, Homo sapiens
aguaccaggggcugggcuccc

SEQ ID NO: 1493723 - RNA, 15 nt, Homo sapiens
aguacccuuucaaac

SEQ ID NO: 1493724 - RNA, 18 nt, Homo sapiens
aguaccuacaucagucaa

SEQ ID NO: 1493725 - RNA, 18 nt, Homo sapiens
aguaccuacugugugcca

SEQ ID NO: 1493726 - RNA, 22 nt, Homo sapiens
aguaccucuguauagaaaucua

SEQ ID NO: 1493727 - RNA, 21 nt, Homo sapiens
aguaccuugcuucuuacugau

SEQ ID NO: 1493728 - RNA, 21 nt, Homo sapiens
aguacguguuauuuuuuucaa

SEQ ID NO: 1493729 - RNA, 19 nt, Homo sapiens
aguacuagaugcaucacug

SEQ ID NO: 1493730 - RNA, 22 nt, Homo sapiens
aguacuagaugcaucacugggu

SEQ ID NO: 1493731 - RNA, 19 nt, Homo sapiens
aguacuccaagacagagac

SEQ ID NO: 1493732 - RNA, 20 nt, Homo sapiens
aguacuuaauaaacuguggu

SEQ ID NO: 1493733 - RNA, 23 nt, Homo sapiens
aguacuuaauaaacuguggugcu

SEQ ID NO: 1493734 - RNA, 18 nt, Homo sapiens
aguacuuauguugcacaa

SEQ ID NO: 1493735 - RNA, 15 nt, Homo sapiens
aguacuugugaaaca

SEQ ID NO: 1493736 - RNA, 20 nt, Homo sapiens
aguacuuuugugcuaucaau

SEQ ID NO: 1493737 - RNA, 21 nt, Homo sapiens
aguagagcuuguaauaaauac

SEQ ID NO: 1493738 - RNA, 18 nt, Homo sapiens
aguagauauugauuacua

SEQ ID NO: 1493739 - RNA, 12 nt, Homo sapiens
aguagcaauuuc

SEQ ID NO: 1493740 - RNA, 21 nt, Homo sapiens
aguagcugggauuacaggugu

SEQ ID NO: 1493741 - RNA, 18 nt, Homo sapiens
aguaggggcuacugugac

SEQ ID NO: 1493742 - RNA, 13 nt, Homo sapiens
aguagguuuacau

SEQ ID NO: 1493743 - RNA, 16 nt, Homo sapiens
aguagguuuacauuca

SEQ ID NO: 1493744 - RNA, 9 nt, Homo sapiens
aguaguccu

SEQ ID NO: 1493745 - RNA, 20 nt, Homo sapiens
aguaguccuuggcauagaca

SEQ ID NO: 1493746 - RNA, 15 nt, Homo sapiens
aguagucuugaugac

SEQ ID NO: 1493747 - RNA, 16 nt, Homo sapiens
aguauaaacaaaguua

SEQ ID NO: 1493748 - RNA, 21 nt, Homo sapiens
aguauagcuugcauagucaau

SEQ ID NO: 1493749 - RNA, 23 nt, Homo sapiens
aguaucaguguuuuaaauucuga

SEQ ID NO: 1493750 - RNA, 14 nt, Homo sapiens
aguaucauacuuac

SEQ ID NO: 1493751 - RNA, 18 nt, Homo sapiens
aguauggcuccuccauau

SEQ ID NO: 1493752 - RNA, 22 nt, Homo sapiens
aguauuaauguaacuagcauaa

SEQ ID NO: 1493753 - RNA, 19 nt, Homo sapiens
aguauuagaugcacuuaag

SEQ ID NO: 1493754 - RNA, 22 nt, Homo sapiens
aguauuugcugaauggggaccu

SEQ ID NO: 1493755 - RNA, 23 nt, Homo sapiens
aguauuugggaagugaagacugg

SEQ ID NO: 1493756 - RNA, 19 nt, Homo sapiens
aguauuuugaaguuuacau

SEQ ID NO: 1493757 - RNA, 21 nt, Homo sapiens
aguauuuuguguccuccagga

SEQ ID NO: 1493758 - RNA, 20 nt, Homo sapiens
agucacacacacauacaaaa

SEQ ID NO: 1493759 - RNA, 21 nt, Homo sapiens
agucacacagcuagugaagac

SEQ ID NO: 1493760 - RNA, 13 nt, Homo sapiens
agucacacagugu

SEQ ID NO: 1493761 - RNA, 20 nt, Homo sapiens
agucacacuguuacuccaca

SEQ ID NO: 1493762 - RNA, 16 nt, Homo sapiens
agucacaugaccugau

SEQ ID NO: 1493763 - RNA, 23 nt, Homo sapiens
agucacuggagguugaagccaag

SEQ ID NO: 1493764 - RNA, 19 nt, Homo sapiens
agucacuucaccaucaaca

SEQ ID NO: 1493765 - RNA, 19 nt, Homo sapiens
agucagggaaggugccucu

SEQ ID NO: 1493766 - RNA, 15 nt, Homo sapiens
agucauacuaguagu

SEQ ID NO: 1493767 - RNA, 14 nt, Homo sapiens
agucaucuacuuaa

SEQ ID NO: 1493768 - RNA, 14 nt, Homo sapiens
agucaucuauucaa

SEQ ID NO: 1493769 - RNA, 15 nt, Homo sapiens
agucaucucauucca

SEQ ID NO: 1493770 - RNA, 16 nt, Homo sapiens
agucaucucauuccac

SEQ ID NO: 1493771 - RNA, 13 nt, Homo sapiens
agucaugguguug

SEQ ID NO: 1493772 - RNA, 19 nt, Homo sapiens
agucauuugcugagcaugu

SEQ ID NO: 1493773 - RNA, 22 nt, Homo sapiens
aguccaaauaacaaguaccaaa

SEQ ID NO: 1493774 - RNA, 21 nt, Homo sapiens
aguccaaggccaguccccauu

SEQ ID NO: 1493775 - RNA, 17 nt, Homo sapiens
aguccagauauuucaca

SEQ ID NO: 1493776 - RNA, 15 nt, Homo sapiens
aguccagcacuggaa

SEQ ID NO: 1493777 - RNA, 22 nt, Homo sapiens
agucccagacaauuccauucaa

SEQ ID NO: 1493778 - RNA, 15 nt, Homo sapiens
agucccagcuacuug

SEQ ID NO: 1493779 - RNA, 23 nt, Homo sapiens
agucccuggaaaaacagucacug

SEQ ID NO: 1493780 - RNA, 14 nt, Homo sapiens
aguccucccuggug

SEQ ID NO: 1493781 - RNA, 21 nt, Homo sapiens
aguccuuaaaaaucacacugu

SEQ ID NO: 1493782 - RNA, 12 nt, Homo sapiens
aguccuugcaaa

SEQ ID NO: 1493783 - RNA, 19 nt, Homo sapiens
aguccuuucuaaguauuuu

SEQ ID NO: 1493784 - RNA, 16 nt, Homo sapiens
agucggccccaucucu

SEQ ID NO: 1493785 - RNA, 19 nt, Homo sapiens
agucggccccaucucucau

SEQ ID NO: 1493786 - RNA, 15 nt, Homo sapiens
agucucauucuguca

SEQ ID NO: 1493787 - RNA, 15 nt, Homo sapiens
agucucccuuccuau

SEQ ID NO: 1493788 - RNA, 18 nt, Homo sapiens
agucugaaugcugccaca

SEQ ID NO: 1493789 - RNA, 23 nt, Homo sapiens
agucugaaugcugccacaaccag

SEQ ID NO: 1493790 - RNA, 22 nt, Homo sapiens
agucugcuacccucauuucuca

SEQ ID NO: 1493791 - RNA, 17 nt, Homo sapiens
agucuuauuuccucaac

SEQ ID NO: 1493792 - RNA, 14 nt, Homo sapiens
agucuuccaugacc

SEQ ID NO: 1493793 - RNA, 17 nt, Homo sapiens
agucuuuagggguuggg

SEQ ID NO: 1493794 - RNA, 21 nt, Homo sapiens
agugaaaaucuuggagacccu

SEQ ID NO: 1493795 - RNA, 15 nt, Homo sapiens
agugaaaccaugacu

SEQ ID NO: 1493796 - RNA, 18 nt, Homo sapiens
agugaaaccccaucucua

SEQ ID NO: 1493797 - RNA, 22 nt, Homo sapiens
agugaaauaauagaaugagcac

SEQ ID NO: 1493798 - RNA, 18 nt, Homo sapiens
agugaaauuauacagaua

SEQ ID NO: 1493799 - RNA, 15 nt, Homo sapiens
agugaagaacacuac

SEQ ID NO: 1493800 - RNA, 16 nt, Homo sapiens
agugaagaugccagug

SEQ ID NO: 1493801 - RNA, 13 nt, Homo sapiens
agugaaucuguau

SEQ ID NO: 1493802 - RNA, 19 nt, Homo sapiens
agugaaugaaacacucagu

SEQ ID NO: 1493803 - RNA, 23 nt, Homo sapiens
agugaccccugaccucacuguga

SEQ ID NO: 1493804 - RNA, 16 nt, Homo sapiens
agugacuaguacaaau

SEQ ID NO: 1493805 - RNA, 18 nt, Homo sapiens
agugagacuccgucacaa

SEQ ID NO: 1493806 - RNA, 13 nt, Homo sapiens
agugagagcuucc

SEQ ID NO: 1493807 - RNA, 15 nt, Homo sapiens
agugagcugauauca

SEQ ID NO: 1493808 - RNA, 16 nt, Homo sapiens
agugaggucacagucc

SEQ ID NO: 1493809 - RNA, 18 nt, Homo sapiens
agugauagaaaagugugg

SEQ ID NO: 1493810 - RNA, 15 nt, Homo sapiens
agugauaggcccaag

SEQ ID NO: 1493811 - RNA, 13 nt, Homo sapiens
agugaucucaggg

SEQ ID NO: 1493812 - RNA, 22 nt, Homo sapiens
agugauugaaccagcucaucuc

SEQ ID NO: 1493813 - RNA, 17 nt, Homo sapiens
agugauugcagcuuuau

SEQ ID NO: 1493814 - RNA, 12 nt, Homo sapiens
agugcacagcug

SEQ ID NO: 1493815 - RNA, 14 nt, Homo sapiens
agugcacagcuguc

SEQ ID NO: 1493816 - RNA, 19 nt, Homo sapiens
agugcacagggaagggcuu

SEQ ID NO: 1493817 - RNA, 12 nt, Homo sapiens
agugcaccacuu

SEQ ID NO: 1493818 - RNA, 19 nt, Homo sapiens
agugcaguggcaugaucau

SEQ ID NO: 1493819 - RNA, 14 nt, Homo sapiens
agugcaguuuaaaa

SEQ ID NO: 1493820 - RNA, 14 nt, Homo sapiens
agugcaucucagcc

SEQ ID NO: 1493821 - RNA, 15 nt, Homo sapiens
agugccauuccacuc

SEQ ID NO: 1493822 - RNA, 18 nt, Homo sapiens
agugccauuccacuccac

SEQ ID NO: 1493823 - RNA, 19 nt, Homo sapiens
agugccauuccacuccacu

SEQ ID NO: 1493824 - RNA, 21 nt, Homo sapiens
agugccauuccacuccacuca

SEQ ID NO: 1493825 - RNA, 14 nt, Homo sapiens
agugcccuacaaag

SEQ ID NO: 1493826 - RNA, 19 nt, Homo sapiens
agugccgacagcucuccaa

SEQ ID NO: 1493827 - RNA, 20 nt, Homo sapiens
agugccucuugucugaggga

SEQ ID NO: 1493828 - RNA, 13 nt, Homo sapiens
agugccugggaau

SEQ ID NO: 1493829 - RNA, 14 nt, Homo sapiens
agugccuucucuau

SEQ ID NO: 1493830 - RNA, 23 nt, Homo sapiens
agugcgugcucccgaugcugcua

SEQ ID NO: 1493831 - RNA, 15 nt, Homo sapiens
agugcguguguagag

SEQ ID NO: 1493832 - RNA, 19 nt, Homo sapiens
agugcuggcucacaguaca

SEQ ID NO: 1493833 - RNA, 15 nt, Homo sapiens
aguggaauagugaau

SEQ ID NO: 1493834 - RNA, 11 nt, Homo sapiens
aguggacaaau

SEQ ID NO: 1493835 - RNA, 15 nt, Homo sapiens
aguggaucuccaagg

SEQ ID NO: 1493836 - RNA, 19 nt, Homo sapiens
aguggcauuaaacauuuga

SEQ ID NO: 1493837 - RNA, 13 nt, Homo sapiens
aguggccacucag

SEQ ID NO: 1493838 - RNA, 20 nt, Homo sapiens
aguggcgugaucucggcuca

SEQ ID NO: 1493839 - RNA, 18 nt, Homo sapiens
aguggcuaccuacauaca

SEQ ID NO: 1493840 - RNA, 19 nt, Homo sapiens
aguggcuacugacuacccu

SEQ ID NO: 1493841 - RNA, 13 nt, Homo sapiens
aguggcuagcgca

SEQ ID NO: 1493842 - RNA, 19 nt, Homo sapiens
aguggcuucccagcucuga

SEQ ID NO: 1493843 - RNA, 20 nt, Homo sapiens
aguggcuucccagcucugac

SEQ ID NO: 1493844 - RNA, 19 nt, Homo sapiens
aguggcuugagcuucuggg

SEQ ID NO: 1493845 - RNA, 20 nt, Homo sapiens
aguggcuuggguucacagug

SEQ ID NO: 1493846 - RNA, 11 nt, Homo sapiens
agugggagaag

SEQ ID NO: 1493847 - RNA, 20 nt, Homo sapiens
agugggagaaggcagugauu

SEQ ID NO: 1493848 - RNA, 22 nt, Homo sapiens
agugggagggagguaacgggug

SEQ ID NO: 1493849 - RNA, 19 nt, Homo sapiens
agugggugguggaucuguc

SEQ ID NO: 1493850 - RNA, 15 nt, Homo sapiens
agugguauccuguga

SEQ ID NO: 1493851 - RNA, 16 nt, Homo sapiens
agugguauccugugac

SEQ ID NO: 1493852 - RNA, 16 nt, Homo sapiens
agugguuuccagucau

SEQ ID NO: 1493853 - RNA, 13 nt, Homo sapiens
aguguacauggaa

SEQ ID NO: 1493854 - RNA, 12 nt, Homo sapiens
aguguaccuccu

SEQ ID NO: 1493855 - RNA, 23 nt, Homo sapiens
aguguauuuuauguguggcccaa

SEQ ID NO: 1493856 - RNA, 13 nt, Homo sapiens
agugucaacucuu

SEQ ID NO: 1493857 - RNA, 12 nt, Homo sapiens
agugucacuuac

SEQ ID NO: 1493858 - RNA, 19 nt, Homo sapiens
aguguccccuccacuguca

SEQ ID NO: 1493859 - RNA, 17 nt, Homo sapiens
aguguccuucuugcucc

SEQ ID NO: 1493860 - RNA, 19 nt, Homo sapiens
agugucugugccauggauu

SEQ ID NO: 1493861 - RNA, 13 nt, Homo sapiens
agugugacagggc

SEQ ID NO: 1493862 - RNA, 22 nt, Homo sapiens
agugugacagggccaguggggc

SEQ ID NO: 1493863 - RNA, 12 nt, Homo sapiens
aguguggcccag

SEQ ID NO: 1493864 - RNA, 16 nt, Homo sapiens
agugugggggguccuu

SEQ ID NO: 1493865 - RNA, 15 nt, Homo sapiens
agugugugacauucc

SEQ ID NO: 1493866 - RNA, 17 nt, Homo sapiens
aguguuaucagucauaa

SEQ ID NO: 1493867 - RNA, 17 nt, Homo sapiens
aguguuauuugcacacu

SEQ ID NO: 1493868 - RNA, 19 nt, Homo sapiens
aguguucccagagcacuuu

SEQ ID NO: 1493869 - RNA, 19 nt, Homo sapiens
aguguuccccaucuggguc

SEQ ID NO: 1493870 - RNA, 13 nt, Homo sapiens
aguguucccugac

SEQ ID NO: 1493871 - RNA, 23 nt, Homo sapiens
aguguugcccaggcuggucucaa

SEQ ID NO: 1493872 - RNA, 19 nt, Homo sapiens
aguguugcucagcuccuac

SEQ ID NO: 1493873 - RNA, 18 nt, Homo sapiens
aguuaagaagcuguugua

SEQ ID NO: 1493874 - RNA, 18 nt, Homo sapiens
aguuacuagguaacuuca

SEQ ID NO: 1493875 - RNA, 22 nt, Homo sapiens
aguuacugaaggugauggaggu

SEQ ID NO: 1493876 - RNA, 12 nt, Homo sapiens
aguuacuugaau

SEQ ID NO: 1493877 - RNA, 20 nt, Homo sapiens
aguuagcauaauacagaagu

SEQ ID NO: 1493878 - RNA, 13 nt, Homo sapiens
aguuagugccaua

SEQ ID NO: 1493879 - RNA, 23 nt, Homo sapiens
aguuaguguuuugccucaccuaa

SEQ ID NO: 1493880 - RNA, 15 nt, Homo sapiens
aguuauaauucugug

SEQ ID NO: 1493881 - RNA, 21 nt, Homo sapiens
aguuauaggaacaauucucuu

SEQ ID NO: 1493882 - RNA, 21 nt, Homo sapiens
aguuaugauguaaucucucug

SEQ ID NO: 1493883 - RNA, 12 nt, Homo sapiens
aguuaugugauu

SEQ ID NO: 1493884 - RNA, 12 nt, Homo sapiens
aguuauugcaca

SEQ ID NO: 1493885 - RNA, 20 nt, Homo sapiens
aguucaaucucccgcugcug

SEQ ID NO: 1493886 - RNA, 20 nt, Homo sapiens
aguucacaggaggccagugg

SEQ ID NO: 1493887 - RNA, 19 nt, Homo sapiens
aguucagacacuaccccau

SEQ ID NO: 1493888 - RNA, 21 nt, Homo sapiens
aguucagggaccguccagggg

SEQ ID NO: 1493889 - RNA, 18 nt, Homo sapiens
aguucgaggcugcaguca

SEQ ID NO: 1493890 - RNA, 20 nt, Homo sapiens
aguucuaugaagaguauuaa

SEQ ID NO: 1493891 - RNA, 13 nt, Homo sapiens
aguucucacuguu

SEQ ID NO: 1493892 - RNA, 23 nt, Homo sapiens
aguucucccuguacaguguuacc

SEQ ID NO: 1493893 - RNA, 24 nt, Homo sapiens
aguucucccuguacaguguuacca

SEQ ID NO: 1493894 - RNA, 17 nt, Homo sapiens
aguucugaggucccugu

SEQ ID NO: 1493895 - RNA, 17 nt, Homo sapiens
aguucugccaggcaacu

SEQ ID NO: 1493896 - RNA, 18 nt, Homo sapiens
aguucugggacuacaggc

SEQ ID NO: 1493897 - RNA, 19 nt, Homo sapiens
aguucuucaccucuaucca

SEQ ID NO: 1493898 - RNA, 19 nt, Homo sapiens
aguucuugggcuggaccug

SEQ ID NO: 1493899 - RNA, 19 nt, Homo sapiens
aguugaaaggccucaagaa

SEQ ID NO: 1493900 - RNA, 17 nt, Homo sapiens
aguugaaauucuauucu

SEQ ID NO: 1493901 - RNA, 15 nt, Homo sapiens
aguugagucuccucu

SEQ ID NO: 1493902 - RNA, 21 nt, Homo sapiens
aguugagucuccucucugaga

SEQ ID NO: 1493903 - RNA, 13 nt, Homo sapiens
aguugaucuggaa

SEQ ID NO: 1493904 - RNA, 17 nt, Homo sapiens
aguugcaauugaauuaa

SEQ ID NO: 1493905 - RNA, 18 nt, Homo sapiens
aguugcauuuagaaauca

SEQ ID NO: 1493906 - RNA, 15 nt, Homo sapiens
aguugccacauuuag

SEQ ID NO: 1493907 - RNA, 22 nt, Homo sapiens
aguugccaucugcgugacaaua

SEQ ID NO: 1493908 - RNA, 21 nt, Homo sapiens
aguugccuuuauuugcuguua

SEQ ID NO: 1493909 - RNA, 16 nt, Homo sapiens
aguugcugaugaacuc

SEQ ID NO: 1493910 - RNA, 17 nt, Homo sapiens
aguugcugaugaacucu

SEQ ID NO: 1493911 - RNA, 22 nt, Homo sapiens
aguuggaaccguguccagcaca

SEQ ID NO: 1493912 - RNA, 14 nt, Homo sapiens
aguuggaauguugu

SEQ ID NO: 1493913 - RNA, 18 nt, Homo sapiens
aguuggaauucaccaaga

SEQ ID NO: 1493914 - RNA, 16 nt, Homo sapiens
aguugggagcacugga

SEQ ID NO: 1493915 - RNA, 22 nt, Homo sapiens
aguuggugcuuuugagaaccaa

SEQ ID NO: 1493916 - RNA, 16 nt, Homo sapiens
aguuguuuugcuucuu

SEQ ID NO: 1493917 - RNA, 23 nt, Homo sapiens
aguuuaauuuuugaaaacuggcu

SEQ ID NO: 1493918 - RNA, 12 nt, Homo sapiens
aguuuacaauau

SEQ ID NO: 1493919 - RNA, 14 nt, Homo sapiens
auaaaaaacacuaa

SEQ ID NO: 1493920 - RNA, 20 nt, Homo sapiens
auaaaaaauuaugacaaugu

SEQ ID NO: 1493921 - RNA, 15 nt, Homo sapiens
auaaaaagugacaca

SEQ ID NO: 1493922 - RNA, 23 nt, Homo sapiens
auaaaaaguuucacaggucaaua

SEQ ID NO: 1493923 - RNA, 21 nt, Homo sapiens
auaaaaauauuguguugugaa

SEQ ID NO: 1493924 - RNA, 22 nt, Homo sapiens
auaaaacgcaaagggcugaaag

SEQ ID NO: 1493925 - RNA, 13 nt, Homo sapiens
auaaaacggugcu

SEQ ID NO: 1493926 - RNA, 14 nt, Homo sapiens
auaaaacugaaucu

SEQ ID NO: 1493927 - RNA, 21 nt, Homo sapiens
auaaaauaauuauaaauauca

SEQ ID NO: 1493928 - RNA, 18 nt, Homo sapiens
auaaaauauaaucuaauu

SEQ ID NO: 1493929 - RNA, 17 nt, Homo sapiens
auaaaaugacuacuuag

SEQ ID NO: 1493930 - RNA, 23 nt, Homo sapiens
auaaaauuuaacuuuugagcaua

SEQ ID NO: 1493931 - RNA, 20 nt, Homo sapiens
auaaacaaaguuacuaggua

SEQ ID NO: 1493932 - RNA, 22 nt, Homo sapiens
auaaacagacuguuaauuauag

SEQ ID NO: 1493933 - RNA, 17 nt, Homo sapiens
auaaacauaaguugcau

SEQ ID NO: 1493934 - RNA, 14 nt, Homo sapiens
auaaacuauacacu

SEQ ID NO: 1493935 - RNA, 17 nt, Homo sapiens
auaaacuauacacuuaa

SEQ ID NO: 1493936 - RNA, 23 nt, Homo sapiens
auaaagaagguuggugaauuuca

SEQ ID NO: 1493937 - RNA, 14 nt, Homo sapiens
auaaagaugaucua

SEQ ID NO: 1493938 - RNA, 13 nt, Homo sapiens
auaaagauguuau

SEQ ID NO: 1493939 - RNA, 23 nt, Homo sapiens
auaaagcaaucugauucagcauc

SEQ ID NO: 1493940 - RNA, 14 nt, Homo sapiens
auaaaggaugugau

SEQ ID NO: 1493941 - RNA, 15 nt, Homo sapiens
auaaaguuacuugaa

SEQ ID NO: 1493942 - RNA, 19 nt, Homo sapiens
auaaauaaacuguugcucg

SEQ ID NO: 1493943 - RNA, 17 nt, Homo sapiens
auaaauauuacagugaa

SEQ ID NO: 1493944 - RNA, 18 nt, Homo sapiens
auaaaucugacccagugc

SEQ ID NO: 1493945 - RNA, 18 nt, Homo sapiens
auaaauuccuacaacuua

SEQ ID NO: 1493946 - RNA, 20 nt, Homo sapiens
auaacaagaucuuucaggaa

SEQ ID NO: 1493947 - RNA, 12 nt, Homo sapiens
auaaccacuuaa

SEQ ID NO: 1493948 - RNA, 22 nt, Homo sapiens
auaaccucaaagugacuauuca

SEQ ID NO: 1493949 - RNA, 22 nt, Homo sapiens
auaaccuccagccuccugccca

SEQ ID NO: 1493950 - RNA, 14 nt, Homo sapiens
auaaccuuguucca

SEQ ID NO: 1493951 - RNA, 21 nt, Homo sapiens
auaacgauuuuaugaaaugac

SEQ ID NO: 1493952 - RNA, 22 nt, Homo sapiens
auaacuaggaaauccauucaca

SEQ ID NO: 1493953 - RNA, 17 nt, Homo sapiens
auaacuccugucccuuu

SEQ ID NO: 1493954 - RNA, 14 nt, Homo sapiens
auaacucuccagua

SEQ ID NO: 1493955 - RNA, 17 nt, Homo sapiens
auaacuuagguggcaag

SEQ ID NO: 1493956 - RNA, 14 nt, Homo sapiens
auaagacacucaaa

SEQ ID NO: 1493957 - RNA, 18 nt, Homo sapiens
auaagagugccguaacaa

SEQ ID NO: 1493958 - RNA, 18 nt, Homo sapiens
auaagcuaaagaggcuga

SEQ ID NO: 1493959 - RNA, 15 nt, Homo sapiens
auaaggacgugugua

SEQ ID NO: 1493960 - RNA, 13 nt, Homo sapiens
auaaguacauuau

SEQ ID NO: 1493961 - RNA, 22 nt, Homo sapiens
auaagugaagugauacuaucca

SEQ ID NO: 1493962 - RNA, 16 nt, Homo sapiens
auaaguuugcaguugg

SEQ ID NO: 1493963 - RNA, 14 nt, Homo sapiens
auaauaaacauaau

SEQ ID NO: 1493964 - RNA, 18 nt, Homo sapiens
auaauaaaugcccucuuc

SEQ ID NO: 1493965 - RNA, 19 nt, Homo sapiens
auaauaacucggauuccag

SEQ ID NO: 1493966 - RNA, 16 nt, Homo sapiens
auaauaagcuaaagag

SEQ ID NO: 1493967 - RNA, 15 nt, Homo sapiens
auaauaucugugagg

SEQ ID NO: 1493968 - RNA, 16 nt, Homo sapiens
auaauaugcugccaaa

SEQ ID NO: 1493969 - RNA, 21 nt, Homo sapiens
auaaucaaucauuucuauuaa

SEQ ID NO: 1493970 - RNA, 13 nt, Homo sapiens
auaaucagugugu

SEQ ID NO: 1493971 - RNA, 16 nt, Homo sapiens
auaaugaaauaaucag

SEQ ID NO: 1493972 - RNA, 16 nt, Homo sapiens
auaaugaggaguuuau

SEQ ID NO: 1493973 - RNA, 18 nt, Homo sapiens
auaauggauucacugagg

SEQ ID NO: 1493974 - RNA, 20 nt, Homo sapiens
auaauuaaccaccaauccaa

SEQ ID NO: 1493975 - RNA, 23 nt, Homo sapiens
auaauuaaugauuaaacuauuaa

SEQ ID NO: 1493976 - RNA, 13 nt, Homo sapiens
auaauucacucaa

SEQ ID NO: 1493977 - RNA, 20 nt, Homo sapiens
auaauucacucaagcacuga

SEQ ID NO: 1493978 - RNA, 14 nt, Homo sapiens
auaauucagcacuu

SEQ ID NO: 1493979 - RNA, 19 nt, Homo sapiens
auaauucagcacuuaacua

SEQ ID NO: 1493980 - RNA, 18 nt, Homo sapiens
auaauuccuacagcacua

SEQ ID NO: 1493981 - RNA, 22 nt, Homo sapiens
auaauucuaaguuauuuacuuu

SEQ ID NO: 1493982 - RNA, 16 nt, Homo sapiens
auaauuuaacuguguu

SEQ ID NO: 1493983 - RNA, 21 nt, Homo sapiens
auaauuuaacuguguuuuagg

SEQ ID NO: 1493984 - RNA, 13 nt, Homo sapiens
auaauuugaucuu

SEQ ID NO: 1493985 - RNA, 16 nt, Homo sapiens
auaauuuuaugcugga

SEQ ID NO: 1493986 - RNA, 15 nt, Homo sapiens
auaauuuucauucau

SEQ ID NO: 1493987 - RNA, 20 nt, Homo sapiens
auaauuuucauucauucacu

SEQ ID NO: 1493988 - RNA, 17 nt, Homo sapiens
auacaaaagggucuuga

SEQ ID NO: 1493989 - RNA, 13 nt, Homo sapiens
auacacagaggag

SEQ ID NO: 1493990 - RNA, 14 nt, Homo sapiens
auacacuaaccaaa

SEQ ID NO: 1493991 - RNA, 13 nt, Homo sapiens
auacacuuaauga

SEQ ID NO: 1493992 - RNA, 20 nt, Homo sapiens
auacacuuaaugauacaugu

SEQ ID NO: 1493993 - RNA, 16 nt, Homo sapiens
auacacuuuguugcaa

SEQ ID NO: 1493994 - RNA, 21 nt, Homo sapiens
auacacuuuuuaaaaucucaa

SEQ ID NO: 1493995 - RNA, 16 nt, Homo sapiens
auacagauagauauau

SEQ ID NO: 1493996 - RNA, 20 nt, Homo sapiens
auacagcucuacguggcaaa

SEQ ID NO: 1493997 - RNA, 19 nt, Homo sapiens
auacaguguaggcauuuaa

SEQ ID NO: 1493998 - RNA, 12 nt, Homo sapiens
auacaguuauuu

SEQ ID NO: 1493999 - RNA, 13 nt, Homo sapiens
auacauaagacca

SEQ ID NO: 1494000 - RNA, 12 nt, Homo sapiens
auacauacaugu

SEQ ID NO: 1494001 - RNA, 18 nt, Homo sapiens
auuggcacuguggagcuc

SEQ ID NO: 1494002 - RNA, 15 nt, Homo sapiens
auugggggacguggg

SEQ ID NO: 1494003 - RNA, 20 nt, Homo sapiens
auugguauacuuuugcuuca

SEQ ID NO: 1494004 - RNA, 22 nt, Homo sapiens
auugucucccuuccagcaauaa

SEQ ID NO: 1494005 - RNA, 15 nt, Homo sapiens
auugugccccaugcu

SEQ ID NO: 1494006 - RNA, 22 nt, Homo sapiens
auugugcuccuucggauaugau

SEQ ID NO: 1494007 - RNA, 17 nt, Homo sapiens
auugugcugauugugga

SEQ ID NO: 1494008 - RNA, 18 nt, Homo sapiens
auuguggugugagcuuca

SEQ ID NO: 1494009 - RNA, 20 nt, Homo sapiens
auuguuacauuauguggaaa

SEQ ID NO: 1494010 - RNA, 18 nt, Homo sapiens
auuguucaaagcacagaa

SEQ ID NO: 1494011 - RNA, 17 nt, Homo sapiens
auuguugacaacuguga

SEQ ID NO: 1494012 - RNA, 18 nt, Homo sapiens
auuguugacaacugugac

SEQ ID NO: 1494013 - RNA, 21 nt, Homo sapiens
auuguugaugggcacuugaga

SEQ ID NO: 1494014 - RNA, 15 nt, Homo sapiens
auuguuguugccaaa

SEQ ID NO: 1494015 - RNA, 16 nt, Homo sapiens
auuguuguugccaaag

SEQ ID NO: 1494016 - RNA, 14 nt, Homo sapiens
auuguuuucagugu

SEQ ID NO: 1494017 - RNA, 17 nt, Homo sapiens
auuguuuucaguguaca

SEQ ID NO: 1494018 - RNA, 22 nt, Homo sapiens
auuguuuucaguguacauggaa

SEQ ID NO: 1494019 - RNA, 21 nt, Homo sapiens
auuuaaaaaacuaacacccag

SEQ ID NO: 1494020 - RNA, 18 nt, Homo sapiens
auuuaaaagcaucucagc

SEQ ID NO: 1494021 - RNA, 17 nt, Homo sapiens
auuuaaaauugcuaugu

SEQ ID NO: 1494022 - RNA, 20 nt, Homo sapiens
auuuaaauaaaguuacuuga

SEQ ID NO: 1494023 - RNA, 22 nt, Homo sapiens
auuuaaauguuaugacuaugua

SEQ ID NO: 1494024 - RNA, 12 nt, Homo sapiens
auuuaagcacaa

SEQ ID NO: 1494025 - RNA, 15 nt, Homo sapiens
auuuaagccuuauaa

SEQ ID NO: 1494026 - RNA, 15 nt, Homo sapiens
auuuaagguacuuaa

SEQ ID NO: 1494027 - RNA, 19 nt, Homo sapiens
auuuaaguuaucaacuuua

SEQ ID NO: 1494028 - RNA, 12 nt, Homo sapiens
auuuaauaacau

SEQ ID NO: 1494029 - RNA, 23 nt, Homo sapiens
auuuacagaaaagacucugacca

SEQ ID NO: 1494030 - RNA, 22 nt, Homo sapiens
auuuacaggaacuucaucauaa

SEQ ID NO: 1494031 - RNA, 22 nt, Homo sapiens
auuuacuaaaucaaucugcagu

SEQ ID NO: 1494032 - RNA, 18 nt, Homo sapiens
auuuagauauaacacuau

SEQ ID NO: 1494033 - RNA, 13 nt, Homo sapiens
auuuaguccugua

SEQ ID NO: 1494034 - RNA, 16 nt, Homo sapiens
auuuagucuugccagg

SEQ ID NO: 1494035 - RNA, 19 nt, Homo sapiens
auuuauaaaacuucucaag

SEQ ID NO: 1494036 - RNA, 19 nt, Homo sapiens
auuuauaauguuaguagaa

SEQ ID NO: 1494037 - RNA, 23 nt, Homo sapiens
auuuaucagaaauuauacuauau

SEQ ID NO: 1494038 - RNA, 14 nt, Homo sapiens
auuuaucagugaca

SEQ ID NO: 1494039 - RNA, 16 nt, Homo sapiens
auuuauccaagaccug

SEQ ID NO: 1494040 - RNA, 12 nt, Homo sapiens
auuuaucugugu

SEQ ID NO: 1494041 - RNA, 15 nt, Homo sapiens
auuuaugaaguuuaa

SEQ ID NO: 1494042 - RNA, 15 nt, Homo sapiens
auuuaugaugcacuu

SEQ ID NO: 1494043 - RNA, 22 nt, Homo sapiens
auuuaugaugcacuuauucaau

SEQ ID NO: 1494044 - RNA, 20 nt, Homo sapiens
auuuaugccucuguauuuaa

SEQ ID NO: 1494045 - RNA, 20 nt, Homo sapiens
auuuauggucaacacuuaag

SEQ ID NO: 1494046 - RNA, 17 nt, Homo sapiens
auuuauuaacuaaucaa

SEQ ID NO: 1494047 - RNA, 17 nt, Homo sapiens
auuuauuuacagaugaa

SEQ ID NO: 1494048 - RNA, 13 nt, Homo sapiens
auuuauuuaugua

SEQ ID NO: 1494049 - RNA, 22 nt, Homo sapiens
auuucaauauuagcaagacagc

SEQ ID NO: 1494050 - RNA, 15 nt, Homo sapiens
auuucacaagcuauu

SEQ ID NO: 1494051 - RNA, 14 nt, Homo sapiens
auuucaccacugaa

SEQ ID NO: 1494052 - RNA, 14 nt, Homo sapiens
auuucacgcuuuua

SEQ ID NO: 1494053 - RNA, 13 nt, Homo sapiens
auuucacugaugu

SEQ ID NO: 1494054 - RNA, 14 nt, Homo sapiens
auuucacuucagga

SEQ ID NO: 1494055 - RNA, 14 nt, Homo sapiens
auuucacuugauga

SEQ ID NO: 1494056 - RNA, 20 nt, Homo sapiens
auuucagaucauauuucaca

SEQ ID NO: 1494057 - RNA, 22 nt, Homo sapiens
auuucagaucauauuucacaau

SEQ ID NO: 1494058 - RNA, 19 nt, Homo sapiens
auuucaggaagacugacag

SEQ ID NO: 1494059 - RNA, 12 nt, Homo sapiens
auuucaggcaua

SEQ ID NO: 1494060 - RNA, 18 nt, Homo sapiens
auuucauuccauugccua

SEQ ID NO: 1494061 - RNA, 23 nt, Homo sapiens
auuuccaagcacuuucaguccaa

SEQ ID NO: 1494062 - RNA, 21 nt, Homo sapiens
auuuccacaaaaucuguccaa

SEQ ID NO: 1494063 - RNA, 23 nt, Homo sapiens
auuuccaccaggccgugccuugu

SEQ ID NO: 1494064 - RNA, 16 nt, Homo sapiens
auuuccagaacuacca

SEQ ID NO: 1494065 - RNA, 15 nt, Homo sapiens
auuuccaucauguca

SEQ ID NO: 1494066 - RNA, 15 nt, Homo sapiens
auuuccuccucaucu

SEQ ID NO: 1494067 - RNA, 15 nt, Homo sapiens
auuuccugacuugag

SEQ ID NO: 1494068 - RNA, 20 nt, Homo sapiens
auuuccuuuuugacacugaa

SEQ ID NO: 1494069 - RNA, 15 nt, Homo sapiens
auuucggagcaugaa

SEQ ID NO: 1494070 - RNA, 20 nt, Homo sapiens
auuucuagcagugaugaaaa

SEQ ID NO: 1494071 - RNA, 17 nt, Homo sapiens
auuucugaaaugugcag

SEQ ID NO: 1494072 - RNA, 23 nt, Homo sapiens
auuucugagagugaaaccaugac

SEQ ID NO: 1494073 - RNA, 18 nt, Homo sapiens
auuucugaucuauacaaa

SEQ ID NO: 1494074 - RNA, 16 nt, Homo sapiens
auuucuucuacugcua

SEQ ID NO: 1494075 - RNA, 11 nt, Homo sapiens
auuucuuugcc

SEQ ID NO: 1494076 - RNA, 22 nt, Homo sapiens
auuucuuuucuggccaaaagca

SEQ ID NO: 1494077 - RNA, 22 nt, Homo sapiens
auuugaaaaaaacuucauucuc

SEQ ID NO: 1494078 - RNA, 22 nt, Homo sapiens
auacugcuugaccguacucuca

SEQ ID NO: 1494079 - RNA, 18 nt, Homo sapiens
auacuuacuauaauuuga

SEQ ID NO: 1494080 - RNA, 13 nt, Homo sapiens
auacuucauuaaa

SEQ ID NO: 1494081 - RNA, 17 nt, Homo sapiens
auacuugaagggccaga

SEQ ID NO: 1494082 - RNA, 20 nt, Homo sapiens
auacuugccuucugauagua

SEQ ID NO: 1494083 - RNA, 19 nt, Homo sapiens
auacuuuauuucugaucua

SEQ ID NO: 1494084 - RNA, 19 nt, Homo sapiens
auacuuuuacucugccuac

SEQ ID NO: 1494085 - RNA, 21 nt, Homo sapiens
auacuuuuuaaaguuuaccau

SEQ ID NO: 1494086 - RNA, 22 nt, Homo sapiens
auagaaaacuugacauguagcu

SEQ ID NO: 1494087 - RNA, 20 nt, Homo sapiens
auagaacucugggcugccau

SEQ ID NO: 1494088 - RNA, 19 nt, Homo sapiens
auagaagaugaaucauuga

SEQ ID NO: 1494089 - RNA, 17 nt, Homo sapiens
auagaaguagcaaaaag

SEQ ID NO: 1494090 - RNA, 22 nt, Homo sapiens
auagaauacauggaaacgcaaa

SEQ ID NO: 1494091 - RNA, 22 nt, Homo sapiens
auagaaugagcacccauuccaa

SEQ ID NO: 1494092 - RNA, 15 nt, Homo sapiens
auagacaauuugcac

SEQ ID NO: 1494093 - RNA, 17 nt, Homo sapiens
auagacacuugcuccca

SEQ ID NO: 1494094 - RNA, 21 nt, Homo sapiens
auagagauagcuacaguguaa

SEQ ID NO: 1494095 - RNA, 21 nt, Homo sapiens
auagagugguacagcacuguu

SEQ ID NO: 1494096 - RNA, 14 nt, Homo sapiens
auagagugucucag

SEQ ID NO: 1494097 - RNA, 16 nt, Homo sapiens
auagagugucucaggg

SEQ ID NO: 1494098 - RNA, 23 nt, Homo sapiens
auagaucagcaaaccggggccua

SEQ ID NO: 1494099 - RNA, 14 nt, Homo sapiens
auagaugcacuuau

SEQ ID NO: 1494100 - RNA, 21 nt, Homo sapiens
auagaugcacuuaugcaguaa

SEQ ID NO: 1494101 - RNA, 22 nt, Homo sapiens
auagauuuucauguucuugcag

SEQ ID NO: 1494102 - RNA, 13 nt, Homo sapiens
auagcaagacaca

SEQ ID NO: 1494103 - RNA, 16 nt, Homo sapiens
auagcacuaaugcuuu

SEQ ID NO: 1494104 - RNA, 18 nt, Homo sapiens
auagcagauuguguaaca

SEQ ID NO: 1494105 - RNA, 13 nt, Homo sapiens
auagcaucucagg

SEQ ID NO: 1494106 - RNA, 13 nt, Homo sapiens
auagcccacagcu

SEQ ID NO: 1494107 - RNA, 22 nt, Homo sapiens
auagcuaagcaucuccuuacag

SEQ ID NO: 1494108 - RNA, 19 nt, Homo sapiens
auagcuaaguacacaauaa

SEQ ID NO: 1494109 - RNA, 17 nt, Homo sapiens
auagcuauauccaugua

SEQ ID NO: 1494110 - RNA, 18 nt, Homo sapiens
auagcuauauccauguac

SEQ ID NO: 1494111 - RNA, 15 nt, Homo sapiens
auaggaauaguccau

SEQ ID NO: 1494112 - RNA, 12 nt, Homo sapiens
auaggacauacu

SEQ ID NO: 1494113 - RNA, 15 nt, Homo sapiens
auaggagaggaugag

SEQ ID NO: 1494114 - RNA, 21 nt, Homo sapiens
auaggccugucccuugccucu

SEQ ID NO: 1494115 - RNA, 18 nt, Homo sapiens
auaggcgcaggugcacag

SEQ ID NO: 1494116 - RNA, 22 nt, Homo sapiens
auaguaaaguuguuguaaaaau

SEQ ID NO: 1494117 - RNA, 13 nt, Homo sapiens
auaguacuaguuu

SEQ ID NO: 1494118 - RNA, 20 nt, Homo sapiens
auaguagauuuuaaagacaa

SEQ ID NO: 1494119 - RNA, 17 nt, Homo sapiens
auaguguucugcuccug

SEQ ID NO: 1494120 - RNA, 14 nt, Homo sapiens
auaguuaagacaug

SEQ ID NO: 1494121 - RNA, 17 nt, Homo sapiens
auaguuaauuauuucaa

SEQ ID NO: 1494122 - RNA, 21 nt, Homo sapiens
auaguuguuuuauauguugcu

SEQ ID NO: 1494123 - RNA, 22 nt, Homo sapiens
auaguuuaggagaaaccagcuu

SEQ ID NO: 1494124 - RNA, 15 nt, Homo sapiens
auauaaacauauaca

SEQ ID NO: 1494125 - RNA, 18 nt, Homo sapiens
auauaaauucuaagccau

SEQ ID NO: 1494126 - RNA, 13 nt, Homo sapiens
auauaaauuuauc

SEQ ID NO: 1494127 - RNA, 20 nt, Homo sapiens
auauaacuaagacauaugca

SEQ ID NO: 1494128 - RNA, 16 nt, Homo sapiens
auauaaggaaagcaau

SEQ ID NO: 1494129 - RNA, 19 nt, Homo sapiens
auauaaguuuacaccuuua

SEQ ID NO: 1494130 - RNA, 20 nt, Homo sapiens
auauaauuauccaaauugau

SEQ ID NO: 1494131 - RNA, 20 nt, Homo sapiens
auauaauucacucaagcacu

SEQ ID NO: 1494132 - RNA, 21 nt, Homo sapiens
auauaauuguaccaaccucau

SEQ ID NO: 1494133 - RNA, 16 nt, Homo sapiens
auauaauuuauuucca

SEQ ID NO: 1494134 - RNA, 12 nt, Homo sapiens
auauacaaauag

SEQ ID NO: 1494135 - RNA, 15 nt, Homo sapiens
auauacugugugcuu

SEQ ID NO: 1494136 - RNA, 12 nt, Homo sapiens
auauacuuugaa

SEQ ID NO: 1494137 - RNA, 17 nt, Homo sapiens
auauacuuuugugaaca

SEQ ID NO: 1494138 - RNA, 15 nt, Homo sapiens
auauagccauugauc

SEQ ID NO: 1494139 - RNA, 14 nt, Homo sapiens
auauaguccagaca

SEQ ID NO: 1494140 - RNA, 19 nt, Homo sapiens
auauaguccagacacuuaa

SEQ ID NO: 1494141 - RNA, 12 nt, Homo sapiens
auauauugaacu

SEQ ID NO: 1494142 - RNA, 17 nt, Homo sapiens
auauauuucagauauca

SEQ ID NO: 1494143 - RNA, 14 nt, Homo sapiens
auaucaaaauucua

SEQ ID NO: 1494144 - RNA, 16 nt, Homo sapiens
auaucacuuccaugac

SEQ ID NO: 1494145 - RNA, 17 nt, Homo sapiens
auaucacuuccaugaca

SEQ ID NO: 1494146 - RNA, 11 nt, Homo sapiens
auaucagggaa

SEQ ID NO: 1494147 - RNA, 13 nt, Homo sapiens
auaucaguaccuc

SEQ ID NO: 1494148 - RNA, 20 nt, Homo sapiens
auaucaguuugcuagcagaa

SEQ ID NO: 1494149 - RNA, 21 nt, Homo sapiens
auaucauccugccuucaugga

SEQ ID NO: 1494150 - RNA, 15 nt, Homo sapiens
auaucaugcaaauuu

SEQ ID NO: 1494151 - RNA, 16 nt, Homo sapiens
auaucccuacauguau

SEQ ID NO: 1494152 - RNA, 14 nt, Homo sapiens
auauccugugacug

SEQ ID NO: 1494153 - RNA, 19 nt, Homo sapiens
auauccuuucuaacaaaaa

SEQ ID NO: 1494154 - RNA, 21 nt, Homo sapiens
auaucugggauucuacuuuaa

SEQ ID NO: 1494155 - RNA, 15 nt, Homo sapiens
auaucugucauauag

SEQ ID NO: 1494156 - RNA, 21 nt, Homo sapiens
auaucugugaggugcugauga

SEQ ID NO: 1494157 - RNA, 15 nt, Homo sapiens
auaucuuugugauaa

SEQ ID NO: 1494158 - RNA, 15 nt, Homo sapiens
auaugaaacauuuaa

SEQ ID NO: 1494159 - RNA, 19 nt, Homo sapiens
auaugaaucugcucacuuu

SEQ ID NO: 1494160 - RNA, 15 nt, Homo sapiens
auaugaauucaagaa

SEQ ID NO: 1494161 - RNA, 19 nt, Homo sapiens
caaaaugucuaagauagua

SEQ ID NO: 1494162 - RNA, 14 nt, Homo sapiens
caaaaugucucagu

SEQ ID NO: 1494163 - RNA, 16 nt, Homo sapiens
caaaauuacacaguua

SEQ ID NO: 1494164 - RNA, 17 nt, Homo sapiens
caaaauuacacaguuaa

SEQ ID NO: 1494165 - RNA, 20 nt, Homo sapiens
caaaauucuaaaaauuugca

SEQ ID NO: 1494166 - RNA, 20 nt, Homo sapiens
caaaauuugaugccaggaca

SEQ ID NO: 1494167 - RNA, 14 nt, Homo sapiens
caaacaaauaugca

SEQ ID NO: 1494168 - RNA, 19 nt, Homo sapiens
caaacaagaggacuguguu

SEQ ID NO: 1494169 - RNA, 12 nt, Homo sapiens
caaacaaugaaa

SEQ ID NO: 1494170 - RNA, 17 nt, Homo sapiens
caaacacuccacccucc

SEQ ID NO: 1494171 - RNA, 20 nt, Homo sapiens
caaacaggguuugauagcac

SEQ ID NO: 1494172 - RNA, 12 nt, Homo sapiens
caaacaucuaau

SEQ ID NO: 1494173 - RNA, 22 nt, Homo sapiens
caaaccaagucggaacagcaga

SEQ ID NO: 1494174 - RNA, 20 nt, Homo sapiens
caaacccuagccuugcuugu

SEQ ID NO: 1494175 - RNA, 17 nt, Homo sapiens
caaacgcccuuuccucc

SEQ ID NO: 1494176 - RNA, 13 nt, Homo sapiens
caaacgcugaaaa

SEQ ID NO: 1494177 - RNA, 13 nt, Homo sapiens
caaacuaaaggug

SEQ ID NO: 1494178 - RNA, 17 nt, Homo sapiens
caaacucaaacuugaga

SEQ ID NO: 1494179 - RNA, 12 nt, Homo sapiens
caaacucagugc

SEQ ID NO: 1494180 - RNA, 22 nt, Homo sapiens
caaacuggcugcuuuguucaau

SEQ ID NO: 1494181 - RNA, 23 nt, Homo sapiens
caaacuggggccuccagaacuca

SEQ ID NO: 1494182 - RNA, 21 nt, Homo sapiens
caaacuggggccucccugguc

SEQ ID NO: 1494183 - RNA, 18 nt, Homo sapiens
caaacugugaagcauuua

SEQ ID NO: 1494184 - RNA, 19 nt, Homo sapiens
caaacugugaagcauuuac

SEQ ID NO: 1494185 - RNA, 15 nt, Homo sapiens
caaacuugcuuuaug

SEQ ID NO: 1494186 - RNA, 22 nt, Homo sapiens
caaacuuggauacuuggauuua

SEQ ID NO: 1494187 - RNA, 19 nt, Homo sapiens
cugccagccccacacagcu

SEQ ID NO: 1494188 - RNA, 17 nt, Homo sapiens
cugccaucaugccugac

SEQ ID NO: 1494189 - RNA, 17 nt, Homo sapiens
cugccaucuagccagcc

SEQ ID NO: 1494190 - RNA, 12 nt, Homo sapiens
cugccauggaag

SEQ ID NO: 1494191 - RNA, 14 nt, Homo sapiens
cugccauguugccc

SEQ ID NO: 1494192 - RNA, 19 nt, Homo sapiens
cugcccaaggaugcuguca

SEQ ID NO: 1494193 - RNA, 22 nt, Homo sapiens
cugccccacggagacagaggaa

SEQ ID NO: 1494194 - RNA, 15 nt, Homo sapiens
cugccccagauuuac

SEQ ID NO: 1494195 - RNA, 12 nt, Homo sapiens
cugcccccggcc

SEQ ID NO: 1494196 - RNA, 15 nt, Homo sapiens
cugccccucucacca

SEQ ID NO: 1494197 - RNA, 17 nt, Homo sapiens
cugcccugcucccacag

SEQ ID NO: 1494198 - RNA, 18 nt, Homo sapiens
cugcccugguccagggaa

SEQ ID NO: 1494199 - RNA, 16 nt, Homo sapiens
cugcccuugucacugg

SEQ ID NO: 1494200 - RNA, 13 nt, Homo sapiens
cugccgaccccua

SEQ ID NO: 1494201 - RNA, 15 nt, Homo sapiens
cugccgcuaccuccc

SEQ ID NO: 1494202 - RNA, 15 nt, Homo sapiens
cugggaaucaagaca

SEQ ID NO: 1494203 - RNA, 22 nt, Homo sapiens
cugggacaccuuuaacacagac

SEQ ID NO: 1494204 - RNA, 16 nt, Homo sapiens
cugggaccaacccugg

SEQ ID NO: 1494205 - RNA, 15 nt, Homo sapiens
cugggagacugggac

SEQ ID NO: 1494206 - RNA, 19 nt, Homo sapiens
cugggagacugggacaccu

SEQ ID NO: 1494207 - RNA, 22 nt, Homo sapiens
cugggagccggaggcugcagug

SEQ ID NO: 1494208 - RNA, 17 nt, Homo sapiens
cugggaggcggagagua

SEQ ID NO: 1494209 - RNA, 21 nt, Homo sapiens
cugggaguguccuuaguguau

SEQ ID NO: 1494210 - RNA, 17 nt, Homo sapiens
cugggaugaggggugcu

SEQ ID NO: 1494211 - RNA, 18 nt, Homo sapiens
cugggaugggaacacugg

SEQ ID NO: 1494212 - RNA, 21 nt, Homo sapiens
cugggauguuuugagggucuu

SEQ ID NO: 1494213 - RNA, 22 nt, Homo sapiens
cugggauuacaauugugagcca

SEQ ID NO: 1494214 - RNA, 22 nt, Homo sapiens
cugggauuacaggcaugagcca

SEQ ID NO: 1494215 - RNA, 15 nt, Homo sapiens
cugggauuacaggug

SEQ ID NO: 1494216 - RNA, 16 nt, Homo sapiens
cugggcaaagccacaa

SEQ ID NO: 1494217 - RNA, 23 nt, Homo sapiens
cugggcagaccccucuaccuccu

SEQ ID NO: 1494218 - RNA, 14 nt, Homo sapiens
cugggccagggucu

SEQ ID NO: 1494219 - RNA, 10 nt, Homo sapiens
cugggccaug

SEQ ID NO: 1494220 - RNA, 14 nt, Homo sapiens
cugggccaugucca

SEQ ID NO: 1494221 - RNA, 16 nt, Homo sapiens
cugggccauguccaaa

SEQ ID NO: 1494222 - RNA, 17 nt, Homo sapiens
cugggccauguccaaag

SEQ ID NO: 1494223 - RNA, 20 nt, Homo sapiens
cugggccauucuccacagca

SEQ ID NO: 1494224 - RNA, 22 nt, Homo sapiens
cugggccauucuccacagcaac

SEQ ID NO: 1494225 - RNA, 14 nt, Homo sapiens
cugggccuucucac

SEQ ID NO: 1494226 - RNA, 17 nt, Homo sapiens
cugggcugagugacaca

SEQ ID NO: 1494227 - RNA, 16 nt, Homo sapiens
cugggcuugggcacca

SEQ ID NO: 1494228 - RNA, 19 nt, Homo sapiens
cugggcuuugucaugucuc

SEQ ID NO: 1494229 - RNA, 19 nt, Homo sapiens
cuggggacagcuuccucac

SEQ ID NO: 1494230 - RNA, 14 nt, Homo sapiens
cuggggaggugaac

SEQ ID NO: 1494231 - RNA, 19 nt, Homo sapiens
cuggggauggaauuauugu

SEQ ID NO: 1494232 - RNA, 16 nt, Homo sapiens
cuggggcauccugugc

SEQ ID NO: 1494233 - RNA, 15 nt, Homo sapiens
cuggggccacccagc

SEQ ID NO: 1494234 - RNA, 15 nt, Homo sapiens
cuggggccuccagaa

SEQ ID NO: 1494235 - RNA, 18 nt, Homo sapiens
cuggggcucucugagacu

SEQ ID NO: 1494236 - RNA, 14 nt, Homo sapiens
cugggggaaaaagc

SEQ ID NO: 1494237 - RNA, 18 nt, Homo sapiens
cugggggagguccaagca

SEQ ID NO: 1494238 - RNA, 11 nt, Homo sapiens
cugggggaguu

SEQ ID NO: 1494239 - RNA, 23 nt, Homo sapiens
cuggggggcguggagagcccggc

SEQ ID NO: 1494240 - RNA, 18 nt, Homo sapiens
cuggggugcugccugaau

SEQ ID NO: 1494241 - RNA, 21 nt, Homo sapiens
cugggguuggacuguaaggga

SEQ ID NO: 1494242 - RNA, 23 nt, Homo sapiens
cugggucucgcuuuguugcccag

SEQ ID NO: 1494243 - RNA, 14 nt, Homo sapiens
cugggugaccucac

SEQ ID NO: 1494244 - RNA, 21 nt, Homo sapiens
cugggugucgaaaucaaacca

SEQ ID NO: 1494245 - RNA, 20 nt, Homo sapiens
cuggguucccuuuccuucca

SEQ ID NO: 1494246 - RNA, 15 nt, Homo sapiens
cuggguuugagaaau

SEQ ID NO: 1494247 - RNA, 21 nt, Homo sapiens
cugguaacaguucauguuugc

SEQ ID NO: 1494248 - RNA, 16 nt, Homo sapiens
cugguauuguucucac

SEQ ID NO: 1494249 - RNA, 17 nt, Homo sapiens
cuggucagaugauauaa

SEQ ID NO: 1494250 - RNA, 15 nt, Homo sapiens
cuggucccuugcagc

SEQ ID NO: 1494251 - RNA, 20 nt, Homo sapiens
cugguggcaccagaugcaac

SEQ ID NO: 1494252 - RNA, 19 nt, Homo sapiens
cugguggcccgacagccug

SEQ ID NO: 1494253 - RNA, 13 nt, Homo sapiens
cuggugggacagu

SEQ ID NO: 1494254 - RNA, 16 nt, Homo sapiens
cugguggugcugcacc

SEQ ID NO: 1494255 - RNA, 23 nt, Homo sapiens
cugguuagaaaaaggacucugcu

SEQ ID NO: 1494256 - RNA, 13 nt, Homo sapiens
cugguuagguaga

SEQ ID NO: 1494257 - RNA, 17 nt, Homo sapiens
cugguugaaaaauggca

SEQ ID NO: 1494258 - RNA, 13 nt, Homo sapiens
cugguugauuugu

SEQ ID NO: 1494259 - RNA, 18 nt, Homo sapiens
cugguuguuaugugauca

SEQ ID NO: 1494260 - RNA, 22 nt, Homo sapiens
cugguuucuaccagcucauaca

SEQ ID NO: 1494261 - RNA, 14 nt, Homo sapiens
cuguaaacugaaua

SEQ ID NO: 1494262 - RNA, 14 nt, Homo sapiens
cuguaaauaaccua

SEQ ID NO: 1494263 - RNA, 23 nt, Homo sapiens
cuguaacagcggcaggguguccc

SEQ ID NO: 1494264 - RNA, 23 nt, Homo sapiens
cuguaauagugaacauauggaaa

SEQ ID NO: 1494265 - RNA, 19 nt, Homo sapiens
cuguaaucccaacacuuug

SEQ ID NO: 1494266 - RNA, 17 nt, Homo sapiens
cuguaaucccagcacuu

SEQ ID NO: 1494267 - RNA, 21 nt, Homo sapiens
cuguaaucccagcacuuuggg

SEQ ID NO: 1494268 - RNA, 17 nt, Homo sapiens
cuguaaucucagcacuu

SEQ ID NO: 1494269 - RNA, 18 nt, Homo sapiens
cuguaaucucagcacuuu

SEQ ID NO: 1494270 - RNA, 19 nt, Homo sapiens
cuguaaucucagcacuuug

SEQ ID NO: 1494271 - RNA, 17 nt, Homo sapiens
cuguaauucuagcacuu

SEQ ID NO: 1494272 - RNA, 15 nt, Homo sapiens
cuguacggacacugu

SEQ ID NO: 1494273 - RNA, 14 nt, Homo sapiens
cuguagaaaugaug

SEQ ID NO: 1494274 - RNA, 13 nt, Homo sapiens
cuguagaguugcu

SEQ ID NO: 1494275 - RNA, 19 nt, Homo sapiens
cuguaggcacacuuugcac

SEQ ID NO: 1494276 - RNA, 23 nt, Homo sapiens
cuguaggugguaugugacaccaa

SEQ ID NO: 1494277 - RNA, 13 nt, Homo sapiens
cuguagucauuua

SEQ ID NO: 1494278 - RNA, 17 nt, Homo sapiens
cuguauaagcacugaaa

SEQ ID NO: 1494279 - RNA, 18 nt, Homo sapiens
cuguaucggagacaguga

SEQ ID NO: 1494280 - RNA, 14 nt, Homo sapiens
cuguaugaacuuua

SEQ ID NO: 1494281 - RNA, 16 nt, Homo sapiens
cuguaugaacuuuauc

SEQ ID NO: 1494282 - RNA, 22 nt, Homo sapiens
cuguauguaaacuguuacugaa

SEQ ID NO: 1494283 - RNA, 18 nt, Homo sapiens
cuguauuccgauacaaag

SEQ ID NO: 1494284 - RNA, 15 nt, Homo sapiens
cugucaaagcuguca

SEQ ID NO: 1494285 - RNA, 22 nt, Homo sapiens
cugucaagaagaggaaagggag

SEQ ID NO: 1494286 - RNA, 14 nt, Homo sapiens
cugucacaccagcc

SEQ ID NO: 1494287 - RNA, 16 nt, Homo sapiens
cugucacagaguagaa

SEQ ID NO: 1494288 - RNA, 24 nt, Homo sapiens
cugucaugaaaucagcaagagagg

SEQ ID NO: 1494289 - RNA, 20 nt, Homo sapiens
cugucauuaguauuucacaa

SEQ ID NO: 1494290 - RNA, 17 nt, Homo sapiens
cugucccaccugcacac

SEQ ID NO: 1494291 - RNA, 12 nt, Homo sapiens
cuguccuaagca

SEQ ID NO: 1494292 - RNA, 19 nt, Homo sapiens
cuguccuaaggaaccuucc

SEQ ID NO: 1494293 - RNA, 17 nt, Homo sapiens
cuguccuaccaguugcc

SEQ ID NO: 1494294 - RNA, 15 nt, Homo sapiens
cuguccucagccuug

SEQ ID NO: 1494295 - RNA, 13 nt, Homo sapiens
cuguccugagaug

SEQ ID NO: 1494296 - RNA, 16 nt, Homo sapiens
cuguccuuucuugcag

SEQ ID NO: 1494297 - RNA, 17 nt, Homo sapiens
cuguccuuucuugcaga

SEQ ID NO: 1494298 - RNA, 22 nt, Homo sapiens
cuguccuuuuggcacugagaua

SEQ ID NO: 1494299 - RNA, 23 nt, Homo sapiens
cugucucagagauauacuggccc

SEQ ID NO: 1494300 - RNA, 18 nt, Homo sapiens
cugucuccuguauguggg

SEQ ID NO: 1494301 - RNA, 23 nt, Homo sapiens
cugucuuaaaugagaaguacuug

SEQ ID NO: 1494302 - RNA, 19 nt, Homo sapiens
cugucuuaugguccagaaa

SEQ ID NO: 1494303 - RNA, 22 nt, Homo sapiens
cugucuucggccgagcugguuu

SEQ ID NO: 1494304 - RNA, 21 nt, Homo sapiens
cugugaaaugcuggcauuugc

SEQ ID NO: 1494305 - RNA, 22 nt, Homo sapiens
cugugaaaugcuggcauuugca

SEQ ID NO: 1494306 - RNA, 13 nt, Homo sapiens
cugugaagcauuu

SEQ ID NO: 1494307 - RNA, 17 nt, Homo sapiens
cugugaaguuacaugca

SEQ ID NO: 1494308 - RNA, 15 nt, Homo sapiens
cugugacuaccucaa

SEQ ID NO: 1494309 - RNA, 18 nt, Homo sapiens
cugugauacgaugcuuca

SEQ ID NO: 1494310 - RNA, 15 nt, Homo sapiens
cugugcagucacugg

SEQ ID NO: 1494311 - RNA, 17 nt, Homo sapiens
cugugccacaaugcagu

SEQ ID NO: 1494312 - RNA, 13 nt, Homo sapiens
cugugccaguucu

SEQ ID NO: 1494313 - RNA, 17 nt, Homo sapiens
cugugcgugccauccag

SEQ ID NO: 1494314 - RNA, 15 nt, Homo sapiens
cugugcuaugaauuu

SEQ ID NO: 1494315 - RNA, 14 nt, Homo sapiens
cugugcugggggaa

SEQ ID NO: 1494316 - RNA, 19 nt, Homo sapiens
cugugcugggggaaugagc

SEQ ID NO: 1494317 - RNA, 22 nt, Homo sapiens
cuguggguccgauaauaucuuu

SEQ ID NO: 1494318 - RNA, 21 nt, Homo sapiens
cuguggucuucaaauugucuu

SEQ ID NO: 1494319 - RNA, 21 nt, Homo sapiens
cuguggugcccucugacaagg

SEQ ID NO: 1494320 - RNA, 16 nt, Homo sapiens
cugugucaaaagccag

SEQ ID NO: 1494321 - RNA, 16 nt, Homo sapiens
cugugucaaugccugu

SEQ ID NO: 1494322 - RNA, 15 nt, Homo sapiens
cugugugaaggugaa

SEQ ID NO: 1494323 - RNA, 12 nt, Homo sapiens
cugugugccauu

SEQ ID NO: 1494324 - RNA, 23 nt, Homo sapiens
cugugugccauuuuaagaguuac

SEQ ID NO: 1494325 - RNA, 15 nt, Homo sapiens
cuguguggacuguga

SEQ ID NO: 1494326 - RNA, 15 nt, Homo sapiens
cugugugugugaaug

SEQ ID NO: 1494327 - RNA, 13 nt, Homo sapiens
cuguguuaggggu

SEQ ID NO: 1494328 - RNA, 16 nt, Homo sapiens
cuguguuccuggcaau

SEQ ID NO: 1494329 - RNA, 22 nt, Homo sapiens
cuguuaacuaugacagauauau

SEQ ID NO: 1494330 - RNA, 20 nt, Homo sapiens
cuguuaacuuaauaguauuu

SEQ ID NO: 1494331 - RNA, 18 nt, Homo sapiens
cuguuaauuccuggaacu

SEQ ID NO: 1494332 - RNA, 15 nt, Homo sapiens
cuguuauauaucucu

SEQ ID NO: 1494333 - RNA, 18 nt, Homo sapiens
cuguuaucaaacugcugu

SEQ ID NO: 1494334 - RNA, 13 nt, Homo sapiens
cuguucaaaaagg

SEQ ID NO: 1494335 - RNA, 22 nt, Homo sapiens
cuguuccccaaggacucuucca

SEQ ID NO: 1494336 - RNA, 21 nt, Homo sapiens
cuguuccccucugcuacuagc

SEQ ID NO: 1494337 - RNA, 22 nt, Homo sapiens
cuguucggaagggguuccucaa

SEQ ID NO: 1494338 - RNA, 18 nt, Homo sapiens
cuguucuaaccacuucag

SEQ ID NO: 1494339 - RNA, 20 nt, Homo sapiens
cuguucuccaggcuucacag

SEQ ID NO: 1494340 - RNA, 19 nt, Homo sapiens
cuguucuggccucagacca

SEQ ID NO: 1494341 - RNA, 20 nt, Homo sapiens
cuguucugggcucuuuccuc

SEQ ID NO: 1494342 - RNA, 19 nt, Homo sapiens
cuguucugggggacagaga

SEQ ID NO: 1494343 - RNA, 13 nt, Homo sapiens
cuguugaugugga

SEQ ID NO: 1494344 - RNA, 12 nt, Homo sapiens
cuguugcucaaa

SEQ ID NO: 1494345 - RNA, 11 nt, Homo sapiens
cuguugcuugu

SEQ ID NO: 1494346 - RNA, 22 nt, Homo sapiens
cuguuguaacuaggcucagaga

SEQ ID NO: 1494347 - RNA, 17 nt, Homo sapiens
cuguuguagaagacaaa

SEQ ID NO: 1494348 - RNA, 20 nt, Homo sapiens
cuguuguaggguugccagau

SEQ ID NO: 1494349 - RNA, 14 nt, Homo sapiens
cuguuuaacauuuc

SEQ ID NO: 1494350 - RNA, 15 nt, Homo sapiens
cuguuuaacauuucc

SEQ ID NO: 1494351 - RNA, 19 nt, Homo sapiens
cuguuuccauagggugaca

SEQ ID NO: 1494352 - RNA, 21 nt, Homo sapiens
cuguuugaugcuauuuaugca

SEQ ID NO: 1494353 - RNA, 15 nt, Homo sapiens
cuguuugcuguggaa

SEQ ID NO: 1494354 - RNA, 20 nt, Homo sapiens
cuguuuguaaauuauuugcu

SEQ ID NO: 1494355 - RNA, 14 nt, Homo sapiens
cuguuuugccuuca

SEQ ID NO: 1494356 - RNA, 19 nt, Homo sapiens
cuguuuuugucuacacucu

SEQ ID NO: 1494357 - RNA, 14 nt, Homo sapiens
cuuaaaacuaaaug

SEQ ID NO: 1494358 - RNA, 22 nt, Homo sapiens
cuuaaaacuaaauguaauuuau

SEQ ID NO: 1494359 - RNA, 23 nt, Homo sapiens
cuuaaaauaaugaauacauuucc

SEQ ID NO: 1494360 - RNA, 19 nt, Homo sapiens
cuuaaaguuuaaaguugca

SEQ ID NO: 1494361 - RNA, 16 nt, Homo sapiens
cuuaaauaauuugggu

SEQ ID NO: 1494362 - RNA, 15 nt, Homo sapiens
cuuaacaaaccaaca

SEQ ID NO: 1494363 - RNA, 12 nt, Homo sapiens
cuuaacauucau

SEQ ID NO: 1494364 - RNA, 12 nt, Homo sapiens
cuuaacuaugag

SEQ ID NO: 1494365 - RNA, 20 nt, Homo sapiens
cuuaacuuguuugguaguua

SEQ ID NO: 1494366 - RNA, 19 nt, Homo sapiens
cuuaagacuuuugggacau

SEQ ID NO: 1494367 - RNA, 12 nt, Homo sapiens
cuuaagcuuuca

SEQ ID NO: 1494368 - RNA, 15 nt, Homo sapiens
cuuaaguucuaugaa

SEQ ID NO: 1494369 - RNA, 23 nt, Homo sapiens
cuuaaguucuaugaagaguauua

SEQ ID NO: 1494370 - RNA, 14 nt, Homo sapiens
cuuaauaaacugug

SEQ ID NO: 1494371 - RNA, 19 nt, Homo sapiens
cuuaauaacuguguacugu

SEQ ID NO: 1494372 - RNA, 16 nt, Homo sapiens
cuuaaugauacauguu

SEQ ID NO: 1494373 - RNA, 14 nt, Homo sapiens
cuuaaugguuuccu

SEQ ID NO: 1494374 - RNA, 21 nt, Homo sapiens
cuuacaggcauggacaugcag

SEQ ID NO: 1494375 - RNA, 17 nt, Homo sapiens
cuuacagucacuaauau

SEQ ID NO: 1494376 - RNA, 18 nt, Homo sapiens
cuuacugcuuaauucaaa

SEQ ID NO: 1494377 - RNA, 14 nt, Homo sapiens
cuuagaaauuguaa

SEQ ID NO: 1494378 - RNA, 15 nt, Homo sapiens
cuuagagacuaucaa

SEQ ID NO: 1494379 - RNA, 21 nt, Homo sapiens
cuuagagugggaccaacuucc

SEQ ID NO: 1494380 - RNA, 14 nt, Homo sapiens
cuuagcuugcacau

SEQ ID NO: 1494381 - RNA, 17 nt, Homo sapiens
cuuaguauuucucagga

SEQ ID NO: 1494382 - RNA, 16 nt, Homo sapiens
cuuaguuauugcugaa

SEQ ID NO: 1494383 - RNA, 12 nt, Homo sapiens
cuuaguucucac

SEQ ID NO: 1494384 - RNA, 18 nt, Homo sapiens
cuuauaagaaagaucaaa

SEQ ID NO: 1494385 - RNA, 14 nt, Homo sapiens
cuuauacauuugau

SEQ ID NO: 1494386 - RNA, 20 nt, Homo sapiens
cuuauauuuaaaacuugccu

SEQ ID NO: 1494387 - RNA, 14 nt, Homo sapiens
cuuauauuuacaau

SEQ ID NO: 1494388 - RNA, 16 nt, Homo sapiens
cuuauauuucccuaaa

SEQ ID NO: 1494389 - RNA, 20 nt, Homo sapiens
cuuauccaggacucugucaa

SEQ ID NO: 1494390 - RNA, 23 nt, Homo sapiens
cuuaucgggcuccagccaucuca

SEQ ID NO: 1494391 - RNA, 14 nt, Homo sapiens
cuuaucugucacac

SEQ ID NO: 1494392 - RNA, 21 nt, Homo sapiens
cucaugcugcagaggguacuu

SEQ ID NO: 1494393 - RNA, 16 nt, Homo sapiens
cucaugcuucacuuag

SEQ ID NO: 1494394 - RNA, 15 nt, Homo sapiens
cucauguggccaagc

SEQ ID NO: 1494395 - RNA, 16 nt, Homo sapiens
cucauguuacucagug

SEQ ID NO: 1494396 - RNA, 23 nt, Homo sapiens
cucauguuguugaggcugucaca

SEQ ID NO: 1494397 - RNA, 14 nt, Homo sapiens
cucauucugucacc

SEQ ID NO: 1494398 - RNA, 22 nt, Homo sapiens
cucauucuuuauucuauuuuag

SEQ ID NO: 1494399 - RNA, 13 nt, Homo sapiens
cucauugacaaga

SEQ ID NO: 1494400 - RNA, 14 nt, Homo sapiens
cucauuuguucuca

SEQ ID NO: 1494401 - RNA, 22 nt, Homo sapiens
cuccaacaccaagcacagcagc

SEQ ID NO: 1494402 - RNA, 19 nt, Homo sapiens
cuccaacugaaauguuaag

SEQ ID NO: 1494403 - RNA, 13 nt, Homo sapiens
cuccaacuggauu

SEQ ID NO: 1494404 - RNA, 18 nt, Homo sapiens
cuccaagcucacgaccuu

SEQ ID NO: 1494405 - RNA, 21 nt, Homo sapiens
cuccaagggacccuuugccuu

SEQ ID NO: 1494406 - RNA, 13 nt, Homo sapiens
cuccaaguacuuu

SEQ ID NO: 1494407 - RNA, 16 nt, Homo sapiens
cuccacaggcacaggu

SEQ ID NO: 1494408 - RNA, 17 nt, Homo sapiens
cuccacagucaauauua

SEQ ID NO: 1494409 - RNA, 22 nt, Homo sapiens
cuaauuuuuucccagacuacua

SEQ ID NO: 1494410 - RNA, 17 nt, Homo sapiens
cuacaaacuucaaagag

SEQ ID NO: 1494411 - RNA, 13 nt, Homo sapiens
cuacaaguauuau

SEQ ID NO: 1494412 - RNA, 19 nt, Homo sapiens
cuacaaguauuauuuuaca

SEQ ID NO: 1494413 - RNA, 16 nt, Homo sapiens
cuacaagucagcucca

SEQ ID NO: 1494414 - RNA, 22 nt, Homo sapiens
cuacaauuaauaguuugucuau

SEQ ID NO: 1494415 - RNA, 18 nt, Homo sapiens
cuacacacacacucccug

SEQ ID NO: 1494416 - RNA, 15 nt, Homo sapiens
cuacacacacccagg

SEQ ID NO: 1494417 - RNA, 13 nt, Homo sapiens
cuacacagccugg

SEQ ID NO: 1494418 - RNA, 22 nt, Homo sapiens
cuacagacaccaaguuccguca

SEQ ID NO: 1494419 - RNA, 22 nt, Homo sapiens
cuacagucuaaaauugcuucuu

SEQ ID NO: 1494420 - RNA, 12 nt, Homo sapiens
cuacaguuauua

SEQ ID NO: 1494421 - RNA, 18 nt, Homo sapiens
cuacauaaggaugaaggu

SEQ ID NO: 1494422 - RNA, 17 nt, Homo sapiens
cuacauacguguuccua

SEQ ID NO: 1494423 - RNA, 11 nt, Homo sapiens
cuacaugccuc

SEQ ID NO: 1494424 - RNA, 14 nt, Homo sapiens
cuacauguauugca

SEQ ID NO: 1494425 - RNA, 15 nt, Homo sapiens
cuacauguauugcac

SEQ ID NO: 1494426 - RNA, 18 nt, Homo sapiens
cuacauguauugcacauu

SEQ ID NO: 1494427 - RNA, 15 nt, Homo sapiens
cuacauugugcugca

SEQ ID NO: 1494428 - RNA, 13 nt, Homo sapiens
cuaccacaaggaa

SEQ ID NO: 1494429 - RNA, 13 nt, Homo sapiens
cuaccacaguguc

SEQ ID NO: 1494430 - RNA, 20 nt, Homo sapiens
cuaccccaaaguuugcucaa

SEQ ID NO: 1494431 - RNA, 18 nt, Homo sapiens
cuacccugcugaccuccc

SEQ ID NO: 1494432 - RNA, 13 nt, Homo sapiens
cuacgugcuccuc

SEQ ID NO: 1494433 - RNA, 13 nt, Homo sapiens
cuacuaaggggcu

SEQ ID NO: 1494434 - RNA, 16 nt, Homo sapiens
cuacuaaggugcuagg

SEQ ID NO: 1494435 - RNA, 19 nt, Homo sapiens
cuacuacaaacuucaaaga

SEQ ID NO: 1494436 - RNA, 14 nt, Homo sapiens
cuacuagagucuga

SEQ ID NO: 1494437 - RNA, 22 nt, Homo sapiens
cuacuagagucugaacagcugu

SEQ ID NO: 1494438 - RNA, 13 nt, Homo sapiens
cuacuauauugau

SEQ ID NO: 1494439 - RNA, 13 nt, Homo sapiens
cuacuaucacuga

SEQ ID NO: 1494440 - RNA, 12 nt, Homo sapiens
cuacucauucag

SEQ ID NO: 1494441 - RNA, 16 nt, Homo sapiens
cuacucucaugcugca

SEQ ID NO: 1494442 - RNA, 16 nt, Homo sapiens
cuacugacuacccucu

SEQ ID NO: 1494443 - RNA, 14 nt, Homo sapiens
cuacugagccuuca

SEQ ID NO: 1494444 - RNA, 16 nt, Homo sapiens
cuacugaggugcuaug

SEQ ID NO: 1494445 - RNA, 17 nt, Homo sapiens
cuacugcuaaauccuca

SEQ ID NO: 1494446 - RNA, 23 nt, Homo sapiens
cuacugggugucauuucauucca

SEQ ID NO: 1494447 - RNA, 13 nt, Homo sapiens
cuacuguguuccu

SEQ ID NO: 1494448 - RNA, 23 nt, Homo sapiens
cuacuuacaacccagggugugaa

SEQ ID NO: 1494449 - RNA, 16 nt, Homo sapiens
cuacuuuaucaauuaa

SEQ ID NO: 1494450 - RNA, 21 nt, Homo sapiens
cuagaaaaauguucuuuaaag

SEQ ID NO: 1494451 - RNA, 23 nt, Homo sapiens
cuagaagaaaagcccauuuucaa

SEQ ID NO: 1494452 - RNA, 12 nt, Homo sapiens
cuagaagccaag

SEQ ID NO: 1494453 - RNA, 20 nt, Homo sapiens
cuagaauuauaagucacaaa

SEQ ID NO: 1494454 - RNA, 15 nt, Homo sapiens
cuagacauggacgca

SEQ ID NO: 1494455 - RNA, 22 nt, Homo sapiens
cuagacccagguggagggcaca

SEQ ID NO: 1494456 - RNA, 16 nt, Homo sapiens
cuagaccuggugcuga

SEQ ID NO: 1494457 - RNA, 19 nt, Homo sapiens
cuagagaaggacccggagg

SEQ ID NO: 1494458 - RNA, 22 nt, Homo sapiens
cuagagacaggcaaacugcaaa

SEQ ID NO: 1494459 - RNA, 22 nt, Homo sapiens
cuagaggcuugcauaauaagcu

SEQ ID NO: 1494460 - RNA, 20 nt, Homo sapiens
cuagcaacccuaacaguaag

SEQ ID NO: 1494461 - RNA, 14 nt, Homo sapiens
cuagcaucccugag

SEQ ID NO: 1494462 - RNA, 20 nt, Homo sapiens
cuagccaccaguguccucca

SEQ ID NO: 1494463 - RNA, 21 nt, Homo sapiens
cuaggccucuccaguuugcac

SEQ ID NO: 1494464 - RNA, 14 nt, Homo sapiens
cuaggcuaccucaa

SEQ ID NO: 1494465 - RNA, 18 nt, Homo sapiens
cuaggggucaggcuccau

SEQ ID NO: 1494466 - RNA, 22 nt, Homo sapiens
cuagggucaggcggggugcugu

SEQ ID NO: 1494467 - RNA, 16 nt, Homo sapiens
cuagggucuugggggu

SEQ ID NO: 1494468 - RNA, 22 nt, Homo sapiens
cuagguagugaccuaaccacuu

SEQ ID NO: 1494469 - RNA, 13 nt, Homo sapiens
cuagguaucauuc

SEQ ID NO: 1494470 - RNA, 16 nt, Homo sapiens
cuaguaagaugcacug

SEQ ID NO: 1494471 - RNA, 16 nt, Homo sapiens
cuaguagcuaaccauc

SEQ ID NO: 1494472 - RNA, 22 nt, Homo sapiens
cuagucacucauccauccccug

SEQ ID NO: 1494473 - RNA, 15 nt, Homo sapiens
cuagucucaccagcc

SEQ ID NO: 1494474 - RNA, 15 nt, Homo sapiens
cuagucugcuagcca

SEQ ID NO: 1494475 - RNA, 23 nt, Homo sapiens
cuagugagcaaaauaugccccuu

SEQ ID NO: 1494476 - RNA, 12 nt, Homo sapiens
cuagugccuuua

SEQ ID NO: 1494477 - RNA, 14 nt, Homo sapiens
cuaguguaccuccu

SEQ ID NO: 1494478 - RNA, 18 nt, Homo sapiens
cuaguguucuguuuguua

SEQ ID NO: 1494479 - RNA, 12 nt, Homo sapiens
cuaguuacacau

SEQ ID NO: 1494480 - RNA, 13 nt, Homo sapiens
cuaguucuaccuc

SEQ ID NO: 1494481 - RNA, 14 nt, Homo sapiens
cuaguuuucaauca

SEQ ID NO: 1494482 - RNA, 17 nt, Homo sapiens
cuaguuuuuauacaugu

SEQ ID NO: 1494483 - RNA, 22 nt, Homo sapiens
cuauaaagaagaacuugcaugg

SEQ ID NO: 1494484 - RNA, 16 nt, Homo sapiens
cuauaagcccacuguu

SEQ ID NO: 1494485 - RNA, 17 nt, Homo sapiens
cuauaagcccacuguua

SEQ ID NO: 1494486 - RNA, 18 nt, Homo sapiens
cuauaaggccauaaaaca

SEQ ID NO: 1494487 - RNA, 23 nt, Homo sapiens
cuauacaaacuacagaguuuaug

SEQ ID NO: 1494488 - RNA, 19 nt, Homo sapiens
cuauacacuuaaugauaca

SEQ ID NO: 1494489 - RNA, 17 nt, Homo sapiens
cuauaccuuauccauag

SEQ ID NO: 1494490 - RNA, 18 nt, Homo sapiens
cuauaggccaaugcauga

SEQ ID NO: 1494491 - RNA, 20 nt, Homo sapiens
cuauagggugugaugaaguc

SEQ ID NO: 1494492 - RNA, 13 nt, Homo sapiens
cuauauccaugua

SEQ ID NO: 1494493 - RNA, 14 nt, Homo sapiens
cuauauuugcuaga

SEQ ID NO: 1494494 - RNA, 19 nt, Homo sapiens
ccagcaauuccugagccaa

SEQ ID NO: 1494495 - RNA, 14 nt, Homo sapiens
ccagcacacagggc

SEQ ID NO: 1494496 - RNA, 12 nt, Homo sapiens
ccagcaccacuu

SEQ ID NO: 1494497 - RNA, 11 nt, Homo sapiens
ccagcacucug

SEQ ID NO: 1494498 - RNA, 12 nt, Homo sapiens
ccagcacuggaa

SEQ ID NO: 1494499 - RNA, 12 nt, Homo sapiens
ccagcacuucca

SEQ ID NO: 1494500 - RNA, 20 nt, Homo sapiens
ccagcacuuugggaggccaa

SEQ ID NO: 1494501 - RNA, 17 nt, Homo sapiens
ccagcagcccaagcuua

SEQ ID NO: 1494502 - RNA, 21 nt, Homo sapiens
ccagcauccuccucuguucua

SEQ ID NO: 1494503 - RNA, 16 nt, Homo sapiens
ccagcaucuggaagau

SEQ ID NO: 1494504 - RNA, 21 nt, Homo sapiens
ccagccagaggcaucugaggg

SEQ ID NO: 1494505 - RNA, 15 nt, Homo sapiens
ccagccagugccauu

SEQ ID NO: 1494506 - RNA, 22 nt, Homo sapiens
ccagccaucaaauagugaaugg

SEQ ID NO: 1494507 - RNA, 14 nt, Homo sapiens
ccagccaugcaaug

SEQ ID NO: 1494508 - RNA, 22 nt, Homo sapiens
ccagccccucccccaucuccca

SEQ ID NO: 1494509 - RNA, 14 nt, Homo sapiens
ccagccucccacaa

SEQ ID NO: 1494510 - RNA, 12 nt, Homo sapiens
ccagccugcuuu

SEQ ID NO: 1494511 - RNA, 20 nt, Homo sapiens
ccagccuggccaacauggca

SEQ ID NO: 1494512 - RNA, 20 nt, Homo sapiens
ccagccugggcagcauagca

SEQ ID NO: 1494513 - RNA, 13 nt, Homo sapiens
ccagcgggcacag

SEQ ID NO: 1494514 - RNA, 18 nt, Homo sapiens
ccagcuaagaaccuggaa

SEQ ID NO: 1494515 - RNA, 18 nt, Homo sapiens
ccagcucaaugcaauggc

SEQ ID NO: 1494516 - RNA, 17 nt, Homo sapiens
ccagcuccaugcuccag

SEQ ID NO: 1494517 - RNA, 18 nt, Homo sapiens
ccagcugcacugaugcug

SEQ ID NO: 1494518 - RNA, 16 nt, Homo sapiens
ccagcugccaaggaaa

SEQ ID NO: 1494519 - RNA, 19 nt, Homo sapiens
ccagcugccaaggaaaccc

SEQ ID NO: 1494520 - RNA, 17 nt, Homo sapiens
ccagcugggucaggcag

SEQ ID NO: 1494521 - RNA, 15 nt, Homo sapiens
ccagcugugcacuuu

SEQ ID NO: 1494522 - RNA, 19 nt, Homo sapiens
ccagcugugcacuuucuuc

SEQ ID NO: 1494523 - RNA, 15 nt, Homo sapiens
ccaggaaagagcagu

SEQ ID NO: 1494524 - RNA, 18 nt, Homo sapiens
ccaggaaagagcagucag

SEQ ID NO: 1494525 - RNA, 22 nt, Homo sapiens
ccaggaagguagcccagcacug

SEQ ID NO: 1494526 - RNA, 13 nt, Homo sapiens
ccaggacaucucu

SEQ ID NO: 1494527 - RNA, 21 nt, Homo sapiens
ccaggacuauauuugggccug

SEQ ID NO: 1494528 - RNA, 22 nt, Homo sapiens
ccaggagacagaccacuugcca

SEQ ID NO: 1494529 - RNA, 21 nt, Homo sapiens
ccaggagauggaaguugcagu

SEQ ID NO: 1494530 - RNA, 15 nt, Homo sapiens
ccaggagcccggcuu

SEQ ID NO: 1494531 - RNA, 22 nt, Homo sapiens
ccaggaggagaaagcagccauu

SEQ ID NO: 1494532 - RNA, 22 nt, Homo sapiens
ccaggagguggaggcugcagug

SEQ ID NO: 1494533 - RNA, 13 nt, Homo sapiens
ccaggaguaccug

SEQ ID NO: 1494534 - RNA, 15 nt, Homo sapiens
ccaggaguaccugga

SEQ ID NO: 1494535 - RNA, 23 nt, Homo sapiens
ccaggauauugacaagaauacac

SEQ ID NO: 1494536 - RNA, 19 nt, Homo sapiens
ccaggaugaguuacuugaa

SEQ ID NO: 1494537 - RNA, 17 nt, Homo sapiens
ccaggcaggugccugga

SEQ ID NO: 1494538 - RNA, 23 nt, Homo sapiens
ccaggcaugaaauucuuccuaau

SEQ ID NO: 1494539 - RNA, 18 nt, Homo sapiens
ccaggccagagggcagug

SEQ ID NO: 1494540 - RNA, 20 nt, Homo sapiens
ccaggcccauuuccugcuuu

SEQ ID NO: 1494541 - RNA, 15 nt, Homo sapiens
ccaggcuaugccauc

SEQ ID NO: 1494542 - RNA, 18 nt, Homo sapiens
ccaggcugaccacagcac

SEQ ID NO: 1494543 - RNA, 23 nt, Homo sapiens
ccaggcugaccacagcacagcca

SEQ ID NO: 1494544 - RNA, 21 nt, Homo sapiens
ccaggcuggacgugguggcuc

SEQ ID NO: 1494545 - RNA, 20 nt, Homo sapiens
ccaggcuggagugcaguggu

SEQ ID NO: 1494546 - RNA, 22 nt, Homo sapiens
ccaggcuguucuccaggcuuca

SEQ ID NO: 1494547 - RNA, 17 nt, Homo sapiens
ccaggcuucuuccuaca

SEQ ID NO: 1494548 - RNA, 23 nt, Homo sapiens
ccagggauggccccuagccacag

SEQ ID NO: 1494549 - RNA, 18 nt, Homo sapiens
ccaggggaaccugccaug

SEQ ID NO: 1494550 - RNA, 22 nt, Homo sapiens
ccaggggaaccugccaugccag

SEQ ID NO: 1494551 - RNA, 17 nt, Homo sapiens
ccaggguacccgccuga

SEQ ID NO: 1494552 - RNA, 18 nt, Homo sapiens
ccagguaccucaugggaa

SEQ ID NO: 1494553 - RNA, 11 nt, Homo sapiens
ccagguccuuu

SEQ ID NO: 1494554 - RNA, 16 nt, Homo sapiens
ccaggucuugacucau

SEQ ID NO: 1494555 - RNA, 16 nt, Homo sapiens
ccaggugaacuggaau

SEQ ID NO: 1494556 - RNA, 13 nt, Homo sapiens
ccaggugagaaac

SEQ ID NO: 1494557 - RNA, 17 nt, Homo sapiens
ccagguugggggcagug

SEQ ID NO: 1494558 - RNA, 22 nt, Homo sapiens
ccagguugggggcaguguugug

SEQ ID NO: 1494559 - RNA, 18 nt, Homo sapiens
ccaguacuuccugcagua

SEQ ID NO: 1494560 - RNA, 15 nt, Homo sapiens
ccaguaugacaguau

SEQ ID NO: 1494561 - RNA, 21 nt, Homo sapiens
ccagucacaugaccugaucac

SEQ ID NO: 1494562 - RNA, 19 nt, Homo sapiens
ccaguccagauauuucaca

SEQ ID NO: 1494563 - RNA, 19 nt, Homo sapiens
ccagucucaaaaauacaaa

SEQ ID NO: 1494564 - RNA, 13 nt, Homo sapiens
ccagugaccccag

SEQ ID NO: 1494565 - RNA, 15 nt, Homo sapiens
ccagugccauuccac

SEQ ID NO: 1494566 - RNA, 20 nt, Homo sapiens
ccagugccauuccacuccac

SEQ ID NO: 1494567 - RNA, 17 nt, Homo sapiens
ccagugcgguuccucau

SEQ ID NO: 1494568 - RNA, 14 nt, Homo sapiens
ccaguggaugccac

SEQ ID NO: 1494569 - RNA, 9 nt, Homo sapiens
ccaguggga

SEQ ID NO: 1494570 - RNA, 24 nt, Homo sapiens
ccaguguaauaauaaaucguccuc

SEQ ID NO: 1494571 - RNA, 13 nt, Homo sapiens
ccagugucauccg

SEQ ID NO: 1494572 - RNA, 23 nt, Homo sapiens
ccaguguccccuccacugucaca

SEQ ID NO: 1494573 - RNA, 14 nt, Homo sapiens
ccaguuaugaauca

SEQ ID NO: 1494574 - RNA, 16 nt, Homo sapiens
cccaggaaguggccaa

SEQ ID NO: 1494575 - RNA, 16 nt, Homo sapiens
cccaggacgcuucuga

SEQ ID NO: 1494576 - RNA, 16 nt, Homo sapiens
cccaggacggggcaca

SEQ ID NO: 1494577 - RNA, 21 nt, Homo sapiens
cccaggagaaaagaagacauu

SEQ ID NO: 1494578 - RNA, 21 nt, Homo sapiens
cccaggaggugugauuccuga

SEQ ID NO: 1494579 - RNA, 19 nt, Homo sapiens
cccaggccccagacagggu

SEQ ID NO: 1494580 - RNA, 21 nt, Homo sapiens
cccaggccccagacagggugg

SEQ ID NO: 1494581 - RNA, 20 nt, Homo sapiens
cccaggcuggacugcaauga

SEQ ID NO: 1494582 - RNA, 23 nt, Homo sapiens
cccaggcuggagugcaguagcac

SEQ ID NO: 1494583 - RNA, 17 nt, Homo sapiens
cccaggcugugcagcgc

SEQ ID NO: 1494584 - RNA, 14 nt, Homo sapiens
cccagggagcucug

SEQ ID NO: 1494585 - RNA, 14 nt, Homo sapiens
cccagggcaacaag

SEQ ID NO: 1494586 - RNA, 18 nt, Homo sapiens
cccaggggacaagggauu

SEQ ID NO: 1494587 - RNA, 14 nt, Homo sapiens
cccaguaacugcac

SEQ ID NO: 1494588 - RNA, 22 nt, Homo sapiens
cccagugcccccacugaccaga

SEQ ID NO: 1494589 - RNA, 22 nt, Homo sapiens
cccaguucacccugauuuagga

SEQ ID NO: 1494590 - RNA, 19 nt, Homo sapiens
cccauagaaaacuugacau

SEQ ID NO: 1494591 - RNA, 23 nt, Homo sapiens
cccauccauuaggccagcaacgc

SEQ ID NO: 1494592 - RNA, 15 nt, Homo sapiens
cccugugccaucacc

SEQ ID NO: 1494593 - RNA, 13 nt, Homo sapiens
cccugugggucaa

SEQ ID NO: 1494594 - RNA, 20 nt, Homo sapiens
cccuguguauucaccaccaa

SEQ ID NO: 1494595 - RNA, 18 nt, Homo sapiens
cccuguucaugugccucu

SEQ ID NO: 1494596 - RNA, 16 nt, Homo sapiens
cccuguucuaaggggg

SEQ ID NO: 1494597 - RNA, 17 nt, Homo sapiens
cccuuaagagucaucca

SEQ ID NO: 1494598 - RNA, 22 nt, Homo sapiens
cccuuacagagcauacaacaga

SEQ ID NO: 1494599 - RNA, 17 nt, Homo sapiens
cccuuagccucccugaa

SEQ ID NO: 1494600 - RNA, 17 nt, Homo sapiens
cccuuagugacucuuga

SEQ ID NO: 1494601 - RNA, 22 nt, Homo sapiens
cccuucaaccauuccccauggg

SEQ ID NO: 1494602 - RNA, 20 nt, Homo sapiens
cccuucaguacccucucagc

SEQ ID NO: 1494603 - RNA, 21 nt, Homo sapiens
cccuucccugcacuaaagcca

SEQ ID NO: 1494604 - RNA, 15 nt, Homo sapiens
cccuucugcucagcu

SEQ ID NO: 1494605 - RNA, 18 nt, Homo sapiens
cccuugcugaacacacac

SEQ ID NO: 1494606 - RNA, 19 nt, Homo sapiens
cccuuugaugauuaauuca

SEQ ID NO: 1494607 - RNA, 20 nt, Homo sapiens
cccuuugggcggccucuggg

SEQ ID NO: 1494608 - RNA, 13 nt, Homo sapiens
cccuuuuacuuuu

SEQ ID NO: 1494609 - RNA, 17 nt, Homo sapiens
cccuuuucucucaccca

SEQ ID NO: 1494610 - RNA, 12 nt, Homo sapiens
ccgaaaccagag

SEQ ID NO: 1494611 - RNA, 15 nt, Homo sapiens
ccgaaacuaagccag

SEQ ID NO: 1494612 - RNA, 18 nt, Homo sapiens
ccgaacuuuaauuucagg

SEQ ID NO: 1494613 - RNA, 18 nt, Homo sapiens
ccgaaggguuuugcuaca

SEQ ID NO: 1494614 - RNA, 15 nt, Homo sapiens
ccgaccggugcauga

SEQ ID NO: 1494615 - RNA, 17 nt, Homo sapiens
ccgacuagacacacaaa

SEQ ID NO: 1494616 - RNA, 17 nt, Homo sapiens
ccgagccuccaguccaa

SEQ ID NO: 1494617 - RNA, 13 nt, Homo sapiens
ccgaggcccucaa

SEQ ID NO: 1494618 - RNA, 17 nt, Homo sapiens
ccgaggccgugcagugg

SEQ ID NO: 1494619 - RNA, 22 nt, Homo sapiens
ccgaggccugcauguccggcug

SEQ ID NO: 1494620 - RNA, 16 nt, Homo sapiens
ccgcaacagccaagug

SEQ ID NO: 1494621 - RNA, 23 nt, Homo sapiens
ccgcagaagcccugauguguccu

SEQ ID NO: 1494622 - RNA, 13 nt, Homo sapiens
ccgcagaauggac

SEQ ID NO: 1494623 - RNA, 14 nt, Homo sapiens
ccgcagaauggacu

SEQ ID NO: 1494624 - RNA, 16 nt, Homo sapiens
ccgcagacgggcacag

SEQ ID NO: 1494625 - RNA, 18 nt, Homo sapiens
ccgcaggugggugcugcc

SEQ ID NO: 1494626 - RNA, 17 nt, Homo sapiens
ccgcauugauggccuca

SEQ ID NO: 1494627 - RNA, 21 nt, Homo sapiens
ccgccauugccaccaggagaa

SEQ ID NO: 1494628 - RNA, 14 nt, Homo sapiens
ccgcugacugccac

SEQ ID NO: 1494629 - RNA, 18 nt, Homo sapiens
ccgcugcaaugccuagac

SEQ ID NO: 1494630 - RNA, 16 nt, Homo sapiens
ccgcugcgggcccacg

SEQ ID NO: 1494631 - RNA, 18 nt, Homo sapiens
ccggaugcuucuccauga

SEQ ID NO: 1494632 - RNA, 17 nt, Homo sapiens
ccggccgauggagacac

SEQ ID NO: 1494633 - RNA, 16 nt, Homo sapiens
ccggcugaggccugag

SEQ ID NO: 1494634 - RNA, 14 nt, Homo sapiens
ccggcuguggagca

SEQ ID NO: 1494635 - RNA, 16 nt, Homo sapiens
ccggggccagcacuuc

SEQ ID NO: 1494636 - RNA, 14 nt, Homo sapiens
ccggugugccugug

SEQ ID NO: 1494637 - RNA, 22 nt, Homo sapiens
ccguaccucuucccaugacugc

SEQ ID NO: 1494638 - RNA, 21 nt, Homo sapiens
ccgucuucucccuauucccuc

SEQ ID NO: 1494639 - RNA, 18 nt, Homo sapiens
ccgugaggcaaugggagc

SEQ ID NO: 1494640 - RNA, 21 nt, Homo sapiens
ccgugagugaaccaucauuau

SEQ ID NO: 1494641 - RNA, 14 nt, Homo sapiens
ccgugcccugguga

SEQ ID NO: 1494642 - RNA, 11 nt, Homo sapiens
ccgugccuuca

SEQ ID NO: 1494643 - RNA, 12 nt, Homo sapiens
ccguggagccuu

SEQ ID NO: 1494644 - RNA, 16 nt, Homo sapiens
ccguggucccugagga

SEQ ID NO: 1494645 - RNA, 16 nt, Homo sapiens
ccguuaggaaaaccag

SEQ ID NO: 1494646 - RNA, 19 nt, Homo sapiens
ccuaaaagugggcuugauu

SEQ ID NO: 1494647 - RNA, 13 nt, Homo sapiens
ccuaacaaaagau

SEQ ID NO: 1494648 - RNA, 11 nt, Homo sapiens
ccuaacacagu

SEQ ID NO: 1494649 - RNA, 16 nt, Homo sapiens
ccuaacacggugcuca

SEQ ID NO: 1494650 - RNA, 21 nt, Homo sapiens
ccuaacauucgaucucauuca

SEQ ID NO: 1494651 - RNA, 21 nt, Homo sapiens
ccuaagagaugggacuaggac

SEQ ID NO: 1494652 - RNA, 16 nt, Homo sapiens
ccuaauaggcugggag

SEQ ID NO: 1494653 - RNA, 12 nt, Homo sapiens
ccuaaucuucca

SEQ ID NO: 1494654 - RNA, 16 nt, Homo sapiens
ccuacacacacacucc

SEQ ID NO: 1494655 - RNA, 19 nt, Homo sapiens
ccuacagaacuucagaaag

SEQ ID NO: 1494656 - RNA, 22 nt, Homo sapiens
ccuacaggugcuguucagugcc

SEQ ID NO: 1494657 - RNA, 17 nt, Homo sapiens
ccuacaucuucuuccca

SEQ ID NO: 1494658 - RNA, 16 nt, Homo sapiens
ccuaccaguugcccua

SEQ ID NO: 1494659 - RNA, 13 nt, Homo sapiens
ccuaccccagggc

SEQ ID NO: 1494660 - RNA, 21 nt, Homo sapiens
ccuacccccuaagagccauuu

SEQ ID NO: 1494661 - RNA, 21 nt, Homo sapiens
ccuaccucacagagugcauug

SEQ ID NO: 1494662 - RNA, 11 nt, Homo sapiens
ccuaccucagc

SEQ ID NO: 1494663 - RNA, 16 nt, Homo sapiens
ccuacguauccugcag

SEQ ID NO: 1494664 - RNA, 13 nt, Homo sapiens
ccuacgugccacu

SEQ ID NO: 1494665 - RNA, 22 nt, Homo sapiens
ccuacuaucacugaacaaacua

SEQ ID NO: 1494666 - RNA, 22 nt, Homo sapiens
ccuagaaugucagauuucuggu

SEQ ID NO: 1494667 - RNA, 19 nt, Homo sapiens
ccuagacaaacaagggaga

SEQ ID NO: 1494668 - RNA, 15 nt, Homo sapiens
ccuagacccaggugg

SEQ ID NO: 1494669 - RNA, 23 nt, Homo sapiens
ccuagcaaggcaugauguuaacc

SEQ ID NO: 1494670 - RNA, 18 nt, Homo sapiens
ccuagccaccaguguccu

SEQ ID NO: 1494671 - RNA, 22 nt, Homo sapiens
ccuagcccagacucugagcugc

SEQ ID NO: 1494672 - RNA, 20 nt, Homo sapiens
ccuaggauuucaugauuuca

SEQ ID NO: 1494673 - RNA, 22 nt, Homo sapiens
ccuaggcuaccucaagacucac

SEQ ID NO: 1494674 - RNA, 21 nt, Homo sapiens
ccuaggggaacagaccaguga

SEQ ID NO: 1494675 - RNA, 22 nt, Homo sapiens
ccuaguacugccccccaugagg

SEQ ID NO: 1494676 - RNA, 20 nt, Homo sapiens
ccaguucauugcacuuugau

SEQ ID NO: 1494677 - RNA, 22 nt, Homo sapiens
ccaguuccuguagaacugagaa

SEQ ID NO: 1494678 - RNA, 13 nt, Homo sapiens
ccauaaaggcaua

SEQ ID NO: 1494679 - RNA, 13 nt, Homo sapiens
ccauaaugcauuc

SEQ ID NO: 1494680 - RNA, 16 nt, Homo sapiens
ccauaauguugcuucu

SEQ ID NO: 1494681 - RNA, 19 nt, Homo sapiens
ccauaauuuauuuugucca

SEQ ID NO: 1494682 - RNA, 14 nt, Homo sapiens
ccauacgagcaccu

SEQ ID NO: 1494683 - RNA, 13 nt, Homo sapiens
ccauagauggguc

SEQ ID NO: 1494684 - RNA, 21 nt, Homo sapiens
ccauaggacauacugcaugua

SEQ ID NO: 1494685 - RNA, 16 nt, Homo sapiens
ccauagugaccaacau

SEQ ID NO: 1494686 - RNA, 23 nt, Homo sapiens
ccauauaccaucuccagcuauuu

SEQ ID NO: 1494687 - RNA, 16 nt, Homo sapiens
ccauaucaugcuaaaa

SEQ ID NO: 1494688 - RNA, 23 nt, Homo sapiens
ccauccaaacacugaggcagccu

SEQ ID NO: 1494689 - RNA, 16 nt, Homo sapiens
ccauccccacccaguc

SEQ ID NO: 1494690 - RNA, 14 nt, Homo sapiens
ccauccccuggacu

SEQ ID NO: 1494691 - RNA, 18 nt, Homo sapiens
ccauccccuggacuggga

SEQ ID NO: 1494692 - RNA, 15 nt, Homo sapiens
ccaucccugauggca

SEQ ID NO: 1494693 - RNA, 21 nt, Homo sapiens
ccauccuuccaacauauauuu

SEQ ID NO: 1494694 - RNA, 15 nt, Homo sapiens
ccauccuucccucau

SEQ ID NO: 1494695 - RNA, 17 nt, Homo sapiens
caucuauucaagcacuu

SEQ ID NO: 1494696 - RNA, 18 nt, Homo sapiens
caucuauucaagcacuua

SEQ ID NO: 1494697 - RNA, 21 nt, Homo sapiens
caucucaaagaaggcauuugc

SEQ ID NO: 1494698 - RNA, 14 nt, Homo sapiens
caucucaggggcca

SEQ ID NO: 1494699 - RNA, 15 nt, Homo sapiens
caucucagugcagga

SEQ ID NO: 1494700 - RNA, 22 nt, Homo sapiens
caucuccagggagcaagacaga

SEQ ID NO: 1494701 - RNA, 12 nt, Homo sapiens
caucucuacuaa

SEQ ID NO: 1494702 - RNA, 18 nt, Homo sapiens
caucucuccccaacccua

SEQ ID NO: 1494703 - RNA, 21 nt, Homo sapiens
caucugaaaguagagguugua

SEQ ID NO: 1494704 - RNA, 22 nt, Homo sapiens
caucuggccuaauguuccagau

SEQ ID NO: 1494705 - RNA, 22 nt, Homo sapiens
caucugugcacugcccauggac

SEQ ID NO: 1494706 - RNA, 15 nt, Homo sapiens
caucuuagaccucca

SEQ ID NO: 1494707 - RNA, 19 nt, Homo sapiens
caucuucaaagcuugaaga

SEQ ID NO: 1494708 - RNA, 11 nt, Homo sapiens
caucuuccaag

SEQ ID NO: 1494709 - RNA, 10 nt, Homo sapiens
caucuuuaag

SEQ ID NO: 1494710 - RNA, 20 nt, Homo sapiens
caucuuuaucuguucuugcu

SEQ ID NO: 1494711 - RNA, 21 nt, Homo sapiens
caucuuuuuaaccugcaaaau

SEQ ID NO: 1494712 - RNA, 19 nt, Homo sapiens
caugaaaguggacaaggag

SEQ ID NO: 1494713 - RNA, 15 nt, Homo sapiens
caugaaauacugugc

SEQ ID NO: 1494714 - RNA, 20 nt, Homo sapiens
caugaaaucuuuaugugaua

SEQ ID NO: 1494715 - RNA, 14 nt, Homo sapiens
caugaacagcauua

SEQ ID NO: 1494716 - RNA, 14 nt, Homo sapiens
cauugacaccagaa

SEQ ID NO: 1494717 - RNA, 11 nt, Homo sapiens
cauugaccucu

SEQ ID NO: 1494718 - RNA, 16 nt, Homo sapiens
cauugacgauuccuuc

SEQ ID NO: 1494719 - RNA, 18 nt, Homo sapiens
cauugagccaguggugcu

SEQ ID NO: 1494720 - RNA, 19 nt, Homo sapiens
cauugagccaguggugcua

SEQ ID NO: 1494721 - RNA, 19 nt, Homo sapiens
cauugaucaaauauuucaa

SEQ ID NO: 1494722 - RNA, 17 nt, Homo sapiens
cauugcgugauucaaug

SEQ ID NO: 1494723 - RNA, 21 nt, Homo sapiens
cauugcuaaacugaugacuua

SEQ ID NO: 1494724 - RNA, 14 nt, Homo sapiens
cauugcucuaugaa

SEQ ID NO: 1494725 - RNA, 17 nt, Homo sapiens
cauugcuugugccacac

SEQ ID NO: 1494726 - RNA, 17 nt, Homo sapiens
cauuggaacaacugaua

SEQ ID NO: 1494727 - RNA, 19 nt, Homo sapiens
cauuggaauaaaacugucu

SEQ ID NO: 1494728 - RNA, 15 nt, Homo sapiens
cauuggacuuccucc

SEQ ID NO: 1494729 - RNA, 23 nt, Homo sapiens
cauuggcuauuuaaaacuuguaa

SEQ ID NO: 1494730 - RNA, 18 nt, Homo sapiens
cauuggcucccaagucac

SEQ ID NO: 1494731 - RNA, 19 nt, Homo sapiens
cauuggcucccaagucaca

SEQ ID NO: 1494732 - RNA, 15 nt, Homo sapiens
cauuggugaaguaaa

SEQ ID NO: 1494733 - RNA, 21 nt, Homo sapiens
cauuguauauauguguaugca

SEQ ID NO: 1494734 - RNA, 13 nt, Homo sapiens
cauuguccagagc

SEQ ID NO: 1494735 - RNA, 17 nt, Homo sapiens
cauugugcugcaccugg

SEQ ID NO: 1494736 - RNA, 19 nt, Homo sapiens
cauuuaaaacauugcaaau

SEQ ID NO: 1494737 - RNA, 16 nt, Homo sapiens
cauuuaaaauucaauu

SEQ ID NO: 1494738 - RNA, 17 nt, Homo sapiens
cauuuaaauguguacaa

SEQ ID NO: 1494739 - RNA, 20 nt, Homo sapiens
cauuuaauacagcaguguca

SEQ ID NO: 1494740 - RNA, 11 nt, Homo sapiens
cauuuacuuuu

SEQ ID NO: 1494741 - RNA, 18 nt, Homo sapiens
cauuuagaacuugcagcu

SEQ ID NO: 1494742 - RNA, 16 nt, Homo sapiens
cauuuagaacuuuaag

SEQ ID NO: 1494743 - RNA, 22 nt, Homo sapiens
cauuuauaaccccagccugacc

SEQ ID NO: 1494744 - RNA, 21 nt, Homo sapiens
cauuuaugauuuaauaaaaua

SEQ ID NO: 1494745 - RNA, 17 nt, Homo sapiens
cauuucagaaaugcugu

SEQ ID NO: 1494746 - RNA, 13 nt, Homo sapiens
cauuucaguauca

SEQ ID NO: 1494747 - RNA, 20 nt, Homo sapiens
cauuuccaacaccacagaca

SEQ ID NO: 1494748 - RNA, 16 nt, Homo sapiens
cauuucccaucugcac

SEQ ID NO: 1494749 - RNA, 18 nt, Homo sapiens
cauuuccuuccagcccau

SEQ ID NO: 1494750 - RNA, 16 nt, Homo sapiens
cauuuccuuccuucca

SEQ ID NO: 1494751 - RNA, 15 nt, Homo sapiens
cauuucuagcaguga

SEQ ID NO: 1494752 - RNA, 18 nt, Homo sapiens
cauuucuagcagugauga

SEQ ID NO: 1494753 - RNA, 17 nt, Homo sapiens
cauuucuuugcauucca

SEQ ID NO: 1494754 - RNA, 18 nt, Homo sapiens
cauuucuuugcauuccag

SEQ ID NO: 1494755 - RNA, 13 nt, Homo sapiens
cauuugaacaugu

SEQ ID NO: 1494756 - RNA, 16 nt, Homo sapiens
cauuugaagcagugau

SEQ ID NO: 1494757 - RNA, 14 nt, Homo sapiens
cauuugauauguga

SEQ ID NO: 1494758 - RNA, 18 nt, Homo sapiens
cauuuggccuugugcggu

SEQ ID NO: 1494759 - RNA, 20 nt, Homo sapiens
cauuugggagacaugugaca

SEQ ID NO: 1494760 - RNA, 21 nt, Homo sapiens
cauuuguucucacaccaacag

SEQ ID NO: 1494761 - RNA, 19 nt, Homo sapiens
cauuuuacaggugcgaaug

SEQ ID NO: 1494762 - RNA, 15 nt, Homo sapiens
cauuuuaucccaugg

SEQ ID NO: 1494763 - RNA, 18 nt, Homo sapiens
cauuuuccuguucaguga

SEQ ID NO: 1494764 - RNA, 15 nt, Homo sapiens
cauuuugacacaaaa

SEQ ID NO: 1494765 - RNA, 17 nt, Homo sapiens
cauuuugacagcaucuu

SEQ ID NO: 1494766 - RNA, 13 nt, Homo sapiens
cauuuugcaaaau

SEQ ID NO: 1494767 - RNA, 14 nt, Homo sapiens
cauuuugcaaaauu

SEQ ID NO: 1494768 - RNA, 19 nt, Homo sapiens
cauuuuggcgcuauuacaa

SEQ ID NO: 1494769 - RNA, 20 nt, Homo sapiens
cauuuugucaguuuuaucuu

SEQ ID NO: 1494770 - RNA, 20 nt, Homo sapiens
cauuuuuauuaaagcauuuc

SEQ ID NO: 1494771 - RNA, 14 nt, Homo sapiens
cauuuuucugggag

SEQ ID NO: 1494772 - RNA, 20 nt, Homo sapiens
ccaaaaagggauccguacau

SEQ ID NO: 1494773 - RNA, 15 nt, Homo sapiens
ccaaaaauuacugau

SEQ ID NO: 1494774 - RNA, 24 nt, Homo sapiens
ccaaaacuuuaaugaacuaacuga

SEQ ID NO: 1494775 - RNA, 19 nt, Homo sapiens
ccaaaauauuuuuugcaag

SEQ ID NO: 1494776 - RNA, 23 nt, Homo sapiens
ccaaaauggucucuaacauuucc

SEQ ID NO: 1494777 - RNA, 18 nt, Homo sapiens
ccaaacugggggcucugu

SEQ ID NO: 1494778 - RNA, 13 nt, Homo sapiens
ccaaagccaguga

SEQ ID NO: 1494779 - RNA, 22 nt, Homo sapiens
ccaaaggugugcccuguacaca

SEQ ID NO: 1494780 - RNA, 13 nt, Homo sapiens
ccaaaguguuaau

SEQ ID NO: 1494781 - RNA, 15 nt, Homo sapiens
ccaaauaaauauauu

SEQ ID NO: 1494782 - RNA, 14 nt, Homo sapiens
ccaaauaauuucau

SEQ ID NO: 1494783 - RNA, 15 nt, Homo sapiens
ccaaaucagcugcua

SEQ ID NO: 1494784 - RNA, 17 nt, Homo sapiens
ccaaaucugacauauua

SEQ ID NO: 1494785 - RNA, 12 nt, Homo sapiens
ccaaaugagauc

SEQ ID NO: 1494786 - RNA, 13 nt, Homo sapiens
ccaacaaaccauc

SEQ ID NO: 1494787 - RNA, 21 nt, Homo sapiens
ccaacacugucacuagucuca

SEQ ID NO: 1494788 - RNA, 22 nt, Homo sapiens
ccaacagaggggcagccaggac

SEQ ID NO: 1494789 - RNA, 18 nt, Homo sapiens
ccaacagcagugaucuca

SEQ ID NO: 1494790 - RNA, 16 nt, Homo sapiens
ccaacauucuuggcau

SEQ ID NO: 1494791 - RNA, 22 nt, Homo sapiens
ccaacccccgccaccucagggc

SEQ ID NO: 1494792 - RNA, 10 nt, Homo sapiens
ccaaccucag

SEQ ID NO: 1494793 - RNA, 14 nt, Homo sapiens
ccaaccuccugacc

SEQ ID NO: 1494794 - RNA, 17 nt, Homo sapiens
ccaacgagcuguacaug

SEQ ID NO: 1494795 - RNA, 23 nt, Homo sapiens
ccaacucacugaacuagugcagg

SEQ ID NO: 1494796 - RNA, 13 nt, Homo sapiens
ccaacuccaggaa

SEQ ID NO: 1494797 - RNA, 13 nt, Homo sapiens
caacaugcugccc

SEQ ID NO: 1494798 - RNA, 16 nt, Homo sapiens
caacaugcugccccag

SEQ ID NO: 1494799 - RNA, 21 nt, Homo sapiens
caacauggugaaaccccaucu

SEQ ID NO: 1494800 - RNA, 24 nt, Homo sapiens
caaccaacggccgacugccuguga

SEQ ID NO: 1494801 - RNA, 20 nt, Homo sapiens
caaccaauuccaaguuuuaa

SEQ ID NO: 1494802 - RNA, 18 nt, Homo sapiens
caaccagagaagcugcua

SEQ ID NO: 1494803 - RNA, 19 nt, Homo sapiens
caaccagagaagcugcuac

SEQ ID NO: 1494804 - RNA, 12 nt, Homo sapiens
caacccacuuaa

SEQ ID NO: 1494805 - RNA, 18 nt, Homo sapiens
caacccagccaugcaaug

SEQ ID NO: 1494806 - RNA, 18 nt, Homo sapiens
caacccagggugugaaca

SEQ ID NO: 1494807 - RNA, 18 nt, Homo sapiens
caacccauucacuacagg

SEQ ID NO: 1494808 - RNA, 13 nt, Homo sapiens
caaccccaggcug

SEQ ID NO: 1494809 - RNA, 15 nt, Homo sapiens
caaccccugcuccag

SEQ ID NO: 1494810 - RNA, 14 nt, Homo sapiens
caacccuucccuca

SEQ ID NO: 1494811 - RNA, 17 nt, Homo sapiens
caaccugacucaggcca

SEQ ID NO: 1494812 - RNA, 13 nt, Homo sapiens
caaccuuccagcu

SEQ ID NO: 1494813 - RNA, 18 nt, Homo sapiens
caacgccucacugaaaca

SEQ ID NO: 1494814 - RNA, 18 nt, Homo sapiens
caacuauuuauugaauga

SEQ ID NO: 1494815 - RNA, 16 nt, Homo sapiens
caacucacacauuccc

SEQ ID NO: 1494816 - RNA, 13 nt, Homo sapiens
caacucuauuuaa

SEQ ID NO: 1494817 - RNA, 16 nt, Homo sapiens
caacucuccaauguuc

SEQ ID NO: 1494818 - RNA, 18 nt, Homo sapiens
caacucuccaauguucua

SEQ ID NO: 1494819 - RNA, 22 nt, Homo sapiens
caacucuccccugaccugugag

SEQ ID NO: 1494820 - RNA, 20 nt, Homo sapiens
caacucugagaucuaaggau

SEQ ID NO: 1494821 - RNA, 19 nt, Homo sapiens
caacugaaguucuauuuau

SEQ ID NO: 1494822 - RNA, 20 nt, Homo sapiens
caacugaguguuauuugcac

SEQ ID NO: 1494823 - RNA, 12 nt, Homo sapiens
caacugauugca

SEQ ID NO: 1494824 - RNA, 20 nt, Homo sapiens
cagagaaucauacuuagcaa

SEQ ID NO: 1494825 - RNA, 14 nt, Homo sapiens
cagagacccaacag

SEQ ID NO: 1494826 - RNA, 21 nt, Homo sapiens
cagagacccaacagcagugau

SEQ ID NO: 1494827 - RNA, 21 nt, Homo sapiens
cagagagacagacuugagaac

SEQ ID NO: 1494828 - RNA, 15 nt, Homo sapiens
cagagagcaacucug

SEQ ID NO: 1494829 - RNA, 16 nt, Homo sapiens
cagagagcaacucuga

SEQ ID NO: 1494830 - RNA, 21 nt, Homo sapiens
cagagagggcaccaucacaau

SEQ ID NO: 1494831 - RNA, 15 nt, Homo sapiens
cagagauccaaaaga

SEQ ID NO: 1494832 - RNA, 20 nt, Homo sapiens
cagagaucguguauugagau

SEQ ID NO: 1494833 - RNA, 21 nt, Homo sapiens
cagagauggucacaugaccca

SEQ ID NO: 1494834 - RNA, 22 nt, Homo sapiens
cagagaugugcacccaugggcu

SEQ ID NO: 1494835 - RNA, 20 nt, Homo sapiens
cagagcaagacuccaucuca

SEQ ID NO: 1494836 - RNA, 20 nt, Homo sapiens
cagagcaagacucugucuca

SEQ ID NO: 1494837 - RNA, 19 nt, Homo sapiens
cagagcaggcaauuucacc

SEQ ID NO: 1494838 - RNA, 14 nt, Homo sapiens
cagagcaguuucau

SEQ ID NO: 1494839 - RNA, 17 nt, Homo sapiens
cagagcccugugucugu

SEQ ID NO: 1494840 - RNA, 20 nt, Homo sapiens
cagagcgagacuccgucuca

SEQ ID NO: 1494841 - RNA, 20 nt, Homo sapiens
cagagcgagauuccgucuua

SEQ ID NO: 1494842 - RNA, 16 nt, Homo sapiens
cagagcugagcccuca

SEQ ID NO: 1494843 - RNA, 17 nt, Homo sapiens
cagagcugucugaacuc

SEQ ID NO: 1494844 - RNA, 16 nt, Homo sapiens
cagaggagccaugucc

SEQ ID NO: 1494845 - RNA, 15 nt, Homo sapiens
cagaggaugucacaa

SEQ ID NO: 1494846 - RNA, 16 nt, Homo sapiens
cagaggcaacacugga

SEQ ID NO: 1494847 - RNA, 20 nt, Homo sapiens
cagaggcauccggaucccag

SEQ ID NO: 1494848 - RNA, 21 nt, Homo sapiens
cagaggccugcugccagugca

SEQ ID NO: 1494849 - RNA, 15 nt, Homo sapiens
cagaggcggucuuca

SEQ ID NO: 1494850 - RNA, 14 nt, Homo sapiens
cagaggcugauguc

SEQ ID NO: 1494851 - RNA, 17 nt, Homo sapiens
cagagggccucaaucuc

SEQ ID NO: 1494852 - RNA, 15 nt, Homo sapiens
cagagggucaggguu

SEQ ID NO: 1494853 - RNA, 14 nt, Homo sapiens
cagaggguugugau

SEQ ID NO: 1494854 - RNA, 18 nt, Homo sapiens
cagagguaaaagugugag

SEQ ID NO: 1494855 - RNA, 23 nt, Homo sapiens
cagagguaaaagugugagcagug

SEQ ID NO: 1494856 - RNA, 19 nt, Homo sapiens
cagagguugcagugagcug

SEQ ID NO: 1494857 - RNA, 15 nt, Homo sapiens
cagaguagaaacuca

SEQ ID NO: 1494858 - RNA, 16 nt, Homo sapiens
cagagugcaacccagu

SEQ ID NO: 1494859 - RNA, 21 nt, Homo sapiens
cagaguuagguugucuccagg

SEQ ID NO: 1494860 - RNA, 23 nt, Homo sapiens
cagaguuggacuucuagacucac

SEQ ID NO: 1494861 - RNA, 13 nt, Homo sapiens
cagaguuugccuu

SEQ ID NO: 1494862 - RNA, 14 nt, Homo sapiens
cagaguuugccuuc

SEQ ID NO: 1494863 - RNA, 15 nt, Homo sapiens
cagauaaacaacaaa

SEQ ID NO: 1494864 - RNA, 18 nt, Homo sapiens
cagauaaacaacaaauaa

SEQ ID NO: 1494865 - RNA, 23 nt, Homo sapiens
cagauaaauagaacuaucugcau

SEQ ID NO: 1494866 - RNA, 11 nt, Homo sapiens
cagauaacaua

SEQ ID NO: 1494867 - RNA, 14 nt, Homo sapiens
cagauaauuggcaa

SEQ ID NO: 1494868 - RNA, 17 nt, Homo sapiens
cagauagauauaugcuc

SEQ ID NO: 1494869 - RNA, 23 nt, Homo sapiens
cagauaucagaaucauugaagua

SEQ ID NO: 1494870 - RNA, 13 nt, Homo sapiens
cagauauuucaca

SEQ ID NO: 1494871 - RNA, 19 nt, Homo sapiens
cagaucaacagcaaccucu

SEQ ID NO: 1494872 - RNA, 16 nt, Homo sapiens
cagaucauauuucaca

SEQ ID NO: 1494873 - RNA, 17 nt, Homo sapiens
cagaucauauuucacaa

SEQ ID NO: 1494874 - RNA, 12 nt, Homo sapiens
cagauccaggga

SEQ ID NO: 1494875 - RNA, 18 nt, Homo sapiens
cagaucccauccaucagc

SEQ ID NO: 1494876 - RNA, 16 nt, Homo sapiens
cagauccccacugucc

SEQ ID NO: 1494877 - RNA, 19 nt, Homo sapiens
cagauccucacaaccaccu

SEQ ID NO: 1494878 - RNA, 17 nt, Homo sapiens
cagaucgcaccacugca

SEQ ID NO: 1494879 - RNA, 20 nt, Homo sapiens
cagaucgcaccacugcacuc

SEQ ID NO: 1494880 - RNA, 15 nt, Homo sapiens
cagaucucccacugc

SEQ ID NO: 1494881 - RNA, 16 nt, Homo sapiens
cagaucugugccccau

SEQ ID NO: 1494882 - RNA, 21 nt, Homo sapiens
cagaucuuucuccuugaauau

SEQ ID NO: 1494883 - RNA, 12 nt, Homo sapiens
cagaugaucucu

SEQ ID NO: 1494884 - RNA, 15 nt, Homo sapiens
cagaugauuguucaa

SEQ ID NO: 1494885 - RNA, 12 nt, Homo sapiens
cagaugcaauac

SEQ ID NO: 1494886 - RNA, 12 nt, Homo sapiens
cagaugcaauug

SEQ ID NO: 1494887 - RNA, 20 nt, Homo sapiens
cagauggaaugcuguguuaa

SEQ ID NO: 1494888 - RNA, 15 nt, Homo sapiens
cagauggggcacuga

SEQ ID NO: 1494889 - RNA, 16 nt, Homo sapiens
cagaugugaaaacauc

SEQ ID NO: 1494890 - RNA, 22 nt, Homo sapiens
cagaugugagccaccgugccug

SEQ ID NO: 1494891 - RNA, 15 nt, Homo sapiens
cagauguuugccuca

SEQ ID NO: 1494892 - RNA, 20 nt, Homo sapiens
cagauuaguucuuuuugcca

SEQ ID NO: 1494893 - RNA, 20 nt, Homo sapiens
cagauucuaggaccuguguc

SEQ ID NO: 1494894 - RNA, 18 nt, Homo sapiens
cagauucuucucucucaa

SEQ ID NO: 1494895 - RNA, 21 nt, Homo sapiens
uucacuagaaaagcugaucau

SEQ ID NO: 1494896 - RNA, 18 nt, Homo sapiens
uucacuauaaaugguguu

SEQ ID NO: 1494897 - RNA, 22 nt, Homo sapiens
uucacugagcuccccagaucuc

SEQ ID NO: 1494898 - RNA, 14 nt, Homo sapiens
uucacuguuucacu

SEQ ID NO: 1494899 - RNA, 18 nt, Homo sapiens
uucacuugaugauacaau

SEQ ID NO: 1494900 - RNA, 12 nt, Homo sapiens
uucacuuuacaa

SEQ ID NO: 1494901 - RNA, 21 nt, Homo sapiens
uucacuuuuuacagugcuauu

SEQ ID NO: 1494902 - RNA, 23 nt, Homo sapiens
uucagacucccauuccugaagaa

SEQ ID NO: 1494903 - RNA, 23 nt, Homo sapiens
uucagagagcagcuuuaaacuca

SEQ ID NO: 1494904 - RNA, 17 nt, Homo sapiens
uucagaguccuugcaaa

SEQ ID NO: 1494905 - RNA, 18 nt, Homo sapiens
uucagaguccuugcaaaa

SEQ ID NO: 1494906 - RNA, 19 nt, Homo sapiens
uucagaugcuucugggaga

SEQ ID NO: 1494907 - RNA, 18 nt, Homo sapiens
uucagauggcaauuucac

SEQ ID NO: 1494908 - RNA, 21 nt, Homo sapiens
uucagauggcaauuucacuga

SEQ ID NO: 1494909 - RNA, 18 nt, Homo sapiens
uucagcaacugucuuauu

SEQ ID NO: 1494910 - RNA, 22 nt, Homo sapiens
uucagcagagaagguaaggugu

SEQ ID NO: 1494911 - RNA, 18 nt, Homo sapiens
uucagcagagaaguuuuc

SEQ ID NO: 1494912 - RNA, 14 nt, Homo sapiens
uucagcaguaccua

SEQ ID NO: 1494913 - RNA, 17 nt, Homo sapiens
uucagcaucacuaaacc

SEQ ID NO: 1494914 - RNA, 13 nt, Homo sapiens
uucagccagguga

SEQ ID NO: 1494915 - RNA, 21 nt, Homo sapiens
uucagccaggugaacuggaau

SEQ ID NO: 1494916 - RNA, 23 nt, Homo sapiens
uucagcucccccaggcuguucuc

SEQ ID NO: 1494917 - RNA, 13 nt, Homo sapiens
uucagcucuacag

SEQ ID NO: 1494918 - RNA, 14 nt, Homo sapiens
uucaggaggcugga

SEQ ID NO: 1494919 - RNA, 23 nt, Homo sapiens
uucaggccauucuccugccucag

SEQ ID NO: 1494920 - RNA, 16 nt, Homo sapiens
uucagggaccguccag

SEQ ID NO: 1494921 - RNA, 18 nt, Homo sapiens
uucagggcagggcucuga

SEQ ID NO: 1494922 - RNA, 13 nt, Homo sapiens
uucaguaauaacu

SEQ ID NO: 1494923 - RNA, 14 nt, Homo sapiens
uucaguacuuguga

SEQ ID NO: 1494924 - RNA, 20 nt, Homo sapiens
uucaguauuagaugcacuua

SEQ ID NO: 1494925 - RNA, 17 nt, Homo sapiens
uucaguccacaguacau

SEQ ID NO: 1494926 - RNA, 23 nt, Homo sapiens
uucaguucccaccaucugauuaa

SEQ ID NO: 1494927 - RNA, 17 nt, Homo sapiens
uucauauaccagcaaua

SEQ ID NO: 1494928 - RNA, 16 nt, Homo sapiens
uucauauuguugcauu

SEQ ID NO: 1494929 - RNA, 22 nt, Homo sapiens
uucaucaauaucccucuuguaa

SEQ ID NO: 1494930 - RNA, 20 nt, Homo sapiens
uucaucaggaaggaaaugac

SEQ ID NO: 1494931 - RNA, 21 nt, Homo sapiens
uucauccaggcccaacuguga

SEQ ID NO: 1494932 - RNA, 18 nt, Homo sapiens
uucauccugacucugccc

SEQ ID NO: 1494933 - RNA, 18 nt, Homo sapiens
uucauccuuccauccauc

SEQ ID NO: 1494934 - RNA, 20 nt, Homo sapiens
uucaucugaaacccacagau

SEQ ID NO: 1494935 - RNA, 15 nt, Homo sapiens
uucaugaaacugucc

SEQ ID NO: 1494936 - RNA, 17 nt, Homo sapiens
uucaugaaacuguccac

SEQ ID NO: 1494937 - RNA, 16 nt, Homo sapiens
uucaugacaagcauuu

SEQ ID NO: 1494938 - RNA, 21 nt, Homo sapiens
uucaugcagccuaaaguacag

SEQ ID NO: 1494939 - RNA, 22 nt, Homo sapiens
uucaugcagccuaaaguacagc

SEQ ID NO: 1494940 - RNA, 12 nt, Homo sapiens
uucaugccagcu

SEQ ID NO: 1494941 - RNA, 19 nt, Homo sapiens
uucauggcugaagucaccu

SEQ ID NO: 1494942 - RNA, 19 nt, Homo sapiens
uucaugggacuaaaugaac

SEQ ID NO: 1494943 - RNA, 16 nt, Homo sapiens
uucauggucugcugag

SEQ ID NO: 1494944 - RNA, 12 nt, Homo sapiens
uucauguaaaac

SEQ ID NO: 1494945 - RNA, 18 nt, Homo sapiens
uucaugugcugccugcaa

SEQ ID NO: 1494946 - RNA, 15 nt, Homo sapiens
uucauguuugcuuca

SEQ ID NO: 1494947 - RNA, 15 nt, Homo sapiens
uucauucacauucag

SEQ ID NO: 1494948 - RNA, 18 nt, Homo sapiens
uucauucaguacaagaga

SEQ ID NO: 1494949 - RNA, 21 nt, Homo sapiens
uucauucccaagguuacugga

SEQ ID NO: 1494950 - RNA, 21 nt, Homo sapiens
uucauuccuaacacagcaugu

SEQ ID NO: 1494951 - RNA, 16 nt, Homo sapiens
uucauugcacuuugau

SEQ ID NO: 1494952 - RNA, 18 nt, Homo sapiens
uucauuuagucaugugac

SEQ ID NO: 1494953 - RNA, 15 nt, Homo sapiens
uuccaaaacuuuaau

SEQ ID NO: 1494954 - RNA, 23 nt, Homo sapiens
uuccaaaacuuuaaugaacuaac

SEQ ID NO: 1494955 - RNA, 16 nt, Homo sapiens
uuccaaacacauacag

SEQ ID NO: 1494956 - RNA, 19 nt, Homo sapiens
uuccaaacacauacaggaa

SEQ ID NO: 1494957 - RNA, 21 nt, Homo sapiens
uuccaaaccugacagauguca

SEQ ID NO: 1494958 - RNA, 16 nt, Homo sapiens
uuccaaagccagugaa

SEQ ID NO: 1494959 - RNA, 23 nt, Homo sapiens
uuccaacaccacagacacacaca

SEQ ID NO: 1494960 - RNA, 23 nt, Homo sapiens
uuccaacucgaaucugugugaaa

SEQ ID NO: 1494961 - RNA, 14 nt, Homo sapiens
uuccaauuuacaua

SEQ ID NO: 1494962 - RNA, 19 nt, Homo sapiens
uuccaccaggccgugccuu

SEQ ID NO: 1494963 - RNA, 13 nt, Homo sapiens
uuccacuucuucc

SEQ ID NO: 1494964 - RNA, 17 nt, Homo sapiens
uuccacuuugcauauga

SEQ ID NO: 1494965 - RNA, 14 nt, Homo sapiens
uuccagaagaucug

SEQ ID NO: 1494966 - RNA, 17 nt, Homo sapiens
uuccagaaggauccaag

SEQ ID NO: 1494967 - RNA, 11 nt, Homo sapiens
uuccagccaca

SEQ ID NO: 1494968 - RNA, 17 nt, Homo sapiens
uuccagcugcugucuuc

SEQ ID NO: 1494969 - RNA, 20 nt, Homo sapiens
uuccaggauaaggagacuga

SEQ ID NO: 1494970 - RNA, 19 nt, Homo sapiens
uuccaggggucguuugcuu

SEQ ID NO: 1494971 - RNA, 14 nt, Homo sapiens
uuccaggguugcuu

SEQ ID NO: 1494972 - RNA, 18 nt, Homo sapiens
uuccagguguuacuguaa

SEQ ID NO: 1494973 - RNA, 23 nt, Homo sapiens
uuccaguggcuuggguucacagu

SEQ ID NO: 1494974 - RNA, 14 nt, Homo sapiens
uuccagugucuguc

SEQ ID NO: 1494975 - RNA, 20 nt, Homo sapiens
uuccagugucugucauuuca

SEQ ID NO: 1494976 - RNA, 16 nt, Homo sapiens
uuccaguuccacgaaa

SEQ ID NO: 1494977 - RNA, 19 nt, Homo sapiens
uuccauccauuaccuccau

SEQ ID NO: 1494978 - RNA, 18 nt, Homo sapiens
uuccauuuccaagcacuu

SEQ ID NO: 1494979 - RNA, 22 nt, Homo sapiens
uucccacuggaggucacauuca

SEQ ID NO: 1494980 - RNA, 18 nt, Homo sapiens
uucccaucuuuacuccca

SEQ ID NO: 1494981 - RNA, 14 nt, Homo sapiens
uuccccaaccacag

SEQ ID NO: 1494982 - RNA, 23 nt, Homo sapiens
uuccccagcgucccagucucugg

SEQ ID NO: 1494983 - RNA, 21 nt, Homo sapiens
uuccccaggugugugcuuuag

SEQ ID NO: 1494984 - RNA, 20 nt, Homo sapiens
uucccccgagcucuuggccu

SEQ ID NO: 1494985 - RNA, 19 nt, Homo sapiens
uucccggcgucccuaccuc

SEQ ID NO: 1494986 - RNA, 20 nt, Homo sapiens
uucccuauggguucugugac

SEQ ID NO: 1494987 - RNA, 12 nt, Homo sapiens
uucccucacccc

SEQ ID NO: 1494988 - RNA, 19 nt, Homo sapiens
uucccucucaugacuugca

SEQ ID NO: 1494989 - RNA, 19 nt, Homo sapiens
uucccucuugcucaguggg

SEQ ID NO: 1494990 - RNA, 19 nt, Homo sapiens
uucccugaaaccguuaaaa

SEQ ID NO: 1494991 - RNA, 18 nt, Homo sapiens
uucccugauugaccugcu

SEQ ID NO: 1494992 - RNA, 18 nt, Homo sapiens
uucccuggugccaccagc

SEQ ID NO: 1494993 - RNA, 20 nt, Homo sapiens
uucccuguaugauuccuuga

SEQ ID NO: 1494994 - RNA, 20 nt, Homo sapiens
uucccuuuuaaucaacugua

SEQ ID NO: 1494995 - RNA, 14 nt, Homo sapiens
uuccuaaacccaau

SEQ ID NO: 1494996 - RNA, 22 nt, Homo sapiens
uuauaacagaauuaaaguagau

SEQ ID NO: 1494997 - RNA, 14 nt, Homo sapiens
uuauaagcauguau

SEQ ID NO: 1494998 - RNA, 14 nt, Homo sapiens
uuauaauauacuau

SEQ ID NO: 1494999 - RNA, 11 nt, Homo sapiens
uuauacuccuc

SEQ ID NO: 1495000 - RNA, 19 nt, Homo sapiens
uuauacuguggcuaugcaa

SEQ ID NO: 1495001 - RNA, 15 nt, Homo sapiens
uuauagaaguagcaa

SEQ ID NO: 1495002 - RNA, 16 nt, Homo sapiens
uuauagaaguagcaaa

SEQ ID NO: 1495003 - RNA, 21 nt, Homo sapiens
uuauagaauauuuauuaccuc

SEQ ID NO: 1495004 - RNA, 23 nt, Homo sapiens
uuauagaguguacuuaacuauuc

SEQ ID NO: 1495005 - RNA, 19 nt, Homo sapiens
uuauagauguacauaccuc

SEQ ID NO: 1495006 - RNA, 18 nt, Homo sapiens
uuauagcaacaacaauug

SEQ ID NO: 1495007 - RNA, 22 nt, Homo sapiens
uuauagcaacaacaauugguaa

SEQ ID NO: 1495008 - RNA, 23 nt, Homo sapiens
uuauaggccugucccuugccucu

SEQ ID NO: 1495009 - RNA, 13 nt, Homo sapiens
uuauaguacauga

SEQ ID NO: 1495010 - RNA, 13 nt, Homo sapiens
uuauauauaaaga

SEQ ID NO: 1495011 - RNA, 14 nt, Homo sapiens
uuauaucagccuga

SEQ ID NO: 1495012 - RNA, 15 nt, Homo sapiens
uuauaucauauguau

SEQ ID NO: 1495013 - RNA, 13 nt, Homo sapiens
uuauaugcuauuu

SEQ ID NO: 1495014 - RNA, 13 nt, Homo sapiens
uuauauggaugau

SEQ ID NO: 1495015 - RNA, 12 nt, Homo sapiens
uuauauguugcu

SEQ ID NO: 1495016 - RNA, 16 nt, Homo sapiens
uuauauguugcuauaa

SEQ ID NO: 1495017 - RNA, 14 nt, Homo sapiens
uuauauuucacuau

SEQ ID NO: 1495018 - RNA, 19 nt, Homo sapiens
uuaucacacuucugugaga

SEQ ID NO: 1495019 - RNA, 23 nt, Homo sapiens
uuaucacuucauucacauucaga

SEQ ID NO: 1495020 - RNA, 22 nt, Homo sapiens
uuauccaagaccugaaagaugg

SEQ ID NO: 1495021 - RNA, 20 nt, Homo sapiens
uuauccacaggaaaguguua

SEQ ID NO: 1495022 - RNA, 20 nt, Homo sapiens
uuaucccccaaaaugcauuu

SEQ ID NO: 1495023 - RNA, 13 nt, Homo sapiens
uuaucccucucuu

SEQ ID NO: 1495024 - RNA, 16 nt, Homo sapiens
uuauccuagucauucu

SEQ ID NO: 1495025 - RNA, 23 nt, Homo sapiens
uuaucgggcuccagccaucucau

SEQ ID NO: 1495026 - RNA, 21 nt, Homo sapiens
uuaucuauuccugaaauuucu

SEQ ID NO: 1495027 - RNA, 15 nt, Homo sapiens
uuaucucugaggcua

SEQ ID NO: 1495028 - RNA, 18 nt, Homo sapiens
uuaucugucacaccugug

SEQ ID NO: 1495029 - RNA, 15 nt, Homo sapiens
uuaucuugucucugg

SEQ ID NO: 1495030 - RNA, 23 nt, Homo sapiens
uuaugagaggcaaugauuguuaa

SEQ ID NO: 1495031 - RNA, 22 nt, Homo sapiens
uuaugauuacuaucauggcaua

SEQ ID NO: 1495032 - RNA, 17 nt, Homo sapiens
uuaugccuucacuuuac

SEQ ID NO: 1495033 - RNA, 23 nt, Homo sapiens
uuauggagcucacacuccagugg

SEQ ID NO: 1495034 - RNA, 18 nt, Homo sapiens
uuauguaguaauugacau

SEQ ID NO: 1495035 - RNA, 21 nt, Homo sapiens
uuauguaugaaaaguaacuga

SEQ ID NO: 1495036 - RNA, 13 nt, Homo sapiens
uuauguucaguca

SEQ ID NO: 1495037 - RNA, 13 nt, Homo sapiens
uuauuaaagaaau

SEQ ID NO: 1495038 - RNA, 14 nt, Homo sapiens
uuauuaaauacaaa

SEQ ID NO: 1495039 - RNA, 13 nt, Homo sapiens
uuauuaacuaaga

SEQ ID NO: 1495040 - RNA, 14 nt, Homo sapiens
uuauuaaugccauu

SEQ ID NO: 1495041 - RNA, 14 nt, Homo sapiens
uuauuaauuucagu

SEQ ID NO: 1495042 - RNA, 19 nt, Homo sapiens
uuauuacauggggucuaga

SEQ ID NO: 1495043 - RNA, 12 nt, Homo sapiens
uuauuauauucc

SEQ ID NO: 1495044 - RNA, 16 nt, Homo sapiens
uuauuauuucuaaucc

SEQ ID NO: 1495045 - RNA, 13 nt, Homo sapiens
uuauuauuucuau

SEQ ID NO: 1495046 - RNA, 22 nt, Homo sapiens
uuauucacauauaucaaaguga

SEQ ID NO: 1495047 - RNA, 13 nt, Homo sapiens
uuauucagaauuu

SEQ ID NO: 1495048 - RNA, 18 nt, Homo sapiens
uuauucauccagcagugu

SEQ ID NO: 1495049 - RNA, 17 nt, Homo sapiens
uuauucauuagcuguga

SEQ ID NO: 1495050 - RNA, 15 nt, Homo sapiens
uuauuccuugaucau

SEQ ID NO: 1495051 - RNA, 14 nt, Homo sapiens
uuauucugugcgcu

SEQ ID NO: 1495052 - RNA, 14 nt, Homo sapiens
uuauugacacugaa

SEQ ID NO: 1495053 - RNA, 12 nt, Homo sapiens
uuauuguuccaa

SEQ ID NO: 1495054 - RNA, 19 nt, Homo sapiens
uuauuguuguugccaaaga

SEQ ID NO: 1495055 - RNA, 23 nt, Homo sapiens
uuauuguuuauuuaucagugaca

SEQ ID NO: 1495056 - RNA, 15 nt, Homo sapiens
uuauuuaauaacauu

SEQ ID NO: 1495057 - RNA, 21 nt, Homo sapiens
uuauuuaggaaguugacuuau

SEQ ID NO: 1495058 - RNA, 12 nt, Homo sapiens
uuauuucacuuu

SEQ ID NO: 1495059 - RNA, 20 nt, Homo sapiens
uuauuugcacacugcacugu

SEQ ID NO: 1495060 - RNA, 17 nt, Homo sapiens
uuauuugcuaagcauau

SEQ ID NO: 1495061 - RNA, 22 nt, Homo sapiens
uuauuugggagggaaaagggaa

SEQ ID NO: 1495062 - RNA, 15 nt, Homo sapiens
uuauuuugcauucca

SEQ ID NO: 1495063 - RNA, 20 nt, Homo sapiens
uucaaaaaagucaacaaacu

SEQ ID NO: 1495064 - RNA, 17 nt, Homo sapiens
uucaaaaaccacguucu

SEQ ID NO: 1495065 - RNA, 15 nt, Homo sapiens
uucaaagagucauau

SEQ ID NO: 1495066 - RNA, 18 nt, Homo sapiens
uucaaaugaaaauuccau

SEQ ID NO: 1495067 - RNA, 18 nt, Homo sapiens
uucaacaguuuuugcuaa

SEQ ID NO: 1495068 - RNA, 17 nt, Homo sapiens
uucaacaugcuccaaau

SEQ ID NO: 1495069 - RNA, 11 nt, Homo sapiens
uucaaccacug

SEQ ID NO: 1495070 - RNA, 20 nt, Homo sapiens
uucaaccugguggcaccaga

SEQ ID NO: 1495071 - RNA, 16 nt, Homo sapiens
uucaacugaaguucua

SEQ ID NO: 1495072 - RNA, 21 nt, Homo sapiens
uucaagaccauccuggacuga

SEQ ID NO: 1495073 - RNA, 21 nt, Homo sapiens
uucaaggcauuucuaucacau

SEQ ID NO: 1495074 - RNA, 16 nt, Homo sapiens
uucaaguuuaguuuga

SEQ ID NO: 1495075 - RNA, 19 nt, Homo sapiens
uucaauagcauaucacaga

SEQ ID NO: 1495076 - RNA, 15 nt, Homo sapiens
uucaaugaaccacaa

SEQ ID NO: 1495077 - RNA, 21 nt, Homo sapiens
uucaaugcuagaacaacgccu

SEQ ID NO: 1495078 - RNA, 16 nt, Homo sapiens
uucacaaaaugucuca

SEQ ID NO: 1495079 - RNA, 16 nt, Homo sapiens
uucacagaauagcaca

SEQ ID NO: 1495080 - RNA, 19 nt, Homo sapiens
uucacaguaauaugguucc

SEQ ID NO: 1495081 - RNA, 11 nt, Homo sapiens
uucacagugca

SEQ ID NO: 1495082 - RNA, 19 nt, Homo sapiens
uucacauucagaaguaauu

SEQ ID NO: 1495083 - RNA, 13 nt, Homo sapiens
uucaccaccaaau

SEQ ID NO: 1495084 - RNA, 11 nt, Homo sapiens
uucaccagagc

SEQ ID NO: 1495085 - RNA, 20 nt, Homo sapiens
uucacccugcauuacaugug

SEQ ID NO: 1495086 - RNA, 16 nt, Homo sapiens
uucaccuaacuagaga

SEQ ID NO: 1495087 - RNA, 18 nt, Homo sapiens
uucaccuacauuaucuca

SEQ ID NO: 1495088 - RNA, 14 nt, Homo sapiens
uucacgcaacuuga

SEQ ID NO: 1495089 - RNA, 13 nt, Homo sapiens
uucacgcaugugu

SEQ ID NO: 1495090 - RNA, 14 nt, Homo sapiens
uucacuacuuuaau

SEQ ID NO: 1495091 - RNA, 16 nt, Homo sapiens
ucuagacuugugcuga

SEQ ID NO: 1495092 - RNA, 16 nt, Homo sapiens
ucuagagcagggauua

SEQ ID NO: 1495093 - RNA, 21 nt, Homo sapiens
ucuagcacuuccuugccaguc

SEQ ID NO: 1495094 - RNA, 20 nt, Homo sapiens
ucuagccuauuuaccugcag

SEQ ID NO: 1495095 - RNA, 18 nt, Homo sapiens
ucuagcuaguaauauauu

SEQ ID NO: 1495096 - RNA, 15 nt, Homo sapiens
ucuagcuuugucaua

SEQ ID NO: 1495097 - RNA, 13 nt, Homo sapiens
ucuaggguccagu

SEQ ID NO: 1495098 - RNA, 16 nt, Homo sapiens
ucuagguucugagcuc

SEQ ID NO: 1495099 - RNA, 21 nt, Homo sapiens
ucuaguaagaugcacugaaaa

SEQ ID NO: 1495100 - RNA, 20 nt, Homo sapiens
ucuaguuucuugugggcuaa

SEQ ID NO: 1495101 - RNA, 20 nt, Homo sapiens
ucuauacaaauuuucagaag

SEQ ID NO: 1495102 - RNA, 17 nt, Homo sapiens
ucuauauggaauugcuu

SEQ ID NO: 1495103 - RNA, 15 nt, Homo sapiens
ucuaucaacuuuaau

SEQ ID NO: 1495104 - RNA, 18 nt, Homo sapiens
ucuaucaggggugcauuc

SEQ ID NO: 1495105 - RNA, 19 nt, Homo sapiens
ucuaucaggggugcauucu

SEQ ID NO: 1495106 - RNA, 14 nt, Homo sapiens
ucuaucauggaaua

SEQ ID NO: 1495107 - RNA, 19 nt, Homo sapiens
ucuaugaaacugcacauug

SEQ ID NO: 1495108 - RNA, 21 nt, Homo sapiens
ucuaugaaacugcacauuggu

SEQ ID NO: 1495109 - RNA, 21 nt, Homo sapiens
ucuaugccagcucagucccau

SEQ ID NO: 1495110 - RNA, 18 nt, Homo sapiens
ucuaugguugacauugua

SEQ ID NO: 1495111 - RNA, 11 nt, Homo sapiens
ucuauguuaau

SEQ ID NO: 1495112 - RNA, 22 nt, Homo sapiens
ucuauguuugcacuugugcuuu

SEQ ID NO: 1495113 - RNA, 23 nt, Homo sapiens
ucuauuaaauaguuauauaauuc

SEQ ID NO: 1495114 - RNA, 14 nt, Homo sapiens
ucuauuaaucaccu

SEQ ID NO: 1495115 - RNA, 16 nt, Homo sapiens
ucuauucaagcacuua

SEQ ID NO: 1495116 - RNA, 21 nt, Homo sapiens
ucuauugagugaacagaauug

SEQ ID NO: 1495117 - RNA, 16 nt, Homo sapiens
ucuauuuaaauaaagu

SEQ ID NO: 1495118 - RNA, 15 nt, Homo sapiens
ucuauuuugugauga

SEQ ID NO: 1495119 - RNA, 22 nt, Homo sapiens
ucucaaaaaaaaaaaaaugcac

SEQ ID NO: 1495120 - RNA, 16 nt, Homo sapiens
ucucaaagaaggcauu

SEQ ID NO: 1495121 - RNA, 19 nt, Homo sapiens
ucucaagcuaguguuucua

SEQ ID NO: 1495122 - RNA, 17 nt, Homo sapiens
ucucaaugaagccagcu

SEQ ID NO: 1495123 - RNA, 14 nt, Homo sapiens
ucucaauuugcagu

SEQ ID NO: 1495124 - RNA, 18 nt, Homo sapiens
ucucaccuggacuccagu

SEQ ID NO: 1495125 - RNA, 14 nt, Homo sapiens
ucucagaagguauu

SEQ ID NO: 1495126 - RNA, 13 nt, Homo sapiens
ucucagagcaugu

SEQ ID NO: 1495127 - RNA, 13 nt, Homo sapiens
ucucagcacuuug

SEQ ID NO: 1495128 - RNA, 16 nt, Homo sapiens
ucucagcaggcaaaga

SEQ ID NO: 1495129 - RNA, 21 nt, Homo sapiens
ucucagccuaccaugagaaua

SEQ ID NO: 1495130 - RNA, 18 nt, Homo sapiens
ucucagcuaccuaagaaa

SEQ ID NO: 1495131 - RNA, 21 nt, Homo sapiens
ucucaggggccagaggaacug

SEQ ID NO: 1495132 - RNA, 15 nt, Homo sapiens
ucucagguguugcca

SEQ ID NO: 1495133 - RNA, 18 nt, Homo sapiens
ucucagguguugccaaau

SEQ ID NO: 1495134 - RNA, 20 nt, Homo sapiens
ucucagucaguaauugccaa

SEQ ID NO: 1495135 - RNA, 21 nt, Homo sapiens
ucucaguggcuucaucuguca

SEQ ID NO: 1495136 - RNA, 14 nt, Homo sapiens
ucucauaauuccua

SEQ ID NO: 1495137 - RNA, 21 nt, Homo sapiens
ucucauaccuuccccacaucu

SEQ ID NO: 1495138 - RNA, 23 nt, Homo sapiens
ucucaucaguguccucuugcuca

SEQ ID NO: 1495139 - RNA, 19 nt, Homo sapiens
ucucaucccacgcacucca

SEQ ID NO: 1495140 - RNA, 17 nt, Homo sapiens
ucucauguaacacauaa

SEQ ID NO: 1495141 - RNA, 17 nt, Homo sapiens
ucucauguaucaucugg

SEQ ID NO: 1495142 - RNA, 13 nt, Homo sapiens
ucucauguaucuu

SEQ ID NO: 1495143 - RNA, 16 nt, Homo sapiens
ucucauuuagaacuug

SEQ ID NO: 1495144 - RNA, 18 nt, Homo sapiens
ucuccaaggcagggacca

SEQ ID NO: 1495145 - RNA, 14 nt, Homo sapiens
ucuccaaguacuuu

SEQ ID NO: 1495146 - RNA, 16 nt, Homo sapiens
ucuccaaguacuuuug

SEQ ID NO: 1495147 - RNA, 13 nt, Homo sapiens
ucuccaauacuca

SEQ ID NO: 1495148 - RNA, 22 nt, Homo sapiens
ucuccaccgucacccaacauca

SEQ ID NO: 1495149 - RNA, 20 nt, Homo sapiens
ucuccacgguagcacuugac

SEQ ID NO: 1495150 - RNA, 15 nt, Homo sapiens
ucuccaggugcucau

SEQ ID NO: 1495151 - RNA, 22 nt, Homo sapiens
ucuccaucucuaggaugucguc

SEQ ID NO: 1495152 - RNA, 18 nt, Homo sapiens
ucucccaaaaaacuacuu

SEQ ID NO: 1495153 - RNA, 14 nt, Homo sapiens
ucucccacuccagc

SEQ ID NO: 1495154 - RNA, 15 nt, Homo sapiens
ucucccaggucccag

SEQ ID NO: 1495155 - RNA, 14 nt, Homo sapiens
ucucccauccuuga

SEQ ID NO: 1495156 - RNA, 14 nt, Homo sapiens
ucuccccuccagcc

SEQ ID NO: 1495157 - RNA, 19 nt, Homo sapiens
ucucccuccccugccauuu

SEQ ID NO: 1495158 - RNA, 22 nt, Homo sapiens
ucucccuguacaguguuaccau

SEQ ID NO: 1495159 - RNA, 21 nt, Homo sapiens
ucucccuuugaagaaacuaua

SEQ ID NO: 1495160 - RNA, 22 nt, Homo sapiens
ucuccuaaaacuuuaaaacuug

SEQ ID NO: 1495161 - RNA, 11 nt, Homo sapiens
ucuccuacuuu

SEQ ID NO: 1495162 - RNA, 12 nt, Homo sapiens
ucuccucagggu

SEQ ID NO: 1495163 - RNA, 23 nt, Homo sapiens
ucuccuccagcccagacccagug

SEQ ID NO: 1495164 - RNA, 14 nt, Homo sapiens
ucuccuccauuccc

SEQ ID NO: 1495165 - RNA, 18 nt, Homo sapiens
ucuccuguauaaucucuc

SEQ ID NO: 1495166 - RNA, 16 nt, Homo sapiens
ucuccuuaaaaacugg

SEQ ID NO: 1495167 - RNA, 13 nt, Homo sapiens
ucuccuuacaguc

SEQ ID NO: 1495168 - RNA, 17 nt, Homo sapiens
ucuccuuagaaaagcca

SEQ ID NO: 1495169 - RNA, 21 nt, Homo sapiens
ucuccuuucucuuaugcuuaa

SEQ ID NO: 1495170 - RNA, 14 nt, Homo sapiens
uguucaaugcuaga

SEQ ID NO: 1495171 - RNA, 16 nt, Homo sapiens
uguucacugaagguga

SEQ ID NO: 1495172 - RNA, 14 nt, Homo sapiens
uguucauaauauca

SEQ ID NO: 1495173 - RNA, 20 nt, Homo sapiens
uguucauaauaucaugugca

SEQ ID NO: 1495174 - RNA, 24 nt, Homo sapiens
uguucauggguuuaccacuaacuc

SEQ ID NO: 1495175 - RNA, 23 nt, Homo sapiens
uguuccaauuugacaaaacccac

SEQ ID NO: 1495176 - RNA, 19 nt, Homo sapiens
uguucucuauuagacuuua

SEQ ID NO: 1495177 - RNA, 18 nt, Homo sapiens
uuaauccuuaacacauuc

SEQ ID NO: 1495178 - RNA, 18 nt, Homo sapiens
uuaaucuguuauguacua

SEQ ID NO: 1495179 - RNA, 20 nt, Homo sapiens
uuaaugaacaugugaaguua

SEQ ID NO: 1495180 - RNA, 14 nt, Homo sapiens
uuaaugauacaugu

SEQ ID NO: 1495181 - RNA, 13 nt, Homo sapiens
uuaaugcuucauu

SEQ ID NO: 1495182 - RNA, 15 nt, Homo sapiens
uuaauuaaaucucaa

SEQ ID NO: 1495183 - RNA, 12 nt, Homo sapiens
uuaauuacauaa

SEQ ID NO: 1495184 - RNA, 18 nt, Homo sapiens
uuaauuagggguugcuaa

SEQ ID NO: 1495185 - RNA, 18 nt, Homo sapiens
uuaauuguuuugcacuuu

SEQ ID NO: 1495186 - RNA, 15 nt, Homo sapiens
uuaauuugaaaccag

SEQ ID NO: 1495187 - RNA, 17 nt, Homo sapiens
uuaauuuuccaaugcac

SEQ ID NO: 1495188 - RNA, 22 nt, Homo sapiens
uuaauuuuuaaggauguugcca

SEQ ID NO: 1495189 - RNA, 18 nt, Homo sapiens
uuaauuuuuauuucuucc

SEQ ID NO: 1495190 - RNA, 12 nt, Homo sapiens
uuacaaacugca

SEQ ID NO: 1495191 - RNA, 20 nt, Homo sapiens
uuacaaaguaauuucuuuga

SEQ ID NO: 1495192 - RNA, 20 nt, Homo sapiens
uuacaacccagggugugaac

SEQ ID NO: 1495193 - RNA, 23 nt, Homo sapiens
uuacaauauuaugaaauuucacu

SEQ ID NO: 1495194 - RNA, 13 nt, Homo sapiens
uuacaauugugag

SEQ ID NO: 1495195 - RNA, 11 nt, Homo sapiens
uuacacaggag

SEQ ID NO: 1495196 - RNA, 13 nt, Homo sapiens
uuacacaucucag

SEQ ID NO: 1495197 - RNA, 12 nt, Homo sapiens
uuacagcaagaa

SEQ ID NO: 1495198 - RNA, 20 nt, Homo sapiens
uuacaggauaucacauugga

SEQ ID NO: 1495199 - RNA, 18 nt, Homo sapiens
uuacauaacugccuugaa

SEQ ID NO: 1495200 - RNA, 14 nt, Homo sapiens
uuacaugcauuuga

SEQ ID NO: 1495201 - RNA, 14 nt, Homo sapiens
uuacauguguaaag

SEQ ID NO: 1495202 - RNA, 21 nt, Homo sapiens
uuacauguguuuauucaucca

SEQ ID NO: 1495203 - RNA, 22 nt, Homo sapiens
uuacauguguuuauucauccag

SEQ ID NO: 1495204 - RNA, 13 nt, Homo sapiens
uuaccaaaggaua

SEQ ID NO: 1495205 - RNA, 15 nt, Homo sapiens
uuaccacuaacuccu

SEQ ID NO: 1495206 - RNA, 22 nt, Homo sapiens
uuaccagaugcugacuggcacu

SEQ ID NO: 1495207 - RNA, 22 nt, Homo sapiens
uuaccauuuguaauaaaguaua

SEQ ID NO: 1495208 - RNA, 22 nt, Homo sapiens
uuacccagagaauauauacauu

SEQ ID NO: 1495209 - RNA, 19 nt, Homo sapiens
uuacccaggcuggagugca

SEQ ID NO: 1495210 - RNA, 20 nt, Homo sapiens
uuaccccucacaauccuugc

SEQ ID NO: 1495211 - RNA, 17 nt, Homo sapiens
uuaccgccugucucuuu

SEQ ID NO: 1495212 - RNA, 21 nt, Homo sapiens
uuaccuccauccauccuucca

SEQ ID NO: 1495213 - RNA, 14 nt, Homo sapiens
uuaccugaccucuu

SEQ ID NO: 1495214 - RNA, 21 nt, Homo sapiens
uuaccugauuugaugauacau

SEQ ID NO: 1495215 - RNA, 20 nt, Homo sapiens
uuaccuguuuucgcaccuac

SEQ ID NO: 1495216 - RNA, 14 nt, Homo sapiens
uuaccuuguauacu

SEQ ID NO: 1495217 - RNA, 20 nt, Homo sapiens
uuacuaaacauaugauuuca

SEQ ID NO: 1495218 - RNA, 16 nt, Homo sapiens
uuacuaucauggcaua

SEQ ID NO: 1495219 - RNA, 18 nt, Homo sapiens
uuacucaggguucaucug

SEQ ID NO: 1495220 - RNA, 12 nt, Homo sapiens
uuacuccagugg

SEQ ID NO: 1495221 - RNA, 18 nt, Homo sapiens
uuacucuuuccuauuuca

SEQ ID NO: 1495222 - RNA, 14 nt, Homo sapiens
uuacugaccagcaa

SEQ ID NO: 1495223 - RNA, 17 nt, Homo sapiens
uuacugaucuuacucac

SEQ ID NO: 1495224 - RNA, 16 nt, Homo sapiens
uuacugcuugaccaaa

SEQ ID NO: 1495225 - RNA, 21 nt, Homo sapiens
uuacuggaauucuucugcaac

SEQ ID NO: 1495226 - RNA, 19 nt, Homo sapiens
uuacuggauuugacuucag

SEQ ID NO: 1495227 - RNA, 17 nt, Homo sapiens
uuacugugaaacuggca

SEQ ID NO: 1495228 - RNA, 23 nt, Homo sapiens
uuacugugaaacuggcacugaau

SEQ ID NO: 1495229 - RNA, 13 nt, Homo sapiens
uuacuuaacucau

SEQ ID NO: 1495230 - RNA, 17 nt, Homo sapiens
uuacuuaccuaaacaga

SEQ ID NO: 1495231 - RNA, 22 nt, Homo sapiens
uuacuucaaugggcucuuccaa

SEQ ID NO: 1495232 - RNA, 19 nt, Homo sapiens
uuacuucauauuguugcau

SEQ ID NO: 1495233 - RNA, 19 nt, Homo sapiens
uuacuuccauuauacauca

SEQ ID NO: 1495234 - RNA, 20 nt, Homo sapiens
uuacuuccuaucaagccagu

SEQ ID NO: 1495235 - RNA, 24 nt, Homo sapiens
uuacuucucacuaauuuguaggaa

SEQ ID NO: 1495236 - RNA, 16 nt, Homo sapiens
uuagaaaaauuccuaa

SEQ ID NO: 1495237 - RNA, 12 nt, Homo sapiens
uuagaaacacca

SEQ ID NO: 1495238 - RNA, 23 nt, Homo sapiens
uuagaaaucaagcauaaaucacu

SEQ ID NO: 1495239 - RNA, 13 nt, Homo sapiens
uuagaaaugcaaa

SEQ ID NO: 1495240 - RNA, 19 nt, Homo sapiens
uuagaagauagaugcacuu

SEQ ID NO: 1495241 - RNA, 18 nt, Homo sapiens
uuagaauuuacagcaaga

SEQ ID NO: 1495242 - RNA, 16 nt, Homo sapiens
uuagagagggaccaug

SEQ ID NO: 1495243 - RNA, 22 nt, Homo sapiens
uuagaguugcucuacaaugaca

SEQ ID NO: 1495244 - RNA, 15 nt, Homo sapiens
uuagaucaaauacuu

SEQ ID NO: 1495245 - RNA, 22 nt, Homo sapiens
uuagauguuucaacugugcucu

SEQ ID NO: 1495246 - RNA, 14 nt, Homo sapiens
uuagcaagacagca

SEQ ID NO: 1495247 - RNA, 18 nt, Homo sapiens
uuagcacuauuuacauac

SEQ ID NO: 1495248 - RNA, 15 nt, Homo sapiens
uuagcagcagccuuu

SEQ ID NO: 1495249 - RNA, 20 nt, Homo sapiens
uuagcauauuuuaaugcagu

SEQ ID NO: 1495250 - RNA, 23 nt, Homo sapiens
uuagcauuccuauugacaacucu

SEQ ID NO: 1495251 - RNA, 22 nt, Homo sapiens
uuagcauuuuucaaaugaucuu

SEQ ID NO: 1495252 - RNA, 17 nt, Homo sapiens
uuagccagguaauguga

SEQ ID NO: 1495253 - RNA, 12 nt, Homo sapiens
uuagccaggugu

SEQ ID NO: 1495254 - RNA, 13 nt, Homo sapiens
uuagccuguguca

SEQ ID NO: 1495255 - RNA, 20 nt, Homo sapiens
uuagcugguggcaauaaaua

SEQ ID NO: 1495256 - RNA, 15 nt, Homo sapiens
uuagcuguaaacuga

SEQ ID NO: 1495257 - RNA, 16 nt, Homo sapiens
uuagcuugcacaugaa

SEQ ID NO: 1495258 - RNA, 12 nt, Homo sapiens
uuagcuuuacaa

SEQ ID NO: 1495259 - RNA, 14 nt, Homo sapiens
uuaggaaaaccaga

SEQ ID NO: 1495260 - RNA, 21 nt, Homo sapiens
uuaggaguaccauaauucugg

SEQ ID NO: 1495261 - RNA, 17 nt, Homo sapiens
uuaggagugguucucau

SEQ ID NO: 1495262 - RNA, 15 nt, Homo sapiens
uuaggcaaagauaau

SEQ ID NO: 1495263 - RNA, 20 nt, Homo sapiens
uuaggccuccggaugacugc

SEQ ID NO: 1495264 - RNA, 12 nt, Homo sapiens
uuagggcacugg

SEQ ID NO: 1495265 - RNA, 13 nt, Homo sapiens
uuagguagcuuua

SEQ ID NO: 1495266 - RNA, 21 nt, Homo sapiens
uuaguauaauugaccuacuuu

SEQ ID NO: 1495267 - RNA, 13 nt, Homo sapiens
uuaguaucucauc

SEQ ID NO: 1495268 - RNA, 15 nt, Homo sapiens
uuaguaucucaucaa

SEQ ID NO: 1495269 - RNA, 14 nt, Homo sapiens
uuaguauuucacaa

SEQ ID NO: 1495270 - RNA, 16 nt, Homo sapiens
uuagucucaagggcua

SEQ ID NO: 1495271 - RNA, 19 nt, Homo sapiens
ugcccagugagacuguguu

SEQ ID NO: 1495272 - RNA, 17 nt, Homo sapiens
ugcccauccugacugaa

SEQ ID NO: 1495273 - RNA, 21 nt, Homo sapiens
ugccccagauggcuuugugau

SEQ ID NO: 1495274 - RNA, 14 nt, Homo sapiens
ugccccagccugcu

SEQ ID NO: 1495275 - RNA, 17 nt, Homo sapiens
ugccccaugccugucca

SEQ ID NO: 1495276 - RNA, 19 nt, Homo sapiens
ugccccccacucugcacag

SEQ ID NO: 1495277 - RNA, 15 nt, Homo sapiens
ugccccgacacccag

SEQ ID NO: 1495278 - RNA, 18 nt, Homo sapiens
ugccccgcuauuccucac

SEQ ID NO: 1495279 - RNA, 16 nt, Homo sapiens
ugccccuggaugcacu

SEQ ID NO: 1495280 - RNA, 18 nt, Homo sapiens
ugccccuggaugcacuuu

SEQ ID NO: 1495281 - RNA, 21 nt, Homo sapiens
ugccccuggaugcacuuucau

SEQ ID NO: 1495282 - RNA, 16 nt, Homo sapiens
ugcccgagcuggugca

SEQ ID NO: 1495283 - RNA, 16 nt, Homo sapiens
ugcccuagcccagacu

SEQ ID NO: 1495284 - RNA, 20 nt, Homo sapiens
ugcccugagaagcugcucca

SEQ ID NO: 1495285 - RNA, 15 nt, Homo sapiens
ugcccuggcauuaag

SEQ ID NO: 1495286 - RNA, 19 nt, Homo sapiens
ugucucacuucacagcccu

SEQ ID NO: 1495287 - RNA, 18 nt, Homo sapiens
ugucuccuacuccugacu

SEQ ID NO: 1495288 - RNA, 20 nt, Homo sapiens
ugucucuacuaaaaaugcaa

SEQ ID NO: 1495289 - RNA, 23 nt, Homo sapiens
ugucucuuuaagggcaugccuug

SEQ ID NO: 1495290 - RNA, 23 nt, Homo sapiens
ugucugaacuugcauugugauug

SEQ ID NO: 1495291 - RNA, 14 nt, Homo sapiens
ugucugacaaccuc

SEQ ID NO: 1495292 - RNA, 13 nt, Homo sapiens
ugucugccuuaaa

SEQ ID NO: 1495293 - RNA, 22 nt, Homo sapiens
ugucuguuuuuguaacuuaaaa

SEQ ID NO: 1495294 - RNA, 22 nt, Homo sapiens
ugucuuguccccucuugaccca

SEQ ID NO: 1495295 - RNA, 21 nt, Homo sapiens
ugucuuguuucccagauuuca

SEQ ID NO: 1495296 - RNA, 18 nt, Homo sapiens
ugucuuuaacucauaaaa

SEQ ID NO: 1495297 - RNA, 13 nt, Homo sapiens
ugucuuucuccaa

SEQ ID NO: 1495298 - RNA, 19 nt, Homo sapiens
ugugaaauaccaaccugaa

SEQ ID NO: 1495299 - RNA, 20 nt, Homo sapiens
ugugaaauucacaguaauau

SEQ ID NO: 1495300 - RNA, 13 nt, Homo sapiens
ugugaacaaccug

SEQ ID NO: 1495301 - RNA, 12 nt, Homo sapiens
ugugaacccugg

SEQ ID NO: 1495302 - RNA, 16 nt, Homo sapiens
ugugaagcaaggagcu

SEQ ID NO: 1495303 - RNA, 13 nt, Homo sapiens
ugugaaguuacau

SEQ ID NO: 1495304 - RNA, 23 nt, Homo sapiens
ugugaauagccuggccaccagcc

SEQ ID NO: 1495305 - RNA, 14 nt, Homo sapiens
ugugaaugaucucu

SEQ ID NO: 1495306 - RNA, 21 nt, Homo sapiens
ugugacaauaaguuugaaccu

SEQ ID NO: 1495307 - RNA, 16 nt, Homo sapiens
ugugacaccaaagcca

SEQ ID NO: 1495308 - RNA, 22 nt, Homo sapiens
ugugacauacauauuaucucau

SEQ ID NO: 1495309 - RNA, 19 nt, Homo sapiens
ugugacaucuacaacucca

SEQ ID NO: 1495310 - RNA, 18 nt, Homo sapiens
ugugacauuuuacauuaa

SEQ ID NO: 1495311 - RNA, 18 nt, Homo sapiens
ugugaccaggaaggaagu

SEQ ID NO: 1495312 - RNA, 15 nt, Homo sapiens
ugugaccagggguga

SEQ ID NO: 1495313 - RNA, 16 nt, Homo sapiens
ugugaccccacugcca

SEQ ID NO: 1495314 - RNA, 12 nt, Homo sapiens
ugugaccuugac

SEQ ID NO: 1495315 - RNA, 15 nt, Homo sapiens
ugugagagauucugu

SEQ ID NO: 1495316 - RNA, 12 nt, Homo sapiens
ugugagcaccug

SEQ ID NO: 1495317 - RNA, 16 nt, Homo sapiens
ugugagccaccacguc

SEQ ID NO: 1495318 - RNA, 17 nt, Homo sapiens
ugugaguguaaguguga

SEQ ID NO: 1495319 - RNA, 15 nt, Homo sapiens
ugugauagcacuuuc

SEQ ID NO: 1495320 - RNA, 18 nt, Homo sapiens
ugugauagcacuuucuac

SEQ ID NO: 1495321 - RNA, 20 nt, Homo sapiens
ugugauauauaaguguacau

SEQ ID NO: 1495322 - RNA, 19 nt, Homo sapiens
ugugauauuuuuacuugca

SEQ ID NO: 1495323 - RNA, 12 nt, Homo sapiens
ugugauugcaca

SEQ ID NO: 1495324 - RNA, 23 nt, Homo sapiens
ugugcaagcgacgacagaugcua

SEQ ID NO: 1495325 - RNA, 12 nt, Homo sapiens
ugugcagaauaa

SEQ ID NO: 1495326 - RNA, 18 nt, Homo sapiens
ugugcagcucccauuugg

SEQ ID NO: 1495327 - RNA, 20 nt, Homo sapiens
ugugcagguuuugaaaaugu

SEQ ID NO: 1495328 - RNA, 22 nt, Homo sapiens
ugugcauggaggcccuccugug

SEQ ID NO: 1495329 - RNA, 19 nt, Homo sapiens
ugugcauuuguucagcucc

SEQ ID NO: 1495330 - RNA, 23 nt, Homo sapiens
ugugccaccaagcauuccugcuc

SEQ ID NO: 1495331 - RNA, 20 nt, Homo sapiens
ugugccagaaacagugggag

SEQ ID NO: 1495332 - RNA, 14 nt, Homo sapiens
ugugccaucaccau

SEQ ID NO: 1495333 - RNA, 19 nt, Homo sapiens
ugugcccgacugacuggag

SEQ ID NO: 1495334 - RNA, 16 nt, Homo sapiens
ugugccugcacugaga

SEQ ID NO: 1495335 - RNA, 23 nt, Homo sapiens
ugugccugugguuaacaucucag

SEQ ID NO: 1495336 - RNA, 13 nt, Homo sapiens
ugugcgugccauc

SEQ ID NO: 1495337 - RNA, 19 nt, Homo sapiens
ugugcugcaccuggucaua

SEQ ID NO: 1495338 - RNA, 21 nt, Homo sapiens
uguggaacauaaaaaggacau

SEQ ID NO: 1495339 - RNA, 21 nt, Homo sapiens
uguggaagcauguagacugug

SEQ ID NO: 1495340 - RNA, 18 nt, Homo sapiens
uguggaguggguaaucca

SEQ ID NO: 1495341 - RNA, 12 nt, Homo sapiens
uguggcacucca

SEQ ID NO: 1495342 - RNA, 13 nt, Homo sapiens
uguggcacuccaa

SEQ ID NO: 1495343 - RNA, 13 nt, Homo sapiens
uguggcagugguu

SEQ ID NO: 1495344 - RNA, 19 nt, Homo sapiens
uguggcccagggaagccaa

SEQ ID NO: 1495345 - RNA, 15 nt, Homo sapiens
uguggccccaacaca

SEQ ID NO: 1495346 - RNA, 23 nt, Homo sapiens
uguggcccucuggauccagccau

SEQ ID NO: 1495347 - RNA, 15 nt, Homo sapiens
uguggccucaagcaa

SEQ ID NO: 1495348 - RNA, 15 nt, Homo sapiens
uguggccugccaguc

SEQ ID NO: 1495349 - RNA, 16 nt, Homo sapiens
uguggcuaaaugccua

SEQ ID NO: 1495350 - RNA, 22 nt, Homo sapiens
ugugggcuggugccccacagcu

SEQ ID NO: 1495351 - RNA, 13 nt, Homo sapiens
ugugggggguccu

SEQ ID NO: 1495352 - RNA, 13 nt, Homo sapiens
uguggucaauccg

SEQ ID NO: 1495353 - RNA, 12 nt, Homo sapiens
uguggucucagg

SEQ ID NO: 1495354 - RNA, 16 nt, Homo sapiens
uguggugagaucaugc

SEQ ID NO: 1495355 - RNA, 15 nt, Homo sapiens
ugugguuaacgccuu

SEQ ID NO: 1495356 - RNA, 9 nt, Homo sapiens
uguguauga

SEQ ID NO: 1495357 - RNA, 24 nt, Homo sapiens
uguguauuuccagugcaauuguag

SEQ ID NO: 1495358 - RNA, 19 nt, Homo sapiens
ugugucaaugccugucuua

SEQ ID NO: 1495359 - RNA, 15 nt, Homo sapiens
uguguccucagggag

SEQ ID NO: 1495360 - RNA, 18 nt, Homo sapiens
uguguccugaaacgcucc

SEQ ID NO: 1495361 - RNA, 21 nt, Homo sapiens
uguguccuguccuuucuugca

SEQ ID NO: 1495362 - RNA, 20 nt, Homo sapiens
ugugucgcgcacacagcuua

SEQ ID NO: 1495363 - RNA, 11 nt, Homo sapiens
ugugugccuuu

SEQ ID NO: 1495364 - RNA, 14 nt, Homo sapiens
ugugugcuuuccca

SEQ ID NO: 1495365 - RNA, 13 nt, Homo sapiens
uguguguacucug

SEQ ID NO: 1495366 - RNA, 22 nt, Homo sapiens
uguuaaaaucuauucuguguug

SEQ ID NO: 1495367 - RNA, 21 nt, Homo sapiens
uguuaacauggacaugaucuu

SEQ ID NO: 1495368 - RNA, 22 nt, Homo sapiens
uguuaaggaaacucuuaucuca

SEQ ID NO: 1495369 - RNA, 18 nt, Homo sapiens
uguuaauucagcacugau

SEQ ID NO: 1495370 - RNA, 22 nt, Homo sapiens
uguuacauagguauauauaugc

SEQ ID NO: 1495371 - RNA, 13 nt, Homo sapiens
uguuaccuaaagu

SEQ ID NO: 1495372 - RNA, 17 nt, Homo sapiens
uguuaguucuagcucua

SEQ ID NO: 1495373 - RNA, 15 nt, Homo sapiens
uguuaucagucaaua

SEQ ID NO: 1495374 - RNA, 20 nt, Homo sapiens
uguuaucagucauaacuaaa

SEQ ID NO: 1495375 - RNA, 18 nt, Homo sapiens
uguuaucuucacuuuuau

SEQ ID NO: 1495376 - RNA, 23 nt, Homo sapiens
uguuauuauauuccguagguaga

SEQ ID NO: 1495377 - RNA, 18 nt, Homo sapiens
uguuauuuuaucugcuau

SEQ ID NO: 1495378 - RNA, 12 nt, Homo sapiens
uguucaaaaagg

SEQ ID NO: 1495379 - RNA, 12 nt, Homo sapiens
uguucaaaugua

SEQ ID NO: 1495380 - RNA, 13 nt, Homo sapiens
uguucaagugucc

SEQ ID NO: 1495381 - RNA, 22 nt, Homo sapiens
uagcacugaggguggcacucaa

SEQ ID NO: 1495382 - RNA, 13 nt, Homo sapiens
uagcagaaaucua

SEQ ID NO: 1495383 - RNA, 21 nt, Homo sapiens
uagcauaguaccucugcuauu

SEQ ID NO: 1495384 - RNA, 19 nt, Homo sapiens
uagcaucagaccugcauug

SEQ ID NO: 1495385 - RNA, 12 nt, Homo sapiens
uagcaucucagg

SEQ ID NO: 1495386 - RNA, 16 nt, Homo sapiens
uagcauugagugcuuu

SEQ ID NO: 1495387 - RNA, 21 nt, Homo sapiens
uagccacagcugcuguucuca

SEQ ID NO: 1495388 - RNA, 17 nt, Homo sapiens
uagccagcugugcacuu

SEQ ID NO: 1495389 - RNA, 18 nt, Homo sapiens
uagccagcugugcacuuu

SEQ ID NO: 1495390 - RNA, 19 nt, Homo sapiens
uagccagcugugcacuuuc

SEQ ID NO: 1495391 - RNA, 17 nt, Homo sapiens
uagccaggaaguacuuc

SEQ ID NO: 1495392 - RNA, 15 nt, Homo sapiens
uagccauugaucaua

SEQ ID NO: 1495393 - RNA, 21 nt, Homo sapiens
uagcccucccccucaaccuca

SEQ ID NO: 1495394 - RNA, 13 nt, Homo sapiens
uagccugugcacg

SEQ ID NO: 1495395 - RNA, 19 nt, Homo sapiens
uagccuuguguucugagua

SEQ ID NO: 1495396 - RNA, 16 nt, Homo sapiens
uagccuuuuuguauaa

SEQ ID NO: 1495397 - RNA, 14 nt, Homo sapiens
uagcggagcccagc

SEQ ID NO: 1495398 - RNA, 15 nt, Homo sapiens
uagcuauauccaugu

SEQ ID NO: 1495399 - RNA, 21 nt, Homo sapiens
uagcuccuuggagcaggcaaa

SEQ ID NO: 1495400 - RNA, 15 nt, Homo sapiens
uagcucucccaguga

SEQ ID NO: 1495401 - RNA, 12 nt, Homo sapiens
uagcucuuucag

SEQ ID NO: 1495402 - RNA, 17 nt, Homo sapiens
uagcugagacuacaggu

SEQ ID NO: 1495403 - RNA, 13 nt, Homo sapiens
uagcuuagcuguc

SEQ ID NO: 1495404 - RNA, 18 nt, Homo sapiens
uagcuuauuauugaagga

SEQ ID NO: 1495405 - RNA, 16 nt, Homo sapiens
uagcuuuagggcaaua

SEQ ID NO: 1495406 - RNA, 21 nt, Homo sapiens
uaggaaaauauggguugcauu

SEQ ID NO: 1495407 - RNA, 14 nt, Homo sapiens
uaggaaauuccuuc

SEQ ID NO: 1495408 - RNA, 16 nt, Homo sapiens
uaggaagagaaaccag

SEQ ID NO: 1495409 - RNA, 19 nt, Homo sapiens
uaggaagaugauggcucau

SEQ ID NO: 1495410 - RNA, 15 nt, Homo sapiens
uaucaagucauggca

SEQ ID NO: 1495411 - RNA, 20 nt, Homo sapiens
uaucaaugaguaacaggaaa

SEQ ID NO: 1495412 - RNA, 18 nt, Homo sapiens
uaucacaguauuaucugu

SEQ ID NO: 1495413 - RNA, 16 nt, Homo sapiens
uaucacauauuugaua

SEQ ID NO: 1495414 - RNA, 17 nt, Homo sapiens
uaucacugaacaaacua

SEQ ID NO: 1495415 - RNA, 21 nt, Homo sapiens
uaucacuucauucacauucag

SEQ ID NO: 1495416 - RNA, 15 nt, Homo sapiens
uaucagaauucucag

SEQ ID NO: 1495417 - RNA, 16 nt, Homo sapiens
uaucaguaccucucaa

SEQ ID NO: 1495418 - RNA, 14 nt, Homo sapiens
uaucagucauaacu

SEQ ID NO: 1495419 - RNA, 21 nt, Homo sapiens
uaucaguugagcuucauauac

SEQ ID NO: 1495420 - RNA, 13 nt, Homo sapiens
uaucaguuuccag

SEQ ID NO: 1495421 - RNA, 20 nt, Homo sapiens
uaucauaauucagcacuuaa

SEQ ID NO: 1495422 - RNA, 19 nt, Homo sapiens
uauccaagaaucagugaag

SEQ ID NO: 1495423 - RNA, 19 nt, Homo sapiens
uauccaaucugugaugaca

SEQ ID NO: 1495424 - RNA, 23 nt, Homo sapiens
uauccaaucugugaugacauucc

SEQ ID NO: 1495425 - RNA, 21 nt, Homo sapiens
uauccacaauuauuggcaaag

SEQ ID NO: 1495426 - RNA, 13 nt, Homo sapiens
uauccaccaagaa

SEQ ID NO: 1495427 - RNA, 21 nt, Homo sapiens
uaucccauggaaccacuaaaa

SEQ ID NO: 1495428 - RNA, 18 nt, Homo sapiens
uaucccauugaaacaaaa

SEQ ID NO: 1495429 - RNA, 23 nt, Homo sapiens
uauccuaaauaaaaaaagacaaa

SEQ ID NO: 1495430 - RNA, 16 nt, Homo sapiens
uauccuagucauucuu

SEQ ID NO: 1495431 - RNA, 17 nt, Homo sapiens
uauccuagucauucuuc

SEQ ID NO: 1495432 - RNA, 18 nt, Homo sapiens
uauccugacuucuaauau

SEQ ID NO: 1495433 - RNA, 23 nt, Homo sapiens
uauccugcgaccuugcaaccuca

SEQ ID NO: 1495434 - RNA, 15 nt, Homo sapiens
uauccuuucuaacaa

SEQ ID NO: 1495435 - RNA, 22 nt, Homo sapiens
uaucggagacagugaucuccau

SEQ ID NO: 1495436 - RNA, 15 nt, Homo sapiens
uaucgggaacagugu

SEQ ID NO: 1495437 - RNA, 15 nt, Homo sapiens
uaucuacauaaggau

SEQ ID NO: 1495438 - RNA, 19 nt, Homo sapiens
uaucuagcaaucacaacac

SEQ ID NO: 1495439 - RNA, 20 nt, Homo sapiens
uaucuauagcuaaguacaca

SEQ ID NO: 1495440 - RNA, 15 nt, Homo sapiens
uaucuauagcugcua

SEQ ID NO: 1495441 - RNA, 16 nt, Homo sapiens
uaucuauguagaauau

SEQ ID NO: 1495442 - RNA, 22 nt, Homo sapiens
uaucucaggggccaacuaggca

SEQ ID NO: 1495443 - RNA, 16 nt, Homo sapiens
uaucugacaaugcuga

SEQ ID NO: 1495444 - RNA, 20 nt, Homo sapiens
uaucugcacucuaaacugca

SEQ ID NO: 1495445 - RNA, 22 nt, Homo sapiens
uaucugcacucuaaacugcaaa

SEQ ID NO: 1495446 - RNA, 15 nt, Homo sapiens
uaucuggacaagcca

SEQ ID NO: 1495447 - RNA, 16 nt, Homo sapiens
uaucugucaucucucu

SEQ ID NO: 1495448 - RNA, 22 nt, Homo sapiens
uaucugugaaaugcuggcauuu

SEQ ID NO: 1495449 - RNA, 17 nt, Homo sapiens
uaucugugaggugcuga

SEQ ID NO: 1495450 - RNA, 19 nt, Homo sapiens
uaucugugucaaaagccag

SEQ ID NO: 1495451 - RNA, 14 nt, Homo sapiens
uaucuguucuugcu

SEQ ID NO: 1495452 - RNA, 22 nt, Homo sapiens
uaucuuagugguuccccaccga

SEQ ID NO: 1495453 - RNA, 14 nt, Homo sapiens
uaucuucacuuuua

SEQ ID NO: 1495454 - RNA, 14 nt, Homo sapiens
uaucuuugugauaa

SEQ ID NO: 1495455 - RNA, 17 nt, Homo sapiens
uaucuuugugugacaug

SEQ ID NO: 1495456 - RNA, 14 nt, Homo sapiens
uaugaacuacaaag

SEQ ID NO: 1495457 - RNA, 22 nt, Homo sapiens
uaugaauauuuauaacagcauu

SEQ ID NO: 1495458 - RNA, 14 nt, Homo sapiens
uaugaccagugaua

SEQ ID NO: 1495459 - RNA, 23 nt, Homo sapiens
uaugaccucgcccuccacaaaug

SEQ ID NO: 1495460 - RNA, 22 nt, Homo sapiens
uaugacuaaagagagaauguag

SEQ ID NO: 1495461 - RNA, 23 nt, Homo sapiens
uaugagacguuuuuggaagagua

SEQ ID NO: 1495462 - RNA, 18 nt, Homo sapiens
uaugagccaggcaucaua

SEQ ID NO: 1495463 - RNA, 22 nt, Homo sapiens
uaugagccgugaacugugcaua

SEQ ID NO: 1495464 - RNA, 18 nt, Homo sapiens
uaugaguaauacaucaaa

SEQ ID NO: 1495465 - RNA, 20 nt, Homo sapiens
uaugaguaauacaucaaaga

SEQ ID NO: 1495466 - RNA, 23 nt, Homo sapiens
uaugaguaucuguauguauauau

SEQ ID NO: 1495467 - RNA, 16 nt, Homo sapiens
uaugagucaaugugca

SEQ ID NO: 1495468 - RNA, 23 nt, Homo sapiens
uaugaguuuuugauagcuuuauu

SEQ ID NO: 1495469 - RNA, 19 nt, Homo sapiens
uaugcaaccaguuuaucca

SEQ ID NO: 1495470 - RNA, 15 nt, Homo sapiens
uaugcagcugugaua

SEQ ID NO: 1495471 - RNA, 21 nt, Homo sapiens
uaugcaguaaauuaucuuggg

SEQ ID NO: 1495472 - RNA, 22 nt, Homo sapiens
uaugcaguaaauuaucuuggga

SEQ ID NO: 1495473 - RNA, 23 nt, Homo sapiens
uaugcauuaagaguaaaauuccu

SEQ ID NO: 1495474 - RNA, 15 nt, Homo sapiens
uaugcauuugcauuu

SEQ ID NO: 1495475 - RNA, 18 nt, Homo sapiens
uaugcauuugcauuugcu

SEQ ID NO: 1495476 - RNA, 20 nt, Homo sapiens
uaugcauuugcauuugcucu

SEQ ID NO: 1495477 - RNA, 22 nt, Homo sapiens
uaugcucagggucaauuucuuu

SEQ ID NO: 1495478 - RNA, 20 nt, Homo sapiens
uaugcucauugaacuuuaag

SEQ ID NO: 1495479 - RNA, 15 nt, Homo sapiens
uaugcuuaaauucaa

SEQ ID NO: 1495480 - RNA, 19 nt, Homo sapiens
uaugcuuggcuaacuauau

SEQ ID NO: 1495481 - RNA, 16 nt, Homo sapiens
uauggaacucucucca

SEQ ID NO: 1495482 - RNA, 19 nt, Homo sapiens
uauggaauugauuugcauu

SEQ ID NO: 1495483 - RNA, 13 nt, Homo sapiens
uaugggaacaauu

SEQ ID NO: 1495484 - RNA, 14 nt, Homo sapiens
uaugguaaucuuua

SEQ ID NO: 1495485 - RNA, 16 nt, Homo sapiens
uauguaagagcaccuu

SEQ ID NO: 1495486 - RNA, 15 nt, Homo sapiens
uauguaccauaugau

SEQ ID NO: 1495487 - RNA, 21 nt, Homo sapiens
uauguagaauauauuuccuua

SEQ ID NO: 1495488 - RNA, 17 nt, Homo sapiens
uauguaugaguaucugu

SEQ ID NO: 1495489 - RNA, 16 nt, Homo sapiens
uaugucaguuugcagu

SEQ ID NO: 1495490 - RNA, 16 nt, Homo sapiens
uaugucgaugcacagu

SEQ ID NO: 1495491 - RNA, 13 nt, Homo sapiens
uaugugacaccaa

SEQ ID NO: 1495492 - RNA, 20 nt, Homo sapiens
uaugugacauuuuacauuaa

SEQ ID NO: 1495493 - RNA, 22 nt, Homo sapiens
uaugugagauuuuuuauugcua

SEQ ID NO: 1495494 - RNA, 20 nt, Homo sapiens
uaugugaucauguguggaag

SEQ ID NO: 1495495 - RNA, 13 nt, Homo sapiens
uaugugugccuuu

SEQ ID NO: 1495496 - RNA, 15 nt, Homo sapiens
uauguuuacauauca

SEQ ID NO: 1495497 - RNA, 15 nt, Homo sapiens
uauuaaaacacagcu

SEQ ID NO: 1495498 - RNA, 12 nt, Homo sapiens
uauuaagcacuu

SEQ ID NO: 1495499 - RNA, 13 nt, Homo sapiens
uauuaagcacuuu

SEQ ID NO: 1495500 - RNA, 20 nt, Homo sapiens
uauuaauauauaguccagac

SEQ ID NO: 1495501 - RNA, 13 nt, Homo sapiens
uauuaaucaccuc

SEQ ID NO: 1495502 - RNA, 13 nt, Homo sapiens
uauuaccaugaga

SEQ ID NO: 1495503 - RNA, 22 nt, Homo sapiens
uauuauaaacuguaugcucaca

SEQ ID NO: 1495504 - RNA, 14 nt, Homo sapiens
uauuauguguuucc

SEQ ID NO: 1495505 - RNA, 13 nt, Homo sapiens
uauuauuguggaa

SEQ ID NO: 1495506 - RNA, 19 nt, Homo sapiens
uauuauuuuuaccuaaaga

SEQ ID NO: 1495507 - RNA, 19 nt, Homo sapiens
uauucaauggaaagcugcu

SEQ ID NO: 1495508 - RNA, 20 nt, Homo sapiens
uauucaauggaaagcugcuu

SEQ ID NO: 1495509 - RNA, 23 nt, Homo sapiens
uauuccaauaaauugucaagacc

SEQ ID NO: 1495510 - RNA, 18 nt, Homo sapiens
uauuccuccaaaucucuu

SEQ ID NO: 1495511 - RNA, 21 nt, Homo sapiens
uauuccuccaaaucucuugcu

SEQ ID NO: 1495512 - RNA, 21 nt, Homo sapiens
ucaaauacuuagagcagugaa

SEQ ID NO: 1495513 - RNA, 13 nt, Homo sapiens
ucaaauauuucaa

SEQ ID NO: 1495514 - RNA, 14 nt, Homo sapiens
ucaaauccuuccaa

SEQ ID NO: 1495515 - RNA, 21 nt, Homo sapiens
ucaaaugaguaacauuugcug

SEQ ID NO: 1495516 - RNA, 12 nt, Homo sapiens
ucaaaugaucuu

SEQ ID NO: 1495517 - RNA, 19 nt, Homo sapiens
ucaaaugcccuuccagugg

SEQ ID NO: 1495518 - RNA, 20 nt, Homo sapiens
ucaaauggggccagauccag

SEQ ID NO: 1495519 - RNA, 19 nt, Homo sapiens
ucaaauguacagugguccu

SEQ ID NO: 1495520 - RNA, 14 nt, Homo sapiens
ucaaauucuucaca

SEQ ID NO: 1495521 - RNA, 23 nt, Homo sapiens
ucaaauugucuuuugucaugugg

SEQ ID NO: 1495522 - RNA, 18 nt, Homo sapiens
ucaaauuuuaucaugcca

SEQ ID NO: 1495523 - RNA, 19 nt, Homo sapiens
ucaacaaaauggucaucca

SEQ ID NO: 1495524 - RNA, 21 nt, Homo sapiens
ucaacaaacugcaagcaccug

SEQ ID NO: 1495525 - RNA, 23 nt, Homo sapiens
ucaacauaugcaaaauacuguac

SEQ ID NO: 1495526 - RNA, 22 nt, Homo sapiens
ucaacaucuuggucagauuuga

SEQ ID NO: 1495527 - RNA, 19 nt, Homo sapiens
ucaacaucuuuuacauucu

SEQ ID NO: 1495528 - RNA, 19 nt, Homo sapiens
ucaacaugccauaucucau

SEQ ID NO: 1495529 - RNA, 17 nt, Homo sapiens
ucaaccagauaacauac

SEQ ID NO: 1495530 - RNA, 19 nt, Homo sapiens
ucaaccucuucuggcucaa

SEQ ID NO: 1495531 - RNA, 16 nt, Homo sapiens
ucaacugaaguucuau

SEQ ID NO: 1495532 - RNA, 19 nt, Homo sapiens
ucaagaccauagugaccaa

SEQ ID NO: 1495533 - RNA, 20 nt, Homo sapiens
ucaagaccauccuggacuga

SEQ ID NO: 1495534 - RNA, 16 nt, Homo sapiens
ucaagaggcagaguuc

SEQ ID NO: 1495535 - RNA, 21 nt, Homo sapiens
ucaagauuuucauacuuuuac

SEQ ID NO: 1495536 - RNA, 18 nt, Homo sapiens
ucaagcaccugcaugugc

SEQ ID NO: 1495537 - RNA, 22 nt, Homo sapiens
ucaagcacuuacagcucuggcc

SEQ ID NO: 1495538 - RNA, 19 nt, Homo sapiens
ucaagcagagaaaauaauu

SEQ ID NO: 1495539 - RNA, 15 nt, Homo sapiens
ucaagcauaaaucac

SEQ ID NO: 1495540 - RNA, 19 nt, Homo sapiens
ucaagccaguacgugcuaa

SEQ ID NO: 1495541 - RNA, 18 nt, Homo sapiens
ucaagcccuuuacuugac

SEQ ID NO: 1495542 - RNA, 15 nt, Homo sapiens
ucaagcuguccuccc

SEQ ID NO: 1495543 - RNA, 20 nt, Homo sapiens
ucaaggaguacaaugcccag

SEQ ID NO: 1495544 - RNA, 21 nt, Homo sapiens
ucaaggcccauaucugugaaa

SEQ ID NO: 1495545 - RNA, 15 nt, Homo sapiens
ucaaggcugcaguga

SEQ ID NO: 1495546 - RNA, 21 nt, Homo sapiens
ucaagggcuagcaucccugag

SEQ ID NO: 1495547 - RNA, 11 nt, Homo sapiens
ucaaguaauaa

SEQ ID NO: 1495548 - RNA, 18 nt, Homo sapiens
ucaagugauucuccugcc

SEQ ID NO: 1495549 - RNA, 12 nt, Homo sapiens
ucaaguggcaug

SEQ ID NO: 1495550 - RNA, 20 nt, Homo sapiens
ucaaguggcaugugcuguga

SEQ ID NO: 1495551 - RNA, 22 nt, Homo sapiens
ucaaguucuggaccugggcaug

SEQ ID NO: 1495552 - RNA, 17 nt, Homo sapiens
ucaauaaaaaucugcuc

SEQ ID NO: 1495553 - RNA, 19 nt, Homo sapiens
ucaauaaagauuucaagau

SEQ ID NO: 1495554 - RNA, 18 nt, Homo sapiens
ucaauaaagcacugagca

SEQ ID NO: 1495555 - RNA, 21 nt, Homo sapiens
ucaauacuuaaaaauagucuu

SEQ ID NO: 1495556 - RNA, 24 nt, Homo sapiens
ucaauauacauaauacaugauugc

SEQ ID NO: 1495557 - RNA, 18 nt, Homo sapiens
ucaaucauaauaccugcu

SEQ ID NO: 1495558 - RNA, 16 nt, Homo sapiens
ucaauccgaaguauga

SEQ ID NO: 1495559 - RNA, 21 nt, Homo sapiens
ucaaucugcaguuuaacaaaa

SEQ ID NO: 1495560 - RNA, 19 nt, Homo sapiens
ucaaugaaccacaaaaaag

SEQ ID NO: 1495561 - RNA, 20 nt, Homo sapiens
ucaaugaauuuuauaaucug

SEQ ID NO: 1495562 - RNA, 20 nt, Homo sapiens
ucaaugcaagagugauugca

SEQ ID NO: 1495563 - RNA, 16 nt, Homo sapiens
ucaaugccuggagaca

SEQ ID NO: 1495564 - RNA, 15 nt, Homo sapiens
ucaaugucacuuaaa

SEQ ID NO: 1495565 - RNA, 13 nt, Homo sapiens
ucaaugugcauaa

SEQ ID NO: 1495566 - RNA, 17 nt, Homo sapiens
ucaauguucauuguaau

SEQ ID NO: 1495567 - RNA, 20 nt, Homo sapiens
ucaauuccaccugcaaucaa

SEQ ID NO: 1495568 - RNA, 22 nt, Homo sapiens
ucaauucccacguagacucuua

SEQ ID NO: 1495569 - RNA, 17 nt, Homo sapiens
ucaauucccucucucag

SEQ ID NO: 1495570 - RNA, 22 nt, Homo sapiens
ucaauuuuaucccucaccugua

SEQ ID NO: 1495571 - RNA, 23 nt, Homo sapiens
ucacaaaacacuucgagcacugu

SEQ ID NO: 1495572 - RNA, 15 nt, Homo sapiens
ucacaaaaugucuca

SEQ ID NO: 1495573 - RNA, 19 nt, Homo sapiens
ucacaaacuuuuauacucu

SEQ ID NO: 1495574 - RNA, 18 nt, Homo sapiens
ucacaagaaguagcuuca

SEQ ID NO: 1495575 - RNA, 15 nt, Homo sapiens
ucacaagauggaauu

SEQ ID NO: 1495576 - RNA, 23 nt, Homo sapiens
ucacaagugguguuuauugcaau

SEQ ID NO: 1495577 - RNA, 23 nt, Homo sapiens
ucacaauccuguggaucugggca

SEQ ID NO: 1495578 - RNA, 11 nt, Homo sapiens
ucacacacuga

SEQ ID NO: 1495579 - RNA, 18 nt, Homo sapiens
ucacacauccgcuucaua

SEQ ID NO: 1495580 - RNA, 14 nt, Homo sapiens
ucacaccaacagug

SEQ ID NO: 1495581 - RNA, 22 nt, Homo sapiens
ucacaccugggcaaacuuucuu

SEQ ID NO: 1495582 - RNA, 22 nt, Homo sapiens
ucacacuccccuagggggagaa

SEQ ID NO: 1495583 - RNA, 12 nt, Homo sapiens
ucacacuguaaa

SEQ ID NO: 1495584 - RNA, 20 nt, Homo sapiens
ucacagccaccccugagauc

SEQ ID NO: 1495585 - RNA, 16 nt, Homo sapiens
ucacagcuccucccac

SEQ ID NO: 1495586 - RNA, 12 nt, Homo sapiens
ucacagcugcuu

SEQ ID NO: 1495587 - RNA, 22 nt, Homo sapiens
ucacagggguucccuucucuca

SEQ ID NO: 1495588 - RNA, 19 nt, Homo sapiens
ucacauccaucccuccauu

SEQ ID NO: 1495589 - RNA, 22 nt, Homo sapiens
ucacauccuaccccuuugcacu

SEQ ID NO: 1495590 - RNA, 13 nt, Homo sapiens
ucacaucucugcc

SEQ ID NO: 1495591 - RNA, 14 nt, Homo sapiens
ucacaucugucacg

SEQ ID NO: 1495592 - RNA, 15 nt, Homo sapiens
ucacaugaccugauc

SEQ ID NO: 1495593 - RNA, 15 nt, Homo sapiens
ucacaugaugcauac

SEQ ID NO: 1495594 - RNA, 22 nt, Homo sapiens
ucacaugcguaaacgacacucu

SEQ ID NO: 1495595 - RNA, 16 nt, Homo sapiens
ucacauguuuaacuuu

SEQ ID NO: 1495596 - RNA, 18 nt, Homo sapiens
ucacauugagcugauaua

SEQ ID NO: 1495597 - RNA, 17 nt, Homo sapiens
ucaccaaaauagucuuc

SEQ ID NO: 1495598 - RNA, 22 nt, Homo sapiens
ucaccaaaauagucuucucaaa

SEQ ID NO: 1495599 - RNA, 19 nt, Homo sapiens
ucaccaaaucagcugcuac

SEQ ID NO: 1495600 - RNA, 19 nt, Homo sapiens
ucaccaccugacgcugcau

SEQ ID NO: 1495601 - RNA, 16 nt, Homo sapiens
ucaccaggugcaugca

SEQ ID NO: 1495602 - RNA, 14 nt, Homo sapiens
ucaccauaaccucu

SEQ ID NO: 1495603 - RNA, 21 nt, Homo sapiens
ucaccaugaagcgaaacacag

SEQ ID NO: 1495604 - RNA, 14 nt, Homo sapiens
ucaccauggccuua

SEQ ID NO: 1495605 - RNA, 19 nt, Homo sapiens
ucaccauugugaagcaccu

SEQ ID NO: 1495606 - RNA, 19 nt, Homo sapiens
ucacccagacuggagugca

SEQ ID NO: 1495607 - RNA, 20 nt, Homo sapiens
ucacccaggcuggacugcaa

SEQ ID NO: 1495608 - RNA, 19 nt, Homo sapiens
ucacccaggcuggaguaca

SEQ ID NO: 1495609 - RNA, 17 nt, Homo sapiens
ucaccccacagacacuu

SEQ ID NO: 1495610 - RNA, 18 nt, Homo sapiens
ucaccccacucagcucac

SEQ ID NO: 1495611 - RNA, 17 nt, Homo sapiens
ucaccccaguggccacu

SEQ ID NO: 1495612 - RNA, 16 nt, Homo sapiens
ucacccccucccuaca

SEQ ID NO: 1495613 - RNA, 18 nt, Homo sapiens
ucacugaacaaacuaaag

SEQ ID NO: 1495614 - RNA, 17 nt, Homo sapiens
ucacugacucaagacac

SEQ ID NO: 1495615 - RNA, 19 nt, Homo sapiens
ucacugagcuccccagauc

SEQ ID NO: 1495616 - RNA, 14 nt, Homo sapiens
ucacugcaaaacca

SEQ ID NO: 1495617 - RNA, 18 nt, Homo sapiens
ucacugcuggcugccuua

SEQ ID NO: 1495618 - RNA, 18 nt, Homo sapiens
ucacugcuugaugaagca

SEQ ID NO: 1495619 - RNA, 21 nt, Homo sapiens
ucacuggagguugaagccaag

SEQ ID NO: 1495620 - RNA, 18 nt, Homo sapiens
ucacuggcaugggagacc

SEQ ID NO: 1495621 - RNA, 24 nt, Homo sapiens
ucacuggccccuacuuuguggcaa

SEQ ID NO: 1495622 - RNA, 14 nt, Homo sapiens
ucacuggcuguuaa

SEQ ID NO: 1495623 - RNA, 15 nt, Homo sapiens
ucacuggcuguuaau

SEQ ID NO: 1495624 - RNA, 13 nt, Homo sapiens
ucacuguggucau

SEQ ID NO: 1495625 - RNA, 15 nt, Homo sapiens
ucacuguggucaucc

SEQ ID NO: 1495626 - RNA, 12 nt, Homo sapiens
ucacuucacccu

SEQ ID NO: 1495627 - RNA, 13 nt, Homo sapiens
ucacuuccaugac

SEQ ID NO: 1495628 - RNA, 17 nt, Homo sapiens
ucacuugaggucaggag

SEQ ID NO: 1495629 - RNA, 15 nt, Homo sapiens
ucacuugaguguaau

SEQ ID NO: 1495630 - RNA, 23 nt, Homo sapiens
ucacuuugcucucaauuaaaguc

SEQ ID NO: 1495631 - RNA, 17 nt, Homo sapiens
ucacuuuuacuacccca

SEQ ID NO: 1495632 - RNA, 13 nt, Homo sapiens
ucagaaaccugca

SEQ ID NO: 1495633 - RNA, 16 nt, Homo sapiens
ucagaaauauaugcag

SEQ ID NO: 1495634 - RNA, 18 nt, Homo sapiens
ucagaaauauaugcagcu

SEQ ID NO: 1495635 - RNA, 18 nt, Homo sapiens
ucagaaaugcugucauaa

SEQ ID NO: 1495636 - RNA, 19 nt, Homo sapiens
ucagaaccucuuccccaga

SEQ ID NO: 1495637 - RNA, 13 nt, Homo sapiens
ucagaacuaacca

SEQ ID NO: 1495638 - RNA, 15 nt, Homo sapiens
ucagaagacacugca

SEQ ID NO: 1495639 - RNA, 16 nt, Homo sapiens
ucagaagcaagccaga

SEQ ID NO: 1495640 - RNA, 13 nt, Homo sapiens
ucagaauagccac

SEQ ID NO: 1495641 - RNA, 15 nt, Homo sapiens
ucagaauagccacau

SEQ ID NO: 1495642 - RNA, 21 nt, Homo sapiens
ucagaauauugucugccuuaa

SEQ ID NO: 1495643 - RNA, 22 nt, Homo sapiens
ucagaaucauugaaguauuuuc

SEQ ID NO: 1495644 - RNA, 15 nt, Homo sapiens
ucagacaagcugcau

SEQ ID NO: 1495645 - RNA, 19 nt, Homo sapiens
ucagacacccucuccuuaa

SEQ ID NO: 1495646 - RNA, 16 nt, Homo sapiens
ucagacacuaccccau

SEQ ID NO: 1495647 - RNA, 20 nt, Homo sapiens
ucagacacuaccccauauac

SEQ ID NO: 1495648 - RNA, 19 nt, Homo sapiens
ucagacagggucugaagga

SEQ ID NO: 1495649 - RNA, 20 nt, Homo sapiens
ucagaccugucuuccaagga

SEQ ID NO: 1495650 - RNA, 14 nt, Homo sapiens
ucagacuuaccagg

SEQ ID NO: 1495651 - RNA, 14 nt, Homo sapiens
ucagagaugaacau

SEQ ID NO: 1495652 - RNA, 14 nt, Homo sapiens
ucagagaugugcac

SEQ ID NO: 1495653 - RNA, 20 nt, Homo sapiens
ucagagccccuacagcauug

SEQ ID NO: 1495654 - RNA, 17 nt, Homo sapiens
ucagaggcccaggaauc

SEQ ID NO: 1495655 - RNA, 18 nt, Homo sapiens
ucagauaaacaacaaaua

SEQ ID NO: 1495656 - RNA, 22 nt, Homo sapiens
ucagauaaagcacccuguauca

SEQ ID NO: 1495657 - RNA, 19 nt, Homo sapiens
ucagaucuaucuugucaau

SEQ ID NO: 1495658 - RNA, 23 nt, Homo sapiens
ucagaugaauuguuaauuaucua

SEQ ID NO: 1495659 - RNA, 15 nt, Homo sapiens
ucagauggugaagca

SEQ ID NO: 1495660 - RNA, 23 nt, Homo sapiens
ucagauuaccaguuauaggaaca

SEQ ID NO: 1495661 - RNA, 20 nt, Homo sapiens
ucagcacaggccauggugca

SEQ ID NO: 1495662 - RNA, 17 nt, Homo sapiens
ucagcagagaaguuuuc

SEQ ID NO: 1495663 - RNA, 13 nt, Homo sapiens
ucagcaucuguga

SEQ ID NO: 1495664 - RNA, 15 nt, Homo sapiens
ucagcaucugugaug

SEQ ID NO: 1495665 - RNA, 21 nt, Homo sapiens
ucagcaugccugaacuacaua

SEQ ID NO: 1495666 - RNA, 15 nt, Homo sapiens
ucagccaacugaaaa

SEQ ID NO: 1495667 - RNA, 18 nt, Homo sapiens
ucagccaggugaacugga

SEQ ID NO: 1495668 - RNA, 23 nt, Homo sapiens
ucagcccccagccccucccccau

SEQ ID NO: 1495669 - RNA, 16 nt, Homo sapiens
ucagcccucaguuccu

SEQ ID NO: 1495670 - RNA, 17 nt, Homo sapiens
ucagccuuaagaaccau

SEQ ID NO: 1495671 - RNA, 16 nt, Homo sapiens
ucagcgggagcacugc

SEQ ID NO: 1495672 - RNA, 14 nt, Homo sapiens
ucagcuauaccugc

SEQ ID NO: 1495673 - RNA, 15 nt, Homo sapiens
ucagcugaaugccuc

SEQ ID NO: 1495674 - RNA, 19 nt, Homo sapiens
ucagcugacccggccucuc

SEQ ID NO: 1495675 - RNA, 15 nt, Homo sapiens
ucagcugccuccugc

SEQ ID NO: 1495676 - RNA, 19 nt, Homo sapiens
ucagcuguaguccucauaa

SEQ ID NO: 1495677 - RNA, 17 nt, Homo sapiens
ucaggaauacauuugga

SEQ ID NO: 1495678 - RNA, 19 nt, Homo sapiens
ucaggaauacauuuggaaa

SEQ ID NO: 1495679 - RNA, 14 nt, Homo sapiens
ucaggacagaugcc

SEQ ID NO: 1495680 - RNA, 18 nt, Homo sapiens
ucaggacagaugccacac

SEQ ID NO: 1495681 - RNA, 20 nt, Homo sapiens
ucaggacagguggugcaaau

SEQ ID NO: 1495682 - RNA, 21 nt, Homo sapiens
ucaggacucaaucuacaggcc

SEQ ID NO: 1495683 - RNA, 16 nt, Homo sapiens
ucaggaugaacccagg

SEQ ID NO: 1495684 - RNA, 13 nt, Homo sapiens
ucaggcacacagc

SEQ ID NO: 1495685 - RNA, 15 nt, Homo sapiens
ucaggcacacagcua

SEQ ID NO: 1495686 - RNA, 19 nt, Homo sapiens
ucaggcagggugagcucca

SEQ ID NO: 1495687 - RNA, 17 nt, Homo sapiens
uacaggaagcaccccau

SEQ ID NO: 1495688 - RNA, 21 nt, Homo sapiens
uacaggaagcaccccaugcca

SEQ ID NO: 1495689 - RNA, 22 nt, Homo sapiens
uacaggcaugaaauacugugcc

SEQ ID NO: 1495690 - RNA, 20 nt, Homo sapiens
uacaggggcccgccaccaca

SEQ ID NO: 1495691 - RNA, 18 nt, Homo sapiens
uacaggugaaggcucuca

SEQ ID NO: 1495692 - RNA, 14 nt, Homo sapiens
uacaggugcgaaug

SEQ ID NO: 1495693 - RNA, 15 nt, Homo sapiens
uacagguuaaccugc

SEQ ID NO: 1495694 - RNA, 14 nt, Homo sapiens
uacagucaucugcc

SEQ ID NO: 1495695 - RNA, 19 nt, Homo sapiens
uacagugccaacuccucac

SEQ ID NO: 1495696 - RNA, 13 nt, Homo sapiens
uacagugcuauuu

SEQ ID NO: 1495697 - RNA, 12 nt, Homo sapiens
uacaguguuauu

SEQ ID NO: 1495698 - RNA, 20 nt, Homo sapiens
uacaguucugggguacaugu

SEQ ID NO: 1495699 - RNA, 15 nt, Homo sapiens
uacaguucugucaua

SEQ ID NO: 1495700 - RNA, 13 nt, Homo sapiens
uacauaaacugac

SEQ ID NO: 1495701 - RNA, 14 nt, Homo sapiens
uacauaacugccuu

SEQ ID NO: 1495702 - RNA, 22 nt, Homo sapiens
uacauauguauuauauaaacuu

SEQ ID NO: 1495703 - RNA, 13 nt, Homo sapiens
uacaucaucucca

SEQ ID NO: 1495704 - RNA, 16 nt, Homo sapiens
uacauccaaagcagac

SEQ ID NO: 1495705 - RNA, 18 nt, Homo sapiens
uacauccagucacuuugc

SEQ ID NO: 1495706 - RNA, 17 nt, Homo sapiens
uacaucucccagacucu

SEQ ID NO: 1495707 - RNA, 15 nt, Homo sapiens
uacaucugcaauaug

SEQ ID NO: 1495708 - RNA, 15 nt, Homo sapiens
uacaugaauugcauu

SEQ ID NO: 1495709 - RNA, 18 nt, Homo sapiens
uacaugcagcccaugccc

SEQ ID NO: 1495710 - RNA, 19 nt, Homo sapiens
uacaugcagcccaugccca

SEQ ID NO: 1495711 - RNA, 14 nt, Homo sapiens
uacaugcauacaaa

SEQ ID NO: 1495712 - RNA, 13 nt, Homo sapiens
uacaugcauuuga

SEQ ID NO: 1495713 - RNA, 16 nt, Homo sapiens
uacauguauugcacau

SEQ ID NO: 1495714 - RNA, 14 nt, Homo sapiens
uacaugucuuccau

SEQ ID NO: 1495715 - RNA, 18 nt, Homo sapiens
uacauugugaacagaagu

SEQ ID NO: 1495716 - RNA, 19 nt, Homo sapiens
uacauugugggauguucag

SEQ ID NO: 1495717 - RNA, 22 nt, Homo sapiens
uacauuguucuuauucuggcau

SEQ ID NO: 1495718 - RNA, 18 nt, Homo sapiens
uacauuuacuggacccug

SEQ ID NO: 1495719 - RNA, 13 nt, Homo sapiens
uacauuucauuaa

SEQ ID NO: 1495720 - RNA, 20 nt, Homo sapiens
uacauuucuaucaguacuuu

SEQ ID NO: 1495721 - RNA, 14 nt, Homo sapiens
uacauuucucauac

SEQ ID NO: 1495722 - RNA, 18 nt, Homo sapiens
uacauuugugaacaaaaa

SEQ ID NO: 1495723 - RNA, 15 nt, Homo sapiens
uacauuuucagugag

SEQ ID NO: 1495724 - RNA, 22 nt, Homo sapiens
uacauuuuuuucuuugucuuau

SEQ ID NO: 1495725 - RNA, 17 nt, Homo sapiens
uaccaaaucugacauau

SEQ ID NO: 1495726 - RNA, 18 nt, Homo sapiens
uaccaaaucugacauauu

SEQ ID NO: 1495727 - RNA, 14 nt, Homo sapiens
uaccaaguauuuau

SEQ ID NO: 1495728 - RNA, 21 nt, Homo sapiens
uaccacaaggaaaauaguuua

SEQ ID NO: 1495729 - RNA, 15 nt, Homo sapiens
uaccacucagagaaa

SEQ ID NO: 1495730 - RNA, 15 nt, Homo sapiens
uaccagagauuuacc

SEQ ID NO: 1495731 - RNA, 14 nt, Homo sapiens
uaccagaugcugac

SEQ ID NO: 1495732 - RNA, 21 nt, Homo sapiens
uaccaguugcccuagcccaga

SEQ ID NO: 1495733 - RNA, 24 nt, Homo sapiens
uaccauaauuuauuuuguccauug

SEQ ID NO: 1495734 - RNA, 13 nt, Homo sapiens
uaccaucagggac

SEQ ID NO: 1495735 - RNA, 17 nt, Homo sapiens
uaccaucuuguauacac

SEQ ID NO: 1495736 - RNA, 12 nt, Homo sapiens
uaccaugcugaa

SEQ ID NO: 1495737 - RNA, 22 nt, Homo sapiens
uaccauuuguaauaaaguauau

SEQ ID NO: 1495738 - RNA, 14 nt, Homo sapiens
uacccacauguaca

SEQ ID NO: 1495739 - RNA, 19 nt, Homo sapiens
uacccaggaccaagccaca

SEQ ID NO: 1495740 - RNA, 23 nt, Homo sapiens
uacccauagaaaacuugacaugu

SEQ ID NO: 1495741 - RNA, 19 nt, Homo sapiens
uacccauagcuuccaugag

SEQ ID NO: 1495742 - RNA, 17 nt, Homo sapiens
uacccaucuaguacuug

SEQ ID NO: 1495743 - RNA, 16 nt, Homo sapiens
uaccccacugggccag

SEQ ID NO: 1495744 - RNA, 16 nt, Homo sapiens
uaccccccuaccacac

SEQ ID NO: 1495745 - RNA, 16 nt, Homo sapiens
uaccccuuugcacuug

SEQ ID NO: 1495746 - RNA, 16 nt, Homo sapiens
uacccuauacauccac

SEQ ID NO: 1495747 - RNA, 19 nt, Homo sapiens
uacccuggagcaagaccug

SEQ ID NO: 1495748 - RNA, 16 nt, Homo sapiens
uacccuuuggggagca

SEQ ID NO: 1495749 - RNA, 14 nt, Homo sapiens
uaccuaaugucuca

SEQ ID NO: 1495750 - RNA, 15 nt, Homo sapiens
uaccuacaucaguca

SEQ ID NO: 1495751 - RNA, 17 nt, Homo sapiens
uaccuaccacagugucu

SEQ ID NO: 1495752 - RNA, 15 nt, Homo sapiens
uaccucaagacucac

SEQ ID NO: 1495753 - RNA, 19 nt, Homo sapiens
uaccucacagagugcauug

SEQ ID NO: 1495754 - RNA, 22 nt, Homo sapiens
uaccucaguucccucuugcuca

SEQ ID NO: 1495755 - RNA, 21 nt, Homo sapiens
uaccuccauccauccuuccaa

SEQ ID NO: 1495756 - RNA, 16 nt, Homo sapiens
uaccucuuaacaauuu

SEQ ID NO: 1495757 - RNA, 23 nt, Homo sapiens
uaccugauggaaguaaagccuca

SEQ ID NO: 1495758 - RNA, 21 nt, Homo sapiens
ggcucugugcagucacuggag

SEQ ID NO: 1495759 - RNA, 19 nt, Homo sapiens
ggcucuuaugugugccuuu

SEQ ID NO: 1495760 - RNA, 16 nt, Homo sapiens
ggcucuugacuacuug

SEQ ID NO: 1495761 - RNA, 10 nt, Homo sapiens
ggcugaugau

SEQ ID NO: 1495762 - RNA, 11 nt, Homo sapiens
ggcugcaguga

SEQ ID NO: 1495763 - RNA, 21 nt, Homo sapiens
ggcugccuaccaggggccuuc

SEQ ID NO: 1495764 - RNA, 14 nt, Homo sapiens
ggcugcuuugccuc

SEQ ID NO: 1495765 - RNA, 22 nt, Homo sapiens
ggcuggacuggaggugggcaug

SEQ ID NO: 1495766 - RNA, 20 nt, Homo sapiens
ggcuggagugcaguggcaug

SEQ ID NO: 1495767 - RNA, 19 nt, Homo sapiens
ggcuggagugcaguggcgu

SEQ ID NO: 1495768 - RNA, 11 nt, Homo sapiens
ggcuggcacug

SEQ ID NO: 1495769 - RNA, 19 nt, Homo sapiens
ggcuggccugcaggcugca

SEQ ID NO: 1495770 - RNA, 17 nt, Homo sapiens
ggcugggacguggcuca

SEQ ID NO: 1495771 - RNA, 11 nt, Homo sapiens
ggcugggagac

SEQ ID NO: 1495772 - RNA, 22 nt, Homo sapiens
ggcugggguggggguggggaga

SEQ ID NO: 1495773 - RNA, 23 nt, Homo sapiens
ggcuggugcuguggccaggguga

SEQ ID NO: 1495774 - RNA, 13 nt, Homo sapiens
ggcugucagccca

SEQ ID NO: 1495775 - RNA, 22 nt, Homo sapiens
ggcugucaggauucuucaagga

SEQ ID NO: 1495776 - RNA, 21 nt, Homo sapiens
ggcugucugucaccagcuauc

SEQ ID NO: 1495777 - RNA, 18 nt, Homo sapiens
ggcuguggaccguggaca

SEQ ID NO: 1495778 - RNA, 14 nt, Homo sapiens
ggcuguggagcaaa

SEQ ID NO: 1495779 - RNA, 17 nt, Homo sapiens
ggcuuaaaccuggaauc

SEQ ID NO: 1495780 - RNA, 15 nt, Homo sapiens
ggcuucacuguauaa

SEQ ID NO: 1495781 - RNA, 14 nt, Homo sapiens
ggcuuccagcucag

SEQ ID NO: 1495782 - RNA, 22 nt, Homo sapiens
guaacauauucuguaugaacuu

SEQ ID NO: 1495783 - RNA, 21 nt, Homo sapiens
guaacaugaggggacauuuug

SEQ ID NO: 1495784 - RNA, 23 nt, Homo sapiens
guaacaugaggggacauuuuggu

SEQ ID NO: 1495785 - RNA, 21 nt, Homo sapiens
guaaccaggucguccaagcaa

SEQ ID NO: 1495786 - RNA, 21 nt, Homo sapiens
guaacccgcucaucacuggau

SEQ ID NO: 1495787 - RNA, 19 nt, Homo sapiens
guaacgaaugguacuacaa

SEQ ID NO: 1495788 - RNA, 19 nt, Homo sapiens
guaacuauuacaccaaaua

SEQ ID NO: 1495789 - RNA, 12 nt, Homo sapiens
guaacuccagau

SEQ ID NO: 1495790 - RNA, 23 nt, Homo sapiens
guaacuugcuuaaauuucuuaug

SEQ ID NO: 1495791 - RNA, 12 nt, Homo sapiens
guaagaaaguga

SEQ ID NO: 1495792 - RNA, 17 nt, Homo sapiens
guaagaaggcaauauua

SEQ ID NO: 1495793 - RNA, 14 nt, Homo sapiens
guaagugcugcuau

SEQ ID NO: 1495794 - RNA, 22 nt, Homo sapiens
guaaguuacaugaaggcagcag

SEQ ID NO: 1495795 - RNA, 14 nt, Homo sapiens
guaaguuucaggug

SEQ ID NO: 1495796 - RNA, 13 nt, Homo sapiens
guaauauuuagcu

SEQ ID NO: 1495797 - RNA, 14 nt, Homo sapiens
guaaucauccccau

SEQ ID NO: 1495798 - RNA, 19 nt, Homo sapiens
guaauccaggcacagcuga

SEQ ID NO: 1495799 - RNA, 14 nt, Homo sapiens
guaauccuauuaaa

SEQ ID NO: 1495800 - RNA, 17 nt, Homo sapiens
guaauuagcauggcccc

SEQ ID NO: 1495801 - RNA, 13 nt, Homo sapiens
guaauuccagcua

SEQ ID NO: 1495802 - RNA, 18 nt, Homo sapiens
guaauuccagcuacucag

SEQ ID NO: 1495803 - RNA, 15 nt, Homo sapiens
guaauugcuugacaa

SEQ ID NO: 1495804 - RNA, 19 nt, Homo sapiens
guaauuuauuaacuaauca

SEQ ID NO: 1495805 - RNA, 21 nt, Homo sapiens
guacaaaagaagggcugguau

SEQ ID NO: 1495806 - RNA, 16 nt, Homo sapiens
guacacuaacauuucc

SEQ ID NO: 1495807 - RNA, 20 nt, Homo sapiens
guacagacaaguuggaaaaa

SEQ ID NO: 1495808 - RNA, 19 nt, Homo sapiens
guacaggaaugaaccuucu

SEQ ID NO: 1495809 - RNA, 20 nt, Homo sapiens
guacaguauguuuuacaugu

SEQ ID NO: 1495810 - RNA, 15 nt, Homo sapiens
guacagucuuaucaa

SEQ ID NO: 1495811 - RNA, 23 nt, Homo sapiens
guacaguucugggguacauguua

SEQ ID NO: 1495812 - RNA, 14 nt, Homo sapiens
guacauugugaaca

SEQ ID NO: 1495813 - RNA, 21 nt, Homo sapiens
guaccaaaucugacauauuau

SEQ ID NO: 1495814 - RNA, 22 nt, Homo sapiens
guaccauuuucuaucauggaau

SEQ ID NO: 1495815 - RNA, 17 nt, Homo sapiens
guaccccccuaccacac

SEQ ID NO: 1495816 - RNA, 18 nt, Homo sapiens
guaccuccucucaguguu

SEQ ID NO: 1495817 - RNA, 14 nt, Homo sapiens
guaccucucuuaua

SEQ ID NO: 1495818 - RNA, 14 nt, Homo sapiens
guaccugaugcuau

SEQ ID NO: 1495819 - RNA, 20 nt, Homo sapiens
guacgaucuuucuggcaaau

SEQ ID NO: 1495820 - RNA, 18 nt, Homo sapiens
guacguaacuauuuccaa

SEQ ID NO: 1495821 - RNA, 21 nt, Homo sapiens
guacucuggggugcugccuga

SEQ ID NO: 1495822 - RNA, 18 nt, Homo sapiens
guacugaaagccuuaggg

SEQ ID NO: 1495823 - RNA, 19 nt, Homo sapiens
guacuguuuuccaguucau

SEQ ID NO: 1495824 - RNA, 23 nt, Homo sapiens
guacuuauguugcacaaugagaa

SEQ ID NO: 1495825 - RNA, 20 nt, Homo sapiens
guacuugugaaacacagcug

SEQ ID NO: 1495826 - RNA, 17 nt, Homo sapiens
guacuuguuucaucugg

SEQ ID NO: 1495827 - RNA, 19 nt, Homo sapiens
guacuuuuaugauguauau

SEQ ID NO: 1495828 - RNA, 14 nt, Homo sapiens
guagaaagccaaau

SEQ ID NO: 1495829 - RNA, 22 nt, Homo sapiens
guagaaauuaacaaaugugcug

SEQ ID NO: 1495830 - RNA, 12 nt, Homo sapiens
guagacuguggc

SEQ ID NO: 1495831 - RNA, 12 nt, Homo sapiens
guagacuuugcu

SEQ ID NO: 1495832 - RNA, 21 nt, Homo sapiens
guagagaaaagcacacuugua

SEQ ID NO: 1495833 - RNA, 15 nt, Homo sapiens
guagagucaucucca

SEQ ID NO: 1495834 - RNA, 20 nt, Homo sapiens
guagauauuguuuucuguaa

SEQ ID NO: 1495835 - RNA, 18 nt, Homo sapiens
guagauuuuaaagacaaa

SEQ ID NO: 1495836 - RNA, 15 nt, Homo sapiens
guagcauacauuuau

SEQ ID NO: 1495837 - RNA, 12 nt, Homo sapiens
guagcauuuuau

SEQ ID NO: 1495838 - RNA, 13 nt, Homo sapiens
guagcccauccuu

SEQ ID NO: 1495839 - RNA, 22 nt, Homo sapiens
guagcugugucauguauauacc

SEQ ID NO: 1495840 - RNA, 14 nt, Homo sapiens
guagcuugcucccu

SEQ ID NO: 1495841 - RNA, 19 nt, Homo sapiens
guaggaaagaggaagcaaa

SEQ ID NO: 1495842 - RNA, 14 nt, Homo sapiens
guagggaguaccug

SEQ ID NO: 1495843 - RNA, 14 nt, Homo sapiens
guaggggcaaaaau

SEQ ID NO: 1495844 - RNA, 15 nt, Homo sapiens
guaggugucugcacc

SEQ ID NO: 1495845 - RNA, 14 nt, Homo sapiens
guagguucuugaua

SEQ ID NO: 1495846 - RNA, 13 nt, Homo sapiens
guaguacuugaaa

SEQ ID NO: 1495847 - RNA, 12 nt, Homo sapiens
guagugaccuaa

SEQ ID NO: 1495848 - RNA, 21 nt, Homo sapiens
guaguuuuuacagcuguguua

SEQ ID NO: 1495849 - RNA, 19 nt, Homo sapiens
guauaacacaauaugaaua

SEQ ID NO: 1495850 - RNA, 21 nt, Homo sapiens
guauaaguggaggcacuuuag

SEQ ID NO: 1495851 - RNA, 16 nt, Homo sapiens
guauacuauaguacca

SEQ ID NO: 1495852 - RNA, 22 nt, Homo sapiens
guauauagagauuguacauuua

SEQ ID NO: 1495853 - RNA, 14 nt, Homo sapiens
guauaucauucuac

SEQ ID NO: 1495854 - RNA, 13 nt, Homo sapiens
guauaugcugaug

SEQ ID NO: 1495855 - RNA, 20 nt, Homo sapiens
guauauucugguuacugugg

SEQ ID NO: 1495856 - RNA, 14 nt, Homo sapiens
guauauugucagau

SEQ ID NO: 1495857 - RNA, 13 nt, Homo sapiens
guaucaacacugu

SEQ ID NO: 1495858 - RNA, 14 nt, Homo sapiens
gcuuuucuggaauu

SEQ ID NO: 1495859 - RNA, 16 nt, Homo sapiens
gcuuuuguuugcucuu

SEQ ID NO: 1495860 - RNA, 19 nt, Homo sapiens
ggaaaaaagcacauacauu

SEQ ID NO: 1495861 - RNA, 21 nt, Homo sapiens
ggaaaagagcgcaucaggccu

SEQ ID NO: 1495862 - RNA, 16 nt, Homo sapiens
ggaaaagaggaguuuc

SEQ ID NO: 1495863 - RNA, 19 nt, Homo sapiens
ggaaaagcaaaacuguagg

SEQ ID NO: 1495864 - RNA, 22 nt, Homo sapiens
ggaaaauuuuaaaaauacagau

SEQ ID NO: 1495865 - RNA, 18 nt, Homo sapiens
ggaaacccccaguguaau

SEQ ID NO: 1495866 - RNA, 17 nt, Homo sapiens
ggaaagaaaaagcaaua

SEQ ID NO: 1495867 - RNA, 21 nt, Homo sapiens
ggaaagagcagucagagucca

SEQ ID NO: 1495868 - RNA, 23 nt, Homo sapiens
ggaaagaggcucuggacagcaga

SEQ ID NO: 1495869 - RNA, 22 nt, Homo sapiens
ggaaagaugguguggguguccu

SEQ ID NO: 1495870 - RNA, 20 nt, Homo sapiens
ggaaagccauugaccaccca

SEQ ID NO: 1495871 - RNA, 19 nt, Homo sapiens
ggaaagccucacugauaua

SEQ ID NO: 1495872 - RNA, 21 nt, Homo sapiens
ggaaagggagacgcccuuuca

SEQ ID NO: 1495873 - RNA, 14 nt, Homo sapiens
ggaaaggggugcuu

SEQ ID NO: 1495874 - RNA, 11 nt, Homo sapiens
ggaaaugucac

SEQ ID NO: 1495875 - RNA, 23 nt, Homo sapiens
ggaaauucaaaacaauuggcaaa

SEQ ID NO: 1495876 - RNA, 15 nt, Homo sapiens
ggaacaguugcauuu

SEQ ID NO: 1495877 - RNA, 23 nt, Homo sapiens
cuauggucagguuauacuccucc

SEQ ID NO: 1495878 - RNA, 14 nt, Homo sapiens
cuaugugauuacaa

SEQ ID NO: 1495879 - RNA, 15 nt, Homo sapiens
cuaugugauuacaag

SEQ ID NO: 1495880 - RNA, 13 nt, Homo sapiens
cuauguucuuagu

SEQ ID NO: 1495881 - RNA, 17 nt, Homo sapiens
cuauguugugguccauc

SEQ ID NO: 1495882 - RNA, 13 nt, Homo sapiens
cuauucucaccag

SEQ ID NO: 1495883 - RNA, 18 nt, Homo sapiens
cuauucugagcauacuca

SEQ ID NO: 1495884 - RNA, 20 nt, Homo sapiens
cuauuguauuauuuggaguu

SEQ ID NO: 1495885 - RNA, 15 nt, Homo sapiens
cuauuguuacauuau

SEQ ID NO: 1495886 - RNA, 23 nt, Homo sapiens
cuauuuaccugcaggcugagcca

SEQ ID NO: 1495887 - RNA, 21 nt, Homo sapiens
cuauuuagaaauggauuuauc

SEQ ID NO: 1495888 - RNA, 19 nt, Homo sapiens
cuauuuauauguacaugag

SEQ ID NO: 1495889 - RNA, 21 nt, Homo sapiens
cuauuuauuugugagacugua

SEQ ID NO: 1495890 - RNA, 17 nt, Homo sapiens
cuauuuccauuccagaa

SEQ ID NO: 1495891 - RNA, 18 nt, Homo sapiens
cuauuucuucuacugcua

SEQ ID NO: 1495892 - RNA, 16 nt, Homo sapiens
cucaaaaggaaaccaa

SEQ ID NO: 1495893 - RNA, 23 nt, Homo sapiens
cucaaacuccugaccuugugauu

SEQ ID NO: 1495894 - RNA, 16 nt, Homo sapiens
cucaaacuuccaguca

SEQ ID NO: 1495895 - RNA, 14 nt, Homo sapiens
cucaaaucuauuca

SEQ ID NO: 1495896 - RNA, 18 nt, Homo sapiens
cucaaaucugagggagcu

SEQ ID NO: 1495897 - RNA, 20 nt, Homo sapiens
cucaacaaaacccaugcauu

SEQ ID NO: 1495898 - RNA, 22 nt, Homo sapiens
cucaacaagggagagaccucau

SEQ ID NO: 1495899 - RNA, 15 nt, Homo sapiens
cucaacuguuuucau

SEQ ID NO: 1495900 - RNA, 23 nt, Homo sapiens
cucaagaaauaaaaggaagccaa

SEQ ID NO: 1495901 - RNA, 21 nt, Homo sapiens
cucaagaacaaacacugcagu

SEQ ID NO: 1495902 - RNA, 16 nt, Homo sapiens
cucaagacucaccuca

SEQ ID NO: 1495903 - RNA, 12 nt, Homo sapiens
cucaagacuuua

SEQ ID NO: 1495904 - RNA, 21 nt, Homo sapiens
cucaagcacugauaucuggcc

SEQ ID NO: 1495905 - RNA, 23 nt, Homo sapiens
cucaagcuguccucccaccucag

SEQ ID NO: 1495906 - RNA, 19 nt, Homo sapiens
cucaaggacuuugcagccg

SEQ ID NO: 1495907 - RNA, 21 nt, Homo sapiens
cucaagucuggcagacuuucu

SEQ ID NO: 1495908 - RNA, 14 nt, Homo sapiens
cucaagugucuuag

SEQ ID NO: 1495909 - RNA, 15 nt, Homo sapiens
cucaauaaauugcaa

SEQ ID NO: 1495910 - RNA, 15 nt, Homo sapiens
cucaauauuccugaa

SEQ ID NO: 1495911 - RNA, 23 nt, Homo sapiens
cucaaugcaauggcucaucagau

SEQ ID NO: 1495912 - RNA, 15 nt, Homo sapiens
cucaaugccaguaac

SEQ ID NO: 1495913 - RNA, 12 nt, Homo sapiens
cucaauucacau

SEQ ID NO: 1495914 - RNA, 14 nt, Homo sapiens
cucaauucacauag

SEQ ID NO: 1495915 - RNA, 16 nt, Homo sapiens
cucaauuuuugucuca

SEQ ID NO: 1495916 - RNA, 14 nt, Homo sapiens
cucacaccaacagu

SEQ ID NO: 1495917 - RNA, 20 nt, Homo sapiens
cucacagagacccaccuuca

SEQ ID NO: 1495918 - RNA, 19 nt, Homo sapiens
cucacagagugcauuguga

SEQ ID NO: 1495919 - RNA, 11 nt, Homo sapiens
cucacaguccu

SEQ ID NO: 1495920 - RNA, 14 nt, Homo sapiens
cucacaguguugcc

SEQ ID NO: 1495921 - RNA, 14 nt, Homo sapiens
cucacauaggaagu

SEQ ID NO: 1495922 - RNA, 21 nt, Homo sapiens
cucacauucgacauaccccac

SEQ ID NO: 1495923 - RNA, 23 nt, Homo sapiens
cucaccagcccugaccccagugu

SEQ ID NO: 1495924 - RNA, 16 nt, Homo sapiens
cucaccuggacuccag

SEQ ID NO: 1495925 - RNA, 14 nt, Homo sapiens
cucacgcagacaca

SEQ ID NO: 1495926 - RNA, 15 nt, Homo sapiens
cucacucccagucca

SEQ ID NO: 1495927 - RNA, 22 nt, Homo sapiens
cucacucugggcuguaacgugg

SEQ ID NO: 1495928 - RNA, 12 nt, Homo sapiens
cucacucuguca

SEQ ID NO: 1495929 - RNA, 21 nt, Homo sapiens
cucacuggaugaaauaacucc

SEQ ID NO: 1495930 - RNA, 23 nt, Homo sapiens
cucacuggggccuacagcuuuga

SEQ ID NO: 1495931 - RNA, 21 nt, Homo sapiens
cucacuguagcuuuuaggaau

SEQ ID NO: 1495932 - RNA, 19 nt, Homo sapiens
cucacuguucaaucauuga

SEQ ID NO: 1495933 - RNA, 20 nt, Homo sapiens
cucacuugaaugugucacua

SEQ ID NO: 1495934 - RNA, 18 nt, Homo sapiens
cucacuugugcaguguug

SEQ ID NO: 1495935 - RNA, 20 nt, Homo sapiens
cucagaauaaggcaggcauu

SEQ ID NO: 1495936 - RNA, 14 nt, Homo sapiens
cucagaggccugcu

SEQ ID NO: 1495937 - RNA, 21 nt, Homo sapiens
cucagccacacccaggcacuu

SEQ ID NO: 1495938 - RNA, 20 nt, Homo sapiens
cucagcugguuacucagggu

SEQ ID NO: 1495939 - RNA, 23 nt, Homo sapiens
cucagcuucuucacaggcacucc

SEQ ID NO: 1495940 - RNA, 15 nt, Homo sapiens
cucagcuuuccuuaa

SEQ ID NO: 1495941 - RNA, 17 nt, Homo sapiens
cucaggagucugaggca

SEQ ID NO: 1495942 - RNA, 22 nt, Homo sapiens
cucaggauauuaguuaaugagc

SEQ ID NO: 1495943 - RNA, 15 nt, Homo sapiens
cucaggcucuugacu

SEQ ID NO: 1495944 - RNA, 16 nt, Homo sapiens
cucagggagcagggaa

SEQ ID NO: 1495945 - RNA, 17 nt, Homo sapiens
cucagggagcagggaag

SEQ ID NO: 1495946 - RNA, 20 nt, Homo sapiens
cucaggggaaccauggggcu

SEQ ID NO: 1495947 - RNA, 14 nt, Homo sapiens
cucagggugggggg

SEQ ID NO: 1495948 - RNA, 16 nt, Homo sapiens
cucaggguucaucugu

SEQ ID NO: 1495949 - RNA, 18 nt, Homo sapiens
cucagucaugcauaaaua

SEQ ID NO: 1495950 - RNA, 17 nt, Homo sapiens
cucagucccaucagaga

SEQ ID NO: 1495951 - RNA, 23 nt, Homo sapiens
cucaguccugggucaacaucuua

SEQ ID NO: 1495952 - RNA, 11 nt, Homo sapiens
cucagugcagg

SEQ ID NO: 1495953 - RNA, 21 nt, Homo sapiens
cucaguguuuuggacuccauc

SEQ ID NO: 1495954 - RNA, 18 nt, Homo sapiens
cucaguuugugugucuua

SEQ ID NO: 1495955 - RNA, 19 nt, Homo sapiens
cucaguuugugugucuuaa

SEQ ID NO: 1495956 - RNA, 21 nt, Homo sapiens
cucauaauagucguaagugga

SEQ ID NO: 1495957 - RNA, 16 nt, Homo sapiens
cucauaauuuugcaaa

SEQ ID NO: 1495958 - RNA, 23 nt, Homo sapiens
cucaucaguguccucuugcucaa

SEQ ID NO: 1495959 - RNA, 19 nt, Homo sapiens
cucaucccacgcacuccau

SEQ ID NO: 1495960 - RNA, 18 nt, Homo sapiens
cucaugccuguaaucuca

SEQ ID NO: 1495961 - RNA, 18 nt, Homo sapiens
cuuauggaauugauuugc

SEQ ID NO: 1495962 - RNA, 22 nt, Homo sapiens
cuuaugggucccccucagcaag

SEQ ID NO: 1495963 - RNA, 21 nt, Homo sapiens
cuuauguggguugccugguga

SEQ ID NO: 1495964 - RNA, 21 nt, Homo sapiens
cuuauucuuugaguaauguga

SEQ ID NO: 1495965 - RNA, 14 nt, Homo sapiens
cuuauuguaccucu

SEQ ID NO: 1495966 - RNA, 16 nt, Homo sapiens
cuuauuuaaugaaaga

SEQ ID NO: 1495967 - RNA, 19 nt, Homo sapiens
cuuauuuucucaaucuccu

SEQ ID NO: 1495968 - RNA, 15 nt, Homo sapiens
cuuauuuugcauucc

SEQ ID NO: 1495969 - RNA, 18 nt, Homo sapiens
cuuauuuugcauuccaga

SEQ ID NO: 1495970 - RNA, 21 nt, Homo sapiens
cuuauuuugugugcuuuccca

SEQ ID NO: 1495971 - RNA, 22 nt, Homo sapiens
cuucaacaaccggccaccagau

SEQ ID NO: 1495972 - RNA, 14 nt, Homo sapiens
cuucaacccagugg

SEQ ID NO: 1495973 - RNA, 13 nt, Homo sapiens
cuucaagugccuu

SEQ ID NO: 1495974 - RNA, 21 nt, Homo sapiens
cuucaaucucuugcacucaaa

SEQ ID NO: 1495975 - RNA, 13 nt, Homo sapiens
gcaauagaacccu

SEQ ID NO: 1495976 - RNA, 17 nt, Homo sapiens
gcaaucuauguuugcac

SEQ ID NO: 1495977 - RNA, 17 nt, Homo sapiens
gcaaucuuugccuuuau

SEQ ID NO: 1495978 - RNA, 20 nt, Homo sapiens
gcaaugcauuugauggccac

SEQ ID NO: 1495979 - RNA, 11 nt, Homo sapiens
gcaauggcgcc

SEQ ID NO: 1495980 - RNA, 21 nt, Homo sapiens
gcaauuaggauuuugauguga

SEQ ID NO: 1495981 - RNA, 22 nt, Homo sapiens
gcaauuccgcauuuaauucaug

SEQ ID NO: 1495982 - RNA, 14 nt, Homo sapiens
gcacaaaagggacu

SEQ ID NO: 1495983 - RNA, 20 nt, Homo sapiens
gcacaagaagugguccaucu

SEQ ID NO: 1495984 - RNA, 22 nt, Homo sapiens
gcacaagccacaagucuuccag

SEQ ID NO: 1495985 - RNA, 16 nt, Homo sapiens
gcacaagggcacguga

SEQ ID NO: 1495986 - RNA, 19 nt, Homo sapiens
gcacacacacacaucucau

SEQ ID NO: 1495987 - RNA, 23 nt, Homo sapiens
gcacacagcuuagaagugcuaua

SEQ ID NO: 1495988 - RNA, 20 nt, Homo sapiens
gcacacuagccucuccagga

SEQ ID NO: 1495989 - RNA, 21 nt, Homo sapiens
gcacacuagccucuccaggaa

SEQ ID NO: 1495990 - RNA, 23 nt, Homo sapiens
gcacacuccaucuccugcucacc

SEQ ID NO: 1495991 - RNA, 16 nt, Homo sapiens
gcacagcucuucacac

SEQ ID NO: 1495992 - RNA, 23 nt, Homo sapiens
gcacaggacaugcgguagccagc

SEQ ID NO: 1495993 - RNA, 22 nt, Homo sapiens
gcacaggcagauguuugccuca

SEQ ID NO: 1495994 - RNA, 18 nt, Homo sapiens
gcacagggggaggccaua

SEQ ID NO: 1495995 - RNA, 21 nt, Homo sapiens
gcacaguaucuuuucuuucaa

SEQ ID NO: 1495996 - RNA, 15 nt, Homo sapiens
gcacauaacaugcuu

SEQ ID NO: 1495997 - RNA, 17 nt, Homo sapiens
gcacaucacaacauuua

SEQ ID NO: 1495998 - RNA, 12 nt, Homo sapiens
gcacaucuuuga

SEQ ID NO: 1495999 - RNA, 12 nt, Homo sapiens
gcacaugcacac

SEQ ID NO: 1496000 - RNA, 13 nt, Homo sapiens
gcacauggugugg

SEQ ID NO: 1496001 - RNA, 20 nt, Homo sapiens
gcacauuccccuugccuaaa

SEQ ID NO: 1496002 - RNA, 18 nt, Homo sapiens
gcacauuuaaggcgccau

SEQ ID NO: 1496003 - RNA, 16 nt, Homo sapiens
gcaccaacaucuacaa

SEQ ID NO: 1496004 - RNA, 13 nt, Homo sapiens
gcaccaaccugca

SEQ ID NO: 1496005 - RNA, 20 nt, Homo sapiens
gcaccacugcacuccagccu

SEQ ID NO: 1496006 - RNA, 16 nt, Homo sapiens
gcaccagcucaugcca

SEQ ID NO: 1496007 - RNA, 17 nt, Homo sapiens
gcacccagcuccagggg

SEQ ID NO: 1496008 - RNA, 12 nt, Homo sapiens
gcacccggccug

SEQ ID NO: 1496009 - RNA, 13 nt, Homo sapiens
gcacccucaggga

SEQ ID NO: 1496010 - RNA, 21 nt, Homo sapiens
gcacccugcgccuccagaggu

SEQ ID NO: 1496011 - RNA, 12 nt, Homo sapiens
gcacccuggauu

SEQ ID NO: 1496012 - RNA, 23 nt, Homo sapiens
gcacccuggggccuggaccugcc

SEQ ID NO: 1496013 - RNA, 19 nt, Homo sapiens
gcacccuguaucacagacu

SEQ ID NO: 1496014 - RNA, 15 nt, Homo sapiens
gcaccgccucagggu

SEQ ID NO: 1496015 - RNA, 16 nt, Homo sapiens
gcaccguucugugcac

SEQ ID NO: 1496016 - RNA, 15 nt, Homo sapiens
gcaccugcacacucc

SEQ ID NO: 1496017 - RNA, 19 nt, Homo sapiens
gcaccuggcccagaugaua

SEQ ID NO: 1496018 - RNA, 13 nt, Homo sapiens
gcacuaaagccag

SEQ ID NO: 1496019 - RNA, 16 nt, Homo sapiens
gcacuaaugcuuuaag

SEQ ID NO: 1496020 - RNA, 19 nt, Homo sapiens
gcacuacauaaacugacuu

SEQ ID NO: 1496021 - RNA, 21 nt, Homo sapiens
gcacuacauucauuuagcuaa

SEQ ID NO: 1496022 - RNA, 22 nt, Homo sapiens
gcacuaccacgccaagcuaauu

SEQ ID NO: 1496023 - RNA, 18 nt, Homo sapiens
gcacucaaagcuuguuaa

SEQ ID NO: 1496024 - RNA, 20 nt, Homo sapiens
gcacucacccaugugccaag

SEQ ID NO: 1496025 - RNA, 16 nt, Homo sapiens
gcacucugguggcagg

SEQ ID NO: 1496026 - RNA, 18 nt, Homo sapiens
gcacugaggguggcacuc

SEQ ID NO: 1496027 - RNA, 17 nt, Homo sapiens
gcacugcccauggacag

SEQ ID NO: 1496028 - RNA, 18 nt, Homo sapiens
gcacugcccuuuucagga

SEQ ID NO: 1496029 - RNA, 21 nt, Homo sapiens
gcacugcuaggcgagugccag

SEQ ID NO: 1496030 - RNA, 20 nt, Homo sapiens
gcacugcucccuaccccagg

SEQ ID NO: 1496031 - RNA, 21 nt, Homo sapiens
gcacuggugguuuuugcucuc

SEQ ID NO: 1496032 - RNA, 18 nt, Homo sapiens
gcacugugaagacccagc

SEQ ID NO: 1496033 - RNA, 21 nt, Homo sapiens
gcacuguggcucugcaugaca

SEQ ID NO: 1496034 - RNA, 17 nt, Homo sapiens
gcacuguugcaaacuca

SEQ ID NO: 1496035 - RNA, 17 nt, Homo sapiens
gcacuugcugaggccaa

SEQ ID NO: 1496036 - RNA, 15 nt, Homo sapiens
gcagaaaaacucugg

SEQ ID NO: 1496037 - RNA, 17 nt, Homo sapiens
gcagaaaggguuccaaa

SEQ ID NO: 1496038 - RNA, 17 nt, Homo sapiens
gcagaagagaaaagcug

SEQ ID NO: 1496039 - RNA, 23 nt, Homo sapiens
gcagaagaucaaggaguacaaug

SEQ ID NO: 1496040 - RNA, 14 nt, Homo sapiens
gcagaagcagggua

SEQ ID NO: 1496041 - RNA, 20 nt, Homo sapiens
gcagaagcaggguacccuuu

SEQ ID NO: 1496042 - RNA, 12 nt, Homo sapiens
gcagaagcccug

SEQ ID NO: 1496043 - RNA, 13 nt, Homo sapiens
gcagaauggacuu

SEQ ID NO: 1496044 - RNA, 17 nt, Homo sapiens
gcagacaguagacagaa

SEQ ID NO: 1496045 - RNA, 21 nt, Homo sapiens
gcagacaucggccuccaugac

SEQ ID NO: 1496046 - RNA, 16 nt, Homo sapiens
gcagaccucaagccau

SEQ ID NO: 1496047 - RNA, 14 nt, Homo sapiens
gcagagagaagccu

SEQ ID NO: 1496048 - RNA, 22 nt, Homo sapiens
gcagagagguggagaacuggga

SEQ ID NO: 1496049 - RNA, 16 nt, Homo sapiens
gcagaggcaacacugg

SEQ ID NO: 1496050 - RNA, 18 nt, Homo sapiens
gcagaggcaacacuggaa

SEQ ID NO: 1496051 - RNA, 13 nt, Homo sapiens
gcagaggcaccuc

SEQ ID NO: 1496052 - RNA, 15 nt, Homo sapiens
gcagaggucagacua

SEQ ID NO: 1496053 - RNA, 13 nt, Homo sapiens
gcagagguugcag

SEQ ID NO: 1496054 - RNA, 16 nt, Homo sapiens
gcagagguugcaguga

SEQ ID NO: 1496055 - RNA, 14 nt, Homo sapiens
gcagauacauauga

SEQ ID NO: 1496056 - RNA, 14 nt, Homo sapiens
gcagaucacuugag

SEQ ID NO: 1496057 - RNA, 18 nt, Homo sapiens
gcagauccccacuguccu

SEQ ID NO: 1496058 - RNA, 21 nt, Homo sapiens
gcagauugaaaaggacaccuu

SEQ ID NO: 1496059 - RNA, 12 nt, Homo sapiens
gcagcaaggccc

SEQ ID NO: 1496060 - RNA, 17 nt, Homo sapiens
gcagcauacacagauga

SEQ ID NO: 1496061 - RNA, 18 nt, Homo sapiens
gcagcauagcaagacaca

SEQ ID NO: 1496062 - RNA, 21 nt, Homo sapiens
gcagcaugagacuuucugcug

SEQ ID NO: 1496063 - RNA, 13 nt, Homo sapiens
cucgugugccugg

SEQ ID NO: 1496064 - RNA, 19 nt, Homo sapiens
cucuacaucuagcaauuuc

SEQ ID NO: 1496065 - RNA, 15 nt, Homo sapiens
cucuacccuauacaa

SEQ ID NO: 1496066 - RNA, 20 nt, Homo sapiens
cucuacccuggcacuauaau

SEQ ID NO: 1496067 - RNA, 21 nt, Homo sapiens
cucuacugaaaguacaaaaau

SEQ ID NO: 1496068 - RNA, 22 nt, Homo sapiens
cucuacugaggugcuauguucu

SEQ ID NO: 1496069 - RNA, 20 nt, Homo sapiens
cucuagcaggccuaagacau

SEQ ID NO: 1496070 - RNA, 20 nt, Homo sapiens
cucuagccugggccacaggg

SEQ ID NO: 1496071 - RNA, 21 nt, Homo sapiens
cucuagcuuugucauaguuau

SEQ ID NO: 1496072 - RNA, 20 nt, Homo sapiens
cucuaguaagaugcacugaa

SEQ ID NO: 1496073 - RNA, 14 nt, Homo sapiens
cucuagucagcaca

SEQ ID NO: 1496074 - RNA, 14 nt, Homo sapiens
cucuauacaucucu

SEQ ID NO: 1496075 - RNA, 19 nt, Homo sapiens
cucuaugccagcucagucc

SEQ ID NO: 1496076 - RNA, 17 nt, Homo sapiens
cucucacccgaccggug

SEQ ID NO: 1496077 - RNA, 22 nt, Homo sapiens
cucucagugcuucuuacuauua

SEQ ID NO: 1496078 - RNA, 19 nt, Homo sapiens
cucucaugggguccaaguu

SEQ ID NO: 1496079 - RNA, 17 nt, Homo sapiens
cugaccucgugauccac

SEQ ID NO: 1496080 - RNA, 15 nt, Homo sapiens
cugaccugaccccau

SEQ ID NO: 1496081 - RNA, 20 nt, Homo sapiens
cugaccuggaaagaaaaagc

SEQ ID NO: 1496082 - RNA, 19 nt, Homo sapiens
cugaccuggcuggugacag

SEQ ID NO: 1496083 - RNA, 14 nt, Homo sapiens
cugacucugacuca

SEQ ID NO: 1496084 - RNA, 15 nt, Homo sapiens
cugacucugacucau

SEQ ID NO: 1496085 - RNA, 17 nt, Homo sapiens
cugacuugaguguuccu

SEQ ID NO: 1496086 - RNA, 19 nt, Homo sapiens
cugacuuuuaaugucauuu

SEQ ID NO: 1496087 - RNA, 21 nt, Homo sapiens
cugagaaagagaaugagaaga

SEQ ID NO: 1496088 - RNA, 23 nt, Homo sapiens
cugagaaauaaaaagccugucau

SEQ ID NO: 1496089 - RNA, 16 nt, Homo sapiens
cugagaaauggccaaa

SEQ ID NO: 1496090 - RNA, 16 nt, Homo sapiens
cugagaacuccugacu

SEQ ID NO: 1496091 - RNA, 20 nt, Homo sapiens
cugagaagucaaacauuuca

SEQ ID NO: 1496092 - RNA, 13 nt, Homo sapiens
cugagaauuucca

SEQ ID NO: 1496093 - RNA, 12 nt, Homo sapiens
cugagacacaaa

SEQ ID NO: 1496094 - RNA, 14 nt, Homo sapiens
cugagacagggauu

SEQ ID NO: 1496095 - RNA, 17 nt, Homo sapiens
cugagagaauuggcuca

SEQ ID NO: 1496096 - RNA, 22 nt, Homo sapiens
cugagaggcaggcauagaggcu

SEQ ID NO: 1496097 - RNA, 14 nt, Homo sapiens
cugagaucgugcua

SEQ ID NO: 1496098 - RNA, 13 nt, Homo sapiens
cugagauugacaa

SEQ ID NO: 1496099 - RNA, 18 nt, Homo sapiens
cugagauuuccuccuggc

SEQ ID NO: 1496100 - RNA, 23 nt, Homo sapiens
cugagcaccacacccagugggaa

SEQ ID NO: 1496101 - RNA, 20 nt, Homo sapiens
cugagcuuuguccugaagga

SEQ ID NO: 1496102 - RNA, 22 nt, Homo sapiens
cugaggcaagagaauugcuuga

SEQ ID NO: 1496103 - RNA, 22 nt, Homo sapiens
cugaggcaggaggauugcuuga

SEQ ID NO: 1496104 - RNA, 16 nt, Homo sapiens
cugaggccaagccacu

SEQ ID NO: 1496105 - RNA, 16 nt, Homo sapiens
cugagggcagacuggg

SEQ ID NO: 1496106 - RNA, 13 nt, Homo sapiens
cugaggucccugu

SEQ ID NO: 1496107 - RNA, 15 nt, Homo sapiens
cugaggucccugugu

SEQ ID NO: 1496108 - RNA, 21 nt, Homo sapiens
cugagguucuugggauacaga

SEQ ID NO: 1496109 - RNA, 19 nt, Homo sapiens
cugaguccagagcuugugc

SEQ ID NO: 1496110 - RNA, 15 nt, Homo sapiens
cugagugagccacag

SEQ ID NO: 1496111 - RNA, 22 nt, Homo sapiens
cugagugcgggcugaggccaga

SEQ ID NO: 1496112 - RNA, 22 nt, Homo sapiens
cugaguggccagccagugccau

SEQ ID NO: 1496113 - RNA, 14 nt, Homo sapiens
cugaguggugccaa

SEQ ID NO: 1496114 - RNA, 16 nt, Homo sapiens
cugaguggugccaaac

SEQ ID NO: 1496115 - RNA, 12 nt, Homo sapiens
cugauaccucaa

SEQ ID NO: 1496116 - RNA, 16 nt, Homo sapiens
cugauaggaaugugaa

SEQ ID NO: 1496117 - RNA, 16 nt, Homo sapiens
cugauauuaaucaaaa

SEQ ID NO: 1496118 - RNA, 14 nt, Homo sapiens
cugaucaugcauug

SEQ ID NO: 1496119 - RNA, 20 nt, Homo sapiens
cugaucgugcuaaauuuuca

SEQ ID NO: 1496120 - RNA, 13 nt, Homo sapiens
cugaucuauacaa

SEQ ID NO: 1496121 - RNA, 12 nt, Homo sapiens
cugaucugugau

SEQ ID NO: 1496122 - RNA, 13 nt, Homo sapiens
cugaucugugaua

SEQ ID NO: 1496123 - RNA, 22 nt, Homo sapiens
cugaugaaaacauagcaucuca

SEQ ID NO: 1496124 - RNA, 17 nt, Homo sapiens
cugaugaaacucacaaa

SEQ ID NO: 1496125 - RNA, 21 nt, Homo sapiens
cugaugacacaggcugacuca

SEQ ID NO: 1496126 - RNA, 19 nt, Homo sapiens
cugauggaaguaaagccuc

SEQ ID NO: 1496127 - RNA, 19 nt, Homo sapiens
cugauugaagacacacuca

SEQ ID NO: 1496128 - RNA, 22 nt, Homo sapiens
cugauuguggaucuuuucauuc

SEQ ID NO: 1496129 - RNA, 20 nt, Homo sapiens
cugauuucuucagaauuaga

SEQ ID NO: 1496130 - RNA, 14 nt, Homo sapiens
cugauuugaugaua

SEQ ID NO: 1496131 - RNA, 16 nt, Homo sapiens
cugcaaaacacuaaag

SEQ ID NO: 1496132 - RNA, 19 nt, Homo sapiens
cugcaaacucacugcucaa

SEQ ID NO: 1496133 - RNA, 19 nt, Homo sapiens
cugcaacaggcuugugcaa

SEQ ID NO: 1496134 - RNA, 18 nt, Homo sapiens
cugcaauaugaauucaag

SEQ ID NO: 1496135 - RNA, 18 nt, Homo sapiens
cugcaaugggcacuggga

SEQ ID NO: 1496136 - RNA, 15 nt, Homo sapiens
cugcacaacaagaua

SEQ ID NO: 1496137 - RNA, 13 nt, Homo sapiens
cugcacacuccag

SEQ ID NO: 1496138 - RNA, 22 nt, Homo sapiens
cugcacagauauuuccauuucu

SEQ ID NO: 1496139 - RNA, 21 nt, Homo sapiens
cugcacagauggauuugccug

SEQ ID NO: 1496140 - RNA, 20 nt, Homo sapiens
cugcacaugaaaguuuugca

SEQ ID NO: 1496141 - RNA, 20 nt, Homo sapiens
cugcaccagagcaaccucuc

SEQ ID NO: 1496142 - RNA, 21 nt, Homo sapiens
cugcacccacgugcauucaca

SEQ ID NO: 1496143 - RNA, 19 nt, Homo sapiens
cugcaccccugcaguuuga

SEQ ID NO: 1496144 - RNA, 16 nt, Homo sapiens
cugcaccccugggcca

SEQ ID NO: 1496145 - RNA, 12 nt, Homo sapiens
cugcaccuguca

SEQ ID NO: 1496146 - RNA, 15 nt, Homo sapiens
cugcacuauuugccg

SEQ ID NO: 1496147 - RNA, 20 nt, Homo sapiens
cugcacuccagccugggcaa

SEQ ID NO: 1496148 - RNA, 20 nt, Homo sapiens
cugcacuccagccuggggga

SEQ ID NO: 1496149 - RNA, 16 nt, Homo sapiens
cugcacugucugagaa

SEQ ID NO: 1496150 - RNA, 15 nt, Homo sapiens
cugcacuguuuucaa

SEQ ID NO: 1496151 - RNA, 17 nt, Homo sapiens
cugcagaaguacuccua

SEQ ID NO: 1496152 - RNA, 13 nt, Homo sapiens
cugcagaauccag

SEQ ID NO: 1496153 - RNA, 21 nt, Homo sapiens
cugcagccagcucacguccag

SEQ ID NO: 1496154 - RNA, 20 nt, Homo sapiens
cugcagcccaccagacguca

SEQ ID NO: 1496155 - RNA, 19 nt, Homo sapiens
cugcagccuggcugguccu

SEQ ID NO: 1496156 - RNA, 14 nt, Homo sapiens
cugcaggagcaguu

SEQ ID NO: 1496157 - RNA, 17 nt, Homo sapiens
cugcagucaucuacuuu

SEQ ID NO: 1496158 - RNA, 21 nt, Homo sapiens
cugcauccccuuggcugugag

SEQ ID NO: 1496159 - RNA, 21 nt, Homo sapiens
cugcauguaccauuugcaugg

SEQ ID NO: 1496160 - RNA, 14 nt, Homo sapiens
cugcauguacugua

SEQ ID NO: 1496161 - RNA, 23 nt, Homo sapiens
cugccaaggaaacccccagugua

SEQ ID NO: 1496162 - RNA, 13 nt, Homo sapiens
cugccaaggugaa

SEQ ID NO: 1496163 - RNA, 18 nt, Homo sapiens
cugccacagccagaggag

SEQ ID NO: 1496164 - RNA, 14 nt, Homo sapiens
cugccacccacuca

SEQ ID NO: 1496165 - RNA, 16 nt, Homo sapiens
uuccucaucugcagaa

SEQ ID NO: 1496166 - RNA, 20 nt, Homo sapiens
uuccuccucaggcacacagc

SEQ ID NO: 1496167 - RNA, 17 nt, Homo sapiens
uuccucuagaagccaag

SEQ ID NO: 1496168 - RNA, 18 nt, Homo sapiens
uuccucuuggugucauau

SEQ ID NO: 1496169 - RNA, 22 nt, Homo sapiens
uuccucuugugauuucuuuaaa

SEQ ID NO: 1496170 - RNA, 16 nt, Homo sapiens
uuccugacaucacagc

SEQ ID NO: 1496171 - RNA, 19 nt, Homo sapiens
uuccugacaucacagcagc

SEQ ID NO: 1496172 - RNA, 16 nt, Homo sapiens
uuccugauaacauuau

SEQ ID NO: 1496173 - RNA, 21 nt, Homo sapiens
uuccugcaacucaaggacuuu

SEQ ID NO: 1496174 - RNA, 22 nt, Homo sapiens
uuccugcgcgucaucucugaca

SEQ ID NO: 1496175 - RNA, 15 nt, Homo sapiens
uuccuggcaauagug

SEQ ID NO: 1496176 - RNA, 18 nt, Homo sapiens
uuccuggcugaugaucca

SEQ ID NO: 1496177 - RNA, 14 nt, Homo sapiens
uuccuuaaagcauu

SEQ ID NO: 1496178 - RNA, 15 nt, Homo sapiens
uuccuuagacuuacu

SEQ ID NO: 1496179 - RNA, 15 nt, Homo sapiens
uuccuuaucugucac

SEQ ID NO: 1496180 - RNA, 14 nt, Homo sapiens
uuccuucugaccac

SEQ ID NO: 1496181 - RNA, 21 nt, Homo sapiens
uuccuugaauguggcuugaga

SEQ ID NO: 1496182 - RNA, 21 nt, Homo sapiens
uuccuugauggagauauuuac

SEQ ID NO: 1496183 - RNA, 17 nt, Homo sapiens
uuccuugggaugaucuu

SEQ ID NO: 1496184 - RNA, 24 nt, Homo sapiens
uuccuuuauagagugucucagggu

SEQ ID NO: 1496185 - RNA, 16 nt, Homo sapiens
uuccuuuguagcuacu

SEQ ID NO: 1496186 - RNA, 17 nt, Homo sapiens
uuccuuuuugacacuga

SEQ ID NO: 1496187 - RNA, 13 nt, Homo sapiens
uucgaaacugcca

SEQ ID NO: 1496188 - RNA, 20 nt, Homo sapiens
uucgagaccagucuggccaa

SEQ ID NO: 1496189 - RNA, 23 nt, Homo sapiens
uucgauacaccgggccuggagaa

SEQ ID NO: 1496190 - RNA, 13 nt, Homo sapiens
uucguaguuuuca

SEQ ID NO: 1496191 - RNA, 13 nt, Homo sapiens
uucuaaaaugugu

SEQ ID NO: 1496192 - RNA, 23 nt, Homo sapiens
uucuaaaugaauguuuacacucu

SEQ ID NO: 1496193 - RNA, 18 nt, Homo sapiens
uucuaaguauuuuauucc

SEQ ID NO: 1496194 - RNA, 21 nt, Homo sapiens
uucuaaguggaaaaaguauua

SEQ ID NO: 1496195 - RNA, 22 nt, Homo sapiens
uucuacaacugauugcaacaga

SEQ ID NO: 1496196 - RNA, 22 nt, Homo sapiens
uucuacagugaauuuaaucaaa

SEQ ID NO: 1496197 - RNA, 14 nt, Homo sapiens
uucuacaugacugg

SEQ ID NO: 1496198 - RNA, 11 nt, Homo sapiens
uucuacuguaa

SEQ ID NO: 1496199 - RNA, 21 nt, Homo sapiens
uucuacuuuuuuugaugaccu

SEQ ID NO: 1496200 - RNA, 21 nt, Homo sapiens
uucuagaaacaggaaacaccg

SEQ ID NO: 1496201 - RNA, 22 nt, Homo sapiens
uucuagucuccuuugcacugag

SEQ ID NO: 1496202 - RNA, 15 nt, Homo sapiens
uucuagucuuggcca

SEQ ID NO: 1496203 - RNA, 23 nt, Homo sapiens
uucuaguucagagccaagccuua

SEQ ID NO: 1496204 - RNA, 24 nt, Homo sapiens
uucuaguuuugucaaacuguagaa

SEQ ID NO: 1496205 - RNA, 22 nt, Homo sapiens
uucuauaacagauauggcagcu

SEQ ID NO: 1496206 - RNA, 17 nt, Homo sapiens
uucuauaggaacauaug

SEQ ID NO: 1496207 - RNA, 15 nt, Homo sapiens
uucuaucaguacuuu

SEQ ID NO: 1496208 - RNA, 15 nt, Homo sapiens
uucuaugcauuaaga

SEQ ID NO: 1496209 - RNA, 22 nt, Homo sapiens
uucuaugguugacauuguauau

SEQ ID NO: 1496210 - RNA, 15 nt, Homo sapiens
uucuauuuauuuacu

SEQ ID NO: 1496211 - RNA, 15 nt, Homo sapiens
uucucaaaguuuuga

SEQ ID NO: 1496212 - RNA, 22 nt, Homo sapiens
uucucaagcugagauugagcag

SEQ ID NO: 1496213 - RNA, 16 nt, Homo sapiens
uucucaccauuugagu

SEQ ID NO: 1496214 - RNA, 19 nt, Homo sapiens
uucucagguguugccaaau

SEQ ID NO: 1496215 - RNA, 21 nt, Homo sapiens
uucucagguguugccaaauau

SEQ ID NO: 1496216 - RNA, 13 nt, Homo sapiens
uucucaucugcaa

SEQ ID NO: 1496217 - RNA, 11 nt, Homo sapiens
uucuccacugg

SEQ ID NO: 1496218 - RNA, 17 nt, Homo sapiens
uucucccaccaccucac

SEQ ID NO: 1496219 - RNA, 22 nt, Homo sapiens
uucucccaccaccucaccaguu

SEQ ID NO: 1496220 - RNA, 19 nt, Homo sapiens
uucuccgcaacagccaagu

SEQ ID NO: 1496221 - RNA, 13 nt, Homo sapiens
uucuccugccuca

SEQ ID NO: 1496222 - RNA, 15 nt, Homo sapiens
uucucucuccagggu

SEQ ID NO: 1496223 - RNA, 17 nt, Homo sapiens
uucucugcuccaccaca

SEQ ID NO: 1496224 - RNA, 18 nt, Homo sapiens
uucucuggacacugccac

SEQ ID NO: 1496225 - RNA, 23 nt, Homo sapiens
uucucuguguaugagugugaaug

SEQ ID NO: 1496226 - RNA, 23 nt, Homo sapiens
uucucuguuguuugguucaggga

SEQ ID NO: 1496227 - RNA, 11 nt, Homo sapiens
uucucuuugcu

SEQ ID NO: 1496228 - RNA, 22 nt, Homo sapiens
uucucuuugcugcuggugcuaa

SEQ ID NO: 1496229 - RNA, 20 nt, Homo sapiens
uucucuuuuccuuugguccu

SEQ ID NO: 1496230 - RNA, 14 nt, Homo sapiens
uucugaaaugugca

SEQ ID NO: 1496231 - RNA, 16 nt, Homo sapiens
uucugaccacagcauc

SEQ ID NO: 1496232 - RNA, 22 nt, Homo sapiens
uucugagaagaaacuuguccuu

SEQ ID NO: 1496233 - RNA, 19 nt, Homo sapiens
uucugagagugaaaccaug

SEQ ID NO: 1496234 - RNA, 23 nt, Homo sapiens
uucugaggcccugcccaaugaga

SEQ ID NO: 1496235 - RNA, 18 nt, Homo sapiens
uucugagggaaagugcau

SEQ ID NO: 1496236 - RNA, 19 nt, Homo sapiens
uucugagguccuuaugucc

SEQ ID NO: 1496237 - RNA, 16 nt, Homo sapiens
uucugauaccacugca

SEQ ID NO: 1496238 - RNA, 17 nt, Homo sapiens
uucugauaccacugcac

SEQ ID NO: 1496239 - RNA, 23 nt, Homo sapiens
uucugcaacaucuuaagauccac

SEQ ID NO: 1496240 - RNA, 20 nt, Homo sapiens
uucugcagcaugaccuguga

SEQ ID NO: 1496241 - RNA, 18 nt, Homo sapiens
uucugcccgcuccaugga

SEQ ID NO: 1496242 - RNA, 22 nt, Homo sapiens
uucugcucugguuagaaaaagg

SEQ ID NO: 1496243 - RNA, 16 nt, Homo sapiens
uucuggaccugggcau

SEQ ID NO: 1496244 - RNA, 15 nt, Homo sapiens
uucuggccucugcug

SEQ ID NO: 1496245 - RNA, 13 nt, Homo sapiens
uucuggcuguaga

SEQ ID NO: 1496246 - RNA, 15 nt, Homo sapiens
uucugggcucaggga

SEQ ID NO: 1496247 - RNA, 23 nt, Homo sapiens
uucugggggaaaaagccauauca

SEQ ID NO: 1496248 - RNA, 19 nt, Homo sapiens
uucuggguggccucgggac

SEQ ID NO: 1496249 - RNA, 18 nt, Homo sapiens
uucugguuguuaugugau

SEQ ID NO: 1496250 - RNA, 18 nt, Homo sapiens
uucuguaucauugauuca

SEQ ID NO: 1496251 - RNA, 17 nt, Homo sapiens
uucuguaugaacuuuau

SEQ ID NO: 1496252 - RNA, 21 nt, Homo sapiens
uucugucacccagacuggagu

SEQ ID NO: 1496253 - RNA, 16 nt, Homo sapiens
uucugucuggagugac

SEQ ID NO: 1496254 - RNA, 18 nt, Homo sapiens
uucugucuuuauaaucua

SEQ ID NO: 1496255 - RNA, 13 nt, Homo sapiens
uucugugaucuuu

SEQ ID NO: 1496256 - RNA, 13 nt, Homo sapiens
uucuuaagacaug

SEQ ID NO: 1496257 - RNA, 16 nt, Homo sapiens
uucuuagcgcaguugu

SEQ ID NO: 1496258 - RNA, 16 nt, Homo sapiens
uucuuagguaaccuua

SEQ ID NO: 1496259 - RNA, 11 nt, Homo sapiens
uucuuccaaaa

SEQ ID NO: 1496260 - RNA, 12 nt, Homo sapiens
uucuuccagaau

SEQ ID NO: 1496261 - RNA, 14 nt, Homo sapiens
uucuucuacugcua

SEQ ID NO: 1496262 - RNA, 17 nt, Homo sapiens
ugauguuaaccaaugua

SEQ ID NO: 1496263 - RNA, 14 nt, Homo sapiens
ugauuaaucaaagg

SEQ ID NO: 1496264 - RNA, 22 nt, Homo sapiens
ugauucaggggucugaugacac

SEQ ID NO: 1496265 - RNA, 22 nt, Homo sapiens
ugauucgcccaccucagccucc

SEQ ID NO: 1496266 - RNA, 16 nt, Homo sapiens
ugauucuccugccuca

SEQ ID NO: 1496267 - RNA, 15 nt, Homo sapiens
ugauugaaccagcuc

SEQ ID NO: 1496268 - RNA, 16 nt, Homo sapiens
ugauugaaccagcuca

SEQ ID NO: 1496269 - RNA, 16 nt, Homo sapiens
ugauugacacacagca

SEQ ID NO: 1496270 - RNA, 16 nt, Homo sapiens
ugauuguuauguguau

SEQ ID NO: 1496271 - RNA, 16 nt, Homo sapiens
ugauuuggugaccaac

SEQ ID NO: 1496272 - RNA, 13 nt, Homo sapiens
ugaucuuacucac

SEQ ID NO: 1496273 - RNA, 22 nt, Homo sapiens
ugaugacacccacccugugcca

SEQ ID NO: 1496274 - RNA, 14 nt, Homo sapiens
ugaugacuuacuau

SEQ ID NO: 1496275 - RNA, 23 nt, Homo sapiens
ugaugagagaauggagacagagu

SEQ ID NO: 1496276 - RNA, 16 nt, Homo sapiens
ugaugauaacacuuaa

SEQ ID NO: 1496277 - RNA, 16 nt, Homo sapiens
ugaugcugagauucuu

SEQ ID NO: 1496278 - RNA, 21 nt, Homo sapiens
ugauggaaauacacuguuauc

SEQ ID NO: 1496279 - RNA, 21 nt, Homo sapiens
ugauggagauauuuacaugaa

SEQ ID NO: 1496280 - RNA, 21 nt, Homo sapiens
ugauggcaccacugcacucca

SEQ ID NO: 1496281 - RNA, 17 nt, Homo sapiens
ugaugguggacuaagca

SEQ ID NO: 1496282 - RNA, 15 nt, Homo sapiens
ugaugucagauuugg

SEQ ID NO: 1496283 - RNA, 15 nt, Homo sapiens
ugaugugaaacauua

SEQ ID NO: 1496284 - RNA, 18 nt, Homo sapiens
ugauguuugcuuuucuaa

SEQ ID NO: 1496285 - RNA, 20 nt, Homo sapiens
ugauguuuguggccucagaa

SEQ ID NO: 1496286 - RNA, 15 nt, Homo sapiens
ugauuaaaacauuau

SEQ ID NO: 1496287 - RNA, 17 nt, Homo sapiens
ugauuacaaggcuuuau

SEQ ID NO: 1496288 - RNA, 15 nt, Homo sapiens
ugauuacugcucuau

SEQ ID NO: 1496289 - RNA, 21 nt, Homo sapiens
ugauucagccaaaugcaggga

SEQ ID NO: 1496290 - RNA, 16 nt, Homo sapiens
ugauucgcccaccuca

SEQ ID NO: 1496291 - RNA, 18 nt, Homo sapiens
ugauucuaauggggacac

SEQ ID NO: 1496292 - RNA, 19 nt, Homo sapiens
ugauugaggagcugcacug

SEQ ID NO: 1496293 - RNA, 12 nt, Homo sapiens
ugauugcagcuu

SEQ ID NO: 1496294 - RNA, 13 nt, Homo sapiens
ugauugcugccau

SEQ ID NO: 1496295 - RNA, 17 nt, Homo sapiens
ugauugcuuaccuacau

SEQ ID NO: 1496296 - RNA, 14 nt, Homo sapiens
ugauuggugauuca

SEQ ID NO: 1496297 - RNA, 17 nt, Homo sapiens
ugauugucagcuacuaa

SEQ ID NO: 1496298 - RNA, 15 nt, Homo sapiens
ugauuuagguagccu

SEQ ID NO: 1496299 - RNA, 17 nt, Homo sapiens
ugauuucuguacaguca

SEQ ID NO: 1496300 - RNA, 18 nt, Homo sapiens
ugauuugcucuuugacaa

SEQ ID NO: 1496301 - RNA, 13 nt, Homo sapiens
ugauuugguggau

SEQ ID NO: 1496302 - RNA, 18 nt, Homo sapiens
ugauuugucccuaugcau

SEQ ID NO: 1496303 - RNA, 13 nt, Homo sapiens
ugauuuuacuuaa

SEQ ID NO: 1496304 - RNA, 14 nt, Homo sapiens
ugauuuuacuuaac

SEQ ID NO: 1496305 - RNA, 16 nt, Homo sapiens
ugauuuuaucugugaa

SEQ ID NO: 1496306 - RNA, 14 nt, Homo sapiens
ugauuuugugauau

SEQ ID NO: 1496307 - RNA, 15 nt, Homo sapiens
ugcaaaauacuguac

SEQ ID NO: 1496308 - RNA, 11 nt, Homo sapiens
ugcaaaaucac

SEQ ID NO: 1496309 - RNA, 17 nt, Homo sapiens
ugcaaacucagugcaaa

SEQ ID NO: 1496310 - RNA, 21 nt, Homo sapiens
ugcaaaggcgcagugcuucuc

SEQ ID NO: 1496311 - RNA, 13 nt, Homo sapiens
ugcaacagacugu

SEQ ID NO: 1496312 - RNA, 18 nt, Homo sapiens
ugcaacagcuacagucua

SEQ ID NO: 1496313 - RNA, 16 nt, Homo sapiens
ugcaaccaaacuccca

SEQ ID NO: 1496314 - RNA, 17 nt, Homo sapiens
ugcaaccucugccuccc

SEQ ID NO: 1496315 - RNA, 21 nt, Homo sapiens
ugcaacucaaggacuuugcag

SEQ ID NO: 1496316 - RNA, 15 nt, Homo sapiens
ugcaagagugacagu

SEQ ID NO: 1496317 - RNA, 12 nt, Homo sapiens
ugcaagccuguc

SEQ ID NO: 1496318 - RNA, 18 nt, Homo sapiens
ugcaagcgacgacagaug

SEQ ID NO: 1496319 - RNA, 16 nt, Homo sapiens
ugcaauagagacugua

SEQ ID NO: 1496320 - RNA, 19 nt, Homo sapiens
ugcaaucuucuacuuuaag

SEQ ID NO: 1496321 - RNA, 18 nt, Homo sapiens
ugcaaugggcacugggau

SEQ ID NO: 1496322 - RNA, 13 nt, Homo sapiens
ugcaaugucugag

SEQ ID NO: 1496323 - RNA, 21 nt, Homo sapiens
ugcacaaaagggacuuggaaa

SEQ ID NO: 1496324 - RNA, 13 nt, Homo sapiens
ugcacacugccug

SEQ ID NO: 1496325 - RNA, 11 nt, Homo sapiens
ugcacagaauu

SEQ ID NO: 1496326 - RNA, 18 nt, Homo sapiens
ugcacagcucaacggaag

SEQ ID NO: 1496327 - RNA, 23 nt, Homo sapiens
ugcacaggcagauguuugccuca

SEQ ID NO: 1496328 - RNA, 16 nt, Homo sapiens
ugcacaguagagcaaa

SEQ ID NO: 1496329 - RNA, 20 nt, Homo sapiens
ugcacaguugccacauuuag

SEQ ID NO: 1496330 - RNA, 21 nt, Homo sapiens
ugcaccaacgagcuguacaug

SEQ ID NO: 1496331 - RNA, 18 nt, Homo sapiens
ugcaccaggcacugcugc

SEQ ID NO: 1496332 - RNA, 14 nt, Homo sapiens
ugcaccgccucagg

SEQ ID NO: 1496333 - RNA, 15 nt, Homo sapiens
ugcaccuggauguac

SEQ ID NO: 1496334 - RNA, 18 nt, Homo sapiens
ugcaccuguaaagugccu

SEQ ID NO: 1496335 - RNA, 17 nt, Homo sapiens
ugcacguggccucuuga

SEQ ID NO: 1496336 - RNA, 21 nt, Homo sapiens
ugcacuccagccugggggaca

SEQ ID NO: 1496337 - RNA, 19 nt, Homo sapiens
ugcacuccagucuggcaac

SEQ ID NO: 1496338 - RNA, 17 nt, Homo sapiens
ugcacuguccugaccau

SEQ ID NO: 1496339 - RNA, 15 nt, Homo sapiens
ugcacugucugagaa

SEQ ID NO: 1496340 - RNA, 15 nt, Homo sapiens
ugcacuuguggcaac

SEQ ID NO: 1496341 - RNA, 19 nt, Homo sapiens
uugucagaaaccugcaggg

SEQ ID NO: 1496342 - RNA, 17 nt, Homo sapiens
uugucagcaauuuaacu

SEQ ID NO: 1496343 - RNA, 18 nt, Homo sapiens
uugucccuaugcauauca

SEQ ID NO: 1496344 - RNA, 20 nt, Homo sapiens
uugucgcuuucucagugugu

SEQ ID NO: 1496345 - RNA, 23 nt, Homo sapiens
uugucuaauuaaaacacuuucaa

SEQ ID NO: 1496346 - RNA, 19 nt, Homo sapiens
uugucuccuacuccugacu

SEQ ID NO: 1496347 - RNA, 21 nt, Homo sapiens
uugucuguuuguuucaagaac

SEQ ID NO: 1496348 - RNA, 17 nt, Homo sapiens
uugucuucaaacuguga

SEQ ID NO: 1496349 - RNA, 22 nt, Homo sapiens
uugucuuuaaauagauacaaau

SEQ ID NO: 1496350 - RNA, 19 nt, Homo sapiens
uugugaugaugcugugaca

SEQ ID NO: 1496351 - RNA, 20 nt, Homo sapiens
uugugaugaugcugugacaa

SEQ ID NO: 1496352 - RNA, 20 nt, Homo sapiens
uugugauuuuuauaauacaa

SEQ ID NO: 1496353 - RNA, 15 nt, Homo sapiens
uugugcaaagccaaa

SEQ ID NO: 1496354 - RNA, 16 nt, Homo sapiens
uugugcugccauuuga

SEQ ID NO: 1496355 - RNA, 20 nt, Homo sapiens
uugugcugugggcagcaccc

SEQ ID NO: 1496356 - RNA, 15 nt, Homo sapiens
uugugggauacuauu

SEQ ID NO: 1496357 - RNA, 18 nt, Homo sapiens
uuguuacauuauguggaa

SEQ ID NO: 1496358 - RNA, 17 nt, Homo sapiens
uuguucaaagcacagaa

SEQ ID NO: 1496359 - RNA, 16 nt, Homo sapiens
uuguucaguaugcaaa

SEQ ID NO: 1496360 - RNA, 20 nt, Homo sapiens
uuguucauuauuggagggua

SEQ ID NO: 1496361 - RNA, 16 nt, Homo sapiens
uuguuccccacugaca

SEQ ID NO: 1496362 - RNA, 17 nt, Homo sapiens
uuguucgggugugcaau

SEQ ID NO: 1496363 - RNA, 19 nt, Homo sapiens
uuguucuccucguccauca

SEQ ID NO: 1496364 - RNA, 22 nt, Homo sapiens
uuguucugacuuuuuguuucuu

SEQ ID NO: 1496365 - RNA, 21 nt, Homo sapiens
uuucuaguuucuugugggcua

SEQ ID NO: 1496366 - RNA, 15 nt, Homo sapiens
uuucuauuauggaaa

SEQ ID NO: 1496367 - RNA, 13 nt, Homo sapiens
uuucucaugaagc

SEQ ID NO: 1496368 - RNA, 15 nt, Homo sapiens
uuucuccauaucaaa

SEQ ID NO: 1496369 - RNA, 19 nt, Homo sapiens
uuucucuguuguaagaaua

SEQ ID NO: 1496370 - RNA, 22 nt, Homo sapiens
uuucugauaacagaauugccaa

SEQ ID NO: 1496371 - RNA, 22 nt, Homo sapiens
uuucugcuaaaaaguccuugau

SEQ ID NO: 1496372 - RNA, 22 nt, Homo sapiens
uuucugggagcagaaacagcca

SEQ ID NO: 1496373 - RNA, 22 nt, Homo sapiens
uuucugggggaaaaagccauau

SEQ ID NO: 1496374 - RNA, 23 nt, Homo sapiens
uuucuuaguguuguggacacugc

SEQ ID NO: 1496375 - RNA, 21 nt, Homo sapiens
uuucuuccaaagcacauugaa

SEQ ID NO: 1496376 - RNA, 12 nt, Homo sapiens
uuucuuccugca

SEQ ID NO: 1496377 - RNA, 15 nt, Homo sapiens
uuucuucuuaaccua

SEQ ID NO: 1496378 - RNA, 13 nt, Homo sapiens
uuucuuucugcca

SEQ ID NO: 1496379 - RNA, 17 nt, Homo sapiens
uuucuuuuuuauacuca

SEQ ID NO: 1496380 - RNA, 17 nt, Homo sapiens
uuugaaaagucacuuac

SEQ ID NO: 1496381 - RNA, 20 nt, Homo sapiens
uuugaaauagucugugugaa

SEQ ID NO: 1496382 - RNA, 20 nt, Homo sapiens
uuugaaaucaaugcaagagu

SEQ ID NO: 1496383 - RNA, 23 nt, Homo sapiens
uuugaaccauccacuuacauaua

SEQ ID NO: 1496384 - RNA, 18 nt, Homo sapiens
uuugaagcaucacauaaa

SEQ ID NO: 1496385 - RNA, 22 nt, Homo sapiens
uuugaauagccuguuccuuuaa

SEQ ID NO: 1496386 - RNA, 21 nt, Homo sapiens
uuugaauguuaagcagaugga

SEQ ID NO: 1496387 - RNA, 23 nt, Homo sapiens
uuugaauuucaguaaacaaugaa

SEQ ID NO: 1496388 - RNA, 16 nt, Homo sapiens
uuugacucaguuccag

SEQ ID NO: 1496389 - RNA, 15 nt, Homo sapiens
uuugacucuggcaaa

SEQ ID NO: 1496390 - RNA, 13 nt, Homo sapiens
uuugagaauguuu

SEQ ID NO: 1496391 - RNA, 19 nt, Homo sapiens
uuugagaucaucagugaua

SEQ ID NO: 1496392 - RNA, 15 nt, Homo sapiens
uuugaguugaauuua

SEQ ID NO: 1496393 - RNA, 20 nt, Homo sapiens
uuugauacucccagucuugu

SEQ ID NO: 1496394 - RNA, 13 nt, Homo sapiens
uuugauagcacuu

SEQ ID NO: 1496395 - RNA, 20 nt, Homo sapiens
uuugaugauuaauucaccuu

SEQ ID NO: 1496396 - RNA, 14 nt, Homo sapiens
uuugauguuuacag

SEQ ID NO: 1496397 - RNA, 14 nt, Homo sapiens
uuugauugauuuga

SEQ ID NO: 1496398 - RNA, 15 nt, Homo sapiens
uuugauuuacauaua

SEQ ID NO: 1496399 - RNA, 14 nt, Homo sapiens
uuugcaaugucaca

SEQ ID NO: 1496400 - RNA, 14 nt, Homo sapiens
uuugcacacugcac

SEQ ID NO: 1496401 - RNA, 21 nt, Homo sapiens
uuugcaggguccucuucuggg

SEQ ID NO: 1496402 - RNA, 17 nt, Homo sapiens
uuugcauaugagccgug

SEQ ID NO: 1496403 - RNA, 19 nt, Homo sapiens
uuugcauuaaauucacaaa

SEQ ID NO: 1496404 - RNA, 15 nt, Homo sapiens
uuugccucauaauag

SEQ ID NO: 1496405 - RNA, 15 nt, Homo sapiens
uuugcuagcagaaau

SEQ ID NO: 1496406 - RNA, 18 nt, Homo sapiens
uuugcuagcagaaaucua

SEQ ID NO: 1496407 - RNA, 17 nt, Homo sapiens
uuugcuaucacacagug

SEQ ID NO: 1496408 - RNA, 17 nt, Homo sapiens
uuuggacuguaacugac

SEQ ID NO: 1496409 - RNA, 20 nt, Homo sapiens
uuuggagauagucucauucu

SEQ ID NO: 1496410 - RNA, 17 nt, Homo sapiens
uuuggaugaccagaaca

SEQ ID NO: 1496411 - RNA, 15 nt, Homo sapiens
uuuggauuguaucaa

SEQ ID NO: 1496412 - RNA, 19 nt, Homo sapiens
uuuggcuagguaucauuca

SEQ ID NO: 1496413 - RNA, 18 nt, Homo sapiens
uuuggcuggaauuacaaa

SEQ ID NO: 1496414 - RNA, 11 nt, Homo sapiens
uuugggagaca

SEQ ID NO: 1496415 - RNA, 19 nt, Homo sapiens
uuugggagggaaaagggaa

SEQ ID NO: 1496416 - RNA, 20 nt, Homo sapiens
uuugggcucccaaaacaccu

SEQ ID NO: 1496417 - RNA, 17 nt, Homo sapiens
uuuggggacucauuuca

SEQ ID NO: 1496418 - RNA, 12 nt, Homo sapiens
uuuggggagcag

SEQ ID NO: 1496419 - RNA, 15 nt, Homo sapiens
uuuggggagcagaga

SEQ ID NO: 1496420 - RNA, 21 nt, Homo sapiens
uuuggggagcaggaggccaau

SEQ ID NO: 1496421 - RNA, 12 nt, Homo sapiens
uuuggguauuaa

SEQ ID NO: 1496422 - RNA, 23 nt, Homo sapiens
uuugguaguggaauagugaauac

SEQ ID NO: 1496423 - RNA, 13 nt, Homo sapiens
uuugguccuugaa

SEQ ID NO: 1496424 - RNA, 18 nt, Homo sapiens
uuugguucucuccaggaa

SEQ ID NO: 1496425 - RNA, 18 nt, Homo sapiens
uuugguuuaccuggggau

SEQ ID NO: 1496426 - RNA, 14 nt, Homo sapiens
uuuguaaugcugca

SEQ ID NO: 1496427 - RNA, 16 nt, Homo sapiens
uuuguaaugcugcaca

SEQ ID NO: 1496428 - RNA, 14 nt, Homo sapiens
uuuguaauugcuua

SEQ ID NO: 1496429 - RNA, 14 nt, Homo sapiens
uuuguagcacugag

SEQ ID NO: 1496430 - RNA, 21 nt, Homo sapiens
uuugucauauaagauucauau

SEQ ID NO: 1496431 - RNA, 13 nt, Homo sapiens
uuugucucagaag

SEQ ID NO: 1496432 - RNA, 15 nt, Homo sapiens
uuugucuuauauaua

SEQ ID NO: 1496433 - RNA, 21 nt, Homo sapiens
uuugugauucccuccagugaa

SEQ ID NO: 1496434 - RNA, 22 nt, Homo sapiens
uuugugcagagauaaagaccuu

SEQ ID NO: 1496435 - RNA, 21 nt, Homo sapiens
uuuguguaucguaaccagcca

SEQ ID NO: 1496436 - RNA, 14 nt, Homo sapiens
uuuguguauucuuc

SEQ ID NO: 1496437 - RNA, 18 nt, Homo sapiens
uuugugucaaaaggacau

SEQ ID NO: 1496438 - RNA, 21 nt, Homo sapiens
uuuguucuccggguguggccu

SEQ ID NO: 1496439 - RNA, 15 nt, Homo sapiens
uuuguugccaugugc

SEQ ID NO: 1496440 - RNA, 14 nt, Homo sapiens
uuuuaaacuuugau

SEQ ID NO: 1496441 - RNA, 21 nt, Homo sapiens
uuuuaaagcauauuggugcua

SEQ ID NO: 1496442 - RNA, 17 nt, Homo sapiens
uuuuaaaucaaguauuu

SEQ ID NO: 1496443 - RNA, 14 nt, Homo sapiens
ugcuucaucauucc

SEQ ID NO: 1496444 - RNA, 22 nt, Homo sapiens
ugcuucuaagaugccagcauau

SEQ ID NO: 1496445 - RNA, 12 nt, Homo sapiens
ugcuucucucac

SEQ ID NO: 1496446 - RNA, 13 nt, Homo sapiens
ugcuucugcacac

SEQ ID NO: 1496447 - RNA, 18 nt, Homo sapiens
ugcuucugcacacaaaac

SEQ ID NO: 1496448 - RNA, 17 nt, Homo sapiens
ugcuugaaaccaaagau

SEQ ID NO: 1496449 - RNA, 18 nt, Homo sapiens
ugcuugaacccaagaggu

SEQ ID NO: 1496450 - RNA, 21 nt, Homo sapiens
ugcuugaacccagaaggcaga

SEQ ID NO: 1496451 - RNA, 14 nt, Homo sapiens
ugcuuggugcuggu

SEQ ID NO: 1496452 - RNA, 17 nt, Homo sapiens
ugcuuguugcauuucca

SEQ ID NO: 1496453 - RNA, 16 nt, Homo sapiens
ugcuuuagaaguaaca

SEQ ID NO: 1496454 - RNA, 14 nt, Homo sapiens
ugcuuuaggcucac

SEQ ID NO: 1496455 - RNA, 13 nt, Homo sapiens
ugcuuucuguucc

SEQ ID NO: 1496456 - RNA, 17 nt, Homo sapiens
ugcuuugaaacuugccu

SEQ ID NO: 1496457 - RNA, 13 nt, Homo sapiens
ugcuuugccucua

SEQ ID NO: 1496458 - RNA, 16 nt, Homo sapiens
ugcuuuggcugagggg

SEQ ID NO: 1496459 - RNA, 14 nt, Homo sapiens
ugcuuuucuguccu

SEQ ID NO: 1496460 - RNA, 19 nt, Homo sapiens
ugcuuuugggagacuggaa

SEQ ID NO: 1496461 - RNA, 19 nt, Homo sapiens
uggaaaaaugguugaugga

SEQ ID NO: 1496462 - RNA, 19 nt, Homo sapiens
uggaaaaccuccuuuacca

SEQ ID NO: 1496463 - RNA, 17 nt, Homo sapiens
uggaaacaaaaauguac

SEQ ID NO: 1496464 - RNA, 12 nt, Homo sapiens
uggaaaccuguc

SEQ ID NO: 1496465 - RNA, 14 nt, Homo sapiens
uggaaacguauuca

SEQ ID NO: 1496466 - RNA, 13 nt, Homo sapiens
uggaaacuaagac

SEQ ID NO: 1496467 - RNA, 17 nt, Homo sapiens
uggaaagaaaaagcaau

SEQ ID NO: 1496468 - RNA, 16 nt, Homo sapiens
uggaaagaaagaccau

SEQ ID NO: 1496469 - RNA, 16 nt, Homo sapiens
uggaaauacacuguua

SEQ ID NO: 1496470 - RNA, 21 nt, Homo sapiens
uggaaauagaaagaagccaua

SEQ ID NO: 1496471 - RNA, 19 nt, Homo sapiens
uggaacaacugauacuuca

SEQ ID NO: 1496472 - RNA, 14 nt, Homo sapiens
uggaacaagcacag

SEQ ID NO: 1496473 - RNA, 18 nt, Homo sapiens
uggaacauauagaaugca

SEQ ID NO: 1496474 - RNA, 18 nt, Homo sapiens
uggaacauuggaauguuc

SEQ ID NO: 1496475 - RNA, 17 nt, Homo sapiens
uggaacuacauuacugu

SEQ ID NO: 1496476 - RNA, 19 nt, Homo sapiens
ugcuacccaugacuuuaua

SEQ ID NO: 1496477 - RNA, 20 nt, Homo sapiens
ugcuacccugaguucaucca

SEQ ID NO: 1496478 - RNA, 18 nt, Homo sapiens
ugcuagaaaaauguucuu

SEQ ID NO: 1496479 - RNA, 17 nt, Homo sapiens
ugcuagagguugcagca

SEQ ID NO: 1496480 - RNA, 22 nt, Homo sapiens
ugcuagcaaauggcagaaccaa

SEQ ID NO: 1496481 - RNA, 14 nt, Homo sapiens
ugcuaggucucgga

SEQ ID NO: 1496482 - RNA, 22 nt, Homo sapiens
ugcuaucuggaggccuuccagc

SEQ ID NO: 1496483 - RNA, 13 nt, Homo sapiens
ugcuaugcuauug

SEQ ID NO: 1496484 - RNA, 16 nt, Homo sapiens
ugcuauugacaaguca

SEQ ID NO: 1496485 - RNA, 16 nt, Homo sapiens
ugcucacaguccucau

SEQ ID NO: 1496486 - RNA, 12 nt, Homo sapiens
ugcucaccagcc

SEQ ID NO: 1496487 - RNA, 17 nt, Homo sapiens
ugcucagcaugauucuu

SEQ ID NO: 1496488 - RNA, 15 nt, Homo sapiens
ugcucagccaagcuu

SEQ ID NO: 1496489 - RNA, 13 nt, Homo sapiens
ugcucagcuccua

SEQ ID NO: 1496490 - RNA, 19 nt, Homo sapiens
ugcucagcuccuaccucug

SEQ ID NO: 1496491 - RNA, 19 nt, Homo sapiens
ugcucaggagccaccagca

SEQ ID NO: 1496492 - RNA, 20 nt, Homo sapiens
ugcucaggcuugaaaugcau

SEQ ID NO: 1496493 - RNA, 22 nt, Homo sapiens
ugcucagugggggcagagccac

SEQ ID NO: 1496494 - RNA, 14 nt, Homo sapiens
ugcucccacagaac

SEQ ID NO: 1496495 - RNA, 15 nt, Homo sapiens
ugcucccagccugcu

SEQ ID NO: 1496496 - RNA, 18 nt, Homo sapiens
ugcucccccugguggugg

SEQ ID NO: 1496497 - RNA, 17 nt, Homo sapiens
ugcuccuggagccuuug

SEQ ID NO: 1496498 - RNA, 19 nt, Homo sapiens
ugcuccuuggcuuaccuga

SEQ ID NO: 1496499 - RNA, 20 nt, Homo sapiens
ugcucugaacuggaugauac

SEQ ID NO: 1496500 - RNA, 16 nt, Homo sapiens
ugcucugcaagcagaa

SEQ ID NO: 1496501 - RNA, 13 nt, Homo sapiens
ugcucugccucag

SEQ ID NO: 1496502 - RNA, 18 nt, Homo sapiens
ugcucuggaaaaugugac

SEQ ID NO: 1496503 - RNA, 16 nt, Homo sapiens
ugcucuuggcugaccc

SEQ ID NO: 1496504 - RNA, 13 nt, Homo sapiens
ugcugaacagugg

SEQ ID NO: 1496505 - RNA, 20 nt, Homo sapiens
ugcugaagaggguugguaua

SEQ ID NO: 1496506 - RNA, 13 nt, Homo sapiens
ugcugaaugcagg

SEQ ID NO: 1496507 - RNA, 18 nt, Homo sapiens
ugcugaccaaaugccugg

SEQ ID NO: 1496508 - RNA, 14 nt, Homo sapiens
ugcugaccaauugu

SEQ ID NO: 1496509 - RNA, 19 nt, Homo sapiens
ugcugagagaaauauggaa

SEQ ID NO: 1496510 - RNA, 22 nt, Homo sapiens
ugcugcagauuugauauuugca

SEQ ID NO: 1496511 - RNA, 21 nt, Homo sapiens
ugcugccagccacuucauccc

SEQ ID NO: 1496512 - RNA, 14 nt, Homo sapiens
ugcugccauuugau

SEQ ID NO: 1496513 - RNA, 11 nt, Homo sapiens
ugcugccuuaa

SEQ ID NO: 1496514 - RNA, 16 nt, Homo sapiens
ugcugcuccagugcag

SEQ ID NO: 1496515 - RNA, 19 nt, Homo sapiens
ugcugcugagugcaccacu

SEQ ID NO: 1496516 - RNA, 23 nt, Homo sapiens
ugcugcugagugcaccacuucaa

SEQ ID NO: 1496517 - RNA, 23 nt, Homo sapiens
ugcugcugcgcccuuaccuuccc

SEQ ID NO: 1496518 - RNA, 17 nt, Homo sapiens
ugcugcuggaucacagc

SEQ ID NO: 1496519 - RNA, 17 nt, Homo sapiens
ugcugcuggggucauuu

SEQ ID NO: 1496520 - RNA, 15 nt, Homo sapiens
ugcuggaagcccagc

SEQ ID NO: 1496521 - RNA, 18 nt, Homo sapiens
ugcuggaagucuccauga

SEQ ID NO: 1496522 - RNA, 16 nt, Homo sapiens
ugcuggaauuccuaac

SEQ ID NO: 1496523 - RNA, 20 nt, Homo sapiens
ugcuggacgccgagaaggcc

SEQ ID NO: 1496524 - RNA, 19 nt, Homo sapiens
ugcuggacuugccuaaaau

SEQ ID NO: 1496525 - RNA, 15 nt, Homo sapiens
ugcuggaucacagcu

SEQ ID NO: 1496526 - RNA, 13 nt, Homo sapiens
ugcuggcauuugc

SEQ ID NO: 1496527 - RNA, 14 nt, Homo sapiens
ugcuggcauuugca

SEQ ID NO: 1496528 - RNA, 15 nt, Homo sapiens
ugcuggcauuugcac

SEQ ID NO: 1496529 - RNA, 19 nt, Homo sapiens
ugcuggcccauaaacaccc

SEQ ID NO: 1496530 - RNA, 18 nt, Homo sapiens
ugcugggcugagugacac

SEQ ID NO: 1496531 - RNA, 23 nt, Homo sapiens
ugcuggucccggggccagcacuu

SEQ ID NO: 1496532 - RNA, 18 nt, Homo sapiens
ugcuggugagaggugcaa

SEQ ID NO: 1496533 - RNA, 15 nt, Homo sapiens
ugcuguccugaucug

SEQ ID NO: 1496534 - RNA, 19 nt, Homo sapiens
ugcuguugggauauaguca

SEQ ID NO: 1496535 - RNA, 13 nt, Homo sapiens
ugcuuaaauucaa

SEQ ID NO: 1496536 - RNA, 21 nt, Homo sapiens
ugcuuaauaaauuguguuucc

SEQ ID NO: 1496537 - RNA, 12 nt, Homo sapiens
ugcuuaauucaa

SEQ ID NO: 1496538 - RNA, 14 nt, Homo sapiens
ugcuuaguaucuca

SEQ ID NO: 1496539 - RNA, 15 nt, Homo sapiens
ugcuuaguaucucau

SEQ ID NO: 1496540 - RNA, 18 nt, Homo sapiens
ugcuuaguguacuuggag

SEQ ID NO: 1496541 - RNA, 16 nt, Homo sapiens
ugcuuaugguugauca

SEQ ID NO: 1496542 - RNA, 19 nt, Homo sapiens
ugcuuauuguuccaagaca

SEQ ID NO: 1496543 - RNA, 17 nt, Homo sapiens
ugcuucaguacuuguga

SEQ ID NO: 1496544 - RNA, 21 nt, Homo sapiens
ugcuucauaaaugaagcagcu

SEQ ID NO: 1496545 - RNA, 23 nt, Homo sapiens
uccauggccuuucuaauaaacug

SEQ ID NO: 1496546 - RNA, 17 nt, Homo sapiens
uccauggugucaugcca

SEQ ID NO: 1496547 - RNA, 13 nt, Homo sapiens
uccauguacugua

SEQ ID NO: 1496548 - RNA, 12 nt, Homo sapiens
uccauguacuug

SEQ ID NO: 1496549 - RNA, 22 nt, Homo sapiens
uccaugugccuuucuuugccuc

SEQ ID NO: 1496550 - RNA, 16 nt, Homo sapiens
uccauguuugcaaugc

SEQ ID NO: 1496551 - RNA, 13 nt, Homo sapiens
uccauuaucuuau

SEQ ID NO: 1496552 - RNA, 14 nt, Homo sapiens
uccauuauuuauau

SEQ ID NO: 1496553 - RNA, 16 nt, Homo sapiens
uccauucauccuucca

SEQ ID NO: 1496554 - RNA, 18 nt, Homo sapiens
uccauuccccacuucucu

SEQ ID NO: 1496555 - RNA, 19 nt, Homo sapiens
uccauuuuggugucuuucu

SEQ ID NO: 1496556 - RNA, 20 nt, Homo sapiens
ucccaaaagauugcugaaaa

SEQ ID NO: 1496557 - RNA, 15 nt, Homo sapiens
ucccaaaccagacac

SEQ ID NO: 1496558 - RNA, 15 nt, Homo sapiens
ucccaaagugcuagu

SEQ ID NO: 1496559 - RNA, 20 nt, Homo sapiens
ucccaaagugcugggauuac

SEQ ID NO: 1496560 - RNA, 17 nt, Homo sapiens
ucccaacguuuuacaua

SEQ ID NO: 1496561 - RNA, 19 nt, Homo sapiens
ucccaacuucauacuggca

SEQ ID NO: 1496562 - RNA, 21 nt, Homo sapiens
ucccaacuuguauuaaagaca

SEQ ID NO: 1496563 - RNA, 21 nt, Homo sapiens
ucccaauccuuaucccaagcu

SEQ ID NO: 1496564 - RNA, 15 nt, Homo sapiens
ucccaaucggccuua

SEQ ID NO: 1496565 - RNA, 20 nt, Homo sapiens
ucccaauuagcuuggccuac

SEQ ID NO: 1496566 - RNA, 13 nt, Homo sapiens
ucccacacaggcu

SEQ ID NO: 1496567 - RNA, 20 nt, Homo sapiens
ucccacaugaggccaucuca

SEQ ID NO: 1496568 - RNA, 15 nt, Homo sapiens
ucccaccgaacacua

SEQ ID NO: 1496569 - RNA, 14 nt, Homo sapiens
ucccaccugcacac

SEQ ID NO: 1496570 - RNA, 17 nt, Homo sapiens
ucccacucaggugaaaa

SEQ ID NO: 1496571 - RNA, 17 nt, Homo sapiens
ucccagauuucaggaaa

SEQ ID NO: 1496572 - RNA, 17 nt, Homo sapiens
ucccagcagcccaagcu

SEQ ID NO: 1496573 - RNA, 16 nt, Homo sapiens
ucccagcuacucggga

SEQ ID NO: 1496574 - RNA, 13 nt, Homo sapiens
ucccaggccaggc

SEQ ID NO: 1496575 - RNA, 15 nt, Homo sapiens
ucccaggcucaagcu

SEQ ID NO: 1496576 - RNA, 17 nt, Homo sapiens
ucccaguccuccagacc

SEQ ID NO: 1496577 - RNA, 22 nt, Homo sapiens
ucccaucacuucccuacaugga

SEQ ID NO: 1496578 - RNA, 20 nt, Homo sapiens
ucccauccccuggacuggga

SEQ ID NO: 1496579 - RNA, 17 nt, Homo sapiens
ucccauccuugaugcaa

SEQ ID NO: 1496580 - RNA, 13 nt, Homo sapiens
ucccaucugugaa

SEQ ID NO: 1496581 - RNA, 19 nt, Homo sapiens
uccccaacaagauugcuua

SEQ ID NO: 1496582 - RNA, 15 nt, Homo sapiens
uccccaaccacagag

SEQ ID NO: 1496583 - RNA, 17 nt, Homo sapiens
uccccaaggaagagcca

SEQ ID NO: 1496584 - RNA, 16 nt, Homo sapiens
uccccacccagucuca

SEQ ID NO: 1496585 - RNA, 17 nt, Homo sapiens
uccccacccagucucau

SEQ ID NO: 1496586 - RNA, 16 nt, Homo sapiens
uccccacccugaacaa

SEQ ID NO: 1496587 - RNA, 23 nt, Homo sapiens
uccccacgagggcuggcuggccu

SEQ ID NO: 1496588 - RNA, 16 nt, Homo sapiens
uccccagucccagaca

SEQ ID NO: 1496589 - RNA, 16 nt, Homo sapiens
uccccauaacucaaug

SEQ ID NO: 1496590 - RNA, 15 nt, Homo sapiens
uccccauaggccauu

SEQ ID NO: 1496591 - RNA, 18 nt, Homo sapiens
uccccauccccaccagcu

SEQ ID NO: 1496592 - RNA, 23 nt, Homo sapiens
ucccccaccagcuaaggacauuu

SEQ ID NO: 1496593 - RNA, 22 nt, Homo sapiens
ucccccuaaaccccugucccau

SEQ ID NO: 1496594 - RNA, 15 nt, Homo sapiens
ucccccugcaacuuc

SEQ ID NO: 1496595 - RNA, 22 nt, Homo sapiens
ucccccuggggcacuugcugag

SEQ ID NO: 1496596 - RNA, 23 nt, Homo sapiens
uccccgauugaaagaaccagaga

SEQ ID NO: 1496597 - RNA, 15 nt, Homo sapiens
uccccggacauacuc

SEQ ID NO: 1496598 - RNA, 16 nt, Homo sapiens
uccccggacauacucu

SEQ ID NO: 1496599 - RNA, 14 nt, Homo sapiens
uccccucaccuccu

SEQ ID NO: 1496600 - RNA, 13 nt, Homo sapiens
uccccuccacugu

SEQ ID NO: 1496601 - RNA, 19 nt, Homo sapiens
uccccucccuggcucccau

SEQ ID NO: 1496602 - RNA, 21 nt, Homo sapiens
uccccuuuggcuaccugaugg

SEQ ID NO: 1496603 - RNA, 14 nt, Homo sapiens
ucccgaugcugcua

SEQ ID NO: 1496604 - RNA, 16 nt, Homo sapiens
ucccgaugcugcuaug

SEQ ID NO: 1496605 - RNA, 22 nt, Homo sapiens
ucccgcccuuccaugugccuuu

SEQ ID NO: 1496606 - RNA, 19 nt, Homo sapiens
ucccggcgucccuaccucc

SEQ ID NO: 1496607 - RNA, 19 nt, Homo sapiens
ucccgggcuuaccagguga

SEQ ID NO: 1496608 - RNA, 14 nt, Homo sapiens
ucauucauucacuc

SEQ ID NO: 1496609 - RNA, 17 nt, Homo sapiens
ucauucccucucaucuc

SEQ ID NO: 1496610 - RNA, 15 nt, Homo sapiens
ucauuccuaacacag

SEQ ID NO: 1496611 - RNA, 20 nt, Homo sapiens
ucauuccuaacacagcaugu

SEQ ID NO: 1496612 - RNA, 12 nt, Homo sapiens
ucauucuaucaa

SEQ ID NO: 1496613 - RNA, 11 nt, Homo sapiens
ucauugcugag

SEQ ID NO: 1496614 - RNA, 17 nt, Homo sapiens
ucauugcugagccucug

SEQ ID NO: 1496615 - RNA, 17 nt, Homo sapiens
ucauuggcuauaaccuc

SEQ ID NO: 1496616 - RNA, 21 nt, Homo sapiens
ucauuuaagggaguuacaucu

SEQ ID NO: 1496617 - RNA, 23 nt, Homo sapiens
ucauuuuaacuuuaucacauuau

SEQ ID NO: 1496618 - RNA, 14 nt, Homo sapiens
ucauuuuguugcuu

SEQ ID NO: 1496619 - RNA, 21 nt, Homo sapiens
uccaaaaauagcccugcaaaa

SEQ ID NO: 1496620 - RNA, 22 nt, Homo sapiens
uccaaaaauuauuauaagcauu

SEQ ID NO: 1496621 - RNA, 21 nt, Homo sapiens
uccaaaacuuuaaugaacuaa

SEQ ID NO: 1496622 - RNA, 20 nt, Homo sapiens
uccaaagcacauugaaagag

SEQ ID NO: 1496623 - RNA, 17 nt, Homo sapiens
uccaaagccggcuugau

SEQ ID NO: 1496624 - RNA, 17 nt, Homo sapiens
uccaaaggaaucuccag

SEQ ID NO: 1496625 - RNA, 19 nt, Homo sapiens
uccaaaggcauaagacccu

SEQ ID NO: 1496626 - RNA, 14 nt, Homo sapiens
uccaaaguuaucca

SEQ ID NO: 1496627 - RNA, 19 nt, Homo sapiens
uccaaauaacaaguaccaa

SEQ ID NO: 1496628 - RNA, 15 nt, Homo sapiens
uccaaauguccucca

SEQ ID NO: 1496629 - RNA, 17 nt, Homo sapiens
uccaacaccacagacac

SEQ ID NO: 1496630 - RNA, 21 nt, Homo sapiens
uccaaccaggaguaccuggac

SEQ ID NO: 1496631 - RNA, 13 nt, Homo sapiens
uccaacccgggga

SEQ ID NO: 1496632 - RNA, 15 nt, Homo sapiens
uccaaccuucccaaa

SEQ ID NO: 1496633 - RNA, 18 nt, Homo sapiens
uccaacucuugguauuac

SEQ ID NO: 1496634 - RNA, 21 nt, Homo sapiens
uccaagaaggccuucauggcc

SEQ ID NO: 1496635 - RNA, 18 nt, Homo sapiens
uccaaggaguuccaugaa

SEQ ID NO: 1496636 - RNA, 21 nt, Homo sapiens
uccaagggacccuuugccuuu

SEQ ID NO: 1496637 - RNA, 22 nt, Homo sapiens
uccaaguaagaguacugggaga

SEQ ID NO: 1496638 - RNA, 14 nt, Homo sapiens
uccaagucuucuca

SEQ ID NO: 1496639 - RNA, 11 nt, Homo sapiens
uccaaugcaca

SEQ ID NO: 1496640 - RNA, 11 nt, Homo sapiens
uccaaugucaa

SEQ ID NO: 1496641 - RNA, 21 nt, Homo sapiens
uccaaugucugcugaggaguu

SEQ ID NO: 1496642 - RNA, 19 nt, Homo sapiens
uccaauuugacaaaaccca

SEQ ID NO: 1496643 - RNA, 17 nt, Homo sapiens
uccacaaaaucugucca

SEQ ID NO: 1496644 - RNA, 11 nt, Homo sapiens
uccacaaggaa

SEQ ID NO: 1496645 - RNA, 14 nt, Homo sapiens
uccacacacacaaa

SEQ ID NO: 1496646 - RNA, 17 nt, Homo sapiens
uccacaccuuuuauuga

SEQ ID NO: 1496647 - RNA, 15 nt, Homo sapiens
uccaccuagacugua

SEQ ID NO: 1496648 - RNA, 20 nt, Homo sapiens
uccaccucccaacacuguca

SEQ ID NO: 1496649 - RNA, 16 nt, Homo sapiens
uccaccuuccaaagga

SEQ ID NO: 1496650 - RNA, 14 nt, Homo sapiens
uccacgaagccuua

SEQ ID NO: 1496651 - RNA, 17 nt, Homo sapiens
uccacgucaacagaauu

SEQ ID NO: 1496652 - RNA, 20 nt, Homo sapiens
uccacuaggguccaccagga

SEQ ID NO: 1496653 - RNA, 22 nt, Homo sapiens
uccacucagcuguccugcagca

SEQ ID NO: 1496654 - RNA, 17 nt, Homo sapiens
uccacucuacccuccca

SEQ ID NO: 1496655 - RNA, 13 nt, Homo sapiens
uccacuucuuccu

SEQ ID NO: 1496656 - RNA, 19 nt, Homo sapiens
uccacuucuuguuccccac

SEQ ID NO: 1496657 - RNA, 14 nt, Homo sapiens
uccagaacucuucc

SEQ ID NO: 1496658 - RNA, 15 nt, Homo sapiens
uccagaagaucugaa

SEQ ID NO: 1496659 - RNA, 12 nt, Homo sapiens
uccagaauucac

SEQ ID NO: 1496660 - RNA, 13 nt, Homo sapiens
uccagacacuuaa

SEQ ID NO: 1496661 - RNA, 19 nt, Homo sapiens
uccagagagcuuaaauugu

SEQ ID NO: 1496662 - RNA, 14 nt, Homo sapiens
uccagagaugguca

SEQ ID NO: 1496663 - RNA, 16 nt, Homo sapiens
uccagagcugccagug

SEQ ID NO: 1496664 - RNA, 22 nt, Homo sapiens
uccagagguauuccucucuuaa

SEQ ID NO: 1496665 - RNA, 17 nt, Homo sapiens
uccagaugcagggcagu

SEQ ID NO: 1496666 - RNA, 22 nt, Homo sapiens
uccagcacaccugccgucuuca

SEQ ID NO: 1496667 - RNA, 18 nt, Homo sapiens
uccagcacagaaggaauc

SEQ ID NO: 1496668 - RNA, 19 nt, Homo sapiens
uccagcaguguugcucagc

SEQ ID NO: 1496669 - RNA, 10 nt, Homo sapiens
uccagccaca

SEQ ID NO: 1496670 - RNA, 19 nt, Homo sapiens
uccagcccaucuccgggga

SEQ ID NO: 1496671 - RNA, 12 nt, Homo sapiens
gugccuucugcc

SEQ ID NO: 1496672 - RNA, 19 nt, Homo sapiens
gugcgcgccaccgugccug

SEQ ID NO: 1496673 - RNA, 15 nt, Homo sapiens
gugcuagaugugcaa

SEQ ID NO: 1496674 - RNA, 18 nt, Homo sapiens
gugcuauaggcuggagaa

SEQ ID NO: 1496675 - RNA, 22 nt, Homo sapiens
gugcucuacaccuuagugcagc

SEQ ID NO: 1496676 - RNA, 24 nt, Homo sapiens
gugcucugccucagacguugccug

SEQ ID NO: 1496677 - RNA, 20 nt, Homo sapiens
gugcucuuugcugcacuauu

SEQ ID NO: 1496678 - RNA, 18 nt, Homo sapiens
gugcugaaggaauggaag

SEQ ID NO: 1496679 - RNA, 12 nt, Homo sapiens
gugcugcaccug

SEQ ID NO: 1496680 - RNA, 13 nt, Homo sapiens
gugcugcuuuaau

SEQ ID NO: 1496681 - RNA, 20 nt, Homo sapiens
gugcuucgagugacugaccc

SEQ ID NO: 1496682 - RNA, 16 nt, Homo sapiens
gugcuugucauuccag

SEQ ID NO: 1496683 - RNA, 22 nt, Homo sapiens
guggaaagaaagaccaucuccc

SEQ ID NO: 1496684 - RNA, 15 nt, Homo sapiens
guggaacucagucau

SEQ ID NO: 1496685 - RNA, 18 nt, Homo sapiens
guggaacucagucauuag

SEQ ID NO: 1496686 - RNA, 12 nt, Homo sapiens
guggaaugagug

SEQ ID NO: 1496687 - RNA, 16 nt, Homo sapiens
guggaaugagugugca

SEQ ID NO: 1496688 - RNA, 17 nt, Homo sapiens
guggacaguccccaccu

SEQ ID NO: 1496689 - RNA, 16 nt, Homo sapiens
guggauaacuuuacag

SEQ ID NO: 1496690 - RNA, 21 nt, Homo sapiens
guggauccucaaacaacacug

SEQ ID NO: 1496691 - RNA, 20 nt, Homo sapiens
guggaucuugccacauuucu

SEQ ID NO: 1496692 - RNA, 20 nt, Homo sapiens
guggcacucaacucugagcc

SEQ ID NO: 1496693 - RNA, 14 nt, Homo sapiens
guggcaugugcugu

SEQ ID NO: 1496694 - RNA, 17 nt, Homo sapiens
guggcauuaaacauuug

SEQ ID NO: 1496695 - RNA, 17 nt, Homo sapiens
guggccagcacucugaa

SEQ ID NO: 1496696 - RNA, 14 nt, Homo sapiens
guggcccaagacaa

SEQ ID NO: 1496697 - RNA, 15 nt, Homo sapiens
guggccccaacacaa

SEQ ID NO: 1496698 - RNA, 19 nt, Homo sapiens
guggcccuggcucugcugu

SEQ ID NO: 1496699 - RNA, 12 nt, Homo sapiens
guggccucagaa

SEQ ID NO: 1496700 - RNA, 14 nt, Homo sapiens
guggccugccuuca

SEQ ID NO: 1496701 - RNA, 14 nt, Homo sapiens
guggcgacucuaua

SEQ ID NO: 1496702 - RNA, 15 nt, Homo sapiens
guggcucagccagca

SEQ ID NO: 1496703 - RNA, 19 nt, Homo sapiens
guggcugugccaccaagca

SEQ ID NO: 1496704 - RNA, 18 nt, Homo sapiens
guggcuucccgcucagcc

SEQ ID NO: 1496705 - RNA, 17 nt, Homo sapiens
gugggauccucccucau

SEQ ID NO: 1496706 - RNA, 23 nt, Homo sapiens
gugggauggggacauuugaacau

SEQ ID NO: 1496707 - RNA, 15 nt, Homo sapiens
gugggcaccucagaa

SEQ ID NO: 1496708 - RNA, 18 nt, Homo sapiens
gugggcagagccuuccac

SEQ ID NO: 1496709 - RNA, 15 nt, Homo sapiens
gugggccacagccau

SEQ ID NO: 1496710 - RNA, 20 nt, Homo sapiens
gugggccucaaggacuugaa

SEQ ID NO: 1496711 - RNA, 13 nt, Homo sapiens
gugggccugugaa

SEQ ID NO: 1496712 - RNA, 23 nt, Homo sapiens
gugggcucugugcagucacugga

SEQ ID NO: 1496713 - RNA, 12 nt, Homo sapiens
gugggcugugag

SEQ ID NO: 1496714 - RNA, 20 nt, Homo sapiens
guggggauggggccucccuc

SEQ ID NO: 1496715 - RNA, 21 nt, Homo sapiens
gugggguaaccaaauguuggc

SEQ ID NO: 1496716 - RNA, 19 nt, Homo sapiens
gugggugcugccaugacag

SEQ ID NO: 1496717 - RNA, 14 nt, Homo sapiens
guggguggcacuga

SEQ ID NO: 1496718 - RNA, 15 nt, Homo sapiens
guggguguacauuuu

SEQ ID NO: 1496719 - RNA, 15 nt, Homo sapiens
gugguauaaucucca

SEQ ID NO: 1496720 - RNA, 12 nt, Homo sapiens
guuucuuucuag

SEQ ID NO: 1496721 - RNA, 13 nt, Homo sapiens
guuugagaccagc

SEQ ID NO: 1496722 - RNA, 19 nt, Homo sapiens
guuugauaccugcacuguc

SEQ ID NO: 1496723 - RNA, 16 nt, Homo sapiens
guuugcaaugucacaa

SEQ ID NO: 1496724 - RNA, 14 nt, Homo sapiens
guuugcuagcagaa

SEQ ID NO: 1496725 - RNA, 14 nt, Homo sapiens
guuugcucuuuuaa

SEQ ID NO: 1496726 - RNA, 19 nt, Homo sapiens
guuuggagguccuagguca

SEQ ID NO: 1496727 - RNA, 21 nt, Homo sapiens
guuuggcuagguaucauucaa

SEQ ID NO: 1496728 - RNA, 18 nt, Homo sapiens
guuugggccccucagagc

SEQ ID NO: 1496729 - RNA, 14 nt, Homo sapiens
guuuguagugaaau

SEQ ID NO: 1496730 - RNA, 16 nt, Homo sapiens
guuugucagacuuuaa

SEQ ID NO: 1496731 - RNA, 14 nt, Homo sapiens
guuuguccugagau

SEQ ID NO: 1496732 - RNA, 14 nt, Homo sapiens
guuuguggccucag

SEQ ID NO: 1496733 - RNA, 20 nt, Homo sapiens
guuugugucuguugcuugua

SEQ ID NO: 1496734 - RNA, 12 nt, Homo sapiens
guuuguguuacc

SEQ ID NO: 1496735 - RNA, 17 nt, Homo sapiens
guuuguuauaucaggga

SEQ ID NO: 1496736 - RNA, 22 nt, Homo sapiens
guuuguugaugugaaacauuau

SEQ ID NO: 1496737 - RNA, 17 nt, Homo sapiens
guuuguuuuuuugccac

SEQ ID NO: 1496738 - RNA, 15 nt, Homo sapiens
guuuuaaacauuaau

SEQ ID NO: 1496739 - RNA, 19 nt, Homo sapiens
guuuuacugugaaacuggc

SEQ ID NO: 1496740 - RNA, 23 nt, Homo sapiens
guuuuagacgaggccacagcugc

SEQ ID NO: 1496741 - RNA, 16 nt, Homo sapiens
guuuuauuacucucac

SEQ ID NO: 1496742 - RNA, 21 nt, Homo sapiens
guuuucaaauaacgauuuuau

SEQ ID NO: 1496743 - RNA, 14 nt, Homo sapiens
guuuucaguguaca

SEQ ID NO: 1496744 - RNA, 23 nt, Homo sapiens
guuuuccaguucaucgauuuucu

SEQ ID NO: 1496745 - RNA, 19 nt, Homo sapiens
guuuuccuaaaugcaguga

SEQ ID NO: 1496746 - RNA, 19 nt, Homo sapiens
guuuucguagguugacuau

SEQ ID NO: 1496747 - RNA, 20 nt, Homo sapiens
guuuucuguaaauaaccuau

SEQ ID NO: 1496748 - RNA, 16 nt, Homo sapiens
guuuucuugccaauga

SEQ ID NO: 1496749 - RNA, 12 nt, Homo sapiens
guuuugccucac

SEQ ID NO: 1496750 - RNA, 19 nt, Homo sapiens
guuuuggggacucauuuca

SEQ ID NO: 1496751 - RNA, 22 nt, Homo sapiens
guuuuggguugaccccaaucca

SEQ ID NO: 1496752 - RNA, 16 nt, Homo sapiens
guuuuguacacugcug

SEQ ID NO: 1496753 - RNA, 23 nt, Homo sapiens
guuuuguagagauggggucucac

SEQ ID NO: 1496754 - RNA, 14 nt, Homo sapiens
guuuuuaaacuaau

SEQ ID NO: 1496755 - RNA, 16 nt, Homo sapiens
guuuuuuaaauguaua

SEQ ID NO: 1496756 - RNA, 18 nt, Homo sapiens
guuuuuuuacaacauuca

SEQ ID NO: 1496757 - RNA, 17 nt, Homo sapiens
uaaaaaaaaaaguuaca

SEQ ID NO: 1496758 - RNA, 15 nt, Homo sapiens
uaaaaaaaaaauuca

SEQ ID NO: 1496759 - RNA, 22 nt, Homo sapiens
uaaaaaacauaaauuucuuuaa

SEQ ID NO: 1496760 - RNA, 16 nt, Homo sapiens
uaaaaacaaggucugc

SEQ ID NO: 1496761 - RNA, 13 nt, Homo sapiens
uaaaaacuggccc

SEQ ID NO: 1496762 - RNA, 18 nt, Homo sapiens
uaaaaagugacacagcag

SEQ ID NO: 1496763 - RNA, 18 nt, Homo sapiens
uaaaaaguuaaucuucau

SEQ ID NO: 1496764 - RNA, 22 nt, Homo sapiens
uaaaaauaaaucccauggaaua

SEQ ID NO: 1496765 - RNA, 16 nt, Homo sapiens
uaaaaauaugcuucua

SEQ ID NO: 1496766 - RNA, 14 nt, Homo sapiens
ucagccacauucua

SEQ ID NO: 1496767 - RNA, 12 nt, Homo sapiens
ucagccagguga

SEQ ID NO: 1496768 - RNA, 17 nt, Homo sapiens
ucagcccucaguuccuu

SEQ ID NO: 1496769 - RNA, 18 nt, Homo sapiens
ucagccucccgaguagcu

SEQ ID NO: 1496770 - RNA, 16 nt, Homo sapiens
ucagccuggccagaca

SEQ ID NO: 1496771 - RNA, 15 nt, Homo sapiens
ucagccuuacauuug

SEQ ID NO: 1496772 - RNA, 18 nt, Homo sapiens
ucagccuugccagagauc

SEQ ID NO: 1496773 - RNA, 21 nt, Homo sapiens
ucagcuaagggaagacauuuc

SEQ ID NO: 1496774 - RNA, 23 nt, Homo sapiens
ucagcucccccaggcuguucucc

SEQ ID NO: 1496775 - RNA, 17 nt, Homo sapiens
ucagcucucugggaccu

SEQ ID NO: 1496776 - RNA, 16 nt, Homo sapiens
ucagcugcucugcaag

SEQ ID NO: 1496777 - RNA, 23 nt, Homo sapiens
ucagcuuuuguuguuuauauaca

SEQ ID NO: 1496778 - RNA, 15 nt, Homo sapiens
ucaggaauacauuug

SEQ ID NO: 1496779 - RNA, 16 nt, Homo sapiens
ucaggagccaccagca

SEQ ID NO: 1496780 - RNA, 18 nt, Homo sapiens
ucaggaguucgagaccag

SEQ ID NO: 1496781 - RNA, 17 nt, Homo sapiens
ucaggaguugaagacca

SEQ ID NO: 1496782 - RNA, 20 nt, Homo sapiens
ucaggaugauacacuaugaa

SEQ ID NO: 1496783 - RNA, 14 nt, Homo sapiens
ucaggauucuucaa

SEQ ID NO: 1496784 - RNA, 15 nt, Homo sapiens
ucaggcaacgcacaa

SEQ ID NO: 1496785 - RNA, 14 nt, Homo sapiens
ucaggcacacagcu

SEQ ID NO: 1496786 - RNA, 17 nt, Homo sapiens
ucaggcacacagcuacu

SEQ ID NO: 1496787 - RNA, 13 nt, Homo sapiens
ucaggcagcucaa

SEQ ID NO: 1496788 - RNA, 13 nt, Homo sapiens
ucaggcagggugc

SEQ ID NO: 1496789 - RNA, 20 nt, Homo sapiens
ucaggcaggguuaaacugca

SEQ ID NO: 1496790 - RNA, 23 nt, Homo sapiens
ucaggcgauccaccugucucagc

SEQ ID NO: 1496791 - RNA, 15 nt, Homo sapiens
ucagggagcauuuaa

SEQ ID NO: 1496792 - RNA, 18 nt, Homo sapiens
ucagggcagggcucugau

SEQ ID NO: 1496793 - RNA, 15 nt, Homo sapiens
ucagggccaguccuc

SEQ ID NO: 1496794 - RNA, 16 nt, Homo sapiens
ucagggccaugccugc

SEQ ID NO: 1496795 - RNA, 18 nt, Homo sapiens
ucaggggaaccauggggc

SEQ ID NO: 1496796 - RNA, 14 nt, Homo sapiens
ucaggucaacugac

SEQ ID NO: 1496797 - RNA, 14 nt, Homo sapiens
ucagguccaauuug

SEQ ID NO: 1496798 - RNA, 19 nt, Homo sapiens
ucaggugaaaauccaucuc

SEQ ID NO: 1496799 - RNA, 12 nt, Homo sapiens
ucaggugacaug

SEQ ID NO: 1496800 - RNA, 21 nt, Homo sapiens
ucaggugauccgccuaccuca

SEQ ID NO: 1496801 - RNA, 15 nt, Homo sapiens
ucaggugauucgccc

SEQ ID NO: 1496802 - RNA, 12 nt, Homo sapiens
ucaggugcucaa

SEQ ID NO: 1496803 - RNA, 16 nt, Homo sapiens
ucagguguugccaaau

SEQ ID NO: 1496804 - RNA, 17 nt, Homo sapiens
ucagguuauauccaaua

SEQ ID NO: 1496805 - RNA, 16 nt, Homo sapiens
ucagguucuucagggc

SEQ ID NO: 1496806 - RNA, 22 nt, Homo sapiens
ucaguaaacaacuuguacuugu

SEQ ID NO: 1496807 - RNA, 18 nt, Homo sapiens
ucaguaaacaaugaauag

SEQ ID NO: 1496808 - RNA, 15 nt, Homo sapiens
ucagucacagccacc

SEQ ID NO: 1496809 - RNA, 16 nt, Homo sapiens
ucaguccaagucuucu

SEQ ID NO: 1496810 - RNA, 17 nt, Homo sapiens
ucagucccccugugcau

SEQ ID NO: 1496811 - RNA, 14 nt, Homo sapiens
ucagucuggugcuc

SEQ ID NO: 1496812 - RNA, 18 nt, Homo sapiens
ucagucuuggugguucua

SEQ ID NO: 1496813 - RNA, 12 nt, Homo sapiens
ucagugaaggac

SEQ ID NO: 1496814 - RNA, 23 nt, Homo sapiens
ucagugacagaguucacuauaaa

SEQ ID NO: 1496815 - RNA, 21 nt, Homo sapiens
ucaguuauucauucugugauc

SEQ ID NO: 1496816 - RNA, 20 nt, Homo sapiens
ucaguucccuuggccucaga

SEQ ID NO: 1496817 - RNA, 17 nt, Homo sapiens
ucaguucuuggugcucu

SEQ ID NO: 1496818 - RNA, 15 nt, Homo sapiens
ucaguugacagugua

SEQ ID NO: 1496819 - RNA, 22 nt, Homo sapiens
ucaguuugcuagcagaaaucua

SEQ ID NO: 1496820 - RNA, 14 nt, Homo sapiens
ucauaacccaugaa

SEQ ID NO: 1496821 - RNA, 17 nt, Homo sapiens
ucauaauaucaugugca

SEQ ID NO: 1496822 - RNA, 19 nt, Homo sapiens
ucauaauaucaugugcacu

SEQ ID NO: 1496823 - RNA, 20 nt, Homo sapiens
ucauaauaucaugugcacuu

SEQ ID NO: 1496824 - RNA, 24 nt, Homo sapiens
ucauaccguguaccucaguucccu

SEQ ID NO: 1496825 - RNA, 19 nt, Homo sapiens
ucauaccucagaauguaaa

SEQ ID NO: 1496826 - RNA, 14 nt, Homo sapiens
ucauagcugagauu

SEQ ID NO: 1496827 - RNA, 20 nt, Homo sapiens
ucauaggauuaagcaguuua

SEQ ID NO: 1496828 - RNA, 16 nt, Homo sapiens
gucgacuucaugacaa

SEQ ID NO: 1496829 - RNA, 15 nt, Homo sapiens
gucgcccuacucacc

SEQ ID NO: 1496830 - RNA, 18 nt, Homo sapiens
gucuaaaaacaccaaaaa

SEQ ID NO: 1496831 - RNA, 19 nt, Homo sapiens
gucuaacuuuagaagugca

SEQ ID NO: 1496832 - RNA, 18 nt, Homo sapiens
gucuacuugaguuagcau

SEQ ID NO: 1496833 - RNA, 20 nt, Homo sapiens
gucuauuuuuuuaacugaaa

SEQ ID NO: 1496834 - RNA, 17 nt, Homo sapiens
gucucacaguguugccc

SEQ ID NO: 1496835 - RNA, 19 nt, Homo sapiens
gucucacuguucugcaaag

SEQ ID NO: 1496836 - RNA, 14 nt, Homo sapiens
gucucauucuguca

SEQ ID NO: 1496837 - RNA, 23 nt, Homo sapiens
gucuccucaauuuuugucucaga

SEQ ID NO: 1496838 - RNA, 23 nt, Homo sapiens
gucuccuuugcacugagggccac

SEQ ID NO: 1496839 - RNA, 17 nt, Homo sapiens
gucucgcuuuguugccc

SEQ ID NO: 1496840 - RNA, 21 nt, Homo sapiens
gucucucggguucaagcaauu

SEQ ID NO: 1496841 - RNA, 19 nt, Homo sapiens
gucucuuuuugguaauaac

SEQ ID NO: 1496842 - RNA, 13 nt, Homo sapiens
gucugacucucca

SEQ ID NO: 1496843 - RNA, 16 nt, Homo sapiens
gucugagaauuuccaa

SEQ ID NO: 1496844 - RNA, 15 nt, Homo sapiens
gucugauuggcucac

SEQ ID NO: 1496845 - RNA, 14 nt, Homo sapiens
gucugcaugugcac

SEQ ID NO: 1496846 - RNA, 14 nt, Homo sapiens
gucugcccuuguca

SEQ ID NO: 1496847 - RNA, 16 nt, Homo sapiens
gucugugaagucaaga

SEQ ID NO: 1496848 - RNA, 19 nt, Homo sapiens
gucugugugaaugugggca

SEQ ID NO: 1496849 - RNA, 15 nt, Homo sapiens
gucuuaucaacuggu

SEQ ID NO: 1496850 - RNA, 18 nt, Homo sapiens
gucuucaacauccugcca

SEQ ID NO: 1496851 - RNA, 18 nt, Homo sapiens
gucuucauaaaguacuug

SEQ ID NO: 1496852 - RNA, 14 nt, Homo sapiens
gucuuccacuuugc

SEQ ID NO: 1496853 - RNA, 13 nt, Homo sapiens
gucuucccuguau

SEQ ID NO: 1496854 - RNA, 22 nt, Homo sapiens
gucuuccugaguggugccaaac

SEQ ID NO: 1496855 - RNA, 19 nt, Homo sapiens
gucuucuaauuucaaaaau

SEQ ID NO: 1496856 - RNA, 18 nt, Homo sapiens
gucuucugggcacagugg

SEQ ID NO: 1496857 - RNA, 17 nt, Homo sapiens
gucuucuugcugcagcc

SEQ ID NO: 1496858 - RNA, 23 nt, Homo sapiens
gucuugaaaguggcaccagaggu

SEQ ID NO: 1496859 - RNA, 16 nt, Homo sapiens
gucuugacucauggca

SEQ ID NO: 1496860 - RNA, 20 nt, Homo sapiens
gucuugcaacuucaguuuua

SEQ ID NO: 1496861 - RNA, 11 nt, Homo sapiens
gucuugccagg

SEQ ID NO: 1496862 - RNA, 15 nt, Homo sapiens
gucuugugaaggcag

SEQ ID NO: 1496863 - RNA, 20 nt, Homo sapiens
gucuuuccugaaccaugugg

SEQ ID NO: 1496864 - RNA, 14 nt, Homo sapiens
gucuuugaacccuu

SEQ ID NO: 1496865 - RNA, 15 nt, Homo sapiens
gucuuuuauauuugu

SEQ ID NO: 1496866 - RNA, 21 nt, Homo sapiens
gucuuuuuuucccuaccauuc

SEQ ID NO: 1496867 - RNA, 17 nt, Homo sapiens
gugaaaauccaucucau

SEQ ID NO: 1496868 - RNA, 21 nt, Homo sapiens
gugaaacccugucucuacuaa

SEQ ID NO: 1496869 - RNA, 19 nt, Homo sapiens
gugaaagcacggacucuua

SEQ ID NO: 1496870 - RNA, 21 nt, Homo sapiens
gugaaaggaagcuccacuguc

SEQ ID NO: 1496871 - RNA, 15 nt, Homo sapiens
gugaaaguacauuug

SEQ ID NO: 1496872 - RNA, 19 nt, Homo sapiens
gugaaaugcuggcauuugc

SEQ ID NO: 1496873 - RNA, 21 nt, Homo sapiens
gugaacauccccucccaucau

SEQ ID NO: 1496874 - RNA, 18 nt, Homo sapiens
gugaaccacuucauucug

SEQ ID NO: 1496875 - RNA, 15 nt, Homo sapiens
gugaacucuggugcu

SEQ ID NO: 1496876 - RNA, 13 nt, Homo sapiens
gugaacugagcug

SEQ ID NO: 1496877 - RNA, 23 nt, Homo sapiens
gcagggcuggcaggaugccgugg

SEQ ID NO: 1496878 - RNA, 21 nt, Homo sapiens
gcaggggagacaggagccuag

SEQ ID NO: 1496879 - RNA, 16 nt, Homo sapiens
gcagggguugcaguga

SEQ ID NO: 1496880 - RNA, 20 nt, Homo sapiens
gcaggugacauuugcucuga

SEQ ID NO: 1496881 - RNA, 13 nt, Homo sapiens
gcaggugccuugu

SEQ ID NO: 1496882 - RNA, 21 nt, Homo sapiens
gcaguaucaugcccugugcaa

SEQ ID NO: 1496883 - RNA, 17 nt, Homo sapiens
gcagucagcaugaaucc

SEQ ID NO: 1496884 - RNA, 12 nt, Homo sapiens
gcaguccuuugu

SEQ ID NO: 1496885 - RNA, 16 nt, Homo sapiens
gcagucuuauuuccaa

SEQ ID NO: 1496886 - RNA, 15 nt, Homo sapiens
gcagugagcugagau

SEQ ID NO: 1496887 - RNA, 15 nt, Homo sapiens
gcagugaucucaggg

SEQ ID NO: 1496888 - RNA, 14 nt, Homo sapiens
gcagugccucuugu

SEQ ID NO: 1496889 - RNA, 17 nt, Homo sapiens
gcagugcuaaagccugu

SEQ ID NO: 1496890 - RNA, 17 nt, Homo sapiens
gcaguggcugugccacc

SEQ ID NO: 1496891 - RNA, 19 nt, Homo sapiens
gcaguucccccaaccucag

SEQ ID NO: 1496892 - RNA, 17 nt, Homo sapiens
gcaguuggacucucagg

SEQ ID NO: 1496893 - RNA, 23 nt, Homo sapiens
gcaguuucaucaaagaacaaaca

SEQ ID NO: 1496894 - RNA, 19 nt, Homo sapiens
gcaguuucugacacuuguu

SEQ ID NO: 1496895 - RNA, 16 nt, Homo sapiens
gcauaaaaacauuuua

SEQ ID NO: 1496896 - RNA, 14 nt, Homo sapiens
gcauaaaucacuuc

SEQ ID NO: 1496897 - RNA, 19 nt, Homo sapiens
gcauaagcuuaugcuuaaa

SEQ ID NO: 1496898 - RNA, 16 nt, Homo sapiens
gcauacaaagcaguuu

SEQ ID NO: 1496899 - RNA, 18 nt, Homo sapiens
gcauacagguuaaccugc

SEQ ID NO: 1496900 - RNA, 23 nt, Homo sapiens
gcauacagguuaaccugcagaaa

SEQ ID NO: 1496901 - RNA, 16 nt, Homo sapiens
gcauagcaagacacau

SEQ ID NO: 1496902 - RNA, 14 nt, Homo sapiens
gcauagccauggaa

SEQ ID NO: 1496903 - RNA, 15 nt, Homo sapiens
gcauagugcugggau

SEQ ID NO: 1496904 - RNA, 22 nt, Homo sapiens
gcauaugucacuagaauggaua

SEQ ID NO: 1496905 - RNA, 23 nt, Homo sapiens
gcauauuuauccaaaauguguau

SEQ ID NO: 1496906 - RNA, 15 nt, Homo sapiens
gcaucaaggugcuga

SEQ ID NO: 1496907 - RNA, 21 nt, Homo sapiens
gcaucaggcagggugagcucc

SEQ ID NO: 1496908 - RNA, 16 nt, Homo sapiens
gcaucagguccuuugg

SEQ ID NO: 1496909 - RNA, 13 nt, Homo sapiens
gcaucaucuaugg

SEQ ID NO: 1496910 - RNA, 17 nt, Homo sapiens
gcaucccagcaccugcc

SEQ ID NO: 1496911 - RNA, 20 nt, Homo sapiens
gcaucguggccuugaccucc

SEQ ID NO: 1496912 - RNA, 16 nt, Homo sapiens
gcaucuacacaauuua

SEQ ID NO: 1496913 - RNA, 14 nt, Homo sapiens
gcaucuacacagcc

SEQ ID NO: 1496914 - RNA, 13 nt, Homo sapiens
gcaucucagccua

SEQ ID NO: 1496915 - RNA, 15 nt, Homo sapiens
gcaucugcaguacag

SEQ ID NO: 1496916 - RNA, 16 nt, Homo sapiens
gcaucuugcuggcuac

SEQ ID NO: 1496917 - RNA, 16 nt, Homo sapiens
gcaucuuuaacacagc

SEQ ID NO: 1496918 - RNA, 20 nt, Homo sapiens
gcaugaccugugaccagcac

SEQ ID NO: 1496919 - RNA, 23 nt, Homo sapiens
gcaugaccugugaccagcacugu

SEQ ID NO: 1496920 - RNA, 13 nt, Homo sapiens
gcaugagacuuuc

SEQ ID NO: 1496921 - RNA, 13 nt, Homo sapiens
gcaugccauugaa

SEQ ID NO: 1496922 - RNA, 23 nt, Homo sapiens
gcauggaggcugcgacugaugaa

SEQ ID NO: 1496923 - RNA, 13 nt, Homo sapiens
gcaugggcacucc

SEQ ID NO: 1496924 - RNA, 21 nt, Homo sapiens
gcauuaaaaaaaaaaucaaug

SEQ ID NO: 1496925 - RNA, 14 nt, Homo sapiens
gcauuaaccugucu

SEQ ID NO: 1496926 - RNA, 21 nt, Homo sapiens
gcauucauuucucuugcaaua

SEQ ID NO: 1496927 - RNA, 16 nt, Homo sapiens
gcauugaaaugagcac

SEQ ID NO: 1496928 - RNA, 22 nt, Homo sapiens
gcauuuauggucaacacuuaag

SEQ ID NO: 1496929 - RNA, 19 nt, Homo sapiens
gcauuuauuuauacagugc

SEQ ID NO: 1496930 - RNA, 22 nt, Homo sapiens
gcauuuauuuauacagugccuu

SEQ ID NO: 1496931 - RNA, 19 nt, Homo sapiens
gcauuuccaacaccacaga

SEQ ID NO: 1496932 - RNA, 14 nt, Homo sapiens
gcauuuuacaggug

SEQ ID NO: 1496933 - RNA, 14 nt, Homo sapiens
gcauuuuucuggga

SEQ ID NO: 1496934 - RNA, 23 nt, Homo sapiens
gcauuuuuuuuuuaugauuuguc

SEQ ID NO: 1496935 - RNA, 20 nt, Homo sapiens
gccaaacccaugaggcaaug

SEQ ID NO: 1496936 - RNA, 19 nt, Homo sapiens
gccaaccagagaagcugcu

SEQ ID NO: 1496937 - RNA, 18 nt, Homo sapiens
gccaaccggucacccagg

SEQ ID NO: 1496938 - RNA, 23 nt, Homo sapiens
gccccugguuaagggagaucugg

SEQ ID NO: 1496939 - RNA, 15 nt, Homo sapiens
gccccuuuuacuuuu

SEQ ID NO: 1496940 - RNA, 23 nt, Homo sapiens
gcccgugcccuggugaaucaccu

SEQ ID NO: 1496941 - RNA, 20 nt, Homo sapiens
gcccuaaaaauccagacucu

SEQ ID NO: 1496942 - RNA, 13 nt, Homo sapiens
gcccuaaucucac

SEQ ID NO: 1496943 - RNA, 13 nt, Homo sapiens
gcccuagcauuuc

SEQ ID NO: 1496944 - RNA, 12 nt, Homo sapiens
gcccucaaucca

SEQ ID NO: 1496945 - RNA, 12 nt, Homo sapiens
gcccucacagag

SEQ ID NO: 1496946 - RNA, 19 nt, Homo sapiens
gcccuccccaucccaugua

SEQ ID NO: 1496947 - RNA, 20 nt, Homo sapiens
gcccucugaacuugccuuaa

SEQ ID NO: 1496948 - RNA, 17 nt, Homo sapiens
gcccugcaccugugcag

SEQ ID NO: 1496949 - RNA, 18 nt, Homo sapiens
gcccugcagcccaccaga

SEQ ID NO: 1496950 - RNA, 22 nt, Homo sapiens
gcccugcagggcuggucagggu

SEQ ID NO: 1496951 - RNA, 21 nt, Homo sapiens
gcccuggagaagcagcuaaca

SEQ ID NO: 1496952 - RNA, 16 nt, Homo sapiens
gcccuggcugacccca

SEQ ID NO: 1496953 - RNA, 23 nt, Homo sapiens
gcccuggggacuguuccaaagcc

SEQ ID NO: 1496954 - RNA, 13 nt, Homo sapiens
gcccugugcaacc

SEQ ID NO: 1496955 - RNA, 14 nt, Homo sapiens
gcccuuaaggacaa

SEQ ID NO: 1496956 - RNA, 18 nt, Homo sapiens
gcccuuccucuccacugc

SEQ ID NO: 1496957 - RNA, 12 nt, Homo sapiens
gcccuuuccucc

SEQ ID NO: 1496958 - RNA, 21 nt, Homo sapiens
gccgagaucacgucacugcac

SEQ ID NO: 1496959 - RNA, 17 nt, Homo sapiens
gccgaggccugcauguc

SEQ ID NO: 1496960 - RNA, 20 nt, Homo sapiens
gccgauauuuucuugcugga

SEQ ID NO: 1496961 - RNA, 11 nt, Homo sapiens
gccgcacuggg

SEQ ID NO: 1496962 - RNA, 14 nt, Homo sapiens
gccgcagacgggca

SEQ ID NO: 1496963 - RNA, 16 nt, Homo sapiens
gccgcagccaacccgg

SEQ ID NO: 1496964 - RNA, 23 nt, Homo sapiens
gccgcaggugggugcugcccugu

SEQ ID NO: 1496965 - RNA, 15 nt, Homo sapiens
gccgccuuaagcuga

SEQ ID NO: 1496966 - RNA, 13 nt, Homo sapiens
gccgcuaccuccc

SEQ ID NO: 1496967 - RNA, 18 nt, Homo sapiens
gccggaggucaugaugau

SEQ ID NO: 1496968 - RNA, 15 nt, Homo sapiens
gccggcuguggagca

SEQ ID NO: 1496969 - RNA, 19 nt, Homo sapiens
gccgugugagugugacagg

SEQ ID NO: 1496970 - RNA, 23 nt, Homo sapiens
gccuaaaaguuacuuaccacaga

SEQ ID NO: 1496971 - RNA, 13 nt, Homo sapiens
gccuaaaguacag

SEQ ID NO: 1496972 - RNA, 17 nt, Homo sapiens
gccuacaaccaucccug

SEQ ID NO: 1496973 - RNA, 21 nt, Homo sapiens
gccuacagucaucugccacca

SEQ ID NO: 1496974 - RNA, 17 nt, Homo sapiens
gccuaccuccacaccac

SEQ ID NO: 1496975 - RNA, 22 nt, Homo sapiens
gccuagcgaucucuccuggccu

SEQ ID NO: 1496976 - RNA, 21 nt, Homo sapiens
gccuagcuccugccacaugga

SEQ ID NO: 1496977 - RNA, 21 nt, Homo sapiens
gccucaagcaauccaccugcc

SEQ ID NO: 1496978 - RNA, 14 nt, Homo sapiens
gccucagcuaccca

SEQ ID NO: 1496979 - RNA, 18 nt, Homo sapiens
gaaaaaucauccaagaca

SEQ ID NO: 1496980 - RNA, 20 nt, Homo sapiens
gaaaacauagcaucucagga

SEQ ID NO: 1496981 - RNA, 15 nt, Homo sapiens
gaaaacuugacaugu

SEQ ID NO: 1496982 - RNA, 20 nt, Homo sapiens
gaaaacuugacauguagcuu

SEQ ID NO: 1496983 - RNA, 16 nt, Homo sapiens
gaaaagaagacucuga

SEQ ID NO: 1496984 - RNA, 23 nt, Homo sapiens
gaaaagaagacucugaccuguac

SEQ ID NO: 1496985 - RNA, 22 nt, Homo sapiens
gaaaagauuuuauuuauggaau

SEQ ID NO: 1496986 - RNA, 16 nt, Homo sapiens
gaaaaggaagacuaga

SEQ ID NO: 1496987 - RNA, 17 nt, Homo sapiens
gaaaaggccuucuuccc

SEQ ID NO: 1496988 - RNA, 15 nt, Homo sapiens
gaaaaguaucacucu

SEQ ID NO: 1496989 - RNA, 16 nt, Homo sapiens
gaaaagugaauuucac

SEQ ID NO: 1496990 - RNA, 14 nt, Homo sapiens
gaaaagugcauauu

SEQ ID NO: 1496991 - RNA, 14 nt, Homo sapiens
gaaaaguucaggga

SEQ ID NO: 1496992 - RNA, 20 nt, Homo sapiens
gaaaaguuucccagucuuca

SEQ ID NO: 1496993 - RNA, 18 nt, Homo sapiens
gaaaauacauaagaccau

SEQ ID NO: 1496994 - RNA, 12 nt, Homo sapiens
gaaaauaugccu

SEQ ID NO: 1496995 - RNA, 16 nt, Homo sapiens
gaaaaucacacugucu

SEQ ID NO: 1496996 - RNA, 12 nt, Homo sapiens
gaaaaugaaucu

SEQ ID NO: 1496997 - RNA, 16 nt, Homo sapiens
gaaaaugaaucuucac

SEQ ID NO: 1496998 - RNA, 20 nt, Homo sapiens
gaaaaugccucaauucacau

SEQ ID NO: 1496999 - RNA, 20 nt, Homo sapiens
gaaaauuagacugugauuca

SEQ ID NO: 1497000 - RNA, 18 nt, Homo sapiens
gaaaauuuuuacauucau

SEQ ID NO: 1497001 - RNA, 15 nt, Homo sapiens
gaaacaaaaauguac

SEQ ID NO: 1497002 - RNA, 14 nt, Homo sapiens
gaaacaauguggag

SEQ ID NO: 1497003 - RNA, 17 nt, Homo sapiens
gaaacacagaaaccuuu

SEQ ID NO: 1497004 - RNA, 23 nt, Homo sapiens
gaaacaccguguuuucugacaca

SEQ ID NO: 1497005 - RNA, 17 nt, Homo sapiens
gaaacagauaacaccaa

SEQ ID NO: 1497006 - RNA, 17 nt, Homo sapiens
gaaacauuaugccuuaa

SEQ ID NO: 1497007 - RNA, 10 nt, Homo sapiens
gaaaccagag

SEQ ID NO: 1497008 - RNA, 19 nt, Homo sapiens
gaaaccucugggucaucuc

SEQ ID NO: 1497009 - RNA, 14 nt, Homo sapiens
gaaacggauccagc

SEQ ID NO: 1497010 - RNA, 23 nt, Homo sapiens
gaaacguauucaaacaauuugaa

SEQ ID NO: 1497011 - RNA, 18 nt, Homo sapiens
gaaacuaagccaggccug

SEQ ID NO: 1497012 - RNA, 15 nt, Homo sapiens
gaaacucacacuccc

SEQ ID NO: 1497013 - RNA, 16 nt, Homo sapiens
gaaacuggacucacau

SEQ ID NO: 1497014 - RNA, 17 nt, Homo sapiens
gaaacuguccaccaaga

SEQ ID NO: 1497015 - RNA, 18 nt, Homo sapiens
gaaacuugugaaguggaa

SEQ ID NO: 1497016 - RNA, 17 nt, Homo sapiens
gaaacuuuacaaccuga

SEQ ID NO: 1497017 - RNA, 23 nt, Homo sapiens
gaaagaaguccuuucucuuuauu

SEQ ID NO: 1497018 - RNA, 23 nt, Homo sapiens
gaaagaauuauuuuuguguuucu

SEQ ID NO: 1497019 - RNA, 14 nt, Homo sapiens
gaaagccauugacc

SEQ ID NO: 1497020 - RNA, 20 nt, Homo sapiens
gaaagcccucaugugcagua

SEQ ID NO: 1497021 - RNA, 19 nt, Homo sapiens
gaaagccugggugacauuu

SEQ ID NO: 1497022 - RNA, 14 nt, Homo sapiens
gaaagcucacucug

SEQ ID NO: 1497023 - RNA, 19 nt, Homo sapiens
gaaagcugagaacuccuga

SEQ ID NO: 1497024 - RNA, 19 nt, Homo sapiens
gaaagcugauuacugucaa

SEQ ID NO: 1497025 - RNA, 23 nt, Homo sapiens
gaaaggaaaaccugaagacugag

SEQ ID NO: 1497026 - RNA, 14 nt, Homo sapiens
gaaaggagacuaga

SEQ ID NO: 1497027 - RNA, 14 nt, Homo sapiens
gaaaggcaucaguc

SEQ ID NO: 1497028 - RNA, 22 nt, Homo sapiens
gaaaggcuuggcacacagcagg

SEQ ID NO: 1497029 - RNA, 13 nt, Homo sapiens
gaaaggggugcuu

SEQ ID NO: 1497030 - RNA, 22 nt, Homo sapiens
gaaaguaaauauuucaggcaua

SEQ ID NO: 1497031 - RNA, 14 nt, Homo sapiens
gaaagucaaauuca

SEQ ID NO: 1497032 - RNA, 14 nt, Homo sapiens
gaaagugacuuuaa

SEQ ID NO: 1497033 - RNA, 23 nt, Homo sapiens
gaaaguggccaugccacccuguu

SEQ ID NO: 1497034 - RNA, 19 nt, Homo sapiens
gaaaguucuugguggugga

SEQ ID NO: 1497035 - RNA, 22 nt, Homo sapiens
gaaauaaaaauggcaaaugcac

SEQ ID NO: 1497036 - RNA, 16 nt, Homo sapiens
gaaauaaacugugcaa

SEQ ID NO: 1497037 - RNA, 22 nt, Homo sapiens
gaaauaaauguaccugauguac

SEQ ID NO: 1497038 - RNA, 17 nt, Homo sapiens
gaaauaaauuuauuuca

SEQ ID NO: 1497039 - RNA, 18 nt, Homo sapiens
gaaauagaaagaagccau

SEQ ID NO: 1497040 - RNA, 14 nt, Homo sapiens
gaaauagaagcaaa

SEQ ID NO: 1497041 - RNA, 13 nt, Homo sapiens
gaaauagugacau

SEQ ID NO: 1497042 - RNA, 22 nt, Homo sapiens
gaaauauggaacuuacauuguu

SEQ ID NO: 1497043 - RNA, 19 nt, Homo sapiens
gaaaucaaaccaccaggca

SEQ ID NO: 1497044 - RNA, 21 nt, Homo sapiens
gaaauccuuccuaaacccaau

SEQ ID NO: 1497045 - RNA, 19 nt, Homo sapiens
gaaaucuagaagacuguca

SEQ ID NO: 1497046 - RNA, 22 nt, Homo sapiens
cuuuaauaguuuugauccuaaa

SEQ ID NO: 1497047 - RNA, 14 nt, Homo sapiens
cuuuaaugaacuaa

SEQ ID NO: 1497048 - RNA, 21 nt, Homo sapiens
cuuuaauucauaaaucacaaa

SEQ ID NO: 1497049 - RNA, 21 nt, Homo sapiens
cuuuacaaucugcacuuuaac

SEQ ID NO: 1497050 - RNA, 14 nt, Homo sapiens
cuuuacaccaacuc

SEQ ID NO: 1497051 - RNA, 16 nt, Homo sapiens
cuuuaccacucuacca

SEQ ID NO: 1497052 - RNA, 18 nt, Homo sapiens
cuuuaccugagaccaguu

SEQ ID NO: 1497053 - RNA, 23 nt, Homo sapiens
cuuuagaguagcaugagagaauu

SEQ ID NO: 1497054 - RNA, 18 nt, Homo sapiens
cuuuagauauacauauca

SEQ ID NO: 1497055 - RNA, 18 nt, Homo sapiens
cuuuaggcagcagcuuuu

SEQ ID NO: 1497056 - RNA, 19 nt, Homo sapiens
cuuuauaaucuacuccuug

SEQ ID NO: 1497057 - RNA, 20 nt, Homo sapiens
cuuuauagagugucucaggg

SEQ ID NO: 1497058 - RNA, 22 nt, Homo sapiens
cuuuauagagugucucagggug

SEQ ID NO: 1497059 - RNA, 21 nt, Homo sapiens
cuuuauauuuuuaacuuuaag

SEQ ID NO: 1497060 - RNA, 14 nt, Homo sapiens
cuuuaucauugcua

SEQ ID NO: 1497061 - RNA, 11 nt, Homo sapiens
cuuuaucucag

SEQ ID NO: 1497062 - RNA, 13 nt, Homo sapiens
cuuuaucucaggg

SEQ ID NO: 1497063 - RNA, 16 nt, Homo sapiens
cuuuauuaaauacaaa

SEQ ID NO: 1497064 - RNA, 18 nt, Homo sapiens
cuuucaaagcuaaauucc

SEQ ID NO: 1497065 - RNA, 19 nt, Homo sapiens
cuuucaagaagugccaguu

SEQ ID NO: 1497066 - RNA, 12 nt, Homo sapiens
cuuucacuuuga

SEQ ID NO: 1497067 - RNA, 23 nt, Homo sapiens
cuuucaucccucgggugugcuau

SEQ ID NO: 1497068 - RNA, 23 nt, Homo sapiens
cuuucauuauagcagagaguuuu

SEQ ID NO: 1497069 - RNA, 21 nt, Homo sapiens
cuuucauuccuucagauuugg

SEQ ID NO: 1497070 - RNA, 11 nt, Homo sapiens
cuuuccaagcu

SEQ ID NO: 1497071 - RNA, 18 nt, Homo sapiens
cuuucccaaccccaggaa

SEQ ID NO: 1497072 - RNA, 14 nt, Homo sapiens
cuuucccaguccca

SEQ ID NO: 1497073 - RNA, 16 nt, Homo sapiens
cuuucccaucuuccaa

SEQ ID NO: 1497074 - RNA, 13 nt, Homo sapiens
cuuucccuaccuu

SEQ ID NO: 1497075 - RNA, 18 nt, Homo sapiens
cuuucccuucuuggugcu

SEQ ID NO: 1497076 - RNA, 15 nt, Homo sapiens
cuuuccugaaccaug

SEQ ID NO: 1497077 - RNA, 16 nt, Homo sapiens
cuuucuccaggaccaa

SEQ ID NO: 1497078 - RNA, 20 nt, Homo sapiens
cuuucuccuguuuauuccca

SEQ ID NO: 1497079 - RNA, 17 nt, Homo sapiens
cuuucucucagccuuac

SEQ ID NO: 1497080 - RNA, 12 nt, Homo sapiens
cuuucucugcaa

SEQ ID NO: 1497081 - RNA, 16 nt, Homo sapiens
cuuucuggaaaagagg

SEQ ID NO: 1497082 - RNA, 14 nt, Homo sapiens
cuuucugugcccua

SEQ ID NO: 1497083 - RNA, 15 nt, Homo sapiens
cuuucuguugccaca

SEQ ID NO: 1497084 - RNA, 22 nt, Homo sapiens
cuuucuuacauuagcaguuugc

SEQ ID NO: 1497085 - RNA, 14 nt, Homo sapiens
cuuucuuguuucau

SEQ ID NO: 1497086 - RNA, 17 nt, Homo sapiens
cuuucuuuaccugagac

SEQ ID NO: 1497087 - RNA, 18 nt, Homo sapiens
cuuucuuuagcaugcuac

SEQ ID NO: 1497088 - RNA, 14 nt, Homo sapiens
cuuugaagccucag

SEQ ID NO: 1497089 - RNA, 18 nt, Homo sapiens
cuuugaaucuaguuguua

SEQ ID NO: 1497090 - RNA, 13 nt, Homo sapiens
cuuugaauguggc

SEQ ID NO: 1497091 - RNA, 15 nt, Homo sapiens
cuuugacuuugccca

SEQ ID NO: 1497092 - RNA, 18 nt, Homo sapiens
cuuugcacaggaugcugg

SEQ ID NO: 1497093 - RNA, 11 nt, Homo sapiens
cuuugcacuug

SEQ ID NO: 1497094 - RNA, 23 nt, Homo sapiens
cuuugccucuucuuugugccuuu

SEQ ID NO: 1497095 - RNA, 20 nt, Homo sapiens
cuuugccuucucuguucccu

SEQ ID NO: 1497096 - RNA, 18 nt, Homo sapiens
cuuugccuuggcuuugcc

SEQ ID NO: 1497097 - RNA, 22 nt, Homo sapiens
cuuugcugccccaccaucuugc

SEQ ID NO: 1497098 - RNA, 20 nt, Homo sapiens
cuuuggaaacaggaccacaa

SEQ ID NO: 1497099 - RNA, 17 nt, Homo sapiens
cuuuggagaugcugagg

SEQ ID NO: 1497100 - RNA, 23 nt, Homo sapiens
cuuuggggcauagaucagaagac

SEQ ID NO: 1497101 - RNA, 19 nt, Homo sapiens
cuuugguuucugucuguaa

SEQ ID NO: 1497102 - RNA, 17 nt, Homo sapiens
cuuuguaugcacuuugu

SEQ ID NO: 1497103 - RNA, 16 nt, Homo sapiens
cuuugucaaaaggaag

SEQ ID NO: 1497104 - RNA, 12 nt, Homo sapiens
cuuugucugucg

SEQ ID NO: 1497105 - RNA, 12 nt, Homo sapiens
cuuugucugugg

SEQ ID NO: 1497106 - RNA, 15 nt, Homo sapiens
cuuugugauaauuua

SEQ ID NO: 1497107 - RNA, 20 nt, Homo sapiens
cuuugugcuugucauuccag

SEQ ID NO: 1497108 - RNA, 13 nt, Homo sapiens
cuuuguguagaaa

SEQ ID NO: 1497109 - RNA, 18 nt, Homo sapiens
cuuuguguagaaagccaa

SEQ ID NO: 1497110 - RNA, 22 nt, Homo sapiens
cuuuuaaggcuaaaacuuaaca

SEQ ID NO: 1497111 - RNA, 15 nt, Homo sapiens
cuuuuaaucagugaa

SEQ ID NO: 1497112 - RNA, 17 nt, Homo sapiens
cuuuuagaaauacugca

SEQ ID NO: 1497113 - RNA, 21 nt, Homo sapiens
cuuuuagaaauacugcaagaa

SEQ ID NO: 1497114 - RNA, 14 nt, Homo sapiens
cuuuuauagaggcu

SEQ ID NO: 1497115 - RNA, 17 nt, Homo sapiens
cuuuuauucauuagcug

SEQ ID NO: 1497116 - RNA, 18 nt, Homo sapiens
cuuuuauugacacagaaa

SEQ ID NO: 1497117 - RNA, 18 nt, Homo sapiens
cuuuucauuaaagaaugu

SEQ ID NO: 1497118 - RNA, 12 nt, Homo sapiens
cuuuuccagaag

SEQ ID NO: 1497119 - RNA, 20 nt, Homo sapiens
cuuuuccagagcauuccagu

SEQ ID NO: 1497120 - RNA, 17 nt, Homo sapiens
cuuuuccccagucccag

SEQ ID NO: 1497121 - RNA, 21 nt, Homo sapiens
cuuuucugcauuuugcuauug

SEQ ID NO: 1497122 - RNA, 16 nt, Homo sapiens
cuuuucuggccaaaag

SEQ ID NO: 1497123 - RNA, 18 nt, Homo sapiens
cuuuugaauuuuugguua

SEQ ID NO: 1497124 - RNA, 18 nt, Homo sapiens
cuuuugcacaucuaguga

SEQ ID NO: 1497125 - RNA, 19 nt, Homo sapiens
cuuuugcacaucuagugag

SEQ ID NO: 1497126 - RNA, 18 nt, Homo sapiens
cuuuugcaggauaauaau

SEQ ID NO: 1497127 - RNA, 20 nt, Homo sapiens
cuuuugcuucaguugcauau

SEQ ID NO: 1497128 - RNA, 20 nt, Homo sapiens
cuuuuggugaaagcugagaa

SEQ ID NO: 1497129 - RNA, 16 nt, Homo sapiens
cuuuugucauguggcu

SEQ ID NO: 1497130 - RNA, 18 nt, Homo sapiens
cuuuuguuuugaguuacu

SEQ ID NO: 1497131 - RNA, 17 nt, Homo sapiens
cuuuuuaauaaagugga

SEQ ID NO: 1497132 - RNA, 16 nt, Homo sapiens
cuuuuuacucaaagag

SEQ ID NO: 1497133 - RNA, 16 nt, Homo sapiens
cuuuuucaaugaauuu

SEQ ID NO: 1497134 - RNA, 17 nt, Homo sapiens
cuuuuucauauguugcu

SEQ ID NO: 1497135 - RNA, 21 nt, Homo sapiens
cuuuuucauccaggccugcca

SEQ ID NO: 1497136 - RNA, 13 nt, Homo sapiens
cuuuuucuuugag

SEQ ID NO: 1497137 - RNA, 14 nt, Homo sapiens
cuuuuuuauacuca

SEQ ID NO: 1497138 - RNA, 18 nt, Homo sapiens
cuuuuuuauacucaauca

SEQ ID NO: 1497139 - RNA, 21 nt, Homo sapiens
gaaaaaaaaaagaaaugcaaa

SEQ ID NO: 1497140 - RNA, 14 nt, Homo sapiens
gaaaaaaacauaaa

SEQ ID NO: 1497141 - RNA, 13 nt, Homo sapiens
gaaaaacuuccau

SEQ ID NO: 1497142 - RNA, 15 nt, Homo sapiens
gaaaaagacacagac

SEQ ID NO: 1497143 - RNA, 20 nt, Homo sapiens
gaaaaagaccuaugagcaca

SEQ ID NO: 1497144 - RNA, 22 nt, Homo sapiens
gaaaaaggacucugcuucaguc

SEQ ID NO: 1497145 - RNA, 19 nt, Homo sapiens
gaaaaaguuaaacauugaa

SEQ ID NO: 1497146 - RNA, 18 nt, Homo sapiens
gaaaaauauuccaagcuu

SEQ ID NO: 1497147 - RNA, 23 nt, Homo sapiens
gaaaaauauugcugaacuacuuu

SEQ ID NO: 1497148 - RNA, 21 nt, Homo sapiens
cgagaucucgccacugcacuc

SEQ ID NO: 1497149 - RNA, 17 nt, Homo sapiens
cgagaugggaaggcaca

SEQ ID NO: 1497150 - RNA, 13 nt, Homo sapiens
cgagcacugugag

SEQ ID NO: 1497151 - RNA, 18 nt, Homo sapiens
cgagggucaggacuguga

SEQ ID NO: 1497152 - RNA, 15 nt, Homo sapiens
cgagucauggcuaau

SEQ ID NO: 1497153 - RNA, 19 nt, Homo sapiens
cgagucucuucuccacugg

SEQ ID NO: 1497154 - RNA, 16 nt, Homo sapiens
cgaguuuuaaacuggu

SEQ ID NO: 1497155 - RNA, 16 nt, Homo sapiens
cgaucuccugaccucg

SEQ ID NO: 1497156 - RNA, 15 nt, Homo sapiens
cgaucucuccuggcc

SEQ ID NO: 1497157 - RNA, 17 nt, Homo sapiens
cgaugcguucacuccaa

SEQ ID NO: 1497158 - RNA, 13 nt, Homo sapiens
cgaugcugcuaug

SEQ ID NO: 1497159 - RNA, 23 nt, Homo sapiens
cgauguuuauguucuuauagaau

SEQ ID NO: 1497160 - RNA, 14 nt, Homo sapiens
cgauugaaggugac

SEQ ID NO: 1497161 - RNA, 16 nt, Homo sapiens
cgcaagaccagucacu

SEQ ID NO: 1497162 - RNA, 13 nt, Homo sapiens
cgcaccacugcac

SEQ ID NO: 1497163 - RNA, 14 nt, Homo sapiens
cgcaccacugcacu

SEQ ID NO: 1497164 - RNA, 12 nt, Homo sapiens
cgcaccaugugg

SEQ ID NO: 1497165 - RNA, 14 nt, Homo sapiens
cgcaccauugcacu

SEQ ID NO: 1497166 - RNA, 16 nt, Homo sapiens
cgcaggccagcaacuc

SEQ ID NO: 1497167 - RNA, 15 nt, Homo sapiens
cgcaucucagugcag

SEQ ID NO: 1497168 - RNA, 19 nt, Homo sapiens
cgccaaucccgccaugcuc

SEQ ID NO: 1497169 - RNA, 17 nt, Homo sapiens
cgccacuccacaaauga

SEQ ID NO: 1497170 - RNA, 13 nt, Homo sapiens
cgccagaucugca

SEQ ID NO: 1497171 - RNA, 16 nt, Homo sapiens
cgccaggcugaccaca

SEQ ID NO: 1497172 - RNA, 19 nt, Homo sapiens
cgccccccgccucucccca

SEQ ID NO: 1497173 - RNA, 15 nt, Homo sapiens
cgcccgcugagcuga

SEQ ID NO: 1497174 - RNA, 12 nt, Homo sapiens
cgcccucggggc

SEQ ID NO: 1497175 - RNA, 20 nt, Homo sapiens
cgcccugugcccgacugacu

SEQ ID NO: 1497176 - RNA, 15 nt, Homo sapiens
cgccugacaaccacu

SEQ ID NO: 1497177 - RNA, 23 nt, Homo sapiens
cgccuggaggagacgcuggacuu

SEQ ID NO: 1497178 - RNA, 22 nt, Homo sapiens
cgccuguaaucccagcacuuug

SEQ ID NO: 1497179 - RNA, 12 nt, Homo sapiens
cgcgcucgccca

SEQ ID NO: 1497180 - RNA, 19 nt, Homo sapiens
cgcgcucgcccagcaggag

SEQ ID NO: 1497181 - RNA, 22 nt, Homo sapiens
cgcuauuccucacucagaggaa

SEQ ID NO: 1497182 - RNA, 22 nt, Homo sapiens
cgcuccuuugugugugugucag

SEQ ID NO: 1497183 - RNA, 12 nt, Homo sapiens
cgcucucaagac

SEQ ID NO: 1497184 - RNA, 14 nt, Homo sapiens
cgcugggugguacc

SEQ ID NO: 1497185 - RNA, 16 nt, Homo sapiens
cgcuguauaaagcaug

SEQ ID NO: 1497186 - RNA, 13 nt, Homo sapiens
cgcuugcuuuagc

SEQ ID NO: 1497187 - RNA, 17 nt, Homo sapiens
cggaagugaccacagaa

SEQ ID NO: 1497188 - RNA, 18 nt, Homo sapiens
cggaagugaccacagaag

SEQ ID NO: 1497189 - RNA, 18 nt, Homo sapiens
cggaccuccaucagagcc

SEQ ID NO: 1497190 - RNA, 16 nt, Homo sapiens
cggagccugugcagcc

SEQ ID NO: 1497191 - RNA, 20 nt, Homo sapiens
cggagcuugcagugagccga

SEQ ID NO: 1497192 - RNA, 17 nt, Homo sapiens
cggaggagaccagcuca

SEQ ID NO: 1497193 - RNA, 15 nt, Homo sapiens
cggauguaugaucuc

SEQ ID NO: 1497194 - RNA, 17 nt, Homo sapiens
cggcaacaucaacccga

SEQ ID NO: 1497195 - RNA, 21 nt, Homo sapiens
cggcagggugucccaggagcc

SEQ ID NO: 1497196 - RNA, 18 nt, Homo sapiens
cggcaucaaggugcugaa

SEQ ID NO: 1497197 - RNA, 15 nt, Homo sapiens
cggccagaagaucua

SEQ ID NO: 1497198 - RNA, 18 nt, Homo sapiens
cggccccucccccugaga

SEQ ID NO: 1497199 - RNA, 14 nt, Homo sapiens
cggccgacugccug

SEQ ID NO: 1497200 - RNA, 22 nt, Homo sapiens
cggccuggggcgagcacuguga

SEQ ID NO: 1497201 - RNA, 23 nt, Homo sapiens
cggccuggggcgagcacugugag

SEQ ID NO: 1497202 - RNA, 15 nt, Homo sapiens
cggcuacucuggaau

SEQ ID NO: 1497203 - RNA, 13 nt, Homo sapiens
cgggaacaguguu

SEQ ID NO: 1497204 - RNA, 13 nt, Homo sapiens
cgggagcacugcg

SEQ ID NO: 1497205 - RNA, 20 nt, Homo sapiens
cgggaggaggaggagcaccu

SEQ ID NO: 1497206 - RNA, 20 nt, Homo sapiens
cgggaucucguaucuuuaaa

SEQ ID NO: 1497207 - RNA, 17 nt, Homo sapiens
cgggauggccagagaug

SEQ ID NO: 1497208 - RNA, 22 nt, Homo sapiens
cgggaugucagcagacacacau

SEQ ID NO: 1497209 - RNA, 15 nt, Homo sapiens
cgggccccaccugca

SEQ ID NO: 1497210 - RNA, 16 nt, Homo sapiens
cgggccccauccucau

SEQ ID NO: 1497211 - RNA, 15 nt, Homo sapiens
cggggcagggccuuc

SEQ ID NO: 1497212 - RNA, 15 nt, Homo sapiens
cggggccagcacuuc

SEQ ID NO: 1497213 - RNA, 18 nt, Homo sapiens
cggggccagcacuuccau

SEQ ID NO: 1497214 - RNA, 18 nt, Homo sapiens
cgggggaccccuuugccc

SEQ ID NO: 1497215 - RNA, 14 nt, Homo sapiens
cggucagugccuuu

SEQ ID NO: 1497216 - RNA, 17 nt, Homo sapiens
cggucccacacugguga

SEQ ID NO: 1497217 - RNA, 16 nt, Homo sapiens
cggucccugucccucu

SEQ ID NO: 1497218 - RNA, 15 nt, Homo sapiens
cggugcaugaugcug

SEQ ID NO: 1497219 - RNA, 18 nt, Homo sapiens
cgguggcucaugccugua

SEQ ID NO: 1497220 - RNA, 16 nt, Homo sapiens
cggugugcaccaacau

SEQ ID NO: 1497221 - RNA, 16 nt, Homo sapiens
cgguuugucaguucuu

SEQ ID NO: 1497222 - RNA, 22 nt, Homo sapiens
cgguuuuuuauuuucuuuacaa

SEQ ID NO: 1497223 - RNA, 18 nt, Homo sapiens
cguaaacgacacucucug

SEQ ID NO: 1497224 - RNA, 22 nt, Homo sapiens
cguaaucauccccauccuccag

SEQ ID NO: 1497225 - RNA, 14 nt, Homo sapiens
cguacucucacaug

SEQ ID NO: 1497226 - RNA, 20 nt, Homo sapiens
cguagaaagauccuucgggu

SEQ ID NO: 1497227 - RNA, 12 nt, Homo sapiens
cuguuggaugau

SEQ ID NO: 1497228 - RNA, 15 nt, Homo sapiens
cuguugucauugcug

SEQ ID NO: 1497229 - RNA, 19 nt, Homo sapiens
cuguuuaacauuuccucag

SEQ ID NO: 1497230 - RNA, 18 nt, Homo sapiens
cuguuuagcagaacucau

SEQ ID NO: 1497231 - RNA, 17 nt, Homo sapiens
cuguuucugcuugcucu

SEQ ID NO: 1497232 - RNA, 19 nt, Homo sapiens
cuguuugaaaacuucagaa

SEQ ID NO: 1497233 - RNA, 20 nt, Homo sapiens
cuguuuuguaagugcugcua

SEQ ID NO: 1497234 - RNA, 21 nt, Homo sapiens
cuguuuuguaagugcugcuau

SEQ ID NO: 1497235 - RNA, 19 nt, Homo sapiens
cuuaaaacaauucugugac

SEQ ID NO: 1497236 - RNA, 22 nt, Homo sapiens
cuuaaaauaagcagguggaucu

SEQ ID NO: 1497237 - RNA, 20 nt, Homo sapiens
cuuaaaauaaugaauacauu

SEQ ID NO: 1497238 - RNA, 21 nt, Homo sapiens
cuuaaacauaauaaaucacac

SEQ ID NO: 1497239 - RNA, 21 nt, Homo sapiens
cuuaaacuaaauaaugaauaa

SEQ ID NO: 1497240 - RNA, 16 nt, Homo sapiens
cuuaaagcauuugcaa

SEQ ID NO: 1497241 - RNA, 20 nt, Homo sapiens
cuuaaagcauuugcaacagc

SEQ ID NO: 1497242 - RNA, 16 nt, Homo sapiens
cuuaaaggcuguggua

SEQ ID NO: 1497243 - RNA, 20 nt, Homo sapiens
cuuaaaguuuaaaguugcac

SEQ ID NO: 1497244 - RNA, 23 nt, Homo sapiens
cuuaaauaauaaacaguggaaua

SEQ ID NO: 1497245 - RNA, 13 nt, Homo sapiens
cuuaaauaaucuc

SEQ ID NO: 1497246 - RNA, 22 nt, Homo sapiens
cuuaaaugaucugccucuaaaa

SEQ ID NO: 1497247 - RNA, 21 nt, Homo sapiens
cuuaaaugcucauuuucuggu

SEQ ID NO: 1497248 - RNA, 21 nt, Homo sapiens
cuuaaauuugauuuacauaua

SEQ ID NO: 1497249 - RNA, 14 nt, Homo sapiens
cuuaacacauucaa

SEQ ID NO: 1497250 - RNA, 14 nt, Homo sapiens
cuuaacacuugacc

SEQ ID NO: 1497251 - RNA, 17 nt, Homo sapiens
cuuaacagaugcaaugu

SEQ ID NO: 1497252 - RNA, 14 nt, Homo sapiens
cuuaacauucugua

SEQ ID NO: 1497253 - RNA, 18 nt, Homo sapiens
cuuaaccuuuuaauacug

SEQ ID NO: 1497254 - RNA, 16 nt, Homo sapiens
cuuaagagacacucca

SEQ ID NO: 1497255 - RNA, 21 nt, Homo sapiens
cuuaagagacacuccaaaccu

SEQ ID NO: 1497256 - RNA, 14 nt, Homo sapiens
cuuccaaaccugac

SEQ ID NO: 1497257 - RNA, 18 nt, Homo sapiens
cuuccagauugacgacaa

SEQ ID NO: 1497258 - RNA, 20 nt, Homo sapiens
cuuccagcucagaacccauc

SEQ ID NO: 1497259 - RNA, 17 nt, Homo sapiens
cuuccagcuucaggcac

SEQ ID NO: 1497260 - RNA, 22 nt, Homo sapiens
cuuccaugacauaagugcuauu

SEQ ID NO: 1497261 - RNA, 17 nt, Homo sapiens
cuuccaugacccuuugc

SEQ ID NO: 1497262 - RNA, 12 nt, Homo sapiens
cuuccaugagaa

SEQ ID NO: 1497263 - RNA, 15 nt, Homo sapiens
cuuccaugugccuuu

SEQ ID NO: 1497264 - RNA, 23 nt, Homo sapiens
cuucccaccccuacacacacacu

SEQ ID NO: 1497265 - RNA, 22 nt, Homo sapiens
cuucccagcucugacccuucua

SEQ ID NO: 1497266 - RNA, 12 nt, Homo sapiens
cuucccauuucu

SEQ ID NO: 1497267 - RNA, 22 nt, Homo sapiens
cuucccucucugcagacuuccc

SEQ ID NO: 1497268 - RNA, 22 nt, Homo sapiens
cuucccuugcuggaaaacccaa

SEQ ID NO: 1497269 - RNA, 14 nt, Homo sapiens
cuuccgccgucuca

SEQ ID NO: 1497270 - RNA, 22 nt, Homo sapiens
cuuccguauccaucgaagcaga

SEQ ID NO: 1497271 - RNA, 15 nt, Homo sapiens
cuuccuaaacccaau

SEQ ID NO: 1497272 - RNA, 15 nt, Homo sapiens
cuuccucacaccccu

SEQ ID NO: 1497273 - RNA, 16 nt, Homo sapiens
cuuccucuagaagcca

SEQ ID NO: 1497274 - RNA, 19 nt, Homo sapiens
cuuccugaacaaccagcug

SEQ ID NO: 1497275 - RNA, 22 nt, Homo sapiens
cuuccugaagggggacacucca

SEQ ID NO: 1497276 - RNA, 15 nt, Homo sapiens
cuuccugagcuuucu

SEQ ID NO: 1497277 - RNA, 20 nt, Homo sapiens
cuuccugaguggugccaaac

SEQ ID NO: 1497278 - RNA, 19 nt, Homo sapiens
cuuccuggaguacaaacac

SEQ ID NO: 1497279 - RNA, 21 nt, Homo sapiens
cuuccugguuuuguacacugc

SEQ ID NO: 1497280 - RNA, 15 nt, Homo sapiens
cuuccuguacuugaa

SEQ ID NO: 1497281 - RNA, 18 nt, Homo sapiens
cuuccuguccccaaaaug

SEQ ID NO: 1497282 - RNA, 15 nt, Homo sapiens
cuuccuguguccuga

SEQ ID NO: 1497283 - RNA, 22 nt, Homo sapiens
cuuccuuccacucccuuugcca

SEQ ID NO: 1497284 - RNA, 20 nt, Homo sapiens
cuuccuuuaaagaugaacuc

SEQ ID NO: 1497285 - RNA, 17 nt, Homo sapiens
cuuccuuuuaacugcca

SEQ ID NO: 1497286 - RNA, 18 nt, Homo sapiens
aauuuaucaaagcauaga

SEQ ID NO: 1497287 - RNA, 18 nt, Homo sapiens
aauuuauucaauuccucu

SEQ ID NO: 1497288 - RNA, 19 nt, Homo sapiens
aauuuauuuaaguucacaa

SEQ ID NO: 1497289 - RNA, 15 nt, Homo sapiens
aauuuauuucaaaaa

SEQ ID NO: 1497290 - RNA, 15 nt, Homo sapiens
aauuucacugaugua

SEQ ID NO: 1497291 - RNA, 23 nt, Homo sapiens
aauuucacuucaggagaaacugc

SEQ ID NO: 1497292 - RNA, 21 nt, Homo sapiens
aauuuccuuuuugacacugaa

SEQ ID NO: 1497293 - RNA, 20 nt, Homo sapiens
aauuucggauuuuuuccaaa

SEQ ID NO: 1497294 - RNA, 15 nt, Homo sapiens
aauuugagauucuac

SEQ ID NO: 1497295 - RNA, 12 nt, Homo sapiens
aauuugaugaaa

SEQ ID NO: 1497296 - RNA, 21 nt, Homo sapiens
aauuugguaaauuaguauuua

SEQ ID NO: 1497297 - RNA, 20 nt, Homo sapiens
aauuuuacuccauaaacaga

SEQ ID NO: 1497298 - RNA, 13 nt, Homo sapiens
aaaaaaacuucau

SEQ ID NO: 1497299 - RNA, 16 nt, Homo sapiens
aaaaaacacaucuggc

SEQ ID NO: 1497300 - RNA, 19 nt, Homo sapiens
aaaaaagaacaacugccaa

SEQ ID NO: 1497301 - RNA, 13 nt, Homo sapiens
aaaaaagaacaca

SEQ ID NO: 1497302 - RNA, 14 nt, Homo sapiens
aaaaacaaccuugc

SEQ ID NO: 1497303 - RNA, 21 nt, Homo sapiens
aaaaacagguauauacuuuga

SEQ ID NO: 1497304 - RNA, 11 nt, Homo sapiens
aaaaacaugua

SEQ ID NO: 1497305 - RNA, 11 nt, Homo sapiens
aaaaacauguu

SEQ ID NO: 1497306 - RNA, 23 nt, Homo sapiens
aaaaaccucuaugcaaucugagu

SEQ ID NO: 1497307 - RNA, 20 nt, Homo sapiens
aaaaacugauugaaugauau

SEQ ID NO: 1497308 - RNA, 13 nt, Homo sapiens
aaaaagaaaugca

SEQ ID NO: 1497309 - RNA, 22 nt, Homo sapiens
aaaaagccugguuuuucucaau

SEQ ID NO: 1497310 - RNA, 17 nt, Homo sapiens
aaaaaggacucugcuuc

SEQ ID NO: 1497311 - RNA, 22 nt, Homo sapiens
aaaaagggauccguacauucaa

SEQ ID NO: 1497312 - RNA, 17 nt, Homo sapiens
aaaaaguuaaucuucau

SEQ ID NO: 1497313 - RNA, 16 nt, Homo sapiens
aaaaaguuucacaggu

SEQ ID NO: 1497314 - RNA, 22 nt, Homo sapiens
aaaaauaaaacuucacauuuau

SEQ ID NO: 1497315 - RNA, 18 nt, Homo sapiens
aaaaauaaaucuguucug

SEQ ID NO: 1497316 - RNA, 23 nt, Homo sapiens
aaaaauagauaaacuauacacuu

SEQ ID NO: 1497317 - RNA, 23 nt, Homo sapiens
aaaaauauauuuaaugauaagua

SEQ ID NO: 1497318 - RNA, 13 nt, Homo sapiens
aaaaauauuccaa

SEQ ID NO: 1497319 - RNA, 20 nt, Homo sapiens
aaaaauauuguuucugcauu

SEQ ID NO: 1497320 - RNA, 20 nt, Homo sapiens
aaaaauauuugcugagugaa

SEQ ID NO: 1497321 - RNA, 17 nt, Homo sapiens
aaaaaucauaguacucu

SEQ ID NO: 1497322 - RNA, 14 nt, Homo sapiens
aaaaaugacuaaaa

SEQ ID NO: 1497323 - RNA, 17 nt, Homo sapiens
aaaaaugaugggacaau

SEQ ID NO: 1497324 - RNA, 18 nt, Homo sapiens
aaaaaugcccauuugccu

SEQ ID NO: 1497325 - RNA, 21 nt, Homo sapiens
aaaaauggaaacuauauugac

SEQ ID NO: 1497326 - RNA, 23 nt, Homo sapiens
aaaaauggauacuggugcaguca

SEQ ID NO: 1497327 - RNA, 20 nt, Homo sapiens
aaaaaugguugauggaaaau

SEQ ID NO: 1497328 - RNA, 15 nt, Homo sapiens
aaaaauguccugccu

SEQ ID NO: 1497329 - RNA, 14 nt, Homo sapiens
aaaaauuagcugug

SEQ ID NO: 1497330 - RNA, 16 nt, Homo sapiens
aaaaauucugaaugua

SEQ ID NO: 1497331 - RNA, 16 nt, Homo sapiens
aaaaauugagacauuu

SEQ ID NO: 1497332 - RNA, 20 nt, Homo sapiens
aaaacaaaugggaaaauguc

SEQ ID NO: 1497333 - RNA, 20 nt, Homo sapiens
aaaacaacuucaauauccaa

SEQ ID NO: 1497334 - RNA, 16 nt, Homo sapiens
aaaacaccuagcuuua

SEQ ID NO: 1497335 - RNA, 18 nt, Homo sapiens
aaaacagacaaaacaauc

SEQ ID NO: 1497336 - RNA, 20 nt, Homo sapiens
aaaacagaucugaauucugc

SEQ ID NO: 1497337 - RNA, 19 nt, Homo sapiens
aaaacaucuuuaaggggag

SEQ ID NO: 1497338 - RNA, 18 nt, Homo sapiens
aaaacaugauuguuuaca

SEQ ID NO: 1497339 - RNA, 16 nt, Homo sapiens
aaaacauguaugugca

SEQ ID NO: 1497340 - RNA, 12 nt, Homo sapiens
aaaaccaaagag

SEQ ID NO: 1497341 - RNA, 16 nt, Homo sapiens
aaaaccaauagcuuua

SEQ ID NO: 1497342 - RNA, 21 nt, Homo sapiens
aaaaccccaucuuuacuaaaa

SEQ ID NO: 1497343 - RNA, 21 nt, Homo sapiens
aaaaccgaggcccucaaucca

SEQ ID NO: 1497344 - RNA, 15 nt, Homo sapiens
aaaaccucuaugcaa

SEQ ID NO: 1497345 - RNA, 23 nt, Homo sapiens
aaaaccugaagacugaggacaaa

SEQ ID NO: 1497346 - RNA, 14 nt, Homo sapiens
aaaaccuuccccag

SEQ ID NO: 1497347 - RNA, 17 nt, Homo sapiens
aaaacguuuuauugugu

SEQ ID NO: 1497348 - RNA, 16 nt, Homo sapiens
aaaacuaagaaacuua

SEQ ID NO: 1497349 - RNA, 14 nt, Homo sapiens
aaaacucacuguga

SEQ ID NO: 1497350 - RNA, 11 nt, Homo sapiens
aaaacucuccu

SEQ ID NO: 1497351 - RNA, 22 nt, Homo sapiens
aaaacucugggaaauaagagag

SEQ ID NO: 1497352 - RNA, 21 nt, Homo sapiens
aaaacucugguaaaugaucac

SEQ ID NO: 1497353 - RNA, 19 nt, Homo sapiens
aaaacugacaguaaaucuc

SEQ ID NO: 1497354 - RNA, 17 nt, Homo sapiens
aaaacugauuuuuagcu

SEQ ID NO: 1497355 - RNA, 15 nt, Homo sapiens
aaaacuguuaccuaa

SEQ ID NO: 1497356 - RNA, 22 nt, Homo sapiens
aaaacuugauguguuaucucuu

SEQ ID NO: 1497357 - RNA, 15 nt, Homo sapiens
aaaagaaaagaaaau

SEQ ID NO: 1497358 - RNA, 16 nt, Homo sapiens
aaaagauaacaagauc

SEQ ID NO: 1497359 - RNA, 18 nt, Homo sapiens
aaaagauuuucagaaaau

SEQ ID NO: 1497360 - RNA, 14 nt, Homo sapiens
aaaagcaaguucgu

SEQ ID NO: 1497361 - RNA, 15 nt, Homo sapiens
aaaagccacaaugaa

SEQ ID NO: 1497362 - RNA, 20 nt, Homo sapiens
aaaagcgacccauucagaga

SEQ ID NO: 1497363 - RNA, 22 nt, Homo sapiens
aaaagcuauuagccaggaucau

SEQ ID NO: 1497364 - RNA, 15 nt, Homo sapiens
aaaagcugaucauaa

SEQ ID NO: 1497365 - RNA, 20 nt, Homo sapiens
aaaagcuucuuaauuaauuu

SEQ ID NO: 1497366 - RNA, 12 nt, Homo sapiens
aaaagcuuuaaa

SEQ ID NO: 1497367 - RNA, 10 nt, Homo sapiens
aaaagcuuuu

SEQ ID NO: 1497368 - RNA, 20 nt, Homo sapiens
aaaaggaaggagaaugggau

SEQ ID NO: 1497369 - RNA, 21 nt, Homo sapiens
aaaagggauccguacauucaa

SEQ ID NO: 1497370 - RNA, 18 nt, Homo sapiens
aaaagggcagggcaucuc

SEQ ID NO: 1497371 - RNA, 20 nt, Homo sapiens
aaaaggucauagcugagauu

SEQ ID NO: 1497372 - RNA, 13 nt, Homo sapiens
aaaaggucauaua

SEQ ID NO: 1497373 - RNA, 22 nt, Homo sapiens
aaaagguuaaacccacagccaa

SEQ ID NO: 1497374 - RNA, 19 nt, Homo sapiens
aaaagguuaaauauuguca

SEQ ID NO: 1497375 - RNA, 15 nt, Homo sapiens
aaaagucuaccaccg

SEQ ID NO: 1497376 - RNA, 12 nt, Homo sapiens
aaaaguuuacaa

SEQ ID NO: 1497377 - RNA, 12 nt, Homo sapiens
aaaauaauucua

SEQ ID NO: 1497378 - RNA, 17 nt, Homo sapiens
aaaauacaugcaucuca

SEQ ID NO: 1497379 - RNA, 13 nt, Homo sapiens
aaaauacauugua

SEQ ID NO: 1497380 - RNA, 21 nt, Homo sapiens
aaaauacggacguacuuugug

SEQ ID NO: 1497381 - RNA, 17 nt, Homo sapiens
aaaauacuauugccuca

SEQ ID NO: 1497382 - RNA, 15 nt, Homo sapiens
aaaauagcucuuuca

SEQ ID NO: 1497383 - RNA, 18 nt, Homo sapiens
aaaauaguuaagacauga

SEQ ID NO: 1497384 - RNA, 15 nt, Homo sapiens
aaaauauauacuaaa

SEQ ID NO: 1497385 - RNA, 21 nt, Homo sapiens
aaaauauauuucagauaucag

SEQ ID NO: 1497386 - RNA, 21 nt, Homo sapiens
aaaauaugggaaagacaugca

SEQ ID NO: 1497387 - RNA, 19 nt, Homo sapiens
aaaauauuauguguuucca

SEQ ID NO: 1497388 - RNA, 15 nt, Homo sapiens
aaaauauuguuucug

SEQ ID NO: 1497389 - RNA, 20 nt, Homo sapiens
aaaauauuucagauaucaaa

SEQ ID NO: 1497390 - RNA, 21 nt, Homo sapiens
aaaauauuuccugacuugagu

SEQ ID NO: 1497391 - RNA, 15 nt, Homo sapiens
aaaaucacacuguaa

SEQ ID NO: 1497392 - RNA, 13 nt, Homo sapiens
aaaaucacucuca

SEQ ID NO: 1497393 - RNA, 19 nt, Homo sapiens
aaaaucacucucagugcuu

SEQ ID NO: 1497394 - RNA, 24 nt, Homo sapiens
aaaauccuauucugaugaaucuca

SEQ ID NO: 1497395 - RNA, 14 nt, Homo sapiens
aaaaucguuuugcc

SEQ ID NO: 1497396 - RNA, 12 nt, Homo sapiens
aaaaucuuggau

SEQ ID NO: 1497397 - RNA, 20 nt, Homo sapiens
aaaaugaaaggaaguuucag

SEQ ID NO: 1497398 - RNA, 12 nt, Homo sapiens
aaaaugacauua

SEQ ID NO: 1497399 - RNA, 12 nt, Homo sapiens
aaaaugagacaa

SEQ ID NO: 1497400 - RNA, 19 nt, Homo sapiens
aaaaugaguugugaugaau

SEQ ID NO: 1497401 - RNA, 22 nt, Homo sapiens
aaaaugccucaauucacauaga

SEQ ID NO: 1497402 - RNA, 17 nt, Homo sapiens
aaaauggaaugcuacuc

SEQ ID NO: 1497403 - RNA, 18 nt, Homo sapiens
aaaauggcaaaugcacug

SEQ ID NO: 1497404 - RNA, 22 nt, Homo sapiens
aaaaugggagacagccucuuac

SEQ ID NO: 1497405 - RNA, 16 nt, Homo sapiens
aaaauguaauuacuua

SEQ ID NO: 1497406 - RNA, 13 nt, Homo sapiens
aaaauguacucag

SEQ ID NO: 1497407 - RNA, 17 nt, Homo sapiens
aaaauguccugccuuuu

SEQ ID NO: 1497408 - RNA, 23 nt, Homo sapiens
aaaaugucuaagauaguaacaau

SEQ ID NO: 1497409 - RNA, 11 nt, Homo sapiens
aaaaugugaug

SEQ ID NO: 1497410 - RNA, 18 nt, Homo sapiens
aaaauguguccuaucuau

SEQ ID NO: 1497411 - RNA, 16 nt, Homo sapiens
aaaauguuuaccagug

SEQ ID NO: 1497412 - RNA, 14 nt, Homo sapiens
aaaauuaugaccau

SEQ ID NO: 1497413 - RNA, 17 nt, Homo sapiens
aaaauucagagaguuag

SEQ ID NO: 1497414 - RNA, 20 nt, Homo sapiens
aaaauucuauguuaauuaca

SEQ ID NO: 1497415 - RNA, 14 nt, Homo sapiens
aaaauugacaauga

SEQ ID NO: 1497416 - RNA, 15 nt, Homo sapiens
aaaauugacaaugau

SEQ ID NO: 1497417 - RNA, 13 nt, Homo sapiens
aaaauugauauac

SEQ ID NO: 1497418 - RNA, 23 nt, Homo sapiens
aaaauugcaauuucuuagguaac

SEQ ID NO: 1497419 - RNA, 17 nt, Homo sapiens
aaaauugggcaugccau

SEQ ID NO: 1497420 - RNA, 17 nt, Homo sapiens
aaaauugugaucagacc

SEQ ID NO: 1497421 - RNA, 18 nt, Homo sapiens
aaaauuuaaaaaacugug

SEQ ID NO: 1497422 - RNA, 15 nt, Homo sapiens
aaaauuuagcccuuu

SEQ ID NO: 1497423 - RNA, 16 nt, Homo sapiens
aaaauuuuaguccaaa

SEQ ID NO: 1497424 - RNA, 22 nt, Homo sapiens
aaaauuuuuuuuguaacuggag

SEQ ID NO: 1497425 - RNA, 16 nt, Homo sapiens
aaacaaaaaagacuug

SEQ ID NO: 1497426 - RNA, 18 nt, Homo sapiens
aaacaaugaaaacucuuu

SEQ ID NO: 1497427 - RNA, 17 nt, Homo sapiens
aaacacaaauagaacau

SEQ ID NO: 1497428 - RNA, 13 nt, Homo sapiens
aaacacacaucca

SEQ ID NO: 1497429 - RNA, 22 nt, Homo sapiens
aaacacauacaggaagguagaa

SEQ ID NO: 1497430 - RNA, 17 nt, Homo sapiens
aaacaccgcuucugccu

SEQ ID NO: 1497431 - RNA, 20 nt, Homo sapiens
aaacaccguguuuucugaca

SEQ ID NO: 1497432 - RNA, 14 nt, Homo sapiens
aaacaccuccucau

SEQ ID NO: 1497433 - RNA, 23 nt, Homo sapiens
aaacacucuugaauagacuucca

SEQ ID NO: 1497434 - RNA, 14 nt, Homo sapiens
aaacacuuacagaa

SEQ ID NO: 1497435 - RNA, 17 nt, Homo sapiens
aaacagaacugcaguca

SEQ ID NO: 1497436 - RNA, 23 nt, Homo sapiens
aaacagaacugcagucagcauga

SEQ ID NO: 1497437 - RNA, 16 nt, Homo sapiens
aaacagaugaugagaa

SEQ ID NO: 1497438 - RNA, 21 nt, Homo sapiens
aaacagcaggacuuguuuaca

SEQ ID NO: 1497439 - RNA, 14 nt, Homo sapiens
aaacagcaguccca

SEQ ID NO: 1497440 - RNA, 16 nt, Homo sapiens
aaacaggaccacaaaa

SEQ ID NO: 1497441 - RNA, 16 nt, Homo sapiens
aaacaggguaccucaa

SEQ ID NO: 1497442 - RNA, 20 nt, Homo sapiens
aaacaguaaugacucucuga

SEQ ID NO: 1497443 - RNA, 17 nt, Homo sapiens
aaacauagcaucucagg

SEQ ID NO: 1497444 - RNA, 23 nt, Homo sapiens
aaacauugauuauaagcauguau

SEQ ID NO: 1497445 - RNA, 14 nt, Homo sapiens
aaacauugugauca

SEQ ID NO: 1497446 - RNA, 13 nt, Homo sapiens
aaacauuuugaca

SEQ ID NO: 1497447 - RNA, 13 nt, Homo sapiens
aauuuuacuucca

SEQ ID NO: 1497448 - RNA, 20 nt, Homo sapiens
aauuuuauaacagaauuaaa

SEQ ID NO: 1497449 - RNA, 16 nt, Homo sapiens
aauuuucaauuugaga

SEQ ID NO: 1497450 - RNA, 23 nt, Homo sapiens
aauuuucagcagagaccuuccaa

SEQ ID NO: 1497451 - RNA, 13 nt, Homo sapiens
aauuuucauucau

SEQ ID NO: 1497452 - RNA, 15 nt, Homo sapiens
aauuuugccaaauaa

SEQ ID NO: 1497453 - RNA, 19 nt, Homo sapiens
aauuuuguuuguugaugug

SEQ ID NO: 1497454 - RNA, 19 nt, Homo sapiens
aauuuuuaaggauguugcc

SEQ ID NO: 1497455 - RNA, 15 nt, Homo sapiens
aauuuuuacauucau

SEQ ID NO: 1497456 - RNA, 21 nt, Homo sapiens
aauuuuugaaaaaaguacaua

SEQ ID NO: 1497457 - RNA, 16 nt, Homo sapiens
aauuuuugaaaacugg

SEQ ID NO: 1497458 - RNA, 23 nt, Homo sapiens
aauuuuuuuuuuuuaacuuuaag

SEQ ID NO: 1497459 - RNA, 20 nt, Homo sapiens
acaaaaaaaccucuaugcaa

SEQ ID NO: 1497460 - RNA, 18 nt, Homo sapiens
acaaaaaauagcuuucaa

SEQ ID NO: 1497461 - RNA, 20 nt, Homo sapiens
acaaaaacagguauauacuu

SEQ ID NO: 1497462 - RNA, 19 nt, Homo sapiens
acaaaaagccuuuuccaga

SEQ ID NO: 1497463 - RNA, 13 nt, Homo sapiens
acaaaaaugagcu

SEQ ID NO: 1497464 - RNA, 13 nt, Homo sapiens
acaaaaauuagcu

SEQ ID NO: 1497465 - RNA, 22 nt, Homo sapiens
acaaaaauugagacauuuacau

SEQ ID NO: 1497466 - RNA, 15 nt, Homo sapiens
acaaaaccacuggga

SEQ ID NO: 1497467 - RNA, 12 nt, Homo sapiens
acaaaaguaaaa

SEQ ID NO: 1497468 - RNA, 19 nt, Homo sapiens
acaaaauagacaauuugca

SEQ ID NO: 1497469 - RNA, 20 nt, Homo sapiens
acaaaauggucauccaaacu

SEQ ID NO: 1497470 - RNA, 20 nt, Homo sapiens
acaaaaugucucaguuuuca

SEQ ID NO: 1497471 - RNA, 14 nt, Homo sapiens
acaaacaaacagaa

SEQ ID NO: 1497472 - RNA, 12 nt, Homo sapiens
acaaacugcaca

SEQ ID NO: 1497473 - RNA, 14 nt, Homo sapiens
acaaacuucaaaga

SEQ ID NO: 1497474 - RNA, 18 nt, Homo sapiens
acaaacuucaaagaggaa

SEQ ID NO: 1497475 - RNA, 19 nt, Homo sapiens
acaaacuuuguuugucaca

SEQ ID NO: 1497476 - RNA, 17 nt, Homo sapiens
acaaagaggagcugcug

SEQ ID NO: 1497477 - RNA, 16 nt, Homo sapiens
acaaagagguguacag

SEQ ID NO: 1497478 - RNA, 19 nt, Homo sapiens
acaaagagguguacaggua

SEQ ID NO: 1497479 - RNA, 16 nt, Homo sapiens
acaaaggcaguucagu

SEQ ID NO: 1497480 - RNA, 16 nt, Homo sapiens
acaaauaaagugcagu

SEQ ID NO: 1497481 - RNA, 22 nt, Homo sapiens
acaaauauggggaaaaaacugu

SEQ ID NO: 1497482 - RNA, 19 nt, Homo sapiens
acaaaugaauaaaugcaua

SEQ ID NO: 1497483 - RNA, 14 nt, Homo sapiens
acaaaugaugccau

SEQ ID NO: 1497484 - RNA, 22 nt, Homo sapiens
acaaaugucuaucaacuuuaau

SEQ ID NO: 1497485 - RNA, 16 nt, Homo sapiens
acaaauuauguuacau

SEQ ID NO: 1497486 - RNA, 16 nt, Homo sapiens
acaaauucaagccuua

SEQ ID NO: 1497487 - RNA, 15 nt, Homo sapiens
acaaauuucacuuau

SEQ ID NO: 1497488 - RNA, 14 nt, Homo sapiens
acaacaaccuaugc

SEQ ID NO: 1497489 - RNA, 17 nt, Homo sapiens
acaacaaccuaugcacc

SEQ ID NO: 1497490 - RNA, 22 nt, Homo sapiens
acaacaggcaguggaagcaguu

SEQ ID NO: 1497491 - RNA, 23 nt, Homo sapiens
acaacaggcauagcaaaugacau

SEQ ID NO: 1497492 - RNA, 19 nt, Homo sapiens
acaacaugcgaccgugacc

SEQ ID NO: 1497493 - RNA, 23 nt, Homo sapiens
acaacaugcuagguagugaccua

SEQ ID NO: 1497494 - RNA, 14 nt, Homo sapiens
acaacauuuacuua

SEQ ID NO: 1497495 - RNA, 14 nt, Homo sapiens
acaacauuugcaga

SEQ ID NO: 1497496 - RNA, 20 nt, Homo sapiens
acaaccaaaaaauucuacaa

SEQ ID NO: 1497497 - RNA, 22 nt, Homo sapiens
acaaccacauguauuuauuccu

SEQ ID NO: 1497498 - RNA, 10 nt, Homo sapiens
acaacccagg

SEQ ID NO: 1497499 - RNA, 22 nt, Homo sapiens
acaaccugaaauuuauucacau

SEQ ID NO: 1497500 - RNA, 15 nt, Homo sapiens
acaaccuuccagcuc

SEQ ID NO: 1497501 - RNA, 20 nt, Homo sapiens
acaacugauacuucacuacu

SEQ ID NO: 1497502 - RNA, 19 nt, Homo sapiens
acaacuuggguucuucuca

SEQ ID NO: 1497503 - RNA, 15 nt, Homo sapiens
acaagaccaccacuu

SEQ ID NO: 1497504 - RNA, 18 nt, Homo sapiens
acaagaccccgucucaaa

SEQ ID NO: 1497505 - RNA, 18 nt, Homo sapiens
acaagaguugucuugucc

SEQ ID NO: 1497506 - RNA, 11 nt, Homo sapiens
acaagcauuuu

SEQ ID NO: 1497507 - RNA, 17 nt, Homo sapiens
acaagccaacuuguaaa

SEQ ID NO: 1497508 - RNA, 20 nt, Homo sapiens
acaagccacaagucuuccag

SEQ ID NO: 1497509 - RNA, 19 nt, Homo sapiens
acaagcccguuagccccag

SEQ ID NO: 1497510 - RNA, 17 nt, Homo sapiens
acaagcuauucccucaa

SEQ ID NO: 1497511 - RNA, 16 nt, Homo sapiens
acaaggcccugagcuu

SEQ ID NO: 1497512 - RNA, 17 nt, Homo sapiens
acaaggcccugagcuuu

SEQ ID NO: 1497513 - RNA, 12 nt, Homo sapiens
acaaggcuccaa

SEQ ID NO: 1497514 - RNA, 18 nt, Homo sapiens
acaaggcuccaagaccua

SEQ ID NO: 1497515 - RNA, 18 nt, Homo sapiens
acaaggcuuuaucucagg

SEQ ID NO: 1497516 - RNA, 19 nt, Homo sapiens
acaaggcuuuaucucaggg

SEQ ID NO: 1497517 - RNA, 20 nt, Homo sapiens
acaagguccucugucaguca

SEQ ID NO: 1497518 - RNA, 13 nt, Homo sapiens
acaaggugacaaa

SEQ ID NO: 1497519 - RNA, 23 nt, Homo sapiens
acaaggugagugugacuucccuu

SEQ ID NO: 1497520 - RNA, 21 nt, Homo sapiens
acaaguaccacucuuggucag

SEQ ID NO: 1497521 - RNA, 18 nt, Homo sapiens
acaaguauggcuccucca

SEQ ID NO: 1497522 - RNA, 18 nt, Homo sapiens
acaaguauguugagaguu

SEQ ID NO: 1497523 - RNA, 12 nt, Homo sapiens
acaagugucagg

SEQ ID NO: 1497524 - RNA, 22 nt, Homo sapiens
acaaguucaauaaaaaucugcu

SEQ ID NO: 1497525 - RNA, 15 nt, Homo sapiens
acaaguuucagacag

SEQ ID NO: 1497526 - RNA, 19 nt, Homo sapiens
acaauaaacaucugagcag

SEQ ID NO: 1497527 - RNA, 18 nt, Homo sapiens
acaauagugauugauaga

SEQ ID NO: 1497528 - RNA, 21 nt, Homo sapiens
acaaucccuggggcugugcau

SEQ ID NO: 1497529 - RNA, 14 nt, Homo sapiens
acaauccuguggau

SEQ ID NO: 1497530 - RNA, 15 nt, Homo sapiens
acaaugaacacuuau

SEQ ID NO: 1497531 - RNA, 19 nt, Homo sapiens
acaaugacuuguacucuga

SEQ ID NO: 1497532 - RNA, 12 nt, Homo sapiens
acaaugauccag

SEQ ID NO: 1497533 - RNA, 12 nt, Homo sapiens
acaaugcugauu

SEQ ID NO: 1497534 - RNA, 18 nt, Homo sapiens
acaauggcuaauucccag

SEQ ID NO: 1497535 - RNA, 21 nt, Homo sapiens
acaauggcuaauucccagagu

SEQ ID NO: 1497536 - RNA, 19 nt, Homo sapiens
acaauguuuauaaaggcca

SEQ ID NO: 1497537 - RNA, 17 nt, Homo sapiens
acaauuaaguaaaguca

SEQ ID NO: 1497538 - RNA, 23 nt, Homo sapiens
acaauugguaaaacucacuguga

SEQ ID NO: 1497539 - RNA, 15 nt, Homo sapiens
acaauuucauucagu

SEQ ID NO: 1497540 - RNA, 13 nt, Homo sapiens
acacaaagacauu

SEQ ID NO: 1497541 - RNA, 18 nt, Homo sapiens
acacaaagcucugucaau

SEQ ID NO: 1497542 - RNA, 12 nt, Homo sapiens
acacaaagggaa

SEQ ID NO: 1497543 - RNA, 18 nt, Homo sapiens
acacaaggauagaugcug

SEQ ID NO: 1497544 - RNA, 14 nt, Homo sapiens
acacaauaauguga

SEQ ID NO: 1497545 - RNA, 15 nt, Homo sapiens
acacacacacacugc

SEQ ID NO: 1497546 - RNA, 14 nt, Homo sapiens
acacacacccaggc

SEQ ID NO: 1497547 - RNA, 13 nt, Homo sapiens
acacacauccagc

SEQ ID NO: 1497548 - RNA, 16 nt, Homo sapiens
acacacccugagguca

SEQ ID NO: 1497549 - RNA, 19 nt, Homo sapiens
aauggacuauuuguuccac

SEQ ID NO: 1497550 - RNA, 16 nt, Homo sapiens
aauggcaaaugcacug

SEQ ID NO: 1497551 - RNA, 22 nt, Homo sapiens
aauggcaugcugaaacucgaag

SEQ ID NO: 1497552 - RNA, 13 nt, Homo sapiens
aauggcaugucag

SEQ ID NO: 1497553 - RNA, 14 nt, Homo sapiens
aauggcuacacuca

SEQ ID NO: 1497554 - RNA, 20 nt, Homo sapiens
aaugggagagcucuuguuau

SEQ ID NO: 1497555 - RNA, 14 nt, Homo sapiens
aaugggcacuggga

SEQ ID NO: 1497556 - RNA, 23 nt, Homo sapiens
aauggguuugcuagaaugugaua

SEQ ID NO: 1497557 - RNA, 17 nt, Homo sapiens
aauggucgcccaggaga

SEQ ID NO: 1497558 - RNA, 17 nt, Homo sapiens
aauggucucuaacauuu

SEQ ID NO: 1497559 - RNA, 21 nt, Homo sapiens
aauggugaagaacuagcauau

SEQ ID NO: 1497560 - RNA, 15 nt, Homo sapiens
aauggugcugcagau

SEQ ID NO: 1497561 - RNA, 23 nt, Homo sapiens
aaaggugagcccucauagggaga

SEQ ID NO: 1497562 - RNA, 13 nt, Homo sapiens
aaagguucacagg

SEQ ID NO: 1497563 - RNA, 21 nt, Homo sapiens
aaagguuucauguucacugug

SEQ ID NO: 1497564 - RNA, 19 nt, Homo sapiens
aaagguuuuggaucuugaa

SEQ ID NO: 1497565 - RNA, 19 nt, Homo sapiens
aaaguaauuguuccagaga

SEQ ID NO: 1497566 - RNA, 14 nt, Homo sapiens
aaaguagcaauuuc

SEQ ID NO: 1497567 - RNA, 17 nt, Homo sapiens
aaagucagaucuggucu

SEQ ID NO: 1497568 - RNA, 15 nt, Homo sapiens
aaaguccuuggacug

SEQ ID NO: 1497569 - RNA, 19 nt, Homo sapiens
aaagugagacuccgucaca

SEQ ID NO: 1497570 - RNA, 15 nt, Homo sapiens
aaagugcuugcuuuu

SEQ ID NO: 1497571 - RNA, 18 nt, Homo sapiens
aaaguggacaaggagugu

SEQ ID NO: 1497572 - RNA, 14 nt, Homo sapiens
aaaguguaacaauu

SEQ ID NO: 1497573 - RNA, 17 nt, Homo sapiens
aaaguguaccaacauaa

SEQ ID NO: 1497574 - RNA, 15 nt, Homo sapiens
aaaguuaaaagcaaa

SEQ ID NO: 1497575 - RNA, 17 nt, Homo sapiens
aaaguuacuauucugua

SEQ ID NO: 1497576 - RNA, 13 nt, Homo sapiens
aaaguugaugcua

SEQ ID NO: 1497577 - RNA, 12 nt, Homo sapiens
aaaguuugcuca

SEQ ID NO: 1497578 - RNA, 13 nt, Homo sapiens
aaaguuugcucaa

SEQ ID NO: 1497579 - RNA, 15 nt, Homo sapiens
aaauaaaacuucaca

SEQ ID NO: 1497580 - RNA, 16 nt, Homo sapiens
aaauaaauagcuauau

SEQ ID NO: 1497581 - RNA, 23 nt, Homo sapiens
aaauaacagaaagccugggugac

SEQ ID NO: 1497582 - RNA, 14 nt, Homo sapiens
aaauaaguggguca

SEQ ID NO: 1497583 - RNA, 20 nt, Homo sapiens
aaauaauuuuauuaugcaac

SEQ ID NO: 1497584 - RNA, 16 nt, Homo sapiens
aaauacaaaacuucca

SEQ ID NO: 1497585 - RNA, 14 nt, Homo sapiens
aaauacacaacaca

SEQ ID NO: 1497586 - RNA, 22 nt, Homo sapiens
aaauacacagugcugaccagac

SEQ ID NO: 1497587 - RNA, 23 nt, Homo sapiens
aaauacacagugcugaccagaca

SEQ ID NO: 1497588 - RNA, 13 nt, Homo sapiens
aaauacauguuca

SEQ ID NO: 1497589 - RNA, 20 nt, Homo sapiens
aaauaccuauaugaauauga

SEQ ID NO: 1497590 - RNA, 15 nt, Homo sapiens
aaauacuuuuacucu

SEQ ID NO: 1497591 - RNA, 18 nt, Homo sapiens
aaauagaaagaagccaua

SEQ ID NO: 1497592 - RNA, 20 nt, Homo sapiens
aaauagaguaaauacaggua

SEQ ID NO: 1497593 - RNA, 19 nt, Homo sapiens
aaauagcuauauccaugua

SEQ ID NO: 1497594 - RNA, 19 nt, Homo sapiens
aaauaggcagaauggaauc

SEQ ID NO: 1497595 - RNA, 16 nt, Homo sapiens
aaauagucuuccacaa

SEQ ID NO: 1497596 - RNA, 17 nt, Homo sapiens
aaauagucuuccacaaa

SEQ ID NO: 1497597 - RNA, 21 nt, Homo sapiens
aaauauaauuauccaaauuga

SEQ ID NO: 1497598 - RNA, 14 nt, Homo sapiens
aaauauaauugaca

SEQ ID NO: 1497599 - RNA, 13 nt, Homo sapiens
aaauauacauuca

SEQ ID NO: 1497600 - RNA, 15 nt, Homo sapiens
aaauauauacuaaac

SEQ ID NO: 1497601 - RNA, 14 nt, Homo sapiens
aaauauauuucaga

SEQ ID NO: 1497602 - RNA, 18 nt, Homo sapiens
aaauauauuuuggaaaac

SEQ ID NO: 1497603 - RNA, 21 nt, Homo sapiens
aaauaugauuuuauuugacaa

SEQ ID NO: 1497604 - RNA, 17 nt, Homo sapiens
aaauaugccuaguaaca

SEQ ID NO: 1497605 - RNA, 18 nt, Homo sapiens
aaauauuacucaguuuau

SEQ ID NO: 1497606 - RNA, 18 nt, Homo sapiens
aaauauuccaagcuucau

SEQ ID NO: 1497607 - RNA, 18 nt, Homo sapiens
aaauauugaggcuuugug

SEQ ID NO: 1497608 - RNA, 23 nt, Homo sapiens
aaauauuguugacaacugugacu

SEQ ID NO: 1497609 - RNA, 15 nt, Homo sapiens
aaauauuucccucac

SEQ ID NO: 1497610 - RNA, 18 nt, Homo sapiens
aaaucaauacacuaguug

SEQ ID NO: 1497611 - RNA, 18 nt, Homo sapiens
aaaucacucagcacucca

SEQ ID NO: 1497612 - RNA, 18 nt, Homo sapiens
aaaucagaccuggcugcu

SEQ ID NO: 1497613 - RNA, 17 nt, Homo sapiens
aaaucagcugcuacuac

SEQ ID NO: 1497614 - RNA, 20 nt, Homo sapiens
aaaucagcugcuacuacucc

SEQ ID NO: 1497615 - RNA, 15 nt, Homo sapiens
aaaucauaguuuaaa

SEQ ID NO: 1497616 - RNA, 23 nt, Homo sapiens
aaaucauaguuuaaacugcauua

SEQ ID NO: 1497617 - RNA, 17 nt, Homo sapiens
aaaucauuucaguauca

SEQ ID NO: 1497618 - RNA, 18 nt, Homo sapiens
aaaucauuucaguaucau

SEQ ID NO: 1497619 - RNA, 22 nt, Homo sapiens
aaaucauuucaguaucaucucc

SEQ ID NO: 1497620 - RNA, 14 nt, Homo sapiens
aaaucguccuccca

SEQ ID NO: 1497621 - RNA, 16 nt, Homo sapiens
aaaucuaagugauaua

SEQ ID NO: 1497622 - RNA, 12 nt, Homo sapiens
aaaucuagaaga

SEQ ID NO: 1497623 - RNA, 15 nt, Homo sapiens
aaaucuaggauuauu

SEQ ID NO: 1497624 - RNA, 17 nt, Homo sapiens
aaaucuauucuguguug

SEQ ID NO: 1497625 - RNA, 15 nt, Homo sapiens
aaaucucacaaauga

SEQ ID NO: 1497626 - RNA, 23 nt, Homo sapiens
aaaucugacauauuaugccugaa

SEQ ID NO: 1497627 - RNA, 15 nt, Homo sapiens
aaaucugacccagug

SEQ ID NO: 1497628 - RNA, 17 nt, Homo sapiens
aaaucuuggaaguacau

SEQ ID NO: 1497629 - RNA, 19 nt, Homo sapiens
aaaucuuguuggcaaauca

SEQ ID NO: 1497630 - RNA, 14 nt, Homo sapiens
aaaugaacauuuca

SEQ ID NO: 1497631 - RNA, 16 nt, Homo sapiens
aaaugaagggauauaa

SEQ ID NO: 1497632 - RNA, 15 nt, Homo sapiens
aaaugagccaugaga

SEQ ID NO: 1497633 - RNA, 12 nt, Homo sapiens
aaaugauggaau

SEQ ID NO: 1497634 - RNA, 14 nt, Homo sapiens
aaaugauguuuuca

SEQ ID NO: 1497635 - RNA, 20 nt, Homo sapiens
aaaugcaucaaaagacuuaa

SEQ ID NO: 1497636 - RNA, 19 nt, Homo sapiens
aaaugcuagguuaauucca

SEQ ID NO: 1497637 - RNA, 17 nt, Homo sapiens
aaaugcuucugcacaca

SEQ ID NO: 1497638 - RNA, 13 nt, Homo sapiens
aaauggcaaagaa

SEQ ID NO: 1497639 - RNA, 17 nt, Homo sapiens
aaaugggaaaaccagac

SEQ ID NO: 1497640 - RNA, 18 nt, Homo sapiens
aaaugggaaaaccagacu

SEQ ID NO: 1497641 - RNA, 13 nt, Homo sapiens
aaauggggccaga

SEQ ID NO: 1497642 - RNA, 15 nt, Homo sapiens
aaauguaacugugcc

SEQ ID NO: 1497643 - RNA, 18 nt, Homo sapiens
aaauguaacugugccagu

SEQ ID NO: 1497644 - RNA, 19 nt, Homo sapiens
aaauguccauuuauaucau

SEQ ID NO: 1497645 - RNA, 13 nt, Homo sapiens
aaaugucuaucaa

SEQ ID NO: 1497646 - RNA, 22 nt, Homo sapiens
aaaugugacccagauccucaca

SEQ ID NO: 1497647 - RNA, 12 nt, Homo sapiens
aaaugugaugcu

SEQ ID NO: 1497648 - RNA, 22 nt, Homo sapiens
aaauguggaggcuaucaacaaa

SEQ ID NO: 1497649 - RNA, 22 nt, Homo sapiens
aaauguguaauuuuguuuauau

SEQ ID NO: 1497650 - RNA, 15 nt, Homo sapiens
aaauuaagaaggcaa

SEQ ID NO: 1497651 - RNA, 18 nt, Homo sapiens
aaauuacugauccucgca

SEQ ID NO: 1497652 - RNA, 14 nt, Homo sapiens
aaccagagugcuga

SEQ ID NO: 1497653 - RNA, 18 nt, Homo sapiens
aaccaggcaccucuuccu

SEQ ID NO: 1497654 - RNA, 16 nt, Homo sapiens
aaccagguuuagacag

SEQ ID NO: 1497655 - RNA, 20 nt, Homo sapiens
aaccaguccccccacccuca

SEQ ID NO: 1497656 - RNA, 12 nt, Homo sapiens
aaccaugacugu

SEQ ID NO: 1497657 - RNA, 16 nt, Homo sapiens
aaccaugacugugacc

SEQ ID NO: 1497658 - RNA, 22 nt, Homo sapiens
aaccaugagaccacuguuauca

SEQ ID NO: 1497659 - RNA, 14 nt, Homo sapiens
aaccauuucucacu

SEQ ID NO: 1497660 - RNA, 11 nt, Homo sapiens
aacccaaagug

SEQ ID NO: 1497661 - RNA, 23 nt, Homo sapiens
aacccaaauugggacaacagugc

SEQ ID NO: 1497662 - RNA, 17 nt, Homo sapiens
aaguuuacaacuugauu

SEQ ID NO: 1497663 - RNA, 16 nt, Homo sapiens
aaguuuacccaugaag

SEQ ID NO: 1497664 - RNA, 18 nt, Homo sapiens
aaguuuaucacacagugu

SEQ ID NO: 1497665 - RNA, 11 nt, Homo sapiens
aaguuucacau

SEQ ID NO: 1497666 - RNA, 17 nt, Homo sapiens
aaguuucaucagucaau

SEQ ID NO: 1497667 - RNA, 14 nt, Homo sapiens
aaguuucccuuccu

SEQ ID NO: 1497668 - RNA, 13 nt, Homo sapiens
aaguuucuaaaaa

SEQ ID NO: 1497669 - RNA, 18 nt, Homo sapiens
aaguuucugauaccacug

SEQ ID NO: 1497670 - RNA, 23 nt, Homo sapiens
aaguuuucagaaccucuucccca

SEQ ID NO: 1497671 - RNA, 16 nt, Homo sapiens
aauaaaaaaagacaaa

SEQ ID NO: 1497672 - RNA, 24 nt, Homo sapiens
aauaaaacccaacagauacuggaa

SEQ ID NO: 1497673 - RNA, 21 nt, Homo sapiens
aauaaaagccaauuagcucua

SEQ ID NO: 1497674 - RNA, 12 nt, Homo sapiens
aauaaaccuccu

SEQ ID NO: 1497675 - RNA, 13 nt, Homo sapiens
aauaaacuacucu

SEQ ID NO: 1497676 - RNA, 17 nt, Homo sapiens
aauaaacuagacucuga

SEQ ID NO: 1497677 - RNA, 17 nt, Homo sapiens
aauaaagaauuaacaga

SEQ ID NO: 1497678 - RNA, 14 nt, Homo sapiens
aauaaauacugcag

SEQ ID NO: 1497679 - RNA, 14 nt, Homo sapiens
aauaaauaucugua

SEQ ID NO: 1497680 - RNA, 13 nt, Homo sapiens
aauaaauauuaca

SEQ ID NO: 1497681 - RNA, 15 nt, Homo sapiens
aauaaauauuacagu

SEQ ID NO: 1497682 - RNA, 16 nt, Homo sapiens
aauaaauauuuaauga

SEQ ID NO: 1497683 - RNA, 18 nt, Homo sapiens
aauaaauauuuaaugaau

SEQ ID NO: 1497684 - RNA, 17 nt, Homo sapiens
aauaaaucacacauuca

SEQ ID NO: 1497685 - RNA, 20 nt, Homo sapiens
aauaaaucguccucccaggc

SEQ ID NO: 1497686 - RNA, 19 nt, Homo sapiens
aauaaaucugacccagugc

SEQ ID NO: 1497687 - RNA, 22 nt, Homo sapiens
aauaaaugagagggaaucgacu

SEQ ID NO: 1497688 - RNA, 15 nt, Homo sapiens
aauaaaugucuugcc

SEQ ID NO: 1497689 - RNA, 14 nt, Homo sapiens
aauaacaggcauuu

SEQ ID NO: 1497690 - RNA, 14 nt, Homo sapiens
aauaacaguauuuu

SEQ ID NO: 1497691 - RNA, 13 nt, Homo sapiens
aauaacauguaau

SEQ ID NO: 1497692 - RNA, 13 nt, Homo sapiens
aauaagcaaucaa

SEQ ID NO: 1497693 - RNA, 21 nt, Homo sapiens
aauaaguauauaauccuguga

SEQ ID NO: 1497694 - RNA, 12 nt, Homo sapiens
aauaauaauuag

SEQ ID NO: 1497695 - RNA, 18 nt, Homo sapiens
aauaauauuguuguauaa

SEQ ID NO: 1497696 - RNA, 16 nt, Homo sapiens
aauaaugaacacuaca

SEQ ID NO: 1497697 - RNA, 16 nt, Homo sapiens
aauaaugaauacauuu

SEQ ID NO: 1497698 - RNA, 14 nt, Homo sapiens
aauaaugauaguua

SEQ ID NO: 1497699 - RNA, 18 nt, Homo sapiens
aauaauggaaacauuaca

SEQ ID NO: 1497700 - RNA, 18 nt, Homo sapiens
aauaauggguuucuuuca

SEQ ID NO: 1497701 - RNA, 21 nt, Homo sapiens
aauaauuaaccaccaauccaa

SEQ ID NO: 1497702 - RNA, 18 nt, Homo sapiens
aauaauugcucauaagca

SEQ ID NO: 1497703 - RNA, 20 nt, Homo sapiens
aauaauugcucauaagcaau

SEQ ID NO: 1497704 - RNA, 23 nt, Homo sapiens
aauacaagaguggagagaagcuc

SEQ ID NO: 1497705 - RNA, 24 nt, Homo sapiens
aauacagcagugucaucagaagau

SEQ ID NO: 1497706 - RNA, 13 nt, Homo sapiens
aauacauguucau

SEQ ID NO: 1497707 - RNA, 23 nt, Homo sapiens
aauacuacccauagaaaacuuga

SEQ ID NO: 1497708 - RNA, 14 nt, Homo sapiens
aauacuccuaagac

SEQ ID NO: 1497709 - RNA, 14 nt, Homo sapiens
aauacugcagcuug

SEQ ID NO: 1497710 - RNA, 14 nt, Homo sapiens
aauacuuacuauaa

SEQ ID NO: 1497711 - RNA, 16 nt, Homo sapiens
aauacuuugcuucaua

SEQ ID NO: 1497712 - RNA, 18 nt, Homo sapiens
aauacuuuuuacaauuaa

SEQ ID NO: 1497713 - RNA, 20 nt, Homo sapiens
aauagaaauaaauuccuaaa

SEQ ID NO: 1497714 - RNA, 19 nt, Homo sapiens
aauagaacuaucugcauua

SEQ ID NO: 1497715 - RNA, 22 nt, Homo sapiens
aauagauacaaaugucuaucaa

SEQ ID NO: 1497716 - RNA, 10 nt, Homo sapiens
aauagaucuc

SEQ ID NO: 1497717 - RNA, 19 nt, Homo sapiens
aauagcagccuuucucucu

SEQ ID NO: 1497718 - RNA, 14 nt, Homo sapiens
aauagcucuuucag

SEQ ID NO: 1497719 - RNA, 21 nt, Homo sapiens
aauagcuuucaaaagaaauuu

SEQ ID NO: 1497720 - RNA, 19 nt, Homo sapiens
aauaggugcuuauucucaa

SEQ ID NO: 1497721 - RNA, 14 nt, Homo sapiens
aauaguauuuauga

SEQ ID NO: 1497722 - RNA, 16 nt, Homo sapiens
aauagucuuccacaaa

SEQ ID NO: 1497723 - RNA, 21 nt, Homo sapiens
aauagugaauacuuacuauaa

SEQ ID NO: 1497724 - RNA, 16 nt, Homo sapiens
aauauaaaaguaaaua

SEQ ID NO: 1497725 - RNA, 20 nt, Homo sapiens
aauauaauaggacaaucauc

SEQ ID NO: 1497726 - RNA, 18 nt, Homo sapiens
aauauacauucaaacuua

SEQ ID NO: 1497727 - RNA, 22 nt, Homo sapiens
aauauagagggcuuaugauuca

SEQ ID NO: 1497728 - RNA, 17 nt, Homo sapiens
aauauauaauguugcca

SEQ ID NO: 1497729 - RNA, 21 nt, Homo sapiens
aauauauaguccagacacuua

SEQ ID NO: 1497730 - RNA, 20 nt, Homo sapiens
aauaucuuuuuuggaacuaa

SEQ ID NO: 1497731 - RNA, 16 nt, Homo sapiens
aauaugaguaauacau

SEQ ID NO: 1497732 - RNA, 13 nt, Homo sapiens
aauaugcagugau

SEQ ID NO: 1497733 - RNA, 22 nt, Homo sapiens
aauaugccuagcacaaguacca

SEQ ID NO: 1497734 - RNA, 14 nt, Homo sapiens
aauauguaaugcuu

SEQ ID NO: 1497735 - RNA, 15 nt, Homo sapiens
aauauguacauuugu

SEQ ID NO: 1497736 - RNA, 17 nt, Homo sapiens
aauauguagcucauccu

SEQ ID NO: 1497737 - RNA, 14 nt, Homo sapiens
aauauuacagugaa

SEQ ID NO: 1497738 - RNA, 17 nt, Homo sapiens
aauauuaguuaauggau

SEQ ID NO: 1497739 - RNA, 15 nt, Homo sapiens
aauauuauuugcuaa

SEQ ID NO: 1497740 - RNA, 12 nt, Homo sapiens
aauauuccugaa

SEQ ID NO: 1497741 - RNA, 19 nt, Homo sapiens
aauauugcugaacuacuuu

SEQ ID NO: 1497742 - RNA, 14 nt, Homo sapiens
aauauugugcccca

SEQ ID NO: 1497743 - RNA, 13 nt, Homo sapiens
aauauuguugaca

SEQ ID NO: 1497744 - RNA, 22 nt, Homo sapiens
aauauuguugacaacugugacu

SEQ ID NO: 1497745 - RNA, 15 nt, Homo sapiens
aauauuuagcuguaa

SEQ ID NO: 1497746 - RNA, 17 nt, Homo sapiens
aauauuuauuaccucug

SEQ ID NO: 1497747 - RNA, 20 nt, Homo sapiens
aauauuuauuauuuucaccu

SEQ ID NO: 1497748 - RNA, 14 nt, Homo sapiens
aauauuuauugucu

SEQ ID NO: 1497749 - RNA, 18 nt, Homo sapiens
aauauuuuaagaauuuca

SEQ ID NO: 1497750 - RNA, 19 nt, Homo sapiens
aauauuuuguaaugcugca

SEQ ID NO: 1497751 - RNA, 18 nt, Homo sapiens
aauauuuuuccacuuaaa

SEQ ID NO: 1497752 - RNA, 16 nt, Homo sapiens
aacuuuaucuaaagaa

SEQ ID NO: 1497753 - RNA, 14 nt, Homo sapiens
aacuuugacuuucu

SEQ ID NO: 1497754 - RNA, 15 nt, Homo sapiens
aacuuugccucaaga

SEQ ID NO: 1497755 - RNA, 18 nt, Homo sapiens
aacuuuguauuaaugugu

SEQ ID NO: 1497756 - RNA, 16 nt, Homo sapiens
aacuuuucgacauauu

SEQ ID NO: 1497757 - RNA, 18 nt, Homo sapiens
aacuuuucugcugauaag

SEQ ID NO: 1497758 - RNA, 18 nt, Homo sapiens
aacuuuuuuuucucucuu

SEQ ID NO: 1497759 - RNA, 18 nt, Homo sapiens
aagaaaacaccacuaauu

SEQ ID NO: 1497760 - RNA, 14 nt, Homo sapiens
aagaaaacuuccau

SEQ ID NO: 1497761 - RNA, 15 nt, Homo sapiens
aagaaaagcugccau

SEQ ID NO: 1497762 - RNA, 14 nt, Homo sapiens
aagaaaaugagaca

SEQ ID NO: 1497763 - RNA, 16 nt, Homo sapiens
aagaaaauggauuuaa

SEQ ID NO: 1497764 - RNA, 17 nt, Homo sapiens
aagaaacagaguggccu

SEQ ID NO: 1497765 - RNA, 20 nt, Homo sapiens
aagaaagacucuauucucaa

SEQ ID NO: 1497766 - RNA, 23 nt, Homo sapiens
aagaaagagcaacaauccaucuc

SEQ ID NO: 1497767 - RNA, 16 nt, Homo sapiens
aagaaagaugaaauaa

SEQ ID NO: 1497768 - RNA, 14 nt, Homo sapiens
aagaaauaccuuga

SEQ ID NO: 1497769 - RNA, 13 nt, Homo sapiens
aagaaaucaaaga

SEQ ID NO: 1497770 - RNA, 14 nt, Homo sapiens
aagaaccucuccau

SEQ ID NO: 1497771 - RNA, 18 nt, Homo sapiens
aagaacucugggcugcua

SEQ ID NO: 1497772 - RNA, 12 nt, Homo sapiens
aagaacuucauu

SEQ ID NO: 1497773 - RNA, 22 nt, Homo sapiens
aagaagacagcuuaauaguagu

SEQ ID NO: 1497774 - RNA, 16 nt, Homo sapiens
aagaagacauggagac

SEQ ID NO: 1497775 - RNA, 20 nt, Homo sapiens
aagaagauagauccaauuaa

SEQ ID NO: 1497776 - RNA, 15 nt, Homo sapiens
aagaagccacagacc

SEQ ID NO: 1497777 - RNA, 20 nt, Homo sapiens
aagaaggccagcaacauugg

SEQ ID NO: 1497778 - RNA, 21 nt, Homo sapiens
aagaagggaauuuauugccuc

SEQ ID NO: 1497779 - RNA, 14 nt, Homo sapiens
aagaaggguguuua

SEQ ID NO: 1497780 - RNA, 14 nt, Homo sapiens
aagaagugccaguu

SEQ ID NO: 1497781 - RNA, 16 nt, Homo sapiens
aagaaguuacuuugua

SEQ ID NO: 1497782 - RNA, 18 nt, Homo sapiens
aagaaucuaaaccuuaca

SEQ ID NO: 1497783 - RNA, 23 nt, Homo sapiens
aagaaucuaaaccuuacaugugu

SEQ ID NO: 1497784 - RNA, 13 nt, Homo sapiens
aagaaucuaauag

SEQ ID NO: 1497785 - RNA, 16 nt, Homo sapiens
aagaauuuuaccauuc

SEQ ID NO: 1497786 - RNA, 16 nt, Homo sapiens
aagacaauuugauaca

SEQ ID NO: 1497787 - RNA, 13 nt, Homo sapiens
aagacaugaacca

SEQ ID NO: 1497788 - RNA, 14 nt, Homo sapiens
aagacauucuucca

SEQ ID NO: 1497789 - RNA, 18 nt, Homo sapiens
aagacauuguguguauua

SEQ ID NO: 1497790 - RNA, 13 nt, Homo sapiens
aagaccaccacuu

SEQ ID NO: 1497791 - RNA, 16 nt, Homo sapiens
aagaccagccuggcca

SEQ ID NO: 1497792 - RNA, 16 nt, Homo sapiens
aagacccccagcacuu

SEQ ID NO: 1497793 - RNA, 20 nt, Homo sapiens
aagaccuggcagcucuggac

SEQ ID NO: 1497794 - RNA, 19 nt, Homo sapiens
aagacggaaaccucccuuu

SEQ ID NO: 1497795 - RNA, 18 nt, Homo sapiens
aagacuaaaugcacauuu

SEQ ID NO: 1497796 - RNA, 21 nt, Homo sapiens
aagacucaccucauccuuacc

SEQ ID NO: 1497797 - RNA, 22 nt, Homo sapiens
aagacuggaagcuaauuugcau

SEQ ID NO: 1497798 - RNA, 19 nt, Homo sapiens
aagacugguuuucugccaa

SEQ ID NO: 1497799 - RNA, 18 nt, Homo sapiens
aagacugucagcuuccaa

SEQ ID NO: 1497800 - RNA, 19 nt, Homo sapiens
aagacuucucuuuugcaca

SEQ ID NO: 1497801 - RNA, 11 nt, Homo sapiens
aagacuugaga

SEQ ID NO: 1497802 - RNA, 23 nt, Homo sapiens
aagacuuugauccaggugccaag

SEQ ID NO: 1497803 - RNA, 21 nt, Homo sapiens
aagagaaugaaauugcugaaa

SEQ ID NO: 1497804 - RNA, 21 nt, Homo sapiens
aagagagaacaacuacuguga

SEQ ID NO: 1497805 - RNA, 21 nt, Homo sapiens
aagagaggaaugccuguguga

SEQ ID NO: 1497806 - RNA, 13 nt, Homo sapiens
aagagcaacaauc

SEQ ID NO: 1497807 - RNA, 21 nt, Homo sapiens
aagagcuggaugcacaucagg

SEQ ID NO: 1497808 - RNA, 14 nt, Homo sapiens
aagaggaaagggag

SEQ ID NO: 1497809 - RNA, 15 nt, Homo sapiens
aagaggauagaauac

SEQ ID NO: 1497810 - RNA, 18 nt, Homo sapiens
aagaggcugccccucuca

SEQ ID NO: 1497811 - RNA, 16 nt, Homo sapiens
aagagggcccagccca

SEQ ID NO: 1497812 - RNA, 18 nt, Homo sapiens
aagagggccugugggagc

SEQ ID NO: 1497813 - RNA, 21 nt, Homo sapiens
aagagggcuuccucuagaagc

SEQ ID NO: 1497814 - RNA, 17 nt, Homo sapiens
aagaguaacuuuacucu

SEQ ID NO: 1497815 - RNA, 22 nt, Homo sapiens
aagaguauuuuaagaagacaua

SEQ ID NO: 1497816 - RNA, 19 nt, Homo sapiens
aagagugccguaacaacug

SEQ ID NO: 1497817 - RNA, 11 nt, Homo sapiens
aagaguggucu

SEQ ID NO: 1497818 - RNA, 16 nt, Homo sapiens
aagaguguuucuucca

SEQ ID NO: 1497819 - RNA, 14 nt, Homo sapiens
aagaguucuggaaa

SEQ ID NO: 1497820 - RNA, 21 nt, Homo sapiens
aagaguucuuaaggauuguga

SEQ ID NO: 1497821 - RNA, 19 nt, Homo sapiens
aagauaaaugugcugaaug

SEQ ID NO: 1497822 - RNA, 19 nt, Homo sapiens
aagauaccaaaaccacagu

SEQ ID NO: 1497823 - RNA, 14 nt, Homo sapiens
aagauaguaacaau

SEQ ID NO: 1497824 - RNA, 13 nt, Homo sapiens
aagauauuguaca

SEQ ID NO: 1497825 - RNA, 16 nt, Homo sapiens
aagauauuguacauaa

SEQ ID NO: 1497826 - RNA, 21 nt, Homo sapiens
aagauccaagaaggccuucau

SEQ ID NO: 1497827 - RNA, 20 nt, Homo sapiens
aagauccaagaggcccugca

SEQ ID NO: 1497828 - RNA, 18 nt, Homo sapiens
aagauccgagucuaccca

SEQ ID NO: 1497829 - RNA, 15 nt, Homo sapiens
aagaucuguuuugaa

SEQ ID NO: 1497830 - RNA, 17 nt, Homo sapiens
aagaucuugucuccacu

SEQ ID NO: 1497831 - RNA, 14 nt, Homo sapiens
aagaugaaguuuua

SEQ ID NO: 1497832 - RNA, 15 nt, Homo sapiens
aagaugaaguuuuau

SEQ ID NO: 1497833 - RNA, 23 nt, Homo sapiens
aagaugauggcucauuuacacuc

SEQ ID NO: 1497834 - RNA, 14 nt, Homo sapiens
aagaugcacugaaa

SEQ ID NO: 1497835 - RNA, 15 nt, Homo sapiens
aagaugcacugaaaa

SEQ ID NO: 1497836 - RNA, 17 nt, Homo sapiens
aagauggacuuaccugg

SEQ ID NO: 1497837 - RNA, 16 nt, Homo sapiens
aagaugggaacacugg

SEQ ID NO: 1497838 - RNA, 20 nt, Homo sapiens
aagaugguguggguguccug

SEQ ID NO: 1497839 - RNA, 22 nt, Homo sapiens
aagauguauuauaccagugaaa

SEQ ID NO: 1497840 - RNA, 23 nt, Homo sapiens
aagauuccugguuaaauuugaau

SEQ ID NO: 1497841 - RNA, 18 nt, Homo sapiens
aagauuuucccagucugu

SEQ ID NO: 1497842 - RNA, 16 nt, Homo sapiens
aagauuuuccucuugu

SEQ ID NO: 1497843 - RNA, 12 nt, Homo sapiens
aaggaugugauu

SEQ ID NO: 1497844 - RNA, 16 nt, Homo sapiens
aaggauuacucuccau

SEQ ID NO: 1497845 - RNA, 22 nt, Homo sapiens
aaggauuauuugcucaggggaa

SEQ ID NO: 1497846 - RNA, 14 nt, Homo sapiens
aaggcagauggggc

SEQ ID NO: 1497847 - RNA, 22 nt, Homo sapiens
aaggcauaugcuggcccauaaa

SEQ ID NO: 1497848 - RNA, 22 nt, Homo sapiens
aaggcaucagucccccugugca

SEQ ID NO: 1497849 - RNA, 15 nt, Homo sapiens
aaggcauuucuauca

SEQ ID NO: 1497850 - RNA, 16 nt, Homo sapiens
aaggcccugcugaguc

SEQ ID NO: 1497851 - RNA, 14 nt, Homo sapiens
aaggccucccucag

SEQ ID NO: 1497852 - RNA, 18 nt, Homo sapiens
aaggcggcuacaugccuc

SEQ ID NO: 1497853 - RNA, 23 nt, Homo sapiens
aaggcucccggaauuccgucacc

SEQ ID NO: 1497854 - RNA, 15 nt, Homo sapiens
aaggcuuuaucucag

SEQ ID NO: 1497855 - RNA, 20 nt, Homo sapiens
uuaauacagggcauuuuggu

SEQ ID NO: 1497856 - RNA, 20 nt, Homo sapiens
uuaauagaaauaaauuccua

SEQ ID NO: 1497857 - RNA, 18 nt, Homo sapiens
uuaauagacugagucaga

SEQ ID NO: 1497858 - RNA, 22 nt, Homo sapiens
uuaauauaguaacacacuucca

SEQ ID NO: 1497859 - RNA, 18 nt, Homo sapiens
uuaauauauaguccagac

SEQ ID NO: 1497860 - RNA, 19 nt, Homo sapiens
uuaauaucccuacauguau

SEQ ID NO: 1497861 - RNA, 19 nt, Homo sapiens
uuaaucacuauuguuccag

SEQ ID NO: 1497862 - RNA, 21 nt, Homo sapiens
uuaaucagugaagaugcaauc

SEQ ID NO: 1497863 - RNA, 14 nt, Homo sapiens
uuaauccagggaag

SEQ ID NO: 1497864 - RNA, 20 nt, Homo sapiens
uuaaucuuucuuuaccugag

SEQ ID NO: 1497865 - RNA, 13 nt, Homo sapiens
uuaaugaacuaac

SEQ ID NO: 1497866 - RNA, 18 nt, Homo sapiens
uuaaugaacuaacugaca

SEQ ID NO: 1497867 - RNA, 21 nt, Homo sapiens
uuaaugagggaaaauguuuac

SEQ ID NO: 1497868 - RNA, 21 nt, Homo sapiens
uuaauggcagcuagugccuuu

SEQ ID NO: 1497869 - RNA, 18 nt, Homo sapiens
uuaauggggauuccacua

SEQ ID NO: 1497870 - RNA, 21 nt, Homo sapiens
uuaauguauuuguuugcaauu

SEQ ID NO: 1497871 - RNA, 17 nt, Homo sapiens
uuaaugucuggugcuuu

SEQ ID NO: 1497872 - RNA, 17 nt, Homo sapiens
uuaauguuauaucauau

SEQ ID NO: 1497873 - RNA, 15 nt, Homo sapiens
uuaauucacagaaua

SEQ ID NO: 1497874 - RNA, 14 nt, Homo sapiens
uuaauuuccagggu

SEQ ID NO: 1497875 - RNA, 22 nt, Homo sapiens
uuaauuuccuuuuugacacuga

SEQ ID NO: 1497876 - RNA, 16 nt, Homo sapiens
uuacaaccugauguca

SEQ ID NO: 1497877 - RNA, 23 nt, Homo sapiens
uuacaauaaaugaagauuacccu

SEQ ID NO: 1497878 - RNA, 12 nt, Homo sapiens
uuacacauaccc

SEQ ID NO: 1497879 - RNA, 14 nt, Homo sapiens
uuacagaacuacuu

SEQ ID NO: 1497880 - RNA, 12 nt, Homo sapiens
uuacagaauuau

SEQ ID NO: 1497881 - RNA, 21 nt, Homo sapiens
uuacagagaggagaaacacau

SEQ ID NO: 1497882 - RNA, 23 nt, Homo sapiens
uuacagagaggagaaacacaucu

SEQ ID NO: 1497883 - RNA, 17 nt, Homo sapiens
uuacaggcgugauccac

SEQ ID NO: 1497884 - RNA, 14 nt, Homo sapiens
uguuuaauggguau

SEQ ID NO: 1497885 - RNA, 17 nt, Homo sapiens
uguuuacaaggugacaa

SEQ ID NO: 1497886 - RNA, 14 nt, Homo sapiens
uguuuauuccugau

SEQ ID NO: 1497887 - RNA, 17 nt, Homo sapiens
uguuucaggaggcugga

SEQ ID NO: 1497888 - RNA, 18 nt, Homo sapiens
uguuucuaaaacuauggu

SEQ ID NO: 1497889 - RNA, 21 nt, Homo sapiens
uguuucuaaaacuaugguucc

SEQ ID NO: 1497890 - RNA, 12 nt, Homo sapiens
uguuucuuccaa

SEQ ID NO: 1497891 - RNA, 21 nt, Homo sapiens
uguuucuuccccuuacucuca

SEQ ID NO: 1497892 - RNA, 16 nt, Homo sapiens
uguuugaaauucuaga

SEQ ID NO: 1497893 - RNA, 22 nt, Homo sapiens
uguuugaaauucuagagccagc

SEQ ID NO: 1497894 - RNA, 20 nt, Homo sapiens
uguuugcuuaaacaaaguga

SEQ ID NO: 1497895 - RNA, 23 nt, Homo sapiens
uguuuggaaauaaacugugcaau

SEQ ID NO: 1497896 - RNA, 23 nt, Homo sapiens
uguuuggcuuauaaacacauuga

SEQ ID NO: 1497897 - RNA, 17 nt, Homo sapiens
uguuugguuuacauuua

SEQ ID NO: 1497898 - RNA, 19 nt, Homo sapiens
uguuuguaaauaagagauu

SEQ ID NO: 1497899 - RNA, 17 nt, Homo sapiens
uguuugucagauaugau

SEQ ID NO: 1497900 - RNA, 14 nt, Homo sapiens
uguuugucuuccau

SEQ ID NO: 1497901 - RNA, 17 nt, Homo sapiens
uguuuguuuuugcuugu

SEQ ID NO: 1497902 - RNA, 21 nt, Homo sapiens
uguuuuaaacacaugccuuaa

SEQ ID NO: 1497903 - RNA, 14 nt, Homo sapiens
uguuuuaaguacua

SEQ ID NO: 1497904 - RNA, 13 nt, Homo sapiens
uguuuuaaguuua

SEQ ID NO: 1497905 - RNA, 22 nt, Homo sapiens
uguuuuaauccuuaacacauuc

SEQ ID NO: 1497906 - RNA, 23 nt, Homo sapiens
uguuuuaauccuuaacacauuca

SEQ ID NO: 1497907 - RNA, 19 nt, Homo sapiens
uguuuuaauucaacccagc

SEQ ID NO: 1497908 - RNA, 13 nt, Homo sapiens
uguuuuaucacuu

SEQ ID NO: 1497909 - RNA, 20 nt, Homo sapiens
uguuuucgcaccuaccauca

SEQ ID NO: 1497910 - RNA, 18 nt, Homo sapiens
uguuuucuucaacaugcu

SEQ ID NO: 1497911 - RNA, 24 nt, Homo sapiens
uguuuugauucccgggcuuaccag

SEQ ID NO: 1497912 - RNA, 14 nt, Homo sapiens
uguuuugcacuuuu

SEQ ID NO: 1497913 - RNA, 20 nt, Homo sapiens
uguuuuguaagugcugcuau

SEQ ID NO: 1497914 - RNA, 21 nt, Homo sapiens
uguuuuguaagugcugcuaua

SEQ ID NO: 1497915 - RNA, 22 nt, Homo sapiens
uguuuuguaucaaaaucacuau

SEQ ID NO: 1497916 - RNA, 14 nt, Homo sapiens
uguuuuuaaacuaa

SEQ ID NO: 1497917 - RNA, 22 nt, Homo sapiens
uuaaaaaaaaaggcauauugcu

SEQ ID NO: 1497918 - RNA, 19 nt, Homo sapiens
uuaaaaagauguauguucc

SEQ ID NO: 1497919 - RNA, 21 nt, Homo sapiens
uuaaaaagccaguuuggguaa

SEQ ID NO: 1497920 - RNA, 21 nt, Homo sapiens
uuaaaaauuguuaauuuuucc

SEQ ID NO: 1497921 - RNA, 19 nt, Homo sapiens
uuaaaacaauucugugaca

SEQ ID NO: 1497922 - RNA, 16 nt, Homo sapiens
uuaaaacaguauuuau

SEQ ID NO: 1497923 - RNA, 15 nt, Homo sapiens
uuaaaauaaauuccu

SEQ ID NO: 1497924 - RNA, 21 nt, Homo sapiens
uuaaaauaaugaauacauuuc

SEQ ID NO: 1497925 - RNA, 20 nt, Homo sapiens
uuaaaauuccauuaucuuau

SEQ ID NO: 1497926 - RNA, 13 nt, Homo sapiens
uuaaacaccugac

SEQ ID NO: 1497927 - RNA, 17 nt, Homo sapiens
uuaaacaccugacacau

SEQ ID NO: 1497928 - RNA, 13 nt, Homo sapiens
uuaaacagcagau

SEQ ID NO: 1497929 - RNA, 22 nt, Homo sapiens
uuaaacauuaauagcagccuuu

SEQ ID NO: 1497930 - RNA, 20 nt, Homo sapiens
uuaaacauugugaucauuag

SEQ ID NO: 1497931 - RNA, 24 nt, Homo sapiens
uuaaacauuugagagcuaacuaua

SEQ ID NO: 1497932 - RNA, 18 nt, Homo sapiens
uuaaacccacagccaaac

SEQ ID NO: 1497933 - RNA, 14 nt, Homo sapiens
uuaaacucagggac

SEQ ID NO: 1497934 - RNA, 16 nt, Homo sapiens
uuaaacucagggacag

SEQ ID NO: 1497935 - RNA, 14 nt, Homo sapiens
uuaaacugauucau

SEQ ID NO: 1497936 - RNA, 18 nt, Homo sapiens
uuaaacuuaccugggcau

SEQ ID NO: 1497937 - RNA, 12 nt, Homo sapiens
uuaaacuuucaa

SEQ ID NO: 1497938 - RNA, 17 nt, Homo sapiens
uuaaacuuuuuuaacca

SEQ ID NO: 1497939 - RNA, 19 nt, Homo sapiens
uuaaagaacucaacuuucc

SEQ ID NO: 1497940 - RNA, 18 nt, Homo sapiens
uuaaagacucaagguggu

SEQ ID NO: 1497941 - RNA, 16 nt, Homo sapiens
uuaaagaucaugacau

SEQ ID NO: 1497942 - RNA, 18 nt, Homo sapiens
uuaaagaugaacucugaa

SEQ ID NO: 1497943 - RNA, 19 nt, Homo sapiens
uuaaagcaagcaacacaga

SEQ ID NO: 1497944 - RNA, 14 nt, Homo sapiens
uuaaagccuccuca

SEQ ID NO: 1497945 - RNA, 18 nt, Homo sapiens
uuaaagggaaaacccuca

SEQ ID NO: 1497946 - RNA, 15 nt, Homo sapiens
uuaaagggacacccc

SEQ ID NO: 1497947 - RNA, 21 nt, Homo sapiens
uuaaagucagguccaauuugu

SEQ ID NO: 1497948 - RNA, 13 nt, Homo sapiens
uuaaaguucucaa

SEQ ID NO: 1497949 - RNA, 16 nt, Homo sapiens
uuaaauaaagucucuc

SEQ ID NO: 1497950 - RNA, 21 nt, Homo sapiens
uuaaauaaagucucucugacu

SEQ ID NO: 1497951 - RNA, 18 nt, Homo sapiens
uuaaauaaaguuacuuga

SEQ ID NO: 1497952 - RNA, 17 nt, Homo sapiens
uuaaauaaaucauaaaa

SEQ ID NO: 1497953 - RNA, 19 nt, Homo sapiens
uuaaauaaaucauuaauac

SEQ ID NO: 1497954 - RNA, 19 nt, Homo sapiens
uuaaauaaugcuucagaua

SEQ ID NO: 1497955 - RNA, 20 nt, Homo sapiens
uuaaauacuucaugagcauu

SEQ ID NO: 1497956 - RNA, 16 nt, Homo sapiens
uuaaauauagauuaga

SEQ ID NO: 1497957 - RNA, 14 nt, Homo sapiens
uuaaaucaaaaggg

SEQ ID NO: 1497958 - RNA, 17 nt, Homo sapiens
uuaaaucucaaauuuau

SEQ ID NO: 1497959 - RNA, 15 nt, Homo sapiens
uuaaauggcaguauu

SEQ ID NO: 1497960 - RNA, 14 nt, Homo sapiens
uuaaauguauacua

SEQ ID NO: 1497961 - RNA, 18 nt, Homo sapiens
uuaaauguccguguaaaa

SEQ ID NO: 1497962 - RNA, 11 nt, Homo sapiens
uuaaauucuga

SEQ ID NO: 1497963 - RNA, 17 nt, Homo sapiens
uuaacaaaugugcugcu

SEQ ID NO: 1497964 - RNA, 18 nt, Homo sapiens
uuaacaaaugugcugcuu

SEQ ID NO: 1497965 - RNA, 15 nt, Homo sapiens
uuaacaacaauaaca

SEQ ID NO: 1497966 - RNA, 21 nt, Homo sapiens
uuaacacccuuuagaaccuua

SEQ ID NO: 1497967 - RNA, 19 nt, Homo sapiens
uuaacagagauugaacucc

SEQ ID NO: 1497968 - RNA, 15 nt, Homo sapiens
uuaacaguuuuccau

SEQ ID NO: 1497969 - RNA, 13 nt, Homo sapiens
uuaacaucucaga

SEQ ID NO: 1497970 - RNA, 16 nt, Homo sapiens
uuaacuaugacagaua

SEQ ID NO: 1497971 - RNA, 11 nt, Homo sapiens
uuaacugccaa

SEQ ID NO: 1497972 - RNA, 12 nt, Homo sapiens
uuaagaaaagca

SEQ ID NO: 1497973 - RNA, 13 nt, Homo sapiens
uuaagaagacaua

SEQ ID NO: 1497974 - RNA, 17 nt, Homo sapiens
uuaagaaugucgauuaa

SEQ ID NO: 1497975 - RNA, 15 nt, Homo sapiens
uuaagaguuacuuaa

SEQ ID NO: 1497976 - RNA, 22 nt, Homo sapiens
uuaagauuuggucacacucuca

SEQ ID NO: 1497977 - RNA, 18 nt, Homo sapiens
uuaagauuuugcaccugu

SEQ ID NO: 1497978 - RNA, 14 nt, Homo sapiens
uuaagcagucucac

SEQ ID NO: 1497979 - RNA, 17 nt, Homo sapiens
uuaagcuuaugucagac

SEQ ID NO: 1497980 - RNA, 22 nt, Homo sapiens
uuaaguaacauaacuaguggcu

SEQ ID NO: 1497981 - RNA, 23 nt, Homo sapiens
uuaaguaucuuuuuucaaaaaca

SEQ ID NO: 1497982 - RNA, 16 nt, Homo sapiens
uuaagugacuauagaa

SEQ ID NO: 1497983 - RNA, 17 nt, Homo sapiens
uuaauaaagaauuaaca

SEQ ID NO: 1497984 - RNA, 16 nt, Homo sapiens
uuaauaaauucagaua

SEQ ID NO: 1497985 - RNA, 13 nt, Homo sapiens
uuaauacaaagaa

SEQ ID NO: 1497986 - RNA, 16 nt, Homo sapiens
uguccucccaccucag

SEQ ID NO: 1497987 - RNA, 15 nt, Homo sapiens
uguccucuugcucaa

SEQ ID NO: 1497988 - RNA, 21 nt, Homo sapiens
uguccugaugcuuuugucuaa

SEQ ID NO: 1497989 - RNA, 19 nt, Homo sapiens
uguccuguccuuucuugca

SEQ ID NO: 1497990 - RNA, 15 nt, Homo sapiens
uguccuuucuugcag

SEQ ID NO: 1497991 - RNA, 15 nt, Homo sapiens
ugucgcgcacacagc

SEQ ID NO: 1497992 - RNA, 17 nt, Homo sapiens
ugucuaaacaaugcuga

SEQ ID NO: 1497993 - RNA, 18 nt, Homo sapiens
ugucucacuucacagccc

SEQ ID NO: 1497994 - RNA, 15 nt, Homo sapiens
ugucuccagcugccu

SEQ ID NO: 1497995 - RNA, 19 nt, Homo sapiens
ugucucuggggcagauccc

SEQ ID NO: 1497996 - RNA, 21 nt, Homo sapiens
ugucucuuagaaauacuugug

SEQ ID NO: 1497997 - RNA, 15 nt, Homo sapiens
ugucuguugcuugua

SEQ ID NO: 1497998 - RNA, 19 nt, Homo sapiens
ugucuuccacuuugcauau

SEQ ID NO: 1497999 - RNA, 21 nt, Homo sapiens
ugucuugaaaguggcaccaga

SEQ ID NO: 1498000 - RNA, 18 nt, Homo sapiens
ugucuuuguuguagugaa

SEQ ID NO: 1498001 - RNA, 15 nt, Homo sapiens
ugugaaaacaucuca

SEQ ID NO: 1498002 - RNA, 20 nt, Homo sapiens
ugugaaacauuuuuucuucu

SEQ ID NO: 1498003 - RNA, 17 nt, Homo sapiens
ugugaaacuggcacuga

SEQ ID NO: 1498004 - RNA, 23 nt, Homo sapiens
ugugaaaggaagcuccacuguca

SEQ ID NO: 1498005 - RNA, 18 nt, Homo sapiens
ugugaagcaccuacuaug

SEQ ID NO: 1498006 - RNA, 16 nt, Homo sapiens
ugugaaguggaaaugu

SEQ ID NO: 1498007 - RNA, 15 nt, Homo sapiens
ugugaaucaauccug

SEQ ID NO: 1498008 - RNA, 13 nt, Homo sapiens
ugugaaugaucaa

SEQ ID NO: 1498009 - RNA, 16 nt, Homo sapiens
ugugaauuauugacac

SEQ ID NO: 1498010 - RNA, 20 nt, Homo sapiens
ugugaauuauugacacugaa

SEQ ID NO: 1498011 - RNA, 11 nt, Homo sapiens
ugugacauuua

SEQ ID NO: 1498012 - RNA, 17 nt, Homo sapiens
ugugagaauaaacuaga

SEQ ID NO: 1498013 - RNA, 18 nt, Homo sapiens
ugugagaauaaacuagac

SEQ ID NO: 1498014 - RNA, 15 nt, Homo sapiens
ugugagagaaagugu

SEQ ID NO: 1498015 - RNA, 17 nt, Homo sapiens
ugugagcagugaguuac

SEQ ID NO: 1498016 - RNA, 17 nt, Homo sapiens
ugaccaaacagccaaga

SEQ ID NO: 1498017 - RNA, 20 nt, Homo sapiens
ugaccaauugugcugccauu

SEQ ID NO: 1498018 - RNA, 17 nt, Homo sapiens
ugaccacagcacagcca

SEQ ID NO: 1498019 - RNA, 16 nt, Homo sapiens
ugaccagcaacuuguc

SEQ ID NO: 1498020 - RNA, 22 nt, Homo sapiens
ugaccaggaucccaagccuccu

SEQ ID NO: 1498021 - RNA, 22 nt, Homo sapiens
ugaccaggcauccuccacaaua

SEQ ID NO: 1498022 - RNA, 22 nt, Homo sapiens
ugaccauggaggccagugccag

SEQ ID NO: 1498023 - RNA, 15 nt, Homo sapiens
ugacccacugaucuc

SEQ ID NO: 1498024 - RNA, 14 nt, Homo sapiens
ugacccccagcucc

SEQ ID NO: 1498025 - RNA, 16 nt, Homo sapiens
ugaccccugaccucac

SEQ ID NO: 1498026 - RNA, 18 nt, Homo sapiens
ugacccugauacaggcau

SEQ ID NO: 1498027 - RNA, 15 nt, Homo sapiens
ugacccugaugaaaa

SEQ ID NO: 1498028 - RNA, 14 nt, Homo sapiens
ugaccucacuuuag

SEQ ID NO: 1498029 - RNA, 23 nt, Homo sapiens
ugaccucacuuuaggcagcugua

SEQ ID NO: 1498030 - RNA, 17 nt, Homo sapiens
ugaccuccaaccaggag

SEQ ID NO: 1498031 - RNA, 21 nt, Homo sapiens
ugaccucuugcugucucugcu

SEQ ID NO: 1498032 - RNA, 19 nt, Homo sapiens
ugaccugucuauaagagaa

SEQ ID NO: 1498033 - RNA, 14 nt, Homo sapiens
ugaccugugaccag

SEQ ID NO: 1498034 - RNA, 18 nt, Homo sapiens
ugaccuugggguacaauu

SEQ ID NO: 1498035 - RNA, 18 nt, Homo sapiens
ugaccuuggguauuugca

SEQ ID NO: 1498036 - RNA, 21 nt, Homo sapiens
ugacggcccucaucuaugagg

SEQ ID NO: 1498037 - RNA, 21 nt, Homo sapiens
ugacggcgcccccagugugca

SEQ ID NO: 1498038 - RNA, 19 nt, Homo sapiens
ugacucaauuauuugcaua

SEQ ID NO: 1498039 - RNA, 17 nt, Homo sapiens
ugacucuaaaugcaguu

SEQ ID NO: 1498040 - RNA, 21 nt, Homo sapiens
ugacucuggcaaagcuuuuag

SEQ ID NO: 1498041 - RNA, 18 nt, Homo sapiens
ugacugauguuacaucac

SEQ ID NO: 1498042 - RNA, 17 nt, Homo sapiens
ugacugcacccagcucc

SEQ ID NO: 1498043 - RNA, 22 nt, Homo sapiens
ugacuggaggaggccuguccca

SEQ ID NO: 1498044 - RNA, 18 nt, Homo sapiens
ugacuggggcccugcaga

SEQ ID NO: 1498045 - RNA, 21 nt, Homo sapiens
ugacuguaacauauucuguau

SEQ ID NO: 1498046 - RNA, 16 nt, Homo sapiens
ugacuuguacucugaa

SEQ ID NO: 1498047 - RNA, 16 nt, Homo sapiens
ugacuugugucccaug

SEQ ID NO: 1498048 - RNA, 19 nt, Homo sapiens
ugacuuguuugucuuccau

SEQ ID NO: 1498049 - RNA, 20 nt, Homo sapiens
ugacuuugcuugcuuugaag

SEQ ID NO: 1498050 - RNA, 17 nt, Homo sapiens
ugagaaaauaucuugcu

SEQ ID NO: 1498051 - RNA, 23 nt, Homo sapiens
ugagaaaauaucuugcuuucaaa

SEQ ID NO: 1498052 - RNA, 17 nt, Homo sapiens
ugagaaagaaacuaaua

SEQ ID NO: 1498053 - RNA, 23 nt, Homo sapiens
ugagaaauaaaaagccugucauu

SEQ ID NO: 1498054 - RNA, 13 nt, Homo sapiens
ugagaagaaugaa

SEQ ID NO: 1498055 - RNA, 16 nt, Homo sapiens
ugagaaggaacuucca

SEQ ID NO: 1498056 - RNA, 19 nt, Homo sapiens
ugagaaggcagccaccagc

SEQ ID NO: 1498057 - RNA, 19 nt, Homo sapiens
ugagaagucaaacauuuca

SEQ ID NO: 1498058 - RNA, 17 nt, Homo sapiens
ugagaagugcacuuuaa

SEQ ID NO: 1498059 - RNA, 17 nt, Homo sapiens
ugagacauugacaccag

SEQ ID NO: 1498060 - RNA, 18 nt, Homo sapiens
ugagacccuggugccugg

SEQ ID NO: 1498061 - RNA, 17 nt, Homo sapiens
ugagacggagucuugcu

SEQ ID NO: 1498062 - RNA, 15 nt, Homo sapiens
ugagacucacaggaa

SEQ ID NO: 1498063 - RNA, 13 nt, Homo sapiens
ugagagaccugag

SEQ ID NO: 1498064 - RNA, 20 nt, Homo sapiens
ugagagcaauuguaacgguu

SEQ ID NO: 1498065 - RNA, 23 nt, Homo sapiens
ugagaggaugaauguaugugcac

SEQ ID NO: 1498066 - RNA, 18 nt, Homo sapiens
ugagagugucucugauaa

SEQ ID NO: 1498067 - RNA, 21 nt, Homo sapiens
ugagauucagaugucauuuag

SEQ ID NO: 1498068 - RNA, 19 nt, Homo sapiens
ugagauugaauuucacugu

SEQ ID NO: 1498069 - RNA, 19 nt, Homo sapiens
ugagauuuuuuauugcuag

SEQ ID NO: 1498070 - RNA, 23 nt, Homo sapiens
ugagcaauggaguggcugccaug

SEQ ID NO: 1498071 - RNA, 17 nt, Homo sapiens
ugagcaccgucauggcu

SEQ ID NO: 1498072 - RNA, 15 nt, Homo sapiens
ugagcagagacauga

SEQ ID NO: 1498073 - RNA, 16 nt, Homo sapiens
ugagcagucacacugu

SEQ ID NO: 1498074 - RNA, 18 nt, Homo sapiens
ugagcagugccucuuguc

SEQ ID NO: 1498075 - RNA, 17 nt, Homo sapiens
ugagccaagauugcacc

SEQ ID NO: 1498076 - RNA, 12 nt, Homo sapiens
ugagccagguaa

SEQ ID NO: 1498077 - RNA, 18 nt, Homo sapiens
ugagccagugagggcagu

SEQ ID NO: 1498078 - RNA, 18 nt, Homo sapiens
ugagccaguuagacuagu

SEQ ID NO: 1498079 - RNA, 21 nt, Homo sapiens
ugagccccuggaggcacugaa

SEQ ID NO: 1498080 - RNA, 17 nt, Homo sapiens
ugagccgugaacugugc

SEQ ID NO: 1498081 - RNA, 18 nt, Homo sapiens
ugagcgggaggcagaguu

SEQ ID NO: 1498082 - RNA, 21 nt, Homo sapiens
ugagcuauugcuguucucuug

SEQ ID NO: 1498083 - RNA, 17 nt, Homo sapiens
ugagcuccccagaucuc

SEQ ID NO: 1498084 - RNA, 15 nt, Homo sapiens
ugagcugacaucuca

SEQ ID NO: 1498085 - RNA, 15 nt, Homo sapiens
ugagcugagaccacu

SEQ ID NO: 1498086 - RNA, 19 nt, Homo sapiens
ugagcugguaggauguaag

SEQ ID NO: 1498087 - RNA, 14 nt, Homo sapiens
ugagcuugcucauu

SEQ ID NO: 1498088 - RNA, 15 nt, Homo sapiens
ugaggacauguggaa

SEQ ID NO: 1498089 - RNA, 15 nt, Homo sapiens
ugaggaccacuccug

SEQ ID NO: 1498090 - RNA, 23 nt, Homo sapiens
ugaggaccacuccuguacacuga

SEQ ID NO: 1498091 - RNA, 15 nt, Homo sapiens
ugaggagacagaaua

SEQ ID NO: 1498092 - RNA, 21 nt, Homo sapiens
ugaggagaggaguuuucucca

SEQ ID NO: 1498093 - RNA, 16 nt, Homo sapiens
ugaggagcugcacuga

SEQ ID NO: 1498094 - RNA, 17 nt, Homo sapiens
ugaggagcugcacugau

SEQ ID NO: 1498095 - RNA, 20 nt, Homo sapiens
ugaggcagauagcacugggu

SEQ ID NO: 1498096 - RNA, 16 nt, Homo sapiens
ugaggccaucucagga

SEQ ID NO: 1498097 - RNA, 18 nt, Homo sapiens
ugaggcuggcacaggaca

SEQ ID NO: 1498098 - RNA, 17 nt, Homo sapiens
ugagggcagacuggggc

SEQ ID NO: 1498099 - RNA, 15 nt, Homo sapiens
ugagggcauggguaa

SEQ ID NO: 1498100 - RNA, 15 nt, Homo sapiens
ugagggccugcugga

SEQ ID NO: 1498101 - RNA, 20 nt, Homo sapiens
ugaggguaucugacaaugcu

SEQ ID NO: 1498102 - RNA, 11 nt, Homo sapiens
ugagggucccc

SEQ ID NO: 1498103 - RNA, 21 nt, Homo sapiens
ugaggguguuucuuccugcac

SEQ ID NO: 1498104 - RNA, 15 nt, Homo sapiens
ugaggguuaaugaaa

SEQ ID NO: 1498105 - RNA, 20 nt, Homo sapiens
ugaggucaggaguucgagac

SEQ ID NO: 1498106 - RNA, 23 nt, Homo sapiens
ugaggugugccuggccucugccu

SEQ ID NO: 1498107 - RNA, 23 nt, Homo sapiens
ugaguaaauauugaggcuuugug

SEQ ID NO: 1498108 - RNA, 18 nt, Homo sapiens
ugaguagagcuuguaaua

SEQ ID NO: 1498109 - RNA, 17 nt, Homo sapiens
ugaguagcucuccugac

SEQ ID NO: 1498110 - RNA, 13 nt, Homo sapiens
ugaguagggacuc

SEQ ID NO: 1498111 - RNA, 17 nt, Homo sapiens
ugaguagggacucaggg

SEQ ID NO: 1498112 - RNA, 18 nt, Homo sapiens
ugaguagggacucagggc

SEQ ID NO: 1498113 - RNA, 16 nt, Homo sapiens
ugaguaguguggaauu

SEQ ID NO: 1498114 - RNA, 19 nt, Homo sapiens
ugaguaucuguauguauau

SEQ ID NO: 1498115 - RNA, 14 nt, Homo sapiens
ugaguccccuccag

SEQ ID NO: 1498116 - RNA, 15 nt, Homo sapiens
ugagucggaagcucc

SEQ ID NO: 1498117 - RNA, 20 nt, Homo sapiens
ucuaguuaaccuagaaguau

SEQ ID NO: 1498118 - RNA, 20 nt, Homo sapiens
ucuauaaagaagaacuugca

SEQ ID NO: 1498119 - RNA, 21 nt, Homo sapiens
ucuauaaagaagaacuugcau

SEQ ID NO: 1498120 - RNA, 19 nt, Homo sapiens
ucuauauaugaagugaaaa

SEQ ID NO: 1498121 - RNA, 17 nt, Homo sapiens
ucuaugagggcuaauau

SEQ ID NO: 1498122 - RNA, 12 nt, Homo sapiens
ucuauuacauuu

SEQ ID NO: 1498123 - RNA, 14 nt, Homo sapiens
ucuauuauagccac

SEQ ID NO: 1498124 - RNA, 14 nt, Homo sapiens
ucuauucucaaagu

SEQ ID NO: 1498125 - RNA, 23 nt, Homo sapiens
ucuauugcuucaccauggccuua

SEQ ID NO: 1498126 - RNA, 19 nt, Homo sapiens
ucuauuggccaacaauccu

SEQ ID NO: 1498127 - RNA, 16 nt, Homo sapiens
ucuauuuugugaugau

SEQ ID NO: 1498128 - RNA, 20 nt, Homo sapiens
ucuauuuuuaucaugaauuc

SEQ ID NO: 1498129 - RNA, 20 nt, Homo sapiens
ucucaaacuccugaccucag

SEQ ID NO: 1498130 - RNA, 17 nt, Homo sapiens
ucucaaagaaggcauuu

SEQ ID NO: 1498131 - RNA, 13 nt, Homo sapiens
ucucaaauuuauu

SEQ ID NO: 1498132 - RNA, 23 nt, Homo sapiens
ucucaagggcuagcaucccugag

SEQ ID NO: 1498133 - RNA, 14 nt, Homo sapiens
ucucacaagaugga

SEQ ID NO: 1498134 - RNA, 14 nt, Homo sapiens
ucucacuaguguca

SEQ ID NO: 1498135 - RNA, 23 nt, Homo sapiens
ucucacucccuguuuuaauucaa

SEQ ID NO: 1498136 - RNA, 21 nt, Homo sapiens
ucucagaaagugccugacaca

SEQ ID NO: 1498137 - RNA, 13 nt, Homo sapiens
ucucagcugacca

SEQ ID NO: 1498138 - RNA, 20 nt, Homo sapiens
ucucaggggccaacuaggca

SEQ ID NO: 1498139 - RNA, 14 nt, Homo sapiens
ucucagggugcaga

SEQ ID NO: 1498140 - RNA, 21 nt, Homo sapiens
ucucauguaacacauaaacaa

SEQ ID NO: 1498141 - RNA, 17 nt, Homo sapiens
ucuccaaaugagaucua

SEQ ID NO: 1498142 - RNA, 18 nt, Homo sapiens
ucuccacacccacuuugu

SEQ ID NO: 1498143 - RNA, 19 nt, Homo sapiens
ucuccacuucuuguucccc

SEQ ID NO: 1498144 - RNA, 17 nt, Homo sapiens
ucuccagacccaccaca

SEQ ID NO: 1498145 - RNA, 21 nt, Homo sapiens
ucuccagccaaccucauugca

SEQ ID NO: 1498146 - RNA, 20 nt, Homo sapiens
ucuccaggauugaagagcau

SEQ ID NO: 1498147 - RNA, 21 nt, Homo sapiens
ucuccagguccucuacuuaau

SEQ ID NO: 1498148 - RNA, 18 nt, Homo sapiens
ucuccaguugggacucag

SEQ ID NO: 1498149 - RNA, 18 nt, Homo sapiens
ucuccaguuugcaccugu

SEQ ID NO: 1498150 - RNA, 21 nt, Homo sapiens
ucucccacuaaaacugcauuu

SEQ ID NO: 1498151 - RNA, 11 nt, Homo sapiens
ucucccacugc

SEQ ID NO: 1498152 - RNA, 21 nt, Homo sapiens
ucuccccacucuaggggucag

SEQ ID NO: 1498153 - RNA, 17 nt, Homo sapiens
ucuccccagcccagaga

SEQ ID NO: 1498154 - RNA, 15 nt, Homo sapiens
ugaaggcccugcuga

SEQ ID NO: 1498155 - RNA, 23 nt, Homo sapiens
ugaaggcugucaggauucuucaa

SEQ ID NO: 1498156 - RNA, 16 nt, Homo sapiens
ugaaggcuuacuucag

SEQ ID NO: 1498157 - RNA, 19 nt, Homo sapiens
ugaagggaguggcucugua

SEQ ID NO: 1498158 - RNA, 14 nt, Homo sapiens
ugaagggcuuuauu

SEQ ID NO: 1498159 - RNA, 24 nt, Homo sapiens
ugaaggggaaccccggggugccca

SEQ ID NO: 1498160 - RNA, 15 nt, Homo sapiens
ugaaggggaggucac

SEQ ID NO: 1498161 - RNA, 13 nt, Homo sapiens
ugaaggggccaug

SEQ ID NO: 1498162 - RNA, 23 nt, Homo sapiens
ugaagucaccccuuucuguccca

SEQ ID NO: 1498163 - RNA, 16 nt, Homo sapiens
ugaagucagcucagac

SEQ ID NO: 1498164 - RNA, 15 nt, Homo sapiens
ugaagugcgugaaug

SEQ ID NO: 1498165 - RNA, 12 nt, Homo sapiens
ugaagugucaca

SEQ ID NO: 1498166 - RNA, 17 nt, Homo sapiens
ugaaguuuacauuguaa

SEQ ID NO: 1498167 - RNA, 15 nt, Homo sapiens
ugaaguuucacauga

SEQ ID NO: 1498168 - RNA, 18 nt, Homo sapiens
ugaauaaagcacgugcaa

SEQ ID NO: 1498169 - RNA, 15 nt, Homo sapiens
ugaauaaaguguaag

SEQ ID NO: 1498170 - RNA, 21 nt, Homo sapiens
ugaauaaaguguaaguucaca

SEQ ID NO: 1498171 - RNA, 19 nt, Homo sapiens
ugaauaaaguugaagcuaa

SEQ ID NO: 1498172 - RNA, 14 nt, Homo sapiens
ugaauacugcuaca

SEQ ID NO: 1498173 - RNA, 13 nt, Homo sapiens
ugaauacugggaa

SEQ ID NO: 1498174 - RNA, 22 nt, Homo sapiens
ugaauacuuacuauaauuugac

SEQ ID NO: 1498175 - RNA, 22 nt, Homo sapiens
ugaauagauggguuauuucaac

SEQ ID NO: 1498176 - RNA, 20 nt, Homo sapiens
ugaaucaccuggcugagcag

SEQ ID NO: 1498177 - RNA, 15 nt, Homo sapiens
ugaaucugcucacuu

SEQ ID NO: 1498178 - RNA, 12 nt, Homo sapiens
ugaaucuucaca

SEQ ID NO: 1498179 - RNA, 18 nt, Homo sapiens
ugaaugcacacuagccuc

SEQ ID NO: 1498180 - RNA, 21 nt, Homo sapiens
ugaaugcagggaaugcaaucc

SEQ ID NO: 1498181 - RNA, 20 nt, Homo sapiens
ugaaugccguggauugcacg

SEQ ID NO: 1498182 - RNA, 19 nt, Homo sapiens
ugaaugccucaaugugacc

SEQ ID NO: 1498183 - RNA, 16 nt, Homo sapiens
ugaaugcugccacaac

SEQ ID NO: 1498184 - RNA, 22 nt, Homo sapiens
ugaaugguccaggguugaucac

SEQ ID NO: 1498185 - RNA, 21 nt, Homo sapiens
ugaauguauguaauguguggu

SEQ ID NO: 1498186 - RNA, 19 nt, Homo sapiens
ugaaugucaaacagugcca

SEQ ID NO: 1498187 - RNA, 18 nt, Homo sapiens
ugaaugugucacuacuca

SEQ ID NO: 1498188 - RNA, 18 nt, Homo sapiens
ugaauguugugauguauu

SEQ ID NO: 1498189 - RNA, 18 nt, Homo sapiens
ugaauuauauguucagau

SEQ ID NO: 1498190 - RNA, 23 nt, Homo sapiens
ugaauuguuaauucacagaauag

SEQ ID NO: 1498191 - RNA, 15 nt, Homo sapiens
ugaauuucacaagcu

SEQ ID NO: 1498192 - RNA, 14 nt, Homo sapiens
ugaauuucaguaaa

SEQ ID NO: 1498193 - RNA, 19 nt, Homo sapiens
ugaauuuuuaagcugcaaa

SEQ ID NO: 1498194 - RNA, 12 nt, Homo sapiens
ugacaaaccauc

SEQ ID NO: 1498195 - RNA, 18 nt, Homo sapiens
ugacaacaaccuaugcac

SEQ ID NO: 1498196 - RNA, 12 nt, Homo sapiens
ugacaacuguga

SEQ ID NO: 1498197 - RNA, 15 nt, Homo sapiens
ugacaacuuugccag

SEQ ID NO: 1498198 - RNA, 14 nt, Homo sapiens
ugacaaucaacucu

SEQ ID NO: 1498199 - RNA, 16 nt, Homo sapiens
ugacaaucaacucuaa

SEQ ID NO: 1498200 - RNA, 23 nt, Homo sapiens
ugacaaucaacucuaauagugcu

SEQ ID NO: 1498201 - RNA, 18 nt, Homo sapiens
ugacacaaguggaccuua

SEQ ID NO: 1498202 - RNA, 21 nt, Homo sapiens
ugacacacaaaucccauuaaa

SEQ ID NO: 1498203 - RNA, 15 nt, Homo sapiens
ugacacacagcacuc

SEQ ID NO: 1498204 - RNA, 16 nt, Homo sapiens
ugacacacagcacucu

SEQ ID NO: 1498205 - RNA, 12 nt, Homo sapiens
ugacacagcagc

SEQ ID NO: 1498206 - RNA, 11 nt, Homo sapiens
ugacacuauuc

SEQ ID NO: 1498207 - RNA, 10 nt, Homo sapiens
ugacacugaa

SEQ ID NO: 1498208 - RNA, 13 nt, Homo sapiens
ugacagacaaaga

SEQ ID NO: 1498209 - RNA, 13 nt, Homo sapiens
ugacagacaauga

SEQ ID NO: 1498210 - RNA, 16 nt, Homo sapiens
ugacagaccacaucuu

SEQ ID NO: 1498211 - RNA, 16 nt, Homo sapiens
ugacagagaauaacuc

SEQ ID NO: 1498212 - RNA, 17 nt, Homo sapiens
ugacagcaggugggaaa

SEQ ID NO: 1498213 - RNA, 16 nt, Homo sapiens
ugacagccugcagcag

SEQ ID NO: 1498214 - RNA, 16 nt, Homo sapiens
ugacauauuaugccug

SEQ ID NO: 1498215 - RNA, 15 nt, Homo sapiens
ugacaucacagcagc

SEQ ID NO: 1498216 - RNA, 23 nt, Homo sapiens
ugacaucacagcagccuccaaca

SEQ ID NO: 1498217 - RNA, 14 nt, Homo sapiens
ugacaucucagggg

SEQ ID NO: 1498218 - RNA, 15 nt, Homo sapiens
ugacauguggggcca

SEQ ID NO: 1498219 - RNA, 17 nt, Homo sapiens
ugacauuaaaugcaaua

SEQ ID NO: 1498220 - RNA, 22 nt, Homo sapiens
ugacauuugggagacaugugac

SEQ ID NO: 1498221 - RNA, 18 nt, Homo sapiens
uccuuccaguguccuuag

SEQ ID NO: 1498222 - RNA, 12 nt, Homo sapiens
uccuuccauccc

SEQ ID NO: 1498223 - RNA, 20 nt, Homo sapiens
uccuucccugcucuugcagu

SEQ ID NO: 1498224 - RNA, 14 nt, Homo sapiens
uccuuccuucaggg

SEQ ID NO: 1498225 - RNA, 13 nt, Homo sapiens
uccuucgcuggaa

SEQ ID NO: 1498226 - RNA, 15 nt, Homo sapiens
uccuucugcuggaua

SEQ ID NO: 1498227 - RNA, 18 nt, Homo sapiens
uccuucuggcuguagaua

SEQ ID NO: 1498228 - RNA, 13 nt, Homo sapiens
uccuucuuugaua

SEQ ID NO: 1498229 - RNA, 21 nt, Homo sapiens
uccuucuuugauaauguuaaa

SEQ ID NO: 1498230 - RNA, 11 nt, Homo sapiens
uccuugaacaa

SEQ ID NO: 1498231 - RNA, 20 nt, Homo sapiens
uccuugcaggugacauuugc

SEQ ID NO: 1498232 - RNA, 20 nt, Homo sapiens
uccuugcccagacuacaggg

SEQ ID NO: 1498233 - RNA, 14 nt, Homo sapiens
uccuugcgccucag

SEQ ID NO: 1498234 - RNA, 20 nt, Homo sapiens
uccuuggucuuuguaucuuc

SEQ ID NO: 1498235 - RNA, 17 nt, Homo sapiens
uccuugucuauccuucc

SEQ ID NO: 1498236 - RNA, 19 nt, Homo sapiens
uccuugugaagaugauaua

SEQ ID NO: 1498237 - RNA, 17 nt, Homo sapiens
uccuuguuguuugcuuu

SEQ ID NO: 1498238 - RNA, 20 nt, Homo sapiens
uccuuuauacacaguggauu

SEQ ID NO: 1498239 - RNA, 14 nt, Homo sapiens
uccuuuauacugug

SEQ ID NO: 1498240 - RNA, 16 nt, Homo sapiens
uccuuucuccagccag

SEQ ID NO: 1498241 - RNA, 14 nt, Homo sapiens
uccuuucugccgac

SEQ ID NO: 1498242 - RNA, 14 nt, Homo sapiens
uccuuucuuccuug

SEQ ID NO: 1498243 - RNA, 13 nt, Homo sapiens
uccuuucuugcag

SEQ ID NO: 1498244 - RNA, 17 nt, Homo sapiens
uccuuugguccuucaaa

SEQ ID NO: 1498245 - RNA, 18 nt, Homo sapiens
uccuuuuaguauucuuag

SEQ ID NO: 1498246 - RNA, 15 nt, Homo sapiens
uccuuuuguguacag

SEQ ID NO: 1498247 - RNA, 22 nt, Homo sapiens
uccuuuuuuuuuuauccuaguc

SEQ ID NO: 1498248 - RNA, 16 nt, Homo sapiens
ucgaaaucaaaccacc

SEQ ID NO: 1498249 - RNA, 18 nt, Homo sapiens
ucgagaccauccuggcua

SEQ ID NO: 1498250 - RNA, 20 nt, Homo sapiens
ucgagcaucagagcuuccag

SEQ ID NO: 1498251 - RNA, 14 nt, Homo sapiens
ucgaggccugaagc

SEQ ID NO: 1498252 - RNA, 22 nt, Homo sapiens
ucgauauguauaucauucuaca

SEQ ID NO: 1498253 - RNA, 18 nt, Homo sapiens
ucgaugcguucacuccaa

SEQ ID NO: 1498254 - RNA, 18 nt, Homo sapiens
ucgauuuucuauuaugga

SEQ ID NO: 1498255 - RNA, 14 nt, Homo sapiens
ucgcaccugugcug

SEQ ID NO: 1498256 - RNA, 14 nt, Homo sapiens
ucgcaggagucucu

SEQ ID NO: 1498257 - RNA, 17 nt, Homo sapiens
ucgcaucucagugcagg

SEQ ID NO: 1498258 - RNA, 19 nt, Homo sapiens
ucgccagcaaaacuuagau

SEQ ID NO: 1498259 - RNA, 13 nt, Homo sapiens
uaugugaaugcuc

SEQ ID NO: 1498260 - RNA, 14 nt, Homo sapiens
uaugugcauuucaa

SEQ ID NO: 1498261 - RNA, 17 nt, Homo sapiens
uaugugguuaucuguga

SEQ ID NO: 1498262 - RNA, 17 nt, Homo sapiens
uauguuaugaacaugca

SEQ ID NO: 1498263 - RNA, 17 nt, Homo sapiens
uauuaacuuuaauucuc

SEQ ID NO: 1498264 - RNA, 15 nt, Homo sapiens
uauuaagcacuuuaa

SEQ ID NO: 1498265 - RNA, 19 nt, Homo sapiens
uauuaaucuggacauucga

SEQ ID NO: 1498266 - RNA, 18 nt, Homo sapiens
uauuaauucuucaccugu

SEQ ID NO: 1498267 - RNA, 20 nt, Homo sapiens
uauuaauuuuccaaugcaca

SEQ ID NO: 1498268 - RNA, 21 nt, Homo sapiens
uauuaauuuuccaaugcacag

SEQ ID NO: 1498269 - RNA, 17 nt, Homo sapiens
uauuagauaaauuucaa

SEQ ID NO: 1498270 - RNA, 19 nt, Homo sapiens
uauuauaaacuguaugcuc

SEQ ID NO: 1498271 - RNA, 13 nt, Homo sapiens
uauuaucauaaga

SEQ ID NO: 1498272 - RNA, 20 nt, Homo sapiens
uauuaucuacaaacacugca

SEQ ID NO: 1498273 - RNA, 20 nt, Homo sapiens
uauucaaaaacauaacugag

SEQ ID NO: 1498274 - RNA, 13 nt, Homo sapiens
uauucaauggaaa

SEQ ID NO: 1498275 - RNA, 23 nt, Homo sapiens
uauucacauauaucaaagugaga

SEQ ID NO: 1498276 - RNA, 13 nt, Homo sapiens
uauucauccagag

SEQ ID NO: 1498277 - RNA, 23 nt, Homo sapiens
uauuccccccacuuaagacugug

SEQ ID NO: 1498278 - RNA, 17 nt, Homo sapiens
uauucucuuaaaagaca

SEQ ID NO: 1498279 - RNA, 14 nt, Homo sapiens
uauugauaugugaa

SEQ ID NO: 1498280 - RNA, 17 nt, Homo sapiens
uauugcaccauacuccu

SEQ ID NO: 1498281 - RNA, 21 nt, Homo sapiens
uauugccgccagaagauccaa

SEQ ID NO: 1498282 - RNA, 15 nt, Homo sapiens
uauugccucuuucac

SEQ ID NO: 1498283 - RNA, 16 nt, Homo sapiens
uauugccucuuucaca

SEQ ID NO: 1498284 - RNA, 18 nt, Homo sapiens
uauugccuggagugugaa

SEQ ID NO: 1498285 - RNA, 14 nt, Homo sapiens
uauugcuucaccau

SEQ ID NO: 1498286 - RNA, 13 nt, Homo sapiens
uauuggagcacau

SEQ ID NO: 1498287 - RNA, 15 nt, Homo sapiens
uauugucugccuuaa

SEQ ID NO: 1498288 - RNA, 14 nt, Homo sapiens
uauuguugcugaaa

SEQ ID NO: 1498289 - RNA, 16 nt, Homo sapiens
uauuguuguugccaaa

SEQ ID NO: 1498290 - RNA, 12 nt, Homo sapiens
uauuguuuccaa

SEQ ID NO: 1498291 - RNA, 13 nt, Homo sapiens
uauuuaaagcauu

SEQ ID NO: 1498292 - RNA, 17 nt, Homo sapiens
uauuuaaauaaaaucac

SEQ ID NO: 1498293 - RNA, 23 nt, Homo sapiens
uauuuaagccuuauaaaccaauc

SEQ ID NO: 1498294 - RNA, 22 nt, Homo sapiens
uauuuacagaaaagacucugac

SEQ ID NO: 1498295 - RNA, 18 nt, Homo sapiens
uauuuacauacaggccau

SEQ ID NO: 1498296 - RNA, 20 nt, Homo sapiens
uauuuagaaauagaacuaca

SEQ ID NO: 1498297 - RNA, 20 nt, Homo sapiens
uauuuaggagugugugacau

SEQ ID NO: 1498298 - RNA, 18 nt, Homo sapiens
uauuuauaagagugccgu

SEQ ID NO: 1498299 - RNA, 21 nt, Homo sapiens
uauuuauaauuccuauauccu

SEQ ID NO: 1498300 - RNA, 21 nt, Homo sapiens
uauuuauauauuuauaacuca

SEQ ID NO: 1498301 - RNA, 12 nt, Homo sapiens
uauuuaugcaag

SEQ ID NO: 1498302 - RNA, 14 nt, Homo sapiens
uauuuaugccucug

SEQ ID NO: 1498303 - RNA, 18 nt, Homo sapiens
uauuuauguuugcacuug

SEQ ID NO: 1498304 - RNA, 21 nt, Homo sapiens
uauuucaacuaauauaucuau

SEQ ID NO: 1498305 - RNA, 19 nt, Homo sapiens
uauuucaauaaaucuuuca

SEQ ID NO: 1498306 - RNA, 21 nt, Homo sapiens
uauuucaauauuagcaagaca

SEQ ID NO: 1498307 - RNA, 12 nt, Homo sapiens
uauuucaggcau

SEQ ID NO: 1498308 - RNA, 19 nt, Homo sapiens
uauuucauugccuguguau

SEQ ID NO: 1498309 - RNA, 18 nt, Homo sapiens
uauuucauuucuugucaa

SEQ ID NO: 1498310 - RNA, 16 nt, Homo sapiens
uauuuccaucauguca

SEQ ID NO: 1498311 - RNA, 12 nt, Homo sapiens
uauuucucugau

SEQ ID NO: 1498312 - RNA, 20 nt, Homo sapiens
uauuucuggagggcaauuug

SEQ ID NO: 1498313 - RNA, 21 nt, Homo sapiens
uauuugaaaauuuuacuucca

SEQ ID NO: 1498314 - RNA, 15 nt, Homo sapiens
uauuugaaccaauaa

SEQ ID NO: 1498315 - RNA, 15 nt, Homo sapiens
uauuuguacaaaaaa

SEQ ID NO: 1498316 - RNA, 17 nt, Homo sapiens
uauuuguuugcaauuuu

SEQ ID NO: 1498317 - RNA, 19 nt, Homo sapiens
uauuuuaagaauuucacaa

SEQ ID NO: 1498318 - RNA, 13 nt, Homo sapiens
uauuuuaagcacu

SEQ ID NO: 1498319 - RNA, 15 nt, Homo sapiens
uauuuugcauuccag

SEQ ID NO: 1498320 - RNA, 22 nt, Homo sapiens
uauuuuguugccuucaucuuca

SEQ ID NO: 1498321 - RNA, 22 nt, Homo sapiens
uauuuuuauaaauauaagccuu

SEQ ID NO: 1498322 - RNA, 20 nt, Homo sapiens
uauuuuuuaaaacacuaaaa

SEQ ID NO: 1498323 - RNA, 14 nt, Homo sapiens
uauuuuuugcaagu

SEQ ID NO: 1498324 - RNA, 16 nt, Homo sapiens
ucaaaacaagacuccu

SEQ ID NO: 1498325 - RNA, 17 nt, Homo sapiens
ucaaaacaauuggcaaa

SEQ ID NO: 1498326 - RNA, 14 nt, Homo sapiens
ucaaaaccuuucaa

SEQ ID NO: 1498327 - RNA, 22 nt, Homo sapiens
ucaaaagaaauuuaaguucuau

SEQ ID NO: 1498328 - RNA, 18 nt, Homo sapiens
ucaaaagccagaugugaa

SEQ ID NO: 1498329 - RNA, 18 nt, Homo sapiens
ucaaaauaaaaagugaca

SEQ ID NO: 1498330 - RNA, 18 nt, Homo sapiens
ucaaaauauacauucaaa

SEQ ID NO: 1498331 - RNA, 24 nt, Homo sapiens
ucaaaaugucuaagauaguaacaa

SEQ ID NO: 1498332 - RNA, 19 nt, Homo sapiens
ucaaacagggcaaaguguu

SEQ ID NO: 1498333 - RNA, 13 nt, Homo sapiens
ucaaaccuguaga

SEQ ID NO: 1498334 - RNA, 14 nt, Homo sapiens
ucaaaccuguagau

SEQ ID NO: 1498335 - RNA, 14 nt, Homo sapiens
ucaaagaggccuua

SEQ ID NO: 1498336 - RNA, 23 nt, Homo sapiens
ucaaagaggcugaggcuggcaca

SEQ ID NO: 1498337 - RNA, 23 nt, Homo sapiens
ucaaagauguguugcuauccuga

SEQ ID NO: 1498338 - RNA, 15 nt, Homo sapiens
ucaaagcaaguuuca

SEQ ID NO: 1498339 - RNA, 20 nt, Homo sapiens
ucaaagcacagaauuuguca

SEQ ID NO: 1498340 - RNA, 17 nt, Homo sapiens
ucaaagugacuauucag

SEQ ID NO: 1498341 - RNA, 14 nt, Homo sapiens
ucaaaguuaauuca

SEQ ID NO: 1498342 - RNA, 20 nt, Homo sapiens
ucaaaguuuugaaaagcuau

SEQ ID NO: 1498343 - RNA, 17 nt, Homo sapiens
ucaaaucuauucagaca

SEQ ID NO: 1498344 - RNA, 22 nt, Homo sapiens
ucaaauuucuguucucucuucc

SEQ ID NO: 1498345 - RNA, 21 nt, Homo sapiens
ucaacaaaauggucauccaaa

SEQ ID NO: 1498346 - RNA, 16 nt, Homo sapiens
ucaacaccacuaggaa

SEQ ID NO: 1498347 - RNA, 21 nt, Homo sapiens
ucaacauaggccugcucagcc

SEQ ID NO: 1498348 - RNA, 13 nt, Homo sapiens
ucaaccacugugg

SEQ ID NO: 1498349 - RNA, 17 nt, Homo sapiens
ucaaccccucacaggag

SEQ ID NO: 1498350 - RNA, 22 nt, Homo sapiens
ucaaccugguggcaccagaugc

SEQ ID NO: 1498351 - RNA, 23 nt, Homo sapiens
ucaacucacugcaaccuccgccu

SEQ ID NO: 1498352 - RNA, 20 nt, Homo sapiens
ucaacuguugauugcaggaa

SEQ ID NO: 1498353 - RNA, 19 nt, Homo sapiens
ucaacuguuuuugucuaca

SEQ ID NO: 1498354 - RNA, 14 nt, Homo sapiens
ucaagaaaauggau

SEQ ID NO: 1498355 - RNA, 14 nt, Homo sapiens
ucaagaacacagcc

SEQ ID NO: 1498356 - RNA, 19 nt, Homo sapiens
ucaagaagaggaaagggag

SEQ ID NO: 1498357 - RNA, 14 nt, Homo sapiens
ucaagaaucacuug

SEQ ID NO: 1498358 - RNA, 13 nt, Homo sapiens
ucaagacacugag

SEQ ID NO: 1498359 - RNA, 15 nt, Homo sapiens
ucaagacucaccuca

SEQ ID NO: 1498360 - RNA, 11 nt, Homo sapiens
ucaagacuuua

SEQ ID NO: 1498361 - RNA, 22 nt, Homo sapiens
uauaaucuuccauacuucuuca

SEQ ID NO: 1498362 - RNA, 16 nt, Homo sapiens
uauaauuggugcauag

SEQ ID NO: 1498363 - RNA, 20 nt, Homo sapiens
uauaauuucaaaccacacau

SEQ ID NO: 1498364 - RNA, 15 nt, Homo sapiens
uauaauuucuguuca

SEQ ID NO: 1498365 - RNA, 12 nt, Homo sapiens
uauacaaagugu

SEQ ID NO: 1498366 - RNA, 16 nt, Homo sapiens
uauacaggcauaaaau

SEQ ID NO: 1498367 - RNA, 21 nt, Homo sapiens
uauaccaaccaaaccaauuca

SEQ ID NO: 1498368 - RNA, 14 nt, Homo sapiens
uauaccauuuccuc

SEQ ID NO: 1498369 - RNA, 22 nt, Homo sapiens
uauacugaaggaaaaacacaag

SEQ ID NO: 1498370 - RNA, 16 nt, Homo sapiens
uauacugauucugugu

SEQ ID NO: 1498371 - RNA, 20 nt, Homo sapiens
uauacugguucacauccuac

SEQ ID NO: 1498372 - RNA, 15 nt, Homo sapiens
uauacuguacuuaau

SEQ ID NO: 1498373 - RNA, 15 nt, Homo sapiens
uauacuguaggcaca

SEQ ID NO: 1498374 - RNA, 18 nt, Homo sapiens
uauacuguggcuaugcaa

SEQ ID NO: 1498375 - RNA, 14 nt, Homo sapiens
uauacuuuugugaa

SEQ ID NO: 1498376 - RNA, 22 nt, Homo sapiens
uauacuuuuuucuuauuuaacu

SEQ ID NO: 1498377 - RNA, 17 nt, Homo sapiens
uauagcuaaguacacaa

SEQ ID NO: 1498378 - RNA, 20 nt, Homo sapiens
uauagcuugcauagucaaua

SEQ ID NO: 1498379 - RNA, 15 nt, Homo sapiens
uauaggucacuccug

SEQ ID NO: 1498380 - RNA, 20 nt, Homo sapiens
uauaguguuuggacagcuga

SEQ ID NO: 1498381 - RNA, 23 nt, Homo sapiens
uauaguuguuuuauauguugcua

SEQ ID NO: 1498382 - RNA, 19 nt, Homo sapiens
uauauaauaaagcuacuga

SEQ ID NO: 1498383 - RNA, 14 nt, Homo sapiens
uauauaaucaauca

SEQ ID NO: 1498384 - RNA, 17 nt, Homo sapiens
uauauauguguaugcac

SEQ ID NO: 1498385 - RNA, 14 nt, Homo sapiens
uauaucaucuauca

SEQ ID NO: 1498386 - RNA, 14 nt, Homo sapiens
uauaucgaucucuu

SEQ ID NO: 1498387 - RNA, 11 nt, Homo sapiens
uauaugcucug

SEQ ID NO: 1498388 - RNA, 16 nt, Homo sapiens
uauauggcuucaaguu

SEQ ID NO: 1498389 - RNA, 14 nt, Homo sapiens
uauauguacaugag

SEQ ID NO: 1498390 - RNA, 13 nt, Homo sapiens
uauauguaccgua

SEQ ID NO: 1498391 - RNA, 14 nt, Homo sapiens
uauaugugugccua

SEQ ID NO: 1498392 - RNA, 16 nt, Homo sapiens
uauauucaggaguugg

SEQ ID NO: 1498393 - RNA, 14 nt, Homo sapiens
uauauucuaagcca

SEQ ID NO: 1498394 - RNA, 18 nt, Homo sapiens
uauauuguauaggggcaa

SEQ ID NO: 1498395 - RNA, 19 nt, Homo sapiens
uauauuguuuucaguguac

SEQ ID NO: 1498396 - RNA, 22 nt, Homo sapiens
uauauuugaaaaaaacuucauu

SEQ ID NO: 1498397 - RNA, 18 nt, Homo sapiens
uauauuuuuauaagacua

SEQ ID NO: 1498398 - RNA, 21 nt, Homo sapiens
uaucaaacccuagccuugcuu

SEQ ID NO: 1498399 - RNA, 14 nt, Homo sapiens
uaucaagcuuuuaa

SEQ ID NO: 1498400 - RNA, 15 nt, Homo sapiens
uaucaauaucuaaua

SEQ ID NO: 1498401 - RNA, 20 nt, Homo sapiens
uaucaauuggcagugacuuu

SEQ ID NO: 1498402 - RNA, 15 nt, Homo sapiens
uaucaccucauggcc

SEQ ID NO: 1498403 - RNA, 17 nt, Homo sapiens
uaucacucuaaaaaaca

SEQ ID NO: 1498404 - RNA, 20 nt, Homo sapiens
uaucacuucauucacauuca

SEQ ID NO: 1498405 - RNA, 21 nt, Homo sapiens
uagaaaacuugacauguagcu

SEQ ID NO: 1498406 - RNA, 18 nt, Homo sapiens
uagaaaauuagacuguga

SEQ ID NO: 1498407 - RNA, 12 nt, Homo sapiens
uagaaacaaaca

SEQ ID NO: 1498408 - RNA, 14 nt, Homo sapiens
uagaaagggucccu

SEQ ID NO: 1498409 - RNA, 23 nt, Homo sapiens
uagaaauaaaagugaaugaaaga

SEQ ID NO: 1498410 - RNA, 13 nt, Homo sapiens
uagaaaugcaaaa

SEQ ID NO: 1498411 - RNA, 12 nt, Homo sapiens
uagaaauggauu

SEQ ID NO: 1498412 - RNA, 22 nt, Homo sapiens
uagaaauuaacaaaugugcugc

SEQ ID NO: 1498413 - RNA, 18 nt, Homo sapiens
uagaaauuggcuggaugu

SEQ ID NO: 1498414 - RNA, 13 nt, Homo sapiens
uagaaauuuuaca

SEQ ID NO: 1498415 - RNA, 18 nt, Homo sapiens
uagaacaacgccugucac

SEQ ID NO: 1498416 - RNA, 19 nt, Homo sapiens
uagaaccuuaaagaaccau

SEQ ID NO: 1498417 - RNA, 17 nt, Homo sapiens
uagaacugucugugaac

SEQ ID NO: 1498418 - RNA, 21 nt, Homo sapiens
uagaagcaaaugacaaaaagc

SEQ ID NO: 1498419 - RNA, 20 nt, Homo sapiens
uagaagccaagggaaagggg

SEQ ID NO: 1498420 - RNA, 18 nt, Homo sapiens
uagaagcuguaacagaau

SEQ ID NO: 1498421 - RNA, 19 nt, Homo sapiens
uagaaguagcaaaaaguau

SEQ ID NO: 1498422 - RNA, 22 nt, Homo sapiens
uagaaguagcaaaaaguauuga

SEQ ID NO: 1498423 - RNA, 17 nt, Homo sapiens
uagaagucuuagaugua

SEQ ID NO: 1498424 - RNA, 15 nt, Homo sapiens
uagaauaaauuccca

SEQ ID NO: 1498425 - RNA, 16 nt, Homo sapiens
uagaauaaauucccaa

SEQ ID NO: 1498426 - RNA, 20 nt, Homo sapiens
uagaauauuuauuaccucug

SEQ ID NO: 1498427 - RNA, 23 nt, Homo sapiens
uagaauauuuauuaccucugaua

SEQ ID NO: 1498428 - RNA, 21 nt, Homo sapiens
uagaauauuuuaagaauuuca

SEQ ID NO: 1498429 - RNA, 23 nt, Homo sapiens
uagaaugggaagggucauagaaa

SEQ ID NO: 1498430 - RNA, 16 nt, Homo sapiens
uagacaaucacuacaa

SEQ ID NO: 1498431 - RNA, 15 nt, Homo sapiens
uagacaauuugcaca

SEQ ID NO: 1498432 - RNA, 22 nt, Homo sapiens
uagacaguaugagucaaugugc

SEQ ID NO: 1498433 - RNA, 15 nt, Homo sapiens
uagacauucuuuauc

SEQ ID NO: 1498434 - RNA, 18 nt, Homo sapiens
uagacgaggccacagcug

SEQ ID NO: 1498435 - RNA, 14 nt, Homo sapiens
uagacugagucaga

SEQ ID NO: 1498436 - RNA, 13 nt, Homo sapiens
uagacugugccag

SEQ ID NO: 1498437 - RNA, 19 nt, Homo sapiens
uagacuuucuuaucacuua

SEQ ID NO: 1498438 - RNA, 22 nt, Homo sapiens
uagagacaggguuucacugugu

SEQ ID NO: 1498439 - RNA, 18 nt, Homo sapiens
uagagaggacaauacugg

SEQ ID NO: 1498440 - RNA, 17 nt, Homo sapiens
uagagauggggguuuca

SEQ ID NO: 1498441 - RNA, 12 nt, Homo sapiens
uagagauugcau

SEQ ID NO: 1498442 - RNA, 16 nt, Homo sapiens
uagagcucgccacgaa

SEQ ID NO: 1498443 - RNA, 16 nt, Homo sapiens
uagagggggucucaga

SEQ ID NO: 1498444 - RNA, 18 nt, Homo sapiens
uagagucugaacagcugu

SEQ ID NO: 1498445 - RNA, 13 nt, Homo sapiens
uagaguggugcug

SEQ ID NO: 1498446 - RNA, 18 nt, Homo sapiens
uagaguguagacuguggc

SEQ ID NO: 1498447 - RNA, 17 nt, Homo sapiens
uagagugucucagggug

SEQ ID NO: 1498448 - RNA, 18 nt, Homo sapiens
uagaguguuaucagucau

SEQ ID NO: 1498449 - RNA, 17 nt, Homo sapiens
uagaguuucuguuugau

SEQ ID NO: 1498450 - RNA, 20 nt, Homo sapiens
uagaguuuuaucaacuuugg

SEQ ID NO: 1498451 - RNA, 20 nt, Homo sapiens
uagauaaacuauacacuuaa

SEQ ID NO: 1498452 - RNA, 15 nt, Homo sapiens
uagauaaauuucaau

SEQ ID NO: 1498453 - RNA, 17 nt, Homo sapiens
uagauauaacacuaugu

SEQ ID NO: 1498454 - RNA, 15 nt, Homo sapiens
uagauaucaugcaaa

SEQ ID NO: 1498455 - RNA, 19 nt, Homo sapiens
uagaugaagaagcuagaaa

SEQ ID NO: 1498456 - RNA, 22 nt, Homo sapiens
uagaugacaaccuccauucuau

SEQ ID NO: 1498457 - RNA, 17 nt, Homo sapiens
uagaugcaugacuugug

SEQ ID NO: 1498458 - RNA, 17 nt, Homo sapiens
uagauguuucaacugug

SEQ ID NO: 1498459 - RNA, 14 nt, Homo sapiens
uagauuaaacaaac

SEQ ID NO: 1498460 - RNA, 16 nt, Homo sapiens
uagauugccucucuag

SEQ ID NO: 1498461 - RNA, 17 nt, Homo sapiens
uagauugcuaguuuauu

SEQ ID NO: 1498462 - RNA, 13 nt, Homo sapiens
ggccugagcaaca

SEQ ID NO: 1498463 - RNA, 19 nt, Homo sapiens
ggccugccuucuucuugug

SEQ ID NO: 1498464 - RNA, 13 nt, Homo sapiens
ggccugcuccaga

SEQ ID NO: 1498465 - RNA, 18 nt, Homo sapiens
ggccugcuccagaccuga

SEQ ID NO: 1498466 - RNA, 23 nt, Homo sapiens
ggccuggaccugcccugggccac

SEQ ID NO: 1498467 - RNA, 23 nt, Homo sapiens
ggccuggacuuccagugcucaga

SEQ ID NO: 1498468 - RNA, 17 nt, Homo sapiens
ggccuggcaagugggug

SEQ ID NO: 1498469 - RNA, 17 nt, Homo sapiens
ggccuggguuuguacuu

SEQ ID NO: 1498470 - RNA, 16 nt, Homo sapiens
ggccugucgugccagu

SEQ ID NO: 1498471 - RNA, 17 nt, Homo sapiens
ggccuuagugggccagg

SEQ ID NO: 1498472 - RNA, 12 nt, Homo sapiens
ggccuucucacc

SEQ ID NO: 1498473 - RNA, 12 nt, Homo sapiens
ggccuuuccugg

SEQ ID NO: 1498474 - RNA, 18 nt, Homo sapiens
ggccuuuccugguuuuca

SEQ ID NO: 1498475 - RNA, 15 nt, Homo sapiens
ggccuuugcucuuac

SEQ ID NO: 1498476 - RNA, 14 nt, Homo sapiens
ggcgagcacuguga

SEQ ID NO: 1498477 - RNA, 20 nt, Homo sapiens
ggcggagguugcaaugagcc

SEQ ID NO: 1498478 - RNA, 14 nt, Homo sapiens
ggcggcccggccag

SEQ ID NO: 1498479 - RNA, 20 nt, Homo sapiens
ggcggguggaucacgagguc

SEQ ID NO: 1498480 - RNA, 14 nt, Homo sapiens
ggcgucccuaccuc

SEQ ID NO: 1498481 - RNA, 12 nt, Homo sapiens
ggcgugaucuug

SEQ ID NO: 1498482 - RNA, 22 nt, Homo sapiens
ggcgugguagcgggcgccugua

SEQ ID NO: 1498483 - RNA, 13 nt, Homo sapiens
ggcuaaauggaag

SEQ ID NO: 1498484 - RNA, 17 nt, Homo sapiens
ggcuacacacaaaccag

SEQ ID NO: 1498485 - RNA, 22 nt, Homo sapiens
ggcuaccucaagacucaccuca

SEQ ID NO: 1498486 - RNA, 15 nt, Homo sapiens
ggcuacucuggaaug

SEQ ID NO: 1498487 - RNA, 14 nt, Homo sapiens
ggcuagcuucugcu

SEQ ID NO: 1498488 - RNA, 16 nt, Homo sapiens
ggcuagguaucauuca

SEQ ID NO: 1498489 - RNA, 15 nt, Homo sapiens
ggcucacaccuguaa

SEQ ID NO: 1498490 - RNA, 17 nt, Homo sapiens
ggcucagacauguuuuc

SEQ ID NO: 1498491 - RNA, 14 nt, Homo sapiens
ggcuccaccccagg

SEQ ID NO: 1498492 - RNA, 13 nt, Homo sapiens
ggcucccaugacc

SEQ ID NO: 1498493 - RNA, 14 nt, Homo sapiens
ggcuccucagagcg

SEQ ID NO: 1498494 - RNA, 16 nt, Homo sapiens
ggcuccuggggcaaug

SEQ ID NO: 1498495 - RNA, 17 nt, Homo sapiens
ggcuccuucccaucgcu

SEQ ID NO: 1498496 - RNA, 17 nt, Homo sapiens
ggcuccuuuacaaaaga

SEQ ID NO: 1498497 - RNA, 18 nt, Homo sapiens
ggcucucuuaggcaugua

SEQ ID NO: 1498498 - RNA, 14 nt, Homo sapiens
ggcucugccagugg

SEQ ID NO: 1498499 - RNA, 17 nt, Homo sapiens
ggcugaagucagcucag

SEQ ID NO: 1498500 - RNA, 15 nt, Homo sapiens
ggcugaagugucaca

SEQ ID NO: 1498501 - RNA, 21 nt, Homo sapiens
ggcugagcaucggaguggagu

SEQ ID NO: 1498502 - RNA, 14 nt, Homo sapiens
ggcugagugacaca

SEQ ID NO: 1498503 - RNA, 21 nt, Homo sapiens
ggcugauuauuaaaguccuuu

SEQ ID NO: 1498504 - RNA, 16 nt, Homo sapiens
ggcugcacagcucaac

SEQ ID NO: 1498505 - RNA, 17 nt, Homo sapiens
ggcugcacccacccagg

SEQ ID NO: 1498506 - RNA, 18 nt, Homo sapiens
ggcugcacccacccagga

SEQ ID NO: 1498507 - RNA, 18 nt, Homo sapiens
ggcugccccucucaccaa

SEQ ID NO: 1498508 - RNA, 16 nt, Homo sapiens
ggcugcuuuguucaau

SEQ ID NO: 1498509 - RNA, 20 nt, Homo sapiens
ggcuggacuggaggugggca

SEQ ID NO: 1498510 - RNA, 16 nt, Homo sapiens
ggcaacgcacaaaaca

SEQ ID NO: 1498511 - RNA, 18 nt, Homo sapiens
ggcaacuuagagauugca

SEQ ID NO: 1498512 - RNA, 23 nt, Homo sapiens
ggcaagacgcgagugcuggugac

SEQ ID NO: 1498513 - RNA, 22 nt, Homo sapiens
ggcaagcagcgggcuaacggga

SEQ ID NO: 1498514 - RNA, 21 nt, Homo sapiens
ggcaagcugugacuucuccag

SEQ ID NO: 1498515 - RNA, 16 nt, Homo sapiens
ggcaagucuuccauga

SEQ ID NO: 1498516 - RNA, 17 nt, Homo sapiens
ggcaagucuuccaugac

SEQ ID NO: 1498517 - RNA, 18 nt, Homo sapiens
ggcaagucuuccaugacc

SEQ ID NO: 1498518 - RNA, 18 nt, Homo sapiens
ggcaagugggaccaggau

SEQ ID NO: 1498519 - RNA, 19 nt, Homo sapiens
ggcaagugugggggguccu

SEQ ID NO: 1498520 - RNA, 13 nt, Homo sapiens
ggcaaucuuugcc

SEQ ID NO: 1498521 - RNA, 22 nt, Homo sapiens
ggcaaugcccugugcaugccau

SEQ ID NO: 1498522 - RNA, 22 nt, Homo sapiens
ggcaauuucaccaccaaaugcc

SEQ ID NO: 1498523 - RNA, 15 nt, Homo sapiens
ggcacaacugcaaua

SEQ ID NO: 1498524 - RNA, 23 nt, Homo sapiens
ggcacaauggcucacaccuguaa

SEQ ID NO: 1498525 - RNA, 21 nt, Homo sapiens
ggcacaauuuuaauucaaaag

SEQ ID NO: 1498526 - RNA, 17 nt, Homo sapiens
ggcacaguccagaccca

SEQ ID NO: 1498527 - RNA, 17 nt, Homo sapiens
ggcacauuccccuugcc

SEQ ID NO: 1498528 - RNA, 14 nt, Homo sapiens
ggcacccaucugca

SEQ ID NO: 1498529 - RNA, 11 nt, Homo sapiens
ggcacugccug

SEQ ID NO: 1498530 - RNA, 14 nt, Homo sapiens
ggcacuugcugagg

SEQ ID NO: 1498531 - RNA, 19 nt, Homo sapiens
ggcagaccgugaccaucuu

SEQ ID NO: 1498532 - RNA, 19 nt, Homo sapiens
ggcagacugugaacuugac

SEQ ID NO: 1498533 - RNA, 13 nt, Homo sapiens
ggcagacuuucuu

SEQ ID NO: 1498534 - RNA, 20 nt, Homo sapiens
ggcagagguugcaguguggu

SEQ ID NO: 1498535 - RNA, 14 nt, Homo sapiens
ggcagauugaaaag

SEQ ID NO: 1498536 - RNA, 12 nt, Homo sapiens
ggcagauuugag

SEQ ID NO: 1498537 - RNA, 14 nt, Homo sapiens
ggcagcaucuucac

SEQ ID NO: 1498538 - RNA, 17 nt, Homo sapiens
ggcagccaggacaucuc

SEQ ID NO: 1498539 - RNA, 16 nt, Homo sapiens
ggcagccauagugcau

SEQ ID NO: 1498540 - RNA, 15 nt, Homo sapiens
ggcagccauggccau

SEQ ID NO: 1498541 - RNA, 15 nt, Homo sapiens
ggcagccccagagag

SEQ ID NO: 1498542 - RNA, 16 nt, Homo sapiens
ggcagcccccaugggc

SEQ ID NO: 1498543 - RNA, 22 nt, Homo sapiens
ggcagcugcuauccccaucucc

SEQ ID NO: 1498544 - RNA, 19 nt, Homo sapiens
ggcagcuucaagugccuuu

SEQ ID NO: 1498545 - RNA, 22 nt, Homo sapiens
ggcaggaaucuauccauugaac

SEQ ID NO: 1498546 - RNA, 18 nt, Homo sapiens
ggcaggacugaguccccu

SEQ ID NO: 1498547 - RNA, 16 nt, Homo sapiens
ggcaggagaauggugu

SEQ ID NO: 1498548 - RNA, 18 nt, Homo sapiens
ggcaggcugggccauguc

SEQ ID NO: 1498549 - RNA, 20 nt, Homo sapiens
ggcaggcugggccaugucca

SEQ ID NO: 1498550 - RNA, 15 nt, Homo sapiens
ggcagggagugauga

SEQ ID NO: 1498551 - RNA, 19 nt, Homo sapiens
ggcagggagugggagccaa

SEQ ID NO: 1498552 - RNA, 19 nt, Homo sapiens
ggcaguauuuuguguccuc

SEQ ID NO: 1498553 - RNA, 11 nt, Homo sapiens
ggcaguugcau

SEQ ID NO: 1498554 - RNA, 16 nt, Homo sapiens
ggcauacagacugggg

SEQ ID NO: 1498555 - RNA, 17 nt, Homo sapiens
ggcauacagacugggga

SEQ ID NO: 1498556 - RNA, 21 nt, Homo sapiens
gcuggacgugcgcgaugccug

SEQ ID NO: 1498557 - RNA, 22 nt, Homo sapiens
gcuggacgugcgcgaugccugg

SEQ ID NO: 1498558 - RNA, 18 nt, Homo sapiens
gcuggacuucuaccugcc

SEQ ID NO: 1498559 - RNA, 23 nt, Homo sapiens
gcuggagagguuaaggugcaaua

SEQ ID NO: 1498560 - RNA, 23 nt, Homo sapiens
gcuggagcggagaggaagccagc

SEQ ID NO: 1498561 - RNA, 15 nt, Homo sapiens
gcuggaggaaccaga

SEQ ID NO: 1498562 - RNA, 20 nt, Homo sapiens
gcuggcaagucuuccaugac

SEQ ID NO: 1498563 - RNA, 17 nt, Homo sapiens
gcuggccaaauagcaaa

SEQ ID NO: 1498564 - RNA, 19 nt, Homo sapiens
gcuggcccgucauguuccu

SEQ ID NO: 1498565 - RNA, 14 nt, Homo sapiens
gcuggccgcggugg

SEQ ID NO: 1498566 - RNA, 22 nt, Homo sapiens
gcuggccucacccaccccugca

SEQ ID NO: 1498567 - RNA, 16 nt, Homo sapiens
gcuggccucuaccaca

SEQ ID NO: 1498568 - RNA, 19 nt, Homo sapiens
gcugggaagacuauggugc

SEQ ID NO: 1498569 - RNA, 13 nt, Homo sapiens
gcugggagacaca

SEQ ID NO: 1498570 - RNA, 18 nt, Homo sapiens
gcuggucucaaacuccug

SEQ ID NO: 1498571 - RNA, 20 nt, Homo sapiens
gcuggucucaaacuccugac

SEQ ID NO: 1498572 - RNA, 22 nt, Homo sapiens
gcuggucuuggugaacacacau

SEQ ID NO: 1498573 - RNA, 13 nt, Homo sapiens
gcuguacccagau

SEQ ID NO: 1498574 - RNA, 22 nt, Homo sapiens
gcuguaggugguaugugacacc

SEQ ID NO: 1498575 - RNA, 16 nt, Homo sapiens
gcuguauaaagcaugu

SEQ ID NO: 1498576 - RNA, 16 nt, Homo sapiens
gcugucgacuucauga

SEQ ID NO: 1498577 - RNA, 18 nt, Homo sapiens
gcugugacuucuccaggu

SEQ ID NO: 1498578 - RNA, 21 nt, Homo sapiens
gcugugcauagugguuggcac

SEQ ID NO: 1498579 - RNA, 17 nt, Homo sapiens
gcugugccaccaagcau

SEQ ID NO: 1498580 - RNA, 17 nt, Homo sapiens
gcuguggaccguggaca

SEQ ID NO: 1498581 - RNA, 15 nt, Homo sapiens
gcuguggcccuggag

SEQ ID NO: 1498582 - RNA, 23 nt, Homo sapiens
gcuguggccgucuccucccucag

SEQ ID NO: 1498583 - RNA, 18 nt, Homo sapiens
gcuguuaacuguuaacua

SEQ ID NO: 1498584 - RNA, 20 nt, Homo sapiens
gcuguuguguuguuguuauu

SEQ ID NO: 1498585 - RNA, 15 nt, Homo sapiens
gcuguuuccaguggu

SEQ ID NO: 1498586 - RNA, 16 nt, Homo sapiens
gcuuaaaaucugugaa

SEQ ID NO: 1498587 - RNA, 16 nt, Homo sapiens
gcuuaaaggcaguauu

SEQ ID NO: 1498588 - RNA, 21 nt, Homo sapiens
gcuuaaccuuuccaguuuaua

SEQ ID NO: 1498589 - RNA, 15 nt, Homo sapiens
gcuuaacuugaaaaa

SEQ ID NO: 1498590 - RNA, 18 nt, Homo sapiens
gcuuacaggcauggacau

SEQ ID NO: 1498591 - RNA, 18 nt, Homo sapiens
gcuuaccuacauacgugu

SEQ ID NO: 1498592 - RNA, 18 nt, Homo sapiens
gcuuacuagcacuuugag

SEQ ID NO: 1498593 - RNA, 14 nt, Homo sapiens
gcuuagaagugcua

SEQ ID NO: 1498594 - RNA, 13 nt, Homo sapiens
gcuuagauuucau

SEQ ID NO: 1498595 - RNA, 16 nt, Homo sapiens
gcuuagcugucucaga

SEQ ID NO: 1498596 - RNA, 14 nt, Homo sapiens
gcuuaggauguuuu

SEQ ID NO: 1498597 - RNA, 14 nt, Homo sapiens
gcuuaguaucucau

SEQ ID NO: 1498598 - RNA, 15 nt, Homo sapiens
gcuuaguauuucuca

SEQ ID NO: 1498599 - RNA, 16 nt, Homo sapiens
gcuuaguauuucucag

SEQ ID NO: 1498600 - RNA, 17 nt, Homo sapiens
gcuuauaaacacauuga

SEQ ID NO: 1498601 - RNA, 12 nt, Homo sapiens
gcuuaugauuca

SEQ ID NO: 1498602 - RNA, 17 nt, Homo sapiens
gcuuaugccugccucuu

SEQ ID NO: 1498603 - RNA, 20 nt, Homo sapiens
gcuuauucaucuguuuuucu

SEQ ID NO: 1498604 - RNA, 17 nt, Homo sapiens
gcuucaagugccuuuug

SEQ ID NO: 1498605 - RNA, 18 nt, Homo sapiens
gcuucaccagagcauuuc

SEQ ID NO: 1498606 - RNA, 21 nt, Homo sapiens
gcuucaccagagcauuuccaa

SEQ ID NO: 1498607 - RNA, 17 nt, Homo sapiens
gcuucaguacuugugaa

SEQ ID NO: 1498608 - RNA, 20 nt, Homo sapiens
gcuucauaaaugaagcagcu

SEQ ID NO: 1498609 - RNA, 16 nt, Homo sapiens
gcuucaucugucaagu

SEQ ID NO: 1498610 - RNA, 24 nt, Homo sapiens
gcuucaugugcugccugcaagcuu

SEQ ID NO: 1498611 - RNA, 15 nt, Homo sapiens
gcuucauuuuacuaa

SEQ ID NO: 1498612 - RNA, 20 nt, Homo sapiens
gcuucccaugucuuucucca

SEQ ID NO: 1498613 - RNA, 23 nt, Homo sapiens
gcuucccggcgucccuaccuccu

SEQ ID NO: 1498614 - RNA, 20 nt, Homo sapiens
ggaccugagccugguccugg

SEQ ID NO: 1498615 - RNA, 17 nt, Homo sapiens
ggaccugcccugggcca

SEQ ID NO: 1498616 - RNA, 14 nt, Homo sapiens
ggaccuguccaugc

SEQ ID NO: 1498617 - RNA, 16 nt, Homo sapiens
ggaccuucucccuccu

SEQ ID NO: 1498618 - RNA, 19 nt, Homo sapiens
ggacgaggaguaauggcau

SEQ ID NO: 1498619 - RNA, 20 nt, Homo sapiens
ggacgaggaguaauggcauu

SEQ ID NO: 1498620 - RNA, 18 nt, Homo sapiens
ggacgugcgcgaugccug

SEQ ID NO: 1498621 - RNA, 13 nt, Homo sapiens
ggacuccaucucu

SEQ ID NO: 1498622 - RNA, 17 nt, Homo sapiens
ggacuccaugcugccag

SEQ ID NO: 1498623 - RNA, 21 nt, Homo sapiens
ggacuccccaggccaggccac

SEQ ID NO: 1498624 - RNA, 20 nt, Homo sapiens
ggacucugcuucaguccacu

SEQ ID NO: 1498625 - RNA, 13 nt, Homo sapiens
ggacucuuccacc

SEQ ID NO: 1498626 - RNA, 17 nt, Homo sapiens
ggacuggaaccagggag

SEQ ID NO: 1498627 - RNA, 10 nt, Homo sapiens
ggacugggag

SEQ ID NO: 1498628 - RNA, 18 nt, Homo sapiens
ggacuuccagugcucaga

SEQ ID NO: 1498629 - RNA, 18 nt, Homo sapiens
ggacuuccuguccagcuc

SEQ ID NO: 1498630 - RNA, 14 nt, Homo sapiens
ggagaacuagagaa

SEQ ID NO: 1498631 - RNA, 16 nt, Homo sapiens
ggagaaucgcuuaaac

SEQ ID NO: 1498632 - RNA, 12 nt, Homo sapiens
ggagaaucucag

SEQ ID NO: 1498633 - RNA, 23 nt, Homo sapiens
ggagacacaacuauuuuuccaaa

SEQ ID NO: 1498634 - RNA, 23 nt, Homo sapiens
ggagacauuguuuggauuuccuu

SEQ ID NO: 1498635 - RNA, 15 nt, Homo sapiens
ggagagacaggcagc

SEQ ID NO: 1498636 - RNA, 23 nt, Homo sapiens
ggagagcccggcgccccugccac

SEQ ID NO: 1498637 - RNA, 15 nt, Homo sapiens
ggagaggcauggcug

SEQ ID NO: 1498638 - RNA, 21 nt, Homo sapiens
ggagaucgcaucauugcacuc

SEQ ID NO: 1498639 - RNA, 14 nt, Homo sapiens
ggagaucuucacuc

SEQ ID NO: 1498640 - RNA, 16 nt, Homo sapiens
ggagauggacaacuca

SEQ ID NO: 1498641 - RNA, 21 nt, Homo sapiens
ggagauuucuuguugcucaaa

SEQ ID NO: 1498642 - RNA, 19 nt, Homo sapiens
ggagcaaaaggcagcucac

SEQ ID NO: 1498643 - RNA, 20 nt, Homo sapiens
ggagcaaaaucgaugcagug

SEQ ID NO: 1498644 - RNA, 21 nt, Homo sapiens
ggagcaggaccuacuaggaga

SEQ ID NO: 1498645 - RNA, 22 nt, Homo sapiens
ggagccccuucugcucagcucu

SEQ ID NO: 1498646 - RNA, 14 nt, Homo sapiens
ggagccucaguuuc

SEQ ID NO: 1498647 - RNA, 16 nt, Homo sapiens
ggagcgaagcagagag

SEQ ID NO: 1498648 - RNA, 21 nt, Homo sapiens
ggagcugaugaaacucacaaa

SEQ ID NO: 1498649 - RNA, 19 nt, Homo sapiens
ggagcuucuuguuuccuug

SEQ ID NO: 1498650 - RNA, 13 nt, Homo sapiens
ggaggaagacugu

SEQ ID NO: 1498651 - RNA, 12 nt, Homo sapiens
ggaggaggccaa

SEQ ID NO: 1498652 - RNA, 15 nt, Homo sapiens
ggaggcccuccugug

SEQ ID NO: 1498653 - RNA, 14 nt, Homo sapiens
ggaggccuuucauc

SEQ ID NO: 1498654 - RNA, 20 nt, Homo sapiens
ggaggcugcagugagccaag

SEQ ID NO: 1498655 - RNA, 14 nt, Homo sapiens
ggaggcuucagaag

SEQ ID NO: 1498656 - RNA, 17 nt, Homo sapiens
ggagggagguaacgggu

SEQ ID NO: 1498657 - RNA, 21 nt, Homo sapiens
ggagggcugucaucugugcac

SEQ ID NO: 1498658 - RNA, 14 nt, Homo sapiens
ggagguauuugaaa

SEQ ID NO: 1498659 - RNA, 20 nt, Homo sapiens
gcucugagacccuuuucuca

SEQ ID NO: 1498660 - RNA, 22 nt, Homo sapiens
gcucugcaaugggcacugggau

SEQ ID NO: 1498661 - RNA, 21 nt, Homo sapiens
gcucugcaauuccccucugcu

SEQ ID NO: 1498662 - RNA, 20 nt, Homo sapiens
gcucugugcagucacuggag

SEQ ID NO: 1498663 - RNA, 18 nt, Homo sapiens
gcucugugugguccaggu

SEQ ID NO: 1498664 - RNA, 21 nt, Homo sapiens
gcucuuagcagcuuccagauu

SEQ ID NO: 1498665 - RNA, 14 nt, Homo sapiens
gcucuucugcccaa

SEQ ID NO: 1498666 - RNA, 15 nt, Homo sapiens
gcucuuucucugcca

SEQ ID NO: 1498667 - RNA, 22 nt, Homo sapiens
gcucuuucucugccagugacag

SEQ ID NO: 1498668 - RNA, 15 nt, Homo sapiens
gcucuuugcugcacu

SEQ ID NO: 1498669 - RNA, 16 nt, Homo sapiens
gcucuuugcugcacua

SEQ ID NO: 1498670 - RNA, 14 nt, Homo sapiens
gcugaagcagguuc

SEQ ID NO: 1498671 - RNA, 19 nt, Homo sapiens
gcugaccccucuggugugu

SEQ ID NO: 1498672 - RNA, 15 nt, Homo sapiens
gcugacuucaucugg

SEQ ID NO: 1498673 - RNA, 15 nt, Homo sapiens
gcugagaacuccuga

SEQ ID NO: 1498674 - RNA, 20 nt, Homo sapiens
gcugagaucacgccacugca

SEQ ID NO: 1498675 - RNA, 14 nt, Homo sapiens
gcugagaucgugcu

SEQ ID NO: 1498676 - RNA, 15 nt, Homo sapiens
gcugaggcuggcaca

SEQ ID NO: 1498677 - RNA, 12 nt, Homo sapiens
gcugagugacac

SEQ ID NO: 1498678 - RNA, 23 nt, Homo sapiens
gcugaguggccagccagugccau

SEQ ID NO: 1498679 - RNA, 13 nt, Homo sapiens
gcugaguguccag

SEQ ID NO: 1498680 - RNA, 13 nt, Homo sapiens
gcugauggugaca

SEQ ID NO: 1498681 - RNA, 15 nt, Homo sapiens
gcugauggugacauu

SEQ ID NO: 1498682 - RNA, 22 nt, Homo sapiens
gcugauugaagacacacucagc

SEQ ID NO: 1498683 - RNA, 20 nt, Homo sapiens
gcugauuuccccucuucccu

SEQ ID NO: 1498684 - RNA, 17 nt, Homo sapiens
gcugcacccacccagga

SEQ ID NO: 1498685 - RNA, 16 nt, Homo sapiens
gcugcaccuggucaua

SEQ ID NO: 1498686 - RNA, 23 nt, Homo sapiens
gcugcagcucccauuucaucagc

SEQ ID NO: 1498687 - RNA, 17 nt, Homo sapiens
gcugcaggacuugagaa

SEQ ID NO: 1498688 - RNA, 15 nt, Homo sapiens
gcugcagucaucuac

SEQ ID NO: 1498689 - RNA, 14 nt, Homo sapiens
gcugccaccagccc

SEQ ID NO: 1498690 - RNA, 14 nt, Homo sapiens
gcugccagcccaga

SEQ ID NO: 1498691 - RNA, 20 nt, Homo sapiens
gcugccagugcuggucacua

SEQ ID NO: 1498692 - RNA, 16 nt, Homo sapiens
gcugcugcacccaacu

SEQ ID NO: 1498693 - RNA, 21 nt, Homo sapiens
gcugcugcacccaacuacuga

SEQ ID NO: 1498694 - RNA, 22 nt, Homo sapiens
gcugcugccccuuaaacacagg

SEQ ID NO: 1498695 - RNA, 18 nt, Homo sapiens
gcugcugggcugagugac

SEQ ID NO: 1498696 - RNA, 22 nt, Homo sapiens
gcugcuuccuggcugggaacaa

SEQ ID NO: 1498697 - RNA, 14 nt, Homo sapiens
gcugcuuuguucaa

SEQ ID NO: 1498698 - RNA, 17 nt, Homo sapiens
gcugcuuuguucaaugc

SEQ ID NO: 1498699 - RNA, 23 nt, Homo sapiens
gcugcuuuugauuuuagccaugc

SEQ ID NO: 1498700 - RNA, 15 nt, Homo sapiens
gcuggaaggggucca

SEQ ID NO: 1498701 - RNA, 14 nt, Homo sapiens
gcaacaagaucuga

SEQ ID NO: 1498702 - RNA, 13 nt, Homo sapiens
gcaacaaugacuu

SEQ ID NO: 1498703 - RNA, 17 nt, Homo sapiens
gcaacagccaaguggaa

SEQ ID NO: 1498704 - RNA, 14 nt, Homo sapiens
gcaaccacuaagaa

SEQ ID NO: 1498705 - RNA, 18 nt, Homo sapiens
gcaacccagucacacugu

SEQ ID NO: 1498706 - RNA, 17 nt, Homo sapiens
gcaacccuaacaguaag

SEQ ID NO: 1498707 - RNA, 16 nt, Homo sapiens
gcaagacuccaucuca

SEQ ID NO: 1498708 - RNA, 17 nt, Homo sapiens
gcaagacuguugcucaa

SEQ ID NO: 1498709 - RNA, 18 nt, Homo sapiens
gcaagacuguugcucaaa

SEQ ID NO: 1498710 - RNA, 12 nt, Homo sapiens
gcaagagacugg

SEQ ID NO: 1498711 - RNA, 22 nt, Homo sapiens
gcaagagaggaugacacaucaa

SEQ ID NO: 1498712 - RNA, 19 nt, Homo sapiens
gcaagagcccccuugacac

SEQ ID NO: 1498713 - RNA, 19 nt, Homo sapiens
gcaagagugauugcagcuu

SEQ ID NO: 1498714 - RNA, 15 nt, Homo sapiens
gcaagcacaucugca

SEQ ID NO: 1498715 - RNA, 12 nt, Homo sapiens
gcaagccagcuu

SEQ ID NO: 1498716 - RNA, 15 nt, Homo sapiens
gcaagcuauucaaug

SEQ ID NO: 1498717 - RNA, 13 nt, Homo sapiens
gcaagcuccugca

SEQ ID NO: 1498718 - RNA, 15 nt, Homo sapiens
gcaaggacauugccc

SEQ ID NO: 1498719 - RNA, 17 nt, Homo sapiens
gcaaggacggccuucaa

SEQ ID NO: 1498720 - RNA, 11 nt, Homo sapiens
gcaaggugcau

SEQ ID NO: 1498721 - RNA, 17 nt, Homo sapiens
gcaagugggaccaggau

SEQ ID NO: 1498722 - RNA, 15 nt, Homo sapiens
gcaaguuaagagaaa

SEQ ID NO: 1498723 - RNA, 19 nt, Homo sapiens
gcaaguuucaucagucaau

SEQ ID NO: 1498724 - RNA, 18 nt, Homo sapiens
gcaaguuuccaucaucua

SEQ ID NO: 1498725 - RNA, 12 nt, Homo sapiens
gcaaguuugcac

SEQ ID NO: 1498726 - RNA, 14 nt, Homo sapiens
gcaauaaauaccag

SEQ ID NO: 1498727 - RNA, 17 nt, Homo sapiens
gcaauaaauaccagaca

SEQ ID NO: 1498728 - RNA, 21 nt, Homo sapiens
gcaauaaaucugacccagugc

SEQ ID NO: 1498729 - RNA, 20 nt, Homo sapiens
gcaauaaccucaaagugacu

SEQ ID NO: 1498730 - RNA, 15 nt, Homo sapiens
gcaauaguguguucu

SEQ ID NO: 1498731 - RNA, 16 nt, Homo sapiens
gcaaucacaacacugg

SEQ ID NO: 1498732 - RNA, 18 nt, Homo sapiens
gcaauccaccugccuugg

SEQ ID NO: 1498733 - RNA, 17 nt, Homo sapiens
gcaaucuucuacuuuaa

SEQ ID NO: 1498734 - RNA, 15 nt, Homo sapiens
gcaaugacaucucag

SEQ ID NO: 1498735 - RNA, 22 nt, Homo sapiens
gcaaugaggcagauagcacugg

SEQ ID NO: 1498736 - RNA, 19 nt, Homo sapiens
gcaaugccuagacuuccca

SEQ ID NO: 1498737 - RNA, 23 nt, Homo sapiens
gcaauggugucaguauccaggcu

SEQ ID NO: 1498738 - RNA, 12 nt, Homo sapiens
gcaaugucacaa

SEQ ID NO: 1498739 - RNA, 17 nt, Homo sapiens
gcacacacacaaacaca

SEQ ID NO: 1498740 - RNA, 13 nt, Homo sapiens
gaugcgacuguaa

SEQ ID NO: 1498741 - RNA, 20 nt, Homo sapiens
gaugcugagauccugaguca

SEQ ID NO: 1498742 - RNA, 12 nt, Homo sapiens
gaugcugcuaug

SEQ ID NO: 1498743 - RNA, 18 nt, Homo sapiens
gauggaaguugcagugag

SEQ ID NO: 1498744 - RNA, 22 nt, Homo sapiens
gauggaauauuccccuaucucu

SEQ ID NO: 1498745 - RNA, 13 nt, Homo sapiens
gauggacaacuca

SEQ ID NO: 1498746 - RNA, 17 nt, Homo sapiens
gauggagacaccaaccg

SEQ ID NO: 1498747 - RNA, 19 nt, Homo sapiens
gauggaggucacacuggua

SEQ ID NO: 1498748 - RNA, 18 nt, Homo sapiens
gauggagguucucagagc

SEQ ID NO: 1498749 - RNA, 17 nt, Homo sapiens
gauggaucugugguccu

SEQ ID NO: 1498750 - RNA, 14 nt, Homo sapiens
gauggccacuguga

SEQ ID NO: 1498751 - RNA, 18 nt, Homo sapiens
gauggcccauagaccuga

SEQ ID NO: 1498752 - RNA, 20 nt, Homo sapiens
gauggcgccaccgcacucca

SEQ ID NO: 1498753 - RNA, 19 nt, Homo sapiens
gauggcuggaaggggucca

SEQ ID NO: 1498754 - RNA, 14 nt, Homo sapiens
gaugggaacacugg

SEQ ID NO: 1498755 - RNA, 14 nt, Homo sapiens
gaugggagugggca

SEQ ID NO: 1498756 - RNA, 19 nt, Homo sapiens
gaugggagugggcaccuca

SEQ ID NO: 1498757 - RNA, 19 nt, Homo sapiens
gauggggagucccaaagcg

SEQ ID NO: 1498758 - RNA, 18 nt, Homo sapiens
gauggggcaagggcacaa

SEQ ID NO: 1498759 - RNA, 14 nt, Homo sapiens
gauggguccagggg

SEQ ID NO: 1498760 - RNA, 14 nt, Homo sapiens
gauggguccucacg

SEQ ID NO: 1498761 - RNA, 21 nt, Homo sapiens
gauguaaaaaugaaaagccaa

SEQ ID NO: 1498762 - RNA, 18 nt, Homo sapiens
gauguaaaacugaacuuc

SEQ ID NO: 1498763 - RNA, 20 nt, Homo sapiens
gauguccagaagaauauuca

SEQ ID NO: 1498764 - RNA, 22 nt, Homo sapiens
gaugucgcccuacucaccugag

SEQ ID NO: 1498765 - RNA, 22 nt, Homo sapiens
gaugugaaaacaucucaauaac

SEQ ID NO: 1498766 - RNA, 14 nt, Homo sapiens
gaugugagccaccg

SEQ ID NO: 1498767 - RNA, 20 nt, Homo sapiens
gauguguauacguaggaauu

SEQ ID NO: 1498768 - RNA, 16 nt, Homo sapiens
gauguguccucaggga

SEQ ID NO: 1498769 - RNA, 13 nt, Homo sapiens
gauguuaaccaau

SEQ ID NO: 1498770 - RNA, 20 nt, Homo sapiens
gauguucugacccugcuuca

SEQ ID NO: 1498771 - RNA, 15 nt, Homo sapiens
gauguuucaaaaaau

SEQ ID NO: 1498772 - RNA, 19 nt, Homo sapiens
gauguuuccagacuuccuu

SEQ ID NO: 1498773 - RNA, 19 nt, Homo sapiens
gauuacaggcaugagccac

SEQ ID NO: 1498774 - RNA, 17 nt, Homo sapiens
gauuacaggcauguguc

SEQ ID NO: 1498775 - RNA, 20 nt, Homo sapiens
gauuacaggugcgcacuacc

SEQ ID NO: 1498776 - RNA, 12 nt, Homo sapiens
gauuacccugag

SEQ ID NO: 1498777 - RNA, 15 nt, Homo sapiens
gauuacccugagcug

SEQ ID NO: 1498778 - RNA, 18 nt, Homo sapiens
gagcagggauuaaccucu

SEQ ID NO: 1498779 - RNA, 17 nt, Homo sapiens
gagcagugccucuuguc

SEQ ID NO: 1498780 - RNA, 17 nt, Homo sapiens
gagcaguggcuggucca

SEQ ID NO: 1498781 - RNA, 19 nt, Homo sapiens
gagcaguggcugguccagg

SEQ ID NO: 1498782 - RNA, 19 nt, Homo sapiens
gagcaucucuugaggccag

SEQ ID NO: 1498783 - RNA, 21 nt, Homo sapiens
gagccaagauugcaccacugc

SEQ ID NO: 1498784 - RNA, 20 nt, Homo sapiens
gagccaccacguccagcugg

SEQ ID NO: 1498785 - RNA, 18 nt, Homo sapiens
gagccaccagcaaagcgc

SEQ ID NO: 1498786 - RNA, 22 nt, Homo sapiens
gagccagcugcuuuuugugauu

SEQ ID NO: 1498787 - RNA, 17 nt, Homo sapiens
gagccagugagggcagu

SEQ ID NO: 1498788 - RNA, 15 nt, Homo sapiens
gagccaguggugcua

SEQ ID NO: 1498789 - RNA, 17 nt, Homo sapiens
gagccaguuagacuagu

SEQ ID NO: 1498790 - RNA, 13 nt, Homo sapiens
gagccaugucaug

SEQ ID NO: 1498791 - RNA, 17 nt, Homo sapiens
gagcccagcuuccugaa

SEQ ID NO: 1498792 - RNA, 16 nt, Homo sapiens
gagcccauacucagcc

SEQ ID NO: 1498793 - RNA, 16 nt, Homo sapiens
gagcccauagccagcu

SEQ ID NO: 1498794 - RNA, 15 nt, Homo sapiens
gagcccauucccacc

SEQ ID NO: 1498795 - RNA, 21 nt, Homo sapiens
gagccccaggggacaagggau

SEQ ID NO: 1498796 - RNA, 16 nt, Homo sapiens
gagcccccaccacaaa

SEQ ID NO: 1498797 - RNA, 14 nt, Homo sapiens
gagcccccuugaca

SEQ ID NO: 1498798 - RNA, 14 nt, Homo sapiens
gagccccugacccc

SEQ ID NO: 1498799 - RNA, 18 nt, Homo sapiens
gagccgugaacugugcau

SEQ ID NO: 1498800 - RNA, 20 nt, Homo sapiens
gagccgugaacugugcauag

SEQ ID NO: 1498801 - RNA, 23 nt, Homo sapiens
gagccucccccucagaugaucuc

SEQ ID NO: 1498802 - RNA, 14 nt, Homo sapiens
gagccucgggacau

SEQ ID NO: 1498803 - RNA, 17 nt, Homo sapiens
gagccugcaaacucacu

SEQ ID NO: 1498804 - RNA, 12 nt, Homo sapiens
gagccuggagaa

SEQ ID NO: 1498805 - RNA, 20 nt, Homo sapiens
gagccuucucagaagcacag

SEQ ID NO: 1498806 - RNA, 17 nt, Homo sapiens
gagcuagaaacucagga

SEQ ID NO: 1498807 - RNA, 17 nt, Homo sapiens
gagcuauggcccagaaa

SEQ ID NO: 1498808 - RNA, 19 nt, Homo sapiens
gagcuauuuuccucuggcc

SEQ ID NO: 1498809 - RNA, 21 nt, Homo sapiens
gagcucacaugggacugggau

SEQ ID NO: 1498810 - RNA, 18 nt, Homo sapiens
gagcuccaaauugaauca

SEQ ID NO: 1498811 - RNA, 19 nt, Homo sapiens
gagcuccccagaucuccca

SEQ ID NO: 1498812 - RNA, 19 nt, Homo sapiens
gagcucgcauuugucaaug

SEQ ID NO: 1498813 - RNA, 23 nt, Homo sapiens
gagcucucaagucaaggaagcug

SEQ ID NO: 1498814 - RNA, 13 nt, Homo sapiens
gaagucuccucaa

SEQ ID NO: 1498815 - RNA, 14 nt, Homo sapiens
gaagugacucucac

SEQ ID NO: 1498816 - RNA, 12 nt, Homo sapiens
gaagugccaguu

SEQ ID NO: 1498817 - RNA, 12 nt, Homo sapiens
gaagugcucuaa

SEQ ID NO: 1498818 - RNA, 21 nt, Homo sapiens
gaaguggcuacugacuacccu

SEQ ID NO: 1498819 - RNA, 15 nt, Homo sapiens
gaaguggucucccca

SEQ ID NO: 1498820 - RNA, 18 nt, Homo sapiens
gaagugguucuaugucca

SEQ ID NO: 1498821 - RNA, 15 nt, Homo sapiens
gaaguuuaauucaua

SEQ ID NO: 1498822 - RNA, 19 nt, Homo sapiens
gaaguuuucuguagucauu

SEQ ID NO: 1498823 - RNA, 21 nt, Homo sapiens
gaaguuuucuguagucauuua

SEQ ID NO: 1498824 - RNA, 15 nt, Homo sapiens
gaauaaaaacauuuc

SEQ ID NO: 1498825 - RNA, 14 nt, Homo sapiens
gaauaaauucccaa

SEQ ID NO: 1498826 - RNA, 15 nt, Homo sapiens
gaauaaauucccaac

SEQ ID NO: 1498827 - RNA, 14 nt, Homo sapiens
gaauacauuuccaa

SEQ ID NO: 1498828 - RNA, 21 nt, Homo sapiens
gaauacugggaaucaagacaa

SEQ ID NO: 1498829 - RNA, 13 nt, Homo sapiens
gaauacugugcau

SEQ ID NO: 1498830 - RNA, 15 nt, Homo sapiens
gaauacuuugcuuca

SEQ ID NO: 1498831 - RNA, 15 nt, Homo sapiens
gaauagaugcugacu

SEQ ID NO: 1498832 - RNA, 12 nt, Homo sapiens
gaauagcacaaa

SEQ ID NO: 1498833 - RNA, 22 nt, Homo sapiens
gaauagccuggccaccagccau

SEQ ID NO: 1498834 - RNA, 15 nt, Homo sapiens
gaauauaaacauaua

SEQ ID NO: 1498835 - RNA, 14 nt, Homo sapiens
gaauauacauuguc

SEQ ID NO: 1498836 - RNA, 20 nt, Homo sapiens
gaauauauuauaaucuucca

SEQ ID NO: 1498837 - RNA, 14 nt, Homo sapiens
gaauauccauguac

SEQ ID NO: 1498838 - RNA, 21 nt, Homo sapiens
gaauaugauaaaacacugccc

SEQ ID NO: 1498839 - RNA, 18 nt, Homo sapiens
gaauauuuauaggccagg

SEQ ID NO: 1498840 - RNA, 21 nt, Homo sapiens
gaauauuuauuaccucugaua

SEQ ID NO: 1498841 - RNA, 15 nt, Homo sapiens
gaaucaagacaagac

SEQ ID NO: 1498842 - RNA, 17 nt, Homo sapiens
gaaucaagagcugcccu

SEQ ID NO: 1498843 - RNA, 20 nt, Homo sapiens
gaaucagugaagaugccagu

SEQ ID NO: 1498844 - RNA, 23 nt, Homo sapiens
gaaucaucaaagcucacaccaaa

SEQ ID NO: 1498845 - RNA, 23 nt, Homo sapiens
gaauccaguccagauauuucaca

SEQ ID NO: 1498846 - RNA, 17 nt, Homo sapiens
gaauccuccuccagggu

SEQ ID NO: 1498847 - RNA, 12 nt, Homo sapiens
gaaucuugacuu

SEQ ID NO: 1498848 - RNA, 22 nt, Homo sapiens
gaaugaagaacaacaacucuca

SEQ ID NO: 1498849 - RNA, 16 nt, Homo sapiens
gaaugaauacugggaa

SEQ ID NO: 1498850 - RNA, 18 nt, Homo sapiens
gaaugaggucccaggcag

SEQ ID NO: 1498851 - RNA, 21 nt, Homo sapiens
gaaugaucagcaucugugaug

SEQ ID NO: 1498852 - RNA, 24 nt, Homo sapiens
gaaugcacacuagccucuccagga

SEQ ID NO: 1498853 - RNA, 19 nt, Homo sapiens
gaaugccuaaauauaauua

SEQ ID NO: 1498854 - RNA, 17 nt, Homo sapiens
gaaugccucaaugugac

SEQ ID NO: 1498855 - RNA, 21 nt, Homo sapiens
gaaugcucuuuacuucaugga

SEQ ID NO: 1498856 - RNA, 18 nt, Homo sapiens
gaauggaagcuucagggc

SEQ ID NO: 1498857 - RNA, 19 nt, Homo sapiens
gaauggacauccuguauaa

SEQ ID NO: 1498858 - RNA, 19 nt, Homo sapiens
gaaugggaagggucauaga

SEQ ID NO: 1498859 - RNA, 15 nt, Homo sapiens
gaaugguccaggguu

SEQ ID NO: 1498860 - RNA, 17 nt, Homo sapiens
gaauguauguaaugugu

SEQ ID NO: 1498861 - RNA, 18 nt, Homo sapiens
gaauguggauucuuccca

SEQ ID NO: 1498862 - RNA, 16 nt, Homo sapiens
gaauguggucucagga

SEQ ID NO: 1498863 - RNA, 17 nt, Homo sapiens
gaauguuuaaagaucau

SEQ ID NO: 1498864 - RNA, 19 nt, Homo sapiens
gaauuaaccuggugcugga

SEQ ID NO: 1498865 - RNA, 22 nt, Homo sapiens
gaauuauuugccuucugaaaug

SEQ ID NO: 1498866 - RNA, 19 nt, Homo sapiens
gaauuauuuuuguguuucu

SEQ ID NO: 1498867 - RNA, 16 nt, Homo sapiens
gaauucaaacuggggc

SEQ ID NO: 1498868 - RNA, 21 nt, Homo sapiens
gaauucauuuucaucacuggg

SEQ ID NO: 1498869 - RNA, 13 nt, Homo sapiens
gaauuccuaacuu

SEQ ID NO: 1498870 - RNA, 17 nt, Homo sapiens
gaauugcuuaccaaagg

SEQ ID NO: 1498871 - RNA, 23 nt, Homo sapiens
gaauuguuuccuuauuugcacuu

SEQ ID NO: 1498872 - RNA, 17 nt, Homo sapiens
gaauuuauucaauuccu

SEQ ID NO: 1498873 - RNA, 19 nt, Homo sapiens
gaauuuauuuaaguucaca

SEQ ID NO: 1498874 - RNA, 13 nt, Homo sapiens
gaauuucccacau

SEQ ID NO: 1498875 - RNA, 17 nt, Homo sapiens
gaauuuggccugcacua

SEQ ID NO: 1498876 - RNA, 14 nt, Homo sapiens
gaauuuuaccauuc

SEQ ID NO: 1498877 - RNA, 16 nt, Homo sapiens
gacaaaacccacuguu

SEQ ID NO: 1498878 - RNA, 17 nt, Homo sapiens
gacaaacagaccauaaa

SEQ ID NO: 1498879 - RNA, 22 nt, Homo sapiens
gacaaagugacauuccugaguc

SEQ ID NO: 1498880 - RNA, 17 nt, Homo sapiens
gacaaagugagacuccg

SEQ ID NO: 1498881 - RNA, 14 nt, Homo sapiens
gacugauguguaua

SEQ ID NO: 1498882 - RNA, 17 nt, Homo sapiens
gacugauguuacaucac

SEQ ID NO: 1498883 - RNA, 14 nt, Homo sapiens
gacugcaacaggcu

SEQ ID NO: 1498884 - RNA, 19 nt, Homo sapiens
gacugcaguggacaguccc

SEQ ID NO: 1498885 - RNA, 19 nt, Homo sapiens
gacugcauugccgcuguau

SEQ ID NO: 1498886 - RNA, 14 nt, Homo sapiens
gacugccugugaag

SEQ ID NO: 1498887 - RNA, 19 nt, Homo sapiens
gacugcucagaacuugcug

SEQ ID NO: 1498888 - RNA, 15 nt, Homo sapiens
gacuggaaccaggga

SEQ ID NO: 1498889 - RNA, 17 nt, Homo sapiens
gacugggggacugggag

SEQ ID NO: 1498890 - RNA, 14 nt, Homo sapiens
gacuguacuccucc

SEQ ID NO: 1498891 - RNA, 13 nt, Homo sapiens
gacuguugccacc

SEQ ID NO: 1498892 - RNA, 19 nt, Homo sapiens
gacuuaccuggcagacuug

SEQ ID NO: 1498893 - RNA, 23 nt, Homo sapiens
gacuuacuaugggauggggucca

SEQ ID NO: 1498894 - RNA, 15 nt, Homo sapiens
gacuuauugccaaaa

SEQ ID NO: 1498895 - RNA, 20 nt, Homo sapiens
gacuucaugacaagcauuuu

SEQ ID NO: 1498896 - RNA, 14 nt, Homo sapiens
gacuuccacuuugu

SEQ ID NO: 1498897 - RNA, 19 nt, Homo sapiens
gacuucccaacagccuuag

SEQ ID NO: 1498898 - RNA, 18 nt, Homo sapiens
gacuucuaauaucauuca

SEQ ID NO: 1498899 - RNA, 18 nt, Homo sapiens
gacuugauuagugccuuc

SEQ ID NO: 1498900 - RNA, 23 nt, Homo sapiens
gacuuggcaggugccuguugaau

SEQ ID NO: 1498901 - RNA, 16 nt, Homo sapiens
gacuuggggucaggaa

SEQ ID NO: 1498902 - RNA, 20 nt, Homo sapiens
gacuuguuuuaugcucaggg

SEQ ID NO: 1498903 - RNA, 19 nt, Homo sapiens
gacuuuacgcccaucucag

SEQ ID NO: 1498904 - RNA, 12 nt, Homo sapiens
gacuuugcuugc

SEQ ID NO: 1498905 - RNA, 17 nt, Homo sapiens
gacuuuguauagaaggu

SEQ ID NO: 1498906 - RNA, 23 nt, Homo sapiens
gagaaaccagggagccccuuuga

SEQ ID NO: 1498907 - RNA, 21 nt, Homo sapiens
gagaaacccuucacaccccag

SEQ ID NO: 1498908 - RNA, 22 nt, Homo sapiens
gagaaaccuuauuguaccucuc

SEQ ID NO: 1498909 - RNA, 20 nt, Homo sapiens
gagaaauaaaaagccuguca

SEQ ID NO: 1498910 - RNA, 17 nt, Homo sapiens
gagaagaggcugcugca

SEQ ID NO: 1498911 - RNA, 19 nt, Homo sapiens
gagaagauucuuguauuua

SEQ ID NO: 1498912 - RNA, 20 nt, Homo sapiens
gagaagccaggaauuuccca

SEQ ID NO: 1498913 - RNA, 14 nt, Homo sapiens
gagaagcucaccca

SEQ ID NO: 1498914 - RNA, 15 nt, Homo sapiens
gagaagcucacccaa

SEQ ID NO: 1498915 - RNA, 18 nt, Homo sapiens
gagaagucaaacauuuca

SEQ ID NO: 1498916 - RNA, 19 nt, Homo sapiens
gaacccaucgguaggcaaa

SEQ ID NO: 1498917 - RNA, 11 nt, Homo sapiens
gaacccaugag

SEQ ID NO: 1498918 - RNA, 21 nt, Homo sapiens
gaacccauuuugagugacucg

SEQ ID NO: 1498919 - RNA, 22 nt, Homo sapiens
gaacccuuggagccaauggaga

SEQ ID NO: 1498920 - RNA, 21 nt, Homo sapiens
gaaccucuccaucaucuuccg

SEQ ID NO: 1498921 - RNA, 18 nt, Homo sapiens
gaaccugcccugcuccca

SEQ ID NO: 1498922 - RNA, 22 nt, Homo sapiens
gaaccuggauccagcacuggug

SEQ ID NO: 1498923 - RNA, 14 nt, Homo sapiens
gaacuaaagcaaau

SEQ ID NO: 1498924 - RNA, 14 nt, Homo sapiens
gaacuaacugacag

SEQ ID NO: 1498925 - RNA, 16 nt, Homo sapiens
gaacuacagcucuuaa

SEQ ID NO: 1498926 - RNA, 15 nt, Homo sapiens
gaacuagagaaggac

SEQ ID NO: 1498927 - RNA, 16 nt, Homo sapiens
gaacuagcauauagcc

SEQ ID NO: 1498928 - RNA, 16 nt, Homo sapiens
gaacuaggguaaggug

SEQ ID NO: 1498929 - RNA, 14 nt, Homo sapiens
gaacuauguacuuu

SEQ ID NO: 1498930 - RNA, 19 nt, Homo sapiens
gaacucaaauggggccaga

SEQ ID NO: 1498931 - RNA, 22 nt, Homo sapiens
gaacucagagaugaacaucuaa

SEQ ID NO: 1498932 - RNA, 17 nt, Homo sapiens
gaacucuacaucuagca

SEQ ID NO: 1498933 - RNA, 16 nt, Homo sapiens
gaacucuacgccacuc

SEQ ID NO: 1498934 - RNA, 14 nt, Homo sapiens
gaacucucuccacc

SEQ ID NO: 1498935 - RNA, 14 nt, Homo sapiens
gaacucugguggca

SEQ ID NO: 1498936 - RNA, 18 nt, Homo sapiens
gaacucuguaaaaccuca

SEQ ID NO: 1498937 - RNA, 17 nt, Homo sapiens
gaacucuugacuuccug

SEQ ID NO: 1498938 - RNA, 18 nt, Homo sapiens
gaacugaaguuucacaug

SEQ ID NO: 1498939 - RNA, 16 nt, Homo sapiens
gaacugcagucagcau

SEQ ID NO: 1498940 - RNA, 15 nt, Homo sapiens
gaacugcuucuaaga

SEQ ID NO: 1498941 - RNA, 20 nt, Homo sapiens
gaacuggggcuuugccuugc

SEQ ID NO: 1498942 - RNA, 21 nt, Homo sapiens
gaacuuaauaacuguguacug

SEQ ID NO: 1498943 - RNA, 14 nt, Homo sapiens
gaacuucagagcau

SEQ ID NO: 1498944 - RNA, 15 nt, Homo sapiens
gaacuucccuuaaga

SEQ ID NO: 1498945 - RNA, 14 nt, Homo sapiens
gaacuuuuguacug

SEQ ID NO: 1498946 - RNA, 18 nt, Homo sapiens
gaagaaaagcugccauuu

SEQ ID NO: 1498947 - RNA, 20 nt, Homo sapiens
gaagaaaagcugccauuucc

SEQ ID NO: 1498948 - RNA, 16 nt, Homo sapiens
gaagaagauagaucca

SEQ ID NO: 1498949 - RNA, 15 nt, Homo sapiens
gaagaauuggaauaa

SEQ ID NO: 1498950 - RNA, 13 nt, Homo sapiens
gaagacacacuca

SEQ ID NO: 1498951 - RNA, 15 nt, Homo sapiens
gaagacacugcaaag

SEQ ID NO: 1498952 - RNA, 11 nt, Homo sapiens
gaagacauaaa

SEQ ID NO: 1498953 - RNA, 22 nt, Homo sapiens
gaagacaucuuauccauccuca

SEQ ID NO: 1498954 - RNA, 17 nt, Homo sapiens
gaagaccacacuuggug

SEQ ID NO: 1498955 - RNA, 17 nt, Homo sapiens
gaagagaaagcacgugu

SEQ ID NO: 1498956 - RNA, 20 nt, Homo sapiens
gaagagaagcugcugaccaa

SEQ ID NO: 1498957 - RNA, 16 nt, Homo sapiens
gaagagagauauaucu

SEQ ID NO: 1498958 - RNA, 13 nt, Homo sapiens
gaagagcauugca

SEQ ID NO: 1498959 - RNA, 20 nt, Homo sapiens
gaagagggagaagcaugaaa

SEQ ID NO: 1498960 - RNA, 20 nt, Homo sapiens
gaagagugcccugcuuugca

SEQ ID NO: 1498961 - RNA, 23 nt, Homo sapiens
gaagaguguuucuuccacaacag

SEQ ID NO: 1498962 - RNA, 14 nt, Homo sapiens
gaagauaauuugca

SEQ ID NO: 1498963 - RNA, 22 nt, Homo sapiens
gaagauauaacauucaguuccc

SEQ ID NO: 1498964 - RNA, 21 nt, Homo sapiens
gaagaugauggcucauuuaca

SEQ ID NO: 1498965 - RNA, 20 nt, Homo sapiens
gaagauguuucaaaaaaucu

SEQ ID NO: 1498966 - RNA, 18 nt, Homo sapiens
gaagauucuccugugcua

SEQ ID NO: 1498967 - RNA, 17 nt, Homo sapiens
gaagauuuaugaugcac

SEQ ID NO: 1498968 - RNA, 13 nt, Homo sapiens
gaagcaacauuuu

SEQ ID NO: 1498969 - RNA, 13 nt, Homo sapiens
gaagcaagccaga

SEQ ID NO: 1498970 - RNA, 16 nt, Homo sapiens
gaagcacauguguauu

SEQ ID NO: 1498971 - RNA, 16 nt, Homo sapiens
gaagcaccccaugcca

SEQ ID NO: 1498972 - RNA, 18 nt, Homo sapiens
gaagcagccagcucccca

SEQ ID NO: 1498973 - RNA, 19 nt, Homo sapiens
gaagcagugccuuccauaa

SEQ ID NO: 1498974 - RNA, 18 nt, Homo sapiens
gaagcauuugauuuucaa

SEQ ID NO: 1498975 - RNA, 12 nt, Homo sapiens
gaagccaaagaa

SEQ ID NO: 1498976 - RNA, 18 nt, Homo sapiens
gaagccaggaauuuccca

SEQ ID NO: 1498977 - RNA, 18 nt, Homo sapiens
gaagccauauaugaccag

SEQ ID NO: 1498978 - RNA, 15 nt, Homo sapiens
gaagccccauccaac

SEQ ID NO: 1498979 - RNA, 19 nt, Homo sapiens
gaagcccugauguguccuc

SEQ ID NO: 1498980 - RNA, 20 nt, Homo sapiens
gaagccggaggguguuuaug

SEQ ID NO: 1498981 - RNA, 13 nt, Homo sapiens
gaagccucagcua

SEQ ID NO: 1498982 - RNA, 18 nt, Homo sapiens
gaagcggauuuccaggga

SEQ ID NO: 1498983 - RNA, 20 nt, Homo sapiens
gaagcuagugaccaucuuca

SEQ ID NO: 1498984 - RNA, 12 nt, Homo sapiens
cucuuugcugca

SEQ ID NO: 1498985 - RNA, 17 nt, Homo sapiens
cucuuugcugcacuauu

SEQ ID NO: 1498986 - RNA, 13 nt, Homo sapiens
cucuuuugcuuaa

SEQ ID NO: 1498987 - RNA, 21 nt, Homo sapiens
cugaaaaugucacauucuauu

SEQ ID NO: 1498988 - RNA, 13 nt, Homo sapiens
cugaaaauucugu

SEQ ID NO: 1498989 - RNA, 14 nt, Homo sapiens
cugaaacacacuga

SEQ ID NO: 1498990 - RNA, 23 nt, Homo sapiens
cugaaaccucugggucaucucuc

SEQ ID NO: 1498991 - RNA, 21 nt, Homo sapiens
cugaaagaacauggacuugua

SEQ ID NO: 1498992 - RNA, 16 nt, Homo sapiens
cugaaagaucuuucag

SEQ ID NO: 1498993 - RNA, 15 nt, Homo sapiens
cugaaagaugaucau

SEQ ID NO: 1498994 - RNA, 16 nt, Homo sapiens
cugaacaaacuaaagg

SEQ ID NO: 1498995 - RNA, 15 nt, Homo sapiens
cugaacacugaaguc

SEQ ID NO: 1498996 - RNA, 15 nt, Homo sapiens
cugaacccauuuuga

SEQ ID NO: 1498997 - RNA, 19 nt, Homo sapiens
cugaacuaaucugauguua

SEQ ID NO: 1498998 - RNA, 14 nt, Homo sapiens
cugaacuauuucag

SEQ ID NO: 1498999 - RNA, 15 nt, Homo sapiens
cugaacuugccuuaa

SEQ ID NO: 1499000 - RNA, 22 nt, Homo sapiens
cugaacuugccuuaaacacuca

SEQ ID NO: 1499001 - RNA, 13 nt, Homo sapiens
cugaagaaauugg

SEQ ID NO: 1499002 - RNA, 21 nt, Homo sapiens
cugaagaagaucccagaggau

SEQ ID NO: 1499003 - RNA, 22 nt, Homo sapiens
cugaagagcuauuauauaaaaa

SEQ ID NO: 1499004 - RNA, 13 nt, Homo sapiens
cugaagcaaagaa

SEQ ID NO: 1499005 - RNA, 19 nt, Homo sapiens
cugaaggcugaaagacagg

SEQ ID NO: 1499006 - RNA, 18 nt, Homo sapiens
cugaaggcugaguguccg

SEQ ID NO: 1499007 - RNA, 17 nt, Homo sapiens
cugaagugaacuaugaa

SEQ ID NO: 1499008 - RNA, 12 nt, Homo sapiens
cugaagugcuua

SEQ ID NO: 1499009 - RNA, 13 nt, Homo sapiens
cugaagugcuuag

SEQ ID NO: 1499010 - RNA, 18 nt, Homo sapiens
cugaagugucacagccug

SEQ ID NO: 1499011 - RNA, 12 nt, Homo sapiens
cugaaucuaccu

SEQ ID NO: 1499012 - RNA, 14 nt, Homo sapiens
cugaaugauuuaga

SEQ ID NO: 1499013 - RNA, 21 nt, Homo sapiens
cugaaugguuccaugccugag

SEQ ID NO: 1499014 - RNA, 12 nt, Homo sapiens
cugaauguucug

SEQ ID NO: 1499015 - RNA, 20 nt, Homo sapiens
cugaauuccagcaaaagagc

SEQ ID NO: 1499016 - RNA, 19 nt, Homo sapiens
cugaauuugauucuccagc

SEQ ID NO: 1499017 - RNA, 20 nt, Homo sapiens
cugaauuuggccugcacuaa

SEQ ID NO: 1499018 - RNA, 11 nt, Homo sapiens
cugacagcuuc

SEQ ID NO: 1499019 - RNA, 17 nt, Homo sapiens
cugacagcuucaugaaa

SEQ ID NO: 1499020 - RNA, 15 nt, Homo sapiens
cugacauauuaugcc

SEQ ID NO: 1499021 - RNA, 18 nt, Homo sapiens
cugacauauuaugccuga

SEQ ID NO: 1499022 - RNA, 11 nt, Homo sapiens
cugaccaaaac

SEQ ID NO: 1499023 - RNA, 14 nt, Homo sapiens
cugaccacagaauu

SEQ ID NO: 1499024 - RNA, 19 nt, Homo sapiens
cugaccacagcacagccaa

SEQ ID NO: 1499025 - RNA, 14 nt, Homo sapiens
cugaccccaaagag

SEQ ID NO: 1499026 - RNA, 14 nt, Homo sapiens
cugaccccauuccu

SEQ ID NO: 1499027 - RNA, 22 nt, Homo sapiens
cugacccggccucucugcccca

SEQ ID NO: 1499028 - RNA, 15 nt, Homo sapiens
cugaccucacuguga

SEQ ID NO: 1499029 - RNA, 19 nt, Homo sapiens
cugaccucaggugauccgc

SEQ ID NO: 1499030 - RNA, 16 nt, Homo sapiens
cugaccucccagugac

SEQ ID NO: 1499031 - RNA, 18 nt, Homo sapiens
cugaccuggcuggugaca

SEQ ID NO: 1499032 - RNA, 15 nt, Homo sapiens
cugaccuugugaucc

SEQ ID NO: 1499033 - RNA, 13 nt, Homo sapiens
cugacucuugcag

SEQ ID NO: 1499034 - RNA, 20 nt, Homo sapiens
cugacugaagugaacuauga

SEQ ID NO: 1499035 - RNA, 11 nt, Homo sapiens
cugacugcuag

SEQ ID NO: 1499036 - RNA, 18 nt, Homo sapiens
cugacugcuaguugccau

SEQ ID NO: 1499037 - RNA, 16 nt, Homo sapiens
cugacuguacuccucc

SEQ ID NO: 1499038 - RNA, 18 nt, Homo sapiens
cugacuuaaguggcauua

SEQ ID NO: 1499039 - RNA, 20 nt, Homo sapiens
cugacuuaaguggcauuaaa

SEQ ID NO: 1499040 - RNA, 13 nt, Homo sapiens
cugacuucaucug

SEQ ID NO: 1499041 - RNA, 19 nt, Homo sapiens
cugacuuguuugucuucca

SEQ ID NO: 1499042 - RNA, 14 nt, Homo sapiens
cugacuuugcuugc

SEQ ID NO: 1499043 - RNA, 16 nt, Homo sapiens
cugacuuuuaauguca

SEQ ID NO: 1499044 - RNA, 18 nt, Homo sapiens
cugagaaauguuaaaggu

SEQ ID NO: 1499045 - RNA, 17 nt, Homo sapiens
cugagaaauguucagaa

SEQ ID NO: 1499046 - RNA, 22 nt, Homo sapiens
cugagaagaaugaaaaugcagu

SEQ ID NO: 1499047 - RNA, 14 nt, Homo sapiens
cugagaagaucuga

SEQ ID NO: 1499048 - RNA, 16 nt, Homo sapiens
cugagaauguggaaua

SEQ ID NO: 1499049 - RNA, 12 nt, Homo sapiens
cugagaauucca

SEQ ID NO: 1499050 - RNA, 20 nt, Homo sapiens
cugagacauucuucaccucc

SEQ ID NO: 1499051 - RNA, 23 nt, Homo sapiens
cugagaccaguugggagcacugg

SEQ ID NO: 1499052 - RNA, 17 nt, Homo sapiens
cugagacuaaguuguag

SEQ ID NO: 1499053 - RNA, 17 nt, Homo sapiens
cugagacuuggcuccac

SEQ ID NO: 1499054 - RNA, 16 nt, Homo sapiens
cugagagaccugaguc

SEQ ID NO: 1499055 - RNA, 13 nt, Homo sapiens
cugagagaugaca

SEQ ID NO: 1499056 - RNA, 21 nt, Homo sapiens
cugagagugaaaccaugacug

SEQ ID NO: 1499057 - RNA, 19 nt, Homo sapiens
cugagauuuuuuuguguau

SEQ ID NO: 1499058 - RNA, 17 nt, Homo sapiens
cugagcaacucuugauu

SEQ ID NO: 1499059 - RNA, 15 nt, Homo sapiens
cugagcaccguguca

SEQ ID NO: 1499060 - RNA, 15 nt, Homo sapiens
cugcuccagugcagg

SEQ ID NO: 1499061 - RNA, 14 nt, Homo sapiens
cugcucccacagaa

SEQ ID NO: 1499062 - RNA, 15 nt, Homo sapiens
cugcucccaucauuc

SEQ ID NO: 1499063 - RNA, 22 nt, Homo sapiens
cugcucccuaccccagggcccu

SEQ ID NO: 1499064 - RNA, 17 nt, Homo sapiens
cugcuccucugccugga

SEQ ID NO: 1499065 - RNA, 19 nt, Homo sapiens
cugcuccuggagccuuuga

SEQ ID NO: 1499066 - RNA, 22 nt, Homo sapiens
cugcucuguaggucauuggcca

SEQ ID NO: 1499067 - RNA, 12 nt, Homo sapiens
cugcucuugcag

SEQ ID NO: 1499068 - RNA, 23 nt, Homo sapiens
cugcucuuucucugccagugaca

SEQ ID NO: 1499069 - RNA, 14 nt, Homo sapiens
cugcugaaugcagg

SEQ ID NO: 1499070 - RNA, 11 nt, Homo sapiens
cugcugaccaa

SEQ ID NO: 1499071 - RNA, 18 nt, Homo sapiens
cugcugagugcaccacuu

SEQ ID NO: 1499072 - RNA, 19 nt, Homo sapiens
cugcugagugcaccacuuc

SEQ ID NO: 1499073 - RNA, 20 nt, Homo sapiens
cugcuggagaggaacccaga

SEQ ID NO: 1499074 - RNA, 19 nt, Homo sapiens
cugcuuacccaucuucaaa

SEQ ID NO: 1499075 - RNA, 10 nt, Homo sapiens
cugcuuccag

SEQ ID NO: 1499076 - RNA, 15 nt, Homo sapiens
cugcuucugaacuca

SEQ ID NO: 1499077 - RNA, 14 nt, Homo sapiens
cugcuugaccaaag

SEQ ID NO: 1499078 - RNA, 22 nt, Homo sapiens
cugcuugauuuuaauacauuga

SEQ ID NO: 1499079 - RNA, 15 nt, Homo sapiens
cugcuugcacuuugu

SEQ ID NO: 1499080 - RNA, 19 nt, Homo sapiens
cugcuuuaggaauucugca

SEQ ID NO: 1499081 - RNA, 22 nt, Homo sapiens
cugcuuuugauuuuagccaugc

SEQ ID NO: 1499082 - RNA, 19 nt, Homo sapiens
cuggaaaaauuccagaaga

SEQ ID NO: 1499083 - RNA, 14 nt, Homo sapiens
cuggaaaagggaag

SEQ ID NO: 1499084 - RNA, 17 nt, Homo sapiens
cuggaagaccugaaaga

SEQ ID NO: 1499085 - RNA, 22 nt, Homo sapiens
cuggaagagcuaggcagggugu

SEQ ID NO: 1499086 - RNA, 23 nt, Homo sapiens
cuggaagauauaacauucaguuc

SEQ ID NO: 1499087 - RNA, 12 nt, Homo sapiens
cuggaagaugua

SEQ ID NO: 1499088 - RNA, 16 nt, Homo sapiens
cucacuuaguccuuua

SEQ ID NO: 1499089 - RNA, 11 nt, Homo sapiens
cucacuuuaaa

SEQ ID NO: 1499090 - RNA, 17 nt, Homo sapiens
cucagaacaauccgauu

SEQ ID NO: 1499091 - RNA, 18 nt, Homo sapiens
cucagaggaugaggucaa

SEQ ID NO: 1499092 - RNA, 14 nt, Homo sapiens
cucagccagcacuu

SEQ ID NO: 1499093 - RNA, 23 nt, Homo sapiens
cucagccuacuuucacacuaaga

SEQ ID NO: 1499094 - RNA, 19 nt, Homo sapiens
cucagccuggccagacaca

SEQ ID NO: 1499095 - RNA, 15 nt, Homo sapiens
cucagcucucuggga

SEQ ID NO: 1499096 - RNA, 15 nt, Homo sapiens
cucagcuucuucaca

SEQ ID NO: 1499097 - RNA, 22 nt, Homo sapiens
cucaggauccagucccuuacac

SEQ ID NO: 1499098 - RNA, 20 nt, Homo sapiens
cucagggcagcgccaggcug

SEQ ID NO: 1499099 - RNA, 21 nt, Homo sapiens
cucaggugaaaauccaucuca

SEQ ID NO: 1499100 - RNA, 14 nt, Homo sapiens
cucaggugcugucc

SEQ ID NO: 1499101 - RNA, 15 nt, Homo sapiens
cucagguguugccaa

SEQ ID NO: 1499102 - RNA, 23 nt, Homo sapiens
cucagguucuucagggccagucc

SEQ ID NO: 1499103 - RNA, 12 nt, Homo sapiens
cucagugccugg

SEQ ID NO: 1499104 - RNA, 19 nt, Homo sapiens
cucaguggugccugcauuu

SEQ ID NO: 1499105 - RNA, 14 nt, Homo sapiens
cucauacacagaaa

SEQ ID NO: 1499106 - RNA, 22 nt, Homo sapiens
cucaucaacaaagaaauauuau

SEQ ID NO: 1499107 - RNA, 14 nt, Homo sapiens
cucaucccaugaga

SEQ ID NO: 1499108 - RNA, 15 nt, Homo sapiens
cucaucccaugagac

SEQ ID NO: 1499109 - RNA, 18 nt, Homo sapiens
cucauccccacagcuggc

SEQ ID NO: 1499110 - RNA, 18 nt, Homo sapiens
cucaucucccgagcaaug

SEQ ID NO: 1499111 - RNA, 16 nt, Homo sapiens
cucaugcccgccagug

SEQ ID NO: 1499112 - RNA, 22 nt, Homo sapiens
cucaugcccgccagugcacagg

SEQ ID NO: 1499113 - RNA, 20 nt, Homo sapiens
cucaugccuguaaucccagc

SEQ ID NO: 1499114 - RNA, 17 nt, Homo sapiens
cucaugccuguaaucuc

SEQ ID NO: 1499115 - RNA, 14 nt, Homo sapiens
cucaugcugcucaa

SEQ ID NO: 1499116 - RNA, 18 nt, Homo sapiens
cucauugacaagaacuga

SEQ ID NO: 1499117 - RNA, 23 nt, Homo sapiens
cucauugacaagaacugaaacca

SEQ ID NO: 1499118 - RNA, 13 nt, Homo sapiens
cucauugcagcua

SEQ ID NO: 1499119 - RNA, 18 nt, Homo sapiens
cuccaaauuuuuuuuacu

SEQ ID NO: 1499120 - RNA, 22 nt, Homo sapiens
cuccaaggauccucuccacucc

SEQ ID NO: 1499121 - RNA, 18 nt, Homo sapiens
cuccaagguaacccggcu

SEQ ID NO: 1499122 - RNA, 20 nt, Homo sapiens
cuccaagguagaauuugcaa

SEQ ID NO: 1499123 - RNA, 19 nt, Homo sapiens
cuccaaugucugcugagga

SEQ ID NO: 1499124 - RNA, 17 nt, Homo sapiens
cuccaccuagacuguaa

SEQ ID NO: 1499125 - RNA, 14 nt, Homo sapiens
cuccaccucuucac

SEQ ID NO: 1499126 - RNA, 19 nt, Homo sapiens
cuccacgguagcacuugac

SEQ ID NO: 1499127 - RNA, 16 nt, Homo sapiens
cuccacugccuucgau

SEQ ID NO: 1499128 - RNA, 13 nt, Homo sapiens
cuccacugucaca

SEQ ID NO: 1499129 - RNA, 22 nt, Homo sapiens
cuccagacuugggaaacuauuc

SEQ ID NO: 1499130 - RNA, 15 nt, Homo sapiens
cuccagagaugguca

SEQ ID NO: 1499131 - RNA, 20 nt, Homo sapiens
cuccagauguuuccagacuu

SEQ ID NO: 1499132 - RNA, 15 nt, Homo sapiens
cuccagcagcuuucc

SEQ ID NO: 1499133 - RNA, 23 nt, Homo sapiens
cuccagccucccugucuccagcu

SEQ ID NO: 1499134 - RNA, 20 nt, Homo sapiens
cuccagcuugggcaacagag

SEQ ID NO: 1499135 - RNA, 17 nt, Homo sapiens
cuccaggaaagagcagu

SEQ ID NO: 1499136 - RNA, 17 nt, Homo sapiens
cuccaggaugaguuacu

SEQ ID NO: 1499137 - RNA, 20 nt, Homo sapiens
cuccaggaugaguuacuuga

SEQ ID NO: 1499138 - RNA, 21 nt, Homo sapiens
cuccaggaugaguuacuugaa

SEQ ID NO: 1499139 - RNA, 19 nt, Homo sapiens
cuccaggauugaagagcau

SEQ ID NO: 1499140 - RNA, 13 nt, Homo sapiens
cuccagggcuuug

SEQ ID NO: 1499141 - RNA, 16 nt, Homo sapiens
cuccaguaacagccua

SEQ ID NO: 1499142 - RNA, 23 nt, Homo sapiens
cuccaguauaugcugauggacca

SEQ ID NO: 1499143 - RNA, 12 nt, Homo sapiens
cuccagugccag

SEQ ID NO: 1499144 - RNA, 18 nt, Homo sapiens
cuccaucauaugccugac

SEQ ID NO: 1499145 - RNA, 15 nt, Homo sapiens
cuccaucccaacagc

SEQ ID NO: 1499146 - RNA, 18 nt, Homo sapiens
cuccaucccaaccaggca

SEQ ID NO: 1499147 - RNA, 20 nt, Homo sapiens
cuccauccugaaagccaaga

SEQ ID NO: 1499148 - RNA, 22 nt, Homo sapiens
cuccaucuuauuuucauguaua

SEQ ID NO: 1499149 - RNA, 20 nt, Homo sapiens
cuccauuaaagucugaauca

SEQ ID NO: 1499150 - RNA, 22 nt, Homo sapiens
cuccauucauccuuccauccau

SEQ ID NO: 1499151 - RNA, 15 nt, Homo sapiens
cuccauuugagaaaa

SEQ ID NO: 1499152 - RNA, 19 nt, Homo sapiens
cucccaaaaaacuacuucu

SEQ ID NO: 1499153 - RNA, 20 nt, Homo sapiens
cucccaaagugcugggauua

SEQ ID NO: 1499154 - RNA, 16 nt, Homo sapiens
cucccaacacugucac

SEQ ID NO: 1499155 - RNA, 16 nt, Homo sapiens
cucccaacccauucac

SEQ ID NO: 1499156 - RNA, 23 nt, Homo sapiens
cucccaagucacacccacucccu

SEQ ID NO: 1499157 - RNA, 17 nt, Homo sapiens
cucccacaaugcugaau

SEQ ID NO: 1499158 - RNA, 21 nt, Homo sapiens
cucccacaugaggccaucuca

SEQ ID NO: 1499159 - RNA, 12 nt, Homo sapiens
cucccacuccag

SEQ ID NO: 1499160 - RNA, 16 nt, Homo sapiens
cucccaggccaggcuc

SEQ ID NO: 1499161 - RNA, 11 nt, Homo sapiens
cucccagugac

SEQ ID NO: 1499162 - RNA, 22 nt, Homo sapiens
cucccagugaccccugaccuca

SEQ ID NO: 1499163 - RNA, 16 nt, Homo sapiens
cuccccacacuaaccu

SEQ ID NO: 1499164 - RNA, 23 nt, Homo sapiens
ccacauuuagauccugguuucau

SEQ ID NO: 1499165 - RNA, 16 nt, Homo sapiens
ccaccaaagacaguug

SEQ ID NO: 1499166 - RNA, 17 nt, Homo sapiens
ccaccauccagguggag

SEQ ID NO: 1499167 - RNA, 14 nt, Homo sapiens
ccaccaucccugau

SEQ ID NO: 1499168 - RNA, 13 nt, Homo sapiens
ccaccccacacuu

SEQ ID NO: 1499169 - RNA, 14 nt, Homo sapiens
ccacccccagcuca

SEQ ID NO: 1499170 - RNA, 16 nt, Homo sapiens
ccacccccagcucaau

SEQ ID NO: 1499171 - RNA, 16 nt, Homo sapiens
ccaccccuguccagau

SEQ ID NO: 1499172 - RNA, 15 nt, Homo sapiens
ccacccgggggagcc

SEQ ID NO: 1499173 - RNA, 17 nt, Homo sapiens
ccacccuccaugcuccu

SEQ ID NO: 1499174 - RNA, 21 nt, Homo sapiens
ccacccuggugggccaacaaa

SEQ ID NO: 1499175 - RNA, 18 nt, Homo sapiens
ccaccgagccccugaccc

SEQ ID NO: 1499176 - RNA, 21 nt, Homo sapiens
ccaccgauggagcccccagau

SEQ ID NO: 1499177 - RNA, 24 nt, Homo sapiens
ccaccuagagguagguaggaucau

SEQ ID NO: 1499178 - RNA, 16 nt, Homo sapiens
cauauuaagcacuuua

SEQ ID NO: 1499179 - RNA, 19 nt, Homo sapiens
cauauuaguauuaauacua

SEQ ID NO: 1499180 - RNA, 12 nt, Homo sapiens
cauauuaucuca

SEQ ID NO: 1499181 - RNA, 23 nt, Homo sapiens
caucaacaagaguugucuugucc

SEQ ID NO: 1499182 - RNA, 12 nt, Homo sapiens
caucaaggucag

SEQ ID NO: 1499183 - RNA, 12 nt, Homo sapiens
caucacacuggg

SEQ ID NO: 1499184 - RNA, 11 nt, Homo sapiens
caucaccacug

SEQ ID NO: 1499185 - RNA, 14 nt, Homo sapiens
caucaccacuguau

SEQ ID NO: 1499186 - RNA, 17 nt, Homo sapiens
caucacuucccuacaug

SEQ ID NO: 1499187 - RNA, 18 nt, Homo sapiens
caucagggacaggaugac

SEQ ID NO: 1499188 - RNA, 21 nt, Homo sapiens
caucaguguccucuugcucaa

SEQ ID NO: 1499189 - RNA, 13 nt, Homo sapiens
caucaucuauggc

SEQ ID NO: 1499190 - RNA, 19 nt, Homo sapiens
caucauggaggucauacau

SEQ ID NO: 1499191 - RNA, 22 nt, Homo sapiens
caucauggaggucauacaugca

SEQ ID NO: 1499192 - RNA, 20 nt, Homo sapiens
caucauuacccuucccugca

SEQ ID NO: 1499193 - RNA, 18 nt, Homo sapiens
caucauuuugacagcauc

SEQ ID NO: 1499194 - RNA, 17 nt, Homo sapiens
caucauuuugcauucaa

SEQ ID NO: 1499195 - RNA, 22 nt, Homo sapiens
cauccaaacuaaaaggaaguca

SEQ ID NO: 1499196 - RNA, 12 nt, Homo sapiens
cauccaaagcag

SEQ ID NO: 1499197 - RNA, 12 nt, Homo sapiens
cauccaacacug

SEQ ID NO: 1499198 - RNA, 13 nt, Homo sapiens
cauccaacacugg

SEQ ID NO: 1499199 - RNA, 19 nt, Homo sapiens
cauccagcaguguugcuca

SEQ ID NO: 1499200 - RNA, 14 nt, Homo sapiens
cauccaggcugccc

SEQ ID NO: 1499201 - RNA, 12 nt, Homo sapiens
cauccaucagcu

SEQ ID NO: 1499202 - RNA, 24 nt, Homo sapiens
cauccauguuccgagaagaacaga

SEQ ID NO: 1499203 - RNA, 14 nt, Homo sapiens
cauccccacagcug

SEQ ID NO: 1499204 - RNA, 15 nt, Homo sapiens
cauccccacccaguc

SEQ ID NO: 1499205 - RNA, 20 nt, Homo sapiens
cauccccuuuggcuaccuga

SEQ ID NO: 1499206 - RNA, 14 nt, Homo sapiens
caucccuccauuca

SEQ ID NO: 1499207 - RNA, 18 nt, Homo sapiens
caucccuuuuucugcuaa

SEQ ID NO: 1499208 - RNA, 19 nt, Homo sapiens
caucccuuuuucugcuaau

SEQ ID NO: 1499209 - RNA, 14 nt, Homo sapiens
cauccgguuuaguc

SEQ ID NO: 1499210 - RNA, 23 nt, Homo sapiens
cauccuaagaaauaugugagauu

SEQ ID NO: 1499211 - RNA, 17 nt, Homo sapiens
cauccucacugcuguca

SEQ ID NO: 1499212 - RNA, 19 nt, Homo sapiens
cauccucacugcugucaac

SEQ ID NO: 1499213 - RNA, 23 nt, Homo sapiens
cauccuccccuagcuuagcuguc

SEQ ID NO: 1499214 - RNA, 24 nt, Homo sapiens
cauccuuaaaacaauucugugaca

SEQ ID NO: 1499215 - RNA, 17 nt, Homo sapiens
cauccuucaagaacucu

SEQ ID NO: 1499216 - RNA, 18 nt, Homo sapiens
cauccuuuacaccaacuc

SEQ ID NO: 1499217 - RNA, 21 nt, Homo sapiens
caucgauauguauaucauucu

SEQ ID NO: 1499218 - RNA, 15 nt, Homo sapiens
caucgcgaugucgca

SEQ ID NO: 1499219 - RNA, 17 nt, Homo sapiens
caucgggggugaaucuu

SEQ ID NO: 1499220 - RNA, 16 nt, Homo sapiens
caucuacaaucaggag

SEQ ID NO: 1499221 - RNA, 14 nt, Homo sapiens
caucuacaaucagu

SEQ ID NO: 1499222 - RNA, 21 nt, Homo sapiens
caucuagcaaccgccucaaaa

SEQ ID NO: 1499223 - RNA, 19 nt, Homo sapiens
caucuauaaagaagaacuu

SEQ ID NO: 1499224 - RNA, 15 nt, Homo sapiens
caucucaauaacaaa

SEQ ID NO: 1499225 - RNA, 12 nt, Homo sapiens
caucucagccua

SEQ ID NO: 1499226 - RNA, 14 nt, Homo sapiens
caucucagugcagg

SEQ ID NO: 1499227 - RNA, 12 nt, Homo sapiens
caucucaugccc

SEQ ID NO: 1499228 - RNA, 20 nt, Homo sapiens
caucuccacucuugugguca

SEQ ID NO: 1499229 - RNA, 15 nt, Homo sapiens
caucuccagcuauuu

SEQ ID NO: 1499230 - RNA, 9 nt, Homo sapiens
caucucuag

SEQ ID NO: 1499231 - RNA, 15 nt, Homo sapiens
caucugagaggcucu

SEQ ID NO: 1499232 - RNA, 11 nt, Homo sapiens
caucugcaaua

SEQ ID NO: 1499233 - RNA, 20 nt, Homo sapiens
caucugccagaccuuaauaa

SEQ ID NO: 1499234 - RNA, 19 nt, Homo sapiens
caucugccuuaaaaccaaa

SEQ ID NO: 1499235 - RNA, 15 nt, Homo sapiens
caucugcgugacaau

SEQ ID NO: 1499236 - RNA, 20 nt, Homo sapiens
caucuucuaggccaagcauu

SEQ ID NO: 1499237 - RNA, 11 nt, Homo sapiens
caucuuuacaa

SEQ ID NO: 1499238 - RNA, 18 nt, Homo sapiens
caucuuuuacauucugca

SEQ ID NO: 1499239 - RNA, 20 nt, Homo sapiens
caugaaaaauauugcugaac

SEQ ID NO: 1499240 - RNA, 15 nt, Homo sapiens
caugaaaaugacauu

SEQ ID NO: 1499241 - RNA, 14 nt, Homo sapiens
caugaaauaugcau

SEQ ID NO: 1499242 - RNA, 18 nt, Homo sapiens
caugaaauucuuccuaau

SEQ ID NO: 1499243 - RNA, 13 nt, Homo sapiens
caugaagaccaca

SEQ ID NO: 1499244 - RNA, 20 nt, Homo sapiens
caugaaggagcagcauugac

SEQ ID NO: 1499245 - RNA, 17 nt, Homo sapiens
caugaaggcagagccau

SEQ ID NO: 1499246 - RNA, 19 nt, Homo sapiens
caugaauauaaaugggaaa

SEQ ID NO: 1499247 - RNA, 13 nt, Homo sapiens
caugaauguauca

SEQ ID NO: 1499248 - RNA, 18 nt, Homo sapiens
caugacuuuauauggaug

SEQ ID NO: 1499249 - RNA, 19 nt, Homo sapiens
caugagauucauucaguua

SEQ ID NO: 1499250 - RNA, 17 nt, Homo sapiens
caugaggaaucugggag

SEQ ID NO: 1499251 - RNA, 15 nt, Homo sapiens
caugaggccaucuca

SEQ ID NO: 1499252 - RNA, 16 nt, Homo sapiens
caugaggccaucucag

SEQ ID NO: 1499253 - RNA, 15 nt, Homo sapiens
caugauaaggcucuu

SEQ ID NO: 1499254 - RNA, 23 nt, Homo sapiens
caugauggcaccacugcacucca

SEQ ID NO: 1499255 - RNA, 17 nt, Homo sapiens
caugaugucaacucacu

SEQ ID NO: 1499256 - RNA, 22 nt, Homo sapiens
caugauuucauuucaacuguuu

SEQ ID NO: 1499257 - RNA, 15 nt, Homo sapiens
caugcaaaauauguu

SEQ ID NO: 1499258 - RNA, 16 nt, Homo sapiens
caugcaaugccaaaua

SEQ ID NO: 1499259 - RNA, 15 nt, Homo sapiens
caugcagugcccuca

SEQ ID NO: 1499260 - RNA, 17 nt, Homo sapiens
caugcccgccagugcac

SEQ ID NO: 1499261 - RNA, 15 nt, Homo sapiens
caugcccugugcaac

SEQ ID NO: 1499262 - RNA, 16 nt, Homo sapiens
caugcccugugcaacc

SEQ ID NO: 1499263 - RNA, 14 nt, Homo sapiens
caugccucagugaa

SEQ ID NO: 1499264 - RNA, 15 nt, Homo sapiens
caugccucagugaag

SEQ ID NO: 1499265 - RNA, 22 nt, Homo sapiens
caugccugccccccucaucuca

SEQ ID NO: 1499266 - RNA, 18 nt, Homo sapiens
caugcgguagccagcaca

SEQ ID NO: 1499267 - RNA, 17 nt, Homo sapiens
caugcgucgcaaacucu

SEQ ID NO: 1499268 - RNA, 15 nt, Homo sapiens
caugcuacaguuauu

SEQ ID NO: 1499269 - RNA, 17 nt, Homo sapiens
cauuuagucuugccagg

SEQ ID NO: 1499270 - RNA, 21 nt, Homo sapiens
cauuuauaauuauuuauguga

SEQ ID NO: 1499271 - RNA, 15 nt, Homo sapiens
cauuuauauauugaa

SEQ ID NO: 1499272 - RNA, 17 nt, Homo sapiens
cauuuauccacaggaaa

SEQ ID NO: 1499273 - RNA, 13 nt, Homo sapiens
cauuucauuccau

SEQ ID NO: 1499274 - RNA, 18 nt, Homo sapiens
cauuucccccgagcucuu

SEQ ID NO: 1499275 - RNA, 14 nt, Homo sapiens
cauuucuacuguga

SEQ ID NO: 1499276 - RNA, 21 nt, Homo sapiens
cauuucuauuuauuuacugag

SEQ ID NO: 1499277 - RNA, 23 nt, Homo sapiens
cauuucucauaccuuccccacau

SEQ ID NO: 1499278 - RNA, 20 nt, Homo sapiens
cauuucucuacacuaagggg

SEQ ID NO: 1499279 - RNA, 12 nt, Homo sapiens
cauuucuuccca

SEQ ID NO: 1499280 - RNA, 21 nt, Homo sapiens
cauuuggaccaauagcccaca

SEQ ID NO: 1499281 - RNA, 22 nt, Homo sapiens
cauuuggagagggggccuggga

SEQ ID NO: 1499282 - RNA, 15 nt, Homo sapiens
caccauguuggccag

SEQ ID NO: 1499283 - RNA, 17 nt, Homo sapiens
cacccaaaucacaucuc

SEQ ID NO: 1499284 - RNA, 16 nt, Homo sapiens
cacccacccugugcca

SEQ ID NO: 1499285 - RNA, 17 nt, Homo sapiens
cacccaccuaugugcca

SEQ ID NO: 1499286 - RNA, 16 nt, Homo sapiens
cacccaccuccaccca

SEQ ID NO: 1499287 - RNA, 21 nt, Homo sapiens
caaggaugcugucaagcaccu

SEQ ID NO: 1499288 - RNA, 18 nt, Homo sapiens
caaggcccccacugccug

SEQ ID NO: 1499289 - RNA, 15 nt, Homo sapiens
caaggccuccaggga

SEQ ID NO: 1499290 - RNA, 14 nt, Homo sapiens
caaggcugcaguga

SEQ ID NO: 1499291 - RNA, 19 nt, Homo sapiens
caaggcugcagugagccau

SEQ ID NO: 1499292 - RNA, 20 nt, Homo sapiens
caaggcugcuuagaauccaa

SEQ ID NO: 1499293 - RNA, 14 nt, Homo sapiens
caagggaaucugua

SEQ ID NO: 1499294 - RNA, 15 nt, Homo sapiens
caagggacccaugag

SEQ ID NO: 1499295 - RNA, 18 nt, Homo sapiens
caagggcacgugaaguca

SEQ ID NO: 1499296 - RNA, 16 nt, Homo sapiens
caaggggugggccaca

SEQ ID NO: 1499297 - RNA, 18 nt, Homo sapiens
caaggggugggccuguga

SEQ ID NO: 1499298 - RNA, 13 nt, Homo sapiens
caagguccacucc

SEQ ID NO: 1499299 - RNA, 18 nt, Homo sapiens
caagguccucugucaguc

SEQ ID NO: 1499300 - RNA, 14 nt, Homo sapiens
caaggugaguguga

SEQ ID NO: 1499301 - RNA, 18 nt, Homo sapiens
caagguggugugaucuua

SEQ ID NO: 1499302 - RNA, 17 nt, Homo sapiens
caaguaagaagacauga

SEQ ID NO: 1499303 - RNA, 14 nt, Homo sapiens
caaguaauugugaa

SEQ ID NO: 1499304 - RNA, 22 nt, Homo sapiens
caaguauuauuuuacaaucaac

SEQ ID NO: 1499305 - RNA, 14 nt, Homo sapiens
caagucagcuccag

SEQ ID NO: 1499306 - RNA, 23 nt, Homo sapiens
caagucccauugaaaaugaaugc

SEQ ID NO: 1499307 - RNA, 13 nt, Homo sapiens
caagucccuguca

SEQ ID NO: 1499308 - RNA, 15 nt, Homo sapiens
caagucuuccaugac

SEQ ID NO: 1499309 - RNA, 16 nt, Homo sapiens
caagugaaaucaaagg

SEQ ID NO: 1499310 - RNA, 19 nt, Homo sapiens
caagugauucuccugccuc

SEQ ID NO: 1499311 - RNA, 14 nt, Homo sapiens
caagugcacugagc

SEQ ID NO: 1499312 - RNA, 19 nt, Homo sapiens
caagugcucaucuguugua

SEQ ID NO: 1499313 - RNA, 22 nt, Homo sapiens
caaguggaccuuaggccuuccu

SEQ ID NO: 1499314 - RNA, 14 nt, Homo sapiens
caagugugucuuac

SEQ ID NO: 1499315 - RNA, 21 nt, Homo sapiens
caaguuaagagaaacuuuaua

SEQ ID NO: 1499316 - RNA, 23 nt, Homo sapiens
caaguuauaaaucaaugucacuu

SEQ ID NO: 1499317 - RNA, 16 nt, Homo sapiens
caaguucacaccugca

SEQ ID NO: 1499318 - RNA, 23 nt, Homo sapiens
caaguucauugaugacccucuga

SEQ ID NO: 1499319 - RNA, 17 nt, Homo sapiens
caaguuccgucagucca

SEQ ID NO: 1499320 - RNA, 18 nt, Homo sapiens
caaguuccgucaguccaa

SEQ ID NO: 1499321 - RNA, 21 nt, Homo sapiens
caaguucuucaccucuaucca

SEQ ID NO: 1499322 - RNA, 20 nt, Homo sapiens
caaguuguaacuuauauuga

SEQ ID NO: 1499323 - RNA, 23 nt, Homo sapiens
caaguuucugauaccacugcacu

SEQ ID NO: 1499324 - RNA, 15 nt, Homo sapiens
caauaaaaaguucag

SEQ ID NO: 1499325 - RNA, 20 nt, Homo sapiens
caauaaaaaguucagaguuc

SEQ ID NO: 1499326 - RNA, 19 nt, Homo sapiens
caauaaaagugacucucag

SEQ ID NO: 1499327 - RNA, 13 nt, Homo sapiens
caauaaacacuug

SEQ ID NO: 1499328 - RNA, 14 nt, Homo sapiens
caauaaacaucuga

SEQ ID NO: 1499329 - RNA, 18 nt, Homo sapiens
caauaaagcacugagcaa

SEQ ID NO: 1499330 - RNA, 17 nt, Homo sapiens
caauaaauaaucuguac

SEQ ID NO: 1499331 - RNA, 19 nt, Homo sapiens
caauaaauaccagacacgu

SEQ ID NO: 1499332 - RNA, 15 nt, Homo sapiens
caauaaaugaagauu

SEQ ID NO: 1499333 - RNA, 14 nt, Homo sapiens
caauaacacuaaaa

SEQ ID NO: 1499334 - RNA, 14 nt, Homo sapiens
caauaacuucugac

SEQ ID NO: 1499335 - RNA, 15 nt, Homo sapiens
caauaagcaaaaaca

SEQ ID NO: 1499336 - RNA, 21 nt, Homo sapiens
caauaauaaauauuuuugcca

SEQ ID NO: 1499337 - RNA, 14 nt, Homo sapiens
caauaauccuuccu

SEQ ID NO: 1499338 - RNA, 14 nt, Homo sapiens
caauagagacugua

SEQ ID NO: 1499339 - RNA, 17 nt, Homo sapiens
caauagcuaagcaucuc

SEQ ID NO: 1499340 - RNA, 18 nt, Homo sapiens
caauauacauaauacaug

SEQ ID NO: 1499341 - RNA, 23 nt, Homo sapiens
caauaucuaauauauaugaauaa

SEQ ID NO: 1499342 - RNA, 21 nt, Homo sapiens
caauauuaaauacagacacua

SEQ ID NO: 1499343 - RNA, 16 nt, Homo sapiens
caauauuagcaagaca

SEQ ID NO: 1499344 - RNA, 19 nt, Homo sapiens
caauauugccaugguuuua

SEQ ID NO: 1499345 - RNA, 18 nt, Homo sapiens
caaucaagccauguauaa

SEQ ID NO: 1499346 - RNA, 17 nt, Homo sapiens
caaucaaggccacugcu

SEQ ID NO: 1499347 - RNA, 21 nt, Homo sapiens
caaucaggguuuuuagauuaa

SEQ ID NO: 1499348 - RNA, 15 nt, Homo sapiens
caaucaguugacuuu

SEQ ID NO: 1499349 - RNA, 16 nt, Homo sapiens
caauccaacccgggga

SEQ ID NO: 1499350 - RNA, 15 nt, Homo sapiens
caauccaucucucaa

SEQ ID NO: 1499351 - RNA, 20 nt, Homo sapiens
caaucccaacguuuuacaua

SEQ ID NO: 1499352 - RNA, 20 nt, Homo sapiens
caaucccuggggcugugcau

SEQ ID NO: 1499353 - RNA, 12 nt, Homo sapiens
caauccugugga

SEQ ID NO: 1499354 - RNA, 19 nt, Homo sapiens
caauccuugccacagugug

SEQ ID NO: 1499355 - RNA, 21 nt, Homo sapiens
caaucugagccagugcuuuaa

SEQ ID NO: 1499356 - RNA, 14 nt, Homo sapiens
caaucugcacacuc

SEQ ID NO: 1499357 - RNA, 14 nt, Homo sapiens
caaucuucuacuuu

SEQ ID NO: 1499358 - RNA, 13 nt, Homo sapiens
caaugacaucuca

SEQ ID NO: 1499359 - RNA, 14 nt, Homo sapiens
caaugacaucucag

SEQ ID NO: 1499360 - RNA, 19 nt, Homo sapiens
caaugacuucccugcucca

SEQ ID NO: 1499361 - RNA, 14 nt, Homo sapiens
caaugcauugcuaa

SEQ ID NO: 1499362 - RNA, 12 nt, Homo sapiens
caaugcugaggu

SEQ ID NO: 1499363 - RNA, 19 nt, Homo sapiens
caaugcuuaaacuaaauaa

SEQ ID NO: 1499364 - RNA, 22 nt, Homo sapiens
caauggcacuguugcaaacuca

SEQ ID NO: 1499365 - RNA, 16 nt, Homo sapiens
caaugggcacugggau

SEQ ID NO: 1499366 - RNA, 23 nt, Homo sapiens
caauggugucaguauccaggcuu

SEQ ID NO: 1499367 - RNA, 13 nt, Homo sapiens
caaugucacuuaa

SEQ ID NO: 1499368 - RNA, 18 nt, Homo sapiens
caauguguggcucagugc

SEQ ID NO: 1499369 - RNA, 21 nt, Homo sapiens
caauguguggcucagugccug

SEQ ID NO: 1499370 - RNA, 15 nt, Homo sapiens
caauguuuaugcaag

SEQ ID NO: 1499371 - RNA, 21 nt, Homo sapiens
caauguuuaugcaaggaagga

SEQ ID NO: 1499372 - RNA, 22 nt, Homo sapiens
caauguuuguaauaauugcuca

SEQ ID NO: 1499373 - RNA, 20 nt, Homo sapiens
caauuaaaacuaagcacaaa

SEQ ID NO: 1499374 - RNA, 17 nt, Homo sapiens
caauuaaagguccugcc

SEQ ID NO: 1499375 - RNA, 23 nt, Homo sapiens
caauuaggauuuugaugugacaa

SEQ ID NO: 1499376 - RNA, 18 nt, Homo sapiens
caauuauauuuauauuuc

SEQ ID NO: 1499377 - RNA, 15 nt, Homo sapiens
caauuaucuguguca

SEQ ID NO: 1499378 - RNA, 15 nt, Homo sapiens
caauuauuggcaaag

SEQ ID NO: 1499379 - RNA, 17 nt, Homo sapiens
caauucaccaacacagu

SEQ ID NO: 1499380 - RNA, 16 nt, Homo sapiens
caauucagacaggcaa

SEQ ID NO: 1499381 - RNA, 15 nt, Homo sapiens
caauuccucugggaa

SEQ ID NO: 1499382 - RNA, 23 nt, Homo sapiens
caauuccuucuucaacgccaucu

SEQ ID NO: 1499383 - RNA, 12 nt, Homo sapiens
caauucugugac

SEQ ID NO: 1499384 - RNA, 20 nt, Homo sapiens
caauucugugacauacauau

SEQ ID NO: 1499385 - RNA, 16 nt, Homo sapiens
caauuggcacuaaaga

SEQ ID NO: 1499386 - RNA, 15 nt, Homo sapiens
caauuguaacgacuu

SEQ ID NO: 1499387 - RNA, 20 nt, Homo sapiens
caauugucuauuuaucuuuu

SEQ ID NO: 1499388 - RNA, 21 nt, Homo sapiens
caauugucugccucagccucc

SEQ ID NO: 1499389 - RNA, 19 nt, Homo sapiens
auuguugacaacugugacu

SEQ ID NO: 1499390 - RNA, 18 nt, Homo sapiens
auguuugcacuugugcuu

SEQ ID NO: 1499391 - RNA, 23 nt, Homo sapiens
auguuuguaauaauugcucauaa

SEQ ID NO: 1499392 - RNA, 19 nt, Homo sapiens
auguuuuaaacacaugccu

SEQ ID NO: 1499393 - RNA, 21 nt, Homo sapiens
auguuuuuuaaacuaguuuau

SEQ ID NO: 1499394 - RNA, 13 nt, Homo sapiens
auuaaacaccuga

SEQ ID NO: 1499395 - RNA, 19 nt, Homo sapiens
auuaaacaccugacacauc

SEQ ID NO: 1499396 - RNA, 17 nt, Homo sapiens
auuaaauacagacacua

SEQ ID NO: 1499397 - RNA, 21 nt, Homo sapiens
auuaaauaccuauaugaauau

SEQ ID NO: 1499398 - RNA, 13 nt, Homo sapiens
auuaaauuaggaa

SEQ ID NO: 1499399 - RNA, 17 nt, Homo sapiens
auuaaauucacaaacuu

SEQ ID NO: 1499400 - RNA, 13 nt, Homo sapiens
auuaacaaaugug

SEQ ID NO: 1499401 - RNA, 17 nt, Homo sapiens
auuaacaaaugugcugc

SEQ ID NO: 1499402 - RNA, 20 nt, Homo sapiens
auuaacaacaauaacacugu

SEQ ID NO: 1499403 - RNA, 16 nt, Homo sapiens
auuaaccaccaaucca

SEQ ID NO: 1499404 - RNA, 13 nt, Homo sapiens
auuaaccuaauca

SEQ ID NO: 1499405 - RNA, 14 nt, Homo sapiens
auuaaccuggugcu

SEQ ID NO: 1499406 - RNA, 17 nt, Homo sapiens
auuaacuaauaugggca

SEQ ID NO: 1499407 - RNA, 15 nt, Homo sapiens
auuaacuacauuuau

SEQ ID NO: 1499408 - RNA, 12 nt, Homo sapiens
auuaacuugagu

SEQ ID NO: 1499409 - RNA, 23 nt, Homo sapiens
auuaacuuuaauguuuuuugcca

SEQ ID NO: 1499410 - RNA, 18 nt, Homo sapiens
auuaacuuuaauucucuu

SEQ ID NO: 1499411 - RNA, 17 nt, Homo sapiens
auuaagucaugugugaa

SEQ ID NO: 1499412 - RNA, 22 nt, Homo sapiens
auuaaucacaaauuucacuuau

SEQ ID NO: 1499413 - RNA, 14 nt, Homo sapiens
auuaaucaccucuc

SEQ ID NO: 1499414 - RNA, 18 nt, Homo sapiens
auuaaucuggaauaugca

SEQ ID NO: 1499415 - RNA, 19 nt, Homo sapiens
auuaaucuggaauaugcaa

SEQ ID NO: 1499416 - RNA, 13 nt, Homo sapiens
auuaauguuaauu

SEQ ID NO: 1499417 - RNA, 16 nt, Homo sapiens
auuaauuaauauucau

SEQ ID NO: 1499418 - RNA, 14 nt, Homo sapiens
auuaauuucagucu

SEQ ID NO: 1499419 - RNA, 22 nt, Homo sapiens
auuaauuuuccaaugcacaguu

SEQ ID NO: 1499420 - RNA, 18 nt, Homo sapiens
auuaauuuuuaaggaugu

SEQ ID NO: 1499421 - RNA, 22 nt, Homo sapiens
auuaauuuuuaaggauguugcc

SEQ ID NO: 1499422 - RNA, 21 nt, Homo sapiens
auuacaaggcuuuaucucagg

SEQ ID NO: 1499423 - RNA, 22 nt, Homo sapiens
auuacaaggcuuuaucucaggg

SEQ ID NO: 1499424 - RNA, 22 nt, Homo sapiens
auuacauguguuuauucaucca

SEQ ID NO: 1499425 - RNA, 12 nt, Homo sapiens
auuaccaagaga

SEQ ID NO: 1499426 - RNA, 15 nt, Homo sapiens
auuaccagacaaaaa

SEQ ID NO: 1499427 - RNA, 21 nt, Homo sapiens
auuacccccucauuguuuauu

SEQ ID NO: 1499428 - RNA, 14 nt, Homo sapiens
auuaccuccaucca

SEQ ID NO: 1499429 - RNA, 17 nt, Homo sapiens
auuaccucugauaccuc

SEQ ID NO: 1499430 - RNA, 13 nt, Homo sapiens
auuacuaucauaa

SEQ ID NO: 1499431 - RNA, 16 nt, Homo sapiens
auuacuaucauaauuc

SEQ ID NO: 1499432 - RNA, 20 nt, Homo sapiens
auuacuggaaggcuuccacu

SEQ ID NO: 1499433 - RNA, 14 nt, Homo sapiens
auuagaaacuacca

SEQ ID NO: 1499434 - RNA, 17 nt, Homo sapiens
auuagaaggcaaguuuc

SEQ ID NO: 1499435 - RNA, 18 nt, Homo sapiens
auuagaggucuccaaaau

SEQ ID NO: 1499436 - RNA, 20 nt, Homo sapiens
auuagcauucugguuuugac

SEQ ID NO: 1499437 - RNA, 13 nt, Homo sapiens
auuagccaggugu

SEQ ID NO: 1499438 - RNA, 10 nt, Homo sapiens
auuagcugug

SEQ ID NO: 1499439 - RNA, 13 nt, Homo sapiens
auuagcuuugugu

SEQ ID NO: 1499440 - RNA, 21 nt, Homo sapiens
auuaguauuaauacuacccau

SEQ ID NO: 1499441 - RNA, 17 nt, Homo sapiens
auuauaaacuguaugcu

SEQ ID NO: 1499442 - RNA, 23 nt, Homo sapiens
auuauaagggagagcugagccag

SEQ ID NO: 1499443 - RNA, 12 nt, Homo sapiens
auuauacagaua

SEQ ID NO: 1499444 - RNA, 20 nt, Homo sapiens
auuauacaggaaagcaauau

SEQ ID NO: 1499445 - RNA, 13 nt, Homo sapiens
auuauacaucaau

SEQ ID NO: 1499446 - RNA, 21 nt, Homo sapiens
auuauagaauucuguacuuga

SEQ ID NO: 1499447 - RNA, 19 nt, Homo sapiens
auuauagauuuucauguuc

SEQ ID NO: 1499448 - RNA, 17 nt, Homo sapiens
auuaucgggaacagugu

SEQ ID NO: 1499449 - RNA, 18 nt, Homo sapiens
auuaucgggaacaguguu

SEQ ID NO: 1499450 - RNA, 16 nt, Homo sapiens
auuaugagaggcaaug

SEQ ID NO: 1499451 - RNA, 21 nt, Homo sapiens
auuauggaaaacuguguugcc

SEQ ID NO: 1499452 - RNA, 16 nt, Homo sapiens
auuauguauaaacaua

SEQ ID NO: 1499453 - RNA, 18 nt, Homo sapiens
auuauguggcccucugga

SEQ ID NO: 1499454 - RNA, 15 nt, Homo sapiens
auuauuauucaaaaa

SEQ ID NO: 1499455 - RNA, 14 nt, Homo sapiens
auuauuguaccauu

SEQ ID NO: 1499456 - RNA, 16 nt, Homo sapiens
auuauuugcucagggg

SEQ ID NO: 1499457 - RNA, 23 nt, Homo sapiens
auuauuugggagggaaaagggaa

SEQ ID NO: 1499458 - RNA, 18 nt, Homo sapiens
auuauuuuuccacuuugu

SEQ ID NO: 1499459 - RNA, 14 nt, Homo sapiens
auucaaaagaucaa

SEQ ID NO: 1499460 - RNA, 18 nt, Homo sapiens
auucaaaguguuguguuc

SEQ ID NO: 1499461 - RNA, 21 nt, Homo sapiens
auucaacucuccaauguucua

SEQ ID NO: 1499462 - RNA, 19 nt, Homo sapiens
auucaagaggaaaugucac

SEQ ID NO: 1499463 - RNA, 15 nt, Homo sapiens
auucaauauugacau

SEQ ID NO: 1499464 - RNA, 17 nt, Homo sapiens
auucacaaaauuuccac

SEQ ID NO: 1499465 - RNA, 20 nt, Homo sapiens
auucacagaauagcacaaac

SEQ ID NO: 1499466 - RNA, 20 nt, Homo sapiens
auucacauauaucaaaguga

SEQ ID NO: 1499467 - RNA, 14 nt, Homo sapiens
auucaccaacacag

SEQ ID NO: 1499468 - RNA, 19 nt, Homo sapiens
auucacccuucaacauaaa

SEQ ID NO: 1499469 - RNA, 23 nt, Homo sapiens
auucacgcuguuuguuucauaua

SEQ ID NO: 1499470 - RNA, 23 nt, Homo sapiens
auucagaauuucuaaaaguuuaa

SEQ ID NO: 1499471 - RNA, 18 nt, Homo sapiens
auucagagcuauggugcu

SEQ ID NO: 1499472 - RNA, 13 nt, Homo sapiens
auucagcacuuaa

SEQ ID NO: 1499473 - RNA, 18 nt, Homo sapiens
auucaggcuacucauuca

SEQ ID NO: 1499474 - RNA, 22 nt, Homo sapiens
auucaggggcugggggugcugg

SEQ ID NO: 1499475 - RNA, 18 nt, Homo sapiens
auucaguucccaccaucu

SEQ ID NO: 1499476 - RNA, 20 nt, Homo sapiens
auucauacccacacacccag

SEQ ID NO: 1499477 - RNA, 14 nt, Homo sapiens
auucauccuuccau

SEQ ID NO: 1499478 - RNA, 22 nt, Homo sapiens
auucauccuuccauccaucuuu

SEQ ID NO: 1499479 - RNA, 19 nt, Homo sapiens
auucauucugcauugcuag

SEQ ID NO: 1499480 - RNA, 20 nt, Homo sapiens
auucauuuucaucacuggga

SEQ ID NO: 1499481 - RNA, 18 nt, Homo sapiens
auuccacacuaccacauu

SEQ ID NO: 1499482 - RNA, 17 nt, Homo sapiens
auuccaccugcaaucaa

SEQ ID NO: 1499483 - RNA, 15 nt, Homo sapiens
auuccacuccacuca

SEQ ID NO: 1499484 - RNA, 22 nt, Homo sapiens
auuccagagugcugaggccagg

SEQ ID NO: 1499485 - RNA, 14 nt, Homo sapiens
auuccagucuacuu

SEQ ID NO: 1499486 - RNA, 16 nt, Homo sapiens
auuccagucuacuuga

SEQ ID NO: 1499487 - RNA, 21 nt, Homo sapiens
auuccagugguucugcuucaa

SEQ ID NO: 1499488 - RNA, 14 nt, Homo sapiens
auucccaagcuuuu

SEQ ID NO: 1499489 - RNA, 23 nt, Homo sapiens
auucccaucuuuacucccaagac

SEQ ID NO: 1499490 - RNA, 19 nt, Homo sapiens
auucccucuccugcccaga

SEQ ID NO: 1499491 - RNA, 16 nt, Homo sapiens
aggugggaaaugguau

SEQ ID NO: 1499492 - RNA, 14 nt, Homo sapiens
aggugggcaugcca

SEQ ID NO: 1499493 - RNA, 16 nt, Homo sapiens
aggugggcaugccacc

SEQ ID NO: 1499494 - RNA, 21 nt, Homo sapiens
aggugggccuugcuaccucaa

SEQ ID NO: 1499495 - RNA, 22 nt, Homo sapiens
aggugguaugugacaccaaagc

SEQ ID NO: 1499496 - RNA, 23 nt, Homo sapiens
aggugucugagaugggcccguac

SEQ ID NO: 1499497 - RNA, 21 nt, Homo sapiens
aggugugcccuguacacaggc

SEQ ID NO: 1499498 - RNA, 16 nt, Homo sapiens
agguguugccaaauau

SEQ ID NO: 1499499 - RNA, 22 nt, Homo sapiens
agguucauugcgugauucaaug

SEQ ID NO: 1499500 - RNA, 20 nt, Homo sapiens
agguuccuugguguucaaaa

SEQ ID NO: 1499501 - RNA, 14 nt, Homo sapiens
agguucuucagggc

SEQ ID NO: 1499502 - RNA, 17 nt, Homo sapiens
agguucuucagggccag

SEQ ID NO: 1499503 - RNA, 14 nt, Homo sapiens
agguugaagccaag

SEQ ID NO: 1499504 - RNA, 13 nt, Homo sapiens
agguugcagugag

SEQ ID NO: 1499505 - RNA, 16 nt, Homo sapiens
agguuggcaccccagc

SEQ ID NO: 1499506 - RNA, 12 nt, Homo sapiens
agguuggcagua

SEQ ID NO: 1499507 - RNA, 17 nt, Homo sapiens
agguuggugaauuucac

SEQ ID NO: 1499508 - RNA, 19 nt, Homo sapiens
agguuggugaauuucacaa

SEQ ID NO: 1499509 - RNA, 21 nt, Homo sapiens
agguugucuccaggccaugau

SEQ ID NO: 1499510 - RNA, 14 nt, Homo sapiens
aguaaaagaugaag

SEQ ID NO: 1499511 - RNA, 13 nt, Homo sapiens
aguaaagccucaa

SEQ ID NO: 1499512 - RNA, 17 nt, Homo sapiens
aguaaaggcugcugcua

SEQ ID NO: 1499513 - RNA, 17 nt, Homo sapiens
aguaaagucaacauaug

SEQ ID NO: 1499514 - RNA, 18 nt, Homo sapiens
aguaaauauugaggcuuu

SEQ ID NO: 1499515 - RNA, 22 nt, Homo sapiens
aguaacaugaggggacauuuug

SEQ ID NO: 1499516 - RNA, 21 nt, Homo sapiens
aguaacauuugcuguuuuaaa

SEQ ID NO: 1499517 - RNA, 15 nt, Homo sapiens
aguaagaagacauga

SEQ ID NO: 1499518 - RNA, 18 nt, Homo sapiens
aguaagagcuggugucug

SEQ ID NO: 1499519 - RNA, 15 nt, Homo sapiens
aguaagaugcacuga

SEQ ID NO: 1499520 - RNA, 20 nt, Homo sapiens
aguaagcccggauagacuua

SEQ ID NO: 1499521 - RNA, 17 nt, Homo sapiens
aguaaguuaauaaugua

SEQ ID NO: 1499522 - RNA, 19 nt, Homo sapiens
aguaaucuaauauggccac

SEQ ID NO: 1499523 - RNA, 21 nt, Homo sapiens
aguaaugaauuuuuaugauau

SEQ ID NO: 1499524 - RNA, 16 nt, Homo sapiens
aguaauguuaauucuu

SEQ ID NO: 1499525 - RNA, 20 nt, Homo sapiens
aguacagcaugugccuuaau

SEQ ID NO: 1499526 - RNA, 12 nt, Homo sapiens
aguacagucuua

SEQ ID NO: 1499527 - RNA, 14 nt, Homo sapiens
aguacuccaagaca

SEQ ID NO: 1499528 - RNA, 21 nt, Homo sapiens
aguacuuccugcaguacaaga

SEQ ID NO: 1499529 - RNA, 17 nt, Homo sapiens
aguacuuggguuugcaa

SEQ ID NO: 1499530 - RNA, 22 nt, Homo sapiens
aguacuuggguuugcaacagcu

SEQ ID NO: 1499531 - RNA, 19 nt, Homo sapiens
aguagcaaguucuagagaa

SEQ ID NO: 1499532 - RNA, 23 nt, Homo sapiens
aguagcguuuuuuaaauguauac

SEQ ID NO: 1499533 - RNA, 21 nt, Homo sapiens
aguaucaggucucccacgugg

SEQ ID NO: 1499534 - RNA, 21 nt, Homo sapiens
aguaucaugcccugugcaacc

SEQ ID NO: 1499535 - RNA, 16 nt, Homo sapiens
aguauccaggcuuugu

SEQ ID NO: 1499536 - RNA, 14 nt, Homo sapiens
aguaugagggaaaa

SEQ ID NO: 1499537 - RNA, 17 nt, Homo sapiens
aguaugguaaucuuuac

SEQ ID NO: 1499538 - RNA, 19 nt, Homo sapiens
aguauguuuguacaguaug

SEQ ID NO: 1499539 - RNA, 17 nt, Homo sapiens
aguauucauucugcauu

SEQ ID NO: 1499540 - RNA, 22 nt, Homo sapiens
aguauucauucugcauugcuag

SEQ ID NO: 1499541 - RNA, 23 nt, Homo sapiens
aguauuccuuuauacacagugga

SEQ ID NO: 1499542 - RNA, 14 nt, Homo sapiens
aguauucucagagc

SEQ ID NO: 1499543 - RNA, 15 nt, Homo sapiens
aguauuucuguggau

SEQ ID NO: 1499544 - RNA, 18 nt, Homo sapiens
aguauuuuaauccuguac

SEQ ID NO: 1499545 - RNA, 15 nt, Homo sapiens
aguauuuuuucaagu

SEQ ID NO: 1499546 - RNA, 15 nt, Homo sapiens
agucaaaacagagau

SEQ ID NO: 1499547 - RNA, 17 nt, Homo sapiens
agucaagaaucacuugc

SEQ ID NO: 1499548 - RNA, 13 nt, Homo sapiens
agucaauuucuac

SEQ ID NO: 1499549 - RNA, 18 nt, Homo sapiens
agucacaaagaguucugg

SEQ ID NO: 1499550 - RNA, 13 nt, Homo sapiens
agucacacugugg

SEQ ID NO: 1499551 - RNA, 13 nt, Homo sapiens
agucacagccacc

SEQ ID NO: 1499552 - RNA, 21 nt, Homo sapiens
agucacaugcguaaacgacac

SEQ ID NO: 1499553 - RNA, 16 nt, Homo sapiens
agucaccgaagguccu

SEQ ID NO: 1499554 - RNA, 18 nt, Homo sapiens
agucaccuauguggucca

SEQ ID NO: 1499555 - RNA, 17 nt, Homo sapiens
agucacugccaagucau

SEQ ID NO: 1499556 - RNA, 23 nt, Homo sapiens
agucagccaguggcuagcgcaag

SEQ ID NO: 1499557 - RNA, 14 nt, Homo sapiens
agucaguauggucu

SEQ ID NO: 1499558 - RNA, 12 nt, Homo sapiens
agucagugucug

SEQ ID NO: 1499559 - RNA, 14 nt, Homo sapiens
agucauauaccuau

SEQ ID NO: 1499560 - RNA, 13 nt, Homo sapiens
agucauauugccc

SEQ ID NO: 1499561 - RNA, 18 nt, Homo sapiens
agucaucuccaucagcug

SEQ ID NO: 1499562 - RNA, 20 nt, Homo sapiens
agucaugaagcccaagugaa

SEQ ID NO: 1499563 - RNA, 19 nt, Homo sapiens
agucauuaugagaggcaau

SEQ ID NO: 1499564 - RNA, 18 nt, Homo sapiens
agucauugaggcccugcu

SEQ ID NO: 1499565 - RNA, 14 nt, Homo sapiens
aguccaacugucaa

SEQ ID NO: 1499566 - RNA, 15 nt, Homo sapiens
aguccacaggcaugg

SEQ ID NO: 1499567 - RNA, 22 nt, Homo sapiens
aguccacuuguucuguacuugu

SEQ ID NO: 1499568 - RNA, 12 nt, Homo sapiens
aguccagcacug

SEQ ID NO: 1499569 - RNA, 18 nt, Homo sapiens
aguccaucuaacaucaua

SEQ ID NO: 1499570 - RNA, 13 nt, Homo sapiens
aguccaugcuucu

SEQ ID NO: 1499571 - RNA, 17 nt, Homo sapiens
aguccgcagaagcccug

SEQ ID NO: 1499572 - RNA, 18 nt, Homo sapiens
aguccucauuuacuggau

SEQ ID NO: 1499573 - RNA, 17 nt, Homo sapiens
aguccugacacuauuca

SEQ ID NO: 1499574 - RNA, 14 nt, Homo sapiens
aguccuguacugua

SEQ ID NO: 1499575 - RNA, 13 nt, Homo sapiens
aguccuuuaguca

SEQ ID NO: 1499576 - RNA, 15 nt, Homo sapiens
agucggaacagcaga

SEQ ID NO: 1499577 - RNA, 22 nt, Homo sapiens
agucgggaugucagcagacaca

SEQ ID NO: 1499578 - RNA, 20 nt, Homo sapiens
agucuauaccauagcaaugu

SEQ ID NO: 1499579 - RNA, 13 nt, Homo sapiens
agucucaccuuca

SEQ ID NO: 1499580 - RNA, 13 nt, Homo sapiens
agucucauucugu

SEQ ID NO: 1499581 - RNA, 14 nt, Homo sapiens
agucuccaugaaga

SEQ ID NO: 1499582 - RNA, 17 nt, Homo sapiens
agucucugccacccacu

SEQ ID NO: 1499583 - RNA, 14 nt, Homo sapiens
agucugaaacuggc

SEQ ID NO: 1499584 - RNA, 17 nt, Homo sapiens
agucugaggcaggagaa

SEQ ID NO: 1499585 - RNA, 15 nt, Homo sapiens
agucugauaaacuga

SEQ ID NO: 1499586 - RNA, 19 nt, Homo sapiens
agucugcaugugcacggug

SEQ ID NO: 1499587 - RNA, 21 nt, Homo sapiens
agucugcuacccucauuucuc

SEQ ID NO: 1499588 - RNA, 22 nt, Homo sapiens
agucuuuuguucgcauggucac

SEQ ID NO: 1499589 - RNA, 23 nt, Homo sapiens
agugaacauauggaaaguauuag

SEQ ID NO: 1499590 - RNA, 14 nt, Homo sapiens
agugaacuaugaag

SEQ ID NO: 1499591 - RNA, 14 nt, Homo sapiens
agugaagacuggaa

SEQ ID NO: 1499592 - RNA, 16 nt, Homo sapiens
agugaaugaacaaaug

SEQ ID NO: 1499593 - RNA, 13 nt, Homo sapiens
agugaauggucuc

SEQ ID NO: 1499594 - RNA, 15 nt, Homo sapiens
agugaaugugucugg

SEQ ID NO: 1499595 - RNA, 14 nt, Homo sapiens
agugacaaggcccu

SEQ ID NO: 1499596 - RNA, 12 nt, Homo sapiens
agugacagucag

SEQ ID NO: 1499597 - RNA, 19 nt, Homo sapiens
agugacauaauauauucua

SEQ ID NO: 1499598 - RNA, 13 nt, Homo sapiens
agugaccaaaggu

SEQ ID NO: 1499599 - RNA, 21 nt, Homo sapiens
agugaccaaaggugugcccug

SEQ ID NO: 1499600 - RNA, 22 nt, Homo sapiens
agugaccccugaccucacugug

SEQ ID NO: 1499601 - RNA, 17 nt, Homo sapiens
agugaccuaaccacuua

SEQ ID NO: 1499602 - RNA, 20 nt, Homo sapiens
agugacucuugaaguacuua

SEQ ID NO: 1499603 - RNA, 13 nt, Homo sapiens
agugacuggugcc

SEQ ID NO: 1499604 - RNA, 17 nt, Homo sapiens
agugacuguuuggcuua

SEQ ID NO: 1499605 - RNA, 14 nt, Homo sapiens
agugagagcuuccu

SEQ ID NO: 1499606 - RNA, 18 nt, Homo sapiens
agugagcagugagcagaa

SEQ ID NO: 1499607 - RNA, 21 nt, Homo sapiens
agugaggcugcacccacccag

SEQ ID NO: 1499608 - RNA, 23 nt, Homo sapiens
agugaggucacaguccacccacc

SEQ ID NO: 1499609 - RNA, 19 nt, Homo sapiens
agugaucaaacuacauauu

SEQ ID NO: 1499610 - RNA, 15 nt, Homo sapiens
agugauguguggucu

SEQ ID NO: 1499611 - RNA, 21 nt, Homo sapiens
agugauugacacacagcacuc

SEQ ID NO: 1499612 - RNA, 17 nt, Homo sapiens
agugauugauagagugu

SEQ ID NO: 1499613 - RNA, 14 nt, Homo sapiens
agugauugcagcuu

SEQ ID NO: 1499614 - RNA, 21 nt, Homo sapiens
agugcaacccagucacacugu

SEQ ID NO: 1499615 - RNA, 20 nt, Homo sapiens
agugcaaccucgcugagggc

SEQ ID NO: 1499616 - RNA, 19 nt, Homo sapiens
agugcaauggcacaaucuu

SEQ ID NO: 1499617 - RNA, 16 nt, Homo sapiens
agugcacagcugucca

SEQ ID NO: 1499618 - RNA, 20 nt, Homo sapiens
agugcaguggcaugauguca

SEQ ID NO: 1499619 - RNA, 14 nt, Homo sapiens
agugccaacuccuc

SEQ ID NO: 1499620 - RNA, 14 nt, Homo sapiens
agugccagcaauga

SEQ ID NO: 1499621 - RNA, 16 nt, Homo sapiens
agugccagcaaugaca

SEQ ID NO: 1499622 - RNA, 21 nt, Homo sapiens
agugccagcaaugacaucuca

SEQ ID NO: 1499623 - RNA, 12 nt, Homo sapiens
agugccaggacu

SEQ ID NO: 1499624 - RNA, 17 nt, Homo sapiens
agugccggcugccaaga

SEQ ID NO: 1499625 - RNA, 16 nt, Homo sapiens
agugccguaacaacug

SEQ ID NO: 1499626 - RNA, 21 nt, Homo sapiens
agugccguaacaacugugguc

SEQ ID NO: 1499627 - RNA, 13 nt, Homo sapiens
agugccucuuguc

SEQ ID NO: 1499628 - RNA, 18 nt, Homo sapiens
agugcggacaaguuuuaa

SEQ ID NO: 1499629 - RNA, 15 nt, Homo sapiens
agugcugaacagugg

SEQ ID NO: 1499630 - RNA, 15 nt, Homo sapiens
agugcugaccagaca

SEQ ID NO: 1499631 - RNA, 11 nt, Homo sapiens
agugcugcuau

SEQ ID NO: 1499632 - RNA, 20 nt, Homo sapiens
agugcugcuauaucuaucca

SEQ ID NO: 1499633 - RNA, 23 nt, Homo sapiens
agugcugcuauaucuauccauuu

SEQ ID NO: 1499634 - RNA, 17 nt, Homo sapiens
agugcugggaccagagc

SEQ ID NO: 1499635 - RNA, 17 nt, Homo sapiens
agugcugggauuacaau

SEQ ID NO: 1499636 - RNA, 16 nt, Homo sapiens
aguggaggcacuuuag

SEQ ID NO: 1499637 - RNA, 14 nt, Homo sapiens
aguggcaaaacacu

SEQ ID NO: 1499638 - RNA, 17 nt, Homo sapiens
aguggcaccagaggugc

SEQ ID NO: 1499639 - RNA, 15 nt, Homo sapiens
aguggccagccagug

SEQ ID NO: 1499640 - RNA, 16 nt, Homo sapiens
aguggccagccagugc

SEQ ID NO: 1499641 - RNA, 20 nt, Homo sapiens
aguggccaugccacccuguu

SEQ ID NO: 1499642 - RNA, 19 nt, Homo sapiens
aguggcgugggagccagcc

SEQ ID NO: 1499643 - RNA, 22 nt, Homo sapiens
aguggcguuguugcauguuuga

SEQ ID NO: 1499644 - RNA, 14 nt, Homo sapiens
aguggcucuguaag

SEQ ID NO: 1499645 - RNA, 14 nt, Homo sapiens
aguggcugccaugg

SEQ ID NO: 1499646 - RNA, 14 nt, Homo sapiens
aguggcugcuucuc

SEQ ID NO: 1499647 - RNA, 15 nt, Homo sapiens
aguggcugugccacc

SEQ ID NO: 1499648 - RNA, 20 nt, Homo sapiens
agugggaucugucacaccag

SEQ ID NO: 1499649 - RNA, 22 nt, Homo sapiens
agugggcaggauaaacugaaaa

SEQ ID NO: 1499650 - RNA, 11 nt, Homo sapiens
agugggccagg

SEQ ID NO: 1499651 - RNA, 24 nt, Homo sapiens
agugggugguggaucuguccaagg

SEQ ID NO: 1499652 - RNA, 21 nt, Homo sapiens
agugguaaucauaugugucuu

SEQ ID NO: 1499653 - RNA, 17 nt, Homo sapiens
agugguauccugugaca

SEQ ID NO: 1499654 - RNA, 13 nt, Homo sapiens
aguggugccaaac

SEQ ID NO: 1499655 - RNA, 21 nt, Homo sapiens
agugguguguguuaucagaua

SEQ ID NO: 1499656 - RNA, 12 nt, Homo sapiens
aguguacaugga

SEQ ID NO: 1499657 - RNA, 15 nt, Homo sapiens
aguguagacuguggc

SEQ ID NO: 1499658 - RNA, 20 nt, Homo sapiens
aguguagcauuggaucaaaa

SEQ ID NO: 1499659 - RNA, 23 nt, Homo sapiens
agugucaggcgccgcacuuccuu

SEQ ID NO: 1499660 - RNA, 21 nt, Homo sapiens
aguguccccuccacugucaca

SEQ ID NO: 1499661 - RNA, 19 nt, Homo sapiens
aguguccuuuccagagcaa

SEQ ID NO: 1499662 - RNA, 17 nt, Homo sapiens
agugucuuagcauauuu

SEQ ID NO: 1499663 - RNA, 17 nt, Homo sapiens
agugugacagggccagu

SEQ ID NO: 1499664 - RNA, 16 nt, Homo sapiens
agugugauauacaaag

SEQ ID NO: 1499665 - RNA, 18 nt, Homo sapiens
aguguggacuuggcaggu

SEQ ID NO: 1499666 - RNA, 23 nt, Homo sapiens
aguguggccacgugggcaaacag

SEQ ID NO: 1499667 - RNA, 19 nt, Homo sapiens
aguguuaagcguucaguga

SEQ ID NO: 1499668 - RNA, 22 nt, Homo sapiens
aguguuaucagucauaacuaaa

SEQ ID NO: 1499669 - RNA, 14 nt, Homo sapiens
aguguuauuugcac

SEQ ID NO: 1499670 - RNA, 16 nt, Homo sapiens
aguguucucacagugu

SEQ ID NO: 1499671 - RNA, 22 nt, Homo sapiens
aguguugcccaggcuggucuca

SEQ ID NO: 1499672 - RNA, 16 nt, Homo sapiens
aguguugcucagcucc

SEQ ID NO: 1499673 - RNA, 18 nt, Homo sapiens
aguguugggcaugugauc

SEQ ID NO: 1499674 - RNA, 17 nt, Homo sapiens
aguguuguggacacugc

SEQ ID NO: 1499675 - RNA, 14 nt, Homo sapiens
aguguuucuuccac

SEQ ID NO: 1499676 - RNA, 21 nt, Homo sapiens
aguguuuuggacuccaucucu

SEQ ID NO: 1499677 - RNA, 19 nt, Homo sapiens
aguuaaacauugaaguaau

SEQ ID NO: 1499678 - RNA, 12 nt, Homo sapiens
aguuaacuauug

SEQ ID NO: 1499679 - RNA, 12 nt, Homo sapiens
aguuaagacaug

SEQ ID NO: 1499680 - RNA, 19 nt, Homo sapiens
aguuaaggauuguuuuaaa

SEQ ID NO: 1499681 - RNA, 12 nt, Homo sapiens
aguuaaggguua

SEQ ID NO: 1499682 - RNA, 13 nt, Homo sapiens
aguuaaucuucau

SEQ ID NO: 1499683 - RNA, 16 nt, Homo sapiens
aguuaaugagccauca

SEQ ID NO: 1499684 - RNA, 15 nt, Homo sapiens
aguuaauucaccuau

SEQ ID NO: 1499685 - RNA, 16 nt, Homo sapiens
aguuacacagaaaugc

SEQ ID NO: 1499686 - RNA, 15 nt, Homo sapiens
auaacccuaacacac

SEQ ID NO: 1499687 - RNA, 18 nt, Homo sapiens
auaacucuguaaaaacac

SEQ ID NO: 1499688 - RNA, 12 nt, Homo sapiens
auaacugugaag

SEQ ID NO: 1499689 - RNA, 20 nt, Homo sapiens
acaggaagcaccccaugcca

SEQ ID NO: 1499690 - RNA, 15 nt, Homo sapiens
acaggagaccuggca

SEQ ID NO: 1499691 - RNA, 12 nt, Homo sapiens
acaggagccuag

SEQ ID NO: 1499692 - RNA, 13 nt, Homo sapiens
acaggaguguccu

SEQ ID NO: 1499693 - RNA, 23 nt, Homo sapiens
acaggaguguccucuucccucuc

SEQ ID NO: 1499694 - RNA, 21 nt, Homo sapiens
acaggaugaaaguucccccau

SEQ ID NO: 1499695 - RNA, 19 nt, Homo sapiens
acaggaugcuggccuuugc

SEQ ID NO: 1499696 - RNA, 19 nt, Homo sapiens
acaggauuauuggaaauuu

SEQ ID NO: 1499697 - RNA, 16 nt, Homo sapiens
acaggcaaacugcaaa

SEQ ID NO: 1499698 - RNA, 17 nt, Homo sapiens
acaggcaaauuccugac

SEQ ID NO: 1499699 - RNA, 20 nt, Homo sapiens
acaggcagauguuugccuca

SEQ ID NO: 1499700 - RNA, 21 nt, Homo sapiens
acaggcagauguuugccucau

SEQ ID NO: 1499701 - RNA, 19 nt, Homo sapiens
acaggcauuuguucacuga

SEQ ID NO: 1499702 - RNA, 14 nt, Homo sapiens
acaggcgaggaccc

SEQ ID NO: 1499703 - RNA, 22 nt, Homo sapiens
acaggcgugauccaccacaccu

SEQ ID NO: 1499704 - RNA, 21 nt, Homo sapiens
acaggcucuuagcagcuucca

SEQ ID NO: 1499705 - RNA, 20 nt, Homo sapiens
acagggaaaacugcaaagcu

SEQ ID NO: 1499706 - RNA, 19 nt, Homo sapiens
acagggcaugcauuuugca

SEQ ID NO: 1499707 - RNA, 13 nt, Homo sapiens
acagggccagagg

SEQ ID NO: 1499708 - RNA, 20 nt, Homo sapiens
acagggcgagacuccgucuc

SEQ ID NO: 1499709 - RNA, 17 nt, Homo sapiens
acagggucauguuugca

SEQ ID NO: 1499710 - RNA, 19 nt, Homo sapiens
acagggucuugcucugucc

SEQ ID NO: 1499711 - RNA, 20 nt, Homo sapiens
acaggguuuuuaccugucac

SEQ ID NO: 1499712 - RNA, 19 nt, Homo sapiens
acagguggcaggaccagga

SEQ ID NO: 1499713 - RNA, 15 nt, Homo sapiens
acaggugggcuguau

SEQ ID NO: 1499714 - RNA, 22 nt, Homo sapiens
acagguguggggacacagcagu

SEQ ID NO: 1499715 - RNA, 15 nt, Homo sapiens
acagguuaaccugca

SEQ ID NO: 1499716 - RNA, 18 nt, Homo sapiens
acaguacagcaugugccu

SEQ ID NO: 1499717 - RNA, 16 nt, Homo sapiens
acaguauuuugguucu

SEQ ID NO: 1499718 - RNA, 19 nt, Homo sapiens
acagucacuaauauaguag

SEQ ID NO: 1499719 - RNA, 19 nt, Homo sapiens
acagucacugacucaagac

SEQ ID NO: 1499720 - RNA, 13 nt, Homo sapiens
acagucauuuaaa

SEQ ID NO: 1499721 - RNA, 15 nt, Homo sapiens
acagucccuauggaa

SEQ ID NO: 1499722 - RNA, 15 nt, Homo sapiens
acagucuggugcuug

SEQ ID NO: 1499723 - RNA, 13 nt, Homo sapiens
acagugcagacag

SEQ ID NO: 1499724 - RNA, 18 nt, Homo sapiens
acagugccgacagcucuc

SEQ ID NO: 1499725 - RNA, 15 nt, Homo sapiens
acagugccugggaau

SEQ ID NO: 1499726 - RNA, 20 nt, Homo sapiens
acaguguaggcauuuaacuc

SEQ ID NO: 1499727 - RNA, 22 nt, Homo sapiens
acaguuguguuagccucuugcg

SEQ ID NO: 1499728 - RNA, 22 nt, Homo sapiens
acaguuuauuuuuauacuuuca

SEQ ID NO: 1499729 - RNA, 23 nt, Homo sapiens
acaguuuauuuuuauacuuucag

SEQ ID NO: 1499730 - RNA, 17 nt, Homo sapiens
acauaaaauaagagauc

SEQ ID NO: 1499731 - RNA, 17 nt, Homo sapiens
acauaaacaauucaugc

SEQ ID NO: 1499732 - RNA, 15 nt, Homo sapiens
acauaacaugcuuua

SEQ ID NO: 1499733 - RNA, 19 nt, Homo sapiens
acauaacuccugucccuuu

SEQ ID NO: 1499734 - RNA, 13 nt, Homo sapiens
acauaacuuccua

SEQ ID NO: 1499735 - RNA, 17 nt, Homo sapiens
acauacauauuaucuca

SEQ ID NO: 1499736 - RNA, 16 nt, Homo sapiens
acauacauuucucaua

SEQ ID NO: 1499737 - RNA, 19 nt, Homo sapiens
acauacuccuuccaucaaa

SEQ ID NO: 1499738 - RNA, 14 nt, Homo sapiens
acauacuuucaucc

SEQ ID NO: 1499739 - RNA, 18 nt, Homo sapiens
acauagaugucccuuucu

SEQ ID NO: 1499740 - RNA, 20 nt, Homo sapiens
acauaggccugcucagccuc

SEQ ID NO: 1499741 - RNA, 22 nt, Homo sapiens
acauaguuuauuucaacuauuu

SEQ ID NO: 1499742 - RNA, 22 nt, Homo sapiens
acauauaaaugaaucugguguu

SEQ ID NO: 1499743 - RNA, 22 nt, Homo sapiens
acauauauacccacauguacag

SEQ ID NO: 1499744 - RNA, 18 nt, Homo sapiens
acauauauauuaauacug

SEQ ID NO: 1499745 - RNA, 20 nt, Homo sapiens
acauaucaccucauggccua

SEQ ID NO: 1499746 - RNA, 18 nt, Homo sapiens
acauaucgcugacuucau

SEQ ID NO: 1499747 - RNA, 12 nt, Homo sapiens
acauaugcauuu

SEQ ID NO: 1499748 - RNA, 20 nt, Homo sapiens
acauauuacuguugcauuua

SEQ ID NO: 1499749 - RNA, 17 nt, Homo sapiens
acauauuaggaaaauau

SEQ ID NO: 1499750 - RNA, 13 nt, Homo sapiens
acauauuaucuca

SEQ ID NO: 1499751 - RNA, 20 nt, Homo sapiens
acaucaaagagcacauuuac

SEQ ID NO: 1499752 - RNA, 14 nt, Homo sapiens
acaucaauguucau

SEQ ID NO: 1499753 - RNA, 17 nt, Homo sapiens
acaucagcaaacaggau

SEQ ID NO: 1499754 - RNA, 15 nt, Homo sapiens
acauccauguuccga

SEQ ID NO: 1499755 - RNA, 22 nt, Homo sapiens
acauccuaccccuuugcacuug

SEQ ID NO: 1499756 - RNA, 12 nt, Homo sapiens
acaucucagaaa

SEQ ID NO: 1499757 - RNA, 19 nt, Homo sapiens
acaucucagaaaacucugg

SEQ ID NO: 1499758 - RNA, 21 nt, Homo sapiens
acaucuccuccauacucagga

SEQ ID NO: 1499759 - RNA, 12 nt, Homo sapiens
acaucugcaaua

SEQ ID NO: 1499760 - RNA, 11 nt, Homo sapiens
acaucugucac

SEQ ID NO: 1499761 - RNA, 13 nt, Homo sapiens
acaucuuuuacau

SEQ ID NO: 1499762 - RNA, 19 nt, Homo sapiens
acaucuuuuacauucugca

SEQ ID NO: 1499763 - RNA, 19 nt, Homo sapiens
acaugaagacaucuuaucc

SEQ ID NO: 1499764 - RNA, 18 nt, Homo sapiens
acaugacaacuuugccag

SEQ ID NO: 1499765 - RNA, 21 nt, Homo sapiens
acaugaccugaucacuagccu

SEQ ID NO: 1499766 - RNA, 19 nt, Homo sapiens
acaugagaacaaacagauc

SEQ ID NO: 1499767 - RNA, 19 nt, Homo sapiens
acaugagaaggaacuucca

SEQ ID NO: 1499768 - RNA, 16 nt, Homo sapiens
acaugagcuauuucca

SEQ ID NO: 1499769 - RNA, 21 nt, Homo sapiens
acaugcagcaaggggacaucu

SEQ ID NO: 1499770 - RNA, 11 nt, Homo sapiens
acaugcauugu

SEQ ID NO: 1499771 - RNA, 19 nt, Homo sapiens
acaugccucugccaaagga

SEQ ID NO: 1499772 - RNA, 17 nt, Homo sapiens
acaugcuaccacuggua

SEQ ID NO: 1499773 - RNA, 14 nt, Homo sapiens
acauggagcuguca

SEQ ID NO: 1499774 - RNA, 20 nt, Homo sapiens
acauggugaaaccccgucuc

SEQ ID NO: 1499775 - RNA, 17 nt, Homo sapiens
acauggugaaacccugu

SEQ ID NO: 1499776 - RNA, 22 nt, Homo sapiens
acauguaauugcagauaacuuu

SEQ ID NO: 1499777 - RNA, 13 nt, Homo sapiens
acauguacagaca

SEQ ID NO: 1499778 - RNA, 14 nt, Homo sapiens
acauguagcuucuu

SEQ ID NO: 1499779 - RNA, 22 nt, Homo sapiens
acauguagguaggaagcacuga

SEQ ID NO: 1499780 - RNA, 18 nt, Homo sapiens
acauguauuuauggagug

SEQ ID NO: 1499781 - RNA, 18 nt, Homo sapiens
acauguuacugaccagca

SEQ ID NO: 1499782 - RNA, 17 nt, Homo sapiens
acauuaaggaauuugau

SEQ ID NO: 1499783 - RNA, 22 nt, Homo sapiens
acauuaucgggagcagugucuu

SEQ ID NO: 1499784 - RNA, 21 nt, Homo sapiens
acauuauguggcccucuggau

SEQ ID NO: 1499785 - RNA, 20 nt, Homo sapiens
acauuauuucuaguccaaaa

SEQ ID NO: 1499786 - RNA, 18 nt, Homo sapiens
acauucaauagcauauca

SEQ ID NO: 1499787 - RNA, 14 nt, Homo sapiens
acauucagggcuau

SEQ ID NO: 1499788 - RNA, 18 nt, Homo sapiens
acauucaguucccaccau

SEQ ID NO: 1499789 - RNA, 23 nt, Homo sapiens
acauucugcaagcacaucugcau

SEQ ID NO: 1499790 - RNA, 21 nt, Homo sapiens
aaaaauauuuauaaaacuucu

SEQ ID NO: 1499791 - RNA, 17 nt, Homo sapiens
aaaaaucuuuucauuaa

SEQ ID NO: 1499792 - RNA, 12 nt, Homo sapiens
aaaaauguucuu

SEQ ID NO: 1499793 - RNA, 14 nt, Homo sapiens
aaaaauuaucuaua

SEQ ID NO: 1499794 - RNA, 14 nt, Homo sapiens
aaaacaauacucaa

SEQ ID NO: 1499795 - RNA, 17 nt, Homo sapiens
aaaacaauucugugaca

SEQ ID NO: 1499796 - RNA, 14 nt, Homo sapiens
aaaacacauugccu

SEQ ID NO: 1499797 - RNA, 14 nt, Homo sapiens
aaaacaccaugaaa

SEQ ID NO: 1499798 - RNA, 22 nt, Homo sapiens
aaaacacugaaaaauauuccaa

SEQ ID NO: 1499799 - RNA, 13 nt, Homo sapiens
aaaacaguauuua

SEQ ID NO: 1499800 - RNA, 11 nt, Homo sapiens
aaaacauguau

SEQ ID NO: 1499801 - RNA, 16 nt, Homo sapiens
aaaacuaaacuuucau

SEQ ID NO: 1499802 - RNA, 15 nt, Homo sapiens
aaaacuaagcacaaa

SEQ ID NO: 1499803 - RNA, 11 nt, Homo sapiens
aaaacuacuuc

SEQ ID NO: 1499804 - RNA, 21 nt, Homo sapiens
aaaacuccacagucaauauua

SEQ ID NO: 1499805 - RNA, 11 nt, Homo sapiens
aaaacucucug

SEQ ID NO: 1499806 - RNA, 21 nt, Homo sapiens
aaaacucucugguuuacuuca

SEQ ID NO: 1499807 - RNA, 20 nt, Homo sapiens
aaaacugauuuuuagcuuua

SEQ ID NO: 1499808 - RNA, 15 nt, Homo sapiens
aaaacugugccuugu

SEQ ID NO: 1499809 - RNA, 17 nt, Homo sapiens
aaaacuguguugccaca

SEQ ID NO: 1499810 - RNA, 14 nt, Homo sapiens
aaaacuuaacauuc

SEQ ID NO: 1499811 - RNA, 16 nt, Homo sapiens
aaaacuugacauguag

SEQ ID NO: 1499812 - RNA, 21 nt, Homo sapiens
aaaacuuuaggcccugcccca

SEQ ID NO: 1499813 - RNA, 17 nt, Homo sapiens
aaaagaaaacaccacua

SEQ ID NO: 1499814 - RNA, 15 nt, Homo sapiens
aaaagaaaugaacau

SEQ ID NO: 1499815 - RNA, 13 nt, Homo sapiens
aaaagaccuauga

SEQ ID NO: 1499816 - RNA, 20 nt, Homo sapiens
aaaagacucugaccagagau

SEQ ID NO: 1499817 - RNA, 12 nt, Homo sapiens
aaaagacugaau

SEQ ID NO: 1499818 - RNA, 18 nt, Homo sapiens
aaaagauuuguuuuguca

SEQ ID NO: 1499819 - RNA, 14 nt, Homo sapiens
aaaagcagcuacca

SEQ ID NO: 1499820 - RNA, 16 nt, Homo sapiens
aaaagcccuuugcuaa

SEQ ID NO: 1499821 - RNA, 15 nt, Homo sapiens
aaaagcuagacagau

SEQ ID NO: 1499822 - RNA, 20 nt, Homo sapiens
aaaaggacucugcuucaguc

SEQ ID NO: 1499823 - RNA, 15 nt, Homo sapiens
aaaaggcauauugcu

SEQ ID NO: 1499824 - RNA, 19 nt, Homo sapiens
aaaagggcugacauuuucu

SEQ ID NO: 1499825 - RNA, 20 nt, Homo sapiens
aaaagguuaaauauugucau

SEQ ID NO: 1499826 - RNA, 13 nt, Homo sapiens
aaaaguacauauu

SEQ ID NO: 1499827 - RNA, 19 nt, Homo sapiens
aaaaguccuugauuuagca

SEQ ID NO: 1499828 - RNA, 13 nt, Homo sapiens
aaaagucuucacu

SEQ ID NO: 1499829 - RNA, 21 nt, Homo sapiens
aaaagugaucaauaaaaugug

SEQ ID NO: 1499830 - RNA, 11 nt, Homo sapiens
aaaagugcucc

SEQ ID NO: 1499831 - RNA, 12 nt, Homo sapiens
aaaagugcuccc

SEQ ID NO: 1499832 - RNA, 16 nt, Homo sapiens
aaaagugugagcagug

SEQ ID NO: 1499833 - RNA, 21 nt, Homo sapiens
aaaaguugguguugacauaca

SEQ ID NO: 1499834 - RNA, 14 nt, Homo sapiens
aaaaguuguuuguu

SEQ ID NO: 1499835 - RNA, 15 nt, Homo sapiens
aaaauaaacaucagu

SEQ ID NO: 1499836 - RNA, 12 nt, Homo sapiens
aaaauaaauucc

SEQ ID NO: 1499837 - RNA, 16 nt, Homo sapiens
aaaauaaugcauuugu

SEQ ID NO: 1499838 - RNA, 22 nt, Homo sapiens
aaaauagauccaaucaguuuau

SEQ ID NO: 1499839 - RNA, 13 nt, Homo sapiens
aaaauaguaaugu

SEQ ID NO: 1499840 - RNA, 15 nt, Homo sapiens
aaaauauacauucaa

SEQ ID NO: 1499841 - RNA, 12 nt, Homo sapiens
aaaauauaucau

SEQ ID NO: 1499842 - RNA, 14 nt, Homo sapiens
aaaauauauuucag

SEQ ID NO: 1499843 - RNA, 22 nt, Homo sapiens
aaaauaugaaaaaaagaaauga

SEQ ID NO: 1499844 - RNA, 14 nt, Homo sapiens
aaaauauggcuaua

SEQ ID NO: 1499845 - RNA, 17 nt, Homo sapiens
aaaaucccaccuuccca

SEQ ID NO: 1499846 - RNA, 18 nt, Homo sapiens
aaaauccuuuuugcauau

SEQ ID NO: 1499847 - RNA, 12 nt, Homo sapiens
aaaaucugucca

SEQ ID NO: 1499848 - RNA, 16 nt, Homo sapiens
aaaaucuguguaacug

SEQ ID NO: 1499849 - RNA, 14 nt, Homo sapiens
aaaaucuguucuaa

SEQ ID NO: 1499850 - RNA, 14 nt, Homo sapiens
aaaaugaaaggaag

SEQ ID NO: 1499851 - RNA, 23 nt, Homo sapiens
aaaaugaagguggaacaagcaca

SEQ ID NO: 1499852 - RNA, 14 nt, Homo sapiens
aaaaugagguacuc

SEQ ID NO: 1499853 - RNA, 16 nt, Homo sapiens
aaaaugauggaaugac

SEQ ID NO: 1499854 - RNA, 18 nt, Homo sapiens
aaaaugaugggacaauaa

SEQ ID NO: 1499855 - RNA, 19 nt, Homo sapiens
aaaaugauuggccccaguc

SEQ ID NO: 1499856 - RNA, 21 nt, Homo sapiens
aaaaugauuuuaucugugaau

SEQ ID NO: 1499857 - RNA, 15 nt, Homo sapiens
aaaaugcacguagcu

SEQ ID NO: 1499858 - RNA, 17 nt, Homo sapiens
aaaaugcaguccugagg

SEQ ID NO: 1499859 - RNA, 16 nt, Homo sapiens
aaaaugccuccauggc

SEQ ID NO: 1499860 - RNA, 12 nt, Homo sapiens
aaaaugccuuug

SEQ ID NO: 1499861 - RNA, 15 nt, Homo sapiens
aaaaugccuuugaga

SEQ ID NO: 1499862 - RNA, 18 nt, Homo sapiens
aaaaugcuucugcacaca

SEQ ID NO: 1499863 - RNA, 17 nt, Homo sapiens
aaaauggcaaaugcacu

SEQ ID NO: 1499864 - RNA, 22 nt, Homo sapiens
aaaauggcaucaaccaccaugg

SEQ ID NO: 1499865 - RNA, 22 nt, Homo sapiens
aaaauggucauccaaacucaaa

SEQ ID NO: 1499866 - RNA, 15 nt, Homo sapiens
aaaauguacaauuaa

SEQ ID NO: 1499867 - RNA, 13 nt, Homo sapiens
aaaauguccauga

SEQ ID NO: 1499868 - RNA, 16 nt, Homo sapiens
aaaauguccugccuuu

SEQ ID NO: 1499869 - RNA, 13 nt, Homo sapiens
aaaaugucucagu

SEQ ID NO: 1499870 - RNA, 22 nt, Homo sapiens
aaaaugucucaguuuucagcua

SEQ ID NO: 1499871 - RNA, 20 nt, Homo sapiens
aaaaugucuguuaacuuaau

SEQ ID NO: 1499872 - RNA, 15 nt, Homo sapiens
aaaauguuggaagag

SEQ ID NO: 1499873 - RNA, 15 nt, Homo sapiens
aaaauuaauacugaa

SEQ ID NO: 1499874 - RNA, 16 nt, Homo sapiens
aaaauuagacugugau

SEQ ID NO: 1499875 - RNA, 17 nt, Homo sapiens
aaaauuaucaauaucua

SEQ ID NO: 1499876 - RNA, 18 nt, Homo sapiens
aaaauuauuauaagcauu

SEQ ID NO: 1499877 - RNA, 21 nt, Homo sapiens
aaaauucagaguccuugcaaa

SEQ ID NO: 1499878 - RNA, 20 nt, Homo sapiens
aaaauucuauuacaguaugu

SEQ ID NO: 1499879 - RNA, 18 nt, Homo sapiens
aaaauuugaaauuuagcu

SEQ ID NO: 1499880 - RNA, 15 nt, Homo sapiens
aaaauuuuacuucca

SEQ ID NO: 1499881 - RNA, 12 nt, Homo sapiens
aaaauuuugcuu

SEQ ID NO: 1499882 - RNA, 20 nt, Homo sapiens
aaacaaaauggguuacuuga

SEQ ID NO: 1499883 - RNA, 14 nt, Homo sapiens
aaacaaauaugcaa

SEQ ID NO: 1499884 - RNA, 19 nt, Homo sapiens
aaacaagaggacuguguug

SEQ ID NO: 1499885 - RNA, 15 nt, Homo sapiens
aaacaauucugugac

SEQ ID NO: 1499886 - RNA, 20 nt, Homo sapiens
aaacaauuggcaaacuuugu

SEQ ID NO: 1499887 - RNA, 21 nt, Homo sapiens
aaacaauuuuuuuuuuccucu

SEQ ID NO: 1499888 - RNA, 21 nt, Homo sapiens
aaacacagcaacaaugacuua

SEQ ID NO: 1499889 - RNA, 19 nt, Homo sapiens
aaacacaucauaauggauu

SEQ ID NO: 1499890 - RNA, 13 nt, Homo sapiens
aaacacugaggca

SEQ ID NO: 1499891 - RNA, 19 nt, Homo sapiens
aaacacugggggcaccuua

SEQ ID NO: 1499892 - RNA, 17 nt, Homo sapiens
aaacacuuacagaauua

SEQ ID NO: 1499893 - RNA, 15 nt, Homo sapiens
aaacagccaugucca

SEQ ID NO: 1499894 - RNA, 18 nt, Homo sapiens
aaagguuucauguucacu

SEQ ID NO: 1499895 - RNA, 23 nt, Homo sapiens
aaagguuucauguucacugugag

SEQ ID NO: 1499896 - RNA, 22 nt, Homo sapiens
aaagguuuuaaccgcacaugca

SEQ ID NO: 1499897 - RNA, 14 nt, Homo sapiens
aaagguuuuccuua

SEQ ID NO: 1499898 - RNA, 14 nt, Homo sapiens
aaaguaaaggcaaa

SEQ ID NO: 1499899 - RNA, 17 nt, Homo sapiens
aaaguaaauucauguaa

SEQ ID NO: 1499900 - RNA, 16 nt, Homo sapiens
aaaguaccuugaacuc

SEQ ID NO: 1499901 - RNA, 13 nt, Homo sapiens
aaaguagccacgu

SEQ ID NO: 1499902 - RNA, 21 nt, Homo sapiens
aaaguauaaccauaugauacu

SEQ ID NO: 1499903 - RNA, 17 nt, Homo sapiens
aaaguauuagaaauauu

SEQ ID NO: 1499904 - RNA, 19 nt, Homo sapiens
aaagucccucccugccuga

SEQ ID NO: 1499905 - RNA, 15 nt, Homo sapiens
aaagugacuauucag

SEQ ID NO: 1499906 - RNA, 21 nt, Homo sapiens
aaagugacucacuuaucccaa

SEQ ID NO: 1499907 - RNA, 23 nt, Homo sapiens
aaagugacucacuuaucccaaga

SEQ ID NO: 1499908 - RNA, 20 nt, Homo sapiens
aaagugagaaaaugccucaa

SEQ ID NO: 1499909 - RNA, 19 nt, Homo sapiens
aaagugcugagauugcaga

SEQ ID NO: 1499910 - RNA, 22 nt, Homo sapiens
aaagugcugggauuacaggcgu

SEQ ID NO: 1499911 - RNA, 23 nt, Homo sapiens
aaagugcugggauuacaggugug

SEQ ID NO: 1499912 - RNA, 19 nt, Homo sapiens
aaaguguaacaauugugua

SEQ ID NO: 1499913 - RNA, 17 nt, Homo sapiens
aaagugugucacccuuu

SEQ ID NO: 1499914 - RNA, 19 nt, Homo sapiens
aaaguguguuucuauguga

SEQ ID NO: 1499915 - RNA, 20 nt, Homo sapiens
aaaguuacuagguaacuuca

SEQ ID NO: 1499916 - RNA, 18 nt, Homo sapiens
aaaguucuuuuugcucua

SEQ ID NO: 1499917 - RNA, 16 nt, Homo sapiens
aaaguugcagauguau

SEQ ID NO: 1499918 - RNA, 13 nt, Homo sapiens
aaaguuguuguaa

SEQ ID NO: 1499919 - RNA, 23 nt, Homo sapiens
aaaguuguuguaaccugcuguga

SEQ ID NO: 1499920 - RNA, 17 nt, Homo sapiens
aaaguuuacccaugaag

SEQ ID NO: 1499921 - RNA, 14 nt, Homo sapiens
aaaguuucagagaa

SEQ ID NO: 1499922 - RNA, 16 nt, Homo sapiens
aaaguuuccuaggaug

SEQ ID NO: 1499923 - RNA, 14 nt, Homo sapiens
aaaguuugcucaag

SEQ ID NO: 1499924 - RNA, 17 nt, Homo sapiens
aaauaaaaaaagacaaa

SEQ ID NO: 1499925 - RNA, 22 nt, Homo sapiens
aaauaaaaagugacacagcagc

SEQ ID NO: 1499926 - RNA, 15 nt, Homo sapiens
aaauaaaacuaagcu

SEQ ID NO: 1499927 - RNA, 14 nt, Homo sapiens
aaauaaaacugaau

SEQ ID NO: 1499928 - RNA, 17 nt, Homo sapiens
aaauaaaaugcagacag

SEQ ID NO: 1499929 - RNA, 18 nt, Homo sapiens
aaauaaaggugacuggga

SEQ ID NO: 1499930 - RNA, 22 nt, Homo sapiens
aaauaaaguauauauagaaucu

SEQ ID NO: 1499931 - RNA, 15 nt, Homo sapiens
aaauaaauagcuaua

SEQ ID NO: 1499932 - RNA, 15 nt, Homo sapiens
aaauaacaggcauuu

SEQ ID NO: 1499933 - RNA, 14 nt, Homo sapiens
aaauaagagauuug

SEQ ID NO: 1499934 - RNA, 18 nt, Homo sapiens
aaauaagcucuccccaaa

SEQ ID NO: 1499935 - RNA, 13 nt, Homo sapiens
aaauaaucaagau

SEQ ID NO: 1499936 - RNA, 14 nt, Homo sapiens
aaauaaucagugac

SEQ ID NO: 1499937 - RNA, 23 nt, Homo sapiens
aaauacacuguuaucuucacuuu

SEQ ID NO: 1499938 - RNA, 22 nt, Homo sapiens
aaauacauaucgcugacuucau

SEQ ID NO: 1499939 - RNA, 16 nt, Homo sapiens
aaauaccaaguauuua

SEQ ID NO: 1499940 - RNA, 16 nt, Homo sapiens
aaauacuauugccuca

SEQ ID NO: 1499941 - RNA, 22 nt, Homo sapiens
aaauacugugcagaauaaugga

SEQ ID NO: 1499942 - RNA, 20 nt, Homo sapiens
aaauacuuagagcagugaag

SEQ ID NO: 1499943 - RNA, 15 nt, Homo sapiens
aaauacuucuugaag

SEQ ID NO: 1499944 - RNA, 19 nt, Homo sapiens
aaauacuucuugaagccga

SEQ ID NO: 1499945 - RNA, 15 nt, Homo sapiens
aaauagaacauucca

SEQ ID NO: 1499946 - RNA, 15 nt, Homo sapiens
aaauagagaauccca

SEQ ID NO: 1499947 - RNA, 20 nt, Homo sapiens
aaauagauaaacuauacacu

SEQ ID NO: 1499948 - RNA, 15 nt, Homo sapiens
aaauagcugccuuuu

SEQ ID NO: 1499949 - RNA, 13 nt, Homo sapiens
aaauagucacuca

SEQ ID NO: 1499950 - RNA, 13 nt, Homo sapiens
aaauagucuucca

SEQ ID NO: 1499951 - RNA, 14 nt, Homo sapiens
aaauauauaugugu

SEQ ID NO: 1499952 - RNA, 20 nt, Homo sapiens
aaauauguaaugcuuccaau

SEQ ID NO: 1499953 - RNA, 16 nt, Homo sapiens
aaauauguauaugaca

SEQ ID NO: 1499954 - RNA, 21 nt, Homo sapiens
aaauauuuauaaaacuucuca

SEQ ID NO: 1499955 - RNA, 12 nt, Homo sapiens
aaauauuucagg

SEQ ID NO: 1499956 - RNA, 17 nt, Homo sapiens
aaauauuugacuugcau

SEQ ID NO: 1499957 - RNA, 16 nt, Homo sapiens
aaaucacucucagugc

SEQ ID NO: 1499958 - RNA, 18 nt, Homo sapiens
aaaucauauuaguauuaa

SEQ ID NO: 1499959 - RNA, 23 nt, Homo sapiens
aaauccgcauugauggccucaau

SEQ ID NO: 1499960 - RNA, 13 nt, Homo sapiens
aaauccuuccaaa

SEQ ID NO: 1499961 - RNA, 17 nt, Homo sapiens
aaauccuuccaaaaauu

SEQ ID NO: 1499962 - RNA, 23 nt, Homo sapiens
aaaucggaucuggggcucuggga

SEQ ID NO: 1499963 - RNA, 19 nt, Homo sapiens
aaaucuauucuguguugca

SEQ ID NO: 1499964 - RNA, 12 nt, Homo sapiens
aaaucuccagug

SEQ ID NO: 1499965 - RNA, 23 nt, Homo sapiens
aaaucucuucuuugcugcaguca

SEQ ID NO: 1499966 - RNA, 19 nt, Homo sapiens
aaaucugacaagacugaaa

SEQ ID NO: 1499967 - RNA, 22 nt, Homo sapiens
aaaucugccacaaaaacaggua

SEQ ID NO: 1499968 - RNA, 12 nt, Homo sapiens
aaaucuguaaau

SEQ ID NO: 1499969 - RNA, 19 nt, Homo sapiens
aaaucuuuggauuugauca

SEQ ID NO: 1499970 - RNA, 13 nt, Homo sapiens
aaaugaacugaag

SEQ ID NO: 1499971 - RNA, 21 nt, Homo sapiens
aaaugaagguuaggauuuaac

SEQ ID NO: 1499972 - RNA, 22 nt, Homo sapiens
aaaugaaucucguucccaaaga

SEQ ID NO: 1499973 - RNA, 15 nt, Homo sapiens
aaaugaaucuucaca

SEQ ID NO: 1499974 - RNA, 17 nt, Homo sapiens
aaaugacagauguugaa

SEQ ID NO: 1499975 - RNA, 13 nt, Homo sapiens
aaaugacuacuua

SEQ ID NO: 1499976 - RNA, 12 nt, Homo sapiens
aaaugagacaaa

SEQ ID NO: 1499977 - RNA, 18 nt, Homo sapiens
aaaugaguugugaugaau

SEQ ID NO: 1499978 - RNA, 15 nt, Homo sapiens
aaaugauagacaauu

SEQ ID NO: 1499979 - RNA, 18 nt, Homo sapiens
aaaugauguguacccaaa

SEQ ID NO: 1499980 - RNA, 21 nt, Homo sapiens
aaaugccacguggucacugug

SEQ ID NO: 1499981 - RNA, 18 nt, Homo sapiens
aaaugccucaauucacau

SEQ ID NO: 1499982 - RNA, 14 nt, Homo sapiens
aaaugcuauauugc

SEQ ID NO: 1499983 - RNA, 14 nt, Homo sapiens
aaaugcuucugcac

SEQ ID NO: 1499984 - RNA, 16 nt, Homo sapiens
aaauggaggaauauga

SEQ ID NO: 1499985 - RNA, 17 nt, Homo sapiens
aaaugggagacagccuc

SEQ ID NO: 1499986 - RNA, 19 nt, Homo sapiens
aaaugggagacagccucuu

SEQ ID NO: 1499987 - RNA, 16 nt, Homo sapiens
aaaugggccauuccag

SEQ ID NO: 1499988 - RNA, 21 nt, Homo sapiens
aaauggggccagauccagccu

SEQ ID NO: 1499989 - RNA, 21 nt, Homo sapiens
aaauggucucuaacauuuccu

SEQ ID NO: 1499990 - RNA, 21 nt, Homo sapiens
aaaugguucagaauuaaacuu

SEQ ID NO: 1499991 - RNA, 22 nt, Homo sapiens
aaauguacaacugcaccuguca

SEQ ID NO: 1499992 - RNA, 14 nt, Homo sapiens
aaauguaugugcuc

SEQ ID NO: 1499993 - RNA, 19 nt, Homo sapiens
aaauguauucaaauaccaa

SEQ ID NO: 1499994 - RNA, 13 nt, Homo sapiens
aaauguccaugau

SEQ ID NO: 1499995 - RNA, 11 nt, Homo sapiens
aaaugucuugc

SEQ ID NO: 1499996 - RNA, 21 nt, Homo sapiens
aacucauggaccacaguaaca

SEQ ID NO: 1499997 - RNA, 19 nt, Homo sapiens
aacuccuuuagcagguggu

SEQ ID NO: 1499998 - RNA, 17 nt, Homo sapiens
aacucuacaucuagcaa

SEQ ID NO: 1499999 - RNA, 21 nt, Homo sapiens
aacucuacaucuagcaauuuc

SEQ ID NO: 1500000 - RNA, 20 nt, Homo sapiens
aacucuacccuggcacuaua

SEQ ID NO: 1500001 - RNA, 18 nt, Homo sapiens
aacucucaguggugccug

SEQ ID NO: 1500002 - RNA, 21 nt, Homo sapiens
aacucuccaauguucuauuaa

SEQ ID NO: 1500003 - RNA, 22 nt, Homo sapiens
aacucucuccuguauaaucucu

SEQ ID NO: 1500004 - RNA, 20 nt, Homo sapiens
aacucucugguuuacuucaa

SEQ ID NO: 1500005 - RNA, 21 nt, Homo sapiens
aacucugagaucuaaggaugu

SEQ ID NO: 1500006 - RNA, 12 nt, Homo sapiens
aacucuggugcu

SEQ ID NO: 1500007 - RNA, 23 nt, Homo sapiens
aacucuggugcuccugcaucuca

SEQ ID NO: 1500008 - RNA, 22 nt, Homo sapiens
aacucuuuaucaagcaacauuc

SEQ ID NO: 1500009 - RNA, 22 nt, Homo sapiens
aacucuuucuggccugccuucg

SEQ ID NO: 1500010 - RNA, 21 nt, Homo sapiens
aacugaaaguuuaacuauuua

SEQ ID NO: 1500011 - RNA, 13 nt, Homo sapiens
aacugacugccuu

SEQ ID NO: 1500012 - RNA, 23 nt, Homo sapiens
aacugacugccuugcuaaaagau

SEQ ID NO: 1500013 - RNA, 18 nt, Homo sapiens
aacugacuuaaguggcau

SEQ ID NO: 1500014 - RNA, 19 nt, Homo sapiens
aacugaguguuauuugcac

SEQ ID NO: 1500015 - RNA, 21 nt, Homo sapiens
aacugauuuuuagcuuuacaa

SEQ ID NO: 1500016 - RNA, 17 nt, Homo sapiens
aacugcaccaacgagcu

SEQ ID NO: 1500017 - RNA, 16 nt, Homo sapiens
aacugcccccacuguc

SEQ ID NO: 1500018 - RNA, 17 nt, Homo sapiens
aacugcguggugcucuu

SEQ ID NO: 1500019 - RNA, 14 nt, Homo sapiens
aacuggaaugccuu

SEQ ID NO: 1500020 - RNA, 23 nt, Homo sapiens
aacugguauuguuuacguuugau

SEQ ID NO: 1500021 - RNA, 23 nt, Homo sapiens
aacuguacauuuaaaauugcuau

SEQ ID NO: 1500022 - RNA, 14 nt, Homo sapiens
aacugucacucauu

SEQ ID NO: 1500023 - RNA, 20 nt, Homo sapiens
aacugucacucauugcugag

SEQ ID NO: 1500024 - RNA, 12 nt, Homo sapiens
aacugugcugaa

SEQ ID NO: 1500025 - RNA, 17 nt, Homo sapiens
aacugugcugaaugcuu

SEQ ID NO: 1500026 - RNA, 20 nt, Homo sapiens
aacugugcugaaugcuuuag

SEQ ID NO: 1500027 - RNA, 18 nt, Homo sapiens
aacuguguauguacauau

SEQ ID NO: 1500028 - RNA, 17 nt, Homo sapiens
aacuguuaacuaugaca

SEQ ID NO: 1500029 - RNA, 22 nt, Homo sapiens
aacuguucuggccucagaccaa

SEQ ID NO: 1500030 - RNA, 13 nt, Homo sapiens
aacuuaacauuca

SEQ ID NO: 1500031 - RNA, 19 nt, Homo sapiens
aacuuagcuugcacaugaa

SEQ ID NO: 1500032 - RNA, 12 nt, Homo sapiens
aacuucaaagag

SEQ ID NO: 1500033 - RNA, 13 nt, Homo sapiens
aacuucaagcaaa

SEQ ID NO: 1500034 - RNA, 16 nt, Homo sapiens
aacuucagguggauga

SEQ ID NO: 1500035 - RNA, 19 nt, Homo sapiens
aacuucucuugcuuucuau

SEQ ID NO: 1500036 - RNA, 16 nt, Homo sapiens
aacuucuuccugugaa

SEQ ID NO: 1500037 - RNA, 16 nt, Homo sapiens
aacuugaaaauauaug

SEQ ID NO: 1500038 - RNA, 18 nt, Homo sapiens
aacuugaaugugucaggu

SEQ ID NO: 1500039 - RNA, 14 nt, Homo sapiens
aacuugacauguag

SEQ ID NO: 1500040 - RNA, 16 nt, Homo sapiens
aacuugagggcccaga

SEQ ID NO: 1500041 - RNA, 20 nt, Homo sapiens
aacuugauguguuaucucuu

SEQ ID NO: 1500042 - RNA, 21 nt, Homo sapiens
aacuugauuuuuucaaaaaag

SEQ ID NO: 1500043 - RNA, 16 nt, Homo sapiens
aacuugcauugugauu

SEQ ID NO: 1500044 - RNA, 18 nt, Homo sapiens
aacuuguauuaaagacag

SEQ ID NO: 1500045 - RNA, 18 nt, Homo sapiens
aacuuguggccucaagca

SEQ ID NO: 1500046 - RNA, 15 nt, Homo sapiens
aacuuguucuuccaa

SEQ ID NO: 1500047 - RNA, 14 nt, Homo sapiens
aacuuucacuuuga

SEQ ID NO: 1500048 - RNA, 17 nt, Homo sapiens
aacuuugacuuugccca

SEQ ID NO: 1500049 - RNA, 14 nt, Homo sapiens
aacuuugccaaaaa

SEQ ID NO: 1500050 - RNA, 19 nt, Homo sapiens
aacuuuggugaacaguuuu

SEQ ID NO: 1500051 - RNA, 19 nt, Homo sapiens
aacuuuuuuuucucucuuu

SEQ ID NO: 1500052 - RNA, 18 nt, Homo sapiens
aagaaaaaaaucuucucc

SEQ ID NO: 1500053 - RNA, 15 nt, Homo sapiens
aagaaaaaggaacua

SEQ ID NO: 1500054 - RNA, 17 nt, Homo sapiens
aagaaaaagguuugcau

SEQ ID NO: 1500055 - RNA, 22 nt, Homo sapiens
aagaaaaguagguuuacauuca

SEQ ID NO: 1500056 - RNA, 21 nt, Homo sapiens
aagaaagacucuauucucaaa

SEQ ID NO: 1500057 - RNA, 15 nt, Homo sapiens
aagaaagaucaaaga

SEQ ID NO: 1500058 - RNA, 22 nt, Homo sapiens
aagaaagcaaugccaaucuuca

SEQ ID NO: 1500059 - RNA, 14 nt, Homo sapiens
aagaaauauuccuu

SEQ ID NO: 1500060 - RNA, 11 nt, Homo sapiens
aagaacacagg

SEQ ID NO: 1500061 - RNA, 12 nt, Homo sapiens
aagaaccuggaa

SEQ ID NO: 1500062 - RNA, 12 nt, Homo sapiens
aagaagacauga

SEQ ID NO: 1500063 - RNA, 18 nt, Homo sapiens
aagaagagacucuuugca

SEQ ID NO: 1500064 - RNA, 16 nt, Homo sapiens
aagaagccacccuccu

SEQ ID NO: 1500065 - RNA, 17 nt, Homo sapiens
aagaaggguguuuaaua

SEQ ID NO: 1500066 - RNA, 22 nt, Homo sapiens
aagaagguuggugaauuucaca

SEQ ID NO: 1500067 - RNA, 14 nt, Homo sapiens
aagaagucuucucu

SEQ ID NO: 1500068 - RNA, 16 nt, Homo sapiens
aagaagugagcagugu

SEQ ID NO: 1500069 - RNA, 13 nt, Homo sapiens
aagaauacagaaa

SEQ ID NO: 1500070 - RNA, 22 nt, Homo sapiens
aagaaugaucagcaucugugau

SEQ ID NO: 1500071 - RNA, 12 nt, Homo sapiens
aagaaugcucuu

SEQ ID NO: 1500072 - RNA, 13 nt, Homo sapiens
aagaauuaacaga

SEQ ID NO: 1500073 - RNA, 22 nt, Homo sapiens
aagaauuggggauucucuauug

SEQ ID NO: 1500074 - RNA, 18 nt, Homo sapiens
aagaauuuuaccauucag

SEQ ID NO: 1500075 - RNA, 15 nt, Homo sapiens
aagacaaaacagauc

SEQ ID NO: 1500076 - RNA, 13 nt, Homo sapiens
aagacaagcauuu

SEQ ID NO: 1500077 - RNA, 21 nt, Homo sapiens
aagacaauuugauacauaaua

SEQ ID NO: 1500078 - RNA, 17 nt, Homo sapiens
aagacaccguucauuca

SEQ ID NO: 1500079 - RNA, 16 nt, Homo sapiens
aagacagaugccccag

SEQ ID NO: 1500080 - RNA, 18 nt, Homo sapiens
aagacagcugcuggguca

SEQ ID NO: 1500081 - RNA, 19 nt, Homo sapiens
aagacagggaagagcagaa

SEQ ID NO: 1500082 - RNA, 21 nt, Homo sapiens
aagacauaaacccaguugcca

SEQ ID NO: 1500083 - RNA, 14 nt, Homo sapiens
aagacauaucucua

SEQ ID NO: 1500084 - RNA, 15 nt, Homo sapiens
aagacauaugcauuu

SEQ ID NO: 1500085 - RNA, 15 nt, Homo sapiens
aagacaugcagcuuu

SEQ ID NO: 1500086 - RNA, 23 nt, Homo sapiens
aagacauuuuuugcuauaaucau

SEQ ID NO: 1500087 - RNA, 21 nt, Homo sapiens
aagaccacacuugguguuacc

SEQ ID NO: 1500088 - RNA, 17 nt, Homo sapiens
aagaccagccuggccaa

SEQ ID NO: 1500089 - RNA, 24 nt, Homo sapiens
aagaccagucacucccucugccuu

SEQ ID NO: 1500090 - RNA, 22 nt, Homo sapiens
aagaccauaacagccaacaggu

SEQ ID NO: 1500091 - RNA, 23 nt, Homo sapiens
aagaccuggagcggcuauuccag

SEQ ID NO: 1500092 - RNA, 21 nt, Homo sapiens
aagacuaaucgaaugaacaaa

SEQ ID NO: 1500093 - RNA, 14 nt, Homo sapiens
aagacuacaaaaau

SEQ ID NO: 1500094 - RNA, 18 nt, Homo sapiens
aagacuacuauacaaacu

SEQ ID NO: 1500095 - RNA, 14 nt, Homo sapiens
aagacuauggugcu

SEQ ID NO: 1500096 - RNA, 14 nt, Homo sapiens
aagacuccaucuca

SEQ ID NO: 1500097 - RNA, 22 nt, Homo sapiens
aagacucuacccauauuacaga

SEQ ID NO: 1500098 - RNA, 17 nt, Homo sapiens
aaggaaacccccagugu

SEQ ID NO: 1500099 - RNA, 20 nt, Homo sapiens
aaggaaacccccaguguaau

SEQ ID NO: 1500100 - RNA, 15 nt, Homo sapiens
aaggaaacgaugaaa

SEQ ID NO: 1500101 - RNA, 21 nt, Homo sapiens
aaggaaauaguaccuucaaua

SEQ ID NO: 1500102 - RNA, 23 nt, Homo sapiens
aaggaacagagugagagacauca

SEQ ID NO: 1500103 - RNA, 12 nt, Homo sapiens
aaggaaccagaa

SEQ ID NO: 1500104 - RNA, 12 nt, Homo sapiens
aaggaacuucca

SEQ ID NO: 1500105 - RNA, 23 nt, Homo sapiens
aaggaagaaaagcugccauuucc

SEQ ID NO: 1500106 - RNA, 21 nt, Homo sapiens
aaggaagcaaguuuucuucca

SEQ ID NO: 1500107 - RNA, 20 nt, Homo sapiens
aaggacaccuuuuaacucac

SEQ ID NO: 1500108 - RNA, 20 nt, Homo sapiens
aaggacucugcuucagucca

SEQ ID NO: 1500109 - RNA, 20 nt, Homo sapiens
aaggacuuccuguccagcuc

SEQ ID NO: 1500110 - RNA, 15 nt, Homo sapiens
aaggacuuugcagcc

SEQ ID NO: 1500111 - RNA, 18 nt, Homo sapiens
aaggagaggcaacaucca

SEQ ID NO: 1500112 - RNA, 23 nt, Homo sapiens
aaggauauuuaagaaaauacaau

SEQ ID NO: 1500113 - RNA, 18 nt, Homo sapiens
aaggauggagccagcucu

SEQ ID NO: 1500114 - RNA, 19 nt, Homo sapiens
aaggaugucacagggccaa

SEQ ID NO: 1500115 - RNA, 18 nt, Homo sapiens
aaggauuugaaccaugaa

SEQ ID NO: 1500116 - RNA, 19 nt, Homo sapiens
aaggcagauggggcacuga

SEQ ID NO: 1500117 - RNA, 16 nt, Homo sapiens
aaggcagccaccagcg

SEQ ID NO: 1500118 - RNA, 14 nt, Homo sapiens
aaggcagggcccuu

SEQ ID NO: 1500119 - RNA, 15 nt, Homo sapiens
aaggcaguagaacuc

SEQ ID NO: 1500120 - RNA, 20 nt, Homo sapiens
aaggcagugauuagcacuug

SEQ ID NO: 1500121 - RNA, 15 nt, Homo sapiens
aaggcauaucuucua

SEQ ID NO: 1500122 - RNA, 19 nt, Homo sapiens
aaggccacugcuacaucuc

SEQ ID NO: 1500123 - RNA, 18 nt, Homo sapiens
aaggcccauaucugugaa

SEQ ID NO: 1500124 - RNA, 22 nt, Homo sapiens
aaggcucccggaauuccgucac

SEQ ID NO: 1500125 - RNA, 16 nt, Homo sapiens
aaggcugcacagcuca

SEQ ID NO: 1500126 - RNA, 20 nt, Homo sapiens
aaggcugcuuagaauccaaa

SEQ ID NO: 1500127 - RNA, 13 nt, Homo sapiens
aaggcuuggcaca

SEQ ID NO: 1500128 - RNA, 17 nt, Homo sapiens
aaggcuuuaucucaggg

SEQ ID NO: 1500129 - RNA, 15 nt, Homo sapiens
aaggcuuugaguuaa

SEQ ID NO: 1500130 - RNA, 15 nt, Homo sapiens
aagggaaaacccuca

SEQ ID NO: 1500131 - RNA, 15 nt, Homo sapiens
aagggaauugcucag

SEQ ID NO: 1500132 - RNA, 18 nt, Homo sapiens
aagggaauugcucagaga

SEQ ID NO: 1500133 - RNA, 21 nt, Homo sapiens
aagggagaacuugaaacagau

SEQ ID NO: 1500134 - RNA, 16 nt, Homo sapiens
aagggagguggcaaga

SEQ ID NO: 1500135 - RNA, 18 nt, Homo sapiens
aagggauccguacauuca

SEQ ID NO: 1500136 - RNA, 19 nt, Homo sapiens
aagggauggaaaaggaaga

SEQ ID NO: 1500137 - RNA, 21 nt, Homo sapiens
aagggcacgugaagucauuga

SEQ ID NO: 1500138 - RNA, 21 nt, Homo sapiens
aagggcauuaggaguguuuca

SEQ ID NO: 1500139 - RNA, 22 nt, Homo sapiens
aagggcccagauucuaccacac

SEQ ID NO: 1500140 - RNA, 14 nt, Homo sapiens
aagggggaaaaagu

SEQ ID NO: 1500141 - RNA, 21 nt, Homo sapiens
aaggguugggagcugaugaaa

SEQ ID NO: 1500142 - RNA, 13 nt, Homo sapiens
aagguagcccagc

SEQ ID NO: 1500143 - RNA, 17 nt, Homo sapiens
aagguagcccagcacug

SEQ ID NO: 1500144 - RNA, 20 nt, Homo sapiens
aagguccucugucagucaca

SEQ ID NO: 1500145 - RNA, 18 nt, Homo sapiens
aaggucucauucuuccaa

SEQ ID NO: 1500146 - RNA, 19 nt, Homo sapiens
aaggucuccuaaaacuggg

SEQ ID NO: 1500147 - RNA, 19 nt, Homo sapiens
aaggucugugggccaaaga

SEQ ID NO: 1500148 - RNA, 15 nt, Homo sapiens
aaggucuucagccau

SEQ ID NO: 1500149 - RNA, 17 nt, Homo sapiens
aaggugaguuugagcug

SEQ ID NO: 1500150 - RNA, 22 nt, Homo sapiens
aaggugggccuugcuaccucaa

SEQ ID NO: 1500151 - RNA, 22 nt, Homo sapiens
aagguucucagguguugccaaa

SEQ ID NO: 1500152 - RNA, 13 nt, Homo sapiens
aaguaaaagcaag

SEQ ID NO: 1500153 - RNA, 16 nt, Homo sapiens
aaguaaauuaggcagu

SEQ ID NO: 1500154 - RNA, 18 nt, Homo sapiens
aaguaacuucacauuaaa

SEQ ID NO: 1500155 - RNA, 15 nt, Homo sapiens
aaguaaggcaugguu

SEQ ID NO: 1500156 - RNA, 23 nt, Homo sapiens
aaguaauuaucgggaacaguguu

SEQ ID NO: 1500157 - RNA, 23 nt, Homo sapiens
aaguaauuucuuugaucuggaca

SEQ ID NO: 1500158 - RNA, 11 nt, Homo sapiens
aaguacaucuc

SEQ ID NO: 1500159 - RNA, 19 nt, Homo sapiens
aaguacaucucuacuaaaa

SEQ ID NO: 1500160 - RNA, 12 nt, Homo sapiens
aaguagcaauuu

SEQ ID NO: 1500161 - RNA, 20 nt, Homo sapiens
aaguagcaucccaucccaac

SEQ ID NO: 1500162 - RNA, 22 nt, Homo sapiens
aaguagucucuccccuggccac

SEQ ID NO: 1500163 - RNA, 17 nt, Homo sapiens
aaguaugagggaaaaug

SEQ ID NO: 1500164 - RNA, 16 nt, Homo sapiens
aagucaacauaugcaa

SEQ ID NO: 1500165 - RNA, 18 nt, Homo sapiens
aagucacacccacucccu

SEQ ID NO: 1500166 - RNA, 22 nt, Homo sapiens
aagucagcuccagcuuucugcc

SEQ ID NO: 1500167 - RNA, 20 nt, Homo sapiens
aagucaugaagcccaaguga

SEQ ID NO: 1500168 - RNA, 17 nt, Homo sapiens
aagucaugugcauuucc

SEQ ID NO: 1500169 - RNA, 18 nt, Homo sapiens
aagucauuuuaacuuuau

SEQ ID NO: 1500170 - RNA, 15 nt, Homo sapiens
aaguccaguguuucu

SEQ ID NO: 1500171 - RNA, 20 nt, Homo sapiens
aagucccugucauuugaacc

SEQ ID NO: 1500172 - RNA, 21 nt, Homo sapiens
aaguccuuggacuguuuugaa

SEQ ID NO: 1500173 - RNA, 16 nt, Homo sapiens
aaguccuuugugaaua

SEQ ID NO: 1500174 - RNA, 21 nt, Homo sapiens
aagucuaaacaaaauugcaau

SEQ ID NO: 1500175 - RNA, 14 nt, Homo sapiens
aagucuccaugaag

SEQ ID NO: 1500176 - RNA, 16 nt, Homo sapiens
aagucugacucuccac

SEQ ID NO: 1500177 - RNA, 17 nt, Homo sapiens
aagucuugcucugccac

SEQ ID NO: 1500178 - RNA, 13 nt, Homo sapiens
aagugaacuauga

SEQ ID NO: 1500179 - RNA, 13 nt, Homo sapiens
aagugacacagca

SEQ ID NO: 1500180 - RNA, 13 nt, Homo sapiens
aagugacuauuca

SEQ ID NO: 1500181 - RNA, 14 nt, Homo sapiens
aagugacucucaca

SEQ ID NO: 1500182 - RNA, 18 nt, Homo sapiens
aagugacucucacaagau

SEQ ID NO: 1500183 - RNA, 19 nt, Homo sapiens
aagugagacuccgucacaa

SEQ ID NO: 1500184 - RNA, 23 nt, Homo sapiens
aagugaggugugucacaaugaga

SEQ ID NO: 1500185 - RNA, 17 nt, Homo sapiens
aagugauacuauccagu

SEQ ID NO: 1500186 - RNA, 23 nt, Homo sapiens
aagugauagaaaaguguggcuug

SEQ ID NO: 1500187 - RNA, 17 nt, Homo sapiens
aagugcauauuuaucca

SEQ ID NO: 1500188 - RNA, 16 nt, Homo sapiens
aagugcauccaaaggu

SEQ ID NO: 1500189 - RNA, 17 nt, Homo sapiens
aagugccaaaugcucuc

SEQ ID NO: 1500190 - RNA, 18 nt, Homo sapiens
aagugccugacacacuaa

SEQ ID NO: 1500191 - RNA, 16 nt, Homo sapiens
aagugccuuacagggu

SEQ ID NO: 1500192 - RNA, 21 nt, Homo sapiens
aagugcugcuauaucuaucca

SEQ ID NO: 1500193 - RNA, 22 nt, Homo sapiens
aagugcugggauuacaggugug

SEQ ID NO: 1500194 - RNA, 17 nt, Homo sapiens
aagugggaucugucaca

SEQ ID NO: 1500195 - RNA, 16 nt, Homo sapiens
aaguggugaaugacac

SEQ ID NO: 1500196 - RNA, 18 nt, Homo sapiens
aagugugaccccacugcc

SEQ ID NO: 1500197 - RNA, 18 nt, Homo sapiens
aaguguguaugauaauga

SEQ ID NO: 1500198 - RNA, 13 nt, Homo sapiens
aagugugucuucc

SEQ ID NO: 1500199 - RNA, 19 nt, Homo sapiens
aaguguuuacuaugugcca

SEQ ID NO: 1500200 - RNA, 16 nt, Homo sapiens
agcugggagcacuggu

SEQ ID NO: 1500201 - RNA, 17 nt, Homo sapiens
agcugggagcacuggug

SEQ ID NO: 1500202 - RNA, 23 nt, Homo sapiens
agcugggggguuggcagcccacu

SEQ ID NO: 1500203 - RNA, 17 nt, Homo sapiens
agcuggguguguuggca

SEQ ID NO: 1500204 - RNA, 21 nt, Homo sapiens
agcugguaggauguaagccug

SEQ ID NO: 1500205 - RNA, 16 nt, Homo sapiens
agcugguggcaauaaa

SEQ ID NO: 1500206 - RNA, 18 nt, Homo sapiens
agcugucaggcugauuau

SEQ ID NO: 1500207 - RNA, 17 nt, Homo sapiens
agcugucccaccugcac

SEQ ID NO: 1500208 - RNA, 23 nt, Homo sapiens
agcuguccugcagcaaacacucc

SEQ ID NO: 1500209 - RNA, 22 nt, Homo sapiens
agcugucuuagagugggaccaa

SEQ ID NO: 1500210 - RNA, 15 nt, Homo sapiens
agcugugaacaggcu

SEQ ID NO: 1500211 - RNA, 19 nt, Homo sapiens
agcugugacuucuccaggu

SEQ ID NO: 1500212 - RNA, 11 nt, Homo sapiens
agcugugauuu

SEQ ID NO: 1500213 - RNA, 18 nt, Homo sapiens
agcugugcagcacgucuc

SEQ ID NO: 1500214 - RNA, 14 nt, Homo sapiens
agcuguugcagaug

SEQ ID NO: 1500215 - RNA, 22 nt, Homo sapiens
agcuguuguacauuuaugauuu

SEQ ID NO: 1500216 - RNA, 18 nt, Homo sapiens
agcuguuuauggccucag

SEQ ID NO: 1500217 - RNA, 15 nt, Homo sapiens
agcuguuucucauga

SEQ ID NO: 1500218 - RNA, 17 nt, Homo sapiens
agcuuaaaaucugugaa

SEQ ID NO: 1500219 - RNA, 16 nt, Homo sapiens
agcuuacuagcacuuu

SEQ ID NO: 1500220 - RNA, 17 nt, Homo sapiens
agcuucaccagagcauu

SEQ ID NO: 1500221 - RNA, 21 nt, Homo sapiens
agcuucauauaccagcaauau

SEQ ID NO: 1500222 - RNA, 12 nt, Homo sapiens
agcuucaugccu

SEQ ID NO: 1500223 - RNA, 13 nt, Homo sapiens
agcuuccucggua

SEQ ID NO: 1500224 - RNA, 16 nt, Homo sapiens
agcuucuaucccagga

SEQ ID NO: 1500225 - RNA, 19 nt, Homo sapiens
agcuucugcuuuucugccc

SEQ ID NO: 1500226 - RNA, 18 nt, Homo sapiens
agcuucuugcugaucaga

SEQ ID NO: 1500227 - RNA, 20 nt, Homo sapiens
agcuugaagaggggguuaga

SEQ ID NO: 1500228 - RNA, 20 nt, Homo sapiens
agcuugaguuuuuaguggaa

SEQ ID NO: 1500229 - RNA, 12 nt, Homo sapiens
agcuugcacaug

SEQ ID NO: 1500230 - RNA, 21 nt, Homo sapiens
agcuuggaggucacagcugga

SEQ ID NO: 1500231 - RNA, 18 nt, Homo sapiens
agcuuggccuacagucau

SEQ ID NO: 1500232 - RNA, 18 nt, Homo sapiens
agcuuuacaaauauguca

SEQ ID NO: 1500233 - RNA, 20 nt, Homo sapiens
agcuuuauuaccaguggcgu

SEQ ID NO: 1500234 - RNA, 12 nt, Homo sapiens
agcuuucuugcu

SEQ ID NO: 1500235 - RNA, 19 nt, Homo sapiens
agcuuugccagcugcugcu

SEQ ID NO: 1500236 - RNA, 21 nt, Homo sapiens
agcuuuguguuugguuuacau

SEQ ID NO: 1500237 - RNA, 18 nt, Homo sapiens
agcuuuuccucaccagga

SEQ ID NO: 1500238 - RNA, 20 nt, Homo sapiens
agcuuuugaggggcugacuu

SEQ ID NO: 1500239 - RNA, 15 nt, Homo sapiens
agcuuuugccaguau

SEQ ID NO: 1500240 - RNA, 18 nt, Homo sapiens
agcuuuuggagggugaua

SEQ ID NO: 1500241 - RNA, 19 nt, Homo sapiens
aggaaaaacacaagcaaaa

SEQ ID NO: 1500242 - RNA, 15 nt, Homo sapiens
aggaaaaauaaucaa

SEQ ID NO: 1500243 - RNA, 15 nt, Homo sapiens
aggaaaacgugcuuu

SEQ ID NO: 1500244 - RNA, 16 nt, Homo sapiens
aggaaaaugauacgca

SEQ ID NO: 1500245 - RNA, 17 nt, Homo sapiens
aggaaacucacacuccc

SEQ ID NO: 1500246 - RNA, 20 nt, Homo sapiens
aggaaacuccacaucugccu

SEQ ID NO: 1500247 - RNA, 16 nt, Homo sapiens
aggaaagcagcauucu

SEQ ID NO: 1500248 - RNA, 19 nt, Homo sapiens
aggaaaguuuacccaugaa

SEQ ID NO: 1500249 - RNA, 18 nt, Homo sapiens
aggaaauauauaugugug

SEQ ID NO: 1500250 - RNA, 13 nt, Homo sapiens
aggaacacugcac

SEQ ID NO: 1500251 - RNA, 17 nt, Homo sapiens
aggaaccaggaggacaa

SEQ ID NO: 1500252 - RNA, 16 nt, Homo sapiens
aggaaccccaggagau

SEQ ID NO: 1500253 - RNA, 13 nt, Homo sapiens
aggaaccuuccuu

SEQ ID NO: 1500254 - RNA, 23 nt, Homo sapiens
aggaacucuuuccuguaucauaa

SEQ ID NO: 1500255 - RNA, 15 nt, Homo sapiens
aggaagaaugaaacu

SEQ ID NO: 1500256 - RNA, 18 nt, Homo sapiens
aggaagcaccccaugcca

SEQ ID NO: 1500257 - RNA, 17 nt, Homo sapiens
aggaagccagcuggcuu

SEQ ID NO: 1500258 - RNA, 19 nt, Homo sapiens
aggaagccaggcugaguga

SEQ ID NO: 1500259 - RNA, 22 nt, Homo sapiens
aggaagcuuggggaacccauga

SEQ ID NO: 1500260 - RNA, 15 nt, Homo sapiens
aggaaggaacagcaa

SEQ ID NO: 1500261 - RNA, 23 nt, Homo sapiens
aggaagguagcccagcacuguga

SEQ ID NO: 1500262 - RNA, 17 nt, Homo sapiens
aggaaggucucauucuu

SEQ ID NO: 1500263 - RNA, 20 nt, Homo sapiens
aggaaguuuucuguagucau

SEQ ID NO: 1500264 - RNA, 19 nt, Homo sapiens
aggaauaacaucaccacug

SEQ ID NO: 1500265 - RNA, 20 nt, Homo sapiens
aggaauaacaucaccacugu

SEQ ID NO: 1500266 - RNA, 14 nt, Homo sapiens
aggaauacauuugg

SEQ ID NO: 1500267 - RNA, 13 nt, Homo sapiens
aggaauccuggac

SEQ ID NO: 1500268 - RNA, 23 nt, Homo sapiens
aggaauccuggaccaagcacaaa

SEQ ID NO: 1500269 - RNA, 18 nt, Homo sapiens
aggaaucugugcagauga

SEQ ID NO: 1500270 - RNA, 17 nt, Homo sapiens
aggaaugugaaagcacg

SEQ ID NO: 1500271 - RNA, 22 nt, Homo sapiens
aggaauuaugucguaagucacu

SEQ ID NO: 1500272 - RNA, 20 nt, Homo sapiens
aggaauuggccgcugucacu

SEQ ID NO: 1500273 - RNA, 16 nt, Homo sapiens
aggaauuugcauuuag

SEQ ID NO: 1500274 - RNA, 18 nt, Homo sapiens
aggacaagaggagcauga

SEQ ID NO: 1500275 - RNA, 16 nt, Homo sapiens
aggacaauacuggggu

SEQ ID NO: 1500276 - RNA, 18 nt, Homo sapiens
aggacaccuuuuaacuca

SEQ ID NO: 1500277 - RNA, 16 nt, Homo sapiens
aggacaggaggcggcc

SEQ ID NO: 1500278 - RNA, 23 nt, Homo sapiens
aggacaucucugcccucuucuca

SEQ ID NO: 1500279 - RNA, 13 nt, Homo sapiens
aggaccacuccug

SEQ ID NO: 1500280 - RNA, 22 nt, Homo sapiens
aggacccugaaggggccaugau

SEQ ID NO: 1500281 - RNA, 22 nt, Homo sapiens
aggaccuacuguucggacaaaa

SEQ ID NO: 1500282 - RNA, 16 nt, Homo sapiens
aggaccuggcugccau

SEQ ID NO: 1500283 - RNA, 23 nt, Homo sapiens
aggacggugcaacccaaggacug

SEQ ID NO: 1500284 - RNA, 19 nt, Homo sapiens
aggacucccuccucaccuc

SEQ ID NO: 1500285 - RNA, 15 nt, Homo sapiens
aggacucugcuucag

SEQ ID NO: 1500286 - RNA, 13 nt, Homo sapiens
aggacucuuccac

SEQ ID NO: 1500287 - RNA, 18 nt, Homo sapiens
aggacugaccucuuccuc

SEQ ID NO: 1500288 - RNA, 14 nt, Homo sapiens
aggacuguaaucuu

SEQ ID NO: 1500289 - RNA, 20 nt, Homo sapiens
aggacuuaacggcuccagga

SEQ ID NO: 1500290 - RNA, 17 nt, Homo sapiens
aggacuucugcagcuau

SEQ ID NO: 1500291 - RNA, 13 nt, Homo sapiens
aggagaaacacau

SEQ ID NO: 1500292 - RNA, 15 nt, Homo sapiens
aggagaaacacaucu

SEQ ID NO: 1500293 - RNA, 20 nt, Homo sapiens
aggagaaacucccauguaug

SEQ ID NO: 1500294 - RNA, 21 nt, Homo sapiens
aggagaaggacauuuuacugc

SEQ ID NO: 1500295 - RNA, 16 nt, Homo sapiens
aggagaaucacuggaa

SEQ ID NO: 1500296 - RNA, 23 nt, Homo sapiens
aggagaaucacuggaaccuggga

SEQ ID NO: 1500297 - RNA, 18 nt, Homo sapiens
aggagaaugaaauguaug

SEQ ID NO: 1500298 - RNA, 22 nt, Homo sapiens
aggagaaugaaauguaugugcu

SEQ ID NO: 1500299 - RNA, 16 nt, Homo sapiens
aggagacagaccacuu

SEQ ID NO: 1500300 - RNA, 16 nt, Homo sapiens
aggagacgacaggcga

SEQ ID NO: 1500301 - RNA, 23 nt, Homo sapiens
aggagacuuucaugcagccuaaa

SEQ ID NO: 1500302 - RNA, 13 nt, Homo sapiens
aggcuuccuucug

SEQ ID NO: 1500303 - RNA, 15 nt, Homo sapiens
aggcuuuacagugua

SEQ ID NO: 1500304 - RNA, 14 nt, Homo sapiens
aggcuuucaagaag

SEQ ID NO: 1500305 - RNA, 21 nt, Homo sapiens
aggcuuuguacagagugcuuu

SEQ ID NO: 1500306 - RNA, 22 nt, Homo sapiens
agggaaaaggaguagggaguuc

SEQ ID NO: 1500307 - RNA, 22 nt, Homo sapiens
agggaaaauguuuaccagugua

SEQ ID NO: 1500308 - RNA, 21 nt, Homo sapiens
agggaaccugguacauccagu

SEQ ID NO: 1500309 - RNA, 15 nt, Homo sapiens
agggaagcucagggg

SEQ ID NO: 1500310 - RNA, 19 nt, Homo sapiens
agggaagcuggccgagggu

SEQ ID NO: 1500311 - RNA, 19 nt, Homo sapiens
agggaaguaguccuuggca

SEQ ID NO: 1500312 - RNA, 13 nt, Homo sapiens
agggaaugcucag

SEQ ID NO: 1500313 - RNA, 22 nt, Homo sapiens
agggacagcaugccccuuggcu

SEQ ID NO: 1500314 - RNA, 21 nt, Homo sapiens
agggaccacacccuguacugu

SEQ ID NO: 1500315 - RNA, 14 nt, Homo sapiens
agggacccaugagu

SEQ ID NO: 1500316 - RNA, 23 nt, Homo sapiens
agggacggggaagccgagcucca

SEQ ID NO: 1500317 - RNA, 19 nt, Homo sapiens
agggacuccaugcugccag

SEQ ID NO: 1500318 - RNA, 16 nt, Homo sapiens
agggacucccacaaca

SEQ ID NO: 1500319 - RNA, 22 nt, Homo sapiens
agggacuuggacaggagucagu

SEQ ID NO: 1500320 - RNA, 16 nt, Homo sapiens
agggacuuugcugauu

SEQ ID NO: 1500321 - RNA, 21 nt, Homo sapiens
agggagacccccaucuuuaca

SEQ ID NO: 1500322 - RNA, 14 nt, Homo sapiens
agggagcugaguaa

SEQ ID NO: 1500323 - RNA, 16 nt, Homo sapiens
agggagcuggaacccg

SEQ ID NO: 1500324 - RNA, 23 nt, Homo sapiens
agggaggccacacgcacuggugc

SEQ ID NO: 1500325 - RNA, 12 nt, Homo sapiens
agggaucacugg

SEQ ID NO: 1500326 - RNA, 14 nt, Homo sapiens
agggaucacuggcu

SEQ ID NO: 1500327 - RNA, 19 nt, Homo sapiens
agggaucuugcauucccag

SEQ ID NO: 1500328 - RNA, 21 nt, Homo sapiens
agggaugugagguucugcuga

SEQ ID NO: 1500329 - RNA, 18 nt, Homo sapiens
agggaugugugagaauaa

SEQ ID NO: 1500330 - RNA, 16 nt, Homo sapiens
agggcacagcccuccg

SEQ ID NO: 1500331 - RNA, 13 nt, Homo sapiens
agggcaccagagg

SEQ ID NO: 1500332 - RNA, 14 nt, Homo sapiens
agggcacugggcug

SEQ ID NO: 1500333 - RNA, 19 nt, Homo sapiens
agggcagaccacauugcuu

SEQ ID NO: 1500334 - RNA, 17 nt, Homo sapiens
agggcauggccaggugg

SEQ ID NO: 1500335 - RNA, 20 nt, Homo sapiens
agggcauucgggccacaggg

SEQ ID NO: 1500336 - RNA, 10 nt, Homo sapiens
agggccaguc

SEQ ID NO: 1500337 - RNA, 14 nt, Homo sapiens
agggcccuaccuga

SEQ ID NO: 1500338 - RNA, 21 nt, Homo sapiens
agggccuggcaggccaguguc

SEQ ID NO: 1500339 - RNA, 15 nt, Homo sapiens
agggcugaaagccau

SEQ ID NO: 1500340 - RNA, 18 nt, Homo sapiens
agggcugauggaggaaaa

SEQ ID NO: 1500341 - RNA, 20 nt, Homo sapiens
agggcuggcucugcacuaag

SEQ ID NO: 1500342 - RNA, 15 nt, Homo sapiens
agggcuggggacaga

SEQ ID NO: 1500343 - RNA, 19 nt, Homo sapiens
aggggaacagaccagugac

SEQ ID NO: 1500344 - RNA, 16 nt, Homo sapiens
aggggaaccccggggu

SEQ ID NO: 1500345 - RNA, 22 nt, Homo sapiens
aggggaagggccagucugggcu

SEQ ID NO: 1500346 - RNA, 16 nt, Homo sapiens
aggggacuugaaucuu

SEQ ID NO: 1500347 - RNA, 14 nt, Homo sapiens
aggggcaacgaaga

SEQ ID NO: 1500348 - RNA, 13 nt, Homo sapiens
aggggcacuggug

SEQ ID NO: 1500349 - RNA, 22 nt, Homo sapiens
aggggcccaaauucuuucagug

SEQ ID NO: 1500350 - RNA, 18 nt, Homo sapiens
aggggcccuggccaggac

SEQ ID NO: 1500351 - RNA, 18 nt, Homo sapiens
agggggucauuguucucc

SEQ ID NO: 1500352 - RNA, 20 nt, Homo sapiens
aggggguuacaaacugcaau

SEQ ID NO: 1500353 - RNA, 15 nt, Homo sapiens
agggguauguucccu

SEQ ID NO: 1500354 - RNA, 17 nt, Homo sapiens
aggggucucauguccug

SEQ ID NO: 1500355 - RNA, 14 nt, Homo sapiens
aggggugugcugag

SEQ ID NO: 1500356 - RNA, 23 nt, Homo sapiens
aggguaaauaaaccacugugcgu

SEQ ID NO: 1500357 - RNA, 18 nt, Homo sapiens
aggguaacuuaacagagu

SEQ ID NO: 1500358 - RNA, 18 nt, Homo sapiens
agggugacugaugauaca

SEQ ID NO: 1500359 - RNA, 16 nt, Homo sapiens
agggugaguccuccag

SEQ ID NO: 1500360 - RNA, 16 nt, Homo sapiens
aggguggcagaacuug

SEQ ID NO: 1500361 - RNA, 18 nt, Homo sapiens
aggguggcccuugcaguu

SEQ ID NO: 1500362 - RNA, 16 nt, Homo sapiens
agggugggcagccuau

SEQ ID NO: 1500363 - RNA, 17 nt, Homo sapiens
aggguggucuugaucuc

SEQ ID NO: 1500364 - RNA, 12 nt, Homo sapiens
aggguuggcacc

SEQ ID NO: 1500365 - RNA, 15 nt, Homo sapiens
aggguuuugacacuu

SEQ ID NO: 1500366 - RNA, 14 nt, Homo sapiens
agguaaugugaaua

SEQ ID NO: 1500367 - RNA, 21 nt, Homo sapiens
agguaccagcugcgcuugcuu

SEQ ID NO: 1500368 - RNA, 20 nt, Homo sapiens
agguagaccaggauuucuaa

SEQ ID NO: 1500369 - RNA, 17 nt, Homo sapiens
agguagcccagcacugu

SEQ ID NO: 1500370 - RNA, 19 nt, Homo sapiens
agguagcccagcacuguga

SEQ ID NO: 1500371 - RNA, 18 nt, Homo sapiens
agguagcuuuagggcaau

SEQ ID NO: 1500372 - RNA, 19 nt, Homo sapiens
agguaggggcccacuucac

SEQ ID NO: 1500373 - RNA, 21 nt, Homo sapiens
agguauaccuguugagacuga

SEQ ID NO: 1500374 - RNA, 19 nt, Homo sapiens
agguaucuguuuaacauuu

SEQ ID NO: 1500375 - RNA, 20 nt, Homo sapiens
agguauuucuccaguuggga

SEQ ID NO: 1500376 - RNA, 16 nt, Homo sapiens
aggucaaggcugcagu

SEQ ID NO: 1500377 - RNA, 18 nt, Homo sapiens
aggucacauugugccuuu

SEQ ID NO: 1500378 - RNA, 20 nt, Homo sapiens
aggucacuuuaccucugugg

SEQ ID NO: 1500379 - RNA, 21 nt, Homo sapiens
aggucagagcagagguggaaa

SEQ ID NO: 1500380 - RNA, 22 nt, Homo sapiens
aggucagauggagguucucaga

SEQ ID NO: 1500381 - RNA, 13 nt, Homo sapiens
aggucaggacggc

SEQ ID NO: 1500382 - RNA, 15 nt, Homo sapiens
aggucaggaguucga

SEQ ID NO: 1500383 - RNA, 17 nt, Homo sapiens
aggucauuaaaauuaca

SEQ ID NO: 1500384 - RNA, 12 nt, Homo sapiens
agguccacagag

SEQ ID NO: 1500385 - RNA, 19 nt, Homo sapiens
agguccccuccacauccca

SEQ ID NO: 1500386 - RNA, 22 nt, Homo sapiens
aggucccgaaaggggcacuggu

SEQ ID NO: 1500387 - RNA, 23 nt, Homo sapiens
agguccucuacuuaaugagauag

SEQ ID NO: 1500388 - RNA, 19 nt, Homo sapiens
agguccucugucagucaca

SEQ ID NO: 1500389 - RNA, 19 nt, Homo sapiens
agguccuuuccacccugag

SEQ ID NO: 1500390 - RNA, 21 nt, Homo sapiens
aggucucacgggcaugggcac

SEQ ID NO: 1500391 - RNA, 11 nt, Homo sapiens
aggucuugacu

SEQ ID NO: 1500392 - RNA, 19 nt, Homo sapiens
aggugaguuugagcugccu

SEQ ID NO: 1500393 - RNA, 19 nt, Homo sapiens
aggugauccgccuaccuca

SEQ ID NO: 1500394 - RNA, 22 nt, Homo sapiens
aggugcaugcaugcccucucug

SEQ ID NO: 1500395 - RNA, 17 nt, Homo sapiens
aggugcccagaauuuac

SEQ ID NO: 1500396 - RNA, 20 nt, Homo sapiens
aggugcguaguccaacucuu

SEQ ID NO: 1500397 - RNA, 23 nt, Homo sapiens
aggugcucauuguaaccauuucu

SEQ ID NO: 1500398 - RNA, 19 nt, Homo sapiens
aggugcuucugccugugca

SEQ ID NO: 1500399 - RNA, 11 nt, Homo sapiens
agguggcaagc

SEQ ID NO: 1500400 - RNA, 15 nt, Homo sapiens
agguggccacuccag

SEQ ID NO: 1500401 - RNA, 14 nt, Homo sapiens
aggugggugcugcc

SEQ ID NO: 1500402 - RNA, 20 nt, Homo sapiens
aggugguaagcaccaggacg

SEQ ID NO: 1500403 - RNA, 15 nt, Homo sapiens
agguggugaggcaau

SEQ ID NO: 1500404 - RNA, 19 nt, Homo sapiens
aguccuugggguuaagucu

SEQ ID NO: 1500405 - RNA, 23 nt, Homo sapiens
agucggauacccuggagcaagac

SEQ ID NO: 1500406 - RNA, 18 nt, Homo sapiens
agucucaaaaauacaaaa

SEQ ID NO: 1500407 - RNA, 15 nt, Homo sapiens
agucucccacuaaaa

SEQ ID NO: 1500408 - RNA, 17 nt, Homo sapiens
agucuccuuugcacuga

SEQ ID NO: 1500409 - RNA, 22 nt, Homo sapiens
agucucuuuaaucuucaguuuu

SEQ ID NO: 1500410 - RNA, 24 nt, Homo sapiens
agucuggcagacuuucuucucuau

SEQ ID NO: 1500411 - RNA, 15 nt, Homo sapiens
agucuggugcuccag

SEQ ID NO: 1500412 - RNA, 16 nt, Homo sapiens
agucuguacuucauca

SEQ ID NO: 1500413 - RNA, 20 nt, Homo sapiens
agucuucagcagagaaguuu

SEQ ID NO: 1500414 - RNA, 13 nt, Homo sapiens
agucuuccaugac

SEQ ID NO: 1500415 - RNA, 21 nt, Homo sapiens
agucuucucauagcauuaacu

SEQ ID NO: 1500416 - RNA, 13 nt, Homo sapiens
agucuucuguaua

SEQ ID NO: 1500417 - RNA, 19 nt, Homo sapiens
agucuugucauugccagcu

SEQ ID NO: 1500418 - RNA, 13 nt, Homo sapiens
agugaaaccauga

SEQ ID NO: 1500419 - RNA, 16 nt, Homo sapiens
agugaaagccagauuc

SEQ ID NO: 1500420 - RNA, 20 nt, Homo sapiens
agugaagaacacuacugcua

SEQ ID NO: 1500421 - RNA, 22 nt, Homo sapiens
agugaagaccagagcaguuuca

SEQ ID NO: 1500422 - RNA, 18 nt, Homo sapiens
agugaaggcaagugcaau

SEQ ID NO: 1500423 - RNA, 18 nt, Homo sapiens
agugaauaaccacuuaaa

SEQ ID NO: 1500424 - RNA, 17 nt, Homo sapiens
agugaauuucacacugu

SEQ ID NO: 1500425 - RNA, 17 nt, Homo sapiens
agugacaaggcccugag

SEQ ID NO: 1500426 - RNA, 18 nt, Homo sapiens
agugacagcagucaggga

SEQ ID NO: 1500427 - RNA, 12 nt, Homo sapiens
agugacauguag

SEQ ID NO: 1500428 - RNA, 16 nt, Homo sapiens
agugaccccugaccuc

SEQ ID NO: 1500429 - RNA, 20 nt, Homo sapiens
agugaccccugaccucacug

SEQ ID NO: 1500430 - RNA, 21 nt, Homo sapiens
agugaccgaaagguuauguua

SEQ ID NO: 1500431 - RNA, 22 nt, Homo sapiens
agugacuguuuggcuuauaaac

SEQ ID NO: 1500432 - RNA, 22 nt, Homo sapiens
agugacuugugucccaugaucc

SEQ ID NO: 1500433 - RNA, 17 nt, Homo sapiens
agugagaaaaagcuccu

SEQ ID NO: 1500434 - RNA, 18 nt, Homo sapiens
agugagaaaaugccucaa

SEQ ID NO: 1500435 - RNA, 22 nt, Homo sapiens
agugagcacucacgcccuaagc

SEQ ID NO: 1500436 - RNA, 21 nt, Homo sapiens
agugauaucccccagccucaa

SEQ ID NO: 1500437 - RNA, 17 nt, Homo sapiens
agugauugacacacagc

SEQ ID NO: 1500438 - RNA, 13 nt, Homo sapiens
agugcaacccagu

SEQ ID NO: 1500439 - RNA, 18 nt, Homo sapiens
agugcaauaaaucugacc

SEQ ID NO: 1500440 - RNA, 15 nt, Homo sapiens
agugcacagcugucc

SEQ ID NO: 1500441 - RNA, 19 nt, Homo sapiens
agugcacuuuaagaggugg

SEQ ID NO: 1500442 - RNA, 19 nt, Homo sapiens
agugcagccuucuccauau

SEQ ID NO: 1500443 - RNA, 20 nt, Homo sapiens
agugcaguggcgugaucucg

SEQ ID NO: 1500444 - RNA, 20 nt, Homo sapiens
agugcaguggugugaucuca

SEQ ID NO: 1500445 - RNA, 13 nt, Homo sapiens
agugcauccaaag

SEQ ID NO: 1500446 - RNA, 16 nt, Homo sapiens
agugccaacuccucac

SEQ ID NO: 1500447 - RNA, 12 nt, Homo sapiens
agugccauucca

SEQ ID NO: 1500448 - RNA, 13 nt, Homo sapiens
agugccauuccac

SEQ ID NO: 1500449 - RNA, 14 nt, Homo sapiens
agugccggcugugg

SEQ ID NO: 1500450 - RNA, 20 nt, Homo sapiens
agugccguagggaguaccug

SEQ ID NO: 1500451 - RNA, 14 nt, Homo sapiens
agugccuuuaguuu

SEQ ID NO: 1500452 - RNA, 14 nt, Homo sapiens
agugcggcugccau

SEQ ID NO: 1500453 - RNA, 14 nt, Homo sapiens
agugcuaguauuau

SEQ ID NO: 1500454 - RNA, 15 nt, Homo sapiens
agugcuauugcagag

SEQ ID NO: 1500455 - RNA, 19 nt, Homo sapiens
agugcugaaggaauggaag

SEQ ID NO: 1500456 - RNA, 19 nt, Homo sapiens
agugcugggauuacaggug

SEQ ID NO: 1500457 - RNA, 20 nt, Homo sapiens
agugcugggauuacaggugu

SEQ ID NO: 1500458 - RNA, 11 nt, Homo sapiens
agugcugugcu

SEQ ID NO: 1500459 - RNA, 17 nt, Homo sapiens
agugcuuaguguacuug

SEQ ID NO: 1500460 - RNA, 23 nt, Homo sapiens
aguggaaggucuauuggccaaca

SEQ ID NO: 1500461 - RNA, 22 nt, Homo sapiens
aguggacucagcagugaccaca

SEQ ID NO: 1500462 - RNA, 14 nt, Homo sapiens
aguggagacagacu

SEQ ID NO: 1500463 - RNA, 22 nt, Homo sapiens
aguggagagaagcucuucaaua

SEQ ID NO: 1500464 - RNA, 15 nt, Homo sapiens
aguggaggcacuuua

SEQ ID NO: 1500465 - RNA, 22 nt, Homo sapiens
aguggagugagagcaauuguaa

SEQ ID NO: 1500466 - RNA, 19 nt, Homo sapiens
aguggccagccagugccau

SEQ ID NO: 1500467 - RNA, 15 nt, Homo sapiens
aguggcgugaucucg

SEQ ID NO: 1500468 - RNA, 20 nt, Homo sapiens
aguggcuaccuacauacaau

SEQ ID NO: 1500469 - RNA, 14 nt, Homo sapiens
aguggcuucaucug

SEQ ID NO: 1500470 - RNA, 16 nt, Homo sapiens
agugggagccaaugaa

SEQ ID NO: 1500471 - RNA, 21 nt, Homo sapiens
agugggcaucagcagcagggu

SEQ ID NO: 1500472 - RNA, 12 nt, Homo sapiens
aguggggugcug

SEQ ID NO: 1500473 - RNA, 19 nt, Homo sapiens
aguggguaauccaggcaca

SEQ ID NO: 1500474 - RNA, 16 nt, Homo sapiens
agugggugguggaucu

SEQ ID NO: 1500475 - RNA, 17 nt, Homo sapiens
aguggucgagugacaca

SEQ ID NO: 1500476 - RNA, 17 nt, Homo sapiens
aguggucuuuguaagag

SEQ ID NO: 1500477 - RNA, 14 nt, Homo sapiens
aguggugccugcau

SEQ ID NO: 1500478 - RNA, 15 nt, Homo sapiens
aguggugugaucucg

SEQ ID NO: 1500479 - RNA, 22 nt, Homo sapiens
agugguucuauguccauucuca

SEQ ID NO: 1500480 - RNA, 15 nt, Homo sapiens
aguguaaguucacaa

SEQ ID NO: 1500481 - RNA, 18 nt, Homo sapiens
aguguacauaguguaaug

SEQ ID NO: 1500482 - RNA, 15 nt, Homo sapiens
aguguaccauuugcc

SEQ ID NO: 1500483 - RNA, 16 nt, Homo sapiens
aguguagaagcauucc

SEQ ID NO: 1500484 - RNA, 21 nt, Homo sapiens
agugucacuuaccuagauuua

SEQ ID NO: 1500485 - RNA, 14 nt, Homo sapiens
aguguccucuugcu

SEQ ID NO: 1500486 - RNA, 21 nt, Homo sapiens
agugucucugccuugagucau

SEQ ID NO: 1500487 - RNA, 16 nt, Homo sapiens
agugucugugccaugg

SEQ ID NO: 1500488 - RNA, 14 nt, Homo sapiens
agugugacagggcc

SEQ ID NO: 1500489 - RNA, 14 nt, Homo sapiens
agugugaccacuga

SEQ ID NO: 1500490 - RNA, 18 nt, Homo sapiens
agugugaccccacugcca

SEQ ID NO: 1500491 - RNA, 19 nt, Homo sapiens
agugugauauacaaagugu

SEQ ID NO: 1500492 - RNA, 19 nt, Homo sapiens
agugugccccucuguaaca

SEQ ID NO: 1500493 - RNA, 22 nt, Homo sapiens
aguguggcccagggaagccaaa

SEQ ID NO: 1500494 - RNA, 17 nt, Homo sapiens
agugugggcuugaccag

SEQ ID NO: 1500495 - RNA, 20 nt, Homo sapiens
aguguggggauuuucacuga

SEQ ID NO: 1500496 - RNA, 23 nt, Homo sapiens
agugugggggaggcgcacagugu

SEQ ID NO: 1500497 - RNA, 18 nt, Homo sapiens
agugugugacauuccagg

SEQ ID NO: 1500498 - RNA, 20 nt, Homo sapiens
aguguuauuugcacacugca

SEQ ID NO: 1500499 - RNA, 15 nt, Homo sapiens
aguguucugcuccug

SEQ ID NO: 1500500 - RNA, 12 nt, Homo sapiens
aguguugcccag

SEQ ID NO: 1500501 - RNA, 18 nt, Homo sapiens
aguguuguggacacugca

SEQ ID NO: 1500502 - RNA, 22 nt, Homo sapiens
aguguuuacaaggugacaaaug

SEQ ID NO: 1500503 - RNA, 21 nt, Homo sapiens
aguguuucuaauaaacuugga

SEQ ID NO: 1500504 - RNA, 18 nt, Homo sapiens
aguguuucuuccacaaca

SEQ ID NO: 1500505 - RNA, 16 nt, Homo sapiens
aguguuugcaauggug

SEQ ID NO: 1500506 - RNA, 22 nt, Homo sapiens
aguguuuuagagagagaacuuu

SEQ ID NO: 1500507 - RNA, 20 nt, Homo sapiens
aguguuuuuuagauacagag

SEQ ID NO: 1500508 - RNA, 15 nt, Homo sapiens
aguguuuuuuauuca

SEQ ID NO: 1500509 - RNA, 20 nt, Homo sapiens
aguuaaagugaauaaccacu

SEQ ID NO: 1500510 - RNA, 20 nt, Homo sapiens
aguuaaccccauguccucag

SEQ ID NO: 1500511 - RNA, 20 nt, Homo sapiens
aguuaagaaugucgauuaaa

SEQ ID NO: 1500512 - RNA, 19 nt, Homo sapiens
aguuaaugauuuuacuuaa

SEQ ID NO: 1500513 - RNA, 13 nt, Homo sapiens
aguuaauucaccu

SEQ ID NO: 1500514 - RNA, 14 nt, Homo sapiens
aguuaauucaccua

SEQ ID NO: 1500515 - RNA, 13 nt, Homo sapiens
aguuacaaaaacc

SEQ ID NO: 1500516 - RNA, 13 nt, Homo sapiens
aguuacacuaaaa

SEQ ID NO: 1500517 - RNA, 17 nt, Homo sapiens
aguuacugccgguuuga

SEQ ID NO: 1500518 - RNA, 11 nt, Homo sapiens
aguuacuugaa

SEQ ID NO: 1500519 - RNA, 22 nt, Homo sapiens
aguuagguagcuuuagggcaau

SEQ ID NO: 1500520 - RNA, 22 nt, Homo sapiens
aguuauaaaucaaugucacuua

SEQ ID NO: 1500521 - RNA, 15 nt, Homo sapiens
aguuaugugauuuuc

SEQ ID NO: 1500522 - RNA, 14 nt, Homo sapiens
aguuauucauucug

SEQ ID NO: 1500523 - RNA, 21 nt, Homo sapiens
aguucaaaaaacucuugauau

SEQ ID NO: 1500524 - RNA, 19 nt, Homo sapiens
aguucacaggaggccagug

SEQ ID NO: 1500525 - RNA, 21 nt, Homo sapiens
aguucagagccaagccuuaaa

SEQ ID NO: 1500526 - RNA, 18 nt, Homo sapiens
aguucauagggucucuuc

SEQ ID NO: 1500527 - RNA, 17 nt, Homo sapiens
aguuccacgaaacacug

SEQ ID NO: 1500528 - RNA, 17 nt, Homo sapiens
aguucccaccaucugau

SEQ ID NO: 1500529 - RNA, 14 nt, Homo sapiens
aguucccucuugcu

SEQ ID NO: 1500530 - RNA, 20 nt, Homo sapiens
aguuccuguaacaggugugg

SEQ ID NO: 1500531 - RNA, 23 nt, Homo sapiens
aguuccuuaucccucucuucccc

SEQ ID NO: 1500532 - RNA, 23 nt, Homo sapiens
aguucuagcucuauuuacuucua

SEQ ID NO: 1500533 - RNA, 20 nt, Homo sapiens
aguucuaugagggcuaauau

SEQ ID NO: 1500534 - RNA, 22 nt, Homo sapiens
aguucugaggucccugugugua

SEQ ID NO: 1500535 - RNA, 19 nt, Homo sapiens
aguucuggcugaacacugg

SEQ ID NO: 1500536 - RNA, 20 nt, Homo sapiens
aguucuggucagaugauaua

SEQ ID NO: 1500537 - RNA, 18 nt, Homo sapiens
aguucuuugggccagaca

SEQ ID NO: 1500538 - RNA, 13 nt, Homo sapiens
aguugaaacaaga

SEQ ID NO: 1500539 - RNA, 20 nt, Homo sapiens
aguugaagggaauacugugc

SEQ ID NO: 1500540 - RNA, 18 nt, Homo sapiens
aguugaagggaggggcug

SEQ ID NO: 1500541 - RNA, 22 nt, Homo sapiens
aguugagucuccucucugagac

SEQ ID NO: 1500542 - RNA, 23 nt, Homo sapiens
aguugaugggggccaggacacca

SEQ ID NO: 1500543 - RNA, 17 nt, Homo sapiens
aguugcagugaauucau

SEQ ID NO: 1500544 - RNA, 23 nt, Homo sapiens
aguugcgacggagagaaaaaaga

SEQ ID NO: 1500545 - RNA, 11 nt, Homo sapiens
aguuggcagaa

SEQ ID NO: 1500546 - RNA, 23 nt, Homo sapiens
aguugggacccaaaacacaggaa

SEQ ID NO: 1500547 - RNA, 23 nt, Homo sapiens
aguuggguuaauaccagcuuaaa

SEQ ID NO: 1500548 - RNA, 21 nt, Homo sapiens
aguuguccuauggacaacuua

SEQ ID NO: 1500549 - RNA, 20 nt, Homo sapiens
aguuguuguaaaaauaaaag

SEQ ID NO: 1500550 - RNA, 20 nt, Homo sapiens
aguuguuuguuuuugcuugu

SEQ ID NO: 1500551 - RNA, 20 nt, Homo sapiens
aguuuaaaacagaagccuga

SEQ ID NO: 1500552 - RNA, 15 nt, Homo sapiens
aguuuauaagacugg

SEQ ID NO: 1500553 - RNA, 20 nt, Homo sapiens
aguuuauaagacuggaauau

SEQ ID NO: 1500554 - RNA, 21 nt, Homo sapiens
aguuuaugcugugcuaaauau

SEQ ID NO: 1500555 - RNA, 22 nt, Homo sapiens
aguuucacaugagcuauuucca

SEQ ID NO: 1500556 - RNA, 15 nt, Homo sapiens
aguuucaucagucaa

SEQ ID NO: 1500557 - RNA, 19 nt, Homo sapiens
aguuuccaaucccauagau

SEQ ID NO: 1500558 - RNA, 17 nt, Homo sapiens
aguuuccauauguuaua

SEQ ID NO: 1500559 - RNA, 14 nt, Homo sapiens
aguuucccuuccuc

SEQ ID NO: 1500560 - RNA, 19 nt, Homo sapiens
aguuuccuaggaugucaug

SEQ ID NO: 1500561 - RNA, 18 nt, Homo sapiens
aguuuccuaugggaacaa

SEQ ID NO: 1500562 - RNA, 16 nt, Homo sapiens
aguuuccucaucugca

SEQ ID NO: 1500563 - RNA, 17 nt, Homo sapiens
aguuucuauucugucag

SEQ ID NO: 1500564 - RNA, 18 nt, Homo sapiens
aguuucugauaccacugc

SEQ ID NO: 1500565 - RNA, 23 nt, Homo sapiens
aguuugaacucuguaaaaccuca

SEQ ID NO: 1500566 - RNA, 17 nt, Homo sapiens
aguuugauaccugcacu

SEQ ID NO: 1500567 - RNA, 21 nt, Homo sapiens
aguuugauaccugcacugucc

SEQ ID NO: 1500568 - RNA, 13 nt, Homo sapiens
aguuugauuucau

SEQ ID NO: 1500569 - RNA, 22 nt, Homo sapiens
aguuugccggauacaaacuggu

SEQ ID NO: 1500570 - RNA, 16 nt, Homo sapiens
aguuugccuuccuuuc

SEQ ID NO: 1500571 - RNA, 20 nt, Homo sapiens
aguuugcuuugcugaccaaa

SEQ ID NO: 1500572 - RNA, 15 nt, Homo sapiens
aguuuuaaauaagcu

SEQ ID NO: 1500573 - RNA, 20 nt, Homo sapiens
aguuuuacuaaaacacugaa

SEQ ID NO: 1500574 - RNA, 23 nt, Homo sapiens
aguuuuacuaaaacacugaaaaa

SEQ ID NO: 1500575 - RNA, 13 nt, Homo sapiens
aguuuuaguugca

SEQ ID NO: 1500576 - RNA, 14 nt, Homo sapiens
aguuuuaucuucag

SEQ ID NO: 1500577 - RNA, 21 nt, Homo sapiens
aguuuuccucuauacaucucu

SEQ ID NO: 1500578 - RNA, 16 nt, Homo sapiens
aguuuuggacuggaua

SEQ ID NO: 1500579 - RNA, 17 nt, Homo sapiens
auaaaaaaagacaaauu

SEQ ID NO: 1500580 - RNA, 17 nt, Homo sapiens
auaaaaaacacuaaaca

SEQ ID NO: 1500581 - RNA, 23 nt, Homo sapiens
auaaaaaaugguucagaauuaaa

SEQ ID NO: 1500582 - RNA, 22 nt, Homo sapiens
auaaaaaucauggcaacauaau

SEQ ID NO: 1500583 - RNA, 18 nt, Homo sapiens
auaaaaauugacaaugau

SEQ ID NO: 1500584 - RNA, 19 nt, Homo sapiens
auaaaacaugggaaucucc

SEQ ID NO: 1500585 - RNA, 15 nt, Homo sapiens
auaaaaggaagccaa

SEQ ID NO: 1500586 - RNA, 17 nt, Homo sapiens
auaaaauagaaacauuu

SEQ ID NO: 1500587 - RNA, 13 nt, Homo sapiens
auaaacacacaaa

SEQ ID NO: 1500588 - RNA, 14 nt, Homo sapiens
auaaacagcuucau

SEQ ID NO: 1500589 - RNA, 18 nt, Homo sapiens
auaaacaguaaugacucu

SEQ ID NO: 1500590 - RNA, 15 nt, Homo sapiens
auaaacauccuucaa

SEQ ID NO: 1500591 - RNA, 16 nt, Homo sapiens
auaaaccuggagauau

SEQ ID NO: 1500592 - RNA, 16 nt, Homo sapiens
auaaacucauuuaacu

SEQ ID NO: 1500593 - RNA, 18 nt, Homo sapiens
auaaacugacuaaacuua

SEQ ID NO: 1500594 - RNA, 20 nt, Homo sapiens
auaaacuguaugcucacaac

SEQ ID NO: 1500595 - RNA, 20 nt, Homo sapiens
auaaagaauuaacagagauu

SEQ ID NO: 1500596 - RNA, 15 nt, Homo sapiens
auaaagucucucuga

SEQ ID NO: 1500597 - RNA, 17 nt, Homo sapiens
auaaauauagagaugug

SEQ ID NO: 1500598 - RNA, 16 nt, Homo sapiens
auaaauauauauucua

SEQ ID NO: 1500599 - RNA, 23 nt, Homo sapiens
auaaauaugguuaauuucaugua

SEQ ID NO: 1500600 - RNA, 18 nt, Homo sapiens
auaaauauuuuugccaua

SEQ ID NO: 1500601 - RNA, 21 nt, Homo sapiens
auaaaucguccucccaggcca

SEQ ID NO: 1500602 - RNA, 22 nt, Homo sapiens
auaaaucucuucuuugcugcag

SEQ ID NO: 1500603 - RNA, 15 nt, Homo sapiens
auaaaugaagauuac

SEQ ID NO: 1500604 - RNA, 16 nt, Homo sapiens
auaaaugggaaaucag

SEQ ID NO: 1500605 - RNA, 14 nt, Homo sapiens
auaaaugugaacuu

SEQ ID NO: 1500606 - RNA, 17 nt, Homo sapiens
auaaauucagauauauu

SEQ ID NO: 1500607 - RNA, 22 nt, Homo sapiens
auaaauucuauaggaacauaug

SEQ ID NO: 1500608 - RNA, 20 nt, Homo sapiens
cagggaauccagccaugacc

SEQ ID NO: 1500609 - RNA, 19 nt, Homo sapiens
cagggcacgcaggaccagu

SEQ ID NO: 1500610 - RNA, 18 nt, Homo sapiens
cagggcagcgccaggcug

SEQ ID NO: 1500611 - RNA, 17 nt, Homo sapiens
cagggcagggcucugau

SEQ ID NO: 1500612 - RNA, 18 nt, Homo sapiens
cagggcauuuugguccaa

SEQ ID NO: 1500613 - RNA, 13 nt, Homo sapiens
cagggccacaacu

SEQ ID NO: 1500614 - RNA, 19 nt, Homo sapiens
cagggcccagagcccagcu

SEQ ID NO: 1500615 - RNA, 16 nt, Homo sapiens
cagggcccccaucuca

SEQ ID NO: 1500616 - RNA, 17 nt, Homo sapiens
cagggcccccaucucau

SEQ ID NO: 1500617 - RNA, 15 nt, Homo sapiens
cagggccuccagggc

SEQ ID NO: 1500618 - RNA, 22 nt, Homo sapiens
cagggccuggcaggccaguguc

SEQ ID NO: 1500619 - RNA, 18 nt, Homo sapiens
cagggcugugucccagau

SEQ ID NO: 1500620 - RNA, 17 nt, Homo sapiens
cagggcugugugaaaca

SEQ ID NO: 1500621 - RNA, 18 nt, Homo sapiens
caggggggagaaguucuu

SEQ ID NO: 1500622 - RNA, 23 nt, Homo sapiens
caggggucucccuggagugcagu

SEQ ID NO: 1500623 - RNA, 18 nt, Homo sapiens
caggguaacugugcugaa

SEQ ID NO: 1500624 - RNA, 20 nt, Homo sapiens
caggguaccucaagccccau

SEQ ID NO: 1500625 - RNA, 12 nt, Homo sapiens
cagggucugcuc

SEQ ID NO: 1500626 - RNA, 16 nt, Homo sapiens
cagggucugcucuuuc

SEQ ID NO: 1500627 - RNA, 20 nt, Homo sapiens
cagggucugcucuuucucug

SEQ ID NO: 1500628 - RNA, 23 nt, Homo sapiens
cagggucugcucuuucucugcca

SEQ ID NO: 1500629 - RNA, 23 nt, Homo sapiens
caggguggcagaacuugaagggu

SEQ ID NO: 1500630 - RNA, 15 nt, Homo sapiens
caggguuaaacugca

SEQ ID NO: 1500631 - RNA, 13 nt, Homo sapiens
caggguucaucug

SEQ ID NO: 1500632 - RNA, 20 nt, Homo sapiens
caggguugaucacacucugg

SEQ ID NO: 1500633 - RNA, 20 nt, Homo sapiens
caggguuucaccauguugcc

SEQ ID NO: 1500634 - RNA, 18 nt, Homo sapiens
caggguuuuuaccuguca

SEQ ID NO: 1500635 - RNA, 13 nt, Homo sapiens
cagguaaugugaa

SEQ ID NO: 1500636 - RNA, 23 nt, Homo sapiens
cagguacaguaggauaagccacu

SEQ ID NO: 1500637 - RNA, 20 nt, Homo sapiens
cagguccaccgagccccuga

SEQ ID NO: 1500638 - RNA, 15 nt, Homo sapiens
caggucuugacucau

SEQ ID NO: 1500639 - RNA, 15 nt, Homo sapiens
caggugaaaauccau

SEQ ID NO: 1500640 - RNA, 20 nt, Homo sapiens
caggugaaaauccaucucau

SEQ ID NO: 1500641 - RNA, 19 nt, Homo sapiens
caggugccaaguuccacuu

SEQ ID NO: 1500642 - RNA, 20 nt, Homo sapiens
caggugcgcgccaccgugcc

SEQ ID NO: 1500643 - RNA, 11 nt, Homo sapiens
caggugcucaa

SEQ ID NO: 1500644 - RNA, 22 nt, Homo sapiens
caggugcugacuucaucuccca

SEQ ID NO: 1500645 - RNA, 20 nt, Homo sapiens
cagguggacacacaaggugc

SEQ ID NO: 1500646 - RNA, 15 nt, Homo sapiens
caggugggaaauggu

SEQ ID NO: 1500647 - RNA, 19 nt, Homo sapiens
caggugguaagcaccagga

SEQ ID NO: 1500648 - RNA, 20 nt, Homo sapiens
caggugugggccacugcacc

SEQ ID NO: 1500649 - RNA, 19 nt, Homo sapiens
caggugugugccaccacac

SEQ ID NO: 1500650 - RNA, 21 nt, Homo sapiens
caggugugugccaccacaccc

SEQ ID NO: 1500651 - RNA, 16 nt, Homo sapiens
cagguuauacuccucc

SEQ ID NO: 1500652 - RNA, 22 nt, Homo sapiens
cagguucaugccaccauggcca

SEQ ID NO: 1500653 - RNA, 15 nt, Homo sapiens
cagguucccccagca

SEQ ID NO: 1500654 - RNA, 19 nt, Homo sapiens
cagguuccuuaucugucac

SEQ ID NO: 1500655 - RNA, 20 nt, Homo sapiens
cagguuccuuaucugucaca

SEQ ID NO: 1500656 - RNA, 14 nt, Homo sapiens
cagguuuguuacau

SEQ ID NO: 1500657 - RNA, 22 nt, Homo sapiens
caguaaaaauggaaacuauauu

SEQ ID NO: 1500658 - RNA, 16 nt, Homo sapiens
caguaaacaacuugua

SEQ ID NO: 1500659 - RNA, 13 nt, Homo sapiens
caguaaacauaaa

SEQ ID NO: 1500660 - RNA, 22 nt, Homo sapiens
caguaaagcaggaagccuccaa

SEQ ID NO: 1500661 - RNA, 18 nt, Homo sapiens
caguaaaggcugcugcua

SEQ ID NO: 1500662 - RNA, 17 nt, Homo sapiens
caguaaaucucacaaau

SEQ ID NO: 1500663 - RNA, 23 nt, Homo sapiens
caguaaauuugcuagcaguaaaa

SEQ ID NO: 1500664 - RNA, 23 nt, Homo sapiens
caguaacacaggccacccugugc

SEQ ID NO: 1500665 - RNA, 15 nt, Homo sapiens
caguaaccaugcccg

SEQ ID NO: 1500666 - RNA, 17 nt, Homo sapiens
caguaacgcgucuuccu

SEQ ID NO: 1500667 - RNA, 16 nt, Homo sapiens
caguacccucucagcu

SEQ ID NO: 1500668 - RNA, 17 nt, Homo sapiens
caguacuuccugcagua

SEQ ID NO: 1500669 - RNA, 21 nt, Homo sapiens
caguacuugugaaacacagcu

SEQ ID NO: 1500670 - RNA, 18 nt, Homo sapiens
caguagaacugucuguga

SEQ ID NO: 1500671 - RNA, 20 nt, Homo sapiens
caguagacugcaguggacag

SEQ ID NO: 1500672 - RNA, 16 nt, Homo sapiens
caguaguuagcuuucu

SEQ ID NO: 1500673 - RNA, 21 nt, Homo sapiens
caguauauucuuugguuguga

SEQ ID NO: 1500674 - RNA, 17 nt, Homo sapiens
caguauauuuauaguca

SEQ ID NO: 1500675 - RNA, 14 nt, Homo sapiens
caguaucaucucca

SEQ ID NO: 1500676 - RNA, 14 nt, Homo sapiens
caguaugacaguau

SEQ ID NO: 1500677 - RNA, 17 nt, Homo sapiens
caguaugagucaaugug

SEQ ID NO: 1500678 - RNA, 23 nt, Homo sapiens
caguauuucuggagggcaauuug

SEQ ID NO: 1500679 - RNA, 19 nt, Homo sapiens
cagucaaugaggaagauuu

SEQ ID NO: 1500680 - RNA, 21 nt, Homo sapiens
cagucacaugaccugaucacu

SEQ ID NO: 1500681 - RNA, 21 nt, Homo sapiens
cagucagaguccagugcucug

SEQ ID NO: 1500682 - RNA, 22 nt, Homo sapiens
caguccaggaugcuaacaucua

SEQ ID NO: 1500683 - RNA, 15 nt, Homo sapiens
cagucccaguauucu

SEQ ID NO: 1500684 - RNA, 17 nt, Homo sapiens
caguccuguacucuggg

SEQ ID NO: 1500685 - RNA, 21 nt, Homo sapiens
cagucguacugauucuaaugg

SEQ ID NO: 1500686 - RNA, 13 nt, Homo sapiens
cagucucccuucc

SEQ ID NO: 1500687 - RNA, 22 nt, Homo sapiens
cagucucuucgaggcuuuacag

SEQ ID NO: 1500688 - RNA, 17 nt, Homo sapiens
cagugacagucagggaa

SEQ ID NO: 1500689 - RNA, 19 nt, Homo sapiens
cagugaccccugaccucac

SEQ ID NO: 1500690 - RNA, 17 nt, Homo sapiens
cagugacuggugccagu

SEQ ID NO: 1500691 - RNA, 18 nt, Homo sapiens
cagugacuggugccagug

SEQ ID NO: 1500692 - RNA, 17 nt, Homo sapiens
cagugagacugccccac

SEQ ID NO: 1500693 - RNA, 14 nt, Homo sapiens
cagugagauaucau

SEQ ID NO: 1500694 - RNA, 20 nt, Homo sapiens
cagugagccuccugugccug

SEQ ID NO: 1500695 - RNA, 21 nt, Homo sapiens
cagugauaaugccccaaggac

SEQ ID NO: 1500696 - RNA, 22 nt, Homo sapiens
cagugaucucagggcagacagc

SEQ ID NO: 1500697 - RNA, 13 nt, Homo sapiens
cagugaucuccau

SEQ ID NO: 1500698 - RNA, 13 nt, Homo sapiens
cagugccauucca

SEQ ID NO: 1500699 - RNA, 14 nt, Homo sapiens
cagugccauuccac

SEQ ID NO: 1500700 - RNA, 16 nt, Homo sapiens
cagugcccccacugac

SEQ ID NO: 1500701 - RNA, 15 nt, Homo sapiens
cagugccuuccauaa

SEQ ID NO: 1500702 - RNA, 23 nt, Homo sapiens
cagugcuaaaauucagaugcugu

SEQ ID NO: 1500703 - RNA, 15 nt, Homo sapiens
caguggacucuucca

SEQ ID NO: 1500704 - RNA, 16 nt, Homo sapiens
cagugggagcccugac

SEQ ID NO: 1500705 - RNA, 16 nt, Homo sapiens
cagugguauccuguga

SEQ ID NO: 1500706 - RNA, 13 nt, Homo sapiens
caguguacaugga

SEQ ID NO: 1500707 - RNA, 20 nt, Homo sapiens
caguguagcccacacuugag

SEQ ID NO: 1500708 - RNA, 21 nt, Homo sapiens
caguguagcccacacuugaga

SEQ ID NO: 1500709 - RNA, 18 nt, Homo sapiens
caguguccccuccacugu

SEQ ID NO: 1500710 - RNA, 20 nt, Homo sapiens
cauccccauccuccagagaa

SEQ ID NO: 1500711 - RNA, 17 nt, Homo sapiens
cauccccuggacuggga

SEQ ID NO: 1500712 - RNA, 19 nt, Homo sapiens
cauccccuuuguguagaaa

SEQ ID NO: 1500713 - RNA, 15 nt, Homo sapiens
caucccuggaaggac

SEQ ID NO: 1500714 - RNA, 21 nt, Homo sapiens
cauccgguggccuauuccagg

SEQ ID NO: 1500715 - RNA, 21 nt, Homo sapiens
cauccuaagaaauaugugaga

SEQ ID NO: 1500716 - RNA, 18 nt, Homo sapiens
cauccuaccccuuugcac

SEQ ID NO: 1500717 - RNA, 20 nt, Homo sapiens
cauccuaccccuuugcacuu

SEQ ID NO: 1500718 - RNA, 16 nt, Homo sapiens
cauccucaugcugcuc

SEQ ID NO: 1500719 - RNA, 17 nt, Homo sapiens
cauccucaugcugcuca

SEQ ID NO: 1500720 - RNA, 17 nt, Homo sapiens
cauccuccacaauagca

SEQ ID NO: 1500721 - RNA, 16 nt, Homo sapiens
cauccugaacugcuuc

SEQ ID NO: 1500722 - RNA, 14 nt, Homo sapiens
cauccugacugaaa

SEQ ID NO: 1500723 - RNA, 21 nt, Homo sapiens
cauccuugaugcaagugcaac

SEQ ID NO: 1500724 - RNA, 15 nt, Homo sapiens
cauccuuuacguguu

SEQ ID NO: 1500725 - RNA, 20 nt, Homo sapiens
caucggguaagaugcuccug

SEQ ID NO: 1500726 - RNA, 21 nt, Homo sapiens
caucguggccuugaccuccaa

SEQ ID NO: 1500727 - RNA, 20 nt, Homo sapiens
caucuacccugcugaccucc

SEQ ID NO: 1500728 - RNA, 22 nt, Homo sapiens
caucuacuuuuuuuuuaauuaa

SEQ ID NO: 1500729 - RNA, 22 nt, Homo sapiens
caucuauaaagaagaacuugca

SEQ ID NO: 1500730 - RNA, 17 nt, Homo sapiens
caucucaaaaagaaaag

SEQ ID NO: 1500731 - RNA, 17 nt, Homo sapiens
caucucaaagaaggcau

SEQ ID NO: 1500732 - RNA, 13 nt, Homo sapiens
caucucagugcag

SEQ ID NO: 1500733 - RNA, 13 nt, Homo sapiens
caucuccagcuau

SEQ ID NO: 1500734 - RNA, 22 nt, Homo sapiens
caucucccacccuguaccucau

SEQ ID NO: 1500735 - RNA, 15 nt, Homo sapiens
caucuccugcucacc

SEQ ID NO: 1500736 - RNA, 23 nt, Homo sapiens
caucucucccuccccugccauuu

SEQ ID NO: 1500737 - RNA, 18 nt, Homo sapiens
caucucuuccccagagag

SEQ ID NO: 1500738 - RNA, 23 nt, Homo sapiens
caucuguagauacuagcuaucua

SEQ ID NO: 1500739 - RNA, 21 nt, Homo sapiens
caucugugcacugcccaugga

SEQ ID NO: 1500740 - RNA, 18 nt, Homo sapiens
caucuguuaucaaacugc

SEQ ID NO: 1500741 - RNA, 14 nt, Homo sapiens
caucuuacuugagc

SEQ ID NO: 1500742 - RNA, 17 nt, Homo sapiens
caucuucacugcaauuu

SEQ ID NO: 1500743 - RNA, 22 nt, Homo sapiens
caucuuccgcgcaggugccaac

SEQ ID NO: 1500744 - RNA, 23 nt, Homo sapiens
caucuuggucagauuugaacucu

SEQ ID NO: 1500745 - RNA, 22 nt, Homo sapiens
caucuuuacaaaacuacaugag

SEQ ID NO: 1500746 - RNA, 14 nt, Homo sapiens
caucuuuggcugag

SEQ ID NO: 1500747 - RNA, 16 nt, Homo sapiens
caucuuuggcugagcu

SEQ ID NO: 1500748 - RNA, 18 nt, Homo sapiens
caugaaaauaaacuugaa

SEQ ID NO: 1500749 - RNA, 24 nt, Homo sapiens
caugaacguuauuauauugucgaa

SEQ ID NO: 1500750 - RNA, 14 nt, Homo sapiens
caugaauccagucc

SEQ ID NO: 1500751 - RNA, 13 nt, Homo sapiens
caugaaugcacac

SEQ ID NO: 1500752 - RNA, 22 nt, Homo sapiens
caugaccugaucacuagccugu

SEQ ID NO: 1500753 - RNA, 19 nt, Homo sapiens
caugaccugcgcucucagc

SEQ ID NO: 1500754 - RNA, 14 nt, Homo sapiens
caugagaauaagag

SEQ ID NO: 1500755 - RNA, 19 nt, Homo sapiens
caugagaccacuguuauca

SEQ ID NO: 1500756 - RNA, 19 nt, Homo sapiens
caugagaugauacauccaa

SEQ ID NO: 1500757 - RNA, 18 nt, Homo sapiens
caugagugaauaaauguc

SEQ ID NO: 1500758 - RNA, 20 nt, Homo sapiens
caugauggccuuacacugaa

SEQ ID NO: 1500759 - RNA, 21 nt, Homo sapiens
caugauggccuuacacugaaa

SEQ ID NO: 1500760 - RNA, 15 nt, Homo sapiens
caugaugucaacuca

SEQ ID NO: 1500761 - RNA, 15 nt, Homo sapiens
caugauuguuuacag

SEQ ID NO: 1500762 - RNA, 10 nt, Homo sapiens
caugcaaaau

SEQ ID NO: 1500763 - RNA, 18 nt, Homo sapiens
caugcagccagccaucaa

SEQ ID NO: 1500764 - RNA, 19 nt, Homo sapiens
caugcagccagccaucaaa

SEQ ID NO: 1500765 - RNA, 18 nt, Homo sapiens
caugcagugccggcugcc

SEQ ID NO: 1500766 - RNA, 21 nt, Homo sapiens
caugcaguugcagugaauuca

SEQ ID NO: 1500767 - RNA, 15 nt, Homo sapiens
caugcauuguuggcu

SEQ ID NO: 1500768 - RNA, 18 nt, Homo sapiens
caugcccgccagugcaca

SEQ ID NO: 1500769 - RNA, 20 nt, Homo sapiens
caugccugaggucuaccccu

SEQ ID NO: 1500770 - RNA, 17 nt, Homo sapiens
caugccuguagucccag

SEQ ID NO: 1500771 - RNA, 23 nt, Homo sapiens
caugccuucaaaucaaucuguaa

SEQ ID NO: 1500772 - RNA, 20 nt, Homo sapiens
caugcgguagccagcacaca

SEQ ID NO: 1500773 - RNA, 19 nt, Homo sapiens
cauggacaccccuuaucca

SEQ ID NO: 1500774 - RNA, 17 nt, Homo sapiens
cauggacacuccagugc

SEQ ID NO: 1500775 - RNA, 14 nt, Homo sapiens
cauggacuacacca

SEQ ID NO: 1500776 - RNA, 20 nt, Homo sapiens
cauggagaaucugcugcaua

SEQ ID NO: 1500777 - RNA, 15 nt, Homo sapiens
cauggauaacacauu

SEQ ID NO: 1500778 - RNA, 17 nt, Homo sapiens
cauggcaagucacaugc

SEQ ID NO: 1500779 - RNA, 15 nt, Homo sapiens
cauggcagaagucaa

SEQ ID NO: 1500780 - RNA, 20 nt, Homo sapiens
cauggcagaagucaacgccu

SEQ ID NO: 1500781 - RNA, 22 nt, Homo sapiens
cauggcagcuguuucucaugaa

SEQ ID NO: 1500782 - RNA, 21 nt, Homo sapiens
cauggccagguggccacucca

SEQ ID NO: 1500783 - RNA, 18 nt, Homo sapiens
cauggccccaucccaguu

SEQ ID NO: 1500784 - RNA, 20 nt, Homo sapiens
caugggacuaaaugaacuaa

SEQ ID NO: 1500785 - RNA, 12 nt, Homo sapiens
caugggagaccc

SEQ ID NO: 1500786 - RNA, 18 nt, Homo sapiens
caugggcaccaaccugca

SEQ ID NO: 1500787 - RNA, 16 nt, Homo sapiens
cauggguuuaccacua

SEQ ID NO: 1500788 - RNA, 21 nt, Homo sapiens
cauggugccccaggaccagcu

SEQ ID NO: 1500789 - RNA, 22 nt, Homo sapiens
cauggugccccaggaccagcuc

SEQ ID NO: 1500790 - RNA, 20 nt, Homo sapiens
caugguggcgcaugccugua

SEQ ID NO: 1500791 - RNA, 20 nt, Homo sapiens
caugguggugugugccugua

SEQ ID NO: 1500792 - RNA, 22 nt, Homo sapiens
caugguuuuuuguauuggucau

SEQ ID NO: 1500793 - RNA, 15 nt, Homo sapiens
cauguaaaacaguua

SEQ ID NO: 1500794 - RNA, 15 nt, Homo sapiens
cauguaauugcagau

SEQ ID NO: 1500795 - RNA, 17 nt, Homo sapiens
cauguacagacauacau

SEQ ID NO: 1500796 - RNA, 12 nt, Homo sapiens
cauguacaugaa

SEQ ID NO: 1500797 - RNA, 18 nt, Homo sapiens
cauguagcuucuucugaa

SEQ ID NO: 1500798 - RNA, 20 nt, Homo sapiens
cauguaucuuuugaacuggc

SEQ ID NO: 1500799 - RNA, 14 nt, Homo sapiens
cauguauucaucca

SEQ ID NO: 1500800 - RNA, 23 nt, Homo sapiens
caugucaacuucuggcuccucaa

SEQ ID NO: 1500801 - RNA, 15 nt, Homo sapiens
caugucagacuguac

SEQ ID NO: 1500802 - RNA, 20 nt, Homo sapiens
caugucccaaaccagacacc

SEQ ID NO: 1500803 - RNA, 15 nt, Homo sapiens
cauguccuaauucuu

SEQ ID NO: 1500804 - RNA, 17 nt, Homo sapiens
caugucucaauaguaaa

SEQ ID NO: 1500805 - RNA, 13 nt, Homo sapiens
caugugacauuua

SEQ ID NO: 1500806 - RNA, 17 nt, Homo sapiens
caugugcacgguggcga

SEQ ID NO: 1500807 - RNA, 18 nt, Homo sapiens
caugugccuuucuuugcc

SEQ ID NO: 1500808 - RNA, 15 nt, Homo sapiens
caugugcugugacca

SEQ ID NO: 1500809 - RNA, 19 nt, Homo sapiens
cauguggaagcacuuuaag

SEQ ID NO: 1500810 - RNA, 15 nt, Homo sapiens
cauguggaugacaca

SEQ ID NO: 1500811 - RNA, 20 nt, Homo sapiens
cauguggcauguucaucgua

SEQ ID NO: 1500812 - RNA, 18 nt, Homo sapiens
ccaaaauauuuuuugcaa

SEQ ID NO: 1500813 - RNA, 20 nt, Homo sapiens
ccaaaauuaccaaaaaucuu

SEQ ID NO: 1500814 - RNA, 23 nt, Homo sapiens
ccaaaccaauucaccaacacagu

SEQ ID NO: 1500815 - RNA, 17 nt, Homo sapiens
ccaaacccuugucagug

SEQ ID NO: 1500816 - RNA, 16 nt, Homo sapiens
ccaaagaacaggugua

SEQ ID NO: 1500817 - RNA, 14 nt, Homo sapiens
ccaaaguaaauguc

SEQ ID NO: 1500818 - RNA, 20 nt, Homo sapiens
ccaaaguaaauguccugcua

SEQ ID NO: 1500819 - RNA, 13 nt, Homo sapiens
ccaaaguuugcuc

SEQ ID NO: 1500820 - RNA, 14 nt, Homo sapiens
ccaaaugcagggag

SEQ ID NO: 1500821 - RNA, 15 nt, Homo sapiens
ccaaaugcagggagg

SEQ ID NO: 1500822 - RNA, 14 nt, Homo sapiens
ccaaauuuggcuaa

SEQ ID NO: 1500823 - RNA, 20 nt, Homo sapiens
ccaacacaaggcuccaagac

SEQ ID NO: 1500824 - RNA, 12 nt, Homo sapiens
ccaacaccacag

SEQ ID NO: 1500825 - RNA, 13 nt, Homo sapiens
ccaacaccacaga

SEQ ID NO: 1500826 - RNA, 13 nt, Homo sapiens
ccaacacuuugag

SEQ ID NO: 1500827 - RNA, 14 nt, Homo sapiens
ccaacauucuuggc

SEQ ID NO: 1500828 - RNA, 15 nt, Homo sapiens
ccaaccaaaccaauu

SEQ ID NO: 1500829 - RNA, 21 nt, Homo sapiens
ccaaccacagcaucgggagca

SEQ ID NO: 1500830 - RNA, 17 nt, Homo sapiens
ccaaccggucacccagg

SEQ ID NO: 1500831 - RNA, 20 nt, Homo sapiens
ccaacuccaggaaagagcag

SEQ ID NO: 1500832 - RNA, 22 nt, Homo sapiens
ccaacugaguguuauuugcaca

SEQ ID NO: 1500833 - RNA, 20 nt, Homo sapiens
ccaacugcagcucuccauca

SEQ ID NO: 1500834 - RNA, 19 nt, Homo sapiens
ccaacuucucuugcuuucu

SEQ ID NO: 1500835 - RNA, 16 nt, Homo sapiens
ccaacuuuguuuucca

SEQ ID NO: 1500836 - RNA, 13 nt, Homo sapiens
ccaacuuuugcau

SEQ ID NO: 1500837 - RNA, 20 nt, Homo sapiens
ccaagacucugaaaucucag

SEQ ID NO: 1500838 - RNA, 22 nt, Homo sapiens
ccaagagaagggcuuacaggca

SEQ ID NO: 1500839 - RNA, 21 nt, Homo sapiens
ccaagcaaaaacaaaugggaa

SEQ ID NO: 1500840 - RNA, 17 nt, Homo sapiens
ccaagcagaguguuuua

SEQ ID NO: 1500841 - RNA, 18 nt, Homo sapiens
ccaagcaggaaccccagg

SEQ ID NO: 1500842 - RNA, 18 nt, Homo sapiens
ccaagcuuguuaucagcu

SEQ ID NO: 1500843 - RNA, 20 nt, Homo sapiens
ccaagcuuguuaucagcuuu

SEQ ID NO: 1500844 - RNA, 18 nt, Homo sapiens
ccaaggaaacccccagug

SEQ ID NO: 1500845 - RNA, 19 nt, Homo sapiens
ccaaggaaacccccagugu

SEQ ID NO: 1500846 - RNA, 15 nt, Homo sapiens
ccaaggaaaccgccu

SEQ ID NO: 1500847 - RNA, 20 nt, Homo sapiens
ccaaggaauuucugcucugg

SEQ ID NO: 1500848 - RNA, 13 nt, Homo sapiens
ccaaggagaccaa

SEQ ID NO: 1500849 - RNA, 20 nt, Homo sapiens
ccaaggggaaucagaacuca

SEQ ID NO: 1500850 - RNA, 24 nt, Homo sapiens
ccaaguuccacuuuucugcaggua

SEQ ID NO: 1500851 - RNA, 13 nt, Homo sapiens
ccaaguuccguca

SEQ ID NO: 1500852 - RNA, 16 nt, Homo sapiens
ccaaguuuccauagca

SEQ ID NO: 1500853 - RNA, 19 nt, Homo sapiens
ccaauaaaaaguucagagu

SEQ ID NO: 1500854 - RNA, 12 nt, Homo sapiens
ccaauagcuuua

SEQ ID NO: 1500855 - RNA, 14 nt, Homo sapiens
ccaaucccgugaaa

SEQ ID NO: 1500856 - RNA, 17 nt, Homo sapiens
ccaaucuccaucuguca

SEQ ID NO: 1500857 - RNA, 14 nt, Homo sapiens
ccaaugauggucac

SEQ ID NO: 1500858 - RNA, 22 nt, Homo sapiens
ccaaugcacaguugccacauuu

SEQ ID NO: 1500859 - RNA, 23 nt, Homo sapiens
ccaaugcauugcuaaaauauuau

SEQ ID NO: 1500860 - RNA, 15 nt, Homo sapiens
ccaaugggacaguua

SEQ ID NO: 1500861 - RNA, 13 nt, Homo sapiens
ccaauguauuuau

SEQ ID NO: 1500862 - RNA, 15 nt, Homo sapiens
ccaauugugcugcca

SEQ ID NO: 1500863 - RNA, 17 nt, Homo sapiens
ccaauuucagacuccca

SEQ ID NO: 1500864 - RNA, 15 nt, Homo sapiens
ccacaacaacaaaag

SEQ ID NO: 1500865 - RNA, 13 nt, Homo sapiens
ccacaaccaaaaa

SEQ ID NO: 1500866 - RNA, 14 nt, Homo sapiens
ccacaaccaaaaaa

SEQ ID NO: 1500867 - RNA, 17 nt, Homo sapiens
ccacaaccaaaaaauuc

SEQ ID NO: 1500868 - RNA, 15 nt, Homo sapiens
ccacaaccacaugua

SEQ ID NO: 1500869 - RNA, 12 nt, Homo sapiens
ccacaacuuuaa

SEQ ID NO: 1500870 - RNA, 14 nt, Homo sapiens
ccacaagucuucca

SEQ ID NO: 1500871 - RNA, 15 nt, Homo sapiens
ccacaauguuuauaa

SEQ ID NO: 1500872 - RNA, 18 nt, Homo sapiens
ccacacauuaguacuuau

SEQ ID NO: 1500873 - RNA, 20 nt, Homo sapiens
ccacaccacaaccaccuuca

SEQ ID NO: 1500874 - RNA, 20 nt, Homo sapiens
ccacagcagcugaacagcca

SEQ ID NO: 1500875 - RNA, 19 nt, Homo sapiens
ccacagccugcaagucagu

SEQ ID NO: 1500876 - RNA, 23 nt, Homo sapiens
ccacagccuucggacagacauau

SEQ ID NO: 1500877 - RNA, 18 nt, Homo sapiens
ccacagcugcuguucuca

SEQ ID NO: 1500878 - RNA, 14 nt, Homo sapiens
ccacaggcacaggu

SEQ ID NO: 1500879 - RNA, 23 nt, Homo sapiens
ccacaggccgcccugcgggugaa

SEQ ID NO: 1500880 - RNA, 15 nt, Homo sapiens
ccacaguguggggca

SEQ ID NO: 1500881 - RNA, 13 nt, Homo sapiens
ccacaucugccag

SEQ ID NO: 1500882 - RNA, 22 nt, Homo sapiens
ccacaugaggccaucucaggag

SEQ ID NO: 1500883 - RNA, 17 nt, Homo sapiens
ccacauguacagacaua

SEQ ID NO: 1500884 - RNA, 18 nt, Homo sapiens
ccaccaacauucuuggca

SEQ ID NO: 1500885 - RNA, 19 nt, Homo sapiens
ccaccaccucaccaguuuc

SEQ ID NO: 1500886 - RNA, 13 nt, Homo sapiens
ccaccaccugucc

SEQ ID NO: 1500887 - RNA, 18 nt, Homo sapiens
ccaccaguaugacaguau

SEQ ID NO: 1500888 - RNA, 22 nt, Homo sapiens
ccacccaggcuggagugcagug

SEQ ID NO: 1500889 - RNA, 13 nt, Homo sapiens
ccacccagucuca

SEQ ID NO: 1500890 - RNA, 20 nt, Homo sapiens
ccacccauaauaagagaaug

SEQ ID NO: 1500891 - RNA, 16 nt, Homo sapiens
ccaccgugccuggcca

SEQ ID NO: 1500892 - RNA, 13 nt, Homo sapiens
ccaccucagggca

SEQ ID NO: 1500893 - RNA, 18 nt, Homo sapiens
ccaccucggucacuccaa

SEQ ID NO: 1500894 - RNA, 22 nt, Homo sapiens
ccaccugccugcaucugugaaa

SEQ ID NO: 1500895 - RNA, 17 nt, Homo sapiens
ccaccugggcauaucca

SEQ ID NO: 1500896 - RNA, 14 nt, Homo sapiens
ccaccugucccacu

SEQ ID NO: 1500897 - RNA, 15 nt, Homo sapiens
ccacgaggugcaaca

SEQ ID NO: 1500898 - RNA, 17 nt, Homo sapiens
ccacgauucucccaaag

SEQ ID NO: 1500899 - RNA, 22 nt, Homo sapiens
ccacguccagcuggaaggguca

SEQ ID NO: 1500900 - RNA, 19 nt, Homo sapiens
ccacgugggcaaacaggca

SEQ ID NO: 1500901 - RNA, 20 nt, Homo sapiens
ccacgugggcaaacaggcag

SEQ ID NO: 1500902 - RNA, 22 nt, Homo sapiens
ccacuaauuguguacauaugua

SEQ ID NO: 1500903 - RNA, 19 nt, Homo sapiens
ccacuaccguaaaugucca

SEQ ID NO: 1500904 - RNA, 20 nt, Homo sapiens
ccacuaggguccaccaggag

SEQ ID NO: 1500905 - RNA, 22 nt, Homo sapiens
ccacucacaaccccugcuccag

SEQ ID NO: 1500906 - RNA, 17 nt, Homo sapiens
ccacucagcucaccucu

SEQ ID NO: 1500907 - RNA, 21 nt, Homo sapiens
ccacucaggcauuugacugaa

SEQ ID NO: 1500908 - RNA, 16 nt, Homo sapiens
ccacucccuuugccag

SEQ ID NO: 1500909 - RNA, 16 nt, Homo sapiens
ccacuccugcucugcu

SEQ ID NO: 1500910 - RNA, 14 nt, Homo sapiens
ccacuccuguacac

SEQ ID NO: 1500911 - RNA, 16 nt, Homo sapiens
ccacugagaagucaaa

SEQ ID NO: 1500912 - RNA, 12 nt, Homo sapiens
ccacugauaucc

SEQ ID NO: 1500913 - RNA, 24 nt, Homo sapiens
ccacugaugcuguucucuucuuca

SEQ ID NO: 1500914 - RNA, 22 nt, Homo sapiens
ccacugcacuccagucuggcaa

SEQ ID NO: 1500915 - RNA, 23 nt, Homo sapiens
ccaguucuacuauggcugaguuc

SEQ ID NO: 1500916 - RNA, 14 nt, Homo sapiens
ccaguugccuuuua

SEQ ID NO: 1500917 - RNA, 20 nt, Homo sapiens
ccaguuggcagacagccguu

SEQ ID NO: 1500918 - RNA, 11 nt, Homo sapiens
ccaguuugcac

SEQ ID NO: 1500919 - RNA, 22 nt, Homo sapiens
ccauaagccccucgcacucugg

SEQ ID NO: 1500920 - RNA, 20 nt, Homo sapiens
ccauaauaagagaauguucc

SEQ ID NO: 1500921 - RNA, 13 nt, Homo sapiens
ccauaauguuaca

SEQ ID NO: 1500922 - RNA, 16 nt, Homo sapiens
ccauagaaaacuugac

SEQ ID NO: 1500923 - RNA, 16 nt, Homo sapiens
ccauagcuuccaugag

SEQ ID NO: 1500924 - RNA, 16 nt, Homo sapiens
ccauaucugugaaaug

SEQ ID NO: 1500925 - RNA, 15 nt, Homo sapiens
ccauauugagucaaa

SEQ ID NO: 1500926 - RNA, 20 nt, Homo sapiens
ccaucagcaaauauuauucu

SEQ ID NO: 1500927 - RNA, 15 nt, Homo sapiens
ccaucauuuacuuuu

SEQ ID NO: 1500928 - RNA, 12 nt, Homo sapiens
ccauccaaauaa

SEQ ID NO: 1500929 - RNA, 23 nt, Homo sapiens
ccauccgguggccuauuccagga

SEQ ID NO: 1500930 - RNA, 15 nt, Homo sapiens
ccauccugaaagcca

SEQ ID NO: 1500931 - RNA, 21 nt, Homo sapiens
ccaucggguaagaugcuccug

SEQ ID NO: 1500932 - RNA, 19 nt, Homo sapiens
ccaucggugaaacuaacag

SEQ ID NO: 1500933 - RNA, 22 nt, Homo sapiens
ccaucucgggcacaggcccacc

SEQ ID NO: 1500934 - RNA, 14 nt, Homo sapiens
ccaucucuacugaa

SEQ ID NO: 1500935 - RNA, 23 nt, Homo sapiens
ccaucugggcuccuccagggugu

SEQ ID NO: 1500936 - RNA, 22 nt, Homo sapiens
ccaucuucuaaacccaauccaa

SEQ ID NO: 1500937 - RNA, 13 nt, Homo sapiens
ccaucuugcugac

SEQ ID NO: 1500938 - RNA, 11 nt, Homo sapiens
ccaucuuuaca

SEQ ID NO: 1500939 - RNA, 12 nt, Homo sapiens
ccaucuuuacaa

SEQ ID NO: 1500940 - RNA, 22 nt, Homo sapiens
ccaugaagcgaaacacagagaa

SEQ ID NO: 1500941 - RNA, 11 nt, Homo sapiens
ccaugaaguca

SEQ ID NO: 1500942 - RNA, 19 nt, Homo sapiens
ccaugacugugaccaccuu

SEQ ID NO: 1500943 - RNA, 20 nt, Homo sapiens
ccaugaggaaggaacagcaa

SEQ ID NO: 1500944 - RNA, 17 nt, Homo sapiens
ccaugaggcaaugucag

SEQ ID NO: 1500945 - RNA, 16 nt, Homo sapiens
ccaugagggacagggu

SEQ ID NO: 1500946 - RNA, 14 nt, Homo sapiens
ccaugccugagggu

SEQ ID NO: 1500947 - RNA, 21 nt, Homo sapiens
ccauggaggccagugccagca

SEQ ID NO: 1500948 - RNA, 22 nt, Homo sapiens
ccauggcaccuuuugcacauaa

SEQ ID NO: 1500949 - RNA, 15 nt, Homo sapiens
ccauggugcacaaaa

SEQ ID NO: 1500950 - RNA, 16 nt, Homo sapiens
ccauggugucaugcca

SEQ ID NO: 1500951 - RNA, 23 nt, Homo sapiens
ccauguaucuuuugaacuggcaa

SEQ ID NO: 1500952 - RNA, 15 nt, Homo sapiens
ccaugugcaccugcc

SEQ ID NO: 1500953 - RNA, 12 nt, Homo sapiens
ccaugugccuuu

SEQ ID NO: 1500954 - RNA, 20 nt, Homo sapiens
ccauguucacaccgcugcac

SEQ ID NO: 1500955 - RNA, 16 nt, Homo sapiens
ccauuaaaguucucaa

SEQ ID NO: 1500956 - RNA, 18 nt, Homo sapiens
ccauuaagucauguguga

SEQ ID NO: 1500957 - RNA, 13 nt, Homo sapiens
ccauuaccuccau

SEQ ID NO: 1500958 - RNA, 15 nt, Homo sapiens
ccauucagagacugu

SEQ ID NO: 1500959 - RNA, 16 nt, Homo sapiens
ccauucagagcuaugg

SEQ ID NO: 1500960 - RNA, 22 nt, Homo sapiens
ccauucauacccacacacccag

SEQ ID NO: 1500961 - RNA, 18 nt, Homo sapiens
ccauuccucagcuucuuc

SEQ ID NO: 1500962 - RNA, 18 nt, Homo sapiens
ccauucuccugccucagc

SEQ ID NO: 1500963 - RNA, 17 nt, Homo sapiens
ccauuuauccacaggaa

SEQ ID NO: 1500964 - RNA, 20 nt, Homo sapiens
ccauuuguguacacagucag

SEQ ID NO: 1500965 - RNA, 17 nt, Homo sapiens
ccauuuuuuaauaaaga

SEQ ID NO: 1500966 - RNA, 16 nt, Homo sapiens
cccaaaaaacuacuuc

SEQ ID NO: 1500967 - RNA, 18 nt, Homo sapiens
cccaaacaaugugcugga

SEQ ID NO: 1500968 - RNA, 21 nt, Homo sapiens
cccaaacuugcuuuaugccuu

SEQ ID NO: 1500969 - RNA, 14 nt, Homo sapiens
cccaaagugcuagu

SEQ ID NO: 1500970 - RNA, 19 nt, Homo sapiens
cccaaagugcuaguauuau

SEQ ID NO: 1500971 - RNA, 17 nt, Homo sapiens
cccaaaucacaucucac

SEQ ID NO: 1500972 - RNA, 22 nt, Homo sapiens
cccaaccuucacaucugucacg

SEQ ID NO: 1500973 - RNA, 14 nt, Homo sapiens
cccaacucuuacuc

SEQ ID NO: 1500974 - RNA, 15 nt, Homo sapiens
cccaaggaagagcca

SEQ ID NO: 1500975 - RNA, 17 nt, Homo sapiens
cccaaggacucuuccac

SEQ ID NO: 1500976 - RNA, 21 nt, Homo sapiens
cccaagggccucccaccagag

SEQ ID NO: 1500977 - RNA, 18 nt, Homo sapiens
cccaauaaaagugacucu

SEQ ID NO: 1500978 - RNA, 19 nt, Homo sapiens
cccaaucugcacacuccag

SEQ ID NO: 1500979 - RNA, 10 nt, Homo sapiens
cccacaccca

SEQ ID NO: 1500980 - RNA, 22 nt, Homo sapiens
cccacacccuggaggauuucau

SEQ ID NO: 1500981 - RNA, 22 nt, Homo sapiens
cccacacgcccuccccagacuc

SEQ ID NO: 1500982 - RNA, 15 nt, Homo sapiens
cccacagacacuuac

SEQ ID NO: 1500983 - RNA, 14 nt, Homo sapiens
cccaccaccugucc

SEQ ID NO: 1500984 - RNA, 17 nt, Homo sapiens
cccaccaguuauuccuu

SEQ ID NO: 1500985 - RNA, 17 nt, Homo sapiens
cccacccccuucucugc

SEQ ID NO: 1500986 - RNA, 16 nt, Homo sapiens
cccaccccuagccacc

SEQ ID NO: 1500987 - RNA, 16 nt, Homo sapiens
cccacccugcacuuuc

SEQ ID NO: 1500988 - RNA, 14 nt, Homo sapiens
cccacccugugcca

SEQ ID NO: 1500989 - RNA, 22 nt, Homo sapiens
cccacgagggucaggacuguga

SEQ ID NO: 1500990 - RNA, 19 nt, Homo sapiens
cccacgucuucuugcugca

SEQ ID NO: 1500991 - RNA, 18 nt, Homo sapiens
cccacucccuuccccaua

SEQ ID NO: 1500992 - RNA, 16 nt, Homo sapiens
cccacugcuggugcca

SEQ ID NO: 1500993 - RNA, 17 nt, Homo sapiens
cccacuggggugugugg

SEQ ID NO: 1500994 - RNA, 17 nt, Homo sapiens
cccacuguaugauuuau

SEQ ID NO: 1500995 - RNA, 22 nt, Homo sapiens
cccacuugggccacacuaccca

SEQ ID NO: 1500996 - RNA, 23 nt, Homo sapiens
cccagaaggcagagguugcagug

SEQ ID NO: 1500997 - RNA, 14 nt, Homo sapiens
cccagaauagcuuu

SEQ ID NO: 1500998 - RNA, 19 nt, Homo sapiens
cccagacuacuauuuucuu

SEQ ID NO: 1500999 - RNA, 17 nt, Homo sapiens
cccagacuccaccguca

SEQ ID NO: 1501000 - RNA, 16 nt, Homo sapiens
cccagagcacuuugca

SEQ ID NO: 1501001 - RNA, 12 nt, Homo sapiens
cccagauccuca

SEQ ID NO: 1501002 - RNA, 22 nt, Homo sapiens
cccagaugcucuccccuccucg

SEQ ID NO: 1501003 - RNA, 11 nt, Homo sapiens
cccagcacuug

SEQ ID NO: 1501004 - RNA, 20 nt, Homo sapiens
cccagccaaacccugucuga

SEQ ID NO: 1501005 - RNA, 15 nt, Homo sapiens
cccagcccagagaca

SEQ ID NO: 1501006 - RNA, 17 nt, Homo sapiens
cccagccgucgucuccc

SEQ ID NO: 1501007 - RNA, 15 nt, Homo sapiens
cccagccucccugaa

SEQ ID NO: 1501008 - RNA, 21 nt, Homo sapiens
cccagcuccggccuguccucc

SEQ ID NO: 1501009 - RNA, 19 nt, Homo sapiens
cccagcuuugcugccugag

SEQ ID NO: 1501010 - RNA, 14 nt, Homo sapiens
cccaggaccagcuc

SEQ ID NO: 1501011 - RNA, 14 nt, Homo sapiens
cccaggacccugaa

SEQ ID NO: 1501012 - RNA, 13 nt, Homo sapiens
cccaggacuguug

SEQ ID NO: 1501013 - RNA, 23 nt, Homo sapiens
cccaggagacagaccacuugcca

SEQ ID NO: 1501014 - RNA, 21 nt, Homo sapiens
cccaggagguggcuauggcca

SEQ ID NO: 1501015 - RNA, 17 nt, Homo sapiens
cccaggcuggacugcaa

SEQ ID NO: 1501016 - RNA, 17 nt, Homo sapiens
cccaggcuggagugcag

SEQ ID NO: 1501017 - RNA, 18 nt, Homo sapiens
cccaggcuggagugcagu

SEQ ID NO: 1501018 - RNA, 15 nt, Homo sapiens
aaccccauguccuca

SEQ ID NO: 1501019 - RNA, 15 nt, Homo sapiens
aacccccaguguaau

SEQ ID NO: 1501020 - RNA, 14 nt, Homo sapiens
aaccccugcuccag

SEQ ID NO: 1501021 - RNA, 20 nt, Homo sapiens
aacccggcuaugggacugca

SEQ ID NO: 1501022 - RNA, 22 nt, Homo sapiens
aacccugcuugcacuuuguaac

SEQ ID NO: 1501023 - RNA, 16 nt, Homo sapiens
aacccuucacacccca

SEQ ID NO: 1501024 - RNA, 14 nt, Homo sapiens
aaccgagcaauuuu

SEQ ID NO: 1501025 - RNA, 23 nt, Homo sapiens
aaccgaggcccucaauccaccuu

SEQ ID NO: 1501026 - RNA, 21 nt, Homo sapiens
aaccgggagaaggcaugagaa

SEQ ID NO: 1501027 - RNA, 17 nt, Homo sapiens
aaccggggccuacuaga

SEQ ID NO: 1501028 - RNA, 16 nt, Homo sapiens
aaccggucacccagga

SEQ ID NO: 1501029 - RNA, 15 nt, Homo sapiens
aaccuagaucugcac

SEQ ID NO: 1501030 - RNA, 23 nt, Homo sapiens
aaccuaguacugccccccaugag

SEQ ID NO: 1501031 - RNA, 23 nt, Homo sapiens
aaccuauuuaaaacagugaauua

SEQ ID NO: 1501032 - RNA, 11 nt, Homo sapiens
aaccucagggc

SEQ ID NO: 1501033 - RNA, 14 nt, Homo sapiens
aaccuccuuuacca

SEQ ID NO: 1501034 - RNA, 22 nt, Homo sapiens
aaccucucugaucuugugcuca

SEQ ID NO: 1501035 - RNA, 15 nt, Homo sapiens
aaccucugcacuacu

SEQ ID NO: 1501036 - RNA, 20 nt, Homo sapiens
aaccucuucaugagcuugaa

SEQ ID NO: 1501037 - RNA, 15 nt, Homo sapiens
aaccucuuugcucaa

SEQ ID NO: 1501038 - RNA, 19 nt, Homo sapiens
aaccucuuuucugcaucau

SEQ ID NO: 1501039 - RNA, 17 nt, Homo sapiens
aaccugaagacugagga

SEQ ID NO: 1501040 - RNA, 19 nt, Homo sapiens
aaccugaugucauauucca

SEQ ID NO: 1501041 - RNA, 21 nt, Homo sapiens
aaccugcagggacuccaugcu

SEQ ID NO: 1501042 - RNA, 18 nt, Homo sapiens
aaccugccaugccaggaa

SEQ ID NO: 1501043 - RNA, 23 nt, Homo sapiens
aaccuguccuaaggaaccuuccu

SEQ ID NO: 1501044 - RNA, 14 nt, Homo sapiens
aaccuuacaugugu

SEQ ID NO: 1501045 - RNA, 13 nt, Homo sapiens
aaccuuccagcuc

SEQ ID NO: 1501046 - RNA, 19 nt, Homo sapiens
aaccuuccuuccugcuuga

SEQ ID NO: 1501047 - RNA, 17 nt, Homo sapiens
aaccuugaaugcugcca

SEQ ID NO: 1501048 - RNA, 18 nt, Homo sapiens
aaccuugaaugcugccag

SEQ ID NO: 1501049 - RNA, 16 nt, Homo sapiens
aacgaaugguacuaca

SEQ ID NO: 1501050 - RNA, 19 nt, Homo sapiens
aacgauaaaauuacaaaag

SEQ ID NO: 1501051 - RNA, 12 nt, Homo sapiens
aacgaugugucu

SEQ ID NO: 1501052 - RNA, 23 nt, Homo sapiens
aacgccgcugacugccacccaca

SEQ ID NO: 1501053 - RNA, 18 nt, Homo sapiens
aacggcuccaggauuuua

SEQ ID NO: 1501054 - RNA, 14 nt, Homo sapiens
aacguaaauacaca

SEQ ID NO: 1501055 - RNA, 23 nt, Homo sapiens
aacguccagcucguucucugggc

SEQ ID NO: 1501056 - RNA, 14 nt, Homo sapiens
aacguggcacuggu

SEQ ID NO: 1501057 - RNA, 15 nt, Homo sapiens
aacguugacaaguuu

SEQ ID NO: 1501058 - RNA, 14 nt, Homo sapiens
aacuaaauaaagcu

SEQ ID NO: 1501059 - RNA, 21 nt, Homo sapiens
aacuacagaguuuaugauuua

SEQ ID NO: 1501060 - RNA, 22 nt, Homo sapiens
aacuacagaguuuaugauuuaa

SEQ ID NO: 1501061 - RNA, 12 nt, Homo sapiens
aacuacuaaagu

SEQ ID NO: 1501062 - RNA, 19 nt, Homo sapiens
aacuacuucuuacuucuuu

SEQ ID NO: 1501063 - RNA, 15 nt, Homo sapiens
aacuaggcucagaga

SEQ ID NO: 1501064 - RNA, 21 nt, Homo sapiens
aacuauacauuuauuguuacg

SEQ ID NO: 1501065 - RNA, 17 nt, Homo sapiens
aacuauauucauuucca

SEQ ID NO: 1501066 - RNA, 22 nt, Homo sapiens
aacuaugagcuugcucauuaau

SEQ ID NO: 1501067 - RNA, 19 nt, Homo sapiens
aacuauguagguaaauucu

SEQ ID NO: 1501068 - RNA, 21 nt, Homo sapiens
aacuaugucgaugcacaguau

SEQ ID NO: 1501069 - RNA, 14 nt, Homo sapiens
acuucaccuacauu

SEQ ID NO: 1501070 - RNA, 18 nt, Homo sapiens
acuucacgcccuuggcca

SEQ ID NO: 1501071 - RNA, 18 nt, Homo sapiens
acuucagagcaugaaaau

SEQ ID NO: 1501072 - RNA, 15 nt, Homo sapiens
acuucagcugccuga

SEQ ID NO: 1501073 - RNA, 15 nt, Homo sapiens
acuucaguugaucuu

SEQ ID NO: 1501074 - RNA, 22 nt, Homo sapiens
acuucauauuguugcauugcuu

SEQ ID NO: 1501075 - RNA, 17 nt, Homo sapiens
acuucauugucccucuu

SEQ ID NO: 1501076 - RNA, 16 nt, Homo sapiens
acuucccuacauggag

SEQ ID NO: 1501077 - RNA, 17 nt, Homo sapiens
acuuccuuuaaagauga

SEQ ID NO: 1501078 - RNA, 21 nt, Homo sapiens
acuuccuuuuaacugccaaga

SEQ ID NO: 1501079 - RNA, 16 nt, Homo sapiens
acuucgggcuguguaa

SEQ ID NO: 1501080 - RNA, 14 nt, Homo sapiens
acuucuaccaggac

SEQ ID NO: 1501081 - RNA, 14 nt, Homo sapiens
acuucuagacucac

SEQ ID NO: 1501082 - RNA, 11 nt, Homo sapiens
acuucucacca

SEQ ID NO: 1501083 - RNA, 16 nt, Homo sapiens
acuucugcuggcauca

SEQ ID NO: 1501084 - RNA, 17 nt, Homo sapiens
acuucuuauacauuuga

SEQ ID NO: 1501085 - RNA, 19 nt, Homo sapiens
acuucuuauacauuugaua

SEQ ID NO: 1501086 - RNA, 13 nt, Homo sapiens
acuucuuccuuuc

SEQ ID NO: 1501087 - RNA, 20 nt, Homo sapiens
acuucuuucccuuccuccau

SEQ ID NO: 1501088 - RNA, 20 nt, Homo sapiens
acuugaaagcauccaugugu

SEQ ID NO: 1501089 - RNA, 15 nt, Homo sapiens
acuugacauguagcu

SEQ ID NO: 1501090 - RNA, 20 nt, Homo sapiens
acuugagaggaugaauguau

SEQ ID NO: 1501091 - RNA, 23 nt, Homo sapiens
acuugaguuagcauaauacagaa

SEQ ID NO: 1501092 - RNA, 20 nt, Homo sapiens
acuugauagcaaacacuggg

SEQ ID NO: 1501093 - RNA, 18 nt, Homo sapiens
acuugaugauacaaugaa

SEQ ID NO: 1501094 - RNA, 12 nt, Homo sapiens
acuugccaagaa

SEQ ID NO: 1501095 - RNA, 23 nt, Homo sapiens
acuugccuaaaauauauuccuga

SEQ ID NO: 1501096 - RNA, 23 nt, Homo sapiens
acuugcugcugagugcaccacuu

SEQ ID NO: 1501097 - RNA, 22 nt, Homo sapiens
acuugcugugugaccucaggcc

SEQ ID NO: 1501098 - RNA, 16 nt, Homo sapiens
acuugcuucucuagcu

SEQ ID NO: 1501099 - RNA, 21 nt, Homo sapiens
acuuggaauuuguaaccucag

SEQ ID NO: 1501100 - RNA, 19 nt, Homo sapiens
acuuguauuauuaaugcca

SEQ ID NO: 1501101 - RNA, 16 nt, Homo sapiens
acuugugucccaugau

SEQ ID NO: 1501102 - RNA, 20 nt, Homo sapiens
acuuuagaguagcaugagag

SEQ ID NO: 1501103 - RNA, 11 nt, Homo sapiens
acuuuagucuc

SEQ ID NO: 1501104 - RNA, 21 nt, Homo sapiens
acuuuaucaauuaacugagua

SEQ ID NO: 1501105 - RNA, 17 nt, Homo sapiens
acuuuauuucugaucua

SEQ ID NO: 1501106 - RNA, 18 nt, Homo sapiens
acuuucaguaaacauaaa

SEQ ID NO: 1501107 - RNA, 20 nt, Homo sapiens
acuuucauuauagcagagag

SEQ ID NO: 1501108 - RNA, 12 nt, Homo sapiens
acuuuccacuuc

SEQ ID NO: 1501109 - RNA, 23 nt, Homo sapiens
acuuuccgagccuccaguccaaa

SEQ ID NO: 1501110 - RNA, 16 nt, Homo sapiens
acuuucuaugugacau

SEQ ID NO: 1501111 - RNA, 22 nt, Homo sapiens
acuuucuguugccacaacccug

SEQ ID NO: 1501112 - RNA, 18 nt, Homo sapiens
acuuucuuaucacuuaua

SEQ ID NO: 1501113 - RNA, 18 nt, Homo sapiens
acuuucuucucuuuccca

SEQ ID NO: 1501114 - RNA, 15 nt, Homo sapiens
acuuugagaagcuga

SEQ ID NO: 1501115 - RNA, 18 nt, Homo sapiens
acuuugcuuccccuccag

SEQ ID NO: 1501116 - RNA, 20 nt, Homo sapiens
acuuugcuugagaauccucu

SEQ ID NO: 1501117 - RNA, 21 nt, Homo sapiens
acuuuggaguccccucaccuc

SEQ ID NO: 1501118 - RNA, 21 nt, Homo sapiens
acuaacuccugagaaauguua

SEQ ID NO: 1501119 - RNA, 18 nt, Homo sapiens
acuaagggguauguuccc

SEQ ID NO: 1501120 - RNA, 15 nt, Homo sapiens
acuaaugaggauugc

SEQ ID NO: 1501121 - RNA, 12 nt, Homo sapiens
acuaaugcuuua

SEQ ID NO: 1501122 - RNA, 18 nt, Homo sapiens
acuaauucuaauguggac

SEQ ID NO: 1501123 - RNA, 21 nt, Homo sapiens
acuaauuuuaguauucauucu

SEQ ID NO: 1501124 - RNA, 15 nt, Homo sapiens
acuacaaacuucaaa

SEQ ID NO: 1501125 - RNA, 14 nt, Homo sapiens
acuacaagucagcu

SEQ ID NO: 1501126 - RNA, 13 nt, Homo sapiens
acuacaccagggu

SEQ ID NO: 1501127 - RNA, 15 nt, Homo sapiens
acuacauauuguaaa

SEQ ID NO: 1501128 - RNA, 22 nt, Homo sapiens
acuacaucugggacugacuuuc

SEQ ID NO: 1501129 - RNA, 21 nt, Homo sapiens
acuaccccaaaguuugcucaa

SEQ ID NO: 1501130 - RNA, 15 nt, Homo sapiens
acuacugacaugugg

SEQ ID NO: 1501131 - RNA, 14 nt, Homo sapiens
acuacugugaucag

SEQ ID NO: 1501132 - RNA, 16 nt, Homo sapiens
acuacuucucuuguua

SEQ ID NO: 1501133 - RNA, 14 nt, Homo sapiens
acuagaacucucca

SEQ ID NO: 1501134 - RNA, 16 nt, Homo sapiens
acuagaagggccaguc

SEQ ID NO: 1501135 - RNA, 16 nt, Homo sapiens
acuagagucugaacag

SEQ ID NO: 1501136 - RNA, 14 nt, Homo sapiens
acuagcuuuugcca

SEQ ID NO: 1501137 - RNA, 16 nt, Homo sapiens
acuaguaaacaugugg

SEQ ID NO: 1501138 - RNA, 16 nt, Homo sapiens
acuagucucaccagcc

SEQ ID NO: 1501139 - RNA, 18 nt, Homo sapiens
acuaguggcucucaguua

SEQ ID NO: 1501140 - RNA, 17 nt, Homo sapiens
acuauaauuugacuuga

SEQ ID NO: 1501141 - RNA, 15 nt, Homo sapiens
acuauauuugcuaga

SEQ ID NO: 1501142 - RNA, 15 nt, Homo sapiens
acuaucuuugcugca

SEQ ID NO: 1501143 - RNA, 17 nt, Homo sapiens
acuaugguucccaauaa

SEQ ID NO: 1501144 - RNA, 22 nt, Homo sapiens
acuauguugccuaagcuggucu

SEQ ID NO: 1501145 - RNA, 21 nt, Homo sapiens
acuauuuaaagccuccucauc

SEQ ID NO: 1501146 - RNA, 22 nt, Homo sapiens
acuauuuagauauaacacuaug

SEQ ID NO: 1501147 - RNA, 15 nt, Homo sapiens
acuauuuuaccugaa

SEQ ID NO: 1501148 - RNA, 19 nt, Homo sapiens
acucaaauggggccagauc

SEQ ID NO: 1501149 - RNA, 19 nt, Homo sapiens
acucaacucugagcccaua

SEQ ID NO: 1501150 - RNA, 17 nt, Homo sapiens
acucaaggaauuugcau

SEQ ID NO: 1501151 - RNA, 20 nt, Homo sapiens
acucaaguccuuaccucuuc

SEQ ID NO: 1501152 - RNA, 14 nt, Homo sapiens
acucaaucauuucu

SEQ ID NO: 1501153 - RNA, 17 nt, Homo sapiens
acucaauggccuaaaac

SEQ ID NO: 1501154 - RNA, 15 nt, Homo sapiens
acucacacauucccc

SEQ ID NO: 1501155 - RNA, 22 nt, Homo sapiens
acucaccuucuagucuuggcca

SEQ ID NO: 1501156 - RNA, 15 nt, Homo sapiens
acucacucaguuuau

SEQ ID NO: 1501157 - RNA, 14 nt, Homo sapiens
acucagagacuuca

SEQ ID NO: 1501158 - RNA, 20 nt, Homo sapiens
acucagagaugaacaucuaa

SEQ ID NO: 1501159 - RNA, 20 nt, Homo sapiens
acucagaggaggacauuugg

SEQ ID NO: 1501160 - RNA, 19 nt, Homo sapiens
acucagauggcugaggcag

SEQ ID NO: 1501161 - RNA, 23 nt, Homo sapiens
acucagauugagcccuacauugu

SEQ ID NO: 1501162 - RNA, 13 nt, Homo sapiens
acucagcacucca

SEQ ID NO: 1501163 - RNA, 13 nt, Homo sapiens
acucagccaagac

SEQ ID NO: 1501164 - RNA, 17 nt, Homo sapiens
acucagcugcucugcaa

SEQ ID NO: 1501165 - RNA, 12 nt, Homo sapiens
acucaggaucca

SEQ ID NO: 1501166 - RNA, 11 nt, Homo sapiens
acucaguucca

SEQ ID NO: 1501167 - RNA, 17 nt, Homo sapiens
acucaucugacucauuc

SEQ ID NO: 1501168 - RNA, 16 nt, Homo sapiens
aagagaaccgagcaaa

SEQ ID NO: 1501169 - RNA, 18 nt, Homo sapiens
aagagaaccgagcaaaga

SEQ ID NO: 1501170 - RNA, 13 nt, Homo sapiens
aagagacacucca

SEQ ID NO: 1501171 - RNA, 18 nt, Homo sapiens
aagagaccaagacucuga

SEQ ID NO: 1501172 - RNA, 22 nt, Homo sapiens
aagagcccucaagcggcccuua

SEQ ID NO: 1501173 - RNA, 19 nt, Homo sapiens
aagagcuggcaaagguggc

SEQ ID NO: 1501174 - RNA, 23 nt, Homo sapiens
aagagcuuugugauauacugguu

SEQ ID NO: 1501175 - RNA, 21 nt, Homo sapiens
aagaggacuguguuguggucu

SEQ ID NO: 1501176 - RNA, 18 nt, Homo sapiens
aagaggagcacuuccaaa

SEQ ID NO: 1501177 - RNA, 13 nt, Homo sapiens
aagaggagcugcu

SEQ ID NO: 1501178 - RNA, 17 nt, Homo sapiens
aagaggcugcugagaaa

SEQ ID NO: 1501179 - RNA, 17 nt, Homo sapiens
aagagggaacuuagcag

SEQ ID NO: 1501180 - RNA, 17 nt, Homo sapiens
aagagggagaagggaug

SEQ ID NO: 1501181 - RNA, 12 nt, Homo sapiens
aagagucaucca

SEQ ID NO: 1501182 - RNA, 19 nt, Homo sapiens
aagagugaaaaagagaaua

SEQ ID NO: 1501183 - RNA, 18 nt, Homo sapiens
aagagugauugcagcuuu

SEQ ID NO: 1501184 - RNA, 14 nt, Homo sapiens
aagaguggaaccaa

SEQ ID NO: 1501185 - RNA, 14 nt, Homo sapiens
aagauaaaugugcu

SEQ ID NO: 1501186 - RNA, 14 nt, Homo sapiens
aagauaacuaggaa

SEQ ID NO: 1501187 - RNA, 22 nt, Homo sapiens
aagauacagugucugacuauaa

SEQ ID NO: 1501188 - RNA, 16 nt, Homo sapiens
aagauaguuuucuccu

SEQ ID NO: 1501189 - RNA, 23 nt, Homo sapiens
aagaucaaaagcuuauucaucug

SEQ ID NO: 1501190 - RNA, 12 nt, Homo sapiens
aagaucaaagac

SEQ ID NO: 1501191 - RNA, 19 nt, Homo sapiens
aagaucaacgccucacuga

SEQ ID NO: 1501192 - RNA, 17 nt, Homo sapiens
aagauccuccugcugca

SEQ ID NO: 1501193 - RNA, 14 nt, Homo sapiens
aagaucgcaccauu

SEQ ID NO: 1501194 - RNA, 20 nt, Homo sapiens
aagaucuguuuugaaggcaa

SEQ ID NO: 1501195 - RNA, 24 nt, Homo sapiens
aagaucuuucaggacucuaccuca

SEQ ID NO: 1501196 - RNA, 17 nt, Homo sapiens
aagaugaucauuugccc

SEQ ID NO: 1501197 - RNA, 22 nt, Homo sapiens
aagaugauucaaaguaguuuua

SEQ ID NO: 1501198 - RNA, 13 nt, Homo sapiens
aagaugcacugaa

SEQ ID NO: 1501199 - RNA, 20 nt, Homo sapiens
aagauggccuuugcuuauga

SEQ ID NO: 1501200 - RNA, 16 nt, Homo sapiens
aagaugggucacugaa

SEQ ID NO: 1501201 - RNA, 20 nt, Homo sapiens
aagauuauagaaguagcaaa

SEQ ID NO: 1501202 - RNA, 17 nt, Homo sapiens
aagauugcgguuuacag

SEQ ID NO: 1501203 - RNA, 19 nt, Homo sapiens
aagauuuaugaugcacuua

SEQ ID NO: 1501204 - RNA, 17 nt, Homo sapiens
aagauuuuccucuugug

SEQ ID NO: 1501205 - RNA, 17 nt, Homo sapiens
aagauuuugcaccugua

SEQ ID NO: 1501206 - RNA, 20 nt, Homo sapiens
aagcaaaaaaugaaugucua

SEQ ID NO: 1501207 - RNA, 18 nt, Homo sapiens
aagcaaaacaauaaacua

SEQ ID NO: 1501208 - RNA, 14 nt, Homo sapiens
aagcaaaaugcuuc

SEQ ID NO: 1501209 - RNA, 17 nt, Homo sapiens
aagcaaguucgucuguu

SEQ ID NO: 1501210 - RNA, 20 nt, Homo sapiens
aagcaauccaccugccuugg

SEQ ID NO: 1501211 - RNA, 13 nt, Homo sapiens
aagcacagaauau

SEQ ID NO: 1501212 - RNA, 18 nt, Homo sapiens
aagcacagaauuugucag

SEQ ID NO: 1501213 - RNA, 15 nt, Homo sapiens
aagcaccugcucaac

SEQ ID NO: 1501214 - RNA, 15 nt, Homo sapiens
aagcaccuguuaaua

SEQ ID NO: 1501215 - RNA, 18 nt, Homo sapiens
aagcacuacaccuugccu

SEQ ID NO: 1501216 - RNA, 23 nt, Homo sapiens
aagcacuguuggagcuacugcaa

SEQ ID NO: 1501217 - RNA, 21 nt, Homo sapiens
aagcacuugaaucaguuuuua

SEQ ID NO: 1501218 - RNA, 14 nt, Homo sapiens
aagcagaagugcaa

SEQ ID NO: 1501219 - RNA, 13 nt, Homo sapiens
aagcuuaugcuua

SEQ ID NO: 1501220 - RNA, 20 nt, Homo sapiens
aaggaaaaaacuaguauucc

SEQ ID NO: 1501221 - RNA, 23 nt, Homo sapiens
aaggaaaaaacuuugacuuugcc

SEQ ID NO: 1501222 - RNA, 22 nt, Homo sapiens
aaggaacucuggcuuccaggua

SEQ ID NO: 1501223 - RNA, 13 nt, Homo sapiens
aaggaagagccaa

SEQ ID NO: 1501224 - RNA, 22 nt, Homo sapiens
aaggaagcaaguuuucuuccau

SEQ ID NO: 1501225 - RNA, 18 nt, Homo sapiens
aaggaagcuccacuguca

SEQ ID NO: 1501226 - RNA, 13 nt, Homo sapiens
aaggaaggcuucu

SEQ ID NO: 1501227 - RNA, 23 nt, Homo sapiens
aaggaagucauccagucuauuca

SEQ ID NO: 1501228 - RNA, 21 nt, Homo sapiens
aaggacauuuaaaauucaauu

SEQ ID NO: 1501229 - RNA, 17 nt, Homo sapiens
aaggacgguucuuacac

SEQ ID NO: 1501230 - RNA, 19 nt, Homo sapiens
aaggacucccggagccugu

SEQ ID NO: 1501231 - RNA, 19 nt, Homo sapiens
aaggacucugcuucagucc

SEQ ID NO: 1501232 - RNA, 14 nt, Homo sapiens
aaggauacuuuaca

SEQ ID NO: 1501233 - RNA, 21 nt, Homo sapiens
aaggauaugguagcauuuuau

SEQ ID NO: 1501234 - RNA, 15 nt, Homo sapiens
aaggauauuuacaga

SEQ ID NO: 1501235 - RNA, 18 nt, Homo sapiens
aaggauccucuccacucc

SEQ ID NO: 1501236 - RNA, 15 nt, Homo sapiens
aaggaucucucagga

SEQ ID NO: 1501237 - RNA, 12 nt, Homo sapiens
aaggaugaauga

SEQ ID NO: 1501238 - RNA, 12 nt, Homo sapiens
aaggauguugcc

SEQ ID NO: 1501239 - RNA, 22 nt, Homo sapiens
aaggauguuuugucccauuucc

SEQ ID NO: 1501240 - RNA, 14 nt, Homo sapiens
aaggauugugauau

SEQ ID NO: 1501241 - RNA, 20 nt, Homo sapiens
aaggcagcugguauauucag

SEQ ID NO: 1501242 - RNA, 19 nt, Homo sapiens
aaggcaggcagaucacuug

SEQ ID NO: 1501243 - RNA, 15 nt, Homo sapiens
aaggcaguucagucc

SEQ ID NO: 1501244 - RNA, 17 nt, Homo sapiens
aaggcccugcugaguca

SEQ ID NO: 1501245 - RNA, 16 nt, Homo sapiens
aaggccuucuucccaa

SEQ ID NO: 1501246 - RNA, 16 nt, Homo sapiens
aaggcuccuccuugcc

SEQ ID NO: 1501247 - RNA, 21 nt, Homo sapiens
aaggcuucugugucaaugccu

SEQ ID NO: 1501248 - RNA, 17 nt, Homo sapiens
aaggcuuggcacacagc

SEQ ID NO: 1501249 - RNA, 17 nt, Homo sapiens
aagggaauacugugcau

SEQ ID NO: 1501250 - RNA, 14 nt, Homo sapiens
aagggaauugcuca

SEQ ID NO: 1501251 - RNA, 15 nt, Homo sapiens
aagggcaugccuugu

SEQ ID NO: 1501252 - RNA, 9 nt, Homo sapiens
aagggccag

SEQ ID NO: 1501253 - RNA, 12 nt, Homo sapiens
aagggcucucuu

SEQ ID NO: 1501254 - RNA, 18 nt, Homo sapiens
aaggggaaucagaacuca

SEQ ID NO: 1501255 - RNA, 15 nt, Homo sapiens
aaggggagaagggaa

SEQ ID NO: 1501256 - RNA, 16 nt, Homo sapiens
aaggggaggaaccaga

SEQ ID NO: 1501257 - RNA, 21 nt, Homo sapiens
aaggggauauagugauggggc

SEQ ID NO: 1501258 - RNA, 16 nt, Homo sapiens
aaggggcacugguggc

SEQ ID NO: 1501259 - RNA, 17 nt, Homo sapiens
aagggggguugcagugg

SEQ ID NO: 1501260 - RNA, 19 nt, Homo sapiens
aagggguuggggugacagu

SEQ ID NO: 1501261 - RNA, 18 nt, Homo sapiens
aagguacuauauuugcua

SEQ ID NO: 1501262 - RNA, 15 nt, Homo sapiens
aagguacuuaaagcu

SEQ ID NO: 1501263 - RNA, 12 nt, Homo sapiens
aagguaugcaau

SEQ ID NO: 1501264 - RNA, 21 nt, Homo sapiens
aagguauuuuguagaugugau

SEQ ID NO: 1501265 - RNA, 18 nt, Homo sapiens
aaggucacauugugccuu

SEQ ID NO: 1501266 - RNA, 12 nt, Homo sapiens
aagguccacucc

SEQ ID NO: 1501267 - RNA, 12 nt, Homo sapiens
aaggugaccucu

SEQ ID NO: 1501268 - RNA, 13 nt, Homo sapiens
aaggugcacugcu

SEQ ID NO: 1501269 - RNA, 12 nt, Homo sapiens
aaggugcucaca

SEQ ID NO: 1501270 - RNA, 19 nt, Homo sapiens
aagguggaacaagcacaga

SEQ ID NO: 1501271 - RNA, 13 nt, Homo sapiens
agguggcucucca

SEQ ID NO: 1501272 - RNA, 15 nt, Homo sapiens
aggugggcacuggag

SEQ ID NO: 1501273 - RNA, 19 nt, Homo sapiens
aggugguccuuccuaccuc

SEQ ID NO: 1501274 - RNA, 13 nt, Homo sapiens
agguggugccagu

SEQ ID NO: 1501275 - RNA, 15 nt, Homo sapiens
aggugucugcaccca

SEQ ID NO: 1501276 - RNA, 21 nt, Homo sapiens
aggugucugcacccaggggug

SEQ ID NO: 1501277 - RNA, 17 nt, Homo sapiens
aggugucuuaagccuuu

SEQ ID NO: 1501278 - RNA, 20 nt, Homo sapiens
aggugugaaccuaccugccu

SEQ ID NO: 1501279 - RNA, 21 nt, Homo sapiens
agguguugugcauuuguucag

SEQ ID NO: 1501280 - RNA, 13 nt, Homo sapiens
agguuaaggcaua

SEQ ID NO: 1501281 - RNA, 16 nt, Homo sapiens
agguuaaggugcaaua

SEQ ID NO: 1501282 - RNA, 14 nt, Homo sapiens
agguuaucgaaaua

SEQ ID NO: 1501283 - RNA, 18 nt, Homo sapiens
agguuaucgaaauaacaa

SEQ ID NO: 1501284 - RNA, 14 nt, Homo sapiens
agguucacaggggu

SEQ ID NO: 1501285 - RNA, 17 nt, Homo sapiens
agguucaggaagaccac

SEQ ID NO: 1501286 - RNA, 20 nt, Homo sapiens
agguuccuuaucugucacac

SEQ ID NO: 1501287 - RNA, 19 nt, Homo sapiens
agguucucagguguugcca

SEQ ID NO: 1501288 - RNA, 16 nt, Homo sapiens
agguucugagaccagu

SEQ ID NO: 1501289 - RNA, 15 nt, Homo sapiens
agguucuucagggcc

SEQ ID NO: 1501290 - RNA, 12 nt, Homo sapiens
agguucuugaua

SEQ ID NO: 1501291 - RNA, 15 nt, Homo sapiens
agguugaacuuugcc

SEQ ID NO: 1501292 - RNA, 21 nt, Homo sapiens
agguugcagcaugagacuuuc

SEQ ID NO: 1501293 - RNA, 18 nt, Homo sapiens
agguuggcaaacgggcuu

SEQ ID NO: 1501294 - RNA, 22 nt, Homo sapiens
agguuggugaauuucacaagcu

SEQ ID NO: 1501295 - RNA, 19 nt, Homo sapiens
agguugucuccaggccaug

SEQ ID NO: 1501296 - RNA, 18 nt, Homo sapiens
agguugucugaagucacu

SEQ ID NO: 1501297 - RNA, 21 nt, Homo sapiens
agguugucugaagucacugca

SEQ ID NO: 1501298 - RNA, 13 nt, Homo sapiens
agguuuacauuca

SEQ ID NO: 1501299 - RNA, 13 nt, Homo sapiens
agguuuuguugcu

SEQ ID NO: 1501300 - RNA, 15 nt, Homo sapiens
aguaaaaagguggua

SEQ ID NO: 1501301 - RNA, 21 nt, Homo sapiens
aguaaaauacuauugccucau

SEQ ID NO: 1501302 - RNA, 13 nt, Homo sapiens
aguaaacaaugaa

SEQ ID NO: 1501303 - RNA, 23 nt, Homo sapiens
aguaaaggcugcugcuacaaugu

SEQ ID NO: 1501304 - RNA, 19 nt, Homo sapiens
aguaaaguuguuguaaaaa

SEQ ID NO: 1501305 - RNA, 20 nt, Homo sapiens
aguaaaucuuuuacaacugc

SEQ ID NO: 1501306 - RNA, 23 nt, Homo sapiens
aguaaaugcuagguuaauuccaa

SEQ ID NO: 1501307 - RNA, 20 nt, Homo sapiens
aguaacaaauaaagugcagu

SEQ ID NO: 1501308 - RNA, 23 nt, Homo sapiens
aguaacaaauaaagugcaguuua

SEQ ID NO: 1501309 - RNA, 20 nt, Homo sapiens
aguaacaauacaaauggauu

SEQ ID NO: 1501310 - RNA, 14 nt, Homo sapiens
aguaacacacuucc

SEQ ID NO: 1501311 - RNA, 19 nt, Homo sapiens
aguaagaguacugggagaa

SEQ ID NO: 1501312 - RNA, 14 nt, Homo sapiens
aguaagaugcacug

SEQ ID NO: 1501313 - RNA, 17 nt, Homo sapiens
aguaagaugcacugaaa

SEQ ID NO: 1501314 - RNA, 22 nt, Homo sapiens
aguaaguuugauuucauuaaua

SEQ ID NO: 1501315 - RNA, 18 nt, Homo sapiens
aguaaucuguaagcauaa

SEQ ID NO: 1501316 - RNA, 15 nt, Homo sapiens
aguaaugagcaugau

SEQ ID NO: 1501317 - RNA, 14 nt, Homo sapiens
aguaauggcauuuu

SEQ ID NO: 1501318 - RNA, 19 nt, Homo sapiens
aguaauugaaaaaggugau

SEQ ID NO: 1501319 - RNA, 23 nt, Homo sapiens
aguaauuggucaugugaugcaag

SEQ ID NO: 1501320 - RNA, 18 nt, Homo sapiens
aguacaaacacaggauuu

SEQ ID NO: 1501321 - RNA, 13 nt, Homo sapiens
agugagucucuuc

SEQ ID NO: 1501322 - RNA, 16 nt, Homo sapiens
agugaguuacagcgag

SEQ ID NO: 1501323 - RNA, 22 nt, Homo sapiens
agugauaucccccagccucaag

SEQ ID NO: 1501324 - RNA, 14 nt, Homo sapiens
agugauuacuguca

SEQ ID NO: 1501325 - RNA, 16 nt, Homo sapiens
agugauucuccugccu

SEQ ID NO: 1501326 - RNA, 22 nt, Homo sapiens
agugauugauagaguguuauca

SEQ ID NO: 1501327 - RNA, 17 nt, Homo sapiens
agugcaacccagucaca

SEQ ID NO: 1501328 - RNA, 12 nt, Homo sapiens
agugcacugagc

SEQ ID NO: 1501329 - RNA, 12 nt, Homo sapiens
agugcagccacu

SEQ ID NO: 1501330 - RNA, 18 nt, Homo sapiens
agugcaggagagacagug

SEQ ID NO: 1501331 - RNA, 19 nt, Homo sapiens
agugcaguggcgugaucuc

SEQ ID NO: 1501332 - RNA, 23 nt, Homo sapiens
agugcaguggcgugaucuuggcu

SEQ ID NO: 1501333 - RNA, 20 nt, Homo sapiens
agugcaguggugugaucucg

SEQ ID NO: 1501334 - RNA, 15 nt, Homo sapiens
agugcauccaaaggu

SEQ ID NO: 1501335 - RNA, 14 nt, Homo sapiens
agugccauuccacu

SEQ ID NO: 1501336 - RNA, 23 nt, Homo sapiens
agugcccaaggaauuucugcucu

SEQ ID NO: 1501337 - RNA, 17 nt, Homo sapiens
agugcccugcuuugcaa

SEQ ID NO: 1501338 - RNA, 14 nt, Homo sapiens
agugccugggaaug

SEQ ID NO: 1501339 - RNA, 20 nt, Homo sapiens
agugccuucugcccucccug

SEQ ID NO: 1501340 - RNA, 20 nt, Homo sapiens
agugcgugguauaaucucca

SEQ ID NO: 1501341 - RNA, 14 nt, Homo sapiens
agugcuggcucaca

SEQ ID NO: 1501342 - RNA, 21 nt, Homo sapiens
agugcugggauuacaggcaug

SEQ ID NO: 1501343 - RNA, 18 nt, Homo sapiens
agugcuggucacuaacca

SEQ ID NO: 1501344 - RNA, 16 nt, Homo sapiens
aguggagagaagcucu

SEQ ID NO: 1501345 - RNA, 16 nt, Homo sapiens
aguggauugcauuucu

SEQ ID NO: 1501346 - RNA, 23 nt, Homo sapiens
aguggcaaccuugucucuaugcc

SEQ ID NO: 1501347 - RNA, 18 nt, Homo sapiens
aguggcaugugcugugac

SEQ ID NO: 1501348 - RNA, 23 nt, Homo sapiens
aguggccagccagugccauucca

SEQ ID NO: 1501349 - RNA, 14 nt, Homo sapiens
aguggccaugccac

SEQ ID NO: 1501350 - RNA, 14 nt, Homo sapiens
aguggccuggccag

SEQ ID NO: 1501351 - RNA, 21 nt, Homo sapiens
aguggcgugaucuuggcucac

SEQ ID NO: 1501352 - RNA, 17 nt, Homo sapiens
aguggcuucaucuguca

SEQ ID NO: 1501353 - RNA, 14 nt, Homo sapiens
agugggcaccucag

SEQ ID NO: 1501354 - RNA, 13 nt, Homo sapiens
aguggguggugga

SEQ ID NO: 1501355 - RNA, 16 nt, Homo sapiens
agugguaugaccagug

SEQ ID NO: 1501356 - RNA, 13 nt, Homo sapiens
aguggucgaguga

SEQ ID NO: 1501357 - RNA, 15 nt, Homo sapiens
aguggucgcuuacuu

SEQ ID NO: 1501358 - RNA, 15 nt, Homo sapiens
aguggugacauaguc

SEQ ID NO: 1501359 - RNA, 14 nt, Homo sapiens
aguggugcugcuuu

SEQ ID NO: 1501360 - RNA, 20 nt, Homo sapiens
aguggugugaucucggcuca

SEQ ID NO: 1501361 - RNA, 23 nt, Homo sapiens
agugguucucauuuggucugcca

SEQ ID NO: 1501362 - RNA, 20 nt, Homo sapiens
aguguacauaugugcuggaa

SEQ ID NO: 1501363 - RNA, 23 nt, Homo sapiens
aguguauuuauuuuacagcucau

SEQ ID NO: 1501364 - RNA, 21 nt, Homo sapiens
aguguauuuuauguguggccc

SEQ ID NO: 1501365 - RNA, 14 nt, Homo sapiens
agugucacaucucu

SEQ ID NO: 1501366 - RNA, 20 nt, Homo sapiens
aguguccccuccacugucac

SEQ ID NO: 1501367 - RNA, 20 nt, Homo sapiens
aguguccccuuauacagugg

SEQ ID NO: 1501368 - RNA, 17 nt, Homo sapiens
aguguccucuugcucaa

SEQ ID NO: 1501369 - RNA, 18 nt, Homo sapiens
aguguccucuugcucaaa

SEQ ID NO: 1501370 - RNA, 18 nt, Homo sapiens
agugucucagggugcaga

SEQ ID NO: 1501371 - RNA, 16 nt, Homo sapiens
agugucugucauuuca

SEQ ID NO: 1501372 - RNA, 19 nt, Homo sapiens
agugucuuaggguagaaag

SEQ ID NO: 1501373 - RNA, 19 nt, Homo sapiens
aguuuauuugaaccaauaa

SEQ ID NO: 1501374 - RNA, 20 nt, Homo sapiens
aguuuauuuuuauacuuuca

SEQ ID NO: 1501375 - RNA, 15 nt, Homo sapiens
aguuucacaugagcu

SEQ ID NO: 1501376 - RNA, 14 nt, Homo sapiens
aguuucaggugaca

SEQ ID NO: 1501377 - RNA, 12 nt, Homo sapiens
aguuucccugaa

SEQ ID NO: 1501378 - RNA, 18 nt, Homo sapiens
aguuuccucaucugcaga

SEQ ID NO: 1501379 - RNA, 16 nt, Homo sapiens
aguuucuaaaaacaca

SEQ ID NO: 1501380 - RNA, 18 nt, Homo sapiens
aguuucuccaaguacuuu

SEQ ID NO: 1501381 - RNA, 15 nt, Homo sapiens
aguuucuuagcuuuu

SEQ ID NO: 1501382 - RNA, 18 nt, Homo sapiens
aguuugauaccugcacug

SEQ ID NO: 1501383 - RNA, 18 nt, Homo sapiens
aguuugcaguuaugcaga

SEQ ID NO: 1501384 - RNA, 20 nt, Homo sapiens
aguuugccaccccuguccag

SEQ ID NO: 1501385 - RNA, 16 nt, Homo sapiens
aguuugggccagugaa

SEQ ID NO: 1501386 - RNA, 13 nt, Homo sapiens
aguuuguagcuca

SEQ ID NO: 1501387 - RNA, 22 nt, Homo sapiens
aguuuguuuuuaaaaaaaucua

SEQ ID NO: 1501388 - RNA, 20 nt, Homo sapiens
aguuuuaaacaaaugugaua

SEQ ID NO: 1501389 - RNA, 22 nt, Homo sapiens
aguuuuaaacaaaugugauaca

SEQ ID NO: 1501390 - RNA, 14 nt, Homo sapiens
aguuuuaaacuggu

SEQ ID NO: 1501391 - RNA, 14 nt, Homo sapiens
aguuuuaacuguaa

SEQ ID NO: 1501392 - RNA, 17 nt, Homo sapiens
aguuuuacuaaaacacu

SEQ ID NO: 1501393 - RNA, 20 nt, Homo sapiens
aguuuucuggagugagcacu

SEQ ID NO: 1501394 - RNA, 19 nt, Homo sapiens
aguuuuggaaacguauuca

SEQ ID NO: 1501395 - RNA, 15 nt, Homo sapiens
aguuuuggcauaaua

SEQ ID NO: 1501396 - RNA, 16 nt, Homo sapiens
aguuuuguauucaaua

SEQ ID NO: 1501397 - RNA, 13 nt, Homo sapiens
aguuuuuauacau

SEQ ID NO: 1501398 - RNA, 17 nt, Homo sapiens
aguuuuugauagcuuua

SEQ ID NO: 1501399 - RNA, 14 nt, Homo sapiens
auaaaaaaagacaa

SEQ ID NO: 1501400 - RNA, 15 nt, Homo sapiens
auaaaaaagaacuuu

SEQ ID NO: 1501401 - RNA, 16 nt, Homo sapiens
auaaaacacugcccuc

SEQ ID NO: 1501402 - RNA, 20 nt, Homo sapiens
auaaaacuuuucugcugaua

SEQ ID NO: 1501403 - RNA, 21 nt, Homo sapiens
auaaaagaaccgagcaauuuu

SEQ ID NO: 1501404 - RNA, 23 nt, Homo sapiens
auaaaagagaagaugaggcauga

SEQ ID NO: 1501405 - RNA, 13 nt, Homo sapiens
auaaaauaauuau

SEQ ID NO: 1501406 - RNA, 17 nt, Homo sapiens
auaaaauauaaucuaau

SEQ ID NO: 1501407 - RNA, 17 nt, Homo sapiens
auaaaauguaauuacuu

SEQ ID NO: 1501408 - RNA, 23 nt, Homo sapiens
auaaaauuggcaccaugugccau

SEQ ID NO: 1501409 - RNA, 19 nt, Homo sapiens
auaaacauuucauuuccca

SEQ ID NO: 1501410 - RNA, 23 nt, Homo sapiens
auaaacuauacacuuaaugauac

SEQ ID NO: 1501411 - RNA, 20 nt, Homo sapiens
auaaacugacuaaacuuaca

SEQ ID NO: 1501412 - RNA, 17 nt, Homo sapiens
auaaagaaaaccuuucu

SEQ ID NO: 1501413 - RNA, 17 nt, Homo sapiens
auaaagauuucaagauc

SEQ ID NO: 1501414 - RNA, 22 nt, Homo sapiens
auaaagcacccuguaucacaga

SEQ ID NO: 1501415 - RNA, 15 nt, Homo sapiens
auaaagcacugagca

SEQ ID NO: 1501416 - RNA, 18 nt, Homo sapiens
auaaaggcccccacuucu

SEQ ID NO: 1501417 - RNA, 19 nt, Homo sapiens
auaaaguccuuggacuguu

SEQ ID NO: 1501418 - RNA, 12 nt, Homo sapiens
auaaagugcagu

SEQ ID NO: 1501419 - RNA, 18 nt, Homo sapiens
auaaaguguaaguucaca

SEQ ID NO: 1501420 - RNA, 12 nt, Homo sapiens
auaaauagccuu

SEQ ID NO: 1501421 - RNA, 13 nt, Homo sapiens
auaaauaugcagu

SEQ ID NO: 1501422 - RNA, 16 nt, Homo sapiens
auaaauauuacaguga

SEQ ID NO: 1501423 - RNA, 15 nt, Homo sapiens
auaaauggguguaua

SEQ ID NO: 1501424 - RNA, 16 nt, Homo sapiens
auacagaucucagggc

SEQ ID NO: 1501425 - RNA, 11 nt, Homo sapiens
auacaguauuu

SEQ ID NO: 1501426 - RNA, 13 nt, Homo sapiens
auacagugccuug

SEQ ID NO: 1501427 - RNA, 17 nt, Homo sapiens
auacauaauacaugauu

SEQ ID NO: 1501428 - RNA, 15 nt, Homo sapiens
auacauauuaucuca

SEQ ID NO: 1501429 - RNA, 22 nt, Homo sapiens
auacauccacaggguuuugaca

SEQ ID NO: 1501430 - RNA, 13 nt, Homo sapiens
auacaugauugca

SEQ ID NO: 1501431 - RNA, 15 nt, Homo sapiens
auacauguaauucua

SEQ ID NO: 1501432 - RNA, 21 nt, Homo sapiens
auacaugugccgaaugugcag

SEQ ID NO: 1501433 - RNA, 15 nt, Homo sapiens
auacauuugauaaag

SEQ ID NO: 1501434 - RNA, 17 nt, Homo sapiens
auaccaaccaaaccaau

SEQ ID NO: 1501435 - RNA, 22 nt, Homo sapiens
auaccaaccugaagacaccguu

SEQ ID NO: 1501436 - RNA, 14 nt, Homo sapiens
auaccaacuguaca

SEQ ID NO: 1501437 - RNA, 21 nt, Homo sapiens
auaccuguugagacugauuca

SEQ ID NO: 1501438 - RNA, 15 nt, Homo sapiens
auaccuuccccacau

SEQ ID NO: 1501439 - RNA, 16 nt, Homo sapiens
auaccuuuuuguguca

SEQ ID NO: 1501440 - RNA, 20 nt, Homo sapiens
auacgcucaggugguugugg

SEQ ID NO: 1501441 - RNA, 23 nt, Homo sapiens
auacuaguuugcuuugcugacca

SEQ ID NO: 1501442 - RNA, 15 nt, Homo sapiens
auacuauccaguuac

SEQ ID NO: 1501443 - RNA, 21 nt, Homo sapiens
auacuccaacugaaauguuaa

SEQ ID NO: 1501444 - RNA, 15 nt, Homo sapiens
auacucuagaugaag

SEQ ID NO: 1501445 - RNA, 14 nt, Homo sapiens
auacugaaggacac

SEQ ID NO: 1501446 - RNA, 19 nt, Homo sapiens
auacugacacuuugccaga

SEQ ID NO: 1501447 - RNA, 19 nt, Homo sapiens
auacuggccuggacuguuu

SEQ ID NO: 1501448 - RNA, 19 nt, Homo sapiens
auacuucaugagcauucau

SEQ ID NO: 1501449 - RNA, 15 nt, Homo sapiens
auacuuuaaaggaaa

SEQ ID NO: 1501450 - RNA, 13 nt, Homo sapiens
auacuuuacaugg

SEQ ID NO: 1501451 - RNA, 14 nt, Homo sapiens
auacuuucagucaa

SEQ ID NO: 1501452 - RNA, 15 nt, Homo sapiens
auacuuuugugaaca

SEQ ID NO: 1501453 - RNA, 19 nt, Homo sapiens
auagaaaauuaaacacaaa

SEQ ID NO: 1501454 - RNA, 15 nt, Homo sapiens
auagaaccacuauga

SEQ ID NO: 1501455 - RNA, 19 nt, Homo sapiens
auagaagcaaaugacaaaa

SEQ ID NO: 1501456 - RNA, 14 nt, Homo sapiens
auagaauacaugga

SEQ ID NO: 1501457 - RNA, 12 nt, Homo sapiens
auagaggcuucu

SEQ ID NO: 1501458 - RNA, 19 nt, Homo sapiens
auagaucaaagucaaaaau

SEQ ID NO: 1501459 - RNA, 13 nt, Homo sapiens
auagaucuuaggg

SEQ ID NO: 1501460 - RNA, 22 nt, Homo sapiens
auagaugccgcggaaggucccu

SEQ ID NO: 1501461 - RNA, 15 nt, Homo sapiens
auagcaaacacuggg

SEQ ID NO: 1501462 - RNA, 14 nt, Homo sapiens
auagcaauuucgcc

SEQ ID NO: 1501463 - RNA, 14 nt, Homo sapiens
auagcaucucagga

SEQ ID NO: 1501464 - RNA, 18 nt, Homo sapiens
auagcuaaguacacaaua

SEQ ID NO: 1501465 - RNA, 17 nt, Homo sapiens
auagcuacaguguaaua

SEQ ID NO: 1501466 - RNA, 18 nt, Homo sapiens
auaggagccgauggaucu

SEQ ID NO: 1501467 - RNA, 15 nt, Homo sapiens
auaggagugaauaca

SEQ ID NO: 1501468 - RNA, 19 nt, Homo sapiens
auaggccaucaauaucaca

SEQ ID NO: 1501469 - RNA, 18 nt, Homo sapiens
auaggccugcucagccuc

SEQ ID NO: 1501470 - RNA, 16 nt, Homo sapiens
auaggccugucccuug

SEQ ID NO: 1501471 - RNA, 17 nt, Homo sapiens
auagguauauauaugcc

SEQ ID NO: 1501472 - RNA, 17 nt, Homo sapiens
auaguaccucugcuauu

SEQ ID NO: 1501473 - RNA, 19 nt, Homo sapiens
auaguaccuucaauacuua

SEQ ID NO: 1501474 - RNA, 21 nt, Homo sapiens
auagucucauucugucaccca

SEQ ID NO: 1501475 - RNA, 14 nt, Homo sapiens
caaccuuccagcuc

SEQ ID NO: 1501476 - RNA, 17 nt, Homo sapiens
caacuaccuagacugga

SEQ ID NO: 1501477 - RNA, 15 nt, Homo sapiens
caacuagcugggacu

SEQ ID NO: 1501478 - RNA, 13 nt, Homo sapiens
caacuaggccuca

SEQ ID NO: 1501479 - RNA, 21 nt, Homo sapiens
caacuaguagcuaaccaucac

SEQ ID NO: 1501480 - RNA, 14 nt, Homo sapiens
caacuauuuuucca

SEQ ID NO: 1501481 - RNA, 22 nt, Homo sapiens
caacucucuccuguauaaucuc

SEQ ID NO: 1501482 - RNA, 18 nt, Homo sapiens
caacucugagaucuaagg

SEQ ID NO: 1501483 - RNA, 20 nt, Homo sapiens
caacugaaaagacucagugu

SEQ ID NO: 1501484 - RNA, 22 nt, Homo sapiens
caacugaccugaccccauuccu

SEQ ID NO: 1501485 - RNA, 21 nt, Homo sapiens
caacugaguguuauuugcaca

SEQ ID NO: 1501486 - RNA, 15 nt, Homo sapiens
caacugauugcaaca

SEQ ID NO: 1501487 - RNA, 19 nt, Homo sapiens
caacugggucugacaugaa

SEQ ID NO: 1501488 - RNA, 13 nt, Homo sapiens
caacugugacugu

SEQ ID NO: 1501489 - RNA, 16 nt, Homo sapiens
caacuguggucaaucc

SEQ ID NO: 1501490 - RNA, 16 nt, Homo sapiens
caacuuagagauugca

SEQ ID NO: 1501491 - RNA, 20 nt, Homo sapiens
caacuucagcaguaccuaua

SEQ ID NO: 1501492 - RNA, 23 nt, Homo sapiens
caacuucaguuuuauuuuugcca

SEQ ID NO: 1501493 - RNA, 21 nt, Homo sapiens
caacuucauuugaugcuaaau

SEQ ID NO: 1501494 - RNA, 16 nt, Homo sapiens
caacuuccgcugaggg

SEQ ID NO: 1501495 - RNA, 12 nt, Homo sapiens
caacuuugacaa

SEQ ID NO: 1501496 - RNA, 17 nt, Homo sapiens
caagaaaaacaucuuug

SEQ ID NO: 1501497 - RNA, 15 nt, Homo sapiens
caagaaaacaacuuc

SEQ ID NO: 1501498 - RNA, 14 nt, Homo sapiens
caagaaaaccuaga

SEQ ID NO: 1501499 - RNA, 17 nt, Homo sapiens
caagaaaauaaaacuaa

SEQ ID NO: 1501500 - RNA, 16 nt, Homo sapiens
caagaacaaacacugc

SEQ ID NO: 1501501 - RNA, 22 nt, Homo sapiens
caagaagaaauaugaaauucca

SEQ ID NO: 1501502 - RNA, 15 nt, Homo sapiens
caagaagaaugaacu

SEQ ID NO: 1501503 - RNA, 18 nt, Homo sapiens
caagaagaggaaagggag

SEQ ID NO: 1501504 - RNA, 21 nt, Homo sapiens
caagaagugaagaaugcacaa

SEQ ID NO: 1501505 - RNA, 13 nt, Homo sapiens
caagaauaauuca

SEQ ID NO: 1501506 - RNA, 23 nt, Homo sapiens
caagaauagaugcugacuguacu

SEQ ID NO: 1501507 - RNA, 22 nt, Homo sapiens
caagacaauucuucuucuucca

SEQ ID NO: 1501508 - RNA, 15 nt, Homo sapiens
caagacacugagaua

SEQ ID NO: 1501509 - RNA, 23 nt, Homo sapiens
caagaccagagacccaacagcag

SEQ ID NO: 1501510 - RNA, 15 nt, Homo sapiens
caagacuccaucuca

SEQ ID NO: 1501511 - RNA, 21 nt, Homo sapiens
caagacuccaucucaaaaaag

SEQ ID NO: 1501512 - RNA, 13 nt, Homo sapiens
caagacugaaaca

SEQ ID NO: 1501513 - RNA, 15 nt, Homo sapiens
caagagaaaaugugu

SEQ ID NO: 1501514 - RNA, 20 nt, Homo sapiens
caagagaugggaaugaggug

SEQ ID NO: 1501515 - RNA, 16 nt, Homo sapiens
caagagggauaaaaca

SEQ ID NO: 1501516 - RNA, 18 nt, Homo sapiens
caagagugauugcagcuu

SEQ ID NO: 1501517 - RNA, 15 nt, Homo sapiens
caagaguuuguucug

SEQ ID NO: 1501518 - RNA, 17 nt, Homo sapiens
caagaguuuguucuguu

SEQ ID NO: 1501519 - RNA, 23 nt, Homo sapiens
caagaguuuguucuguucugggg

SEQ ID NO: 1501520 - RNA, 22 nt, Homo sapiens
caagauaggggcacacuacaga

SEQ ID NO: 1501521 - RNA, 19 nt, Homo sapiens
caagauccuccugcugcag

SEQ ID NO: 1501522 - RNA, 20 nt, Homo sapiens
caagaucgcaccauugcacu

SEQ ID NO: 1501523 - RNA, 13 nt, Homo sapiens
caagaugguccau

SEQ ID NO: 1501524 - RNA, 17 nt, Homo sapiens
caagauuguaaguaaau

SEQ ID NO: 1501525 - RNA, 22 nt, Homo sapiens
caagcacaaaaacuuaacaaaa

SEQ ID NO: 1501526 - RNA, 13 nt, Homo sapiens
caagcaccuguua

SEQ ID NO: 1501527 - RNA, 20 nt, Homo sapiens
caauucagauugucuugcaa

SEQ ID NO: 1501528 - RNA, 14 nt, Homo sapiens
caauuccgcauuua

SEQ ID NO: 1501529 - RNA, 23 nt, Homo sapiens
caauucugugacauacauauuau

SEQ ID NO: 1501530 - RNA, 11 nt, Homo sapiens
caauuguguag

SEQ ID NO: 1501531 - RNA, 11 nt, Homo sapiens
caauuuaguuc

SEQ ID NO: 1501532 - RNA, 17 nt, Homo sapiens
caauuucuugguauuau

SEQ ID NO: 1501533 - RNA, 13 nt, Homo sapiens
cacaaaacccaga

SEQ ID NO: 1501534 - RNA, 21 nt, Homo sapiens
cacaaaaguccacugaugcaa

SEQ ID NO: 1501535 - RNA, 16 nt, Homo sapiens
cacaaaaucacuuuaa

SEQ ID NO: 1501536 - RNA, 14 nt, Homo sapiens
cacaaaauucuuau

SEQ ID NO: 1501537 - RNA, 13 nt, Homo sapiens
cacaaaccaguau

SEQ ID NO: 1501538 - RNA, 22 nt, Homo sapiens
cacaaaggaaguccaaccugag

SEQ ID NO: 1501539 - RNA, 11 nt, Homo sapiens
cacaaagggaa

SEQ ID NO: 1501540 - RNA, 18 nt, Homo sapiens
cacaaaugauguuuucag

SEQ ID NO: 1501541 - RNA, 15 nt, Homo sapiens
cacaacacacacacu

SEQ ID NO: 1501542 - RNA, 12 nt, Homo sapiens
cacaaccaaaaa

SEQ ID NO: 1501543 - RNA, 15 nt, Homo sapiens
cacaaccacauguau

SEQ ID NO: 1501544 - RNA, 14 nt, Homo sapiens
cacaacccaagaau

SEQ ID NO: 1501545 - RNA, 16 nt, Homo sapiens
cacaacccuguuuuau

SEQ ID NO: 1501546 - RNA, 19 nt, Homo sapiens
cacaaccuuccagcuccau

SEQ ID NO: 1501547 - RNA, 21 nt, Homo sapiens
cacaacuccuacaugauguua

SEQ ID NO: 1501548 - RNA, 20 nt, Homo sapiens
cacaagaagcugguggagca

SEQ ID NO: 1501549 - RNA, 18 nt, Homo sapiens
cacaagaagugguccauc

SEQ ID NO: 1501550 - RNA, 17 nt, Homo sapiens
cacaagcagagugcaca

SEQ ID NO: 1501551 - RNA, 17 nt, Homo sapiens
cacaagcuggaagcaca

SEQ ID NO: 1501552 - RNA, 18 nt, Homo sapiens
cacaagcuggaagcacau

SEQ ID NO: 1501553 - RNA, 16 nt, Homo sapiens
cacaaggucacuagau

SEQ ID NO: 1501554 - RNA, 22 nt, Homo sapiens
cacaagugguguuuauugcaau

SEQ ID NO: 1501555 - RNA, 15 nt, Homo sapiens
cacaaugaugaugau

SEQ ID NO: 1501556 - RNA, 21 nt, Homo sapiens
cacaauuauuggcaaaguuua

SEQ ID NO: 1501557 - RNA, 16 nt, Homo sapiens
cacacaaggugcaaau

SEQ ID NO: 1501558 - RNA, 13 nt, Homo sapiens
cacacacacaugc

SEQ ID NO: 1501559 - RNA, 19 nt, Homo sapiens
cacacacucccugcuugca

SEQ ID NO: 1501560 - RNA, 14 nt, Homo sapiens
cacacagacuccac

SEQ ID NO: 1501561 - RNA, 12 nt, Homo sapiens
cacacagcacuc

SEQ ID NO: 1501562 - RNA, 16 nt, Homo sapiens
cacacaggguggcaga

SEQ ID NO: 1501563 - RNA, 22 nt, Homo sapiens
cacacauccccuuuguguagaa

SEQ ID NO: 1501564 - RNA, 12 nt, Homo sapiens
cacacaucucau

SEQ ID NO: 1501565 - RNA, 18 nt, Homo sapiens
cacacaugcuaggaugcg

SEQ ID NO: 1501566 - RNA, 13 nt, Homo sapiens
cacaccaacagug

SEQ ID NO: 1501567 - RNA, 19 nt, Homo sapiens
cacacccacagaaggacac

SEQ ID NO: 1501568 - RNA, 19 nt, Homo sapiens
cacacccaggcccaugcca

SEQ ID NO: 1501569 - RNA, 21 nt, Homo sapiens
cacaccuggcccuugcaaucu

SEQ ID NO: 1501570 - RNA, 19 nt, Homo sapiens
cacaccugugccuccucag

SEQ ID NO: 1501571 - RNA, 17 nt, Homo sapiens
cacacuaagagggcaga

SEQ ID NO: 1501572 - RNA, 14 nt, Homo sapiens
cacacugguacuua

SEQ ID NO: 1501573 - RNA, 19 nt, Homo sapiens
cacacuguucugaaaguga

SEQ ID NO: 1501574 - RNA, 14 nt, Homo sapiens
cacacuuggaugca

SEQ ID NO: 1501575 - RNA, 20 nt, Homo sapiens
cacacuuggaugcaggguuu

SEQ ID NO: 1501576 - RNA, 15 nt, Homo sapiens
cacacuugugugugg

SEQ ID NO: 1501577 - RNA, 15 nt, Homo sapiens
cacacuuugcacuga

SEQ ID NO: 1501578 - RNA, 14 nt, Homo sapiens
cacagaaaugcugc

SEQ ID NO: 1501579 - RNA, 18 nt, Homo sapiens
cacagaaggaaucugugc

SEQ ID NO: 1501580 - RNA, 22 nt, Homo sapiens
cacagaauauuuuuauauuucc

SEQ ID NO: 1501581 - RNA, 22 nt, Homo sapiens
cacagacacacacacgcacgca

SEQ ID NO: 1501582 - RNA, 14 nt, Homo sapiens
cacagacacuuaca

SEQ ID NO: 1501583 - RNA, 20 nt, Homo sapiens
cacagagaagcggauuucca

SEQ ID NO: 1501584 - RNA, 16 nt, Homo sapiens
cacagaggagugcagc

SEQ ID NO: 1501585 - RNA, 14 nt, Homo sapiens
cacagagugcauug

SEQ ID NO: 1501586 - RNA, 15 nt, Homo sapiens
cacagcaacaaugac

SEQ ID NO: 1501587 - RNA, 20 nt, Homo sapiens
cacagcaggcuuucaagaag

SEQ ID NO: 1501588 - RNA, 22 nt, Homo sapiens
cacagcagguccuccaucccaa

SEQ ID NO: 1501589 - RNA, 21 nt, Homo sapiens
cacagcaucauuuugcauuca

SEQ ID NO: 1501590 - RNA, 17 nt, Homo sapiens
cacagcaucgggagcac

SEQ ID NO: 1501591 - RNA, 19 nt, Homo sapiens
cacagccaccccugagauc

SEQ ID NO: 1501592 - RNA, 11 nt, Homo sapiens
cacagccagag

SEQ ID NO: 1501593 - RNA, 21 nt, Homo sapiens
cacagcggaggagaccagcuc

SEQ ID NO: 1501594 - RNA, 20 nt, Homo sapiens
cacagcuccuuuuccagagc

SEQ ID NO: 1501595 - RNA, 18 nt, Homo sapiens
cacagcuuagauuucaua

SEQ ID NO: 1501596 - RNA, 18 nt, Homo sapiens
cacaggacaacuuuacaa

SEQ ID NO: 1501597 - RNA, 23 nt, Homo sapiens
cacaggagauuccagucuacuug

SEQ ID NO: 1501598 - RNA, 18 nt, Homo sapiens
cacaggauccuauucuca

SEQ ID NO: 1501599 - RNA, 14 nt, Homo sapiens
cacaggauuuguaa

SEQ ID NO: 1501600 - RNA, 18 nt, Homo sapiens
cacaggcagauguuugcc

SEQ ID NO: 1501601 - RNA, 22 nt, Homo sapiens
cacaggcagcuggaugagacuu

SEQ ID NO: 1501602 - RNA, 19 nt, Homo sapiens
cacaggcaucuacacagcc

SEQ ID NO: 1501603 - RNA, 16 nt, Homo sapiens
cacagggcaccagagg

SEQ ID NO: 1501604 - RNA, 14 nt, Homo sapiens
cacaguagaacugu

SEQ ID NO: 1501605 - RNA, 15 nt, Homo sapiens
cacaguccucauuua

SEQ ID NO: 1501606 - RNA, 11 nt, Homo sapiens
cacagugcaua

SEQ ID NO: 1501607 - RNA, 23 nt, Homo sapiens
cacaguucuuugggccagacaug

SEQ ID NO: 1501608 - RNA, 18 nt, Homo sapiens
cacauacaggugcucaau

SEQ ID NO: 1501609 - RNA, 16 nt, Homo sapiens
cacauauguaguauaa

SEQ ID NO: 1501610 - RNA, 23 nt, Homo sapiens
cacaucccuggaaggacauccau

SEQ ID NO: 1501611 - RNA, 15 nt, Homo sapiens
cacaucccuuugaaa

SEQ ID NO: 1501612 - RNA, 12 nt, Homo sapiens
cacaucugucac

SEQ ID NO: 1501613 - RNA, 16 nt, Homo sapiens
cacaugaauauaaaug

SEQ ID NO: 1501614 - RNA, 19 nt, Homo sapiens
cacaugacaacuuugccag

SEQ ID NO: 1501615 - RNA, 18 nt, Homo sapiens
cacaugcuaggaugcgga

SEQ ID NO: 1501616 - RNA, 14 nt, Homo sapiens
cacauggaacuuua

SEQ ID NO: 1501617 - RNA, 16 nt, Homo sapiens
cacauguuuaacuuua

SEQ ID NO: 1501618 - RNA, 21 nt, Homo sapiens
cacauuaguacuuauguugca

SEQ ID NO: 1501619 - RNA, 17 nt, Homo sapiens
cacauuucuaugccaaa

SEQ ID NO: 1501620 - RNA, 23 nt, Homo sapiens
caccaaaucagcugcuacuacuc

SEQ ID NO: 1501621 - RNA, 16 nt, Homo sapiens
caccacaccaucaggc

SEQ ID NO: 1501622 - RNA, 17 nt, Homo sapiens
caccaccugacgcugca

SEQ ID NO: 1501623 - RNA, 20 nt, Homo sapiens
caccagagcauuuccaacac

SEQ ID NO: 1501624 - RNA, 18 nt, Homo sapiens
caccagaugugacagugu

SEQ ID NO: 1501625 - RNA, 21 nt, Homo sapiens
caccagccauacuuaucucuc

SEQ ID NO: 1501626 - RNA, 18 nt, Homo sapiens
caccagcccugaccccag

SEQ ID NO: 1501627 - RNA, 22 nt, Homo sapiens
caccaggacuuggggucaggaa

SEQ ID NO: 1501628 - RNA, 16 nt, Homo sapiens
caccaggcacugccug

SEQ ID NO: 1501629 - RNA, 20 nt, Homo sapiens
cauuguuaagaaaguauuug

SEQ ID NO: 1501630 - RNA, 15 nt, Homo sapiens
cauuuaccaguauag

SEQ ID NO: 1501631 - RNA, 12 nt, Homo sapiens
cauuuacuuaac

SEQ ID NO: 1501632 - RNA, 21 nt, Homo sapiens
cauuuagaacuuuaagucuca

SEQ ID NO: 1501633 - RNA, 13 nt, Homo sapiens
cauuuagcuucuu

SEQ ID NO: 1501634 - RNA, 15 nt, Homo sapiens
cauuuagucauguga

SEQ ID NO: 1501635 - RNA, 12 nt, Homo sapiens
cauuuaugcaca

SEQ ID NO: 1501636 - RNA, 19 nt, Homo sapiens
cauuuauuuauacagugcc

SEQ ID NO: 1501637 - RNA, 17 nt, Homo sapiens
cauuuauuuuaagcacu

SEQ ID NO: 1501638 - RNA, 20 nt, Homo sapiens
cauuucaucagcaaguuugg

SEQ ID NO: 1501639 - RNA, 20 nt, Homo sapiens
cauuucauuaagguuccagu

SEQ ID NO: 1501640 - RNA, 18 nt, Homo sapiens
cauuuccaacaccacaga

SEQ ID NO: 1501641 - RNA, 19 nt, Homo sapiens
cauuuccugacagaaggac

SEQ ID NO: 1501642 - RNA, 21 nt, Homo sapiens
cauuuccuuccagcccaucca

SEQ ID NO: 1501643 - RNA, 14 nt, Homo sapiens
cauuucuaucacau

SEQ ID NO: 1501644 - RNA, 17 nt, Homo sapiens
cauuucuucagucagaa

SEQ ID NO: 1501645 - RNA, 19 nt, Homo sapiens
cauuucuuuucuuuuuaca

SEQ ID NO: 1501646 - RNA, 14 nt, Homo sapiens
cauuugaacauguu

SEQ ID NO: 1501647 - RNA, 14 nt, Homo sapiens
cauuugauggccac

SEQ ID NO: 1501648 - RNA, 22 nt, Homo sapiens
cauuugcaaaggcgacaauaaa

SEQ ID NO: 1501649 - RNA, 15 nt, Homo sapiens
cauuugcaccuaccu

SEQ ID NO: 1501650 - RNA, 14 nt, Homo sapiens
cauuugcauuugcu

SEQ ID NO: 1501651 - RNA, 14 nt, Homo sapiens
cauuugcucuuuca

SEQ ID NO: 1501652 - RNA, 19 nt, Homo sapiens
cauuugcucuuucaucucu

SEQ ID NO: 1501653 - RNA, 14 nt, Homo sapiens
cauuugcuuugucc

SEQ ID NO: 1501654 - RNA, 19 nt, Homo sapiens
cauuugggagacaugugac

SEQ ID NO: 1501655 - RNA, 16 nt, Homo sapiens
cauuuguaccucgagu

SEQ ID NO: 1501656 - RNA, 12 nt, Homo sapiens
cauuugucacag

SEQ ID NO: 1501657 - RNA, 16 nt, Homo sapiens
cauuuguuaaaauaca

SEQ ID NO: 1501658 - RNA, 22 nt, Homo sapiens
cauuuuaucccauggaaccacu

SEQ ID NO: 1501659 - RNA, 16 nt, Homo sapiens
cauuuuauucuuuaag

SEQ ID NO: 1501660 - RNA, 17 nt, Homo sapiens
cauuuuuaauaugacaa

SEQ ID NO: 1501661 - RNA, 17 nt, Homo sapiens
cauuuuuuucacuggag

SEQ ID NO: 1501662 - RNA, 23 nt, Homo sapiens
cauuuuuuucacuggaguuacau

SEQ ID NO: 1501663 - RNA, 18 nt, Homo sapiens
ccaaaacaaacaaacaga

SEQ ID NO: 1501664 - RNA, 16 nt, Homo sapiens
ccaaaacuuuaaugaa

SEQ ID NO: 1501665 - RNA, 11 nt, Homo sapiens
ccaaaagcuag

SEQ ID NO: 1501666 - RNA, 13 nt, Homo sapiens
ccaaaauccgacu

SEQ ID NO: 1501667 - RNA, 13 nt, Homo sapiens
ccaaaaugcauuu

SEQ ID NO: 1501668 - RNA, 13 nt, Homo sapiens
ccaaaauggucuc

SEQ ID NO: 1501669 - RNA, 18 nt, Homo sapiens
ccaaacacauacaggaag

SEQ ID NO: 1501670 - RNA, 15 nt, Homo sapiens
ccaaacacugaggca

SEQ ID NO: 1501671 - RNA, 17 nt, Homo sapiens
ccaaacucaaacuugag

SEQ ID NO: 1501672 - RNA, 18 nt, Homo sapiens
ccaaaggauaaguguccc

SEQ ID NO: 1501673 - RNA, 18 nt, Homo sapiens
ccaaaggcauaagacccu

SEQ ID NO: 1501674 - RNA, 20 nt, Homo sapiens
ccaaaguccuuuuuuuccau

SEQ ID NO: 1501675 - RNA, 18 nt, Homo sapiens
ccaaaguuugcucaagga

SEQ ID NO: 1501676 - RNA, 19 nt, Homo sapiens
ccaaaguuugcucaaggag

SEQ ID NO: 1501677 - RNA, 12 nt, Homo sapiens
ccaaauagcaaa

SEQ ID NO: 1501678 - RNA, 18 nt, Homo sapiens
ccaaaucugacauauuau

SEQ ID NO: 1501679 - RNA, 12 nt, Homo sapiens
ccaaauugcagc

SEQ ID NO: 1501680 - RNA, 15 nt, Homo sapiens
ccaaauuuggcuaaa

SEQ ID NO: 1501681 - RNA, 16 nt, Homo sapiens
ccaaauuuggcuaaaa

SEQ ID NO: 1501682 - RNA, 21 nt, Homo sapiens
ccaacagaagcuuccauucca

SEQ ID NO: 1501683 - RNA, 18 nt, Homo sapiens
ccaacagucaaaacagag

SEQ ID NO: 1501684 - RNA, 20 nt, Homo sapiens
ccaacaucaacaucuugguc

SEQ ID NO: 1501685 - RNA, 13 nt, Homo sapiens
ccaaccaguuuga

SEQ ID NO: 1501686 - RNA, 20 nt, Homo sapiens
ccaaccccaguggauucuca

SEQ ID NO: 1501687 - RNA, 16 nt, Homo sapiens
ccaaccucagaggcag

SEQ ID NO: 1501688 - RNA, 12 nt, Homo sapiens
ccaacuaggcag

SEQ ID NO: 1501689 - RNA, 12 nt, Homo sapiens
ccaacuccucac

SEQ ID NO: 1501690 - RNA, 23 nt, Homo sapiens
ccaacuuguaaauacaccaccuc

SEQ ID NO: 1501691 - RNA, 17 nt, Homo sapiens
ccaagauugcaccacug

SEQ ID NO: 1501692 - RNA, 16 nt, Homo sapiens
ccaagcacagagccug

SEQ ID NO: 1501693 - RNA, 23 nt, Homo sapiens
ccaagcguuucccagucuuagcc

SEQ ID NO: 1501694 - RNA, 22 nt, Homo sapiens
ccaagcuaggcuuaaaccugga

SEQ ID NO: 1501695 - RNA, 21 nt, Homo sapiens
ccaagcugccucugggccaug

SEQ ID NO: 1501696 - RNA, 10 nt, Homo sapiens
ccaagcuggu

SEQ ID NO: 1501697 - RNA, 21 nt, Homo sapiens
ccaaggaaacccccaguguaa

SEQ ID NO: 1501698 - RNA, 16 nt, Homo sapiens
ccaaggaaacuugaau

SEQ ID NO: 1501699 - RNA, 14 nt, Homo sapiens
ccaaggaagagcca

SEQ ID NO: 1501700 - RNA, 15 nt, Homo sapiens
ccaaggacucuucca

SEQ ID NO: 1501701 - RNA, 16 nt, Homo sapiens
ccaaggacucuuccac

SEQ ID NO: 1501702 - RNA, 22 nt, Homo sapiens
ccaaggauccucuccacuccau

SEQ ID NO: 1501703 - RNA, 18 nt, Homo sapiens
ccaaggauggaccacaca

SEQ ID NO: 1501704 - RNA, 21 nt, Homo sapiens
ccaaggccuucuccuccccac

SEQ ID NO: 1501705 - RNA, 17 nt, Homo sapiens
ccaagggaaaggggugc

SEQ ID NO: 1501706 - RNA, 22 nt, Homo sapiens
ccaagggacccuuugccuuucu

SEQ ID NO: 1501707 - RNA, 22 nt, Homo sapiens
ccaagggcugaguguccagcac

SEQ ID NO: 1501708 - RNA, 18 nt, Homo sapiens
ccaaggguacuaaggaau

SEQ ID NO: 1501709 - RNA, 11 nt, Homo sapiens
ccaagguccug

SEQ ID NO: 1501710 - RNA, 21 nt, Homo sapiens
ccaaggugugccccgugggca

SEQ ID NO: 1501711 - RNA, 16 nt, Homo sapiens
ccaagucggaacagca

SEQ ID NO: 1501712 - RNA, 16 nt, Homo sapiens
ccaagugugaccccac

SEQ ID NO: 1501713 - RNA, 17 nt, Homo sapiens
ccaaguucuucaccucu

SEQ ID NO: 1501714 - RNA, 20 nt, Homo sapiens
ccaaguucuucaccucuauc

SEQ ID NO: 1501715 - RNA, 18 nt, Homo sapiens
ccaauaaaagugacucuc

SEQ ID NO: 1501716 - RNA, 20 nt, Homo sapiens
ccaauacggcaaaaccucau

SEQ ID NO: 1501717 - RNA, 15 nt, Homo sapiens
ccaauccaacaucca

SEQ ID NO: 1501718 - RNA, 22 nt, Homo sapiens
ccaaugaggucugaaauggagg

SEQ ID NO: 1501719 - RNA, 16 nt, Homo sapiens
ccaauggcggacucaa

SEQ ID NO: 1501720 - RNA, 15 nt, Homo sapiens
ccaauuagcucuaua

SEQ ID NO: 1501721 - RNA, 18 nt, Homo sapiens
ccaauucaccaacacagu

SEQ ID NO: 1501722 - RNA, 16 nt, Homo sapiens
ccaauuccaaguuuua

SEQ ID NO: 1501723 - RNA, 12 nt, Homo sapiens
ccaauugaugua

SEQ ID NO: 1501724 - RNA, 15 nt, Homo sapiens
ccaauuucagacucc

SEQ ID NO: 1501725 - RNA, 16 nt, Homo sapiens
ccacaaaaaauacuuu

SEQ ID NO: 1501726 - RNA, 13 nt, Homo sapiens
ccacaaaacugac

SEQ ID NO: 1501727 - RNA, 13 nt, Homo sapiens
ccacaacuuuaaa

SEQ ID NO: 1501728 - RNA, 15 nt, Homo sapiens
ccacaagcaccugcu

SEQ ID NO: 1501729 - RNA, 19 nt, Homo sapiens
ccacaauuauuggcaaagu

SEQ ID NO: 1501730 - RNA, 22 nt, Homo sapiens
ccacaauuauuggcaaaguuua

SEQ ID NO: 1501731 - RNA, 13 nt, Homo sapiens
ccacacacacaaa

SEQ ID NO: 1501732 - RNA, 19 nt, Homo sapiens
ccacacgcacuggugccaa

SEQ ID NO: 1501733 - RNA, 19 nt, Homo sapiens
ccacagcaaccccaggcug

SEQ ID NO: 1501734 - RNA, 14 nt, Homo sapiens
ccacagcacagcca

SEQ ID NO: 1501735 - RNA, 11 nt, Homo sapiens
ccacagggaac

SEQ ID NO: 1501736 - RNA, 22 nt, Homo sapiens
ccacauugcuuuucacauccau

SEQ ID NO: 1501737 - RNA, 19 nt, Homo sapiens
ccaccacugauauccuccu

SEQ ID NO: 1501738 - RNA, 18 nt, Homo sapiens
ccacccaccuaugugcca

SEQ ID NO: 1501739 - RNA, 17 nt, Homo sapiens
ccaccccuaaagagaua

SEQ ID NO: 1501740 - RNA, 17 nt, Homo sapiens
ccacccgcccacagcca

SEQ ID NO: 1501741 - RNA, 13 nt, Homo sapiens
ccacccuaguccc

SEQ ID NO: 1501742 - RNA, 13 nt, Homo sapiens
ccaccuagacugu

SEQ ID NO: 1501743 - RNA, 17 nt, Homo sapiens
ccaccucuugugcaagg

SEQ ID NO: 1501744 - RNA, 24 nt, Homo sapiens
ccaccugccugcaucugugaaaag

SEQ ID NO: 1501745 - RNA, 13 nt, Homo sapiens
ccaccugucucag

SEQ ID NO: 1501746 - RNA, 21 nt, Homo sapiens
ccaccuugaucccaauccuua

SEQ ID NO: 1501747 - RNA, 16 nt, Homo sapiens
ccacgaccuuugaaga

SEQ ID NO: 1501748 - RNA, 16 nt, Homo sapiens
ccacgucaacagaauu

SEQ ID NO: 1501749 - RNA, 14 nt, Homo sapiens
ccacuaagaauuca

SEQ ID NO: 1501750 - RNA, 16 nt, Homo sapiens
ccacuacaucugggac

SEQ ID NO: 1501751 - RNA, 12 nt, Homo sapiens
ccacuacugcag

SEQ ID NO: 1501752 - RNA, 14 nt, Homo sapiens
ccacuacugcagca

SEQ ID NO: 1501753 - RNA, 17 nt, Homo sapiens
ccacuauuuaaguuauc

SEQ ID NO: 1501754 - RNA, 18 nt, Homo sapiens
ccacucaggauugggaau

SEQ ID NO: 1501755 - RNA, 20 nt, Homo sapiens
ccacucagguucuucagggc

SEQ ID NO: 1501756 - RNA, 15 nt, Homo sapiens
ccacucccuuugcca

SEQ ID NO: 1501757 - RNA, 13 nt, Homo sapiens
ccacucuaccuga

SEQ ID NO: 1501758 - RNA, 19 nt, Homo sapiens
ccacugcguuguccacaag

SEQ ID NO: 1501759 - RNA, 19 nt, Homo sapiens
ccacuguaauuaaaacuau

SEQ ID NO: 1501760 - RNA, 15 nt, Homo sapiens
ccacuguguauuuaa

SEQ ID NO: 1501761 - RNA, 19 nt, Homo sapiens
ccacuuaaaaaauguccau

SEQ ID NO: 1501762 - RNA, 16 nt, Homo sapiens
ccacuucagaaauaua

SEQ ID NO: 1501763 - RNA, 12 nt, Homo sapiens
ccagaaaugucu

SEQ ID NO: 1501764 - RNA, 14 nt, Homo sapiens
ccagaaccucagca

SEQ ID NO: 1501765 - RNA, 18 nt, Homo sapiens
ccagaaggcgugcuggca

SEQ ID NO: 1501766 - RNA, 21 nt, Homo sapiens
ccagaauaaaacgcaaagggc

SEQ ID NO: 1501767 - RNA, 14 nt, Homo sapiens
ccagaauacugggu

SEQ ID NO: 1501768 - RNA, 15 nt, Homo sapiens
ccagaaugcugaacu

SEQ ID NO: 1501769 - RNA, 22 nt, Homo sapiens
ccagaaugcugcaggacuugag

SEQ ID NO: 1501770 - RNA, 15 nt, Homo sapiens
ccagacaauuccauu

SEQ ID NO: 1501771 - RNA, 10 nt, Homo sapiens
ccagacagac

SEQ ID NO: 1501772 - RNA, 23 nt, Homo sapiens
ccagacccaguggacucuuccac

SEQ ID NO: 1501773 - RNA, 12 nt, Homo sapiens
ccagacccugaa

SEQ ID NO: 1501774 - RNA, 22 nt, Homo sapiens
ccagacuaaaggauccagagag

SEQ ID NO: 1501775 - RNA, 17 nt, Homo sapiens
ccagacucugagcugcu

SEQ ID NO: 1501776 - RNA, 10 nt, Homo sapiens
ccagacuguu

SEQ ID NO: 1501777 - RNA, 18 nt, Homo sapiens
ccagacuuccuccuuucc

SEQ ID NO: 1501778 - RNA, 20 nt, Homo sapiens
ccagagagccuggugcugcu

SEQ ID NO: 1501779 - RNA, 13 nt, Homo sapiens
ccagagaugcugg

SEQ ID NO: 1501780 - RNA, 17 nt, Homo sapiens
ccagagaugcuggacuu

SEQ ID NO: 1501781 - RNA, 15 nt, Homo sapiens
ccagagcagaugcag

SEQ ID NO: 1501782 - RNA, 17 nt, Homo sapiens
ccagagcagaugcagag

SEQ ID NO: 1501783 - RNA, 12 nt, Homo sapiens
ccagagcaguuu

SEQ ID NO: 1501784 - RNA, 22 nt, Homo sapiens
ccagagccaggggggugaggag

SEQ ID NO: 1501785 - RNA, 17 nt, Homo sapiens
ccagagcccagcuccaa

SEQ ID NO: 1501786 - RNA, 21 nt, Homo sapiens
ccagagccccccacaaugaug

SEQ ID NO: 1501787 - RNA, 22 nt, Homo sapiens
ccagaggcaggcggagguugaa

SEQ ID NO: 1501788 - RNA, 17 nt, Homo sapiens
ccagaggguugugauuu

SEQ ID NO: 1501789 - RNA, 22 nt, Homo sapiens
ccagagguauuccucucuuaaa

SEQ ID NO: 1501790 - RNA, 20 nt, Homo sapiens
ccagauagguggugccagug

SEQ ID NO: 1501791 - RNA, 16 nt, Homo sapiens
ccagaugcagggcagu

SEQ ID NO: 1501792 - RNA, 20 nt, Homo sapiens
ccagaugugaaaacaucuca

SEQ ID NO: 1501793 - RNA, 20 nt, Homo sapiens
ccagauucuaccacacagca

SEQ ID NO: 1501794 - RNA, 20 nt, Homo sapiens
ccagauucugccucucugga

SEQ ID NO: 1501795 - RNA, 20 nt, Homo sapiens
ccagcaagccgaauagcuga

SEQ ID NO: 1501796 - RNA, 13 nt, Homo sapiens
ccagcaaggcagg

SEQ ID NO: 1501797 - RNA, 20 nt, Homo sapiens
ccagcaaugauguccagaag

SEQ ID NO: 1501798 - RNA, 17 nt, Homo sapiens
ccagcacacagggcagu

SEQ ID NO: 1501799 - RNA, 22 nt, Homo sapiens
ccagcacuaacguaaauacaca

SEQ ID NO: 1501800 - RNA, 13 nt, Homo sapiens
ccagcacucugaa

SEQ ID NO: 1501801 - RNA, 14 nt, Homo sapiens
ccagcacuggugaa

SEQ ID NO: 1501802 - RNA, 10 nt, Homo sapiens
ccagcacuuc

SEQ ID NO: 1501803 - RNA, 19 nt, Homo sapiens
ccagcagaagcaggguacc

SEQ ID NO: 1501804 - RNA, 20 nt, Homo sapiens
ccagcagaagcaggguaccc

SEQ ID NO: 1501805 - RNA, 18 nt, Homo sapiens
ccagccagugccauucca

SEQ ID NO: 1501806 - RNA, 20 nt, Homo sapiens
ccagccaucaaaaugcuuuu

SEQ ID NO: 1501807 - RNA, 17 nt, Homo sapiens
ccagcccagacccagug

SEQ ID NO: 1501808 - RNA, 15 nt, Homo sapiens
ccagcccagagccac

SEQ ID NO: 1501809 - RNA, 18 nt, Homo sapiens
ccagcccuccucugucaa

SEQ ID NO: 1501810 - RNA, 15 nt, Homo sapiens
ccagcccugcugcag

SEQ ID NO: 1501811 - RNA, 19 nt, Homo sapiens
ccagccugaggcagccacu

SEQ ID NO: 1501812 - RNA, 16 nt, Homo sapiens
ccagccuggccaauac

SEQ ID NO: 1501813 - RNA, 20 nt, Homo sapiens
ccagccugggcaacagagca

SEQ ID NO: 1501814 - RNA, 22 nt, Homo sapiens
ccagccugggggccagugggga

SEQ ID NO: 1501815 - RNA, 20 nt, Homo sapiens
ccagccugggugacagagca

SEQ ID NO: 1501816 - RNA, 17 nt, Homo sapiens
ccagcuaaggacauuuc

SEQ ID NO: 1501817 - RNA, 18 nt, Homo sapiens
ccagcuacucaggagucu

SEQ ID NO: 1501818 - RNA, 14 nt, Homo sapiens
ccagcuaucuguca

SEQ ID NO: 1501819 - RNA, 12 nt, Homo sapiens
ccagcuaugaau

SEQ ID NO: 1501820 - RNA, 23 nt, Homo sapiens
ccagcucaggacagaugccacac

SEQ ID NO: 1501821 - RNA, 21 nt, Homo sapiens
ccagcucagucccaucagaga

SEQ ID NO: 1501822 - RNA, 13 nt, Homo sapiens
ccagcucaugcca

SEQ ID NO: 1501823 - RNA, 19 nt, Homo sapiens
ccagcuccaaccugcaaag

SEQ ID NO: 1501824 - RNA, 20 nt, Homo sapiens
ccagcuccaaccugcaaaga

SEQ ID NO: 1501825 - RNA, 23 nt, Homo sapiens
ccagcugacacgcucaguugaaa

SEQ ID NO: 1501826 - RNA, 15 nt, Homo sapiens
ccagcugccuuggac

SEQ ID NO: 1501827 - RNA, 16 nt, Homo sapiens
ccagcugcugucuucu

SEQ ID NO: 1501828 - RNA, 23 nt, Homo sapiens
ccagcugggucaggcagggugca

SEQ ID NO: 1501829 - RNA, 22 nt, Homo sapiens
ccagcugugcacuuucuucucu

SEQ ID NO: 1501830 - RNA, 14 nt, Homo sapiens
ccagcugugcagca

SEQ ID NO: 1501831 - RNA, 22 nt, Homo sapiens
ccagcugugggacaauuaucug

SEQ ID NO: 1501832 - RNA, 18 nt, Homo sapiens
ccagcuuacuagcacuuu

SEQ ID NO: 1501833 - RNA, 19 nt, Homo sapiens
uacucuucuuacuggugcu

SEQ ID NO: 1501834 - RNA, 16 nt, Homo sapiens
uacucuugaugugaag

SEQ ID NO: 1501835 - RNA, 15 nt, Homo sapiens
uacucuuuguagcaa

SEQ ID NO: 1501836 - RNA, 13 nt, Homo sapiens
uacugacuugagg

SEQ ID NO: 1501837 - RNA, 16 nt, Homo sapiens
uacugauuuuagcaua

SEQ ID NO: 1501838 - RNA, 23 nt, Homo sapiens
uacugcaaaugcuauauugcacu

SEQ ID NO: 1501839 - RNA, 19 nt, Homo sapiens
uacugcuaucuacuacaaa

SEQ ID NO: 1501840 - RNA, 14 nt, Homo sapiens
uacuggaaggcuuc

SEQ ID NO: 1501841 - RNA, 18 nt, Homo sapiens
uacugggaaucaagacaa

SEQ ID NO: 1501842 - RNA, 14 nt, Homo sapiens
uacuggugcaguca

SEQ ID NO: 1501843 - RNA, 23 nt, Homo sapiens
uacuguaggcacacuuugcacug

SEQ ID NO: 1501844 - RNA, 17 nt, Homo sapiens
uacugucuguuaugauu

SEQ ID NO: 1501845 - RNA, 15 nt, Homo sapiens
uacuguuucacgugu

SEQ ID NO: 1501846 - RNA, 17 nt, Homo sapiens
uacuuagagcagugaag

SEQ ID NO: 1501847 - RNA, 20 nt, Homo sapiens
uacuuauauguaaaguauua

SEQ ID NO: 1501848 - RNA, 20 nt, Homo sapiens
uacuuauuguauuuaugugu

SEQ ID NO: 1501849 - RNA, 18 nt, Homo sapiens
uacuucaucauuuugaca

SEQ ID NO: 1501850 - RNA, 22 nt, Homo sapiens
uacuuccaccuccaccacaucu

SEQ ID NO: 1501851 - RNA, 19 nt, Homo sapiens
uacuugggagaccuguaau

SEQ ID NO: 1501852 - RNA, 9 nt, Homo sapiens
uacuuguca

SEQ ID NO: 1501853 - RNA, 21 nt, Homo sapiens
uacuugugaaacacagcuguu

SEQ ID NO: 1501854 - RNA, 13 nt, Homo sapiens
uacuuuaaaggaa

SEQ ID NO: 1501855 - RNA, 14 nt, Homo sapiens
uacuuucacacuaa

SEQ ID NO: 1501856 - RNA, 17 nt, Homo sapiens
uacuuucuguugccaca

SEQ ID NO: 1501857 - RNA, 14 nt, Homo sapiens
uacuuuuauuugca

SEQ ID NO: 1501858 - RNA, 13 nt, Homo sapiens
uacuuuugcuuca

SEQ ID NO: 1501859 - RNA, 20 nt, Homo sapiens
uagaaaacaggcaaauuccu

SEQ ID NO: 1501860 - RNA, 14 nt, Homo sapiens
uagaaacacugcaa

SEQ ID NO: 1501861 - RNA, 17 nt, Homo sapiens
uagaaagggccuugaca

SEQ ID NO: 1501862 - RNA, 12 nt, Homo sapiens
uagaaaguaaaa

SEQ ID NO: 1501863 - RNA, 13 nt, Homo sapiens
uagaaaguagcca

SEQ ID NO: 1501864 - RNA, 18 nt, Homo sapiens
uagaaaugaccaauauua

SEQ ID NO: 1501865 - RNA, 17 nt, Homo sapiens
uagaacagauaaucagu

SEQ ID NO: 1501866 - RNA, 18 nt, Homo sapiens
uagaaccacuuccugcua

SEQ ID NO: 1501867 - RNA, 16 nt, Homo sapiens
uagaacuaucugcauu

SEQ ID NO: 1501868 - RNA, 18 nt, Homo sapiens
uagaacuauuaaaacagc

SEQ ID NO: 1501869 - RNA, 12 nt, Homo sapiens
uagaacuugcag

SEQ ID NO: 1501870 - RNA, 19 nt, Homo sapiens
uagaacuugcagcugaugu

SEQ ID NO: 1501871 - RNA, 22 nt, Homo sapiens
uagaagaaaagcccauuuucaa

SEQ ID NO: 1501872 - RNA, 14 nt, Homo sapiens
uagaagcacuacac

SEQ ID NO: 1501873 - RNA, 16 nt, Homo sapiens
uagaagcugucuaggu

SEQ ID NO: 1501874 - RNA, 21 nt, Homo sapiens
uagaauauauuuccuuauuca

SEQ ID NO: 1501875 - RNA, 17 nt, Homo sapiens
uagaauauuuauuaccu

SEQ ID NO: 1501876 - RNA, 21 nt, Homo sapiens
uagaaugagcacccauuccaa

SEQ ID NO: 1501877 - RNA, 20 nt, Homo sapiens
uagaauguggauuugauuca

SEQ ID NO: 1501878 - RNA, 17 nt, Homo sapiens
uagaauuggagaguaaa

SEQ ID NO: 1501879 - RNA, 14 nt, Homo sapiens
uagacacagauaau

SEQ ID NO: 1501880 - RNA, 20 nt, Homo sapiens
uagaccaggauuucuaauca

SEQ ID NO: 1501881 - RNA, 22 nt, Homo sapiens
uagaccuccacacccgugagaa

SEQ ID NO: 1501882 - RNA, 22 nt, Homo sapiens
uagacgaggccacagcugccau

SEQ ID NO: 1501883 - RNA, 14 nt, Homo sapiens
uagacuagcaaucu

SEQ ID NO: 1501884 - RNA, 23 nt, Homo sapiens
uagacugacuuguuugucuucca

SEQ ID NO: 1501885 - RNA, 15 nt, Homo sapiens
uagacuggcugaaaa

SEQ ID NO: 1501886 - RNA, 17 nt, Homo sapiens
uagacuuaaacagcaga

SEQ ID NO: 1501887 - RNA, 16 nt, Homo sapiens
uagacuuauugccaaa

SEQ ID NO: 1501888 - RNA, 16 nt, Homo sapiens
uagagaauuuccuuac

SEQ ID NO: 1501889 - RNA, 15 nt, Homo sapiens
uagagagagaacuuu

SEQ ID NO: 1501890 - RNA, 19 nt, Homo sapiens
uagagaggacaauacuggg

SEQ ID NO: 1501891 - RNA, 21 nt, Homo sapiens
uagagaggacaauacuggggu

SEQ ID NO: 1501892 - RNA, 22 nt, Homo sapiens
uagagccuucugaugucucuaa

SEQ ID NO: 1501893 - RNA, 17 nt, Homo sapiens
uagaggcuagcuucugc

SEQ ID NO: 1501894 - RNA, 21 nt, Homo sapiens
uagagguagguaggaucaucc

SEQ ID NO: 1501895 - RNA, 15 nt, Homo sapiens
uagaguggugcugcu

SEQ ID NO: 1501896 - RNA, 18 nt, Homo sapiens
uagagugugguuaugaac

SEQ ID NO: 1501897 - RNA, 23 nt, Homo sapiens
uagauaaaagaaccgagcaauuu

SEQ ID NO: 1501898 - RNA, 22 nt, Homo sapiens
uagauauaacacuauguuuauu

SEQ ID NO: 1501899 - RNA, 15 nt, Homo sapiens
uagauauacauauca

SEQ ID NO: 1501900 - RNA, 14 nt, Homo sapiens
uagauaucaugcaa

SEQ ID NO: 1501901 - RNA, 16 nt, Homo sapiens
uagaucaucagucacc

SEQ ID NO: 1501902 - RNA, 17 nt, Homo sapiens
uagaugcugacuguacu

SEQ ID NO: 1501903 - RNA, 18 nt, Homo sapiens
uagauggguuauuucaac

SEQ ID NO: 1501904 - RNA, 23 nt, Homo sapiens
uagaugucaagcugaaaacaaac

SEQ ID NO: 1501905 - RNA, 13 nt, Homo sapiens
uagaugugcaaua

SEQ ID NO: 1501906 - RNA, 15 nt, Homo sapiens
uagauuaaacaaaca

SEQ ID NO: 1501907 - RNA, 17 nt, Homo sapiens
uagauuucuucucuuua

SEQ ID NO: 1501908 - RNA, 19 nt, Homo sapiens
uagcaaauaguaaucugua

SEQ ID NO: 1501909 - RNA, 13 nt, Homo sapiens
uagcaaaugacau

SEQ ID NO: 1501910 - RNA, 19 nt, Homo sapiens
uagcaaauggcagaaccaa

SEQ ID NO: 1501911 - RNA, 21 nt, Homo sapiens
uagcaaauggcagaaccaaag

SEQ ID NO: 1501912 - RNA, 20 nt, Homo sapiens
uagcaagcugccgaaccaaa

SEQ ID NO: 1501913 - RNA, 22 nt, Homo sapiens
uagcaagcuggccucuaccaca

SEQ ID NO: 1501914 - RNA, 16 nt, Homo sapiens
uagcaagcuuuugcuc

SEQ ID NO: 1501915 - RNA, 20 nt, Homo sapiens
uagcaaggcugugcaucuag

SEQ ID NO: 1501916 - RNA, 16 nt, Homo sapiens
uagcacaaacuacaau

SEQ ID NO: 1501917 - RNA, 19 nt, Homo sapiens
uagcacugggugugagaau

SEQ ID NO: 1501918 - RNA, 20 nt, Homo sapiens
uagcagaggagccauguccu

SEQ ID NO: 1501919 - RNA, 16 nt, Homo sapiens
uagcagaugguuucca

SEQ ID NO: 1501920 - RNA, 13 nt, Homo sapiens
uagcauaauacag

SEQ ID NO: 1501921 - RNA, 22 nt, Homo sapiens
uagcaucccccuggggcacuug

SEQ ID NO: 1501922 - RNA, 13 nt, Homo sapiens
uagcaucucagga

SEQ ID NO: 1501923 - RNA, 16 nt, Homo sapiens
uagcauuaacuaaucu

SEQ ID NO: 1501924 - RNA, 19 nt, Homo sapiens
uagccaggaaguacuucca

SEQ ID NO: 1501925 - RNA, 23 nt, Homo sapiens
uagcccucccccucaaccucacc

SEQ ID NO: 1501926 - RNA, 22 nt, Homo sapiens
ucuuugcugccagccacuucau

SEQ ID NO: 1501927 - RNA, 19 nt, Homo sapiens
ucuuuggaaaguacacucu

SEQ ID NO: 1501928 - RNA, 16 nt, Homo sapiens
ucuuuggacaaccaug

SEQ ID NO: 1501929 - RNA, 14 nt, Homo sapiens
ucuuuggauuugau

SEQ ID NO: 1501930 - RNA, 16 nt, Homo sapiens
ucuuuggcaguugcau

SEQ ID NO: 1501931 - RNA, 21 nt, Homo sapiens
ucuuuggggguuagaccacuu

SEQ ID NO: 1501932 - RNA, 17 nt, Homo sapiens
ucuuuggggucagccag

SEQ ID NO: 1501933 - RNA, 18 nt, Homo sapiens
ugaaguuugugggggcca

SEQ ID NO: 1501934 - RNA, 13 nt, Homo sapiens
ugaauaaccacuu

SEQ ID NO: 1501935 - RNA, 14 nt, Homo sapiens
ugaauacuugcuau

SEQ ID NO: 1501936 - RNA, 17 nt, Homo sapiens
ugaauauaaagcuuaau

SEQ ID NO: 1501937 - RNA, 21 nt, Homo sapiens
ugaauauaaaugggaaaucag

SEQ ID NO: 1501938 - RNA, 13 nt, Homo sapiens
ugaauauguagcu

SEQ ID NO: 1501939 - RNA, 21 nt, Homo sapiens
ugaauauuuuuuuuuugccaa

SEQ ID NO: 1501940 - RNA, 22 nt, Homo sapiens
ugaaucaaugaaaaauguaauu

SEQ ID NO: 1501941 - RNA, 21 nt, Homo sapiens
ugaaucaugagccugcuggaa

SEQ ID NO: 1501942 - RNA, 23 nt, Homo sapiens
ugagacucuaggguccaguggau

SEQ ID NO: 1501943 - RNA, 13 nt, Homo sapiens
ugagacuguguug

SEQ ID NO: 1501944 - RNA, 12 nt, Homo sapiens
ugagagaccuga

SEQ ID NO: 1501945 - RNA, 17 nt, Homo sapiens
ugagaucaucagugaua

SEQ ID NO: 1501946 - RNA, 18 nt, Homo sapiens
ugagauuucuuaaauaau

SEQ ID NO: 1501947 - RNA, 12 nt, Homo sapiens
ugagcaacucuu

SEQ ID NO: 1501948 - RNA, 16 nt, Homo sapiens
ugagcaacucuugauu

SEQ ID NO: 1501949 - RNA, 19 nt, Homo sapiens
ugagcaacucuugauuauc

SEQ ID NO: 1501950 - RNA, 23 nt, Homo sapiens
ugagcaaggacauugccccaaga

SEQ ID NO: 1501951 - RNA, 22 nt, Homo sapiens
ugagcaguguuggagugaggac

SEQ ID NO: 1501952 - RNA, 14 nt, Homo sapiens
gaccaacuuccugu

SEQ ID NO: 1501953 - RNA, 18 nt, Homo sapiens
gaccacagaagacccgcu

SEQ ID NO: 1501954 - RNA, 15 nt, Homo sapiens
gaccaccacuucgaa

SEQ ID NO: 1501955 - RNA, 21 nt, Homo sapiens
gaccacgcuuucuagcuguug

SEQ ID NO: 1501956 - RNA, 18 nt, Homo sapiens
gaccacugcuggaccaag

SEQ ID NO: 1501957 - RNA, 15 nt, Homo sapiens
gaccacuuccagggg

SEQ ID NO: 1501958 - RNA, 17 nt, Homo sapiens
gaccacuuccaggggaa

SEQ ID NO: 1501959 - RNA, 23 nt, Homo sapiens
gaccaggcuucuuccuacaucuu

SEQ ID NO: 1501960 - RNA, 15 nt, Homo sapiens
gaccagucacucccu

SEQ ID NO: 1501961 - RNA, 20 nt, Homo sapiens
gacccaggccuggccaguca

SEQ ID NO: 1501962 - RNA, 21 nt, Homo sapiens
gaccccaaagagccuggagaa

SEQ ID NO: 1501963 - RNA, 15 nt, Homo sapiens
gacccccagcacuug

SEQ ID NO: 1501964 - RNA, 17 nt, Homo sapiens
gacccugauacaggcau

SEQ ID NO: 1501965 - RNA, 17 nt, Homo sapiens
gacccugccacagccag

SEQ ID NO: 1501966 - RNA, 22 nt, Homo sapiens
gacccuuugccuuucuucugcc

SEQ ID NO: 1501967 - RNA, 17 nt, Homo sapiens
gacccuuuucucaggac

SEQ ID NO: 1501968 - RNA, 21 nt, Homo sapiens
gaccgcguuggaaggugcaga

SEQ ID NO: 1501969 - RNA, 20 nt, Homo sapiens
gaccuaagggacucccacaa

SEQ ID NO: 1501970 - RNA, 14 nt, Homo sapiens
gaccuaggcucaug

SEQ ID NO: 1501971 - RNA, 13 nt, Homo sapiens
gaccuauuuccag

SEQ ID NO: 1501972 - RNA, 16 nt, Homo sapiens
gaccucaccuagaaau

SEQ ID NO: 1501973 - RNA, 12 nt, Homo sapiens
gaccucucaggg

SEQ ID NO: 1501974 - RNA, 10 nt, Homo sapiens
gaccucuugu

SEQ ID NO: 1501975 - RNA, 20 nt, Homo sapiens
gaccugagucugcaugugca

SEQ ID NO: 1501976 - RNA, 23 nt, Homo sapiens
gaccuggagacugacaaccucau

SEQ ID NO: 1501977 - RNA, 22 nt, Homo sapiens
gaccugugaccagcacugucuc

SEQ ID NO: 1501978 - RNA, 16 nt, Homo sapiens
gaccuguucaaaaagg

SEQ ID NO: 1501979 - RNA, 19 nt, Homo sapiens
gaccuguucaaaaaggaaa

SEQ ID NO: 1501980 - RNA, 21 nt, Homo sapiens
gaccuguuuaugagaugcugg

SEQ ID NO: 1501981 - RNA, 18 nt, Homo sapiens
gaccuuaggccuuccucu

SEQ ID NO: 1501982 - RNA, 18 nt, Homo sapiens
gaccuuccaaggacauau

SEQ ID NO: 1501983 - RNA, 16 nt, Homo sapiens
gaccuugaccauuaau

SEQ ID NO: 1501984 - RNA, 13 nt, Homo sapiens
gacgaaaguggaa

SEQ ID NO: 1501985 - RNA, 17 nt, Homo sapiens
gacgacaagugcugaac

SEQ ID NO: 1501986 - RNA, 13 nt, Homo sapiens
gacgacagaugcu

SEQ ID NO: 1501987 - RNA, 23 nt, Homo sapiens
gacgcacggcauuagcuuccugc

SEQ ID NO: 1501988 - RNA, 20 nt, Homo sapiens
gacguggagcgggguaugaa

SEQ ID NO: 1501989 - RNA, 22 nt, Homo sapiens
gacuaaaauguuucauuuaccu

SEQ ID NO: 1501990 - RNA, 13 nt, Homo sapiens
gacuacaaccaau

SEQ ID NO: 1501991 - RNA, 14 nt, Homo sapiens
gacuacacaggaug

SEQ ID NO: 1501992 - RNA, 15 nt, Homo sapiens
gacuaccaagcuggc

SEQ ID NO: 1501993 - RNA, 21 nt, Homo sapiens
gacuacuuggaacuaggcucu

SEQ ID NO: 1501994 - RNA, 18 nt, Homo sapiens
gacucaaguccuuaccuc

SEQ ID NO: 1501995 - RNA, 23 nt, Homo sapiens
gacucauggcagcuguuucucau

SEQ ID NO: 1501996 - RNA, 18 nt, Homo sapiens
gacucauggccgggcuga

SEQ ID NO: 1501997 - RNA, 15 nt, Homo sapiens
gacucauuguagaaa

SEQ ID NO: 1501998 - RNA, 14 nt, Homo sapiens
gacuccaucucuca

SEQ ID NO: 1501999 - RNA, 12 nt, Homo sapiens
gacuccaugcug

SEQ ID NO: 1502000 - RNA, 14 nt, Homo sapiens
gacucccacaacaa

SEQ ID NO: 1502001 - RNA, 16 nt, Homo sapiens
gacuccgucucaaaaa

SEQ ID NO: 1502002 - RNA, 13 nt, Homo sapiens
gacuccuaccugc

SEQ ID NO: 1502003 - RNA, 12 nt, Homo sapiens
gacuccucauca

SEQ ID NO: 1502004 - RNA, 16 nt, Homo sapiens
gacucugcuucagucc

SEQ ID NO: 1502005 - RNA, 11 nt, Homo sapiens
gacucuuccac

SEQ ID NO: 1502006 - RNA, 23 nt, Homo sapiens
gacucuuuugagugguaaucaua

SEQ ID NO: 1502007 - RNA, 21 nt, Homo sapiens
gacugcaacaggcuugugcaa

SEQ ID NO: 1502008 - RNA, 20 nt, Homo sapiens
gacugccacccacacgcccu

SEQ ID NO: 1502009 - RNA, 15 nt, Homo sapiens
gacuggaggugggca

SEQ ID NO: 1502010 - RNA, 17 nt, Homo sapiens
gacuggauucgugacaa

SEQ ID NO: 1502011 - RNA, 21 nt, Homo sapiens
gacugggugagacccaaagcg

SEQ ID NO: 1502012 - RNA, 13 nt, Homo sapiens
gacuggguggucc

SEQ ID NO: 1502013 - RNA, 16 nt, Homo sapiens
gacugguuuucugcca

SEQ ID NO: 1502014 - RNA, 19 nt, Homo sapiens
gacuguuccaaagccagug

SEQ ID NO: 1502015 - RNA, 21 nt, Homo sapiens
gagacuacaggugugugucca

SEQ ID NO: 1502016 - RNA, 13 nt, Homo sapiens
gagacucuagggu

SEQ ID NO: 1502017 - RNA, 22 nt, Homo sapiens
gagacugggagccacuucuccc

SEQ ID NO: 1502018 - RNA, 17 nt, Homo sapiens
gagacuguagauugcuu

SEQ ID NO: 1502019 - RNA, 21 nt, Homo sapiens
gagacugucucaagagggcac

SEQ ID NO: 1502020 - RNA, 20 nt, Homo sapiens
gagagauggagaagcuagaa

SEQ ID NO: 1502021 - RNA, 16 nt, Homo sapiens
gagagauucugugauc

SEQ ID NO: 1502022 - RNA, 13 nt, Homo sapiens
gagagcagcagca

SEQ ID NO: 1502023 - RNA, 14 nt, Homo sapiens
gagagcccauuccc

SEQ ID NO: 1502024 - RNA, 22 nt, Homo sapiens
gagagcccccaccuugauccca

SEQ ID NO: 1502025 - RNA, 22 nt, Homo sapiens
gagagcccggcgccccugccac

SEQ ID NO: 1502026 - RNA, 23 nt, Homo sapiens
gagaggaaaaguaaggugcaguu

SEQ ID NO: 1502027 - RNA, 14 nt, Homo sapiens
gagaggaugugcaa

SEQ ID NO: 1502028 - RNA, 16 nt, Homo sapiens
gagaggcugcuuuuga

SEQ ID NO: 1502029 - RNA, 22 nt, Homo sapiens
gagaguagaugguuugagccug

SEQ ID NO: 1502030 - RNA, 15 nt, Homo sapiens
gagagugaaaccaug

SEQ ID NO: 1502031 - RNA, 16 nt, Homo sapiens
gagaguggcuccuccc

SEQ ID NO: 1502032 - RNA, 17 nt, Homo sapiens
gagauaauaucugugag

SEQ ID NO: 1502033 - RNA, 22 nt, Homo sapiens
gagaucacgucacugcacucca

SEQ ID NO: 1502034 - RNA, 16 nt, Homo sapiens
gagauccugagucaug

SEQ ID NO: 1502035 - RNA, 17 nt, Homo sapiens
gagaucgcgccacugca

SEQ ID NO: 1502036 - RNA, 20 nt, Homo sapiens
gagaucgugcuacugcacuc

SEQ ID NO: 1502037 - RNA, 21 nt, Homo sapiens
gagaucgugcuacugcacucc

SEQ ID NO: 1502038 - RNA, 21 nt, Homo sapiens
gagaucuaaggaugucacagg

SEQ ID NO: 1502039 - RNA, 17 nt, Homo sapiens
gagauggaggaaaguga

SEQ ID NO: 1502040 - RNA, 23 nt, Homo sapiens
gagaugggcuuguuuucuugcca

SEQ ID NO: 1502041 - RNA, 19 nt, Homo sapiens
gagaugggguuucacuaug

SEQ ID NO: 1502042 - RNA, 12 nt, Homo sapiens
gagauggucaca

SEQ ID NO: 1502043 - RNA, 20 nt, Homo sapiens
gagauugaauuucacugucu

SEQ ID NO: 1502044 - RNA, 17 nt, Homo sapiens
gagauugugccacuuca

SEQ ID NO: 1502045 - RNA, 12 nt, Homo sapiens
gagauuuccucc

SEQ ID NO: 1502046 - RNA, 18 nt, Homo sapiens
gagauuucuuguugcuca

SEQ ID NO: 1502047 - RNA, 19 nt, Homo sapiens
gagcaaaaucgaugcagug

SEQ ID NO: 1502048 - RNA, 23 nt, Homo sapiens
gagcaaacuaacuugacuuuuaa

SEQ ID NO: 1502049 - RNA, 22 nt, Homo sapiens
gagcaagaucuugucuccacua

SEQ ID NO: 1502050 - RNA, 17 nt, Homo sapiens
gagcacauacuguguuc

SEQ ID NO: 1502051 - RNA, 20 nt, Homo sapiens
gagcaccacacccaguggga

SEQ ID NO: 1502052 - RNA, 19 nt, Homo sapiens
gagcaccuuugcacaggau

SEQ ID NO: 1502053 - RNA, 17 nt, Homo sapiens
gagcacuggagugcagg

SEQ ID NO: 1502054 - RNA, 12 nt, Homo sapiens
gagcacugugag

SEQ ID NO: 1502055 - RNA, 13 nt, Homo sapiens
gagcacuuccaaa

SEQ ID NO: 1502056 - RNA, 14 nt, Homo sapiens
gagcagcagcacca

SEQ ID NO: 1502057 - RNA, 19 nt, Homo sapiens
gagcagccacaaccaaaaa

SEQ ID NO: 1502058 - RNA, 21 nt, Homo sapiens
gagcagcuuuaaacucaggga

SEQ ID NO: 1502059 - RNA, 19 nt, Homo sapiens
gagcagcuuuggaaacagg

SEQ ID NO: 1502060 - RNA, 15 nt, Homo sapiens
gagcaggaacaauga

SEQ ID NO: 1502061 - RNA, 16 nt, Homo sapiens
gagcaggaacaaugac

SEQ ID NO: 1502062 - RNA, 18 nt, Homo sapiens
gagcaggaccuacuagga

SEQ ID NO: 1502063 - RNA, 18 nt, Homo sapiens
gagcaggaggccaauaaa

SEQ ID NO: 1502064 - RNA, 21 nt, Homo sapiens
gagcaggccggaaccacaggg

SEQ ID NO: 1502065 - RNA, 17 nt, Homo sapiens
gagcaguccugccucag

SEQ ID NO: 1502066 - RNA, 13 nt, Homo sapiens
gagcaguuugcca

SEQ ID NO: 1502067 - RNA, 12 nt, Homo sapiens
gagcaucuggcu

SEQ ID NO: 1502068 - RNA, 18 nt, Homo sapiens
gagcaugacagccugcag

SEQ ID NO: 1502069 - RNA, 15 nt, Homo sapiens
gagcauuacgugagc

SEQ ID NO: 1502070 - RNA, 16 nt, Homo sapiens
gagcauucauaauuaa

SEQ ID NO: 1502071 - RNA, 16 nt, Homo sapiens
gagccaagauugcacc

SEQ ID NO: 1502072 - RNA, 17 nt, Homo sapiens
gagccaccccuaaagag

SEQ ID NO: 1502073 - RNA, 19 nt, Homo sapiens
gagccaccugacucuugca

SEQ ID NO: 1502074 - RNA, 20 nt, Homo sapiens
gagccaguccuccacucgac

SEQ ID NO: 1502075 - RNA, 20 nt, Homo sapiens
gagccauagcugaucauguc

SEQ ID NO: 1502076 - RNA, 15 nt, Homo sapiens
gagccaugcugggaa

SEQ ID NO: 1502077 - RNA, 12 nt, Homo sapiens
gagccaugucau

SEQ ID NO: 1502078 - RNA, 17 nt, Homo sapiens
gagccauuuugugaaug

SEQ ID NO: 1502079 - RNA, 18 nt, Homo sapiens
ggcugagugagccacaga

SEQ ID NO: 1502080 - RNA, 19 nt, Homo sapiens
ggcugccccaaccugcuga

SEQ ID NO: 1502081 - RNA, 15 nt, Homo sapiens
ggcugcccucuccac

SEQ ID NO: 1502082 - RNA, 17 nt, Homo sapiens
ggcugccugacacugag

SEQ ID NO: 1502083 - RNA, 12 nt, Homo sapiens
ggcugcugagaa

SEQ ID NO: 1502084 - RNA, 16 nt, Homo sapiens
ggcuggaaggggucca

SEQ ID NO: 1502085 - RNA, 15 nt, Homo sapiens
ggcuggacaugcuga

SEQ ID NO: 1502086 - RNA, 20 nt, Homo sapiens
ggcugggcgucuaugcugcu

SEQ ID NO: 1502087 - RNA, 13 nt, Homo sapiens
ggcuggugacaga

SEQ ID NO: 1502088 - RNA, 23 nt, Homo sapiens
ggcuggugacagaacaugcagca

SEQ ID NO: 1502089 - RNA, 17 nt, Homo sapiens
ggcugucaucugugcac

SEQ ID NO: 1502090 - RNA, 16 nt, Homo sapiens
ggcuguggagaggguc

SEQ ID NO: 1502091 - RNA, 22 nt, Homo sapiens
ggcuguggagagggucaaggag

SEQ ID NO: 1502092 - RNA, 12 nt, Homo sapiens
ggcuguucucca

SEQ ID NO: 1502093 - RNA, 15 nt, Homo sapiens
ggcuucaucugucaa

SEQ ID NO: 1502094 - RNA, 19 nt, Homo sapiens
ggcuucucuugagucacac

SEQ ID NO: 1502095 - RNA, 16 nt, Homo sapiens
ggcuugacaugugcaa

SEQ ID NO: 1502096 - RNA, 14 nt, Homo sapiens
ggcuugcaugccaa

SEQ ID NO: 1502097 - RNA, 15 nt, Homo sapiens
ggcuuuaucucaggg

SEQ ID NO: 1502098 - RNA, 19 nt, Homo sapiens
ggcuuugccucuucuuugu

SEQ ID NO: 1502099 - RNA, 19 nt, Homo sapiens
ggcuuuuugccaucuguga

SEQ ID NO: 1502100 - RNA, 21 nt, Homo sapiens
gggaaaggauauuuucuucca

SEQ ID NO: 1502101 - RNA, 16 nt, Homo sapiens
gggaaaggcugccgag

SEQ ID NO: 1502102 - RNA, 14 nt, Homo sapiens
gggaaaucaguguu

SEQ ID NO: 1502103 - RNA, 15 nt, Homo sapiens
gggaacagaccagug

SEQ ID NO: 1502104 - RNA, 16 nt, Homo sapiens
gggaacggacugguau

SEQ ID NO: 1502105 - RNA, 15 nt, Homo sapiens
gggaagagugcauuu

SEQ ID NO: 1502106 - RNA, 21 nt, Homo sapiens
gggaagaguggucuugagggg

SEQ ID NO: 1502107 - RNA, 14 nt, Homo sapiens
gggaagcucagggg

SEQ ID NO: 1502108 - RNA, 15 nt, Homo sapiens
gggaaggucaccagc

SEQ ID NO: 1502109 - RNA, 13 nt, Homo sapiens
gggaauccagcca

SEQ ID NO: 1502110 - RNA, 13 nt, Homo sapiens
gggaauccugcua

SEQ ID NO: 1502111 - RNA, 14 nt, Homo sapiens
gggacaagggauuu

SEQ ID NO: 1502112 - RNA, 13 nt, Homo sapiens
gggacacagcagu

SEQ ID NO: 1502113 - RNA, 20 nt, Homo sapiens
gggacaggaugaccuggaua

SEQ ID NO: 1502114 - RNA, 14 nt, Homo sapiens
gggacauaucagug

SEQ ID NO: 1502115 - RNA, 12 nt, Homo sapiens
gggacuaggacc

SEQ ID NO: 1502116 - RNA, 18 nt, Homo sapiens
gggacuggcugggcugcu

SEQ ID NO: 1502117 - RNA, 20 nt, Homo sapiens
gggacuggggggccauuucc

SEQ ID NO: 1502118 - RNA, 23 nt, Homo sapiens
gggacuguuccaaagccagugaa

SEQ ID NO: 1502119 - RNA, 17 nt, Homo sapiens
gggagaaggcagugauu

SEQ ID NO: 1502120 - RNA, 20 nt, Homo sapiens
gggagacacuggccccucaa

SEQ ID NO: 1502121 - RNA, 22 nt, Homo sapiens
gggagaugcuucucuccuugcc

SEQ ID NO: 1502122 - RNA, 16 nt, Homo sapiens
gggagcccagugaagc

SEQ ID NO: 1502123 - RNA, 23 nt, Homo sapiens
gggaggcaagugugggggguccu

SEQ ID NO: 1502124 - RNA, 20 nt, Homo sapiens
gggaggcagagguugcagug

SEQ ID NO: 1502125 - RNA, 20 nt, Homo sapiens
gggaggcggagcuugcagug

SEQ ID NO: 1502126 - RNA, 13 nt, Homo sapiens
gggaggcuucccc

SEQ ID NO: 1502127 - RNA, 22 nt, Homo sapiens
gggauguccuacuaucacugaa

SEQ ID NO: 1502128 - RNA, 22 nt, Homo sapiens
gggauguucagcacugucccuu

SEQ ID NO: 1502129 - RNA, 13 nt, Homo sapiens
gggcaaucuuugc

SEQ ID NO: 1502130 - RNA, 15 nt, Homo sapiens
gggcacuggcccagg

SEQ ID NO: 1502131 - RNA, 13 nt, Homo sapiens
gggcacugguggc

SEQ ID NO: 1502132 - RNA, 23 nt, Homo sapiens
gggcacuugcugaggccaagcca

SEQ ID NO: 1502133 - RNA, 21 nt, Homo sapiens
gggcagagcacagcgggguga

SEQ ID NO: 1502134 - RNA, 19 nt, Homo sapiens
gggcagccugccuugccca

SEQ ID NO: 1502135 - RNA, 17 nt, Homo sapiens
gggcagggaucuugcaa

SEQ ID NO: 1502136 - RNA, 14 nt, Homo sapiens
gggcauuguaguua

SEQ ID NO: 1502137 - RNA, 21 nt, Homo sapiens
gggccagagccagggggguga

SEQ ID NO: 1502138 - RNA, 19 nt, Homo sapiens
gggccagaggaacugucca

SEQ ID NO: 1502139 - RNA, 16 nt, Homo sapiens
gggccaugccaggcca

SEQ ID NO: 1502140 - RNA, 16 nt, Homo sapiens
gggccauguccaaaga

SEQ ID NO: 1502141 - RNA, 18 nt, Homo sapiens
gggccauucuccacagca

SEQ ID NO: 1502142 - RNA, 21 nt, Homo sapiens
gggcccacagggaacccugcu

SEQ ID NO: 1502143 - RNA, 19 nt, Homo sapiens
gggcccagccaggagcaga

SEQ ID NO: 1502144 - RNA, 14 nt, Homo sapiens
gggccccauccuca

SEQ ID NO: 1502145 - RNA, 23 nt, Homo sapiens
gggccccccaaaucccagggaag

SEQ ID NO: 1502146 - RNA, 14 nt, Homo sapiens
gggccccucagagc

SEQ ID NO: 1502147 - RNA, 16 nt, Homo sapiens
gggcccugggccucag

SEQ ID NO: 1502148 - RNA, 18 nt, Homo sapiens
gggccggggaagcugcca

SEQ ID NO: 1502149 - RNA, 19 nt, Homo sapiens
gggccuggcaggccagugu

SEQ ID NO: 1502150 - RNA, 15 nt, Homo sapiens
gggccuggggcuccu

SEQ ID NO: 1502151 - RNA, 18 nt, Homo sapiens
gggccuuggaucgcuaag

SEQ ID NO: 1502152 - RNA, 12 nt, Homo sapiens
gggcgcgguggc

SEQ ID NO: 1502153 - RNA, 17 nt, Homo sapiens
gggcuauagcacacagu

SEQ ID NO: 1502154 - RNA, 23 nt, Homo sapiens
gggcuauuuuuucccccacaaac

SEQ ID NO: 1502155 - RNA, 16 nt, Homo sapiens
gggcucccaggggucu

SEQ ID NO: 1502156 - RNA, 14 nt, Homo sapiens
gggcucuguauaua

SEQ ID NO: 1502157 - RNA, 22 nt, Homo sapiens
gggcucuuccaacaaggaagaa

SEQ ID NO: 1502158 - RNA, 18 nt, Homo sapiens
gggcugaaagaacaugga

SEQ ID NO: 1502159 - RNA, 13 nt, Homo sapiens
gggguagccugag

SEQ ID NO: 1502160 - RNA, 14 nt, Homo sapiens
ggggucguuugcuu

SEQ ID NO: 1502161 - RNA, 11 nt, Homo sapiens
ggggucucaga

SEQ ID NO: 1502162 - RNA, 18 nt, Homo sapiens
gggguggugggaaccaug

SEQ ID NO: 1502163 - RNA, 14 nt, Homo sapiens
gggguuagaccacu

SEQ ID NO: 1502164 - RNA, 19 nt, Homo sapiens
ggguaaccaaauguuggcc

SEQ ID NO: 1502165 - RNA, 22 nt, Homo sapiens
ggguaauccaggcacagcugag

SEQ ID NO: 1502166 - RNA, 22 nt, Homo sapiens
ggguaccuuaagagacacucca

SEQ ID NO: 1502167 - RNA, 14 nt, Homo sapiens
ggguagaugugcaa

SEQ ID NO: 1502168 - RNA, 22 nt, Homo sapiens
ggguaggaaagaggaagcaaau

SEQ ID NO: 1502169 - RNA, 13 nt, Homo sapiens
gggucaacaucuu

SEQ ID NO: 1502170 - RNA, 21 nt, Homo sapiens
gggucaugaugcucuuuccca

SEQ ID NO: 1502171 - RNA, 12 nt, Homo sapiens
gggucgucugcc

SEQ ID NO: 1502172 - RNA, 20 nt, Homo sapiens
gggucucacaguguugccca

SEQ ID NO: 1502173 - RNA, 18 nt, Homo sapiens
gggucugugugaaugugg

SEQ ID NO: 1502174 - RNA, 23 nt, Homo sapiens
gggucuugcggcugaagugucac

SEQ ID NO: 1502175 - RNA, 20 nt, Homo sapiens
gggucuuguuucacauuugu

SEQ ID NO: 1502176 - RNA, 16 nt, Homo sapiens
gggucuuugaacccuu

SEQ ID NO: 1502177 - RNA, 12 nt, Homo sapiens
gggucuuugugg

SEQ ID NO: 1502178 - RNA, 16 nt, Homo sapiens
gggugacagugccuuc

SEQ ID NO: 1502179 - RNA, 16 nt, Homo sapiens
gggugcgguggcucac

SEQ ID NO: 1502180 - RNA, 17 nt, Homo sapiens
gggugcuggauggacag

SEQ ID NO: 1502181 - RNA, 18 nt, Homo sapiens
ggguggggggugacagug

SEQ ID NO: 1502182 - RNA, 18 nt, Homo sapiens
ggguggugagaaccggag

SEQ ID NO: 1502183 - RNA, 21 nt, Homo sapiens
ggguuaguuuacaaucagcca

SEQ ID NO: 1502184 - RNA, 23 nt, Homo sapiens
ggguucauuauuggaauuaaccu

SEQ ID NO: 1502185 - RNA, 16 nt, Homo sapiens
ggguucugauauugcc

SEQ ID NO: 1502186 - RNA, 19 nt, Homo sapiens
ggguuggacuguaagggau

SEQ ID NO: 1502187 - RNA, 17 nt, Homo sapiens
ggguugugcacauuucu

SEQ ID NO: 1502188 - RNA, 22 nt, Homo sapiens
ggguuuaauagacugagucaga

SEQ ID NO: 1502189 - RNA, 23 nt, Homo sapiens
ggguuuuuaaucuuugugacagg

SEQ ID NO: 1502190 - RNA, 19 nt, Homo sapiens
gguaaaacucacugugauc

SEQ ID NO: 1502191 - RNA, 16 nt, Homo sapiens
gguaaaugauguggug

SEQ ID NO: 1502192 - RNA, 14 nt, Homo sapiens
gguaagaaguuuua

SEQ ID NO: 1502193 - RNA, 14 nt, Homo sapiens
gguaagcaccagga

SEQ ID NO: 1502194 - RNA, 15 nt, Homo sapiens
gguacuacaaccaau

SEQ ID NO: 1502195 - RNA, 16 nt, Homo sapiens
gguacugaaagccuua

SEQ ID NO: 1502196 - RNA, 22 nt, Homo sapiens
gguagccagcacacagggcagu

SEQ ID NO: 1502197 - RNA, 20 nt, Homo sapiens
gguaguacuccugcaaaauu

SEQ ID NO: 1502198 - RNA, 16 nt, Homo sapiens
gguauccugcccagug

SEQ ID NO: 1502199 - RNA, 17 nt, Homo sapiens
gguauccugggggaccc

SEQ ID NO: 1502200 - RNA, 20 nt, Homo sapiens
gguaucuguuuaacauuucc

SEQ ID NO: 1502201 - RNA, 16 nt, Homo sapiens
gguauuagccaagcug

SEQ ID NO: 1502202 - RNA, 11 nt, Homo sapiens
ggucacagcua

SEQ ID NO: 1502203 - RNA, 13 nt, Homo sapiens
ggucacaguccac

SEQ ID NO: 1502204 - RNA, 20 nt, Homo sapiens
ggucaccggccgauggagac

SEQ ID NO: 1502205 - RNA, 18 nt, Homo sapiens
ggucagaagagaggguga

SEQ ID NO: 1502206 - RNA, 18 nt, Homo sapiens
ggucaggaacaguggcug

SEQ ID NO: 1502207 - RNA, 19 nt, Homo sapiens
ggucaguaaauaacaggca

SEQ ID NO: 1502208 - RNA, 21 nt, Homo sapiens
ggucccauuucucacugagaa

SEQ ID NO: 1502209 - RNA, 19 nt, Homo sapiens
gguccucugucagucacag

SEQ ID NO: 1502210 - RNA, 17 nt, Homo sapiens
gguccugcccuuccuga

SEQ ID NO: 1502211 - RNA, 19 nt, Homo sapiens
gguccuggccgucccuaag

SEQ ID NO: 1502212 - RNA, 16 nt, Homo sapiens
ggucucaaacuccuga

SEQ ID NO: 1502213 - RNA, 20 nt, Homo sapiens
ggucucaaacuccugaccuc

SEQ ID NO: 1502214 - RNA, 20 nt, Homo sapiens
ggucucacaguguugcccag

SEQ ID NO: 1502215 - RNA, 20 nt, Homo sapiens
ggucucgcuuuguugcccag

SEQ ID NO: 1502216 - RNA, 21 nt, Homo sapiens
ggucucuggcccuucuugccu

SEQ ID NO: 1502217 - RNA, 21 nt, Homo sapiens
ggucugacaugaacacuuuuu

SEQ ID NO: 1502218 - RNA, 16 nt, Homo sapiens
ggucugauuucaggau

SEQ ID NO: 1502219 - RNA, 23 nt, Homo sapiens
ggucugcucuuucucugccagug

SEQ ID NO: 1502220 - RNA, 18 nt, Homo sapiens
ggucugugugaauguggg

SEQ ID NO: 1502221 - RNA, 14 nt, Homo sapiens
ggucuugacucuaa

SEQ ID NO: 1502222 - RNA, 18 nt, Homo sapiens
ggugaaaccccgucucua

SEQ ID NO: 1502223 - RNA, 21 nt, Homo sapiens
ggugaaccacuucauucugca

SEQ ID NO: 1502224 - RNA, 15 nt, Homo sapiens
ggugacagcugcaag

SEQ ID NO: 1502225 - RNA, 16 nt, Homo sapiens
ggugacauugcaccug

SEQ ID NO: 1502226 - RNA, 16 nt, Homo sapiens
ggugaccucacuuuag

SEQ ID NO: 1502227 - RNA, 19 nt, Homo sapiens
ggugagcuccagcugcugc

SEQ ID NO: 1502228 - RNA, 17 nt, Homo sapiens
ggugauccgccuaccuc

SEQ ID NO: 1502229 - RNA, 19 nt, Homo sapiens
ggugcaguaucaugcccug

SEQ ID NO: 1502230 - RNA, 13 nt, Homo sapiens
ggugcauagcaga

SEQ ID NO: 1502231 - RNA, 16 nt, Homo sapiens
ggugccaaguuccacu

SEQ ID NO: 1502232 - RNA, 15 nt, Homo sapiens
ggugccccacagcua

SEQ ID NO: 1502233 - RNA, 18 nt, Homo sapiens
ggugcccuuugggguccc

SEQ ID NO: 1502234 - RNA, 19 nt, Homo sapiens
ggugcccuuuggggucccg

SEQ ID NO: 1502235 - RNA, 17 nt, Homo sapiens
gguggaggcugcaguga

SEQ ID NO: 1502236 - RNA, 13 nt, Homo sapiens
gguggagggcaca

SEQ ID NO: 1502237 - RNA, 22 nt, Homo sapiens
gguggauauuaaaaaucuguaa

SEQ ID NO: 1502238 - RNA, 16 nt, Homo sapiens
gguggaucuguccaag

SEQ ID NO: 1502239 - RNA, 13 nt, Homo sapiens
gguggaugugaug

SEQ ID NO: 1502240 - RNA, 12 nt, Homo sapiens
uauauccuguga

SEQ ID NO: 1502241 - RNA, 14 nt, Homo sapiens
uauaucuaugucua

SEQ ID NO: 1502242 - RNA, 16 nt, Homo sapiens
uauaucugaagagcua

SEQ ID NO: 1502243 - RNA, 16 nt, Homo sapiens
uauaugcacuauguau

SEQ ID NO: 1502244 - RNA, 15 nt, Homo sapiens
uauaugugugccuau

SEQ ID NO: 1502245 - RNA, 11 nt, Homo sapiens
uauauuugcua

SEQ ID NO: 1502246 - RNA, 20 nt, Homo sapiens
uauauuuuuuuaaaauguua

SEQ ID NO: 1502247 - RNA, 21 nt, Homo sapiens
uaucaagccaguacgugcuaa

SEQ ID NO: 1502248 - RNA, 13 nt, Homo sapiens
uaucaagcuuuua

SEQ ID NO: 1502249 - RNA, 14 nt, Homo sapiens
uaucacaguauuau

SEQ ID NO: 1502250 - RNA, 23 nt, Homo sapiens
uaucacaugaauauaaaugggaa

SEQ ID NO: 1502251 - RNA, 17 nt, Homo sapiens
uaucacauuuaccauaa

SEQ ID NO: 1502252 - RNA, 23 nt, Homo sapiens
uaucagcuuuuuaaaguggguua

SEQ ID NO: 1502253 - RNA, 15 nt, Homo sapiens
uaucaguuacccacu

SEQ ID NO: 1502254 - RNA, 16 nt, Homo sapiens
uaucaguugacagugu

SEQ ID NO: 1502255 - RNA, 22 nt, Homo sapiens
uaucaugcaaauuucaugacca

SEQ ID NO: 1502256 - RNA, 16 nt, Homo sapiens
uaucauggcauauaac

SEQ ID NO: 1502257 - RNA, 23 nt, Homo sapiens
uaucauugcuaaacugaugacuu

SEQ ID NO: 1502258 - RNA, 20 nt, Homo sapiens
uaucauuggaacaacugaua

SEQ ID NO: 1502259 - RNA, 13 nt, Homo sapiens
uauccaaauugau

SEQ ID NO: 1502260 - RNA, 16 nt, Homo sapiens
uauccaagaccugaaa

SEQ ID NO: 1502261 - RNA, 16 nt, Homo sapiens
uauccaaucugugaug

SEQ ID NO: 1502262 - RNA, 13 nt, Homo sapiens
uauccaccaccuc

SEQ ID NO: 1502263 - RNA, 14 nt, Homo sapiens
uauccaccaccucc

SEQ ID NO: 1502264 - RNA, 19 nt, Homo sapiens
uauccagaggguugugauu

SEQ ID NO: 1502265 - RNA, 14 nt, Homo sapiens
uauccagccuccca

SEQ ID NO: 1502266 - RNA, 12 nt, Homo sapiens
uauccauggcaa

SEQ ID NO: 1502267 - RNA, 14 nt, Homo sapiens
uaucccuacaugua

SEQ ID NO: 1502268 - RNA, 21 nt, Homo sapiens
uaucccuacauguauugcaca

SEQ ID NO: 1502269 - RNA, 20 nt, Homo sapiens
uauccugagccaucggugaa

SEQ ID NO: 1502270 - RNA, 21 nt, Homo sapiens
uauccugggagcacugcguuu

SEQ ID NO: 1502271 - RNA, 22 nt, Homo sapiens
uauccuggugccccccaccccu

SEQ ID NO: 1502272 - RNA, 15 nt, Homo sapiens
uauccugugacuguc

SEQ ID NO: 1502273 - RNA, 15 nt, Homo sapiens
uauccuuagcucaca

SEQ ID NO: 1502274 - RNA, 21 nt, Homo sapiens
uaucgaaauaacaauguuaag

SEQ ID NO: 1502275 - RNA, 23 nt, Homo sapiens
uaucucauuuuacacaaagggaa

SEQ ID NO: 1502276 - RNA, 10 nt, Homo sapiens
uaucucucaa

SEQ ID NO: 1502277 - RNA, 14 nt, Homo sapiens
uaucugaauggaag

SEQ ID NO: 1502278 - RNA, 11 nt, Homo sapiens
uaucugcuaug

SEQ ID NO: 1502279 - RNA, 20 nt, Homo sapiens
uaucuggaggccuuccagcu

SEQ ID NO: 1502280 - RNA, 14 nt, Homo sapiens
uaucugucaucucu

SEQ ID NO: 1502281 - RNA, 11 nt, Homo sapiens
uaucugugaaa

SEQ ID NO: 1502282 - RNA, 18 nt, Homo sapiens
uaucugugaauucagauu

SEQ ID NO: 1502283 - RNA, 15 nt, Homo sapiens
uaucugugucaaaag

SEQ ID NO: 1502284 - RNA, 20 nt, Homo sapiens
uaucuuaaguucuaugaaga

SEQ ID NO: 1502285 - RNA, 15 nt, Homo sapiens
uaucuucacuuuuau

SEQ ID NO: 1502286 - RNA, 22 nt, Homo sapiens
uaucuucccuuuauuacaagaa

SEQ ID NO: 1502287 - RNA, 15 nt, Homo sapiens
uaucuugauaaacua

SEQ ID NO: 1502288 - RNA, 16 nt, Homo sapiens
uaucuugcaccccaaa

SEQ ID NO: 1502289 - RNA, 19 nt, Homo sapiens
uaucuugcaccccaaagcu

SEQ ID NO: 1502290 - RNA, 19 nt, Homo sapiens
uaucuuuauuaaucacuau

SEQ ID NO: 1502291 - RNA, 14 nt, Homo sapiens
uaucuuucaaagag

SEQ ID NO: 1502292 - RNA, 13 nt, Homo sapiens
uaugaaacuauug

SEQ ID NO: 1502293 - RNA, 14 nt, Homo sapiens
uaugaacaugcagu

SEQ ID NO: 1502294 - RNA, 13 nt, Homo sapiens
uaugaacuuuaua

SEQ ID NO: 1502295 - RNA, 21 nt, Homo sapiens
uaugaaggauuacucuccaua

SEQ ID NO: 1502296 - RNA, 22 nt, Homo sapiens
uaugaaguugcaaugcuucaca

SEQ ID NO: 1502297 - RNA, 14 nt, Homo sapiens
uaugaaucugcuca

SEQ ID NO: 1502298 - RNA, 17 nt, Homo sapiens
uaugagucaaugugcag

SEQ ID NO: 1502299 - RNA, 15 nt, Homo sapiens
uaugauguaaucucu

SEQ ID NO: 1502300 - RNA, 14 nt, Homo sapiens
uaugcaaaauggaa

SEQ ID NO: 1502301 - RNA, 12 nt, Homo sapiens
uaugcaaucuga

SEQ ID NO: 1502302 - RNA, 14 nt, Homo sapiens
uaugcaguccuuua

SEQ ID NO: 1502303 - RNA, 12 nt, Homo sapiens
uaugcagugaua

SEQ ID NO: 1502304 - RNA, 19 nt, Homo sapiens
uaugcauggugccccagga

SEQ ID NO: 1502305 - RNA, 17 nt, Homo sapiens
uaugcauuuggaauuag

SEQ ID NO: 1502306 - RNA, 18 nt, Homo sapiens
uaugcccagguaccaccc

SEQ ID NO: 1502307 - RNA, 15 nt, Homo sapiens
uaugccucuguauuu

SEQ ID NO: 1502308 - RNA, 17 nt, Homo sapiens
uaugcgcaauguggcau

SEQ ID NO: 1502309 - RNA, 21 nt, Homo sapiens
uaugcuauuuauuaaguauuu

SEQ ID NO: 1502310 - RNA, 22 nt, Homo sapiens
uaugcuggacucuggaccauau

SEQ ID NO: 1502311 - RNA, 14 nt, Homo sapiens
uaugcugugcuaaa

SEQ ID NO: 1502312 - RNA, 18 nt, Homo sapiens
uauggaaccuucccucca

SEQ ID NO: 1502313 - RNA, 20 nt, Homo sapiens
uauggacaguaaguccagua

SEQ ID NO: 1502314 - RNA, 23 nt, Homo sapiens
uauggagugccugcuguggaccc

SEQ ID NO: 1502315 - RNA, 22 nt, Homo sapiens
uauggcuucaaguuguaaaaau

SEQ ID NO: 1502316 - RNA, 15 nt, Homo sapiens
uaugggaaagacaug

SEQ ID NO: 1502317 - RNA, 19 nt, Homo sapiens
uaugggagcuuaacuuuau

SEQ ID NO: 1502318 - RNA, 16 nt, Homo sapiens
uauggguugcauuugg

SEQ ID NO: 1502319 - RNA, 16 nt, Homo sapiens
uauggugaacccacaa

SEQ ID NO: 1502320 - RNA, 12 nt, Homo sapiens
uauguaccauau

SEQ ID NO: 1502321 - RNA, 13 nt, Homo sapiens
uauguagcacaua

SEQ ID NO: 1502322 - RNA, 13 nt, Homo sapiens
uauguauauauac

SEQ ID NO: 1502323 - RNA, 20 nt, Homo sapiens
uauguaucuuaguuacauuu

SEQ ID NO: 1502324 - RNA, 13 nt, Homo sapiens
uauguauggaaua

SEQ ID NO: 1502325 - RNA, 13 nt, Homo sapiens
uauguauuuucag

SEQ ID NO: 1502326 - RNA, 23 nt, Homo sapiens
uaugugagagaaagugugagcaa

SEQ ID NO: 1502327 - RNA, 21 nt, Homo sapiens
uaugugaucaauuuugacuua

SEQ ID NO: 1502328 - RNA, 13 nt, Homo sapiens
uauguguaaguau

SEQ ID NO: 1502329 - RNA, 22 nt, Homo sapiens
uaugugucccgaauccacaguc

SEQ ID NO: 1502330 - RNA, 20 nt, Homo sapiens
uauguguggaugaugcugcc

SEQ ID NO: 1502331 - RNA, 20 nt, Homo sapiens
uauguuagagaauuuccuua

SEQ ID NO: 1502332 - RNA, 16 nt, Homo sapiens
uauguucccucuuguc

SEQ ID NO: 1502333 - RNA, 20 nt, Homo sapiens
uauguuuacauaucaccuca

SEQ ID NO: 1502334 - RNA, 15 nt, Homo sapiens
uauuaacccuaccug

SEQ ID NO: 1502335 - RNA, 16 nt, Homo sapiens
uauuaacccuaccugu

SEQ ID NO: 1502336 - RNA, 24 nt, Homo sapiens
uauuaauuuuuaaggauguugcca

SEQ ID NO: 1502337 - RNA, 20 nt, Homo sapiens
ucuggccuugaaaccaccuu

SEQ ID NO: 1502338 - RNA, 13 nt, Homo sapiens
ucugggaagccaa

SEQ ID NO: 1502339 - RNA, 15 nt, Homo sapiens
ucugggaggcccuga

SEQ ID NO: 1502340 - RNA, 21 nt, Homo sapiens
ucugggccuucucaccacaga

SEQ ID NO: 1502341 - RNA, 18 nt, Homo sapiens
ucugggcugccaugugaa

SEQ ID NO: 1502342 - RNA, 14 nt, Homo sapiens
ucugggcugucagc

SEQ ID NO: 1502343 - RNA, 22 nt, Homo sapiens
ucugggcugucagcccaugugc

SEQ ID NO: 1502344 - RNA, 17 nt, Homo sapiens
ucuggggagcucaggaa

SEQ ID NO: 1502345 - RNA, 20 nt, Homo sapiens
ucugggggacagagaaggcg

SEQ ID NO: 1502346 - RNA, 14 nt, Homo sapiens
ucuggguccuugca

SEQ ID NO: 1502347 - RNA, 16 nt, Homo sapiens
ucugguaauauugacu

SEQ ID NO: 1502348 - RNA, 22 nt, Homo sapiens
ucugguaauauugacuuguaua

SEQ ID NO: 1502349 - RNA, 15 nt, Homo sapiens
ucugguaaugaagca

SEQ ID NO: 1502350 - RNA, 19 nt, Homo sapiens
ucugguacugcaggaccuc

SEQ ID NO: 1502351 - RNA, 19 nt, Homo sapiens
ucuggucuaguuaaccuag

SEQ ID NO: 1502352 - RNA, 13 nt, Homo sapiens
ucugguguugacu

SEQ ID NO: 1502353 - RNA, 16 nt, Homo sapiens
ucugguuuacuucaaa

SEQ ID NO: 1502354 - RNA, 20 nt, Homo sapiens
ucuguaaggacgccuugaug

SEQ ID NO: 1502355 - RNA, 15 nt, Homo sapiens
ucuguaguaaacuau

SEQ ID NO: 1502356 - RNA, 21 nt, Homo sapiens
ucuguauugggguacaggaau

SEQ ID NO: 1502357 - RNA, 19 nt, Homo sapiens
ucuguauuuuauuuagaca

SEQ ID NO: 1502358 - RNA, 14 nt, Homo sapiens
ucugucaacaucaa

SEQ ID NO: 1502359 - RNA, 17 nt, Homo sapiens
ucugucaacaucaaaga

SEQ ID NO: 1502360 - RNA, 14 nt, Homo sapiens
ucugucacaccagc

SEQ ID NO: 1502361 - RNA, 13 nt, Homo sapiens
ucugucaccaacu

SEQ ID NO: 1502362 - RNA, 23 nt, Homo sapiens
ucugucaccaacugaaguggcua

SEQ ID NO: 1502363 - RNA, 12 nt, Homo sapiens
ucugucaccagc

SEQ ID NO: 1502364 - RNA, 18 nt, Homo sapiens
ucugucacguucuccaca

SEQ ID NO: 1502365 - RNA, 16 nt, Homo sapiens
ucugucaucucucugg

SEQ ID NO: 1502366 - RNA, 19 nt, Homo sapiens
ucuguccccgcuccccuaa

SEQ ID NO: 1502367 - RNA, 17 nt, Homo sapiens
ucugucuuuauaaucua

SEQ ID NO: 1502368 - RNA, 14 nt, Homo sapiens
ucugugaaaguaca

SEQ ID NO: 1502369 - RNA, 19 nt, Homo sapiens
ucuguuaccaugucacugu

SEQ ID NO: 1502370 - RNA, 19 nt, Homo sapiens
ucuguucuaaccacuucag

SEQ ID NO: 1502371 - RNA, 14 nt, Homo sapiens
ucuguugacugggg

SEQ ID NO: 1502372 - RNA, 15 nt, Homo sapiens
ucuguugucauugcu

SEQ ID NO: 1502373 - RNA, 21 nt, Homo sapiens
ucuguugucguaaagauuugg

SEQ ID NO: 1502374 - RNA, 17 nt, Homo sapiens
ucuguuuccuuguucca

SEQ ID NO: 1502375 - RNA, 23 nt, Homo sapiens
ucuguuugaaauucuagagccag

SEQ ID NO: 1502376 - RNA, 14 nt, Homo sapiens
ucuguuugacuuua

SEQ ID NO: 1502377 - RNA, 13 nt, Homo sapiens
ucuuacaugcauu

SEQ ID NO: 1502378 - RNA, 14 nt, Homo sapiens
ucuuacaugcauuu

SEQ ID NO: 1502379 - RNA, 16 nt, Homo sapiens
ucuuacaugcauuuga

SEQ ID NO: 1502380 - RNA, 21 nt, Homo sapiens
ucuuacuaauguaaaaugauu

SEQ ID NO: 1502381 - RNA, 14 nt, Homo sapiens
ucuuacuacacuga

SEQ ID NO: 1502382 - RNA, 15 nt, Homo sapiens
ucuuagugucacuua

SEQ ID NO: 1502383 - RNA, 18 nt, Homo sapiens
ucuuaguugacaaccuag

SEQ ID NO: 1502384 - RNA, 14 nt, Homo sapiens
ucuuaguuugcagu

SEQ ID NO: 1502385 - RNA, 18 nt, Homo sapiens
ucuuauuuugcauuccag

SEQ ID NO: 1502386 - RNA, 16 nt, Homo sapiens
ucuucaaccucauuga

SEQ ID NO: 1502387 - RNA, 22 nt, Homo sapiens
ucuucaaccucauugacaagaa

SEQ ID NO: 1502388 - RNA, 12 nt, Homo sapiens
ucuucacaggca

SEQ ID NO: 1502389 - RNA, 18 nt, Homo sapiens
ucuucacaggcacuccug

SEQ ID NO: 1502390 - RNA, 15 nt, Homo sapiens
ucuucaccuuauuca

SEQ ID NO: 1502391 - RNA, 20 nt, Homo sapiens
ucuucacugucugacuuuag

SEQ ID NO: 1502392 - RNA, 22 nt, Homo sapiens
ucuucacuucuaaaugcauauc

SEQ ID NO: 1502393 - RNA, 15 nt, Homo sapiens
ucuucacuugcacug

SEQ ID NO: 1502394 - RNA, 15 nt, Homo sapiens
ucuucagggccaguc

SEQ ID NO: 1502395 - RNA, 12 nt, Homo sapiens
ucuucaugcaau

SEQ ID NO: 1502396 - RNA, 14 nt, Homo sapiens
ucuucauggccaua

SEQ ID NO: 1502397 - RNA, 13 nt, Homo sapiens
ucuuccaaaaaga

SEQ ID NO: 1502398 - RNA, 11 nt, Homo sapiens
ucuuccaugac

SEQ ID NO: 1502399 - RNA, 12 nt, Homo sapiens
ucuuccauucca

SEQ ID NO: 1502400 - RNA, 19 nt, Homo sapiens
ucuucccugggcugccacc

SEQ ID NO: 1502401 - RNA, 19 nt, Homo sapiens
ucuuccucuagacuuggag

SEQ ID NO: 1502402 - RNA, 20 nt, Homo sapiens
ucuuccugaguggugccaaa

SEQ ID NO: 1502403 - RNA, 16 nt, Homo sapiens
ucuuccugcacccaca

SEQ ID NO: 1502404 - RNA, 16 nt, Homo sapiens
ucuuccuuagacuuac

SEQ ID NO: 1502405 - RNA, 14 nt, Homo sapiens
ucuucuaaacuucc

SEQ ID NO: 1502406 - RNA, 15 nt, Homo sapiens
ucuucucugcacuua

SEQ ID NO: 1502407 - RNA, 20 nt, Homo sapiens
ucuucugcaaaaauggauau

SEQ ID NO: 1502408 - RNA, 14 nt, Homo sapiens
ucuugaaguacuua

SEQ ID NO: 1502409 - RNA, 14 nt, Homo sapiens
ucuugacuagugca

SEQ ID NO: 1502410 - RNA, 18 nt, Homo sapiens
ucuugauaugaccuguua

SEQ ID NO: 1502411 - RNA, 13 nt, Homo sapiens
ucuugcaaaagau

SEQ ID NO: 1502412 - RNA, 16 nt, Homo sapiens
ucuugcauucccagug

SEQ ID NO: 1502413 - RNA, 13 nt, Homo sapiens
ucuugcucaaaaa

SEQ ID NO: 1502414 - RNA, 15 nt, Homo sapiens
ucuugcucccuucag

SEQ ID NO: 1502415 - RNA, 17 nt, Homo sapiens
ucuugggauaguuccca

SEQ ID NO: 1502416 - RNA, 20 nt, Homo sapiens
ucuugggcccaggacuguug

SEQ ID NO: 1502417 - RNA, 21 nt, Homo sapiens
ucuuggggcaagacugcaaac

SEQ ID NO: 1502418 - RNA, 19 nt, Homo sapiens
ucuugguucgauaccugga

SEQ ID NO: 1502419 - RNA, 18 nt, Homo sapiens
ucuuguauacacauauau

SEQ ID NO: 1502420 - RNA, 13 nt, Homo sapiens
ucuugucuuuauu

SEQ ID NO: 1502421 - RNA, 15 nt, Homo sapiens
ucuuguuucccagau

SEQ ID NO: 1502422 - RNA, 22 nt, Homo sapiens
ucuuguuuuuuuuuuccacuua

SEQ ID NO: 1502423 - RNA, 20 nt, Homo sapiens
ucuuuaauuuguuaucucaa

SEQ ID NO: 1502424 - RNA, 21 nt, Homo sapiens
ucuuucaggacucuaccucau

SEQ ID NO: 1502425 - RNA, 21 nt, Homo sapiens
ucuuucaguggcuaccuacau

SEQ ID NO: 1502426 - RNA, 16 nt, Homo sapiens
ucuuucaucucugcuu

SEQ ID NO: 1502427 - RNA, 22 nt, Homo sapiens
ucuuuccaggcuucccugacuu

SEQ ID NO: 1502428 - RNA, 16 nt, Homo sapiens
ucuuucccaaaggcau

SEQ ID NO: 1502429 - RNA, 17 nt, Homo sapiens
ucuuucucugccaguga

SEQ ID NO: 1502430 - RNA, 20 nt, Homo sapiens
ucuuugaacccuugcuugca

SEQ ID NO: 1502431 - RNA, 19 nt, Homo sapiens
ucuuugauauuggcuuaaa

SEQ ID NO: 1502432 - RNA, 19 nt, Homo sapiens
ucuuugcucuaauuuugga

SEQ ID NO: 1502433 - RNA, 15 nt, Homo sapiens
ucuuugcugcaguca

SEQ ID NO: 1502434 - RNA, 21 nt, Homo sapiens
aucugccuuaaaaccaaagag

SEQ ID NO: 1502435 - RNA, 15 nt, Homo sapiens
aucugcgugacaaua

SEQ ID NO: 1502436 - RNA, 18 nt, Homo sapiens
aucuggaacccagacuca

SEQ ID NO: 1502437 - RNA, 19 nt, Homo sapiens
aucuggaacccagacucag

SEQ ID NO: 1502438 - RNA, 22 nt, Homo sapiens
aucuggacagaacauuuauauc

SEQ ID NO: 1502439 - RNA, 20 nt, Homo sapiens
aucuggacauucgaggaauu

SEQ ID NO: 1502440 - RNA, 17 nt, Homo sapiens
aucugggcaaaugaaaa

SEQ ID NO: 1502441 - RNA, 15 nt, Homo sapiens
aucugucuccuguau

SEQ ID NO: 1502442 - RNA, 17 nt, Homo sapiens
aucugugccccaugccu

SEQ ID NO: 1502443 - RNA, 20 nt, Homo sapiens
aucuguuugaucccuguuac

SEQ ID NO: 1502444 - RNA, 20 nt, Homo sapiens
aucuguuuugaaggcaaaau

SEQ ID NO: 1502445 - RNA, 14 nt, Homo sapiens
aucuuagugccuga

SEQ ID NO: 1502446 - RNA, 15 nt, Homo sapiens
aucuuauuuucucaa

SEQ ID NO: 1502447 - RNA, 15 nt, Homo sapiens
aucuucaaacuuuca

SEQ ID NO: 1502448 - RNA, 19 nt, Homo sapiens
aucuucaaagcuugaagau

SEQ ID NO: 1502449 - RNA, 17 nt, Homo sapiens
aucuucacaaaacacuu

SEQ ID NO: 1502450 - RNA, 18 nt, Homo sapiens
aucuucacugucugacuu

SEQ ID NO: 1502451 - RNA, 18 nt, Homo sapiens
aucuuccaaaugcaauuu

SEQ ID NO: 1502452 - RNA, 13 nt, Homo sapiens
aucuuccaagggu

SEQ ID NO: 1502453 - RNA, 22 nt, Homo sapiens
aucuuccaaggguacuaaggaa

SEQ ID NO: 1502454 - RNA, 20 nt, Homo sapiens
aucuucuaaacccaauccaa

SEQ ID NO: 1502455 - RNA, 14 nt, Homo sapiens
augcaagccagcuu

SEQ ID NO: 1502456 - RNA, 16 nt, Homo sapiens
augcaaguauccugcg

SEQ ID NO: 1502457 - RNA, 16 nt, Homo sapiens
augcaaucagacaagu

SEQ ID NO: 1502458 - RNA, 15 nt, Homo sapiens
augcaaugccaaaua

SEQ ID NO: 1502459 - RNA, 19 nt, Homo sapiens
augcacugaaaacuuagcc

SEQ ID NO: 1502460 - RNA, 12 nt, Homo sapiens
augcacugugaa

SEQ ID NO: 1502461 - RNA, 13 nt, Homo sapiens
augcagacuuccu

SEQ ID NO: 1502462 - RNA, 21 nt, Homo sapiens
augcagcucacuacccuauuc

SEQ ID NO: 1502463 - RNA, 16 nt, Homo sapiens
augcaugcccucucug

SEQ ID NO: 1502464 - RNA, 22 nt, Homo sapiens
augcauuugauggccaccagcu

SEQ ID NO: 1502465 - RNA, 13 nt, Homo sapiens
augccacccucac

SEQ ID NO: 1502466 - RNA, 20 nt, Homo sapiens
augccacguggucacugugc

SEQ ID NO: 1502467 - RNA, 13 nt, Homo sapiens
augccacuuccuu

SEQ ID NO: 1502468 - RNA, 14 nt, Homo sapiens
augccagcuacuuc

SEQ ID NO: 1502469 - RNA, 19 nt, Homo sapiens
augccagcuucucucucca

SEQ ID NO: 1502470 - RNA, 16 nt, Homo sapiens
augccaggaaccuguc

SEQ ID NO: 1502471 - RNA, 22 nt, Homo sapiens
augccagugaaacuucaagcaa

SEQ ID NO: 1502472 - RNA, 18 nt, Homo sapiens
augcccacugcuggugcc

SEQ ID NO: 1502473 - RNA, 17 nt, Homo sapiens
augccccaaggacaagg

SEQ ID NO: 1502474 - RNA, 19 nt, Homo sapiens
augcccugugcaaccucuu

SEQ ID NO: 1502475 - RNA, 17 nt, Homo sapiens
augcccugugcaugcca

SEQ ID NO: 1502476 - RNA, 17 nt, Homo sapiens
augccuaaauauaauua

SEQ ID NO: 1502477 - RNA, 15 nt, Homo sapiens
auguaacgaauggua

SEQ ID NO: 1502478 - RNA, 12 nt, Homo sapiens
auguaagcacuc

SEQ ID NO: 1502479 - RNA, 14 nt, Homo sapiens
auguaauucuacca

SEQ ID NO: 1502480 - RNA, 15 nt, Homo sapiens
auguaauuuaugcaa

SEQ ID NO: 1502481 - RNA, 12 nt, Homo sapiens
auguacaaauag

SEQ ID NO: 1502482 - RNA, 21 nt, Homo sapiens
auguacaugaagaagcuaaau

SEQ ID NO: 1502483 - RNA, 17 nt, Homo sapiens
auguagacugugccaga

SEQ ID NO: 1502484 - RNA, 22 nt, Homo sapiens
auguagcaauggcacuguugca

SEQ ID NO: 1502485 - RNA, 14 nt, Homo sapiens
auguauaucauucu

SEQ ID NO: 1502486 - RNA, 18 nt, Homo sapiens
auguauguuucugcauag

SEQ ID NO: 1502487 - RNA, 21 nt, Homo sapiens
auguauuuauuugggagaccg

SEQ ID NO: 1502488 - RNA, 17 nt, Homo sapiens
auguauuuugacacugg

SEQ ID NO: 1502489 - RNA, 13 nt, Homo sapiens
augucaagcacca

SEQ ID NO: 1502490 - RNA, 22 nt, Homo sapiens
auguccaugauggaauauuccc

SEQ ID NO: 1502491 - RNA, 21 nt, Homo sapiens
augucccuuucuuggccaguu

SEQ ID NO: 1502492 - RNA, 19 nt, Homo sapiens
auguccuaaggacacacua

SEQ ID NO: 1502493 - RNA, 15 nt, Homo sapiens
augucgaugcacagu

SEQ ID NO: 1502494 - RNA, 14 nt, Homo sapiens
augucuagcuuuca

SEQ ID NO: 1502495 - RNA, 16 nt, Homo sapiens
augucuauuauuauga

SEQ ID NO: 1502496 - RNA, 18 nt, Homo sapiens
augucugccauguugccc

SEQ ID NO: 1502497 - RNA, 23 nt, Homo sapiens
augucuguuuaagaaaaguauuu

SEQ ID NO: 1502498 - RNA, 21 nt, Homo sapiens
augucuuuucuuggcaaaagc

SEQ ID NO: 1502499 - RNA, 23 nt, Homo sapiens
augugaagagggagaagcaugaa

SEQ ID NO: 1502500 - RNA, 18 nt, Homo sapiens
auuaggauuuugauguga

SEQ ID NO: 1502501 - RNA, 15 nt, Homo sapiens
auuagguagacuuug

SEQ ID NO: 1502502 - RNA, 12 nt, Homo sapiens
auuauaacuuaa

SEQ ID NO: 1502503 - RNA, 17 nt, Homo sapiens
auuauaauauacuauau

SEQ ID NO: 1502504 - RNA, 12 nt, Homo sapiens
auuauaccagug

SEQ ID NO: 1502505 - RNA, 15 nt, Homo sapiens
auuauaccucaaugu

SEQ ID NO: 1502506 - RNA, 20 nt, Homo sapiens
auuauauauuccgcacucaa

SEQ ID NO: 1502507 - RNA, 17 nt, Homo sapiens
auuaucgggagcagugu

SEQ ID NO: 1502508 - RNA, 13 nt, Homo sapiens
auuaucucacuua

SEQ ID NO: 1502509 - RNA, 14 nt, Homo sapiens
auuaugacaguuau

SEQ ID NO: 1502510 - RNA, 11 nt, Homo sapiens
auuauggcauu

SEQ ID NO: 1502511 - RNA, 12 nt, Homo sapiens
auuauguacaaa

SEQ ID NO: 1502512 - RNA, 16 nt, Homo sapiens
auuaugucguaaguca

SEQ ID NO: 1502513 - RNA, 19 nt, Homo sapiens
auuaugugacauuuuacau

SEQ ID NO: 1502514 - RNA, 20 nt, Homo sapiens
auuauuaaagucuaaacaaa

SEQ ID NO: 1502515 - RNA, 19 nt, Homo sapiens
auuauugacacugaacuua

SEQ ID NO: 1502516 - RNA, 22 nt, Homo sapiens
auuauuggcugcuuugccucua

SEQ ID NO: 1502517 - RNA, 15 nt, Homo sapiens
auuauuuaauaacau

SEQ ID NO: 1502518 - RNA, 23 nt, Homo sapiens
auuauuuaauugcaacaugaagu

SEQ ID NO: 1502519 - RNA, 13 nt, Homo sapiens
auuauuuaccguu

SEQ ID NO: 1502520 - RNA, 19 nt, Homo sapiens
auucaaaaacauaacugag

SEQ ID NO: 1502521 - RNA, 19 nt, Homo sapiens
auucaaaaauuaucuauag

SEQ ID NO: 1502522 - RNA, 21 nt, Homo sapiens
auucaaaguuaaaagcaaaca

SEQ ID NO: 1502523 - RNA, 14 nt, Homo sapiens
auucaauccuacuu

SEQ ID NO: 1502524 - RNA, 15 nt, Homo sapiens
auucaauccuacuuu

SEQ ID NO: 1502525 - RNA, 19 nt, Homo sapiens
auucaauuuuaaagacuca

SEQ ID NO: 1502526 - RNA, 21 nt, Homo sapiens
auucacaguaauaugguuccc

SEQ ID NO: 1502527 - RNA, 20 nt, Homo sapiens
auucacauaguuuauuucaa

SEQ ID NO: 1502528 - RNA, 13 nt, Homo sapiens
auucacauucaga

SEQ ID NO: 1502529 - RNA, 22 nt, Homo sapiens
auucaccuuccagugucucgga

SEQ ID NO: 1502530 - RNA, 13 nt, Homo sapiens
auucacuacaggu

SEQ ID NO: 1502531 - RNA, 23 nt, Homo sapiens
auucagagcuauggugcuugcug

SEQ ID NO: 1502532 - RNA, 12 nt, Homo sapiens
auucagcacuua

SEQ ID NO: 1502533 - RNA, 21 nt, Homo sapiens
auucaggacuuaacggcucca

SEQ ID NO: 1502534 - RNA, 17 nt, Homo sapiens
auucaggccagcccagc

SEQ ID NO: 1502535 - RNA, 13 nt, Homo sapiens
auucaguauuaaa

SEQ ID NO: 1502536 - RNA, 16 nt, Homo sapiens
auucaguuuucaggau

SEQ ID NO: 1502537 - RNA, 16 nt, Homo sapiens
auucauaaaucacaaa

SEQ ID NO: 1502538 - RNA, 22 nt, Homo sapiens
auucaugccagggacugacaaa

SEQ ID NO: 1502539 - RNA, 14 nt, Homo sapiens
auucauuggugaag

SEQ ID NO: 1502540 - RNA, 20 nt, Homo sapiens
auucauuuaaaaugauuaga

SEQ ID NO: 1502541 - RNA, 21 nt, Homo sapiens
auuccaaacacauacaggaag

SEQ ID NO: 1502542 - RNA, 17 nt, Homo sapiens
auuccaaaugucuuuua

SEQ ID NO: 1502543 - RNA, 23 nt, Homo sapiens
auuccaauaaauugucaagacca

SEQ ID NO: 1502544 - RNA, 13 nt, Homo sapiens
auuccagaagaag

SEQ ID NO: 1502545 - RNA, 19 nt, Homo sapiens
auuccagaaugcuguacau

SEQ ID NO: 1502546 - RNA, 15 nt, Homo sapiens
auuccagcugucacu

SEQ ID NO: 1502547 - RNA, 12 nt, Homo sapiens
auuccauugccu

SEQ ID NO: 1502548 - RNA, 18 nt, Homo sapiens
auucccaagcuuuuggag

SEQ ID NO: 1502549 - RNA, 14 nt, Homo sapiens
auucccaccaaggu

SEQ ID NO: 1502550 - RNA, 21 nt, Homo sapiens
auucccccaccagcugcagcc

SEQ ID NO: 1502551 - RNA, 16 nt, Homo sapiens
auuccccugugucauc

SEQ ID NO: 1502552 - RNA, 22 nt, Homo sapiens
auucccugaaucugugccugca

SEQ ID NO: 1502553 - RNA, 13 nt, Homo sapiens
auuccgucuuaaa

SEQ ID NO: 1502554 - RNA, 15 nt, Homo sapiens
auuccucacuuugaa

SEQ ID NO: 1502555 - RNA, 12 nt, Homo sapiens
auuccucugucc

SEQ ID NO: 1502556 - RNA, 17 nt, Homo sapiens
auuccugguuugacuca

SEQ ID NO: 1502557 - RNA, 14 nt, Homo sapiens
auuccuuagucuca

SEQ ID NO: 1502558 - RNA, 22 nt, Homo sapiens
auuccuucuggccucugcugaa

SEQ ID NO: 1502559 - RNA, 15 nt, Homo sapiens
auuccuugguaauau

SEQ ID NO: 1502560 - RNA, 17 nt, Homo sapiens
auucggauguaugaucu

SEQ ID NO: 1502561 - RNA, 13 nt, Homo sapiens
auucguagggaug

SEQ ID NO: 1502562 - RNA, 20 nt, Homo sapiens
auucgugcauuuuuggauca

SEQ ID NO: 1502563 - RNA, 20 nt, Homo sapiens
auucuaaaugaauguuuaca

SEQ ID NO: 1502564 - RNA, 14 nt, Homo sapiens
auucuaagcccuuu

SEQ ID NO: 1502565 - RNA, 21 nt, Homo sapiens
auucuaaguuauuuacuuuua

SEQ ID NO: 1502566 - RNA, 18 nt, Homo sapiens
auucuaauggggacacag

SEQ ID NO: 1502567 - RNA, 20 nt, Homo sapiens
auucuaccgugguacacagu

SEQ ID NO: 1502568 - RNA, 15 nt, Homo sapiens
auucuagagccagcu

SEQ ID NO: 1502569 - RNA, 16 nt, Homo sapiens
auucuagagccagcug

SEQ ID NO: 1502570 - RNA, 22 nt, Homo sapiens
auucuauccccaaucagcuccu

SEQ ID NO: 1502571 - RNA, 21 nt, Homo sapiens
auucuauuacauuuucaguga

SEQ ID NO: 1502572 - RNA, 19 nt, Homo sapiens
auucuauuuauauguacau

SEQ ID NO: 1502573 - RNA, 21 nt, Homo sapiens
auucuauuuauauguacauga

SEQ ID NO: 1502574 - RNA, 16 nt, Homo sapiens
auucucaaaauuccua

SEQ ID NO: 1502575 - RNA, 16 nt, Homo sapiens
auucucaaagcaggaa

SEQ ID NO: 1502576 - RNA, 14 nt, Homo sapiens
auucucacuccuac

SEQ ID NO: 1502577 - RNA, 18 nt, Homo sapiens
auucucccaaaguaccuu

SEQ ID NO: 1502578 - RNA, 15 nt, Homo sapiens
auucuccugccucag

SEQ ID NO: 1502579 - RNA, 17 nt, Homo sapiens
auucugagcauacucaa

SEQ ID NO: 1502580 - RNA, 14 nt, Homo sapiens
auucugcagccaca

SEQ ID NO: 1502581 - RNA, 14 nt, Homo sapiens
auucugcuuaccuu

SEQ ID NO: 1502582 - RNA, 21 nt, Homo sapiens
auucugggcuccuggaaccaa

SEQ ID NO: 1502583 - RNA, 20 nt, Homo sapiens
auucuguguccccucugcau

SEQ ID NO: 1502584 - RNA, 22 nt, Homo sapiens
auucuuaguuguucaguugcca

SEQ ID NO: 1502585 - RNA, 19 nt, Homo sapiens
auucuuaugauuacuauca

SEQ ID NO: 1502586 - RNA, 20 nt, Homo sapiens
auucuuauuuaaguuauuga

SEQ ID NO: 1502587 - RNA, 20 nt, Homo sapiens
auucuucaaccucauugaca

SEQ ID NO: 1502588 - RNA, 19 nt, Homo sapiens
auucuuguuuuaagugccu

SEQ ID NO: 1502589 - RNA, 14 nt, Homo sapiens
auucuuuguuacag

SEQ ID NO: 1502590 - RNA, 13 nt, Homo sapiens
auucuuuuaguuu

SEQ ID NO: 1502591 - RNA, 20 nt, Homo sapiens
auugaaacuaagagcucuca

SEQ ID NO: 1502592 - RNA, 14 nt, Homo sapiens
auugaaagaaccag

SEQ ID NO: 1502593 - RNA, 18 nt, Homo sapiens
auugaacuuuuguacuga

SEQ ID NO: 1502594 - RNA, 12 nt, Homo sapiens
auugaaugaaac

SEQ ID NO: 1502595 - RNA, 15 nt, Homo sapiens
auugaaugcgcuuua

SEQ ID NO: 1502596 - RNA, 14 nt, Homo sapiens
auugacaacugcac

SEQ ID NO: 1502597 - RNA, 16 nt, Homo sapiens
auugacaacugcacau

SEQ ID NO: 1502598 - RNA, 20 nt, Homo sapiens
auugacaacugcacaugaaa

SEQ ID NO: 1502599 - RNA, 22 nt, Homo sapiens
auugacaacugcacaugaaagu

SEQ ID NO: 1502600 - RNA, 20 nt, Homo sapiens
auugacacacagcacucucu

SEQ ID NO: 1502601 - RNA, 17 nt, Homo sapiens
auugacagaacacccaa

SEQ ID NO: 1502602 - RNA, 16 nt, Homo sapiens
agccucucaccuggac

SEQ ID NO: 1502603 - RNA, 13 nt, Homo sapiens
agccucuggcuag

SEQ ID NO: 1502604 - RNA, 17 nt, Homo sapiens
agccugaacagaagcuc

SEQ ID NO: 1502605 - RNA, 18 nt, Homo sapiens
agccugcaaacucacugc

SEQ ID NO: 1502606 - RNA, 15 nt, Homo sapiens
agccugcagaaucca

SEQ ID NO: 1502607 - RNA, 18 nt, Homo sapiens
agccugcagaauccagcu

SEQ ID NO: 1502608 - RNA, 23 nt, Homo sapiens
agccugccucccaagguccucuc

SEQ ID NO: 1502609 - RNA, 19 nt, Homo sapiens
agccugcucuagugggaca

SEQ ID NO: 1502610 - RNA, 18 nt, Homo sapiens
agccugcuggcacccacc

SEQ ID NO: 1502611 - RNA, 17 nt, Homo sapiens
agccuggccaacaugau

SEQ ID NO: 1502612 - RNA, 19 nt, Homo sapiens
agccuggggaacagagcaa

SEQ ID NO: 1502613 - RNA, 19 nt, Homo sapiens
agccugggggccagugggg

SEQ ID NO: 1502614 - RNA, 15 nt, Homo sapiens
agccugucccaugga

SEQ ID NO: 1502615 - RNA, 20 nt, Homo sapiens
aggcagcauugcacagugaa

SEQ ID NO: 1502616 - RNA, 16 nt, Homo sapiens
aggcagcccccuccac

SEQ ID NO: 1502617 - RNA, 12 nt, Homo sapiens
aggcagcucaag

SEQ ID NO: 1502618 - RNA, 17 nt, Homo sapiens
aggcagcucgugugccu

SEQ ID NO: 1502619 - RNA, 19 nt, Homo sapiens
aggcaguauuuuguguccu

SEQ ID NO: 1502620 - RNA, 12 nt, Homo sapiens
aggcaguggccu

SEQ ID NO: 1502621 - RNA, 15 nt, Homo sapiens
aggcauacugacacu

SEQ ID NO: 1502622 - RNA, 14 nt, Homo sapiens
aggcauggcucaga

SEQ ID NO: 1502623 - RNA, 16 nt, Homo sapiens
aggcaugguggcucau

SEQ ID NO: 1502624 - RNA, 16 nt, Homo sapiens
aggcauuaacacaaag

SEQ ID NO: 1502625 - RNA, 14 nt, Homo sapiens
aggcauuucuauca

SEQ ID NO: 1502626 - RNA, 18 nt, Homo sapiens
aggcauuugcaggguccu

SEQ ID NO: 1502627 - RNA, 13 nt, Homo sapiens
aggccaacagcac

SEQ ID NO: 1502628 - RNA, 15 nt, Homo sapiens
aggccaacagcaccu

SEQ ID NO: 1502629 - RNA, 14 nt, Homo sapiens
aggccaacucacug

SEQ ID NO: 1502630 - RNA, 20 nt, Homo sapiens
aacacauugccuaacuacua

SEQ ID NO: 1502631 - RNA, 14 nt, Homo sapiens
aacaccacagacac

SEQ ID NO: 1502632 - RNA, 19 nt, Homo sapiens
aacacccgacuccucaaaa

SEQ ID NO: 1502633 - RNA, 18 nt, Homo sapiens
aacaccgcuucugccuuu

SEQ ID NO: 1502634 - RNA, 21 nt, Homo sapiens
aacaccguguuuucugacaca

SEQ ID NO: 1502635 - RNA, 15 nt, Homo sapiens
aacaccuauugcacu

SEQ ID NO: 1502636 - RNA, 13 nt, Homo sapiens
aacaccuccucau

SEQ ID NO: 1502637 - RNA, 14 nt, Homo sapiens
aacacggugcucau

SEQ ID NO: 1502638 - RNA, 14 nt, Homo sapiens
aacacuacagggga

SEQ ID NO: 1502639 - RNA, 22 nt, Homo sapiens
aacacuacugcuaaauccucau

SEQ ID NO: 1502640 - RNA, 19 nt, Homo sapiens
aacacuaguuuugugccag

SEQ ID NO: 1502641 - RNA, 17 nt, Homo sapiens
aacacucaguuguucaa

SEQ ID NO: 1502642 - RNA, 14 nt, Homo sapiens
aacacugcccucuu

SEQ ID NO: 1502643 - RNA, 13 nt, Homo sapiens
aacacugcugcuc

SEQ ID NO: 1502644 - RNA, 11 nt, Homo sapiens
aacacuggcau

SEQ ID NO: 1502645 - RNA, 20 nt, Homo sapiens
aacacugucacuagucucac

SEQ ID NO: 1502646 - RNA, 12 nt, Homo sapiens
aacagaaagcau

SEQ ID NO: 1502647 - RNA, 23 nt, Homo sapiens
aacagaagccugaugcugacauu

SEQ ID NO: 1502648 - RNA, 18 nt, Homo sapiens
aacagacaaaacaauccc

SEQ ID NO: 1502649 - RNA, 13 nt, Homo sapiens
aacagacaacaga

SEQ ID NO: 1502650 - RNA, 15 nt, Homo sapiens
aacagacaacagaag

SEQ ID NO: 1502651 - RNA, 18 nt, Homo sapiens
aacagaccagugacccca

SEQ ID NO: 1502652 - RNA, 21 nt, Homo sapiens
aacagagcaagacuccaucuc

SEQ ID NO: 1502653 - RNA, 22 nt, Homo sapiens
aacagauaaucccuguauuuca

SEQ ID NO: 1502654 - RNA, 16 nt, Homo sapiens
aacagauccaauggga

SEQ ID NO: 1502655 - RNA, 13 nt, Homo sapiens
aacagcagaacuu

SEQ ID NO: 1502656 - RNA, 18 nt, Homo sapiens
aacagcagaacuucugaa

SEQ ID NO: 1502657 - RNA, 19 nt, Homo sapiens
aacagcagugaucucaggg

SEQ ID NO: 1502658 - RNA, 16 nt, Homo sapiens
aacagcaguguucuca

SEQ ID NO: 1502659 - RNA, 15 nt, Homo sapiens
aacagcaucauguca

SEQ ID NO: 1502660 - RNA, 21 nt, Homo sapiens
aacagcauucuugucacaaua

SEQ ID NO: 1502661 - RNA, 15 nt, Homo sapiens
aacagccaaaugcau

SEQ ID NO: 1502662 - RNA, 17 nt, Homo sapiens
aacagccaacagguggc

SEQ ID NO: 1502663 - RNA, 20 nt, Homo sapiens
aacagccaagugugacccca

SEQ ID NO: 1502664 - RNA, 13 nt, Homo sapiens
aacagcgacaaaa

SEQ ID NO: 1502665 - RNA, 13 nt, Homo sapiens
aacagggcauuuu

SEQ ID NO: 1502666 - RNA, 16 nt, Homo sapiens
aacaggguaccucaag

SEQ ID NO: 1502667 - RNA, 14 nt, Homo sapiens
aacaguaaugacuc

SEQ ID NO: 1502668 - RNA, 21 nt, Homo sapiens
aacaguacuuggguuugcaac

SEQ ID NO: 1502669 - RNA, 12 nt, Homo sapiens
aacaguauuuca

SEQ ID NO: 1502670 - RNA, 11 nt, Homo sapiens
aacaguggcug

SEQ ID NO: 1502671 - RNA, 20 nt, Homo sapiens
aacaguucauguuugcuuca

SEQ ID NO: 1502672 - RNA, 15 nt, Homo sapiens
aacaguugcauuuag

SEQ ID NO: 1502673 - RNA, 13 nt, Homo sapiens
aacaguugugaac

SEQ ID NO: 1502674 - RNA, 22 nt, Homo sapiens
aacauaauaaaucacacauuca

SEQ ID NO: 1502675 - RNA, 14 nt, Homo sapiens
aacauaaugcacuu

SEQ ID NO: 1502676 - RNA, 17 nt, Homo sapiens
aacauaggccugcucag

SEQ ID NO: 1502677 - RNA, 13 nt, Homo sapiens
aacaucaccacug

SEQ ID NO: 1502678 - RNA, 15 nt, Homo sapiens
aacaucauaacccau

SEQ ID NO: 1502679 - RNA, 18 nt, Homo sapiens
aacaucauaacccaugaa

SEQ ID NO: 1502680 - RNA, 16 nt, Homo sapiens
aacaucucaauaacaa

SEQ ID NO: 1502681 - RNA, 16 nt, Homo sapiens
aacaucuguuaucaaa

SEQ ID NO: 1502682 - RNA, 18 nt, Homo sapiens
aacaugcaguucauuauu

SEQ ID NO: 1502683 - RNA, 11 nt, Homo sapiens
aacaugcugcc

SEQ ID NO: 1502684 - RNA, 23 nt, Homo sapiens
aacauggagcugucaucacucaa

SEQ ID NO: 1502685 - RNA, 23 nt, Homo sapiens
aacauguaauaaaaaguauaugu

SEQ ID NO: 1502686 - RNA, 11 nt, Homo sapiens
aacauguaauu

SEQ ID NO: 1502687 - RNA, 15 nt, Homo sapiens
aacauguaugugcau

SEQ ID NO: 1502688 - RNA, 13 nt, Homo sapiens
aacauuaugccuu

SEQ ID NO: 1502689 - RNA, 14 nt, Homo sapiens
aacauuaugccuua

SEQ ID NO: 1502690 - RNA, 14 nt, Homo sapiens
aacauucaguuccc

SEQ ID NO: 1502691 - RNA, 16 nt, Homo sapiens
aacauuccaaugcauu

SEQ ID NO: 1502692 - RNA, 17 nt, Homo sapiens
aacauuccaaugcauug

SEQ ID NO: 1502693 - RNA, 18 nt, Homo sapiens
aacauuucaguugccauu

SEQ ID NO: 1502694 - RNA, 14 nt, Homo sapiens
aaccaacacuaaca

SEQ ID NO: 1502695 - RNA, 15 nt, Homo sapiens
aaccaagaucuauaa

SEQ ID NO: 1502696 - RNA, 16 nt, Homo sapiens
aaccaaggacugagca

SEQ ID NO: 1502697 - RNA, 17 nt, Homo sapiens
aaccaauuuacacugcc

SEQ ID NO: 1502698 - RNA, 10 nt, Homo sapiens
aaccacagag

SEQ ID NO: 1502699 - RNA, 14 nt, Homo sapiens
aaccaccaauccaa

SEQ ID NO: 1502700 - RNA, 16 nt, Homo sapiens
aaccagagaagcugcu

SEQ ID NO: 1502701 - RNA, 13 nt, Homo sapiens
aaccagagaggcu

SEQ ID NO: 1502702 - RNA, 16 nt, Homo sapiens
aaccaguuaugugaau

SEQ ID NO: 1502703 - RNA, 18 nt, Homo sapiens
aaccauaugauacuauca

SEQ ID NO: 1502704 - RNA, 16 nt, Homo sapiens
aaccauccacuuacau

SEQ ID NO: 1502705 - RNA, 19 nt, Homo sapiens
aacccacagaugucucugg

SEQ ID NO: 1502706 - RNA, 17 nt, Homo sapiens
aacccauucccucucca

SEQ ID NO: 1502707 - RNA, 16 nt, Homo sapiens
aaccccaagcugccuc

SEQ ID NO: 1502708 - RNA, 22 nt, Homo sapiens
aaccccagccugaccugagacu

SEQ ID NO: 1502709 - RNA, 13 nt, Homo sapiens
aaccccaguggau

SEQ ID NO: 1502710 - RNA, 16 nt, Homo sapiens
gaaccuguccuaagga

SEQ ID NO: 1502711 - RNA, 22 nt, Homo sapiens
gaaccuguccuaaggaaccuuc

SEQ ID NO: 1502712 - RNA, 15 nt, Homo sapiens
gaaccuugcuguccu

SEQ ID NO: 1502713 - RNA, 16 nt, Homo sapiens
gaacuaaauguucuau

SEQ ID NO: 1502714 - RNA, 14 nt, Homo sapiens
gaacuaaugaggau

SEQ ID NO: 1502715 - RNA, 21 nt, Homo sapiens
gaacuacaaagcuucuauccc

SEQ ID NO: 1502716 - RNA, 17 nt, Homo sapiens
gaacuacuuuuggugcu

SEQ ID NO: 1502717 - RNA, 19 nt, Homo sapiens
gaacuacuuuuggugcuua

SEQ ID NO: 1502718 - RNA, 12 nt, Homo sapiens
gaacuaggcucu

SEQ ID NO: 1502719 - RNA, 23 nt, Homo sapiens
gaacucaaauggggccagaucca

SEQ ID NO: 1502720 - RNA, 19 nt, Homo sapiens
gaacucugguggcacagga

SEQ ID NO: 1502721 - RNA, 13 nt, Homo sapiens
gaacucuguaaaa

SEQ ID NO: 1502722 - RNA, 17 nt, Homo sapiens
gaacugcguggugcucu

SEQ ID NO: 1502723 - RNA, 19 nt, Homo sapiens
gaacuggggcuuugccuug

SEQ ID NO: 1502724 - RNA, 13 nt, Homo sapiens
gaacugucuguga

SEQ ID NO: 1502725 - RNA, 16 nt, Homo sapiens
gcccugcaccugugca

SEQ ID NO: 1502726 - RNA, 18 nt, Homo sapiens
gcccugcagcccaaaacc

SEQ ID NO: 1502727 - RNA, 20 nt, Homo sapiens
gcccugcccuccuuugccuu

SEQ ID NO: 1502728 - RNA, 17 nt, Homo sapiens
gcccugcucuuccucag

SEQ ID NO: 1502729 - RNA, 23 nt, Homo sapiens
gcccuguccaaaagcgcccucac

SEQ ID NO: 1502730 - RNA, 19 nt, Homo sapiens
gcccuguccuaagcacuuu

SEQ ID NO: 1502731 - RNA, 17 nt, Homo sapiens
gcccuguguacauauaa

SEQ ID NO: 1502732 - RNA, 16 nt, Homo sapiens
gcccuuaaggacaaaa

SEQ ID NO: 1502733 - RNA, 23 nt, Homo sapiens
gcccuuuaacuuucagaggcaau

SEQ ID NO: 1502734 - RNA, 19 nt, Homo sapiens
gcccuuugcuaaaauauaa

SEQ ID NO: 1502735 - RNA, 18 nt, Homo sapiens
gcccuuuucucucaccca

SEQ ID NO: 1502736 - RNA, 12 nt, Homo sapiens
gccgacugccug

SEQ ID NO: 1502737 - RNA, 17 nt, Homo sapiens
gccgcaggugggugcug

SEQ ID NO: 1502738 - RNA, 16 nt, Homo sapiens
gccgggaaccaagcag

SEQ ID NO: 1502739 - RNA, 23 nt, Homo sapiens
gccgggccuagaccuggugcuga

SEQ ID NO: 1502740 - RNA, 13 nt, Homo sapiens
gccgggcgcagug

SEQ ID NO: 1502741 - RNA, 21 nt, Homo sapiens
gccuaaaguacagccuggacc

SEQ ID NO: 1502742 - RNA, 15 nt, Homo sapiens
gccuaaauauaauua

SEQ ID NO: 1502743 - RNA, 16 nt, Homo sapiens
gccuaaaucuccagug

SEQ ID NO: 1502744 - RNA, 19 nt, Homo sapiens
gccuaaguccaguguuucu

SEQ ID NO: 1502745 - RNA, 21 nt, Homo sapiens
gccuacuuucacacuaagaaa

SEQ ID NO: 1502746 - RNA, 22 nt, Homo sapiens
gccuagcagagugcuggcacuu

SEQ ID NO: 1502747 - RNA, 20 nt, Homo sapiens
gccucaagaacaaacacugc

SEQ ID NO: 1502748 - RNA, 17 nt, Homo sapiens
gccucacucaccaucug

SEQ ID NO: 1502749 - RNA, 13 nt, Homo sapiens
gccucagggccag

SEQ ID NO: 1502750 - RNA, 13 nt, Homo sapiens
gccuccaugaccu

SEQ ID NO: 1502751 - RNA, 20 nt, Homo sapiens
gccuccaugaccugcgcucu

SEQ ID NO: 1502752 - RNA, 13 nt, Homo sapiens
gccucccacaaga

SEQ ID NO: 1502753 - RNA, 21 nt, Homo sapiens
gccuccugcccagcacaggaa

SEQ ID NO: 1502754 - RNA, 16 nt, Homo sapiens
gccucgaaacacagaa

SEQ ID NO: 1502755 - RNA, 17 nt, Homo sapiens
gccucgcagccuccgga

SEQ ID NO: 1502756 - RNA, 18 nt, Homo sapiens
gccucgcagccuccggaa

SEQ ID NO: 1502757 - RNA, 9 nt, Homo sapiens
gccucggga

SEQ ID NO: 1502758 - RNA, 17 nt, Homo sapiens
gccucgugccaugaucu

SEQ ID NO: 1502759 - RNA, 22 nt, Homo sapiens
gccucugccccucccaacccag

SEQ ID NO: 1502760 - RNA, 15 nt, Homo sapiens
gccucuggcucucau

SEQ ID NO: 1502761 - RNA, 20 nt, Homo sapiens
gccucuggcucucauggggu

SEQ ID NO: 1502762 - RNA, 16 nt, Homo sapiens
gccucuuucacauuga

SEQ ID NO: 1502763 - RNA, 21 nt, Homo sapiens
gccugaagagcgagacucugu

SEQ ID NO: 1502764 - RNA, 15 nt, Homo sapiens
gccugagggcaguac

SEQ ID NO: 1502765 - RNA, 18 nt, Homo sapiens
gccugaugcugacauuca

SEQ ID NO: 1502766 - RNA, 13 nt, Homo sapiens
gccugcacugaga

SEQ ID NO: 1502767 - RNA, 23 nt, Homo sapiens
gccugccccaaacaaauaugcaa

SEQ ID NO: 1502768 - RNA, 18 nt, Homo sapiens
gccugccccccucaucuc

SEQ ID NO: 1502769 - RNA, 17 nt, Homo sapiens
gccugccccgacaccca

SEQ ID NO: 1502770 - RNA, 22 nt, Homo sapiens
gccugcuuucacacuaaggaaa

SEQ ID NO: 1502771 - RNA, 16 nt, Homo sapiens
gccuggacuuuccugc

SEQ ID NO: 1502772 - RNA, 17 nt, Homo sapiens
gccuggacuuuccugca

SEQ ID NO: 1502773 - RNA, 18 nt, Homo sapiens
gccuggagcuaauggcga

SEQ ID NO: 1502774 - RNA, 20 nt, Homo sapiens
gccuggagugcccacccugg

SEQ ID NO: 1502775 - RNA, 18 nt, Homo sapiens
gccuggaugccagcugug

SEQ ID NO: 1502776 - RNA, 20 nt, Homo sapiens
gccuggcagccgugccuuca

SEQ ID NO: 1502777 - RNA, 14 nt, Homo sapiens
gccuggccaccagc

SEQ ID NO: 1502778 - RNA, 15 nt, Homo sapiens
gccuggccaccagcc

SEQ ID NO: 1502779 - RNA, 15 nt, Homo sapiens
gccugggagcccaga

SEQ ID NO: 1502780 - RNA, 13 nt, Homo sapiens
gccugggccucug

SEQ ID NO: 1502781 - RNA, 18 nt, Homo sapiens
gccugggcuguggacaga

SEQ ID NO: 1502782 - RNA, 12 nt, Homo sapiens
gccuggugguca

SEQ ID NO: 1502783 - RNA, 23 nt, Homo sapiens
gccuguaaucccaacacuuugag

SEQ ID NO: 1502784 - RNA, 21 nt, Homo sapiens
gccuguaaucccagcacuuug

SEQ ID NO: 1502785 - RNA, 22 nt, Homo sapiens
gccuguaaucucagcacuuugg

SEQ ID NO: 1502786 - RNA, 19 nt, Homo sapiens
gccuguagucccagcuacu

SEQ ID NO: 1502787 - RNA, 16 nt, Homo sapiens
gccugucugagacuca

SEQ ID NO: 1502788 - RNA, 20 nt, Homo sapiens
gccugucugccccagcccag

SEQ ID NO: 1502789 - RNA, 14 nt, Homo sapiens
gccugugacuuuca

SEQ ID NO: 1502790 - RNA, 16 nt, Homo sapiens
gccuuagggcacuggg

SEQ ID NO: 1502791 - RNA, 13 nt, Homo sapiens
gccuucacugaca

SEQ ID NO: 1502792 - RNA, 14 nt, Homo sapiens
gccuuccacaguga

SEQ ID NO: 1502793 - RNA, 15 nt, Homo sapiens
gccuuccagccacau

SEQ ID NO: 1502794 - RNA, 19 nt, Homo sapiens
gccuuccuuucuccaggac

SEQ ID NO: 1502795 - RNA, 23 nt, Homo sapiens
gccuuccuuucuccaggaccaau

SEQ ID NO: 1502796 - RNA, 17 nt, Homo sapiens
gccuucucaccacagag

SEQ ID NO: 1502797 - RNA, 15 nt, Homo sapiens
gccuucugcccuccc

SEQ ID NO: 1502798 - RNA, 14 nt, Homo sapiens
gccuugggcugcuc

SEQ ID NO: 1502799 - RNA, 20 nt, Homo sapiens
gccuuggugccaccaaaagu

SEQ ID NO: 1502800 - RNA, 22 nt, Homo sapiens
gccuugugcgguuguguucuca

SEQ ID NO: 1502801 - RNA, 16 nt, Homo sapiens
gccuugugcuguuaau

SEQ ID NO: 1502802 - RNA, 21 nt, Homo sapiens
gccuuguguauauuuguauau

SEQ ID NO: 1502803 - RNA, 22 nt, Homo sapiens
gccuuguuugaguuuuuccucc

SEQ ID NO: 1502804 - RNA, 19 nt, Homo sapiens
gccuuucuccgcaacagcc

SEQ ID NO: 1502805 - RNA, 19 nt, Homo sapiens
gccuuucugggagcagaaa

SEQ ID NO: 1502806 - RNA, 14 nt, Homo sapiens
gccuuuugcugcgc

SEQ ID NO: 1502807 - RNA, 18 nt, Homo sapiens
gcgauccucccaccucag

SEQ ID NO: 1502808 - RNA, 17 nt, Homo sapiens
gcgauugaaagggcaau

SEQ ID NO: 1502809 - RNA, 19 nt, Homo sapiens
cuucuuugauaauguuaaa

SEQ ID NO: 1502810 - RNA, 15 nt, Homo sapiens
cuucuuugugccuuu

SEQ ID NO: 1502811 - RNA, 17 nt, Homo sapiens
cuugaaccacaguucua

SEQ ID NO: 1502812 - RNA, 16 nt, Homo sapiens
cuugaaccugugagua

SEQ ID NO: 1502813 - RNA, 15 nt, Homo sapiens
cuugaagcuguggag

SEQ ID NO: 1502814 - RNA, 15 nt, Homo sapiens
cuugaauacaaguuu

SEQ ID NO: 1502815 - RNA, 19 nt, Homo sapiens
cuugaauauguagcucauc

SEQ ID NO: 1502816 - RNA, 13 nt, Homo sapiens
cuugaaugugguc

SEQ ID NO: 1502817 - RNA, 13 nt, Homo sapiens
cuugaauuguagg

SEQ ID NO: 1502818 - RNA, 18 nt, Homo sapiens
cuugacccccuugagggu

SEQ ID NO: 1502819 - RNA, 16 nt, Homo sapiens
cuugaccguacucuca

SEQ ID NO: 1502820 - RNA, 23 nt, Homo sapiens
cuugaccucucauaaauuuacuu

SEQ ID NO: 1502821 - RNA, 15 nt, Homo sapiens
cuugagccaguaauu

SEQ ID NO: 1502822 - RNA, 20 nt, Homo sapiens
cuugagccaguaauuggucc

SEQ ID NO: 1502823 - RNA, 20 nt, Homo sapiens
cuugagccgggccccugggc

SEQ ID NO: 1502824 - RNA, 15 nt, Homo sapiens
cgcuuuguugcccag

SEQ ID NO: 1502825 - RNA, 15 nt, Homo sapiens
cggaaccacagggcc

SEQ ID NO: 1502826 - RNA, 17 nt, Homo sapiens
cggaagggguuccucaa

SEQ ID NO: 1502827 - RNA, 18 nt, Homo sapiens
cggaaggucccucagaca

SEQ ID NO: 1502828 - RNA, 21 nt, Homo sapiens
cggacaagacccccagcacuu

SEQ ID NO: 1502829 - RNA, 17 nt, Homo sapiens
cggagccuccucucuca

SEQ ID NO: 1502830 - RNA, 16 nt, Homo sapiens
cggagcuugcagugag

SEQ ID NO: 1502831 - RNA, 13 nt, Homo sapiens
cggaggcaccugg

SEQ ID NO: 1502832 - RNA, 17 nt, Homo sapiens
cggaggccccacugaug

SEQ ID NO: 1502833 - RNA, 11 nt, Homo sapiens
cggaggucucu

SEQ ID NO: 1502834 - RNA, 17 nt, Homo sapiens
cggaggucucuguaaaa

SEQ ID NO: 1502835 - RNA, 21 nt, Homo sapiens
cggauggaccaaccugcucug

SEQ ID NO: 1502836 - RNA, 14 nt, Homo sapiens
cggcagcuacucag

SEQ ID NO: 1502837 - RNA, 14 nt, Homo sapiens
cggccacgcacugg

SEQ ID NO: 1502838 - RNA, 16 nt, Homo sapiens
cggccacucuaccuga

SEQ ID NO: 1502839 - RNA, 13 nt, Homo sapiens
cggccgacugccu

SEQ ID NO: 1502840 - RNA, 16 nt, Homo sapiens
cggccuccaugaccug

SEQ ID NO: 1502841 - RNA, 14 nt, Homo sapiens
cggcuacucuggaa

SEQ ID NO: 1502842 - RNA, 19 nt, Homo sapiens
cggcuaugggacugcagug

SEQ ID NO: 1502843 - RNA, 19 nt, Homo sapiens
cuucacaaaaucuguuuag

SEQ ID NO: 1502844 - RNA, 13 nt, Homo sapiens
cuucacaacuagg

SEQ ID NO: 1502845 - RNA, 14 nt, Homo sapiens
cuucacaucuguca

SEQ ID NO: 1502846 - RNA, 21 nt, Homo sapiens
cuucaccccaguggccacuca

SEQ ID NO: 1502847 - RNA, 15 nt, Homo sapiens
cuucacccugaaugg

SEQ ID NO: 1502848 - RNA, 11 nt, Homo sapiens
cuucaccugcg

SEQ ID NO: 1502849 - RNA, 12 nt, Homo sapiens
cuucacuacuuu

SEQ ID NO: 1502850 - RNA, 18 nt, Homo sapiens
cuucacuguggucauccu

SEQ ID NO: 1502851 - RNA, 13 nt, Homo sapiens
cuucacuuuacaa

SEQ ID NO: 1502852 - RNA, 22 nt, Homo sapiens
cuucagaaauucucugcgauua

SEQ ID NO: 1502853 - RNA, 17 nt, Homo sapiens
cuucagaguacguccug

SEQ ID NO: 1502854 - RNA, 17 nt, Homo sapiens
cuucagauacaaacugc

SEQ ID NO: 1502855 - RNA, 19 nt, Homo sapiens
cuucagccaucaacaagag

SEQ ID NO: 1502856 - RNA, 18 nt, Homo sapiens
cuucagcugccugaaaca

SEQ ID NO: 1502857 - RNA, 19 nt, Homo sapiens
cuucagggccaguccuccu

SEQ ID NO: 1502858 - RNA, 21 nt, Homo sapiens
cuucaggguuuaauagacuga

SEQ ID NO: 1502859 - RNA, 18 nt, Homo sapiens
cuucaguccaacugucaa

SEQ ID NO: 1502860 - RNA, 14 nt, Homo sapiens
cuucaguugaucuu

SEQ ID NO: 1502861 - RNA, 23 nt, Homo sapiens
cuucauccccuuuggcuaccuga

SEQ ID NO: 1502862 - RNA, 21 nt, Homo sapiens
cuucauccucugagugugacc

SEQ ID NO: 1502863 - RNA, 22 nt, Homo sapiens
cuucauccucugagugugacca

SEQ ID NO: 1502864 - RNA, 20 nt, Homo sapiens
cuucaucugaaacccacaga

SEQ ID NO: 1502865 - RNA, 21 nt, Homo sapiens
cuucaucugaaacccacagau

SEQ ID NO: 1502866 - RNA, 15 nt, Homo sapiens
cuucaugcaaugaca

SEQ ID NO: 1502867 - RNA, 21 nt, Homo sapiens
cuucauggaacucagcugucu

SEQ ID NO: 1502868 - RNA, 14 nt, Homo sapiens
cuucaugugcugcc

SEQ ID NO: 1502869 - RNA, 17 nt, Homo sapiens
cuucauucacauucaga

SEQ ID NO: 1502870 - RNA, 20 nt, Homo sapiens
cuucauucuccuuguuguug

SEQ ID NO: 1502871 - RNA, 15 nt, Homo sapiens
cuucauuucaggaag

SEQ ID NO: 1502872 - RNA, 20 nt, Homo sapiens
cuuccaaacauuaaugcaau

SEQ ID NO: 1502873 - RNA, 14 nt, Homo sapiens
cuuccaacaaggaa

SEQ ID NO: 1502874 - RNA, 21 nt, Homo sapiens
cuuccaauuuacauacucugc

SEQ ID NO: 1502875 - RNA, 19 nt, Homo sapiens
cuuccacccccaccaucca

SEQ ID NO: 1502876 - RNA, 20 nt, Homo sapiens
cuuccacccccaccauccag

SEQ ID NO: 1502877 - RNA, 13 nt, Homo sapiens
cuuccagauccug

SEQ ID NO: 1502878 - RNA, 16 nt, Homo sapiens
cuuccaguguccuuag

SEQ ID NO: 1502879 - RNA, 21 nt, Homo sapiens
cuuccauaauuaugacaguua

SEQ ID NO: 1502880 - RNA, 18 nt, Homo sapiens
cuuccauacacagaggag

SEQ ID NO: 1502881 - RNA, 16 nt, Homo sapiens
cuuccauauuuggaag

SEQ ID NO: 1502882 - RNA, 18 nt, Homo sapiens
cuuccauuauacaucaau

SEQ ID NO: 1502883 - RNA, 12 nt, Homo sapiens
cuuccauuccau

SEQ ID NO: 1502884 - RNA, 15 nt, Homo sapiens
cuucccauuucucua

SEQ ID NO: 1502885 - RNA, 18 nt, Homo sapiens
cuucccauuucucuacac

SEQ ID NO: 1502886 - RNA, 17 nt, Homo sapiens
cuuccccaaugcuccau

SEQ ID NO: 1502887 - RNA, 16 nt, Homo sapiens
cuuccccaucuucuaa

SEQ ID NO: 1502888 - RNA, 20 nt, Homo sapiens
cuuccccuuagaaacacugc

SEQ ID NO: 1502889 - RNA, 22 nt, Homo sapiens
cuucccgccagagggcuuguga

SEQ ID NO: 1502890 - RNA, 22 nt, Homo sapiens
cuucccggcgucccuaccuccu

SEQ ID NO: 1502891 - RNA, 15 nt, Homo sapiens
cuucccuacauggag

SEQ ID NO: 1502892 - RNA, 13 nt, Homo sapiens
cuucccuaccuca

SEQ ID NO: 1502893 - RNA, 17 nt, Homo sapiens
cuucccucucaugacuu

SEQ ID NO: 1502894 - RNA, 17 nt, Homo sapiens
cuuccgauggaugaauc

SEQ ID NO: 1502895 - RNA, 22 nt, Homo sapiens
cuuccgcugaggggucucggau

SEQ ID NO: 1502896 - RNA, 17 nt, Homo sapiens
cuuccucacuaugacac

SEQ ID NO: 1502897 - RNA, 21 nt, Homo sapiens
cuuccucucaggcucuugacu

SEQ ID NO: 1502898 - RNA, 15 nt, Homo sapiens
cuuccucucugcaau

SEQ ID NO: 1502899 - RNA, 23 nt, Homo sapiens
cuuccugaagggggacacuccau

SEQ ID NO: 1502900 - RNA, 19 nt, Homo sapiens
cuuccugaguggugccaaa

SEQ ID NO: 1502901 - RNA, 17 nt, Homo sapiens
cuuccuuggccaagaga

SEQ ID NO: 1502902 - RNA, 20 nt, Homo sapiens
cuuccuugggaugaucuuga

SEQ ID NO: 1502903 - RNA, 23 nt, Homo sapiens
cuucgauacaccgggccuggaga

SEQ ID NO: 1502904 - RNA, 19 nt, Homo sapiens
cuucuaaacccaauccaaa

SEQ ID NO: 1502905 - RNA, 18 nt, Homo sapiens
cuucuacgggauggccag

SEQ ID NO: 1502906 - RNA, 19 nt, Homo sapiens
cuucuacgggauggccaga

SEQ ID NO: 1502907 - RNA, 12 nt, Homo sapiens
cuucuacugcua

SEQ ID NO: 1502908 - RNA, 22 nt, Homo sapiens
cuucuaggucacuucucacaau

SEQ ID NO: 1502909 - RNA, 23 nt, Homo sapiens
cuucuauuuuuaucaugaauucc

SEQ ID NO: 1502910 - RNA, 12 nt, Homo sapiens
cuucucaagacu

SEQ ID NO: 1502911 - RNA, 17 nt, Homo sapiens
cuucuccaaaugagauc

SEQ ID NO: 1502912 - RNA, 14 nt, Homo sapiens
cuucuccacuggau

SEQ ID NO: 1502913 - RNA, 18 nt, Homo sapiens
cuucuccuuccccaggau

SEQ ID NO: 1502914 - RNA, 14 nt, Homo sapiens
cuucucggcucagg

SEQ ID NO: 1502915 - RNA, 16 nt, Homo sapiens
cuucucggcucaggcu

SEQ ID NO: 1502916 - RNA, 16 nt, Homo sapiens
cuucucguuaaggaga

SEQ ID NO: 1502917 - RNA, 18 nt, Homo sapiens
cuucucuacagacuucuc

SEQ ID NO: 1502918 - RNA, 23 nt, Homo sapiens
cuucucuucccugcgccugugau

SEQ ID NO: 1502919 - RNA, 16 nt, Homo sapiens
cuucucuugagucaca

SEQ ID NO: 1502920 - RNA, 15 nt, Homo sapiens
cuucugaaugcugcu

SEQ ID NO: 1502921 - RNA, 19 nt, Homo sapiens
cuucugacuuuuagaaaca

SEQ ID NO: 1502922 - RNA, 19 nt, Homo sapiens
cuucugaggcgcugcuuug

SEQ ID NO: 1502923 - RNA, 14 nt, Homo sapiens
cuucugcaaaaaac

SEQ ID NO: 1502924 - RNA, 14 nt, Homo sapiens
cuucugcacacaaa

SEQ ID NO: 1502925 - RNA, 20 nt, Homo sapiens
cuucuggggguagaucucaa

SEQ ID NO: 1502926 - RNA, 19 nt, Homo sapiens
cuucuuacaugcauuugag

SEQ ID NO: 1502927 - RNA, 16 nt, Homo sapiens
cuucuuacuggugcua

SEQ ID NO: 1502928 - RNA, 16 nt, Homo sapiens
cuucuugcugaucaga

SEQ ID NO: 1502929 - RNA, 16 nt, Homo sapiens
cuucuuuaccaaggau

SEQ ID NO: 1502930 - RNA, 13 nt, Homo sapiens
ccugagagucagc

SEQ ID NO: 1502931 - RNA, 21 nt, Homo sapiens
ccugagauucagaugucauuu

SEQ ID NO: 1502932 - RNA, 22 nt, Homo sapiens
ccugagcaggaaaguuuaccca

SEQ ID NO: 1502933 - RNA, 16 nt, Homo sapiens
ccugagcgagugucca

SEQ ID NO: 1502934 - RNA, 17 nt, Homo sapiens
ccugagcuggggaagcc

SEQ ID NO: 1502935 - RNA, 17 nt, Homo sapiens
ccugaggaugggucaga

SEQ ID NO: 1502936 - RNA, 18 nt, Homo sapiens
ccugagucugcaugugca

SEQ ID NO: 1502937 - RNA, 14 nt, Homo sapiens
ccugauguguccuc

SEQ ID NO: 1502938 - RNA, 13 nt, Homo sapiens
ccugcaaaaucug

SEQ ID NO: 1502939 - RNA, 12 nt, Homo sapiens
ccugcacacucc

SEQ ID NO: 1502940 - RNA, 14 nt, Homo sapiens
ccugcaccugugca

SEQ ID NO: 1502941 - RNA, 23 nt, Homo sapiens
ccugcacuggggagcccgucuca

SEQ ID NO: 1502942 - RNA, 22 nt, Homo sapiens
ccugcagaagcagaagugcaau

SEQ ID NO: 1502943 - RNA, 18 nt, Homo sapiens
ccugcagaaguacuccua

SEQ ID NO: 1502944 - RNA, 17 nt, Homo sapiens
ccugcagaauccagcua

SEQ ID NO: 1502945 - RNA, 13 nt, Homo sapiens
ccugcagaccuca

SEQ ID NO: 1502946 - RNA, 14 nt, Homo sapiens
ccugcagaccucaa

SEQ ID NO: 1502947 - RNA, 18 nt, Homo sapiens
ccugcagcaaacacucca

SEQ ID NO: 1502948 - RNA, 16 nt, Homo sapiens
ccugcaggcugcaguc

SEQ ID NO: 1502949 - RNA, 21 nt, Homo sapiens
ccuaguuaguguuuugccuca

SEQ ID NO: 1502950 - RNA, 18 nt, Homo sapiens
ccuaguuucccugaagga

SEQ ID NO: 1502951 - RNA, 22 nt, Homo sapiens
ccuauaugcuggagauggacaa

SEQ ID NO: 1502952 - RNA, 16 nt, Homo sapiens
ccuauauuguuuucag

SEQ ID NO: 1502953 - RNA, 20 nt, Homo sapiens
ccuauuagaguauuuuccac

SEQ ID NO: 1502954 - RNA, 22 nt, Homo sapiens
ccuauuggaagcauacaaagca

SEQ ID NO: 1502955 - RNA, 15 nt, Homo sapiens
ccuauugucauuaaa

SEQ ID NO: 1502956 - RNA, 19 nt, Homo sapiens
ccuauuuagaaauggauuu

SEQ ID NO: 1502957 - RNA, 20 nt, Homo sapiens
ccuauuuccauucaacaaga

SEQ ID NO: 1502958 - RNA, 12 nt, Homo sapiens
ccuauuugccau

SEQ ID NO: 1502959 - RNA, 21 nt, Homo sapiens
ccucaaacgaaucauuggcua

SEQ ID NO: 1502960 - RNA, 16 nt, Homo sapiens
ccucaaucucccaucu

SEQ ID NO: 1502961 - RNA, 15 nt, Homo sapiens
ccucaauguccccaa

SEQ ID NO: 1502962 - RNA, 13 nt, Homo sapiens
ccucaaugugacc

SEQ ID NO: 1502963 - RNA, 23 nt, Homo sapiens
ccucacacacacagcugggcaaa

SEQ ID NO: 1502964 - RNA, 14 nt, Homo sapiens
ccucaccaccugac

SEQ ID NO: 1502965 - RNA, 21 nt, Homo sapiens
ccucaccuuggcaccagacac

SEQ ID NO: 1502966 - RNA, 23 nt, Homo sapiens
ccucacuuugcugccccaccauc

SEQ ID NO: 1502967 - RNA, 20 nt, Homo sapiens
ccucagaaagucaccaggac

SEQ ID NO: 1502968 - RNA, 19 nt, Homo sapiens
ccucagacuucaagaccau

SEQ ID NO: 1502969 - RNA, 14 nt, Homo sapiens
ccucagaguggucg

SEQ ID NO: 1502970 - RNA, 22 nt, Homo sapiens
ccucagccucagaggagcucua

SEQ ID NO: 1502971 - RNA, 18 nt, Homo sapiens
ccucagccuugccagaga

SEQ ID NO: 1502972 - RNA, 20 nt, Homo sapiens
ccucagcugccucacuuccu

SEQ ID NO: 1502973 - RNA, 17 nt, Homo sapiens
ccucagcuucuucacag

SEQ ID NO: 1502974 - RNA, 18 nt, Homo sapiens
ccucagggagcagggaag

SEQ ID NO: 1502975 - RNA, 15 nt, Homo sapiens
ccucaggggacuuga

SEQ ID NO: 1502976 - RNA, 20 nt, Homo sapiens
ccucagguggccccaguuca

SEQ ID NO: 1502977 - RNA, 16 nt, Homo sapiens
ccucaguccauuuaua

SEQ ID NO: 1502978 - RNA, 21 nt, Homo sapiens
ccucagucuggugcuccaguu

SEQ ID NO: 1502979 - RNA, 20 nt, Homo sapiens
ccucaguucccucuugcuca

SEQ ID NO: 1502980 - RNA, 20 nt, Homo sapiens
ccucaguuuuaucauuuuca

SEQ ID NO: 1502981 - RNA, 14 nt, Homo sapiens
ccucauacacagaa

SEQ ID NO: 1502982 - RNA, 19 nt, Homo sapiens
ccucaugcugcucaauucc

SEQ ID NO: 1502983 - RNA, 20 nt, Homo sapiens
ccucauuccccaaccacuuc

SEQ ID NO: 1502984 - RNA, 15 nt, Homo sapiens
ccucauucuacugaa

SEQ ID NO: 1502985 - RNA, 16 nt, Homo sapiens
ccuccaacacaaggcu

SEQ ID NO: 1502986 - RNA, 14 nt, Homo sapiens
ccuccaacaccaag

SEQ ID NO: 1502987 - RNA, 17 nt, Homo sapiens
ccuccagggacaaagag

SEQ ID NO: 1502988 - RNA, 10 nt, Homo sapiens
ccuccagggc

SEQ ID NO: 1502989 - RNA, 19 nt, Homo sapiens
ccuccauggcagaagucaa

SEQ ID NO: 1502990 - RNA, 20 nt, Homo sapiens
ccucccaaagugcuaguauu

SEQ ID NO: 1502991 - RNA, 20 nt, Homo sapiens
ccucccaaagugcugggauu

SEQ ID NO: 1502992 - RNA, 13 nt, Homo sapiens
ccucccaccagag

SEQ ID NO: 1502993 - RNA, 20 nt, Homo sapiens
ccucccgaguagcugggauu

SEQ ID NO: 1502994 - RNA, 23 nt, Homo sapiens
ccuccgaacuguucaaguguccc

SEQ ID NO: 1502995 - RNA, 13 nt, Homo sapiens
ccuccucaccucu

SEQ ID NO: 1502996 - RNA, 20 nt, Homo sapiens
ccuccucaggcacacagcua

SEQ ID NO: 1502997 - RNA, 21 nt, Homo sapiens
ccuccucuccuacuuugggac

SEQ ID NO: 1502998 - RNA, 13 nt, Homo sapiens
ccuccuguaaaug

SEQ ID NO: 1502999 - RNA, 16 nt, Homo sapiens
ccuccuuugccuucca

SEQ ID NO: 1503000 - RNA, 16 nt, Homo sapiens
ccucgcccuccacaaa

SEQ ID NO: 1503001 - RNA, 18 nt, Homo sapiens
ccucgggacaucaaaaac

SEQ ID NO: 1503002 - RNA, 17 nt, Homo sapiens
ccucgggugugcuaugg

SEQ ID NO: 1503003 - RNA, 22 nt, Homo sapiens
ccucguuauuguuguugccaaa

SEQ ID NO: 1503004 - RNA, 22 nt, Homo sapiens
ccucguuggaagaggaacagca

SEQ ID NO: 1503005 - RNA, 13 nt, Homo sapiens
ccucuaagccacu

SEQ ID NO: 1503006 - RNA, 18 nt, Homo sapiens
ccucuaagccacucuucc

SEQ ID NO: 1503007 - RNA, 13 nt, Homo sapiens
ccucuaauugcau

SEQ ID NO: 1503008 - RNA, 16 nt, Homo sapiens
ccucuacuuaaugaga

SEQ ID NO: 1503009 - RNA, 18 nt, Homo sapiens
ccucuacuuaaugagaua

SEQ ID NO: 1503010 - RNA, 20 nt, Homo sapiens
ccucuaguaagaugcacuga

SEQ ID NO: 1503011 - RNA, 22 nt, Homo sapiens
ccucuaguaagaugcacugaaa

SEQ ID NO: 1503012 - RNA, 13 nt, Homo sapiens
ccucucaugacuu

SEQ ID NO: 1503013 - RNA, 22 nt, Homo sapiens
ccucucccaaaaaacuacuucu

SEQ ID NO: 1503014 - RNA, 17 nt, Homo sapiens
ccucugcacuacugaca

SEQ ID NO: 1503015 - RNA, 21 nt, Homo sapiens
ccucuggggaccccaaccuca

SEQ ID NO: 1503016 - RNA, 20 nt, Homo sapiens
ccucugucaacaucaaagag

SEQ ID NO: 1503017 - RNA, 19 nt, Homo sapiens
ccucugucagucacagcca

SEQ ID NO: 1503018 - RNA, 11 nt, Homo sapiens
ccucuguggac

SEQ ID NO: 1503019 - RNA, 14 nt, Homo sapiens
ccucuuacuuugcu

SEQ ID NO: 1503020 - RNA, 17 nt, Homo sapiens
ccucuucaccuuauuca

SEQ ID NO: 1503021 - RNA, 17 nt, Homo sapiens
ccucuucccaugacugc

SEQ ID NO: 1503022 - RNA, 14 nt, Homo sapiens
ccucuuccccagaa

SEQ ID NO: 1503023 - RNA, 20 nt, Homo sapiens
ccucuucccuucaacaugaa

SEQ ID NO: 1503024 - RNA, 21 nt, Homo sapiens
ccucuuccuccucgcugccag

SEQ ID NO: 1503025 - RNA, 15 nt, Homo sapiens
ccucuucugcucuuu

SEQ ID NO: 1503026 - RNA, 18 nt, Homo sapiens
ccucuucuuugugccuuu

SEQ ID NO: 1503027 - RNA, 13 nt, Homo sapiens
ccucuugcugucu

SEQ ID NO: 1503028 - RNA, 22 nt, Homo sapiens
ccucuuggugugauugcacaga

SEQ ID NO: 1503029 - RNA, 14 nt, Homo sapiens
ccucuuugucccag

SEQ ID NO: 1503030 - RNA, 15 nt, Homo sapiens
ccucuuuucucugug

SEQ ID NO: 1503031 - RNA, 18 nt, Homo sapiens
ccucuuuucucugugcuu

SEQ ID NO: 1503032 - RNA, 23 nt, Homo sapiens
ccucuuuucugcaucaucuguag

SEQ ID NO: 1503033 - RNA, 20 nt, Homo sapiens
ccucuuuuuccuccuggaca

SEQ ID NO: 1503034 - RNA, 20 nt, Homo sapiens
ccugaaauuuauucacauau

SEQ ID NO: 1503035 - RNA, 16 nt, Homo sapiens
ccugaacuaaucugau

SEQ ID NO: 1503036 - RNA, 14 nt, Homo sapiens
ccugaagaaccagu

SEQ ID NO: 1503037 - RNA, 22 nt, Homo sapiens
ccugaagacugaggacaaagug

SEQ ID NO: 1503038 - RNA, 24 nt, Homo sapiens
ccugaagacugaggacaaagugga

SEQ ID NO: 1503039 - RNA, 21 nt, Homo sapiens
ccugaauucuuuuucauuuga

SEQ ID NO: 1503040 - RNA, 14 nt, Homo sapiens
ccugacaaccacug

SEQ ID NO: 1503041 - RNA, 12 nt, Homo sapiens
ccugacaccccc

SEQ ID NO: 1503042 - RNA, 17 nt, Homo sapiens
ccugaccucaggugauu

SEQ ID NO: 1503043 - RNA, 16 nt, Homo sapiens
ccugaccugagacugu

SEQ ID NO: 1503044 - RNA, 12 nt, Homo sapiens
ccugaccuguca

SEQ ID NO: 1503045 - RNA, 20 nt, Homo sapiens
ccugacuccucuaagccacu

SEQ ID NO: 1503046 - RNA, 18 nt, Homo sapiens
ccugacucuugcaggggu

SEQ ID NO: 1503047 - RNA, 14 nt, Homo sapiens
ccugacuggccaaa

SEQ ID NO: 1503048 - RNA, 18 nt, Homo sapiens
ccugagaagaaguggcug

SEQ ID NO: 1503049 - RNA, 15 nt, Homo sapiens
ccugagaagccagug

SEQ ID NO: 1503050 - RNA, 18 nt, Homo sapiens
caguucccccaaccucag

SEQ ID NO: 1503051 - RNA, 18 nt, Homo sapiens
caguucccccaguaccuc

SEQ ID NO: 1503052 - RNA, 13 nt, Homo sapiens
caguucucacucc

SEQ ID NO: 1503053 - RNA, 20 nt, Homo sapiens
caguucugagcaccguguca

SEQ ID NO: 1503054 - RNA, 15 nt, Homo sapiens
caguucuuuccaugg

SEQ ID NO: 1503055 - RNA, 15 nt, Homo sapiens
caguugcauaucuua

SEQ ID NO: 1503056 - RNA, 18 nt, Homo sapiens
caguugccauugacagaa

SEQ ID NO: 1503057 - RNA, 14 nt, Homo sapiens
caguugcccuagcc

SEQ ID NO: 1503058 - RNA, 19 nt, Homo sapiens
caguugggacccaaaacac

SEQ ID NO: 1503059 - RNA, 17 nt, Homo sapiens
caguuuauacccuaguu

SEQ ID NO: 1503060 - RNA, 19 nt, Homo sapiens
caguuucuuagcuuuuuaa

SEQ ID NO: 1503061 - RNA, 22 nt, Homo sapiens
cauaaaaagccugcaauuucau

SEQ ID NO: 1503062 - RNA, 16 nt, Homo sapiens
cauaaagugucuauaa

SEQ ID NO: 1503063 - RNA, 20 nt, Homo sapiens
cauaaaucacuucaacugcu

SEQ ID NO: 1503064 - RNA, 14 nt, Homo sapiens
cauaacaugcuuua

SEQ ID NO: 1503065 - RNA, 16 nt, Homo sapiens
cauaacaugcuuuaga

SEQ ID NO: 1503066 - RNA, 22 nt, Homo sapiens
cauaaccucuggggaccccaac

SEQ ID NO: 1503067 - RNA, 16 nt, Homo sapiens
cauaagaaaacuaaga

SEQ ID NO: 1503068 - RNA, 15 nt, Homo sapiens
cauaagaauucuguu

SEQ ID NO: 1503069 - RNA, 21 nt, Homo sapiens
cauaagaauuuuuuauaagua

SEQ ID NO: 1503070 - RNA, 17 nt, Homo sapiens
cauaagauaaaugugcu

SEQ ID NO: 1503071 - RNA, 21 nt, Homo sapiens
cauaagugaaaaucuuacaac

SEQ ID NO: 1503072 - RNA, 13 nt, Homo sapiens
cauaaguugcauu

SEQ ID NO: 1503073 - RNA, 23 nt, Homo sapiens
cauaauaaagcaaucugauucag

SEQ ID NO: 1503074 - RNA, 16 nt, Homo sapiens
cauaauaaauaauuaa

SEQ ID NO: 1503075 - RNA, 16 nt, Homo sapiens
cauaauaaauaucugu

SEQ ID NO: 1503076 - RNA, 17 nt, Homo sapiens
cauaauacaugauugca

SEQ ID NO: 1503077 - RNA, 15 nt, Homo sapiens
cauaauagucaauuu

SEQ ID NO: 1503078 - RNA, 21 nt, Homo sapiens
cauaauggacucuguggugcc

SEQ ID NO: 1503079 - RNA, 15 nt, Homo sapiens
cauaauucagcacuu

SEQ ID NO: 1503080 - RNA, 19 nt, Homo sapiens
cauaauuccuacagcacua

SEQ ID NO: 1503081 - RNA, 15 nt, Homo sapiens
cauacauuuaugcac

SEQ ID NO: 1503082 - RNA, 18 nt, Homo sapiens
cauaccccggugugccug

SEQ ID NO: 1503083 - RNA, 14 nt, Homo sapiens
cauacgucagcauu

SEQ ID NO: 1503084 - RNA, 22 nt, Homo sapiens
cauacuccaacugaaauguuaa

SEQ ID NO: 1503085 - RNA, 13 nt, Homo sapiens
cauacugcaugua

SEQ ID NO: 1503086 - RNA, 21 nt, Homo sapiens
cauacuuaucucucugugcug

SEQ ID NO: 1503087 - RNA, 17 nt, Homo sapiens
cauacuugaagggccag

SEQ ID NO: 1503088 - RNA, 23 nt, Homo sapiens
cauagaaaauuaaacacaaagug

SEQ ID NO: 1503089 - RNA, 18 nt, Homo sapiens
cauagcagaugguuucca

SEQ ID NO: 1503090 - RNA, 17 nt, Homo sapiens
cauaggcgcaggugcac

SEQ ID NO: 1503091 - RNA, 18 nt, Homo sapiens
cauaggcgcaggugcaca

SEQ ID NO: 1503092 - RNA, 20 nt, Homo sapiens
cauaguaccauuuauacaaa

SEQ ID NO: 1503093 - RNA, 17 nt, Homo sapiens
cauaguaccucugcuau

SEQ ID NO: 1503094 - RNA, 19 nt, Homo sapiens
cauauacacaauaauguga

SEQ ID NO: 1503095 - RNA, 12 nt, Homo sapiens
cauauaccagca

SEQ ID NO: 1503096 - RNA, 23 nt, Homo sapiens
cauauacugccauguacuaguuu

SEQ ID NO: 1503097 - RNA, 21 nt, Homo sapiens
cauauagagaugaaguuugua

SEQ ID NO: 1503098 - RNA, 20 nt, Homo sapiens
cauauauacaggcauaaaau

SEQ ID NO: 1503099 - RNA, 19 nt, Homo sapiens
cauauauacccacauguac

SEQ ID NO: 1503100 - RNA, 21 nt, Homo sapiens
cauauauacccacauguacag

SEQ ID NO: 1503101 - RNA, 20 nt, Homo sapiens
cauauauauugaaaugcaaa

SEQ ID NO: 1503102 - RNA, 17 nt, Homo sapiens
cauaucccuuccucuca

SEQ ID NO: 1503103 - RNA, 15 nt, Homo sapiens
cauauccugagccau

SEQ ID NO: 1503104 - RNA, 21 nt, Homo sapiens
cauaucgcugacuucauggaa

SEQ ID NO: 1503105 - RNA, 11 nt, Homo sapiens
cauaucuccau

SEQ ID NO: 1503106 - RNA, 18 nt, Homo sapiens
cauaucuuaaaacuaaau

SEQ ID NO: 1503107 - RNA, 14 nt, Homo sapiens
cauaucuucuauau

SEQ ID NO: 1503108 - RNA, 17 nt, Homo sapiens
cauauuaagcacuuuaa

SEQ ID NO: 1503109 - RNA, 23 nt, Homo sapiens
cauauucugggcuccuggaacca

SEQ ID NO: 1503110 - RNA, 19 nt, Homo sapiens
cauauuguuugaucuacuu

SEQ ID NO: 1503111 - RNA, 21 nt, Homo sapiens
cauauuuacauucuaguucag

SEQ ID NO: 1503112 - RNA, 23 nt, Homo sapiens
cauauuuggaagaaaaaaaucuu

SEQ ID NO: 1503113 - RNA, 13 nt, Homo sapiens
caucaaauaguga

SEQ ID NO: 1503114 - RNA, 21 nt, Homo sapiens
caucaacaaagaaauauuauu

SEQ ID NO: 1503115 - RNA, 14 nt, Homo sapiens
caucaacauuccug

SEQ ID NO: 1503116 - RNA, 23 nt, Homo sapiens
caucaaucuaaagauacaguguc

SEQ ID NO: 1503117 - RNA, 19 nt, Homo sapiens
caucagaccugucuuccaa

SEQ ID NO: 1503118 - RNA, 12 nt, Homo sapiens
caucagcauuug

SEQ ID NO: 1503119 - RNA, 19 nt, Homo sapiens
caucaggaaggaaaugaca

SEQ ID NO: 1503120 - RNA, 18 nt, Homo sapiens
caucaggccgcauccuga

SEQ ID NO: 1503121 - RNA, 15 nt, Homo sapiens
caucagucaacaacu

SEQ ID NO: 1503122 - RNA, 19 nt, Homo sapiens
caucagucccccugugcau

SEQ ID NO: 1503123 - RNA, 15 nt, Homo sapiens
caucauaacccauga

SEQ ID NO: 1503124 - RNA, 16 nt, Homo sapiens
caucauaugccugacc

SEQ ID NO: 1503125 - RNA, 18 nt, Homo sapiens
caucaucaaaaacuuugg

SEQ ID NO: 1503126 - RNA, 22 nt, Homo sapiens
caucaugcggugggugcugcca

SEQ ID NO: 1503127 - RNA, 13 nt, Homo sapiens
caucauuacccuu

SEQ ID NO: 1503128 - RNA, 19 nt, Homo sapiens
caucauuggaaaugaaacu

SEQ ID NO: 1503129 - RNA, 11 nt, Homo sapiens
cauccaaauaa

SEQ ID NO: 1503130 - RNA, 22 nt, Homo sapiens
cauccacaggguuuugacacuu

SEQ ID NO: 1503131 - RNA, 15 nt, Homo sapiens
cauccagcaguguug

SEQ ID NO: 1503132 - RNA, 13 nt, Homo sapiens
cauccaggcugcc

SEQ ID NO: 1503133 - RNA, 19 nt, Homo sapiens
cauccaucccuccauucau

SEQ ID NO: 1503134 - RNA, 20 nt, Homo sapiens
cauccauuaccuccauccau

SEQ ID NO: 1503135 - RNA, 15 nt, Homo sapiens
caucccaucaucuug

SEQ ID NO: 1503136 - RNA, 14 nt, Homo sapiens
caucccauguauuu

SEQ ID NO: 1503137 - RNA, 19 nt, Homo sapiens
caucccucgggugugcuau

SEQ ID NO: 1503138 - RNA, 17 nt, Homo sapiens
caucccugccacauaca

SEQ ID NO: 1503139 - RNA, 15 nt, Homo sapiens
cauccucaugcugcu

SEQ ID NO: 1503140 - RNA, 15 nt, Homo sapiens
cauccuuccauccau

SEQ ID NO: 1503141 - RNA, 12 nt, Homo sapiens
cauccuugaugc

SEQ ID NO: 1503142 - RNA, 24 nt, Homo sapiens
cauccuuggaaauuggaagagcac

SEQ ID NO: 1503143 - RNA, 22 nt, Homo sapiens
cauccuuuacaccaacuccuaa

SEQ ID NO: 1503144 - RNA, 22 nt, Homo sapiens
caucgaaucuacuaauuccaca

SEQ ID NO: 1503145 - RNA, 18 nt, Homo sapiens
caucgauauguauaucau

SEQ ID NO: 1503146 - RNA, 21 nt, Homo sapiens
caucgauuuucuauuauggaa

SEQ ID NO: 1503147 - RNA, 20 nt, Homo sapiens
caucgcaggaugacagcucc

SEQ ID NO: 1503148 - RNA, 20 nt, Homo sapiens
caucuaccuuuucuggcaaa

SEQ ID NO: 1503149 - RNA, 14 nt, Homo sapiens
caucuagcaauuuc

SEQ ID NO: 1503150 - RNA, 13 nt, Homo sapiens
caucuauucaagc

SEQ ID NO: 1503151 - RNA, 18 nt, Homo sapiens
caggaaaguggcaccugu

SEQ ID NO: 1503152 - RNA, 23 nt, Homo sapiens
caggaaauauauaugugugugua

SEQ ID NO: 1503153 - RNA, 14 nt, Homo sapiens
caggaagacugaca

SEQ ID NO: 1503154 - RNA, 16 nt, Homo sapiens
caggaagaugaaagag

SEQ ID NO: 1503155 - RNA, 17 nt, Homo sapiens
caggaagcauucagaga

SEQ ID NO: 1503156 - RNA, 14 nt, Homo sapiens
caggaagcuuguca

SEQ ID NO: 1503157 - RNA, 19 nt, Homo sapiens
caggaagggagaacuugaa

SEQ ID NO: 1503158 - RNA, 16 nt, Homo sapiens
caggaaggggugugcu

SEQ ID NO: 1503159 - RNA, 22 nt, Homo sapiens
caggaagguagcccagcacugu

SEQ ID NO: 1503160 - RNA, 15 nt, Homo sapiens
caggaaguacuucca

SEQ ID NO: 1503161 - RNA, 14 nt, Homo sapiens
caggaauacauuug

SEQ ID NO: 1503162 - RNA, 23 nt, Homo sapiens
caggaauuucccaggacccugaa

SEQ ID NO: 1503163 - RNA, 21 nt, Homo sapiens
caggacacggggcaguggcaa

SEQ ID NO: 1503164 - RNA, 19 nt, Homo sapiens
caggacagguggugcaaau

SEQ ID NO: 1503165 - RNA, 15 nt, Homo sapiens
caggacaguauuccu

SEQ ID NO: 1503166 - RNA, 10 nt, Homo sapiens
caggacaucu

SEQ ID NO: 1503167 - RNA, 12 nt, Homo sapiens
caggacaucucu

SEQ ID NO: 1503168 - RNA, 17 nt, Homo sapiens
caggaccagcucaggac

SEQ ID NO: 1503169 - RNA, 13 nt, Homo sapiens
caggacggggcac

SEQ ID NO: 1503170 - RNA, 18 nt, Homo sapiens
caggagaaucacuggaac

SEQ ID NO: 1503171 - RNA, 18 nt, Homo sapiens
caggagaccuggcacugg

SEQ ID NO: 1503172 - RNA, 19 nt, Homo sapiens
caggagaccuggcacugga

SEQ ID NO: 1503173 - RNA, 22 nt, Homo sapiens
caggagaccuggcacuggaugc

SEQ ID NO: 1503174 - RNA, 21 nt, Homo sapiens
caggagacuuuacauggaugc

SEQ ID NO: 1503175 - RNA, 23 nt, Homo sapiens
caggagcuugggcagugccccag

SEQ ID NO: 1503176 - RNA, 15 nt, Homo sapiens
caggaggauggcaaa

SEQ ID NO: 1503177 - RNA, 17 nt, Homo sapiens
caggaggccaauaaaaa

SEQ ID NO: 1503178 - RNA, 20 nt, Homo sapiens
caggaggcccccaucuauga

SEQ ID NO: 1503179 - RNA, 21 nt, Homo sapiens
caggaggugugauuccugaag

SEQ ID NO: 1503180 - RNA, 17 nt, Homo sapiens
caggagugguggaaccu

SEQ ID NO: 1503181 - RNA, 23 nt, Homo sapiens
caggaguuggaauguuguaguua

SEQ ID NO: 1503182 - RNA, 17 nt, Homo sapiens
caggauaucacauugga

SEQ ID NO: 1503183 - RNA, 13 nt, Homo sapiens
caggauauugaca

SEQ ID NO: 1503184 - RNA, 16 nt, Homo sapiens
caggauauugacaaga

SEQ ID NO: 1503185 - RNA, 13 nt, Homo sapiens
caggaucaccucc

SEQ ID NO: 1503186 - RNA, 12 nt, Homo sapiens
caggauggucau

SEQ ID NO: 1503187 - RNA, 14 nt, Homo sapiens
caggcaaacuugca

SEQ ID NO: 1503188 - RNA, 18 nt, Homo sapiens
caggcaacgcacaaaaca

SEQ ID NO: 1503189 - RNA, 20 nt, Homo sapiens
caggcacacacagccccuau

SEQ ID NO: 1503190 - RNA, 12 nt, Homo sapiens
caggcacagggc

SEQ ID NO: 1503191 - RNA, 12 nt, Homo sapiens
caggcaccugcc

SEQ ID NO: 1503192 - RNA, 14 nt, Homo sapiens
caggcacuccugga

SEQ ID NO: 1503193 - RNA, 15 nt, Homo sapiens
caggcacugccugga

SEQ ID NO: 1503194 - RNA, 12 nt, Homo sapiens
caggcagacuac

SEQ ID NO: 1503195 - RNA, 19 nt, Homo sapiens
caggcagacuacacaggau

SEQ ID NO: 1503196 - RNA, 16 nt, Homo sapiens
caggcagauccaggac

SEQ ID NO: 1503197 - RNA, 20 nt, Homo sapiens
caggcagaucugugccccau

SEQ ID NO: 1503198 - RNA, 16 nt, Homo sapiens
caggcagcgccaagug

SEQ ID NO: 1503199 - RNA, 17 nt, Homo sapiens
caggcauagaggcuucu

SEQ ID NO: 1503200 - RNA, 22 nt, Homo sapiens
caggccaccccuaggaacucag

SEQ ID NO: 1503201 - RNA, 14 nt, Homo sapiens
caggcccccagugg

SEQ ID NO: 1503202 - RNA, 23 nt, Homo sapiens
caggcccuguccuaagcacuuua

SEQ ID NO: 1503203 - RNA, 17 nt, Homo sapiens
caggccgcagcuccauu

SEQ ID NO: 1503204 - RNA, 22 nt, Homo sapiens
caggccgcccugcgggugaaca

SEQ ID NO: 1503205 - RNA, 18 nt, Homo sapiens
caggccuaagacauguga

SEQ ID NO: 1503206 - RNA, 13 nt, Homo sapiens
caggcgugaucca

SEQ ID NO: 1503207 - RNA, 14 nt, Homo sapiens
caggcuaaaugcac

SEQ ID NO: 1503208 - RNA, 16 nt, Homo sapiens
caggcuccaggccuca

SEQ ID NO: 1503209 - RNA, 22 nt, Homo sapiens
caggcucucugguguucagggu

SEQ ID NO: 1503210 - RNA, 13 nt, Homo sapiens
caggcucuucucc

SEQ ID NO: 1503211 - RNA, 20 nt, Homo sapiens
caggcucuugacuacuugga

SEQ ID NO: 1503212 - RNA, 20 nt, Homo sapiens
caggcugcagucccuggaaa

SEQ ID NO: 1503213 - RNA, 12 nt, Homo sapiens
caggcugggaac

SEQ ID NO: 1503214 - RNA, 20 nt, Homo sapiens
caggcugggccauguccaaa

SEQ ID NO: 1503215 - RNA, 22 nt, Homo sapiens
caggcuguggguagaugugcaa

SEQ ID NO: 1503216 - RNA, 14 nt, Homo sapiens
caggcuuaugaaua

SEQ ID NO: 1503217 - RNA, 15 nt, Homo sapiens
caggcuuaugaauau

SEQ ID NO: 1503218 - RNA, 23 nt, Homo sapiens
caggcuucugucaauuucauuau

SEQ ID NO: 1503219 - RNA, 13 nt, Homo sapiens
caggcuugugcaa

SEQ ID NO: 1503220 - RNA, 19 nt, Homo sapiens
caggcuuucaagaagugcc

SEQ ID NO: 1503221 - RNA, 13 nt, Homo sapiens
caggcuuuguaca

SEQ ID NO: 1503222 - RNA, 16 nt, Homo sapiens
cagggaaaacugcaaa

SEQ ID NO: 1503223 - RNA, 22 nt, Homo sapiens
cagggaacccugcuugcacuuu

SEQ ID NO: 1503224 - RNA, 16 nt, Homo sapiens
cagggacuccaugcug

SEQ ID NO: 1503225 - RNA, 19 nt, Homo sapiens
cagggacuccaugcugcca

SEQ ID NO: 1503226 - RNA, 19 nt, Homo sapiens
cagggagaccgagcgcuuu

SEQ ID NO: 1503227 - RNA, 22 nt, Homo sapiens
cagggagcucuggggacagcuu

SEQ ID NO: 1503228 - RNA, 22 nt, Homo sapiens
cagggaguccaggguuucucug

SEQ ID NO: 1503229 - RNA, 17 nt, Homo sapiens
cagggagugggagccaa

SEQ ID NO: 1503230 - RNA, 14 nt, Homo sapiens
cagggaucuugcaa

SEQ ID NO: 1503231 - RNA, 22 nt, Homo sapiens
cagggaugaagaaagacucuga

SEQ ID NO: 1503232 - RNA, 13 nt, Homo sapiens
cagggauggcccc

SEQ ID NO: 1503233 - RNA, 21 nt, Homo sapiens
cagggauuaaccucugcacua

SEQ ID NO: 1503234 - RNA, 22 nt, Homo sapiens
cagggauuuagacuuacuauua

SEQ ID NO: 1503235 - RNA, 14 nt, Homo sapiens
cagggcaccagagg

SEQ ID NO: 1503236 - RNA, 22 nt, Homo sapiens
cagggcagccccacaacuuuaa

SEQ ID NO: 1503237 - RNA, 18 nt, Homo sapiens
cagggcccuccaccgcca

SEQ ID NO: 1503238 - RNA, 14 nt, Homo sapiens
cagggccguugccc

SEQ ID NO: 1503239 - RNA, 18 nt, Homo sapiens
cagggccuggggccugag

SEQ ID NO: 1503240 - RNA, 16 nt, Homo sapiens
cagggccuuccugguu

SEQ ID NO: 1503241 - RNA, 13 nt, Homo sapiens
cagggcuagugac

SEQ ID NO: 1503242 - RNA, 20 nt, Homo sapiens
cagggcucugugaccaggaa

SEQ ID NO: 1503243 - RNA, 20 nt, Homo sapiens
caggggcgugaggucccagg

SEQ ID NO: 1503244 - RNA, 13 nt, Homo sapiens
caggguaccucaa

SEQ ID NO: 1503245 - RNA, 18 nt, Homo sapiens
cagggucauguuugcagg

SEQ ID NO: 1503246 - RNA, 17 nt, Homo sapiens
cagggucugugugaaug

SEQ ID NO: 1503247 - RNA, 20 nt, Homo sapiens
cagggugacccugaagugag

SEQ ID NO: 1503248 - RNA, 19 nt, Homo sapiens
caggguggguguccaugug

SEQ ID NO: 1503249 - RNA, 18 nt, Homo sapiens
caggguucaucuguccau

SEQ ID NO: 1503250 - RNA, 14 nt, Homo sapiens
caggguugaucaca

SEQ ID NO: 1503251 - RNA, 21 nt, Homo sapiens
caggguuucaccauguugccc

SEQ ID NO: 1503252 - RNA, 15 nt, Homo sapiens
caggguuucucugca

SEQ ID NO: 1503253 - RNA, 15 nt, Homo sapiens
cagguaaugagggac

SEQ ID NO: 1503254 - RNA, 14 nt, Homo sapiens
cagguaaugugaau

SEQ ID NO: 1503255 - RNA, 21 nt, Homo sapiens
cagguaccaucuuguauacac

SEQ ID NO: 1503256 - RNA, 23 nt, Homo sapiens
cagguaccaucuuguauacacau

SEQ ID NO: 1503257 - RNA, 14 nt, Homo sapiens
caggucaccaagca

SEQ ID NO: 1503258 - RNA, 19 nt, Homo sapiens
caggucacccuuugcugug

SEQ ID NO: 1503259 - RNA, 16 nt, Homo sapiens
cagguccaauuuguaa

SEQ ID NO: 1503260 - RNA, 14 nt, Homo sapiens
caggucuugacuca

SEQ ID NO: 1503261 - RNA, 14 nt, Homo sapiens
caggugaaaaucca

SEQ ID NO: 1503262 - RNA, 16 nt, Homo sapiens
caggugauccacccac

SEQ ID NO: 1503263 - RNA, 22 nt, Homo sapiens
caggugauccacccaccuuggc

SEQ ID NO: 1503264 - RNA, 23 nt, Homo sapiens
caggugauuuguaugcucauuga

SEQ ID NO: 1503265 - RNA, 16 nt, Homo sapiens
caggugccuucccaga

SEQ ID NO: 1503266 - RNA, 23 nt, Homo sapiens
caggugccuuguccucagggcua

SEQ ID NO: 1503267 - RNA, 22 nt, Homo sapiens
caggugcgcgccaccgugccug

SEQ ID NO: 1503268 - RNA, 17 nt, Homo sapiens
caggugcgguuccucau

SEQ ID NO: 1503269 - RNA, 16 nt, Homo sapiens
caggugcucuguggau

SEQ ID NO: 1503270 - RNA, 17 nt, Homo sapiens
caggugguccugagacc

SEQ ID NO: 1503271 - RNA, 20 nt, Homo sapiens
cagguguuacuguaauuccu

SEQ ID NO: 1503272 - RNA, 14 nt, Homo sapiens
cagguuaaccugca

SEQ ID NO: 1503273 - RNA, 16 nt, Homo sapiens
cagguuaaugcugaaa

SEQ ID NO: 1503274 - RNA, 15 nt, Homo sapiens
cagguucuucagggc

SEQ ID NO: 1503275 - RNA, 21 nt, Homo sapiens
cagguucuucagggccagucc

SEQ ID NO: 1503276 - RNA, 21 nt, Homo sapiens
cagguuggaugggagugggca

SEQ ID NO: 1503277 - RNA, 20 nt, Homo sapiens
cagguuuucuguuucugugu

SEQ ID NO: 1503278 - RNA, 17 nt, Homo sapiens
caguaaaagaugaaguu

SEQ ID NO: 1503279 - RNA, 17 nt, Homo sapiens
caguaaacaacuuguac

SEQ ID NO: 1503280 - RNA, 21 nt, Homo sapiens
caguaaacuuuggcuuauaaa

SEQ ID NO: 1503281 - RNA, 22 nt, Homo sapiens
caguaaauaacaggcauuuguu

SEQ ID NO: 1503282 - RNA, 14 nt, Homo sapiens
caguaaauguacaa

SEQ ID NO: 1503283 - RNA, 19 nt, Homo sapiens
caguaaauguacaacugca

SEQ ID NO: 1503284 - RNA, 23 nt, Homo sapiens
caguaaauguacaacugcaccug

SEQ ID NO: 1503285 - RNA, 21 nt, Homo sapiens
caguaacaaauaaagugcagu

SEQ ID NO: 1503286 - RNA, 17 nt, Homo sapiens
caguaacugcaccaacg

SEQ ID NO: 1503287 - RNA, 20 nt, Homo sapiens
caguacagcaugugccuuaa

SEQ ID NO: 1503288 - RNA, 14 nt, Homo sapiens
caguagaacuccag

SEQ ID NO: 1503289 - RNA, 14 nt, Homo sapiens
caguagacugcagu

SEQ ID NO: 1503290 - RNA, 14 nt, Homo sapiens
caguagaugugcuu

SEQ ID NO: 1503291 - RNA, 20 nt, Homo sapiens
caguagggaggucagugcuu

SEQ ID NO: 1503292 - RNA, 14 nt, Homo sapiens
caguaugacauuuc

SEQ ID NO: 1503293 - RNA, 18 nt, Homo sapiens
caguauuagaugcacuua

SEQ ID NO: 1503294 - RNA, 13 nt, Homo sapiens
caguauucucaga

SEQ ID NO: 1503295 - RNA, 22 nt, Homo sapiens
caguauucucagagcauguguc

SEQ ID NO: 1503296 - RNA, 13 nt, Homo sapiens
cagucacagccac

SEQ ID NO: 1503297 - RNA, 20 nt, Homo sapiens
cagucagccaagaucuugcc

SEQ ID NO: 1503298 - RNA, 23 nt, Homo sapiens
cagucauagcaagcuuuugcuca

SEQ ID NO: 1503299 - RNA, 23 nt, Homo sapiens
cagucauucuaggauguggagcu

SEQ ID NO: 1503300 - RNA, 15 nt, Homo sapiens
cagucccaugaccuu

SEQ ID NO: 1503301 - RNA, 16 nt, Homo sapiens
cagucccccugugcau

SEQ ID NO: 1503302 - RNA, 23 nt, Homo sapiens
cagucccuuacacguaccucuca

SEQ ID NO: 1503303 - RNA, 14 nt, Homo sapiens
caguccuccagacc

SEQ ID NO: 1503304 - RNA, 19 nt, Homo sapiens
caguccugccucagccucc

SEQ ID NO: 1503305 - RNA, 19 nt, Homo sapiens
cagucgaugcguucacucc

SEQ ID NO: 1503306 - RNA, 14 nt, Homo sapiens
cagucugggcacuu

SEQ ID NO: 1503307 - RNA, 21 nt, Homo sapiens
cagucuuauuuccaaguaaga

SEQ ID NO: 1503308 - RNA, 14 nt, Homo sapiens
cagugaaaugugaa

SEQ ID NO: 1503309 - RNA, 21 nt, Homo sapiens
cagugaauuaaauuuucacua

SEQ ID NO: 1503310 - RNA, 16 nt, Homo sapiens
cagugacaaggcccug

SEQ ID NO: 1503311 - RNA, 15 nt, Homo sapiens
cagugagccauguuc

SEQ ID NO: 1503312 - RNA, 14 nt, Homo sapiens
cagugagcccagau

SEQ ID NO: 1503313 - RNA, 18 nt, Homo sapiens
cagugaggcugcacccac

SEQ ID NO: 1503314 - RNA, 17 nt, Homo sapiens
cagugagucucuucaga

SEQ ID NO: 1503315 - RNA, 16 nt, Homo sapiens
cagugauauggcagaa

SEQ ID NO: 1503316 - RNA, 11 nt, Homo sapiens
cagugaucuca

SEQ ID NO: 1503317 - RNA, 17 nt, Homo sapiens
cagugccagcaaugaca

SEQ ID NO: 1503318 - RNA, 15 nt, Homo sapiens
cagugccagcaccug

SEQ ID NO: 1503319 - RNA, 17 nt, Homo sapiens
cagugccagcaccugcc

SEQ ID NO: 1503320 - RNA, 18 nt, Homo sapiens
cagugccagcaccugccc

SEQ ID NO: 1503321 - RNA, 10 nt, Homo sapiens
cagugccauu

SEQ ID NO: 1503322 - RNA, 13 nt, Homo sapiens
cagugccuugcuc

SEQ ID NO: 1503323 - RNA, 14 nt, Homo sapiens
cagugccuugcucg

SEQ ID NO: 1503324 - RNA, 23 nt, Homo sapiens
cagugcgugcucccgaugcugcu

SEQ ID NO: 1503325 - RNA, 19 nt, Homo sapiens
caguggaagcaguuucaga

SEQ ID NO: 1503326 - RNA, 16 nt, Homo sapiens
caguggacucuuccac

SEQ ID NO: 1503327 - RNA, 22 nt, Homo sapiens
caguggaugccacagcccagcu

SEQ ID NO: 1503328 - RNA, 13 nt, Homo sapiens
caguggaugcugc

SEQ ID NO: 1503329 - RNA, 17 nt, Homo sapiens
caguggauugauuauaa

SEQ ID NO: 1503330 - RNA, 17 nt, Homo sapiens
caguggauugcauuucu

SEQ ID NO: 1503331 - RNA, 18 nt, Homo sapiens
caguggcagacaaacaga

SEQ ID NO: 1503332 - RNA, 20 nt, Homo sapiens
caguggcaugaucauagcuc

SEQ ID NO: 1503333 - RNA, 16 nt, Homo sapiens
caguggcgugaucucg

SEQ ID NO: 1503334 - RNA, 14 nt, Homo sapiens
caguggcuaccuac

SEQ ID NO: 1503335 - RNA, 16 nt, Homo sapiens
caguggcugugccacc

SEQ ID NO: 1503336 - RNA, 19 nt, Homo sapiens
caguggcuucaucugucaa

SEQ ID NO: 1503337 - RNA, 19 nt, Homo sapiens
cagugggcgggccaugagg

SEQ ID NO: 1503338 - RNA, 15 nt, Homo sapiens
cagugguccuuuuca

SEQ ID NO: 1503339 - RNA, 20 nt, Homo sapiens
caguggugaagaaaacuccu

SEQ ID NO: 1503340 - RNA, 16 nt, Homo sapiens
caguggugugaucucg

SEQ ID NO: 1503341 - RNA, 14 nt, Homo sapiens
caguguacccuccu

SEQ ID NO: 1503342 - RNA, 15 nt, Homo sapiens
caguguaggcauuua

SEQ ID NO: 1503343 - RNA, 11 nt, Homo sapiens
caguguugccc

SEQ ID NO: 1503344 - RNA, 17 nt, Homo sapiens
caguguugcucagcucc

SEQ ID NO: 1503345 - RNA, 11 nt, Homo sapiens
caguguuuaca

SEQ ID NO: 1503346 - RNA, 16 nt, Homo sapiens
caguguuugcaauggu

SEQ ID NO: 1503347 - RNA, 16 nt, Homo sapiens
caguuaacuauugcau

SEQ ID NO: 1503348 - RNA, 17 nt, Homo sapiens
caguuaaugccacaaaa

SEQ ID NO: 1503349 - RNA, 16 nt, Homo sapiens
caguuagguagcuuua

SEQ ID NO: 1503350 - RNA, 16 nt, Homo sapiens
caguuauuaaucugga

SEQ ID NO: 1503351 - RNA, 20 nt, Homo sapiens
caguucauuauuuugugguu

SEQ ID NO: 1503352 - RNA, 18 nt, Homo sapiens
caguucauugcacuuuga

SEQ ID NO: 1503353 - RNA, 14 nt, Homo sapiens
caguucauuguggg

SEQ ID NO: 1503354 - RNA, 19 nt, Homo sapiens
caguuccaggccugaucuu

SEQ ID NO: 1503355 - RNA, 13 nt, Homo sapiens
cagauuucaggaa

SEQ ID NO: 1503356 - RNA, 14 nt, Homo sapiens
cagcaaaagagcua

SEQ ID NO: 1503357 - RNA, 15 nt, Homo sapiens
cagcaacugucuuau

SEQ ID NO: 1503358 - RNA, 18 nt, Homo sapiens
cagcaaugacaucucagg

SEQ ID NO: 1503359 - RNA, 21 nt, Homo sapiens
cagcaaugacaucucaggggc

SEQ ID NO: 1503360 - RNA, 22 nt, Homo sapiens
cagcaauucuccugccucagcc

SEQ ID NO: 1503361 - RNA, 14 nt, Homo sapiens
cagcacaaggccau

SEQ ID NO: 1503362 - RNA, 11 nt, Homo sapiens
cagcacccucc

SEQ ID NO: 1503363 - RNA, 19 nt, Homo sapiens
cagcacucuuaucuacaua

SEQ ID NO: 1503364 - RNA, 12 nt, Homo sapiens
cagcacuuccau

SEQ ID NO: 1503365 - RNA, 21 nt, Homo sapiens
cagcagaagccuccaagcaca

SEQ ID NO: 1503366 - RNA, 23 nt, Homo sapiens
cagcagaggcggucuucaacauc

SEQ ID NO: 1503367 - RNA, 22 nt, Homo sapiens
cagcagccuccaacacaaggcu

SEQ ID NO: 1503368 - RNA, 20 nt, Homo sapiens
cagcagggggagaaacccuu

SEQ ID NO: 1503369 - RNA, 17 nt, Homo sapiens
cagcagugaucucaggg

SEQ ID NO: 1503370 - RNA, 14 nt, Homo sapiens
cagcaguguucuca

SEQ ID NO: 1503371 - RNA, 15 nt, Homo sapiens
cagcaguguugcuca

SEQ ID NO: 1503372 - RNA, 17 nt, Homo sapiens
cagcauacacagaugaa

SEQ ID NO: 1503373 - RNA, 15 nt, Homo sapiens
cagcaucugcuaaua

SEQ ID NO: 1503374 - RNA, 17 nt, Homo sapiens
cagcauuuucauaucca

SEQ ID NO: 1503375 - RNA, 21 nt, Homo sapiens
cagcauuuucauauccaagau

SEQ ID NO: 1503376 - RNA, 18 nt, Homo sapiens
cagccaaacccugucuga

SEQ ID NO: 1503377 - RNA, 16 nt, Homo sapiens
cagccaaaugcaggga

SEQ ID NO: 1503378 - RNA, 15 nt, Homo sapiens
cagccaacuuuugca

SEQ ID NO: 1503379 - RNA, 17 nt, Homo sapiens
cagccaagaucuugcca

SEQ ID NO: 1503380 - RNA, 14 nt, Homo sapiens
cagccaagugugac

SEQ ID NO: 1503381 - RNA, 22 nt, Homo sapiens
cagccacaaaguugagacuucu

SEQ ID NO: 1503382 - RNA, 16 nt, Homo sapiens
cagccacaaccaaaaa

SEQ ID NO: 1503383 - RNA, 20 nt, Homo sapiens
cagccacaucgccugagauu

SEQ ID NO: 1503384 - RNA, 12 nt, Homo sapiens
cagccaccagcg

SEQ ID NO: 1503385 - RNA, 16 nt, Homo sapiens
cagccacgaggugcaa

SEQ ID NO: 1503386 - RNA, 18 nt, Homo sapiens
cagccacgggggacugac

SEQ ID NO: 1503387 - RNA, 12 nt, Homo sapiens
cagccagcacuu

SEQ ID NO: 1503388 - RNA, 21 nt, Homo sapiens
cagccaggcagguccacagag

SEQ ID NO: 1503389 - RNA, 14 nt, Homo sapiens
cagccagugccauu

SEQ ID NO: 1503390 - RNA, 17 nt, Homo sapiens
cagccagugccauucca

SEQ ID NO: 1503391 - RNA, 16 nt, Homo sapiens
cagcccaaaacccagg

SEQ ID NO: 1503392 - RNA, 21 nt, Homo sapiens
cagccccaucccuguccucau

SEQ ID NO: 1503393 - RNA, 21 nt, Homo sapiens
cagccccucacauuccuaggg

SEQ ID NO: 1503394 - RNA, 18 nt, Homo sapiens
cagcccuagagccugccu

SEQ ID NO: 1503395 - RNA, 17 nt, Homo sapiens
cagcccuccucugucaa

SEQ ID NO: 1503396 - RNA, 16 nt, Homo sapiens
cagccgaaaagcuuuu

SEQ ID NO: 1503397 - RNA, 24 nt, Homo sapiens
cagccgggauuuugagaucaucag

SEQ ID NO: 1503398 - RNA, 21 nt, Homo sapiens
cagccguccuucuaaugaaga

SEQ ID NO: 1503399 - RNA, 14 nt, Homo sapiens
cagccucagaggag

SEQ ID NO: 1503400 - RNA, 19 nt, Homo sapiens
cagccucagaggagcucua

SEQ ID NO: 1503401 - RNA, 20 nt, Homo sapiens
cagccucccaaguagcugag

SEQ ID NO: 1503402 - RNA, 18 nt, Homo sapiens
cagccuccccgugccaaa

SEQ ID NO: 1503403 - RNA, 18 nt, Homo sapiens
cagccucccugaagccuu

SEQ ID NO: 1503404 - RNA, 15 nt, Homo sapiens
cagccucccuuugau

SEQ ID NO: 1503405 - RNA, 22 nt, Homo sapiens
cagccuccuuauauuuggccca

SEQ ID NO: 1503406 - RNA, 19 nt, Homo sapiens
cagccucucgaagugcuga

SEQ ID NO: 1503407 - RNA, 12 nt, Homo sapiens
cagccucuggac

SEQ ID NO: 1503408 - RNA, 17 nt, Homo sapiens
cagccugcucuaguggg

SEQ ID NO: 1503409 - RNA, 21 nt, Homo sapiens
cagccuggccaacauggugaa

SEQ ID NO: 1503410 - RNA, 18 nt, Homo sapiens
cagccuggccaucuggau

SEQ ID NO: 1503411 - RNA, 19 nt, Homo sapiens
cagccuggggaacagagca

SEQ ID NO: 1503412 - RNA, 21 nt, Homo sapiens
cagccuggucaacauggugaa

SEQ ID NO: 1503413 - RNA, 16 nt, Homo sapiens
cagccuuaugauuaaa

SEQ ID NO: 1503414 - RNA, 14 nt, Homo sapiens
cagccuugccagag

SEQ ID NO: 1503415 - RNA, 14 nt, Homo sapiens
cagccuuggugcca

SEQ ID NO: 1503416 - RNA, 23 nt, Homo sapiens
cagcgagaggcagagaaagaaga

SEQ ID NO: 1503417 - RNA, 13 nt, Homo sapiens
cagcgcaccuguu

SEQ ID NO: 1503418 - RNA, 15 nt, Homo sapiens
cagcgcuucuaugca

SEQ ID NO: 1503419 - RNA, 15 nt, Homo sapiens
cagcggaggagacca

SEQ ID NO: 1503420 - RNA, 15 nt, Homo sapiens
cagcgggcacagggc

SEQ ID NO: 1503421 - RNA, 15 nt, Homo sapiens
cagcgucccagucuc

SEQ ID NO: 1503422 - RNA, 13 nt, Homo sapiens
cagcuaaauuuuc

SEQ ID NO: 1503423 - RNA, 19 nt, Homo sapiens
cagcuaaggacauuuccca

SEQ ID NO: 1503424 - RNA, 22 nt, Homo sapiens
cagcuacacaaggaaggcauuu

SEQ ID NO: 1503425 - RNA, 14 nt, Homo sapiens
cagcuaucagcucu

SEQ ID NO: 1503426 - RNA, 18 nt, Homo sapiens
cagcuaucugcacucuaa

SEQ ID NO: 1503427 - RNA, 18 nt, Homo sapiens
cagcuccaaccugcaaag

SEQ ID NO: 1503428 - RNA, 17 nt, Homo sapiens
cagcucccauuucauca

SEQ ID NO: 1503429 - RNA, 14 nt, Homo sapiens
cagcuccuguaaca

SEQ ID NO: 1503430 - RNA, 21 nt, Homo sapiens
cagcuccuguaacauacuggc

SEQ ID NO: 1503431 - RNA, 14 nt, Homo sapiens
cagcucguucucug

SEQ ID NO: 1503432 - RNA, 21 nt, Homo sapiens
cagcucugcauuaucugaggu

SEQ ID NO: 1503433 - RNA, 17 nt, Homo sapiens
cagcucugggagaggau

SEQ ID NO: 1503434 - RNA, 16 nt, Homo sapiens
cagcugaacagccaaa

SEQ ID NO: 1503435 - RNA, 21 nt, Homo sapiens
cagcugagccuucugagcugg

SEQ ID NO: 1503436 - RNA, 15 nt, Homo sapiens
cagcugaguuaugau

SEQ ID NO: 1503437 - RNA, 19 nt, Homo sapiens
cagcugccaucgaccugga

SEQ ID NO: 1503438 - RNA, 19 nt, Homo sapiens
cagcugccuuggacugugu

SEQ ID NO: 1503439 - RNA, 21 nt, Homo sapiens
cagcugcucccuggcauucaa

SEQ ID NO: 1503440 - RNA, 21 nt, Homo sapiens
cagcugcugggucaggccacc

SEQ ID NO: 1503441 - RNA, 21 nt, Homo sapiens
cagcuggaucugcuuguugca

SEQ ID NO: 1503442 - RNA, 22 nt, Homo sapiens
cagcugggagacacagcaagac

SEQ ID NO: 1503443 - RNA, 18 nt, Homo sapiens
cagcugggcucugcaauu

SEQ ID NO: 1503444 - RNA, 22 nt, Homo sapiens
cagcuguaagaagagacuggga

SEQ ID NO: 1503445 - RNA, 16 nt, Homo sapiens
cagcugucuguggcuu

SEQ ID NO: 1503446 - RNA, 19 nt, Homo sapiens
cagcugugauacuuguaga

SEQ ID NO: 1503447 - RNA, 15 nt, Homo sapiens
cagcugugcacuuuc

SEQ ID NO: 1503448 - RNA, 14 nt, Homo sapiens
cagcuuccaaacau

SEQ ID NO: 1503449 - RNA, 15 nt, Homo sapiens
cagcuuccugaagca

SEQ ID NO: 1503450 - RNA, 19 nt, Homo sapiens
cagcuucucucuccagggu

SEQ ID NO: 1503451 - RNA, 16 nt, Homo sapiens
cagcuuggcccuuucc

SEQ ID NO: 1503452 - RNA, 22 nt, Homo sapiens
cagcuuguucugggcucaggga

SEQ ID NO: 1503453 - RNA, 13 nt, Homo sapiens
cagcuuucuugcu

SEQ ID NO: 1503454 - RNA, 21 nt, Homo sapiens
cagcuuuucccaagaugucaa

SEQ ID NO: 1503455 - RNA, 23 nt, Homo sapiens
caggaaaaaaaaaaaucuaucca

SEQ ID NO: 1503456 - RNA, 14 nt, Homo sapiens
ccuucacuuuacaa

SEQ ID NO: 1503457 - RNA, 12 nt, Homo sapiens
ccuucaucugaa

SEQ ID NO: 1503458 - RNA, 21 nt, Homo sapiens
ccuuccauagccuaaucccug

SEQ ID NO: 1503459 - RNA, 16 nt, Homo sapiens
ccuuccaugugccuuu

SEQ ID NO: 1503460 - RNA, 17 nt, Homo sapiens
ccuuccuaaacccaaug

SEQ ID NO: 1503461 - RNA, 16 nt, Homo sapiens
ccuuccuaagacuucu

SEQ ID NO: 1503462 - RNA, 17 nt, Homo sapiens
ccuuccucacuuccaua

SEQ ID NO: 1503463 - RNA, 17 nt, Homo sapiens
ccuucguuaacugugua

SEQ ID NO: 1503464 - RNA, 19 nt, Homo sapiens
ccuucuacauuugagggcc

SEQ ID NO: 1503465 - RNA, 16 nt, Homo sapiens
ccuucucaagacuuua

SEQ ID NO: 1503466 - RNA, 16 nt, Homo sapiens
ccuucuccaccaaaga

SEQ ID NO: 1503467 - RNA, 18 nt, Homo sapiens
ccuucucuucucuuugcu

SEQ ID NO: 1503468 - RNA, 23 nt, Homo sapiens
ccuucugcucagcucugggccau

SEQ ID NO: 1503469 - RNA, 14 nt, Homo sapiens
ccuucuguggcuca

SEQ ID NO: 1503470 - RNA, 22 nt, Homo sapiens
ccuucuuuugaaggacuccuua

SEQ ID NO: 1503471 - RNA, 13 nt, Homo sapiens
ccuugaaccaaua

SEQ ID NO: 1503472 - RNA, 16 nt, Homo sapiens
ccuugaguguguuacc

SEQ ID NO: 1503473 - RNA, 21 nt, Homo sapiens
ccuugcugcugcugcacccaa

SEQ ID NO: 1503474 - RNA, 13 nt, Homo sapiens
ccuuggcugugag

SEQ ID NO: 1503475 - RNA, 19 nt, Homo sapiens
uggcuucuagaucuggaac

SEQ ID NO: 1503476 - RNA, 20 nt, Homo sapiens
uggcuucugcuucaaacccu

SEQ ID NO: 1503477 - RNA, 15 nt, Homo sapiens
ugggagagagugcau

SEQ ID NO: 1503478 - RNA, 14 nt, Homo sapiens
ugggagaucagcca

SEQ ID NO: 1503479 - RNA, 19 nt, Homo sapiens
ugggcaguugggagugagu

SEQ ID NO: 1503480 - RNA, 16 nt, Homo sapiens
ugggccacuguagggg

SEQ ID NO: 1503481 - RNA, 17 nt, Homo sapiens
ugggccacuguaggggu

SEQ ID NO: 1503482 - RNA, 21 nt, Homo sapiens
ugggccagcugucgcaucuca

SEQ ID NO: 1503483 - RNA, 20 nt, Homo sapiens
uggggaguuauaaaaauaca

SEQ ID NO: 1503484 - RNA, 15 nt, Homo sapiens
ugggggagaagcaag

SEQ ID NO: 1503485 - RNA, 18 nt, Homo sapiens
ugggucuuuguacauuuu

SEQ ID NO: 1503486 - RNA, 18 nt, Homo sapiens
ugguaaacauucucucag

SEQ ID NO: 1503487 - RNA, 18 nt, Homo sapiens
ugauacauuagcagcuau

SEQ ID NO: 1503488 - RNA, 14 nt, Homo sapiens
ugauagaaaugcca

SEQ ID NO: 1503489 - RNA, 14 nt, Homo sapiens
ugauauaugccuau

SEQ ID NO: 1503490 - RNA, 17 nt, Homo sapiens
ugaucaauccuucuuau

SEQ ID NO: 1503491 - RNA, 17 nt, Homo sapiens
ugaucauuacauggcug

SEQ ID NO: 1503492 - RNA, 17 nt, Homo sapiens
ugaucauuuuagacacu

SEQ ID NO: 1503493 - RNA, 22 nt, Homo sapiens
ugauccacaaaaacaacuuauu

SEQ ID NO: 1503494 - RNA, 14 nt, Homo sapiens
ugaucuaauuuaca

SEQ ID NO: 1503495 - RNA, 14 nt, Homo sapiens
ugaugguugcaaaa

SEQ ID NO: 1503496 - RNA, 17 nt, Homo sapiens
ugauuaaacagacuuua

SEQ ID NO: 1503497 - RNA, 13 nt, Homo sapiens
ugauuaacaaaua

SEQ ID NO: 1503498 - RNA, 18 nt, Homo sapiens
ugauucagacagcuuaug

SEQ ID NO: 1503499 - RNA, 19 nt, Homo sapiens
ugauuccauuuuacuucca

SEQ ID NO: 1503500 - RNA, 22 nt, Homo sapiens
ugauuccauuuuacuuccauga

SEQ ID NO: 1503501 - RNA, 22 nt, Homo sapiens
ugauuuagggaagcagggacac

SEQ ID NO: 1503502 - RNA, 20 nt, Homo sapiens
ugauuucacucagggugaua

SEQ ID NO: 1503503 - RNA, 13 nt, Homo sapiens
ugauuucaggaua

SEQ ID NO: 1503504 - RNA, 17 nt, Homo sapiens
ccucacugaaugccuca

SEQ ID NO: 1503505 - RNA, 17 nt, Homo sapiens
ccuccagagacaggaaa

SEQ ID NO: 1503506 - RNA, 23 nt, Homo sapiens
ccuccagcacucccucccagaga

SEQ ID NO: 1503507 - RNA, 22 nt, Homo sapiens
ccucccagcguguguauccgac

SEQ ID NO: 1503508 - RNA, 16 nt, Homo sapiens
ccuccugccuccagca

SEQ ID NO: 1503509 - RNA, 15 nt, Homo sapiens
ccuccuuuugcuuga

SEQ ID NO: 1503510 - RNA, 13 nt, Homo sapiens
ccucguaccagcc

SEQ ID NO: 1503511 - RNA, 23 nt, Homo sapiens
ccucuaacauuugcaaaauggaa

SEQ ID NO: 1503512 - RNA, 13 nt, Homo sapiens
ccucuaagccacu

SEQ ID NO: 1503513 - RNA, 17 nt, Homo sapiens
ccucucugcuccagaga

SEQ ID NO: 1503514 - RNA, 22 nt, Homo sapiens
ccucugcaaaaagauuuaacaa

SEQ ID NO: 1503515 - RNA, 17 nt, Homo sapiens
ccucuuaccuauguccc

SEQ ID NO: 1503516 - RNA, 14 nt, Homo sapiens
ccucuuaucacugg

SEQ ID NO: 1503517 - RNA, 13 nt, Homo sapiens
ccucuuuccccac

SEQ ID NO: 1503518 - RNA, 17 nt, Homo sapiens
ccucuuuccccaccucu

SEQ ID NO: 1503519 - RNA, 21 nt, Homo sapiens
ccugaaaaaaugauacgcugg

SEQ ID NO: 1503520 - RNA, 16 nt, Homo sapiens
ccugacuuugugaucc

SEQ ID NO: 1503521 - RNA, 20 nt, Homo sapiens
ccugcaaagcuaaaauugaa

SEQ ID NO: 1503522 - RNA, 13 nt, Homo sapiens
ccugcacuacucu

SEQ ID NO: 1503523 - RNA, 18 nt, Homo sapiens
ccugcacuccagaaucca

SEQ ID NO: 1503524 - RNA, 19 nt, Homo sapiens
ccugcacucuuauuucacu

SEQ ID NO: 1503525 - RNA, 19 nt, Homo sapiens
ccugcaggccaagagcaga

SEQ ID NO: 1503526 - RNA, 23 nt, Homo sapiens
ccugcagucagggcccagaguug

SEQ ID NO: 1503527 - RNA, 13 nt, Homo sapiens
ccugcggaugcau

SEQ ID NO: 1503528 - RNA, 21 nt, Homo sapiens
ccugcugcuguguuuuugcua

SEQ ID NO: 1503529 - RNA, 10 nt, Homo sapiens
ccugcuggaa

SEQ ID NO: 1503530 - RNA, 20 nt, Homo sapiens
ccuggaaucaagaugucaga

SEQ ID NO: 1503531 - RNA, 23 nt, Homo sapiens
ccuggaccgcuucccagaggcca

SEQ ID NO: 1503532 - RNA, 23 nt, Homo sapiens
ccuggaucaggguuguucuggga

SEQ ID NO: 1503533 - RNA, 20 nt, Homo sapiens
ccugggggcugcugcacugc

SEQ ID NO: 1503534 - RNA, 17 nt, Homo sapiens
ccugguccugcacuguc

SEQ ID NO: 1503535 - RNA, 22 nt, Homo sapiens
ccugguugagcuucugcuaaaa

SEQ ID NO: 1503536 - RNA, 13 nt, Homo sapiens
ccugugacuaugg

SEQ ID NO: 1503537 - RNA, 14 nt, Homo sapiens
ccugugcuaaagaa

SEQ ID NO: 1503538 - RNA, 12 nt, Homo sapiens
ccugugcugacg

SEQ ID NO: 1503539 - RNA, 21 nt, Homo sapiens
ccuuaagccaauauuuacuca

SEQ ID NO: 1503540 - RNA, 22 nt, Homo sapiens
ccuuacagaacacgcuuucaca

SEQ ID NO: 1503541 - RNA, 17 nt, Homo sapiens
ccuuaggaacagcucuu

SEQ ID NO: 1503542 - RNA, 15 nt, Homo sapiens
ccuucaagugccaaa

SEQ ID NO: 1503543 - RNA, 12 nt, Homo sapiens
ccuucagugaca

SEQ ID NO: 1503544 - RNA, 12 nt, Homo sapiens
ccuucaugcccu

SEQ ID NO: 1503545 - RNA, 15 nt, Homo sapiens
ccuucuccaucuuug

SEQ ID NO: 1503546 - RNA, 19 nt, Homo sapiens
ccuucugguacaauccuuu

SEQ ID NO: 1503547 - RNA, 13 nt, Homo sapiens
ccuugaagccacu

SEQ ID NO: 1503548 - RNA, 13 nt, Homo sapiens
ccuugagcacuca

SEQ ID NO: 1503549 - RNA, 11 nt, Homo sapiens
ccuugcucugc

SEQ ID NO: 1503550 - RNA, 12 nt, Homo sapiens
ccuugcucugca

SEQ ID NO: 1503551 - RNA, 18 nt, Homo sapiens
ccuuggaaaguucagcca

SEQ ID NO: 1503552 - RNA, 13 nt, Homo sapiens
ccuuggagccuga

SEQ ID NO: 1503553 - RNA, 16 nt, Homo sapiens
ccuuggcagcccugau

SEQ ID NO: 1503554 - RNA, 14 nt, Homo sapiens
ccuuggugugaccc

SEQ ID NO: 1503555 - RNA, 11 nt, Homo sapiens
ccuugugauug

SEQ ID NO: 1503556 - RNA, 13 nt, Homo sapiens
ccuuuaccuacca

SEQ ID NO: 1503557 - RNA, 19 nt, Homo sapiens
ccuuuaccuaccaccuucc

SEQ ID NO: 1503558 - RNA, 18 nt, Homo sapiens
ccuuucccccaccccaga

SEQ ID NO: 1503559 - RNA, 15 nt, Homo sapiens
ccuuugcaaugcaag

SEQ ID NO: 1503560 - RNA, 20 nt, Homo sapiens
ccuuuguguaaagaagggaa

SEQ ID NO: 1503561 - RNA, 15 nt, Homo sapiens
ccuuuuaucccucac

SEQ ID NO: 1503562 - RNA, 16 nt, Homo sapiens
ccaaggaaacuugaau

SEQ ID NO: 1503563 - RNA, 13 nt, Homo sapiens
ccaaggaguggaa

SEQ ID NO: 1503564 - RNA, 14 nt, Homo sapiens
ccaagucuacuuca

SEQ ID NO: 1503565 - RNA, 17 nt, Homo sapiens
ccaagucuagcuuuccu

SEQ ID NO: 1503566 - RNA, 16 nt, Homo sapiens
ccaagucucagaagag

SEQ ID NO: 1503567 - RNA, 17 nt, Homo sapiens
ccaauaggcauuugauu

SEQ ID NO: 1503568 - RNA, 22 nt, Homo sapiens
ccaaucugagcaaacaccagug

SEQ ID NO: 1503569 - RNA, 22 nt, Homo sapiens
ccacaaacuguaauacaaugau

SEQ ID NO: 1503570 - RNA, 17 nt, Homo sapiens
ccacaagcaauggaccu

SEQ ID NO: 1503571 - RNA, 13 nt, Homo sapiens
ccacaagccauuu

SEQ ID NO: 1503572 - RNA, 17 nt, Homo sapiens
ccacaauggagugggag

SEQ ID NO: 1503573 - RNA, 20 nt, Homo sapiens
ccacagcagcugaacagcca

SEQ ID NO: 1503574 - RNA, 18 nt, Homo sapiens
ccacagccuuugcuucca

SEQ ID NO: 1503575 - RNA, 18 nt, Homo sapiens
ccaccaagggaucugcca

SEQ ID NO: 1503576 - RNA, 15 nt, Homo sapiens
ccacccaccuuugcc

SEQ ID NO: 1503577 - RNA, 20 nt, Homo sapiens
ccaccuuugggaucagccuc

SEQ ID NO: 1503578 - RNA, 15 nt, Homo sapiens
ccacuccaccuccac

SEQ ID NO: 1503579 - RNA, 20 nt, Homo sapiens
ccacugccccugcaccugcu

SEQ ID NO: 1503580 - RNA, 14 nt, Homo sapiens
ccacuggacuugag

SEQ ID NO: 1503581 - RNA, 12 nt, Homo sapiens
ccagaaccacag

SEQ ID NO: 1503582 - RNA, 16 nt, Homo sapiens
ccagaaggauauuuac

SEQ ID NO: 1503583 - RNA, 19 nt, Homo sapiens
ccagaaguccuaucgacuu

SEQ ID NO: 1503584 - RNA, 21 nt, Homo sapiens
ccagaauaaaacgcaaagggc

SEQ ID NO: 1503585 - RNA, 19 nt, Homo sapiens
ccagacccaccacaccgca

SEQ ID NO: 1503586 - RNA, 20 nt, Homo sapiens
ccagagcacugcuccagugg

SEQ ID NO: 1503587 - RNA, 13 nt, Homo sapiens
ccagauaguuaua

SEQ ID NO: 1503588 - RNA, 13 nt, Homo sapiens
ccagcaacacaga

SEQ ID NO: 1503589 - RNA, 14 nt, Homo sapiens
ccagcaguacucag

SEQ ID NO: 1503590 - RNA, 16 nt, Homo sapiens
ccagcaguuguaaaau

SEQ ID NO: 1503591 - RNA, 21 nt, Homo sapiens
ccagcauugcaguauggugug

SEQ ID NO: 1503592 - RNA, 14 nt, Homo sapiens
ccagccaggaacug

SEQ ID NO: 1503593 - RNA, 18 nt, Homo sapiens
ccagccucuuaucacugg

SEQ ID NO: 1503594 - RNA, 15 nt, Homo sapiens
ccagccuggccaaca

SEQ ID NO: 1503595 - RNA, 13 nt, Homo sapiens
ccagcuacccagg

SEQ ID NO: 1503596 - RNA, 18 nt, Homo sapiens
ccagcugcaccugccagc

SEQ ID NO: 1503597 - RNA, 16 nt, Homo sapiens
ccagcuuuuucucuca

SEQ ID NO: 1503598 - RNA, 22 nt, Homo sapiens
ccaggauugcacugacauggcg

SEQ ID NO: 1503599 - RNA, 11 nt, Homo sapiens
ccaggauuuug

SEQ ID NO: 1503600 - RNA, 22 nt, Homo sapiens
ccaggcagagaucaggugggca

SEQ ID NO: 1503601 - RNA, 15 nt, Homo sapiens
ccaggccaaugcagc

SEQ ID NO: 1503602 - RNA, 12 nt, Homo sapiens
ccaggccagugg

SEQ ID NO: 1503603 - RNA, 17 nt, Homo sapiens
ccaggccagugggccug

SEQ ID NO: 1503604 - RNA, 20 nt, Homo sapiens
ccaggcgggcggcacgccaa

SEQ ID NO: 1503605 - RNA, 21 nt, Homo sapiens
ccagguccggagggguugcgg

SEQ ID NO: 1503606 - RNA, 16 nt, Homo sapiens
ccagucuggaagaaga

SEQ ID NO: 1503607 - RNA, 11 nt, Homo sapiens
ccagugacacc

SEQ ID NO: 1503608 - RNA, 22 nt, Homo sapiens
ccagugauccucaaacacacaa

SEQ ID NO: 1503609 - RNA, 21 nt, Homo sapiens
ccauaauugcuuugccaaaau

SEQ ID NO: 1503610 - RNA, 12 nt, Homo sapiens
ccauauucacac

SEQ ID NO: 1503611 - RNA, 15 nt, Homo sapiens
ccauauucacaccuc

SEQ ID NO: 1503612 - RNA, 15 nt, Homo sapiens
ccaucacacaugcau

SEQ ID NO: 1503613 - RNA, 17 nt, Homo sapiens
ccaucccucuacuuucc

SEQ ID NO: 1503614 - RNA, 10 nt, Homo sapiens
ccaucucagg

SEQ ID NO: 1503615 - RNA, 14 nt, Homo sapiens
gaaagaaaaugucu

SEQ ID NO: 1503616 - RNA, 15 nt, Homo sapiens
gaaagaaacacucaa

SEQ ID NO: 1503617 - RNA, 18 nt, Homo sapiens
gaaagaaagcaccuguuu

SEQ ID NO: 1503618 - RNA, 18 nt, Homo sapiens
gaaagaauuugccuucuc

SEQ ID NO: 1503619 - RNA, 17 nt, Homo sapiens
gaaagacaucacauccc

SEQ ID NO: 1503620 - RNA, 19 nt, Homo sapiens
gaaagcaaaagcaagggac

SEQ ID NO: 1503621 - RNA, 15 nt, Homo sapiens
gaaagcaacaaagau

SEQ ID NO: 1503622 - RNA, 18 nt, Homo sapiens
gaaagcaucaccucaggc

SEQ ID NO: 1503623 - RNA, 15 nt, Homo sapiens
gaaagccucuggaaa

SEQ ID NO: 1503624 - RNA, 20 nt, Homo sapiens
gaaagcuuaggcugcuuauu

SEQ ID NO: 1503625 - RNA, 13 nt, Homo sapiens
gaaagggaagccu

SEQ ID NO: 1503626 - RNA, 16 nt, Homo sapiens
gaaauaaaugauguac

SEQ ID NO: 1503627 - RNA, 18 nt, Homo sapiens
gaaauaagcccaacagac

SEQ ID NO: 1503628 - RNA, 16 nt, Homo sapiens
gaaauagacaguauau

SEQ ID NO: 1503629 - RNA, 12 nt, Homo sapiens
gaaaucugccaa

SEQ ID NO: 1503630 - RNA, 13 nt, Homo sapiens
gaaaucugccaau

SEQ ID NO: 1503631 - RNA, 18 nt, Homo sapiens
gaaaugagaaacuuugau

SEQ ID NO: 1503632 - RNA, 14 nt, Homo sapiens
gaacaagcaacaua

SEQ ID NO: 1503633 - RNA, 14 nt, Homo sapiens
gaacaaugcuauaa

SEQ ID NO: 1503634 - RNA, 19 nt, Homo sapiens
gaacaauggagauaucagu

SEQ ID NO: 1503635 - RNA, 20 nt, Homo sapiens
gaacaauuaaacagccaaau

SEQ ID NO: 1503636 - RNA, 16 nt, Homo sapiens
gaacaauucucucuua

SEQ ID NO: 1503637 - RNA, 14 nt, Homo sapiens
gaacacgcuuucac

SEQ ID NO: 1503638 - RNA, 16 nt, Homo sapiens
gaacauugccuuccuc

SEQ ID NO: 1503639 - RNA, 14 nt, Homo sapiens
gaaccaauaaugua

SEQ ID NO: 1503640 - RNA, 21 nt, Homo sapiens
gaacccauuuugagugacucg

SEQ ID NO: 1503641 - RNA, 22 nt, Homo sapiens
gaaccccuggccucaagcaauc

SEQ ID NO: 1503642 - RNA, 14 nt, Homo sapiens
gaacguugccacac

SEQ ID NO: 1503643 - RNA, 18 nt, Homo sapiens
gaacuauuuauuucaccc

SEQ ID NO: 1503644 - RNA, 19 nt, Homo sapiens
gaacucuucacucuucaaa

SEQ ID NO: 1503645 - RNA, 16 nt, Homo sapiens
gaacugaagaccucca

SEQ ID NO: 1503646 - RNA, 20 nt, Homo sapiens
gaacugccccaucuccuccc

SEQ ID NO: 1503647 - RNA, 22 nt, Homo sapiens
gaacugguucaagagacacugc

SEQ ID NO: 1503648 - RNA, 17 nt, Homo sapiens
gaacuucaaguucucuu

SEQ ID NO: 1503649 - RNA, 13 nt, Homo sapiens
gaagaaagcaaca

SEQ ID NO: 1503650 - RNA, 16 nt, Homo sapiens
gaagaaagcaacaaag

SEQ ID NO: 1503651 - RNA, 21 nt, Homo sapiens
gaagaaguuuaaaaaaccaug

SEQ ID NO: 1503652 - RNA, 12 nt, Homo sapiens
gaagacacugca

SEQ ID NO: 1503653 - RNA, 15 nt, Homo sapiens
gaagacacugcaaag

SEQ ID NO: 1503654 - RNA, 12 nt, Homo sapiens
gaagaccaaaaa

SEQ ID NO: 1503655 - RNA, 23 nt, Homo sapiens
gaagaccuccacauuaaguggcu

SEQ ID NO: 1503656 - RNA, 14 nt, Homo sapiens
gaagagaagggaag

SEQ ID NO: 1503657 - RNA, 21 nt, Homo sapiens
gaagagguaauuuuucaccuu

SEQ ID NO: 1503658 - RNA, 19 nt, Homo sapiens
gaagagguugggcuuccau

SEQ ID NO: 1503659 - RNA, 14 nt, Homo sapiens
gaagauguugucau

SEQ ID NO: 1503660 - RNA, 15 nt, Homo sapiens
gaagcacacugcagg

SEQ ID NO: 1503661 - RNA, 23 nt, Homo sapiens
gaagcacuccucgguacucccau

SEQ ID NO: 1503662 - RNA, 20 nt, Homo sapiens
gaagccacugaagcugggau

SEQ ID NO: 1503663 - RNA, 17 nt, Homo sapiens
gaagccaggacugugau

SEQ ID NO: 1503664 - RNA, 19 nt, Homo sapiens
gaagccauauucacaccuc

SEQ ID NO: 1503665 - RNA, 17 nt, Homo sapiens
gaagcucacccaauaaa

SEQ ID NO: 1503666 - RNA, 17 nt, Homo sapiens
gaagcuucuugcugcca

SEQ ID NO: 1503667 - RNA, 20 nt, Homo sapiens
gaagcuuuggugagaaccug

SEQ ID NO: 1503668 - RNA, 14 nt, Homo sapiens
gaaggaaauaucau

SEQ ID NO: 1503669 - RNA, 19 nt, Homo sapiens
gaaggcuccaucuccagug

SEQ ID NO: 1503670 - RNA, 17 nt, Homo sapiens
gaagguuagagguuugu

SEQ ID NO: 1503671 - RNA, 21 nt, Homo sapiens
gaagguuagagguuugucaac

SEQ ID NO: 1503672 - RNA, 19 nt, Homo sapiens
gaagguuagguuugucaac

SEQ ID NO: 1503673 - RNA, 14 nt, Homo sapiens
gaaguaaaagcaaa

SEQ ID NO: 1503674 - RNA, 16 nt, Homo sapiens
gaaguaaaagcuaauu

SEQ ID NO: 1503675 - RNA, 16 nt, Homo sapiens
gaaguuauucuugaca

SEQ ID NO: 1503676 - RNA, 19 nt, Homo sapiens
gaaguuucuggugccauuu

SEQ ID NO: 1503677 - RNA, 18 nt, Homo sapiens
gaauaaaauuguaaaauu

SEQ ID NO: 1503678 - RNA, 16 nt, Homo sapiens
gaauaaagcccuugaa

SEQ ID NO: 1503679 - RNA, 19 nt, Homo sapiens
gaauaaagcccuugaacca

SEQ ID NO: 1503680 - RNA, 17 nt, Homo sapiens
gaauagccauguacuau

SEQ ID NO: 1503681 - RNA, 18 nt, Homo sapiens
gaauagcgaaucaucuca

SEQ ID NO: 1503682 - RNA, 22 nt, Homo sapiens
gaauaggaaaauguacauacua

SEQ ID NO: 1503683 - RNA, 13 nt, Homo sapiens
gaauaggcauuug

SEQ ID NO: 1503684 - RNA, 22 nt, Homo sapiens
gaauaugacucaggagccuccu

SEQ ID NO: 1503685 - RNA, 19 nt, Homo sapiens
gaauauuuuagaaccacaa

SEQ ID NO: 1503686 - RNA, 17 nt, Homo sapiens
gaaucgcuuaaaccugg

SEQ ID NO: 1503687 - RNA, 17 nt, Homo sapiens
gaaugacucugacuuug

SEQ ID NO: 1503688 - RNA, 13 nt, Homo sapiens
gaaugaguaggaa

SEQ ID NO: 1503689 - RNA, 14 nt, Homo sapiens
gaauggaaccaaaa

SEQ ID NO: 1503690 - RNA, 18 nt, Homo sapiens
gaauggaaggcuuugcca

SEQ ID NO: 1503691 - RNA, 17 nt, Homo sapiens
gaaugggccacuguagg

SEQ ID NO: 1503692 - RNA, 23 nt, Homo sapiens
gaaugucaugcaccgcugcagcc

SEQ ID NO: 1503693 - RNA, 13 nt, Homo sapiens
gaauuauuuugca

SEQ ID NO: 1503694 - RNA, 17 nt, Homo sapiens
gaauuccaacucacuuu

SEQ ID NO: 1503695 - RNA, 17 nt, Homo sapiens
gaauucuuuacaauaaa

SEQ ID NO: 1503696 - RNA, 21 nt, Homo sapiens
gacaaagccaaacucugccag

SEQ ID NO: 1503697 - RNA, 19 nt, Homo sapiens
gacaaaguugaauguaaag

SEQ ID NO: 1503698 - RNA, 22 nt, Homo sapiens
gacaaauggacuauacauacua

SEQ ID NO: 1503699 - RNA, 14 nt, Homo sapiens
gacaacauguggaa

SEQ ID NO: 1503700 - RNA, 21 nt, Homo sapiens
gacaacauugcauugugacua

SEQ ID NO: 1503701 - RNA, 22 nt, Homo sapiens
gacaauccugaagaaaccacag

SEQ ID NO: 1503702 - RNA, 23 nt, Homo sapiens
gacaaugaaaguuugcacuguau

SEQ ID NO: 1503703 - RNA, 15 nt, Homo sapiens
gacacacaucaaaaa

SEQ ID NO: 1503704 - RNA, 20 nt, Homo sapiens
gacaccugggagaaaucugg

SEQ ID NO: 1503705 - RNA, 20 nt, Homo sapiens
gacacucuagugacuuccug

SEQ ID NO: 1503706 - RNA, 10 nt, Homo sapiens
gacacugucu

SEQ ID NO: 1503707 - RNA, 23 nt, Homo sapiens
gacagacauuuucaauaauguga

SEQ ID NO: 1503708 - RNA, 13 nt, Homo sapiens
gacaggguuucac

SEQ ID NO: 1503709 - RNA, 15 nt, Homo sapiens
gacagguaaguggca

SEQ ID NO: 1503710 - RNA, 20 nt, Homo sapiens
gacauaaagccucugacuca

SEQ ID NO: 1503711 - RNA, 17 nt, Homo sapiens
gacauauaccuucucaa

SEQ ID NO: 1503712 - RNA, 18 nt, Homo sapiens
gacaugcuucagugcugc

SEQ ID NO: 1503713 - RNA, 22 nt, Homo sapiens
gacauggaagguuagguuuguc

SEQ ID NO: 1503714 - RNA, 13 nt, Homo sapiens
gacaugucucaca

SEQ ID NO: 1503715 - RNA, 19 nt, Homo sapiens
gacauugcuucugcuaaau

SEQ ID NO: 1503716 - RNA, 15 nt, Homo sapiens
gaccaauaggugcaa

SEQ ID NO: 1503717 - RNA, 16 nt, Homo sapiens
gaccaauaggugcaaa

SEQ ID NO: 1503718 - RNA, 13 nt, Homo sapiens
gaccacaacuauu

SEQ ID NO: 1503719 - RNA, 20 nt, Homo sapiens
gaccaggauugcacugacau

SEQ ID NO: 1503720 - RNA, 21 nt, Homo sapiens
gacccagcuccucugagccau

SEQ ID NO: 1503721 - RNA, 12 nt, Homo sapiens
gaccccaaagag

SEQ ID NO: 1503722 - RNA, 12 nt, Homo sapiens
gaccccaucuca

SEQ ID NO: 1503723 - RNA, 22 nt, Homo sapiens
gaccccuuucccccaccccaga

SEQ ID NO: 1503724 - RNA, 21 nt, Homo sapiens
gacccuccuccacuccaccuc

SEQ ID NO: 1503725 - RNA, 21 nt, Homo sapiens
gaccgauagcaggugaacucg

SEQ ID NO: 1503726 - RNA, 21 nt, Homo sapiens
gaccgcuucccagaggccagg

SEQ ID NO: 1503727 - RNA, 19 nt, Homo sapiens
gaccgugaccagugcugcu

SEQ ID NO: 1503728 - RNA, 20 nt, Homo sapiens
gaccugaaugaccugcaguc

SEQ ID NO: 1503729 - RNA, 19 nt, Homo sapiens
gaccugacaagcacugcua

SEQ ID NO: 1503730 - RNA, 18 nt, Homo sapiens
gaccuguuuuuguguuuu

SEQ ID NO: 1503731 - RNA, 13 nt, Homo sapiens
gaccuucaugccc

SEQ ID NO: 1503732 - RNA, 17 nt, Homo sapiens
gaccuuucagcugugaa

SEQ ID NO: 1503733 - RNA, 17 nt, Homo sapiens
gacgucucaagacugaa

SEQ ID NO: 1503734 - RNA, 21 nt, Homo sapiens
gacuagaauagugcauuguau

SEQ ID NO: 1503735 - RNA, 14 nt, Homo sapiens
gacuaugaaaagcu

SEQ ID NO: 1503736 - RNA, 15 nt, Homo sapiens
gacucugacuuugag

SEQ ID NO: 1503737 - RNA, 17 nt, Homo sapiens
gacucuuuaugcuugca

SEQ ID NO: 1503738 - RNA, 23 nt, Homo sapiens
gacugaauauggacccugcugaa

SEQ ID NO: 1503739 - RNA, 23 nt, Homo sapiens
gacugauguuacaucacaguguu

SEQ ID NO: 1503740 - RNA, 14 nt, Homo sapiens
gacugggaccugaa

SEQ ID NO: 1503741 - RNA, 17 nt, Homo sapiens
gacuguaggauuugaag

SEQ ID NO: 1503742 - RNA, 14 nt, Homo sapiens
gacuuccuggugag

SEQ ID NO: 1503743 - RNA, 17 nt, Homo sapiens
gacuugauacugcaaua

SEQ ID NO: 1503744 - RNA, 21 nt, Homo sapiens
gagaaauuuaaacuauaagca

SEQ ID NO: 1503745 - RNA, 13 nt, Homo sapiens
gagaaccauuccc

SEQ ID NO: 1503746 - RNA, 20 nt, Homo sapiens
gagaaccauucccaagccau

SEQ ID NO: 1503747 - RNA, 15 nt, Homo sapiens
gagaagcaaggguug

SEQ ID NO: 1503748 - RNA, 14 nt, Homo sapiens
gagaaggaaggcuc

SEQ ID NO: 1503749 - RNA, 19 nt, Homo sapiens
gagaagggaagccucuuca

SEQ ID NO: 1503750 - RNA, 19 nt, Homo sapiens
ggaaaguuugggaagggau

SEQ ID NO: 1503751 - RNA, 18 nt, Homo sapiens
ggaagauaccagcuuuuu

SEQ ID NO: 1503752 - RNA, 19 nt, Homo sapiens
ggaagcuucuugcugccag

SEQ ID NO: 1503753 - RNA, 14 nt, Homo sapiens
ggaaggagugagau

SEQ ID NO: 1503754 - RNA, 19 nt, Homo sapiens
ggaaggucccuuguuucca

SEQ ID NO: 1503755 - RNA, 18 nt, Homo sapiens
ggaaguuucuggugccau

SEQ ID NO: 1503756 - RNA, 20 nt, Homo sapiens
ggaaguuucuggugccauuu

SEQ ID NO: 1503757 - RNA, 12 nt, Homo sapiens
ggaaguuuucag

SEQ ID NO: 1503758 - RNA, 23 nt, Homo sapiens
ggaauucuuuacaauaaacauag

SEQ ID NO: 1503759 - RNA, 12 nt, Homo sapiens
ggacaaaaugga

SEQ ID NO: 1503760 - RNA, 23 nt, Homo sapiens
ggacaaaauggaagguuggagac

SEQ ID NO: 1503761 - RNA, 20 nt, Homo sapiens
ggacaccccuuauccaggac

SEQ ID NO: 1503762 - RNA, 16 nt, Homo sapiens
ggacagaacauugccu

SEQ ID NO: 1503763 - RNA, 17 nt, Homo sapiens
ggacaggauguguuugc

SEQ ID NO: 1503764 - RNA, 17 nt, Homo sapiens
ggacaguccugggagaa

SEQ ID NO: 1503765 - RNA, 19 nt, Homo sapiens
ggacaugcuucagugcugc

SEQ ID NO: 1503766 - RNA, 20 nt, Homo sapiens
ggacucugccuuuuuucaca

SEQ ID NO: 1503767 - RNA, 18 nt, Homo sapiens
ggagaagcucacccaaua

SEQ ID NO: 1503768 - RNA, 16 nt, Homo sapiens
ggagaaucgcuuaaac

SEQ ID NO: 1503769 - RNA, 17 nt, Homo sapiens
ggagaaugaagacuguu

SEQ ID NO: 1503770 - RNA, 14 nt, Homo sapiens
ggagaggacucugc

SEQ ID NO: 1503771 - RNA, 21 nt, Homo sapiens
ggagaguacagugagccaaga

SEQ ID NO: 1503772 - RNA, 22 nt, Homo sapiens
ggagccugaacaugacauuucu

SEQ ID NO: 1503773 - RNA, 13 nt, Homo sapiens
ggagcgcaccugc

SEQ ID NO: 1503774 - RNA, 15 nt, Homo sapiens
ggagcuggaaauaaa

SEQ ID NO: 1503775 - RNA, 14 nt, Homo sapiens
ggaggucgacccca

SEQ ID NO: 1503776 - RNA, 19 nt, Homo sapiens
ggagguggagguugcagug

SEQ ID NO: 1503777 - RNA, 16 nt, Homo sapiens
ggagguugcagugagc

SEQ ID NO: 1503778 - RNA, 18 nt, Homo sapiens
ggagugagaucauuuucu

SEQ ID NO: 1503779 - RNA, 20 nt, Homo sapiens
ggaucacaaggucacuagau

SEQ ID NO: 1503780 - RNA, 21 nt, Homo sapiens
ggaugacgugaagccacagga

SEQ ID NO: 1503781 - RNA, 13 nt, Homo sapiens
ggaugccacccag

SEQ ID NO: 1503782 - RNA, 18 nt, Homo sapiens
ggauuccagcauuugcca

SEQ ID NO: 1503783 - RNA, 15 nt, Homo sapiens
ggcaaagcuggagau

SEQ ID NO: 1503784 - RNA, 17 nt, Homo sapiens
ggcaacgacgguuucaa

SEQ ID NO: 1503785 - RNA, 15 nt, Homo sapiens
ggcaaggcauuccuc

SEQ ID NO: 1503786 - RNA, 14 nt, Homo sapiens
ggcaagggguuucc

SEQ ID NO: 1503787 - RNA, 20 nt, Homo sapiens
ggcagacucuuuaugcuugc

SEQ ID NO: 1503788 - RNA, 12 nt, Homo sapiens
ggcagagaagaa

SEQ ID NO: 1503789 - RNA, 20 nt, Homo sapiens
ggcagagccaccagggcacu

SEQ ID NO: 1503790 - RNA, 22 nt, Homo sapiens
ggcagagccccuuaaagcugcu

SEQ ID NO: 1503791 - RNA, 18 nt, Homo sapiens
ggcagcauccccuugaac

SEQ ID NO: 1503792 - RNA, 22 nt, Homo sapiens
ggcagcuguagcucccgagcua

SEQ ID NO: 1503793 - RNA, 17 nt, Homo sapiens
ggcaggcagaucacaag

SEQ ID NO: 1503794 - RNA, 13 nt, Homo sapiens
ggcagugcugauu

SEQ ID NO: 1503795 - RNA, 11 nt, Homo sapiens
ggcauaugcaa

SEQ ID NO: 1503796 - RNA, 22 nt, Homo sapiens
ggcauugaaugacaagcaucag

SEQ ID NO: 1503797 - RNA, 15 nt, Homo sapiens
ggccaaguuccucua

SEQ ID NO: 1503798 - RNA, 13 nt, Homo sapiens
ggccacauugaca

SEQ ID NO: 1503799 - RNA, 18 nt, Homo sapiens
ggccacucuugaccugga

SEQ ID NO: 1503800 - RNA, 16 nt, Homo sapiens
ggccagaggcauuuuu

SEQ ID NO: 1503801 - RNA, 20 nt, Homo sapiens
ggccaggcaggggugggaga

SEQ ID NO: 1503802 - RNA, 17 nt, Homo sapiens
ggccaugccacccuguu

SEQ ID NO: 1503803 - RNA, 21 nt, Homo sapiens
ggcccaaagcccagcucuuug

SEQ ID NO: 1503804 - RNA, 17 nt, Homo sapiens
ggccgaaggcagugcaa

SEQ ID NO: 1503805 - RNA, 15 nt, Homo sapiens
ggccuccugugacug

SEQ ID NO: 1503806 - RNA, 17 nt, Homo sapiens
ggccugcccucagggau

SEQ ID NO: 1503807 - RNA, 20 nt, Homo sapiens
ggcuaagucaagaucaacau

SEQ ID NO: 1503808 - RNA, 22 nt, Homo sapiens
ggcucagcaugcagaagugcau

SEQ ID NO: 1503809 - RNA, 16 nt, Homo sapiens
ggcucagucucaggag

SEQ ID NO: 1503810 - RNA, 21 nt, Homo sapiens
ggcucccagggacaccuggga

SEQ ID NO: 1503811 - RNA, 13 nt, Homo sapiens
ggcuccugucauc

SEQ ID NO: 1503812 - RNA, 18 nt, Homo sapiens
ggcuccugugcuacuuug

SEQ ID NO: 1503813 - RNA, 13 nt, Homo sapiens
ggcugagcugaac

SEQ ID NO: 1503814 - RNA, 13 nt, Homo sapiens
ggcugcugggaga

SEQ ID NO: 1503815 - RNA, 16 nt, Homo sapiens
ggcuggaguucagugg

SEQ ID NO: 1503816 - RNA, 19 nt, Homo sapiens
ggcuggccuuucaggucca

SEQ ID NO: 1503817 - RNA, 14 nt, Homo sapiens
ggcuuagugccacc

SEQ ID NO: 1503818 - RNA, 14 nt, Homo sapiens
ggcuuccaugccug

SEQ ID NO: 1503819 - RNA, 13 nt, Homo sapiens
ggcuucuugccca

SEQ ID NO: 1503820 - RNA, 17 nt, Homo sapiens
ggcuugcuguggcuaug

SEQ ID NO: 1503821 - RNA, 22 nt, Homo sapiens
gggaagcgaugaauuuggagac

SEQ ID NO: 1503822 - RNA, 21 nt, Homo sapiens
gggaauauuuuagaaccacaa

SEQ ID NO: 1503823 - RNA, 15 nt, Homo sapiens
gggacacaggggcaa

SEQ ID NO: 1503824 - RNA, 15 nt, Homo sapiens
gggaccuauaucuca

SEQ ID NO: 1503825 - RNA, 15 nt, Homo sapiens
gggagcuaugaucca

SEQ ID NO: 1503826 - RNA, 16 nt, Homo sapiens
gggauagccauuucca

SEQ ID NO: 1503827 - RNA, 22 nt, Homo sapiens
gggaugcugccugagucaccca

SEQ ID NO: 1503828 - RNA, 18 nt, Homo sapiens
gggcaagaaccuaaagua

SEQ ID NO: 1503829 - RNA, 12 nt, Homo sapiens
gggcacugucug

SEQ ID NO: 1503830 - RNA, 23 nt, Homo sapiens
gggcccacaauggagugggagau

SEQ ID NO: 1503831 - RNA, 21 nt, Homo sapiens
gggcccacagggaacccugcu

SEQ ID NO: 1503832 - RNA, 22 nt, Homo sapiens
gggccugcugcgucagaccagu

SEQ ID NO: 1503833 - RNA, 16 nt, Homo sapiens
gggcgacagagcaaga

SEQ ID NO: 1503834 - RNA, 23 nt, Homo sapiens
ggggagcugggguacagguuugg

SEQ ID NO: 1503835 - RNA, 19 nt, Homo sapiens
ggggcuaggguaggggcaa

SEQ ID NO: 1503836 - RNA, 15 nt, Homo sapiens
ggggguggacacaga

SEQ ID NO: 1503837 - RNA, 21 nt, Homo sapiens
gggguuugcuuguaaaaccaa

SEQ ID NO: 1503838 - RNA, 16 nt, Homo sapiens
gggucaaccugggaug

SEQ ID NO: 1503839 - RNA, 23 nt, Homo sapiens
gggucacaccugacaaauggaag

SEQ ID NO: 1503840 - RNA, 20 nt, Homo sapiens
gggucuggcuguguggccaa

SEQ ID NO: 1503841 - RNA, 13 nt, Homo sapiens
ggguguguguagc

SEQ ID NO: 1503842 - RNA, 17 nt, Homo sapiens
ggguguguguagccaag

SEQ ID NO: 1503843 - RNA, 17 nt, Homo sapiens
gguaaaaccccaucucu

SEQ ID NO: 1503844 - RNA, 15 nt, Homo sapiens
gguaauuuucuuuga

SEQ ID NO: 1503845 - RNA, 16 nt, Homo sapiens
gguacauuucccugug

SEQ ID NO: 1503846 - RNA, 22 nt, Homo sapiens
gguaggggcaaggaaacucgaa

SEQ ID NO: 1503847 - RNA, 14 nt, Homo sapiens
gguaguacugggaa

SEQ ID NO: 1503848 - RNA, 17 nt, Homo sapiens
gguauaauuuuuaucca

SEQ ID NO: 1503849 - RNA, 20 nt, Homo sapiens
gguauaccugggaagauacc

SEQ ID NO: 1503850 - RNA, 14 nt, Homo sapiens
gguauguugcacgu

SEQ ID NO: 1503851 - RNA, 17 nt, Homo sapiens
gguauuuaccacagcag

SEQ ID NO: 1503852 - RNA, 15 nt, Homo sapiens
ggucacauucaggaa

SEQ ID NO: 1503853 - RNA, 13 nt, Homo sapiens
ggucagagccacu

SEQ ID NO: 1503854 - RNA, 15 nt, Homo sapiens
ggucagagugccacu

SEQ ID NO: 1503855 - RNA, 14 nt, Homo sapiens
gguccccagcauug

SEQ ID NO: 1503856 - RNA, 12 nt, Homo sapiens
gguccugcacug

SEQ ID NO: 1503857 - RNA, 14 nt, Homo sapiens
gguccugcacuguc

SEQ ID NO: 1503858 - RNA, 18 nt, Homo sapiens
ggucggggcuaggguagg

SEQ ID NO: 1503859 - RNA, 16 nt, Homo sapiens
ggucugauuucaggau

SEQ ID NO: 1503860 - RNA, 21 nt, Homo sapiens
ggugauuccauuuuacuucca

SEQ ID NO: 1503861 - RNA, 21 nt, Homo sapiens
ggugcaguuuuccaggaauag

SEQ ID NO: 1503862 - RNA, 17 nt, Homo sapiens
gguggagguugcaguga

SEQ ID NO: 1503863 - RNA, 20 nt, Homo sapiens
gguggaugggcccugcaaga

SEQ ID NO: 1503864 - RNA, 22 nt, Homo sapiens
gguggauuccugggcaagaacc

SEQ ID NO: 1503865 - RNA, 14 nt, Homo sapiens
gguggcucuugccu

SEQ ID NO: 1503866 - RNA, 15 nt, Homo sapiens
ggugugaaagucaga

SEQ ID NO: 1503867 - RNA, 14 nt, Homo sapiens
gguucaacuuauua

SEQ ID NO: 1503868 - RNA, 18 nt, Homo sapiens
gguucugaguucugguga

SEQ ID NO: 1503869 - RNA, 17 nt, Homo sapiens
gguuuggggucugccac

SEQ ID NO: 1503870 - RNA, 16 nt, Homo sapiens
gguuuuaacaauuucc

SEQ ID NO: 1503871 - RNA, 21 nt, Homo sapiens
gguuuugucucugcaucucau

SEQ ID NO: 1503872 - RNA, 16 nt, Homo sapiens
guaaaagugugagcag

SEQ ID NO: 1503873 - RNA, 15 nt, Homo sapiens
guaaaauaacaucag

SEQ ID NO: 1503874 - RNA, 14 nt, Homo sapiens
guaaacaacaaacu

SEQ ID NO: 1503875 - RNA, 14 nt, Homo sapiens
guaaacauucucuc

SEQ ID NO: 1503876 - RNA, 13 nt, Homo sapiens
guaaaccaaaaag

SEQ ID NO: 1503877 - RNA, 14 nt, Homo sapiens
guaaagaagggaag

SEQ ID NO: 1503878 - RNA, 15 nt, Homo sapiens
guaaagaaguuugau

SEQ ID NO: 1503879 - RNA, 18 nt, Homo sapiens
guaaaugaccuaauugau

SEQ ID NO: 1503880 - RNA, 15 nt, Homo sapiens
guaaaugagccuuuc

SEQ ID NO: 1503881 - RNA, 14 nt, Homo sapiens
guaaaugccacaaa

SEQ ID NO: 1503882 - RNA, 21 nt, Homo sapiens
guaacucagacauuccaaggg

SEQ ID NO: 1503883 - RNA, 16 nt, Homo sapiens
guaagaagaaagcaaa

SEQ ID NO: 1503884 - RNA, 21 nt, Homo sapiens
guaagguaauuucuguguauu

SEQ ID NO: 1503885 - RNA, 16 nt, Homo sapiens
aaaucaacuugcuuau

SEQ ID NO: 1503886 - RNA, 20 nt, Homo sapiens
aaaucacccuaagugacaca

SEQ ID NO: 1503887 - RNA, 20 nt, Homo sapiens
aaaucccuauuuaauuuucc

SEQ ID NO: 1503888 - RNA, 13 nt, Homo sapiens
aaaucucuaauau

SEQ ID NO: 1503889 - RNA, 16 nt, Homo sapiens
aaaugaguuuucaccu

SEQ ID NO: 1503890 - RNA, 13 nt, Homo sapiens
aaaugcauggugc

SEQ ID NO: 1503891 - RNA, 17 nt, Homo sapiens
aaaugcauggugcaguu

SEQ ID NO: 1503892 - RNA, 14 nt, Homo sapiens
aaaugccacaaaga

SEQ ID NO: 1503893 - RNA, 15 nt, Homo sapiens
aaaugccacaaagaa

SEQ ID NO: 1503894 - RNA, 16 nt, Homo sapiens
aaauggguuggugcuu

SEQ ID NO: 1503895 - RNA, 16 nt, Homo sapiens
aaauguuauuauguca

SEQ ID NO: 1503896 - RNA, 17 nt, Homo sapiens
aaauuauaagaugucau

SEQ ID NO: 1503897 - RNA, 20 nt, Homo sapiens
aaauucagaaagucauagau

SEQ ID NO: 1503898 - RNA, 22 nt, Homo sapiens
aaauucauaacugguagcuaua

SEQ ID NO: 1503899 - RNA, 13 nt, Homo sapiens
aaauuccacucau

SEQ ID NO: 1503900 - RNA, 22 nt, Homo sapiens
aaauucuuuuucacacugaugu

SEQ ID NO: 1503901 - RNA, 14 nt, Homo sapiens
aaauugaaccuggu

SEQ ID NO: 1503902 - RNA, 15 nt, Homo sapiens
aaauugaauacacaa

SEQ ID NO: 1503903 - RNA, 13 nt, Homo sapiens
aaauuguauagag

SEQ ID NO: 1503904 - RNA, 12 nt, Homo sapiens
aaauuucaucuc

SEQ ID NO: 1503905 - RNA, 13 nt, Homo sapiens
aaauuuucaccug

SEQ ID NO: 1503906 - RNA, 14 nt, Homo sapiens
aacaaaaaaccaca

SEQ ID NO: 1503907 - RNA, 15 nt, Homo sapiens
aacaaaaaaccacaa

SEQ ID NO: 1503908 - RNA, 15 nt, Homo sapiens
aacaacaaaccaaaa

SEQ ID NO: 1503909 - RNA, 22 nt, Homo sapiens
aacaacuaggcuucagcauauu

SEQ ID NO: 1503910 - RNA, 22 nt, Homo sapiens
aacaagagaaaaaacuagagcc

SEQ ID NO: 1503911 - RNA, 23 nt, Homo sapiens
aacaagagcaaaaugaugcuuuc

SEQ ID NO: 1503912 - RNA, 12 nt, Homo sapiens
aacaaguagcua

SEQ ID NO: 1503913 - RNA, 18 nt, Homo sapiens
aacaauaaagacugagac

SEQ ID NO: 1503914 - RNA, 14 nt, Homo sapiens
aacaauucucucuu

SEQ ID NO: 1503915 - RNA, 17 nt, Homo sapiens
aacaauuuuuuccccaa

SEQ ID NO: 1503916 - RNA, 20 nt, Homo sapiens
aacacccgacuccucaaaag

SEQ ID NO: 1503917 - RNA, 21 nt, Homo sapiens
aacaccuuuguuuugcacuga

SEQ ID NO: 1503918 - RNA, 18 nt, Homo sapiens
aacacuagagucugucau

SEQ ID NO: 1503919 - RNA, 20 nt, Homo sapiens
aacacuccacccccuccagc

SEQ ID NO: 1503920 - RNA, 15 nt, Homo sapiens
aacacucuucuugag

SEQ ID NO: 1503921 - RNA, 16 nt, Homo sapiens
aacacugugaagacaa

SEQ ID NO: 1503922 - RNA, 22 nt, Homo sapiens
aacagcguguucuaaguauuug

SEQ ID NO: 1503923 - RNA, 19 nt, Homo sapiens
aacauacucuagugaaugu

SEQ ID NO: 1503924 - RNA, 23 nt, Homo sapiens
aacauaguauucaugacuaugga

SEQ ID NO: 1503925 - RNA, 16 nt, Homo sapiens
aacauaucuuuaucuu

SEQ ID NO: 1503926 - RNA, 13 nt, Homo sapiens
aacauuuauuuca

SEQ ID NO: 1503927 - RNA, 18 nt, Homo sapiens
aacauuugcaaaauggaa

SEQ ID NO: 1503928 - RNA, 17 nt, Homo sapiens
aaccaagucuacuucac

SEQ ID NO: 1503929 - RNA, 19 nt, Homo sapiens
aaccaaguggaaaggcaag

SEQ ID NO: 1503930 - RNA, 16 nt, Homo sapiens
aaccaauggaauguga

SEQ ID NO: 1503931 - RNA, 23 nt, Homo sapiens
aaccacuuugccucugaaacuua

SEQ ID NO: 1503932 - RNA, 15 nt, Homo sapiens
aaccagaauagauaa

SEQ ID NO: 1503933 - RNA, 20 nt, Homo sapiens
aaccagaucuagucaaucaa

SEQ ID NO: 1503934 - RNA, 19 nt, Homo sapiens
aaccauaaacuguacaaau

SEQ ID NO: 1503935 - RNA, 14 nt, Homo sapiens
aaccauagcacagg

SEQ ID NO: 1503936 - RNA, 22 nt, Homo sapiens
aaccauaguuauuuacuugaaa

SEQ ID NO: 1503937 - RNA, 18 nt, Homo sapiens
aaccauucccaagccaug

SEQ ID NO: 1503938 - RNA, 13 nt, Homo sapiens
aacccagcucuca

SEQ ID NO: 1503939 - RNA, 12 nt, Homo sapiens
aaccccaucucu

SEQ ID NO: 1503940 - RNA, 16 nt, Homo sapiens
aacccccgcuccagau

SEQ ID NO: 1503941 - RNA, 17 nt, Homo sapiens
aacccccgcuccagauc

SEQ ID NO: 1503942 - RNA, 22 nt, Homo sapiens
aacccugcuugcacuuuguaac

SEQ ID NO: 1503943 - RNA, 14 nt, Homo sapiens
aaccuaaaauuuca

SEQ ID NO: 1503944 - RNA, 19 nt, Homo sapiens
aaccucaaacuaggaggaa

SEQ ID NO: 1503945 - RNA, 15 nt, Homo sapiens
aaccucagagggaua

SEQ ID NO: 1503946 - RNA, 23 nt, Homo sapiens
aaccucaguaauuuagaaaucau

SEQ ID NO: 1503947 - RNA, 19 nt, Homo sapiens
aaccuccccugguccugca

SEQ ID NO: 1503948 - RNA, 16 nt, Homo sapiens
aaccugaugagcaaga

SEQ ID NO: 1503949 - RNA, 22 nt, Homo sapiens
aaccugaugagcaagaauuaua

SEQ ID NO: 1503950 - RNA, 17 nt, Homo sapiens
aaccugccugugcauga

SEQ ID NO: 1503951 - RNA, 12 nt, Homo sapiens
aaccugggaugu

SEQ ID NO: 1503952 - RNA, 21 nt, Homo sapiens
aaccuuguugcuuuaggugag

SEQ ID NO: 1503953 - RNA, 11 nt, Homo sapiens
aaccuuucaaa

SEQ ID NO: 1503954 - RNA, 15 nt, Homo sapiens
aacgacaaagccaaa

SEQ ID NO: 1503955 - RNA, 21 nt, Homo sapiens
aacgacgguuucaaaccagga

SEQ ID NO: 1503956 - RNA, 16 nt, Homo sapiens
aacgccuuuuauucua

SEQ ID NO: 1503957 - RNA, 11 nt, Homo sapiens
aacgucagggu

SEQ ID NO: 1503958 - RNA, 17 nt, Homo sapiens
aacuagaaaucugccaa

SEQ ID NO: 1503959 - RNA, 14 nt, Homo sapiens
aacuauaagcaaga

SEQ ID NO: 1503960 - RNA, 15 nt, Homo sapiens
aacuaugcugaagag

SEQ ID NO: 1503961 - RNA, 17 nt, Homo sapiens
aacuaugugauguuaac

SEQ ID NO: 1503962 - RNA, 15 nt, Homo sapiens
aacuauuuacauaua

SEQ ID NO: 1503963 - RNA, 14 nt, Homo sapiens
aacuauuuauuuca

SEQ ID NO: 1503964 - RNA, 15 nt, Homo sapiens
aacucagacauucca

SEQ ID NO: 1503965 - RNA, 16 nt, Homo sapiens
aacucagacauuccaa

SEQ ID NO: 1503966 - RNA, 16 nt, Homo sapiens
aacucaggaugccaag

SEQ ID NO: 1503967 - RNA, 18 nt, Homo sapiens
aacucgaauaaaggaugg

SEQ ID NO: 1503968 - RNA, 19 nt, Homo sapiens
aacucgaggagcucagggu

SEQ ID NO: 1503969 - RNA, 15 nt, Homo sapiens
aacucuccacuccau

SEQ ID NO: 1503970 - RNA, 15 nt, Homo sapiens
aacucucugcuauga

SEQ ID NO: 1503971 - RNA, 23 nt, Homo sapiens
aacucuucacucuucaaaugccu

SEQ ID NO: 1503972 - RNA, 22 nt, Homo sapiens
aacucuuggccucugcuuucuc

SEQ ID NO: 1503973 - RNA, 17 nt, Homo sapiens
aacugacuucuuugugg

SEQ ID NO: 1503974 - RNA, 17 nt, Homo sapiens
aacugcugaucaaugaa

SEQ ID NO: 1503975 - RNA, 18 nt, Homo sapiens
aacugugaaauaccacaa

SEQ ID NO: 1503976 - RNA, 15 nt, Homo sapiens
aacuucaaguucucu

SEQ ID NO: 1503977 - RNA, 20 nt, Homo sapiens
aacuucaaguucucuugauu

SEQ ID NO: 1503978 - RNA, 16 nt, Homo sapiens
aacuucuuugaaguua

SEQ ID NO: 1503979 - RNA, 20 nt, Homo sapiens
aacuugaggacacaugucca

SEQ ID NO: 1503980 - RNA, 16 nt, Homo sapiens
aagaaaaccauuuuag

SEQ ID NO: 1503981 - RNA, 19 nt, Homo sapiens
aagaaaaugucuguuuucc

SEQ ID NO: 1503982 - RNA, 19 nt, Homo sapiens
aagaaacacucaacaauaa

SEQ ID NO: 1503983 - RNA, 14 nt, Homo sapiens
aagaacacugagau

SEQ ID NO: 1503984 - RNA, 23 nt, Homo sapiens
aagaagcaaccucaguaauuuag

SEQ ID NO: 1503985 - RNA, 16 nt, Homo sapiens
aagaagcuuuaauauu

SEQ ID NO: 1503986 - RNA, 19 nt, Homo sapiens
aagacagauuaccaaagaa

SEQ ID NO: 1503987 - RNA, 11 nt, Homo sapiens
aagacauggaa

SEQ ID NO: 1503988 - RNA, 22 nt, Homo sapiens
aagacauuucucuaacuccugc

SEQ ID NO: 1503989 - RNA, 19 nt, Homo sapiens
aagaccgauagcaggugaa

SEQ ID NO: 1503990 - RNA, 20 nt, Homo sapiens
aagacuauuaagagcaauaa

SEQ ID NO: 1503991 - RNA, 21 nt, Homo sapiens
aagacucauucccuagaucuu

SEQ ID NO: 1503992 - RNA, 15 nt, Homo sapiens
aagagacucuggccu

SEQ ID NO: 1503993 - RNA, 19 nt, Homo sapiens
aagagcuggcaaagguggc

SEQ ID NO: 1503994 - RNA, 20 nt, Homo sapiens
aagagucucuauuucacaau

SEQ ID NO: 1503995 - RNA, 16 nt, Homo sapiens
accuggcacaauggcu

SEQ ID NO: 1503996 - RNA, 23 nt, Homo sapiens
accuggcauggugcuuucagguc

SEQ ID NO: 1503997 - RNA, 17 nt, Homo sapiens
accuguggagaagccua

SEQ ID NO: 1503998 - RNA, 16 nt, Homo sapiens
accuuaaaaaguaauu

SEQ ID NO: 1503999 - RNA, 13 nt, Homo sapiens
accuucaauacuu

SEQ ID NO: 1504000 - RNA, 18 nt, Homo sapiens
accuucaauacuucauga

SEQ ID NO: 1504001 - RNA, 15 nt, Homo sapiens
accuucaauuccugg

SEQ ID NO: 1504002 - RNA, 21 nt, Homo sapiens
accuucagauuuguguuauaa

SEQ ID NO: 1504003 - RNA, 13 nt, Homo sapiens
accuugcaucuca

SEQ ID NO: 1504004 - RNA, 18 nt, Homo sapiens
accuuggacuccucccac

SEQ ID NO: 1504005 - RNA, 19 nt, Homo sapiens
accuuuauagcucaucacu

SEQ ID NO: 1504006 - RNA, 23 nt, Homo sapiens
acgaagucuguuuuaaugacaag

SEQ ID NO: 1504007 - RNA, 15 nt, Homo sapiens
agagcaaaaugaugc

SEQ ID NO: 1504008 - RNA, 18 nt, Homo sapiens
agagccaccagggcacug

SEQ ID NO: 1504009 - RNA, 14 nt, Homo sapiens
agagccacuaccuu

SEQ ID NO: 1504010 - RNA, 15 nt, Homo sapiens
agagccagcucucuc

SEQ ID NO: 1504011 - RNA, 14 nt, Homo sapiens
agagccuggagaag

SEQ ID NO: 1504012 - RNA, 19 nt, Homo sapiens
agagccugugcuaaagaag

SEQ ID NO: 1504013 - RNA, 19 nt, Homo sapiens
agaggaccugagucugcua

SEQ ID NO: 1504014 - RNA, 13 nt, Homo sapiens
agaggagguuugg

SEQ ID NO: 1504015 - RNA, 23 nt, Homo sapiens
agaggagguuuggggucugccac

SEQ ID NO: 1504016 - RNA, 19 nt, Homo sapiens
agaggauuuaacugugaac

SEQ ID NO: 1504017 - RNA, 16 nt, Homo sapiens
agaggcaacugcccag

SEQ ID NO: 1504018 - RNA, 20 nt, Homo sapiens
agaggggaaaccaguguagc

SEQ ID NO: 1504019 - RNA, 17 nt, Homo sapiens
agaggugacaguggaug

SEQ ID NO: 1504020 - RNA, 19 nt, Homo sapiens
agaggugguagaaccacuu

SEQ ID NO: 1504021 - RNA, 14 nt, Homo sapiens
agagguuugucaac

SEQ ID NO: 1504022 - RNA, 18 nt, Homo sapiens
agagguuugucaacacaa

SEQ ID NO: 1504023 - RNA, 20 nt, Homo sapiens
agagguuugucaacacaaag

SEQ ID NO: 1504024 - RNA, 21 nt, Homo sapiens
agagguuugucaacacaaaga

SEQ ID NO: 1504025 - RNA, 17 nt, Homo sapiens
agagucucuauuucaca

SEQ ID NO: 1504026 - RNA, 20 nt, Homo sapiens
agagugcauaaagguucugg

SEQ ID NO: 1504027 - RNA, 12 nt, Homo sapiens
agaguggugggg

SEQ ID NO: 1504028 - RNA, 23 nt, Homo sapiens
agaguguccccagagacaugcaa

SEQ ID NO: 1504029 - RNA, 20 nt, Homo sapiens
agaguugggaugcggggcag

SEQ ID NO: 1504030 - RNA, 20 nt, Homo sapiens
agauaaaguuuuuauuuucc

SEQ ID NO: 1504031 - RNA, 19 nt, Homo sapiens
agauaaauuuugacuugaa

SEQ ID NO: 1504032 - RNA, 22 nt, Homo sapiens
agauacaucuuauaaacugacu

SEQ ID NO: 1504033 - RNA, 23 nt, Homo sapiens
agauagauauuccuauugugcaa

SEQ ID NO: 1504034 - RNA, 17 nt, Homo sapiens
agauaucaugauuuuau

SEQ ID NO: 1504035 - RNA, 17 nt, Homo sapiens
agauauuggacaaagaa

SEQ ID NO: 1504036 - RNA, 14 nt, Homo sapiens
agaucaacauucca

SEQ ID NO: 1504037 - RNA, 12 nt, Homo sapiens
agaucugcacug

SEQ ID NO: 1504038 - RNA, 23 nt, Homo sapiens
agaucugcuucuucaucuugaca

SEQ ID NO: 1504039 - RNA, 17 nt, Homo sapiens
agaucuuucaggaaaga

SEQ ID NO: 1504040 - RNA, 20 nt, Homo sapiens
agaucuuucaggaaagacgg

SEQ ID NO: 1504041 - RNA, 18 nt, Homo sapiens
agauggaauaaagcccuu

SEQ ID NO: 1504042 - RNA, 13 nt, Homo sapiens
agauggauuucac

SEQ ID NO: 1504043 - RNA, 14 nt, Homo sapiens
agauguaaaugcca

SEQ ID NO: 1504044 - RNA, 19 nt, Homo sapiens
agaugugcaagucuuguca

SEQ ID NO: 1504045 - RNA, 18 nt, Homo sapiens
agauuaaauaugaucacu

SEQ ID NO: 1504046 - RNA, 23 nt, Homo sapiens
agauuaguauuuuccacgucacu

SEQ ID NO: 1504047 - RNA, 14 nt, Homo sapiens
agauuuaacaaaua

SEQ ID NO: 1504048 - RNA, 23 nt, Homo sapiens
agauuugaauagaaaaaguaauc

SEQ ID NO: 1504049 - RNA, 17 nt, Homo sapiens
agauuuugucgggacag

SEQ ID NO: 1504050 - RNA, 16 nt, Homo sapiens
agcaaaaggcugagaa

SEQ ID NO: 1504051 - RNA, 17 nt, Homo sapiens
agcaaaagucauuacac

SEQ ID NO: 1504052 - RNA, 20 nt, Homo sapiens
agcaaaccacauaaucucuc

SEQ ID NO: 1504053 - RNA, 16 nt, Homo sapiens
agcaaaccucagucau

SEQ ID NO: 1504054 - RNA, 22 nt, Homo sapiens
agcaaacugaauggcaaugaaa

SEQ ID NO: 1504055 - RNA, 14 nt, Homo sapiens
agcaaagagugggc

SEQ ID NO: 1504056 - RNA, 13 nt, Homo sapiens
agcaaagcaaaag

SEQ ID NO: 1504057 - RNA, 21 nt, Homo sapiens
agcaaagcaaaaggcugagaa

SEQ ID NO: 1504058 - RNA, 17 nt, Homo sapiens
agcaacuccgugugccu

SEQ ID NO: 1504059 - RNA, 17 nt, Homo sapiens
agcaaggcauaccuguc

SEQ ID NO: 1504060 - RNA, 18 nt, Homo sapiens
agcaaucucgcaguacau

SEQ ID NO: 1504061 - RNA, 23 nt, Homo sapiens
agcaaucugagagauuugaauag

SEQ ID NO: 1504062 - RNA, 19 nt, Homo sapiens
agcaaugcccguaaugcuu

SEQ ID NO: 1504063 - RNA, 20 nt, Homo sapiens
agcaauuagauuaguauuuu

SEQ ID NO: 1504064 - RNA, 19 nt, Homo sapiens
agcaauuauugugccucag

SEQ ID NO: 1504065 - RNA, 14 nt, Homo sapiens
agcacaacucaguc

SEQ ID NO: 1504066 - RNA, 23 nt, Homo sapiens
agcacuuuaacccucucuucccu

SEQ ID NO: 1504067 - RNA, 16 nt, Homo sapiens
agcagaugguccucca

SEQ ID NO: 1504068 - RNA, 13 nt, Homo sapiens
agcaggggccaga

SEQ ID NO: 1504069 - RNA, 15 nt, Homo sapiens
agcaguacucugaag

SEQ ID NO: 1504070 - RNA, 14 nt, Homo sapiens
agcaucaccucagg

SEQ ID NO: 1504071 - RNA, 13 nt, Homo sapiens
agcaucagaguug

SEQ ID NO: 1504072 - RNA, 21 nt, Homo sapiens
agcauccuggccaacauggug

SEQ ID NO: 1504073 - RNA, 17 nt, Homo sapiens
agcaugcagaagugcau

SEQ ID NO: 1504074 - RNA, 21 nt, Homo sapiens
agcauugacucuguggcuuug

SEQ ID NO: 1504075 - RNA, 18 nt, Homo sapiens
agccaaauaaaaccucag

SEQ ID NO: 1504076 - RNA, 15 nt, Homo sapiens
agccaaaugcauggu

SEQ ID NO: 1504077 - RNA, 19 nt, Homo sapiens
agccaauauuuacucauca

SEQ ID NO: 1504078 - RNA, 19 nt, Homo sapiens
agccacaucccuuugaaac

SEQ ID NO: 1504079 - RNA, 22 nt, Homo sapiens
agccacggaccguugcacaaaa

SEQ ID NO: 1504080 - RNA, 23 nt, Homo sapiens
agccagaaucuucguccugcccc

SEQ ID NO: 1504081 - RNA, 12 nt, Homo sapiens
agccaguauuuc

SEQ ID NO: 1504082 - RNA, 20 nt, Homo sapiens
agccauguacuauaauguga

SEQ ID NO: 1504083 - RNA, 20 nt, Homo sapiens
agccauuauucucugaugca

SEQ ID NO: 1504084 - RNA, 12 nt, Homo sapiens
agcccagugugg

SEQ ID NO: 1504085 - RNA, 12 nt, Homo sapiens
agcccuauucau

SEQ ID NO: 1504086 - RNA, 16 nt, Homo sapiens
agcccuauucaucccu

SEQ ID NO: 1504087 - RNA, 19 nt, Homo sapiens
agcccucccccagcaguug

SEQ ID NO: 1504088 - RNA, 19 nt, Homo sapiens
agcccucccuggcauguca

SEQ ID NO: 1504089 - RNA, 15 nt, Homo sapiens
agcccuugaaccagc

SEQ ID NO: 1504090 - RNA, 20 nt, Homo sapiens
agccgagauugcaccacugc

SEQ ID NO: 1504091 - RNA, 21 nt, Homo sapiens
agccgagauugcaccacugca

SEQ ID NO: 1504092 - RNA, 16 nt, Homo sapiens
agccggggcacuuuca

SEQ ID NO: 1504093 - RNA, 16 nt, Homo sapiens
agccuaacuccauccc

SEQ ID NO: 1504094 - RNA, 23 nt, Homo sapiens
agccucagccacaaaacucuguc

SEQ ID NO: 1504095 - RNA, 19 nt, Homo sapiens
agccuccuuuugcuugaaa

SEQ ID NO: 1504096 - RNA, 22 nt, Homo sapiens
agccuggagcggagcuugccug

SEQ ID NO: 1504097 - RNA, 19 nt, Homo sapiens
agccugggcgacagagcaa

SEQ ID NO: 1504098 - RNA, 21 nt, Homo sapiens
agccugggcgacagagcaaga

SEQ ID NO: 1504099 - RNA, 16 nt, Homo sapiens
agccuucaagugccaa

SEQ ID NO: 1504100 - RNA, 23 nt, Homo sapiens
agcgagcugagaucacaccacug

SEQ ID NO: 1504101 - RNA, 16 nt, Homo sapiens
agcgagcugcucugcu

SEQ ID NO: 1504102 - RNA, 22 nt, Homo sapiens
agcgcagguuuaguuuacucaa

SEQ ID NO: 1504103 - RNA, 23 nt, Homo sapiens
agcuacguauuuaauagcaaaga

SEQ ID NO: 1504104 - RNA, 14 nt, Homo sapiens
agcuaggaugguuc

SEQ ID NO: 1504105 - RNA, 15 nt, Homo sapiens
agcuaggaugguucu

SEQ ID NO: 1504106 - RNA, 17 nt, Homo sapiens
agcuauaagagaacuuu

SEQ ID NO: 1504107 - RNA, 13 nt, Homo sapiens
agcucacagucua

SEQ ID NO: 1504108 - RNA, 21 nt, Homo sapiens
agcucauguuuucuauaugaa

SEQ ID NO: 1504109 - RNA, 17 nt, Homo sapiens
agcucucagggcugucu

SEQ ID NO: 1504110 - RNA, 19 nt, Homo sapiens
agcucucaucacuaccuuu

SEQ ID NO: 1504111 - RNA, 14 nt, Homo sapiens
agcucucugcugag

SEQ ID NO: 1504112 - RNA, 15 nt, Homo sapiens
agcucuggcuuccag

SEQ ID NO: 1504113 - RNA, 20 nt, Homo sapiens
agcugaacagccaaaugcau

SEQ ID NO: 1504114 - RNA, 15 nt, Homo sapiens
agcugagagacuuuu

SEQ ID NO: 1504115 - RNA, 18 nt, Homo sapiens
agcugagaucacgccauu

SEQ ID NO: 1504116 - RNA, 18 nt, Homo sapiens
agcugagggacguggugc

SEQ ID NO: 1504117 - RNA, 14 nt, Homo sapiens
agcugcaccugcca

SEQ ID NO: 1504118 - RNA, 15 nt, Homo sapiens
agcugcaccugccag

SEQ ID NO: 1504119 - RNA, 13 nt, Homo sapiens
agcugcugaagag

SEQ ID NO: 1504120 - RNA, 19 nt, Homo sapiens
agcuggaaauaaaccugga

SEQ ID NO: 1504121 - RNA, 15 nt, Homo sapiens
agcugggcaugaacg

SEQ ID NO: 1504122 - RNA, 22 nt, Homo sapiens
agcuguagcucccgagcuacuc

SEQ ID NO: 1504123 - RNA, 21 nt, Homo sapiens
agcuguaguagcccuuucugu

SEQ ID NO: 1504124 - RNA, 22 nt, Homo sapiens
agcugugugugcccguggugag

SEQ ID NO: 1504125 - RNA, 14 nt, Homo sapiens
agcuucagacuuuu

SEQ ID NO: 1504126 - RNA, 18 nt, Homo sapiens
agcuucucugaugugaua

SEQ ID NO: 1504127 - RNA, 13 nt, Homo sapiens
agcuucuguccug

SEQ ID NO: 1504128 - RNA, 14 nt, Homo sapiens
agcuugcugagggg

SEQ ID NO: 1504129 - RNA, 19 nt, Homo sapiens
agcuuucaugaguuuccca

SEQ ID NO: 1504130 - RNA, 16 nt, Homo sapiens
aggaaaaaauaauauc

SEQ ID NO: 1504131 - RNA, 16 nt, Homo sapiens
aggaaaaaugcugcuu

SEQ ID NO: 1504132 - RNA, 11 nt, Homo sapiens
aggaaaaccag

SEQ ID NO: 1504133 - RNA, 20 nt, Homo sapiens
aggaaaccuggcauggugcu

SEQ ID NO: 1504134 - RNA, 22 nt, Homo sapiens
aggaaacucgaauaaaggaugg

SEQ ID NO: 1504135 - RNA, 22 nt, Homo sapiens
aggaaagauuugugaacuggaa

SEQ ID NO: 1504136 - RNA, 15 nt, Homo sapiens
cgucuccuuugacau

SEQ ID NO: 1504137 - RNA, 16 nt, Homo sapiens
cgugaaagcagaugag

SEQ ID NO: 1504138 - RNA, 16 nt, Homo sapiens
cgugacacaaacacac

SEQ ID NO: 1504139 - RNA, 16 nt, Homo sapiens
cgugaccagugcugcu

SEQ ID NO: 1504140 - RNA, 20 nt, Homo sapiens
cguggugagguugugcugcc

SEQ ID NO: 1504141 - RNA, 18 nt, Homo sapiens
cguuacugcauacugauc

SEQ ID NO: 1504142 - RNA, 17 nt, Homo sapiens
cguugguucugcacuaa

SEQ ID NO: 1504143 - RNA, 22 nt, Homo sapiens
cuaaaauacaaacaagcacaga

SEQ ID NO: 1504144 - RNA, 20 nt, Homo sapiens
cuaaacagacuauuuaacuu

SEQ ID NO: 1504145 - RNA, 10 nt, Homo sapiens
cuaaacugua

SEQ ID NO: 1504146 - RNA, 16 nt, Homo sapiens
cuaaagagucuggaac

SEQ ID NO: 1504147 - RNA, 17 nt, Homo sapiens
cuaacaauaauauuuca

SEQ ID NO: 1504148 - RNA, 13 nt, Homo sapiens
cuaacauaaaaua

SEQ ID NO: 1504149 - RNA, 16 nt, Homo sapiens
cuaacuccugccauuc

SEQ ID NO: 1504150 - RNA, 13 nt, Homo sapiens
cuaagccacucuu

SEQ ID NO: 1504151 - RNA, 21 nt, Homo sapiens
cuaagccacucuuccaaaggc

SEQ ID NO: 1504152 - RNA, 15 nt, Homo sapiens
cuaagcugugugcag

SEQ ID NO: 1504153 - RNA, 14 nt, Homo sapiens
cuaauacuaauuca

SEQ ID NO: 1504154 - RNA, 23 nt, Homo sapiens
cuaaucaguccuuauuaucccag

SEQ ID NO: 1504155 - RNA, 22 nt, Homo sapiens
cuaauccucaacaacaaaccaa

SEQ ID NO: 1504156 - RNA, 23 nt, Homo sapiens
cuaaugugccccauguccaaguc

SEQ ID NO: 1504157 - RNA, 21 nt, Homo sapiens
cuaauuauaugggaaccagaa

SEQ ID NO: 1504158 - RNA, 19 nt, Homo sapiens
cuaauugggggagguguga

SEQ ID NO: 1504159 - RNA, 21 nt, Homo sapiens
cuacaacaaauacuacaggcc

SEQ ID NO: 1504160 - RNA, 23 nt, Homo sapiens
cuaccucugagaagacacaaggu

SEQ ID NO: 1504161 - RNA, 17 nt, Homo sapiens
cuaccuuuguccaggcc

SEQ ID NO: 1504162 - RNA, 18 nt, Homo sapiens
cuacuucacuaaugacga

SEQ ID NO: 1504163 - RNA, 19 nt, Homo sapiens
cuacuuccucugcaaaaag

SEQ ID NO: 1504164 - RNA, 23 nt, Homo sapiens
cuagagaagaggcuggugcugug

SEQ ID NO: 1504165 - RNA, 22 nt, Homo sapiens
cuaggaaacccaaggaacaaga

SEQ ID NO: 1504166 - RNA, 19 nt, Homo sapiens
cuaggcgauuuugucuacc

SEQ ID NO: 1504167 - RNA, 18 nt, Homo sapiens
cuagggccuuuuguggau

SEQ ID NO: 1504168 - RNA, 16 nt, Homo sapiens
cuaggguaggggcaag

SEQ ID NO: 1504169 - RNA, 23 nt, Homo sapiens
cuaggguaggggcaaggaaacuc

SEQ ID NO: 1504170 - RNA, 21 nt, Homo sapiens
cuaggugggagagagugcaua

SEQ ID NO: 1504171 - RNA, 17 nt, Homo sapiens
cuaguagcggaucucac

SEQ ID NO: 1504172 - RNA, 20 nt, Homo sapiens
cuaguagcggaucucacuca

SEQ ID NO: 1504173 - RNA, 13 nt, Homo sapiens
cuauaaaaucaaa

SEQ ID NO: 1504174 - RNA, 22 nt, Homo sapiens
cuauaagaggacuguaguuuaa

SEQ ID NO: 1504175 - RNA, 21 nt, Homo sapiens
cuauaugaacuuagucauuaa

SEQ ID NO: 1504176 - RNA, 15 nt, Homo sapiens
cuaucugugaaguua

SEQ ID NO: 1504177 - RNA, 13 nt, Homo sapiens
cuaugaagacauc

SEQ ID NO: 1504178 - RNA, 15 nt, Homo sapiens
cuaugaauauggaaa

SEQ ID NO: 1504179 - RNA, 14 nt, Homo sapiens
cuauggucaguuga

SEQ ID NO: 1504180 - RNA, 23 nt, Homo sapiens
cuauuaaaaagguuuacagaauu

SEQ ID NO: 1504181 - RNA, 20 nt, Homo sapiens
cuauuaaauguauaugucau

SEQ ID NO: 1504182 - RNA, 15 nt, Homo sapiens
cuauuacauguguua

SEQ ID NO: 1504183 - RNA, 19 nt, Homo sapiens
cuauucaaguauuaggggu

SEQ ID NO: 1504184 - RNA, 13 nt, Homo sapiens
cuauucucaccag

SEQ ID NO: 1504185 - RNA, 14 nt, Homo sapiens
cuauuuacauauaa

SEQ ID NO: 1504186 - RNA, 23 nt, Homo sapiens
cuauuuggggcuugcaugccaaa

SEQ ID NO: 1504187 - RNA, 18 nt, Homo sapiens
cuauuuguuuacaugcag

SEQ ID NO: 1504188 - RNA, 23 nt, Homo sapiens
cuauuuuuuaauaaaaguacuga

SEQ ID NO: 1504189 - RNA, 13 nt, Homo sapiens
cucaaaacuuaac

SEQ ID NO: 1504190 - RNA, 13 nt, Homo sapiens
cucaaaucuccag

SEQ ID NO: 1504191 - RNA, 17 nt, Homo sapiens
cucaacaacaaaccaaa

SEQ ID NO: 1504192 - RNA, 16 nt, Homo sapiens
cucaauaaauguugcu

SEQ ID NO: 1504193 - RNA, 13 nt, Homo sapiens
cucagacauucca

SEQ ID NO: 1504194 - RNA, 18 nt, Homo sapiens
cucagauugaccuauaaa

SEQ ID NO: 1504195 - RNA, 15 nt, Homo sapiens
cucagcaccccuguc

SEQ ID NO: 1504196 - RNA, 13 nt, Homo sapiens
cucaggagacaau

SEQ ID NO: 1504197 - RNA, 14 nt, Homo sapiens
cucagggacaacau

SEQ ID NO: 1504198 - RNA, 15 nt, Homo sapiens
cucagguaguacugg

SEQ ID NO: 1504199 - RNA, 17 nt, Homo sapiens
cucagguaguacuggga

SEQ ID NO: 1504200 - RNA, 18 nt, Homo sapiens
cucagguaguacugggaa

SEQ ID NO: 1504201 - RNA, 14 nt, Homo sapiens
cucagucucaggag

SEQ ID NO: 1504202 - RNA, 13 nt, Homo sapiens
cucaguguaguua

SEQ ID NO: 1504203 - RNA, 16 nt, Homo sapiens
cucauaaaccaaugug

SEQ ID NO: 1504204 - RNA, 17 nt, Homo sapiens
cucauaaaccaaugugg

SEQ ID NO: 1504205 - RNA, 17 nt, Homo sapiens
cucaucagaaaugucau

SEQ ID NO: 1504206 - RNA, 16 nt, Homo sapiens
cucaugcuucuucuca

SEQ ID NO: 1504207 - RNA, 21 nt, Homo sapiens
cucauucauuuauucauucau

SEQ ID NO: 1504208 - RNA, 13 nt, Homo sapiens
cucauuccuguag

SEQ ID NO: 1504209 - RNA, 16 nt, Homo sapiens
cuccaaggaguggaaa

SEQ ID NO: 1504210 - RNA, 15 nt, Homo sapiens
cuccagcacucccuc

SEQ ID NO: 1504211 - RNA, 19 nt, Homo sapiens
cuccaggauugaagagcau

SEQ ID NO: 1504212 - RNA, 19 nt, Homo sapiens
cuccauccggcuccuguca

SEQ ID NO: 1504213 - RNA, 15 nt, Homo sapiens
cuccaucuccagugg

SEQ ID NO: 1504214 - RNA, 23 nt, Homo sapiens
cuccauuggcuuccucacuccaa

SEQ ID NO: 1504215 - RNA, 13 nt, Homo sapiens
cucccaagcugcc

SEQ ID NO: 1504216 - RNA, 14 nt, Homo sapiens
cucccaggguccug

SEQ ID NO: 1504217 - RNA, 14 nt, Homo sapiens
cucccuccagggaa

SEQ ID NO: 1504218 - RNA, 15 nt, Homo sapiens
cucccucccagagaa

SEQ ID NO: 1504219 - RNA, 15 nt, Homo sapiens
cucccucuagccuuu

SEQ ID NO: 1504220 - RNA, 20 nt, Homo sapiens
cuccuaaagugcugggauua

SEQ ID NO: 1504221 - RNA, 11 nt, Homo sapiens
cuccugccauu

SEQ ID NO: 1504222 - RNA, 21 nt, Homo sapiens
cuccuuaauagccauaugcaa

SEQ ID NO: 1504223 - RNA, 18 nt, Homo sapiens
cuccuuuaccuaccaccu

SEQ ID NO: 1504224 - RNA, 13 nt, Homo sapiens
cuccuuuaggcag

SEQ ID NO: 1504225 - RNA, 13 nt, Homo sapiens
cuccuuuuugccc

SEQ ID NO: 1504226 - RNA, 21 nt, Homo sapiens
cucgcaguacauguuacuugu

SEQ ID NO: 1504227 - RNA, 18 nt, Homo sapiens
cucggcaccuccccggcc

SEQ ID NO: 1504228 - RNA, 21 nt, Homo sapiens
cucggucaggagggugcagua

SEQ ID NO: 1504229 - RNA, 13 nt, Homo sapiens
cucgucucaaaaa

SEQ ID NO: 1504230 - RNA, 17 nt, Homo sapiens
cucuaacuccugccauu

SEQ ID NO: 1504231 - RNA, 14 nt, Homo sapiens
cucuauacuacccu

SEQ ID NO: 1504232 - RNA, 15 nt, Homo sapiens
cucucaggguucuga

SEQ ID NO: 1504233 - RNA, 13 nt, Homo sapiens
cucuccacuccau

SEQ ID NO: 1504234 - RNA, 20 nt, Homo sapiens
cucugaaacaaaaguauuua

SEQ ID NO: 1504235 - RNA, 22 nt, Homo sapiens
cucugaaacuuaauuacaucca

SEQ ID NO: 1504236 - RNA, 18 nt, Homo sapiens
cucugaaggauccuggaa

SEQ ID NO: 1504237 - RNA, 19 nt, Homo sapiens
cucugccagccacauccaa

SEQ ID NO: 1504238 - RNA, 23 nt, Homo sapiens
cucugcuccccagugcuaccucu

SEQ ID NO: 1504239 - RNA, 22 nt, Homo sapiens
cucuggaaaacucaggauucuc

SEQ ID NO: 1504240 - RNA, 14 nt, Homo sapiens
cucuggcuccagaa

SEQ ID NO: 1504241 - RNA, 19 nt, Homo sapiens
cucuggcuuugucucuagc

SEQ ID NO: 1504242 - RNA, 21 nt, Homo sapiens
cucuggcuuugucucuagccg

SEQ ID NO: 1504243 - RNA, 12 nt, Homo sapiens
cucuuacauggc

SEQ ID NO: 1504244 - RNA, 19 nt, Homo sapiens
cucuucccccacuccucuu

SEQ ID NO: 1504245 - RNA, 15 nt, Homo sapiens
cucuugcauugcaaa

SEQ ID NO: 1504246 - RNA, 16 nt, Homo sapiens
cucuugccagcauuuu

SEQ ID NO: 1504247 - RNA, 14 nt, Homo sapiens
cucuuuaaccacuc

SEQ ID NO: 1504248 - RNA, 15 nt, Homo sapiens
cucuuucuacauucu

SEQ ID NO: 1504249 - RNA, 23 nt, Homo sapiens
cucuuuuuaaagaaaaaugcuaa

SEQ ID NO: 1504250 - RNA, 15 nt, Homo sapiens
cugaaagcaguguau

SEQ ID NO: 1504251 - RNA, 12 nt, Homo sapiens
cugaacagccaa

SEQ ID NO: 1504252 - RNA, 22 nt, Homo sapiens
cugaaggauccuggaaccacug

SEQ ID NO: 1504253 - RNA, 22 nt, Homo sapiens
cugaaguuagggaugacuguga

SEQ ID NO: 1504254 - RNA, 22 nt, Homo sapiens
cugaauauggacccugcugaaa

SEQ ID NO: 1504255 - RNA, 18 nt, Homo sapiens
cugaaugccucaauguga

SEQ ID NO: 1504256 - RNA, 17 nt, Homo sapiens
cugaccaagauacuuaa

SEQ ID NO: 1504257 - RNA, 20 nt, Homo sapiens
cugacccuccuccacuccac

SEQ ID NO: 1504258 - RNA, 17 nt, Homo sapiens
cugaccucgugauccac

SEQ ID NO: 1504259 - RNA, 12 nt, Homo sapiens
cugacuagucau

SEQ ID NO: 1504260 - RNA, 21 nt, Homo sapiens
cugacucucugugaccugccc

SEQ ID NO: 1504261 - RNA, 14 nt, Homo sapiens
cugacugcacacag

SEQ ID NO: 1504262 - RNA, 16 nt, Homo sapiens
cugagaauuccaagga

SEQ ID NO: 1504263 - RNA, 16 nt, Homo sapiens
cugagagaaacugagg

SEQ ID NO: 1504264 - RNA, 15 nt, Homo sapiens
cugagagaguagcag

SEQ ID NO: 1504265 - RNA, 19 nt, Homo sapiens
cugagauacauacagaauu

SEQ ID NO: 1504266 - RNA, 20 nt, Homo sapiens
cugagauacauacagaauua

SEQ ID NO: 1504267 - RNA, 16 nt, Homo sapiens
cugagauccagaguuu

SEQ ID NO: 1504268 - RNA, 15 nt, Homo sapiens
cugagauuacaggug

SEQ ID NO: 1504269 - RNA, 22 nt, Homo sapiens
cugagcaccagggagcaguugc

SEQ ID NO: 1504270 - RNA, 13 nt, Homo sapiens
cugagcccuggca

SEQ ID NO: 1504271 - RNA, 18 nt, Homo sapiens
cugaggaugugagccuga

SEQ ID NO: 1504272 - RNA, 15 nt, Homo sapiens
cugaggucacugggu

SEQ ID NO: 1504273 - RNA, 19 nt, Homo sapiens
aggaaggcuuguugugcuu

SEQ ID NO: 1504274 - RNA, 22 nt, Homo sapiens
aggaagguggugcuuacauccu

SEQ ID NO: 1504275 - RNA, 12 nt, Homo sapiens
aggaaucugcca

SEQ ID NO: 1504276 - RNA, 16 nt, Homo sapiens
aggaccccaaccccuc

SEQ ID NO: 1504277 - RNA, 17 nt, Homo sapiens
aggaccugagucugcua

SEQ ID NO: 1504278 - RNA, 17 nt, Homo sapiens
aggacuauagcccaggu

SEQ ID NO: 1504279 - RNA, 19 nt, Homo sapiens
aggaggcuuggaaagcauc

SEQ ID NO: 1504280 - RNA, 19 nt, Homo sapiens
aggagguuuggggucugcc

SEQ ID NO: 1504281 - RNA, 16 nt, Homo sapiens
aggaucuuugacugaa

SEQ ID NO: 1504282 - RNA, 21 nt, Homo sapiens
aggaugccaaguggcccucag

SEQ ID NO: 1504283 - RNA, 16 nt, Homo sapiens
aggaugguucugugac

SEQ ID NO: 1504284 - RNA, 13 nt, Homo sapiens
aggauuaauuuau

SEQ ID NO: 1504285 - RNA, 16 nt, Homo sapiens
aggauugcacugacau

SEQ ID NO: 1504286 - RNA, 19 nt, Homo sapiens
aggauuuauauucaaggau

SEQ ID NO: 1504287 - RNA, 20 nt, Homo sapiens
aggcaaagagaaaagccacg

SEQ ID NO: 1504288 - RNA, 21 nt, Homo sapiens
aggcaacugugaguccgggaa

SEQ ID NO: 1504289 - RNA, 15 nt, Homo sapiens
aggcagacucuuuau

SEQ ID NO: 1504290 - RNA, 15 nt, Homo sapiens
aggcagguuacaguu

SEQ ID NO: 1504291 - RNA, 13 nt, Homo sapiens
aggcauagaggga

SEQ ID NO: 1504292 - RNA, 11 nt, Homo sapiens
aggcauaugca

SEQ ID NO: 1504293 - RNA, 13 nt, Homo sapiens
aggcauugaauga

SEQ ID NO: 1504294 - RNA, 12 nt, Homo sapiens
aggccaagcccc

SEQ ID NO: 1504295 - RNA, 21 nt, Homo sapiens
aggccaccuggccaggagcuu

SEQ ID NO: 1504296 - RNA, 22 nt, Homo sapiens
aggccagcugacuagaucucug

SEQ ID NO: 1504297 - RNA, 21 nt, Homo sapiens
aggccggugugggcugugucg

SEQ ID NO: 1504298 - RNA, 20 nt, Homo sapiens
aggccuccugugacuggcag

SEQ ID NO: 1504299 - RNA, 21 nt, Homo sapiens
aggccugcacucuuauuucac

SEQ ID NO: 1504300 - RNA, 18 nt, Homo sapiens
aggcgggcggcacgccaa

SEQ ID NO: 1504301 - RNA, 14 nt, Homo sapiens
aggcuccugugcua

SEQ ID NO: 1504302 - RNA, 23 nt, Homo sapiens
aggcuccugugcuacuuugccuu

SEQ ID NO: 1504303 - RNA, 17 nt, Homo sapiens
aggcucuauugagccaa

SEQ ID NO: 1504304 - RNA, 14 nt, Homo sapiens
aggcugagaaggaa

SEQ ID NO: 1504305 - RNA, 20 nt, Homo sapiens
aggcugcagcgagcuaugau

SEQ ID NO: 1504306 - RNA, 18 nt, Homo sapiens
aggcugcccugaacaaaa

SEQ ID NO: 1504307 - RNA, 17 nt, Homo sapiens
aggcuggaguacaguga

SEQ ID NO: 1504308 - RNA, 13 nt, Homo sapiens
aggcuuaucaaaa

SEQ ID NO: 1504309 - RNA, 17 nt, Homo sapiens
aggcuuguugugcuuuu

SEQ ID NO: 1504310 - RNA, 18 nt, Homo sapiens
agggaacaagcauucucc

SEQ ID NO: 1504311 - RNA, 18 nt, Homo sapiens
agggaacacucaucccug

SEQ ID NO: 1504312 - RNA, 21 nt, Homo sapiens
agggaacccugcuugcacuuu

SEQ ID NO: 1504313 - RNA, 13 nt, Homo sapiens
agggaagcaggga

SEQ ID NO: 1504314 - RNA, 16 nt, Homo sapiens
agggaccuucaugccc

SEQ ID NO: 1504315 - RNA, 19 nt, Homo sapiens
agggaucuugcauucccag

SEQ ID NO: 1504316 - RNA, 22 nt, Homo sapiens
agggaucuugcauucccagugg

SEQ ID NO: 1504317 - RNA, 16 nt, Homo sapiens
agggaugacugugauu

SEQ ID NO: 1504318 - RNA, 22 nt, Homo sapiens
agggaugccacccagcaacaca

SEQ ID NO: 1504319 - RNA, 17 nt, Homo sapiens
agggaugcugccugagu

SEQ ID NO: 1504320 - RNA, 19 nt, Homo sapiens
agggaugcugccugaguca

SEQ ID NO: 1504321 - RNA, 19 nt, Homo sapiens
agggaugggagaguggcuu

SEQ ID NO: 1504322 - RNA, 16 nt, Homo sapiens
agggauguaacuauug

SEQ ID NO: 1504323 - RNA, 15 nt, Homo sapiens
agggauguucuagcc

SEQ ID NO: 1504324 - RNA, 16 nt, Homo sapiens
agggauuuuagccucu

SEQ ID NO: 1504325 - RNA, 15 nt, Homo sapiens
agggcugaaagccau

SEQ ID NO: 1504326 - RNA, 18 nt, Homo sapiens
aggggaaagacuuccauc

SEQ ID NO: 1504327 - RNA, 17 nt, Homo sapiens
aggggaggaucacugga

SEQ ID NO: 1504328 - RNA, 16 nt, Homo sapiens
aggggccgagccauuu

SEQ ID NO: 1504329 - RNA, 18 nt, Homo sapiens
aggguaugggaagccaua

SEQ ID NO: 1504330 - RNA, 20 nt, Homo sapiens
agggucccuggaucaggguu

SEQ ID NO: 1504331 - RNA, 14 nt, Homo sapiens
agggugauaaauca

SEQ ID NO: 1504332 - RNA, 16 nt, Homo sapiens
aggguuugcagaaagc

SEQ ID NO: 1504333 - RNA, 13 nt, Homo sapiens
agguaaguggcag

SEQ ID NO: 1504334 - RNA, 15 nt, Homo sapiens
agguaucaaaauguu

SEQ ID NO: 1504335 - RNA, 18 nt, Homo sapiens
agguauuagcaaagcaaa

SEQ ID NO: 1504336 - RNA, 14 nt, Homo sapiens
aggucaacaucuaa

SEQ ID NO: 1504337 - RNA, 12 nt, Homo sapiens
aggucacugggu

SEQ ID NO: 1504338 - RNA, 19 nt, Homo sapiens
aggucacuugaagccaaac

SEQ ID NO: 1504339 - RNA, 14 nt, Homo sapiens
aggucagcgugcuu

SEQ ID NO: 1504340 - RNA, 18 nt, Homo sapiens
aggucagcgugcuuagcc

SEQ ID NO: 1504341 - RNA, 20 nt, Homo sapiens
agguccaggccagugggccu

SEQ ID NO: 1504342 - RNA, 21 nt, Homo sapiens
aggucgaccccaaagccccuu

SEQ ID NO: 1504343 - RNA, 15 nt, Homo sapiens
aggugaauagcacag

SEQ ID NO: 1504344 - RNA, 15 nt, Homo sapiens
aggugagaccaccuc

SEQ ID NO: 1504345 - RNA, 15 nt, Homo sapiens
agguucacaccauuu

SEQ ID NO: 1504346 - RNA, 18 nt, Homo sapiens
agguuucaagacuugaua

SEQ ID NO: 1504347 - RNA, 12 nt, Homo sapiens
agguuugucaac

SEQ ID NO: 1504348 - RNA, 13 nt, Homo sapiens
aguaaaccaaaaa

SEQ ID NO: 1504349 - RNA, 20 nt, Homo sapiens
aguaaguaccacucaggcca

SEQ ID NO: 1504350 - RNA, 21 nt, Homo sapiens
aguaaguaccacucaggccaa

SEQ ID NO: 1504351 - RNA, 19 nt, Homo sapiens
aguaaucaaguuaaaaccu

SEQ ID NO: 1504352 - RNA, 20 nt, Homo sapiens
aguaaucccccuugccaaau

SEQ ID NO: 1504353 - RNA, 13 nt, Homo sapiens
aguaauugucaau

SEQ ID NO: 1504354 - RNA, 16 nt, Homo sapiens
aguacagacgucucaa

SEQ ID NO: 1504355 - RNA, 19 nt, Homo sapiens
aguacagacgucucaagac

SEQ ID NO: 1504356 - RNA, 21 nt, Homo sapiens
aguacagacgucucaagacug

SEQ ID NO: 1504357 - RNA, 19 nt, Homo sapiens
aguacagauguaaaugcca

SEQ ID NO: 1504358 - RNA, 20 nt, Homo sapiens
aguacagauguaaaugccac

SEQ ID NO: 1504359 - RNA, 15 nt, Homo sapiens
aguaccacucaggcc

SEQ ID NO: 1504360 - RNA, 11 nt, Homo sapiens
aguacugaaga

SEQ ID NO: 1504361 - RNA, 11 nt, Homo sapiens
aguagcuuugg

SEQ ID NO: 1504362 - RNA, 16 nt, Homo sapiens
aguaggacuuuccuaa

SEQ ID NO: 1504363 - RNA, 14 nt, Homo sapiens
aguaugauccagga

SEQ ID NO: 1504364 - RNA, 16 nt, Homo sapiens
aguauucuugucaaaa

SEQ ID NO: 1504365 - RNA, 17 nt, Homo sapiens
agucaagaucaacauuc

SEQ ID NO: 1504366 - RNA, 12 nt, Homo sapiens
agucaccaaaau

SEQ ID NO: 1504367 - RNA, 13 nt, Homo sapiens
agucaccaaaauu

SEQ ID NO: 1504368 - RNA, 14 nt, Homo sapiens
agucagaugcccag

SEQ ID NO: 1504369 - RNA, 21 nt, Homo sapiens
agucauugucgcucagcaaua

SEQ ID NO: 1504370 - RNA, 22 nt, Homo sapiens
agucauugucgcucagcaauag

SEQ ID NO: 1504371 - RNA, 13 nt, Homo sapiens
agucccugacucu

SEQ ID NO: 1504372 - RNA, 19 nt, Homo sapiens
aguccgccaaacacuccac

SEQ ID NO: 1504373 - RNA, 13 nt, Homo sapiens
agucuaaaguuua

SEQ ID NO: 1504374 - RNA, 14 nt, Homo sapiens
agucuaaaguuuac

SEQ ID NO: 1504375 - RNA, 21 nt, Homo sapiens
agucuggaagaagaggaggaa

SEQ ID NO: 1504376 - RNA, 17 nt, Homo sapiens
agucugggcaaugaaac

SEQ ID NO: 1504377 - RNA, 13 nt, Homo sapiens
agucuugucagaa

SEQ ID NO: 1504378 - RNA, 14 nt, Homo sapiens
agugaacacacuca

SEQ ID NO: 1504379 - RNA, 17 nt, Homo sapiens
agugaacacacucagca

SEQ ID NO: 1504380 - RNA, 21 nt, Homo sapiens
agugaacuugaaauauccugc

SEQ ID NO: 1504381 - RNA, 21 nt, Homo sapiens
agugacaaguagggcacaaaa

SEQ ID NO: 1504382 - RNA, 12 nt, Homo sapiens
agugacauuugu

SEQ ID NO: 1504383 - RNA, 16 nt, Homo sapiens
agugacuaauggcaug

SEQ ID NO: 1504384 - RNA, 16 nt, Homo sapiens
agugcacuguauauag

SEQ ID NO: 1504385 - RNA, 13 nt, Homo sapiens
agugcugugcugu

SEQ ID NO: 1504386 - RNA, 20 nt, Homo sapiens
aguggcaggacccugucagg

SEQ ID NO: 1504387 - RNA, 21 nt, Homo sapiens
aguggcucacgccuaugaucc

SEQ ID NO: 1504388 - RNA, 19 nt, Homo sapiens
agugggaggugagaccacc

SEQ ID NO: 1504389 - RNA, 19 nt, Homo sapiens
agugggccugguagcacau

SEQ ID NO: 1504390 - RNA, 21 nt, Homo sapiens
agugggggcggggaagggugc

SEQ ID NO: 1504391 - RNA, 19 nt, Homo sapiens
agugggugguggaucuguc

SEQ ID NO: 1504392 - RNA, 20 nt, Homo sapiens
agugguuguuuugucaugaa

SEQ ID NO: 1504393 - RNA, 19 nt, Homo sapiens
aguguaaccuugcaucuca

SEQ ID NO: 1504394 - RNA, 20 nt, Homo sapiens
aguguccccagagacaugca

SEQ ID NO: 1504395 - RNA, 19 nt, Homo sapiens
agugugauuuuuuucacau

SEQ ID NO: 1504396 - RNA, 18 nt, Homo sapiens
aguguguguuuaacauuc

SEQ ID NO: 1504397 - RNA, 22 nt, Homo sapiens
aguuaagaauggaagaaaacgg

SEQ ID NO: 1504398 - RNA, 18 nt, Homo sapiens
aguuaauuuugaccaaaa

SEQ ID NO: 1504399 - RNA, 19 nt, Homo sapiens
aguuacuggguauuugaua

SEQ ID NO: 1504400 - RNA, 16 nt, Homo sapiens
aguuagcaacaaaucc

SEQ ID NO: 1504401 - RNA, 23 nt, Homo sapiens
aguuaggucauuacuaaccauag

SEQ ID NO: 1504402 - RNA, 14 nt, Homo sapiens
aguucaccccuuau

SEQ ID NO: 1504403 - RNA, 19 nt, Homo sapiens
aguucccgcucugcauugc

SEQ ID NO: 1504404 - RNA, 21 nt, Homo sapiens
aguuccucuaacauuugcaaa

SEQ ID NO: 1504405 - RNA, 17 nt, Homo sapiens
aguucgaccugcggcug

SEQ ID NO: 1504406 - RNA, 20 nt, Homo sapiens
aguucuggugaauguucaau

SEQ ID NO: 1504407 - RNA, 22 nt, Homo sapiens
aguucuuuaaaauguaaagcca

SEQ ID NO: 1504408 - RNA, 14 nt, Homo sapiens
auuuguaaguuuau

SEQ ID NO: 1504409 - RNA, 15 nt, Homo sapiens
auuugucugacaaac

SEQ ID NO: 1504410 - RNA, 18 nt, Homo sapiens
auuugugugugugauaua

SEQ ID NO: 1504411 - RNA, 13 nt, Homo sapiens
auuuuacuuccau

SEQ ID NO: 1504412 - RNA, 15 nt, Homo sapiens
auuuuagaaccacaa

SEQ ID NO: 1504413 - RNA, 20 nt, Homo sapiens
auuuuagcaggguacauauu

SEQ ID NO: 1504414 - RNA, 17 nt, Homo sapiens
auuuuagugaacuugaa

SEQ ID NO: 1504415 - RNA, 18 nt, Homo sapiens
auuuuagugaacuugaaa

SEQ ID NO: 1504416 - RNA, 15 nt, Homo sapiens
auuuuaguuccuuua

SEQ ID NO: 1504417 - RNA, 15 nt, Homo sapiens
auuuuccuaaccaca

SEQ ID NO: 1504418 - RNA, 16 nt, Homo sapiens
auuuuccuaaccacaa

SEQ ID NO: 1504419 - RNA, 18 nt, Homo sapiens
aaggaaaaaugcugcuuc

SEQ ID NO: 1504420 - RNA, 14 nt, Homo sapiens
aaggaaaccaaagg

SEQ ID NO: 1504421 - RNA, 22 nt, Homo sapiens
aaggaacucuggcuuccaggua

SEQ ID NO: 1504422 - RNA, 16 nt, Homo sapiens
aaggaagucaccaaaa

SEQ ID NO: 1504423 - RNA, 14 nt, Homo sapiens
aaggcauuccucau

SEQ ID NO: 1504424 - RNA, 13 nt, Homo sapiens
aaggccucacuca

SEQ ID NO: 1504425 - RNA, 15 nt, Homo sapiens
aaggccuccugugac

SEQ ID NO: 1504426 - RNA, 13 nt, Homo sapiens
aaggcucagucuc

SEQ ID NO: 1504427 - RNA, 17 nt, Homo sapiens
aaggcucagucucagga

SEQ ID NO: 1504428 - RNA, 16 nt, Homo sapiens
aaggcuccaucuccag

SEQ ID NO: 1504429 - RNA, 16 nt, Homo sapiens
aagggcagaaggggaa

SEQ ID NO: 1504430 - RNA, 14 nt, Homo sapiens
aagguaaaaugcca

SEQ ID NO: 1504431 - RNA, 20 nt, Homo sapiens
aaggucaauuucaguguaug

SEQ ID NO: 1504432 - RNA, 16 nt, Homo sapiens
aaggucccuuguuucc

SEQ ID NO: 1504433 - RNA, 14 nt, Homo sapiens
aaggugcucugugu

SEQ ID NO: 1504434 - RNA, 12 nt, Homo sapiens
aagguuacugau

SEQ ID NO: 1504435 - RNA, 18 nt, Homo sapiens
aaguaaguaccacucagg

SEQ ID NO: 1504436 - RNA, 18 nt, Homo sapiens
aaguaauaugcucucauu

SEQ ID NO: 1504437 - RNA, 20 nt, Homo sapiens
aaguaauuccucucacuaaa

SEQ ID NO: 1504438 - RNA, 20 nt, Homo sapiens
aaguaccccugauaagcaaa

SEQ ID NO: 1504439 - RNA, 18 nt, Homo sapiens
aaguaugugaauaugaau

SEQ ID NO: 1504440 - RNA, 23 nt, Homo sapiens
aaguauucuucaucagcauuuaa

SEQ ID NO: 1504441 - RNA, 14 nt, Homo sapiens
aagucccuuuuugu

SEQ ID NO: 1504442 - RNA, 23 nt, Homo sapiens
aagucuaaaguuuacaguaaaua

SEQ ID NO: 1504443 - RNA, 16 nt, Homo sapiens
aagucuacuucacuaa

SEQ ID NO: 1504444 - RNA, 13 nt, Homo sapiens
aagucuccaguca

SEQ ID NO: 1504445 - RNA, 15 nt, Homo sapiens
aaguguaaauccuuu

SEQ ID NO: 1504446 - RNA, 17 nt, Homo sapiens
aaguguaacagauauca

SEQ ID NO: 1504447 - RNA, 14 nt, Homo sapiens
aaguguaauagauu

SEQ ID NO: 1504448 - RNA, 16 nt, Homo sapiens
aaguuacuacuuacag

SEQ ID NO: 1504449 - RNA, 17 nt, Homo sapiens
aaguucaacuuccagaa

SEQ ID NO: 1504450 - RNA, 22 nt, Homo sapiens
aaguuggguguaauuaggugaa

SEQ ID NO: 1504451 - RNA, 17 nt, Homo sapiens
aauaaaaggaaaaccag

SEQ ID NO: 1504452 - RNA, 13 nt, Homo sapiens
aauaaaauguuau

SEQ ID NO: 1504453 - RNA, 21 nt, Homo sapiens
aauaaaccuggagaugaugau

SEQ ID NO: 1504454 - RNA, 18 nt, Homo sapiens
aauaaauaugaauggagu

SEQ ID NO: 1504455 - RNA, 11 nt, Homo sapiens
aauaauaccaa

SEQ ID NO: 1504456 - RNA, 22 nt, Homo sapiens
aauaauagacacuggagacuug

SEQ ID NO: 1504457 - RNA, 15 nt, Homo sapiens
aauaauauaugcuca

SEQ ID NO: 1504458 - RNA, 13 nt, Homo sapiens
aauaauaugugau

SEQ ID NO: 1504459 - RNA, 16 nt, Homo sapiens
aauaauguauacacau

SEQ ID NO: 1504460 - RNA, 22 nt, Homo sapiens
aauaauuacccacaaaugccac

SEQ ID NO: 1504461 - RNA, 15 nt, Homo sapiens
aauaauuguuccaaa

SEQ ID NO: 1504462 - RNA, 22 nt, Homo sapiens
aauaauuuagacuucaagcaug

SEQ ID NO: 1504463 - RNA, 17 nt, Homo sapiens
aauacugcguguucuca

SEQ ID NO: 1504464 - RNA, 16 nt, Homo sapiens
aauacuuuuccuuaau

SEQ ID NO: 1504465 - RNA, 19 nt, Homo sapiens
aauagaaccaagaauucua

SEQ ID NO: 1504466 - RNA, 18 nt, Homo sapiens
aauagccauguacuauaa

SEQ ID NO: 1504467 - RNA, 23 nt, Homo sapiens
aauagccauguacuauaauguga

SEQ ID NO: 1504468 - RNA, 14 nt, Homo sapiens
aauagcucuuucag

SEQ ID NO: 1504469 - RNA, 14 nt, Homo sapiens
aauaggcauuugau

SEQ ID NO: 1504470 - RNA, 14 nt, Homo sapiens
aauauacaaucuau

SEQ ID NO: 1504471 - RNA, 15 nt, Homo sapiens
aauaugaauggagug

SEQ ID NO: 1504472 - RNA, 19 nt, Homo sapiens
aauauguagccuuuuaucc

SEQ ID NO: 1504473 - RNA, 19 nt, Homo sapiens
aauaugugaaaaugauuag

SEQ ID NO: 1504474 - RNA, 22 nt, Homo sapiens
aauaugugaugauuaauacaau

SEQ ID NO: 1504475 - RNA, 11 nt, Homo sapiens
aauaugugcuu

SEQ ID NO: 1504476 - RNA, 12 nt, Homo sapiens
aauauuauuaac

SEQ ID NO: 1504477 - RNA, 15 nt, Homo sapiens
aauauucagauauaa

SEQ ID NO: 1504478 - RNA, 14 nt, Homo sapiens
aauauuuaggcaag

SEQ ID NO: 1504479 - RNA, 14 nt, Homo sapiens
aaucacucuguccu

SEQ ID NO: 1504480 - RNA, 14 nt, Homo sapiens
aaucagaagcacaa

SEQ ID NO: 1504481 - RNA, 22 nt, Homo sapiens
aaucaggcugaggugucuuaag

SEQ ID NO: 1504482 - RNA, 15 nt, Homo sapiens
aaucauggcauucac

SEQ ID NO: 1504483 - RNA, 23 nt, Homo sapiens
aauccaaucuguaauuucacuuu

SEQ ID NO: 1504484 - RNA, 15 nt, Homo sapiens
aauccacaagccauu

SEQ ID NO: 1504485 - RNA, 22 nt, Homo sapiens
aaucccuguaggcgugcuagca

SEQ ID NO: 1504486 - RNA, 23 nt, Homo sapiens
aauccucaacaacaaaccaaaac

SEQ ID NO: 1504487 - RNA, 19 nt, Homo sapiens
aaucuaguacaaccuuguu

SEQ ID NO: 1504488 - RNA, 15 nt, Homo sapiens
aaucugaauggugcu

SEQ ID NO: 1504489 - RNA, 17 nt, Homo sapiens
aaucugagagauuugaa

SEQ ID NO: 1504490 - RNA, 13 nt, Homo sapiens
aaugaaaccaaag

SEQ ID NO: 1504491 - RNA, 16 nt, Homo sapiens
aaugagccuuucugcc

SEQ ID NO: 1504492 - RNA, 15 nt, Homo sapiens
aaugaggacauguuu

SEQ ID NO: 1504493 - RNA, 22 nt, Homo sapiens
aaugagucugcuuucacuguga

SEQ ID NO: 1504494 - RNA, 13 nt, Homo sapiens
aaugagugacaau

SEQ ID NO: 1504495 - RNA, 14 nt, Homo sapiens
aaugcuaagggcag

SEQ ID NO: 1504496 - RNA, 18 nt, Homo sapiens
aaugcugcuucuccuccc

SEQ ID NO: 1504497 - RNA, 19 nt, Homo sapiens
aaugcugcuucuccuccca

SEQ ID NO: 1504498 - RNA, 19 nt, Homo sapiens
aaugcuuuuugaauguuau

SEQ ID NO: 1504499 - RNA, 13 nt, Homo sapiens
aauggaagguugg

SEQ ID NO: 1504500 - RNA, 14 nt, Homo sapiens
aauggagucugcag

SEQ ID NO: 1504501 - RNA, 20 nt, Homo sapiens
aauggcuuuaaucaauucua

SEQ ID NO: 1504502 - RNA, 14 nt, Homo sapiens
aaugggacagggug

SEQ ID NO: 1504503 - RNA, 20 nt, Homo sapiens
aauggguacaauguacauua

SEQ ID NO: 1504504 - RNA, 14 nt, Homo sapiens
aauggucaguugua

SEQ ID NO: 1504505 - RNA, 22 nt, Homo sapiens
aaugguuugggagcaauacuuu

SEQ ID NO: 1504506 - RNA, 13 nt, Homo sapiens
aauguaaagccau

SEQ ID NO: 1504507 - RNA, 14 nt, Homo sapiens
aauguacauacuau

SEQ ID NO: 1504508 - RNA, 13 nt, Homo sapiens
aaugucagcacau

SEQ ID NO: 1504509 - RNA, 12 nt, Homo sapiens
aaugucaucaaa

SEQ ID NO: 1504510 - RNA, 12 nt, Homo sapiens
aaugucauucac

SEQ ID NO: 1504511 - RNA, 16 nt, Homo sapiens
aaugugaccaggggug

SEQ ID NO: 1504512 - RNA, 12 nt, Homo sapiens
aaugugccccau

SEQ ID NO: 1504513 - RNA, 12 nt, Homo sapiens
aauguguacaaa

SEQ ID NO: 1504514 - RNA, 22 nt, Homo sapiens
aauguguauugaagaaaagcac

SEQ ID NO: 1504515 - RNA, 19 nt, Homo sapiens
aauguuuaagauaaacaga

SEQ ID NO: 1504516 - RNA, 16 nt, Homo sapiens
aauuaccagauaguua

SEQ ID NO: 1504517 - RNA, 23 nt, Homo sapiens
aauuauaucuguuuuguuucuug

SEQ ID NO: 1504518 - RNA, 18 nt, Homo sapiens
aauuauuauauguaacug

SEQ ID NO: 1504519 - RNA, 12 nt, Homo sapiens
aauuccuaguca

SEQ ID NO: 1504520 - RNA, 22 nt, Homo sapiens
aauucuauaugauccugaaaaa

SEQ ID NO: 1504521 - RNA, 17 nt, Homo sapiens
aauucucucucuugcag

SEQ ID NO: 1504522 - RNA, 21 nt, Homo sapiens
aauucucuuuaguucugucag

SEQ ID NO: 1504523 - RNA, 15 nt, Homo sapiens
aauucuugaugguaa

SEQ ID NO: 1504524 - RNA, 16 nt, Homo sapiens
aauugacccaaaacgu

SEQ ID NO: 1504525 - RNA, 15 nt, Homo sapiens
aauugcuuugccaaa

SEQ ID NO: 1504526 - RNA, 16 nt, Homo sapiens
aauuguacuaaagcca

SEQ ID NO: 1504527 - RNA, 23 nt, Homo sapiens
aauuguagacagccuuccagugg

SEQ ID NO: 1504528 - RNA, 17 nt, Homo sapiens
aauuuaaggccugcacu

SEQ ID NO: 1504529 - RNA, 17 nt, Homo sapiens
aauuuaaugcuuaaaaa

SEQ ID NO: 1504530 - RNA, 18 nt, Homo sapiens
aauuuauuaaaaugauug

SEQ ID NO: 1504531 - RNA, 22 nt, Homo sapiens
aauuugaaaacauaaucugcaa

SEQ ID NO: 1504532 - RNA, 23 nt, Homo sapiens
aauuugcaaaacugugcuuuuau

SEQ ID NO: 1504533 - RNA, 17 nt, Homo sapiens
aauuuucagucaucuca

SEQ ID NO: 1504534 - RNA, 13 nt, Homo sapiens
aauuuugaccaaa

SEQ ID NO: 1504535 - RNA, 16 nt, Homo sapiens
aaagcacagauuucaa

SEQ ID NO: 1504536 - RNA, 10 nt, Homo sapiens
aaagcagugu

SEQ ID NO: 1504537 - RNA, 18 nt, Homo sapiens
aaagcccaaccuccugac

SEQ ID NO: 1504538 - RNA, 16 nt, Homo sapiens
aaagcccagcucuuug

SEQ ID NO: 1504539 - RNA, 15 nt, Homo sapiens
aaagcccuugaacca

SEQ ID NO: 1504540 - RNA, 17 nt, Homo sapiens
aaagcccuugaaccagc

SEQ ID NO: 1504541 - RNA, 22 nt, Homo sapiens
aaagcuacaacaaauacuacag

SEQ ID NO: 1504542 - RNA, 22 nt, Homo sapiens
aaagcugcugagaaucuagccu

SEQ ID NO: 1504543 - RNA, 13 nt, Homo sapiens
aaagcugcuguca

SEQ ID NO: 1504544 - RNA, 21 nt, Homo sapiens
aaagcuguguguuuggaagac

SEQ ID NO: 1504545 - RNA, 22 nt, Homo sapiens
aaagcuuuauauguaauuaaca

SEQ ID NO: 1504546 - RNA, 22 nt, Homo sapiens
aaaggcauaagacccuaagccu

SEQ ID NO: 1504547 - RNA, 13 nt, Homo sapiens
aaaggcauaugca

SEQ ID NO: 1504548 - RNA, 13 nt, Homo sapiens
aaaggcugagaag

SEQ ID NO: 1504549 - RNA, 17 nt, Homo sapiens
aaagguuucaagacuug

SEQ ID NO: 1504550 - RNA, 21 nt, Homo sapiens
aaaguaaaaaauaacuaucaa

SEQ ID NO: 1504551 - RNA, 21 nt, Homo sapiens
aaagucuggcuaugcucacag

SEQ ID NO: 1504552 - RNA, 23 nt, Homo sapiens
aaaguugucuggcuuuuugcacg

SEQ ID NO: 1504553 - RNA, 23 nt, Homo sapiens
aaaguuugggaagggaugggaga

SEQ ID NO: 1504554 - RNA, 13 nt, Homo sapiens
aaauaaaccugga

SEQ ID NO: 1504555 - RNA, 19 nt, Homo sapiens
aaauacaaacaagcacaga

SEQ ID NO: 1504556 - RNA, 16 nt, Homo sapiens
aaauacaaauuggaca

SEQ ID NO: 1504557 - RNA, 13 nt, Homo sapiens
aaauacaucaaaa

SEQ ID NO: 1504558 - RNA, 19 nt, Homo sapiens
aaauaccacaagccugaga

SEQ ID NO: 1504559 - RNA, 18 nt, Homo sapiens
aaauagacaacucuucca

SEQ ID NO: 1504560 - RNA, 22 nt, Homo sapiens
aaauaggaagauuaaaaccaca

SEQ ID NO: 1504561 - RNA, 12 nt, Homo sapiens
aaauaugugaaa

SEQ ID NO: 1504562 - RNA, 18 nt, Homo sapiens
uccuucucguuugcucua

SEQ ID NO: 1504563 - RNA, 18 nt, Homo sapiens
uccuugauaaaugccuca

SEQ ID NO: 1504564 - RNA, 23 nt, Homo sapiens
uccuuugaguuauaguuugcuuu

SEQ ID NO: 1504565 - RNA, 17 nt, Homo sapiens
uccuuugccucugcuac

SEQ ID NO: 1504566 - RNA, 16 nt, Homo sapiens
uccuuuuugcaguaua

SEQ ID NO: 1504567 - RNA, 20 nt, Homo sapiens
ucgaauaaaggaugggacca

SEQ ID NO: 1504568 - RNA, 21 nt, Homo sapiens
ucgaauaaaggaugggaccaa

SEQ ID NO: 1504569 - RNA, 14 nt, Homo sapiens
ucgaguuuacuuca

SEQ ID NO: 1504570 - RNA, 15 nt, Homo sapiens
ucgaguuuacuucau

SEQ ID NO: 1504571 - RNA, 20 nt, Homo sapiens
ucgaguuuacuucaugagga

SEQ ID NO: 1504572 - RNA, 20 nt, Homo sapiens
ucgcuuguuuuucuuugaag

SEQ ID NO: 1504573 - RNA, 16 nt, Homo sapiens
ucgggauuguguuuga

SEQ ID NO: 1504574 - RNA, 15 nt, Homo sapiens
ucguaaauauucccu

SEQ ID NO: 1504575 - RNA, 10 nt, Homo sapiens
ucguagccaa

SEQ ID NO: 1504576 - RNA, 13 nt, Homo sapiens
ucgugacaacaug

SEQ ID NO: 1504577 - RNA, 23 nt, Homo sapiens
ucgugggagagagacguguacau

SEQ ID NO: 1504578 - RNA, 20 nt, Homo sapiens
ucguggguguguguagccaa

SEQ ID NO: 1504579 - RNA, 21 nt, Homo sapiens
ucguggguguguguagccaag

SEQ ID NO: 1504580 - RNA, 16 nt, Homo sapiens
ucgugguagaagccag

SEQ ID NO: 1504581 - RNA, 17 nt, Homo sapiens
ucuaacccccagugcca

SEQ ID NO: 1504582 - RNA, 21 nt, Homo sapiens
ucuaacucuucuggaaaccaa

SEQ ID NO: 1504583 - RNA, 19 nt, Homo sapiens
ucuaagugguauauacaua

SEQ ID NO: 1504584 - RNA, 13 nt, Homo sapiens
ucuaauacauucc

SEQ ID NO: 1504585 - RNA, 18 nt, Homo sapiens
ucuaauauuuuuagcucu

SEQ ID NO: 1504586 - RNA, 14 nt, Homo sapiens
ucuacaagcauuug

SEQ ID NO: 1504587 - RNA, 16 nt, Homo sapiens
ucuaccauuugaauuu

SEQ ID NO: 1504588 - RNA, 22 nt, Homo sapiens
ucuacuuuccccagaggaccac

SEQ ID NO: 1504589 - RNA, 16 nt, Homo sapiens
ucuagagcacugccac

SEQ ID NO: 1504590 - RNA, 17 nt, Homo sapiens
ucuagccacaguucuaa

SEQ ID NO: 1504591 - RNA, 17 nt, Homo sapiens
ucuaggaaacccaagga

SEQ ID NO: 1504592 - RNA, 17 nt, Homo sapiens
ucuauccuguacauuuc

SEQ ID NO: 1504593 - RNA, 22 nt, Homo sapiens
ucuauggcgaacacagguguug

SEQ ID NO: 1504594 - RNA, 14 nt, Homo sapiens
ucuauuauagccac

SEQ ID NO: 1504595 - RNA, 17 nt, Homo sapiens
ucuauuccuaucugugg

SEQ ID NO: 1504596 - RNA, 19 nt, Homo sapiens
ucuauugagccaagaccaa

SEQ ID NO: 1504597 - RNA, 17 nt, Homo sapiens
ucuauuuugccacaagc

SEQ ID NO: 1504598 - RNA, 21 nt, Homo sapiens
ucucaaauccuugagcacuca

SEQ ID NO: 1504599 - RNA, 14 nt, Homo sapiens
ucucaggguucuga

SEQ ID NO: 1504600 - RNA, 16 nt, Homo sapiens
ucucagugcucuccua

SEQ ID NO: 1504601 - RNA, 22 nt, Homo sapiens
ucucaucagaaaugucaucaaa

SEQ ID NO: 1504602 - RNA, 18 nt, Homo sapiens
ucuccaagucuagcuuuc

SEQ ID NO: 1504603 - RNA, 12 nt, Homo sapiens
ucuccacuccau

SEQ ID NO: 1504604 - RNA, 18 nt, Homo sapiens
ucuccagugugaauauau

SEQ ID NO: 1504605 - RNA, 16 nt, Homo sapiens
ucuccucccauggccu

SEQ ID NO: 1504606 - RNA, 16 nt, Homo sapiens
ucuccuccucugugcu

SEQ ID NO: 1504607 - RNA, 21 nt, Homo sapiens
ucucggaccuuucagcuguga

SEQ ID NO: 1504608 - RNA, 18 nt, Homo sapiens
ucucguaacugguuucau

SEQ ID NO: 1504609 - RNA, 18 nt, Homo sapiens
ucucuaacuccugccauu

SEQ ID NO: 1504610 - RNA, 23 nt, Homo sapiens
ucucuccuaagacaccugcaaua

SEQ ID NO: 1504611 - RNA, 15 nt, Homo sapiens
ucucucuugcaggaa

SEQ ID NO: 1504612 - RNA, 20 nt, Homo sapiens
ucucugaaauauagguuuaa

SEQ ID NO: 1504613 - RNA, 14 nt, Homo sapiens
ucugaaacuuaauu

SEQ ID NO: 1504614 - RNA, 17 nt, Homo sapiens
ucugaaauauagguuua

SEQ ID NO: 1504615 - RNA, 17 nt, Homo sapiens
ucugaacagaagguaua

SEQ ID NO: 1504616 - RNA, 18 nt, Homo sapiens
uacuugccacacacuguu

SEQ ID NO: 1504617 - RNA, 22 nt, Homo sapiens
uacuuuugaaaaucaacuguau

SEQ ID NO: 1504618 - RNA, 12 nt, Homo sapiens
uacuuuuugccc

SEQ ID NO: 1504619 - RNA, 17 nt, Homo sapiens
uagaaaauuuucuaguc

SEQ ID NO: 1504620 - RNA, 20 nt, Homo sapiens
uagaaauaccucauucgccu

SEQ ID NO: 1504621 - RNA, 14 nt, Homo sapiens
uagaaaugagccag

SEQ ID NO: 1504622 - RNA, 11 nt, Homo sapiens
uagaaaugcca

SEQ ID NO: 1504623 - RNA, 16 nt, Homo sapiens
uagaacacugcauuag

SEQ ID NO: 1504624 - RNA, 18 nt, Homo sapiens
uagaaccacuuggcugcu

SEQ ID NO: 1504625 - RNA, 14 nt, Homo sapiens
uagaaugcauguaa

SEQ ID NO: 1504626 - RNA, 12 nt, Homo sapiens
uagaauugggaa

SEQ ID NO: 1504627 - RNA, 23 nt, Homo sapiens
uagacacccauuuucacauuccc

SEQ ID NO: 1504628 - RNA, 14 nt, Homo sapiens
uagagauaugcaga

SEQ ID NO: 1504629 - RNA, 14 nt, Homo sapiens
uagagcacugccac

SEQ ID NO: 1504630 - RNA, 22 nt, Homo sapiens
uagagcagaacugaacuuauua

SEQ ID NO: 1504631 - RNA, 11 nt, Homo sapiens
uagagccugug

SEQ ID NO: 1504632 - RNA, 17 nt, Homo sapiens
uagaggaagaccaaaaa

SEQ ID NO: 1504633 - RNA, 17 nt, Homo sapiens
uagagugcaguggcaug

SEQ ID NO: 1504634 - RNA, 18 nt, Homo sapiens
uagaguuccaaauaagga

SEQ ID NO: 1504635 - RNA, 12 nt, Homo sapiens
uagaucuagaaa

SEQ ID NO: 1504636 - RNA, 22 nt, Homo sapiens
uagaucuaguucucaaucacug

SEQ ID NO: 1504637 - RNA, 19 nt, Homo sapiens
uagauuacgacagguuugg

SEQ ID NO: 1504638 - RNA, 22 nt, Homo sapiens
uagauugagaaguuuuguacag

SEQ ID NO: 1504639 - RNA, 13 nt, Homo sapiens
uagcaaaagaaga

SEQ ID NO: 1504640 - RNA, 13 nt, Homo sapiens
uagcaaagcaaaa

SEQ ID NO: 1504641 - RNA, 23 nt, Homo sapiens
uagcaaagcaaaaggcugagaag

SEQ ID NO: 1504642 - RNA, 14 nt, Homo sapiens
uagcagaaaccaag

SEQ ID NO: 1504643 - RNA, 17 nt, Homo sapiens
uagcccaucucuccaga

SEQ ID NO: 1504644 - RNA, 18 nt, Homo sapiens
uagccggggguggugaca

SEQ ID NO: 1504645 - RNA, 16 nt, Homo sapiens
uagccucuccaggaau

SEQ ID NO: 1504646 - RNA, 15 nt, Homo sapiens
uagcgaaucaucuca

SEQ ID NO: 1504647 - RNA, 20 nt, Homo sapiens
uagcuauuuguuuacaugca

SEQ ID NO: 1504648 - RNA, 18 nt, Homo sapiens
uagcucccugauuuggag

SEQ ID NO: 1504649 - RNA, 19 nt, Homo sapiens
uagcugaguuuaacaugug

SEQ ID NO: 1504650 - RNA, 16 nt, Homo sapiens
uagcugggacuacagg

SEQ ID NO: 1504651 - RNA, 18 nt, Homo sapiens
uagcugguucacacugac

SEQ ID NO: 1504652 - RNA, 23 nt, Homo sapiens
uagcugguucacacugaccaaga

SEQ ID NO: 1504653 - RNA, 19 nt, Homo sapiens
uaggaaaauuagaagcaag

SEQ ID NO: 1504654 - RNA, 16 nt, Homo sapiens
uaggaaaucaggcagu

SEQ ID NO: 1504655 - RNA, 15 nt, Homo sapiens
uaggcagggauuuga

SEQ ID NO: 1504656 - RNA, 23 nt, Homo sapiens
uagggagagaguccguagguuua

SEQ ID NO: 1504657 - RNA, 15 nt, Homo sapiens
uagggaugacuguga

SEQ ID NO: 1504658 - RNA, 20 nt, Homo sapiens
uagguacuucacauugcaaa

SEQ ID NO: 1504659 - RNA, 19 nt, Homo sapiens
uagguccuggcuucuagau

SEQ ID NO: 1504660 - RNA, 17 nt, Homo sapiens
uaggugucuguuuccca

SEQ ID NO: 1504661 - RNA, 13 nt, Homo sapiens
uagguuaaaugca

SEQ ID NO: 1504662 - RNA, 14 nt, Homo sapiens
uagguuuaauuuca

SEQ ID NO: 1504663 - RNA, 13 nt, Homo sapiens
uagguuuguagua

SEQ ID NO: 1504664 - RNA, 13 nt, Homo sapiens
uaguacugggaau

SEQ ID NO: 1504665 - RNA, 13 nt, Homo sapiens
uagucacaaagac

SEQ ID NO: 1504666 - RNA, 17 nt, Homo sapiens
uagugauuuccuguaua

SEQ ID NO: 1504667 - RNA, 14 nt, Homo sapiens
uagugcacuagcau

SEQ ID NO: 1504668 - RNA, 20 nt, Homo sapiens
uagugccacccaccuuugcc

SEQ ID NO: 1504669 - RNA, 22 nt, Homo sapiens
uagugccacccaccuuugccac

SEQ ID NO: 1504670 - RNA, 16 nt, Homo sapiens
uaguuauuuacuugaa

SEQ ID NO: 1504671 - RNA, 18 nt, Homo sapiens
uaguucuaggguuucccu

SEQ ID NO: 1504672 - RNA, 22 nt, Homo sapiens
uaguuuauuuuguuacacuaaa

SEQ ID NO: 1504673 - RNA, 16 nt, Homo sapiens
uauaaauaugugaaaa

SEQ ID NO: 1504674 - RNA, 12 nt, Homo sapiens
uauacauuugau

SEQ ID NO: 1504675 - RNA, 13 nt, Homo sapiens
uauaccugggaag

SEQ ID NO: 1504676 - RNA, 15 nt, Homo sapiens
uauacuauacaacaa

SEQ ID NO: 1504677 - RNA, 15 nt, Homo sapiens
uauacuguacuuaau

SEQ ID NO: 1504678 - RNA, 14 nt, Homo sapiens
uauagagauaugca

SEQ ID NO: 1504679 - RNA, 17 nt, Homo sapiens
uauauagguugugcaaa

SEQ ID NO: 1504680 - RNA, 22 nt, Homo sapiens
uccaaggguaugggaagccaua

SEQ ID NO: 1504681 - RNA, 20 nt, Homo sapiens
uccaaguuccugcacuccag

SEQ ID NO: 1504682 - RNA, 19 nt, Homo sapiens
uccacaaaaacaacuuauu

SEQ ID NO: 1504683 - RNA, 15 nt, Homo sapiens
uccaccuuguuacac

SEQ ID NO: 1504684 - RNA, 23 nt, Homo sapiens
uccacucuuguucaaguaucuaa

SEQ ID NO: 1504685 - RNA, 17 nt, Homo sapiens
uccacugaggaugugag

SEQ ID NO: 1504686 - RNA, 19 nt, Homo sapiens
uccagaaaacaaaacugca

SEQ ID NO: 1504687 - RNA, 20 nt, Homo sapiens
uccagaaaacaaaacugcau

SEQ ID NO: 1504688 - RNA, 21 nt, Homo sapiens
uccagaaagaaggacacuugu

SEQ ID NO: 1504689 - RNA, 16 nt, Homo sapiens
uccagaauaugcauaa

SEQ ID NO: 1504690 - RNA, 14 nt, Homo sapiens
uccagaauccacaa

SEQ ID NO: 1504691 - RNA, 13 nt, Homo sapiens
uccagaucugcac

SEQ ID NO: 1504692 - RNA, 12 nt, Homo sapiens
uccagcauuugc

SEQ ID NO: 1504693 - RNA, 19 nt, Homo sapiens
uccagccgcugcacaucac

SEQ ID NO: 1504694 - RNA, 22 nt, Homo sapiens
uccaggaauaggcauuugccua

SEQ ID NO: 1504695 - RNA, 16 nt, Homo sapiens
uccaggaucuuugacu

SEQ ID NO: 1504696 - RNA, 19 nt, Homo sapiens
uccaguauucuugucaaaa

SEQ ID NO: 1504697 - RNA, 18 nt, Homo sapiens
uccaguuagcaacaaauc

SEQ ID NO: 1504698 - RNA, 19 nt, Homo sapiens
uccaguuguuacugaaguu

SEQ ID NO: 1504699 - RNA, 18 nt, Homo sapiens
uccaguuucccaccaccu

SEQ ID NO: 1504700 - RNA, 19 nt, Homo sapiens
uccauacagucaagauaca

SEQ ID NO: 1504701 - RNA, 13 nt, Homo sapiens
uccauagugcacu

SEQ ID NO: 1504702 - RNA, 14 nt, Homo sapiens
uccauagugcacua

SEQ ID NO: 1504703 - RNA, 17 nt, Homo sapiens
uccauccggcuccuguc

SEQ ID NO: 1504704 - RNA, 22 nt, Homo sapiens
uccauccggcuccugucauccc

SEQ ID NO: 1504705 - RNA, 22 nt, Homo sapiens
uccaugaaguuugaacuucaua

SEQ ID NO: 1504706 - RNA, 15 nt, Homo sapiens
uccauguuuguaaaa

SEQ ID NO: 1504707 - RNA, 20 nt, Homo sapiens
uccauucaugccaaagcaaa

SEQ ID NO: 1504708 - RNA, 17 nt, Homo sapiens
uccauucccaacucucu

SEQ ID NO: 1504709 - RNA, 21 nt, Homo sapiens
uccauuccuaggucacuugaa

SEQ ID NO: 1504710 - RNA, 19 nt, Homo sapiens
uccauuuggacaaaaugga

SEQ ID NO: 1504711 - RNA, 15 nt, Homo sapiens
uccauuuuacuucca

SEQ ID NO: 1504712 - RNA, 16 nt, Homo sapiens
uccauuuuacuuccau

SEQ ID NO: 1504713 - RNA, 19 nt, Homo sapiens
uccauuuuacuuccaugau

SEQ ID NO: 1504714 - RNA, 20 nt, Homo sapiens
uccauuuuacuuccaugaua

SEQ ID NO: 1504715 - RNA, 23 nt, Homo sapiens
ucccagaaauuagaaaccuuaau

SEQ ID NO: 1504716 - RNA, 20 nt, Homo sapiens
uccccaccuuccccagacuc

SEQ ID NO: 1504717 - RNA, 21 nt, Homo sapiens
uccccagcauugcaguauggu

SEQ ID NO: 1504718 - RNA, 20 nt, Homo sapiens
uccccuccguaggagcucac

SEQ ID NO: 1504719 - RNA, 17 nt, Homo sapiens
uccccuguggucuugga

SEQ ID NO: 1504720 - RNA, 17 nt, Homo sapiens
uccccuuccauucccaa

SEQ ID NO: 1504721 - RNA, 23 nt, Homo sapiens
ucccgauaucaaaaagacugugg

SEQ ID NO: 1504722 - RNA, 16 nt, Homo sapiens
ucccggguguguacac

SEQ ID NO: 1504723 - RNA, 14 nt, Homo sapiens
ucccugacacuguc

SEQ ID NO: 1504724 - RNA, 17 nt, Homo sapiens
ucccuguuaucugcuag

SEQ ID NO: 1504725 - RNA, 19 nt, Homo sapiens
ucccuguuaucugcuagau

SEQ ID NO: 1504726 - RNA, 14 nt, Homo sapiens
ucccuguuccucaa

SEQ ID NO: 1504727 - RNA, 15 nt, Homo sapiens
uccgaggcaaagaga

SEQ ID NO: 1504728 - RNA, 13 nt, Homo sapiens
uccgccauuccaa

SEQ ID NO: 1504729 - RNA, 20 nt, Homo sapiens
uccgccauuccaagucaaca

SEQ ID NO: 1504730 - RNA, 13 nt, Homo sapiens
uccgcucagccaa

SEQ ID NO: 1504731 - RNA, 19 nt, Homo sapiens
uccguggucagagugccac

SEQ ID NO: 1504732 - RNA, 19 nt, Homo sapiens
uccuaagaaagacaucaca

SEQ ID NO: 1504733 - RNA, 21 nt, Homo sapiens
uccuaagcuucaaaucagaag

SEQ ID NO: 1504734 - RNA, 20 nt, Homo sapiens
uccuaaugguuugggagcaa

SEQ ID NO: 1504735 - RNA, 21 nt, Homo sapiens
uccuacacccuuggacuugag

SEQ ID NO: 1504736 - RNA, 23 nt, Homo sapiens
uccuaucacugauaguguccaaa

SEQ ID NO: 1504737 - RNA, 19 nt, Homo sapiens
uccucaacaacaaaccaaa

SEQ ID NO: 1504738 - RNA, 19 nt, Homo sapiens
uccucagagcaggggccag

SEQ ID NO: 1504739 - RNA, 18 nt, Homo sapiens
uccucccagcguguguau

SEQ ID NO: 1504740 - RNA, 14 nt, Homo sapiens
uccuccuguguaca

SEQ ID NO: 1504741 - RNA, 13 nt, Homo sapiens
uccucguagccau

SEQ ID NO: 1504742 - RNA, 20 nt, Homo sapiens
uccucuaagccacucuucca

SEQ ID NO: 1504743 - RNA, 23 nt, Homo sapiens
uccucugccucccauucugacca

SEQ ID NO: 1504744 - RNA, 21 nt, Homo sapiens
uccucugggcagcgcuaucua

SEQ ID NO: 1504745 - RNA, 12 nt, Homo sapiens
uccugaguuucu

SEQ ID NO: 1504746 - RNA, 23 nt, Homo sapiens
uccugcaccgagagagauggaau

SEQ ID NO: 1504747 - RNA, 14 nt, Homo sapiens
uccugccucaggcu

SEQ ID NO: 1504748 - RNA, 22 nt, Homo sapiens
uccugcgggcgggcgucugcug

SEQ ID NO: 1504749 - RNA, 15 nt, Homo sapiens
uccuggaaccacuga

SEQ ID NO: 1504750 - RNA, 16 nt, Homo sapiens
uccuggcaugacacuc

SEQ ID NO: 1504751 - RNA, 18 nt, Homo sapiens
uccuggcaugacacucua

SEQ ID NO: 1504752 - RNA, 20 nt, Homo sapiens
uccugggagaaccucaggcu

SEQ ID NO: 1504753 - RNA, 20 nt, Homo sapiens
uccugggggcugcugcacug

SEQ ID NO: 1504754 - RNA, 23 nt, Homo sapiens
uccuuaauagccauaugcaauaa

SEQ ID NO: 1504755 - RNA, 13 nt, Homo sapiens
uccuuaauccuga

SEQ ID NO: 1504756 - RNA, 21 nt, Homo sapiens
uccuuauuguuuguaaacaac

SEQ ID NO: 1504757 - RNA, 19 nt, Homo sapiens
cccccacccaguccgccaa

SEQ ID NO: 1504758 - RNA, 15 nt, Homo sapiens
cccccaccuuuggga

SEQ ID NO: 1504759 - RNA, 14 nt, Homo sapiens
cccccuggagagaa

SEQ ID NO: 1504760 - RNA, 17 nt, Homo sapiens
ccccuccgugcuuuucu

SEQ ID NO: 1504761 - RNA, 13 nt, Homo sapiens
ccccucuccuccg

SEQ ID NO: 1504762 - RNA, 16 nt, Homo sapiens
cccgacuccucaaaag

SEQ ID NO: 1504763 - RNA, 22 nt, Homo sapiens
cccgccgccuccugcaccgaga

SEQ ID NO: 1504764 - RNA, 11 nt, Homo sapiens
cccucagggau

SEQ ID NO: 1504765 - RNA, 18 nt, Homo sapiens
cccuccuggagcauccca

SEQ ID NO: 1504766 - RNA, 19 nt, Homo sapiens
cccucuuucuacauucuca

SEQ ID NO: 1504767 - RNA, 15 nt, Homo sapiens
cccugauaagcaaau

SEQ ID NO: 1504768 - RNA, 24 nt, Homo sapiens
cccugcccgaccccaucucauuca

SEQ ID NO: 1504769 - RNA, 14 nt, Homo sapiens
cccuggagugcagu

SEQ ID NO: 1504770 - RNA, 20 nt, Homo sapiens
cccuggcugaccccaaagag

SEQ ID NO: 1504771 - RNA, 17 nt, Homo sapiens
cccugguccugcacugu

SEQ ID NO: 1504772 - RNA, 20 nt, Homo sapiens
cccugugcugacggaagcca

SEQ ID NO: 1504773 - RNA, 15 nt, Homo sapiens
cccuguuaagcaauu

SEQ ID NO: 1504774 - RNA, 21 nt, Homo sapiens
cccuuccacuuugaguaccaa

SEQ ID NO: 1504775 - RNA, 21 nt, Homo sapiens
cccuucgacacggaccugcuu

SEQ ID NO: 1504776 - RNA, 16 nt, Homo sapiens
cccuuuccccagugac

SEQ ID NO: 1504777 - RNA, 19 nt, Homo sapiens
cccuuuucuguauguccuu

SEQ ID NO: 1504778 - RNA, 22 nt, Homo sapiens
ccgcacuuggaaagguuucaag

SEQ ID NO: 1504779 - RNA, 22 nt, Homo sapiens
ccgccuguccugccucucugcu

SEQ ID NO: 1504780 - RNA, 13 nt, Homo sapiens
ccggaggggaccc

SEQ ID NO: 1504781 - RNA, 21 nt, Homo sapiens
ccguggugagguugugcugcc

SEQ ID NO: 1504782 - RNA, 15 nt, Homo sapiens
ccuaaaauacaaaca

SEQ ID NO: 1504783 - RNA, 13 nt, Homo sapiens
ccuaauacaacau

SEQ ID NO: 1504784 - RNA, 17 nt, Homo sapiens
ccuaauacaacauguag

SEQ ID NO: 1504785 - RNA, 23 nt, Homo sapiens
ccuaaugaaggaguucacuguaa

SEQ ID NO: 1504786 - RNA, 17 nt, Homo sapiens
ccuacgcagaugcuguc

SEQ ID NO: 1504787 - RNA, 19 nt, Homo sapiens
ccuacuuccucugcaaaaa

SEQ ID NO: 1504788 - RNA, 12 nt, Homo sapiens
ccuagacuguua

SEQ ID NO: 1504789 - RNA, 23 nt, Homo sapiens
ccuauacauuucuguucaucuua

SEQ ID NO: 1504790 - RNA, 12 nt, Homo sapiens
ccuaugauccca

SEQ ID NO: 1504791 - RNA, 22 nt, Homo sapiens
ccucaaaguuggggcaggcugg

SEQ ID NO: 1504792 - RNA, 18 nt, Homo sapiens
ccucaauaaauguugcuu

SEQ ID NO: 1504793 - RNA, 16 nt, Homo sapiens
ccucacuccaaaauag

SEQ ID NO: 1504794 - RNA, 17 nt, Homo sapiens
ccucagagccuuggaau

SEQ ID NO: 1504795 - RNA, 22 nt, Homo sapiens
ccucagggaucuugcauuccca

SEQ ID NO: 1504796 - RNA, 13 nt, Homo sapiens
ccucagggccaag

SEQ ID NO: 1504797 - RNA, 15 nt, Homo sapiens
ccucagguaguacug

SEQ ID NO: 1504798 - RNA, 18 nt, Homo sapiens
ccucagguaguacuggga

SEQ ID NO: 1504799 - RNA, 12 nt, Homo sapiens
ccucaguuauac

SEQ ID NO: 1504800 - RNA, 16 nt, Homo sapiens
ccuccaaaugccaacu

SEQ ID NO: 1504801 - RNA, 14 nt, Homo sapiens
ccuccacagcagug

SEQ ID NO: 1504802 - RNA, 12 nt, Homo sapiens
ccuccacuccac

SEQ ID NO: 1504803 - RNA, 12 nt, Homo sapiens
ccuccagccuuc

SEQ ID NO: 1504804 - RNA, 19 nt, Homo sapiens
ccuccagcuccaguuucca

SEQ ID NO: 1504805 - RNA, 20 nt, Homo sapiens
ccucccauaauugcuuugcc

SEQ ID NO: 1504806 - RNA, 12 nt, Homo sapiens
ccucccuggcau

SEQ ID NO: 1504807 - RNA, 16 nt, Homo sapiens
ccuccuugucacugaa

SEQ ID NO: 1504808 - RNA, 13 nt, Homo sapiens
ccucugaagggaa

SEQ ID NO: 1504809 - RNA, 20 nt, Homo sapiens
ccucugagaauuccaaggag

SEQ ID NO: 1504810 - RNA, 21 nt, Homo sapiens
ccucuuauaacuucugaagua

SEQ ID NO: 1504811 - RNA, 14 nt, Homo sapiens
ccucuuauuugcuc

SEQ ID NO: 1504812 - RNA, 22 nt, Homo sapiens
ccucuuucuacauucucaucua

SEQ ID NO: 1504813 - RNA, 16 nt, Homo sapiens
ccugacacugucugcu

SEQ ID NO: 1504814 - RNA, 19 nt, Homo sapiens
ccugaccugucaccgugag

SEQ ID NO: 1504815 - RNA, 15 nt, Homo sapiens
ccugacgacacugaa

SEQ ID NO: 1504816 - RNA, 20 nt, Homo sapiens
ccugacuccucuaagccacu

SEQ ID NO: 1504817 - RNA, 15 nt, Homo sapiens
ccugacugcacacag

SEQ ID NO: 1504818 - RNA, 19 nt, Homo sapiens
ccugagcaacagagugaga

SEQ ID NO: 1504819 - RNA, 18 nt, Homo sapiens
ccugagcaguguacacug

SEQ ID NO: 1504820 - RNA, 18 nt, Homo sapiens
ccugaggcuccugugcua

SEQ ID NO: 1504821 - RNA, 21 nt, Homo sapiens
ccugaggcuccugugcuacuu

SEQ ID NO: 1504822 - RNA, 13 nt, Homo sapiens
ccugaucaccucu

SEQ ID NO: 1504823 - RNA, 17 nt, Homo sapiens
ccugaugaaaaauaugu

SEQ ID NO: 1504824 - RNA, 12 nt, Homo sapiens
ccugauggugcu

SEQ ID NO: 1504825 - RNA, 23 nt, Homo sapiens
ccugauuagaugacucucagucc

SEQ ID NO: 1504826 - RNA, 23 nt, Homo sapiens
ccugcaccgagagagauggaaua

SEQ ID NO: 1504827 - RNA, 15 nt, Homo sapiens
ccugcacgccaccgc

SEQ ID NO: 1504828 - RNA, 12 nt, Homo sapiens
ccugcacuccag

SEQ ID NO: 1504829 - RNA, 10 nt, Homo sapiens
ccugccaagu

SEQ ID NO: 1504830 - RNA, 16 nt, Homo sapiens
ccugcccugcugccgc

SEQ ID NO: 1504831 - RNA, 18 nt, Homo sapiens
ccugccucaggcuucuga

SEQ ID NO: 1504832 - RNA, 16 nt, Homo sapiens
ccugccuccagcacuc

SEQ ID NO: 1504833 - RNA, 14 nt, Homo sapiens
ccugcgauuuugcc

SEQ ID NO: 1504834 - RNA, 21 nt, Homo sapiens
ccugcucuucuaccauuugaa

SEQ ID NO: 1504835 - RNA, 19 nt, Homo sapiens
ccugcugaaagcaguguau

SEQ ID NO: 1504836 - RNA, 19 nt, Homo sapiens
ccugcugcgucagaccagu

SEQ ID NO: 1504837 - RNA, 19 nt, Homo sapiens
ccugcugcugaccugauca

SEQ ID NO: 1504838 - RNA, 22 nt, Homo sapiens
ccuggaauuuucagucaucuca

SEQ ID NO: 1504839 - RNA, 14 nt, Homo sapiens
ccuggagaugauga

SEQ ID NO: 1504840 - RNA, 14 nt, Homo sapiens
ccuggagugcaguu

SEQ ID NO: 1504841 - RNA, 18 nt, Homo sapiens
ccuggcaugucagagcca

SEQ ID NO: 1504842 - RNA, 20 nt, Homo sapiens
ccugggauguagcggugaag

SEQ ID NO: 1504843 - RNA, 14 nt, Homo sapiens
ccugggccuggacc

SEQ ID NO: 1504844 - RNA, 23 nt, Homo sapiens
ccugggggcccauucugcaugcc

SEQ ID NO: 1504845 - RNA, 17 nt, Homo sapiens
ccugggggcugcugcac

SEQ ID NO: 1504846 - RNA, 13 nt, Homo sapiens
ccuggguucagcc

SEQ ID NO: 1504847 - RNA, 16 nt, Homo sapiens
ccuggucgucuauccc

SEQ ID NO: 1504848 - RNA, 20 nt, Homo sapiens
ccuguaaucccaacacuuuu

SEQ ID NO: 1504849 - RNA, 17 nt, Homo sapiens
ccugucucuagccacuu

SEQ ID NO: 1504850 - RNA, 18 nt, Homo sapiens
ccugugacuggcagcauu

SEQ ID NO: 1504851 - RNA, 17 nt, Homo sapiens
ccugugcccagcaugcc

SEQ ID NO: 1504852 - RNA, 16 nt, Homo sapiens
ccugugccuaacagca

SEQ ID NO: 1504853 - RNA, 17 nt, Homo sapiens
ccugugccuaacagcau

SEQ ID NO: 1504854 - RNA, 21 nt, Homo sapiens
ccugugggaagagaagggaag

SEQ ID NO: 1504855 - RNA, 19 nt, Homo sapiens
ccuguguauaaagccauua

SEQ ID NO: 1504856 - RNA, 14 nt, Homo sapiens
ccuguuaagcaauu

SEQ ID NO: 1504857 - RNA, 12 nt, Homo sapiens
ccuguuccucaa

SEQ ID NO: 1504858 - RNA, 16 nt, Homo sapiens
ccuuacucaccucucu

SEQ ID NO: 1504859 - RNA, 16 nt, Homo sapiens
ccuucaagugccaaac

SEQ ID NO: 1504860 - RNA, 20 nt, Homo sapiens
ccuuccacuuugaguaccaa

SEQ ID NO: 1504861 - RNA, 20 nt, Homo sapiens
ccuucccugacacugucugc

SEQ ID NO: 1504862 - RNA, 13 nt, Homo sapiens
ccuucucuccuuc

SEQ ID NO: 1504863 - RNA, 19 nt, Homo sapiens
ccuucuuucucuucccucc

SEQ ID NO: 1504864 - RNA, 14 nt, Homo sapiens
cacgccaacagccc

SEQ ID NO: 1504865 - RNA, 18 nt, Homo sapiens
cacgcuuuuugaaaaagc

SEQ ID NO: 1504866 - RNA, 19 nt, Homo sapiens
cacuaaacagacuauuuaa

SEQ ID NO: 1504867 - RNA, 17 nt, Homo sapiens
cacuaaacuucuuaacg

SEQ ID NO: 1504868 - RNA, 19 nt, Homo sapiens
cacuacacuccagccugag

SEQ ID NO: 1504869 - RNA, 14 nt, Homo sapiens
cacuacagauauca

SEQ ID NO: 1504870 - RNA, 21 nt, Homo sapiens
cacuaccuuuauagcucucau

SEQ ID NO: 1504871 - RNA, 22 nt, Homo sapiens
cacuagcauuuucuugaaccaa

SEQ ID NO: 1504872 - RNA, 20 nt, Homo sapiens
cacucaacaauaaagacuga

SEQ ID NO: 1504873 - RNA, 13 nt, Homo sapiens
cacucagggugau

SEQ ID NO: 1504874 - RNA, 23 nt, Homo sapiens
cacuccacccccuccagcuccag

SEQ ID NO: 1504875 - RNA, 16 nt, Homo sapiens
cacucccuggcucuca

SEQ ID NO: 1504876 - RNA, 18 nt, Homo sapiens
cacucuccccucccucuu

SEQ ID NO: 1504877 - RNA, 23 nt, Homo sapiens
cacucuccccucccucuuccuuc

SEQ ID NO: 1504878 - RNA, 21 nt, Homo sapiens
cacucuuauuucacuaaagaa

SEQ ID NO: 1504879 - RNA, 23 nt, Homo sapiens
cacugaaugccucaaugugacca

SEQ ID NO: 1504880 - RNA, 18 nt, Homo sapiens
cacugcgggagcucugua

SEQ ID NO: 1504881 - RNA, 14 nt, Homo sapiens
cacugcuccagugg

SEQ ID NO: 1504882 - RNA, 19 nt, Homo sapiens
cacuggcgcagacuucaca

SEQ ID NO: 1504883 - RNA, 15 nt, Homo sapiens
cacuguaaaugcagc

SEQ ID NO: 1504884 - RNA, 18 nt, Homo sapiens
cacuguaagacucauucc

SEQ ID NO: 1504885 - RNA, 21 nt, Homo sapiens
cacugucccggagcucaggcc

SEQ ID NO: 1504886 - RNA, 16 nt, Homo sapiens
cacugugaaaccacua

SEQ ID NO: 1504887 - RNA, 19 nt, Homo sapiens
cacuuaagcagagcagaac

SEQ ID NO: 1504888 - RNA, 12 nt, Homo sapiens
cacuuguaugcu

SEQ ID NO: 1504889 - RNA, 17 nt, Homo sapiens
cagaaaaaagaccaaua

SEQ ID NO: 1504890 - RNA, 18 nt, Homo sapiens
cagaaaacaaaacugcau

SEQ ID NO: 1504891 - RNA, 21 nt, Homo sapiens
cagaaaccaagucuacuucac

SEQ ID NO: 1504892 - RNA, 18 nt, Homo sapiens
cagaaaguggccaugcca

SEQ ID NO: 1504893 - RNA, 16 nt, Homo sapiens
cagaacuguuguuuac

SEQ ID NO: 1504894 - RNA, 23 nt, Homo sapiens
cagaagcaguugagucgucauca

SEQ ID NO: 1504895 - RNA, 19 nt, Homo sapiens
cagaauuaacuccauucca

SEQ ID NO: 1504896 - RNA, 13 nt, Homo sapiens
cagaauuacugua

SEQ ID NO: 1504897 - RNA, 16 nt, Homo sapiens
cagaauuuuaaagagc

SEQ ID NO: 1504898 - RNA, 16 nt, Homo sapiens
cagacacaacacaguu

SEQ ID NO: 1504899 - RNA, 18 nt, Homo sapiens
cagacuguaggauuugaa

SEQ ID NO: 1504900 - RNA, 14 nt, Homo sapiens
cagacuuuagcuua

SEQ ID NO: 1504901 - RNA, 15 nt, Homo sapiens
cagagaaauucugug

SEQ ID NO: 1504902 - RNA, 19 nt, Homo sapiens
cagagagcaaacauaggaa

SEQ ID NO: 1504903 - RNA, 19 nt, Homo sapiens
cagagagccuagaacaucc

SEQ ID NO: 1504904 - RNA, 18 nt, Homo sapiens
cagagcaagcacuggacu

SEQ ID NO: 1504905 - RNA, 13 nt, Homo sapiens
cagagcacagccc

SEQ ID NO: 1504906 - RNA, 13 nt, Homo sapiens
cagagcaggcuca

SEQ ID NO: 1504907 - RNA, 14 nt, Homo sapiens
cagagccaccaggg

SEQ ID NO: 1504908 - RNA, 16 nt, Homo sapiens
cagagccacuaccuuu

SEQ ID NO: 1504909 - RNA, 20 nt, Homo sapiens
cagagcgagagucugucuca

SEQ ID NO: 1504910 - RNA, 14 nt, Homo sapiens
cagaggaagcacau

SEQ ID NO: 1504911 - RNA, 21 nt, Homo sapiens
cagaggcaguaggaacccagc

SEQ ID NO: 1504912 - RNA, 18 nt, Homo sapiens
cagaggcuggcagugcug

SEQ ID NO: 1504913 - RNA, 15 nt, Homo sapiens
cagagggcccaggca

SEQ ID NO: 1504914 - RNA, 20 nt, Homo sapiens
cagaguaaauagcauucucu

SEQ ID NO: 1504915 - RNA, 11 nt, Homo sapiens
cagagugccac

SEQ ID NO: 1504916 - RNA, 13 nt, Homo sapiens
cagagugccacug

SEQ ID NO: 1504917 - RNA, 19 nt, Homo sapiens
cagauccucacaaccaccu

SEQ ID NO: 1504918 - RNA, 18 nt, Homo sapiens
cagaucuuccguggucag

SEQ ID NO: 1504919 - RNA, 17 nt, Homo sapiens
cagaugcaccacccaug

SEQ ID NO: 1504920 - RNA, 23 nt, Homo sapiens
cagauggcaauggguacuccagc

SEQ ID NO: 1504921 - RNA, 21 nt, Homo sapiens
cagauguaaaugccacaaaga

SEQ ID NO: 1504922 - RNA, 20 nt, Homo sapiens
cagcacucccucccagagaa

SEQ ID NO: 1504923 - RNA, 14 nt, Homo sapiens
cagcaucauugcau

SEQ ID NO: 1504924 - RNA, 18 nt, Homo sapiens
cagcaugcagaagugcau

SEQ ID NO: 1504925 - RNA, 16 nt, Homo sapiens
cagcauugacucugug

SEQ ID NO: 1504926 - RNA, 19 nt, Homo sapiens
cagcauugacucuguggcu

SEQ ID NO: 1504927 - RNA, 21 nt, Homo sapiens
cagcccagaaccacagaugug

SEQ ID NO: 1504928 - RNA, 14 nt, Homo sapiens
cagcccccacuuuc

SEQ ID NO: 1504929 - RNA, 16 nt, Homo sapiens
cagcccugacuggugc

SEQ ID NO: 1504930 - RNA, 18 nt, Homo sapiens
cagccucccaaguagcug

SEQ ID NO: 1504931 - RNA, 19 nt, Homo sapiens
cagccucccaaguagcugg

SEQ ID NO: 1504932 - RNA, 20 nt, Homo sapiens
cagccucccaaguagcugga

SEQ ID NO: 1504933 - RNA, 20 nt, Homo sapiens
cagccucccgaguagcugag

SEQ ID NO: 1504934 - RNA, 19 nt, Homo sapiens
cagccucccgaguagcugg

SEQ ID NO: 1504935 - RNA, 20 nt, Homo sapiens
cagccucccucugaccugca

SEQ ID NO: 1504936 - RNA, 23 nt, Homo sapiens
cagccugacugcacacagcuagg

SEQ ID NO: 1504937 - RNA, 16 nt, Homo sapiens
cagccuggguggcaga

SEQ ID NO: 1504938 - RNA, 14 nt, Homo sapiens
cagccuuccagugg

SEQ ID NO: 1504939 - RNA, 15 nt, Homo sapiens
cagccuucuuuucaa

SEQ ID NO: 1504940 - RNA, 15 nt, Homo sapiens
cagcgugcuuagccu

SEQ ID NO: 1504941 - RNA, 17 nt, Homo sapiens
cagcucuaauacauucc

SEQ ID NO: 1504942 - RNA, 13 nt, Homo sapiens
cagcugcaccugc

SEQ ID NO: 1504943 - RNA, 14 nt, Homo sapiens
cagcugcugaagag

SEQ ID NO: 1504944 - RNA, 18 nt, Homo sapiens
cagcugguggcuagguuu

SEQ ID NO: 1504945 - RNA, 23 nt, Homo sapiens
cagcugugaacauggacucuucc

SEQ ID NO: 1504946 - RNA, 18 nt, Homo sapiens
caggagaaucaauaaaaa

SEQ ID NO: 1504947 - RNA, 18 nt, Homo sapiens
caggaggcuuggaaagca

SEQ ID NO: 1504948 - RNA, 18 nt, Homo sapiens
caggaggguaacagaaga

SEQ ID NO: 1504949 - RNA, 20 nt, Homo sapiens
caggaguugacgcauccugc

SEQ ID NO: 1504950 - RNA, 24 nt, Homo sapiens
caggauagagacuggaacacuaga

SEQ ID NO: 1504951 - RNA, 22 nt, Homo sapiens
caggauccuauucucaccagga

SEQ ID NO: 1504952 - RNA, 15 nt, Homo sapiens
caggaucuguacaau

SEQ ID NO: 1504953 - RNA, 18 nt, Homo sapiens
caggaucuuugacugaaa

SEQ ID NO: 1504954 - RNA, 14 nt, Homo sapiens
caggcacgucugca

SEQ ID NO: 1504955 - RNA, 14 nt, Homo sapiens
caggccaccaggau

SEQ ID NO: 1504956 - RNA, 22 nt, Homo sapiens
caggcuguaagcauucugagcu

SEQ ID NO: 1504957 - RNA, 13 nt, Homo sapiens
cagggaauuucag

SEQ ID NO: 1504958 - RNA, 21 nt, Homo sapiens
cagggcccugcagaggggaaa

SEQ ID NO: 1504959 - RNA, 14 nt, Homo sapiens
cagggccucaaagu

SEQ ID NO: 1504960 - RNA, 22 nt, Homo sapiens
cagggggagcucccaagcugcc

SEQ ID NO: 1504961 - RNA, 14 nt, Homo sapiens
caggguugaucaca

SEQ ID NO: 1504962 - RNA, 20 nt, Homo sapiens
caggguugaucacacucugg

SEQ ID NO: 1504963 - RNA, 16 nt, Homo sapiens
cagguaguacugggaa

SEQ ID NO: 1504964 - RNA, 14 nt, Homo sapiens
caggucuagacuuu

SEQ ID NO: 1504965 - RNA, 20 nt, Homo sapiens
caggugccuggcuugcugug

SEQ ID NO: 1504966 - RNA, 13 nt, Homo sapiens
caguauuccaugg

SEQ ID NO: 1504967 - RNA, 19 nt, Homo sapiens
cagucaccgacaacaugcu

SEQ ID NO: 1504968 - RNA, 15 nt, Homo sapiens
cagucuggagaaggu

SEQ ID NO: 1504969 - RNA, 16 nt, Homo sapiens
cagucuuaccaaugac

SEQ ID NO: 1504970 - RNA, 14 nt, Homo sapiens
cagucuugccuagg

SEQ ID NO: 1504971 - RNA, 19 nt, Homo sapiens
cagugacaaguagggcaca

SEQ ID NO: 1504972 - RNA, 14 nt, Homo sapiens
cagugauccucaaa

SEQ ID NO: 1504973 - RNA, 19 nt, Homo sapiens
cagugcaagagacucuggc

SEQ ID NO: 1504974 - RNA, 14 nt, Homo sapiens
cagugcuaccucuc

SEQ ID NO: 1504975 - RNA, 14 nt, Homo sapiens
cagugcuggauuug

SEQ ID NO: 1504976 - RNA, 18 nt, Homo sapiens
caguggauuuuuuuuuaa

SEQ ID NO: 1504977 - RNA, 19 nt, Homo sapiens
cagugggccugguagcaca

SEQ ID NO: 1504978 - RNA, 22 nt, Homo sapiens
caguguguguuuaacauucaca

SEQ ID NO: 1504979 - RNA, 16 nt, Homo sapiens
caguucaguuccucuu

SEQ ID NO: 1504980 - RNA, 17 nt, Homo sapiens
ccauggagagguuuguc

SEQ ID NO: 1504981 - RNA, 16 nt, Homo sapiens
ccauuaggcaugccua

SEQ ID NO: 1504982 - RNA, 22 nt, Homo sapiens
ccauuccaagucaacacucuuc

SEQ ID NO: 1504983 - RNA, 22 nt, Homo sapiens
ccauuuuacuuccaugauacuu

SEQ ID NO: 1504984 - RNA, 18 nt, Homo sapiens
ccauuuuucuagacuguc

SEQ ID NO: 1504985 - RNA, 15 nt, Homo sapiens
cccaaaggcauccau

SEQ ID NO: 1504986 - RNA, 18 nt, Homo sapiens
cccaaccucauggucaug

SEQ ID NO: 1504987 - RNA, 18 nt, Homo sapiens
cccaaggugcugauguca

SEQ ID NO: 1504988 - RNA, 22 nt, Homo sapiens
cccacaaucuggcuuagugcca

SEQ ID NO: 1504989 - RNA, 13 nt, Homo sapiens
cccagaaccacag

SEQ ID NO: 1504990 - RNA, 19 nt, Homo sapiens
cccagaaccacagaugugu

SEQ ID NO: 1504991 - RNA, 14 nt, Homo sapiens
cccagacucagcuc

SEQ ID NO: 1504992 - RNA, 21 nt, Homo sapiens
cccagaggugacccaaugcuc

SEQ ID NO: 1504993 - RNA, 13 nt, Homo sapiens
cccagcacuuugg

SEQ ID NO: 1504994 - RNA, 16 nt, Homo sapiens
cccagcguguguaucc

SEQ ID NO: 1504995 - RNA, 17 nt, Homo sapiens
cccaggaaggacugugc

SEQ ID NO: 1504996 - RNA, 17 nt, Homo sapiens
cccaggcaaacuugcac

SEQ ID NO: 1504997 - RNA, 13 nt, Homo sapiens
cccagggcuaccc

SEQ ID NO: 1504998 - RNA, 15 nt, Homo sapiens
cccaguguguguuua

SEQ ID NO: 1504999 - RNA, 22 nt, Homo sapiens
cccaguguguguuuaacauuca

SEQ ID NO: 1505000 - RNA, 20 nt, Homo sapiens
cccaguuguugguuuggcca

SEQ ID NO: 1505001 - RNA, 18 nt, Homo sapiens
cccauaauugcuuugcca

SEQ ID NO: 1505002 - RNA, 19 nt, Homo sapiens
cccauagugcacacuugua

SEQ ID NO: 1505003 - RNA, 24 nt, Homo sapiens
ccccagagccacuaccuuugucca

SEQ ID NO: 1505004 - RNA, 15 nt, Homo sapiens
ccccagcccuuugca

SEQ ID NO: 1505005 - RNA, 22 nt, Homo sapiens
ccccaugcaccucagggccaag

SEQ ID NO: 1505006 - RNA, 14 nt, Homo sapiens
ugagcuucaguaua

SEQ ID NO: 1505007 - RNA, 18 nt, Homo sapiens
ugaggaugugagccugau

SEQ ID NO: 1505008 - RNA, 23 nt, Homo sapiens
ugaggcucuauugagccaagacc

SEQ ID NO: 1505009 - RNA, 20 nt, Homo sapiens
ugagggacuggaaccaggga

SEQ ID NO: 1505010 - RNA, 13 nt, Homo sapiens
ugagggcccuucc

SEQ ID NO: 1505011 - RNA, 20 nt, Homo sapiens
ugagucugcuuucacuguga

SEQ ID NO: 1505012 - RNA, 19 nt, Homo sapiens
ugaguuuaggcagcuucuc

SEQ ID NO: 1505013 - RNA, 14 nt, Homo sapiens
ugaguuuucaccug

SEQ ID NO: 1505014 - RNA, 15 nt, Homo sapiens
ugauaaagcaguauu

SEQ ID NO: 1505015 - RNA, 18 nt, Homo sapiens
ugauaaagcaguauuugg

SEQ ID NO: 1505016 - RNA, 22 nt, Homo sapiens
ugauaagcaggaaggauggcaa

SEQ ID NO: 1505017 - RNA, 23 nt, Homo sapiens
ugauaauaaauuagguaagauaa

SEQ ID NO: 1505018 - RNA, 14 nt, Homo sapiens
ugauauaugcaugu

SEQ ID NO: 1505019 - RNA, 15 nt, Homo sapiens
ugaucacacucuggg

SEQ ID NO: 1505020 - RNA, 19 nt, Homo sapiens
ugaugaaaaauaugugcuu

SEQ ID NO: 1505021 - RNA, 16 nt, Homo sapiens
ugauguacuacauuaa

SEQ ID NO: 1505022 - RNA, 22 nt, Homo sapiens
ugauguucauggguauaguuca

SEQ ID NO: 1505023 - RNA, 22 nt, Homo sapiens
ugauguuguuacugauucuccu

SEQ ID NO: 1505024 - RNA, 18 nt, Homo sapiens
ugauguuugaaguuacaa

SEQ ID NO: 1505025 - RNA, 23 nt, Homo sapiens
ugauuauacgacuuuuaagcaaa

SEQ ID NO: 1505026 - RNA, 16 nt, Homo sapiens
ugauuguauaauguga

SEQ ID NO: 1505027 - RNA, 16 nt, Homo sapiens
ugauuuaacacuaucc

SEQ ID NO: 1505028 - RNA, 15 nt, Homo sapiens
ugauuucagacugca

SEQ ID NO: 1505029 - RNA, 21 nt, Homo sapiens
ugauuuuuguaauaaaaggua

SEQ ID NO: 1505030 - RNA, 19 nt, Homo sapiens
ugcaaaaagauuuaacaaa

SEQ ID NO: 1505031 - RNA, 18 nt, Homo sapiens
ugcaaaccauagcacagg

SEQ ID NO: 1505032 - RNA, 12 nt, Homo sapiens
ugcaaaccucag

SEQ ID NO: 1505033 - RNA, 13 nt, Homo sapiens
ugcaagcacaaau

SEQ ID NO: 1505034 - RNA, 18 nt, Homo sapiens
ugcaauaaauuauggcuc

SEQ ID NO: 1505035 - RNA, 16 nt, Homo sapiens
ugcaauauuuacauuu

SEQ ID NO: 1505036 - RNA, 17 nt, Homo sapiens
ugcaauauuuacauuuu

SEQ ID NO: 1505037 - RNA, 12 nt, Homo sapiens
ugcacacuugua

SEQ ID NO: 1505038 - RNA, 15 nt, Homo sapiens
ugcacaucacaacau

SEQ ID NO: 1505039 - RNA, 16 nt, Homo sapiens
ugcaccucagggccaa

SEQ ID NO: 1505040 - RNA, 19 nt, Homo sapiens
ugcacuaauugacccaaaa

SEQ ID NO: 1505041 - RNA, 21 nt, Homo sapiens
ugcacugcccuccgcccuucc

SEQ ID NO: 1505042 - RNA, 16 nt, Homo sapiens
ugcacuguuugcccca

SEQ ID NO: 1505043 - RNA, 22 nt, Homo sapiens
ugcacuuaguagcuaugugauu

SEQ ID NO: 1505044 - RNA, 15 nt, Homo sapiens
ugcagaaacagugca

SEQ ID NO: 1505045 - RNA, 18 nt, Homo sapiens
ugcagaagcaguguuucu

SEQ ID NO: 1505046 - RNA, 15 nt, Homo sapiens
ugcagaauguugauu

SEQ ID NO: 1505047 - RNA, 23 nt, Homo sapiens
ugcagacaggaaucuuaaggugu

SEQ ID NO: 1505048 - RNA, 22 nt, Homo sapiens
ugcagaggggaaagacuuccau

SEQ ID NO: 1505049 - RNA, 17 nt, Homo sapiens
ugcagcgagcugagauc

SEQ ID NO: 1505050 - RNA, 18 nt, Homo sapiens
ugcagcgagcugagauca

SEQ ID NO: 1505051 - RNA, 14 nt, Homo sapiens
ugcagcuuguucag

SEQ ID NO: 1505052 - RNA, 22 nt, Homo sapiens
ugcaguuuccaaucccauagau

SEQ ID NO: 1505053 - RNA, 21 nt, Homo sapiens
ugcauaaaauagagugcauuu

SEQ ID NO: 1505054 - RNA, 17 nt, Homo sapiens
ugcaucaucagccuauu

SEQ ID NO: 1505055 - RNA, 14 nt, Homo sapiens
cuuaaacacuugca

SEQ ID NO: 1505056 - RNA, 15 nt, Homo sapiens
cuuaaacacuugcaa

SEQ ID NO: 1505057 - RNA, 21 nt, Homo sapiens
cuuaaaggcaccaucuaauag

SEQ ID NO: 1505058 - RNA, 17 nt, Homo sapiens
cuuaaauauuaugugaa

SEQ ID NO: 1505059 - RNA, 15 nt, Homo sapiens
cuuaaauauugaaua

SEQ ID NO: 1505060 - RNA, 16 nt, Homo sapiens
cuuaaucuccacuguu

SEQ ID NO: 1505061 - RNA, 14 nt, Homo sapiens
cuuaaugcucugau

SEQ ID NO: 1505062 - RNA, 19 nt, Homo sapiens
cuuaauggguacaauguac

SEQ ID NO: 1505063 - RNA, 21 nt, Homo sapiens
cuuacacuacauuagaacacu

SEQ ID NO: 1505064 - RNA, 18 nt, Homo sapiens
cuuagaauaaaauuguaa

SEQ ID NO: 1505065 - RNA, 23 nt, Homo sapiens
cuuagauaaucgagucuaccucu

SEQ ID NO: 1505066 - RNA, 18 nt, Homo sapiens
cuuagccuccugaccuga

SEQ ID NO: 1505067 - RNA, 21 nt, Homo sapiens
cuuagcuucuauuauagccac

SEQ ID NO: 1505068 - RNA, 13 nt, Homo sapiens
cuuaguggcuuuu

SEQ ID NO: 1505069 - RNA, 18 nt, Homo sapiens
cuuauaaagcauugcaac

SEQ ID NO: 1505070 - RNA, 18 nt, Homo sapiens
cuuauaacuucugaagua

SEQ ID NO: 1505071 - RNA, 17 nt, Homo sapiens
cuuauucccaacugcuc

SEQ ID NO: 1505072 - RNA, 21 nt, Homo sapiens
cuuauuguuuguaaacaacaa

SEQ ID NO: 1505073 - RNA, 13 nt, Homo sapiens
cuucaagugccaa

SEQ ID NO: 1505074 - RNA, 15 nt, Homo sapiens
cuucaagugccaaac

SEQ ID NO: 1505075 - RNA, 19 nt, Homo sapiens
cuucaaguuagcucaggag

SEQ ID NO: 1505076 - RNA, 14 nt, Homo sapiens
cuucaauacuucau

SEQ ID NO: 1505077 - RNA, 14 nt, Homo sapiens
cuucacaagugugu

SEQ ID NO: 1505078 - RNA, 16 nt, Homo sapiens
cuucagaagacacugc

SEQ ID NO: 1505079 - RNA, 20 nt, Homo sapiens
cuucagaagacacugcaaag

SEQ ID NO: 1505080 - RNA, 16 nt, Homo sapiens
cuucagauuuguguua

SEQ ID NO: 1505081 - RNA, 18 nt, Homo sapiens
cuucaggacuauuucacu

SEQ ID NO: 1505082 - RNA, 22 nt, Homo sapiens
cuucauaagguaauucauggca

SEQ ID NO: 1505083 - RNA, 20 nt, Homo sapiens
cuucaucuugacauguaaug

SEQ ID NO: 1505084 - RNA, 20 nt, Homo sapiens
cuucauuugggaaauucagc

SEQ ID NO: 1505085 - RNA, 18 nt, Homo sapiens
cuucccuguccaccucac

SEQ ID NO: 1505086 - RNA, 23 nt, Homo sapiens
cuuccguggucagagugccacug

SEQ ID NO: 1505087 - RNA, 15 nt, Homo sapiens
cuuccucacuccaaa

SEQ ID NO: 1505088 - RNA, 22 nt, Homo sapiens
cuuccugcaaagggaacugaag

SEQ ID NO: 1505089 - RNA, 23 nt, Homo sapiens
cuuccugguugagcuucugcuaa

SEQ ID NO: 1505090 - RNA, 20 nt, Homo sapiens
cuuccuuaauucacucccac

SEQ ID NO: 1505091 - RNA, 15 nt, Homo sapiens
cuucuccucccagcg

SEQ ID NO: 1505092 - RNA, 21 nt, Homo sapiens
cuucuccucccagcgugugua

SEQ ID NO: 1505093 - RNA, 20 nt, Homo sapiens
cuucuucaucuugacaugua

SEQ ID NO: 1505094 - RNA, 16 nt, Homo sapiens
cuucuuccuuaauuca

SEQ ID NO: 1505095 - RNA, 18 nt, Homo sapiens
cuucuuguguccugauga

SEQ ID NO: 1505096 - RNA, 16 nt, Homo sapiens
cuucuuuaucugugau

SEQ ID NO: 1505097 - RNA, 14 nt, Homo sapiens
cuucuuugaaguua

SEQ ID NO: 1505098 - RNA, 22 nt, Homo sapiens
cuucuuuucaccucuuuaacca

SEQ ID NO: 1505099 - RNA, 14 nt, Homo sapiens
cuugaaaccaaaga

SEQ ID NO: 1505100 - RNA, 12 nt, Homo sapiens
cuugaaaucuga

SEQ ID NO: 1505101 - RNA, 13 nt, Homo sapiens
cuugaaucaaagc

SEQ ID NO: 1505102 - RNA, 17 nt, Homo sapiens
cuugaaucaaagcaguu

SEQ ID NO: 1505103 - RNA, 14 nt, Homo sapiens
cuugagucugaggc

SEQ ID NO: 1505104 - RNA, 12 nt, Homo sapiens
cuugauucucuc

SEQ ID NO: 1505105 - RNA, 19 nt, Homo sapiens
cuugcaaccuaccuguuga

SEQ ID NO: 1505106 - RNA, 13 nt, Homo sapiens
cuugccagcauuu

SEQ ID NO: 1505107 - RNA, 15 nt, Homo sapiens
cuugccuaggcgauu

SEQ ID NO: 1505108 - RNA, 17 nt, Homo sapiens
cuugccuguaaucccag

SEQ ID NO: 1505109 - RNA, 20 nt, Homo sapiens
cuuggaaaaagaaagaaaca

SEQ ID NO: 1505110 - RNA, 22 nt, Homo sapiens
cuuggaaguguguggaaggcag

SEQ ID NO: 1505111 - RNA, 13 nt, Homo sapiens
cuuggacuugagg

SEQ ID NO: 1505112 - RNA, 14 nt, Homo sapiens
cuuggcaguauucc

SEQ ID NO: 1505113 - RNA, 18 nt, Homo sapiens
cuuggccuugguuuugau

SEQ ID NO: 1505114 - RNA, 21 nt, Homo sapiens
cuugggaaaggugguguuucu

SEQ ID NO: 1505115 - RNA, 19 nt, Homo sapiens
cuuggggaagcggguggug

SEQ ID NO: 1505116 - RNA, 13 nt, Homo sapiens
cuuguaaaaccaa

SEQ ID NO: 1505117 - RNA, 16 nt, Homo sapiens
cuuguauaguguaaaa

SEQ ID NO: 1505118 - RNA, 14 nt, Homo sapiens
cuuguauuuccaaa

SEQ ID NO: 1505119 - RNA, 15 nt, Homo sapiens
cuuguauuuucuuaa

SEQ ID NO: 1505120 - RNA, 21 nt, Homo sapiens
cuuguauuuucuuaauauaca

SEQ ID NO: 1505121 - RNA, 13 nt, Homo sapiens
gaccucccaaagu

SEQ ID NO: 1505122 - RNA, 18 nt, Homo sapiens
gaccuugaaggguaaaga

SEQ ID NO: 1505123 - RNA, 21 nt, Homo sapiens
gaccuuuuuuaggaagcaagc

SEQ ID NO: 1505124 - RNA, 19 nt, Homo sapiens
gacgggguuucaccguguu

SEQ ID NO: 1505125 - RNA, 12 nt, Homo sapiens
gacuaacagcug

SEQ ID NO: 1505126 - RNA, 19 nt, Homo sapiens
gacuaguugaacaucucac

SEQ ID NO: 1505127 - RNA, 17 nt, Homo sapiens
gacuauacauacuauaa

SEQ ID NO: 1505128 - RNA, 20 nt, Homo sapiens
gacuauggauaaacuaaaca

SEQ ID NO: 1505129 - RNA, 11 nt, Homo sapiens
gacuccauuuc

SEQ ID NO: 1505130 - RNA, 21 nt, Homo sapiens
gacuccgggcacggcuuccca

SEQ ID NO: 1505131 - RNA, 18 nt, Homo sapiens
gacucuaagcugugugca

SEQ ID NO: 1505132 - RNA, 23 nt, Homo sapiens
gacucugucacacuaaacuucuu

SEQ ID NO: 1505133 - RNA, 17 nt, Homo sapiens
gacucuuccugcaaagg

SEQ ID NO: 1505134 - RNA, 13 nt, Homo sapiens
gacugaguccucg

SEQ ID NO: 1505135 - RNA, 13 nt, Homo sapiens
gacugcuaccucu

SEQ ID NO: 1505136 - RNA, 18 nt, Homo sapiens
gacugcuaccucugagaa

SEQ ID NO: 1505137 - RNA, 15 nt, Homo sapiens
gacuggaaccaggga

SEQ ID NO: 1505138 - RNA, 22 nt, Homo sapiens
gacuggcagcauugacucugug

SEQ ID NO: 1505139 - RNA, 17 nt, Homo sapiens
gacuguaguuuaauacu

SEQ ID NO: 1505140 - RNA, 20 nt, Homo sapiens
gacuuccaucuagucacaaa

SEQ ID NO: 1505141 - RNA, 15 nt, Homo sapiens
gacuucucuugaauu

SEQ ID NO: 1505142 - RNA, 20 nt, Homo sapiens
gacuucugcugaaggacaga

SEQ ID NO: 1505143 - RNA, 16 nt, Homo sapiens
gacuugaggauuuuga

SEQ ID NO: 1505144 - RNA, 17 nt, Homo sapiens
gacuuggggaccagagg

SEQ ID NO: 1505145 - RNA, 20 nt, Homo sapiens
gacuuggucugauuucagga

SEQ ID NO: 1505146 - RNA, 17 nt, Homo sapiens
gagaaaagaaaccagag

SEQ ID NO: 1505147 - RNA, 20 nt, Homo sapiens
gagaaagggcggugaacucu

SEQ ID NO: 1505148 - RNA, 13 nt, Homo sapiens
gagaaaucuggcu

SEQ ID NO: 1505149 - RNA, 16 nt, Homo sapiens
gagaaaucuggcuucu

SEQ ID NO: 1505150 - RNA, 15 nt, Homo sapiens
gagaagauagggaac

SEQ ID NO: 1505151 - RNA, 14 nt, Homo sapiens
gagaagcucaccca

SEQ ID NO: 1505152 - RNA, 22 nt, Homo sapiens
gagaagguauuagcaaagcaaa

SEQ ID NO: 1505153 - RNA, 20 nt, Homo sapiens
gagacuuggggaccagaggu

SEQ ID NO: 1505154 - RNA, 22 nt, Homo sapiens
gagagaucauagcucacuguaa

SEQ ID NO: 1505155 - RNA, 13 nt, Homo sapiens
gagagauggaaua

SEQ ID NO: 1505156 - RNA, 20 nt, Homo sapiens
gagagauggaauaaagcccu

SEQ ID NO: 1505157 - RNA, 14 nt, Homo sapiens
gagaggaagcacac

SEQ ID NO: 1505158 - RNA, 20 nt, Homo sapiens
gagaggacugaugaaugaca

SEQ ID NO: 1505159 - RNA, 18 nt, Homo sapiens
gagauaaugucaaaauca

SEQ ID NO: 1505160 - RNA, 17 nt, Homo sapiens
gagauaccauggugcca

SEQ ID NO: 1505161 - RNA, 20 nt, Homo sapiens
gagauauggcuaguggcaau

SEQ ID NO: 1505162 - RNA, 20 nt, Homo sapiens
gagaucaugucauugaugaa

SEQ ID NO: 1505163 - RNA, 19 nt, Homo sapiens
gagauggggucuugcuaua

SEQ ID NO: 1505164 - RNA, 14 nt, Homo sapiens
gagcaacagaguga

SEQ ID NO: 1505165 - RNA, 19 nt, Homo sapiens
gagcagcuuuggaaacagg

SEQ ID NO: 1505166 - RNA, 17 nt, Homo sapiens
gagcaggggcaggguga

SEQ ID NO: 1505167 - RNA, 18 nt, Homo sapiens
gagcaguugcccucaggc

SEQ ID NO: 1505168 - RNA, 19 nt, Homo sapiens
gagcaucacagaaugugau

SEQ ID NO: 1505169 - RNA, 15 nt, Homo sapiens
gagcauuacgugagc

SEQ ID NO: 1505170 - RNA, 23 nt, Homo sapiens
gagccagcucucucuacccggcc

SEQ ID NO: 1505171 - RNA, 21 nt, Homo sapiens
gagcccauuucaauucucaaa

SEQ ID NO: 1505172 - RNA, 20 nt, Homo sapiens
gagccuggagggaugccacc

SEQ ID NO: 1505173 - RNA, 17 nt, Homo sapiens
gagccuuggaauucuau

SEQ ID NO: 1505174 - RNA, 23 nt, Homo sapiens
gagcuacugccgucagugcugug

SEQ ID NO: 1505175 - RNA, 22 nt, Homo sapiens
gagcugaacccauuuugaguga

SEQ ID NO: 1505176 - RNA, 17 nt, Homo sapiens
gagcuggcaaagguggc

SEQ ID NO: 1505177 - RNA, 23 nt, Homo sapiens
gagcuggcauuggucugcugacc

SEQ ID NO: 1505178 - RNA, 13 nt, Homo sapiens
gagcuucaguaua

SEQ ID NO: 1505179 - RNA, 18 nt, Homo sapiens
gagcuucaguauaaaaga

SEQ ID NO: 1505180 - RNA, 15 nt, Homo sapiens
gaggaugcaacaaau

SEQ ID NO: 1505181 - RNA, 19 nt, Homo sapiens
gaggcggagaguacaguga

SEQ ID NO: 1505182 - RNA, 12 nt, Homo sapiens
gaggcuccugug

SEQ ID NO: 1505183 - RNA, 15 nt, Homo sapiens
gaggcuccugugcua

SEQ ID NO: 1505184 - RNA, 21 nt, Homo sapiens
gaggggaaguccagccuacca

SEQ ID NO: 1505185 - RNA, 23 nt, Homo sapiens
gaggguuggguucaucugagcaa

SEQ ID NO: 1505186 - RNA, 16 nt, Homo sapiens
gaggugagaccaccuc

SEQ ID NO: 1505187 - RNA, 20 nt, Homo sapiens
gagguggagguugcagugag

SEQ ID NO: 1505188 - RNA, 16 nt, Homo sapiens
gagguugggcuuccau

SEQ ID NO: 1505189 - RNA, 22 nt, Homo sapiens
gagguuugucaacacaaagaca

SEQ ID NO: 1505190 - RNA, 17 nt, Homo sapiens
gaguacagacgucucaa

SEQ ID NO: 1505191 - RNA, 23 nt, Homo sapiens
gagucacccaugaagacaggaca

SEQ ID NO: 1505192 - RNA, 13 nt, Homo sapiens
gagucagauggca

SEQ ID NO: 1505193 - RNA, 20 nt, Homo sapiens
gaguccucguagccaucucu

SEQ ID NO: 1505194 - RNA, 23 nt, Homo sapiens
gagucugggcaaugaaaccaaag

SEQ ID NO: 1505195 - RNA, 17 nt, Homo sapiens
gagucuuguacacuuaa

SEQ ID NO: 1505196 - RNA, 22 nt, Homo sapiens
gagugacggucccacacuggug

SEQ ID NO: 1505197 - RNA, 15 nt, Homo sapiens
cacugccuauauaug

SEQ ID NO: 1505198 - RNA, 14 nt, Homo sapiens
cacuggaggucaca

SEQ ID NO: 1505199 - RNA, 15 nt, Homo sapiens
cacugugaagacaau

SEQ ID NO: 1505200 - RNA, 18 nt, Homo sapiens
cacuguuguacacagucu

SEQ ID NO: 1505201 - RNA, 18 nt, Homo sapiens
cacuuagcuaucagaaga

SEQ ID NO: 1505202 - RNA, 15 nt, Homo sapiens
cacuuaggaagaaau

SEQ ID NO: 1505203 - RNA, 21 nt, Homo sapiens
cacuugggcccaggaggucaa

SEQ ID NO: 1505204 - RNA, 19 nt, Homo sapiens
cagaaacagugcaaggaag

SEQ ID NO: 1505205 - RNA, 21 nt, Homo sapiens
cagaaagaaggacacuuguau

SEQ ID NO: 1505206 - RNA, 17 nt, Homo sapiens
cagaaagcuuuauaugu

SEQ ID NO: 1505207 - RNA, 20 nt, Homo sapiens
cagaaagcuuuauauguaau

SEQ ID NO: 1505208 - RNA, 12 nt, Homo sapiens
cagaaccacaga

SEQ ID NO: 1505209 - RNA, 18 nt, Homo sapiens
cagaacuguuguuuacuu

SEQ ID NO: 1505210 - RNA, 14 nt, Homo sapiens
cagaagacacugca

SEQ ID NO: 1505211 - RNA, 16 nt, Homo sapiens
cagaagacacugcaaa

SEQ ID NO: 1505212 - RNA, 13 nt, Homo sapiens
cagaagcacaaag

SEQ ID NO: 1505213 - RNA, 14 nt, Homo sapiens
cagaagcacaaagg

SEQ ID NO: 1505214 - RNA, 15 nt, Homo sapiens
cagaagugaccaaau

SEQ ID NO: 1505215 - RNA, 16 nt, Homo sapiens
cagaaugaaaauuaga

SEQ ID NO: 1505216 - RNA, 15 nt, Homo sapiens
cagacagauugcuga

SEQ ID NO: 1505217 - RNA, 14 nt, Homo sapiens
cagaccaguacugg

SEQ ID NO: 1505218 - RNA, 22 nt, Homo sapiens
cagaccccuuggcuuuugcuug

SEQ ID NO: 1505219 - RNA, 17 nt, Homo sapiens
cagacgucucaagacug

SEQ ID NO: 1505220 - RNA, 21 nt, Homo sapiens
cagacuauuuaacuugagggu

SEQ ID NO: 1505221 - RNA, 17 nt, Homo sapiens
cagagaaagaagagaca

SEQ ID NO: 1505222 - RNA, 19 nt, Homo sapiens
cagagacuuuguguuuaca

SEQ ID NO: 1505223 - RNA, 15 nt, Homo sapiens
cagagccacuaccuu

SEQ ID NO: 1505224 - RNA, 19 nt, Homo sapiens
cagagcugauggagaagga

SEQ ID NO: 1505225 - RNA, 21 nt, Homo sapiens
cagaggauuuaacugugaacc

SEQ ID NO: 1505226 - RNA, 20 nt, Homo sapiens
cagaggcacagagagaguca

SEQ ID NO: 1505227 - RNA, 20 nt, Homo sapiens
cagagggcguguuguuuuac

SEQ ID NO: 1505228 - RNA, 22 nt, Homo sapiens
cagagggguaggcagagccuuu

SEQ ID NO: 1505229 - RNA, 23 nt, Homo sapiens
cagagguaaaagugugagcagug

SEQ ID NO: 1505230 - RNA, 16 nt, Homo sapiens
cagagucaaauuugaa

SEQ ID NO: 1505231 - RNA, 19 nt, Homo sapiens
cagaguugauaaauuagau

SEQ ID NO: 1505232 - RNA, 21 nt, Homo sapiens
cagauacuucccauuuuggaa

SEQ ID NO: 1505233 - RNA, 17 nt, Homo sapiens
cagaugacucacuccau

SEQ ID NO: 1505234 - RNA, 18 nt, Homo sapiens
cagaugcaccacccaugg

SEQ ID NO: 1505235 - RNA, 16 nt, Homo sapiens
cagaugccuuccuguc

SEQ ID NO: 1505236 - RNA, 17 nt, Homo sapiens
cagauggaaagaaagca

SEQ ID NO: 1505237 - RNA, 17 nt, Homo sapiens
cagauguaaaugccaca

SEQ ID NO: 1505238 - RNA, 22 nt, Homo sapiens
cagaugugucugggagagccug

SEQ ID NO: 1505239 - RNA, 20 nt, Homo sapiens
cagcagugagcuucuauuaa

SEQ ID NO: 1505240 - RNA, 21 nt, Homo sapiens
cagcagugagcuucuauuaaa

SEQ ID NO: 1505241 - RNA, 16 nt, Homo sapiens
cagcaguguggucucu

SEQ ID NO: 1505242 - RNA, 22 nt, Homo sapiens
cagcagugugucaggugcugca

SEQ ID NO: 1505243 - RNA, 19 nt, Homo sapiens
cagcaugcagaagugcaug

SEQ ID NO: 1505244 - RNA, 12 nt, Homo sapiens
cagcauuugcca

SEQ ID NO: 1505245 - RNA, 17 nt, Homo sapiens
cagcauuugccauuccu

SEQ ID NO: 1505246 - RNA, 14 nt, Homo sapiens
cagccaacugcccc

SEQ ID NO: 1505247 - RNA, 16 nt, Homo sapiens
cagcccuauucauccc

SEQ ID NO: 1505248 - RNA, 13 nt, Homo sapiens
cagcccuccuacg

SEQ ID NO: 1505249 - RNA, 18 nt, Homo sapiens
cagccuccgccauuccaa

SEQ ID NO: 1505250 - RNA, 22 nt, Homo sapiens
cagccuggggggucguggcaga

SEQ ID NO: 1505251 - RNA, 21 nt, Homo sapiens
cagcgagcuaugaucgcgcca

SEQ ID NO: 1505252 - RNA, 13 nt, Homo sapiens
cagcgcgugcaca

SEQ ID NO: 1505253 - RNA, 13 nt, Homo sapiens
cagcguguguauc

SEQ ID NO: 1505254 - RNA, 22 nt, Homo sapiens
cagcguguguauccgacucuaa

SEQ ID NO: 1505255 - RNA, 19 nt, Homo sapiens
cagcuaauaaugaaguuau

SEQ ID NO: 1505256 - RNA, 19 nt, Homo sapiens
cagcuagaaauaagcccaa

SEQ ID NO: 1505257 - RNA, 14 nt, Homo sapiens
cagcugcaccugcc

SEQ ID NO: 1505258 - RNA, 15 nt, Homo sapiens
cagcugcaccugcca

SEQ ID NO: 1505259 - RNA, 21 nt, Homo sapiens
cagcuuuuucucucaggguuc

SEQ ID NO: 1505260 - RNA, 19 nt, Homo sapiens
caggaacacccgacuccuc

SEQ ID NO: 1505261 - RNA, 15 nt, Homo sapiens
caggaacucccagca

SEQ ID NO: 1505262 - RNA, 15 nt, Homo sapiens
caggaagagaaggag

SEQ ID NO: 1505263 - RNA, 16 nt, Homo sapiens
caggaaggacuaugaa

SEQ ID NO: 1505264 - RNA, 21 nt, Homo sapiens
caggaauaggcauuugccuaa

SEQ ID NO: 1505265 - RNA, 17 nt, Homo sapiens
caggacuuggucugauu

SEQ ID NO: 1505266 - RNA, 17 nt, Homo sapiens
caggagcauggggauaa

SEQ ID NO: 1505267 - RNA, 14 nt, Homo sapiens
caggagggugcagu

SEQ ID NO: 1505268 - RNA, 15 nt, Homo sapiens
caggagggugcagua

SEQ ID NO: 1505269 - RNA, 22 nt, Homo sapiens
caggaguuugaggcugcagcga

SEQ ID NO: 1505270 - RNA, 16 nt, Homo sapiens
caggaugccaaguggc

SEQ ID NO: 1505271 - RNA, 14 nt, Homo sapiens
caggcaaacuugca

SEQ ID NO: 1505272 - RNA, 13 nt, Homo sapiens
caggcagccccac

SEQ ID NO: 1505273 - RNA, 18 nt, Homo sapiens
caggcagcgauggucuca

SEQ ID NO: 1505274 - RNA, 14 nt, Homo sapiens
caggcccuggugag

SEQ ID NO: 1505275 - RNA, 19 nt, Homo sapiens
caggcucagacucuggguc

SEQ ID NO: 1505276 - RNA, 19 nt, Homo sapiens
caggcuguaagcauucuga

SEQ ID NO: 1505277 - RNA, 14 nt, Homo sapiens
caggcuuucucugg

SEQ ID NO: 1505278 - RNA, 12 nt, Homo sapiens
cagggaaacuca

SEQ ID NO: 1505279 - RNA, 14 nt, Homo sapiens
cagggaacccacag

SEQ ID NO: 1505280 - RNA, 22 nt, Homo sapiens
cagggaacccugcuugcacuuu

SEQ ID NO: 1505281 - RNA, 13 nt, Homo sapiens
cagggaagaaggu

SEQ ID NO: 1505282 - RNA, 19 nt, Homo sapiens
cagggagaccgagcgcuuu

SEQ ID NO: 1505283 - RNA, 13 nt, Homo sapiens
cagggcacugucu

SEQ ID NO: 1505284 - RNA, 15 nt, Homo sapiens
cagggugagugaaug

SEQ ID NO: 1505285 - RNA, 13 nt, Homo sapiens
cagguacuuguaa

SEQ ID NO: 1505286 - RNA, 18 nt, Homo sapiens
cagguaggggcacaguga

SEQ ID NO: 1505287 - RNA, 17 nt, Homo sapiens
augaggaaagacacaga

SEQ ID NO: 1505288 - RNA, 16 nt, Homo sapiens
augaguuaacugugaa

SEQ ID NO: 1505289 - RNA, 17 nt, Homo sapiens
augaguuuaucauguca

SEQ ID NO: 1505290 - RNA, 22 nt, Homo sapiens
augaucgcgccacuacacucca

SEQ ID NO: 1505291 - RNA, 16 nt, Homo sapiens
augaugaaacauucau

SEQ ID NO: 1505292 - RNA, 12 nt, Homo sapiens
augaugaugaug

SEQ ID NO: 1505293 - RNA, 14 nt, Homo sapiens
augaugguggauca

SEQ ID NO: 1505294 - RNA, 20 nt, Homo sapiens
augauuuuugucgaguuuac

SEQ ID NO: 1505295 - RNA, 13 nt, Homo sapiens
augcaagugagaa

SEQ ID NO: 1505296 - RNA, 11 nt, Homo sapiens
augcacacugu

SEQ ID NO: 1505297 - RNA, 22 nt, Homo sapiens
augcagcucaagagaucccaag

SEQ ID NO: 1505298 - RNA, 18 nt, Homo sapiens
augcaugcgcaggcucau

SEQ ID NO: 1505299 - RNA, 17 nt, Homo sapiens
augccaagaaaguauuu

SEQ ID NO: 1505300 - RNA, 21 nt, Homo sapiens
augccaaguggcccucagauu

SEQ ID NO: 1505301 - RNA, 22 nt, Homo sapiens
augccaaguggcccucagauua

SEQ ID NO: 1505302 - RNA, 22 nt, Homo sapiens
augccuuucuguaaccaaaaau

SEQ ID NO: 1505303 - RNA, 20 nt, Homo sapiens
augcuccuugaagaaucucu

SEQ ID NO: 1505304 - RNA, 15 nt, Homo sapiens
augcugcuucuccuc

SEQ ID NO: 1505305 - RNA, 16 nt, Homo sapiens
augcuucagugcugcu

SEQ ID NO: 1505306 - RNA, 15 nt, Homo sapiens
augcuuugcuucaaa

SEQ ID NO: 1505307 - RNA, 20 nt, Homo sapiens
auggaagauuagagguuugu

SEQ ID NO: 1505308 - RNA, 18 nt, Homo sapiens
auggaagguuagguuugu

SEQ ID NO: 1505309 - RNA, 15 nt, Homo sapiens
auggaauaaagcccu

SEQ ID NO: 1505310 - RNA, 14 nt, Homo sapiens
auggacucuucccc

SEQ ID NO: 1505311 - RNA, 18 nt, Homo sapiens
auggagaggggguacaau

SEQ ID NO: 1505312 - RNA, 11 nt, Homo sapiens
auggagugugc

SEQ ID NO: 1505313 - RNA, 15 nt, Homo sapiens
auggccacaaaggga

SEQ ID NO: 1505314 - RNA, 18 nt, Homo sapiens
auggccagugugauccca

SEQ ID NO: 1505315 - RNA, 15 nt, Homo sapiens
auggcuauauggcaa

SEQ ID NO: 1505316 - RNA, 15 nt, Homo sapiens
auggcuggggggcca

SEQ ID NO: 1505317 - RNA, 15 nt, Homo sapiens
augggguccagguca

SEQ ID NO: 1505318 - RNA, 13 nt, Homo sapiens
auggguacauucc

SEQ ID NO: 1505319 - RNA, 22 nt, Homo sapiens
augggucuggcugagcugaacc

SEQ ID NO: 1505320 - RNA, 20 nt, Homo sapiens
augguccugcagaaagcuuu

SEQ ID NO: 1505321 - RNA, 16 nt, Homo sapiens
auguaaaugccacaaa

SEQ ID NO: 1505322 - RNA, 22 nt, Homo sapiens
auguagcggugaagaguacaga

SEQ ID NO: 1505323 - RNA, 19 nt, Homo sapiens
auguagcuaaacauuguga

SEQ ID NO: 1505324 - RNA, 15 nt, Homo sapiens
auguaucuaccucac

SEQ ID NO: 1505325 - RNA, 11 nt, Homo sapiens
augucauuuga

SEQ ID NO: 1505326 - RNA, 20 nt, Homo sapiens
augugaaccauuaaccagau

SEQ ID NO: 1505327 - RNA, 16 nt, Homo sapiens
auguggcauggcagaa

SEQ ID NO: 1505328 - RNA, 16 nt, Homo sapiens
augugugucugaagac

SEQ ID NO: 1505329 - RNA, 22 nt, Homo sapiens
auguuaaaaaaauaagaagaau

SEQ ID NO: 1505330 - RNA, 23 nt, Homo sapiens
auguuaagcaaaggaaaccaaag

SEQ ID NO: 1505331 - RNA, 14 nt, Homo sapiens
auguucuagugauu

SEQ ID NO: 1505332 - RNA, 21 nt, Homo sapiens
auguuggaugaugaaacauuc

SEQ ID NO: 1505333 - RNA, 20 nt, Homo sapiens
auguuuacuuuucagggcau

SEQ ID NO: 1505334 - RNA, 15 nt, Homo sapiens
auuaaaaaccacuga

SEQ ID NO: 1505335 - RNA, 19 nt, Homo sapiens
auuaaccacuucugcgaua

SEQ ID NO: 1505336 - RNA, 17 nt, Homo sapiens
auuaaguaaaccaaaaa

SEQ ID NO: 1505337 - RNA, 14 nt, Homo sapiens
auuacagacaugag

SEQ ID NO: 1505338 - RNA, 17 nt, Homo sapiens
auuacuauaagaacuuu

SEQ ID NO: 1505339 - RNA, 14 nt, Homo sapiens
auuacugcauaaaa

SEQ ID NO: 1505340 - RNA, 15 nt, Homo sapiens
auuacuuacaaacug

SEQ ID NO: 1505341 - RNA, 20 nt, Homo sapiens
auuauagaguauacuaaaaa

SEQ ID NO: 1505342 - RNA, 19 nt, Homo sapiens
auuauauacuauguaugga

SEQ ID NO: 1505343 - RNA, 22 nt, Homo sapiens
auuauaugacaauccugaagaa

SEQ ID NO: 1505344 - RNA, 18 nt, Homo sapiens
auuaugugaaaucaaagc

SEQ ID NO: 1505345 - RNA, 19 nt, Homo sapiens
auuauguggaagaagcaaa

SEQ ID NO: 1505346 - RNA, 13 nt, Homo sapiens
auuauuauuacuc

SEQ ID NO: 1505347 - RNA, 18 nt, Homo sapiens
auuauuccuugcuuucau

SEQ ID NO: 1505348 - RNA, 15 nt, Homo sapiens
auuauuguauuacau

SEQ ID NO: 1505349 - RNA, 23 nt, Homo sapiens
auuauuuauugucggaagacuug

SEQ ID NO: 1505350 - RNA, 19 nt, Homo sapiens
auucaagaaacagaaguag

SEQ ID NO: 1505351 - RNA, 15 nt, Homo sapiens
auucaaggaucucaa

SEQ ID NO: 1505352 - RNA, 16 nt, Homo sapiens
auucaaugaucuuaga

SEQ ID NO: 1505353 - RNA, 20 nt, Homo sapiens
auucaggaugguuucuuuaa

SEQ ID NO: 1505354 - RNA, 13 nt, Homo sapiens
auuccacuggacu

SEQ ID NO: 1505355 - RNA, 15 nt, Homo sapiens
auuccagcauuugcc

SEQ ID NO: 1505356 - RNA, 16 nt, Homo sapiens
auuccaugggauguua

SEQ ID NO: 1505357 - RNA, 17 nt, Homo sapiens
auuccauuuuacuucca

SEQ ID NO: 1505358 - RNA, 19 nt, Homo sapiens
auuccauuuuacuuccaug

SEQ ID NO: 1505359 - RNA, 20 nt, Homo sapiens
auuccauuuuacuuccauga

SEQ ID NO: 1505360 - RNA, 22 nt, Homo sapiens
auuccauuuuacuuccaugaua

SEQ ID NO: 1505361 - RNA, 13 nt, Homo sapiens
auucccaagccau

SEQ ID NO: 1505362 - RNA, 14 nt, Homo sapiens
auucccaccaaggu

SEQ ID NO: 1505363 - RNA, 17 nt, Homo sapiens
auuccccucgugugacu

SEQ ID NO: 1505364 - RNA, 14 nt, Homo sapiens
auuccgucuuaaaa

SEQ ID NO: 1505365 - RNA, 18 nt, Homo sapiens
auuccuaggucacuugaa

SEQ ID NO: 1505366 - RNA, 13 nt, Homo sapiens
auuccugugauuu

SEQ ID NO: 1505367 - RNA, 17 nt, Homo sapiens
auucgugacaacaugcg

SEQ ID NO: 1505368 - RNA, 20 nt, Homo sapiens
auucuagccaaacuauucua

SEQ ID NO: 1505369 - RNA, 12 nt, Homo sapiens
auucucaccagg

SEQ ID NO: 1505370 - RNA, 14 nt, Homo sapiens
auucucaucuacuc

SEQ ID NO: 1505371 - RNA, 15 nt, Homo sapiens
auucuccugucagag

SEQ ID NO: 1505372 - RNA, 12 nt, Homo sapiens
auugaacuacuu

SEQ ID NO: 1505373 - RNA, 17 nt, Homo sapiens
auugaagaaaagcacuu

SEQ ID NO: 1505374 - RNA, 19 nt, Homo sapiens
auugaagcauguacaaauu

SEQ ID NO: 1505375 - RNA, 16 nt, Homo sapiens
auugaaugacaagcau

SEQ ID NO: 1505376 - RNA, 20 nt, Homo sapiens
auugaauuggauacaaggau

SEQ ID NO: 1505377 - RNA, 18 nt, Homo sapiens
auugacgcauauuuaacu

SEQ ID NO: 1505378 - RNA, 12 nt, Homo sapiens
auugcauuguga

SEQ ID NO: 1505379 - RNA, 15 nt, Homo sapiens
auugcauugugacua

SEQ ID NO: 1505380 - RNA, 15 nt, Homo sapiens
auugccugcagagag

SEQ ID NO: 1505381 - RNA, 18 nt, Homo sapiens
auuggagggaagacaggu

SEQ ID NO: 1505382 - RNA, 17 nt, Homo sapiens
auuggcuacuauggcaa

SEQ ID NO: 1505383 - RNA, 15 nt, Homo sapiens
auuguaaguaccccu

SEQ ID NO: 1505384 - RNA, 17 nt, Homo sapiens
auugucgcucagcaaua

SEQ ID NO: 1505385 - RNA, 18 nt, Homo sapiens
auuguggguaacgugaga

SEQ ID NO: 1505386 - RNA, 16 nt, Homo sapiens
auuguuuuauguucua

SEQ ID NO: 1505387 - RNA, 14 nt, Homo sapiens
auuuaacaaauaca

SEQ ID NO: 1505388 - RNA, 22 nt, Homo sapiens
agcuuuccuuuccuucuggcuc

SEQ ID NO: 1505389 - RNA, 18 nt, Homo sapiens
agcuuuugcaacaugguc

SEQ ID NO: 1505390 - RNA, 14 nt, Homo sapiens
agcuuuugcuucau

SEQ ID NO: 1505391 - RNA, 23 nt, Homo sapiens
aggaaaaaauaauauccauacag

SEQ ID NO: 1505392 - RNA, 19 nt, Homo sapiens
aggaaaaaugcugcuucuc

SEQ ID NO: 1505393 - RNA, 23 nt, Homo sapiens
aggaaagacaggcugagcuuucu

SEQ ID NO: 1505394 - RNA, 17 nt, Homo sapiens
aggaacccagcucucag

SEQ ID NO: 1505395 - RNA, 19 nt, Homo sapiens
aggaacuggcuccuuugcc

SEQ ID NO: 1505396 - RNA, 22 nt, Homo sapiens
aggagggcagagacuuuguguu

SEQ ID NO: 1505397 - RNA, 17 nt, Homo sapiens
aggagucagaaacuguu

SEQ ID NO: 1505398 - RNA, 13 nt, Homo sapiens
aggaucccuccau

SEQ ID NO: 1505399 - RNA, 13 nt, Homo sapiens
aggaucucugaaa

SEQ ID NO: 1505400 - RNA, 19 nt, Homo sapiens
aggaucucugaaacauauu

SEQ ID NO: 1505401 - RNA, 14 nt, Homo sapiens
aggaucuguacaau

SEQ ID NO: 1505402 - RNA, 15 nt, Homo sapiens
aggauggcaagcacg

SEQ ID NO: 1505403 - RNA, 15 nt, Homo sapiens
aggaugugagccuga

SEQ ID NO: 1505404 - RNA, 21 nt, Homo sapiens
aggauuaaugguccugugaug

SEQ ID NO: 1505405 - RNA, 14 nt, Homo sapiens
aggcaacugugagu

SEQ ID NO: 1505406 - RNA, 19 nt, Homo sapiens
aggcaccugcuggaaacca

SEQ ID NO: 1505407 - RNA, 19 nt, Homo sapiens
aggcacgcaccaccaugcc

SEQ ID NO: 1505408 - RNA, 16 nt, Homo sapiens
aggcacgucugcagaa

SEQ ID NO: 1505409 - RNA, 18 nt, Homo sapiens
aggcaggggaguagugga

SEQ ID NO: 1505410 - RNA, 14 nt, Homo sapiens
aggcauuugccuaa

SEQ ID NO: 1505411 - RNA, 14 nt, Homo sapiens
aggccacauugaca

SEQ ID NO: 1505412 - RNA, 20 nt, Homo sapiens
aggccagcugacuagaucuc

SEQ ID NO: 1505413 - RNA, 19 nt, Homo sapiens
aggcccaggucaacaucua

SEQ ID NO: 1505414 - RNA, 12 nt, Homo sapiens
aggccucacuca

SEQ ID NO: 1505415 - RNA, 16 nt, Homo sapiens
aggcgcgguggcucuu

SEQ ID NO: 1505416 - RNA, 15 nt, Homo sapiens
aggcggcuccagguc

SEQ ID NO: 1505417 - RNA, 14 nt, Homo sapiens
aggcggugcuugau

SEQ ID NO: 1505418 - RNA, 15 nt, Homo sapiens
aggcucccacugccc

SEQ ID NO: 1505419 - RNA, 19 nt, Homo sapiens
aggcuccugugcuacuuug

SEQ ID NO: 1505420 - RNA, 16 nt, Homo sapiens
aggcugagcuuucuag

SEQ ID NO: 1505421 - RNA, 19 nt, Homo sapiens
aggcugaggggaggaucac

SEQ ID NO: 1505422 - RNA, 21 nt, Homo sapiens
aggcugcccaaucugagcaaa

SEQ ID NO: 1505423 - RNA, 12 nt, Homo sapiens
aggcugguggga

SEQ ID NO: 1505424 - RNA, 16 nt, Homo sapiens
aggcuucuugcccaga

SEQ ID NO: 1505425 - RNA, 15 nt, Homo sapiens
agggaaaagauuucu

SEQ ID NO: 1505426 - RNA, 12 nt, Homo sapiens
agggaacacuca

SEQ ID NO: 1505427 - RNA, 23 nt, Homo sapiens
agggagccaucccuucccugucc

SEQ ID NO: 1505428 - RNA, 16 nt, Homo sapiens
agggagccgagaucac

SEQ ID NO: 1505429 - RNA, 12 nt, Homo sapiens
agggaugggaga

SEQ ID NO: 1505430 - RNA, 22 nt, Homo sapiens
agggcugccccuguagguugcu

SEQ ID NO: 1505431 - RNA, 16 nt, Homo sapiens
aggggacccagcuccu

SEQ ID NO: 1505432 - RNA, 16 nt, Homo sapiens
aggggcacagugaaug

SEQ ID NO: 1505433 - RNA, 14 nt, Homo sapiens
aggggcccacaggg

SEQ ID NO: 1505434 - RNA, 23 nt, Homo sapiens
aggggcuucagguccaggcugug

SEQ ID NO: 1505435 - RNA, 20 nt, Homo sapiens
agggggguugugaggccugg

SEQ ID NO: 1505436 - RNA, 12 nt, Homo sapiens
aggggguugugg

SEQ ID NO: 1505437 - RNA, 20 nt, Homo sapiens
aggggucguaccuugcuuua

SEQ ID NO: 1505438 - RNA, 15 nt, Homo sapiens
aggggugcugcuccu

SEQ ID NO: 1505439 - RNA, 22 nt, Homo sapiens
agggguugcgggggagcuggaa

SEQ ID NO: 1505440 - RNA, 18 nt, Homo sapiens
agggucuaaagagaacaa

SEQ ID NO: 1505441 - RNA, 23 nt, Homo sapiens
aggguuggguucaucugagcaag

SEQ ID NO: 1505442 - RNA, 16 nt, Homo sapiens
agguaaaaugccauga

SEQ ID NO: 1505443 - RNA, 15 nt, Homo sapiens
agguaguacugggaa

SEQ ID NO: 1505444 - RNA, 19 nt, Homo sapiens
aggucaccagccugacugc

SEQ ID NO: 1505445 - RNA, 15 nt, Homo sapiens
agguccugcauuucu

SEQ ID NO: 1505446 - RNA, 19 nt, Homo sapiens
aggucuucuuguguccuga

SEQ ID NO: 1505447 - RNA, 16 nt, Homo sapiens
aggugaauagcacagg

SEQ ID NO: 1505448 - RNA, 18 nt, Homo sapiens
agguggagguugcaguga

SEQ ID NO: 1505449 - RNA, 19 nt, Homo sapiens
agguggcaggaccaggacu

SEQ ID NO: 1505450 - RNA, 19 nt, Homo sapiens
aggugguuuuugguuacau

SEQ ID NO: 1505451 - RNA, 17 nt, Homo sapiens
agguguaauaagacuau

SEQ ID NO: 1505452 - RNA, 13 nt, Homo sapiens
agguugcagugag

SEQ ID NO: 1505453 - RNA, 20 nt, Homo sapiens
agguugugcugccuguggug

SEQ ID NO: 1505454 - RNA, 18 nt, Homo sapiens
agguuugucaacacaaag

SEQ ID NO: 1505455 - RNA, 18 nt, Homo sapiens
aguaaaaaauaacuauca

SEQ ID NO: 1505456 - RNA, 14 nt, Homo sapiens
aguaaaccaaaaag

SEQ ID NO: 1505457 - RNA, 17 nt, Homo sapiens
aguaaauagcauucucu

SEQ ID NO: 1505458 - RNA, 17 nt, Homo sapiens
aguaaaugguaucauuu

SEQ ID NO: 1505459 - RNA, 23 nt, Homo sapiens
aguaagaauguuaaaaagugaaa

SEQ ID NO: 1505460 - RNA, 16 nt, Homo sapiens
aguaauaugcucucau

SEQ ID NO: 1505461 - RNA, 13 nt, Homo sapiens
aguaauuguaagu

SEQ ID NO: 1505462 - RNA, 15 nt, Homo sapiens
aguacagacgucuca

SEQ ID NO: 1505463 - RNA, 22 nt, Homo sapiens
aguacagagaaauucuguggug

SEQ ID NO: 1505464 - RNA, 18 nt, Homo sapiens
aguacagugagccaagau

SEQ ID NO: 1505465 - RNA, 17 nt, Homo sapiens
aguaccaccaagggauc

SEQ ID NO: 1505466 - RNA, 22 nt, Homo sapiens
aguaccaccaagggaucugcca

SEQ ID NO: 1505467 - RNA, 19 nt, Homo sapiens
aguagcaaguucuagagaa

SEQ ID NO: 1505468 - RNA, 19 nt, Homo sapiens
aguagcggaucucacucag

SEQ ID NO: 1505469 - RNA, 17 nt, Homo sapiens
aguaguugacagugcua

SEQ ID NO: 1505470 - RNA, 21 nt, Homo sapiens
aguauauuuauagucacaaga

SEQ ID NO: 1505471 - RNA, 18 nt, Homo sapiens
aguauguccgaugguauc

SEQ ID NO: 1505472 - RNA, 13 nt, Homo sapiens
aguaugugaauau

SEQ ID NO: 1505473 - RNA, 16 nt, Homo sapiens
aguauucaugacuaug

SEQ ID NO: 1505474 - RNA, 22 nt, Homo sapiens
aguauucuaaagcuuucugaca

SEQ ID NO: 1505475 - RNA, 23 nt, Homo sapiens
aguauuuuauuugucugacaaac

SEQ ID NO: 1505476 - RNA, 15 nt, Homo sapiens
agucaacacucuucu

SEQ ID NO: 1505477 - RNA, 18 nt, Homo sapiens
agucaagaucaacauucc

SEQ ID NO: 1505478 - RNA, 16 nt, Homo sapiens
agucaaugaaaacuga

SEQ ID NO: 1505479 - RNA, 20 nt, Homo sapiens
agucaauuaaaggcuuucag

SEQ ID NO: 1505480 - RNA, 14 nt, Homo sapiens
agucaauuuuacaa

SEQ ID NO: 1505481 - RNA, 18 nt, Homo sapiens
agucaauuuuacaauuau

SEQ ID NO: 1505482 - RNA, 17 nt, Homo sapiens
agucagaacucuguguu

SEQ ID NO: 1505483 - RNA, 21 nt, Homo sapiens
agucagggcccagaguuggga

SEQ ID NO: 1505484 - RNA, 15 nt, Homo sapiens
agucaguaguauucu

SEQ ID NO: 1505485 - RNA, 15 nt, Homo sapiens
aguccaaccugccug

SEQ ID NO: 1505486 - RNA, 22 nt, Homo sapiens
aguccccuccguaggagcucac

SEQ ID NO: 1505487 - RNA, 19 nt, Homo sapiens
aguccucguagccaucucu

SEQ ID NO: 1505488 - RNA, 14 nt, Homo sapiens
aguccuuucaggaa

SEQ ID NO: 1505489 - RNA, 12 nt, Homo sapiens
agucuaccucuu

SEQ ID NO: 1505490 - RNA, 13 nt, Homo sapiens
agucugcuuucac

SEQ ID NO: 1505491 - RNA, 21 nt, Homo sapiens
agucugguugaauaaagcuua

SEQ ID NO: 1505492 - RNA, 17 nt, Homo sapiens
agucugugggagcucag

SEQ ID NO: 1505493 - RNA, 15 nt, Homo sapiens
agucuguuuacugca

SEQ ID NO: 1505494 - RNA, 16 nt, Homo sapiens
agucuuguacacuuaa

SEQ ID NO: 1505495 - RNA, 16 nt, Homo sapiens
agugacacaaauugaa

SEQ ID NO: 1505496 - RNA, 16 nt, Homo sapiens
agugacuuccugguga

SEQ ID NO: 1505497 - RNA, 16 nt, Homo sapiens
agugagcugagaucac

SEQ ID NO: 1505498 - RNA, 16 nt, Homo sapiens
agugaguuacagcgag

SEQ ID NO: 1505499 - RNA, 16 nt, Homo sapiens
acuacaggcucaugcc

SEQ ID NO: 1505500 - RNA, 18 nt, Homo sapiens
acuaccuuuauagcucau

SEQ ID NO: 1505501 - RNA, 19 nt, Homo sapiens
acuaccuuuauagcucuca

SEQ ID NO: 1505502 - RNA, 14 nt, Homo sapiens
acuacuuacaggug

SEQ ID NO: 1505503 - RNA, 20 nt, Homo sapiens
acuacuugccacacacuguu

SEQ ID NO: 1505504 - RNA, 15 nt, Homo sapiens
acuaggacucugagg

SEQ ID NO: 1505505 - RNA, 12 nt, Homo sapiens
acuaguaucucu

SEQ ID NO: 1505506 - RNA, 18 nt, Homo sapiens
acuaguaucucuggccuc

SEQ ID NO: 1505507 - RNA, 23 nt, Homo sapiens
acuagucauagaaauaccucauu

SEQ ID NO: 1505508 - RNA, 21 nt, Homo sapiens
acuaguugaacaucucacuuu

SEQ ID NO: 1505509 - RNA, 23 nt, Homo sapiens
acuaguugaacaucucacuuugc

SEQ ID NO: 1505510 - RNA, 17 nt, Homo sapiens
acuauaaugugaugauu

SEQ ID NO: 1505511 - RNA, 14 nt, Homo sapiens
acuauagcccaggu

SEQ ID NO: 1505512 - RNA, 13 nt, Homo sapiens
acuauccaaugaa

SEQ ID NO: 1505513 - RNA, 18 nt, Homo sapiens
acuaucugugaaguuaca

SEQ ID NO: 1505514 - RNA, 21 nt, Homo sapiens
acuaucuucacaaguguguaa

SEQ ID NO: 1505515 - RNA, 17 nt, Homo sapiens
acuauggguacauucca

SEQ ID NO: 1505516 - RNA, 12 nt, Homo sapiens
acuaugugaugu

SEQ ID NO: 1505517 - RNA, 16 nt, Homo sapiens
acuauucuauggccau

SEQ ID NO: 1505518 - RNA, 23 nt, Homo sapiens
acuauugaauuggauacaaggau

SEQ ID NO: 1505519 - RNA, 12 nt, Homo sapiens
acucaaacaauc

SEQ ID NO: 1505520 - RNA, 20 nt, Homo sapiens
acucaaacaaucaugaguca

SEQ ID NO: 1505521 - RNA, 13 nt, Homo sapiens
acucaacaauaaa

SEQ ID NO: 1505522 - RNA, 13 nt, Homo sapiens
acucaagccugag

SEQ ID NO: 1505523 - RNA, 18 nt, Homo sapiens
acucaucccuguuccuca

SEQ ID NO: 1505524 - RNA, 16 nt, Homo sapiens
acucccuccacuaccg

SEQ ID NO: 1505525 - RNA, 22 nt, Homo sapiens
acuccucaaaagcaaaugagau

SEQ ID NO: 1505526 - RNA, 23 nt, Homo sapiens
acucgaauaaaggaugggaccaa

SEQ ID NO: 1505527 - RNA, 17 nt, Homo sapiens
acucuaagcugugugca

SEQ ID NO: 1505528 - RNA, 19 nt, Homo sapiens
acucucuugccagcauuuu

SEQ ID NO: 1505529 - RNA, 14 nt, Homo sapiens
acucugacuuugag

SEQ ID NO: 1505530 - RNA, 19 nt, Homo sapiens
acucugccagccacaucca

SEQ ID NO: 1505531 - RNA, 15 nt, Homo sapiens
acucugucacacuaa

SEQ ID NO: 1505532 - RNA, 23 nt, Homo sapiens
acucugucacacuaaacuucuua

SEQ ID NO: 1505533 - RNA, 16 nt, Homo sapiens
acucuuauuucacuaa

SEQ ID NO: 1505534 - RNA, 19 nt, Homo sapiens
acugaauguuuauuccuug

SEQ ID NO: 1505535 - RNA, 15 nt, Homo sapiens
acugauuaacaaaua

SEQ ID NO: 1505536 - RNA, 16 nt, Homo sapiens
acugauuaacaaauaa

SEQ ID NO: 1505537 - RNA, 20 nt, Homo sapiens
acugccaugccucaagaaca

SEQ ID NO: 1505538 - RNA, 16 nt, Homo sapiens
acugcuuuguauccau

SEQ ID NO: 1505539 - RNA, 14 nt, Homo sapiens
acuggcagcauuga

SEQ ID NO: 1505540 - RNA, 15 nt, Homo sapiens
acuggugauuucuga

SEQ ID NO: 1505541 - RNA, 15 nt, Homo sapiens
acugugaaaccacua

SEQ ID NO: 1505542 - RNA, 19 nt, Homo sapiens
acuguggcccuucugucca

SEQ ID NO: 1505543 - RNA, 21 nt, Homo sapiens
acuguuggaaguucacuggag

SEQ ID NO: 1505544 - RNA, 15 nt, Homo sapiens
acuguuucuuaccuu

SEQ ID NO: 1505545 - RNA, 23 nt, Homo sapiens
acuguuuuugcuauuacaugugu

SEQ ID NO: 1505546 - RNA, 20 nt, Homo sapiens
acuuagaagcaucagaguug

SEQ ID NO: 1505547 - RNA, 14 nt, Homo sapiens
acuucacauugcaa

SEQ ID NO: 1505548 - RNA, 16 nt, Homo sapiens
acuucauaaauguuca

SEQ ID NO: 1505549 - RNA, 13 nt, Homo sapiens
acuuccacauuau

SEQ ID NO: 1505550 - RNA, 22 nt, Homo sapiens
acuuccacauuauacauuugau

SEQ ID NO: 1505551 - RNA, 12 nt, Homo sapiens
acuuccaugaua

SEQ ID NO: 1505552 - RNA, 17 nt, Homo sapiens
acuuccucugcaaaaag

SEQ ID NO: 1505553 - RNA, 22 nt, Homo sapiens
acuuccuugguuuggacacagu

SEQ ID NO: 1505554 - RNA, 13 nt, Homo sapiens
acuucucuugaau

SEQ ID NO: 1505555 - RNA, 14 nt, Homo sapiens
acuugaagccaaac

SEQ ID NO: 1505556 - RNA, 13 nt, Homo sapiens
acuuggcugcuca

SEQ ID NO: 1505557 - RNA, 18 nt, Homo sapiens
acuuguccuuuuguacca

SEQ ID NO: 1505558 - RNA, 20 nt, Homo sapiens
acuuguugcugauucaagaa

SEQ ID NO: 1505559 - RNA, 19 nt, Homo sapiens
acuuuauaaauucauaacu

SEQ ID NO: 1505560 - RNA, 19 nt, Homo sapiens
acuuucucuucauacuuuu

SEQ ID NO: 1505561 - RNA, 14 nt, Homo sapiens
acuuugaucucugc

SEQ ID NO: 1505562 - RNA, 17 nt, Homo sapiens
acuuugaucucugcuua

SEQ ID NO: 1505563 - RNA, 21 nt, Homo sapiens
acuuugccucugaaacuuaau

SEQ ID NO: 1505564 - RNA, 17 nt, Homo sapiens
acuuugguacauggcca

SEQ ID NO: 1505565 - RNA, 13 nt, Homo sapiens
acuuugguauucu

SEQ ID NO: 1505566 - RNA, 22 nt, Homo sapiens
acuuugguggccacauaagcca

SEQ ID NO: 1505567 - RNA, 17 nt, Homo sapiens
agaaaaaacuagagccu

SEQ ID NO: 1505568 - RNA, 16 nt, Homo sapiens
agaaaauuggauguuu

SEQ ID NO: 1505569 - RNA, 11 nt, Homo sapiens
agaaacaaagg

SEQ ID NO: 1505570 - RNA, 21 nt, Homo sapiens
agaaacacaaauguaaaauaa

SEQ ID NO: 1505571 - RNA, 20 nt, Homo sapiens
agaaacuaguaucucuggcc

SEQ ID NO: 1505572 - RNA, 13 nt, Homo sapiens
agaaacugugguc

SEQ ID NO: 1505573 - RNA, 21 nt, Homo sapiens
agaaagauuaaauaugaucac

SEQ ID NO: 1505574 - RNA, 15 nt, Homo sapiens
agaaagccuucauaa

SEQ ID NO: 1505575 - RNA, 12 nt, Homo sapiens
agaaaucugcca

SEQ ID NO: 1505576 - RNA, 23 nt, Homo sapiens
agaaaucuggcuucuggccagga

SEQ ID NO: 1505577 - RNA, 15 nt, Homo sapiens
agaacaaugcuauaa

SEQ ID NO: 1505578 - RNA, 20 nt, Homo sapiens
agaaccaaaaguuuuccuga

SEQ ID NO: 1505579 - RNA, 21 nt, Homo sapiens
agaaccacaagagaucagcag

SEQ ID NO: 1505580 - RNA, 15 nt, Homo sapiens
agaaccacuuggcug

SEQ ID NO: 1505581 - RNA, 18 nt, Homo sapiens
agaacccccacauuuacc

SEQ ID NO: 1505582 - RNA, 21 nt, Homo sapiens
agaaccucaaacuaggaggaa

SEQ ID NO: 1505583 - RNA, 12 nt, Homo sapiens
agaaccucaggc

SEQ ID NO: 1505584 - RNA, 19 nt, Homo sapiens
agaacugaggucacugggu

SEQ ID NO: 1505585 - RNA, 17 nt, Homo sapiens
agaacugccccaucucc

SEQ ID NO: 1505586 - RNA, 13 nt, Homo sapiens
agaagacacugca

SEQ ID NO: 1505587 - RNA, 14 nt, Homo sapiens
agaagagacaggag

SEQ ID NO: 1505588 - RNA, 21 nt, Homo sapiens
agaagaggagggaccuacuga

SEQ ID NO: 1505589 - RNA, 17 nt, Homo sapiens
agaagauuuugccacau

SEQ ID NO: 1505590 - RNA, 11 nt, Homo sapiens
agaagcacaaa

SEQ ID NO: 1505591 - RNA, 16 nt, Homo sapiens
agaagcagaaacuggc

SEQ ID NO: 1505592 - RNA, 13 nt, Homo sapiens
agaaggaaggcag

SEQ ID NO: 1505593 - RNA, 16 nt, Homo sapiens
agaaggauagccucag

SEQ ID NO: 1505594 - RNA, 22 nt, Homo sapiens
agaaggcaugaaauugucuagc

SEQ ID NO: 1505595 - RNA, 22 nt, Homo sapiens
agaagggaagcuuuguuugaaa

SEQ ID NO: 1505596 - RNA, 13 nt, Homo sapiens
agaaguuugcacu

SEQ ID NO: 1505597 - RNA, 17 nt, Homo sapiens
agaaguuuuguacagag

SEQ ID NO: 1505598 - RNA, 14 nt, Homo sapiens
agaaucgcuuaaac

SEQ ID NO: 1505599 - RNA, 20 nt, Homo sapiens
agaaugccgguuaaauucca

SEQ ID NO: 1505600 - RNA, 16 nt, Homo sapiens
agaauucacaccuuag

SEQ ID NO: 1505601 - RNA, 22 nt, Homo sapiens
agaauucugagauccagcacaa

SEQ ID NO: 1505602 - RNA, 14 nt, Homo sapiens
agaauuguaucauu

SEQ ID NO: 1505603 - RNA, 17 nt, Homo sapiens
agacaaguaaucacuaa

SEQ ID NO: 1505604 - RNA, 18 nt, Homo sapiens
agacagauuaccaaagaa

SEQ ID NO: 1505605 - RNA, 19 nt, Homo sapiens
agacaggaagguggugcuu

SEQ ID NO: 1505606 - RNA, 23 nt, Homo sapiens
agacauuucucuaacuccugcca

SEQ ID NO: 1505607 - RNA, 17 nt, Homo sapiens
agaccaauaggugcaaa

SEQ ID NO: 1505608 - RNA, 21 nt, Homo sapiens
agaccacaaaaauugacucaa

SEQ ID NO: 1505609 - RNA, 13 nt, Homo sapiens
agaccacauccac

SEQ ID NO: 1505610 - RNA, 13 nt, Homo sapiens
agaccaguacugg

SEQ ID NO: 1505611 - RNA, 20 nt, Homo sapiens
agacccaacuuucucacugc

SEQ ID NO: 1505612 - RNA, 16 nt, Homo sapiens
agaccugacaagcacu

SEQ ID NO: 1505613 - RNA, 19 nt, Homo sapiens
agaccugacaagcacugcu

SEQ ID NO: 1505614 - RNA, 20 nt, Homo sapiens
agacuaguugaacaucucac

SEQ ID NO: 1505615 - RNA, 17 nt, Homo sapiens
agacucacgcugacugc

SEQ ID NO: 1505616 - RNA, 23 nt, Homo sapiens
agacucauucccuagaucuuucu

SEQ ID NO: 1505617 - RNA, 19 nt, Homo sapiens
agacugcugggacuggcca

SEQ ID NO: 1505618 - RNA, 18 nt, Homo sapiens
agacuggauucgugacaa

SEQ ID NO: 1505619 - RNA, 17 nt, Homo sapiens
agacuuccaucuaguca

SEQ ID NO: 1505620 - RNA, 14 nt, Homo sapiens
uuauguuugcuaaa

SEQ ID NO: 1505621 - RNA, 19 nt, Homo sapiens
uuauucaggaugguuucuu

SEQ ID NO: 1505622 - RNA, 13 nt, Homo sapiens
uuauuccuugcuu

SEQ ID NO: 1505623 - RNA, 14 nt, Homo sapiens
uuauugugccucag

SEQ ID NO: 1505624 - RNA, 17 nt, Homo sapiens
uuauuuguacaguucag

SEQ ID NO: 1505625 - RNA, 21 nt, Homo sapiens
uucaaagcacauaugugccaa

SEQ ID NO: 1505626 - RNA, 19 nt, Homo sapiens
uucaaaugucaguucauaa

SEQ ID NO: 1505627 - RNA, 13 nt, Homo sapiens
uucaagcucucug

SEQ ID NO: 1505628 - RNA, 20 nt, Homo sapiens
uucaaggaaaaaugcugcuu

SEQ ID NO: 1505629 - RNA, 21 nt, Homo sapiens
uucaaggaaaaaugcugcuuc

SEQ ID NO: 1505630 - RNA, 15 nt, Homo sapiens
uucaagugccaaaca

SEQ ID NO: 1505631 - RNA, 10 nt, Homo sapiens
uucacauaaa

SEQ ID NO: 1505632 - RNA, 19 nt, Homo sapiens
uucacauacacucaaacaa

SEQ ID NO: 1505633 - RNA, 17 nt, Homo sapiens
uucacauuagaagacaa

SEQ ID NO: 1505634 - RNA, 13 nt, Homo sapiens
uucacauuuugcc

SEQ ID NO: 1505635 - RNA, 21 nt, Homo sapiens
uucacuaauaaacauuuggca

SEQ ID NO: 1505636 - RNA, 18 nt, Homo sapiens
uucacuguaagacucauu

SEQ ID NO: 1505637 - RNA, 16 nt, Homo sapiens
uucagaggaagcacau

SEQ ID NO: 1505638 - RNA, 12 nt, Homo sapiens
uucagaugugaa

SEQ ID NO: 1505639 - RNA, 13 nt, Homo sapiens
uucagcugggaag

SEQ ID NO: 1505640 - RNA, 18 nt, Homo sapiens
uucagggaauuucaggaa

SEQ ID NO: 1505641 - RNA, 18 nt, Homo sapiens
uucagguccaggcugugu

SEQ ID NO: 1505642 - RNA, 13 nt, Homo sapiens
uucagucuugccu

SEQ ID NO: 1505643 - RNA, 16 nt, Homo sapiens
uucauaagguaauuca

SEQ ID NO: 1505644 - RNA, 21 nt, Homo sapiens
uucauaagguaauucauggca

SEQ ID NO: 1505645 - RNA, 14 nt, Homo sapiens
uucaucacuaccuu

SEQ ID NO: 1505646 - RNA, 23 nt, Homo sapiens
uucauggaagccaccagugagau

SEQ ID NO: 1505647 - RNA, 15 nt, Homo sapiens
uuccagcauuugcca

SEQ ID NO: 1505648 - RNA, 18 nt, Homo sapiens
uuccaucccuacuuuuca

SEQ ID NO: 1505649 - RNA, 21 nt, Homo sapiens
uuccaucuccauccaagcaaa

SEQ ID NO: 1505650 - RNA, 15 nt, Homo sapiens
uuccaugaagaccac

SEQ ID NO: 1505651 - RNA, 14 nt, Homo sapiens
uuccaugaaguuug

SEQ ID NO: 1505652 - RNA, 17 nt, Homo sapiens
uuccauuuuacuuccau

SEQ ID NO: 1505653 - RNA, 13 nt, Homo sapiens
uucccaagccaug

SEQ ID NO: 1505654 - RNA, 16 nt, Homo sapiens
uucccaauacauacca

SEQ ID NO: 1505655 - RNA, 13 nt, Homo sapiens
uucccacauucau

SEQ ID NO: 1505656 - RNA, 22 nt, Homo sapiens
uucccacuggaggucacauuca

SEQ ID NO: 1505657 - RNA, 20 nt, Homo sapiens
uucccaguggucaaaccgca

SEQ ID NO: 1505658 - RNA, 18 nt, Homo sapiens
uuccccaggagcucucug

SEQ ID NO: 1505659 - RNA, 15 nt, Homo sapiens
uucccugacacuguc

SEQ ID NO: 1505660 - RNA, 12 nt, Homo sapiens
uuccuaacauaa

SEQ ID NO: 1505661 - RNA, 15 nt, Homo sapiens
uuccuacaaaaugga

SEQ ID NO: 1505662 - RNA, 23 nt, Homo sapiens
uuccuacacccuuggacuugagg

SEQ ID NO: 1505663 - RNA, 22 nt, Homo sapiens
uuccuaggucacuugaagccaa

SEQ ID NO: 1505664 - RNA, 20 nt, Homo sapiens
uuccuauuuggggcuugcau

SEQ ID NO: 1505665 - RNA, 18 nt, Homo sapiens
uuccuccuugucacugaa

SEQ ID NO: 1505666 - RNA, 22 nt, Homo sapiens
uuccucuauccuguacauuuca

SEQ ID NO: 1505667 - RNA, 18 nt, Homo sapiens
uuccucugggcagcgcua

SEQ ID NO: 1505668 - RNA, 12 nt, Homo sapiens
uuccucugucaa

SEQ ID NO: 1505669 - RNA, 13 nt, Homo sapiens
uuccugcacucca

SEQ ID NO: 1505670 - RNA, 17 nt, Homo sapiens
uuccugcacuccagaau

SEQ ID NO: 1505671 - RNA, 20 nt, Homo sapiens
uuccuucuuucucuucccuc

SEQ ID NO: 1505672 - RNA, 11 nt, Homo sapiens
uucgcuugcuu

SEQ ID NO: 1505673 - RNA, 18 nt, Homo sapiens
uucuaaguagauagaaag

SEQ ID NO: 1505674 - RNA, 20 nt, Homo sapiens
uucuaaguggggugcauccc

SEQ ID NO: 1505675 - RNA, 21 nt, Homo sapiens
uucuaauauuuuuagcucugu

SEQ ID NO: 1505676 - RNA, 17 nt, Homo sapiens
uucuccagauagcugaa

SEQ ID NO: 1505677 - RNA, 15 nt, Homo sapiens
uucuccucccagcgu

SEQ ID NO: 1505678 - RNA, 14 nt, Homo sapiens
uucuccugccucag

SEQ ID NO: 1505679 - RNA, 18 nt, Homo sapiens
uucuccuguagcacaaag

SEQ ID NO: 1505680 - RNA, 15 nt, Homo sapiens
uucucucguaacugg

SEQ ID NO: 1505681 - RNA, 14 nt, Homo sapiens
uucugaguucuggu

SEQ ID NO: 1505682 - RNA, 23 nt, Homo sapiens
uucugauuucacucagggugaua

SEQ ID NO: 1505683 - RNA, 23 nt, Homo sapiens
uucugcauaguggccuuguccaa

SEQ ID NO: 1505684 - RNA, 13 nt, Homo sapiens
uucugcugaagga

SEQ ID NO: 1505685 - RNA, 17 nt, Homo sapiens
uucuggaaguuucuggu

SEQ ID NO: 1505686 - RNA, 21 nt, Homo sapiens
uucugggccacucaggccagu

SEQ ID NO: 1505687 - RNA, 23 nt, Homo sapiens
uucuggucuucacugccaugccu

SEQ ID NO: 1505688 - RNA, 14 nt, Homo sapiens
uucuggugccauuu

SEQ ID NO: 1505689 - RNA, 15 nt, Homo sapiens
uucuguucaucuuaa

SEQ ID NO: 1505690 - RNA, 13 nt, Homo sapiens
uucuguugccaca

SEQ ID NO: 1505691 - RNA, 18 nt, Homo sapiens
uucuuaaucuccacuguu

SEQ ID NO: 1505692 - RNA, 13 nt, Homo sapiens
uucuucugccuca

SEQ ID NO: 1505693 - RNA, 22 nt, Homo sapiens
uucuucuucagaagacacugca

SEQ ID NO: 1505694 - RNA, 13 nt, Homo sapiens
uucuugaaccaau

SEQ ID NO: 1505695 - RNA, 21 nt, Homo sapiens
uucuuuaaaauguaaagccau

SEQ ID NO: 1505696 - RNA, 22 nt, Homo sapiens
uucuuuaaaauguaaagccaug

SEQ ID NO: 1505697 - RNA, 15 nt, Homo sapiens
uucuuucucuucccu

SEQ ID NO: 1505698 - RNA, 17 nt, Homo sapiens
uugaaaagauagggaag

SEQ ID NO: 1505699 - RNA, 13 nt, Homo sapiens
uugaaaccaaaga

SEQ ID NO: 1505700 - RNA, 18 nt, Homo sapiens
uugaaacccauuaggcau

SEQ ID NO: 1505701 - RNA, 14 nt, Homo sapiens
uugaaacugaaugu

SEQ ID NO: 1505702 - RNA, 16 nt, Homo sapiens
uaggacucugaggcuc

SEQ ID NO: 1505703 - RNA, 15 nt, Homo sapiens
uaggccacauugaca

SEQ ID NO: 1505704 - RNA, 14 nt, Homo sapiens
uagggagaaaccaa

SEQ ID NO: 1505705 - RNA, 17 nt, Homo sapiens
uagggcagucaguagua

SEQ ID NO: 1505706 - RNA, 16 nt, Homo sapiens
uaggggaaguaugugu

SEQ ID NO: 1505707 - RNA, 17 nt, Homo sapiens
uaggguccuggcccucu

SEQ ID NO: 1505708 - RNA, 13 nt, Homo sapiens
uaggugcaaaaau

SEQ ID NO: 1505709 - RNA, 22 nt, Homo sapiens
uaggugccaggcuguaagcauu

SEQ ID NO: 1505710 - RNA, 19 nt, Homo sapiens
uaggugggagagagugcau

SEQ ID NO: 1505711 - RNA, 14 nt, Homo sapiens
uagguugugcaaau

SEQ ID NO: 1505712 - RNA, 22 nt, Homo sapiens
uagguuugucaacacaaagaca

SEQ ID NO: 1505713 - RNA, 23 nt, Homo sapiens
uagguuugucaacacaaagacau

SEQ ID NO: 1505714 - RNA, 22 nt, Homo sapiens
uaguaaagacaggguuucacca

SEQ ID NO: 1505715 - RNA, 16 nt, Homo sapiens
uaguaacauagacaaa

SEQ ID NO: 1505716 - RNA, 20 nt, Homo sapiens
uaguaauugucaauaccccu

SEQ ID NO: 1505717 - RNA, 12 nt, Homo sapiens
uaguauucauga

SEQ ID NO: 1505718 - RNA, 17 nt, Homo sapiens
uagugacuuccugguga

SEQ ID NO: 1505719 - RNA, 16 nt, Homo sapiens
uagugcacacuuguau

SEQ ID NO: 1505720 - RNA, 21 nt, Homo sapiens
uagugccacccaccuuugcca

SEQ ID NO: 1505721 - RNA, 22 nt, Homo sapiens
uaguggcuuuuuuccuccugug

SEQ ID NO: 1505722 - RNA, 23 nt, Homo sapiens
uaguuaaguauuuacagauguua

SEQ ID NO: 1505723 - RNA, 19 nt, Homo sapiens
uaguucagaggaagcacau

SEQ ID NO: 1505724 - RNA, 14 nt, Homo sapiens
uaguucaugucugc

SEQ ID NO: 1505725 - RNA, 22 nt, Homo sapiens
uaguuuacagaauggaaccaaa

SEQ ID NO: 1505726 - RNA, 15 nt, Homo sapiens
uauaaaauaggcuua

SEQ ID NO: 1505727 - RNA, 13 nt, Homo sapiens
uauaaacauuggu

SEQ ID NO: 1505728 - RNA, 23 nt, Homo sapiens
uauaaacauugguauauuuccau

SEQ ID NO: 1505729 - RNA, 13 nt, Homo sapiens
uauaaauauguga

SEQ ID NO: 1505730 - RNA, 21 nt, Homo sapiens
uauaaugugauuuuuuuuaga

SEQ ID NO: 1505731 - RNA, 16 nt, Homo sapiens
uauacugcuuggagcu

SEQ ID NO: 1505732 - RNA, 16 nt, Homo sapiens
uauagccucaacaaca

SEQ ID NO: 1505733 - RNA, 20 nt, Homo sapiens
uauaggaaacauaauuuuga

SEQ ID NO: 1505734 - RNA, 17 nt, Homo sapiens
uauauaguagcauuuca

SEQ ID NO: 1505735 - RNA, 19 nt, Homo sapiens
uauauauaguagcauuuca

SEQ ID NO: 1505736 - RNA, 23 nt, Homo sapiens
uauaugaguaaguuacuacuuac

SEQ ID NO: 1505737 - RNA, 23 nt, Homo sapiens
uauauuggucauugccuugccaa

SEQ ID NO: 1505738 - RNA, 18 nt, Homo sapiens
uauauuuauauauaucca

SEQ ID NO: 1505739 - RNA, 13 nt, Homo sapiens
uaucaacuuccua

SEQ ID NO: 1505740 - RNA, 15 nt, Homo sapiens
uaucaauuacagucc

SEQ ID NO: 1505741 - RNA, 17 nt, Homo sapiens
uaucacaaacuuaacau

SEQ ID NO: 1505742 - RNA, 15 nt, Homo sapiens
uaucaccaugauuua

SEQ ID NO: 1505743 - RNA, 22 nt, Homo sapiens
uaucauuuuuuuaacacauaac

SEQ ID NO: 1505744 - RNA, 19 nt, Homo sapiens
uaucucggaccuuucagcu

SEQ ID NO: 1505745 - RNA, 17 nt, Homo sapiens
uaucucuugcugggaac

SEQ ID NO: 1505746 - RNA, 19 nt, Homo sapiens
uaugaagucccucuauguc

SEQ ID NO: 1505747 - RNA, 12 nt, Homo sapiens
uaugcaagcaca

SEQ ID NO: 1505748 - RNA, 13 nt, Homo sapiens
uaugcaagcacaa

SEQ ID NO: 1505749 - RNA, 20 nt, Homo sapiens
uaugcaauauaucaauguaa

SEQ ID NO: 1505750 - RNA, 16 nt, Homo sapiens
uauguaaaguauguaa

SEQ ID NO: 1505751 - RNA, 17 nt, Homo sapiens
uauguaugaaggccaca

SEQ ID NO: 1505752 - RNA, 23 nt, Homo sapiens
uauguauggaugaaagcaaucug

SEQ ID NO: 1505753 - RNA, 23 nt, Homo sapiens
uaugucugugugccccuccugcc

SEQ ID NO: 1505754 - RNA, 10 nt, Homo sapiens
uaugugaaaa

SEQ ID NO: 1505755 - RNA, 16 nt, Homo sapiens
uaugugcuucacauaa

SEQ ID NO: 1505756 - RNA, 20 nt, Homo sapiens
uauguggacguaaucuccac

SEQ ID NO: 1505757 - RNA, 16 nt, Homo sapiens
uauuaacaauuaggca

SEQ ID NO: 1505758 - RNA, 13 nt, Homo sapiens
uauuaccaaaaaa

SEQ ID NO: 1505759 - RNA, 18 nt, Homo sapiens
uauuacucagauuccaca

SEQ ID NO: 1505760 - RNA, 14 nt, Homo sapiens
uauuagaaugcaug

SEQ ID NO: 1505761 - RNA, 14 nt, Homo sapiens
uauuaugucucaaa

SEQ ID NO: 1505762 - RNA, 17 nt, Homo sapiens
uauucaauaaagcugcu

SEQ ID NO: 1505763 - RNA, 23 nt, Homo sapiens
uauucagauauaaaacaguuuug

SEQ ID NO: 1505764 - RNA, 15 nt, Homo sapiens
uauucauucauucau

SEQ ID NO: 1505765 - RNA, 21 nt, Homo sapiens
uauuccacuggcgcaucauau

SEQ ID NO: 1505766 - RNA, 16 nt, Homo sapiens
uauucccaacugcucu

SEQ ID NO: 1505767 - RNA, 23 nt, Homo sapiens
uauuccgggugccauucccacua

SEQ ID NO: 1505768 - RNA, 23 nt, Homo sapiens
uauuccuaucaguauaauacuaa

SEQ ID NO: 1505769 - RNA, 12 nt, Homo sapiens
uauuccuaucug

SEQ ID NO: 1505770 - RNA, 15 nt, Homo sapiens
uauucuaaagcuuuc

SEQ ID NO: 1505771 - RNA, 12 nt, Homo sapiens
uauugcaagaca

SEQ ID NO: 1505772 - RNA, 20 nt, Homo sapiens
uauuggaccagaaguccuau

SEQ ID NO: 1505773 - RNA, 20 nt, Homo sapiens
uauuggucauugccuugcca

SEQ ID NO: 1505774 - RNA, 15 nt, Homo sapiens
uauuguauaaacuau

SEQ ID NO: 1505775 - RNA, 15 nt, Homo sapiens
uauuguauuacauuu

SEQ ID NO: 1505776 - RNA, 13 nt, Homo sapiens
uauugugccucag

SEQ ID NO: 1505777 - RNA, 16 nt, Homo sapiens
uauuuaguucuugagu

SEQ ID NO: 1505778 - RNA, 16 nt, Homo sapiens
uauuuauacuuugcaa

SEQ ID NO: 1505779 - RNA, 19 nt, Homo sapiens
uauuuccugcuacacaaaa

SEQ ID NO: 1505780 - RNA, 13 nt, Homo sapiens
uauuugaauauca

SEQ ID NO: 1505781 - RNA, 15 nt, Homo sapiens
uauuuuaagcauucu

SEQ ID NO: 1505782 - RNA, 13 nt, Homo sapiens
uauuuucacauga

SEQ ID NO: 1505783 - RNA, 21 nt, Homo sapiens
uauuuucagaugugaaccauu

SEQ ID NO: 1505784 - RNA, 20 nt, Homo sapiens
uauuuuccucugaagggaaa

SEQ ID NO: 1505785 - RNA, 18 nt, Homo sapiens
uauuuuuuuaagcuguaa

SEQ ID NO: 1505786 - RNA, 21 nt, Homo sapiens
ucaaaagacagcacuacagau

SEQ ID NO: 1505787 - RNA, 19 nt, Homo sapiens
ucaaaaguaaugcuucaau

SEQ ID NO: 1505788 - RNA, 20 nt, Homo sapiens
ucaaaauggacguacugguu

SEQ ID NO: 1505789 - RNA, 20 nt, Homo sapiens
ucaaaauguuguccuuuccc

SEQ ID NO: 1505790 - RNA, 20 nt, Homo sapiens
ucaaacuccuggacucaugc

SEQ ID NO: 1505791 - RNA, 22 nt, Homo sapiens
ucaaaugucaguucauaauaua

SEQ ID NO: 1505792 - RNA, 12 nt, Homo sapiens
ucaacacaaaga

SEQ ID NO: 1505793 - RNA, 19 nt, Homo sapiens
ucaacacaaagacacagga

SEQ ID NO: 1505794 - RNA, 20 nt, Homo sapiens
ucaacacaaagacacaggaa

SEQ ID NO: 1505795 - RNA, 18 nt, Homo sapiens
ucaacacaaagacaugga

SEQ ID NO: 1505796 - RNA, 17 nt, Homo sapiens
ucaacagugaagacaga

SEQ ID NO: 1505797 - RNA, 18 nt, Homo sapiens
ucaagaagucugaagcga

SEQ ID NO: 1505798 - RNA, 20 nt, Homo sapiens
ucaagacauaaguaaaugag

SEQ ID NO: 1505799 - RNA, 12 nt, Homo sapiens
ucaagacuugau

SEQ ID NO: 1505800 - RNA, 18 nt, Homo sapiens
ucaagacuugauacugca

SEQ ID NO: 1505801 - RNA, 17 nt, Homo sapiens
ucaagaucaacauucca

SEQ ID NO: 1505802 - RNA, 18 nt, Homo sapiens
ucaagaucaacauuccag

SEQ ID NO: 1505803 - RNA, 20 nt, Homo sapiens
ucaaguaccaaaauguuaau

SEQ ID NO: 1505804 - RNA, 20 nt, Homo sapiens
ucaaucuucggggugugaug

SEQ ID NO: 1505805 - RNA, 16 nt, Homo sapiens
uccuucccccaucccc

SEQ ID NO: 1505806 - RNA, 17 nt, Homo sapiens
uccuugcuuucaucacu

SEQ ID NO: 1505807 - RNA, 17 nt, Homo sapiens
uccuuggauggcaccau

SEQ ID NO: 1505808 - RNA, 18 nt, Homo sapiens
uccuuuaccuaccaccuu

SEQ ID NO: 1505809 - RNA, 18 nt, Homo sapiens
uccuuuuucaacuuggaa

SEQ ID NO: 1505810 - RNA, 23 nt, Homo sapiens
ucgaguaacuuuaaaaaaaucau

SEQ ID NO: 1505811 - RNA, 22 nt, Homo sapiens
ucgcucagcaauagggugcagu

SEQ ID NO: 1505812 - RNA, 16 nt, Homo sapiens
ucggaagacuugccac

SEQ ID NO: 1505813 - RNA, 22 nt, Homo sapiens
ucgggaaauuauuaugacucaa

SEQ ID NO: 1505814 - RNA, 10 nt, Homo sapiens
ucggggagcu

SEQ ID NO: 1505815 - RNA, 18 nt, Homo sapiens
ucuaaaucugagaucucc

SEQ ID NO: 1505816 - RNA, 16 nt, Homo sapiens
ucuaagcugugugcag

SEQ ID NO: 1505817 - RNA, 17 nt, Homo sapiens
ucuaagcugugugcagg

SEQ ID NO: 1505818 - RNA, 13 nt, Homo sapiens
ucuaaguauuuga

SEQ ID NO: 1505819 - RNA, 15 nt, Homo sapiens
ucuacaagcauuugc

SEQ ID NO: 1505820 - RNA, 23 nt, Homo sapiens
ucuacauguuuuagacagagaca

SEQ ID NO: 1505821 - RNA, 20 nt, Homo sapiens
ucuaccuaggaugcaugaca

SEQ ID NO: 1505822 - RNA, 21 nt, Homo sapiens
ucuaccuuuuuuucucuccua

SEQ ID NO: 1505823 - RNA, 13 nt, Homo sapiens
ucuagaagcagaa

SEQ ID NO: 1505824 - RNA, 22 nt, Homo sapiens
ucuagagauuuucuuggcagua

SEQ ID NO: 1505825 - RNA, 15 nt, Homo sapiens
ucuagagcacugcca

SEQ ID NO: 1505826 - RNA, 13 nt, Homo sapiens
ucuaggcaguuca

SEQ ID NO: 1505827 - RNA, 18 nt, Homo sapiens
ucuagguccauuuuccua

SEQ ID NO: 1505828 - RNA, 21 nt, Homo sapiens
ucuauagagaaaaacuuucau

SEQ ID NO: 1505829 - RNA, 14 nt, Homo sapiens
ucucagaagguauu

SEQ ID NO: 1505830 - RNA, 23 nt, Homo sapiens
ucucaguugauuuucuggauucc

SEQ ID NO: 1505831 - RNA, 22 nt, Homo sapiens
ucucauugaaaaaaauauauga

SEQ ID NO: 1505832 - RNA, 20 nt, Homo sapiens
ucuccaggauugaagagcau

SEQ ID NO: 1505833 - RNA, 13 nt, Homo sapiens
ucucccugccaag

SEQ ID NO: 1505834 - RNA, 21 nt, Homo sapiens
ucucccugccaagucucagaa

SEQ ID NO: 1505835 - RNA, 17 nt, Homo sapiens
ucucccugggucugcgu

SEQ ID NO: 1505836 - RNA, 15 nt, Homo sapiens
ucuccgcacuuggaa

SEQ ID NO: 1505837 - RNA, 19 nt, Homo sapiens
ucuccucccagcgugugua

SEQ ID NO: 1505838 - RNA, 17 nt, Homo sapiens
ucuccugacaugucuca

SEQ ID NO: 1505839 - RNA, 16 nt, Homo sapiens
ucucuaacuccugcca

SEQ ID NO: 1505840 - RNA, 20 nt, Homo sapiens
ucucuacccggcccagagac

SEQ ID NO: 1505841 - RNA, 20 nt, Homo sapiens
ucucuccagagagcaaacau

SEQ ID NO: 1505842 - RNA, 11 nt, Homo sapiens
ugaccaggaac

SEQ ID NO: 1505843 - RNA, 14 nt, Homo sapiens
ugaccccaaagagc

SEQ ID NO: 1505844 - RNA, 19 nt, Homo sapiens
ugacuccucuaagccacuc

SEQ ID NO: 1505845 - RNA, 14 nt, Homo sapiens
ugacucugucacac

SEQ ID NO: 1505846 - RNA, 20 nt, Homo sapiens
ugacugggaccugaaugacc

SEQ ID NO: 1505847 - RNA, 16 nt, Homo sapiens
ugacugucccuucgac

SEQ ID NO: 1505848 - RNA, 15 nt, Homo sapiens
ugacuuuugcaauuc

SEQ ID NO: 1505849 - RNA, 12 nt, Homo sapiens
ugagaaagccuu

SEQ ID NO: 1505850 - RNA, 20 nt, Homo sapiens
ugagaaagccuucauaagcc

SEQ ID NO: 1505851 - RNA, 18 nt, Homo sapiens
ugagaaggagucagaaac

SEQ ID NO: 1505852 - RNA, 13 nt, Homo sapiens
ugagaugauggaa

SEQ ID NO: 1505853 - RNA, 12 nt, Homo sapiens
ugagccagguaa

SEQ ID NO: 1505854 - RNA, 14 nt, Homo sapiens
ugagccugauuauc

SEQ ID NO: 1505855 - RNA, 16 nt, Homo sapiens
ugaggcuccugugcua

SEQ ID NO: 1505856 - RNA, 18 nt, Homo sapiens
ugaggcuccugugcuacu

SEQ ID NO: 1505857 - RNA, 14 nt, Homo sapiens
ugaggcugcagcga

SEQ ID NO: 1505858 - RNA, 13 nt, Homo sapiens
ugaguaaaaucua

SEQ ID NO: 1505859 - RNA, 17 nt, Homo sapiens
ugagucagacauuuggu

SEQ ID NO: 1505860 - RNA, 16 nt, Homo sapiens
ugagucagaggacacc

SEQ ID NO: 1505861 - RNA, 18 nt, Homo sapiens
ugaguggaucuccaagga

SEQ ID NO: 1505862 - RNA, 17 nt, Homo sapiens
ugauacgugugugaagu

SEQ ID NO: 1505863 - RNA, 13 nt, Homo sapiens
ugauacugcaaua

SEQ ID NO: 1505864 - RNA, 20 nt, Homo sapiens
ugaucauuucucaagaauaa

SEQ ID NO: 1505865 - RNA, 17 nt, Homo sapiens
ugaucucaaauccacug

SEQ ID NO: 1505866 - RNA, 14 nt, Homo sapiens
ugaugaaacauuca

SEQ ID NO: 1505867 - RNA, 22 nt, Homo sapiens
ugaugaauagcgaaucaucuca

SEQ ID NO: 1505868 - RNA, 20 nt, Homo sapiens
ugaugaaugacaacauugca

SEQ ID NO: 1505869 - RNA, 16 nt, Homo sapiens
ugaugguaagacugua

SEQ ID NO: 1505870 - RNA, 11 nt, Homo sapiens
ugauggugcug

SEQ ID NO: 1505871 - RNA, 16 nt, Homo sapiens
ugauuauccuauaggc

SEQ ID NO: 1505872 - RNA, 17 nt, Homo sapiens
ugauucugaaucugaaa

SEQ ID NO: 1505873 - RNA, 13 nt, Homo sapiens
ugauuggcucacc

SEQ ID NO: 1505874 - RNA, 15 nt, Homo sapiens
ugauuuaacacuauc

SEQ ID NO: 1505875 - RNA, 19 nt, Homo sapiens
ugauuuggaagagaggcac

SEQ ID NO: 1505876 - RNA, 20 nt, Homo sapiens
ugauuuugagcaaaccacau

SEQ ID NO: 1505877 - RNA, 21 nt, Homo sapiens
ugcaaaaagauuuaacaaaua

SEQ ID NO: 1505878 - RNA, 13 nt, Homo sapiens
ugcaaaauggaaa

SEQ ID NO: 1505879 - RNA, 13 nt, Homo sapiens
ugcaaacuuuauu

SEQ ID NO: 1505880 - RNA, 21 nt, Homo sapiens
ugcaaaggcgcagugcuucuc

SEQ ID NO: 1505881 - RNA, 17 nt, Homo sapiens
ugcaaccuuugccuccc

SEQ ID NO: 1505882 - RNA, 15 nt, Homo sapiens
ugcaagagacucugg

SEQ ID NO: 1505883 - RNA, 19 nt, Homo sapiens
ugcaaggcuaagaaguacu

SEQ ID NO: 1505884 - RNA, 15 nt, Homo sapiens
uggagagguuuguca

SEQ ID NO: 1505885 - RNA, 18 nt, Homo sapiens
uggagagguuugucaaca

SEQ ID NO: 1505886 - RNA, 15 nt, Homo sapiens
uggagaugaugauga

SEQ ID NO: 1505887 - RNA, 19 nt, Homo sapiens
uggaggacacacagucuca

SEQ ID NO: 1505888 - RNA, 14 nt, Homo sapiens
uggagggagccauc

SEQ ID NO: 1505889 - RNA, 14 nt, Homo sapiens
uggagggaugccac

SEQ ID NO: 1505890 - RNA, 16 nt, Homo sapiens
uggaguauaauauuca

SEQ ID NO: 1505891 - RNA, 18 nt, Homo sapiens
uggagucuuguacacuua

SEQ ID NO: 1505892 - RNA, 13 nt, Homo sapiens
uggagugcucaau

SEQ ID NO: 1505893 - RNA, 20 nt, Homo sapiens
uggaucaggguuguucuggg

SEQ ID NO: 1505894 - RNA, 18 nt, Homo sapiens
uggaugaugaaacauuca

SEQ ID NO: 1505895 - RNA, 21 nt, Homo sapiens
uggaugggcccugcaagacac

SEQ ID NO: 1505896 - RNA, 18 nt, Homo sapiens
uggauuccagcauuugcc

SEQ ID NO: 1505897 - RNA, 18 nt, Homo sapiens
uggauuccccaucucagg

SEQ ID NO: 1505898 - RNA, 21 nt, Homo sapiens
uggcaauuuccuggcccucca

SEQ ID NO: 1505899 - RNA, 14 nt, Homo sapiens
uggcacugguugua

SEQ ID NO: 1505900 - RNA, 18 nt, Homo sapiens
uggcagcauugacucugu

SEQ ID NO: 1505901 - RNA, 17 nt, Homo sapiens
uggcaugagaaauacaa

SEQ ID NO: 1505902 - RNA, 17 nt, Homo sapiens
uggcauggcagaaugaa

SEQ ID NO: 1505903 - RNA, 11 nt, Homo sapiens
uggcaugucag

SEQ ID NO: 1505904 - RNA, 21 nt, Homo sapiens
uggcauucacacagcccauaa

SEQ ID NO: 1505905 - RNA, 21 nt, Homo sapiens
uggccacugaauuagccaaaa

SEQ ID NO: 1505906 - RNA, 18 nt, Homo sapiens
uggccagugugaucccaa

SEQ ID NO: 1505907 - RNA, 23 nt, Homo sapiens
uggccuguguguuacaaugauau

SEQ ID NO: 1505908 - RNA, 22 nt, Homo sapiens
uggcguuuuagacaaauuugca

SEQ ID NO: 1505909 - RNA, 22 nt, Homo sapiens
uggcuaauucccagagugugaa

SEQ ID NO: 1505910 - RNA, 15 nt, Homo sapiens
uggcuaugggaauca

SEQ ID NO: 1505911 - RNA, 23 nt, Homo sapiens
uggcucccaucugaaccacuuug

SEQ ID NO: 1505912 - RNA, 15 nt, Homo sapiens
uggcucucagaaggu

SEQ ID NO: 1505913 - RNA, 22 nt, Homo sapiens
uggcucuguuaugcaagcacaa

SEQ ID NO: 1505914 - RNA, 22 nt, Homo sapiens
uggcuuccagguaucuccagga

SEQ ID NO: 1505915 - RNA, 23 nt, Homo sapiens
uggcuuugguccccagcauugca

SEQ ID NO: 1505916 - RNA, 21 nt, Homo sapiens
ugggaaugacucugacuuuga

SEQ ID NO: 1505917 - RNA, 15 nt, Homo sapiens
ugggagagccuggca

SEQ ID NO: 1505918 - RNA, 18 nt, Homo sapiens
ugggagaucagccacgga

SEQ ID NO: 1505919 - RNA, 12 nt, Homo sapiens
ugggauucccac

SEQ ID NO: 1505920 - RNA, 16 nt, Homo sapiens
ugggcaaugaaaccaa

SEQ ID NO: 1505921 - RNA, 14 nt, Homo sapiens
ugggcagaaagugg

SEQ ID NO: 1505922 - RNA, 22 nt, Homo sapiens
ugggccgggaggcagugcugau

SEQ ID NO: 1505923 - RNA, 23 nt, Homo sapiens
ugggccgggaggcagugcugauc

SEQ ID NO: 1505924 - RNA, 18 nt, Homo sapiens
ugggggcugcugcacugc

SEQ ID NO: 1505925 - RNA, 17 nt, Homo sapiens
ugguauaucuuuuucca

SEQ ID NO: 1505926 - RNA, 21 nt, Homo sapiens
ugguauccauuauaaacaauc

SEQ ID NO: 1505927 - RNA, 15 nt, Homo sapiens
uggucagagugccac

SEQ ID NO: 1505928 - RNA, 17 nt, Homo sapiens
ugguccccagcauugca

SEQ ID NO: 1505929 - RNA, 17 nt, Homo sapiens
uuaaaaucacuauaucu

SEQ ID NO: 1505930 - RNA, 11 nt, Homo sapiens
uuaaaccugga

SEQ ID NO: 1505931 - RNA, 18 nt, Homo sapiens
uuaaacuauaagcaagaa

SEQ ID NO: 1505932 - RNA, 14 nt, Homo sapiens
uuaaagaaccaaaa

SEQ ID NO: 1505933 - RNA, 17 nt, Homo sapiens
uuaaauaaaaaaguuua

SEQ ID NO: 1505934 - RNA, 12 nt, Homo sapiens
uuaaauauauca

SEQ ID NO: 1505935 - RNA, 23 nt, Homo sapiens
uuaaauauauuucuugcuauugu

SEQ ID NO: 1505936 - RNA, 21 nt, Homo sapiens
uuaaauauuaugugaaaucaa

SEQ ID NO: 1505937 - RNA, 18 nt, Homo sapiens
uuaaaugaaagaauaucu

SEQ ID NO: 1505938 - RNA, 14 nt, Homo sapiens
uuaaauguuuuaca

SEQ ID NO: 1505939 - RNA, 19 nt, Homo sapiens
uuaaauugaugcacuacac

SEQ ID NO: 1505940 - RNA, 14 nt, Homo sapiens
uuaacacauaacua

SEQ ID NO: 1505941 - RNA, 12 nt, Homo sapiens
uuaacauucaca

SEQ ID NO: 1505942 - RNA, 20 nt, Homo sapiens
uuaacugugaaauaccacaa

SEQ ID NO: 1505943 - RNA, 17 nt, Homo sapiens
uuaacugugaaccugga

SEQ ID NO: 1505944 - RNA, 21 nt, Homo sapiens
uuaagcaaaggaaaccaaagg

SEQ ID NO: 1505945 - RNA, 16 nt, Homo sapiens
uuaauaaaaguacuga

SEQ ID NO: 1505946 - RNA, 16 nt, Homo sapiens
uuaauaauaccaagac

SEQ ID NO: 1505947 - RNA, 17 nt, Homo sapiens
uuaaugacaaggugaua

SEQ ID NO: 1505948 - RNA, 13 nt, Homo sapiens
uuaauuacaucca

SEQ ID NO: 1505949 - RNA, 16 nt, Homo sapiens
uuaauucacucccaca

SEQ ID NO: 1505950 - RNA, 21 nt, Homo sapiens
uuaauuucuacacacccauag

SEQ ID NO: 1505951 - RNA, 19 nt, Homo sapiens
uuacaacuuguauuuccaa

SEQ ID NO: 1505952 - RNA, 17 nt, Homo sapiens
uuacaucugugugguau

SEQ ID NO: 1505953 - RNA, 19 nt, Homo sapiens
uuaccaaggaaagaacaaa

SEQ ID NO: 1505954 - RNA, 17 nt, Homo sapiens
uuaccacguuacugcau

SEQ ID NO: 1505955 - RNA, 18 nt, Homo sapiens
uuacuauuucacaacagc

SEQ ID NO: 1505956 - RNA, 12 nt, Homo sapiens
uuacuccagugg

SEQ ID NO: 1505957 - RNA, 19 nt, Homo sapiens
uuacugcaaccuuugccuc

SEQ ID NO: 1505958 - RNA, 12 nt, Homo sapiens
uuacuucaugag

SEQ ID NO: 1505959 - RNA, 12 nt, Homo sapiens
uuagaaccacaa

SEQ ID NO: 1505960 - RNA, 21 nt, Homo sapiens
uuagagaaaugguucuggaua

SEQ ID NO: 1505961 - RNA, 13 nt, Homo sapiens
uuagagaauguuc

SEQ ID NO: 1505962 - RNA, 23 nt, Homo sapiens
uuagagcccauuucaauucucaa

SEQ ID NO: 1505963 - RNA, 16 nt, Homo sapiens
uuagagguuugucaac

SEQ ID NO: 1505964 - RNA, 14 nt, Homo sapiens
uuagauuaguauuu

SEQ ID NO: 1505965 - RNA, 20 nt, Homo sapiens
uuaggcaggaucuguacaau

SEQ ID NO: 1505966 - RNA, 13 nt, Homo sapiens
uuaggcaugccua

SEQ ID NO: 1505967 - RNA, 21 nt, Homo sapiens
uuaggucauuacuaaccauag

SEQ ID NO: 1505968 - RNA, 14 nt, Homo sapiens
uuagguuugucaac

SEQ ID NO: 1505969 - RNA, 23 nt, Homo sapiens
uuaguuuguuuuacaaauuuuuc

SEQ ID NO: 1505970 - RNA, 20 nt, Homo sapiens
uuaguuuugggaauaggcau

SEQ ID NO: 1505971 - RNA, 18 nt, Homo sapiens
uuaguuuuuaacaaucua

SEQ ID NO: 1505972 - RNA, 17 nt, Homo sapiens
uuauaagaugucauccc

SEQ ID NO: 1505973 - RNA, 21 nt, Homo sapiens
uuauaugacaauccugaagaa

SEQ ID NO: 1505974 - RNA, 18 nt, Homo sapiens
uuauauucaaggaucuca

SEQ ID NO: 1505975 - RNA, 16 nt, Homo sapiens
uuauauuuucuauuac

SEQ ID NO: 1505976 - RNA, 20 nt, Homo sapiens
uuaucaaaaaguacaauaau

SEQ ID NO: 1505977 - RNA, 14 nt, Homo sapiens
uuaugaaaaagaag

SEQ ID NO: 1505978 - RNA, 21 nt, Homo sapiens
uuaugauaacuauuuacauau

SEQ ID NO: 1505979 - RNA, 14 nt, Homo sapiens
uuauguagcuaaac

SEQ ID NO: 1505980 - RNA, 14 nt, Homo sapiens
aauaauuaaugugu

SEQ ID NO: 1505981 - RNA, 23 nt, Homo sapiens
aauacacagaugauaauaugcua

SEQ ID NO: 1505982 - RNA, 16 nt, Homo sapiens
aauacacuaauuccuu

SEQ ID NO: 1505983 - RNA, 15 nt, Homo sapiens
aauacaucaaaaaug

SEQ ID NO: 1505984 - RNA, 22 nt, Homo sapiens
aauaccccauuaccagcauuua

SEQ ID NO: 1505985 - RNA, 17 nt, Homo sapiens
aauagaguuccaaauaa

SEQ ID NO: 1505986 - RNA, 17 nt, Homo sapiens
aauagcuaaauaccuca

SEQ ID NO: 1505987 - RNA, 17 nt, Homo sapiens
aauauaucaauguaaca

SEQ ID NO: 1505988 - RNA, 19 nt, Homo sapiens
aauaucauuaaauuggaau

SEQ ID NO: 1505989 - RNA, 15 nt, Homo sapiens
aauauccugcuugau

SEQ ID NO: 1505990 - RNA, 21 nt, Homo sapiens
aauauucccugacgacacuga

SEQ ID NO: 1505991 - RNA, 22 nt, Homo sapiens
aauauugaauaaguauucuuca

SEQ ID NO: 1505992 - RNA, 20 nt, Homo sapiens
aaucacaaggcaacugugag

SEQ ID NO: 1505993 - RNA, 23 nt, Homo sapiens
aaucaccacaaacuguaauacaa

SEQ ID NO: 1505994 - RNA, 14 nt, Homo sapiens
aaucagcaucgugg

SEQ ID NO: 1505995 - RNA, 19 nt, Homo sapiens
aaucagccagcucauuugg

SEQ ID NO: 1505996 - RNA, 14 nt, Homo sapiens
aaucaucucaaauc

SEQ ID NO: 1505997 - RNA, 16 nt, Homo sapiens
aaucauggcauucaca

SEQ ID NO: 1505998 - RNA, 21 nt, Homo sapiens
aaucaugggauuuuacuagaa

SEQ ID NO: 1505999 - RNA, 15 nt, Homo sapiens
aauccguaucugcag

SEQ ID NO: 1506000 - RNA, 23 nt, Homo sapiens
aauccucagguaguacugggaau

SEQ ID NO: 1506001 - RNA, 23 nt, Homo sapiens
aauccugcuccugacucggucaa

SEQ ID NO: 1506002 - RNA, 15 nt, Homo sapiens
aauccugcugccaga

SEQ ID NO: 1506003 - RNA, 16 nt, Homo sapiens
aaucgagucuaccucu

SEQ ID NO: 1506004 - RNA, 14 nt, Homo sapiens
aaucgugucuucaa

SEQ ID NO: 1506005 - RNA, 16 nt, Homo sapiens
aaucuaacuacaagga

SEQ ID NO: 1506006 - RNA, 17 nt, Homo sapiens
aaucuaacuacaaggac

SEQ ID NO: 1506007 - RNA, 16 nt, Homo sapiens
aaucucaucucaguga

SEQ ID NO: 1506008 - RNA, 16 nt, Homo sapiens
aaucuguaauuucacu

SEQ ID NO: 1506009 - RNA, 19 nt, Homo sapiens
aaucuucggggugugauga

SEQ ID NO: 1506010 - RNA, 20 nt, Homo sapiens
aaucuuucagcacucagaaa

SEQ ID NO: 1506011 - RNA, 21 nt, Homo sapiens
aaugaaaaaaaguacauguau

SEQ ID NO: 1506012 - RNA, 16 nt, Homo sapiens
aaugaaaccaaagcca

SEQ ID NO: 1506013 - RNA, 18 nt, Homo sapiens
aaugaaugcuccaugaaa

SEQ ID NO: 1506014 - RNA, 23 nt, Homo sapiens
aaugagaaacuuugaucucugcu

SEQ ID NO: 1506015 - RNA, 14 nt, Homo sapiens
aaugagaacuucaa

SEQ ID NO: 1506016 - RNA, 19 nt, Homo sapiens
aaugagaaggagucagaaa

SEQ ID NO: 1506017 - RNA, 21 nt, Homo sapiens
aaugagucugcuuucacugug

SEQ ID NO: 1506018 - RNA, 13 nt, Homo sapiens
aaugauccuguau

SEQ ID NO: 1506019 - RNA, 14 nt, Homo sapiens
aaugcauggugcag

SEQ ID NO: 1506020 - RNA, 16 nt, Homo sapiens
aaugccucaaugugac

SEQ ID NO: 1506021 - RNA, 22 nt, Homo sapiens
aaugcuguuuuaaaaacaaaga

SEQ ID NO: 1506022 - RNA, 15 nt, Homo sapiens
aauggaaaacauuua

SEQ ID NO: 1506023 - RNA, 16 nt, Homo sapiens
aauggaaauguaauaa

SEQ ID NO: 1506024 - RNA, 15 nt, Homo sapiens
aauggacguacuggu

SEQ ID NO: 1506025 - RNA, 21 nt, Homo sapiens
aauggguacaauguacauuau

SEQ ID NO: 1506026 - RNA, 16 nt, Homo sapiens
aaugguacucuaauca

SEQ ID NO: 1506027 - RNA, 17 nt, Homo sapiens
aauguaaauacaucaaa

SEQ ID NO: 1506028 - RNA, 20 nt, Homo sapiens
aauguaacucuauaguuauu

SEQ ID NO: 1506029 - RNA, 16 nt, Homo sapiens
aaugucugauuuaaca

SEQ ID NO: 1506030 - RNA, 21 nt, Homo sapiens
aaugucuuaaaaauauauuua

SEQ ID NO: 1506031 - RNA, 17 nt, Homo sapiens
aaugugacaacaugugg

SEQ ID NO: 1506032 - RNA, 23 nt, Homo sapiens
aauguuggaugaugaaacauuca

SEQ ID NO: 1506033 - RNA, 14 nt, Homo sapiens
aauguugggagaaa

SEQ ID NO: 1506034 - RNA, 23 nt, Homo sapiens
aauguuuccaaccuggaguauaa

SEQ ID NO: 1506035 - RNA, 18 nt, Homo sapiens
aauuacuguaacugauua

SEQ ID NO: 1506036 - RNA, 12 nt, Homo sapiens
aauuagccaaaa

SEQ ID NO: 1506037 - RNA, 21 nt, Homo sapiens
aauuauauuaaagaaccaaaa

SEQ ID NO: 1506038 - RNA, 13 nt, Homo sapiens
aauucacucccac

SEQ ID NO: 1506039 - RNA, 18 nt, Homo sapiens
aauuccaacucacuuuuu

SEQ ID NO: 1506040 - RNA, 16 nt, Homo sapiens
aauuccuagucacaau

SEQ ID NO: 1506041 - RNA, 23 nt, Homo sapiens
aauucucaaaagaaaaggcaaaa

SEQ ID NO: 1506042 - RNA, 15 nt, Homo sapiens
aauucugauacauua

SEQ ID NO: 1506043 - RNA, 23 nt, Homo sapiens
aauucugauacauuagcagcuau

SEQ ID NO: 1506044 - RNA, 14 nt, Homo sapiens
aauugaacuacuug

SEQ ID NO: 1506045 - RNA, 16 nt, Homo sapiens
aauuggccucagugua

SEQ ID NO: 1506046 - RNA, 22 nt, Homo sapiens
aauuguaaguaccccugauaag

SEQ ID NO: 1506047 - RNA, 23 nt, Homo sapiens
aauuguauuuuuguauguggcau

SEQ ID NO: 1506048 - RNA, 23 nt, Homo sapiens
aauuguuaguaaacauagguaua

SEQ ID NO: 1506049 - RNA, 13 nt, Homo sapiens
aauuuauaucuua

SEQ ID NO: 1506050 - RNA, 20 nt, Homo sapiens
aauuucuaccuuuacuacau

SEQ ID NO: 1506051 - RNA, 16 nt, Homo sapiens
aauuucugauuucacu

SEQ ID NO: 1506052 - RNA, 18 nt, Homo sapiens
aauuuggagacucugugg

SEQ ID NO: 1506053 - RNA, 19 nt, Homo sapiens
aauuuguuuuauauucucu

SEQ ID NO: 1506054 - RNA, 11 nt, Homo sapiens
aauuuuuccau

SEQ ID NO: 1506055 - RNA, 13 nt, Homo sapiens
aauuuuuccugca

SEQ ID NO: 1506056 - RNA, 13 nt, Homo sapiens
acaaaaaaccaca

SEQ ID NO: 1506057 - RNA, 16 nt, Homo sapiens
acaaaaagacauggaa

SEQ ID NO: 1506058 - RNA, 23 nt, Homo sapiens
acaaaauuagcugaagaaguuau

SEQ ID NO: 1506059 - RNA, 14 nt, Homo sapiens
acaaacaagcacag

SEQ ID NO: 1506060 - RNA, 11 nt, Homo sapiens
acaaaccaccc

SEQ ID NO: 1506061 - RNA, 24 nt, Homo sapiens
acaaacuuggucuuacaucugugu

SEQ ID NO: 1506062 - RNA, 20 nt, Homo sapiens
acaaauccauggaccuauga

SEQ ID NO: 1506063 - RNA, 21 nt, Homo sapiens
acaaauccauggaccuaugac

SEQ ID NO: 1506064 - RNA, 19 nt, Homo sapiens
acaaauggaaggaguuccu

SEQ ID NO: 1506065 - RNA, 15 nt, Homo sapiens
acaaauuucaucucc

SEQ ID NO: 1506066 - RNA, 19 nt, Homo sapiens
acaacuuguauuuccaaac

SEQ ID NO: 1506067 - RNA, 18 nt, Homo sapiens
acaagagacuuaacuuau

SEQ ID NO: 1506068 - RNA, 18 nt, Homo sapiens
acaagaguugucuugucc

SEQ ID NO: 1506069 - RNA, 17 nt, Homo sapiens
acaagauaacugagaau

SEQ ID NO: 1506070 - RNA, 13 nt, Homo sapiens
acaagcauucucc

SEQ ID NO: 1506071 - RNA, 20 nt, Homo sapiens
acaaggaccaggauugcacu

SEQ ID NO: 1506072 - RNA, 21 nt, Homo sapiens
acaauaauauuucaagugccu

SEQ ID NO: 1506073 - RNA, 16 nt, Homo sapiens
acaauaauuaaugugu

SEQ ID NO: 1506074 - RNA, 20 nt, Homo sapiens
acaaucuggcuuagugccac

SEQ ID NO: 1506075 - RNA, 18 nt, Homo sapiens
acaaucugggacuuucac

SEQ ID NO: 1506076 - RNA, 20 nt, Homo sapiens
acaaugccacuauaguuuaa

SEQ ID NO: 1506077 - RNA, 17 nt, Homo sapiens
acaauuaaacagccaaa

SEQ ID NO: 1506078 - RNA, 16 nt, Homo sapiens
acaauuuuuaagcauu

SEQ ID NO: 1506079 - RNA, 17 nt, Homo sapiens
acacaaacuauuacuua

SEQ ID NO: 1506080 - RNA, 13 nt, Homo sapiens
acacaaagacaug

SEQ ID NO: 1506081 - RNA, 16 nt, Homo sapiens
acacaaagacauggaa

SEQ ID NO: 1506082 - RNA, 23 nt, Homo sapiens
acacacccauagugcacacuugu

SEQ ID NO: 1506083 - RNA, 23 nt, Homo sapiens
acacagacccacacauguuuaca

SEQ ID NO: 1506084 - RNA, 19 nt, Homo sapiens
acacaguauuaagugacag

SEQ ID NO: 1506085 - RNA, 22 nt, Homo sapiens
acacagucuguuuucuauuugu

SEQ ID NO: 1506086 - RNA, 18 nt, Homo sapiens
acacauggacacaccaga

SEQ ID NO: 1506087 - RNA, 17 nt, Homo sapiens
acacauucuuaacacau

SEQ ID NO: 1506088 - RNA, 20 nt, Homo sapiens
acacauucuuaacacauguc

SEQ ID NO: 1506089 - RNA, 17 nt, Homo sapiens
acacauuuggcaguuua

SEQ ID NO: 1506090 - RNA, 17 nt, Homo sapiens
acacccgacuccucaaa

SEQ ID NO: 1506091 - RNA, 23 nt, Homo sapiens
acacccgccgccuccugcaccga

SEQ ID NO: 1506092 - RNA, 13 nt, Homo sapiens
acaccuaagagaa

SEQ ID NO: 1506093 - RNA, 22 nt, Homo sapiens
acaccuaagagaaaaagaucga

SEQ ID NO: 1506094 - RNA, 16 nt, Homo sapiens
acaccuuuguuuugca

SEQ ID NO: 1506095 - RNA, 20 nt, Homo sapiens
acaccuuuuuucaacaguga

SEQ ID NO: 1506096 - RNA, 12 nt, Homo sapiens
acacgcuuucac

SEQ ID NO: 1506097 - RNA, 16 nt, Homo sapiens
acacguggguauuuaa

SEQ ID NO: 1506098 - RNA, 22 nt, Homo sapiens
acacuagacaagccagaacuug

SEQ ID NO: 1506099 - RNA, 15 nt, Homo sapiens
acacucaacaauaaa

SEQ ID NO: 1506100 - RNA, 12 nt, Homo sapiens
acacucaucccu

SEQ ID NO: 1506101 - RNA, 19 nt, Homo sapiens
acacuuuugggagguccag

SEQ ID NO: 1506102 - RNA, 15 nt, Homo sapiens
acagaaacauuuuca

SEQ ID NO: 1506103 - RNA, 15 nt, Homo sapiens
acagaaggauguccc

SEQ ID NO: 1506104 - RNA, 22 nt, Homo sapiens
acagaauggaaccaaaauguau

SEQ ID NO: 1506105 - RNA, 20 nt, Homo sapiens
acagaauuuuaaagagcaua

SEQ ID NO: 1506106 - RNA, 18 nt, Homo sapiens
acagaauuuuauggugca

SEQ ID NO: 1506107 - RNA, 14 nt, Homo sapiens
acagacgucucaag

SEQ ID NO: 1506108 - RNA, 18 nt, Homo sapiens
acagagaggaguugccag

SEQ ID NO: 1506109 - RNA, 22 nt, Homo sapiens
acagagaugcaugcgcaggcuc

SEQ ID NO: 1506110 - RNA, 19 nt, Homo sapiens
acagaggauuguauugcaa

SEQ ID NO: 1506111 - RNA, 13 nt, Homo sapiens
acagaggcaguag

SEQ ID NO: 1506112 - RNA, 17 nt, Homo sapiens
acagauagacagugcug

SEQ ID NO: 1506113 - RNA, 18 nt, Homo sapiens
acagauaucagugucucc

SEQ ID NO: 1506114 - RNA, 19 nt, Homo sapiens
agguaggggcacagugaau

SEQ ID NO: 1506115 - RNA, 18 nt, Homo sapiens
agguaucaaaauguuguc

SEQ ID NO: 1506116 - RNA, 15 nt, Homo sapiens
agguaucuuacucug

SEQ ID NO: 1506117 - RNA, 21 nt, Homo sapiens
aggucaagcuauuucucugga

SEQ ID NO: 1506118 - RNA, 19 nt, Homo sapiens
aggucauuacuaaccauag

SEQ ID NO: 1506119 - RNA, 17 nt, Homo sapiens
aggugagaccaaaggau

SEQ ID NO: 1506120 - RNA, 16 nt, Homo sapiens
aggugggaaaugguau

SEQ ID NO: 1506121 - RNA, 21 nt, Homo sapiens
aggugucugcacccaggggug

SEQ ID NO: 1506122 - RNA, 17 nt, Homo sapiens
aggugucuuaagccuuu

SEQ ID NO: 1506123 - RNA, 15 nt, Homo sapiens
agguuagagguuugu

SEQ ID NO: 1506124 - RNA, 18 nt, Homo sapiens
agguuagggugugugcca

SEQ ID NO: 1506125 - RNA, 22 nt, Homo sapiens
agguuagguuugucaacacaaa

SEQ ID NO: 1506126 - RNA, 20 nt, Homo sapiens
agguugaggggcuccuggaa

SEQ ID NO: 1506127 - RNA, 12 nt, Homo sapiens
agguuucaagac

SEQ ID NO: 1506128 - RNA, 17 nt, Homo sapiens
agguuucaagacuugau

SEQ ID NO: 1506129 - RNA, 17 nt, Homo sapiens
aguaacaggaaaccacu

SEQ ID NO: 1506130 - RNA, 14 nt, Homo sapiens
aguaagaacacuga

SEQ ID NO: 1506131 - RNA, 21 nt, Homo sapiens
aguacaauaauaaauccucag

SEQ ID NO: 1506132 - RNA, 19 nt, Homo sapiens
aguaccccugauaagcaaa

SEQ ID NO: 1506133 - RNA, 12 nt, Homo sapiens
aguacugggaag

SEQ ID NO: 1506134 - RNA, 20 nt, Homo sapiens
aguagaaaggccagcugacu

SEQ ID NO: 1506135 - RNA, 22 nt, Homo sapiens
aguagaaguaauaugcucucau

SEQ ID NO: 1506136 - RNA, 16 nt, Homo sapiens
aguaggaaaucaggca

SEQ ID NO: 1506137 - RNA, 14 nt, Homo sapiens
aguaguguguugua

SEQ ID NO: 1506138 - RNA, 15 nt, Homo sapiens
aguaguuaagagcua

SEQ ID NO: 1506139 - RNA, 20 nt, Homo sapiens
aguauuaagugacagugcua

SEQ ID NO: 1506140 - RNA, 21 nt, Homo sapiens
aguauuuuagugaacuugaaa

SEQ ID NO: 1506141 - RNA, 23 nt, Homo sapiens
agucagaggacaccauccaagaa

SEQ ID NO: 1506142 - RNA, 11 nt, Homo sapiens
agucaucucau

SEQ ID NO: 1506143 - RNA, 15 nt, Homo sapiens
aguccguagguuuau

SEQ ID NO: 1506144 - RNA, 10 nt, Homo sapiens
aguccucaca

SEQ ID NO: 1506145 - RNA, 20 nt, Homo sapiens
aguccuuugggauucuagga

SEQ ID NO: 1506146 - RNA, 18 nt, Homo sapiens
agucuacuucacuaauga

SEQ ID NO: 1506147 - RNA, 16 nt, Homo sapiens
agucucacucugucac

SEQ ID NO: 1506148 - RNA, 15 nt, Homo sapiens
agucugaguaaaauc

SEQ ID NO: 1506149 - RNA, 14 nt, Homo sapiens
agucugaugacaca

SEQ ID NO: 1506150 - RNA, 13 nt, Homo sapiens
agucugcagugag

SEQ ID NO: 1506151 - RNA, 14 nt, Homo sapiens
agugaaauaauuaa

SEQ ID NO: 1506152 - RNA, 21 nt, Homo sapiens
agugaaauaauuaaaaaccac

SEQ ID NO: 1506153 - RNA, 13 nt, Homo sapiens
agugaacacacuc

SEQ ID NO: 1506154 - RNA, 13 nt, Homo sapiens
agugagaugacau

SEQ ID NO: 1506155 - RNA, 17 nt, Homo sapiens
agugauauuguggguaa

SEQ ID NO: 1506156 - RNA, 16 nt, Homo sapiens
agugcacuccugguga

SEQ ID NO: 1506157 - RNA, 16 nt, Homo sapiens
agugcaugaacagggu

SEQ ID NO: 1506158 - RNA, 16 nt, Homo sapiens
agugccacucauuccu

SEQ ID NO: 1506159 - RNA, 12 nt, Homo sapiens
agugccaggacu

SEQ ID NO: 1506160 - RNA, 12 nt, Homo sapiens
agugcuaccucu

SEQ ID NO: 1506161 - RNA, 13 nt, Homo sapiens
agugcuaccucuc

SEQ ID NO: 1506162 - RNA, 16 nt, Homo sapiens
agugcuuggguggugg

SEQ ID NO: 1506163 - RNA, 22 nt, Homo sapiens
aguggaaaaaucagaagcacaa

SEQ ID NO: 1506164 - RNA, 17 nt, Homo sapiens
aguggcaggacccuuag

SEQ ID NO: 1506165 - RNA, 14 nt, Homo sapiens
aguggccaugccac

SEQ ID NO: 1506166 - RNA, 20 nt, Homo sapiens
aguggccaugccacccuguu

SEQ ID NO: 1506167 - RNA, 12 nt, Homo sapiens
aguggcuucucc

SEQ ID NO: 1506168 - RNA, 13 nt, Homo sapiens
aguggguggugga

SEQ ID NO: 1506169 - RNA, 12 nt, Homo sapiens
agugugauccca

SEQ ID NO: 1506170 - RNA, 13 nt, Homo sapiens
aguuaaguauuua

SEQ ID NO: 1506171 - RNA, 18 nt, Homo sapiens
aguuacuacuuacaggug

SEQ ID NO: 1506172 - RNA, 17 nt, Homo sapiens
aguuaggucauuacuaa

SEQ ID NO: 1506173 - RNA, 14 nt, Homo sapiens
aguuauucuugaca

SEQ ID NO: 1506174 - RNA, 22 nt, Homo sapiens
aguuauucuugacaugagaaaa

SEQ ID NO: 1506175 - RNA, 21 nt, Homo sapiens
aguucagccagaaucuucguc

SEQ ID NO: 1506176 - RNA, 19 nt, Homo sapiens
aguuccaugaagaccacau

SEQ ID NO: 1506177 - RNA, 16 nt, Homo sapiens
aguuccugcacuccag

SEQ ID NO: 1506178 - RNA, 23 nt, Homo sapiens
aguucuuuaaaauguaaagccau

SEQ ID NO: 1506179 - RNA, 16 nt, Homo sapiens
aguugaacaucucacu

SEQ ID NO: 1506180 - RNA, 22 nt, Homo sapiens
aguugucuggcuuuuugcacgu

SEQ ID NO: 1506181 - RNA, 20 nt, Homo sapiens
aguuguuuucccgagcaaag

SEQ ID NO: 1506182 - RNA, 10 nt, Homo sapiens
aguuugauau

SEQ ID NO: 1506183 - RNA, 12 nt, Homo sapiens
aguuuucaccug

SEQ ID NO: 1506184 - RNA, 21 nt, Homo sapiens
aguuuuuaauuuaucagagac

SEQ ID NO: 1506185 - RNA, 15 nt, Homo sapiens
aguuuuuguuucaca

SEQ ID NO: 1506186 - RNA, 21 nt, Homo sapiens
auaaaaccucagggacaacau

SEQ ID NO: 1506187 - RNA, 20 nt, Homo sapiens
auaaaauaaaguacauuauu

SEQ ID NO: 1506188 - RNA, 21 nt, Homo sapiens
auaaacauugguauauuucca

SEQ ID NO: 1506189 - RNA, 13 nt, Homo sapiens
auaaagacugaga

SEQ ID NO: 1506190 - RNA, 15 nt, Homo sapiens
auaaagcaagacaga

SEQ ID NO: 1506191 - RNA, 19 nt, Homo sapiens
auaaaggaagucaccaaaa

SEQ ID NO: 1506192 - RNA, 16 nt, Homo sapiens
auaaaggaugggacca

SEQ ID NO: 1506193 - RNA, 17 nt, Homo sapiens
auaaaggaugggaccaa

SEQ ID NO: 1506194 - RNA, 17 nt, Homo sapiens
auaaauuuuaacauuuu

SEQ ID NO: 1506195 - RNA, 14 nt, Homo sapiens
auaagaaacacaaa

SEQ ID NO: 1506196 - RNA, 15 nt, Homo sapiens
auaagaaacaugaug

SEQ ID NO: 1506197 - RNA, 20 nt, Homo sapiens
auaagaaacaugaugugaga

SEQ ID NO: 1506198 - RNA, 16 nt, Homo sapiens
auaaguuccauguuaa

SEQ ID NO: 1506199 - RNA, 16 nt, Homo sapiens
auaaucgagucuaccu

SEQ ID NO: 1506200 - RNA, 18 nt, Homo sapiens
auaaucgagucuaccucu

SEQ ID NO: 1506201 - RNA, 20 nt, Homo sapiens
auaaugccuuguaugguguu

SEQ ID NO: 1506202 - RNA, 18 nt, Homo sapiens
auaaugucgaacucugaa

SEQ ID NO: 1506203 - RNA, 21 nt, Homo sapiens
auaauugccuuuuccuaugua

SEQ ID NO: 1506204 - RNA, 15 nt, Homo sapiens
auaauugcuuugcca

SEQ ID NO: 1506205 - RNA, 16 nt, Homo sapiens
auacaaacaagcacag

SEQ ID NO: 1506206 - RNA, 13 nt, Homo sapiens
auacaacauguag

SEQ ID NO: 1506207 - RNA, 15 nt, Homo sapiens
auacaauuugcccaa

SEQ ID NO: 1506208 - RNA, 14 nt, Homo sapiens
auacacaacauuua

SEQ ID NO: 1506209 - RNA, 16 nt, Homo sapiens
auacagaauuacugua

SEQ ID NO: 1506210 - RNA, 19 nt, Homo sapiens
auacagucaagauacauag

SEQ ID NO: 1506211 - RNA, 15 nt, Homo sapiens
auacauuagcagcua

SEQ ID NO: 1506212 - RNA, 18 nt, Homo sapiens
auacauuggaggcuuuau

SEQ ID NO: 1506213 - RNA, 17 nt, Homo sapiens
auacauuuuacauaugg

SEQ ID NO: 1506214 - RNA, 14 nt, Homo sapiens
auacgugugugaag

SEQ ID NO: 1506215 - RNA, 24 nt, Homo sapiens
auacuacaugagaggacugaugaa

SEQ ID NO: 1506216 - RNA, 16 nt, Homo sapiens
auacuuugcaauccaa

SEQ ID NO: 1506217 - RNA, 14 nt, Homo sapiens
auagaaagcaauaa

SEQ ID NO: 1506218 - RNA, 16 nt, Homo sapiens
auagaauuuccaauau

SEQ ID NO: 1506219 - RNA, 20 nt, Homo sapiens
auagacacuggagacuugga

SEQ ID NO: 1506220 - RNA, 21 nt, Homo sapiens
auagacagcacuuggcuccuu

SEQ ID NO: 1506221 - RNA, 20 nt, Homo sapiens
auagagcuuucaaguacaug

SEQ ID NO: 1506222 - RNA, 16 nt, Homo sapiens
auagccauaugcaaua

SEQ ID NO: 1506223 - RNA, 21 nt, Homo sapiens
auagccuaauacaacauguag

SEQ ID NO: 1506224 - RNA, 16 nt, Homo sapiens
auagcgaaucaucuca

SEQ ID NO: 1506225 - RNA, 11 nt, Homo sapiens
auagcucucau

SEQ ID NO: 1506226 - RNA, 17 nt, Homo sapiens
auaggcaguagacucau

SEQ ID NO: 1506227 - RNA, 13 nt, Homo sapiens
auaguagcauuuc

SEQ ID NO: 1506228 - RNA, 15 nt, Homo sapiens
auaguauaugcauuu

SEQ ID NO: 1506229 - RNA, 16 nt, Homo sapiens
auaguggccuugucca

SEQ ID NO: 1506230 - RNA, 12 nt, Homo sapiens
auaguguccaaa

SEQ ID NO: 1506231 - RNA, 15 nt, Homo sapiens
auauaaaguguaaua

SEQ ID NO: 1506232 - RNA, 14 nt, Homo sapiens
auauacauaugaca

SEQ ID NO: 1506233 - RNA, 16 nt, Homo sapiens
auauagguugugcaaa

SEQ ID NO: 1506234 - RNA, 18 nt, Homo sapiens
auauauuuaugauaacua

SEQ ID NO: 1506235 - RNA, 19 nt, Homo sapiens
auauccucucagcucucuu

SEQ ID NO: 1506236 - RNA, 14 nt, Homo sapiens
auaucuuauguuaa

SEQ ID NO: 1506237 - RNA, 22 nt, Homo sapiens
auaugauuguauaaugugauuu

SEQ ID NO: 1506238 - RNA, 13 nt, Homo sapiens
auaugcacaugua

SEQ ID NO: 1506239 - RNA, 21 nt, Homo sapiens
auaugcauuugccuucaucca

SEQ ID NO: 1506240 - RNA, 13 nt, Homo sapiens
auauggugcaaaa

SEQ ID NO: 1506241 - RNA, 15 nt, Homo sapiens
auauguaaauagcuu

SEQ ID NO: 1506242 - RNA, 19 nt, Homo sapiens
auauguaaauagugcagaa

SEQ ID NO: 1506243 - RNA, 18 nt, Homo sapiens
auauguauauacauauca

SEQ ID NO: 1506244 - RNA, 12 nt, Homo sapiens
auaugugccaau

SEQ ID NO: 1506245 - RNA, 15 nt, Homo sapiens
auauuaaggggauca

SEQ ID NO: 1506246 - RNA, 18 nt, Homo sapiens
auauuuccauucaugcca

SEQ ID NO: 1506247 - RNA, 20 nt, Homo sapiens
auauuucccaauacauacca

SEQ ID NO: 1506248 - RNA, 23 nt, Homo sapiens
auauuuucuggguuaaaacccca

SEQ ID NO: 1506249 - RNA, 21 nt, Homo sapiens
aucaaaaucuuucagcacuca

SEQ ID NO: 1506250 - RNA, 20 nt, Homo sapiens
cauuuguguuuugaaagccc

SEQ ID NO: 1506251 - RNA, 20 nt, Homo sapiens
cauuuuacuuccaugauacu

SEQ ID NO: 1506252 - RNA, 23 nt, Homo sapiens
cauuuuuaccuuguggaugcuag

SEQ ID NO: 1506253 - RNA, 19 nt, Homo sapiens
ccaaaaaggaacacuggaa

SEQ ID NO: 1506254 - RNA, 13 nt, Homo sapiens
ccaaaauguuaau

SEQ ID NO: 1506255 - RNA, 20 nt, Homo sapiens
ccaaagauaauguuauacau

SEQ ID NO: 1506256 - RNA, 18 nt, Homo sapiens
ccaaaggcauaagacccu

SEQ ID NO: 1506257 - RNA, 20 nt, Homo sapiens
ccaaaggcauccauagugca

SEQ ID NO: 1506258 - RNA, 23 nt, Homo sapiens
ccaaauaaacucuaaacauuaau

SEQ ID NO: 1506259 - RNA, 21 nt, Homo sapiens
ccaaauaaggauuuguucaca

SEQ ID NO: 1506260 - RNA, 24 nt, Homo sapiens
ccaaauaaggauuuguucacaugc

SEQ ID NO: 1506261 - RNA, 17 nt, Homo sapiens
ccaaccccccaccugcc

SEQ ID NO: 1506262 - RNA, 19 nt, Homo sapiens
ccaacuugguuuugcuaca

SEQ ID NO: 1506263 - RNA, 10 nt, Homo sapiens
ccaagagcua

SEQ ID NO: 1506264 - RNA, 13 nt, Homo sapiens
ccaaggaacaaga

SEQ ID NO: 1506265 - RNA, 18 nt, Homo sapiens
ccaagguaaacaguuuga

SEQ ID NO: 1506266 - RNA, 19 nt, Homo sapiens
ccaaggugaauagcacagg

SEQ ID NO: 1506267 - RNA, 15 nt, Homo sapiens
ccaauaggugcaaaa

SEQ ID NO: 1506268 - RNA, 20 nt, Homo sapiens
ccacaauaagaguucuugcc

SEQ ID NO: 1506269 - RNA, 22 nt, Homo sapiens
ccacaaucuggcuuagugccac

SEQ ID NO: 1506270 - RNA, 13 nt, Homo sapiens
ccacaccaucucc

SEQ ID NO: 1506271 - RNA, 11 nt, Homo sapiens
ccacagggaac

SEQ ID NO: 1506272 - RNA, 21 nt, Homo sapiens
ccacaguucuaagacccaaag

SEQ ID NO: 1506273 - RNA, 14 nt, Homo sapiens
ccacauaaucucuc

SEQ ID NO: 1506274 - RNA, 19 nt, Homo sapiens
ccacauuauacauuugaug

SEQ ID NO: 1506275 - RNA, 13 nt, Homo sapiens
ccacauuggacuu

SEQ ID NO: 1506276 - RNA, 15 nt, Homo sapiens
ccaccacgugcucaa

SEQ ID NO: 1506277 - RNA, 12 nt, Homo sapiens
ccaccaggcuag

SEQ ID NO: 1506278 - RNA, 16 nt, Homo sapiens
ccaccagggcacuguc

SEQ ID NO: 1506279 - RNA, 16 nt, Homo sapiens
ccacccaccuuugcca

SEQ ID NO: 1506280 - RNA, 10 nt, Homo sapiens
ccaccucuca

SEQ ID NO: 1506281 - RNA, 16 nt, Homo sapiens
ccaccuuugccacaaa

SEQ ID NO: 1506282 - RNA, 16 nt, Homo sapiens
ccacuaggacucugag

SEQ ID NO: 1506283 - RNA, 11 nt, Homo sapiens
ccacucaggcc

SEQ ID NO: 1506284 - RNA, 14 nt, Homo sapiens
ccacuugucaucca

SEQ ID NO: 1506285 - RNA, 19 nt, Homo sapiens
ccagaacaauucugcagag

SEQ ID NO: 1506286 - RNA, 14 nt, Homo sapiens
ccagaaugcuaaag

SEQ ID NO: 1506287 - RNA, 23 nt, Homo sapiens
ccagacuuuaccacuaugcaaua

SEQ ID NO: 1506288 - RNA, 17 nt, Homo sapiens
ccagagccacuaccuuu

SEQ ID NO: 1506289 - RNA, 19 nt, Homo sapiens
ccagaggcagagugaaaua

SEQ ID NO: 1506290 - RNA, 17 nt, Homo sapiens
ccagagucaaauuugaa

SEQ ID NO: 1506291 - RNA, 22 nt, Homo sapiens
ccagaguguccccagagacaug

SEQ ID NO: 1506292 - RNA, 20 nt, Homo sapiens
ccagauguuuacagacugug

SEQ ID NO: 1506293 - RNA, 23 nt, Homo sapiens
ccagcagugugucaggugcugca

SEQ ID NO: 1506294 - RNA, 15 nt, Homo sapiens
ccagcuccaguuucc

SEQ ID NO: 1506295 - RNA, 16 nt, Homo sapiens
ccaggaauaggcauuu

SEQ ID NO: 1506296 - RNA, 13 nt, Homo sapiens
ccaggaaugccuc

SEQ ID NO: 1506297 - RNA, 14 nt, Homo sapiens
ccaggacugugaua

SEQ ID NO: 1506298 - RNA, 13 nt, Homo sapiens
ccaggagcucucu

SEQ ID NO: 1506299 - RNA, 14 nt, Homo sapiens
ccaggcuagaggca

SEQ ID NO: 1506300 - RNA, 15 nt, Homo sapiens
ccaggcuagagugca

SEQ ID NO: 1506301 - RNA, 17 nt, Homo sapiens
ccaggcuggaguacagu

SEQ ID NO: 1506302 - RNA, 22 nt, Homo sapiens
ccaggguugaucacacucuggg

SEQ ID NO: 1506303 - RNA, 14 nt, Homo sapiens
ccaguaagugauaa

SEQ ID NO: 1506304 - RNA, 13 nt, Homo sapiens
ccaguacugggaa

SEQ ID NO: 1506305 - RNA, 20 nt, Homo sapiens
ccaguaggaaaucaggcagu

SEQ ID NO: 1506306 - RNA, 21 nt, Homo sapiens
ccaguaggaaaucaggcaguu

SEQ ID NO: 1506307 - RNA, 23 nt, Homo sapiens
ccagugagaugacauugccucag

SEQ ID NO: 1506308 - RNA, 17 nt, Homo sapiens
ccagugcaacaaaauca

SEQ ID NO: 1506309 - RNA, 19 nt, Homo sapiens
ccaguggugaagaaaacuc

SEQ ID NO: 1506310 - RNA, 17 nt, Homo sapiens
ccaguuagcaacaaauc

SEQ ID NO: 1506311 - RNA, 12 nt, Homo sapiens
ccauaacagcca

SEQ ID NO: 1506312 - RNA, 13 nt, Homo sapiens
ccauagauggguc

SEQ ID NO: 1506313 - RNA, 19 nt, Homo sapiens
ccauauaucuuauguuaaa

SEQ ID NO: 1506314 - RNA, 16 nt, Homo sapiens
ccauaucuacccagaa

SEQ ID NO: 1506315 - RNA, 22 nt, Homo sapiens
ccauccagccgcugcacaucac

SEQ ID NO: 1506316 - RNA, 14 nt, Homo sapiens
ccaucguguuugca

SEQ ID NO: 1506317 - RNA, 18 nt, Homo sapiens
ccaucugaaccacuuugc

SEQ ID NO: 1506318 - RNA, 22 nt, Homo sapiens
ccaugaaacuuuagagauuaac

SEQ ID NO: 1506319 - RNA, 14 nt, Homo sapiens
ccaugaagaccaca

SEQ ID NO: 1506320 - RNA, 14 nt, Homo sapiens
ccaugcaccucagg

SEQ ID NO: 1506321 - RNA, 18 nt, Homo sapiens
ccaugcccucccugcugc

SEQ ID NO: 1506322 - RNA, 23 nt, Homo sapiens
ccauguacucaaguaccaccaag

SEQ ID NO: 1506323 - RNA, 23 nt, Homo sapiens
ccauguuucacaaggucuuuaaa

SEQ ID NO: 1506324 - RNA, 14 nt, Homo sapiens
ccauuaagagugaa

SEQ ID NO: 1506325 - RNA, 16 nt, Homo sapiens
ccauuacugcauaaaa

SEQ ID NO: 1506326 - RNA, 18 nt, Homo sapiens
ccauuaggcaugccuaau

SEQ ID NO: 1506327 - RNA, 21 nt, Homo sapiens
ccauuccuggaaucaaggaau

SEQ ID NO: 1506328 - RNA, 21 nt, Homo sapiens
ccauugaauuugccuuccuca

SEQ ID NO: 1506329 - RNA, 17 nt, Homo sapiens
ccauuuuacuuccauga

SEQ ID NO: 1506330 - RNA, 13 nt, Homo sapiens
cccaaaccuagcu

SEQ ID NO: 1506331 - RNA, 12 nt, Homo sapiens
cccaaagagccu

SEQ ID NO: 1506332 - RNA, 22 nt, Homo sapiens
cccaaccuccccugguccugca

SEQ ID NO: 1506333 - RNA, 23 nt, Homo sapiens
cccaacugcucugcccacuguga

SEQ ID NO: 1506334 - RNA, 21 nt, Homo sapiens
cccaagguaaacaguuugaaa

SEQ ID NO: 1506335 - RNA, 23 nt, Homo sapiens
cccacaaucuggcuuagugccac

SEQ ID NO: 1506336 - RNA, 13 nt, Homo sapiens
cccacaguccuca

SEQ ID NO: 1506337 - RNA, 13 nt, Homo sapiens
cccaccuuugcca

SEQ ID NO: 1506338 - RNA, 18 nt, Homo sapiens
cccacuguaucuaggcaa

SEQ ID NO: 1506339 - RNA, 16 nt, Homo sapiens
cccagagacaugcaag

SEQ ID NO: 1506340 - RNA, 23 nt, Homo sapiens
cccagagaccccuuccuuuccuc

SEQ ID NO: 1506341 - RNA, 23 nt, Homo sapiens
cccagaggccaggaaucugccau

SEQ ID NO: 1506342 - RNA, 12 nt, Homo sapiens
cccagcaaagag

SEQ ID NO: 1506343 - RNA, 16 nt, Homo sapiens
cccagcaacacaagcu

SEQ ID NO: 1506344 - RNA, 15 nt, Homo sapiens
cccagccaacugccc

SEQ ID NO: 1506345 - RNA, 15 nt, Homo sapiens
cccagccacucggga

SEQ ID NO: 1506346 - RNA, 21 nt, Homo sapiens
cccagccuagcccacuuguca

SEQ ID NO: 1506347 - RNA, 11 nt, Homo sapiens
cccagcucucg

SEQ ID NO: 1506348 - RNA, 21 nt, Homo sapiens
cccaggaaacacaaauggggu

SEQ ID NO: 1506349 - RNA, 16 nt, Homo sapiens
cccaggcuggucuuga

SEQ ID NO: 1506350 - RNA, 17 nt, Homo sapiens
cccauuuugagugacuc

SEQ ID NO: 1506351 - RNA, 22 nt, Homo sapiens
ccccaccugccauuugcacccu

SEQ ID NO: 1506352 - RNA, 17 nt, Homo sapiens
ccccaucucauucaggu

SEQ ID NO: 1506353 - RNA, 18 nt, Homo sapiens
ccccugguccugcacugu

SEQ ID NO: 1506354 - RNA, 22 nt, Homo sapiens
ccccuuauccaggacucuguca

SEQ ID NO: 1506355 - RNA, 20 nt, Homo sapiens
cccgucauguuccucaaaag

SEQ ID NO: 1506356 - RNA, 23 nt, Homo sapiens
cccguggccauuacugcauaaaa

SEQ ID NO: 1506357 - RNA, 15 nt, Homo sapiens
cccuaggaagcugga

SEQ ID NO: 1506358 - RNA, 10 nt, Homo sapiens
cccucaggcc

SEQ ID NO: 1506359 - RNA, 19 nt, Homo sapiens
cccucauccuuuuacuuuu

SEQ ID NO: 1506360 - RNA, 19 nt, Homo sapiens
cccugcuugcacuuuguaa

SEQ ID NO: 1506361 - RNA, 14 nt, Homo sapiens
cccugucucaaaaa

SEQ ID NO: 1506362 - RNA, 15 nt, Homo sapiens
cccugucucuacuaa

SEQ ID NO: 1506363 - RNA, 18 nt, Homo sapiens
cccuguggggccugaugg

SEQ ID NO: 1506364 - RNA, 21 nt, Homo sapiens
cccuugugucaagacauuucu

SEQ ID NO: 1506365 - RNA, 17 nt, Homo sapiens
ccgagagagauggaaua

SEQ ID NO: 1506366 - RNA, 20 nt, Homo sapiens
ccgagagagauggaauaaag

SEQ ID NO: 1506367 - RNA, 22 nt, Homo sapiens
ccgggaagcggagguugcaggg

SEQ ID NO: 1506368 - RNA, 16 nt, Homo sapiens
ccggggguggugacau

SEQ ID NO: 1506369 - RNA, 14 nt, Homo sapiens
ccgguggcagugga

SEQ ID NO: 1506370 - RNA, 23 nt, Homo sapiens
ccgguuaaauuccauaugcucca

SEQ ID NO: 1506371 - RNA, 17 nt, Homo sapiens
ccgugaccagugcugcu

SEQ ID NO: 1506372 - RNA, 11 nt, Homo sapiens
ccguugcacaa

SEQ ID NO: 1506373 - RNA, 17 nt, Homo sapiens
ccuaaacaucauucauu

SEQ ID NO: 1506374 - RNA, 17 nt, Homo sapiens
ccuaaacuguacaugug

SEQ ID NO: 1506375 - RNA, 20 nt, Homo sapiens
ccuaaguauaaaugguuguc

SEQ ID NO: 1506376 - RNA, 14 nt, Homo sapiens
ccuaucacugauag

SEQ ID NO: 1506377 - RNA, 14 nt, Homo sapiens
ccuauuucuuaaac

SEQ ID NO: 1506378 - RNA, 23 nt, Homo sapiens
ccucaaacuccuggacucaugca

SEQ ID NO: 1506379 - RNA, 20 nt, Homo sapiens
ccucaacaacaaaccaaaac

SEQ ID NO: 1506380 - RNA, 17 nt, Homo sapiens
ccucaauaaauguugcu

SEQ ID NO: 1506381 - RNA, 13 nt, Homo sapiens
ccucacuauucaa

SEQ ID NO: 1506382 - RNA, 19 nt, Homo sapiens
ccucaggccaggugcagug

SEQ ID NO: 1506383 - RNA, 18 nt, Homo sapiens
ccucagggacaacauuuu

SEQ ID NO: 1506384 - RNA, 16 nt, Homo sapiens
ccucauggucauggac

SEQ ID NO: 1506385 - RNA, 17 nt, Homo sapiens
uccuuuaccuaccaccu

SEQ ID NO: 1506386 - RNA, 18 nt, Homo sapiens
ucgaauuuuucagaugau

SEQ ID NO: 1506387 - RNA, 15 nt, Homo sapiens
ucgagucuaccucuu

SEQ ID NO: 1506388 - RNA, 11 nt, Homo sapiens
ucgcaucucag

SEQ ID NO: 1506389 - RNA, 21 nt, Homo sapiens
ucggccguacaucucugugag

SEQ ID NO: 1506390 - RNA, 13 nt, Homo sapiens
ucguagccaucuc

SEQ ID NO: 1506391 - RNA, 18 nt, Homo sapiens
ucguauccccaagccaca

SEQ ID NO: 1506392 - RNA, 21 nt, Homo sapiens
ucuaacauuugcaaaauggaa

SEQ ID NO: 1506393 - RNA, 16 nt, Homo sapiens
ucuaacuacaaggaca

SEQ ID NO: 1506394 - RNA, 23 nt, Homo sapiens
ucuacaagcauuugcccugugga

SEQ ID NO: 1506395 - RNA, 22 nt, Homo sapiens
ucuacugugacugauguuacau

SEQ ID NO: 1506396 - RNA, 13 nt, Homo sapiens
ucuacuuugucua

SEQ ID NO: 1506397 - RNA, 15 nt, Homo sapiens
ucuagaaacagaucu

SEQ ID NO: 1506398 - RNA, 17 nt, Homo sapiens
ucuagaagauaucauga

SEQ ID NO: 1506399 - RNA, 22 nt, Homo sapiens
ucuagacugucucuguggaaua

SEQ ID NO: 1506400 - RNA, 21 nt, Homo sapiens
ucuagccacaguucuaagacc

SEQ ID NO: 1506401 - RNA, 21 nt, Homo sapiens
ucuaggugggagagagugcau

SEQ ID NO: 1506402 - RNA, 12 nt, Homo sapiens
ucuauaggucau

SEQ ID NO: 1506403 - RNA, 15 nt, Homo sapiens
ucuauaugauccuga

SEQ ID NO: 1506404 - RNA, 18 nt, Homo sapiens
ucuauauuggucauugcc

SEQ ID NO: 1506405 - RNA, 18 nt, Homo sapiens
ucuaugaguuggacuuca

SEQ ID NO: 1506406 - RNA, 21 nt, Homo sapiens
ucucaauaugcuuacaaaguc

SEQ ID NO: 1506407 - RNA, 20 nt, Homo sapiens
ucucacagaggcaguaggaa

SEQ ID NO: 1506408 - RNA, 20 nt, Homo sapiens
ucucacugcugucagccaag

SEQ ID NO: 1506409 - RNA, 23 nt, Homo sapiens
ucucacuuugccccaguuacaaa

SEQ ID NO: 1506410 - RNA, 18 nt, Homo sapiens
ucucagcgcaacagcugu

SEQ ID NO: 1506411 - RNA, 18 nt, Homo sapiens
ucuccaccuuguuacaca

SEQ ID NO: 1506412 - RNA, 12 nt, Homo sapiens
ucuccagguuug

SEQ ID NO: 1506413 - RNA, 14 nt, Homo sapiens
ucucccagccucuu

SEQ ID NO: 1506414 - RNA, 14 nt, Homo sapiens
ucucccugccaagu

SEQ ID NO: 1506415 - RNA, 16 nt, Homo sapiens
ucuccgcacuuggaaa

SEQ ID NO: 1506416 - RNA, 14 nt, Homo sapiens
ucuccuucugaaag

SEQ ID NO: 1506417 - RNA, 17 nt, Homo sapiens
ucucgcagauguuaccu

SEQ ID NO: 1506418 - RNA, 21 nt, Homo sapiens
ucucuacuaaaaacacaaaag

SEQ ID NO: 1506419 - RNA, 14 nt, Homo sapiens
ucucucucucugga

SEQ ID NO: 1506420 - RNA, 22 nt, Homo sapiens
ucucugagauguguucagauag

SEQ ID NO: 1506421 - RNA, 16 nt, Homo sapiens
ucucuggacacacuau

SEQ ID NO: 1506422 - RNA, 16 nt, Homo sapiens
ucucuggaucuaugau

SEQ ID NO: 1506423 - RNA, 17 nt, Homo sapiens
ucucuugccagcauuuu

SEQ ID NO: 1506424 - RNA, 16 nt, Homo sapiens
ucucuuggccuguccu

SEQ ID NO: 1506425 - RNA, 14 nt, Homo sapiens
ucugaacuguuaca

SEQ ID NO: 1506426 - RNA, 15 nt, Homo sapiens
ucugacuuugagacg

SEQ ID NO: 1506427 - RNA, 20 nt, Homo sapiens
ucugagaagacacaagguga

SEQ ID NO: 1506428 - RNA, 16 nt, Homo sapiens
ucugaguucuggugag

SEQ ID NO: 1506429 - RNA, 20 nt, Homo sapiens
ucugauacccagagcauuac

SEQ ID NO: 1506430 - RNA, 23 nt, Homo sapiens
ucugauuuaacacuauccaauga

SEQ ID NO: 1506431 - RNA, 18 nt, Homo sapiens
ucugcagggagcaacucu

SEQ ID NO: 1506432 - RNA, 19 nt, Homo sapiens
ucugcauaguggccuuguc

SEQ ID NO: 1506433 - RNA, 15 nt, Homo sapiens
ucugcccacugugaa

SEQ ID NO: 1506434 - RNA, 22 nt, Homo sapiens
ucugcccacugugaaaccacua

SEQ ID NO: 1506435 - RNA, 14 nt, Homo sapiens
ucugccucacauca

SEQ ID NO: 1506436 - RNA, 19 nt, Homo sapiens
ucuggaaaacucaggauuc

SEQ ID NO: 1506437 - RNA, 13 nt, Homo sapiens
ucuggaaaccacg

SEQ ID NO: 1506438 - RNA, 22 nt, Homo sapiens
ucugggagggauguucuagccc

SEQ ID NO: 1506439 - RNA, 20 nt, Homo sapiens
ucugggauucccaccaaggu

SEQ ID NO: 1506440 - RNA, 21 nt, Homo sapiens
ucugggcaaugaaaccaaagc

SEQ ID NO: 1506441 - RNA, 23 nt, Homo sapiens
ucuggucuucacugccaugccuc

SEQ ID NO: 1506442 - RNA, 17 nt, Homo sapiens
ucuguaauuucacuuua

SEQ ID NO: 1506443 - RNA, 19 nt, Homo sapiens
ucuguagcuuguucccugu

SEQ ID NO: 1506444 - RNA, 15 nt, Homo sapiens
ucugugcgucugugu

SEQ ID NO: 1506445 - RNA, 24 nt, Homo sapiens
ucuguguaaaucuaacuacaagga

SEQ ID NO: 1506446 - RNA, 14 nt, Homo sapiens
ucuuacacuacauu

SEQ ID NO: 1506447 - RNA, 17 nt, Homo sapiens
ucuuauaacuucugaag

SEQ ID NO: 1506448 - RNA, 12 nt, Homo sapiens
ucuucacugcca

SEQ ID NO: 1506449 - RNA, 11 nt, Homo sapiens
ucuucagccau

SEQ ID NO: 1506450 - RNA, 13 nt, Homo sapiens
ucuuccuacacau

SEQ ID NO: 1506451 - RNA, 14 nt, Homo sapiens
ucuuccugccucag

SEQ ID NO: 1506452 - RNA, 20 nt, Homo sapiens
ucuuccuuacccugcgauuu

SEQ ID NO: 1506453 - RNA, 15 nt, Homo sapiens
ucuucgcugcuagag

SEQ ID NO: 1506454 - RNA, 23 nt, Homo sapiens
ucuucuauauuccgggugccauu

SEQ ID NO: 1506455 - RNA, 19 nt, Homo sapiens
ucuucuggacugguuuuca

SEQ ID NO: 1506456 - RNA, 22 nt, Homo sapiens
ucuucuuauucaugcuuucucc

SEQ ID NO: 1506457 - RNA, 20 nt, Homo sapiens
ucuugaaccccuggccucaa

SEQ ID NO: 1506458 - RNA, 13 nt, Homo sapiens
ucuugacauguaa

SEQ ID NO: 1506459 - RNA, 16 nt, Homo sapiens
ucuugcauucccagug

SEQ ID NO: 1506460 - RNA, 22 nt, Homo sapiens
ucuugcugccaggcccacacau

SEQ ID NO: 1506461 - RNA, 22 nt, Homo sapiens
ucuugcuguaacucagacauuc

SEQ ID NO: 1506462 - RNA, 15 nt, Homo sapiens
ucuuggaagugugug

SEQ ID NO: 1506463 - RNA, 21 nt, Homo sapiens
ucuugggguuuucaguaugaa

SEQ ID NO: 1506464 - RNA, 16 nt, Homo sapiens
ucuuuaaccucaucua

SEQ ID NO: 1506465 - RNA, 17 nt, Homo sapiens
ucuuuacaauaaacaua

SEQ ID NO: 1506466 - RNA, 15 nt, Homo sapiens
ucuuuccaugccacg

SEQ ID NO: 1506467 - RNA, 18 nt, Homo sapiens
ucuuucccagaugcccca

SEQ ID NO: 1506468 - RNA, 23 nt, Homo sapiens
ucuuuccuaagaaagacaucaca

SEQ ID NO: 1506469 - RNA, 18 nt, Homo sapiens
ucuuugacucugucacac

SEQ ID NO: 1506470 - RNA, 17 nt, Homo sapiens
ucuuuucgaauguggcu

SEQ ID NO: 1506471 - RNA, 21 nt, Homo sapiens
ucuuuugggggucaacaguuu

SEQ ID NO: 1506472 - RNA, 17 nt, Homo sapiens
ucuuuuuccuuuugcca

SEQ ID NO: 1506473 - RNA, 15 nt, Homo sapiens
ugaaaaaacugguau

SEQ ID NO: 1506474 - RNA, 16 nt, Homo sapiens
ugaaaaauaugugcuu

SEQ ID NO: 1506475 - RNA, 17 nt, Homo sapiens
ugaaaacauaaucugca

SEQ ID NO: 1506476 - RNA, 16 nt, Homo sapiens
ugaaaagacaaauggg

SEQ ID NO: 1506477 - RNA, 17 nt, Homo sapiens
ugaaaauuauuccuugc

SEQ ID NO: 1506478 - RNA, 20 nt, Homo sapiens
ugaaacauauuuauaguuua

SEQ ID NO: 1506479 - RNA, 15 nt, Homo sapiens
ugaaacuuaauuaca

SEQ ID NO: 1506480 - RNA, 20 nt, Homo sapiens
ugaaacuucauaaauguuca

SEQ ID NO: 1506481 - RNA, 16 nt, Homo sapiens
ugaaagagaguaccau

SEQ ID NO: 1506482 - RNA, 10 nt, Homo sapiens
ugaaagcaga

SEQ ID NO: 1506483 - RNA, 17 nt, Homo sapiens
ugaaagcccaaggugcu

SEQ ID NO: 1506484 - RNA, 14 nt, Homo sapiens
ugaaauaccacaag

SEQ ID NO: 1506485 - RNA, 16 nt, Homo sapiens
ugaaauugaaccuggu

SEQ ID NO: 1506486 - RNA, 20 nt, Homo sapiens
ugaacaaaaaaaacaaaaag

SEQ ID NO: 1506487 - RNA, 16 nt, Homo sapiens
ugaacagccaaaugca

SEQ ID NO: 1506488 - RNA, 18 nt, Homo sapiens
ugaacaucucacuuugcc

SEQ ID NO: 1506489 - RNA, 12 nt, Homo sapiens
ugaacauuugcu

SEQ ID NO: 1506490 - RNA, 14 nt, Homo sapiens
ugaaccacuuugcc

SEQ ID NO: 1506491 - RNA, 23 nt, Homo sapiens
ugaaccuauuucuuaaacacuug

SEQ ID NO: 1506492 - RNA, 13 nt, Homo sapiens
ugaacugcugauu

SEQ ID NO: 1506493 - RNA, 15 nt, Homo sapiens
ugaagaaaacuccuu

SEQ ID NO: 1506494 - RNA, 20 nt, Homo sapiens
ugaagaaaagcacuuuuuaa

SEQ ID NO: 1506495 - RNA, 15 nt, Homo sapiens
ugaagacaucuuccc

SEQ ID NO: 1506496 - RNA, 12 nt, Homo sapiens
ugaagaguacag

SEQ ID NO: 1506497 - RNA, 17 nt, Homo sapiens
ugaaggaggugagggau

SEQ ID NO: 1506498 - RNA, 18 nt, Homo sapiens
ugaagguaacugagagca

SEQ ID NO: 1506499 - RNA, 16 nt, Homo sapiens
ugaaggucacucuucc

SEQ ID NO: 1506500 - RNA, 17 nt, Homo sapiens
ugaaguggccagaugag

SEQ ID NO: 1506501 - RNA, 23 nt, Homo sapiens
ugaaguuagggaugacugugauu

SEQ ID NO: 1506502 - RNA, 16 nt, Homo sapiens
ugaaguuugaacuuca

SEQ ID NO: 1506503 - RNA, 22 nt, Homo sapiens
ugaauaauuuucuggcacuggu

SEQ ID NO: 1506504 - RNA, 20 nt, Homo sapiens
ugaaucaggggcaaacggag

SEQ ID NO: 1506505 - RNA, 19 nt, Homo sapiens
ugaaugccucaaugugacc

SEQ ID NO: 1506506 - RNA, 18 nt, Homo sapiens
ugaauuggauacaaggau

SEQ ID NO: 1506507 - RNA, 22 nt, Homo sapiens
ugaauuuugggacuucuaccca

SEQ ID NO: 1506508 - RNA, 19 nt, Homo sapiens
ugacaacauuucuauagcc

SEQ ID NO: 1506509 - RNA, 14 nt, Homo sapiens
ugacaagcacugcu

SEQ ID NO: 1506510 - RNA, 14 nt, Homo sapiens
ugacaaguagggca

SEQ ID NO: 1506511 - RNA, 18 nt, Homo sapiens
ugacauauauauguauau

SEQ ID NO: 1506512 - RNA, 14 nt, Homo sapiens
ugacaugucucaca

SEQ ID NO: 1506513 - RNA, 15 nt, Homo sapiens
ugacaugucucacag

SEQ ID NO: 1506514 - RNA, 20 nt, Homo sapiens
ugacauugcuucugcuaaau

SEQ ID NO: 1506515 - RNA, 20 nt, Homo sapiens
ugaccaagauacuuaagugc

SEQ ID NO: 1506516 - RNA, 22 nt, Homo sapiens
ugaccugaggcuccugugcuac

SEQ ID NO: 1506517 - RNA, 21 nt, Homo sapiens
ugaccugucaccgugagcagc

SEQ ID NO: 1506518 - RNA, 22 nt, Homo sapiens
ugacuauccagugauccucaaa

SEQ ID NO: 1506519 - RNA, 17 nt, Homo sapiens
uugugcugccuguggug

SEQ ID NO: 1506520 - RNA, 22 nt, Homo sapiens
uuguguguguguguugauccca

SEQ ID NO: 1506521 - RNA, 14 nt, Homo sapiens
uuguucacauauau

SEQ ID NO: 1506522 - RNA, 19 nt, Homo sapiens
uuguuuguaaaugccucuu

SEQ ID NO: 1506523 - RNA, 22 nt, Homo sapiens
uuuaaacacuuaucuucuggau

SEQ ID NO: 1506524 - RNA, 17 nt, Homo sapiens
uuuaaagagcauaauaa

SEQ ID NO: 1506525 - RNA, 17 nt, Homo sapiens
uuuaacauuuuccaaaa

SEQ ID NO: 1506526 - RNA, 14 nt, Homo sapiens
uuuaacugcauaau

SEQ ID NO: 1506527 - RNA, 11 nt, Homo sapiens
uuuaagaacga

SEQ ID NO: 1506528 - RNA, 16 nt, Homo sapiens
uuuaagauaaacagaa

SEQ ID NO: 1506529 - RNA, 20 nt, Homo sapiens
uuuaaguggcuuucagcaaa

SEQ ID NO: 1506530 - RNA, 16 nt, Homo sapiens
uuuaauaagaguaaaa

SEQ ID NO: 1506531 - RNA, 14 nt, Homo sapiens
uuuaauacauuaag

SEQ ID NO: 1506532 - RNA, 17 nt, Homo sapiens
uuuacaaguguauauca

SEQ ID NO: 1506533 - RNA, 12 nt, Homo sapiens
uuuacagaauuu

SEQ ID NO: 1506534 - RNA, 14 nt, Homo sapiens
uuuacagaauuuua

SEQ ID NO: 1506535 - RNA, 20 nt, Homo sapiens
uuuaccacuaugcaauauau

SEQ ID NO: 1506536 - RNA, 14 nt, Homo sapiens
uuuacuuccaugau

SEQ ID NO: 1506537 - RNA, 17 nt, Homo sapiens
uuuacuuccaugauacu

SEQ ID NO: 1506538 - RNA, 18 nt, Homo sapiens
uuuagcaggguacauauu

SEQ ID NO: 1506539 - RNA, 14 nt, Homo sapiens
uuuauagcucauca

SEQ ID NO: 1506540 - RNA, 15 nt, Homo sapiens
uuuaucagaauauca

SEQ ID NO: 1506541 - RNA, 15 nt, Homo sapiens
uuuaugaaccuagag

SEQ ID NO: 1506542 - RNA, 15 nt, Homo sapiens
uuuauguucuaguga

SEQ ID NO: 1506543 - RNA, 12 nt, Homo sapiens
uuuauuugucug

SEQ ID NO: 1506544 - RNA, 13 nt, Homo sapiens
uuucaaacuauug

SEQ ID NO: 1506545 - RNA, 16 nt, Homo sapiens
uuucaacauaucauuu

SEQ ID NO: 1506546 - RNA, 14 nt, Homo sapiens
uuucaagacuugau

SEQ ID NO: 1506547 - RNA, 20 nt, Homo sapiens
uuucaaggaaaaaugcugcu

SEQ ID NO: 1506548 - RNA, 22 nt, Homo sapiens
uuucacaaaaaggcauaugcaa

SEQ ID NO: 1506549 - RNA, 21 nt, Homo sapiens
uuucaucuuuuaauucaccuc

SEQ ID NO: 1506550 - RNA, 18 nt, Homo sapiens
uuucaugcacacuguugg

SEQ ID NO: 1506551 - RNA, 21 nt, Homo sapiens
uuuccaaaaaggaacacugga

SEQ ID NO: 1506552 - RNA, 21 nt, Homo sapiens
uuuccuccuguguacagggaa

SEQ ID NO: 1506553 - RNA, 13 nt, Homo sapiens
uuucgaacauucu

SEQ ID NO: 1506554 - RNA, 13 nt, Homo sapiens
uuucuagacuguc

SEQ ID NO: 1506555 - RNA, 15 nt, Homo sapiens
uuucuagagcacugc

SEQ ID NO: 1506556 - RNA, 15 nt, Homo sapiens
uuucucucaggguuc

SEQ ID NO: 1506557 - RNA, 13 nt, Homo sapiens
uuucugccucaca

SEQ ID NO: 1506558 - RNA, 23 nt, Homo sapiens
uuucugcucccucgacacuugau

SEQ ID NO: 1506559 - RNA, 15 nt, Homo sapiens
uuucuggaccagauc

SEQ ID NO: 1506560 - RNA, 15 nt, Homo sapiens
uuucuguaaccaaaa

SEQ ID NO: 1506561 - RNA, 17 nt, Homo sapiens
uuucuguugccacaacc

SEQ ID NO: 1506562 - RNA, 18 nt, Homo sapiens
uuucuuacccauauaucu

SEQ ID NO: 1506563 - RNA, 17 nt, Homo sapiens
uuucuugaaccaauaau

SEQ ID NO: 1506564 - RNA, 17 nt, Homo sapiens
uuucuuucucacuaaau

SEQ ID NO: 1506565 - RNA, 13 nt, Homo sapiens
uuugaaaugucau

SEQ ID NO: 1506566 - RNA, 16 nt, Homo sapiens
uuugagcaaaccacau

SEQ ID NO: 1506567 - RNA, 18 nt, Homo sapiens
uuugagcaggagcagaaa

SEQ ID NO: 1506568 - RNA, 21 nt, Homo sapiens
uuugauuauauacuauguaug

SEQ ID NO: 1506569 - RNA, 14 nt, Homo sapiens
uuugauucagacag

SEQ ID NO: 1506570 - RNA, 14 nt, Homo sapiens
uuugcaaaauggaa

SEQ ID NO: 1506571 - RNA, 17 nt, Homo sapiens
uuuggaugaccagaaca

SEQ ID NO: 1506572 - RNA, 14 nt, Homo sapiens
uuugucaacacaaa

SEQ ID NO: 1506573 - RNA, 17 nt, Homo sapiens
uuugucucugcaucuca

SEQ ID NO: 1506574 - RNA, 12 nt, Homo sapiens
uuugugaacugg

SEQ ID NO: 1506575 - RNA, 13 nt, Homo sapiens
uuuguguuuacau

SEQ ID NO: 1506576 - RNA, 16 nt, Homo sapiens
uuuuaauuugauacaa

SEQ ID NO: 1506577 - RNA, 16 nt, Homo sapiens
uuuuacuuccaugaua

SEQ ID NO: 1506578 - RNA, 22 nt, Homo sapiens
uuuuacuuccaugauacuuuaa

SEQ ID NO: 1506579 - RNA, 17 nt, Homo sapiens
uuuucaugucauuugac

SEQ ID NO: 1506580 - RNA, 19 nt, Homo sapiens
uuuucccgagcaaagucua

SEQ ID NO: 1506581 - RNA, 13 nt, Homo sapiens
uuuucgaacauuc

SEQ ID NO: 1506582 - RNA, 23 nt, Homo sapiens
uuuuuaauaaaaguacugaagac

SEQ ID NO: 1506583 - RNA, 16 nt, Homo sapiens
uuuuugguguauuuga

SEQ ID NO: 1506584 - RNA, 17 nt, Homo sapiens
uuuuuguaaaggaaaua

SEQ ID NO: 1506585 - RNA, 13 nt, Homo sapiens
acaacaaaccaaa

SEQ ID NO: 1506586 - RNA, 17 nt, Homo sapiens
acaacauugcauuguga

SEQ ID NO: 1506587 - RNA, 14 nt, Homo sapiens
acaacauuuacuua

SEQ ID NO: 1506588 - RNA, 19 nt, Homo sapiens
acaacauuuacuuaacaga

SEQ ID NO: 1506589 - RNA, 22 nt, Homo sapiens
acaacauuuuugguguauuuga

SEQ ID NO: 1506590 - RNA, 17 nt, Homo sapiens
acaaccuuguugcuuua

SEQ ID NO: 1506591 - RNA, 21 nt, Homo sapiens
acaacuuguauuuccaaaccu

SEQ ID NO: 1506592 - RNA, 19 nt, Homo sapiens
acaagauugucuuuuccua

SEQ ID NO: 1506593 - RNA, 11 nt, Homo sapiens
acaagcacaga

SEQ ID NO: 1506594 - RNA, 21 nt, Homo sapiens
acaagcauuugcccuguggau

SEQ ID NO: 1506595 - RNA, 14 nt, Homo sapiens
acaagccugagaac

SEQ ID NO: 1506596 - RNA, 20 nt, Homo sapiens
acaagguucccucugagaau

SEQ ID NO: 1506597 - RNA, 14 nt, Homo sapiens
acaauaaagacuga

SEQ ID NO: 1506598 - RNA, 16 nt, Homo sapiens
acaauaagaguucuug

SEQ ID NO: 1506599 - RNA, 12 nt, Homo sapiens
acaaucugggac

SEQ ID NO: 1506600 - RNA, 17 nt, Homo sapiens
acaauggagugggagau

SEQ ID NO: 1506601 - RNA, 21 nt, Homo sapiens
acaauggcuaauucccagagu

SEQ ID NO: 1506602 - RNA, 15 nt, Homo sapiens
acacaaaagccaaaa

SEQ ID NO: 1506603 - RNA, 14 nt, Homo sapiens
acacaaguuuaaaa

SEQ ID NO: 1506604 - RNA, 11 nt, Homo sapiens
acaccaucucc

SEQ ID NO: 1506605 - RNA, 13 nt, Homo sapiens
acaccccaugcac

SEQ ID NO: 1506606 - RNA, 22 nt, Homo sapiens
acacuaagcgaauguguacaaa

SEQ ID NO: 1506607 - RNA, 15 nt, Homo sapiens
acacuauccaaugaa

SEQ ID NO: 1506608 - RNA, 14 nt, Homo sapiens
acacucaacaauaa

SEQ ID NO: 1506609 - RNA, 18 nt, Homo sapiens
acacucaacaauaaagac

SEQ ID NO: 1506610 - RNA, 18 nt, Homo sapiens
acacucuagugacuuccu

SEQ ID NO: 1506611 - RNA, 16 nt, Homo sapiens
acacugugaagacaau

SEQ ID NO: 1506612 - RNA, 18 nt, Homo sapiens
acagaagaucuauauugu

SEQ ID NO: 1506613 - RNA, 22 nt, Homo sapiens
acagacauuuucaauaauguga

SEQ ID NO: 1506614 - RNA, 15 nt, Homo sapiens
acagacgcuccugaa

SEQ ID NO: 1506615 - RNA, 13 nt, Homo sapiens
acagacgucucaa

SEQ ID NO: 1506616 - RNA, 21 nt, Homo sapiens
acagacgucucaagacugaaa

SEQ ID NO: 1506617 - RNA, 17 nt, Homo sapiens
acagacuucuccagacc

SEQ ID NO: 1506618 - RNA, 20 nt, Homo sapiens
acagagcgagagucugucuc

SEQ ID NO: 1506619 - RNA, 21 nt, Homo sapiens
acagaguaaauagcauucucu

SEQ ID NO: 1506620 - RNA, 20 nt, Homo sapiens
acagauguaaaugccacaaa

SEQ ID NO: 1506621 - RNA, 17 nt, Homo sapiens
acagcaguguggucucu

SEQ ID NO: 1506622 - RNA, 16 nt, Homo sapiens
acagcccagaaccaca

SEQ ID NO: 1506623 - RNA, 17 nt, Homo sapiens
acagcccagaaccacag

SEQ ID NO: 1506624 - RNA, 12 nt, Homo sapiens
acagcuaauaau

SEQ ID NO: 1506625 - RNA, 22 nt, Homo sapiens
acagcugaaguaaugacagauu

SEQ ID NO: 1506626 - RNA, 19 nt, Homo sapiens
acaggauccuauucucacc

SEQ ID NO: 1506627 - RNA, 16 nt, Homo sapiens
acaggcugaaagccca

SEQ ID NO: 1506628 - RNA, 14 nt, Homo sapiens
acaggcugagcuuu

SEQ ID NO: 1506629 - RNA, 15 nt, Homo sapiens
acaggcugguucuga

SEQ ID NO: 1506630 - RNA, 15 nt, Homo sapiens
acagguaaguggcag

SEQ ID NO: 1506631 - RNA, 19 nt, Homo sapiens
acagguggcaggaccagga

SEQ ID NO: 1506632 - RNA, 23 nt, Homo sapiens
acaguaaauaaauuguuugacca

SEQ ID NO: 1506633 - RNA, 15 nt, Homo sapiens
acaguccugggagaa

SEQ ID NO: 1506634 - RNA, 21 nt, Homo sapiens
acagugcccuuuucaucucca

SEQ ID NO: 1506635 - RNA, 14 nt, Homo sapiens
acaguggaucucaa

SEQ ID NO: 1506636 - RNA, 20 nt, Homo sapiens
acauaagaccauaacagcca

SEQ ID NO: 1506637 - RNA, 14 nt, Homo sapiens
acauaauucacucu

SEQ ID NO: 1506638 - RNA, 18 nt, Homo sapiens
acauauauauacuauuaa

SEQ ID NO: 1506639 - RNA, 16 nt, Homo sapiens
acaucacaacauuuac

SEQ ID NO: 1506640 - RNA, 15 nt, Homo sapiens
acaucauuacuauaa

SEQ ID NO: 1506641 - RNA, 16 nt, Homo sapiens
acaucauucuacauaa

SEQ ID NO: 1506642 - RNA, 21 nt, Homo sapiens
acauccaaccccccaccugcc

SEQ ID NO: 1506643 - RNA, 15 nt, Homo sapiens
acaucuaagccuguu

SEQ ID NO: 1506644 - RNA, 19 nt, Homo sapiens
acaucuauuauaaaaccau

SEQ ID NO: 1506645 - RNA, 20 nt, Homo sapiens
acaucuauuauaaaaccaug

SEQ ID NO: 1506646 - RNA, 16 nt, Homo sapiens
acaucucccucccaca

SEQ ID NO: 1506647 - RNA, 12 nt, Homo sapiens
acaucucuguga

SEQ ID NO: 1506648 - RNA, 19 nt, Homo sapiens
acaugagaggacugaugaa

SEQ ID NO: 1506649 - RNA, 20 nt, Homo sapiens
acaugcgaccgugaccagga

SEQ ID NO: 1506650 - RNA, 19 nt, Homo sapiens
acauggaagauauuccuuu

SEQ ID NO: 1506651 - RNA, 19 nt, Homo sapiens
acauggacacaccagagug

SEQ ID NO: 1506652 - RNA, 21 nt, Homo sapiens
acauguuuauauuuggcucuc

SEQ ID NO: 1506653 - RNA, 22 nt, Homo sapiens
acauguuuuagacagagacaau

SEQ ID NO: 1506654 - RNA, 18 nt, Homo sapiens
acauuagaagacaauuga

SEQ ID NO: 1506655 - RNA, 18 nt, Homo sapiens
acauugcuucugcuaaau

SEQ ID NO: 1506656 - RNA, 13 nt, Homo sapiens
acauugguauauu

SEQ ID NO: 1506657 - RNA, 21 nt, Homo sapiens
acauugucaaagcuugccgua

SEQ ID NO: 1506658 - RNA, 13 nt, Homo sapiens
acauuuaccucuu

SEQ ID NO: 1506659 - RNA, 21 nt, Homo sapiens
acauuugauuauauacuaugu

SEQ ID NO: 1506660 - RNA, 15 nt, Homo sapiens
accaacauggugaaa

SEQ ID NO: 1506661 - RNA, 23 nt, Homo sapiens
accaacuuauaaagcauugcaac

SEQ ID NO: 1506662 - RNA, 19 nt, Homo sapiens
accaaggaaagaacaaaug

SEQ ID NO: 1506663 - RNA, 13 nt, Homo sapiens
accaaggucuuca

SEQ ID NO: 1506664 - RNA, 15 nt, Homo sapiens
accaagucuacuuca

SEQ ID NO: 1506665 - RNA, 17 nt, Homo sapiens
accaagucuacuucacu

SEQ ID NO: 1506666 - RNA, 16 nt, Homo sapiens
accaauaggugcaaaa

SEQ ID NO: 1506667 - RNA, 13 nt, Homo sapiens
accacaacuauuu

SEQ ID NO: 1506668 - RNA, 16 nt, Homo sapiens
accacaagccugagaa

SEQ ID NO: 1506669 - RNA, 15 nt, Homo sapiens
accacuagguucuag

SEQ ID NO: 1506670 - RNA, 19 nt, Homo sapiens
accacuaugcaauauauca

SEQ ID NO: 1506671 - RNA, 10 nt, Homo sapiens
accacuccag

SEQ ID NO: 1506672 - RNA, 16 nt, Homo sapiens
accacuuugccucuga

SEQ ID NO: 1506673 - RNA, 15 nt, Homo sapiens
accagcaguacucag

SEQ ID NO: 1506674 - RNA, 23 nt, Homo sapiens
accagcauuuacuaugccacaga

SEQ ID NO: 1506675 - RNA, 17 nt, Homo sapiens
accagcuuuuucucuca

SEQ ID NO: 1506676 - RNA, 13 nt, Homo sapiens
accaguguagccu

SEQ ID NO: 1506677 - RNA, 17 nt, Homo sapiens
accauagcacaggcuaa

SEQ ID NO: 1506678 - RNA, 15 nt, Homo sapiens
accaugccaggcuaa

SEQ ID NO: 1506679 - RNA, 20 nt, Homo sapiens
accauuaaccagaucuaguc

SEQ ID NO: 1506680 - RNA, 19 nt, Homo sapiens
acccaccuuugccacaaag

SEQ ID NO: 1506681 - RNA, 19 nt, Homo sapiens
acccauagugcacacuugu

SEQ ID NO: 1506682 - RNA, 23 nt, Homo sapiens
acccauagugcacacuuguauau

SEQ ID NO: 1506683 - RNA, 11 nt, Homo sapiens
accccaucuca

SEQ ID NO: 1506684 - RNA, 11 nt, Homo sapiens
accccaucucu

SEQ ID NO: 1506685 - RNA, 23 nt, Homo sapiens
acccccuccagcuccaguuucca

SEQ ID NO: 1506686 - RNA, 15 nt, Homo sapiens
acccuaagugacaca

SEQ ID NO: 1506687 - RNA, 19 nt, Homo sapiens
acccucaauaaauguugcu

SEQ ID NO: 1506688 - RNA, 14 nt, Homo sapiens
acccucucuucccu

SEQ ID NO: 1506689 - RNA, 18 nt, Homo sapiens
acccuguuuucagcuaaa

SEQ ID NO: 1506690 - RNA, 22 nt, Homo sapiens
acccuucauuuaacaaguaaga

SEQ ID NO: 1506691 - RNA, 21 nt, Homo sapiens
accgugcccggcccauucuaa

SEQ ID NO: 1506692 - RNA, 12 nt, Homo sapiens
accucaccaaaa

SEQ ID NO: 1506693 - RNA, 17 nt, Homo sapiens
accucacgcucuggaca

SEQ ID NO: 1506694 - RNA, 19 nt, Homo sapiens
accuccccugguccugcac

SEQ ID NO: 1506695 - RNA, 19 nt, Homo sapiens
accucugagaagacacaag

SEQ ID NO: 1506696 - RNA, 21 nt, Homo sapiens
accugaaugaccugcagucag

SEQ ID NO: 1506697 - RNA, 12 nt, Homo sapiens
accugacaaaug

SEQ ID NO: 1506698 - RNA, 14 nt, Homo sapiens
accugaucauuaca

SEQ ID NO: 1506699 - RNA, 18 nt, Homo sapiens
accugcuuugagauuucc

SEQ ID NO: 1506700 - RNA, 17 nt, Homo sapiens
accuggagccaucuucc

SEQ ID NO: 1506701 - RNA, 16 nt, Homo sapiens
accuggagugcucaau

SEQ ID NO: 1506702 - RNA, 16 nt, Homo sapiens
accuucaauacuucau

SEQ ID NO: 1506703 - RNA, 20 nt, Homo sapiens
accuucaugcccuucugauu

SEQ ID NO: 1506704 - RNA, 18 nt, Homo sapiens
accuucccucuuucuaca

SEQ ID NO: 1506705 - RNA, 14 nt, Homo sapiens
accuuggagccuga

SEQ ID NO: 1506706 - RNA, 15 nt, Homo sapiens
accuuuauagcucau

SEQ ID NO: 1506707 - RNA, 14 nt, Homo sapiens
accuuuauagcucu

SEQ ID NO: 1506708 - RNA, 16 nt, Homo sapiens
accuuuauagcucuca

SEQ ID NO: 1506709 - RNA, 21 nt, Homo sapiens
accuuuauagcucucaucacu

SEQ ID NO: 1506710 - RNA, 17 nt, Homo sapiens
accuuucaaauuucaca

SEQ ID NO: 1506711 - RNA, 22 nt, Homo sapiens
accuuuguguaaagaagggaag

SEQ ID NO: 1506712 - RNA, 14 nt, Homo sapiens
acgagaucaacaca

SEQ ID NO: 1506713 - RNA, 18 nt, Homo sapiens
acgcacucaacuuccuuu

SEQ ID NO: 1506714 - RNA, 15 nt, Homo sapiens
acgccacugcacucc

SEQ ID NO: 1506715 - RNA, 21 nt, Homo sapiens
acgccuguaaucccagcacuu

SEQ ID NO: 1506716 - RNA, 19 nt, Homo sapiens
acggaguacagacgucuca

SEQ ID NO: 1506717 - RNA, 15 nt, Homo sapiens
acggcagcuguagcu

SEQ ID NO: 1506718 - RNA, 23 nt, Homo sapiens
acgggguuucaccacauucguca

SEQ ID NO: 1506719 - RNA, 16 nt, Homo sapiens
acggguuaagaucuga

SEQ ID NO: 1506720 - RNA, 21 nt, Homo sapiens
agacuuccaucuagucacaaa

SEQ ID NO: 1506721 - RNA, 18 nt, Homo sapiens
agacuuggggaccagagg

SEQ ID NO: 1506722 - RNA, 20 nt, Homo sapiens
agacuuuaccacuaugcaau

SEQ ID NO: 1506723 - RNA, 21 nt, Homo sapiens
agagaaaaacuuucauuuuug

SEQ ID NO: 1506724 - RNA, 12 nt, Homo sapiens
agagaaaagcca

SEQ ID NO: 1506725 - RNA, 18 nt, Homo sapiens
agagaacaggggcuucuu

SEQ ID NO: 1506726 - RNA, 13 nt, Homo sapiens
agagacucuggcc

SEQ ID NO: 1506727 - RNA, 13 nt, Homo sapiens
agagagauggaau

SEQ ID NO: 1506728 - RNA, 14 nt, Homo sapiens
agagagauggaaua

SEQ ID NO: 1506729 - RNA, 11 nt, Homo sapiens
agagagcaaac

SEQ ID NO: 1506730 - RNA, 12 nt, Homo sapiens
agagaguaccau

SEQ ID NO: 1506731 - RNA, 20 nt, Homo sapiens
agagaucaggaagagaagga

SEQ ID NO: 1506732 - RNA, 17 nt, Homo sapiens
agagaucccaaguagaa

SEQ ID NO: 1506733 - RNA, 19 nt, Homo sapiens
agagauggaauaaagcccu

SEQ ID NO: 1506734 - RNA, 23 nt, Homo sapiens
agagauggaauaaagcccuugaa

SEQ ID NO: 1506735 - RNA, 20 nt, Homo sapiens
agagcaagacuccauuucaa

SEQ ID NO: 1506736 - RNA, 12 nt, Homo sapiens
agcucucucuac

SEQ ID NO: 1506737 - RNA, 20 nt, Homo sapiens
agcucuuacacuacauuaga

SEQ ID NO: 1506738 - RNA, 12 nt, Homo sapiens
agcugaacccau

SEQ ID NO: 1506739 - RNA, 16 nt, Homo sapiens
agcugaccagccguga

SEQ ID NO: 1506740 - RNA, 23 nt, Homo sapiens
agcugagacccucgccacgggga

SEQ ID NO: 1506741 - RNA, 18 nt, Homo sapiens
agcugagaucacaccacu

SEQ ID NO: 1506742 - RNA, 20 nt, Homo sapiens
agcugagaucacaccacugc

SEQ ID NO: 1506743 - RNA, 19 nt, Homo sapiens
agcugagggacguggugcc

SEQ ID NO: 1506744 - RNA, 13 nt, Homo sapiens
agcugcaccugcc

SEQ ID NO: 1506745 - RNA, 19 nt, Homo sapiens
agcugcagaugccacaccu

SEQ ID NO: 1506746 - RNA, 13 nt, Homo sapiens
agcugcucuggaa

SEQ ID NO: 1506747 - RNA, 16 nt, Homo sapiens
agcugcuguuuuuaga

SEQ ID NO: 1506748 - RNA, 18 nt, Homo sapiens
agcugcuguuuuuagacu

SEQ ID NO: 1506749 - RNA, 18 nt, Homo sapiens
agcuggaaauaaaccugg

SEQ ID NO: 1506750 - RNA, 14 nt, Homo sapiens
agcuggcaaaggug

SEQ ID NO: 1506751 - RNA, 19 nt, Homo sapiens
agcuggcaaagguggcucu

SEQ ID NO: 1506752 - RNA, 19 nt, Homo sapiens
agcuggcauuggucugcug

SEQ ID NO: 1506753 - RNA, 23 nt, Homo sapiens
agcuggcucuccaccuuguuaca

SEQ ID NO: 1506754 - RNA, 20 nt, Homo sapiens
agcuguaaaaagagagaaaa

SEQ ID NO: 1506755 - RNA, 16 nt, Homo sapiens
agcugucgcaucucag

SEQ ID NO: 1506756 - RNA, 23 nt, Homo sapiens
agcuugagggacaaugccacuau

SEQ ID NO: 1506757 - RNA, 23 nt, Homo sapiens
gguuagguuugucaacacaaaga

SEQ ID NO: 1506758 - RNA, 22 nt, Homo sapiens
gguuccuuuuucaacuuggaaa

SEQ ID NO: 1506759 - RNA, 22 nt, Homo sapiens
gguuuaagaacgaaggagaaaa

SEQ ID NO: 1506760 - RNA, 11 nt, Homo sapiens
gguuugcaguu

SEQ ID NO: 1506761 - RNA, 13 nt, Homo sapiens
gguuuuuucacau

SEQ ID NO: 1506762 - RNA, 23 nt, Homo sapiens
guaaaaaagauuuguagagucaa

SEQ ID NO: 1506763 - RNA, 14 nt, Homo sapiens
guaaaagcaaaaaa

SEQ ID NO: 1506764 - RNA, 15 nt, Homo sapiens
guaaacaacaaacuu

SEQ ID NO: 1506765 - RNA, 21 nt, Homo sapiens
guaaauccuauuauguguuca

SEQ ID NO: 1506766 - RNA, 10 nt, Homo sapiens
guaacaaaua

SEQ ID NO: 1506767 - RNA, 15 nt, Homo sapiens
guaacucacuuuaaa

SEQ ID NO: 1506768 - RNA, 20 nt, Homo sapiens
guaagaaaccuacugcccag

SEQ ID NO: 1506769 - RNA, 16 nt, Homo sapiens
guaagaacacugagau

SEQ ID NO: 1506770 - RNA, 15 nt, Homo sapiens
guaagacucauuccc

SEQ ID NO: 1506771 - RNA, 22 nt, Homo sapiens
guaaguaccccugauaagcaaa

SEQ ID NO: 1506772 - RNA, 16 nt, Homo sapiens
guaaucccccuugcca

SEQ ID NO: 1506773 - RNA, 22 nt, Homo sapiens
guaaugaaacaaagaguucaag

SEQ ID NO: 1506774 - RNA, 16 nt, Homo sapiens
guacaauguacauuau

SEQ ID NO: 1506775 - RNA, 20 nt, Homo sapiens
guacagacgucucaagacug

SEQ ID NO: 1506776 - RNA, 10 nt, Homo sapiens
guacauguau

SEQ ID NO: 1506777 - RNA, 20 nt, Homo sapiens
guacauuucccugugcugac

SEQ ID NO: 1506778 - RNA, 21 nt, Homo sapiens
guaccaaauccacaagccauu

SEQ ID NO: 1506779 - RNA, 18 nt, Homo sapiens
guaccagaugcagcucaa

SEQ ID NO: 1506780 - RNA, 13 nt, Homo sapiens
guacuaaagccaa

SEQ ID NO: 1506781 - RNA, 16 nt, Homo sapiens
guacucugaaggaaua

SEQ ID NO: 1506782 - RNA, 18 nt, Homo sapiens
guagagguuuuguuguuu

SEQ ID NO: 1506783 - RNA, 14 nt, Homo sapiens
guagauaacagcuu

SEQ ID NO: 1506784 - RNA, 18 nt, Homo sapiens
guagcaaguucuagagaa

SEQ ID NO: 1506785 - RNA, 20 nt, Homo sapiens
guagccaaagguucacucuc

SEQ ID NO: 1506786 - RNA, 22 nt, Homo sapiens
guagccaccgguaauaagccaa

SEQ ID NO: 1506787 - RNA, 20 nt, Homo sapiens
guagcgagcugcucugcuau

SEQ ID NO: 1506788 - RNA, 23 nt, Homo sapiens
guaguuaaagggcagaaggggaa

SEQ ID NO: 1506789 - RNA, 17 nt, Homo sapiens
guauccgacucuaagcu

SEQ ID NO: 1506790 - RNA, 20 nt, Homo sapiens
guauccgacucuaagcugug

SEQ ID NO: 1506791 - RNA, 19 nt, Homo sapiens
guaucuaccucacuauuca

SEQ ID NO: 1506792 - RNA, 22 nt, Homo sapiens
guauguguuuuuauacuuuuag

SEQ ID NO: 1506793 - RNA, 20 nt, Homo sapiens
guauguuacaugcauucuac

SEQ ID NO: 1506794 - RNA, 20 nt, Homo sapiens
guauuaaagauguguuguug

SEQ ID NO: 1506795 - RNA, 13 nt, Homo sapiens
guauucuucauca

SEQ ID NO: 1506796 - RNA, 21 nt, Homo sapiens
guauuuuaggcagggauuuga

SEQ ID NO: 1506797 - RNA, 19 nt, Homo sapiens
gucaacaaaaagacaugga

SEQ ID NO: 1506798 - RNA, 11 nt, Homo sapiens
gucaacacaaa

SEQ ID NO: 1506799 - RNA, 15 nt, Homo sapiens
gucaacacaaagaca

SEQ ID NO: 1506800 - RNA, 12 nt, Homo sapiens
gucaacaucuaa

SEQ ID NO: 1506801 - RNA, 17 nt, Homo sapiens
gucaagaucaacauucc

SEQ ID NO: 1506802 - RNA, 16 nt, Homo sapiens
gucaauuucaguguau

SEQ ID NO: 1506803 - RNA, 21 nt, Homo sapiens
gucacaauaaaagaaacugug

SEQ ID NO: 1506804 - RNA, 15 nt, Homo sapiens
gucacacaguauuaa

SEQ ID NO: 1506805 - RNA, 19 nt, Homo sapiens
gucacaccugacaaaugga

SEQ ID NO: 1506806 - RNA, 22 nt, Homo sapiens
gucacuaucuucacaagugugu

SEQ ID NO: 1506807 - RNA, 23 nt, Homo sapiens
gucaguugaggaauaugacuguu

SEQ ID NO: 1506808 - RNA, 21 nt, Homo sapiens
gucaucaaauauuaccaaaaa

SEQ ID NO: 1506809 - RNA, 13 nt, Homo sapiens
gucauugaugaac

SEQ ID NO: 1506810 - RNA, 21 nt, Homo sapiens
gucauuuggugccaguauuuu

SEQ ID NO: 1506811 - RNA, 16 nt, Homo sapiens
guccaaaauguugauc

SEQ ID NO: 1506812 - RNA, 19 nt, Homo sapiens
guccaugugguucuucaaa

SEQ ID NO: 1506813 - RNA, 16 nt, Homo sapiens
gucccggguguguaca

SEQ ID NO: 1506814 - RNA, 17 nt, Homo sapiens
guccucagagcaggggc

SEQ ID NO: 1506815 - RNA, 19 nt, Homo sapiens
guccuccauuucaacucca

SEQ ID NO: 1506816 - RNA, 20 nt, Homo sapiens
guccuucuuuaucugugaua

SEQ ID NO: 1506817 - RNA, 16 nt, Homo sapiens
gucuaaagagcuuuag

SEQ ID NO: 1506818 - RNA, 14 nt, Homo sapiens
gucuagaggugaga

SEQ ID NO: 1506819 - RNA, 21 nt, Homo sapiens
gucuauggucaguugaggaau

SEQ ID NO: 1506820 - RNA, 23 nt, Homo sapiens
gucucaccccucauccuuuuacu

SEQ ID NO: 1506821 - RNA, 13 nt, Homo sapiens
gucucaguccaga

SEQ ID NO: 1506822 - RNA, 16 nt, Homo sapiens
gucuccgcacuuggaa

SEQ ID NO: 1506823 - RNA, 22 nt, Homo sapiens
gucuggagaagguauuagcaaa

SEQ ID NO: 1506824 - RNA, 15 nt, Homo sapiens
gucuggcuaugcuca

SEQ ID NO: 1506825 - RNA, 16 nt, Homo sapiens
gucugucuacauuucu

SEQ ID NO: 1506826 - RNA, 13 nt, Homo sapiens
gucuuaccaauga

SEQ ID NO: 1506827 - RNA, 17 nt, Homo sapiens
gucuuauaaacaaauga

SEQ ID NO: 1506828 - RNA, 14 nt, Homo sapiens
gucuuccacuguac

SEQ ID NO: 1506829 - RNA, 17 nt, Homo sapiens
gucuuugggcagggaau

SEQ ID NO: 1506830 - RNA, 16 nt, Homo sapiens
gugaacacacucagca

SEQ ID NO: 1506831 - RNA, 18 nt, Homo sapiens
gugaauugccugcagaga

SEQ ID NO: 1506832 - RNA, 15 nt, Homo sapiens
gugaauuucuucacu

SEQ ID NO: 1506833 - RNA, 14 nt, Homo sapiens
gugaccagugcugc

SEQ ID NO: 1506834 - RNA, 21 nt, Homo sapiens
gugacuggcagcauugacucu

SEQ ID NO: 1506835 - RNA, 14 nt, Homo sapiens
gugagaccaaagga

SEQ ID NO: 1506836 - RNA, 23 nt, Homo sapiens
gugagaccaccucucaauauuca

SEQ ID NO: 1506837 - RNA, 19 nt, Homo sapiens
gugcaaaaauaaaaggaaa

SEQ ID NO: 1506838 - RNA, 19 nt, Homo sapiens
gugccacccaccuuugcca

SEQ ID NO: 1506839 - RNA, 14 nt, Homo sapiens
gugccacucauucc

SEQ ID NO: 1506840 - RNA, 14 nt, Homo sapiens
gugccuagacuguu

SEQ ID NO: 1506841 - RNA, 23 nt, Homo sapiens
gugccuagacuguuacuuuggca

SEQ ID NO: 1506842 - RNA, 22 nt, Homo sapiens
gugccuuucucuggcuccagaa

SEQ ID NO: 1506843 - RNA, 18 nt, Homo sapiens
gugcuauaggcuggagaa

SEQ ID NO: 1506844 - RNA, 15 nt, Homo sapiens
gugcucuccuacccc

SEQ ID NO: 1506845 - RNA, 15 nt, Homo sapiens
gugcuggagacacuc

SEQ ID NO: 1506846 - RNA, 15 nt, Homo sapiens
gugcuucagccugag

SEQ ID NO: 1506847 - RNA, 15 nt, Homo sapiens
guggaaaaaucagaa

SEQ ID NO: 1506848 - RNA, 21 nt, Homo sapiens
guggaaaaaucagaagcacaa

SEQ ID NO: 1506849 - RNA, 14 nt, Homo sapiens
gcuuaggauguuuu

SEQ ID NO: 1506850 - RNA, 20 nt, Homo sapiens
gcuuauucaggaugguuucu

SEQ ID NO: 1506851 - RNA, 13 nt, Homo sapiens
gcuucagccugag

SEQ ID NO: 1506852 - RNA, 20 nt, Homo sapiens
gcuucauuugggaaauucag

SEQ ID NO: 1506853 - RNA, 23 nt, Homo sapiens
gcuucauuugggaaauucagcuu

SEQ ID NO: 1506854 - RNA, 17 nt, Homo sapiens
gcuuccucacuccaaaa

SEQ ID NO: 1506855 - RNA, 14 nt, Homo sapiens
gcuugcaugccaaa

SEQ ID NO: 1506856 - RNA, 21 nt, Homo sapiens
gcuugggaacuguaagcucaa

SEQ ID NO: 1506857 - RNA, 20 nt, Homo sapiens
gcuuuaguccuagaggaccu

SEQ ID NO: 1506858 - RNA, 17 nt, Homo sapiens
gcuuucaucacuaccuu

SEQ ID NO: 1506859 - RNA, 21 nt, Homo sapiens
gcuuuccuggucccucacccc

SEQ ID NO: 1506860 - RNA, 13 nt, Homo sapiens
gcuuuugcaacau

SEQ ID NO: 1506861 - RNA, 16 nt, Homo sapiens
gcuuuugcaacauggu

SEQ ID NO: 1506862 - RNA, 13 nt, Homo sapiens
gcuuuuucucuca

SEQ ID NO: 1506863 - RNA, 22 nt, Homo sapiens
ggaaaauaauacugcugagaua

SEQ ID NO: 1506864 - RNA, 12 nt, Homo sapiens
ggaaaccaaagg

SEQ ID NO: 1506865 - RNA, 14 nt, Homo sapiens
ggaaaccaguguag

SEQ ID NO: 1506866 - RNA, 22 nt, Homo sapiens
ggaaagacaggcugagcuuucu

SEQ ID NO: 1506867 - RNA, 16 nt, Homo sapiens
ggaaagcaucaccuca

SEQ ID NO: 1506868 - RNA, 20 nt, Homo sapiens
ggaacccugcuugcacuuug

SEQ ID NO: 1506869 - RNA, 14 nt, Homo sapiens
ggaacucacuuucc

SEQ ID NO: 1506870 - RNA, 22 nt, Homo sapiens
ggaacugguucaagagacacug

SEQ ID NO: 1506871 - RNA, 14 nt, Homo sapiens
ggaagucaccaaaa

SEQ ID NO: 1506872 - RNA, 15 nt, Homo sapiens
ggaaguucaacuucc

SEQ ID NO: 1506873 - RNA, 14 nt, Homo sapiens
ggaauuuaauuuau

SEQ ID NO: 1506874 - RNA, 16 nt, Homo sapiens
ggaccacauguguucu

SEQ ID NO: 1506875 - RNA, 20 nt, Homo sapiens
ggaccaggauugcacugaca

SEQ ID NO: 1506876 - RNA, 20 nt, Homo sapiens
ggaccugcuuugagauuucc

SEQ ID NO: 1506877 - RNA, 13 nt, Homo sapiens
ggacuacaggugc

SEQ ID NO: 1506878 - RNA, 20 nt, Homo sapiens
ggacuauggguacauuccac

SEQ ID NO: 1506879 - RNA, 21 nt, Homo sapiens
ggacuccccaggccaggccac

SEQ ID NO: 1506880 - RNA, 17 nt, Homo sapiens
ggacuggaaccagggag

SEQ ID NO: 1506881 - RNA, 19 nt, Homo sapiens
ggagaaggaaggcuccauc

SEQ ID NO: 1506882 - RNA, 17 nt, Homo sapiens
ggagaccccgguggcag

SEQ ID NO: 1506883 - RNA, 15 nt, Homo sapiens
ggagagcagcuggcu

SEQ ID NO: 1506884 - RNA, 14 nt, Homo sapiens
ggagaggaagcaca

SEQ ID NO: 1506885 - RNA, 15 nt, Homo sapiens
ggagaggaagcacac

SEQ ID NO: 1506886 - RNA, 16 nt, Homo sapiens
ggagaguacagugagc

SEQ ID NO: 1506887 - RNA, 20 nt, Homo sapiens
ggagaguacagugagccaag

SEQ ID NO: 1506888 - RNA, 14 nt, Homo sapiens
ggagaugaugauga

SEQ ID NO: 1506889 - RNA, 21 nt, Homo sapiens
ggagcuggaaauaaaccugga

SEQ ID NO: 1506890 - RNA, 18 nt, Homo sapiens
ggaggacacacagucuca

SEQ ID NO: 1506891 - RNA, 16 nt, Homo sapiens
ggaggguaacagaaga

SEQ ID NO: 1506892 - RNA, 20 nt, Homo sapiens
ggagguggagguugcaguga

SEQ ID NO: 1506893 - RNA, 19 nt, Homo sapiens
ggagucagaaacuguuucu

SEQ ID NO: 1506894 - RNA, 12 nt, Homo sapiens
ggagugcaguuu

SEQ ID NO: 1506895 - RNA, 20 nt, Homo sapiens
ggauaucaauuaauuugaaa

SEQ ID NO: 1506896 - RNA, 14 nt, Homo sapiens
ggaucaagacauaa

SEQ ID NO: 1506897 - RNA, 16 nt, Homo sapiens
ggaucacaaggucacu

SEQ ID NO: 1506898 - RNA, 21 nt, Homo sapiens
ggaucagccuccgccauucca

SEQ ID NO: 1506899 - RNA, 17 nt, Homo sapiens
ggaugaaagcaaucuga

SEQ ID NO: 1506900 - RNA, 16 nt, Homo sapiens
ggaugaugguugcaaa

SEQ ID NO: 1506901 - RNA, 15 nt, Homo sapiens
ggaugcuagugcugu

SEQ ID NO: 1506902 - RNA, 14 nt, Homo sapiens
ggaugugugucuca

SEQ ID NO: 1506903 - RNA, 20 nt, Homo sapiens
ggauuacagguguaagccac

SEQ ID NO: 1506904 - RNA, 14 nt, Homo sapiens
ggauuagaaugccg

SEQ ID NO: 1506905 - RNA, 22 nt, Homo sapiens
ggauuccagagcacugcuccag

SEQ ID NO: 1506906 - RNA, 23 nt, Homo sapiens
ggauuugaagcaaagcaccagcu

SEQ ID NO: 1506907 - RNA, 22 nt, Homo sapiens
ggcaaagaacugccccaucucc

SEQ ID NO: 1506908 - RNA, 19 nt, Homo sapiens
ggcaaagguggcucuccag

SEQ ID NO: 1506909 - RNA, 12 nt, Homo sapiens
ggcaacugugag

SEQ ID NO: 1506910 - RNA, 16 nt, Homo sapiens
ggcaaugaaaccaaag

SEQ ID NO: 1506911 - RNA, 13 nt, Homo sapiens
ggcaaugcaaaag

SEQ ID NO: 1506912 - RNA, 18 nt, Homo sapiens
ggcaccagaaugcuaaag

SEQ ID NO: 1506913 - RNA, 16 nt, Homo sapiens
ggcacgccaacagccc

SEQ ID NO: 1506914 - RNA, 22 nt, Homo sapiens
ggcacugcaggggccgagccau

SEQ ID NO: 1506915 - RNA, 13 nt, Homo sapiens
ggcagaggggagc

SEQ ID NO: 1506916 - RNA, 16 nt, Homo sapiens
ggcagcugucauucag

SEQ ID NO: 1506917 - RNA, 20 nt, Homo sapiens
ggcaggagaaucgcuugaac

SEQ ID NO: 1506918 - RNA, 23 nt, Homo sapiens
ggcaggggugggagagccagcuc

SEQ ID NO: 1506919 - RNA, 14 nt, Homo sapiens
ggcaugacacucua

SEQ ID NO: 1506920 - RNA, 17 nt, Homo sapiens
ggccaagacuuggcaac

SEQ ID NO: 1506921 - RNA, 16 nt, Homo sapiens
ggccagagccaagggg

SEQ ID NO: 1506922 - RNA, 19 nt, Homo sapiens
ggccagcugucgcaucuca

SEQ ID NO: 1506923 - RNA, 15 nt, Homo sapiens
ggccccccuccaggc

SEQ ID NO: 1506924 - RNA, 13 nt, Homo sapiens
ggccugauggugc

SEQ ID NO: 1506925 - RNA, 23 nt, Homo sapiens
ggccugccuugaagccacugaag

SEQ ID NO: 1506926 - RNA, 14 nt, Homo sapiens
ggccugguagcaca

SEQ ID NO: 1506927 - RNA, 20 nt, Homo sapiens
ggcgacagagcaagacucca

SEQ ID NO: 1506928 - RNA, 21 nt, Homo sapiens
ggcuaauucccagagugugaa

SEQ ID NO: 1506929 - RNA, 22 nt, Homo sapiens
ggcuaggaaagggaagccugac

SEQ ID NO: 1506930 - RNA, 22 nt, Homo sapiens
ggcuaggguaggggcaaggaaa

SEQ ID NO: 1506931 - RNA, 15 nt, Homo sapiens
ggcucagcaugcaga

SEQ ID NO: 1506932 - RNA, 22 nt, Homo sapiens
ggcucccacugccccugcaccu

SEQ ID NO: 1506933 - RNA, 13 nt, Homo sapiens
ggcucccaucuga

SEQ ID NO: 1506934 - RNA, 21 nt, Homo sapiens
ggcucccuccuggagcauccc

SEQ ID NO: 1506935 - RNA, 13 nt, Homo sapiens
ggcuccugugcua

SEQ ID NO: 1506936 - RNA, 19 nt, Homo sapiens
gaagaaguuuaaaaaacca

SEQ ID NO: 1506937 - RNA, 13 nt, Homo sapiens
gaagagaccacag

SEQ ID NO: 1506938 - RNA, 11 nt, Homo sapiens
gaagagcauug

SEQ ID NO: 1506939 - RNA, 21 nt, Homo sapiens
gaagaggugagaguaagccuu

SEQ ID NO: 1506940 - RNA, 20 nt, Homo sapiens
gaagauacugacuagucaua

SEQ ID NO: 1506941 - RNA, 18 nt, Homo sapiens
gaagauuagagguuuguc

SEQ ID NO: 1506942 - RNA, 21 nt, Homo sapiens
gaagauuagagguuugucaac

SEQ ID NO: 1506943 - RNA, 15 nt, Homo sapiens
gaagcauguacaaau

SEQ ID NO: 1506944 - RNA, 13 nt, Homo sapiens
gaagccauauuca

SEQ ID NO: 1506945 - RNA, 13 nt, Homo sapiens
gaagcuucuugcu

SEQ ID NO: 1506946 - RNA, 21 nt, Homo sapiens
gaaggacuaugaaaagcuaga

SEQ ID NO: 1506947 - RNA, 12 nt, Homo sapiens
gaaggacugugc

SEQ ID NO: 1506948 - RNA, 14 nt, Homo sapiens
gaaggagagcaaga

SEQ ID NO: 1506949 - RNA, 22 nt, Homo sapiens
gaaggccucacucaagccugag

SEQ ID NO: 1506950 - RNA, 16 nt, Homo sapiens
gaaggcuuguugugcu

SEQ ID NO: 1506951 - RNA, 15 nt, Homo sapiens
gaagguuagguuugu

SEQ ID NO: 1506952 - RNA, 14 nt, Homo sapiens
gaagucaccaaaau

SEQ ID NO: 1506953 - RNA, 15 nt, Homo sapiens
gaagucuacuuuguc

SEQ ID NO: 1506954 - RNA, 16 nt, Homo sapiens
gaaguuuaaaaaacca

SEQ ID NO: 1506955 - RNA, 17 nt, Homo sapiens
gaaguuucuggugccau

SEQ ID NO: 1506956 - RNA, 20 nt, Homo sapiens
gaaguuucuggugccauuuc

SEQ ID NO: 1506957 - RNA, 13 nt, Homo sapiens
gaaguuuggcaau

SEQ ID NO: 1506958 - RNA, 14 nt, Homo sapiens
gaauaaagcccuug

SEQ ID NO: 1506959 - RNA, 21 nt, Homo sapiens
gaauaaagcccuugaaccagc

SEQ ID NO: 1506960 - RNA, 18 nt, Homo sapiens
gaauaaagcuuauucuuu

SEQ ID NO: 1506961 - RNA, 15 nt, Homo sapiens
gaauaccuucuucgc

SEQ ID NO: 1506962 - RNA, 22 nt, Homo sapiens
gaauauauuugugugugugaua

SEQ ID NO: 1506963 - RNA, 16 nt, Homo sapiens
gaauauguauguuucu

SEQ ID NO: 1506964 - RNA, 19 nt, Homo sapiens
gaaucacauacagugcugc

SEQ ID NO: 1506965 - RNA, 12 nt, Homo sapiens
gaaucaucucaa

SEQ ID NO: 1506966 - RNA, 19 nt, Homo sapiens
gaaucaucucaaauccuug

SEQ ID NO: 1506967 - RNA, 12 nt, Homo sapiens
gaaucauugugc

SEQ ID NO: 1506968 - RNA, 23 nt, Homo sapiens
gaaucuuuaaaagaugcuuuuaa

SEQ ID NO: 1506969 - RNA, 15 nt, Homo sapiens
gaaugauaagcagga

SEQ ID NO: 1506970 - RNA, 24 nt, Homo sapiens
gaaugcacacuagccucuccagga

SEQ ID NO: 1506971 - RNA, 13 nt, Homo sapiens
gaauuagccaaaa

SEQ ID NO: 1506972 - RNA, 23 nt, Homo sapiens
gaauuggccucaguguaguuaaa

SEQ ID NO: 1506973 - RNA, 13 nt, Homo sapiens
gacaaaccagagc

SEQ ID NO: 1506974 - RNA, 12 nt, Homo sapiens
gacaaagccaaa

SEQ ID NO: 1506975 - RNA, 22 nt, Homo sapiens
gacaaauauuguuaccaugaag

SEQ ID NO: 1506976 - RNA, 20 nt, Homo sapiens
gacaaaugggccugccaaac

SEQ ID NO: 1506977 - RNA, 18 nt, Homo sapiens
gacaacauuucuauagcc

SEQ ID NO: 1506978 - RNA, 15 nt, Homo sapiens
gacaagccagaacuu

SEQ ID NO: 1506979 - RNA, 14 nt, Homo sapiens
gacacaaacacaca

SEQ ID NO: 1506980 - RNA, 14 nt, Homo sapiens
gacacacagucuca

SEQ ID NO: 1506981 - RNA, 15 nt, Homo sapiens
gacacugcaaaggcg

SEQ ID NO: 1506982 - RNA, 18 nt, Homo sapiens
gacagucaaggagaugag

SEQ ID NO: 1506983 - RNA, 22 nt, Homo sapiens
gacauagcuggaaaauuccuau

SEQ ID NO: 1506984 - RNA, 16 nt, Homo sapiens
gacauauaccuucuca

SEQ ID NO: 1506985 - RNA, 19 nt, Homo sapiens
gacaugaacagaaacaaua

SEQ ID NO: 1506986 - RNA, 14 nt, Homo sapiens
gacaugcaagucau

SEQ ID NO: 1506987 - RNA, 19 nt, Homo sapiens
gacaugcuucagugcugcu

SEQ ID NO: 1506988 - RNA, 19 nt, Homo sapiens
gacauggagaccgugacca

SEQ ID NO: 1506989 - RNA, 14 nt, Homo sapiens
gacauuaaaccugg

SEQ ID NO: 1506990 - RNA, 18 nt, Homo sapiens
gaccacaggugccuacca

SEQ ID NO: 1506991 - RNA, 17 nt, Homo sapiens
gaccacauguguucucu

SEQ ID NO: 1506992 - RNA, 15 nt, Homo sapiens
gaccaguacugggaa

SEQ ID NO: 1506993 - RNA, 15 nt, Homo sapiens
gacccagucaaugaa

SEQ ID NO: 1506994 - RNA, 13 nt, Homo sapiens
gaccccaucucau

SEQ ID NO: 1506995 - RNA, 20 nt, Homo sapiens
gacccucugaaugguccagg

SEQ ID NO: 1506996 - RNA, 16 nt, Homo sapiens
gacccugucucaaaaa

SEQ ID NO: 1506997 - RNA, 17 nt, Homo sapiens
gcacuccagaauccaca

SEQ ID NO: 1506998 - RNA, 18 nt, Homo sapiens
gcacucccucccagagaa

SEQ ID NO: 1506999 - RNA, 13 nt, Homo sapiens
gcacugcccuccg

SEQ ID NO: 1507000 - RNA, 15 nt, Homo sapiens
gcacugcuccagugg

SEQ ID NO: 1507001 - RNA, 18 nt, Homo sapiens
gcacuguaaaugcagccu

SEQ ID NO: 1507002 - RNA, 22 nt, Homo sapiens
gcagaaaccaagucuacuucac

SEQ ID NO: 1507003 - RNA, 13 nt, Homo sapiens
gcagaagugcaug

SEQ ID NO: 1507004 - RNA, 20 nt, Homo sapiens
gcagagguaaaagugugagc

SEQ ID NO: 1507005 - RNA, 14 nt, Homo sapiens
gcagcaacucccac

SEQ ID NO: 1507006 - RNA, 23 nt, Homo sapiens
gcagcaaggaggaagaggacuca

SEQ ID NO: 1507007 - RNA, 14 nt, Homo sapiens
gcagcccagcacaa

SEQ ID NO: 1507008 - RNA, 16 nt, Homo sapiens
gcagccccacacccgc

SEQ ID NO: 1507009 - RNA, 17 nt, Homo sapiens
gcagccuucuuuucaaa

SEQ ID NO: 1507010 - RNA, 22 nt, Homo sapiens
gcaggaacucccagcaacacaa

SEQ ID NO: 1507011 - RNA, 15 nt, Homo sapiens
gcaggcucagacucu

SEQ ID NO: 1507012 - RNA, 17 nt, Homo sapiens
gcaggcucagacucugg

SEQ ID NO: 1507013 - RNA, 19 nt, Homo sapiens
gcagggguccuugguguga

SEQ ID NO: 1507014 - RNA, 23 nt, Homo sapiens
gcagggguccuuggugugacccu

SEQ ID NO: 1507015 - RNA, 16 nt, Homo sapiens
gcagguucgugcccug

SEQ ID NO: 1507016 - RNA, 20 nt, Homo sapiens
gcaguaggaacccagcucuc

SEQ ID NO: 1507017 - RNA, 14 nt, Homo sapiens
gcagucagugucaa

SEQ ID NO: 1507018 - RNA, 13 nt, Homo sapiens
gcagugagcugag

SEQ ID NO: 1507019 - RNA, 23 nt, Homo sapiens
gcauagagggagaggaagcacac

SEQ ID NO: 1507020 - RNA, 16 nt, Homo sapiens
gcaucacagaauguga

SEQ ID NO: 1507021 - RNA, 18 nt, Homo sapiens
gcaucacagaaugugaua

SEQ ID NO: 1507022 - RNA, 19 nt, Homo sapiens
gcaucagccuuuguacucu

SEQ ID NO: 1507023 - RNA, 22 nt, Homo sapiens
gcaucuagaauuaguggagcuu

SEQ ID NO: 1507024 - RNA, 9 nt, Homo sapiens
gcaucucau

SEQ ID NO: 1507025 - RNA, 16 nt, Homo sapiens
gcaucuucccgcugag

SEQ ID NO: 1507026 - RNA, 20 nt, Homo sapiens
gcaugcuuaaauauugaaua

SEQ ID NO: 1507027 - RNA, 11 nt, Homo sapiens
gcauuagcaca

SEQ ID NO: 1507028 - RNA, 21 nt, Homo sapiens
gcauuccaccacacauggcua

SEQ ID NO: 1507029 - RNA, 21 nt, Homo sapiens
gcauugccugaaaaaacuggu

SEQ ID NO: 1507030 - RNA, 15 nt, Homo sapiens
gcauuuacucucuua

SEQ ID NO: 1507031 - RNA, 16 nt, Homo sapiens
gcauuucuacauguuu

SEQ ID NO: 1507032 - RNA, 23 nt, Homo sapiens
gcauuucuacauguuuuagacag

SEQ ID NO: 1507033 - RNA, 15 nt, Homo sapiens
gcauuugauuuugcc

SEQ ID NO: 1507034 - RNA, 15 nt, Homo sapiens
gccaaacucugccag

SEQ ID NO: 1507035 - RNA, 17 nt, Homo sapiens
gccaaacuguacaguuu

SEQ ID NO: 1507036 - RNA, 22 nt, Homo sapiens
gccaaggagucagauggcaaug

SEQ ID NO: 1507037 - RNA, 23 nt, Homo sapiens
gccaaggugggguauuuaccaca

SEQ ID NO: 1507038 - RNA, 13 nt, Homo sapiens
gccaaugcagcua

SEQ ID NO: 1507039 - RNA, 18 nt, Homo sapiens
gccacaaagaagaaguuu

SEQ ID NO: 1507040 - RNA, 14 nt, Homo sapiens
gccacacacuguuc

SEQ ID NO: 1507041 - RNA, 18 nt, Homo sapiens
gccaccagggcacugucu

SEQ ID NO: 1507042 - RNA, 20 nt, Homo sapiens
gccaccccuaaucacuauug

SEQ ID NO: 1507043 - RNA, 23 nt, Homo sapiens
gccaccucccuauacugcuugga

SEQ ID NO: 1507044 - RNA, 16 nt, Homo sapiens
gccacucauuccugua

SEQ ID NO: 1507045 - RNA, 18 nt, Homo sapiens
gccacugaauuagccaaa

SEQ ID NO: 1507046 - RNA, 14 nt, Homo sapiens
gccacuguaggggu

SEQ ID NO: 1507047 - RNA, 13 nt, Homo sapiens
gccagaacuugac

SEQ ID NO: 1507048 - RNA, 20 nt, Homo sapiens
gccagaaucuucguccugcc

SEQ ID NO: 1507049 - RNA, 15 nt, Homo sapiens
gccaggaaucugcca

SEQ ID NO: 1507050 - RNA, 19 nt, Homo sapiens
gccaggcuagagugcagug

SEQ ID NO: 1507051 - RNA, 18 nt, Homo sapiens
gccaugauggugcugacc

SEQ ID NO: 1507052 - RNA, 17 nt, Homo sapiens
gccaugccucaagaaca

SEQ ID NO: 1507053 - RNA, 21 nt, Homo sapiens
gccauuacugcauaaaauaga

SEQ ID NO: 1507054 - RNA, 14 nt, Homo sapiens
gccauuccuggaau

SEQ ID NO: 1507055 - RNA, 23 nt, Homo sapiens
gccauugaauuugccuuccucau

SEQ ID NO: 1507056 - RNA, 14 nt, Homo sapiens
gccauuguacucca

SEQ ID NO: 1507057 - RNA, 18 nt, Homo sapiens
gcccaagguaaacaguuu

SEQ ID NO: 1507058 - RNA, 14 nt, Homo sapiens
gcccacaauggagu

SEQ ID NO: 1507059 - RNA, 19 nt, Homo sapiens
gcccacugugaaaccacua

SEQ ID NO: 1507060 - RNA, 14 nt, Homo sapiens
gcccagcugcaccu

SEQ ID NO: 1507061 - RNA, 16 nt, Homo sapiens
gcccagcugcaccugc

SEQ ID NO: 1507062 - RNA, 22 nt, Homo sapiens
gcccauuggcucccaucugaac

SEQ ID NO: 1507063 - RNA, 20 nt, Homo sapiens
gcccauuuuucuagacuguc

SEQ ID NO: 1507064 - RNA, 15 nt, Homo sapiens
gcccccacccagucc

SEQ ID NO: 1507065 - RNA, 21 nt, Homo sapiens
gccccccuccuugcucugcag

SEQ ID NO: 1507066 - RNA, 15 nt, Homo sapiens
gcccuccgcccuucc

SEQ ID NO: 1507067 - RNA, 18 nt, Homo sapiens
gcccuggagggaggcucu

SEQ ID NO: 1507068 - RNA, 20 nt, Homo sapiens
gcccuggcugaccccaaaga

SEQ ID NO: 1507069 - RNA, 15 nt, Homo sapiens
gcccuucccacugga

SEQ ID NO: 1507070 - RNA, 21 nt, Homo sapiens
gccgagaucacgccacugcac

SEQ ID NO: 1507071 - RNA, 17 nt, Homo sapiens
gccgugagcauguuugg

SEQ ID NO: 1507072 - RNA, 14 nt, Homo sapiens
gccuagaacauccc

SEQ ID NO: 1507073 - RNA, 22 nt, Homo sapiens
gccucuccugcugcugaccuga

SEQ ID NO: 1507074 - RNA, 12 nt, Homo sapiens
gccucuggaaaa

SEQ ID NO: 1507075 - RNA, 21 nt, Homo sapiens
gccucuggaaaacucaggauu

SEQ ID NO: 1507076 - RNA, 23 nt, Homo sapiens
gccugauggugcucacgacucuu

SEQ ID NO: 1507077 - RNA, 14 nt, Homo sapiens
gccuguaaucccag

SEQ ID NO: 1507078 - RNA, 14 nt, Homo sapiens
gccugugcuaaaga

SEQ ID NO: 1507079 - RNA, 18 nt, Homo sapiens
aguuucuuggccacugaa

SEQ ID NO: 1507080 - RNA, 21 nt, Homo sapiens
aguuucuuggccacugaauua

SEQ ID NO: 1507081 - RNA, 14 nt, Homo sapiens
aguuugaucaaauc

SEQ ID NO: 1507082 - RNA, 21 nt, Homo sapiens
aguuugcuuauguaaucucac

SEQ ID NO: 1507083 - RNA, 18 nt, Homo sapiens
aguuuggcuuaagcaaca

SEQ ID NO: 1507084 - RNA, 11 nt, Homo sapiens
auaaacaaaug

SEQ ID NO: 1507085 - RNA, 19 nt, Homo sapiens
auaaacacauacauugcca

SEQ ID NO: 1507086 - RNA, 14 nt, Homo sapiens
auaaacauuuggca

SEQ ID NO: 1507087 - RNA, 21 nt, Homo sapiens
auaaaccuggagaugaugaug

SEQ ID NO: 1507088 - RNA, 15 nt, Homo sapiens
auaaagcccuugaac

SEQ ID NO: 1507089 - RNA, 17 nt, Homo sapiens
auaaagcccuugaacca

SEQ ID NO: 1507090 - RNA, 13 nt, Homo sapiens
auaaauaugugaa

SEQ ID NO: 1507091 - RNA, 22 nt, Homo sapiens
auaaauccucagguaguacugg

SEQ ID NO: 1507092 - RNA, 17 nt, Homo sapiens
auaaaugauguacuaca

SEQ ID NO: 1507093 - RNA, 14 nt, Homo sapiens
auaaauuuugacuu

SEQ ID NO: 1507094 - RNA, 20 nt, Homo sapiens
auaacaagaucuuucaggaa

SEQ ID NO: 1507095 - RNA, 11 nt, Homo sapiens
auaacugagaa

SEQ ID NO: 1507096 - RNA, 12 nt, Homo sapiens
auaacuugcaua

SEQ ID NO: 1507097 - RNA, 23 nt, Homo sapiens
auaagagauagcagaggaaaaag

SEQ ID NO: 1507098 - RNA, 15 nt, Homo sapiens
auaagaggauaugaa

SEQ ID NO: 1507099 - RNA, 19 nt, Homo sapiens
auaauaaaaagacuauuaa

SEQ ID NO: 1507100 - RNA, 23 nt, Homo sapiens
auaauaaaguguuuuuaauaauu

SEQ ID NO: 1507101 - RNA, 19 nt, Homo sapiens
auaauauuucaagugccua

SEQ ID NO: 1507102 - RNA, 17 nt, Homo sapiens
auaauugccaaauaccu

SEQ ID NO: 1507103 - RNA, 19 nt, Homo sapiens
auaauuuucuggcacuggu

SEQ ID NO: 1507104 - RNA, 13 nt, Homo sapiens
auacaauuugccc

SEQ ID NO: 1507105 - RNA, 16 nt, Homo sapiens
auacaauuugcccaag

SEQ ID NO: 1507106 - RNA, 22 nt, Homo sapiens
auacacaaauuuccccucuaau

SEQ ID NO: 1507107 - RNA, 17 nt, Homo sapiens
auacaccuacuacucaa

SEQ ID NO: 1507108 - RNA, 13 nt, Homo sapiens
auacauaagacca

SEQ ID NO: 1507109 - RNA, 15 nt, Homo sapiens
auacauucauaagga

SEQ ID NO: 1507110 - RNA, 20 nt, Homo sapiens
auacauucuccuuuuugccc

SEQ ID NO: 1507111 - RNA, 23 nt, Homo sapiens
auaccagagccuucaagugccaa

SEQ ID NO: 1507112 - RNA, 19 nt, Homo sapiens
auaccagcuuuuucucuca

SEQ ID NO: 1507113 - RNA, 18 nt, Homo sapiens
auacuuugcaauccaaau

SEQ ID NO: 1507114 - RNA, 14 nt, Homo sapiens
auagaaaacugaaa

SEQ ID NO: 1507115 - RNA, 21 nt, Homo sapiens
auagaacaagacccugucuca

SEQ ID NO: 1507116 - RNA, 14 nt, Homo sapiens
auagacagugcugc

SEQ ID NO: 1507117 - RNA, 21 nt, Homo sapiens
auagauaaauuuugacuugaa

SEQ ID NO: 1507118 - RNA, 23 nt, Homo sapiens
auagaugugcaagucuugucaga

SEQ ID NO: 1507119 - RNA, 24 nt, Homo sapiens
auagauugagaaguuuuguacaga

SEQ ID NO: 1507120 - RNA, 20 nt, Homo sapiens
auagcucucaucacuaccuu

SEQ ID NO: 1507121 - RNA, 21 nt, Homo sapiens
auagcugaaugagucugcuuu

SEQ ID NO: 1507122 - RNA, 18 nt, Homo sapiens
auaggcauuugauuuugc

SEQ ID NO: 1507123 - RNA, 19 nt, Homo sapiens
auaggcauuugauuuugcc

SEQ ID NO: 1507124 - RNA, 17 nt, Homo sapiens
auagucccagcuacuca

SEQ ID NO: 1507125 - RNA, 14 nt, Homo sapiens
auagugcacacuug

SEQ ID NO: 1507126 - RNA, 22 nt, Homo sapiens
auaguuauuguuuuauguucua

SEQ ID NO: 1507127 - RNA, 15 nt, Homo sapiens
auaguucuuacuacu

SEQ ID NO: 1507128 - RNA, 14 nt, Homo sapiens
auauauacuauuaa

SEQ ID NO: 1507129 - RNA, 21 nt, Homo sapiens
auauauauguauauacauauc

SEQ ID NO: 1507130 - RNA, 13 nt, Homo sapiens
auaucaagauguu

SEQ ID NO: 1507131 - RNA, 16 nt, Homo sapiens
auaucuuuaucuuuau

SEQ ID NO: 1507132 - RNA, 17 nt, Homo sapiens
auaugcaauauuuacau

SEQ ID NO: 1507133 - RNA, 16 nt, Homo sapiens
auaugggcucaaguca

SEQ ID NO: 1507134 - RNA, 21 nt, Homo sapiens
auaugguagcaacacugugaa

SEQ ID NO: 1507135 - RNA, 14 nt, Homo sapiens
auauguauauacau

SEQ ID NO: 1507136 - RNA, 14 nt, Homo sapiens
auauuaccaaaaaa

SEQ ID NO: 1507137 - RNA, 16 nt, Homo sapiens
auauuaugugaaauca

SEQ ID NO: 1507138 - RNA, 16 nt, Homo sapiens
auauucaaggaucuca

SEQ ID NO: 1507139 - RNA, 20 nt, Homo sapiens
auauucagauauaaaacagu

SEQ ID NO: 1507140 - RNA, 13 nt, Homo sapiens
auauucauguaga

SEQ ID NO: 1507141 - RNA, 12 nt, Homo sapiens
auauucccugac

SEQ ID NO: 1507142 - RNA, 20 nt, Homo sapiens
auauuccgggugccauuccc

SEQ ID NO: 1507143 - RNA, 13 nt, Homo sapiens
auauugcaaaaac

SEQ ID NO: 1507144 - RNA, 18 nt, Homo sapiens
auauuuaauggcaaugca

SEQ ID NO: 1507145 - RNA, 15 nt, Homo sapiens
auauuuauagcaauc

SEQ ID NO: 1507146 - RNA, 19 nt, Homo sapiens
auauuuauagcaauccaug

SEQ ID NO: 1507147 - RNA, 16 nt, Homo sapiens
auauuucccaauacau

SEQ ID NO: 1507148 - RNA, 16 nt, Homo sapiens
auauuugaauaucauu

SEQ ID NO: 1507149 - RNA, 16 nt, Homo sapiens
auauuuucuauuacac

SEQ ID NO: 1507150 - RNA, 20 nt, Homo sapiens
aucaaaaucuuucagcacuc

SEQ ID NO: 1507151 - RNA, 14 nt, Homo sapiens
aucaaaauguuguc

SEQ ID NO: 1507152 - RNA, 17 nt, Homo sapiens
aucacaguguuugcaau

SEQ ID NO: 1507153 - RNA, 20 nt, Homo sapiens
aucacaguguuugcaauggu

SEQ ID NO: 1507154 - RNA, 21 nt, Homo sapiens
aucacaguguuugcaauggug

SEQ ID NO: 1507155 - RNA, 13 nt, Homo sapiens
aucaccaugauuu

SEQ ID NO: 1507156 - RNA, 21 nt, Homo sapiens
aucacgccauuguacuccagc

SEQ ID NO: 1507157 - RNA, 14 nt, Homo sapiens
aucagaagcacaaa

SEQ ID NO: 1507158 - RNA, 13 nt, Homo sapiens
aucagagagccua

SEQ ID NO: 1507159 - RNA, 22 nt, Homo sapiens
aucagccucacugagcuaauaa

SEQ ID NO: 1507160 - RNA, 21 nt, Homo sapiens
aucagccuccgccauuccaag

SEQ ID NO: 1507161 - RNA, 18 nt, Homo sapiens
aucauauugaauguuucc

SEQ ID NO: 1507162 - RNA, 18 nt, Homo sapiens
aucauccgaggcaaagag

SEQ ID NO: 1507163 - RNA, 14 nt, Homo sapiens
aucaugucauugau

SEQ ID NO: 1507164 - RNA, 18 nt, Homo sapiens
aucauuuggaaaucagca

SEQ ID NO: 1507165 - RNA, 13 nt, Homo sapiens
aucauuuuagaca

SEQ ID NO: 1507166 - RNA, 22 nt, Homo sapiens
auccacaaaaacaacuuauuau

SEQ ID NO: 1507167 - RNA, 15 nt, Homo sapiens
auccacaagccauuu

SEQ ID NO: 1507168 - RNA, 23 nt, Homo sapiens
auccagaacugaggucacugggu

SEQ ID NO: 1507169 - RNA, 17 nt, Homo sapiens
auccaggacucugucaa

SEQ ID NO: 1507170 - RNA, 22 nt, Homo sapiens
aucccaggcgggcggcacgcca

SEQ ID NO: 1507171 - RNA, 12 nt, Homo sapiens
aucccagugugu

SEQ ID NO: 1507172 - RNA, 14 nt, Homo sapiens
aucccuucccuguc

SEQ ID NO: 1507173 - RNA, 19 nt, Homo sapiens
auccucaacaacaaaccaa

SEQ ID NO: 1507174 - RNA, 22 nt, Homo sapiens
auccucaacaacaaaccaaaac

SEQ ID NO: 1507175 - RNA, 15 nt, Homo sapiens
auccuccugccucag

SEQ ID NO: 1507176 - RNA, 21 nt, Homo sapiens
auccuccuuucuauaguucca

SEQ ID NO: 1507177 - RNA, 21 nt, Homo sapiens
auccuggccaacauggugaaa

SEQ ID NO: 1507178 - RNA, 14 nt, Homo sapiens
auccuuuaucaaga

SEQ ID NO: 1507179 - RNA, 17 nt, Homo sapiens
aucuauggcgaacacag

SEQ ID NO: 1507180 - RNA, 14 nt, Homo sapiens
aucucaguggcaca

SEQ ID NO: 1507181 - RNA, 18 nt, Homo sapiens
aucucauucagguguucu

SEQ ID NO: 1507182 - RNA, 12 nt, Homo sapiens
aucuccaaggac

SEQ ID NO: 1507183 - RNA, 21 nt, Homo sapiens
aucuccaggauugaagagcau

SEQ ID NO: 1507184 - RNA, 22 nt, Homo sapiens
aucuccagugggaacucuucaa

SEQ ID NO: 1507185 - RNA, 16 nt, Homo sapiens
uuauauuacacuacac

SEQ ID NO: 1507186 - RNA, 23 nt, Homo sapiens
uuauauucaaggaucucaaagaa

SEQ ID NO: 1507187 - RNA, 19 nt, Homo sapiens
uuauauuccugagaaugaa

SEQ ID NO: 1507188 - RNA, 19 nt, Homo sapiens
uuauauuuggcucucagau

SEQ ID NO: 1507189 - RNA, 11 nt, Homo sapiens
uuaucugcuag

SEQ ID NO: 1507190 - RNA, 15 nt, Homo sapiens
uuaugaaaaagaaga

SEQ ID NO: 1507191 - RNA, 12 nt, Homo sapiens
uuaugcugucau

SEQ ID NO: 1507192 - RNA, 14 nt, Homo sapiens
uuauggugcauuac

SEQ ID NO: 1507193 - RNA, 15 nt, Homo sapiens
uuauuccuuugcaua

SEQ ID NO: 1507194 - RNA, 15 nt, Homo sapiens
uuauucuuuguccau

SEQ ID NO: 1507195 - RNA, 22 nt, Homo sapiens
uucaaaccaauucacccagaaa

SEQ ID NO: 1507196 - RNA, 13 nt, Homo sapiens
uucaaaccaggau

SEQ ID NO: 1507197 - RNA, 14 nt, Homo sapiens
uucaacuccagaag

SEQ ID NO: 1507198 - RNA, 20 nt, Homo sapiens
uucaagacuugauacugcaa

SEQ ID NO: 1507199 - RNA, 14 nt, Homo sapiens
uucaagagugcagu

SEQ ID NO: 1507200 - RNA, 12 nt, Homo sapiens
uucaauacuuca

SEQ ID NO: 1507201 - RNA, 16 nt, Homo sapiens
uucaauacuucaugau

SEQ ID NO: 1507202 - RNA, 23 nt, Homo sapiens
uucacaccucacgcucuggacau

SEQ ID NO: 1507203 - RNA, 19 nt, Homo sapiens
uucacauucccaucuguca

SEQ ID NO: 1507204 - RNA, 16 nt, Homo sapiens
uucaccacauucguca

SEQ ID NO: 1507205 - RNA, 17 nt, Homo sapiens
uucagagcaagcacugg

SEQ ID NO: 1507206 - RNA, 22 nt, Homo sapiens
uucagagggcguguuguuuuac

SEQ ID NO: 1507207 - RNA, 18 nt, Homo sapiens
uucagcugugaacaugga

SEQ ID NO: 1507208 - RNA, 16 nt, Homo sapiens
uucaguggugugaucu

SEQ ID NO: 1507209 - RNA, 20 nt, Homo sapiens
uucauggaagccaccaguga

SEQ ID NO: 1507210 - RNA, 13 nt, Homo sapiens
uucauggugacau

SEQ ID NO: 1507211 - RNA, 23 nt, Homo sapiens
uuccaaggguaugggaagccaua

SEQ ID NO: 1507212 - RNA, 13 nt, Homo sapiens
uuccagcauuugc

SEQ ID NO: 1507213 - RNA, 20 nt, Homo sapiens
uuccagcauuugccauuccu

SEQ ID NO: 1507214 - RNA, 22 nt, Homo sapiens
uuccagccccuauguuauugau

SEQ ID NO: 1507215 - RNA, 17 nt, Homo sapiens
uuccaguuguuacugaa

SEQ ID NO: 1507216 - RNA, 13 nt, Homo sapiens
uuccaugauacuu

SEQ ID NO: 1507217 - RNA, 19 nt, Homo sapiens
uuccauuuuacuuccauga

SEQ ID NO: 1507218 - RNA, 18 nt, Homo sapiens
uucccaaaauaacugaga

SEQ ID NO: 1507219 - RNA, 16 nt, Homo sapiens
uucccauauacaaucu

SEQ ID NO: 1507220 - RNA, 19 nt, Homo sapiens
uucccucuuuccccaccuc

SEQ ID NO: 1507221 - RNA, 20 nt, Homo sapiens
uucccuucucuccuucccuc

SEQ ID NO: 1507222 - RNA, 15 nt, Homo sapiens
uuccguggucagagu

SEQ ID NO: 1507223 - RNA, 13 nt, Homo sapiens
uuccucacuccaa

SEQ ID NO: 1507224 - RNA, 17 nt, Homo sapiens
uuccugcuacacaaaag

SEQ ID NO: 1507225 - RNA, 21 nt, Homo sapiens
uuccugggcaagaaccuaaag

SEQ ID NO: 1507226 - RNA, 20 nt, Homo sapiens
uucgagaccagccuggccaa

SEQ ID NO: 1507227 - RNA, 21 nt, Homo sapiens
uucguagauauuggacaaaga

SEQ ID NO: 1507228 - RNA, 13 nt, Homo sapiens
uucuauucaaaag

SEQ ID NO: 1507229 - RNA, 17 nt, Homo sapiens
uucucaugggguggggu

SEQ ID NO: 1507230 - RNA, 23 nt, Homo sapiens
uucuccucccuguuaucugcuag

SEQ ID NO: 1507231 - RNA, 15 nt, Homo sapiens
uucuccuuuuugccc

SEQ ID NO: 1507232 - RNA, 18 nt, Homo sapiens
uucucuauaggucaugau

SEQ ID NO: 1507233 - RNA, 19 nt, Homo sapiens
uucucucaggguucugagu

SEQ ID NO: 1507234 - RNA, 16 nt, Homo sapiens
uucucuccuucuuccc

SEQ ID NO: 1507235 - RNA, 18 nt, Homo sapiens
uucugaaacuucauaaau

SEQ ID NO: 1507236 - RNA, 22 nt, Homo sapiens
uucugauuccccuccaccaaac

SEQ ID NO: 1507237 - RNA, 21 nt, Homo sapiens
uucugcugaaggacagaacau

SEQ ID NO: 1507238 - RNA, 23 nt, Homo sapiens
uucuggauucaaaugucaguuca

SEQ ID NO: 1507239 - RNA, 15 nt, Homo sapiens
uucuguacacagaag

SEQ ID NO: 1507240 - RNA, 19 nt, Homo sapiens
uucuguccaccagacccac

SEQ ID NO: 1507241 - RNA, 14 nt, Homo sapiens
uucugugaagcaaa

SEQ ID NO: 1507242 - RNA, 13 nt, Homo sapiens
uucuuagcuguca

SEQ ID NO: 1507243 - RNA, 17 nt, Homo sapiens
uucuugguaacugauua

SEQ ID NO: 1507244 - RNA, 15 nt, Homo sapiens
uucuuuacauuugau

SEQ ID NO: 1507245 - RNA, 12 nt, Homo sapiens
uucuuuguccau

SEQ ID NO: 1507246 - RNA, 17 nt, Homo sapiens
uugaaagcccaaggugc

SEQ ID NO: 1507247 - RNA, 19 nt, Homo sapiens
uugaaauuuuauuuaguuc

SEQ ID NO: 1507248 - RNA, 12 nt, Homo sapiens
uugaacugguuc

SEQ ID NO: 1507249 - RNA, 18 nt, Homo sapiens
uugaacugguucaugaaa

SEQ ID NO: 1507250 - RNA, 15 nt, Homo sapiens
uugaacugguuguga

SEQ ID NO: 1507251 - RNA, 18 nt, Homo sapiens
uugaacugguugugaaua

SEQ ID NO: 1507252 - RNA, 19 nt, Homo sapiens
uugaacuuauuuacacaua

SEQ ID NO: 1507253 - RNA, 22 nt, Homo sapiens
uugaagagauuucaacauauca

SEQ ID NO: 1507254 - RNA, 19 nt, Homo sapiens
uugaaguaggacuuuccua

SEQ ID NO: 1507255 - RNA, 17 nt, Homo sapiens
uugaaucaaagcaguua

SEQ ID NO: 1507256 - RNA, 15 nt, Homo sapiens
uugacaacugguuua

SEQ ID NO: 1507257 - RNA, 17 nt, Homo sapiens
uugagaaagccuucaua

SEQ ID NO: 1507258 - RNA, 15 nt, Homo sapiens
uugagcaaaccacau

SEQ ID NO: 1507259 - RNA, 13 nt, Homo sapiens
uugagccaagacc

SEQ ID NO: 1507260 - RNA, 16 nt, Homo sapiens
uugagcccucccagca

SEQ ID NO: 1507261 - RNA, 20 nt, Homo sapiens
uugaggccugcccucaggga

SEQ ID NO: 1507262 - RNA, 20 nt, Homo sapiens
uugagugacucgaggguugg

SEQ ID NO: 1507263 - RNA, 16 nt, Homo sapiens
uugauaaaugccucau

SEQ ID NO: 1507264 - RNA, 14 nt, Homo sapiens
uugauagcacacau

SEQ ID NO: 1507265 - RNA, 18 nt, Homo sapiens
uugauggagcuacuuuaa

SEQ ID NO: 1507266 - RNA, 24 nt, Homo sapiens
uugcaaccuaccuguugagcauca

SEQ ID NO: 1507267 - RNA, 19 nt, Homo sapiens
uugcaagauuuaacacuaa

SEQ ID NO: 1507268 - RNA, 16 nt, Homo sapiens
uugcagauccuugaua

SEQ ID NO: 1507269 - RNA, 18 nt, Homo sapiens
uugccaaaauaccagagc

SEQ ID NO: 1507270 - RNA, 13 nt, Homo sapiens
uugcgggggagcu

SEQ ID NO: 1507271 - RNA, 15 nt, Homo sapiens
uugcuguuugcaauu

SEQ ID NO: 1507272 - RNA, 16 nt, Homo sapiens
uugcuuguaaaaccaa

SEQ ID NO: 1507273 - RNA, 11 nt, Homo sapiens
uugcuuuucag

SEQ ID NO: 1507274 - RNA, 19 nt, Homo sapiens
uuggaauuuaaaaauaucg

SEQ ID NO: 1507275 - RNA, 19 nt, Homo sapiens
uuggcagcccugaugacug

SEQ ID NO: 1507276 - RNA, 18 nt, Homo sapiens
uuggcuuuugcuuggcag

SEQ ID NO: 1507277 - RNA, 15 nt, Homo sapiens
uugggcugucaacau

SEQ ID NO: 1507278 - RNA, 14 nt, Homo sapiens
uugguuacauggaa

SEQ ID NO: 1507279 - RNA, 13 nt, Homo sapiens
uuguaaaggaaau

SEQ ID NO: 1507280 - RNA, 17 nt, Homo sapiens
uuguaauaugucugcca

SEQ ID NO: 1507281 - RNA, 19 nt, Homo sapiens
uuguagaaaugagccagaa

SEQ ID NO: 1507282 - RNA, 16 nt, Homo sapiens
uuguaggcuguggggu

SEQ ID NO: 1507283 - RNA, 15 nt, Homo sapiens
uuguauuuuuguaug

SEQ ID NO: 1507284 - RNA, 22 nt, Homo sapiens
uugucaacaaaaagacauggaa

SEQ ID NO: 1507285 - RNA, 15 nt, Homo sapiens
uugucaacacaaaga

SEQ ID NO: 1507286 - RNA, 23 nt, Homo sapiens
uugucaacacaaagacauggaag

SEQ ID NO: 1507287 - RNA, 16 nt, Homo sapiens
uuguccuucagccaaa

SEQ ID NO: 1507288 - RNA, 15 nt, Homo sapiens
uugucuaccauuugu

SEQ ID NO: 1507289 - RNA, 18 nt, Homo sapiens
uugugcuugcugguacua

SEQ ID NO: 1507290 - RNA, 15 nt, Homo sapiens
uuguguccugaugaa

SEQ ID NO: 1507291 - RNA, 17 nt, Homo sapiens
uugugucuggcaguuua

SEQ ID NO: 1507292 - RNA, 18 nt, Homo sapiens
uuguucacuagacugugc

SEQ ID NO: 1507293 - RNA, 15 nt, Homo sapiens
uuguucugucuuuag

SEQ ID NO: 1507294 - RNA, 23 nt, Homo sapiens
uuguugguuuggccacucuugac

SEQ ID NO: 1507295 - RNA, 15 nt, Homo sapiens
uuuaaaaaacuaaaa

SEQ ID NO: 1507296 - RNA, 16 nt, Homo sapiens
uuuaaaaaagcuuaaa

SEQ ID NO: 1507297 - RNA, 12 nt, Homo sapiens
uuuaaaacacaa

SEQ ID NO: 1507298 - RNA, 22 nt, Homo sapiens
uuuaaagguagagaugugugug

SEQ ID NO: 1507299 - RNA, 21 nt, Homo sapiens
uuuaaauaaaaaaguuuacag

SEQ ID NO: 1507300 - RNA, 20 nt, Homo sapiens
uuuaacaagugacaggguug

SEQ ID NO: 1507301 - RNA, 16 nt, Homo sapiens
uuuaacccucucuucc

SEQ ID NO: 1507302 - RNA, 14 nt, Homo sapiens
uuuaagaacgaagg

SEQ ID NO: 1507303 - RNA, 14 nt, Homo sapiens
uuuaagaacuguau

SEQ ID NO: 1507304 - RNA, 13 nt, Homo sapiens
uuuaagcuguaaa

SEQ ID NO: 1507305 - RNA, 14 nt, Homo sapiens
uuuaauagcaaaga

SEQ ID NO: 1507306 - RNA, 20 nt, Homo sapiens
uuuacagaauggaaccaaaa

SEQ ID NO: 1507307 - RNA, 14 nt, Homo sapiens
uuuacagacuguga

SEQ ID NO: 1507308 - RNA, 14 nt, Homo sapiens
uuuaccacagcagc

SEQ ID NO: 1507309 - RNA, 14 nt, Homo sapiens
uuuacuagugugug

SEQ ID NO: 1507310 - RNA, 21 nt, Homo sapiens
uuuagaaaauaaaaacuuuag

SEQ ID NO: 1507311 - RNA, 18 nt, Homo sapiens
uuuagcccaucucuccag

SEQ ID NO: 1507312 - RNA, 16 nt, Homo sapiens
uuuagucuguauugau

SEQ ID NO: 1507313 - RNA, 22 nt, Homo sapiens
uuuauugucggaagacuugcca

SEQ ID NO: 1507314 - RNA, 20 nt, Homo sapiens
uuuauuuaguuuuuaacaau

SEQ ID NO: 1507315 - RNA, 12 nt, Homo sapiens
uauuaccaaaaa

SEQ ID NO: 1507316 - RNA, 16 nt, Homo sapiens
uauuauuuuuuccaca

SEQ ID NO: 1507317 - RNA, 13 nt, Homo sapiens
uauucaaguauua

SEQ ID NO: 1507318 - RNA, 23 nt, Homo sapiens
uauucauucauuuacucauucau

SEQ ID NO: 1507319 - RNA, 14 nt, Homo sapiens
uauucuauuuacaa

SEQ ID NO: 1507320 - RNA, 23 nt, Homo sapiens
uauucuuaagggaacuuccacau

SEQ ID NO: 1507321 - RNA, 19 nt, Homo sapiens
uauugggacacacaucaaa

SEQ ID NO: 1507322 - RNA, 16 nt, Homo sapiens
uauugucggaagacuu

SEQ ID NO: 1507323 - RNA, 20 nt, Homo sapiens
uauugucggaagacuugcca

SEQ ID NO: 1507324 - RNA, 16 nt, Homo sapiens
uauuuaaaaguauaaa

SEQ ID NO: 1507325 - RNA, 21 nt, Homo sapiens
uauuuaaauaaaaucauauug

SEQ ID NO: 1507326 - RNA, 22 nt, Homo sapiens
uauuuaguuuuuaacaaucuaa

SEQ ID NO: 1507327 - RNA, 16 nt, Homo sapiens
uauuucaaaacacauc

SEQ ID NO: 1507328 - RNA, 20 nt, Homo sapiens
uauuuguaauagugacauau

SEQ ID NO: 1507329 - RNA, 16 nt, Homo sapiens
uauuuuuuaaagucua

SEQ ID NO: 1507330 - RNA, 18 nt, Homo sapiens
uauuuuuuacaauggcca

SEQ ID NO: 1507331 - RNA, 16 nt, Homo sapiens
uauuuuuuacuuugcc

SEQ ID NO: 1507332 - RNA, 21 nt, Homo sapiens
ucaaaaaccuggagugcucaa

SEQ ID NO: 1507333 - RNA, 15 nt, Homo sapiens
ucaaaacugcuaaau

SEQ ID NO: 1507334 - RNA, 19 nt, Homo sapiens
ucaaaagucuggccuuuca

SEQ ID NO: 1507335 - RNA, 14 nt, Homo sapiens
ucaaaccaggauuu

SEQ ID NO: 1507336 - RNA, 13 nt, Homo sapiens
ucaaaguguaaca

SEQ ID NO: 1507337 - RNA, 16 nt, Homo sapiens
ucaaauauuaccaaaa

SEQ ID NO: 1507338 - RNA, 12 nt, Homo sapiens
ucaaaugccuga

SEQ ID NO: 1507339 - RNA, 23 nt, Homo sapiens
ucaaauuuugaugccaagaaagu

SEQ ID NO: 1507340 - RNA, 15 nt, Homo sapiens
ucaacaaaaagacau

SEQ ID NO: 1507341 - RNA, 19 nt, Homo sapiens
ucaacaaaaagacauggaa

SEQ ID NO: 1507342 - RNA, 17 nt, Homo sapiens
ucaacaagaguugucuu

SEQ ID NO: 1507343 - RNA, 17 nt, Homo sapiens
ucaacaauaaagacuga

SEQ ID NO: 1507344 - RNA, 19 nt, Homo sapiens
ucaacacaaagacauggaa

SEQ ID NO: 1507345 - RNA, 10 nt, Homo sapiens
ucaacugagg

SEQ ID NO: 1507346 - RNA, 23 nt, Homo sapiens
ucaagaaaugaaugcuccaugaa

SEQ ID NO: 1507347 - RNA, 14 nt, Homo sapiens
ucaagagacacugc

SEQ ID NO: 1507348 - RNA, 15 nt, Homo sapiens
ucaagagacacugcu

SEQ ID NO: 1507349 - RNA, 15 nt, Homo sapiens
ucaagaucaacauuc

SEQ ID NO: 1507350 - RNA, 16 nt, Homo sapiens
ucaagaucaacauucc

SEQ ID NO: 1507351 - RNA, 22 nt, Homo sapiens
ucaagcaauccuccugccucag

SEQ ID NO: 1507352 - RNA, 21 nt, Homo sapiens
ucaagcgauucuucugccuca

SEQ ID NO: 1507353 - RNA, 22 nt, Homo sapiens
ucaagcgauucuucugccucag

SEQ ID NO: 1507354 - RNA, 16 nt, Homo sapiens
ucaaggcggugcuuga

SEQ ID NO: 1507355 - RNA, 17 nt, Homo sapiens
ucaaguagaucauggca

SEQ ID NO: 1507356 - RNA, 15 nt, Homo sapiens
ucaauaaauguugcu

SEQ ID NO: 1507357 - RNA, 21 nt, Homo sapiens
ucaauaccccuguuaagcaau

SEQ ID NO: 1507358 - RNA, 20 nt, Homo sapiens
ucaaucaugaguaccucaaa

SEQ ID NO: 1507359 - RNA, 23 nt, Homo sapiens
ucaaugaaaaaaaguacauguau

SEQ ID NO: 1507360 - RNA, 18 nt, Homo sapiens
ucaauguucaguuuuccu

SEQ ID NO: 1507361 - RNA, 23 nt, Homo sapiens
ucaauuggaaguaguucuaugaa

SEQ ID NO: 1507362 - RNA, 20 nt, Homo sapiens
ucacaacagaaaacccaaaa

SEQ ID NO: 1507363 - RNA, 20 nt, Homo sapiens
ucacaacauuuacuuaacag

SEQ ID NO: 1507364 - RNA, 18 nt, Homo sapiens
ucacaaccaccuaaucag

SEQ ID NO: 1507365 - RNA, 21 nt, Homo sapiens
ucacaaugccuagacugugua

SEQ ID NO: 1507366 - RNA, 15 nt, Homo sapiens
ucacacgggguauuu

SEQ ID NO: 1507367 - RNA, 13 nt, Homo sapiens
ucacagaauguga

SEQ ID NO: 1507368 - RNA, 18 nt, Homo sapiens
ucacaguugacaaaaagc

SEQ ID NO: 1507369 - RNA, 12 nt, Homo sapiens
ucacauaaacuu

SEQ ID NO: 1507370 - RNA, 15 nt, Homo sapiens
ucacauuuugccuuu

SEQ ID NO: 1507371 - RNA, 10 nt, Homo sapiens
ucaccaaaau

SEQ ID NO: 1507372 - RNA, 13 nt, Homo sapiens
ucaccuauuacau

SEQ ID NO: 1507373 - RNA, 16 nt, Homo sapiens
ucaccuuggagccuga

SEQ ID NO: 1507374 - RNA, 15 nt, Homo sapiens
ucacuaagagcuuua

SEQ ID NO: 1507375 - RNA, 23 nt, Homo sapiens
ucacuaccuuuauagcucucauc

SEQ ID NO: 1507376 - RNA, 11 nt, Homo sapiens
ucacucaggcu

SEQ ID NO: 1507377 - RNA, 17 nt, Homo sapiens
ucacucugaguguuuua

SEQ ID NO: 1507378 - RNA, 17 nt, Homo sapiens
ucacucuucaaaugccu

SEQ ID NO: 1507379 - RNA, 19 nt, Homo sapiens
ucacucuucaaaugccuga

SEQ ID NO: 1507380 - RNA, 22 nt, Homo sapiens
ucacugaagaaaccuucagauu

SEQ ID NO: 1507381 - RNA, 14 nt, Homo sapiens
ucacugcuaccucu

SEQ ID NO: 1507382 - RNA, 18 nt, Homo sapiens
ucacuuuuuauuuugcca

SEQ ID NO: 1507383 - RNA, 22 nt, Homo sapiens
ucagaagagguugggcuuccau

SEQ ID NO: 1507384 - RNA, 12 nt, Homo sapiens
ucagaagcacaa

SEQ ID NO: 1507385 - RNA, 20 nt, Homo sapiens
ucagaauggaaagaaacuca

SEQ ID NO: 1507386 - RNA, 13 nt, Homo sapiens
ucagacauuccaa

SEQ ID NO: 1507387 - RNA, 19 nt, Homo sapiens
ucagacauuugguauauua

SEQ ID NO: 1507388 - RNA, 15 nt, Homo sapiens
ucagagcaggcucag

SEQ ID NO: 1507389 - RNA, 23 nt, Homo sapiens
ucagaguuugaagguaacugaga

SEQ ID NO: 1507390 - RNA, 12 nt, Homo sapiens
ucagauaaggua

SEQ ID NO: 1507391 - RNA, 22 nt, Homo sapiens
ucagauaagguaaaaugccaug

SEQ ID NO: 1507392 - RNA, 12 nt, Homo sapiens
ucagcacauguu

SEQ ID NO: 1507393 - RNA, 22 nt, Homo sapiens
ucagccgcagacaaguaaucac

SEQ ID NO: 1507394 - RNA, 16 nt, Homo sapiens
ucaggauacucuguca

SEQ ID NO: 1507395 - RNA, 19 nt, Homo sapiens
ucaggcaguucccuguuga

SEQ ID NO: 1507396 - RNA, 17 nt, Homo sapiens
ucaggcauugaaugaca

SEQ ID NO: 1507397 - RNA, 17 nt, Homo sapiens
ucaggccaacaagccaa

SEQ ID NO: 1507398 - RNA, 18 nt, Homo sapiens
ucaggccaacaagccaac

SEQ ID NO: 1507399 - RNA, 15 nt, Homo sapiens
ucaggcuucugagua

SEQ ID NO: 1507400 - RNA, 16 nt, Homo sapiens
ucagggucggggcuag

SEQ ID NO: 1507401 - RNA, 14 nt, Homo sapiens
ucagguaguacugg

SEQ ID NO: 1507402 - RNA, 16 nt, Homo sapiens
ucagguaguacuggga

SEQ ID NO: 1507403 - RNA, 12 nt, Homo sapiens
ucagguauuugu

SEQ ID NO: 1507404 - RNA, 18 nt, Homo sapiens
ucaguauaaaagacaaaa

SEQ ID NO: 1507405 - RNA, 12 nt, Homo sapiens
ucagucaucuca

SEQ ID NO: 1507406 - RNA, 14 nt, Homo sapiens
ucagucaucucaug

SEQ ID NO: 1507407 - RNA, 12 nt, Homo sapiens
ucaguccagaug

SEQ ID NO: 1507408 - RNA, 16 nt, Homo sapiens
ucaguccccauggcac

SEQ ID NO: 1507409 - RNA, 17 nt, Homo sapiens
ucagugaaaaauaauua

SEQ ID NO: 1507410 - RNA, 18 nt, Homo sapiens
ucagugcacuguauauag

SEQ ID NO: 1507411 - RNA, 21 nt, Homo sapiens
ucaguguaugauauacuuuau

SEQ ID NO: 1507412 - RNA, 13 nt, Homo sapiens
ucaguuaacauua

SEQ ID NO: 1507413 - RNA, 14 nt, Homo sapiens
ucaguuguuuuccc

SEQ ID NO: 1507414 - RNA, 14 nt, Homo sapiens
ucaguuuuccuuag

SEQ ID NO: 1507415 - RNA, 14 nt, Homo sapiens
ucauaucagcuuua

SEQ ID NO: 1507416 - RNA, 23 nt, Homo sapiens
ucauauugguauucacuaaucug

SEQ ID NO: 1507417 - RNA, 20 nt, Homo sapiens
ucauauuuauacuuugcaau

SEQ ID NO: 1507418 - RNA, 20 nt, Homo sapiens
ucauauuuuguauauaucug

SEQ ID NO: 1507419 - RNA, 17 nt, Homo sapiens
ucauccccacaaucugg

SEQ ID NO: 1507420 - RNA, 21 nt, Homo sapiens
ucaucccuggucgucuauccc

SEQ ID NO: 1507421 - RNA, 17 nt, Homo sapiens
guugauuacagugcagu

SEQ ID NO: 1507422 - RNA, 18 nt, Homo sapiens
guugauuacagugcagug

SEQ ID NO: 1507423 - RNA, 14 nt, Homo sapiens
guuggaaauauuca

SEQ ID NO: 1507424 - RNA, 23 nt, Homo sapiens
guuggacuucagucuugccuagg

SEQ ID NO: 1507425 - RNA, 20 nt, Homo sapiens
guugucuggcuuuuugcacg

SEQ ID NO: 1507426 - RNA, 21 nt, Homo sapiens
guugugcagucagugucaauc

SEQ ID NO: 1507427 - RNA, 12 nt, Homo sapiens
guuuaacauuca

SEQ ID NO: 1507428 - RNA, 22 nt, Homo sapiens
guuuaagccaaaaugcagucuu

SEQ ID NO: 1507429 - RNA, 23 nt, Homo sapiens
guuuagcacggguuaagaucuga

SEQ ID NO: 1507430 - RNA, 13 nt, Homo sapiens
guuuaucugagcu

SEQ ID NO: 1507431 - RNA, 21 nt, Homo sapiens
guuuauuuuccucagagccuu

SEQ ID NO: 1507432 - RNA, 22 nt, Homo sapiens
guuucaaauggacucauggcuu

SEQ ID NO: 1507433 - RNA, 23 nt, Homo sapiens
guuuccaguuguuacugaaguua

SEQ ID NO: 1507434 - RNA, 15 nt, Homo sapiens
guuuccugguuugua

SEQ ID NO: 1507435 - RNA, 14 nt, Homo sapiens
guuugagcuuucau

SEQ ID NO: 1507436 - RNA, 13 nt, Homo sapiens
guuuggcuuucag

SEQ ID NO: 1507437 - RNA, 20 nt, Homo sapiens
guuuuaaugacaaggugaua

SEQ ID NO: 1507438 - RNA, 20 nt, Homo sapiens
guuuuacagugaauuucuga

SEQ ID NO: 1507439 - RNA, 19 nt, Homo sapiens
guuuuagacaaauuugcaa

SEQ ID NO: 1507440 - RNA, 20 nt, Homo sapiens
guuuugucucugcaucucau

SEQ ID NO: 1507441 - RNA, 17 nt, Homo sapiens
guuuuuguuuuuuucca

SEQ ID NO: 1507442 - RNA, 18 nt, Homo sapiens
guuuuuucuguacacaga

SEQ ID NO: 1507443 - RNA, 12 nt, Homo sapiens
guuuuuuuccaa

SEQ ID NO: 1507444 - RNA, 16 nt, Homo sapiens
uaaaaacaaagaaaua

SEQ ID NO: 1507445 - RNA, 14 nt, Homo sapiens
uaaaaacuuccauc

SEQ ID NO: 1507446 - RNA, 17 nt, Homo sapiens
uaaaaacuuccaucccu

SEQ ID NO: 1507447 - RNA, 19 nt, Homo sapiens
uaaaacacaccuaagagaa

SEQ ID NO: 1507448 - RNA, 15 nt, Homo sapiens
uaaaaccauuauuua

SEQ ID NO: 1507449 - RNA, 12 nt, Homo sapiens
uaaaaccuuuca

SEQ ID NO: 1507450 - RNA, 16 nt, Homo sapiens
uaaaagaaacuguggu

SEQ ID NO: 1507451 - RNA, 17 nt, Homo sapiens
uaaaauaagaaugauuu

SEQ ID NO: 1507452 - RNA, 23 nt, Homo sapiens
uaaaauaauuuuaaaaguuggga

SEQ ID NO: 1507453 - RNA, 20 nt, Homo sapiens
uaaaauauuuuuugcuauau

SEQ ID NO: 1507454 - RNA, 13 nt, Homo sapiens
uaaaaucaauaaa

SEQ ID NO: 1507455 - RNA, 12 nt, Homo sapiens
uaaaaugaggcu

SEQ ID NO: 1507456 - RNA, 19 nt, Homo sapiens
uaaaaugccaugaugccuc

SEQ ID NO: 1507457 - RNA, 16 nt, Homo sapiens
uaaaauguaaagccau

SEQ ID NO: 1507458 - RNA, 17 nt, Homo sapiens
uaaaauuucaaguuuaa

SEQ ID NO: 1507459 - RNA, 14 nt, Homo sapiens
uaaacuguacaugu

SEQ ID NO: 1507460 - RNA, 14 nt, Homo sapiens
uaaagaaguuugau

SEQ ID NO: 1507461 - RNA, 20 nt, Homo sapiens
uaaagcccaaccuccugacc

SEQ ID NO: 1507462 - RNA, 14 nt, Homo sapiens
uaaagcccuugaac

SEQ ID NO: 1507463 - RNA, 13 nt, Homo sapiens
uaaagcugcugag

SEQ ID NO: 1507464 - RNA, 19 nt, Homo sapiens
uaaagcuuucugacaagau

SEQ ID NO: 1507465 - RNA, 19 nt, Homo sapiens
uaaaggaagucaccaaaau

SEQ ID NO: 1507466 - RNA, 17 nt, Homo sapiens
uaaaggaugggaccaac

SEQ ID NO: 1507467 - RNA, 18 nt, Homo sapiens
uaaaggucacauaaacuu

SEQ ID NO: 1507468 - RNA, 14 nt, Homo sapiens
uaaaguacuacauc

SEQ ID NO: 1507469 - RNA, 20 nt, Homo sapiens
uaaagugacuaauggcauga

SEQ ID NO: 1507470 - RNA, 18 nt, Homo sapiens
uaaaguuguucacauaua

SEQ ID NO: 1507471 - RNA, 15 nt, Homo sapiens
uaaauagcauucucu

SEQ ID NO: 1507472 - RNA, 13 nt, Homo sapiens
uaaauaugugaaa

SEQ ID NO: 1507473 - RNA, 14 nt, Homo sapiens
uaaauaugugaaaa

SEQ ID NO: 1507474 - RNA, 21 nt, Homo sapiens
uaaauccucagguaguacugg

SEQ ID NO: 1507475 - RNA, 18 nt, Homo sapiens
uaaaugauguacuacauu

SEQ ID NO: 1507476 - RNA, 13 nt, Homo sapiens
uaaaugcagguau

SEQ ID NO: 1507477 - RNA, 18 nt, Homo sapiens
uaaauggcuggggggcca

SEQ ID NO: 1507478 - RNA, 18 nt, Homo sapiens
uaaauucagaaagucaua

SEQ ID NO: 1507479 - RNA, 21 nt, Homo sapiens
uaaauuggaauuuucuuaccc

SEQ ID NO: 1507480 - RNA, 14 nt, Homo sapiens
uaaauuggcuuauu

SEQ ID NO: 1507481 - RNA, 11 nt, Homo sapiens
uaaauuuucca

SEQ ID NO: 1507482 - RNA, 21 nt, Homo sapiens
uaacaaauauauugcaaaaac

SEQ ID NO: 1507483 - RNA, 16 nt, Homo sapiens
uaacaacaaugguuua

SEQ ID NO: 1507484 - RNA, 13 nt, Homo sapiens
uaacacaucuuua

SEQ ID NO: 1507485 - RNA, 14 nt, Homo sapiens
uaacacuauccaau

SEQ ID NO: 1507486 - RNA, 16 nt, Homo sapiens
uaacagacuuguuuaa

SEQ ID NO: 1507487 - RNA, 22 nt, Homo sapiens
uaacaugaaaaacacggcagcu

SEQ ID NO: 1507488 - RNA, 23 nt, Homo sapiens
uaacauuuggaguguguauucaa

SEQ ID NO: 1507489 - RNA, 19 nt, Homo sapiens
uaaccagacacauacucau

SEQ ID NO: 1507490 - RNA, 23 nt, Homo sapiens
uaaccauaguuauuuacuugaaa

SEQ ID NO: 1507491 - RNA, 19 nt, Homo sapiens
uaaccgaacuggugcuuua

SEQ ID NO: 1507492 - RNA, 20 nt, Homo sapiens
uaacuaucaacuagcagaaa

SEQ ID NO: 1507493 - RNA, 15 nt, Homo sapiens
uaacucagacauucc

SEQ ID NO: 1507494 - RNA, 16 nt, Homo sapiens
uaacucagacauucca

SEQ ID NO: 1507495 - RNA, 17 nt, Homo sapiens
uaacucagacauuccaa

SEQ ID NO: 1507496 - RNA, 21 nt, Homo sapiens
uaacucgaggagcucaggguu

SEQ ID NO: 1507497 - RNA, 19 nt, Homo sapiens
uaacugauuaccugccaau

SEQ ID NO: 1507498 - RNA, 21 nt, Homo sapiens
uaacugauuaccugccaauug

SEQ ID NO: 1507499 - RNA, 19 nt, Homo sapiens
uaacugguagcuauaacuu

SEQ ID NO: 1507500 - RNA, 22 nt, Homo sapiens
uaacugugaaauaccacaagcc

SEQ ID NO: 1507501 - RNA, 13 nt, Homo sapiens
uaagaaucauugu

SEQ ID NO: 1507502 - RNA, 18 nt, Homo sapiens
uaagaccauaacagccaa

SEQ ID NO: 1507503 - RNA, 19 nt, Homo sapiens
uaagaccugaucuauagau

SEQ ID NO: 1507504 - RNA, 12 nt, Homo sapiens
uaagagcuuuau

SEQ ID NO: 1507505 - RNA, 16 nt, Homo sapiens
uaagaguucuugcccu

SEQ ID NO: 1507506 - RNA, 17 nt, Homo sapiens
uaagcaaaggaaaccaa

SEQ ID NO: 1507507 - RNA, 19 nt, Homo sapiens
uaagcaccauaaccaagaa

SEQ ID NO: 1507508 - RNA, 18 nt, Homo sapiens
uaagguaaaaugccauga

SEQ ID NO: 1507509 - RNA, 15 nt, Homo sapiens
uaaggugugcaauuu

SEQ ID NO: 1507510 - RNA, 14 nt, Homo sapiens
uaaguaaaccaaaa

SEQ ID NO: 1507511 - RNA, 15 nt, Homo sapiens
uaaguaaaccaaaaa

SEQ ID NO: 1507512 - RNA, 20 nt, Homo sapiens
uaaguaccccugauaagcaa

SEQ ID NO: 1507513 - RNA, 23 nt, Homo sapiens
uaaguaccccugauaagcaaauu

SEQ ID NO: 1507514 - RNA, 20 nt, Homo sapiens
uaagucaagaucaacauucc

SEQ ID NO: 1507515 - RNA, 22 nt, Homo sapiens
uaagucccuuuuuguauguguu

SEQ ID NO: 1507516 - RNA, 17 nt, Homo sapiens
uaauaaaggucacauaa

SEQ ID NO: 1507517 - RNA, 15 nt, Homo sapiens
uaauaauaugugaug

SEQ ID NO: 1507518 - RNA, 16 nt, Homo sapiens
uaauagccauaugcaa

SEQ ID NO: 1507519 - RNA, 18 nt, Homo sapiens
uaauauuucaagugccua

SEQ ID NO: 1507520 - RNA, 19 nt, Homo sapiens
uaauauuucaagugccuag

SEQ ID NO: 1507521 - RNA, 21 nt, Homo sapiens
uaaucagacaaaguaauuccu

SEQ ID NO: 1507522 - RNA, 18 nt, Homo sapiens
uaaucaguuuuauccaca

SEQ ID NO: 1507523 - RNA, 22 nt, Homo sapiens
uaaucaguuuuauccacagaaa

SEQ ID NO: 1507524 - RNA, 19 nt, Homo sapiens
uaaucccacccaccucacc

SEQ ID NO: 1507525 - RNA, 15 nt, Homo sapiens
uaaucccagcacuuu

SEQ ID NO: 1507526 - RNA, 17 nt, Homo sapiens
uaaucgagucuaccucu

SEQ ID NO: 1507527 - RNA, 18 nt, Homo sapiens
uaaucgagucuaccucuu

SEQ ID NO: 1507528 - RNA, 18 nt, Homo sapiens
uaaucucucuagguccau

SEQ ID NO: 1507529 - RNA, 18 nt, Homo sapiens
uaaugaacagaacauaga

SEQ ID NO: 1507530 - RNA, 19 nt, Homo sapiens
uaaugaaggaguucacugu

SEQ ID NO: 1507531 - RNA, 23 nt, Homo sapiens
uaaugcuuagaauucugagaucc

SEQ ID NO: 1507532 - RNA, 16 nt, Homo sapiens
uaaugucagcacaugu

SEQ ID NO: 1507533 - RNA, 17 nt, Homo sapiens
uaaugucgaacucugaa

SEQ ID NO: 1507534 - RNA, 21 nt, Homo sapiens
uaaugucgaacucugaaacaa

SEQ ID NO: 1507535 - RNA, 18 nt, Homo sapiens
uaauuaacuaugugaugu

SEQ ID NO: 1507536 - RNA, 17 nt, Homo sapiens
uaauuaaguaaaccaaa

SEQ ID NO: 1507537 - RNA, 17 nt, Homo sapiens
uaauugcuuugccaaaa

SEQ ID NO: 1507538 - RNA, 18 nt, Homo sapiens
uaauuguacuaaagccaa

SEQ ID NO: 1507539 - RNA, 14 nt, Homo sapiens
uaauuuguaucuga

SEQ ID NO: 1507540 - RNA, 20 nt, Homo sapiens
uaauuuuuauaaauauguga

SEQ ID NO: 1507541 - RNA, 20 nt, Homo sapiens
uacaaaaauaguagaacaag

SEQ ID NO: 1507542 - RNA, 18 nt, Homo sapiens
uacaaccuuguugcuuua

SEQ ID NO: 1507543 - RNA, 17 nt, Homo sapiens
uacaacuuguauuucca

SEQ ID NO: 1507544 - RNA, 14 nt, Homo sapiens
uacaagcauuugcc

SEQ ID NO: 1507545 - RNA, 16 nt, Homo sapiens
uacaaggacaaugccu

SEQ ID NO: 1507546 - RNA, 22 nt, Homo sapiens
uacaauuauggaaauauaguuc

SEQ ID NO: 1507547 - RNA, 16 nt, Homo sapiens
uacacucaaacaauca

SEQ ID NO: 1507548 - RNA, 16 nt, Homo sapiens
uacacuuugaaguauu

SEQ ID NO: 1507549 - RNA, 19 nt, Homo sapiens
uacagaauggaaccaaaau

SEQ ID NO: 1507550 - RNA, 20 nt, Homo sapiens
uacagacgucucaagacuga

SEQ ID NO: 1507551 - RNA, 16 nt, Homo sapiens
uacagcaucauugcau

SEQ ID NO: 1507552 - RNA, 21 nt, Homo sapiens
uacagugaauuucugauuuca

SEQ ID NO: 1507553 - RNA, 11 nt, Homo sapiens
uacaucaaaaa

SEQ ID NO: 1507554 - RNA, 18 nt, Homo sapiens
uacauccagaaagaagga

SEQ ID NO: 1507555 - RNA, 16 nt, Homo sapiens
uacaucugugugguau

SEQ ID NO: 1507556 - RNA, 19 nt, Homo sapiens
uacaucuuauaaacugacu

SEQ ID NO: 1507557 - RNA, 16 nt, Homo sapiens
uacauggccacaaagg

SEQ ID NO: 1507558 - RNA, 19 nt, Homo sapiens
uacauucuccuuuuugccc

SEQ ID NO: 1507559 - RNA, 16 nt, Homo sapiens
uaccaaaaaaguauuu

SEQ ID NO: 1507560 - RNA, 15 nt, Homo sapiens
uaccaaaauguuaau

SEQ ID NO: 1507561 - RNA, 21 nt, Homo sapiens
uaccaagacuaagcaccauaa

SEQ ID NO: 1507562 - RNA, 18 nt, Homo sapiens
uaccacaagccugagaac

SEQ ID NO: 1507563 - RNA, 21 nt, Homo sapiens
uaccaccaagggaucugccau

SEQ ID NO: 1507564 - RNA, 15 nt, Homo sapiens
uaccacuaugcaaua

SEQ ID NO: 1507565 - RNA, 23 nt, Homo sapiens
uaccagagccuucaagugccaaa

SEQ ID NO: 1507566 - RNA, 23 nt, Homo sapiens
uaccagcagugugucaggugcug

SEQ ID NO: 1507567 - RNA, 16 nt, Homo sapiens
uacccaaauauguuua

SEQ ID NO: 1507568 - RNA, 18 nt, Homo sapiens
uacccugcgauuuugccu

SEQ ID NO: 1507569 - RNA, 13 nt, Homo sapiens
uaccucagccuag

SEQ ID NO: 1507570 - RNA, 21 nt, Homo sapiens
uaccucugagaagacacaagg

SEQ ID NO: 1507571 - RNA, 17 nt, Homo sapiens
uaccugcgauguuuacg

SEQ ID NO: 1507572 - RNA, 18 nt, Homo sapiens
uaccuuuauagcucucau

SEQ ID NO: 1507573 - RNA, 15 nt, Homo sapiens
uacgguggucuuuga

SEQ ID NO: 1507574 - RNA, 13 nt, Homo sapiens
uacuaaagccaaa

SEQ ID NO: 1507575 - RNA, 13 nt, Homo sapiens
uacuaaugugccc

SEQ ID NO: 1507576 - RNA, 13 nt, Homo sapiens
uacucaaguacca

SEQ ID NO: 1507577 - RNA, 23 nt, Homo sapiens
uacucagauaagguaaaaugcca

SEQ ID NO: 1507578 - RNA, 13 nt, Homo sapiens
uacucagcaguaa

SEQ ID NO: 1507579 - RNA, 21 nt, Homo sapiens
uacuccagcagguaggggcac

SEQ ID NO: 1507580 - RNA, 13 nt, Homo sapiens
uacucuagugaau

SEQ ID NO: 1507581 - RNA, 12 nt, Homo sapiens
uacucucuugcc

SEQ ID NO: 1507582 - RNA, 22 nt, Homo sapiens
uacugcaauaaauuauggcucu

SEQ ID NO: 1507583 - RNA, 13 nt, Homo sapiens
uacuguacuuaau

SEQ ID NO: 1507584 - RNA, 12 nt, Homo sapiens
uacuuccaugau

SEQ ID NO: 1507585 - RNA, 16 nt, Homo sapiens
uacuuccaugauacuu

SEQ ID NO: 1507586 - RNA, 17 nt, Homo sapiens
uacuuccaugauacuuu

SEQ ID NO: 1507587 - RNA, 17 nt, Homo sapiens
uacuugccacacacugu

SEQ ID NO: 1507588 - RNA, 22 nt, Homo sapiens
uacuuugcaauccaaauaaaga

SEQ ID NO: 1507589 - RNA, 17 nt, Homo sapiens
uagaaauuuuguuaaca

SEQ ID NO: 1507590 - RNA, 17 nt, Homo sapiens
uagaacaaugcuauaau

SEQ ID NO: 1507591 - RNA, 11 nt, Homo sapiens
uagaaccacaa

SEQ ID NO: 1507592 - RNA, 16 nt, Homo sapiens
uagaauagugcauugu

SEQ ID NO: 1507593 - RNA, 15 nt, Homo sapiens
uagaauucugagauc

SEQ ID NO: 1507594 - RNA, 16 nt, Homo sapiens
uagacacugggagaag

SEQ ID NO: 1507595 - RNA, 14 nt, Homo sapiens
uagacucaucuuuu

SEQ ID NO: 1507596 - RNA, 18 nt, Homo sapiens
uagagauaugcagaagga

SEQ ID NO: 1507597 - RNA, 16 nt, Homo sapiens
uagaguucacuguugu

SEQ ID NO: 1507598 - RNA, 20 nt, Homo sapiens
uagauaaugaaugauaagca

SEQ ID NO: 1507599 - RNA, 22 nt, Homo sapiens
uagauccauuuggacaaaaugg

SEQ ID NO: 1507600 - RNA, 14 nt, Homo sapiens
uagaucuaguucuc

SEQ ID NO: 1507601 - RNA, 15 nt, Homo sapiens
uagaugucauuacaa

SEQ ID NO: 1507602 - RNA, 18 nt, Homo sapiens
uagauguuacugugugaa

SEQ ID NO: 1507603 - RNA, 18 nt, Homo sapiens
uagauugaaaccauucca

SEQ ID NO: 1507604 - RNA, 20 nt, Homo sapiens
uagcaaccuucugcauucau

SEQ ID NO: 1507605 - RNA, 13 nt, Homo sapiens
uagcaacuacagu

SEQ ID NO: 1507606 - RNA, 23 nt, Homo sapiens
uagcagaaaccaagucuacuuca

SEQ ID NO: 1507607 - RNA, 21 nt, Homo sapiens
uagccaccgguaauaagccaa

SEQ ID NO: 1507608 - RNA, 12 nt, Homo sapiens
uagccauaugca

SEQ ID NO: 1507609 - RNA, 15 nt, Homo sapiens
uagcuaaacauugug

SEQ ID NO: 1507610 - RNA, 12 nt, Homo sapiens
uagcucuuucag

SEQ ID NO: 1507611 - RNA, 23 nt, Homo sapiens
uagcugaagaaguuauucucaag

SEQ ID NO: 1507612 - RNA, 21 nt, Homo sapiens
uagcuuuccuggucccucacc

SEQ ID NO: 1507613 - RNA, 20 nt, Homo sapiens
uaggaaaauuagaagcaagc

SEQ ID NO: 1507614 - RNA, 20 nt, Homo sapiens
uaggauuuggggugaaugaa

SEQ ID NO: 1507615 - RNA, 16 nt, Homo sapiens
uaggcaguagacucau

SEQ ID NO: 1507616 - RNA, 19 nt, Homo sapiens
uaggcaugccugggaaucc

SEQ ID NO: 1507617 - RNA, 13 nt, Homo sapiens
uaggcuguggggu

SEQ ID NO: 1507618 - RNA, 12 nt, Homo sapiens
uaggcuuaucaa

SEQ ID NO: 1507619 - RNA, 14 nt, Homo sapiens
uaggggcaaggaaa

SEQ ID NO: 1507620 - RNA, 17 nt, Homo sapiens
uaggggcaaggaaacuc

SEQ ID NO: 1507621 - RNA, 22 nt, Homo sapiens
uagggguuaacuuggucagagc

SEQ ID NO: 1507622 - RNA, 23 nt, Homo sapiens
uaggucacuugaagccaaacugu

SEQ ID NO: 1507623 - RNA, 20 nt, Homo sapiens
uaggucauuacuaaccauag

SEQ ID NO: 1507624 - RNA, 20 nt, Homo sapiens
uaguaaaugguaucauuugg

SEQ ID NO: 1507625 - RNA, 20 nt, Homo sapiens
uaguaaucccccuugccaaa

SEQ ID NO: 1507626 - RNA, 21 nt, Homo sapiens
uaguaaucccccuugccaaau

SEQ ID NO: 1507627 - RNA, 20 nt, Homo sapiens
uaguaauuguaaguaccccu

SEQ ID NO: 1507628 - RNA, 23 nt, Homo sapiens
uaguaauuuauugucugucuaca

SEQ ID NO: 1507629 - RNA, 18 nt, Homo sapiens
uagucccagcuacucaga

SEQ ID NO: 1507630 - RNA, 17 nt, Homo sapiens
uagugcacacuuguaua

SEQ ID NO: 1507631 - RNA, 16 nt, Homo sapiens
uagugcagaaucucau

SEQ ID NO: 1507632 - RNA, 18 nt, Homo sapiens
uaguguguguguguauau

SEQ ID NO: 1507633 - RNA, 21 nt, Homo sapiens
uaguucagaggaagcacauaa

SEQ ID NO: 1507634 - RNA, 19 nt, Homo sapiens
uaguucuuacuacuugcca

SEQ ID NO: 1507635 - RNA, 15 nt, Homo sapiens
uaguugaacaucuca

SEQ ID NO: 1507636 - RNA, 20 nt, Homo sapiens
uauaaauucauaacugguag

SEQ ID NO: 1507637 - RNA, 16 nt, Homo sapiens
uauaacuucugaagua

SEQ ID NO: 1507638 - RNA, 18 nt, Homo sapiens
uauaagaugucauccccu

SEQ ID NO: 1507639 - RNA, 21 nt, Homo sapiens
uauaagcaagaaggcaaaaau

SEQ ID NO: 1507640 - RNA, 14 nt, Homo sapiens
uauaauauaccaau

SEQ ID NO: 1507641 - RNA, 16 nt, Homo sapiens
uauaauucuacaggau

SEQ ID NO: 1507642 - RNA, 18 nt, Homo sapiens
uauacauaugacauauau

SEQ ID NO: 1507643 - RNA, 18 nt, Homo sapiens
uauacauuugauguauug

SEQ ID NO: 1507644 - RNA, 19 nt, Homo sapiens
uauacauuuuacauaugga

SEQ ID NO: 1507645 - RNA, 14 nt, Homo sapiens
uauacuacaugaga

SEQ ID NO: 1507646 - RNA, 18 nt, Homo sapiens
uauagcguggguuaucag

SEQ ID NO: 1507647 - RNA, 14 nt, Homo sapiens
uauaguagcauuuc

SEQ ID NO: 1507648 - RNA, 13 nt, Homo sapiens
uauauacuacaug

SEQ ID NO: 1507649 - RNA, 20 nt, Homo sapiens
uauauguaguacuaacuaag

SEQ ID NO: 1507650 - RNA, 19 nt, Homo sapiens
uauaugucuaauucuaugu

SEQ ID NO: 1507651 - RNA, 11 nt, Homo sapiens
uauauguuaau

SEQ ID NO: 1507652 - RNA, 14 nt, Homo sapiens
uauauuaccucaaa

SEQ ID NO: 1507653 - RNA, 13 nt, Homo sapiens
uauauugcaaaaa

SEQ ID NO: 1507654 - RNA, 20 nt, Homo sapiens
uauauuuugugcuaucagac

SEQ ID NO: 1507655 - RNA, 20 nt, Homo sapiens
aaagacaaaacuuccuguuu

SEQ ID NO: 1507656 - RNA, 12 nt, Homo sapiens
aaagacauggaa

SEQ ID NO: 1507657 - RNA, 12 nt, Homo sapiens
aaagacuauuaa

SEQ ID NO: 1507658 - RNA, 23 nt, Homo sapiens
aaagaggagagaggaagcucucu

SEQ ID NO: 1507659 - RNA, 22 nt, Homo sapiens
aaagauuguuuuauauguagua

SEQ ID NO: 1507660 - RNA, 23 nt, Homo sapiens
aaagauuuaacaaauacauucau

SEQ ID NO: 1507661 - RNA, 19 nt, Homo sapiens
aaagcaaaaggcugagaag

SEQ ID NO: 1507662 - RNA, 20 nt, Homo sapiens
aaagcagaugagcuguggac

SEQ ID NO: 1507663 - RNA, 13 nt, Homo sapiens
aaagcaugucuca

SEQ ID NO: 1507664 - RNA, 14 nt, Homo sapiens
aaagccucuggaaa

SEQ ID NO: 1507665 - RNA, 22 nt, Homo sapiens
aaagccucuggaaaacucagga

SEQ ID NO: 1507666 - RNA, 21 nt, Homo sapiens
aaagccuuuuuuuaggccaca

SEQ ID NO: 1507667 - RNA, 23 nt, Homo sapiens
aaagcuaggaugguucugugacc

SEQ ID NO: 1507668 - RNA, 15 nt, Homo sapiens
aaagcugcugucacu

SEQ ID NO: 1507669 - RNA, 15 nt, Homo sapiens
aaagcuuaggcugcu

SEQ ID NO: 1507670 - RNA, 21 nt, Homo sapiens
aaagcuuauucuuuguccaug

SEQ ID NO: 1507671 - RNA, 14 nt, Homo sapiens
aaaggaaaccaaag

SEQ ID NO: 1507672 - RNA, 15 nt, Homo sapiens
aaaggaugggaccaa

SEQ ID NO: 1507673 - RNA, 15 nt, Homo sapiens
aaaggcucagucuca

SEQ ID NO: 1507674 - RNA, 18 nt, Homo sapiens
aaaggugguguuucugua

SEQ ID NO: 1507675 - RNA, 18 nt, Homo sapiens
aaagguuaaaacaaaaac

SEQ ID NO: 1507676 - RNA, 16 nt, Homo sapiens
aaagguucacucucaa

SEQ ID NO: 1507677 - RNA, 19 nt, Homo sapiens
aaagguuucaagacuugau

SEQ ID NO: 1507678 - RNA, 21 nt, Homo sapiens
aaaguaaaaguuauaucuaac

SEQ ID NO: 1507679 - RNA, 13 nt, Homo sapiens
aaaguacauguau

SEQ ID NO: 1507680 - RNA, 14 nt, Homo sapiens
aaagugacauuugu

SEQ ID NO: 1507681 - RNA, 24 nt, Homo sapiens
aaaguuuuugucacuaucuucaca

SEQ ID NO: 1507682 - RNA, 19 nt, Homo sapiens
aaauaaauaugaauggagu

SEQ ID NO: 1507683 - RNA, 15 nt, Homo sapiens
aaauaagaaugauuu

SEQ ID NO: 1507684 - RNA, 13 nt, Homo sapiens
aaauaauugccaa

SEQ ID NO: 1507685 - RNA, 23 nt, Homo sapiens
aaauacacagaugauaauaugcu

SEQ ID NO: 1507686 - RNA, 14 nt, Homo sapiens
aaauagcauucucu

SEQ ID NO: 1507687 - RNA, 17 nt, Homo sapiens
aaauaucgauaucacca

SEQ ID NO: 1507688 - RNA, 20 nt, Homo sapiens
aaauauggaacuucuaauau

SEQ ID NO: 1507689 - RNA, 22 nt, Homo sapiens
aaauaugugcuugaaaugagaa

SEQ ID NO: 1507690 - RNA, 16 nt, Homo sapiens
aaaucagaagcacaaa

SEQ ID NO: 1507691 - RNA, 12 nt, Homo sapiens
aaaucagacucu

SEQ ID NO: 1507692 - RNA, 15 nt, Homo sapiens
aaauccaguuuccca

SEQ ID NO: 1507693 - RNA, 18 nt, Homo sapiens
aagguauuagcaaagcaa

SEQ ID NO: 1507694 - RNA, 19 nt, Homo sapiens
aaggucaauuucaguguau

SEQ ID NO: 1507695 - RNA, 12 nt, Homo sapiens
aagguccaggca

SEQ ID NO: 1507696 - RNA, 17 nt, Homo sapiens
aaggugaauagcacagg

SEQ ID NO: 1507697 - RNA, 15 nt, Homo sapiens
aagguucacucucaa

SEQ ID NO: 1507698 - RNA, 22 nt, Homo sapiens
aagguugcugaggcucugaccc

SEQ ID NO: 1507699 - RNA, 15 nt, Homo sapiens
aaguaaaccaaaaag

SEQ ID NO: 1507700 - RNA, 13 nt, Homo sapiens
aaguaacacucac

SEQ ID NO: 1507701 - RNA, 22 nt, Homo sapiens
aaguaauuccucucacuaaacu

SEQ ID NO: 1507702 - RNA, 18 nt, Homo sapiens
aaguauguaaacaggaga

SEQ ID NO: 1507703 - RNA, 14 nt, Homo sapiens
aagucaacacucuu

SEQ ID NO: 1507704 - RNA, 13 nt, Homo sapiens
aagucaccaaaau

SEQ ID NO: 1507705 - RNA, 13 nt, Homo sapiens
aagucacuuuuau

SEQ ID NO: 1507706 - RNA, 20 nt, Homo sapiens
aagucccugacucucuguga

SEQ ID NO: 1507707 - RNA, 20 nt, Homo sapiens
aagucuccagucaccuacaa

SEQ ID NO: 1507708 - RNA, 11 nt, Homo sapiens
aagugccaaac

SEQ ID NO: 1507709 - RNA, 20 nt, Homo sapiens
aagugcugggauuacaggca

SEQ ID NO: 1507710 - RNA, 16 nt, Homo sapiens
aaguggggcucuggga

SEQ ID NO: 1507711 - RNA, 19 nt, Homo sapiens
aaguuaauuuugaccaaaa

SEQ ID NO: 1507712 - RNA, 19 nt, Homo sapiens
aaguuagggaugacuguga

SEQ ID NO: 1507713 - RNA, 15 nt, Homo sapiens
aaguuccucuagugc

SEQ ID NO: 1507714 - RNA, 22 nt, Homo sapiens
aaguucuucuccaauccuauca

SEQ ID NO: 1507715 - RNA, 22 nt, Homo sapiens
aaguuuagaugcuuugugacuu

SEQ ID NO: 1507716 - RNA, 12 nt, Homo sapiens
aaguuugaacuu

SEQ ID NO: 1507717 - RNA, 13 nt, Homo sapiens
aaguuuucaggac

SEQ ID NO: 1507718 - RNA, 13 nt, Homo sapiens
aauaaaaguugau

SEQ ID NO: 1507719 - RNA, 22 nt, Homo sapiens
aauaaaaguugaucauaauuaa

SEQ ID NO: 1507720 - RNA, 12 nt, Homo sapiens
aauaaaggucac

SEQ ID NO: 1507721 - RNA, 17 nt, Homo sapiens
aauaaaguacuacauca

SEQ ID NO: 1507722 - RNA, 13 nt, Homo sapiens
aauaaauguugcu

SEQ ID NO: 1507723 - RNA, 17 nt, Homo sapiens
aauaagacuaucgucuu

SEQ ID NO: 1507724 - RNA, 15 nt, Homo sapiens
aauaaugaaugucau

SEQ ID NO: 1507725 - RNA, 13 nt, Homo sapiens
aauaauguauaca

SEQ ID NO: 1507726 - RNA, 17 nt, Homo sapiens
aauacaaugauccugua

SEQ ID NO: 1507727 - RNA, 15 nt, Homo sapiens
aauacauaagaccau

SEQ ID NO: 1507728 - RNA, 22 nt, Homo sapiens
aauacuuucugcauaguggccu

SEQ ID NO: 1507729 - RNA, 22 nt, Homo sapiens
aauagauaaauuuugacuugaa

SEQ ID NO: 1507730 - RNA, 14 nt, Homo sapiens
aauagccauaugca

SEQ ID NO: 1507731 - RNA, 21 nt, Homo sapiens
aauagccuaauacaacaugua

SEQ ID NO: 1507732 - RNA, 18 nt, Homo sapiens
aauagcgaaucaucucaa

SEQ ID NO: 1507733 - RNA, 16 nt, Homo sapiens
aauaggugcaaaaaua

SEQ ID NO: 1507734 - RNA, 23 nt, Homo sapiens
aauaguaaaagauaacaagaucu

SEQ ID NO: 1507735 - RNA, 22 nt, Homo sapiens
aauauaugauuguauaauguga

SEQ ID NO: 1507736 - RNA, 16 nt, Homo sapiens
aauauauuucuugcua

SEQ ID NO: 1507737 - RNA, 17 nt, Homo sapiens
aauauccuaaacaucau

SEQ ID NO: 1507738 - RNA, 14 nt, Homo sapiens
aauaugaauugaca

SEQ ID NO: 1507739 - RNA, 15 nt, Homo sapiens
aauauggacuuaaau

SEQ ID NO: 1507740 - RNA, 19 nt, Homo sapiens
aauaugggcucaagucacu

SEQ ID NO: 1507741 - RNA, 19 nt, Homo sapiens
aauaugucugccacagaga

SEQ ID NO: 1507742 - RNA, 20 nt, Homo sapiens
aauaugucugccacagagag

SEQ ID NO: 1507743 - RNA, 12 nt, Homo sapiens
aauaugugaaaa

SEQ ID NO: 1507744 - RNA, 11 nt, Homo sapiens
aauauucaaua

SEQ ID NO: 1507745 - RNA, 18 nt, Homo sapiens
aauauuuaggcaagagaa

SEQ ID NO: 1507746 - RNA, 18 nt, Homo sapiens
aauauuuauauauuugaa

SEQ ID NO: 1507747 - RNA, 18 nt, Homo sapiens
aauauuuuagaaccacaa

SEQ ID NO: 1507748 - RNA, 12 nt, Homo sapiens
aaucacuaaccc

SEQ ID NO: 1507749 - RNA, 18 nt, Homo sapiens
aaucacuauugcuuccua

SEQ ID NO: 1507750 - RNA, 15 nt, Homo sapiens
aaucagaagcacaaa

SEQ ID NO: 1507751 - RNA, 20 nt, Homo sapiens
aaucaggggcaaacggagua

SEQ ID NO: 1507752 - RNA, 14 nt, Homo sapiens
aaucauggcauuca

SEQ ID NO: 1507753 - RNA, 22 nt, Homo sapiens
aauccucaacaacaaaccaaaa

SEQ ID NO: 1507754 - RNA, 22 nt, Homo sapiens
aauccucagguaguacugggaa

SEQ ID NO: 1507755 - RNA, 12 nt, Homo sapiens
aauccugaagaa

SEQ ID NO: 1507756 - RNA, 19 nt, Homo sapiens
aaucggcuggggacugcua

SEQ ID NO: 1507757 - RNA, 22 nt, Homo sapiens
aaucggcuggggacugcuaccu

SEQ ID NO: 1507758 - RNA, 23 nt, Homo sapiens
aaucucgguagaugucauuacaa

SEQ ID NO: 1507759 - RNA, 23 nt, Homo sapiens
aaucucucuagguccauuuuccu

SEQ ID NO: 1507760 - RNA, 16 nt, Homo sapiens
aaucuuccugccucag

SEQ ID NO: 1507761 - RNA, 17 nt, Homo sapiens
aaucuuucagcacucag

SEQ ID NO: 1507762 - RNA, 13 nt, Homo sapiens
aaugaagacuguu

SEQ ID NO: 1507763 - RNA, 20 nt, Homo sapiens
aaugaaggaaaaccucacuu

SEQ ID NO: 1507764 - RNA, 23 nt, Homo sapiens
aaugccugacuagggagccaugu

SEQ ID NO: 1507765 - RNA, 13 nt, Homo sapiens
aaugcuucaauca

SEQ ID NO: 1507766 - RNA, 17 nt, Homo sapiens
aauggaaauguaauaau

SEQ ID NO: 1507767 - RNA, 19 nt, Homo sapiens
aauggacuauacauacuau

SEQ ID NO: 1507768 - RNA, 14 nt, Homo sapiens
aaugguucuggaua

SEQ ID NO: 1507769 - RNA, 15 nt, Homo sapiens
aauguauaugucauu

SEQ ID NO: 1507770 - RNA, 17 nt, Homo sapiens
aauguauaugucauuua

SEQ ID NO: 1507771 - RNA, 16 nt, Homo sapiens
aaugucagcacauguu

SEQ ID NO: 1507772 - RNA, 19 nt, Homo sapiens
aaugucagcacauguugcu

SEQ ID NO: 1507773 - RNA, 13 nt, Homo sapiens
aaugucaguucau

SEQ ID NO: 1507774 - RNA, 20 nt, Homo sapiens
aaugucaucaaauauuacca

SEQ ID NO: 1507775 - RNA, 23 nt, Homo sapiens
aaugucugauuuaacacuaucca

SEQ ID NO: 1507776 - RNA, 15 nt, Homo sapiens
aaugucuguuuucca

SEQ ID NO: 1507777 - RNA, 16 nt, Homo sapiens
aauguuuauguucuca

SEQ ID NO: 1507778 - RNA, 18 nt, Homo sapiens
aauguuugaguaccugau

SEQ ID NO: 1507779 - RNA, 13 nt, Homo sapiens
aauuaaaaaccac

SEQ ID NO: 1507780 - RNA, 19 nt, Homo sapiens
aauuauaagaggauaugaa

SEQ ID NO: 1507781 - RNA, 21 nt, Homo sapiens
aauuauacaucacagcagugc

SEQ ID NO: 1507782 - RNA, 18 nt, Homo sapiens
aauuauuaugucucaaaa

SEQ ID NO: 1507783 - RNA, 21 nt, Homo sapiens
aauuauuaugucucaaaauaa

SEQ ID NO: 1507784 - RNA, 19 nt, Homo sapiens
aauuauuccuugcuuucau

SEQ ID NO: 1507785 - RNA, 16 nt, Homo sapiens
aauucaaugucuuaaa

SEQ ID NO: 1507786 - RNA, 21 nt, Homo sapiens
aauuccuaauaaguuugauca

SEQ ID NO: 1507787 - RNA, 22 nt, Homo sapiens
aauuccuaauaaguuugaucaa

SEQ ID NO: 1507788 - RNA, 15 nt, Homo sapiens
aauuccuuuuugcag

SEQ ID NO: 1507789 - RNA, 16 nt, Homo sapiens
aauucuagcauuuuau

SEQ ID NO: 1507790 - RNA, 19 nt, Homo sapiens
aauucuccugccucagccu

SEQ ID NO: 1507791 - RNA, 21 nt, Homo sapiens
aauucuccugccucagccucc

SEQ ID NO: 1507792 - RNA, 18 nt, Homo sapiens
aauucuuuuucacacuga

SEQ ID NO: 1507793 - RNA, 20 nt, Homo sapiens
aauugaacauacucuaguga

SEQ ID NO: 1507794 - RNA, 14 nt, Homo sapiens
acacaaauucuaaa

SEQ ID NO: 1507795 - RNA, 13 nt, Homo sapiens
acacacagucuca

SEQ ID NO: 1507796 - RNA, 22 nt, Homo sapiens
acacaggggcaaagaacugccc

SEQ ID NO: 1507797 - RNA, 14 nt, Homo sapiens
acacagucucaguc

SEQ ID NO: 1507798 - RNA, 19 nt, Homo sapiens
acacaguguuccagcugcc

SEQ ID NO: 1507799 - RNA, 15 nt, Homo sapiens
acacauacauugcca

SEQ ID NO: 1507800 - RNA, 21 nt, Homo sapiens
acacauuagauguuacugugu

SEQ ID NO: 1507801 - RNA, 23 nt, Homo sapiens
acacccaagaagaaaugcuuucc

SEQ ID NO: 1507802 - RNA, 22 nt, Homo sapiens
acacccauagugcacacuugua

SEQ ID NO: 1507803 - RNA, 17 nt, Homo sapiens
acaccugacaaauggaa

SEQ ID NO: 1507804 - RNA, 23 nt, Homo sapiens
acacuaguucagaggaagcacau

SEQ ID NO: 1507805 - RNA, 21 nt, Homo sapiens
acacuaucaccuauuacauuu

SEQ ID NO: 1507806 - RNA, 15 nt, Homo sapiens
acacucaucccuggu

SEQ ID NO: 1507807 - RNA, 23 nt, Homo sapiens
acagacaccaucuuuugugagau

SEQ ID NO: 1507808 - RNA, 14 nt, Homo sapiens
acagacaugagcca

SEQ ID NO: 1507809 - RNA, 19 nt, Homo sapiens
acagacgucucaagacuga

SEQ ID NO: 1507810 - RNA, 12 nt, Homo sapiens
acagacugugag

SEQ ID NO: 1507811 - RNA, 13 nt, Homo sapiens
acagacugugagu

SEQ ID NO: 1507812 - RNA, 15 nt, Homo sapiens
acagagaugcaugcg

SEQ ID NO: 1507813 - RNA, 20 nt, Homo sapiens
acagagcgagauuccgucuu

SEQ ID NO: 1507814 - RNA, 19 nt, Homo sapiens
acagagcuggcugucuucc

SEQ ID NO: 1507815 - RNA, 21 nt, Homo sapiens
acagauagacagugcugcccu

SEQ ID NO: 1507816 - RNA, 16 nt, Homo sapiens
acagaucaaaugugaa

SEQ ID NO: 1507817 - RNA, 15 nt, Homo sapiens
acagauguaaaugcc

SEQ ID NO: 1507818 - RNA, 18 nt, Homo sapiens
acagcacuuggcuccuua

SEQ ID NO: 1507819 - RNA, 20 nt, Homo sapiens
acagcagggucuugcuguaa

SEQ ID NO: 1507820 - RNA, 15 nt, Homo sapiens
acagcaucauugcau

SEQ ID NO: 1507821 - RNA, 19 nt, Homo sapiens
acagccaguaagugauaaa

SEQ ID NO: 1507822 - RNA, 18 nt, Homo sapiens
acagcccauaaagcaaga

SEQ ID NO: 1507823 - RNA, 22 nt, Homo sapiens
acagcccgggugugccugcccu

SEQ ID NO: 1507824 - RNA, 18 nt, Homo sapiens
acagcuaugcacuguaaa

SEQ ID NO: 1507825 - RNA, 17 nt, Homo sapiens
acagcuuaacauuuaca

SEQ ID NO: 1507826 - RNA, 15 nt, Homo sapiens
acaggaaaccacuua

SEQ ID NO: 1507827 - RNA, 14 nt, Homo sapiens
acaggaggggccca

SEQ ID NO: 1507828 - RNA, 22 nt, Homo sapiens
acaggcugagcuuucuagccua

SEQ ID NO: 1507829 - RNA, 20 nt, Homo sapiens
acaguauguuacaugcauuc

SEQ ID NO: 1507830 - RNA, 19 nt, Homo sapiens
acaguccuaccucaguuca

SEQ ID NO: 1507831 - RNA, 18 nt, Homo sapiens
acaguccucacagccucu

SEQ ID NO: 1507832 - RNA, 19 nt, Homo sapiens
acagucuggagaagguauu

SEQ ID NO: 1507833 - RNA, 14 nt, Homo sapiens
acagugacaaaagg

SEQ ID NO: 1507834 - RNA, 19 nt, Homo sapiens
acagugcccuuuucaucuc

SEQ ID NO: 1507835 - RNA, 16 nt, Homo sapiens
acaguuucuuccccaa

SEQ ID NO: 1507836 - RNA, 16 nt, Homo sapiens
acauaaacacauacau

SEQ ID NO: 1507837 - RNA, 16 nt, Homo sapiens
acauauaccuucucaa

SEQ ID NO: 1507838 - RNA, 14 nt, Homo sapiens
acauauggaaauau

SEQ ID NO: 1507839 - RNA, 22 nt, Homo sapiens
acauccaaccccccaccugcca

SEQ ID NO: 1507840 - RNA, 22 nt, Homo sapiens
acauccccaucccucuacuuuc

SEQ ID NO: 1507841 - RNA, 20 nt, Homo sapiens
acaucuucccagaguguccc

SEQ ID NO: 1507842 - RNA, 13 nt, Homo sapiens
acaugcaagucau

SEQ ID NO: 1507843 - RNA, 14 nt, Homo sapiens
acaugcuucagugc

SEQ ID NO: 1507844 - RNA, 16 nt, Homo sapiens
acaugcuucagugcug

SEQ ID NO: 1507845 - RNA, 17 nt, Homo sapiens
acaugucuguccucaga

SEQ ID NO: 1507846 - RNA, 13 nt, Homo sapiens
acaugugccugua

SEQ ID NO: 1507847 - RNA, 22 nt, Homo sapiens
acauguguucucuauuuugccu

SEQ ID NO: 1507848 - RNA, 14 nt, Homo sapiens
acauuaaaccugga

SEQ ID NO: 1507849 - RNA, 15 nt, Homo sapiens
acauuccacagugcc

SEQ ID NO: 1507850 - RNA, 17 nt, Homo sapiens
acauugcauugugacua

SEQ ID NO: 1507851 - RNA, 15 nt, Homo sapiens
acauugucaccauuu

SEQ ID NO: 1507852 - RNA, 21 nt, Homo sapiens
acauuucucuaacuccugcca

SEQ ID NO: 1507853 - RNA, 17 nt, Homo sapiens
acauuuuacugauuaac

SEQ ID NO: 1507854 - RNA, 22 nt, Homo sapiens
acauuuucuguguguacaugua

SEQ ID NO: 1507855 - RNA, 17 nt, Homo sapiens
acauuuuuuguuugcug

SEQ ID NO: 1507856 - RNA, 21 nt, Homo sapiens
accaaaauguauaaauguuau

SEQ ID NO: 1507857 - RNA, 19 nt, Homo sapiens
accaagggaucugccauug

SEQ ID NO: 1507858 - RNA, 22 nt, Homo sapiens
accaagucuacuucacuaauga

SEQ ID NO: 1507859 - RNA, 20 nt, Homo sapiens
accaaguucuggaaaccacg

SEQ ID NO: 1507860 - RNA, 20 nt, Homo sapiens
accacaaaaauugacucaaa

SEQ ID NO: 1507861 - RNA, 19 nt, Homo sapiens
accacagaugugucuggga

SEQ ID NO: 1507862 - RNA, 21 nt, Homo sapiens
accacucaggccaacaagcca

SEQ ID NO: 1507863 - RNA, 23 nt, Homo sapiens
accacucaggccaacaagccaac

SEQ ID NO: 1507864 - RNA, 16 nt, Homo sapiens
accacugcacuccagc

SEQ ID NO: 1507865 - RNA, 14 nt, Homo sapiens
accacuuaucacau

SEQ ID NO: 1507866 - RNA, 14 nt, Homo sapiens
accagaaguccuau

SEQ ID NO: 1507867 - RNA, 15 nt, Homo sapiens
accagcauauugugu

SEQ ID NO: 1507868 - RNA, 16 nt, Homo sapiens
accaggacuauagccc

SEQ ID NO: 1507869 - RNA, 21 nt, Homo sapiens
accaggggugauuucagagag

SEQ ID NO: 1507870 - RNA, 20 nt, Homo sapiens
accauaaacuguacaaauga

SEQ ID NO: 1507871 - RNA, 14 nt, Homo sapiens
accauaacagccaa

SEQ ID NO: 1507872 - RNA, 12 nt, Homo sapiens
accccagaguug

SEQ ID NO: 1507873 - RNA, 21 nt, Homo sapiens
acccuaagccuccuuuugcuu

SEQ ID NO: 1507874 - RNA, 16 nt, Homo sapiens
acccugcgauuuugcc

SEQ ID NO: 1507875 - RNA, 23 nt, Homo sapiens
acccugguggaggcuucuugccc

SEQ ID NO: 1507876 - RNA, 20 nt, Homo sapiens
acccugucucuacuaaaaau

SEQ ID NO: 1507877 - RNA, 16 nt, Homo sapiens
accgauagcaggugaa

SEQ ID NO: 1507878 - RNA, 16 nt, Homo sapiens
accgugaccagugcug

SEQ ID NO: 1507879 - RNA, 15 nt, Homo sapiens
accguugcacaaaaa

SEQ ID NO: 1507880 - RNA, 14 nt, Homo sapiens
accuaaaauuucaa

SEQ ID NO: 1507881 - RNA, 18 nt, Homo sapiens
accuaccaccuucccucu

SEQ ID NO: 1507882 - RNA, 22 nt, Homo sapiens
accuaccaccuucccucuuucu

SEQ ID NO: 1507883 - RNA, 22 nt, Homo sapiens
accuagagaagcagaauccuua

SEQ ID NO: 1507884 - RNA, 21 nt, Homo sapiens
accuaugucccuucucaugcc

SEQ ID NO: 1507885 - RNA, 21 nt, Homo sapiens
accucacgcucuggacaugau

SEQ ID NO: 1507886 - RNA, 19 nt, Homo sapiens
accucagggacaacauuuu

SEQ ID NO: 1507887 - RNA, 13 nt, Homo sapiens
accucccaaagug

SEQ ID NO: 1507888 - RNA, 24 nt, Homo sapiens
accuccccugguccugcacugucc

SEQ ID NO: 1507889 - RNA, 17 nt, Homo sapiens
accucccuauacugcuu

SEQ ID NO: 1507890 - RNA, 23 nt, Homo sapiens
accuccugaccugucaccgugag

SEQ ID NO: 1507891 - RNA, 18 nt, Homo sapiens
accucugagaagacacaa

SEQ ID NO: 1507892 - RNA, 19 nt, Homo sapiens
accugauacaauuugccca

SEQ ID NO: 1507893 - RNA, 16 nt, Homo sapiens
accuggagaugaugau

SEQ ID NO: 1507894 - RNA, 17 nt, Homo sapiens
accuggagaugaugaug

SEQ ID NO: 1507895 - RNA, 19 nt, Homo sapiens
accuggagccaucuuccua

SEQ ID NO: 1507896 - RNA, 22 nt, Homo sapiens
augcccucauaaaccaaugugg

SEQ ID NO: 1507897 - RNA, 18 nt, Homo sapiens
augccgguuaaauuccau

SEQ ID NO: 1507898 - RNA, 12 nt, Homo sapiens
augccugggaau

SEQ ID NO: 1507899 - RNA, 15 nt, Homo sapiens
augccuuaagccaau

SEQ ID NO: 1507900 - RNA, 22 nt, Homo sapiens
augcucagcccugacuggugcu

SEQ ID NO: 1507901 - RNA, 22 nt, Homo sapiens
augcuggaaaauaauacugcug

SEQ ID NO: 1507902 - RNA, 18 nt, Homo sapiens
augcuggggucauauaaa

SEQ ID NO: 1507903 - RNA, 14 nt, Homo sapiens
augcuuacaaaguc

SEQ ID NO: 1507904 - RNA, 20 nt, Homo sapiens
augcuuugugacuuaagcag

SEQ ID NO: 1507905 - RNA, 19 nt, Homo sapiens
auggaaggaguuccucuaa

SEQ ID NO: 1507906 - RNA, 20 nt, Homo sapiens
auggaagguuagagguuugu

SEQ ID NO: 1507907 - RNA, 21 nt, Homo sapiens
auggaagguuagguuugucaa

SEQ ID NO: 1507908 - RNA, 19 nt, Homo sapiens
auggaaugugauguucaug

SEQ ID NO: 1507909 - RNA, 11 nt, Homo sapiens
auggacaugcu

SEQ ID NO: 1507910 - RNA, 23 nt, Homo sapiens
auggacaugcuucagugcugcuc

SEQ ID NO: 1507911 - RNA, 17 nt, Homo sapiens
auggacucuucccccac

SEQ ID NO: 1507912 - RNA, 17 nt, Homo sapiens
auggagagguuugucaa

SEQ ID NO: 1507913 - RNA, 13 nt, Homo sapiens
auggaguuucccu

SEQ ID NO: 1507914 - RNA, 23 nt, Homo sapiens
auggauggggguuaccuagcccu

SEQ ID NO: 1507915 - RNA, 16 nt, Homo sapiens
auggcagaaugaaaau

SEQ ID NO: 1507916 - RNA, 18 nt, Homo sapiens
auggcaugagaaauacaa

SEQ ID NO: 1507917 - RNA, 21 nt, Homo sapiens
auggcgaacacagguguugga

SEQ ID NO: 1507918 - RNA, 23 nt, Homo sapiens
auggcucuguuaugcaagcacaa

SEQ ID NO: 1507919 - RNA, 15 nt, Homo sapiens
augggaaccagaaua

SEQ ID NO: 1507920 - RNA, 20 nt, Homo sapiens
augggaauucuuuacaauaa

SEQ ID NO: 1507921 - RNA, 16 nt, Homo sapiens
augggcccugcaagac

SEQ ID NO: 1507922 - RNA, 18 nt, Homo sapiens
augggcucaagucacuuu

SEQ ID NO: 1507923 - RNA, 23 nt, Homo sapiens
auggggauaaaggagaaggcaug

SEQ ID NO: 1507924 - RNA, 22 nt, Homo sapiens
auggggcgaucaaguccagagc

SEQ ID NO: 1507925 - RNA, 15 nt, Homo sapiens
auggguacuccagca

SEQ ID NO: 1507926 - RNA, 18 nt, Homo sapiens
augguaaaaccccaucuc

SEQ ID NO: 1507927 - RNA, 17 nt, Homo sapiens
augguccuccauuucaa

SEQ ID NO: 1507928 - RNA, 20 nt, Homo sapiens
augguccuggggcucugugc

SEQ ID NO: 1507929 - RNA, 21 nt, Homo sapiens
auggugagagauaagaucuau

SEQ ID NO: 1507930 - RNA, 14 nt, Homo sapiens
augguuuacaugaa

SEQ ID NO: 1507931 - RNA, 16 nt, Homo sapiens
augguuuuacagugaa

SEQ ID NO: 1507932 - RNA, 23 nt, Homo sapiens
augguuuuacagugaauuucuga

SEQ ID NO: 1507933 - RNA, 21 nt, Homo sapiens
auguaaaauaaguauuuccau

SEQ ID NO: 1507934 - RNA, 24 nt, Homo sapiens
auguaaggucuucuuguguccuga

SEQ ID NO: 1507935 - RNA, 22 nt, Homo sapiens
auguaauuuagcaguccaaaga

SEQ ID NO: 1507936 - RNA, 16 nt, Homo sapiens
auguacaaauuauaca

SEQ ID NO: 1507937 - RNA, 22 nt, Homo sapiens
auguagggguuaacuuggucag

SEQ ID NO: 1507938 - RNA, 21 nt, Homo sapiens
auguaguaguuugggugugua

SEQ ID NO: 1507939 - RNA, 16 nt, Homo sapiens
augucaaccagugagg

SEQ ID NO: 1507940 - RNA, 20 nt, Homo sapiens
augucauugaugaacugcca

SEQ ID NO: 1507941 - RNA, 15 nt, Homo sapiens
auguccaaguccaac

SEQ ID NO: 1507942 - RNA, 11 nt, Homo sapiens
augucuguccu

SEQ ID NO: 1507943 - RNA, 23 nt, Homo sapiens
augugauuuugagcaaaccacau

SEQ ID NO: 1507944 - RNA, 11 nt, Homo sapiens
augugccaagg

SEQ ID NO: 1507945 - RNA, 19 nt, Homo sapiens
augugucugggagagccug

SEQ ID NO: 1507946 - RNA, 18 nt, Homo sapiens
auguuacaugcauucuac

SEQ ID NO: 1507947 - RNA, 21 nt, Homo sapiens
auguucaugauagugugauuu

SEQ ID NO: 1507948 - RNA, 19 nt, Homo sapiens
auguuccucugucaaugaa

SEQ ID NO: 1507949 - RNA, 13 nt, Homo sapiens
auguucugugaua

SEQ ID NO: 1507950 - RNA, 23 nt, Homo sapiens
auguuggaugaugaaacauucau

SEQ ID NO: 1507951 - RNA, 13 nt, Homo sapiens
auguuggucaaaa

SEQ ID NO: 1507952 - RNA, 15 nt, Homo sapiens
auguuguuagcuuuu

SEQ ID NO: 1507953 - RNA, 18 nt, Homo sapiens
auguuuacagacugugag

SEQ ID NO: 1507954 - RNA, 20 nt, Homo sapiens
auguuucuaucuuguauguc

SEQ ID NO: 1507955 - RNA, 18 nt, Homo sapiens
auguuuucuaccagugug

SEQ ID NO: 1507956 - RNA, 19 nt, Homo sapiens
auuaaaugaaagaauaucu

SEQ ID NO: 1507957 - RNA, 15 nt, Homo sapiens
auuaacuaugugaug

SEQ ID NO: 1507958 - RNA, 23 nt, Homo sapiens
auuaaguggcuuuuuaacaugaa

SEQ ID NO: 1507959 - RNA, 17 nt, Homo sapiens
auuaauaaauuuuaaca

SEQ ID NO: 1507960 - RNA, 15 nt, Homo sapiens
auuacacaaguuuaa

SEQ ID NO: 1507961 - RNA, 16 nt, Homo sapiens
auuacauggcaguguu

SEQ ID NO: 1507962 - RNA, 21 nt, Homo sapiens
auuaccucaaauuccuaauaa

SEQ ID NO: 1507963 - RNA, 21 nt, Homo sapiens
auuaccugccaauugcuaccg

SEQ ID NO: 1507964 - RNA, 13 nt, Homo sapiens
auuagaaugcaug

SEQ ID NO: 1507965 - RNA, 15 nt, Homo sapiens
auuagaaugcaugua

SEQ ID NO: 1507966 - RNA, 13 nt, Homo sapiens
auuaggcaugccu

SEQ ID NO: 1507967 - RNA, 16 nt, Homo sapiens
auuauaagaugucauc

SEQ ID NO: 1507968 - RNA, 13 nt, Homo sapiens
auuauacauuuga

SEQ ID NO: 1507969 - RNA, 16 nt, Homo sapiens
auuauagccacauccc

SEQ ID NO: 1507970 - RNA, 20 nt, Homo sapiens
auuaucuuuaauaaaauguu

SEQ ID NO: 1507971 - RNA, 16 nt, Homo sapiens
auuauucucugaugca

SEQ ID NO: 1507972 - RNA, 23 nt, Homo sapiens
auuauugaggggacuaggcuaua

SEQ ID NO: 1507973 - RNA, 12 nt, Homo sapiens
auucaaaccaau

SEQ ID NO: 1507974 - RNA, 24 nt, Homo sapiens
auucaaugaucuuagaaguacuga

SEQ ID NO: 1507975 - RNA, 13 nt, Homo sapiens
auucacaccucac

SEQ ID NO: 1507976 - RNA, 16 nt, Homo sapiens
auucagaaagucauag

SEQ ID NO: 1507977 - RNA, 15 nt, Homo sapiens
auucaggguuauaca

SEQ ID NO: 1507978 - RNA, 18 nt, Homo sapiens
auucaggguuauacacag

SEQ ID NO: 1507979 - RNA, 19 nt, Homo sapiens
auucagguauuuguaauag

SEQ ID NO: 1507980 - RNA, 21 nt, Homo sapiens
auucauuuaucaccagcauau

SEQ ID NO: 1507981 - RNA, 18 nt, Homo sapiens
auucauuuauucauucau

SEQ ID NO: 1507982 - RNA, 16 nt, Homo sapiens
auuccagcauuugcca

SEQ ID NO: 1507983 - RNA, 22 nt, Homo sapiens
auuccauaaucaaucuaucaau

SEQ ID NO: 1507984 - RNA, 18 nt, Homo sapiens
auuccaugggauguuaag

SEQ ID NO: 1507985 - RNA, 18 nt, Homo sapiens
auuccauuuuacuuccau

SEQ ID NO: 1507986 - RNA, 13 nt, Homo sapiens
auucccaccaagg

SEQ ID NO: 1507987 - RNA, 15 nt, Homo sapiens
auuccuggcaugaca

SEQ ID NO: 1507988 - RNA, 20 nt, Homo sapiens
auuccugggcaagaaccuaa

SEQ ID NO: 1507989 - RNA, 16 nt, Homo sapiens
auucuauuccuaucug

SEQ ID NO: 1507990 - RNA, 17 nt, Homo sapiens
auucucugaugcacugu

SEQ ID NO: 1507991 - RNA, 14 nt, Homo sapiens
auucugagauccag

SEQ ID NO: 1507992 - RNA, 22 nt, Homo sapiens
auucugauacauuagcagcuau

SEQ ID NO: 1507993 - RNA, 17 nt, Homo sapiens
auucuggucuucacugc

SEQ ID NO: 1507994 - RNA, 23 nt, Homo sapiens
auucuguggugggaacauucgag

SEQ ID NO: 1507995 - RNA, 18 nt, Homo sapiens
auucuuuccaugccacga

SEQ ID NO: 1507996 - RNA, 22 nt, Homo sapiens
auugaaaccauuccaguaggaa

SEQ ID NO: 1507997 - RNA, 21 nt, Homo sapiens
auugaauguuuccaaccugga

SEQ ID NO: 1507998 - RNA, 15 nt, Homo sapiens
auugacgcauauuua

SEQ ID NO: 1507999 - RNA, 18 nt, Homo sapiens
auugacucuguggcuuug

SEQ ID NO: 1508000 - RNA, 17 nt, Homo sapiens
auugaugaacugccaaa

SEQ ID NO: 1508001 - RNA, 19 nt, Homo sapiens
auugcauugugacuaucca

SEQ ID NO: 1508002 - RNA, 13 nt, Homo sapiens
auugcuuugccaa

SEQ ID NO: 1508003 - RNA, 22 nt, Homo sapiens
auugggaagcugggggaagggu

SEQ ID NO: 1508004 - RNA, 22 nt, Homo sapiens
auugggacccuccagugcugga

SEQ ID NO: 1508005 - RNA, 19 nt, Homo sapiens
auugguauauuuccauuca

SEQ ID NO: 1508006 - RNA, 13 nt, Homo sapiens
auuguacacuauc

SEQ ID NO: 1508007 - RNA, 15 nt, Homo sapiens
auuguacuaaagcca

SEQ ID NO: 1508008 - RNA, 22 nt, Homo sapiens
auuguauuuuagcaggguacau

SEQ ID NO: 1508009 - RNA, 14 nt, Homo sapiens
auugucugucuaca

SEQ ID NO: 1508010 - RNA, 21 nt, Homo sapiens
auuguucuuauccucaauuca

SEQ ID NO: 1508011 - RNA, 15 nt, Homo sapiens
auuuaacacuaaaaa

SEQ ID NO: 1508012 - RNA, 19 nt, Homo sapiens
auuuaauaagaaacaugau

SEQ ID NO: 1508013 - RNA, 23 nt, Homo sapiens
auuuaguugugcagucaguguca

SEQ ID NO: 1508014 - RNA, 18 nt, Homo sapiens
cacccgccgccuccugca

SEQ ID NO: 1508015 - RNA, 19 nt, Homo sapiens
caccucuggcuuugucucu

SEQ ID NO: 1508016 - RNA, 19 nt, Homo sapiens
caccugggcgccaacugcu

SEQ ID NO: 1508017 - RNA, 16 nt, Homo sapiens
caccuucaauacuuca

SEQ ID NO: 1508018 - RNA, 20 nt, Homo sapiens
cacgacuguuguacaagcuc

SEQ ID NO: 1508019 - RNA, 17 nt, Homo sapiens
cacgagaucaacacaca

SEQ ID NO: 1508020 - RNA, 15 nt, Homo sapiens
cacggggaucacagc

SEQ ID NO: 1508021 - RNA, 22 nt, Homo sapiens
cacuaaagggugcccacaaaau

SEQ ID NO: 1508022 - RNA, 16 nt, Homo sapiens
cacuaagcuuucuccu

SEQ ID NO: 1508023 - RNA, 19 nt, Homo sapiens
cacuaauugacccaaaacg

SEQ ID NO: 1508024 - RNA, 13 nt, Homo sapiens
cacuagacugugc

SEQ ID NO: 1508025 - RNA, 12 nt, Homo sapiens
cacuagcauuuu

SEQ ID NO: 1508026 - RNA, 15 nt, Homo sapiens
cauaaaacaaugaag

SEQ ID NO: 1508027 - RNA, 17 nt, Homo sapiens
cauaaaauagagugcau

SEQ ID NO: 1508028 - RNA, 18 nt, Homo sapiens
cauaaaauagagugcauu

SEQ ID NO: 1508029 - RNA, 12 nt, Homo sapiens
cauaaccaagaa

SEQ ID NO: 1508030 - RNA, 20 nt, Homo sapiens
cauaacucauaauccagaga

SEQ ID NO: 1508031 - RNA, 21 nt, Homo sapiens
cauaagccuaccaauguagac

SEQ ID NO: 1508032 - RNA, 17 nt, Homo sapiens
cauaauugcuuugccaa

SEQ ID NO: 1508033 - RNA, 13 nt, Homo sapiens
cgacaaagccaaa

SEQ ID NO: 1508034 - RNA, 13 nt, Homo sapiens
cgaccccaucuca

SEQ ID NO: 1508035 - RNA, 14 nt, Homo sapiens
cgaccccaucucau

SEQ ID NO: 1508036 - RNA, 23 nt, Homo sapiens
cgacgguuucaaaccaggauuuu

SEQ ID NO: 1508037 - RNA, 21 nt, Homo sapiens
cgagaucacgccacugcacuc

SEQ ID NO: 1508038 - RNA, 18 nt, Homo sapiens
cgagcuacucucuugcca

SEQ ID NO: 1508039 - RNA, 22 nt, Homo sapiens
cgagcuaugaucgcgccacuac

SEQ ID NO: 1508040 - RNA, 21 nt, Homo sapiens
cgaggcaaagagaaaagccac

SEQ ID NO: 1508041 - RNA, 13 nt, Homo sapiens
cgaggggcgcgau

SEQ ID NO: 1508042 - RNA, 15 nt, Homo sapiens
cgauaucaccaugau

SEQ ID NO: 1508043 - RNA, 14 nt, Homo sapiens
cgcauuucucaugc

SEQ ID NO: 1508044 - RNA, 17 nt, Homo sapiens
cgccauuccaagucaac

SEQ ID NO: 1508045 - RNA, 15 nt, Homo sapiens
cgccuaugaucccag

SEQ ID NO: 1508046 - RNA, 22 nt, Homo sapiens
cgccuguaaucccagcacuuug

SEQ ID NO: 1508047 - RNA, 17 nt, Homo sapiens
cgcuggucuggauggua

SEQ ID NO: 1508048 - RNA, 23 nt, Homo sapiens
cggacugcaagcagggcucugcc

SEQ ID NO: 1508049 - RNA, 13 nt, Homo sapiens
cggagcuugccug

SEQ ID NO: 1508050 - RNA, 22 nt, Homo sapiens
cggaugugugucucaccccuca

SEQ ID NO: 1508051 - RNA, 16 nt, Homo sapiens
cggcaucccuguguua

SEQ ID NO: 1508052 - RNA, 15 nt, Homo sapiens
cgggaggcugagaca

SEQ ID NO: 1508053 - RNA, 15 nt, Homo sapiens
cggguuacuuucaca

SEQ ID NO: 1508054 - RNA, 18 nt, Homo sapiens
cggucaggagggugcagu

SEQ ID NO: 1508055 - RNA, 14 nt, Homo sapiens
cggucccacacugg

SEQ ID NO: 1508056 - RNA, 18 nt, Homo sapiens
cgguggcucuugccugua

SEQ ID NO: 1508057 - RNA, 13 nt, Homo sapiens
cguagccaucucu

SEQ ID NO: 1508058 - RNA, 19 nt, Homo sapiens
cguaggauuuggggugaau

SEQ ID NO: 1508059 - RNA, 23 nt, Homo sapiens
cgucagggucggggcuaggguag

SEQ ID NO: 1508060 - RNA, 14 nt, Homo sapiens
cguccccaguugcc

SEQ ID NO: 1508061 - RNA, 12 nt, Homo sapiens
cgucucaagacu

SEQ ID NO: 1508062 - RNA, 13 nt, Homo sapiens
cgucuguguaugu

SEQ ID NO: 1508063 - RNA, 14 nt, Homo sapiens
cgugacaacaugcg

SEQ ID NO: 1508064 - RNA, 17 nt, Homo sapiens
cgugagcagcuuuggaa

SEQ ID NO: 1508065 - RNA, 15 nt, Homo sapiens
cguuuucaccagcaa

SEQ ID NO: 1508066 - RNA, 21 nt, Homo sapiens
cuaaacacgugacacaaacac

SEQ ID NO: 1508067 - RNA, 15 nt, Homo sapiens
cuaaagagcuuuagu

SEQ ID NO: 1508068 - RNA, 18 nt, Homo sapiens
cuaaagcuuucugacaag

SEQ ID NO: 1508069 - RNA, 16 nt, Homo sapiens
cuaaauaccucaauca

SEQ ID NO: 1508070 - RNA, 12 nt, Homo sapiens
cuaacagcauaa

SEQ ID NO: 1508071 - RNA, 20 nt, Homo sapiens
cuaacauuugcaaaauggaa

SEQ ID NO: 1508072 - RNA, 15 nt, Homo sapiens
cuaacccccagugcc

SEQ ID NO: 1508073 - RNA, 22 nt, Homo sapiens
cuaacuacaaggacaaugccuu

SEQ ID NO: 1508074 - RNA, 14 nt, Homo sapiens
cuaagacaccugca

SEQ ID NO: 1508075 - RNA, 21 nt, Homo sapiens
cuaagagucucuauuucacaa

SEQ ID NO: 1508076 - RNA, 13 nt, Homo sapiens
cuaagcaccauaa

SEQ ID NO: 1508077 - RNA, 17 nt, Homo sapiens
cuaagccacucuuccaa

SEQ ID NO: 1508078 - RNA, 22 nt, Homo sapiens
cuaagcgaauguguacaaagug

SEQ ID NO: 1508079 - RNA, 23 nt, Homo sapiens
cuaagcgaauguguacaaagugu

SEQ ID NO: 1508080 - RNA, 16 nt, Homo sapiens
cuaagcugugugcagg

SEQ ID NO: 1508081 - RNA, 12 nt, Homo sapiens
cuaagcuuucuc

SEQ ID NO: 1508082 - RNA, 23 nt, Homo sapiens
cuaagucaagaucaacauuccag

SEQ ID NO: 1508083 - RNA, 14 nt, Homo sapiens
cuaauauggcaaaa

SEQ ID NO: 1508084 - RNA, 19 nt, Homo sapiens
cuaauauuuuuagcucugu

SEQ ID NO: 1508085 - RNA, 22 nt, Homo sapiens
cuaauuccuggcaugacacucu

SEQ ID NO: 1508086 - RNA, 17 nt, Homo sapiens
cuacauuucugcagauc

SEQ ID NO: 1508087 - RNA, 18 nt, Homo sapiens
cuaccauuugaauuugug

SEQ ID NO: 1508088 - RNA, 14 nt, Homo sapiens
cuacuaaaaacaca

SEQ ID NO: 1508089 - RNA, 23 nt, Homo sapiens
cuacucucuccuuuuugcuuccu

SEQ ID NO: 1508090 - RNA, 14 nt, Homo sapiens
cuacucucuugcca

SEQ ID NO: 1508091 - RNA, 13 nt, Homo sapiens
cuacuuacaggug

SEQ ID NO: 1508092 - RNA, 18 nt, Homo sapiens
cuacuugccacacacugu

SEQ ID NO: 1508093 - RNA, 17 nt, Homo sapiens
cuacuugcucagguacu

SEQ ID NO: 1508094 - RNA, 12 nt, Homo sapiens
cuagaagucaaa

SEQ ID NO: 1508095 - RNA, 17 nt, Homo sapiens
cuagacuguuacuuugg

SEQ ID NO: 1508096 - RNA, 18 nt, Homo sapiens
cuagaggugagaccaaag

SEQ ID NO: 1508097 - RNA, 16 nt, Homo sapiens
cuagcaggaauauuuc

SEQ ID NO: 1508098 - RNA, 16 nt, Homo sapiens
cuagcauuuucuugaa

SEQ ID NO: 1508099 - RNA, 16 nt, Homo sapiens
cuaggaugguucugug

SEQ ID NO: 1508100 - RNA, 18 nt, Homo sapiens
cuaggccacaccaucucc

SEQ ID NO: 1508101 - RNA, 13 nt, Homo sapiens
cuaggguaggggc

SEQ ID NO: 1508102 - RNA, 13 nt, Homo sapiens
cuagucacaaaga

SEQ ID NO: 1508103 - RNA, 23 nt, Homo sapiens
cuagucuauggucaguugaggaa

SEQ ID NO: 1508104 - RNA, 18 nt, Homo sapiens
cuagugaagauguuguca

SEQ ID NO: 1508105 - RNA, 23 nt, Homo sapiens
cuaguugaacaucucacuuugcc

SEQ ID NO: 1508106 - RNA, 12 nt, Homo sapiens
cuauagucccag

SEQ ID NO: 1508107 - RNA, 16 nt, Homo sapiens
cuaucaauuacagucc

SEQ ID NO: 1508108 - RNA, 15 nt, Homo sapiens
cuaucuguauaacac

SEQ ID NO: 1508109 - RNA, 12 nt, Homo sapiens
cuaucugugaag

SEQ ID NO: 1508110 - RNA, 15 nt, Homo sapiens
cuaucuuuuugcuua

SEQ ID NO: 1508111 - RNA, 20 nt, Homo sapiens
cuaugaguugucaagacuga

SEQ ID NO: 1508112 - RNA, 13 nt, Homo sapiens
cuaugcugaagag

SEQ ID NO: 1508113 - RNA, 14 nt, Homo sapiens
cuauggugcucugu

SEQ ID NO: 1508114 - RNA, 15 nt, Homo sapiens
cuaugugauguuaac

SEQ ID NO: 1508115 - RNA, 15 nt, Homo sapiens
cuauuauaaaaccau

SEQ ID NO: 1508116 - RNA, 21 nt, Homo sapiens
cuauuaugggaaugacucuga

SEQ ID NO: 1508117 - RNA, 23 nt, Homo sapiens
cuauuuauuauaaauuaugagau

SEQ ID NO: 1508118 - RNA, 17 nt, Homo sapiens
cuauuuguuuacaugca

SEQ ID NO: 1508119 - RNA, 13 nt, Homo sapiens
cuauuuuguaauu

SEQ ID NO: 1508120 - RNA, 18 nt, Homo sapiens
cucaacaauaaagacuga

SEQ ID NO: 1508121 - RNA, 12 nt, Homo sapiens
cucaagacugaa

SEQ ID NO: 1508122 - RNA, 13 nt, Homo sapiens
cucaagacugaaa

SEQ ID NO: 1508123 - RNA, 16 nt, Homo sapiens
cucaagacugaaacgg

SEQ ID NO: 1508124 - RNA, 15 nt, Homo sapiens
cucaaguaccaccaa

SEQ ID NO: 1508125 - RNA, 17 nt, Homo sapiens
cucaaucacugcucccc

SEQ ID NO: 1508126 - RNA, 18 nt, Homo sapiens
cucaauuggaaguaguuc

SEQ ID NO: 1508127 - RNA, 14 nt, Homo sapiens
cucacagaggcagu

SEQ ID NO: 1508128 - RNA, 12 nt, Homo sapiens
cucaccaaaacg

SEQ ID NO: 1508129 - RNA, 11 nt, Homo sapiens
cucaccucucu

SEQ ID NO: 1508130 - RNA, 18 nt, Homo sapiens
cucacgccuaugauccca

SEQ ID NO: 1508131 - RNA, 17 nt, Homo sapiens
cucacugguccauuucu

SEQ ID NO: 1508132 - RNA, 22 nt, Homo sapiens
cucacuuuuuuacaacuccaac

SEQ ID NO: 1508133 - RNA, 15 nt, Homo sapiens
cucagagcaggcuca

SEQ ID NO: 1508134 - RNA, 19 nt, Homo sapiens
cucagagcaggggccagau

SEQ ID NO: 1508135 - RNA, 20 nt, Homo sapiens
cucagcaugcagaagugcau

SEQ ID NO: 1508136 - RNA, 20 nt, Homo sapiens
cucagccucccgaguagcug

SEQ ID NO: 1508137 - RNA, 22 nt, Homo sapiens
cucagcucacugguccauuucu

SEQ ID NO: 1508138 - RNA, 20 nt, Homo sapiens
cucagcuccagaauaccuuc

SEQ ID NO: 1508139 - RNA, 15 nt, Homo sapiens
cucaggaacagaaca

SEQ ID NO: 1508140 - RNA, 14 nt, Homo sapiens
cucaggaugccaag

SEQ ID NO: 1508141 - RNA, 20 nt, Homo sapiens
cucagucugugggagcucag

SEQ ID NO: 1508142 - RNA, 20 nt, Homo sapiens
cucaguuuuuaucaggcuuu

SEQ ID NO: 1508143 - RNA, 14 nt, Homo sapiens
cucaucacuaccuu

SEQ ID NO: 1508144 - RNA, 21 nt, Homo sapiens
cuccaccaacuggagcacuga

SEQ ID NO: 1508145 - RNA, 21 nt, Homo sapiens
cuccaccuuguuacacauuau

SEQ ID NO: 1508146 - RNA, 16 nt, Homo sapiens
cuccacuccaccucca

SEQ ID NO: 1508147 - RNA, 18 nt, Homo sapiens
cuccacugaggaugugag

SEQ ID NO: 1508148 - RNA, 18 nt, Homo sapiens
cuccagaauccacaaagc

SEQ ID NO: 1508149 - RNA, 15 nt, Homo sapiens
cuccagagacaggaa

SEQ ID NO: 1508150 - RNA, 14 nt, Homo sapiens
cuccaggaaugccu

SEQ ID NO: 1508151 - RNA, 17 nt, Homo sapiens
cuccaguauucuuguca

SEQ ID NO: 1508152 - RNA, 16 nt, Homo sapiens
cuccagugugaauaua

SEQ ID NO: 1508153 - RNA, 20 nt, Homo sapiens
cuccaguuuccaaguuccug

SEQ ID NO: 1508154 - RNA, 17 nt, Homo sapiens
cuccauauuuauuuaaa

SEQ ID NO: 1508155 - RNA, 12 nt, Homo sapiens
cuccaucuccag

SEQ ID NO: 1508156 - RNA, 19 nt, Homo sapiens
cuccauuucaacuccagaa

SEQ ID NO: 1508157 - RNA, 15 nt, Homo sapiens
cucccacauugucac

SEQ ID NO: 1508158 - RNA, 21 nt, Homo sapiens
cucccauaauugcuuugccaa

SEQ ID NO: 1508159 - RNA, 16 nt, Homo sapiens
cuccccugguccugca

SEQ ID NO: 1508160 - RNA, 16 nt, Homo sapiens
cucccgggagcacaga

SEQ ID NO: 1508161 - RNA, 15 nt, Homo sapiens
cucccuggcauguca

SEQ ID NO: 1508162 - RNA, 20 nt, Homo sapiens
cucccuguuaucugcuagau

SEQ ID NO: 1508163 - RNA, 16 nt, Homo sapiens
cuccggccugaugaca

SEQ ID NO: 1508164 - RNA, 18 nt, Homo sapiens
cuccuagauggacuuccu

SEQ ID NO: 1508165 - RNA, 16 nt, Homo sapiens
cuccugacaugucuca

SEQ ID NO: 1508166 - RNA, 22 nt, Homo sapiens
cucgaauaaaggaugggaccaa

SEQ ID NO: 1508167 - RNA, 16 nt, Homo sapiens
cucggccucccaaagu

SEQ ID NO: 1508168 - RNA, 15 nt, Homo sapiens
ccaugccucaagaac

SEQ ID NO: 1508169 - RNA, 14 nt, Homo sapiens
ccaugcuuugcuua

SEQ ID NO: 1508170 - RNA, 15 nt, Homo sapiens
ccaugggauguuaag

SEQ ID NO: 1508171 - RNA, 17 nt, Homo sapiens
cucuacuccuaccucag

SEQ ID NO: 1508172 - RNA, 20 nt, Homo sapiens
cucuauugagccaagaccaa

SEQ ID NO: 1508173 - RNA, 15 nt, Homo sapiens
cucucaauaugcuua

SEQ ID NO: 1508174 - RNA, 13 nt, Homo sapiens
cucucaggggcca

SEQ ID NO: 1508175 - RNA, 14 nt, Homo sapiens
cucucccugccaag

SEQ ID NO: 1508176 - RNA, 15 nt, Homo sapiens
cucucccugccaagu

SEQ ID NO: 1508177 - RNA, 16 nt, Homo sapiens
cucucccugccaaguc

SEQ ID NO: 1508178 - RNA, 20 nt, Homo sapiens
cucucuacccggcccagaga

SEQ ID NO: 1508179 - RNA, 19 nt, Homo sapiens
cucugaaacaaaaguauuu

SEQ ID NO: 1508180 - RNA, 13 nt, Homo sapiens
cucugaagggaaa

SEQ ID NO: 1508181 - RNA, 19 nt, Homo sapiens
cucugagaagacacaaggu

SEQ ID NO: 1508182 - RNA, 20 nt, Homo sapiens
cucuguuaugcaagcacaaa

SEQ ID NO: 1508183 - RNA, 21 nt, Homo sapiens
cucuguuaugcaagcacaaau

SEQ ID NO: 1508184 - RNA, 20 nt, Homo sapiens
cucuuacauggccacaaagg

SEQ ID NO: 1508185 - RNA, 14 nt, Homo sapiens
cucuuacugcagua

SEQ ID NO: 1508186 - RNA, 16 nt, Homo sapiens
cucuuaguaacauaga

SEQ ID NO: 1508187 - RNA, 15 nt, Homo sapiens
cucuuauuugcucac

SEQ ID NO: 1508188 - RNA, 14 nt, Homo sapiens
cucuucaaaugccu

SEQ ID NO: 1508189 - RNA, 14 nt, Homo sapiens
cucuugcauugcaa

SEQ ID NO: 1508190 - RNA, 20 nt, Homo sapiens
cucuuuuccacuccaagaug

SEQ ID NO: 1508191 - RNA, 16 nt, Homo sapiens
cugaaaaaaugauacg

SEQ ID NO: 1508192 - RNA, 14 nt, Homo sapiens
cugaaccacuuugc

SEQ ID NO: 1508193 - RNA, 15 nt, Homo sapiens
cugaaccacuuugcc

SEQ ID NO: 1508194 - RNA, 15 nt, Homo sapiens
cugaacccauuuuga

SEQ ID NO: 1508195 - RNA, 21 nt, Homo sapiens
cugaagaaaccuucagauuug

SEQ ID NO: 1508196 - RNA, 14 nt, Homo sapiens
cugaagaccuccac

SEQ ID NO: 1508197 - RNA, 20 nt, Homo sapiens
cugaaugccucaaugugacc

SEQ ID NO: 1508198 - RNA, 14 nt, Homo sapiens
cugacaagauggaa

SEQ ID NO: 1508199 - RNA, 13 nt, Homo sapiens
cugacaagcacug

SEQ ID NO: 1508200 - RNA, 14 nt, Homo sapiens
cugacaagcacugc

SEQ ID NO: 1508201 - RNA, 11 nt, Homo sapiens
cugacacuguc

SEQ ID NO: 1508202 - RNA, 20 nt, Homo sapiens
cugaccagccgugagcaugu

SEQ ID NO: 1508203 - RNA, 16 nt, Homo sapiens
cugacgacacugaaga

SEQ ID NO: 1508204 - RNA, 18 nt, Homo sapiens
cugagaaugaaugaguag

SEQ ID NO: 1508205 - RNA, 22 nt, Homo sapiens
cugagacuucaggugcauucca

SEQ ID NO: 1508206 - RNA, 14 nt, Homo sapiens
cugagauacauaca

SEQ ID NO: 1508207 - RNA, 17 nt, Homo sapiens
cugagaucacaccacug

SEQ ID NO: 1508208 - RNA, 19 nt, Homo sapiens
cugagcaaaucaccacaaa

SEQ ID NO: 1508209 - RNA, 19 nt, Homo sapiens
cugagcagcccagcacaac

SEQ ID NO: 1508210 - RNA, 14 nt, Homo sapiens
cugagcucuuaucu

SEQ ID NO: 1508211 - RNA, 21 nt, Homo sapiens
cugaguagcuaggacuauggg

SEQ ID NO: 1508212 - RNA, 21 nt, Homo sapiens
cugaguuugcuguuugcaauu

SEQ ID NO: 1508213 - RNA, 15 nt, Homo sapiens
cugauacccagagca

SEQ ID NO: 1508214 - RNA, 14 nt, Homo sapiens
cugauauggcuuuu

SEQ ID NO: 1508215 - RNA, 17 nt, Homo sapiens
cugaugacacauuuggc

SEQ ID NO: 1508216 - RNA, 15 nt, Homo sapiens
cugauuuaacacuau

SEQ ID NO: 1508217 - RNA, 22 nt, Homo sapiens
cugauuuaacacuauccaauga

SEQ ID NO: 1508218 - RNA, 20 nt, Homo sapiens
cugcaacuuaaugcucugau

SEQ ID NO: 1508219 - RNA, 13 nt, Homo sapiens
cugcaccgagaga

SEQ ID NO: 1508220 - RNA, 22 nt, Homo sapiens
cugcaccgagagagauggaaua

SEQ ID NO: 1508221 - RNA, 19 nt, Homo sapiens
cugcacuccagaauccaca

SEQ ID NO: 1508222 - RNA, 23 nt, Homo sapiens
cugcacucuuauuucacuaaaga

SEQ ID NO: 1508223 - RNA, 22 nt, Homo sapiens
cugcacuuaguagcuaugugau

SEQ ID NO: 1508224 - RNA, 13 nt, Homo sapiens
cugcagcacuuua

SEQ ID NO: 1508225 - RNA, 16 nt, Homo sapiens
cugcagccugguagaa

SEQ ID NO: 1508226 - RNA, 11 nt, Homo sapiens
cugcaucucau

SEQ ID NO: 1508227 - RNA, 15 nt, Homo sapiens
cugccccacccucaa

SEQ ID NO: 1508228 - RNA, 19 nt, Homo sapiens
cugcccgaccccaucucau

SEQ ID NO: 1508229 - RNA, 22 nt, Homo sapiens
cugccugugcaugaccugauca

SEQ ID NO: 1508230 - RNA, 13 nt, Homo sapiens
cugccugugguga

SEQ ID NO: 1508231 - RNA, 20 nt, Homo sapiens
cugccuguggugagguccug

SEQ ID NO: 1508232 - RNA, 18 nt, Homo sapiens
cugccuugaagccacuga

SEQ ID NO: 1508233 - RNA, 13 nt, Homo sapiens
cugcggcgaccgc

SEQ ID NO: 1508234 - RNA, 23 nt, Homo sapiens
cugcgggcaccagaaugcuaaag

SEQ ID NO: 1508235 - RNA, 24 nt, Homo sapiens
cugcuauaugccuuaagccaauau

SEQ ID NO: 1508236 - RNA, 22 nt, Homo sapiens
cugcucuggaaaaugugaccca

SEQ ID NO: 1508237 - RNA, 15 nt, Homo sapiens
cugcuucuccuccca

SEQ ID NO: 1508238 - RNA, 17 nt, Homo sapiens
cugcuucuccucccagc

SEQ ID NO: 1508239 - RNA, 23 nt, Homo sapiens
cugcuuucuccuguagcacaaag

SEQ ID NO: 1508240 - RNA, 14 nt, Homo sapiens
cuggaaaaugugac

SEQ ID NO: 1508241 - RNA, 20 nt, Homo sapiens
cuggacacacuaucaccuau

SEQ ID NO: 1508242 - RNA, 20 nt, Homo sapiens
cuggacuggguuuugucucu

SEQ ID NO: 1508243 - RNA, 14 nt, Homo sapiens
cuggagaugaugau

SEQ ID NO: 1508244 - RNA, 16 nt, Homo sapiens
cuggagaugaugauga

SEQ ID NO: 1508245 - RNA, 13 nt, Homo sapiens
cuggagugcaguu

SEQ ID NO: 1508246 - RNA, 17 nt, Homo sapiens
cuggaugcaguggcuca

SEQ ID NO: 1508247 - RNA, 15 nt, Homo sapiens
cuggcaugacacucu

SEQ ID NO: 1508248 - RNA, 16 nt, Homo sapiens
cuggcaugacacucua

SEQ ID NO: 1508249 - RNA, 21 nt, Homo sapiens
cuggcccuuucuggaccagau

SEQ ID NO: 1508250 - RNA, 23 nt, Homo sapiens
cuggcgagauaccauggugccau

SEQ ID NO: 1508251 - RNA, 19 nt, Homo sapiens
cuggcuccaaggugcucug

SEQ ID NO: 1508252 - RNA, 13 nt, Homo sapiens
cuggcuccagaau

SEQ ID NO: 1508253 - RNA, 18 nt, Homo sapiens
cuggcugagcugaaccca

SEQ ID NO: 1508254 - RNA, 14 nt, Homo sapiens
cuggcugucuuccc

SEQ ID NO: 1508255 - RNA, 15 nt, Homo sapiens
cuggcuuagugccac

SEQ ID NO: 1508256 - RNA, 14 nt, Homo sapiens
cuggcuucuggcca

SEQ ID NO: 1508257 - RNA, 15 nt, Homo sapiens
cuggcuuuuugcacg

SEQ ID NO: 1508258 - RNA, 22 nt, Homo sapiens
cugggaaauucuauaugauccu

SEQ ID NO: 1508259 - RNA, 12 nt, Homo sapiens
cugggaacuggu

SEQ ID NO: 1508260 - RNA, 22 nt, Homo sapiens
cugggaacugguucaagagaca

SEQ ID NO: 1508261 - RNA, 15 nt, Homo sapiens
cugggagaaccucag

SEQ ID NO: 1508262 - RNA, 22 nt, Homo sapiens
cugggauuacaggcaugagcca

SEQ ID NO: 1508263 - RNA, 16 nt, Homo sapiens
cugggcgccaacugcu

SEQ ID NO: 1508264 - RNA, 19 nt, Homo sapiens
cuggggccaugggugcaug

SEQ ID NO: 1508265 - RNA, 14 nt, Homo sapiens
cuggggcucugugc

SEQ ID NO: 1508266 - RNA, 21 nt, Homo sapiens
cugggggcccauucugcaugc

SEQ ID NO: 1508267 - RNA, 17 nt, Homo sapiens
cugguaauuuguaucug

SEQ ID NO: 1508268 - RNA, 12 nt, Homo sapiens
cugguagcacau

SEQ ID NO: 1508269 - RNA, 16 nt, Homo sapiens
cuggucuucacugcca

SEQ ID NO: 1508270 - RNA, 19 nt, Homo sapiens
cuggugauuucugagauuu

SEQ ID NO: 1508271 - RNA, 22 nt, Homo sapiens
cugguggaggcuucuugcccag

SEQ ID NO: 1508272 - RNA, 20 nt, Homo sapiens
cugguugagaucaugucauu

SEQ ID NO: 1508273 - RNA, 15 nt, Homo sapiens
cugguuugaaagccu

SEQ ID NO: 1508274 - RNA, 12 nt, Homo sapiens
cugguuuuaaca

SEQ ID NO: 1508275 - RNA, 22 nt, Homo sapiens
cugguuuucucuuacugcagua

SEQ ID NO: 1508276 - RNA, 19 nt, Homo sapiens
cuguaacucagacauucca

SEQ ID NO: 1508277 - RNA, 21 nt, Homo sapiens
cuguaagaaaccuacugccca

SEQ ID NO: 1508278 - RNA, 12 nt, Homo sapiens
cuguaagcauuc

SEQ ID NO: 1508279 - RNA, 17 nt, Homo sapiens
cuguaaucccagcacuu

SEQ ID NO: 1508280 - RNA, 22 nt, Homo sapiens
cuguaauuaaguaaaccaaaaa

SEQ ID NO: 1508281 - RNA, 17 nt, Homo sapiens
cuguaauuucacuuuag

SEQ ID NO: 1508282 - RNA, 14 nt, Homo sapiens
cuguagcacaaaga

SEQ ID NO: 1508283 - RNA, 13 nt, Homo sapiens
cugucaugguccu

SEQ ID NO: 1508284 - RNA, 12 nt, Homo sapiens
cuguccuaggcc

SEQ ID NO: 1508285 - RNA, 21 nt, Homo sapiens
cuguccugccucucugcucca

SEQ ID NO: 1508286 - RNA, 14 nt, Homo sapiens
cugucgcaucucag

SEQ ID NO: 1508287 - RNA, 17 nt, Homo sapiens
cugucuccuuucucagc

SEQ ID NO: 1508288 - RNA, 13 nt, Homo sapiens
cugucucuacuaa

SEQ ID NO: 1508289 - RNA, 16 nt, Homo sapiens
cugucuuccacuguac

SEQ ID NO: 1508290 - RNA, 13 nt, Homo sapiens
cugugaaauacca

SEQ ID NO: 1508291 - RNA, 15 nt, Homo sapiens
cugugaagcaaaaag

SEQ ID NO: 1508292 - RNA, 20 nt, Homo sapiens
cugugauagagcagaacuga

SEQ ID NO: 1508293 - RNA, 21 nt, Homo sapiens
cugugauagagcagaacugaa

SEQ ID NO: 1508294 - RNA, 19 nt, Homo sapiens
cugugcgucuguguguuua

SEQ ID NO: 1508295 - RNA, 20 nt, Homo sapiens
cuguggaugaugguugcaaa

SEQ ID NO: 1508296 - RNA, 16 nt, Homo sapiens
cuguggggccugaugg

SEQ ID NO: 1508297 - RNA, 24 nt, Homo sapiens
cuguguaugucuauuugcacaaga

SEQ ID NO: 1508298 - RNA, 19 nt, Homo sapiens
cugugugaugaacuuucuc

SEQ ID NO: 1508299 - RNA, 19 nt, Homo sapiens
cuguguguuacaaugauau

SEQ ID NO: 1508300 - RNA, 16 nt, Homo sapiens
cuguuacuuuggcaau

SEQ ID NO: 1508301 - RNA, 17 nt, Homo sapiens
acagaugauaauaugcu

SEQ ID NO: 1508302 - RNA, 17 nt, Homo sapiens
acagauguaaaugccac

SEQ ID NO: 1508303 - RNA, 22 nt, Homo sapiens
acagaugugucugggagagccu

SEQ ID NO: 1508304 - RNA, 18 nt, Homo sapiens
acagcagcugaacagcca

SEQ ID NO: 1508305 - RNA, 20 nt, Homo sapiens
acagcagcugaacagccaaa

SEQ ID NO: 1508306 - RNA, 13 nt, Homo sapiens
acagcagugcaua

SEQ ID NO: 1508307 - RNA, 15 nt, Homo sapiens
acagcauaauugccu

SEQ ID NO: 1508308 - RNA, 18 nt, Homo sapiens
acagcgagaggcagagaa

SEQ ID NO: 1508309 - RNA, 22 nt, Homo sapiens
acaggaggggcccacaauggag

SEQ ID NO: 1508310 - RNA, 20 nt, Homo sapiens
acagucaccgacaacaugcu

SEQ ID NO: 1508311 - RNA, 22 nt, Homo sapiens
acaguccugggagaaccucagg

SEQ ID NO: 1508312 - RNA, 19 nt, Homo sapiens
acagugaauguguguaugu

SEQ ID NO: 1508313 - RNA, 17 nt, Homo sapiens
acagugcccagcuaauu

SEQ ID NO: 1508314 - RNA, 12 nt, Homo sapiens
acaguuuagccc

SEQ ID NO: 1508315 - RNA, 19 nt, Homo sapiens
acauaaacacauacauugc

SEQ ID NO: 1508316 - RNA, 22 nt, Homo sapiens
acauaauggaaaacauuuacau

SEQ ID NO: 1508317 - RNA, 21 nt, Homo sapiens
acauacauugccaauuuucca

SEQ ID NO: 1508318 - RNA, 15 nt, Homo sapiens
acauagacagaagaa

SEQ ID NO: 1508319 - RNA, 14 nt, Homo sapiens
acauaugacauaua

SEQ ID NO: 1508320 - RNA, 14 nt, Homo sapiens
acaucucacuuugc

SEQ ID NO: 1508321 - RNA, 15 nt, Homo sapiens
acaucugcauuucua

SEQ ID NO: 1508322 - RNA, 16 nt, Homo sapiens
acaucugcauuucuac

SEQ ID NO: 1508323 - RNA, 19 nt, Homo sapiens
acaucuuauaaacugacuu

SEQ ID NO: 1508324 - RNA, 19 nt, Homo sapiens
acaugaacagaaacaauaa

SEQ ID NO: 1508325 - RNA, 21 nt, Homo sapiens
acaugauggagcgcaccugcc

SEQ ID NO: 1508326 - RNA, 17 nt, Homo sapiens
acauggugaaacccugu

SEQ ID NO: 1508327 - RNA, 16 nt, Homo sapiens
acauguacaugcauuu

SEQ ID NO: 1508328 - RNA, 15 nt, Homo sapiens
acauuauacauuuga

SEQ ID NO: 1508329 - RNA, 22 nt, Homo sapiens
acauucacagcccagaaccaca

SEQ ID NO: 1508330 - RNA, 17 nt, Homo sapiens
acauuggagcugacugu

SEQ ID NO: 1508331 - RNA, 19 nt, Homo sapiens
acauuggagcugacuguuc

SEQ ID NO: 1508332 - RNA, 18 nt, Homo sapiens
acauuucccugugcugac

SEQ ID NO: 1508333 - RNA, 18 nt, Homo sapiens
acauuucuauagccaaaa

SEQ ID NO: 1508334 - RNA, 23 nt, Homo sapiens
acauuucucuaacuccugccauu

SEQ ID NO: 1508335 - RNA, 15 nt, Homo sapiens
acauuugcaaaaugg

SEQ ID NO: 1508336 - RNA, 17 nt, Homo sapiens
acauuugcaaaauggaa

SEQ ID NO: 1508337 - RNA, 22 nt, Homo sapiens
acauuugguauauuaccucaaa

SEQ ID NO: 1508338 - RNA, 15 nt, Homo sapiens
acauuuuuguacaca

SEQ ID NO: 1508339 - RNA, 16 nt, Homo sapiens
acauuuuuuguuugcu

SEQ ID NO: 1508340 - RNA, 23 nt, Homo sapiens
accaaaucuugguugaugccaaa

SEQ ID NO: 1508341 - RNA, 12 nt, Homo sapiens
accaacuuucug

SEQ ID NO: 1508342 - RNA, 14 nt, Homo sapiens
accaagacuaagca

SEQ ID NO: 1508343 - RNA, 23 nt, Homo sapiens
accaagauagauccauuuggaca

SEQ ID NO: 1508344 - RNA, 15 nt, Homo sapiens
accaauaggugcaaa

SEQ ID NO: 1508345 - RNA, 14 nt, Homo sapiens
accacacuucuuga

SEQ ID NO: 1508346 - RNA, 11 nt, Homo sapiens
accacagcagc

SEQ ID NO: 1508347 - RNA, 14 nt, Homo sapiens
accacuaggguccu

SEQ ID NO: 1508348 - RNA, 19 nt, Homo sapiens
accagauaguuauauuaaa

SEQ ID NO: 1508349 - RNA, 17 nt, Homo sapiens
accaggacuauagccca

SEQ ID NO: 1508350 - RNA, 17 nt, Homo sapiens
accagggagcaguugcc

SEQ ID NO: 1508351 - RNA, 14 nt, Homo sapiens
accaguacugggaa

SEQ ID NO: 1508352 - RNA, 15 nt, Homo sapiens
accauaaccaagaaa

SEQ ID NO: 1508353 - RNA, 14 nt, Homo sapiens
accaugaauucuug

SEQ ID NO: 1508354 - RNA, 16 nt, Homo sapiens
accauucccaagccau

SEQ ID NO: 1508355 - RNA, 18 nt, Homo sapiens
acccagcaacacagagcu

SEQ ID NO: 1508356 - RNA, 12 nt, Homo sapiens
acccagcucuca

SEQ ID NO: 1508357 - RNA, 13 nt, Homo sapiens
acccagcucucag

SEQ ID NO: 1508358 - RNA, 22 nt, Homo sapiens
acccaguccgccaaacacucca

SEQ ID NO: 1508359 - RNA, 21 nt, Homo sapiens
accccacauuggacuuccuug

SEQ ID NO: 1508360 - RNA, 15 nt, Homo sapiens
accccaucucuacua

SEQ ID NO: 1508361 - RNA, 13 nt, Homo sapiens
accccugucucua

SEQ ID NO: 1508362 - RNA, 23 nt, Homo sapiens
accccugucucuagccacuuugg

SEQ ID NO: 1508363 - RNA, 22 nt, Homo sapiens
accccuuggcuuuugcuuggca

SEQ ID NO: 1508364 - RNA, 19 nt, Homo sapiens
acccguuuuauucuauucc

SEQ ID NO: 1508365 - RNA, 17 nt, Homo sapiens
acccuccuccacuccac

SEQ ID NO: 1508366 - RNA, 17 nt, Homo sapiens
acccugagguccugcau

SEQ ID NO: 1508367 - RNA, 16 nt, Homo sapiens
acccuuggacuugagg

SEQ ID NO: 1508368 - RNA, 18 nt, Homo sapiens
accgagagagauggaaua

SEQ ID NO: 1508369 - RNA, 19 nt, Homo sapiens
accgagagagauggaauaa

SEQ ID NO: 1508370 - RNA, 15 nt, Homo sapiens
accgugaccaggaac

SEQ ID NO: 1508371 - RNA, 13 nt, Homo sapiens
accguugcacaaa

SEQ ID NO: 1508372 - RNA, 13 nt, Homo sapiens
accucaccaaaac

SEQ ID NO: 1508373 - RNA, 13 nt, Homo sapiens
accucacuauuca

SEQ ID NO: 1508374 - RNA, 19 nt, Homo sapiens
accucagagggauaaggca

SEQ ID NO: 1508375 - RNA, 17 nt, Homo sapiens
accucaucuacaagcau

SEQ ID NO: 1508376 - RNA, 17 nt, Homo sapiens
accuccacccacugucc

SEQ ID NO: 1508377 - RNA, 22 nt, Homo sapiens
accucccccaagcagagcuucc

SEQ ID NO: 1508378 - RNA, 23 nt, Homo sapiens
accuccuauccuuggagagcagc

SEQ ID NO: 1508379 - RNA, 10 nt, Homo sapiens
accucugaga

SEQ ID NO: 1508380 - RNA, 16 nt, Homo sapiens
accucuggcuuugucu

SEQ ID NO: 1508381 - RNA, 12 nt, Homo sapiens
accucuuccuuc

SEQ ID NO: 1508382 - RNA, 19 nt, Homo sapiens
accugaggcuccugugcua

SEQ ID NO: 1508383 - RNA, 13 nt, Homo sapiens
accugcaggccaa

SEQ ID NO: 1508384 - RNA, 17 nt, Homo sapiens
accugcggcugcugugu

SEQ ID NO: 1508385 - RNA, 23 nt, Homo sapiens
accugcuuugagauuuccugaca

SEQ ID NO: 1508386 - RNA, 18 nt, Homo sapiens
accuggagaugaugauga

SEQ ID NO: 1508387 - RNA, 13 nt, Homo sapiens
accuguaacuuaa

SEQ ID NO: 1508388 - RNA, 18 nt, Homo sapiens
accuuaccaacuuucugu

SEQ ID NO: 1508389 - RNA, 15 nt, Homo sapiens
accuuaguggcuuuu

SEQ ID NO: 1508390 - RNA, 17 nt, Homo sapiens
accuuuauagcucucau

SEQ ID NO: 1508391 - RNA, 22 nt, Homo sapiens
acgacaaagccaaacucugcca

SEQ ID NO: 1508392 - RNA, 18 nt, Homo sapiens
acgacuguuguacaagcu

SEQ ID NO: 1508393 - RNA, 18 nt, Homo sapiens
acgauucuucacuucuug

SEQ ID NO: 1508394 - RNA, 21 nt, Homo sapiens
acggaagccaacuuggcuuuc

SEQ ID NO: 1508395 - RNA, 13 nt, Homo sapiens
acguacugguuua

SEQ ID NO: 1508396 - RNA, 22 nt, Homo sapiens
acgucugcagaaacagugcaag

SEQ ID NO: 1508397 - RNA, 19 nt, Homo sapiens
acgugaagccacaggagcc

SEQ ID NO: 1508398 - RNA, 21 nt, Homo sapiens
acgugacacaaacacacacaa

SEQ ID NO: 1508399 - RNA, 17 nt, Homo sapiens
acuaaacagacuauuua

SEQ ID NO: 1508400 - RNA, 13 nt, Homo sapiens
acuaaacuucuua

SEQ ID NO: 1508401 - RNA, 11 nt, Homo sapiens
acuaaagccaa

SEQ ID NO: 1508402 - RNA, 16 nt, Homo sapiens
acuaaugucagcacau

SEQ ID NO: 1508403 - RNA, 19 nt, Homo sapiens
acuaaugucagcacauguu

SEQ ID NO: 1508404 - RNA, 17 nt, Homo sapiens
acuaccuuuauagcucu

SEQ ID NO: 1508405 - RNA, 17 nt, Homo sapiens
acuagagccugugcuaa

SEQ ID NO: 1508406 - RNA, 15 nt, Homo sapiens
acuagggagccaugu

SEQ ID NO: 1508407 - RNA, 14 nt, Homo sapiens
acuaguaucucugg

SEQ ID NO: 1508408 - RNA, 20 nt, Homo sapiens
acuaucuuucagcuccaguu

SEQ ID NO: 1508409 - RNA, 23 nt, Homo sapiens
acuauuucacuaauaaacauuug

SEQ ID NO: 1508410 - RNA, 21 nt, Homo sapiens
acuauuuuugauagcacacau

SEQ ID NO: 1508411 - RNA, 12 nt, Homo sapiens
acucaacaauaa

SEQ ID NO: 1508412 - RNA, 17 nt, Homo sapiens
acucaaguaccaccaag

SEQ ID NO: 1508413 - RNA, 19 nt, Homo sapiens
acucagaaaagaaaaccau

SEQ ID NO: 1508414 - RNA, 22 nt, Homo sapiens
acucagaaaauggggcuugccc

SEQ ID NO: 1508415 - RNA, 18 nt, Homo sapiens
acucaggccaacaagcca

SEQ ID NO: 1508416 - RNA, 19 nt, Homo sapiens
acucaucccuguuccucaa

SEQ ID NO: 1508417 - RNA, 13 nt, Homo sapiens
acucauugucuca

SEQ ID NO: 1508418 - RNA, 15 nt, Homo sapiens
acucauugucucagu

SEQ ID NO: 1508419 - RNA, 18 nt, Homo sapiens
acuccagaaguggggcuc

SEQ ID NO: 1508420 - RNA, 13 nt, Homo sapiens
acuccagaaucca

SEQ ID NO: 1508421 - RNA, 13 nt, Homo sapiens
acuccagccugag

SEQ ID NO: 1508422 - RNA, 15 nt, Homo sapiens
acuccaguggugaag

SEQ ID NO: 1508423 - RNA, 13 nt, Homo sapiens
acuccgugugccu

SEQ ID NO: 1508424 - RNA, 14 nt, Homo sapiens
acucuaagcugugu

SEQ ID NO: 1508425 - RNA, 18 nt, Homo sapiens
acucucugugaccugccc

SEQ ID NO: 1508426 - RNA, 19 nt, Homo sapiens
acucugcgguggugccaga

SEQ ID NO: 1508427 - RNA, 22 nt, Homo sapiens
acucuggguuuauuacauggca

SEQ ID NO: 1508428 - RNA, 16 nt, Homo sapiens
acucugucacacuaaa

SEQ ID NO: 1508429 - RNA, 21 nt, Homo sapiens
acucuguccacucuuguucaa

SEQ ID NO: 1508430 - RNA, 22 nt, Homo sapiens
acucuucaaggucugcuuuuca

SEQ ID NO: 1508431 - RNA, 16 nt, Homo sapiens
acucuuccaaaggcau

SEQ ID NO: 1508432 - RNA, 14 nt, Homo sapiens
acugaacauuugcu

SEQ ID NO: 1508433 - RNA, 16 nt, Homo sapiens
acugaauuagccaaaa

SEQ ID NO: 1508434 - RNA, 16 nt, Homo sapiens
acugaauuuugggacu

SEQ ID NO: 1508435 - RNA, 20 nt, Homo sapiens
acugaauuuugggacuucua

SEQ ID NO: 1508436 - RNA, 17 nt, Homo sapiens
aucaaagaaaacauagc

SEQ ID NO: 1508437 - RNA, 17 nt, Homo sapiens
aucaaaucccacuuacu

SEQ ID NO: 1508438 - RNA, 15 nt, Homo sapiens
aucaagaauauucaa

SEQ ID NO: 1508439 - RNA, 23 nt, Homo sapiens
aucaauccuucuuauguuugcuu

SEQ ID NO: 1508440 - RNA, 21 nt, Homo sapiens
aucacaccacugcacuccagc

SEQ ID NO: 1508441 - RNA, 16 nt, Homo sapiens
aucacagcagugcaua

SEQ ID NO: 1508442 - RNA, 14 nt, Homo sapiens
aucaccuauuacau

SEQ ID NO: 1508443 - RNA, 21 nt, Homo sapiens
aucaccucuggcuuugucucu

SEQ ID NO: 1508444 - RNA, 22 nt, Homo sapiens
aucacuauugcuuccuaaaggu

SEQ ID NO: 1508445 - RNA, 12 nt, Homo sapiens
aucagacuguag

SEQ ID NO: 1508446 - RNA, 14 nt, Homo sapiens
aucagcaguggcag

SEQ ID NO: 1508447 - RNA, 19 nt, Homo sapiens
aucagccuccgccauucca

SEQ ID NO: 1508448 - RNA, 15 nt, Homo sapiens
aucaguugcagauag

SEQ ID NO: 1508449 - RNA, 21 nt, Homo sapiens
aucauauugguauucacuaau

SEQ ID NO: 1508450 - RNA, 14 nt, Homo sapiens
auccacaagccauu

SEQ ID NO: 1508451 - RNA, 18 nt, Homo sapiens
auccacccauguuuauua

SEQ ID NO: 1508452 - RNA, 17 nt, Homo sapiens
auccacgcacacaugga

SEQ ID NO: 1508453 - RNA, 19 nt, Homo sapiens
auccacgcacacauggaca

SEQ ID NO: 1508454 - RNA, 9 nt, Homo sapiens
auccagggc

SEQ ID NO: 1508455 - RNA, 17 nt, Homo sapiens
auccagugauccucaaa

SEQ ID NO: 1508456 - RNA, 22 nt, Homo sapiens
auccauagugcacuagcauuuu

SEQ ID NO: 1508457 - RNA, 20 nt, Homo sapiens
aucccaaguagaaucucagu

SEQ ID NO: 1508458 - RNA, 21 nt, Homo sapiens
auccccaucccucuacuuucc

SEQ ID NO: 1508459 - RNA, 18 nt, Homo sapiens
aucccccuugccaaauuc

SEQ ID NO: 1508460 - RNA, 22 nt, Homo sapiens
aucccuucccuguccaccucac

SEQ ID NO: 1508461 - RNA, 23 nt, Homo sapiens
auccuauauuccuaucaguauaa

SEQ ID NO: 1508462 - RNA, 16 nt, Homo sapiens
auccuugauaaaugcc

SEQ ID NO: 1508463 - RNA, 16 nt, Homo sapiens
auccuuuaucaagaag

SEQ ID NO: 1508464 - RNA, 15 nt, Homo sapiens
aucgaggggugcuua

SEQ ID NO: 1508465 - RNA, 15 nt, Homo sapiens
aucuacaagcauuug

SEQ ID NO: 1508466 - RNA, 17 nt, Homo sapiens
aucuaccucacuauuca

SEQ ID NO: 1508467 - RNA, 17 nt, Homo sapiens
aucuacucauugucuca

SEQ ID NO: 1508468 - RNA, 14 nt, Homo sapiens
aucuagauuuuccu

SEQ ID NO: 1508469 - RNA, 16 nt, Homo sapiens
aucuagucacaaagac

SEQ ID NO: 1508470 - RNA, 14 nt, Homo sapiens
aucuaguucucaau

SEQ ID NO: 1508471 - RNA, 19 nt, Homo sapiens
aucuaguucucaaucacug

SEQ ID NO: 1508472 - RNA, 13 nt, Homo sapiens
aucuccaguggga

SEQ ID NO: 1508473 - RNA, 20 nt, Homo sapiens
aucucgcaguacauguuacu

SEQ ID NO: 1508474 - RNA, 16 nt, Homo sapiens
aucucugaaacauauu

SEQ ID NO: 1508475 - RNA, 13 nt, Homo sapiens
aucugaaccacuu

SEQ ID NO: 1508476 - RNA, 16 nt, Homo sapiens
aucugagaaacuuaaa

SEQ ID NO: 1508477 - RNA, 19 nt, Homo sapiens
aucugagagauuugaauag

SEQ ID NO: 1508478 - RNA, 18 nt, Homo sapiens
aucugagcucuuaucuau

SEQ ID NO: 1508479 - RNA, 19 nt, Homo sapiens
aucugcauuucuacauguu

SEQ ID NO: 1508480 - RNA, 16 nt, Homo sapiens
aucugccauugggacc

SEQ ID NO: 1508481 - RNA, 16 nt, Homo sapiens
aucuggguaagaagaa

SEQ ID NO: 1508482 - RNA, 22 nt, Homo sapiens
aucuggguaagaagaaagcaaa

SEQ ID NO: 1508483 - RNA, 20 nt, Homo sapiens
aucuguuuuguuucuugacu

SEQ ID NO: 1508484 - RNA, 17 nt, Homo sapiens
aucuuauaaacugacuu

SEQ ID NO: 1508485 - RNA, 13 nt, Homo sapiens
aucuuauguuaaa

SEQ ID NO: 1508486 - RNA, 15 nt, Homo sapiens
aucuuccccggaugu

SEQ ID NO: 1508487 - RNA, 15 nt, Homo sapiens
aucuuugacugaaaa

SEQ ID NO: 1508488 - RNA, 13 nt, Homo sapiens
augaaaccaaagc

SEQ ID NO: 1508489 - RNA, 18 nt, Homo sapiens
augaacacagcugcugaa

SEQ ID NO: 1508490 - RNA, 12 nt, Homo sapiens
augaacuuucuc

SEQ ID NO: 1508491 - RNA, 20 nt, Homo sapiens
augaauagcgaaucaucuca

SEQ ID NO: 1508492 - RNA, 15 nt, Homo sapiens
augaaugacaacauu

SEQ ID NO: 1508493 - RNA, 15 nt, Homo sapiens
augaaugaguaggaa

SEQ ID NO: 1508494 - RNA, 11 nt, Homo sapiens
augaauucuua

SEQ ID NO: 1508495 - RNA, 12 nt, Homo sapiens
augacauguuau

SEQ ID NO: 1508496 - RNA, 13 nt, Homo sapiens
augacuuuuccau

SEQ ID NO: 1508497 - RNA, 22 nt, Homo sapiens
augagaauaauucuuuccaugc

SEQ ID NO: 1508498 - RNA, 22 nt, Homo sapiens
augagcaauucuccugccucag

SEQ ID NO: 1508499 - RNA, 14 nt, Homo sapiens
augagugaucucaa

SEQ ID NO: 1508500 - RNA, 14 nt, Homo sapiens
augaucauuucuca

SEQ ID NO: 1508501 - RNA, 16 nt, Homo sapiens
augauuaauacaauau

SEQ ID NO: 1508502 - RNA, 19 nt, Homo sapiens
augauucagaaauuuucau

SEQ ID NO: 1508503 - RNA, 11 nt, Homo sapiens
augauuuuccu

SEQ ID NO: 1508504 - RNA, 18 nt, Homo sapiens
augauuuuccucccuggu

SEQ ID NO: 1508505 - RNA, 12 nt, Homo sapiens
augauuuuuaca

SEQ ID NO: 1508506 - RNA, 16 nt, Homo sapiens
augcaaaagucuuccu

SEQ ID NO: 1508507 - RNA, 13 nt, Homo sapiens
augcaagcacaaa

SEQ ID NO: 1508508 - RNA, 14 nt, Homo sapiens
augcaagcacaaau

SEQ ID NO: 1508509 - RNA, 12 nt, Homo sapiens
augcaagucaug

SEQ ID NO: 1508510 - RNA, 12 nt, Homo sapiens
augcacauguaa

SEQ ID NO: 1508511 - RNA, 11 nt, Homo sapiens
augcaccucag

SEQ ID NO: 1508512 - RNA, 17 nt, Homo sapiens
augcagaagugcaugaa

SEQ ID NO: 1508513 - RNA, 13 nt, Homo sapiens
augcaucaucagc

SEQ ID NO: 1508514 - RNA, 16 nt, Homo sapiens
augccacuauaguuua

SEQ ID NO: 1508515 - RNA, 19 nt, Homo sapiens
augccuaauauuuaggcaa

SEQ ID NO: 1508516 - RNA, 13 nt, Homo sapiens
augccucaagaac

SEQ ID NO: 1508517 - RNA, 21 nt, Homo sapiens
augccuuucuguaaccaaaaa

SEQ ID NO: 1508518 - RNA, 22 nt, Homo sapiens
augccuuuucccaaaauguuga

SEQ ID NO: 1508519 - RNA, 16 nt, Homo sapiens
augcugucaugguccu

SEQ ID NO: 1508520 - RNA, 21 nt, Homo sapiens
augcuguuuuaaaaacaaaga

SEQ ID NO: 1508521 - RNA, 15 nt, Homo sapiens
auggaauaaaccauu

SEQ ID NO: 1508522 - RNA, 16 nt, Homo sapiens
auggaauaaagcccuu

SEQ ID NO: 1508523 - RNA, 23 nt, Homo sapiens
auggacaccccuuauccaggacu

SEQ ID NO: 1508524 - RNA, 15 nt, Homo sapiens
auggagaccgugacc

SEQ ID NO: 1508525 - RNA, 16 nt, Homo sapiens
auggagagguuuguca

SEQ ID NO: 1508526 - RNA, 24 nt, Homo sapiens
auggagagguuugucaacacaaag

SEQ ID NO: 1508527 - RNA, 18 nt, Homo sapiens
auggagggagccaucccu

SEQ ID NO: 1508528 - RNA, 20 nt, Homo sapiens
auggcaaaagguugacucau

SEQ ID NO: 1508529 - RNA, 23 nt, Homo sapiens
auggcauugaacugguucaugaa

SEQ ID NO: 1508530 - RNA, 18 nt, Homo sapiens
auggcucuggcaccacua

SEQ ID NO: 1508531 - RNA, 13 nt, Homo sapiens
auggggcuugccc

SEQ ID NO: 1508532 - RNA, 15 nt, Homo sapiens
augguaagacuguaa

SEQ ID NO: 1508533 - RNA, 19 nt, Homo sapiens
augguaagcauuagcacau

SEQ ID NO: 1508534 - RNA, 15 nt, Homo sapiens
augguacucuaauca

SEQ ID NO: 1508535 - RNA, 21 nt, Homo sapiens
augguccuggggcucugugca

SEQ ID NO: 1508536 - RNA, 14 nt, Homo sapiens
augguccugugaug

SEQ ID NO: 1508537 - RNA, 14 nt, Homo sapiens
auggugcaaaaaug

SEQ ID NO: 1508538 - RNA, 20 nt, Homo sapiens
auggugcucacgacucuucc

SEQ ID NO: 1508539 - RNA, 21 nt, Homo sapiens
augguguguuccuaacauaaa

SEQ ID NO: 1508540 - RNA, 19 nt, Homo sapiens
augguuucuuuaaaaccau

SEQ ID NO: 1508541 - RNA, 21 nt, Homo sapiens
augguuuucuccaagagcuac

SEQ ID NO: 1508542 - RNA, 12 nt, Homo sapiens
auguaaagccau

SEQ ID NO: 1508543 - RNA, 13 nt, Homo sapiens
auguaaagccaug

SEQ ID NO: 1508544 - RNA, 15 nt, Homo sapiens
auguaaauacaucaa

SEQ ID NO: 1508545 - RNA, 19 nt, Homo sapiens
auguacucaaguaccacca

SEQ ID NO: 1508546 - RNA, 13 nt, Homo sapiens
auguauaaauguu

SEQ ID NO: 1508547 - RNA, 22 nt, Homo sapiens
auguaucuaccucacuauucaa

SEQ ID NO: 1508548 - RNA, 19 nt, Homo sapiens
auguauggaugaaagcaau

SEQ ID NO: 1508549 - RNA, 21 nt, Homo sapiens
auguauuuauauuuugugcua

SEQ ID NO: 1508550 - RNA, 23 nt, Homo sapiens
augucaaguaccaaaauguuaau

SEQ ID NO: 1508551 - RNA, 13 nt, Homo sapiens
augucaguucaua

SEQ ID NO: 1508552 - RNA, 13 nt, Homo sapiens
augucaucaaaua

SEQ ID NO: 1508553 - RNA, 21 nt, Homo sapiens
augucaucaaauauuaccaaa

SEQ ID NO: 1508554 - RNA, 12 nt, Homo sapiens
augucauuacaa

SEQ ID NO: 1508555 - RNA, 22 nt, Homo sapiens
auguccaauggaguucagagau

SEQ ID NO: 1508556 - RNA, 18 nt, Homo sapiens
augucccuucucaugccu

SEQ ID NO: 1508557 - RNA, 15 nt, Homo sapiens
augucgaacucugaa

SEQ ID NO: 1508558 - RNA, 15 nt, Homo sapiens
augucuauuugcaca

SEQ ID NO: 1508559 - RNA, 23 nt, Homo sapiens
augucugauuuaacacuauccaa

SEQ ID NO: 1508560 - RNA, 14 nt, Homo sapiens
augugaacugcuga

SEQ ID NO: 1508561 - RNA, 15 nt, Homo sapiens
augugcuucacauaa

SEQ ID NO: 1508562 - RNA, 22 nt, Homo sapiens
auguguauugaagaaaagcacu

SEQ ID NO: 1508563 - RNA, 15 nt, Homo sapiens
auguuacugugugaa

SEQ ID NO: 1508564 - RNA, 16 nt, Homo sapiens
auguuacugugugaag

SEQ ID NO: 1508565 - RNA, 14 nt, Homo sapiens
auguuccucaaaag

SEQ ID NO: 1508566 - RNA, 20 nt, Homo sapiens
auuaaacagacuuuagcuua

SEQ ID NO: 1508567 - RNA, 21 nt, Homo sapiens
auuaacuaugugauguuaacu

SEQ ID NO: 1508568 - RNA, 17 nt, Homo sapiens
auuaagaaucauugugc

SEQ ID NO: 1508569 - RNA, 17 nt, Homo sapiens
auuaagagugaaugugu

SEQ ID NO: 1508570 - RNA, 14 nt, Homo sapiens
auuaaguggcuuuu

SEQ ID NO: 1508571 - RNA, 21 nt, Homo sapiens
auuaagugggguagacugagg

SEQ ID NO: 1508572 - RNA, 15 nt, Homo sapiens
cagauagcugaauga

SEQ ID NO: 1508573 - RNA, 16 nt, Homo sapiens
cagaucaaaugugaaa

SEQ ID NO: 1508574 - RNA, 14 nt, Homo sapiens
cagauccucacaac

SEQ ID NO: 1508575 - RNA, 17 nt, Homo sapiens
cagaucuagucaaucaa

SEQ ID NO: 1508576 - RNA, 16 nt, Homo sapiens
cagaucugcacugggu

SEQ ID NO: 1508577 - RNA, 17 nt, Homo sapiens
cagaugugaaccauuaa

SEQ ID NO: 1508578 - RNA, 15 nt, Homo sapiens
cagauuaccaaagaa

SEQ ID NO: 1508579 - RNA, 22 nt, Homo sapiens
cagcaaucaacugagguuucuu

SEQ ID NO: 1508580 - RNA, 16 nt, Homo sapiens
cagcagaggacagucu

SEQ ID NO: 1508581 - RNA, 17 nt, Homo sapiens
cagcagcugaacagcca

SEQ ID NO: 1508582 - RNA, 21 nt, Homo sapiens
cagcagggucuugcuguaacu

SEQ ID NO: 1508583 - RNA, 11 nt, Homo sapiens
cagcaucaggg

SEQ ID NO: 1508584 - RNA, 11 nt, Homo sapiens
cagcauugcag

SEQ ID NO: 1508585 - RNA, 18 nt, Homo sapiens
cagccucccgaguagcug

SEQ ID NO: 1508586 - RNA, 19 nt, Homo sapiens
cagccucccgaguagcuga

SEQ ID NO: 1508587 - RNA, 21 nt, Homo sapiens
cagccugaccaacauggugaa

SEQ ID NO: 1508588 - RNA, 19 nt, Homo sapiens
cagccugggcgacagagca

SEQ ID NO: 1508589 - RNA, 15 nt, Homo sapiens
cagccuguuuagcca

SEQ ID NO: 1508590 - RNA, 22 nt, Homo sapiens
cagccuugcaucaagggcuuua

SEQ ID NO: 1508591 - RNA, 23 nt, Homo sapiens
cagcgagaggcagagaaagaaga

SEQ ID NO: 1508592 - RNA, 14 nt, Homo sapiens
cagcgcgugcacag

SEQ ID NO: 1508593 - RNA, 22 nt, Homo sapiens
cagcguucauguucugugauag

SEQ ID NO: 1508594 - RNA, 21 nt, Homo sapiens
cagcuaugcacuguaaaugca

SEQ ID NO: 1508595 - RNA, 20 nt, Homo sapiens
cagcucacugguccauuucu

SEQ ID NO: 1508596 - RNA, 18 nt, Homo sapiens
cagcugcagaugccacac

SEQ ID NO: 1508597 - RNA, 20 nt, Homo sapiens
cagcugcggcaucccugugu

SEQ ID NO: 1508598 - RNA, 13 nt, Homo sapiens
cagcugucauuca

SEQ ID NO: 1508599 - RNA, 17 nt, Homo sapiens
cagcugucgcaucucag

SEQ ID NO: 1508600 - RNA, 14 nt, Homo sapiens
caggaaaccacuua

SEQ ID NO: 1508601 - RNA, 24 nt, Homo sapiens
caggaacuggcuccuuugccucug

SEQ ID NO: 1508602 - RNA, 16 nt, Homo sapiens
caggaagaugaaagag

SEQ ID NO: 1508603 - RNA, 13 nt, Homo sapiens
caggaaucugcca

SEQ ID NO: 1508604 - RNA, 20 nt, Homo sapiens
caggaauggggauccaguua

SEQ ID NO: 1508605 - RNA, 22 nt, Homo sapiens
caggacccugucaggauugcag

SEQ ID NO: 1508606 - RNA, 15 nt, Homo sapiens
caggauacucuguca

SEQ ID NO: 1508607 - RNA, 23 nt, Homo sapiens
caggaucuguacaauaauaauua

SEQ ID NO: 1508608 - RNA, 21 nt, Homo sapiens
caggauggggacacuaaugaa

SEQ ID NO: 1508609 - RNA, 18 nt, Homo sapiens
caggaugguuucuuuaaa

SEQ ID NO: 1508610 - RNA, 22 nt, Homo sapiens
caggauuucaucugagugugga

SEQ ID NO: 1508611 - RNA, 15 nt, Homo sapiens
caggcagacacagcu

SEQ ID NO: 1508612 - RNA, 12 nt, Homo sapiens
caggcaggccac

SEQ ID NO: 1508613 - RNA, 19 nt, Homo sapiens
caggcauugaaugacaagc

SEQ ID NO: 1508614 - RNA, 16 nt, Homo sapiens
caggcucauaugcguc

SEQ ID NO: 1508615 - RNA, 18 nt, Homo sapiens
cagggaauuaaugacaga

SEQ ID NO: 1508616 - RNA, 23 nt, Homo sapiens
cagggagcaguugcccucaggcc

SEQ ID NO: 1508617 - RNA, 22 nt, Homo sapiens
cagggucccuggaucaggguug

SEQ ID NO: 1508618 - RNA, 16 nt, Homo sapiens
cagggucuugcuguaa

SEQ ID NO: 1508619 - RNA, 21 nt, Homo sapiens
cagggugaauaaagcagggaa

SEQ ID NO: 1508620 - RNA, 14 nt, Homo sapiens
cagguaaguggcag

SEQ ID NO: 1508621 - RNA, 15 nt, Homo sapiens
cagguaaugagggac

SEQ ID NO: 1508622 - RNA, 19 nt, Homo sapiens
cagguaggggcacagugaa

SEQ ID NO: 1508623 - RNA, 13 nt, Homo sapiens
cagguaguacugg

SEQ ID NO: 1508624 - RNA, 21 nt, Homo sapiens
cagguauuuuaacugugugaa

SEQ ID NO: 1508625 - RNA, 16 nt, Homo sapiens
cagguccaggccagug

SEQ ID NO: 1508626 - RNA, 23 nt, Homo sapiens
caggugguuuuugguuacaugga

SEQ ID NO: 1508627 - RNA, 17 nt, Homo sapiens
cagguguuggaagccag

SEQ ID NO: 1508628 - RNA, 20 nt, Homo sapiens
caguauauuuauagucacaa

SEQ ID NO: 1508629 - RNA, 11 nt, Homo sapiens
cagucaucuca

SEQ ID NO: 1508630 - RNA, 14 nt, Homo sapiens
cagucaucucauga

SEQ ID NO: 1508631 - RNA, 17 nt, Homo sapiens
cagucccccaacuaccc

SEQ ID NO: 1508632 - RNA, 23 nt, Homo sapiens
caguccugggagaaccucaggcu

SEQ ID NO: 1508633 - RNA, 21 nt, Homo sapiens
cagucucugagcaccagggag

SEQ ID NO: 1508634 - RNA, 13 nt, Homo sapiens
cagugaagacaga

SEQ ID NO: 1508635 - RNA, 22 nt, Homo sapiens
cagugaauguguguauguauga

SEQ ID NO: 1508636 - RNA, 16 nt, Homo sapiens
cagugacaaguagggc

SEQ ID NO: 1508637 - RNA, 17 nt, Homo sapiens
cagugacgugcaccugu

SEQ ID NO: 1508638 - RNA, 15 nt, Homo sapiens
cagugcgcuguagua

SEQ ID NO: 1508639 - RNA, 13 nt, Homo sapiens
cagugcuaccucu

SEQ ID NO: 1508640 - RNA, 23 nt, Homo sapiens
caguggaaaaaucagaagcacaa

SEQ ID NO: 1508641 - RNA, 16 nt, Homo sapiens
caguguuugcaauggu

SEQ ID NO: 1508642 - RNA, 19 nt, Homo sapiens
caguguuugcaaugguguu

SEQ ID NO: 1508643 - RNA, 23 nt, Homo sapiens
caguugacuuacuguuucuuacc

SEQ ID NO: 1508644 - RNA, 13 nt, Homo sapiens
caguuguaaaauu

SEQ ID NO: 1508645 - RNA, 15 nt, Homo sapiens
cauaacuaguuuaau

SEQ ID NO: 1508646 - RNA, 17 nt, Homo sapiens
cauaacuaguuuaauua

SEQ ID NO: 1508647 - RNA, 20 nt, Homo sapiens
cauaauugcuuugccaaaau

SEQ ID NO: 1508648 - RNA, 17 nt, Homo sapiens
cauacacucaaacaauc

SEQ ID NO: 1508649 - RNA, 14 nt, Homo sapiens
cauacauugccaau

SEQ ID NO: 1508650 - RNA, 21 nt, Homo sapiens
cauagagggagaggaagcaca

SEQ ID NO: 1508651 - RNA, 20 nt, Homo sapiens
cauaguggccuuguccaaug

SEQ ID NO: 1508652 - RNA, 12 nt, Homo sapiens
caucacaacauu

SEQ ID NO: 1508653 - RNA, 18 nt, Homo sapiens
caucaguagcugagugca

SEQ ID NO: 1508654 - RNA, 16 nt, Homo sapiens
cauccaagcaaacuga

SEQ ID NO: 1508655 - RNA, 17 nt, Homo sapiens
cauccaagcaaacugaa

SEQ ID NO: 1508656 - RNA, 22 nt, Homo sapiens
cauccauagugcacuagcauuu

SEQ ID NO: 1508657 - RNA, 13 nt, Homo sapiens
cauccccuacacu

SEQ ID NO: 1508658 - RNA, 16 nt, Homo sapiens
cauccggcuccuguca

SEQ ID NO: 1508659 - RNA, 13 nt, Homo sapiens
cauccuucaucug

SEQ ID NO: 1508660 - RNA, 22 nt, Homo sapiens
caucguguuugcaaagguuaaa

SEQ ID NO: 1508661 - RNA, 16 nt, Homo sapiens
caucuacaagcauuug

SEQ ID NO: 1508662 - RNA, 21 nt, Homo sapiens
caucucacuuugccccaguua

SEQ ID NO: 1508663 - RNA, 14 nt, Homo sapiens
caucugaaccacuu

SEQ ID NO: 1508664 - RNA, 22 nt, Homo sapiens
caucuuauaaacugacuucuuu

SEQ ID NO: 1508665 - RNA, 11 nt, Homo sapiens
caucuuccuag

SEQ ID NO: 1508666 - RNA, 16 nt, Homo sapiens
caucuuuugaaacaga

SEQ ID NO: 1508667 - RNA, 13 nt, Homo sapiens
caugaagaccaca

SEQ ID NO: 1508668 - RNA, 19 nt, Homo sapiens
caugaagguagguaaauag

SEQ ID NO: 1508669 - RNA, 14 nt, Homo sapiens
caugaauauuucaa

SEQ ID NO: 1508670 - RNA, 21 nt, Homo sapiens
caugagagaauuguaucauuu

SEQ ID NO: 1508671 - RNA, 14 nt, Homo sapiens
caugauggugcuga

SEQ ID NO: 1508672 - RNA, 19 nt, Homo sapiens
caugccacccuguuuucag

SEQ ID NO: 1508673 - RNA, 13 nt, Homo sapiens
caugcuggggcaa

SEQ ID NO: 1508674 - RNA, 17 nt, Homo sapiens
caugcuucagugcugcu

SEQ ID NO: 1508675 - RNA, 20 nt, Homo sapiens
cauggaagauuagagguuug

SEQ ID NO: 1508676 - RNA, 16 nt, Homo sapiens
cauggaauaaaccauu

SEQ ID NO: 1508677 - RNA, 14 nt, Homo sapiens
cauggccacaaagg

SEQ ID NO: 1508678 - RNA, 16 nt, Homo sapiens
caugguuuuacaguga

SEQ ID NO: 1508679 - RNA, 17 nt, Homo sapiens
caugguuuuacagugaa

SEQ ID NO: 1508680 - RNA, 23 nt, Homo sapiens
cauguagauuuuaguucacuaaa

SEQ ID NO: 1508681 - RNA, 15 nt, Homo sapiens
cauguccaaguccaa

SEQ ID NO: 1508682 - RNA, 15 nt, Homo sapiens
caugucucaauagua

SEQ ID NO: 1508683 - RNA, 17 nt, Homo sapiens
caugucucaauaguaaa

SEQ ID NO: 1508684 - RNA, 13 nt, Homo sapiens
caugucucacaga

SEQ ID NO: 1508685 - RNA, 18 nt, Homo sapiens
caugugacuuuuaucugu

SEQ ID NO: 1508686 - RNA, 19 nt, Homo sapiens
cauguguuaguguauguga

SEQ ID NO: 1508687 - RNA, 18 nt, Homo sapiens
cauguuauccacaagcaa

SEQ ID NO: 1508688 - RNA, 12 nt, Homo sapiens
cauuacugcaua

SEQ ID NO: 1508689 - RNA, 20 nt, Homo sapiens
cauuauucucugaugcacug

SEQ ID NO: 1508690 - RNA, 14 nt, Homo sapiens
cauucacagcccag

SEQ ID NO: 1508691 - RNA, 23 nt, Homo sapiens
cauucagaagaaaaagaagcaac

SEQ ID NO: 1508692 - RNA, 19 nt, Homo sapiens
cauucaggguuauacacag

SEQ ID NO: 1508693 - RNA, 11 nt, Homo sapiens
cauucaucuca

SEQ ID NO: 1508694 - RNA, 19 nt, Homo sapiens
cauuccaaggguaugggaa

SEQ ID NO: 1508695 - RNA, 11 nt, Homo sapiens
cauucugacca

SEQ ID NO: 1508696 - RNA, 20 nt, Homo sapiens
cauucuguuuuuucuguaca

SEQ ID NO: 1508697 - RNA, 21 nt, Homo sapiens
cauucuguuuuuucuguacac

SEQ ID NO: 1508698 - RNA, 13 nt, Homo sapiens
cauugaauuugcc

SEQ ID NO: 1508699 - RNA, 19 nt, Homo sapiens
cauugacucuguggcuuug

SEQ ID NO: 1508700 - RNA, 19 nt, Homo sapiens
cauugaugaacugccaaag

SEQ ID NO: 1508701 - RNA, 17 nt, Homo sapiens
cauugcuucugcuaaau

SEQ ID NO: 1508702 - RNA, 16 nt, Homo sapiens
cauuggcuacuauggc

SEQ ID NO: 1508703 - RNA, 19 nt, Homo sapiens
cauuggguuguagccaaag

SEQ ID NO: 1508704 - RNA, 21 nt, Homo sapiens
cauugugacuauccagugauc

SEQ ID NO: 1508705 - RNA, 12 nt, Homo sapiens
cauuuacuuaac

SEQ ID NO: 1508706 - RNA, 16 nt, Homo sapiens
cauuucuauagccaaa

SEQ ID NO: 1508707 - RNA, 13 nt, Homo sapiens
ucacacucagaaa

SEQ ID NO: 1508708 - RNA, 18 nt, Homo sapiens
ucacagaggcaguaggaa

SEQ ID NO: 1508709 - RNA, 22 nt, Homo sapiens
ucaccaggggugcuaugacaug

SEQ ID NO: 1508710 - RNA, 14 nt, Homo sapiens
ucaccgugagcagc

SEQ ID NO: 1508711 - RNA, 17 nt, Homo sapiens
ucaccuuggagccugaa

SEQ ID NO: 1508712 - RNA, 13 nt, Homo sapiens
ucacgacucuucc

SEQ ID NO: 1508713 - RNA, 15 nt, Homo sapiens
ucacgaugaaauuga

SEQ ID NO: 1508714 - RNA, 23 nt, Homo sapiens
ucacuaaagggugcccacaaaau

SEQ ID NO: 1508715 - RNA, 14 nt, Homo sapiens
ucacuaauacuaau

SEQ ID NO: 1508716 - RNA, 14 nt, Homo sapiens
ucacuagacugugc

SEQ ID NO: 1508717 - RNA, 14 nt, Homo sapiens
ucacucaagccuga

SEQ ID NO: 1508718 - RNA, 17 nt, Homo sapiens
ucacucagccacacccc

SEQ ID NO: 1508719 - RNA, 20 nt, Homo sapiens
ucacuccauuccuaggucac

SEQ ID NO: 1508720 - RNA, 18 nt, Homo sapiens
ucacugaguuuuccaugg

SEQ ID NO: 1508721 - RNA, 14 nt, Homo sapiens
ucacugcugucagc

SEQ ID NO: 1508722 - RNA, 19 nt, Homo sapiens
ucacuguuguacacagucu

SEQ ID NO: 1508723 - RNA, 17 nt, Homo sapiens
ucacuucauacuucuaa

SEQ ID NO: 1508724 - RNA, 22 nt, Homo sapiens
ucacuugaagccaaacuguugg

SEQ ID NO: 1508725 - RNA, 21 nt, Homo sapiens
ucagaaaauggggcuugcccu

SEQ ID NO: 1508726 - RNA, 22 nt, Homo sapiens
ucagaagaagaugcugugaaca

SEQ ID NO: 1508727 - RNA, 13 nt, Homo sapiens
ucagaagccugag

SEQ ID NO: 1508728 - RNA, 23 nt, Homo sapiens
ucagaaucagguugacagucccu

SEQ ID NO: 1508729 - RNA, 16 nt, Homo sapiens
ucagaccaguacuggg

SEQ ID NO: 1508730 - RNA, 17 nt, Homo sapiens
ucagaccaguacuggga

SEQ ID NO: 1508731 - RNA, 21 nt, Homo sapiens
ucagacugcugggacuggcca

SEQ ID NO: 1508732 - RNA, 21 nt, Homo sapiens
ucagagagccuagaacauccc

SEQ ID NO: 1508733 - RNA, 15 nt, Homo sapiens
ucagaggaagcacau

SEQ ID NO: 1508734 - RNA, 12 nt, Homo sapiens
ucagagugccac

SEQ ID NO: 1508735 - RNA, 23 nt, Homo sapiens
ucagauaagguaaaaugccauga

SEQ ID NO: 1508736 - RNA, 21 nt, Homo sapiens
ucagaugauucagaaauuuuc

SEQ ID NO: 1508737 - RNA, 19 nt, Homo sapiens
ucagauuacacuucuccag

SEQ ID NO: 1508738 - RNA, 15 nt, Homo sapiens
ucagauuuguguuau

SEQ ID NO: 1508739 - RNA, 20 nt, Homo sapiens
ucagcaccccugucucuagc

SEQ ID NO: 1508740 - RNA, 14 nt, Homo sapiens
ucagcacuguuuca

SEQ ID NO: 1508741 - RNA, 22 nt, Homo sapiens
ucagcccuguguauaaagccau

SEQ ID NO: 1508742 - RNA, 20 nt, Homo sapiens
ucagccucuuaaagcugccu

SEQ ID NO: 1508743 - RNA, 19 nt, Homo sapiens
ucagcuccagaauaccuuc

SEQ ID NO: 1508744 - RNA, 17 nt, Homo sapiens
ucagcugugaacaugga

SEQ ID NO: 1508745 - RNA, 17 nt, Homo sapiens
ucaggagggugcaguau

SEQ ID NO: 1508746 - RNA, 16 nt, Homo sapiens
ucaggccagugcaccc

SEQ ID NO: 1508747 - RNA, 22 nt, Homo sapiens
ucagguuugaggguuugcagaa

SEQ ID NO: 1508748 - RNA, 17 nt, Homo sapiens
ucaguggcuucuccauc

SEQ ID NO: 1508749 - RNA, 15 nt, Homo sapiens
ucauaaccauuccca

SEQ ID NO: 1508750 - RNA, 18 nt, Homo sapiens
ucauaacugguagcuaua

SEQ ID NO: 1508751 - RNA, 19 nt, Homo sapiens
ucauaacugguagcuauaa

SEQ ID NO: 1508752 - RNA, 16 nt, Homo sapiens
ucauaauccagagaua

SEQ ID NO: 1508753 - RNA, 20 nt, Homo sapiens
ucauaugaaaaaaaugcauu

SEQ ID NO: 1508754 - RNA, 15 nt, Homo sapiens
ucaucacugugccuu

SEQ ID NO: 1508755 - RNA, 14 nt, Homo sapiens
ucaucaggucauua

SEQ ID NO: 1508756 - RNA, 20 nt, Homo sapiens
ucaucuacaagcauuugccc

SEQ ID NO: 1508757 - RNA, 15 nt, Homo sapiens
ucaugcaaucuuccu

SEQ ID NO: 1508758 - RNA, 23 nt, Homo sapiens
ucaugucauugaugaacugccaa

SEQ ID NO: 1508759 - RNA, 15 nt, Homo sapiens
ucauguucugugaua

SEQ ID NO: 1508760 - RNA, 18 nt, Homo sapiens
ucauuacuaaccauaguu

SEQ ID NO: 1508761 - RNA, 16 nt, Homo sapiens
ucauuauuuuuuacaa

SEQ ID NO: 1508762 - RNA, 22 nt, Homo sapiens
ucauuauuuuuuacaauggcca

SEQ ID NO: 1508763 - RNA, 20 nt, Homo sapiens
ucauucagguauuuguaaua

SEQ ID NO: 1508764 - RNA, 15 nt, Homo sapiens
ucauuucuacuguga

SEQ ID NO: 1508765 - RNA, 13 nt, Homo sapiens
ucauuugaacaac

SEQ ID NO: 1508766 - RNA, 19 nt, Homo sapiens
uccaacagugagucuguca

SEQ ID NO: 1508767 - RNA, 19 nt, Homo sapiens
uccaaccugccugugcaug

SEQ ID NO: 1508768 - RNA, 20 nt, Homo sapiens
uccaaccugccugugcauga

SEQ ID NO: 1508769 - RNA, 22 nt, Homo sapiens
uccaagaauguuguuagcuuuu

SEQ ID NO: 1508770 - RNA, 18 nt, Homo sapiens
uccaaggaguuccaugaa

SEQ ID NO: 1508771 - RNA, 16 nt, Homo sapiens
uccaagucuagcuuuc

SEQ ID NO: 1508772 - RNA, 19 nt, Homo sapiens
uccaagucuagcuuuccuu

SEQ ID NO: 1508773 - RNA, 19 nt, Homo sapiens
uccaaguuccugcacucca

SEQ ID NO: 1508774 - RNA, 15 nt, Homo sapiens
uccaauaggcauuug

SEQ ID NO: 1508775 - RNA, 17 nt, Homo sapiens
uccaauaggcauuugau

SEQ ID NO: 1508776 - RNA, 17 nt, Homo sapiens
uccaauauuggagcaua

SEQ ID NO: 1508777 - RNA, 15 nt, Homo sapiens
uccacccagcaaaga

SEQ ID NO: 1508778 - RNA, 18 nt, Homo sapiens
uccaccgcagaaggaagg

SEQ ID NO: 1508779 - RNA, 15 nt, Homo sapiens
uccacgcacacaugg

SEQ ID NO: 1508780 - RNA, 13 nt, Homo sapiens
uccagaugccuuc

SEQ ID NO: 1508781 - RNA, 21 nt, Homo sapiens
uccagcacucccucccagaga

SEQ ID NO: 1508782 - RNA, 19 nt, Homo sapiens
uccaggaauaggcauuugc

SEQ ID NO: 1508783 - RNA, 22 nt, Homo sapiens
uccagugauccucaaacacaca

SEQ ID NO: 1508784 - RNA, 19 nt, Homo sapiens
uccaguuucccaccaccuu

SEQ ID NO: 1508785 - RNA, 20 nt, Homo sapiens
uccauacagucaagauacau

SEQ ID NO: 1508786 - RNA, 21 nt, Homo sapiens
uccauagugcacuagcauuuu

SEQ ID NO: 1508787 - RNA, 16 nt, Homo sapiens
uccauccccaaacugu

SEQ ID NO: 1508788 - RNA, 14 nt, Homo sapiens
uccaugauacuuua

SEQ ID NO: 1508789 - RNA, 15 nt, Homo sapiens
uccaugauacuuuaa

SEQ ID NO: 1508790 - RNA, 16 nt, Homo sapiens
uccaugauacuuuaau

SEQ ID NO: 1508791 - RNA, 20 nt, Homo sapiens
uccauggcaggaaggcuugu

SEQ ID NO: 1508792 - RNA, 13 nt, Homo sapiens
uccauucaucuca

SEQ ID NO: 1508793 - RNA, 22 nt, Homo sapiens
uccauuuauugcacucagcuuu

SEQ ID NO: 1508794 - RNA, 18 nt, Homo sapiens
uccauuuuacuuccauga

SEQ ID NO: 1508795 - RNA, 10 nt, Homo sapiens
ucccaaagaa

SEQ ID NO: 1508796 - RNA, 18 nt, Homo sapiens
ucccaaguagaaucucag

SEQ ID NO: 1508797 - RNA, 22 nt, Homo sapiens
ucccaauauguagccuuuuauc

SEQ ID NO: 1508798 - RNA, 20 nt, Homo sapiens
ucccacgacuguuguacaag

SEQ ID NO: 1508799 - RNA, 21 nt, Homo sapiens
ucccacugccccugcaccugc

SEQ ID NO: 1508800 - RNA, 17 nt, Homo sapiens
ucccagccacucgggag

SEQ ID NO: 1508801 - RNA, 13 nt, Homo sapiens
ucccagcuacuca

SEQ ID NO: 1508802 - RNA, 23 nt, Homo sapiens
ucccaguguguguuuaacauuca

SEQ ID NO: 1508803 - RNA, 17 nt, Homo sapiens
uccccaaaggcauccau

SEQ ID NO: 1508804 - RNA, 21 nt, Homo sapiens
uccccaagcuggcagcuguca

SEQ ID NO: 1508805 - RNA, 20 nt, Homo sapiens
uccccaguugccgucuagga

SEQ ID NO: 1508806 - RNA, 12 nt, Homo sapiens
uccccaucucag

SEQ ID NO: 1508807 - RNA, 11 nt, Homo sapiens
uccccuguggu

SEQ ID NO: 1508808 - RNA, 22 nt, Homo sapiens
ucccuacuuccucugcaaaaag

SEQ ID NO: 1508809 - RNA, 20 nt, Homo sapiens
ucccucccagagaacagggg

SEQ ID NO: 1508810 - RNA, 20 nt, Homo sapiens
ucccuccuucccuucucucc

SEQ ID NO: 1508811 - RNA, 17 nt, Homo sapiens
ucccuuggcagaguaug

SEQ ID NO: 1508812 - RNA, 16 nt, Homo sapiens
uccgacugcuagggag

SEQ ID NO: 1508813 - RNA, 14 nt, Homo sapiens
uccgccaaacacuc

SEQ ID NO: 1508814 - RNA, 15 nt, Homo sapiens
uccuaaccacaagau

SEQ ID NO: 1508815 - RNA, 23 nt, Homo sapiens
uccuaagccuguugcugaaguca

SEQ ID NO: 1508816 - RNA, 19 nt, Homo sapiens
uccuaaugguuugggagca

SEQ ID NO: 1508817 - RNA, 21 nt, Homo sapiens
uccucaaacacacaaacuauu

SEQ ID NO: 1508818 - RNA, 19 nt, Homo sapiens
uccucagguaguacuggga

SEQ ID NO: 1508819 - RNA, 16 nt, Homo sapiens
uccucgguacucccau

SEQ ID NO: 1508820 - RNA, 14 nt, Homo sapiens
uccucugaagggaa

SEQ ID NO: 1508821 - RNA, 13 nt, Homo sapiens
uccucugcugcuc

SEQ ID NO: 1508822 - RNA, 10 nt, Homo sapiens
uccucugugc

SEQ ID NO: 1508823 - RNA, 18 nt, Homo sapiens
uccugagaaugaaugagu

SEQ ID NO: 1508824 - RNA, 23 nt, Homo sapiens
uccugagaaugaaugaguaggaa

SEQ ID NO: 1508825 - RNA, 19 nt, Homo sapiens
uccugagucugggcaauga

SEQ ID NO: 1508826 - RNA, 15 nt, Homo sapiens
uccugcaccgagaga

SEQ ID NO: 1508827 - RNA, 11 nt, Homo sapiens
uccugcacugu

SEQ ID NO: 1508828 - RNA, 18 nt, Homo sapiens
uccugcagaaagcuuuau

SEQ ID NO: 1508829 - RNA, 18 nt, Homo sapiens
uccugccauucuucuggu

SEQ ID NO: 1508830 - RNA, 18 nt, Homo sapiens
uccugccuccagcacucc

SEQ ID NO: 1508831 - RNA, 19 nt, Homo sapiens
uccugccuccagcacuccc

SEQ ID NO: 1508832 - RNA, 22 nt, Homo sapiens
uccugcuacacaaaagccaaaa

SEQ ID NO: 1508833 - RNA, 22 nt, Homo sapiens
uccuggggagcuucacaaacau

SEQ ID NO: 1508834 - RNA, 21 nt, Homo sapiens
uccugggggcccauucugcau

SEQ ID NO: 1508835 - RNA, 23 nt, Homo sapiens
uccugguuuucucuuacugcagu

SEQ ID NO: 1508836 - RNA, 15 nt, Homo sapiens
uccugugcuacuuug

SEQ ID NO: 1508837 - RNA, 12 nt, Homo sapiens
uccuguguacag

SEQ ID NO: 1508838 - RNA, 19 nt, Homo sapiens
uccuuaauagccauaugca

SEQ ID NO: 1508839 - RNA, 18 nt, Homo sapiens
uccuugaccacuggcccu

SEQ ID NO: 1508840 - RNA, 14 nt, Homo sapiens
uccuugucacugaa

SEQ ID NO: 1508841 - RNA, 12 nt, Homo sapiens
ugggaagccaua

SEQ ID NO: 1508842 - RNA, 23 nt, Homo sapiens
ugggaagccauauucacaccuca

SEQ ID NO: 1508843 - RNA, 14 nt, Homo sapiens
ugggaccugaauga

SEQ ID NO: 1508844 - RNA, 16 nt, Homo sapiens
ugggagaucagccacg

SEQ ID NO: 1508845 - RNA, 17 nt, Homo sapiens
ugggaggucuccacuga

SEQ ID NO: 1508846 - RNA, 23 nt, Homo sapiens
ugggccaccccuaaucacuauug

SEQ ID NO: 1508847 - RNA, 14 nt, Homo sapiens
ugggccugccaaac

SEQ ID NO: 1508848 - RNA, 16 nt, Homo sapiens
ugggccugguagcaca

SEQ ID NO: 1508849 - RNA, 18 nt, Homo sapiens
ugggcgacagagcaagac

SEQ ID NO: 1508850 - RNA, 16 nt, Homo sapiens
uggggaaaagggcaau

SEQ ID NO: 1508851 - RNA, 20 nt, Homo sapiens
uggggauccaguuagcaaca

SEQ ID NO: 1508852 - RNA, 14 nt, Homo sapiens
uggggcaaagccuc

SEQ ID NO: 1508853 - RNA, 19 nt, Homo sapiens
ugggguccaggucaccagc

SEQ ID NO: 1508854 - RNA, 19 nt, Homo sapiens
uggggucuugcuauauugc

SEQ ID NO: 1508855 - RNA, 16 nt, Homo sapiens
uggguauuuaauaaga

SEQ ID NO: 1508856 - RNA, 22 nt, Homo sapiens
uggguuuugucucugcaucuca

SEQ ID NO: 1508857 - RNA, 18 nt, Homo sapiens
ugguaaaaccccaucucu

SEQ ID NO: 1508858 - RNA, 15 nt, Homo sapiens
ugguaaacauucucu

SEQ ID NO: 1508859 - RNA, 23 nt, Homo sapiens
ugguaacugauuaccugccaauu

SEQ ID NO: 1508860 - RNA, 20 nt, Homo sapiens
ugguaugaacuugaggacac

SEQ ID NO: 1508861 - RNA, 14 nt, Homo sapiens
uggucagagugcca

SEQ ID NO: 1508862 - RNA, 17 nt, Homo sapiens
uggucauggacagauag

SEQ ID NO: 1508863 - RNA, 22 nt, Homo sapiens
ugguccaguuucuagagggcac

SEQ ID NO: 1508864 - RNA, 16 nt, Homo sapiens
ugguccccacagccuc

SEQ ID NO: 1508865 - RNA, 16 nt, Homo sapiens
ugguccugcacugucc

SEQ ID NO: 1508866 - RNA, 20 nt, Homo sapiens
uggucuuauagaaagcacua

SEQ ID NO: 1508867 - RNA, 17 nt, Homo sapiens
uggugacaugugccugu

SEQ ID NO: 1508868 - RNA, 21 nt, Homo sapiens
uggugauuccauuuuacuucc

SEQ ID NO: 1508869 - RNA, 22 nt, Homo sapiens
uggugccauuucugaacuguua

SEQ ID NO: 1508870 - RNA, 21 nt, Homo sapiens
ugguggagucaggaaagacag

SEQ ID NO: 1508871 - RNA, 17 nt, Homo sapiens
uggugggaacauucgag

SEQ ID NO: 1508872 - RNA, 22 nt, Homo sapiens
ugguguugauacgugugugaag

SEQ ID NO: 1508873 - RNA, 21 nt, Homo sapiens
ugguuucauuucuacugugac

SEQ ID NO: 1508874 - RNA, 15 nt, Homo sapiens
uguaaauacagugga

SEQ ID NO: 1508875 - RNA, 15 nt, Homo sapiens
uguaagacucauucc

SEQ ID NO: 1508876 - RNA, 14 nt, Homo sapiens
uguaauaagacuau

SEQ ID NO: 1508877 - RNA, 15 nt, Homo sapiens
uguaauuaacauauc

SEQ ID NO: 1508878 - RNA, 14 nt, Homo sapiens
uguaauugcuacau

SEQ ID NO: 1508879 - RNA, 16 nt, Homo sapiens
uguacacagaaguuua

SEQ ID NO: 1508880 - RNA, 23 nt, Homo sapiens
uguacgguggucuuugaauuaua

SEQ ID NO: 1508881 - RNA, 18 nt, Homo sapiens
uguacucaaguaccacca

SEQ ID NO: 1508882 - RNA, 17 nt, Homo sapiens
uguagacagccuuccag

SEQ ID NO: 1508883 - RNA, 15 nt, Homo sapiens
uguagagucaaucau

SEQ ID NO: 1508884 - RNA, 17 nt, Homo sapiens
uguauccgacucuaagc

SEQ ID NO: 1508885 - RNA, 19 nt, Homo sapiens
uguaucuaccucacuauuc

SEQ ID NO: 1508886 - RNA, 20 nt, Homo sapiens
uguaucuaccucacuauuca

SEQ ID NO: 1508887 - RNA, 18 nt, Homo sapiens
ugucacccugcagagcua

SEQ ID NO: 1508888 - RNA, 22 nt, Homo sapiens
ugucaucaaauauuaccaaaaa

SEQ ID NO: 1508889 - RNA, 23 nt, Homo sapiens
ugucaucaaauauuaccaaaaaa

SEQ ID NO: 1508890 - RNA, 22 nt, Homo sapiens
ugucauugaugaacugccaaag

SEQ ID NO: 1508891 - RNA, 15 nt, Homo sapiens
uguccaaguccaacc

SEQ ID NO: 1508892 - RNA, 21 nt, Homo sapiens
uguccagcgcggcucccgcca

SEQ ID NO: 1508893 - RNA, 16 nt, Homo sapiens
uguccggagaugagau

SEQ ID NO: 1508894 - RNA, 18 nt, Homo sapiens
uguccucucccugccaag

SEQ ID NO: 1508895 - RNA, 21 nt, Homo sapiens
uguccuucuuuaucugugaua

SEQ ID NO: 1508896 - RNA, 13 nt, Homo sapiens
ugucgcaucucag

SEQ ID NO: 1508897 - RNA, 19 nt, Homo sapiens
ugucgccaggcuagagugc

SEQ ID NO: 1508898 - RNA, 16 nt, Homo sapiens
ugucuaaagagcuuua

SEQ ID NO: 1508899 - RNA, 18 nt, Homo sapiens
ugucugcuaucauuauuc

SEQ ID NO: 1508900 - RNA, 21 nt, Homo sapiens
ugucugucuacauuucugcag

SEQ ID NO: 1508901 - RNA, 13 nt, Homo sapiens
ugucuuagcugua

SEQ ID NO: 1508902 - RNA, 22 nt, Homo sapiens
ugucuuguccccucuugaccca

SEQ ID NO: 1508903 - RNA, 19 nt, Homo sapiens
ugugaacauggacucuucc

SEQ ID NO: 1508904 - RNA, 15 nt, Homo sapiens
ugugaccagggguga

SEQ ID NO: 1508905 - RNA, 17 nt, Homo sapiens
ugugagcagugaguuac

SEQ ID NO: 1508906 - RNA, 14 nt, Homo sapiens
ugugauaaucagaa

SEQ ID NO: 1508907 - RNA, 17 nt, Homo sapiens
ugugcaagucuugucag

SEQ ID NO: 1508908 - RNA, 15 nt, Homo sapiens
ugugccccaugucca

SEQ ID NO: 1508909 - RNA, 10 nt, Homo sapiens
ugugccuaac

SEQ ID NO: 1508910 - RNA, 15 nt, Homo sapiens
ugugccuuacuuaag

SEQ ID NO: 1508911 - RNA, 15 nt, Homo sapiens
ugugcugccuguggu

SEQ ID NO: 1508912 - RNA, 22 nt, Homo sapiens
uguggauaaggcuuaggugcca

SEQ ID NO: 1508913 - RNA, 19 nt, Homo sapiens
uguggauuccagcauuugc

SEQ ID NO: 1508914 - RNA, 23 nt, Homo sapiens
uguggauuuuguccauucaucuc

SEQ ID NO: 1508915 - RNA, 23 nt, Homo sapiens
uguggcccuucuguccaccagac

SEQ ID NO: 1508916 - RNA, 22 nt, Homo sapiens
uguguaaauggcuggggggcca

SEQ ID NO: 1508917 - RNA, 15 nt, Homo sapiens
ugugugucugaagac

SEQ ID NO: 1508918 - RNA, 22 nt, Homo sapiens
uguguguuagcagucaaaucua

SEQ ID NO: 1508919 - RNA, 19 nt, Homo sapiens
uguuaacucaggaugccaa

SEQ ID NO: 1508920 - RNA, 20 nt, Homo sapiens
uguuacaacuuguauuucca

SEQ ID NO: 1508921 - RNA, 19 nt, Homo sapiens
uguuacuuuggcaauuucc

SEQ ID NO: 1508922 - RNA, 20 nt, Homo sapiens
uguuauguauauagaugugc

SEQ ID NO: 1508923 - RNA, 15 nt, Homo sapiens
uguucaguugacuua

SEQ ID NO: 1508924 - RNA, 22 nt, Homo sapiens
uguuccccacuguaucuaggca

SEQ ID NO: 1508925 - RNA, 14 nt, Homo sapiens
uguucuugaugaca

SEQ ID NO: 1508926 - RNA, 11 nt, Homo sapiens
uguugauccca

SEQ ID NO: 1508927 - RNA, 22 nt, Homo sapiens
uguugucauuauguacaauaca

SEQ ID NO: 1508928 - RNA, 22 nt, Homo sapiens
uguuguggguuuuuucacauaa

SEQ ID NO: 1508929 - RNA, 15 nt, Homo sapiens
uguuuaaguggcuuu

SEQ ID NO: 1508930 - RNA, 15 nt, Homo sapiens
uguuuacagacugug

SEQ ID NO: 1508931 - RNA, 16 nt, Homo sapiens
uguuuauucuauaguu

SEQ ID NO: 1508932 - RNA, 19 nt, Homo sapiens
uguuugauaugaaguguua

SEQ ID NO: 1508933 - RNA, 20 nt, Homo sapiens
uguuugcugaagugaaaaaa

SEQ ID NO: 1508934 - RNA, 16 nt, Homo sapiens
uguuuguggaacaaaa

SEQ ID NO: 1508935 - RNA, 20 nt, Homo sapiens
uguuuuaauuuuugugauuu

SEQ ID NO: 1508936 - RNA, 13 nt, Homo sapiens
uguuuuuuuccaa

SEQ ID NO: 1508937 - RNA, 17 nt, Homo sapiens
uuaaaaaaauaagaaga

SEQ ID NO: 1508938 - RNA, 11 nt, Homo sapiens
uuaaaaaccac

SEQ ID NO: 1508939 - RNA, 24 nt, Homo sapiens
uuaaaacuaaaaaggaccagagaa

SEQ ID NO: 1508940 - RNA, 19 nt, Homo sapiens
uuaaaagauaaacaguuua

SEQ ID NO: 1508941 - RNA, 19 nt, Homo sapiens
uuaaaaguugugauuccag

SEQ ID NO: 1508942 - RNA, 22 nt, Homo sapiens
uuaaaaguuuuugucacuaucu

SEQ ID NO: 1508943 - RNA, 19 nt, Homo sapiens
uuaaaauagcaaaagaaga

SEQ ID NO: 1508944 - RNA, 21 nt, Homo sapiens
uuaaacaaaauagaagcugua

SEQ ID NO: 1508945 - RNA, 22 nt, Homo sapiens
uuaaacaacaaacaaaacgcaa

SEQ ID NO: 1508946 - RNA, 14 nt, Homo sapiens
uuaaacagccaaau

SEQ ID NO: 1508947 - RNA, 20 nt, Homo sapiens
uuaaagaaaaaaaaagucag

SEQ ID NO: 1508948 - RNA, 20 nt, Homo sapiens
uuaaagaaagucgaauuaau

SEQ ID NO: 1508949 - RNA, 16 nt, Homo sapiens
uuaaauuauuuuauca

SEQ ID NO: 1508950 - RNA, 17 nt, Homo sapiens
uuaacuaugugauguua

SEQ ID NO: 1508951 - RNA, 20 nt, Homo sapiens
uuaacugcauaauagccuaa

SEQ ID NO: 1508952 - RNA, 22 nt, Homo sapiens
uuaacugugaaauaccacaagc

SEQ ID NO: 1508953 - RNA, 17 nt, Homo sapiens
uuaagggcucagcauaa

SEQ ID NO: 1508954 - RNA, 16 nt, Homo sapiens
uuaaguaaaccaaaaa

SEQ ID NO: 1508955 - RNA, 16 nt, Homo sapiens
uuaauaaauucagaua

SEQ ID NO: 1508956 - RNA, 18 nt, Homo sapiens
uuaaugacagaaugagca

SEQ ID NO: 1508957 - RNA, 19 nt, Homo sapiens
uuaauuuuuauaaauaugu

SEQ ID NO: 1508958 - RNA, 11 nt, Homo sapiens
uuacagaauuu

SEQ ID NO: 1508959 - RNA, 20 nt, Homo sapiens
uuacaucaaaucccacuuac

SEQ ID NO: 1508960 - RNA, 13 nt, Homo sapiens
uuaccaaagaaga

SEQ ID NO: 1508961 - RNA, 20 nt, Homo sapiens
uuaccaucacugaguuuucc

SEQ ID NO: 1508962 - RNA, 19 nt, Homo sapiens
uuaccuaccaccuucccuc

SEQ ID NO: 1508963 - RNA, 22 nt, Homo sapiens
uuacuaaugugccccaugucca

SEQ ID NO: 1508964 - RNA, 13 nt, Homo sapiens
uuacuacuugcca

SEQ ID NO: 1508965 - RNA, 21 nt, Homo sapiens
uuacuauaagaacuuugagcu

SEQ ID NO: 1508966 - RNA, 12 nt, Homo sapiens
uuacugaaguua

SEQ ID NO: 1508967 - RNA, 22 nt, Homo sapiens
uuacugauucuccugucagaga

SEQ ID NO: 1508968 - RNA, 21 nt, Homo sapiens
uuacuguuuggcugacaugac

SEQ ID NO: 1508969 - RNA, 15 nt, Homo sapiens
uuacuuccaugauac

SEQ ID NO: 1508970 - RNA, 20 nt, Homo sapiens
uuacuuccaugauacuuuaa

SEQ ID NO: 1508971 - RNA, 20 nt, Homo sapiens
uuagaaauacuuuuccuuaa

SEQ ID NO: 1508972 - RNA, 23 nt, Homo sapiens
uuagaaugccgguuaaauuccau

SEQ ID NO: 1508973 - RNA, 16 nt, Homo sapiens
uuagcaggguacauau

SEQ ID NO: 1508974 - RNA, 17 nt, Homo sapiens
gaucucugaaacauauu

SEQ ID NO: 1508975 - RNA, 12 nt, Homo sapiens
gaucuucagagc

SEQ ID NO: 1508976 - RNA, 16 nt, Homo sapiens
gaugcugccugaguca

SEQ ID NO: 1508977 - RNA, 20 nt, Homo sapiens
gauggaauaaagcccuugaa

SEQ ID NO: 1508978 - RNA, 18 nt, Homo sapiens
gauggagaggggguacaa

SEQ ID NO: 1508979 - RNA, 20 nt, Homo sapiens
gauggugguaaacauucucu

SEQ ID NO: 1508980 - RNA, 16 nt, Homo sapiens
gauguaaaugccacaa

SEQ ID NO: 1508981 - RNA, 18 nt, Homo sapiens
gaugucacaugucagaga

SEQ ID NO: 1508982 - RNA, 21 nt, Homo sapiens
gaugugaauugccugcagaga

SEQ ID NO: 1508983 - RNA, 14 nt, Homo sapiens
gauuaaacagacuu

SEQ ID NO: 1508984 - RNA, 19 nt, Homo sapiens
gauuacagacaugagccac

SEQ ID NO: 1508985 - RNA, 14 nt, Homo sapiens
gauuaccugccaau

SEQ ID NO: 1508986 - RNA, 19 nt, Homo sapiens
gauuacuacuuugccucuu

SEQ ID NO: 1508987 - RNA, 17 nt, Homo sapiens
gauuagaugacucucag

SEQ ID NO: 1508988 - RNA, 23 nt, Homo sapiens
gauuauacgacuuuuaagcaaag

SEQ ID NO: 1508989 - RNA, 19 nt, Homo sapiens
gauuccauuuuacuuccau

SEQ ID NO: 1508990 - RNA, 23 nt, Homo sapiens
gauuccauuuuacuuccaugaua

SEQ ID NO: 1508991 - RNA, 19 nt, Homo sapiens
ggcaggagaaucaauaaaa

SEQ ID NO: 1508992 - RNA, 16 nt, Homo sapiens
ggcagggggcaggccu

SEQ ID NO: 1508993 - RNA, 17 nt, Homo sapiens
ggcaguugggagugagu

SEQ ID NO: 1508994 - RNA, 19 nt, Homo sapiens
ggccaaggugaauagcaca

SEQ ID NO: 1508995 - RNA, 15 nt, Homo sapiens
ggccacaccaucucc

SEQ ID NO: 1508996 - RNA, 15 nt, Homo sapiens
ggccacucaggccag

SEQ ID NO: 1508997 - RNA, 15 nt, Homo sapiens
ggccaugggugcaug

SEQ ID NO: 1508998 - RNA, 20 nt, Homo sapiens
ggcccuucuguccaccagac

SEQ ID NO: 1508999 - RNA, 18 nt, Homo sapiens
ggccugccaaacuguaca

SEQ ID NO: 1509000 - RNA, 16 nt, Homo sapiens
ggccugcccucaggga

SEQ ID NO: 1509001 - RNA, 13 nt, Homo sapiens
ggcgcagugcuuc

SEQ ID NO: 1509002 - RNA, 15 nt, Homo sapiens
ggcgcaucauaugca

SEQ ID NO: 1509003 - RNA, 14 nt, Homo sapiens
ggcggcuccagguc

SEQ ID NO: 1509004 - RNA, 16 nt, Homo sapiens
ggcgggcagggguucc

SEQ ID NO: 1509005 - RNA, 16 nt, Homo sapiens
ggcuaagucaagauca

SEQ ID NO: 1509006 - RNA, 23 nt, Homo sapiens
ggcuaagucaagaucaacauucc

SEQ ID NO: 1509007 - RNA, 15 nt, Homo sapiens
ggcuacucagcagua

SEQ ID NO: 1509008 - RNA, 21 nt, Homo sapiens
ggcuagacacccauuuucaca

SEQ ID NO: 1509009 - RNA, 15 nt, Homo sapiens
ggcuccagguccgga

SEQ ID NO: 1509010 - RNA, 19 nt, Homo sapiens
ggcuccaucuccaguggga

SEQ ID NO: 1509011 - RNA, 14 nt, Homo sapiens
ggcucccacugccc

SEQ ID NO: 1509012 - RNA, 14 nt, Homo sapiens
ggcugcugggagau

SEQ ID NO: 1509013 - RNA, 19 nt, Homo sapiens
ggcuuccagguaucuccag

SEQ ID NO: 1509014 - RNA, 14 nt, Homo sapiens
ggcuugcaugccaa

SEQ ID NO: 1509015 - RNA, 21 nt, Homo sapiens
agggaagagagggguacauuu

SEQ ID NO: 1509016 - RNA, 14 nt, Homo sapiens
agggaagcuuuguu

SEQ ID NO: 1509017 - RNA, 22 nt, Homo sapiens
agggaagcuuuguuugaaaauu

SEQ ID NO: 1509018 - RNA, 20 nt, Homo sapiens
agggacacacagugacaaaa

SEQ ID NO: 1509019 - RNA, 21 nt, Homo sapiens
agggcagaaggggaagauacu

SEQ ID NO: 1509020 - RNA, 17 nt, Homo sapiens
aggggcaaagaacugcc

SEQ ID NO: 1509021 - RNA, 20 nt, Homo sapiens
aggggcaaggaaacucgaau

SEQ ID NO: 1509022 - RNA, 18 nt, Homo sapiens
aggggcagggagagcgcc

SEQ ID NO: 1509023 - RNA, 17 nt, Homo sapiens
aggggugauuucagaga

SEQ ID NO: 1509024 - RNA, 22 nt, Homo sapiens
aggggugggagagccagcucuc

SEQ ID NO: 1509025 - RNA, 18 nt, Homo sapiens
aggggugugauuggagug

SEQ ID NO: 1509026 - RNA, 13 nt, Homo sapiens
aggguaggggcaa

SEQ ID NO: 1509027 - RNA, 14 nt, Homo sapiens
aggguaggggcaag

SEQ ID NO: 1509028 - RNA, 22 nt, Homo sapiens
agguaaugauuauguguccuuu

SEQ ID NO: 1509029 - RNA, 13 nt, Homo sapiens
aggucaacaucua

SEQ ID NO: 1509030 - RNA, 15 nt, Homo sapiens
aggucagcgugcuua

SEQ ID NO: 1509031 - RNA, 20 nt, Homo sapiens
aggucagcgugcuuagccuc

SEQ ID NO: 1509032 - RNA, 16 nt, Homo sapiens
aggucauuacuaacca

SEQ ID NO: 1509033 - RNA, 18 nt, Homo sapiens
aggucauuauuuuuuaca

SEQ ID NO: 1509034 - RNA, 22 nt, Homo sapiens
agguccauuuuccuaaccacaa

SEQ ID NO: 1509035 - RNA, 14 nt, Homo sapiens
agguccggaggggu

SEQ ID NO: 1509036 - RNA, 21 nt, Homo sapiens
agguccucccgggagcacaga

SEQ ID NO: 1509037 - RNA, 16 nt, Homo sapiens
agguccugcauuucuc

SEQ ID NO: 1509038 - RNA, 14 nt, Homo sapiens
aggugaauagcaca

SEQ ID NO: 1509039 - RNA, 12 nt, Homo sapiens
aggugagcucag

SEQ ID NO: 1509040 - RNA, 16 nt, Homo sapiens
aggugccuggcuugcu

SEQ ID NO: 1509041 - RNA, 13 nt, Homo sapiens
agguggcucucca

SEQ ID NO: 1509042 - RNA, 18 nt, Homo sapiens
aggugggagagagugcau

SEQ ID NO: 1509043 - RNA, 15 nt, Homo sapiens
aggugucugcaccca

SEQ ID NO: 1509044 - RNA, 19 nt, Homo sapiens
agguucuucuaaaauugaa

SEQ ID NO: 1509045 - RNA, 12 nt, Homo sapiens
agguugacucau

SEQ ID NO: 1509046 - RNA, 11 nt, Homo sapiens
agguugccaau

SEQ ID NO: 1509047 - RNA, 19 nt, Homo sapiens
agguugggcuuccaugccu

SEQ ID NO: 1509048 - RNA, 13 nt, Homo sapiens
agguuucaagacu

SEQ ID NO: 1509049 - RNA, 20 nt, Homo sapiens
agguuucaccugaucauaua

SEQ ID NO: 1509050 - RNA, 17 nt, Homo sapiens
agguuugucaacacaaa

SEQ ID NO: 1509051 - RNA, 17 nt, Homo sapiens
aguaacacucaccauca

SEQ ID NO: 1509052 - RNA, 19 nt, Homo sapiens
aguaacaggaaaccacuua

SEQ ID NO: 1509053 - RNA, 19 nt, Homo sapiens
aguaaucccccuugccaaa

SEQ ID NO: 1509054 - RNA, 19 nt, Homo sapiens
aguaauuguaaguaccccu

SEQ ID NO: 1509055 - RNA, 19 nt, Homo sapiens
aguaauugucaauaccccu

SEQ ID NO: 1509056 - RNA, 14 nt, Homo sapiens
aguagaaucucagu

SEQ ID NO: 1509057 - RNA, 19 nt, Homo sapiens
aguagauagaaagcaauaa

SEQ ID NO: 1509058 - RNA, 17 nt, Homo sapiens
aguagcugagugcacuc

SEQ ID NO: 1509059 - RNA, 14 nt, Homo sapiens
aguaucucuugcug

SEQ ID NO: 1509060 - RNA, 17 nt, Homo sapiens
aguauguuacaugcauu

SEQ ID NO: 1509061 - RNA, 23 nt, Homo sapiens
aguauuccaugggauguuaagca

SEQ ID NO: 1509062 - RNA, 11 nt, Homo sapiens
aguauuuccau

SEQ ID NO: 1509063 - RNA, 17 nt, Homo sapiens
aguauuuggggucauau

SEQ ID NO: 1509064 - RNA, 16 nt, Homo sapiens
agucaguaguauucua

SEQ ID NO: 1509065 - RNA, 12 nt, Homo sapiens
agucagugucaa

SEQ ID NO: 1509066 - RNA, 15 nt, Homo sapiens
agucaugggucacac

SEQ ID NO: 1509067 - RNA, 22 nt, Homo sapiens
aguccaaccugccugugcauga

SEQ ID NO: 1509068 - RNA, 18 nt, Homo sapiens
aguccagaugccuuccug

SEQ ID NO: 1509069 - RNA, 12 nt, Homo sapiens
aguccauuuuaa

SEQ ID NO: 1509070 - RNA, 23 nt, Homo sapiens
agucccugacucucugugaccug

SEQ ID NO: 1509071 - RNA, 20 nt, Homo sapiens
aguccuaucgacuuuauaca

SEQ ID NO: 1509072 - RNA, 21 nt, Homo sapiens
aguccuaucgacuuuauacag

SEQ ID NO: 1509073 - RNA, 12 nt, Homo sapiens
aguccugucagc

SEQ ID NO: 1509074 - RNA, 13 nt, Homo sapiens
agucuaaaacaca

SEQ ID NO: 1509075 - RNA, 14 nt, Homo sapiens
agucugaaccuauu

SEQ ID NO: 1509076 - RNA, 18 nt, Homo sapiens
agucugcuuucacuguga

SEQ ID NO: 1509077 - RNA, 15 nt, Homo sapiens
agucuuaccaaugac

SEQ ID NO: 1509078 - RNA, 18 nt, Homo sapiens
agucuuaccaaugacuuu

SEQ ID NO: 1509079 - RNA, 18 nt, Homo sapiens
agugaaagagaguaccau

SEQ ID NO: 1509080 - RNA, 13 nt, Homo sapiens
agugaacuugaaa

SEQ ID NO: 1509081 - RNA, 22 nt, Homo sapiens
agugacauauauauguauauac

SEQ ID NO: 1509082 - RNA, 20 nt, Homo sapiens
agugaucucccugaacauuu

SEQ ID NO: 1509083 - RNA, 22 nt, Homo sapiens
agugauuuccuguauaauuuaa

SEQ ID NO: 1509084 - RNA, 21 nt, Homo sapiens
agugccacccaccuuugccac

SEQ ID NO: 1509085 - RNA, 19 nt, Homo sapiens
agugcugagauuacaggug

SEQ ID NO: 1509086 - RNA, 15 nt, Homo sapiens
aguggaucuccaagg

SEQ ID NO: 1509087 - RNA, 14 nt, Homo sapiens
aguggccuugucca

SEQ ID NO: 1509088 - RNA, 23 nt, Homo sapiens
aguggcucacgccuaugauccca

SEQ ID NO: 1509089 - RNA, 13 nt, Homo sapiens
aguggcuuuuuaa

SEQ ID NO: 1509090 - RNA, 21 nt, Homo sapiens
aguggcuuuuuuccuccugug

SEQ ID NO: 1509091 - RNA, 16 nt, Homo sapiens
agugguauauacauau

SEQ ID NO: 1509092 - RNA, 16 nt, Homo sapiens
aguguagccuugcccg

SEQ ID NO: 1509093 - RNA, 14 nt, Homo sapiens
agugugaucccaag

SEQ ID NO: 1509094 - RNA, 19 nt, Homo sapiens
aguuaugcugucauggucc

SEQ ID NO: 1509095 - RNA, 17 nt, Homo sapiens
aguuauuaaacaguguu

SEQ ID NO: 1509096 - RNA, 22 nt, Homo sapiens
aguucaccccuuauccugagca

SEQ ID NO: 1509097 - RNA, 12 nt, Homo sapiens
aguuccaaauaa

SEQ ID NO: 1509098 - RNA, 23 nt, Homo sapiens
aguuccaguuuagcccuucccug

SEQ ID NO: 1509099 - RNA, 14 nt, Homo sapiens
aguuccauguuaaa

SEQ ID NO: 1509100 - RNA, 22 nt, Homo sapiens
aguucccgcucugcauugccug

SEQ ID NO: 1509101 - RNA, 13 nt, Homo sapiens
aguuccugcacuc

SEQ ID NO: 1509102 - RNA, 22 nt, Homo sapiens
aguucuggauucaaaugucagu

SEQ ID NO: 1509103 - RNA, 17 nt, Homo sapiens
aguucuuuacuggugau

SEQ ID NO: 1509104 - RNA, 14 nt, Homo sapiens
aguugaacaucuca

SEQ ID NO: 1509105 - RNA, 15 nt, Homo sapiens
aguugaacaucucac

SEQ ID NO: 1509106 - RNA, 15 nt, Homo sapiens
aguugaaccugauga

SEQ ID NO: 1509107 - RNA, 14 nt, Homo sapiens
aguugaggaauaug

SEQ ID NO: 1509108 - RNA, 17 nt, Homo sapiens
aguuguaccauucaccg

SEQ ID NO: 1509109 - RNA, 18 nt, Homo sapiens
aguuuaauagauguuacu

SEQ ID NO: 1509110 - RNA, 12 nt, Homo sapiens
aguuuacuucau

SEQ ID NO: 1509111 - RNA, 14 nt, Homo sapiens
aguuuaucauguca

SEQ ID NO: 1509112 - RNA, 16 nt, Homo sapiens
aguuuaucaugucagu

SEQ ID NO: 1509113 - RNA, 13 nt, Homo sapiens
aguuuguuuuaca

SEQ ID NO: 1509114 - RNA, 13 nt, Homo sapiens
aguuuuccucaau

SEQ ID NO: 1509115 - RNA, 22 nt, Homo sapiens
auaaaacgcaaagggcugaaag

SEQ ID NO: 1509116 - RNA, 23 nt, Homo sapiens
auaaaauauuuuugaaaggcaug

SEQ ID NO: 1509117 - RNA, 20 nt, Homo sapiens
auaaaauuguaaaauuguau

SEQ ID NO: 1509118 - RNA, 22 nt, Homo sapiens
auaaacacugccuauauaugua

SEQ ID NO: 1509119 - RNA, 17 nt, Homo sapiens
auaaaccuggagaugau

SEQ ID NO: 1509120 - RNA, 16 nt, Homo sapiens
auaaacuuagcauuua

SEQ ID NO: 1509121 - RNA, 14 nt, Homo sapiens
auaaagacugagac

SEQ ID NO: 1509122 - RNA, 18 nt, Homo sapiens
auaaaggaagucaccaaa

SEQ ID NO: 1509123 - RNA, 19 nt, Homo sapiens
auaaagguuuuugaauuca

SEQ ID NO: 1509124 - RNA, 16 nt, Homo sapiens
auaaauaugugaaaau

SEQ ID NO: 1509125 - RNA, 14 nt, Homo sapiens
auaaauauugacuu

SEQ ID NO: 1509126 - RNA, 23 nt, Homo sapiens
auaaauccucagguaguacuggg

SEQ ID NO: 1509127 - RNA, 20 nt, Homo sapiens
auaaauguauaggcagaugu

SEQ ID NO: 1509128 - RNA, 12 nt, Homo sapiens
auaacuaucaac

SEQ ID NO: 1509129 - RNA, 22 nt, Homo sapiens
auacagcccucccccagcaguu

SEQ ID NO: 1509130 - RNA, 14 nt, Homo sapiens
auacauaccacuuu

SEQ ID NO: 1509131 - RNA, 19 nt, Homo sapiens
auacaucacagcagugcau

SEQ ID NO: 1509132 - RNA, 16 nt, Homo sapiens
auaccagagccuucaa

SEQ ID NO: 1509133 - RNA, 17 nt, Homo sapiens
auaccgaccaucgucca

SEQ ID NO: 1509134 - RNA, 15 nt, Homo sapiens
auacugauauuucau

SEQ ID NO: 1509135 - RNA, 23 nt, Homo sapiens
auacugcaauaaauuauggcucu

SEQ ID NO: 1509136 - RNA, 18 nt, Homo sapiens
auacuuuuuuucacaguu

SEQ ID NO: 1509137 - RNA, 14 nt, Homo sapiens
auagaaaugccaag

SEQ ID NO: 1509138 - RNA, 23 nt, Homo sapiens
auagagauuaauuuuaacuuaaa

SEQ ID NO: 1509139 - RNA, 21 nt, Homo sapiens
auagagggagaggaagcacac

SEQ ID NO: 1509140 - RNA, 13 nt, Homo sapiens
auagagguacaug

SEQ ID NO: 1509141 - RNA, 13 nt, Homo sapiens
auagaguuccaaa

SEQ ID NO: 1509142 - RNA, 21 nt, Homo sapiens
auagauccauuuggacaaaau

SEQ ID NO: 1509143 - RNA, 12 nt, Homo sapiens
auagaugugcaa

SEQ ID NO: 1509144 - RNA, 19 nt, Homo sapiens
auagcaugcaucuguuuau

SEQ ID NO: 1509145 - RNA, 17 nt, Homo sapiens
auagcgaaucaucucaa

SEQ ID NO: 1509146 - RNA, 18 nt, Homo sapiens
auagcgaaucaucucaaa

SEQ ID NO: 1509147 - RNA, 15 nt, Homo sapiens
auagcucucaucacu

SEQ ID NO: 1509148 - RNA, 16 nt, Homo sapiens
auaggcugcauaugag

SEQ ID NO: 1509149 - RNA, 22 nt, Homo sapiens
auaggcuggagaagcucaccca

SEQ ID NO: 1509150 - RNA, 19 nt, Homo sapiens
auagggugcaguuuuccag

SEQ ID NO: 1509151 - RNA, 16 nt, Homo sapiens
auagguuuaauuucaa

SEQ ID NO: 1509152 - RNA, 15 nt, Homo sapiens
auaguagaaaggcca

SEQ ID NO: 1509153 - RNA, 14 nt, Homo sapiens
auagucacaagagc

SEQ ID NO: 1509154 - RNA, 18 nt, Homo sapiens
auagugcacuagcauuuu

SEQ ID NO: 1509155 - RNA, 17 nt, Homo sapiens
auaguuauuuacuugaa

SEQ ID NO: 1509156 - RNA, 17 nt, Homo sapiens
auaguucaugucugcua

SEQ ID NO: 1509157 - RNA, 13 nt, Homo sapiens
auauaagccauag

SEQ ID NO: 1509158 - RNA, 20 nt, Homo sapiens
auauaauaauaugugaugau

SEQ ID NO: 1509159 - RNA, 13 nt, Homo sapiens
auauacauaugac

SEQ ID NO: 1509160 - RNA, 14 nt, Homo sapiens
auauauaccacuuu

SEQ ID NO: 1509161 - RNA, 14 nt, Homo sapiens
auauauguaaauag

SEQ ID NO: 1509162 - RNA, 14 nt, Homo sapiens
auauauugcugcug

SEQ ID NO: 1509163 - RNA, 17 nt, Homo sapiens
auaucaaaaaguauuaa

SEQ ID NO: 1509164 - RNA, 17 nt, Homo sapiens
auaucaagauguuaaau

SEQ ID NO: 1509165 - RNA, 17 nt, Homo sapiens
auaucauuuuuuuaaca

SEQ ID NO: 1509166 - RNA, 22 nt, Homo sapiens
auaucuguuuuguuucuugacu

SEQ ID NO: 1509167 - RNA, 15 nt, Homo sapiens
auaucuuauguuaaa

SEQ ID NO: 1509168 - RNA, 15 nt, Homo sapiens
auaugauuguauaau

SEQ ID NO: 1509169 - RNA, 15 nt, Homo sapiens
auaugcagugauaua

SEQ ID NO: 1509170 - RNA, 12 nt, Homo sapiens
auauggugcaaa

SEQ ID NO: 1509171 - RNA, 14 nt, Homo sapiens
auauggugcaaaaa

SEQ ID NO: 1509172 - RNA, 22 nt, Homo sapiens
auauguaggugucugcacccag

SEQ ID NO: 1509173 - RNA, 16 nt, Homo sapiens
auaugucuaauucuau

SEQ ID NO: 1509174 - RNA, 20 nt, Homo sapiens
auauuaaauuuauaucuuau

SEQ ID NO: 1509175 - RNA, 21 nt, Homo sapiens
auauuaaauuuauaucuuaua

SEQ ID NO: 1509176 - RNA, 13 nt, Homo sapiens
auauuaugagaug

SEQ ID NO: 1509177 - RNA, 18 nt, Homo sapiens
auauucaauaaagcugcu

SEQ ID NO: 1509178 - RNA, 16 nt, Homo sapiens
auauugaaaagauagg

SEQ ID NO: 1509179 - RNA, 12 nt, Homo sapiens
auauugcaaaaa

SEQ ID NO: 1509180 - RNA, 22 nt, Homo sapiens
auauuggucauugccuugccaa

SEQ ID NO: 1509181 - RNA, 21 nt, Homo sapiens
auauuguggguaacgugagaa

SEQ ID NO: 1509182 - RNA, 16 nt, Homo sapiens
auauuucaagugccua

SEQ ID NO: 1509183 - RNA, 16 nt, Homo sapiens
auauuuuagaaccaca

SEQ ID NO: 1509184 - RNA, 17 nt, Homo sapiens
auauuuuagaaccacaa

SEQ ID NO: 1509185 - RNA, 15 nt, Homo sapiens
auauuuucacaugac

SEQ ID NO: 1509186 - RNA, 19 nt, Homo sapiens
aucaacuuccuaaauauua

SEQ ID NO: 1509187 - RNA, 23 nt, Homo sapiens
aucaacuugcuuaucaacuuccu

SEQ ID NO: 1509188 - RNA, 15 nt, Homo sapiens
aucaagucuguuuac

SEQ ID NO: 1509189 - RNA, 18 nt, Homo sapiens
aucaaugaaaugcuuguu

SEQ ID NO: 1509190 - RNA, 15 nt, Homo sapiens
aucaaugucaaguac

SEQ ID NO: 1509191 - RNA, 11 nt, Homo sapiens
aucacaacauu

SEQ ID NO: 1509192 - RNA, 19 nt, Homo sapiens
aucacaacauuuacuuaac

SEQ ID NO: 1509193 - RNA, 20 nt, Homo sapiens
aucaccagcauauuguguuc

SEQ ID NO: 1509194 - RNA, 18 nt, Homo sapiens
aucaccaggaugucacau

SEQ ID NO: 1509195 - RNA, 22 nt, Homo sapiens
aucaccuauuacauuuuacuga

SEQ ID NO: 1509196 - RNA, 14 nt, Homo sapiens
aucacuaccuuuau

SEQ ID NO: 1509197 - RNA, 22 nt, Homo sapiens
aucacuaccuuuauagcucuca

SEQ ID NO: 1509198 - RNA, 17 nt, Homo sapiens
aucacuauugcuuccua

SEQ ID NO: 1509199 - RNA, 12 nt, Homo sapiens
aucagaagcaca

SEQ ID NO: 1509200 - RNA, 13 nt, Homo sapiens
aucaggauuucau

SEQ ID NO: 1509201 - RNA, 21 nt, Homo sapiens
aucaguuaacauuaacaucua

SEQ ID NO: 1509202 - RNA, 17 nt, Homo sapiens
aucauagcucacuguaa

SEQ ID NO: 1509203 - RNA, 20 nt, Homo sapiens
aucaugaguaccucaaagga

SEQ ID NO: 1509204 - RNA, 20 nt, Homo sapiens
aucaugggauuuuacuagaa

SEQ ID NO: 1509205 - RNA, 21 nt, Homo sapiens
aucauugugcuuaauaauacc

SEQ ID NO: 1509206 - RNA, 18 nt, Homo sapiens
aucauuuuagacacuggg

SEQ ID NO: 1509207 - RNA, 19 nt, Homo sapiens
auccaaccccccaccugcc

SEQ ID NO: 1509208 - RNA, 12 nt, Homo sapiens
auccacaagcaa

SEQ ID NO: 1509209 - RNA, 21 nt, Homo sapiens
auccauguuaguuuuuacuuu

SEQ ID NO: 1509210 - RNA, 18 nt, Homo sapiens
auccauuauaaacaauca

SEQ ID NO: 1509211 - RNA, 20 nt, Homo sapiens
auccauuuggacaaaaugga

SEQ ID NO: 1509212 - RNA, 21 nt, Homo sapiens
auccauuuggacaaaauggaa

SEQ ID NO: 1509213 - RNA, 12 nt, Homo sapiens
aucccagcacuu

SEQ ID NO: 1509214 - RNA, 14 nt, Homo sapiens
aucccagcuacuca

SEQ ID NO: 1509215 - RNA, 14 nt, Homo sapiens
auccccacaaucug

SEQ ID NO: 1509216 - RNA, 16 nt, Homo sapiens
auccuauuauguguuc

SEQ ID NO: 1509217 - RNA, 23 nt, Homo sapiens
auccucaauucaauguggugaug

SEQ ID NO: 1509218 - RNA, 14 nt, Homo sapiens
auccuccuuucuau

SEQ ID NO: 1509219 - RNA, 15 nt, Homo sapiens
auccuucaucuggau

SEQ ID NO: 1509220 - RNA, 23 nt, Homo sapiens
auccuuugaguuauaguuugcuu

SEQ ID NO: 1509221 - RNA, 16 nt, Homo sapiens
aucgagucuaccucuu

SEQ ID NO: 1509222 - RNA, 18 nt, Homo sapiens
aucuacaagcauuugccc

SEQ ID NO: 1509223 - RNA, 15 nt, Homo sapiens
aucuacucauugucu

SEQ ID NO: 1509224 - RNA, 15 nt, Homo sapiens
aucuagauuuuccua

SEQ ID NO: 1509225 - RNA, 18 nt, Homo sapiens
aucuagugcuagauguau

SEQ ID NO: 1509226 - RNA, 17 nt, Homo sapiens
aucuauuauaaaaccau

SEQ ID NO: 1509227 - RNA, 22 nt, Homo sapiens
aucucaaauccuugagcacuca

SEQ ID NO: 1509228 - RNA, 23 nt, Homo sapiens
aucucaguggcacagguuuaaga

SEQ ID NO: 1509229 - RNA, 15 nt, Homo sapiens
aucucaugcucucug

SEQ ID NO: 1509230 - RNA, 22 nt, Homo sapiens
aucucuccagagagcaaacaua

SEQ ID NO: 1509231 - RNA, 16 nt, Homo sapiens
aucugaaccacuuugc

SEQ ID NO: 1509232 - RNA, 13 nt, Homo sapiens
aucugagaucucc

SEQ ID NO: 1509233 - RNA, 12 nt, Homo sapiens
aucugcacuggg

SEQ ID NO: 1509234 - RNA, 11 nt, Homo sapiens
aucugccauug

SEQ ID NO: 1509235 - RNA, 15 nt, Homo sapiens
aucugccuuuaccua

SEQ ID NO: 1509236 - RNA, 14 nt, Homo sapiens
aucuguccaaggaa

SEQ ID NO: 1509237 - RNA, 14 nt, Homo sapiens
aucuguguuuacuu

SEQ ID NO: 1509238 - RNA, 16 nt, Homo sapiens
aucuguuuuucaugua

SEQ ID NO: 1509239 - RNA, 23 nt, Homo sapiens
aucuuauauauaauaauauguga

SEQ ID NO: 1509240 - RNA, 20 nt, Homo sapiens
aucuucaggacuauuucacu

SEQ ID NO: 1509241 - RNA, 12 nt, Homo sapiens
aucuuuuccacu

SEQ ID NO: 1509242 - RNA, 20 nt, Homo sapiens
augaaaaaaaugcauuuuau

SEQ ID NO: 1509243 - RNA, 16 nt, Homo sapiens
augaaaccagaaggau

SEQ ID NO: 1509244 - RNA, 18 nt, Homo sapiens
augaacuuagucauuaau

SEQ ID NO: 1509245 - RNA, 15 nt, Homo sapiens
augaaugucaugcac

SEQ ID NO: 1509246 - RNA, 12 nt, Homo sapiens
gggaagggugca

SEQ ID NO: 1509247 - RNA, 20 nt, Homo sapiens
gggacugcuaccucugagaa

SEQ ID NO: 1509248 - RNA, 15 nt, Homo sapiens
gggagaugcugggau

SEQ ID NO: 1509249 - RNA, 11 nt, Homo sapiens
gggagcacaga

SEQ ID NO: 1509250 - RNA, 13 nt, Homo sapiens
gggagcuggaaau

SEQ ID NO: 1509251 - RNA, 23 nt, Homo sapiens
gggagcuggaaauaaaccuggag

SEQ ID NO: 1509252 - RNA, 15 nt, Homo sapiens
gggaucacagcguuu

SEQ ID NO: 1509253 - RNA, 14 nt, Homo sapiens
gggaucugccauug

SEQ ID NO: 1509254 - RNA, 19 nt, Homo sapiens
gggaugagaaugaaagcuu

SEQ ID NO: 1509255 - RNA, 21 nt, Homo sapiens
gggcacggcuucccaggggaa

SEQ ID NO: 1509256 - RNA, 14 nt, Homo sapiens
gggcacugcagggg

SEQ ID NO: 1509257 - RNA, 22 nt, Homo sapiens
gggcaugcuggggcaagucccu

SEQ ID NO: 1509258 - RNA, 21 nt, Homo sapiens
gggccagcugucgcaucucag

SEQ ID NO: 1509259 - RNA, 14 nt, Homo sapiens
gggccuacacccgu

SEQ ID NO: 1509260 - RNA, 17 nt, Homo sapiens
gggccugauggugcuca

SEQ ID NO: 1509261 - RNA, 23 nt, Homo sapiens
gggcucaggaggggaaguccagc

SEQ ID NO: 1509262 - RNA, 16 nt, Homo sapiens
gggcugagcccuggca

SEQ ID NO: 1509263 - RNA, 14 nt, Homo sapiens
gggcugcccugcca

SEQ ID NO: 1509264 - RNA, 11 nt, Homo sapiens
gggcuugcccu

SEQ ID NO: 1509265 - RNA, 14 nt, Homo sapiens
gggggagcuggaaa

SEQ ID NO: 1509266 - RNA, 21 nt, Homo sapiens
gggguauuuuaggcagggauu

SEQ ID NO: 1509267 - RNA, 19 nt, Homo sapiens
ggguaagaagaaagcaaaa

SEQ ID NO: 1509268 - RNA, 20 nt, Homo sapiens
ggguaauuuucuuugacucu

SEQ ID NO: 1509269 - RNA, 18 nt, Homo sapiens
ggguaugggaagccauau

SEQ ID NO: 1509270 - RNA, 19 nt, Homo sapiens
ggguauuuaccacagcagc

SEQ ID NO: 1509271 - RNA, 15 nt, Homo sapiens
ggguccuugguguga

SEQ ID NO: 1509272 - RNA, 11 nt, Homo sapiens
gggugccauuc

SEQ ID NO: 1509273 - RNA, 16 nt, Homo sapiens
gggugcgguggcucac

SEQ ID NO: 1509274 - RNA, 15 nt, Homo sapiens
ggguggaucaccuga

SEQ ID NO: 1509275 - RNA, 11 nt, Homo sapiens
gggugggagag

SEQ ID NO: 1509276 - RNA, 19 nt, Homo sapiens
ggguggucugagcaccccc

SEQ ID NO: 1509277 - RNA, 22 nt, Homo sapiens
ggguuccuuuuucaacuuggaa

SEQ ID NO: 1509278 - RNA, 22 nt, Homo sapiens
ggguuuugucucugcaucucau

SEQ ID NO: 1509279 - RNA, 14 nt, Homo sapiens
gguaaacauucucu

SEQ ID NO: 1509280 - RNA, 18 nt, Homo sapiens
gguaagaagaaagcaaaa

SEQ ID NO: 1509281 - RNA, 18 nt, Homo sapiens
gguaauauaaaguguaau

SEQ ID NO: 1509282 - RNA, 20 nt, Homo sapiens
gguaauauaaaguguaauag

SEQ ID NO: 1509283 - RNA, 13 nt, Homo sapiens
gguagacugaggg

SEQ ID NO: 1509284 - RNA, 14 nt, Homo sapiens
gguagacugaggga

SEQ ID NO: 1509285 - RNA, 13 nt, Homo sapiens
gguauauuuccau

SEQ ID NO: 1509286 - RNA, 14 nt, Homo sapiens
gguaucuccaggau

SEQ ID NO: 1509287 - RNA, 18 nt, Homo sapiens
gguauuagcaaagcaaaa

SEQ ID NO: 1509288 - RNA, 21 nt, Homo sapiens
gguauucuuaagggaacuucc

SEQ ID NO: 1509289 - RNA, 21 nt, Homo sapiens
ggucauauaaaauauauuuau

SEQ ID NO: 1509290 - RNA, 18 nt, Homo sapiens
gguccacccagcaaagag

SEQ ID NO: 1509291 - RNA, 21 nt, Homo sapiens
gguccauuuuccuaaccacaa

SEQ ID NO: 1509292 - RNA, 21 nt, Homo sapiens
gguccugggggcugcugcacu

SEQ ID NO: 1509293 - RNA, 17 nt, Homo sapiens
ggugagucacacucaga

SEQ ID NO: 1509294 - RNA, 18 nt, Homo sapiens
ggugcaguugacagcagg

SEQ ID NO: 1509295 - RNA, 15 nt, Homo sapiens
ggugccucagagcag

SEQ ID NO: 1509296 - RNA, 16 nt, Homo sapiens
gguggaucuguccaag

SEQ ID NO: 1509297 - RNA, 16 nt, Homo sapiens
gguuaacuuggucaga

SEQ ID NO: 1509298 - RNA, 21 nt, Homo sapiens
gguuaauggcagcauucagaa

SEQ ID NO: 1509299 - RNA, 14 nt, Homo sapiens
gguuauacacagaa

SEQ ID NO: 1509300 - RNA, 16 nt, Homo sapiens
gguugaaauugaacau

SEQ ID NO: 1509301 - RNA, 19 nt, Homo sapiens
gguuucaaaucagccagcu

SEQ ID NO: 1509302 - RNA, 18 nt, Homo sapiens
gguuucuagcgcauuuga

SEQ ID NO: 1509303 - RNA, 16 nt, Homo sapiens
guaaaaaagauuugua

SEQ ID NO: 1509304 - RNA, 22 nt, Homo sapiens
guaaaaauaugugaaucuggau

SEQ ID NO: 1509305 - RNA, 12 nt, Homo sapiens
guaaacaguuug

SEQ ID NO: 1509306 - RNA, 12 nt, Homo sapiens
guaaaccaaaaa

SEQ ID NO: 1509307 - RNA, 19 nt, Homo sapiens
guaaaugagccuuucugcc

SEQ ID NO: 1509308 - RNA, 16 nt, Homo sapiens
guaaaugccacaaaga

SEQ ID NO: 1509309 - RNA, 14 nt, Homo sapiens
guaacauagacaaa

SEQ ID NO: 1509310 - RNA, 14 nt, Homo sapiens
guaagacucauucc

SEQ ID NO: 1509311 - RNA, 20 nt, Homo sapiens
guaaguaccacucaggccaa

SEQ ID NO: 1509312 - RNA, 17 nt, Homo sapiens
guaauagauguuugaua

SEQ ID NO: 1509313 - RNA, 19 nt, Homo sapiens
guaaucccccuugccaaau

SEQ ID NO: 1509314 - RNA, 14 nt, Homo sapiens
guacaaaugaaauu

SEQ ID NO: 1509315 - RNA, 21 nt, Homo sapiens
guacacuuaagcagagcagaa

SEQ ID NO: 1509316 - RNA, 14 nt, Homo sapiens
guacagugagccaa

SEQ ID NO: 1509317 - RNA, 18 nt, Homo sapiens
guaccccugauaagcaaa

SEQ ID NO: 1509318 - RNA, 14 nt, Homo sapiens
guacuauaauguga

SEQ ID NO: 1509319 - RNA, 17 nt, Homo sapiens
guacucuaaucaguccu

SEQ ID NO: 1509320 - RNA, 17 nt, Homo sapiens
guacugaaaaaaaaaga

SEQ ID NO: 1509321 - RNA, 12 nt, Homo sapiens
guagaaaggcca

SEQ ID NO: 1509322 - RNA, 21 nt, Homo sapiens
guagaaccacuuggcugcuca

SEQ ID NO: 1509323 - RNA, 21 nt, Homo sapiens
guagacucacgcugacugcag

SEQ ID NO: 1509324 - RNA, 17 nt, Homo sapiens
guagaguucacuguugu

SEQ ID NO: 1509325 - RNA, 22 nt, Homo sapiens
guagaguuugaaggaggugagg

SEQ ID NO: 1509326 - RNA, 23 nt, Homo sapiens
guagauauuggacaaagaaccuu

SEQ ID NO: 1509327 - RNA, 13 nt, Homo sapiens
guaggaaaggaau

SEQ ID NO: 1509328 - RNA, 14 nt, Homo sapiens
guaggaaaggaaua

SEQ ID NO: 1509329 - RNA, 21 nt, Homo sapiens
guaggaaaucaggcaguuccc

SEQ ID NO: 1509330 - RNA, 20 nt, Homo sapiens
guagguucuugggagggaau

SEQ ID NO: 1509331 - RNA, 24 nt, Homo sapiens
guaguaauuuauugucugucuaca

SEQ ID NO: 1509332 - RNA, 21 nt, Homo sapiens
guagugucacucaaggcggug

SEQ ID NO: 1509333 - RNA, 13 nt, Homo sapiens
guaguucuugucu

SEQ ID NO: 1509334 - RNA, 23 nt, Homo sapiens
guauaaauguuauguuugcuaaa

SEQ ID NO: 1509335 - RNA, 13 nt, Homo sapiens
guauauacauaug

SEQ ID NO: 1509336 - RNA, 16 nt, Homo sapiens
guauauagaugugcaa

SEQ ID NO: 1509337 - RNA, 19 nt, Homo sapiens
guauauauaguagcauuuc

SEQ ID NO: 1509338 - RNA, 20 nt, Homo sapiens
guaucuaccucacuauucaa

SEQ ID NO: 1509339 - RNA, 18 nt, Homo sapiens
guaucucggaccuuucag

SEQ ID NO: 1509340 - RNA, 22 nt, Homo sapiens
guaucucuugcugggaacacag

SEQ ID NO: 1509341 - RNA, 15 nt, Homo sapiens
guaugacuucugcug

SEQ ID NO: 1509342 - RNA, 16 nt, Homo sapiens
guaugcagaauguuuu

SEQ ID NO: 1509343 - RNA, 17 nt, Homo sapiens
guaugucuauuugcaca

SEQ ID NO: 1509344 - RNA, 11 nt, Homo sapiens
guaugugaaua

SEQ ID NO: 1509345 - RNA, 14 nt, Homo sapiens
guauucuauucaaa

SEQ ID NO: 1509346 - RNA, 18 nt, Homo sapiens
guauugcuaaucauuaag

SEQ ID NO: 1509347 - RNA, 17 nt, Homo sapiens
guauuuaccacagcagc

SEQ ID NO: 1509348 - RNA, 19 nt, Homo sapiens
guauuuuaaaacauaagaa

SEQ ID NO: 1509349 - RNA, 22 nt, Homo sapiens
guauuuuaggcagggauuugag

SEQ ID NO: 1509350 - RNA, 20 nt, Homo sapiens
gucaaaccgcacucacccau

SEQ ID NO: 1509351 - RNA, 19 nt, Homo sapiens
gucaacacaaagacaugga

SEQ ID NO: 1509352 - RNA, 23 nt, Homo sapiens
gucaauaccccuguuaagcaauu

SEQ ID NO: 1509353 - RNA, 23 nt, Homo sapiens
gucaauuucaguguaugauauac

SEQ ID NO: 1509354 - RNA, 20 nt, Homo sapiens
gucacaccugacaaauggaa

SEQ ID NO: 1509355 - RNA, 16 nt, Homo sapiens
gucacuugaagccaaa

SEQ ID NO: 1509356 - RNA, 17 nt, Homo sapiens
gucagaacucuguguug

SEQ ID NO: 1509357 - RNA, 19 nt, Homo sapiens
ugguaagcauuagcacaua

SEQ ID NO: 1509358 - RNA, 21 nt, Homo sapiens
ugguaauuguacuaaagccaa

SEQ ID NO: 1509359 - RNA, 16 nt, Homo sapiens
ugguaauuuguaucug

SEQ ID NO: 1509360 - RNA, 17 nt, Homo sapiens
ugguauacaggugguuu

SEQ ID NO: 1509361 - RNA, 14 nt, Homo sapiens
ugguauauuuccau

SEQ ID NO: 1509362 - RNA, 17 nt, Homo sapiens
uggucagagugccacug

SEQ ID NO: 1509363 - RNA, 19 nt, Homo sapiens
uggucuuauagaaagcacu

SEQ ID NO: 1509364 - RNA, 19 nt, Homo sapiens
uggugagguugugcugccu

SEQ ID NO: 1509365 - RNA, 16 nt, Homo sapiens
uggugauuucugagau

SEQ ID NO: 1509366 - RNA, 20 nt, Homo sapiens
uggugcuguggccaggguga

SEQ ID NO: 1509367 - RNA, 15 nt, Homo sapiens
ugguggaucugucca

SEQ ID NO: 1509368 - RNA, 23 nt, Homo sapiens
ugguuacagcccagacuuuacca

SEQ ID NO: 1509369 - RNA, 15 nt, Homo sapiens
ugguuccuaagccug

SEQ ID NO: 1509370 - RNA, 18 nt, Homo sapiens
ugguuucccaagagcuac

SEQ ID NO: 1509371 - RNA, 20 nt, Homo sapiens
uguaaaauaaguauuuccau

SEQ ID NO: 1509372 - RNA, 21 nt, Homo sapiens
uguaaacagcuaauaaugaag

SEQ ID NO: 1509373 - RNA, 21 nt, Homo sapiens
uguaaauauuaugauggugga

SEQ ID NO: 1509374 - RNA, 18 nt, Homo sapiens
uguaaaugccacaaagaa

SEQ ID NO: 1509375 - RNA, 23 nt, Homo sapiens
uguaacacagcugagagacuuuu

SEQ ID NO: 1509376 - RNA, 20 nt, Homo sapiens
uguaacagauaucagugucu

SEQ ID NO: 1509377 - RNA, 11 nt, Homo sapiens
uguaacuauug

SEQ ID NO: 1509378 - RNA, 18 nt, Homo sapiens
uguaagcauucugagcug

SEQ ID NO: 1509379 - RNA, 23 nt, Homo sapiens
uguaaguaccccugauaagcaaa

SEQ ID NO: 1509380 - RNA, 18 nt, Homo sapiens
uguaaucaguuuuaucca

SEQ ID NO: 1509381 - RNA, 21 nt, Homo sapiens
uguaauuaaguaaaccaaaaa

SEQ ID NO: 1509382 - RNA, 22 nt, Homo sapiens
uguaauuaaguaaaccaaaaag

SEQ ID NO: 1509383 - RNA, 13 nt, Homo sapiens
uguacaccaaggu

SEQ ID NO: 1509384 - RNA, 18 nt, Homo sapiens
uguacauuucacaaaaag

SEQ ID NO: 1509385 - RNA, 21 nt, Homo sapiens
uguacccucccucuagccuuu

SEQ ID NO: 1509386 - RNA, 14 nt, Homo sapiens
uguacuaaagccaa

SEQ ID NO: 1509387 - RNA, 15 nt, Homo sapiens
uguacucaaguacca

SEQ ID NO: 1509388 - RNA, 12 nt, Homo sapiens
uguagaauuaua

SEQ ID NO: 1509389 - RNA, 18 nt, Homo sapiens
uguagaucaagugugcau

SEQ ID NO: 1509390 - RNA, 15 nt, Homo sapiens
uguauaaacuaucag

SEQ ID NO: 1509391 - RNA, 17 nt, Homo sapiens
uguaucauuugaacaac

SEQ ID NO: 1509392 - RNA, 20 nt, Homo sapiens
uguauccccgugaaaucugg

SEQ ID NO: 1509393 - RNA, 14 nt, Homo sapiens
uguauccgacucua

SEQ ID NO: 1509394 - RNA, 15 nt, Homo sapiens
ugucaacacaaagac

SEQ ID NO: 1509395 - RNA, 13 nt, Homo sapiens
ugucaauaccccu

SEQ ID NO: 1509396 - RNA, 18 nt, Homo sapiens
uguccauguguauuuuag

SEQ ID NO: 1509397 - RNA, 15 nt, Homo sapiens
uguccauucaucuca

SEQ ID NO: 1509398 - RNA, 16 nt, Homo sapiens
uguccauucaucucau

SEQ ID NO: 1509399 - RNA, 21 nt, Homo sapiens
uguccccuuuccccagugaca

SEQ ID NO: 1509400 - RNA, 17 nt, Homo sapiens
ugucgaguuuacuucau

SEQ ID NO: 1509401 - RNA, 11 nt, Homo sapiens
ugucugaagac

SEQ ID NO: 1509402 - RNA, 21 nt, Homo sapiens
ugucugauuggcucacccaag

SEQ ID NO: 1509403 - RNA, 19 nt, Homo sapiens
ugucugauuuaacacuauc

SEQ ID NO: 1509404 - RNA, 12 nt, Homo sapiens
ugucugccacag

SEQ ID NO: 1509405 - RNA, 14 nt, Homo sapiens
ugucugucccaaag

SEQ ID NO: 1509406 - RNA, 22 nt, Homo sapiens
ugucuguuuuuguaacuuaaaa

SEQ ID NO: 1509407 - RNA, 22 nt, Homo sapiens
ugugaaauaaauaugaauggag

SEQ ID NO: 1509408 - RNA, 23 nt, Homo sapiens
ugugaacuggaagaaagcaacaa

SEQ ID NO: 1509409 - RNA, 18 nt, Homo sapiens
ugugaugauuaauacaau

SEQ ID NO: 1509410 - RNA, 20 nt, Homo sapiens
ugugauuuuaauuugauaca

SEQ ID NO: 1509411 - RNA, 17 nt, Homo sapiens
ugugauuuuuuucacau

SEQ ID NO: 1509412 - RNA, 16 nt, Homo sapiens
ugugcagucaguguca

SEQ ID NO: 1509413 - RNA, 12 nt, Homo sapiens
ugugcaugaccu

SEQ ID NO: 1509414 - RNA, 15 nt, Homo sapiens
ugugcuucacauaau

SEQ ID NO: 1509415 - RNA, 19 nt, Homo sapiens
uguggauguguaaauggcu

SEQ ID NO: 1509416 - RNA, 17 nt, Homo sapiens
uguggguuuuuucacau

SEQ ID NO: 1509417 - RNA, 20 nt, Homo sapiens
uguggguuuuuucacauaaa

SEQ ID NO: 1509418 - RNA, 19 nt, Homo sapiens
ugugguaacuucuuugaag

SEQ ID NO: 1509419 - RNA, 13 nt, Homo sapiens
ugugguuuacuag

SEQ ID NO: 1509420 - RNA, 22 nt, Homo sapiens
uguguauauauaguagcauuuc

SEQ ID NO: 1509421 - RNA, 17 nt, Homo sapiens
uguguauccgacucuaa

SEQ ID NO: 1509422 - RNA, 12 nt, Homo sapiens
ugugugccacac

SEQ ID NO: 1509423 - RNA, 12 nt, Homo sapiens
uguguguagcca

SEQ ID NO: 1509424 - RNA, 12 nt, Homo sapiens
ugugugugauau

SEQ ID NO: 1509425 - RNA, 15 nt, Homo sapiens
uguguuuaacauuca

SEQ ID NO: 1509426 - RNA, 11 nt, Homo sapiens
uguguuuacuu

SEQ ID NO: 1509427 - RNA, 14 nt, Homo sapiens
uguguuucuuacag

SEQ ID NO: 1509428 - RNA, 21 nt, Homo sapiens
uguuaagcaaaggaaaccaaa

SEQ ID NO: 1509429 - RNA, 13 nt, Homo sapiens
uguuaagcaauuc

SEQ ID NO: 1509430 - RNA, 23 nt, Homo sapiens
uguuaaugagaaaauggcuuuaa

SEQ ID NO: 1509431 - RNA, 13 nt, Homo sapiens
uguuaucugcuag

SEQ ID NO: 1509432 - RNA, 16 nt, Homo sapiens
uguuauuuguacaguu

SEQ ID NO: 1509433 - RNA, 21 nt, Homo sapiens
uguucccaauauguagccuuu

SEQ ID NO: 1509434 - RNA, 22 nt, Homo sapiens
uguucccuagcugaggaugaca

SEQ ID NO: 1509435 - RNA, 15 nt, Homo sapiens
uguucuaaguauuug

SEQ ID NO: 1509436 - RNA, 17 nt, Homo sapiens
uguugaaucaggggcaa

SEQ ID NO: 1509437 - RNA, 17 nt, Homo sapiens
uguugagcaucacagaa

SEQ ID NO: 1509438 - RNA, 20 nt, Homo sapiens
uguugauaaauuccacugga

SEQ ID NO: 1509439 - RNA, 17 nt, Homo sapiens
uguugauacguguguga

SEQ ID NO: 1509440 - RNA, 18 nt, Homo sapiens
uguugcuaggacauauac

SEQ ID NO: 1509441 - RNA, 16 nt, Homo sapiens
uguuggggcaguggua

SEQ ID NO: 1509442 - RNA, 21 nt, Homo sapiens
uguuguuagcuuuucaguucc

SEQ ID NO: 1509443 - RNA, 22 nt, Homo sapiens
uguuuaaguggcuuucagcaaa

SEQ ID NO: 1509444 - RNA, 12 nt, Homo sapiens
uguuuacuuaag

SEQ ID NO: 1509445 - RNA, 20 nt, Homo sapiens
uguuucagcccgaagcugcu

SEQ ID NO: 1509446 - RNA, 22 nt, Homo sapiens
uguuucuauauuggucauugcc

SEQ ID NO: 1509447 - RNA, 14 nt, Homo sapiens
uguuuuuaaguccu

SEQ ID NO: 1509448 - RNA, 13 nt, Homo sapiens
uguuuuuauacuu

SEQ ID NO: 1509449 - RNA, 16 nt, Homo sapiens
uuaaaaaacguauuau

SEQ ID NO: 1509450 - RNA, 20 nt, Homo sapiens
uuaaaaagguuuacagaauu

SEQ ID NO: 1509451 - RNA, 20 nt, Homo sapiens
uuaaaaauauuuucugaauu

SEQ ID NO: 1509452 - RNA, 12 nt, Homo sapiens
uuaaaaugauug

SEQ ID NO: 1509453 - RNA, 21 nt, Homo sapiens
uuaaauaugaucacuucauac

SEQ ID NO: 1509454 - RNA, 21 nt, Homo sapiens
uuaaaugguguuuuauuacaa

SEQ ID NO: 1509455 - RNA, 22 nt, Homo sapiens
uuaaauucugaacaauucucuc

SEQ ID NO: 1509456 - RNA, 12 nt, Homo sapiens
uuaaauuuucca

SEQ ID NO: 1509457 - RNA, 14 nt, Homo sapiens
uuaacauucacagc

SEQ ID NO: 1509458 - RNA, 13 nt, Homo sapiens
uuaacauuuucca

SEQ ID NO: 1509459 - RNA, 16 nt, Homo sapiens
uuaaccucaucuacaa

SEQ ID NO: 1509460 - RNA, 20 nt, Homo sapiens
uuaacgacccagucaaugaa

SEQ ID NO: 1509461 - RNA, 14 nt, Homo sapiens
uuaacuaugugaug

SEQ ID NO: 1509462 - RNA, 21 nt, Homo sapiens
uuaacugugaaauaccacaag

SEQ ID NO: 1509463 - RNA, 15 nt, Homo sapiens
uuaacuugaggguaa

SEQ ID NO: 1509464 - RNA, 17 nt, Homo sapiens
uuaaguaaaccaaaaag

SEQ ID NO: 1509465 - RNA, 20 nt, Homo sapiens
uuaauaaaaacuucagaaaa

SEQ ID NO: 1509466 - RNA, 14 nt, Homo sapiens
uuaauauaucccag

SEQ ID NO: 1509467 - RNA, 12 nt, Homo sapiens
uuaauuccucag

SEQ ID NO: 1509468 - RNA, 22 nt, Homo sapiens
uuaauuuuuauaaauaugugaa

SEQ ID NO: 1509469 - RNA, 19 nt, Homo sapiens
uuaauuuuugauacuaagc

SEQ ID NO: 1509470 - RNA, 19 nt, Homo sapiens
uuacaauuauggaaauaua

SEQ ID NO: 1509471 - RNA, 14 nt, Homo sapiens
uuacagacugugag

SEQ ID NO: 1509472 - RNA, 21 nt, Homo sapiens
uuaccaggcaccaaaagaagu

SEQ ID NO: 1509473 - RNA, 21 nt, Homo sapiens
uuacccugguggaggcuucuu

SEQ ID NO: 1509474 - RNA, 17 nt, Homo sapiens
uuaccuuaaaaaguaau

SEQ ID NO: 1509475 - RNA, 13 nt, Homo sapiens
uuacgugagccag

SEQ ID NO: 1509476 - RNA, 22 nt, Homo sapiens
uuacuaacacgcauuguacacu

SEQ ID NO: 1509477 - RNA, 10 nt, Homo sapiens
uuacuguaac

SEQ ID NO: 1509478 - RNA, 13 nt, Homo sapiens
uuacuuccaugau

SEQ ID NO: 1509479 - RNA, 21 nt, Homo sapiens
uuacuuccaugauacuuuaau

SEQ ID NO: 1509480 - RNA, 21 nt, Homo sapiens
uuagagguuugucaacacaaa

SEQ ID NO: 1509481 - RNA, 12 nt, Homo sapiens
uuagaucuggca

SEQ ID NO: 1509482 - RNA, 23 nt, Homo sapiens
ugcaaaaauaaaaggaaaaccag

SEQ ID NO: 1509483 - RNA, 22 nt, Homo sapiens
ugcaaccuaccuguugagcauc

SEQ ID NO: 1509484 - RNA, 17 nt, Homo sapiens
ugcaagagacucuggcc

SEQ ID NO: 1509485 - RNA, 22 nt, Homo sapiens
ugcaagcacaaauuucaucucc

SEQ ID NO: 1509486 - RNA, 18 nt, Homo sapiens
ugcaauauaaaaauguga

SEQ ID NO: 1509487 - RNA, 17 nt, Homo sapiens
ugcaaugcaagcccuuu

SEQ ID NO: 1509488 - RNA, 17 nt, Homo sapiens
ugcaauuggggaagaaa

SEQ ID NO: 1509489 - RNA, 16 nt, Homo sapiens
ugcacacagcuaggca

SEQ ID NO: 1509490 - RNA, 18 nt, Homo sapiens
ugcaccaucacacaugca

SEQ ID NO: 1509491 - RNA, 14 nt, Homo sapiens
ugcacuccagccug

SEQ ID NO: 1509492 - RNA, 21 nt, Homo sapiens
ugcacuguauauagaagucua

SEQ ID NO: 1509493 - RNA, 16 nt, Homo sapiens
ugcagaaagcccuuca

SEQ ID NO: 1509494 - RNA, 12 nt, Homo sapiens
ugcagagcaaug

SEQ ID NO: 1509495 - RNA, 22 nt, Homo sapiens
ugcaguaucucuugcugggaac

SEQ ID NO: 1509496 - RNA, 14 nt, Homo sapiens
ugcaguugauucug

SEQ ID NO: 1509497 - RNA, 15 nt, Homo sapiens
ugcaguuuccaaucc

SEQ ID NO: 1509498 - RNA, 18 nt, Homo sapiens
ugcauaaagguucugggg

SEQ ID NO: 1509499 - RNA, 14 nt, Homo sapiens
ugcauaagauuaaa

SEQ ID NO: 1509500 - RNA, 22 nt, Homo sapiens
ugcauccacgcacacauggaca

SEQ ID NO: 1509501 - RNA, 18 nt, Homo sapiens
ugcaucccccagcacuga

SEQ ID NO: 1509502 - RNA, 10 nt, Homo sapiens
ugcaucucau

SEQ ID NO: 1509503 - RNA, 13 nt, Homo sapiens
ugcaugaccugau

SEQ ID NO: 1509504 - RNA, 21 nt, Homo sapiens
ugcaugaccugaucauuacau

SEQ ID NO: 1509505 - RNA, 15 nt, Homo sapiens
ugcaugugugugaug

SEQ ID NO: 1509506 - RNA, 16 nt, Homo sapiens
ugcauucccagugguc

SEQ ID NO: 1509507 - RNA, 16 nt, Homo sapiens
ugccaagaaaguauuu

SEQ ID NO: 1509508 - RNA, 18 nt, Homo sapiens
ugccacccauuccaucuc

SEQ ID NO: 1509509 - RNA, 22 nt, Homo sapiens
ugccacuuuucaugucauuuga

SEQ ID NO: 1509510 - RNA, 20 nt, Homo sapiens
ugccaggcuguaagcauucu

SEQ ID NO: 1509511 - RNA, 19 nt, Homo sapiens
ugccauuucugaacuguua

SEQ ID NO: 1509512 - RNA, 18 nt, Homo sapiens
ugcccaaucugagcaaac

SEQ ID NO: 1509513 - RNA, 21 nt, Homo sapiens
ugccccuccagagacaggaaa

SEQ ID NO: 1509514 - RNA, 20 nt, Homo sapiens
ugcccuuugggguugcccag

SEQ ID NO: 1509515 - RNA, 16 nt, Homo sapiens
ugccuaauuccuggca

SEQ ID NO: 1509516 - RNA, 16 nt, Homo sapiens
ugccuagacuguuacu

SEQ ID NO: 1509517 - RNA, 17 nt, Homo sapiens
ugccucucugcuccaga

SEQ ID NO: 1509518 - RNA, 17 nt, Homo sapiens
ugccucugaaacuuaau

SEQ ID NO: 1509519 - RNA, 14 nt, Homo sapiens
ugccugacuaggga

SEQ ID NO: 1509520 - RNA, 13 nt, Homo sapiens
ugccugauuagau

SEQ ID NO: 1509521 - RNA, 23 nt, Homo sapiens
ugccugggaauccugcugccaga

SEQ ID NO: 1509522 - RNA, 20 nt, Homo sapiens
ugccuguaaucccagcacuu

SEQ ID NO: 1509523 - RNA, 15 nt, Homo sapiens
ugccuugaagccacu

SEQ ID NO: 1509524 - RNA, 16 nt, Homo sapiens
ugcgggggagcuggaa

SEQ ID NO: 1509525 - RNA, 22 nt, Homo sapiens
ugcgucagaccaguacugggaa

SEQ ID NO: 1509526 - RNA, 12 nt, Homo sapiens
ugcgucugugug

SEQ ID NO: 1509527 - RNA, 18 nt, Homo sapiens
ugcuacacaaaagccaaa

SEQ ID NO: 1509528 - RNA, 19 nt, Homo sapiens
ugcuauauaaacuuuaaca

SEQ ID NO: 1509529 - RNA, 21 nt, Homo sapiens
ugcuauaugccuuaagccaau

SEQ ID NO: 1509530 - RNA, 13 nt, Homo sapiens
ugcuauauugccc

SEQ ID NO: 1509531 - RNA, 17 nt, Homo sapiens
ugcuaucucaaaguuua

SEQ ID NO: 1509532 - RNA, 23 nt, Homo sapiens
ugcuaugguuuucuccaagagcu

SEQ ID NO: 1509533 - RNA, 18 nt, Homo sapiens
ugcuccccagugcuaccu

SEQ ID NO: 1509534 - RNA, 22 nt, Homo sapiens
ugcucggucaggagggugcagu

SEQ ID NO: 1509535 - RNA, 21 nt, Homo sapiens
ugcugaaggacagaacauugc

SEQ ID NO: 1509536 - RNA, 23 nt, Homo sapiens
ugcugacggaagccaacuuggcu

SEQ ID NO: 1509537 - RNA, 21 nt, Homo sapiens
ugcugagauacauacagaauu

SEQ ID NO: 1509538 - RNA, 20 nt, Homo sapiens
ugcugagcagcccagcacaa

SEQ ID NO: 1509539 - RNA, 13 nt, Homo sapiens
ugcugcacugccc

SEQ ID NO: 1509540 - RNA, 21 nt, Homo sapiens
ugcugcugaccugaucaccuc

SEQ ID NO: 1509541 - RNA, 17 nt, Homo sapiens
ugcuggggucauauaaa

SEQ ID NO: 1509542 - RNA, 19 nt, Homo sapiens
ugcugucagccaagucaug

SEQ ID NO: 1509543 - RNA, 13 nt, Homo sapiens
ugcugugcuaugg

SEQ ID NO: 1509544 - RNA, 18 nt, Homo sapiens
ugcuuaaagcaaggcaua

SEQ ID NO: 1509545 - RNA, 14 nt, Homo sapiens
ugcuucaugcucag

SEQ ID NO: 1509546 - RNA, 14 nt, Homo sapiens
ugcuucuccuccca

SEQ ID NO: 1509547 - RNA, 17 nt, Homo sapiens
ugcuugaaaccaaagau

SEQ ID NO: 1509548 - RNA, 15 nt, Homo sapiens
ugcuuguaaaaccaa

SEQ ID NO: 1509549 - RNA, 18 nt, Homo sapiens
ugcuuucaucacuaccuu

SEQ ID NO: 1509550 - RNA, 13 nt, Homo sapiens
ugcuuugccaaaa

SEQ ID NO: 1509551 - RNA, 14 nt, Homo sapiens
ugcuuuguauccau

SEQ ID NO: 1509552 - RNA, 19 nt, Homo sapiens
uggaaaaaucagaagcaca

SEQ ID NO: 1509553 - RNA, 20 nt, Homo sapiens
uggaaaaaucagaagcacaa

SEQ ID NO: 1509554 - RNA, 21 nt, Homo sapiens
uggaaaaaucagaagcacaaa

SEQ ID NO: 1509555 - RNA, 16 nt, Homo sapiens
uggaaaacucaggauu

SEQ ID NO: 1509556 - RNA, 16 nt, Homo sapiens
uggaaagacugauugu

SEQ ID NO: 1509557 - RNA, 18 nt, Homo sapiens
uggaaagcaucaccucag

SEQ ID NO: 1509558 - RNA, 15 nt, Homo sapiens
uggaaaguucagcca

SEQ ID NO: 1509559 - RNA, 15 nt, Homo sapiens
uggaaauaaaccugg

SEQ ID NO: 1509560 - RNA, 22 nt, Homo sapiens
uggaaauguaauaauaaugaau

SEQ ID NO: 1509561 - RNA, 16 nt, Homo sapiens
uggaagaaagcaacaa

SEQ ID NO: 1509562 - RNA, 14 nt, Homo sapiens
uggaagcacauguu

SEQ ID NO: 1509563 - RNA, 20 nt, Homo sapiens
uggaagccaggacugugaua

SEQ ID NO: 1509564 - RNA, 14 nt, Homo sapiens
uggaauaaagcccu

SEQ ID NO: 1509565 - RNA, 23 nt, Homo sapiens
uggaauuuucuuacccauauauc

SEQ ID NO: 1509566 - RNA, 14 nt, Homo sapiens
uggacaaaauggaa

SEQ ID NO: 1509567 - RNA, 17 nt, Homo sapiens
uggacaugcgugaccag

SEQ ID NO: 1509568 - RNA, 13 nt, Homo sapiens
uggaccacuccag

SEQ ID NO: 1509569 - RNA, 19 nt, Homo sapiens
uggagaaagggaaguggaa

SEQ ID NO: 1509570 - RNA, 23 nt, Homo sapiens
uggagaccgugaccagugcugcu

SEQ ID NO: 1509571 - RNA, 23 nt, Homo sapiens
uggagcccaggaguuugaggcug

SEQ ID NO: 1509572 - RNA, 18 nt, Homo sapiens
uggagggaggcucuucag

SEQ ID NO: 1509573 - RNA, 20 nt, Homo sapiens
uggaggucacauucaggaag

SEQ ID NO: 1509574 - RNA, 20 nt, Homo sapiens
uggagucuuguacacuuaag

SEQ ID NO: 1509575 - RNA, 18 nt, Homo sapiens
uggaguguaagugcuuca

SEQ ID NO: 1509576 - RNA, 16 nt, Homo sapiens
uggauauggugcaaaa

SEQ ID NO: 1509577 - RNA, 16 nt, Homo sapiens
uggaucuguccaagga

SEQ ID NO: 1509578 - RNA, 20 nt, Homo sapiens
uggaucuuuugguggaguca

SEQ ID NO: 1509579 - RNA, 22 nt, Homo sapiens
uggaugacgugaagccacagga

SEQ ID NO: 1509580 - RNA, 21 nt, Homo sapiens
uggaugcuagugcuguagagu

SEQ ID NO: 1509581 - RNA, 14 nt, Homo sapiens
uggaugguagaaua

SEQ ID NO: 1509582 - RNA, 14 nt, Homo sapiens
uggauuauuuagau

SEQ ID NO: 1509583 - RNA, 17 nt, Homo sapiens
uggcaaagguggcucuc

SEQ ID NO: 1509584 - RNA, 16 nt, Homo sapiens
uggcagagcacagccc

SEQ ID NO: 1509585 - RNA, 20 nt, Homo sapiens
uggcaggacccuuaggaauc

SEQ ID NO: 1509586 - RNA, 16 nt, Homo sapiens
uggcaggagaaucaau

SEQ ID NO: 1509587 - RNA, 15 nt, Homo sapiens
uggcaucacagggca

SEQ ID NO: 1509588 - RNA, 13 nt, Homo sapiens
uggccaagccugg

SEQ ID NO: 1509589 - RNA, 20 nt, Homo sapiens
uggccaaggugaauagcaca

SEQ ID NO: 1509590 - RNA, 13 nt, Homo sapiens
uggccacucuuga

SEQ ID NO: 1509591 - RNA, 19 nt, Homo sapiens
uggcccuuucuggaccaga

SEQ ID NO: 1509592 - RNA, 23 nt, Homo sapiens
uggcgacugcagcugcaccauca

SEQ ID NO: 1509593 - RNA, 15 nt, Homo sapiens
uggcgcaucauaugc

SEQ ID NO: 1509594 - RNA, 16 nt, Homo sapiens
uggcgcaucauaugca

SEQ ID NO: 1509595 - RNA, 19 nt, Homo sapiens
uggcuaauuccccuuccau

SEQ ID NO: 1509596 - RNA, 22 nt, Homo sapiens
uggcuaggaaagggaagccuga

SEQ ID NO: 1509597 - RNA, 12 nt, Homo sapiens
uggcucuucacc

SEQ ID NO: 1509598 - RNA, 17 nt, Homo sapiens
uggcugaccccaaagag

SEQ ID NO: 1509599 - RNA, 12 nt, Homo sapiens
uggcugcaguga

SEQ ID NO: 1509600 - RNA, 17 nt, Homo sapiens
uggcugcucauuccuuc

SEQ ID NO: 1509601 - RNA, 14 nt, Homo sapiens
uggcuuagugccac

SEQ ID NO: 1509602 - RNA, 15 nt, Homo sapiens
ucugaaccacuuugc

SEQ ID NO: 1509603 - RNA, 15 nt, Homo sapiens
ucugagaagacacaa

SEQ ID NO: 1509604 - RNA, 20 nt, Homo sapiens
ucugagcaagagcuggcaaa

SEQ ID NO: 1509605 - RNA, 14 nt, Homo sapiens
ucugauuggcucac

SEQ ID NO: 1509606 - RNA, 20 nt, Homo sapiens
ucugcacuaauugacccaaa

SEQ ID NO: 1509607 - RNA, 12 nt, Homo sapiens
ucugcacugggu

SEQ ID NO: 1509608 - RNA, 20 nt, Homo sapiens
ucugcagggagcaacucucc

SEQ ID NO: 1509609 - RNA, 16 nt, Homo sapiens
ucugccccacccucaa

SEQ ID NO: 1509610 - RNA, 15 nt, Homo sapiens
ucugcguuacaacag

SEQ ID NO: 1509611 - RNA, 22 nt, Homo sapiens
ucuggaaaccaaauaggcuuua

SEQ ID NO: 1509612 - RNA, 15 nt, Homo sapiens
ucuggaagacaugau

SEQ ID NO: 1509613 - RNA, 22 nt, Homo sapiens
ucuggaaguuucuggugccauu

SEQ ID NO: 1509614 - RNA, 18 nt, Homo sapiens
ucuggauauggugcaaaa

SEQ ID NO: 1509615 - RNA, 23 nt, Homo sapiens
ucuggcugcaacuuaaugcucug

SEQ ID NO: 1509616 - RNA, 18 nt, Homo sapiens
ucugggauucccaccaag

SEQ ID NO: 1509617 - RNA, 14 nt, Homo sapiens
ucuguaaacucaaa

SEQ ID NO: 1509618 - RNA, 13 nt, Homo sapiens
ucuguaauuucac

SEQ ID NO: 1509619 - RNA, 20 nt, Homo sapiens
ucugucacacuaaacuucuu

SEQ ID NO: 1509620 - RNA, 18 nt, Homo sapiens
ucuguuaugcaagcacaa

SEQ ID NO: 1509621 - RNA, 16 nt, Homo sapiens
ucuguucugccuuccg

SEQ ID NO: 1509622 - RNA, 16 nt, Homo sapiens
ucuguuucccaccuca

SEQ ID NO: 1509623 - RNA, 14 nt, Homo sapiens
ucuuagcugucacc

SEQ ID NO: 1509624 - RNA, 22 nt, Homo sapiens
ucuucaaaugccugacuaggga

SEQ ID NO: 1509625 - RNA, 16 nt, Homo sapiens
ucuucagaagacacug

SEQ ID NO: 1509626 - RNA, 16 nt, Homo sapiens
ucuucauggugacauu

SEQ ID NO: 1509627 - RNA, 22 nt, Homo sapiens
ucuuccguggucagagugccac

SEQ ID NO: 1509628 - RNA, 23 nt, Homo sapiens
ucuuccguggucagagugccacu

SEQ ID NO: 1509629 - RNA, 21 nt, Homo sapiens
ucuuccuuucuaaaucugaga

SEQ ID NO: 1509630 - RNA, 18 nt, Homo sapiens
ucuucuuagcugucaccu

SEQ ID NO: 1509631 - RNA, 17 nt, Homo sapiens
ucuucuuauucaugcuu

SEQ ID NO: 1509632 - RNA, 17 nt, Homo sapiens
ucuugaaaucugaaugc

SEQ ID NO: 1509633 - RNA, 21 nt, Homo sapiens
ucuugaacugguugugaauaa

SEQ ID NO: 1509634 - RNA, 13 nt, Homo sapiens
ucuugcauugcaa

SEQ ID NO: 1509635 - RNA, 14 nt, Homo sapiens
ucuugcauugcaaa

SEQ ID NO: 1509636 - RNA, 16 nt, Homo sapiens
ucuuggcaguauucca

SEQ ID NO: 1509637 - RNA, 16 nt, Homo sapiens
ucuugguuugccuucc

SEQ ID NO: 1509638 - RNA, 13 nt, Homo sapiens
ucuuuaaaaccau

SEQ ID NO: 1509639 - RNA, 18 nt, Homo sapiens
ucuuuaaaaccauaaacu

SEQ ID NO: 1509640 - RNA, 16 nt, Homo sapiens
ucuuuaguucugucag

SEQ ID NO: 1509641 - RNA, 14 nt, Homo sapiens
ucuuucagcacuca

SEQ ID NO: 1509642 - RNA, 22 nt, Homo sapiens
ucuuuccccaccucuuccuucc

SEQ ID NO: 1509643 - RNA, 19 nt, Homo sapiens
ucuuuccuaagaaagacau

SEQ ID NO: 1509644 - RNA, 17 nt, Homo sapiens
ucuuugagaacaaugga

SEQ ID NO: 1509645 - RNA, 12 nt, Homo sapiens
ucuuugcaugga

SEQ ID NO: 1509646 - RNA, 22 nt, Homo sapiens
ucuuugcucauggcaacaguua

SEQ ID NO: 1509647 - RNA, 16 nt, Homo sapiens
ugaaaaaaaugcauuu

SEQ ID NO: 1509648 - RNA, 12 nt, Homo sapiens
ugaaaaugauua

SEQ ID NO: 1509649 - RNA, 19 nt, Homo sapiens
ugaaacuucauaaauguuc

SEQ ID NO: 1509650 - RNA, 21 nt, Homo sapiens
ugaaaucugguuagauaauga

SEQ ID NO: 1509651 - RNA, 16 nt, Homo sapiens
ugaaccauuaaccaga

SEQ ID NO: 1509652 - RNA, 19 nt, Homo sapiens
ugaacccagagucaggaag

SEQ ID NO: 1509653 - RNA, 18 nt, Homo sapiens
ugaacgccaaacuaaagu

SEQ ID NO: 1509654 - RNA, 15 nt, Homo sapiens
ugaacucgaagccca

SEQ ID NO: 1509655 - RNA, 12 nt, Homo sapiens
ugaacugccaaa

SEQ ID NO: 1509656 - RNA, 13 nt, Homo sapiens
ugaagccacugaa

SEQ ID NO: 1509657 - RNA, 14 nt, Homo sapiens
ugaaggauccugga

SEQ ID NO: 1509658 - RNA, 14 nt, Homo sapiens
ugaagggaaagggc

SEQ ID NO: 1509659 - RNA, 16 nt, Homo sapiens
ugaaggguaaagaagu

SEQ ID NO: 1509660 - RNA, 21 nt, Homo sapiens
ugaaguuagggaugacuguga

SEQ ID NO: 1509661 - RNA, 20 nt, Homo sapiens
ugaauagcgaaucaucucaa

SEQ ID NO: 1509662 - RNA, 21 nt, Homo sapiens
ugaauagcgaaucaucucaaa

SEQ ID NO: 1509663 - RNA, 14 nt, Homo sapiens
ugaaucaggggcaa

SEQ ID NO: 1509664 - RNA, 21 nt, Homo sapiens
ugaaugaguaggaaaggaaua

SEQ ID NO: 1509665 - RNA, 18 nt, Homo sapiens
ugaaugcacacuagccuc

SEQ ID NO: 1509666 - RNA, 12 nt, Homo sapiens
ugaauguucaau

SEQ ID NO: 1509667 - RNA, 15 nt, Homo sapiens
ugaauucuuaugcuu

SEQ ID NO: 1509668 - RNA, 17 nt, Homo sapiens
ugaauuugccuuccuca

SEQ ID NO: 1509669 - RNA, 18 nt, Homo sapiens
ugaauuugccuuccucau

SEQ ID NO: 1509670 - RNA, 23 nt, Homo sapiens
ugacaaauucuuuuucacacuga

SEQ ID NO: 1509671 - RNA, 11 nt, Homo sapiens
ugacacugucu

SEQ ID NO: 1509672 - RNA, 14 nt, Homo sapiens
ugacacugucugcu

SEQ ID NO: 1509673 - RNA, 14 nt, Homo sapiens
ugaccagugcugcu

SEQ ID NO: 1509674 - RNA, 15 nt, Homo sapiens
ugaccagugcugcug

SEQ ID NO: 1509675 - RNA, 19 nt, Homo sapiens
ugaccggcagaauguucug

SEQ ID NO: 1509676 - RNA, 13 nt, Homo sapiens
ugacuauggggaa

SEQ ID NO: 1509677 - RNA, 15 nt, Homo sapiens
ugacugcucggucag

SEQ ID NO: 1509678 - RNA, 16 nt, Homo sapiens
ugacuguucuugguaa

SEQ ID NO: 1509679 - RNA, 14 nt, Homo sapiens
ugacuucucuugaa

SEQ ID NO: 1509680 - RNA, 22 nt, Homo sapiens
ugagaaacuuugaucucugcuu

SEQ ID NO: 1509681 - RNA, 14 nt, Homo sapiens
ugagaagccaugua

SEQ ID NO: 1509682 - RNA, 21 nt, Homo sapiens
ugagacccucgccacggggag

SEQ ID NO: 1509683 - RNA, 20 nt, Homo sapiens
ugagauuuccugacagggaa

SEQ ID NO: 1509684 - RNA, 18 nt, Homo sapiens
ugagcacccccucauucc

SEQ ID NO: 1509685 - RNA, 18 nt, Homo sapiens
ugagcagcccagcacaac

SEQ ID NO: 1509686 - RNA, 14 nt, Homo sapiens
cuauuccaaagugc

SEQ ID NO: 1509687 - RNA, 16 nt, Homo sapiens
cuauuguguuucacaa

SEQ ID NO: 1509688 - RNA, 15 nt, Homo sapiens
cuauuuaacuugagg

SEQ ID NO: 1509689 - RNA, 17 nt, Homo sapiens
cuauuuaacuugagggu

SEQ ID NO: 1509690 - RNA, 20 nt, Homo sapiens
cuauuuaaggugugcaauuu

SEQ ID NO: 1509691 - RNA, 13 nt, Homo sapiens
cuauuuauuucac

SEQ ID NO: 1509692 - RNA, 14 nt, Homo sapiens
cucaaacacacaaa

SEQ ID NO: 1509693 - RNA, 21 nt, Homo sapiens
cucaaacccuguggggccuga

SEQ ID NO: 1509694 - RNA, 11 nt, Homo sapiens
cucaagacuga

SEQ ID NO: 1509695 - RNA, 19 nt, Homo sapiens
cucacuauucaaguauuag

SEQ ID NO: 1509696 - RNA, 23 nt, Homo sapiens
cucacuauucaaguauuaggggu

SEQ ID NO: 1509697 - RNA, 19 nt, Homo sapiens
cucacuuucccuuguguca

SEQ ID NO: 1509698 - RNA, 12 nt, Homo sapiens
cucacuuugccc

SEQ ID NO: 1509699 - RNA, 14 nt, Homo sapiens
cucagacauuccaa

SEQ ID NO: 1509700 - RNA, 17 nt, Homo sapiens
cucagcaauagggugca

SEQ ID NO: 1509701 - RNA, 15 nt, Homo sapiens
cucagcauaaguaaa

SEQ ID NO: 1509702 - RNA, 21 nt, Homo sapiens
cucagccuuggcagcccugau

SEQ ID NO: 1509703 - RNA, 16 nt, Homo sapiens
cucagguagauuuugu

SEQ ID NO: 1509704 - RNA, 14 nt, Homo sapiens
cucagguaguacug

SEQ ID NO: 1509705 - RNA, 21 nt, Homo sapiens
cucagugggacaaaccagagc

SEQ ID NO: 1509706 - RNA, 10 nt, Homo sapiens
cucauaauag

SEQ ID NO: 1509707 - RNA, 17 nt, Homo sapiens
cucaucccuguuccuca

SEQ ID NO: 1509708 - RNA, 15 nt, Homo sapiens
cucaucuacaagcau

SEQ ID NO: 1509709 - RNA, 21 nt, Homo sapiens
cucaucuacaagcauuugccc

SEQ ID NO: 1509710 - RNA, 18 nt, Homo sapiens
cucauuccuguagucaaa

SEQ ID NO: 1509711 - RNA, 14 nt, Homo sapiens
cuccaggcucuuug

SEQ ID NO: 1509712 - RNA, 19 nt, Homo sapiens
cucccaaagugcugggauu

SEQ ID NO: 1509713 - RNA, 22 nt, Homo sapiens
cucccacauugucaccauuuca

SEQ ID NO: 1509714 - RNA, 21 nt, Homo sapiens
cuccccagcccuuugcaggcc

SEQ ID NO: 1509715 - RNA, 14 nt, Homo sapiens
cuccccgccugucc

SEQ ID NO: 1509716 - RNA, 22 nt, Homo sapiens
cucccugguuugcagcuguuuu

SEQ ID NO: 1509717 - RNA, 18 nt, Homo sapiens
cucccuguuaucugcuag

SEQ ID NO: 1509718 - RNA, 13 nt, Homo sapiens
cuccgccauucca

SEQ ID NO: 1509719 - RNA, 15 nt, Homo sapiens
cuccuaagacaccug

SEQ ID NO: 1509720 - RNA, 12 nt, Homo sapiens
cuccucaaaagc

SEQ ID NO: 1509721 - RNA, 16 nt, Homo sapiens
cuccugaccugaggcu

SEQ ID NO: 1509722 - RNA, 15 nt, Homo sapiens
cuccuguagcacaaa

SEQ ID NO: 1509723 - RNA, 17 nt, Homo sapiens
cuccugugcuacuuugc

SEQ ID NO: 1509724 - RNA, 19 nt, Homo sapiens
cuccuuuugcuugaaacca

SEQ ID NO: 1509725 - RNA, 23 nt, Homo sapiens
cuccuuuugcuugaaaccaaaga

SEQ ID NO: 1509726 - RNA, 21 nt, Homo sapiens
cucgaauaaaggaugggacca

SEQ ID NO: 1509727 - RNA, 17 nt, Homo sapiens
cucggccucccaaagug

SEQ ID NO: 1509728 - RNA, 12 nt, Homo sapiens
cucguaccagcc

SEQ ID NO: 1509729 - RNA, 16 nt, Homo sapiens
cucuaacuccugccau

SEQ ID NO: 1509730 - RNA, 19 nt, Homo sapiens
cucuaagccacucuuccaa

SEQ ID NO: 1509731 - RNA, 12 nt, Homo sapiens
cucuaagcugug

SEQ ID NO: 1509732 - RNA, 18 nt, Homo sapiens
cucuacuccuaccucagc

SEQ ID NO: 1509733 - RNA, 18 nt, Homo sapiens
cucuagguccauuuuccu

SEQ ID NO: 1509734 - RNA, 15 nt, Homo sapiens
cucucaucacuaccu

SEQ ID NO: 1509735 - RNA, 18 nt, Homo sapiens
cucuccuuuuugcuuccu

SEQ ID NO: 1509736 - RNA, 13 nt, Homo sapiens
cucucucucucuu

SEQ ID NO: 1509737 - RNA, 15 nt, Homo sapiens
cucugauacccagag

SEQ ID NO: 1509738 - RNA, 15 nt, Homo sapiens
cucugcagcacuuua

SEQ ID NO: 1509739 - RNA, 12 nt, Homo sapiens
cucugcaucuca

SEQ ID NO: 1509740 - RNA, 13 nt, Homo sapiens
cucugcuccagag

SEQ ID NO: 1509741 - RNA, 17 nt, Homo sapiens
cucuggaaaaugugacc

SEQ ID NO: 1509742 - RNA, 18 nt, Homo sapiens
cucuggaaaaugugaccc

SEQ ID NO: 1509743 - RNA, 20 nt, Homo sapiens
cucugggccaagacuccugu

SEQ ID NO: 1509744 - RNA, 23 nt, Homo sapiens
cucuggucaaguagaucauggca

SEQ ID NO: 1509745 - RNA, 18 nt, Homo sapiens
cucuggucuguagguuug

SEQ ID NO: 1509746 - RNA, 17 nt, Homo sapiens
cucugucgccaggcuag

SEQ ID NO: 1509747 - RNA, 16 nt, Homo sapiens
cucuuaaugcuguguu

SEQ ID NO: 1509748 - RNA, 15 nt, Homo sapiens
cucuuaccaaaacag

SEQ ID NO: 1509749 - RNA, 15 nt, Homo sapiens
cucuuacugcaguaa

SEQ ID NO: 1509750 - RNA, 22 nt, Homo sapiens
cucuuacugcaguaacacuggc

SEQ ID NO: 1509751 - RNA, 20 nt, Homo sapiens
cucuuccaaaggcauaagac

SEQ ID NO: 1509752 - RNA, 15 nt, Homo sapiens
cugaaaaucuaauau

SEQ ID NO: 1509753 - RNA, 15 nt, Homo sapiens
cugaaagccauuugu

SEQ ID NO: 1509754 - RNA, 13 nt, Homo sapiens
cugaagaccucca

SEQ ID NO: 1509755 - RNA, 20 nt, Homo sapiens
cugaagcgacuauaaagguu

SEQ ID NO: 1509756 - RNA, 19 nt, Homo sapiens
cugaaggacagaacauugc

SEQ ID NO: 1509757 - RNA, 23 nt, Homo sapiens
cugaaucauccgaggcaaagaga

SEQ ID NO: 1509758 - RNA, 15 nt, Homo sapiens
cugaauuagccaaaa

SEQ ID NO: 1509759 - RNA, 17 nt, Homo sapiens
cugaccaacauggugaa

SEQ ID NO: 1509760 - RNA, 14 nt, Homo sapiens
cugaccccaaagag

SEQ ID NO: 1509761 - RNA, 15 nt, Homo sapiens
cugaccuugugaucu

SEQ ID NO: 1509762 - RNA, 15 nt, Homo sapiens
cugacuuugugaucc

SEQ ID NO: 1509763 - RNA, 14 nt, Homo sapiens
cugagaaucuagcc

SEQ ID NO: 1509764 - RNA, 14 nt, Homo sapiens
cugagaaugaauga

SEQ ID NO: 1509765 - RNA, 12 nt, Homo sapiens
cugagaauucca

SEQ ID NO: 1509766 - RNA, 18 nt, Homo sapiens
cugagacuuucagugcac

SEQ ID NO: 1509767 - RNA, 17 nt, Homo sapiens
cugagauccagcacaac

SEQ ID NO: 1509768 - RNA, 20 nt, Homo sapiens
cugagcaaaucaccacaaac

SEQ ID NO: 1509769 - RNA, 20 nt, Homo sapiens
cugagccuccacagcagugg

SEQ ID NO: 1509770 - RNA, 20 nt, Homo sapiens
cugagcugaacccauuuuga

SEQ ID NO: 1509771 - RNA, 18 nt, Homo sapiens
cugagcuuucuagccuaa

SEQ ID NO: 1509772 - RNA, 22 nt, Homo sapiens
cugaggcaggggaguaguggag

SEQ ID NO: 1509773 - RNA, 17 nt, Homo sapiens
cugaggcuccugugcua

SEQ ID NO: 1509774 - RNA, 21 nt, Homo sapiens
cugaggggggccgugcccagg

SEQ ID NO: 1509775 - RNA, 12 nt, Homo sapiens
cugauaagcaaa

SEQ ID NO: 1509776 - RNA, 20 nt, Homo sapiens
cugauacaauuugcccaagg

SEQ ID NO: 1509777 - RNA, 14 nt, Homo sapiens
cugaucauuacaug

SEQ ID NO: 1509778 - RNA, 23 nt, Homo sapiens
cugaucccuuucccaugauccag

SEQ ID NO: 1509779 - RNA, 23 nt, Homo sapiens
cugaugcuuugcuucaaauccau

SEQ ID NO: 1509780 - RNA, 16 nt, Homo sapiens
cugauuaccugccaau

SEQ ID NO: 1509781 - RNA, 20 nt, Homo sapiens
cugauuccccuccaccaaac

SEQ ID NO: 1509782 - RNA, 18 nt, Homo sapiens
cugauuuaacacuaucca

SEQ ID NO: 1509783 - RNA, 19 nt, Homo sapiens
cugcaaaggcgcagugcuu

SEQ ID NO: 1509784 - RNA, 14 nt, Homo sapiens
cugcacuccagaau

SEQ ID NO: 1509785 - RNA, 18 nt, Homo sapiens
cugcagagagaagccugu

SEQ ID NO: 1509786 - RNA, 14 nt, Homo sapiens
cugcagcacuuuaa

SEQ ID NO: 1509787 - RNA, 21 nt, Homo sapiens
cugcagcuuaaaacaagcaaa

SEQ ID NO: 1509788 - RNA, 23 nt, Homo sapiens
cugcauuagagcccauuucaauu

SEQ ID NO: 1509789 - RNA, 16 nt, Homo sapiens
cugccagccacaucca

SEQ ID NO: 1509790 - RNA, 16 nt, Homo sapiens
cugccagccuggcuuc

SEQ ID NO: 1509791 - RNA, 17 nt, Homo sapiens
cugccauugggacccuc

SEQ ID NO: 1509792 - RNA, 18 nt, Homo sapiens
cugcccaggcacugcaaa

SEQ ID NO: 1509793 - RNA, 13 nt, Homo sapiens
cugccucugguca

SEQ ID NO: 1509794 - RNA, 20 nt, Homo sapiens
cugcuacacaaaagccaaaa

SEQ ID NO: 1509795 - RNA, 12 nt, Homo sapiens
cugcucugcuau

SEQ ID NO: 1509796 - RNA, 15 nt, Homo sapiens
cugcugcacugcccu

SEQ ID NO: 1509797 - RNA, 13 nt, Homo sapiens
cugcuuacuaaug

SEQ ID NO: 1509798 - RNA, 16 nt, Homo sapiens
cugcuucuccucccag

SEQ ID NO: 1509799 - RNA, 15 nt, Homo sapiens
cugcuugcacuuugu

SEQ ID NO: 1509800 - RNA, 16 nt, Homo sapiens
cuggaaaacucaggau

SEQ ID NO: 1509801 - RNA, 18 nt, Homo sapiens
cuggaaaacucaggauuc

SEQ ID NO: 1509802 - RNA, 15 nt, Homo sapiens
cuggaaaaugugacc

SEQ ID NO: 1509803 - RNA, 13 nt, Homo sapiens
cuggaaagaccca

SEQ ID NO: 1509804 - RNA, 21 nt, Homo sapiens
cuggaaucaaggaauccugag

SEQ ID NO: 1509805 - RNA, 16 nt, Homo sapiens
cuggaauggaauucag

SEQ ID NO: 1509806 - RNA, 21 nt, Homo sapiens
cuggaauuuucagucaucuca

SEQ ID NO: 1509807 - RNA, 17 nt, Homo sapiens
cuggagcaaaagucauu

SEQ ID NO: 1509808 - RNA, 16 nt, Homo sapiens
cuggaggacacacagu

SEQ ID NO: 1509809 - RNA, 17 nt, Homo sapiens
cuggauauggugcaaaa

SEQ ID NO: 1509810 - RNA, 14 nt, Homo sapiens
cuggaucaggguug

SEQ ID NO: 1509811 - RNA, 19 nt, Homo sapiens
cuggaucaggguuguucug

SEQ ID NO: 1509812 - RNA, 23 nt, Homo sapiens
cuggaucuuuugguggagucagg

SEQ ID NO: 1509813 - RNA, 18 nt, Homo sapiens
cuggauuguugacaugag

SEQ ID NO: 1509814 - RNA, 16 nt, Homo sapiens
cuggccucaagcaauc

SEQ ID NO: 1509815 - RNA, 19 nt, Homo sapiens
cuggcugaccccaaagagc

SEQ ID NO: 1509816 - RNA, 13 nt, Homo sapiens
cuggcugagcuga

SEQ ID NO: 1509817 - RNA, 13 nt, Homo sapiens
cugggaacacagc

SEQ ID NO: 1509818 - RNA, 13 nt, Homo sapiens
cugggacuuucac

SEQ ID NO: 1509819 - RNA, 16 nt, Homo sapiens
cugggagaaccucagg

SEQ ID NO: 1509820 - RNA, 22 nt, Homo sapiens
cugggauuacagacaugagcca

SEQ ID NO: 1509821 - RNA, 20 nt, Homo sapiens
cugggccaaguuccucuagu

SEQ ID NO: 1509822 - RNA, 22 nt, Homo sapiens
gagaccaaaggauccagagacu

SEQ ID NO: 1509823 - RNA, 20 nt, Homo sapiens
gagaccccuuccuuuccucu

SEQ ID NO: 1509824 - RNA, 20 nt, Homo sapiens
gagacuugugcucaaggaau

SEQ ID NO: 1509825 - RNA, 14 nt, Homo sapiens
gagagauggaauaa

SEQ ID NO: 1509826 - RNA, 20 nt, Homo sapiens
gagagcagcuggcucuccac

SEQ ID NO: 1509827 - RNA, 18 nt, Homo sapiens
gagaggaccccacuggac

SEQ ID NO: 1509828 - RNA, 12 nt, Homo sapiens
gagaggacucug

SEQ ID NO: 1509829 - RNA, 18 nt, Homo sapiens
gagagggaagagugcauu

SEQ ID NO: 1509830 - RNA, 18 nt, Homo sapiens
gagauaagaucuauagcc

SEQ ID NO: 1509831 - RNA, 23 nt, Homo sapiens
gagauacaucuuauaaacugacu

SEQ ID NO: 1509832 - RNA, 19 nt, Homo sapiens
gagaucaacacacacuccc

SEQ ID NO: 1509833 - RNA, 19 nt, Homo sapiens
gagaugcugggauagccau

SEQ ID NO: 1509834 - RNA, 13 nt, Homo sapiens
gagauuacaggug

SEQ ID NO: 1509835 - RNA, 22 nt, Homo sapiens
gagauuuccugacagggaaaag

SEQ ID NO: 1509836 - RNA, 15 nt, Homo sapiens
gagauuuucuuggca

SEQ ID NO: 1509837 - RNA, 23 nt, Homo sapiens
gagauuuucuuggcaguauucca

SEQ ID NO: 1509838 - RNA, 14 nt, Homo sapiens
gagcaacucuccac

SEQ ID NO: 1509839 - RNA, 13 nt, Homo sapiens
gagcaagacucca

SEQ ID NO: 1509840 - RNA, 15 nt, Homo sapiens
gagcaauacuuucug

SEQ ID NO: 1509841 - RNA, 18 nt, Homo sapiens
gagcaggcucagacucug

SEQ ID NO: 1509842 - RNA, 22 nt, Homo sapiens
gagcauaucaaaaaguauuaaa

SEQ ID NO: 1509843 - RNA, 19 nt, Homo sapiens
gagcauuacgugagccagg

SEQ ID NO: 1509844 - RNA, 20 nt, Homo sapiens
gagccaccagggcacugucu

SEQ ID NO: 1509845 - RNA, 16 nt, Homo sapiens
gagcccuggcaggaug

SEQ ID NO: 1509846 - RNA, 12 nt, Homo sapiens
gagccuggagaa

SEQ ID NO: 1509847 - RNA, 17 nt, Homo sapiens
gagccugugcuaaagaa

SEQ ID NO: 1509848 - RNA, 15 nt, Homo sapiens
gagcugccagccggg

SEQ ID NO: 1509849 - RNA, 21 nt, Homo sapiens
gagcuggaaauaaaccuggag

SEQ ID NO: 1509850 - RNA, 16 nt, Homo sapiens
gagcuggcugucuucc

SEQ ID NO: 1509851 - RNA, 17 nt, Homo sapiens
gagcuguggacuuuguu

SEQ ID NO: 1509852 - RNA, 16 nt, Homo sapiens
gagcuuggcagcugaa

SEQ ID NO: 1509853 - RNA, 17 nt, Homo sapiens
gagcuuuaguccuagag

SEQ ID NO: 1509854 - RNA, 12 nt, Homo sapiens
gaggaagcacac

SEQ ID NO: 1509855 - RNA, 17 nt, Homo sapiens
gaggacacacagucuca

SEQ ID NO: 1509856 - RNA, 13 nt, Homo sapiens
gaggaucacugga

SEQ ID NO: 1509857 - RNA, 21 nt, Homo sapiens
gaggcaccugcuggaaaccac

SEQ ID NO: 1509858 - RNA, 23 nt, Homo sapiens
gaggcagcgugaaagcagaugag

SEQ ID NO: 1509859 - RNA, 13 nt, Homo sapiens
gaggcucuucagu

SEQ ID NO: 1509860 - RNA, 20 nt, Homo sapiens
gagggaccuacugaacccag

SEQ ID NO: 1509861 - RNA, 21 nt, Homo sapiens
gagggaugccacccagcaaca

SEQ ID NO: 1509862 - RNA, 21 nt, Homo sapiens
gagggauucuggucuucacug

SEQ ID NO: 1509863 - RNA, 14 nt, Homo sapiens
gaggguuugcagaa

SEQ ID NO: 1509864 - RNA, 18 nt, Homo sapiens
gaggucaagauuucagga

SEQ ID NO: 1509865 - RNA, 20 nt, Homo sapiens
gaggucuccacugaggaugu

SEQ ID NO: 1509866 - RNA, 19 nt, Homo sapiens
gagguuuggggucugccac

SEQ ID NO: 1509867 - RNA, 23 nt, Homo sapiens
gagguuugucaacaaaaagacau

SEQ ID NO: 1509868 - RNA, 23 nt, Homo sapiens
gagguuugucaacacaaagacau

SEQ ID NO: 1509869 - RNA, 14 nt, Homo sapiens
gaguauaauauuca

SEQ ID NO: 1509870 - RNA, 18 nt, Homo sapiens
gaguccugucagcuuccc

SEQ ID NO: 1509871 - RNA, 12 nt, Homo sapiens
gagucuaccucu

SEQ ID NO: 1509872 - RNA, 22 nt, Homo sapiens
gagucugggcaaugaaaccaaa

SEQ ID NO: 1509873 - RNA, 19 nt, Homo sapiens
gagugcaguuuccaauccc

SEQ ID NO: 1509874 - RNA, 15 nt, Homo sapiens
gaguuaacugugaaa

SEQ ID NO: 1509875 - RNA, 18 nt, Homo sapiens
gaguuguggaaagccucu

SEQ ID NO: 1509876 - RNA, 15 nt, Homo sapiens
gaguuuaacaugugu

SEQ ID NO: 1509877 - RNA, 12 nt, Homo sapiens
gaguuuagcacg

SEQ ID NO: 1509878 - RNA, 23 nt, Homo sapiens
gaguuugaaggaggugagggaug

SEQ ID NO: 1509879 - RNA, 17 nt, Homo sapiens
gauaacccuuauuccau

SEQ ID NO: 1509880 - RNA, 15 nt, Homo sapiens
gauaacugagaauuu

SEQ ID NO: 1509881 - RNA, 15 nt, Homo sapiens
gauaauaugcuaaau

SEQ ID NO: 1509882 - RNA, 17 nt, Homo sapiens
gauaaucagaagcuaua

SEQ ID NO: 1509883 - RNA, 18 nt, Homo sapiens
gauaaucagaagcuauaa

SEQ ID NO: 1509884 - RNA, 13 nt, Homo sapiens
gauacccagagca

SEQ ID NO: 1509885 - RNA, 17 nt, Homo sapiens
gauacccagagcauuac

SEQ ID NO: 1509886 - RNA, 17 nt, Homo sapiens
gauacgcuggucuggau

SEQ ID NO: 1509887 - RNA, 13 nt, Homo sapiens
gauagaaaugcca

SEQ ID NO: 1509888 - RNA, 18 nt, Homo sapiens
gauagaacaaugcuauaa

SEQ ID NO: 1509889 - RNA, 21 nt, Homo sapiens
gauagaacaggcugguucuga

SEQ ID NO: 1509890 - RNA, 18 nt, Homo sapiens
gauagauccauuuggaca

SEQ ID NO: 1509891 - RNA, 12 nt, Homo sapiens
gauagggacuga

SEQ ID NO: 1509892 - RNA, 19 nt, Homo sapiens
gauaucaaaaagacugugg

SEQ ID NO: 1509893 - RNA, 13 nt, Homo sapiens
gauauuaaaggag

SEQ ID NO: 1509894 - RNA, 20 nt, Homo sapiens
gauauugggacacacaucaa

SEQ ID NO: 1509895 - RNA, 21 nt, Homo sapiens
gauauuguggguaacgugaga

SEQ ID NO: 1509896 - RNA, 21 nt, Homo sapiens
gaucagccuccgccauuccaa

SEQ ID NO: 1509897 - RNA, 19 nt, Homo sapiens
gaucauagguauuucaaaa

SEQ ID NO: 1509898 - RNA, 18 nt, Homo sapiens
gaucuccaaggaccaggu

SEQ ID NO: 1509899 - RNA, 12 nt, Homo sapiens
gaucuccugacc

SEQ ID NO: 1509900 - RNA, 17 nt, Homo sapiens
gaucuuccguggucaga

SEQ ID NO: 1509901 - RNA, 16 nt, Homo sapiens
gaucuugcauucccag

SEQ ID NO: 1509902 - RNA, 20 nt, Homo sapiens
gaucuugcauucccaguggu

SEQ ID NO: 1509903 - RNA, 20 nt, Homo sapiens
gaugaaauuuucuagacuuu

SEQ ID NO: 1509904 - RNA, 18 nt, Homo sapiens
gaugaccagaacaagguu

SEQ ID NO: 1509905 - RNA, 15 nt, Homo sapiens
gaugaggcuuuccau

SEQ ID NO: 1509906 - RNA, 18 nt, Homo sapiens
gaugaguuaacugugaaa

SEQ ID NO: 1509907 - RNA, 24 nt, Homo sapiens
gaugccacccagcaacacagagcu

SEQ ID NO: 1509908 - RNA, 17 nt, Homo sapiens
gaugcccaugguccagg

SEQ ID NO: 1509909 - RNA, 18 nt, Homo sapiens
gauggaauaaagcccuug

SEQ ID NO: 1509910 - RNA, 13 nt, Homo sapiens
gauggacuuccug

SEQ ID NO: 1509911 - RNA, 22 nt, Homo sapiens
gaugggucuccgcacuuggaaa

SEQ ID NO: 1509912 - RNA, 21 nt, Homo sapiens
gaugguaucuggguaagaaga

SEQ ID NO: 1509913 - RNA, 13 nt, Homo sapiens
gauggugcugacc

SEQ ID NO: 1509914 - RNA, 16 nt, Homo sapiens
gauggugcugaccucu

SEQ ID NO: 1509915 - RNA, 23 nt, Homo sapiens
gauguuaagcaaaggaaaccaaa

SEQ ID NO: 1509916 - RNA, 14 nt, Homo sapiens
gauuaaaauuccua

SEQ ID NO: 1509917 - RNA, 12 nt, Homo sapiens
gauuauuugaac

SEQ ID NO: 1509918 - RNA, 23 nt, Homo sapiens
gauuauuuguuauuuguacaguu

SEQ ID NO: 1509919 - RNA, 22 nt, Homo sapiens
gauuccauuuuacuuccaugau

SEQ ID NO: 1509920 - RNA, 15 nt, Homo sapiens
gauuccccaucucag

SEQ ID NO: 1509921 - RNA, 21 nt, Homo sapiens
gauuccccaucucaggccaga

SEQ ID NO: 1509922 - RNA, 21 nt, Homo sapiens
gauuccugggcaagaaccuaa

SEQ ID NO: 1509923 - RNA, 13 nt, Homo sapiens
gauucuccuguca

SEQ ID NO: 1509924 - RNA, 14 nt, Homo sapiens
gauuggcucaccca

SEQ ID NO: 1509925 - RNA, 20 nt, Homo sapiens
gauuuaacaaauacauucau

SEQ ID NO: 1509926 - RNA, 15 nt, Homo sapiens
gauuuugucuaccau

SEQ ID NO: 1509927 - RNA, 15 nt, Homo sapiens
gcaaaaagaugccuu

SEQ ID NO: 1509928 - RNA, 19 nt, Homo sapiens
gcaaaaagauuuaacaaau

SEQ ID NO: 1509929 - RNA, 16 nt, Homo sapiens
gcaaaagucauuacac

SEQ ID NO: 1509930 - RNA, 22 nt, Homo sapiens
gcaaacauaggaauaugacuca

SEQ ID NO: 1509931 - RNA, 21 nt, Homo sapiens
gcaaagcaccagcuucuccag

SEQ ID NO: 1509932 - RNA, 23 nt, Homo sapiens
gcaaagcuaaaauugaacuacuu

SEQ ID NO: 1509933 - RNA, 17 nt, Homo sapiens
gcaaagcuggagaugag

SEQ ID NO: 1509934 - RNA, 16 nt, Homo sapiens
gcaaaggaaaccaaag

SEQ ID NO: 1509935 - RNA, 17 nt, Homo sapiens
gcaaaggaaaccaaagg

SEQ ID NO: 1509936 - RNA, 12 nt, Homo sapiens
gcaaagucuaaa

SEQ ID NO: 1509937 - RNA, 18 nt, Homo sapiens
gcaacuggugacuguccc

SEQ ID NO: 1509938 - RNA, 21 nt, Homo sapiens
gcaagcacaaauuucaucucc

SEQ ID NO: 1509939 - RNA, 16 nt, Homo sapiens
gcaagucccugacucu

SEQ ID NO: 1509940 - RNA, 19 nt, Homo sapiens
gcaaucugagagauuugaa

SEQ ID NO: 1509941 - RNA, 18 nt, Homo sapiens
gcaauuuucgaacauucu

SEQ ID NO: 1509942 - RNA, 17 nt, Homo sapiens
gcacaaauuucaucucc

SEQ ID NO: 1509943 - RNA, 21 nt, Homo sapiens
gcacacagcuaggcaugccug

SEQ ID NO: 1509944 - RNA, 21 nt, Homo sapiens
gcacacuagccucuccaggaa

SEQ ID NO: 1509945 - RNA, 12 nt, Homo sapiens
gcacacuuguau

SEQ ID NO: 1509946 - RNA, 16 nt, Homo sapiens
gcacauaugugccaau

SEQ ID NO: 1509947 - RNA, 17 nt, Homo sapiens
gcacauaugugccaaug

SEQ ID NO: 1509948 - RNA, 19 nt, Homo sapiens
gcacauguugcuaaugaca

SEQ ID NO: 1509949 - RNA, 16 nt, Homo sapiens
gcaccaucacacaugc

SEQ ID NO: 1509950 - RNA, 20 nt, Homo sapiens
gcaccuucaauacuucauga

SEQ ID NO: 1509951 - RNA, 13 nt, Homo sapiens
gcacggcuuccca

SEQ ID NO: 1509952 - RNA, 12 nt, Homo sapiens
gcacuagcauuu

SEQ ID NO: 1509953 - RNA, 13 nt, Homo sapiens
gcacuagcauuuu

SEQ ID NO: 1509954 - RNA, 15 nt, Homo sapiens
gcagaagugcaugaa

SEQ ID NO: 1509955 - RNA, 16 nt, Homo sapiens
gcagaauccuuacuuu

SEQ ID NO: 1509956 - RNA, 22 nt, Homo sapiens
guaaggucuucuuguguccuga

SEQ ID NO: 1509957 - RNA, 23 nt, Homo sapiens
guaaguugaauggccugccuuga

SEQ ID NO: 1509958 - RNA, 16 nt, Homo sapiens
guaaucccaacacuuu

SEQ ID NO: 1509959 - RNA, 18 nt, Homo sapiens
guaaucccagcuacucag

SEQ ID NO: 1509960 - RNA, 19 nt, Homo sapiens
guaauuaaguaaaccaaaa

SEQ ID NO: 1509961 - RNA, 21 nt, Homo sapiens
guaauuguacuaaagccaaac

SEQ ID NO: 1509962 - RNA, 21 nt, Homo sapiens
guaauuucuguguauuuugag

SEQ ID NO: 1509963 - RNA, 10 nt, Homo sapiens
guacaucucu

SEQ ID NO: 1509964 - RNA, 21 nt, Homo sapiens
guaccacucaggccaacaagc

SEQ ID NO: 1509965 - RNA, 12 nt, Homo sapiens
guacuaaagcca

SEQ ID NO: 1509966 - RNA, 19 nt, Homo sapiens
guacuaagaggcuauuuaa

SEQ ID NO: 1509967 - RNA, 23 nt, Homo sapiens
guacucaaguaccaccaagggau

SEQ ID NO: 1509968 - RNA, 12 nt, Homo sapiens
guagaagccagu

SEQ ID NO: 1509969 - RNA, 13 nt, Homo sapiens
guagaugucauua

SEQ ID NO: 1509970 - RNA, 23 nt, Homo sapiens
guagcagguuaccacucuggcag

SEQ ID NO: 1509971 - RNA, 15 nt, Homo sapiens
guaggggcaaggaaa

SEQ ID NO: 1509972 - RNA, 22 nt, Homo sapiens
guagguacuucacauugcaaac

SEQ ID NO: 1509973 - RNA, 14 nt, Homo sapiens
guagugucacucaa

SEQ ID NO: 1509974 - RNA, 22 nt, Homo sapiens
guaguuaggaaauaaaaccuuu

SEQ ID NO: 1509975 - RNA, 15 nt, Homo sapiens
guauaaacuaucagu

SEQ ID NO: 1509976 - RNA, 14 nt, Homo sapiens
guauaaagccauua

SEQ ID NO: 1509977 - RNA, 15 nt, Homo sapiens
guauaaucccaccca

SEQ ID NO: 1509978 - RNA, 14 nt, Homo sapiens
guauauuuaucaaa

SEQ ID NO: 1509979 - RNA, 20 nt, Homo sapiens
guauccaauaggcauuugau

SEQ ID NO: 1509980 - RNA, 19 nt, Homo sapiens
guauguaugaaggccacau

SEQ ID NO: 1509981 - RNA, 16 nt, Homo sapiens
gucaaccagugaggcu

SEQ ID NO: 1509982 - RNA, 17 nt, Homo sapiens
gucacuuuuauuugaaa

SEQ ID NO: 1509983 - RNA, 15 nt, Homo sapiens
gucagaccaguacug

SEQ ID NO: 1509984 - RNA, 18 nt, Homo sapiens
gucagaccaguacuggga

SEQ ID NO: 1509985 - RNA, 19 nt, Homo sapiens
gucagaccaguacugggaa

SEQ ID NO: 1509986 - RNA, 14 nt, Homo sapiens
gucagauggcaaug

SEQ ID NO: 1509987 - RNA, 22 nt, Homo sapiens
gucagcacauguugcuaaugac

SEQ ID NO: 1509988 - RNA, 20 nt, Homo sapiens
gucaggauugcaggugccug

SEQ ID NO: 1509989 - RNA, 20 nt, Homo sapiens
gucaucaaauauuaccaaaa

SEQ ID NO: 1509990 - RNA, 21 nt, Homo sapiens
gucauugaugaacugccaaag

SEQ ID NO: 1509991 - RNA, 23 nt, Homo sapiens
gucauuuugggaccuauaucuca

SEQ ID NO: 1509992 - RNA, 23 nt, Homo sapiens
guccagagccggggcacuuucag

SEQ ID NO: 1509993 - RNA, 12 nt, Homo sapiens
guccaggccagu

SEQ ID NO: 1509994 - RNA, 17 nt, Homo sapiens
guccaggguugaucaca

SEQ ID NO: 1509995 - RNA, 15 nt, Homo sapiens
guccauucaucucau

SEQ ID NO: 1509996 - RNA, 17 nt, Homo sapiens
gucccagcuacucagaa

SEQ ID NO: 1509997 - RNA, 15 nt, Homo sapiens
guccccuccguagga

SEQ ID NO: 1509998 - RNA, 16 nt, Homo sapiens
guccccucuugaccca

SEQ ID NO: 1509999 - RNA, 17 nt, Homo sapiens
guccgccaaacacucca

SEQ ID NO: 1510000 - RNA, 17 nt, Homo sapiens
guccucucccugccaag

SEQ ID NO: 1510001 - RNA, 12 nt, Homo sapiens
guccugcacugu

SEQ ID NO: 1510002 - RNA, 14 nt, Homo sapiens
guccugcacugucc

SEQ ID NO: 1510003 - RNA, 14 nt, Homo sapiens
guccuggcuucuag

SEQ ID NO: 1510004 - RNA, 20 nt, Homo sapiens
guccugggggcugcugcacu

SEQ ID NO: 1510005 - RNA, 22 nt, Homo sapiens
guccuucaaguuagcucaggag

SEQ ID NO: 1510006 - RNA, 17 nt, Homo sapiens
gucuaagauaaaagcuu

SEQ ID NO: 1510007 - RNA, 13 nt, Homo sapiens
gucuagacuuucu

SEQ ID NO: 1510008 - RNA, 20 nt, Homo sapiens
gucuagaggugagaccaaag

SEQ ID NO: 1510009 - RNA, 18 nt, Homo sapiens
gucuaguagcggaucuca

SEQ ID NO: 1510010 - RNA, 15 nt, Homo sapiens
gucucaagacugaaa

SEQ ID NO: 1510011 - RNA, 15 nt, Homo sapiens
gucucgaacuccugg

SEQ ID NO: 1510012 - RNA, 14 nt, Homo sapiens
gucucugcaucuca

SEQ ID NO: 1510013 - RNA, 22 nt, Homo sapiens
gucucuuacauggccacaaagg

SEQ ID NO: 1510014 - RNA, 23 nt, Homo sapiens
gucugaaucauccgaggcaaaga

SEQ ID NO: 1510015 - RNA, 19 nt, Homo sapiens
gucugccccacccucaaac

SEQ ID NO: 1510016 - RNA, 14 nt, Homo sapiens
gucugucccaaaga

SEQ ID NO: 1510017 - RNA, 16 nt, Homo sapiens
gucuuguacacuuaag

SEQ ID NO: 1510018 - RNA, 15 nt, Homo sapiens
gugaaguucacuucc

SEQ ID NO: 1510019 - RNA, 19 nt, Homo sapiens
gugacauauauauguauau

SEQ ID NO: 1510020 - RNA, 20 nt, Homo sapiens
gugacugggaccugaaugac

SEQ ID NO: 1510021 - RNA, 22 nt, Homo sapiens
gugacugucccuucgacacgga

SEQ ID NO: 1510022 - RNA, 13 nt, Homo sapiens
gugagaccaccuc

SEQ ID NO: 1510023 - RNA, 13 nt, Homo sapiens
gugagauguaauu

SEQ ID NO: 1510024 - RNA, 15 nt, Homo sapiens
gugauauaugcaugu

SEQ ID NO: 1510025 - RNA, 23 nt, Homo sapiens
gugauccucaaacacacaaacua

SEQ ID NO: 1510026 - RNA, 14 nt, Homo sapiens
gugaugcccaaaga

SEQ ID NO: 1510027 - RNA, 17 nt, Homo sapiens
gugauuuggaagagagg

SEQ ID NO: 1510028 - RNA, 23 nt, Homo sapiens
gugcagguaccugcgauguuuac

SEQ ID NO: 1510029 - RNA, 11 nt, Homo sapiens
gugcauuuuau

SEQ ID NO: 1510030 - RNA, 15 nt, Homo sapiens
gugccuguaauccca

SEQ ID NO: 1510031 - RNA, 16 nt, Homo sapiens
gugcuauggugcucug

SEQ ID NO: 1510032 - RNA, 15 nt, Homo sapiens
gugcugggauuacag

SEQ ID NO: 1510033 - RNA, 17 nt, Homo sapiens
gugcuuaauaauaccaa

SEQ ID NO: 1510034 - RNA, 13 nt, Homo sapiens
guggaacaaaagu

SEQ ID NO: 1510035 - RNA, 21 nt, Homo sapiens
guggacaugcgugaccagcag

SEQ ID NO: 1510036 - RNA, 23 nt, Homo sapiens
guggauuccugggcaagaaccua

SEQ ID NO: 1510037 - RNA, 21 nt, Homo sapiens
guggcagauaaucagccucuu

SEQ ID NO: 1510038 - RNA, 20 nt, Homo sapiens
guggcuuuuuuccuccugug

SEQ ID NO: 1510039 - RNA, 16 nt, Homo sapiens
gugggacugacauuuc

SEQ ID NO: 1510040 - RNA, 18 nt, Homo sapiens
guggucaaaccgcacuca

SEQ ID NO: 1510041 - RNA, 23 nt, Homo sapiens
guguauuuuagaaauaguaacuu

SEQ ID NO: 1510042 - RNA, 16 nt, Homo sapiens
guguauuuugagauaa

SEQ ID NO: 1510043 - RNA, 16 nt, Homo sapiens
gugucaagacauuucu

SEQ ID NO: 1510044 - RNA, 17 nt, Homo sapiens
guguguauccgacucua

SEQ ID NO: 1510045 - RNA, 13 nt, Homo sapiens
guguguauucaag

SEQ ID NO: 1510046 - RNA, 16 nt, Homo sapiens
guguguuuaacauuca

SEQ ID NO: 1510047 - RNA, 14 nt, Homo sapiens
guguuaacucagga

SEQ ID NO: 1510048 - RNA, 16 nt, Homo sapiens
guguuccccacuguau

SEQ ID NO: 1510049 - RNA, 14 nt, Homo sapiens
guguugaucccaag

SEQ ID NO: 1510050 - RNA, 14 nt, Homo sapiens
guguuggaagccag

SEQ ID NO: 1510051 - RNA, 14 nt, Homo sapiens
guguuuaacauuca

SEQ ID NO: 1510052 - RNA, 18 nt, Homo sapiens
guuaauuuguuauguaua

SEQ ID NO: 1510053 - RNA, 18 nt, Homo sapiens
guuacaacaguaacacau

SEQ ID NO: 1510054 - RNA, 21 nt, Homo sapiens
guuacagcgagaggcagagaa

SEQ ID NO: 1510055 - RNA, 15 nt, Homo sapiens
guuaggauagcauuu

SEQ ID NO: 1510056 - RNA, 17 nt, Homo sapiens
guuagggaugacuguga

SEQ ID NO: 1510057 - RNA, 19 nt, Homo sapiens
guuagggaugacugugauu

SEQ ID NO: 1510058 - RNA, 20 nt, Homo sapiens
guuagguaucaaaauguugu

SEQ ID NO: 1510059 - RNA, 21 nt, Homo sapiens
guuauacauccuauuuuguaa

SEQ ID NO: 1510060 - RNA, 16 nt, Homo sapiens
guuaugcaagcacaaa

SEQ ID NO: 1510061 - RNA, 15 nt, Homo sapiens
guuauguacguauau

SEQ ID NO: 1510062 - RNA, 14 nt, Homo sapiens
guuauuuacuugaa

SEQ ID NO: 1510063 - RNA, 15 nt, Homo sapiens
guucaaggaccacau

SEQ ID NO: 1510064 - RNA, 18 nt, Homo sapiens
guucagaggaagcacaua

SEQ ID NO: 1510065 - RNA, 16 nt, Homo sapiens
guucagcuucagacuu

SEQ ID NO: 1510066 - RNA, 19 nt, Homo sapiens
guucauauuuauacuuugc

SEQ ID NO: 1510067 - RNA, 17 nt, Homo sapiens
guuccaugaagaccaca

SEQ ID NO: 1510068 - RNA, 13 nt, Homo sapiens
guuccauguuaaa

SEQ ID NO: 1510069 - RNA, 14 nt, Homo sapiens
guuccugcacucca

SEQ ID NO: 1510070 - RNA, 19 nt, Homo sapiens
guucugaugggucccaaaa

SEQ ID NO: 1510071 - RNA, 16 nt, Homo sapiens
guucugguaugaacuu

SEQ ID NO: 1510072 - RNA, 18 nt, Homo sapiens
guucuuacuacuugccac

SEQ ID NO: 1510073 - RNA, 21 nt, Homo sapiens
guucuuuuuuguuacagcuau

SEQ ID NO: 1510074 - RNA, 19 nt, Homo sapiens
guugaacaucucacuuugc

SEQ ID NO: 1510075 - RNA, 18 nt, Homo sapiens
guugaggggcuccuggaa

SEQ ID NO: 1510076 - RNA, 20 nt, Homo sapiens
guugauaaauuccacuggac

SEQ ID NO: 1510077 - RNA, 15 nt, Homo sapiens
guugaucccaagaca

SEQ ID NO: 1510078 - RNA, 14 nt, Homo sapiens
guugcuaaugacag

SEQ ID NO: 1510079 - RNA, 22 nt, Homo sapiens
guugcuucaccuuggagccuga

SEQ ID NO: 1510080 - RNA, 20 nt, Homo sapiens
guuggacuucagucuugccu

SEQ ID NO: 1510081 - RNA, 13 nt, Homo sapiens
guugggcuuccau

SEQ ID NO: 1510082 - RNA, 19 nt, Homo sapiens
guugguugaacuaugcuga

SEQ ID NO: 1510083 - RNA, 18 nt, Homo sapiens
guugugaaugucauucac

SEQ ID NO: 1510084 - RNA, 15 nt, Homo sapiens
guuguucacauauau

SEQ ID NO: 1510085 - RNA, 13 nt, Homo sapiens
guuuaacauucac

SEQ ID NO: 1510086 - RNA, 16 nt, Homo sapiens
guuuagaugcuuugug

SEQ ID NO: 1510087 - RNA, 22 nt, Homo sapiens
guuuauccacccacaacaucua

SEQ ID NO: 1510088 - RNA, 15 nt, Homo sapiens
guuucaaacuccuga

SEQ ID NO: 1510089 - RNA, 22 nt, Homo sapiens
guuucaaagcacauaugugcca

SEQ ID NO: 1510090 - RNA, 16 nt, Homo sapiens
guuucauuguguguua

SEQ ID NO: 1510091 - RNA, 19 nt, Homo sapiens
aggaaggauggcaagcacg

SEQ ID NO: 1510092 - RNA, 15 nt, Homo sapiens
aggaagucaccaaaa

SEQ ID NO: 1510093 - RNA, 11 nt, Homo sapiens
aggacaaugcc

SEQ ID NO: 1510094 - RNA, 14 nt, Homo sapiens
aggacaccauccaa

SEQ ID NO: 1510095 - RNA, 12 nt, Homo sapiens
aggagagcaaga

SEQ ID NO: 1510096 - RNA, 11 nt, Homo sapiens
aggagcucucu

SEQ ID NO: 1510097 - RNA, 16 nt, Homo sapiens
aggaggaaaagacaga

SEQ ID NO: 1510098 - RNA, 22 nt, Homo sapiens
aggagguuuggggucugccacc

SEQ ID NO: 1510099 - RNA, 22 nt, Homo sapiens
aggaguucgagaccagccugac

SEQ ID NO: 1510100 - RNA, 17 nt, Homo sapiens
aggaguuguaccuccau

SEQ ID NO: 1510101 - RNA, 13 nt, Homo sapiens
aggauagccucag

SEQ ID NO: 1510102 - RNA, 13 nt, Homo sapiens
aggcaagagaaaa

SEQ ID NO: 1510103 - RNA, 18 nt, Homo sapiens
aggcaccuuaguggcuuu

SEQ ID NO: 1510104 - RNA, 23 nt, Homo sapiens
aggcaggggugggagagccagcu

SEQ ID NO: 1510105 - RNA, 18 nt, Homo sapiens
aggcaguucaaagcagga

SEQ ID NO: 1510106 - RNA, 22 nt, Homo sapiens
aggcauaagacccuaagccucc

SEQ ID NO: 1510107 - RNA, 16 nt, Homo sapiens
aggccacaccaucucc

SEQ ID NO: 1510108 - RNA, 21 nt, Homo sapiens
aggccacauugacaguggugg

SEQ ID NO: 1510109 - RNA, 14 nt, Homo sapiens
aggccagagccaag

SEQ ID NO: 1510110 - RNA, 17 nt, Homo sapiens
aggccgagccaauagac

SEQ ID NO: 1510111 - RNA, 18 nt, Homo sapiens
aggcggguggaucaccug

SEQ ID NO: 1510112 - RNA, 18 nt, Homo sapiens
aggcuccaucuccagugg

SEQ ID NO: 1510113 - RNA, 22 nt, Homo sapiens
aggcugcccaaucugagcaaac

SEQ ID NO: 1510114 - RNA, 17 nt, Homo sapiens
aggcuuagagaggaaaa

SEQ ID NO: 1510115 - RNA, 16 nt, Homo sapiens
uuuauagcucucauca

SEQ ID NO: 1510116 - RNA, 13 nt, Homo sapiens
uuuauauauaucc

SEQ ID NO: 1510117 - RNA, 22 nt, Homo sapiens
uuuauccacagaaacauuuuca

SEQ ID NO: 1510118 - RNA, 18 nt, Homo sapiens
uuuaugguguguuccuaa

SEQ ID NO: 1510119 - RNA, 15 nt, Homo sapiens
uuucaaaacacaucu

SEQ ID NO: 1510120 - RNA, 22 nt, Homo sapiens
uuucaaggaaaaaugcugcuuc

SEQ ID NO: 1510121 - RNA, 21 nt, Homo sapiens
uuucacaaaaaggcauaugca

SEQ ID NO: 1510122 - RNA, 15 nt, Homo sapiens
uuucacauaaaaccu

SEQ ID NO: 1510123 - RNA, 20 nt, Homo sapiens
uuucacauaaacacauacau

SEQ ID NO: 1510124 - RNA, 16 nt, Homo sapiens
uuucagcacucagaaa

SEQ ID NO: 1510125 - RNA, 22 nt, Homo sapiens
uuucccaccaccuuggacuccu

SEQ ID NO: 1510126 - RNA, 19 nt, Homo sapiens
uuucccaccucaccugaga

SEQ ID NO: 1510127 - RNA, 13 nt, Homo sapiens
uuucccauauaca

SEQ ID NO: 1510128 - RNA, 15 nt, Homo sapiens
uuuccccagugacac

SEQ ID NO: 1510129 - RNA, 14 nt, Homo sapiens
uuuccucugcagca

SEQ ID NO: 1510130 - RNA, 13 nt, Homo sapiens
uuuccugacaggg

SEQ ID NO: 1510131 - RNA, 15 nt, Homo sapiens
uuuccugacagggaa

SEQ ID NO: 1510132 - RNA, 17 nt, Homo sapiens
uuuccuggucccucacc

SEQ ID NO: 1510133 - RNA, 14 nt, Homo sapiens
uuucuccagguuug

SEQ ID NO: 1510134 - RNA, 18 nt, Homo sapiens
uuucucuaacuccugcca

SEQ ID NO: 1510135 - RNA, 20 nt, Homo sapiens
uuucucuaacuccugccauu

SEQ ID NO: 1510136 - RNA, 20 nt, Homo sapiens
uuucuggugaugcccaaaga

SEQ ID NO: 1510137 - RNA, 13 nt, Homo sapiens
uuucuggugccau

SEQ ID NO: 1510138 - RNA, 13 nt, Homo sapiens
uuucuguaaacuc

SEQ ID NO: 1510139 - RNA, 14 nt, Homo sapiens
uuucuucaccaaau

SEQ ID NO: 1510140 - RNA, 16 nt, Homo sapiens
uuugaaaaagcgaaaa

SEQ ID NO: 1510141 - RNA, 17 nt, Homo sapiens
uuugaaacagauuccau

SEQ ID NO: 1510142 - RNA, 13 nt, Homo sapiens
uuugaagcaaagc

SEQ ID NO: 1510143 - RNA, 17 nt, Homo sapiens
uuugagauaaugucaaa

SEQ ID NO: 1510144 - RNA, 22 nt, Homo sapiens
uuugaugccaagaaaguauuug

SEQ ID NO: 1510145 - RNA, 17 nt, Homo sapiens
uuugaugguaagacugu

SEQ ID NO: 1510146 - RNA, 14 nt, Homo sapiens
uuugcagaaagcca

SEQ ID NO: 1510147 - RNA, 19 nt, Homo sapiens
uuugccaaaauaccagagc

SEQ ID NO: 1510148 - RNA, 14 nt, Homo sapiens
uuuggaacaauuau

SEQ ID NO: 1510149 - RNA, 14 nt, Homo sapiens
uuuggggcugcgaa

SEQ ID NO: 1510150 - RNA, 20 nt, Homo sapiens
uuugucaacaaaaagacaug

SEQ ID NO: 1510151 - RNA, 14 nt, Homo sapiens
uuuguuuuaaauac

SEQ ID NO: 1510152 - RNA, 15 nt, Homo sapiens
uuuuaacacauaacu

SEQ ID NO: 1510153 - RNA, 12 nt, Homo sapiens
uuuuaacugcau

SEQ ID NO: 1510154 - RNA, 14 nt, Homo sapiens
uuuuaagaaagugc

SEQ ID NO: 1510155 - RNA, 22 nt, Homo sapiens
uuuuauaaauucagaaagucau

SEQ ID NO: 1510156 - RNA, 12 nt, Homo sapiens
uuuuauauccac

SEQ ID NO: 1510157 - RNA, 21 nt, Homo sapiens
uuuuauuuuuaugugcucuca

SEQ ID NO: 1510158 - RNA, 17 nt, Homo sapiens
uuuucaacaaguaacuu

SEQ ID NO: 1510159 - RNA, 19 nt, Homo sapiens
uuuucaagagugcaguuga

SEQ ID NO: 1510160 - RNA, 14 nt, Homo sapiens
uuuucaagaugcuu

SEQ ID NO: 1510161 - RNA, 22 nt, Homo sapiens
uuuucaaggaaaaaugcugcuu

SEQ ID NO: 1510162 - RNA, 20 nt, Homo sapiens
uuuucaggauuuuugguaua

SEQ ID NO: 1510163 - RNA, 13 nt, Homo sapiens
uuuuccaucaugu

SEQ ID NO: 1510164 - RNA, 21 nt, Homo sapiens
uuuucccgagcaaagucuaaa

SEQ ID NO: 1510165 - RNA, 17 nt, Homo sapiens
uuuucuggugaugccca

SEQ ID NO: 1510166 - RNA, 12 nt, Homo sapiens
uuuucuuggcag

SEQ ID NO: 1510167 - RNA, 12 nt, Homo sapiens
uuuugacuugaa

SEQ ID NO: 1510168 - RNA, 22 nt, Homo sapiens
uuuuggugguccccacagccuc

SEQ ID NO: 1510169 - RNA, 15 nt, Homo sapiens
uuuugugaccacagu

SEQ ID NO: 1510170 - RNA, 17 nt, Homo sapiens
uuuuuaacugcauaaua

SEQ ID NO: 1510171 - RNA, 17 nt, Homo sapiens
uuuuuacuccaguggug

SEQ ID NO: 1510172 - RNA, 15 nt, Homo sapiens
uuuuucaacuuggaa

SEQ ID NO: 1510173 - RNA, 11 nt, Homo sapiens
uuuuucaccuu

SEQ ID NO: 1510174 - RNA, 12 nt, Homo sapiens
uuuuugcuaaac

SEQ ID NO: 1510175 - RNA, 23 nt, Homo sapiens
agaccccacccugagguccugca

SEQ ID NO: 1510176 - RNA, 14 nt, Homo sapiens
agacgucucaagac

SEQ ID NO: 1510177 - RNA, 19 nt, Homo sapiens
agacgucucaagacugaaa

SEQ ID NO: 1510178 - RNA, 19 nt, Homo sapiens
agacuaguugaacaucuca

SEQ ID NO: 1510179 - RNA, 21 nt, Homo sapiens
agacuaucuuacuauuucaca

SEQ ID NO: 1510180 - RNA, 18 nt, Homo sapiens
agacucagcuccagaaua

SEQ ID NO: 1510181 - RNA, 15 nt, Homo sapiens
agacucuggagccaa

SEQ ID NO: 1510182 - RNA, 13 nt, Homo sapiens
agagaaaacuuau

SEQ ID NO: 1510183 - RNA, 15 nt, Homo sapiens
agagaaaagaaacca

SEQ ID NO: 1510184 - RNA, 20 nt, Homo sapiens
agagaaccauucccaagcca

SEQ ID NO: 1510185 - RNA, 14 nt, Homo sapiens
agagaagaggcugg

SEQ ID NO: 1510186 - RNA, 17 nt, Homo sapiens
agagaagcagaauccuu

SEQ ID NO: 1510187 - RNA, 20 nt, Homo sapiens
agagaauauuucaaaugaac

SEQ ID NO: 1510188 - RNA, 16 nt, Homo sapiens
agagaccccuuccuuu

SEQ ID NO: 1510189 - RNA, 21 nt, Homo sapiens
agagacuuggggaccagaggu

SEQ ID NO: 1510190 - RNA, 16 nt, Homo sapiens
agagacuuuguguuua

SEQ ID NO: 1510191 - RNA, 14 nt, Homo sapiens
agagagaaccagga

SEQ ID NO: 1510192 - RNA, 14 nt, Homo sapiens
agagaguuaaguga

SEQ ID NO: 1510193 - RNA, 16 nt, Homo sapiens
agagauguagcagaau

SEQ ID NO: 1510194 - RNA, 16 nt, Homo sapiens
agagauuugaauagaa

SEQ ID NO: 1510195 - RNA, 23 nt, Homo sapiens
agagauuuugucgggacagagag

SEQ ID NO: 1510196 - RNA, 15 nt, Homo sapiens
agagcacugcuccag

SEQ ID NO: 1510197 - RNA, 21 nt, Homo sapiens
agagccaccagggcacugucu

SEQ ID NO: 1510198 - RNA, 16 nt, Homo sapiens
agagccaggcucugcc

SEQ ID NO: 1510199 - RNA, 14 nt, Homo sapiens
agagccuccuccag

SEQ ID NO: 1510200 - RNA, 20 nt, Homo sapiens
agagccugugcuaaagaagc

SEQ ID NO: 1510201 - RNA, 24 nt, Homo sapiens
agagccuugucuucuuagcuguca

SEQ ID NO: 1510202 - RNA, 23 nt, Homo sapiens
gaauauauggucugugugucuga

SEQ ID NO: 1510203 - RNA, 17 nt, Homo sapiens
gaaucauugugcuuaau

SEQ ID NO: 1510204 - RNA, 19 nt, Homo sapiens
gaaucguuucaaauggacu

SEQ ID NO: 1510205 - RNA, 19 nt, Homo sapiens
gaaucuuaagguguagcca

SEQ ID NO: 1510206 - RNA, 17 nt, Homo sapiens
gaaugcaaaccauagca

SEQ ID NO: 1510207 - RNA, 14 nt, Homo sapiens
gaaugcuccaugaa

SEQ ID NO: 1510208 - RNA, 15 nt, Homo sapiens
gaaugguccaggguu

SEQ ID NO: 1510209 - RNA, 17 nt, Homo sapiens
gaauguuuauguucuca

SEQ ID NO: 1510210 - RNA, 15 nt, Homo sapiens
gaauucacaccuuag

SEQ ID NO: 1510211 - RNA, 15 nt, Homo sapiens
gaauuucugauuuca

SEQ ID NO: 1510212 - RNA, 16 nt, Homo sapiens
gaauuuuuaaacaagu

SEQ ID NO: 1510213 - RNA, 21 nt, Homo sapiens
gacaaaccagagcagagagca

SEQ ID NO: 1510214 - RNA, 18 nt, Homo sapiens
gacaagaaggccacuggu

SEQ ID NO: 1510215 - RNA, 15 nt, Homo sapiens
gacaagauaaaggaa

SEQ ID NO: 1510216 - RNA, 19 nt, Homo sapiens
gacacacaucaaaaaccug

SEQ ID NO: 1510217 - RNA, 17 nt, Homo sapiens
gacagaagaucuauauu

SEQ ID NO: 1510218 - RNA, 15 nt, Homo sapiens
gacaguaguccccuc

SEQ ID NO: 1510219 - RNA, 23 nt, Homo sapiens
gacagucccuugcugacauggcu

SEQ ID NO: 1510220 - RNA, 16 nt, Homo sapiens
gacaugucucacagac

SEQ ID NO: 1510221 - RNA, 21 nt, Homo sapiens
gacaugucucacagacgcucc

SEQ ID NO: 1510222 - RNA, 15 nt, Homo sapiens
gacauuaaaccugga

SEQ ID NO: 1510223 - RNA, 15 nt, Homo sapiens
gaccaaauugggaga

SEQ ID NO: 1510224 - RNA, 22 nt, Homo sapiens
gaccacaacuauuuucagaugu

SEQ ID NO: 1510225 - RNA, 22 nt, Homo sapiens
gaccaccucucaauauucaaua

SEQ ID NO: 1510226 - RNA, 21 nt, Homo sapiens
gaccccaaagagccuggagaa

SEQ ID NO: 1510227 - RNA, 23 nt, Homo sapiens
gacggacguugguucugcacuaa

SEQ ID NO: 1510228 - RNA, 20 nt, Homo sapiens
gacgugaccaugguguuguu

SEQ ID NO: 1510229 - RNA, 13 nt, Homo sapiens
gacuagaucucug

SEQ ID NO: 1510230 - RNA, 17 nt, Homo sapiens
gacuaguugaacaucuc

SEQ ID NO: 1510231 - RNA, 13 nt, Homo sapiens
gacuauacauacu

SEQ ID NO: 1510232 - RNA, 20 nt, Homo sapiens
gacuaucuuacuauuucaca

SEQ ID NO: 1510233 - RNA, 16 nt, Homo sapiens
gacuauuuaacuugag

SEQ ID NO: 1510234 - RNA, 17 nt, Homo sapiens
gacuauuucacuaauaa

SEQ ID NO: 1510235 - RNA, 20 nt, Homo sapiens
gacuauuucacuaauaaaca

SEQ ID NO: 1510236 - RNA, 12 nt, Homo sapiens
gacucacuccau

SEQ ID NO: 1510237 - RNA, 15 nt, Homo sapiens
gacucgucucaaaaa

SEQ ID NO: 1510238 - RNA, 20 nt, Homo sapiens
gacucuaagcugugugcagg

SEQ ID NO: 1510239 - RNA, 17 nt, Homo sapiens
gacuggauucgugacaa

SEQ ID NO: 1510240 - RNA, 19 nt, Homo sapiens
gacuggccucaaagcaagc

SEQ ID NO: 1510241 - RNA, 16 nt, Homo sapiens
gacugguaaguaacug

SEQ ID NO: 1510242 - RNA, 13 nt, Homo sapiens
gacuuaaguagaa

SEQ ID NO: 1510243 - RNA, 16 nt, Homo sapiens
gacuucagucuugccu

SEQ ID NO: 1510244 - RNA, 13 nt, Homo sapiens
gacuucugcugaa

SEQ ID NO: 1510245 - RNA, 20 nt, Homo sapiens
gagaaaacuuauuugaguga

SEQ ID NO: 1510246 - RNA, 19 nt, Homo sapiens
gagaaauguuuaagccaaa

SEQ ID NO: 1510247 - RNA, 23 nt, Homo sapiens
gagaacuucaaucacuguagucu

SEQ ID NO: 1510248 - RNA, 23 nt, Homo sapiens
gagaagguauuagcaaagcaaaa

SEQ ID NO: 1510249 - RNA, 21 nt, Homo sapiens
gagaauaauucuuuccaugcc

SEQ ID NO: 1510250 - RNA, 16 nt, Homo sapiens
gagacagcccugccua

SEQ ID NO: 1510251 - RNA, 17 nt, Homo sapiens
gagacuuagaagcauca

SEQ ID NO: 1510252 - RNA, 14 nt, Homo sapiens
gagagcaggacagg

SEQ ID NO: 1510253 - RNA, 17 nt, Homo sapiens
gagaggaagcucucuuu

SEQ ID NO: 1510254 - RNA, 21 nt, Homo sapiens
gagaggagggaugcugccuga

SEQ ID NO: 1510255 - RNA, 20 nt, Homo sapiens
gagagguuugucaacacaaa

SEQ ID NO: 1510256 - RNA, 20 nt, Homo sapiens
gagaguacagugagccaaga

SEQ ID NO: 1510257 - RNA, 11 nt, Homo sapiens
gagaguaccau

SEQ ID NO: 1510258 - RNA, 18 nt, Homo sapiens
gagaguauauuauguauu

SEQ ID NO: 1510259 - RNA, 19 nt, Homo sapiens
gagauaccauggugccauc

SEQ ID NO: 1510260 - RNA, 22 nt, Homo sapiens
gagaucacaccacugcacucca

SEQ ID NO: 1510261 - RNA, 20 nt, Homo sapiens
gagaugcaugcgcaggcuca

SEQ ID NO: 1510262 - RNA, 14 nt, Homo sapiens
gagaugccuuccag

SEQ ID NO: 1510263 - RNA, 20 nt, Homo sapiens
gagauggggucuugcuauau

SEQ ID NO: 1510264 - RNA, 19 nt, Homo sapiens
gagauuuugucgggacaga

SEQ ID NO: 1510265 - RNA, 13 nt, Homo sapiens
gagcaaaccacau

SEQ ID NO: 1510266 - RNA, 21 nt, Homo sapiens
gagcaaagucuaaaguuuaca

SEQ ID NO: 1510267 - RNA, 21 nt, Homo sapiens
gagcaugggacugugccuuug

SEQ ID NO: 1510268 - RNA, 18 nt, Homo sapiens
gagccaccagggcacugu

SEQ ID NO: 1510269 - RNA, 15 nt, Homo sapiens
gagccuaacucccuc

SEQ ID NO: 1510270 - RNA, 16 nt, Homo sapiens
gagccuagaacauccc

SEQ ID NO: 1510271 - RNA, 17 nt, Homo sapiens
gagccuccuagggcuua

SEQ ID NO: 1510272 - RNA, 21 nt, Homo sapiens
gagcuaugauccacaaaaaca

SEQ ID NO: 1510273 - RNA, 21 nt, Homo sapiens
gagcugagaucacaccacugc

SEQ ID NO: 1510274 - RNA, 13 nt, Homo sapiens
gagcugcucugcu

SEQ ID NO: 1510275 - RNA, 17 nt, Homo sapiens
gagcugcucugcuauau

SEQ ID NO: 1510276 - RNA, 23 nt, Homo sapiens
gagcuggaaauaaaccuggagau

SEQ ID NO: 1510277 - RNA, 12 nt, Homo sapiens
gagcuuccucag

SEQ ID NO: 1510278 - RNA, 12 nt, Homo sapiens
gaggaagcacau

SEQ ID NO: 1510279 - RNA, 19 nt, Homo sapiens
gaggaauucugaagccauu

SEQ ID NO: 1510280 - RNA, 18 nt, Homo sapiens
gaggacagagcuggcugu

SEQ ID NO: 1510281 - RNA, 22 nt, Homo sapiens
gaggagggaugcugccugaguc

SEQ ID NO: 1510282 - RNA, 22 nt, Homo sapiens
gaggaugcagaggggugcugcu

SEQ ID NO: 1510283 - RNA, 23 nt, Homo sapiens
gaggcauuccagccccuauguua

SEQ ID NO: 1510284 - RNA, 18 nt, Homo sapiens
gaggcugagacaggagaa

SEQ ID NO: 1510285 - RNA, 12 nt, Homo sapiens
gaggcuuggaaa

SEQ ID NO: 1510286 - RNA, 16 nt, Homo sapiens
gagggcaggugcccuc

SEQ ID NO: 1510287 - RNA, 21 nt, Homo sapiens
gagguaaaagugugagcagug

SEQ ID NO: 1510288 - RNA, 22 nt, Homo sapiens
gagguaccagcaauauguaaau

SEQ ID NO: 1510289 - RNA, 17 nt, Homo sapiens
gaggugguagaaccacu

SEQ ID NO: 1510290 - RNA, 17 nt, Homo sapiens
gagguguggauaaggcu

SEQ ID NO: 1510291 - RNA, 18 nt, Homo sapiens
gagguuugucaacacaaa

SEQ ID NO: 1510292 - RNA, 21 nt, Homo sapiens
gaguacagauguaaaugccac

SEQ ID NO: 1510293 - RNA, 16 nt, Homo sapiens
gaguacagugagccaa

SEQ ID NO: 1510294 - RNA, 23 nt, Homo sapiens
gaguaccaaauccacaagccauu

SEQ ID NO: 1510295 - RNA, 13 nt, Homo sapiens
gaguauacuaaaa

SEQ ID NO: 1510296 - RNA, 17 nt, Homo sapiens
gagucacaguugacaaa

SEQ ID NO: 1510297 - RNA, 16 nt, Homo sapiens
gagucaggaaagacag

SEQ ID NO: 1510298 - RNA, 19 nt, Homo sapiens
gagucaggaaagacaggcu

SEQ ID NO: 1510299 - RNA, 20 nt, Homo sapiens
gaguccugucagcuucccca

SEQ ID NO: 1510300 - RNA, 13 nt, Homo sapiens
gagucuaccucuu

SEQ ID NO: 1510301 - RNA, 17 nt, Homo sapiens
gaguugccagggaagaa

SEQ ID NO: 1510302 - RNA, 10 nt, Homo sapiens
gauaaacuaa

SEQ ID NO: 1510303 - RNA, 20 nt, Homo sapiens
gauaaaggaagucaccaaaa

SEQ ID NO: 1510304 - RNA, 14 nt, Homo sapiens
gauaaaugccucau

SEQ ID NO: 1510305 - RNA, 15 nt, Homo sapiens
gauaaucagccucuu

SEQ ID NO: 1510306 - RNA, 19 nt, Homo sapiens
gauaaucgagucuaccucu

SEQ ID NO: 1510307 - RNA, 20 nt, Homo sapiens
gauacaaggaucagaaugga

SEQ ID NO: 1510308 - RNA, 14 nt, Homo sapiens
gauacugcaauaaa

SEQ ID NO: 1510309 - RNA, 17 nt, Homo sapiens
gauagagcagaacugaa

SEQ ID NO: 1510310 - RNA, 14 nt, Homo sapiens
gauagcugaaugag

SEQ ID NO: 1510311 - RNA, 14 nt, Homo sapiens
gauagggaacacuc

SEQ ID NO: 1510312 - RNA, 23 nt, Homo sapiens
gauauauacauguuuaguauuau

SEQ ID NO: 1510313 - RNA, 21 nt, Homo sapiens
gauauccaguaagcacauguu

SEQ ID NO: 1510314 - RNA, 18 nt, Homo sapiens
gaucacuucauacuucua

SEQ ID NO: 1510315 - RNA, 19 nt, Homo sapiens
gauccacaaaaacaacuua

SEQ ID NO: 1510316 - RNA, 15 nt, Homo sapiens
gauccaguuagcaac

SEQ ID NO: 1510317 - RNA, 16 nt, Homo sapiens
gauccucaaacacaca

SEQ ID NO: 1510318 - RNA, 17 nt, Homo sapiens
gauccuggaaccacuga

SEQ ID NO: 1510319 - RNA, 20 nt, Homo sapiens
gaucgcgccacugcacuccg

SEQ ID NO: 1510320 - RNA, 22 nt, Homo sapiens
gaucuaguucucaaucacugcu

SEQ ID NO: 1510321 - RNA, 15 nt, Homo sapiens
gauucccaccaaggu

SEQ ID NO: 1510322 - RNA, 18 nt, Homo sapiens
gauuccugggcaagaacc

SEQ ID NO: 1510323 - RNA, 20 nt, Homo sapiens
gauucgugacaacaugcgac

SEQ ID NO: 1510324 - RNA, 15 nt, Homo sapiens
gauucuucugccuca

SEQ ID NO: 1510325 - RNA, 19 nt, Homo sapiens
gauugaccuauaaaacaaa

SEQ ID NO: 1510326 - RNA, 16 nt, Homo sapiens
gauugagaaguuuugu

SEQ ID NO: 1510327 - RNA, 17 nt, Homo sapiens
gauuggcucacccaagc

SEQ ID NO: 1510328 - RNA, 13 nt, Homo sapiens
gauuguauugcaa

SEQ ID NO: 1510329 - RNA, 15 nt, Homo sapiens
gauuuaacacuaaaa

SEQ ID NO: 1510330 - RNA, 15 nt, Homo sapiens
gauuuaacugugaac

SEQ ID NO: 1510331 - RNA, 18 nt, Homo sapiens
gauuucugugaagcaaaa

SEQ ID NO: 1510332 - RNA, 16 nt, Homo sapiens
gauuuguucacaugca

SEQ ID NO: 1510333 - RNA, 19 nt, Homo sapiens
gauuuguucacaugcauca

SEQ ID NO: 1510334 - RNA, 14 nt, Homo sapiens
gauuuuaguucacu

SEQ ID NO: 1510335 - RNA, 21 nt, Homo sapiens
gcaaaaagaugccuuuuacca

SEQ ID NO: 1510336 - RNA, 14 nt, Homo sapiens
gcaaaagcucugug

SEQ ID NO: 1510337 - RNA, 18 nt, Homo sapiens
gcaaaagguugacucaua

SEQ ID NO: 1510338 - RNA, 16 nt, Homo sapiens
gcaaagagaaaagcca

SEQ ID NO: 1510339 - RNA, 22 nt, Homo sapiens
gcaaagucuaaaguuuacagua

SEQ ID NO: 1510340 - RNA, 16 nt, Homo sapiens
gcaacaaauccaugga

SEQ ID NO: 1510341 - RNA, 18 nt, Homo sapiens
gcaacucuauagacuuuu

SEQ ID NO: 1510342 - RNA, 23 nt, Homo sapiens
gcaagggaccuucaugcccuucu

SEQ ID NO: 1510343 - RNA, 14 nt, Homo sapiens
gcaagucuugucag

SEQ ID NO: 1510344 - RNA, 21 nt, Homo sapiens
gcaauagggugcaguuuucca

SEQ ID NO: 1510345 - RNA, 13 nt, Homo sapiens
gcaaucaacugag

SEQ ID NO: 1510346 - RNA, 21 nt, Homo sapiens
gcaaucugagagauuugaaua

SEQ ID NO: 1510347 - RNA, 15 nt, Homo sapiens
gcaaugaaaccaaag

SEQ ID NO: 1510348 - RNA, 18 nt, Homo sapiens
gcaauucuccugccucag

SEQ ID NO: 1510349 - RNA, 13 nt, Homo sapiens
gcaauuuuuccau

SEQ ID NO: 1510350 - RNA, 21 nt, Homo sapiens
gcacaaaauucuagaagcaga

SEQ ID NO: 1510351 - RNA, 23 nt, Homo sapiens
gcacagguuagggugugugccac

SEQ ID NO: 1510352 - RNA, 17 nt, Homo sapiens
gcacaucacaacauuua

SEQ ID NO: 1510353 - RNA, 17 nt, Homo sapiens
gcaccugaaccacugug

SEQ ID NO: 1510354 - RNA, 16 nt, Homo sapiens
gcaccuguacucagga

SEQ ID NO: 1510355 - RNA, 18 nt, Homo sapiens
gcaccuuaccaacuuucu

SEQ ID NO: 1510356 - RNA, 17 nt, Homo sapiens
gcacuaauugacccaaa

SEQ ID NO: 1510357 - RNA, 20 nt, Homo sapiens
gcacucacccaugugccaag

SEQ ID NO: 1510358 - RNA, 22 nt, Homo sapiens
gcacucagaaaagaaaaccauu

SEQ ID NO: 1510359 - RNA, 20 nt, Homo sapiens
gcacucccucccagagaaca

SEQ ID NO: 1510360 - RNA, 21 nt, Homo sapiens
gcacuguggcccuucugucca

SEQ ID NO: 1510361 - RNA, 22 nt, Homo sapiens
gcacuuggaaagguuucaagac

SEQ ID NO: 1510362 - RNA, 22 nt, Homo sapiens
gcacuuuaacccucucuucccu

SEQ ID NO: 1510363 - RNA, 14 nt, Homo sapiens
gcagagagaagccu

SEQ ID NO: 1510364 - RNA, 19 nt, Homo sapiens
gcagagguaaaagugugag

SEQ ID NO: 1510365 - RNA, 17 nt, Homo sapiens
gcagcagggggagcucc

SEQ ID NO: 1510366 - RNA, 14 nt, Homo sapiens
gcagcgcgugcaca

SEQ ID NO: 1510367 - RNA, 15 nt, Homo sapiens
gcagcgcgugcacag

SEQ ID NO: 1510368 - RNA, 14 nt, Homo sapiens
gcaggcagccccac

SEQ ID NO: 1510369 - RNA, 21 nt, Homo sapiens
gcaggcagccccacacccgcc

SEQ ID NO: 1510370 - RNA, 18 nt, Homo sapiens
gcaggggaguaguggaga

SEQ ID NO: 1510371 - RNA, 16 nt, Homo sapiens
gcaggggccgagccau

SEQ ID NO: 1510372 - RNA, 14 nt, Homo sapiens
gcaguauuccaugg

SEQ ID NO: 1510373 - RNA, 16 nt, Homo sapiens
gcagugaacacacuca

SEQ ID NO: 1510374 - RNA, 23 nt, Homo sapiens
gcagugacgugcaccuguacuca

SEQ ID NO: 1510375 - RNA, 18 nt, Homo sapiens
gcagugagcugagaucac

SEQ ID NO: 1510376 - RNA, 11 nt, Homo sapiens
gcagugcugau

SEQ ID NO: 1510377 - RNA, 23 nt, Homo sapiens
gcaguuguaaaauuguuaguaaa

SEQ ID NO: 1510378 - RNA, 15 nt, Homo sapiens
gcauaaagguucugg

SEQ ID NO: 1510379 - RNA, 21 nt, Homo sapiens
gcauaaucagcgcccuggagu

SEQ ID NO: 1510380 - RNA, 20 nt, Homo sapiens
gcauaggccauauaauguua

SEQ ID NO: 1510381 - RNA, 14 nt, Homo sapiens
gcaucacagaaugu

SEQ ID NO: 1510382 - RNA, 17 nt, Homo sapiens
gcaucuacucuaggcau

SEQ ID NO: 1510383 - RNA, 23 nt, Homo sapiens
gcaucucagcggggcgcacaugu

SEQ ID NO: 1510384 - RNA, 23 nt, Homo sapiens
gcaucugggauucccaccaaggu

SEQ ID NO: 1510385 - RNA, 16 nt, Homo sapiens
gcaugacaauugucag

SEQ ID NO: 1510386 - RNA, 20 nt, Homo sapiens
gcaugagagaauuguaucau

SEQ ID NO: 1510387 - RNA, 17 nt, Homo sapiens
gcaugcagaagugcaug

SEQ ID NO: 1510388 - RNA, 18 nt, Homo sapiens
gcaugcagaagugcauga

SEQ ID NO: 1510389 - RNA, 20 nt, Homo sapiens
gcaugcccuccccacuuccc

SEQ ID NO: 1510390 - RNA, 13 nt, Homo sapiens
gcauggugcaguu

SEQ ID NO: 1510391 - RNA, 14 nt, Homo sapiens
gcauggugcaguug

SEQ ID NO: 1510392 - RNA, 18 nt, Homo sapiens
gcaugguuuuacagugaa

SEQ ID NO: 1510393 - RNA, 15 nt, Homo sapiens
gcauuagcacauauu

SEQ ID NO: 1510394 - RNA, 18 nt, Homo sapiens
gcauuagcacauauuuca

SEQ ID NO: 1510395 - RNA, 20 nt, Homo sapiens
gcauuccagccccuauguua

SEQ ID NO: 1510396 - RNA, 18 nt, Homo sapiens
gcauuuacuaugccacag

SEQ ID NO: 1510397 - RNA, 17 nt, Homo sapiens
gcauuugcccuguggau

SEQ ID NO: 1510398 - RNA, 21 nt, Homo sapiens
gcauuuucauuucacugcaca

SEQ ID NO: 1510399 - RNA, 18 nt, Homo sapiens
gccaaacagccccaaagu

SEQ ID NO: 1510400 - RNA, 23 nt, Homo sapiens
gccaacagccccccccuugaauc

SEQ ID NO: 1510401 - RNA, 20 nt, Homo sapiens
gccaagaucgcgccacugca

SEQ ID NO: 1510402 - RNA, 22 nt, Homo sapiens
gccaaugucugauuuaacacua

SEQ ID NO: 1510403 - RNA, 16 nt, Homo sapiens
gccacaucccuuugaa

SEQ ID NO: 1510404 - RNA, 12 nt, Homo sapiens
gccacauuugau

SEQ ID NO: 1510405 - RNA, 19 nt, Homo sapiens
gccacccagcaacacagag

SEQ ID NO: 1510406 - RNA, 19 nt, Homo sapiens
gccaggagcuucucugaug

SEQ ID NO: 1510407 - RNA, 15 nt, Homo sapiens
gccaggccaccagga

SEQ ID NO: 1510408 - RNA, 18 nt, Homo sapiens
gccaggcucccacugccc

SEQ ID NO: 1510409 - RNA, 14 nt, Homo sapiens
gccaggcucugccu

SEQ ID NO: 1510410 - RNA, 21 nt, Homo sapiens
gccaggcuguaagcauucuga

SEQ ID NO: 1510411 - RNA, 18 nt, Homo sapiens
gccagggcccugcagagg

SEQ ID NO: 1510412 - RNA, 11 nt, Homo sapiens
gccaguauuuu

SEQ ID NO: 1510413 - RNA, 21 nt, Homo sapiens
gccagugggccugguagcaca

SEQ ID NO: 1510414 - RNA, 19 nt, Homo sapiens
gccauguacuauaauguga

SEQ ID NO: 1510415 - RNA, 22 nt, Homo sapiens
gccauuccaagucaacacucuu

SEQ ID NO: 1510416 - RNA, 17 nt, Homo sapiens
gccauucccacuaagcu

SEQ ID NO: 1510417 - RNA, 16 nt, Homo sapiens
gcccagcccuauucau

SEQ ID NO: 1510418 - RNA, 14 nt, Homo sapiens
gcccagcucuuugu

SEQ ID NO: 1510419 - RNA, 15 nt, Homo sapiens
gcccaggcaggccac

SEQ ID NO: 1510420 - RNA, 21 nt, Homo sapiens
gccccccccuugaaucugcag

SEQ ID NO: 1510421 - RNA, 14 nt, Homo sapiens
gccccccuccuugc

SEQ ID NO: 1510422 - RNA, 16 nt, Homo sapiens
gcccgaccccaucuca

SEQ ID NO: 1510423 - RNA, 17 nt, Homo sapiens
gcccgaccccaucucau

SEQ ID NO: 1510424 - RNA, 20 nt, Homo sapiens
gcccgucauguuccucaaaa

SEQ ID NO: 1510425 - RNA, 21 nt, Homo sapiens
gcccgucauguuccucaaaag

SEQ ID NO: 1510426 - RNA, 16 nt, Homo sapiens
gcccuccccacuuccc

SEQ ID NO: 1510427 - RNA, 22 nt, Homo sapiens
gcccuggcuaauuccccuucca

SEQ ID NO: 1510428 - RNA, 16 nt, Homo sapiens
gcccuggcugacccca

SEQ ID NO: 1510429 - RNA, 20 nt, Homo sapiens
gcccuggcuggaguucagug

SEQ ID NO: 1510430 - RNA, 22 nt, Homo sapiens
gcccuggggccaugggugcaug

SEQ ID NO: 1510431 - RNA, 21 nt, Homo sapiens
gcccuucccacuggaggucac

SEQ ID NO: 1510432 - RNA, 20 nt, Homo sapiens
gcccuucccugacacugucu

SEQ ID NO: 1510433 - RNA, 21 nt, Homo sapiens
gccgagauugcaccacugcac

SEQ ID NO: 1510434 - RNA, 17 nt, Homo sapiens
gccuaauacaacaugua

SEQ ID NO: 1510435 - RNA, 18 nt, Homo sapiens
gccuagaacaucccuggg

SEQ ID NO: 1510436 - RNA, 14 nt, Homo sapiens
gccucaaagcaagc

SEQ ID NO: 1510437 - RNA, 12 nt, Homo sapiens
gccucccaaagu

SEQ ID NO: 1510438 - RNA, 14 nt, Homo sapiens
gccuccugaccuga

SEQ ID NO: 1510439 - RNA, 22 nt, Homo sapiens
gccuccuuuuuaauacauuaag

SEQ ID NO: 1510440 - RNA, 18 nt, Homo sapiens
gccucguaccagccagga

SEQ ID NO: 1510441 - RNA, 19 nt, Homo sapiens
gccugagucacccaugaag

SEQ ID NO: 1510442 - RNA, 13 nt, Homo sapiens
gccugccuugaag

SEQ ID NO: 1510443 - RNA, 15 nt, Homo sapiens
gccuggcuucuggag

SEQ ID NO: 1510444 - RNA, 17 nt, Homo sapiens
gccuucaagugccaaac

SEQ ID NO: 1510445 - RNA, 22 nt, Homo sapiens
gccuugggagagaugccuucca

SEQ ID NO: 1510446 - RNA, 18 nt, Homo sapiens
gccuuuagaugugagcuu

SEQ ID NO: 1510447 - RNA, 20 nt, Homo sapiens
gccuuucucuggcuccagaa

SEQ ID NO: 1510448 - RNA, 22 nt, Homo sapiens
gccuuuugcucacaaaaccugg

SEQ ID NO: 1510449 - RNA, 14 nt, Homo sapiens
gcgcucccgcauuu

SEQ ID NO: 1510450 - RNA, 15 nt, Homo sapiens
gcggagaguacagug

SEQ ID NO: 1510451 - RNA, 21 nt, Homo sapiens
gcgucagaccaguacugggaa

SEQ ID NO: 1510452 - RNA, 19 nt, Homo sapiens
gcgucugccccacccucaa

SEQ ID NO: 1510453 - RNA, 13 nt, Homo sapiens
gcgucugcugcuc

SEQ ID NO: 1510454 - RNA, 19 nt, Homo sapiens
gcgugaccagcaguacuca

SEQ ID NO: 1510455 - RNA, 18 nt, Homo sapiens
gcgugucccucucggaag

SEQ ID NO: 1510456 - RNA, 18 nt, Homo sapiens
gcguuuggcccugugacu

SEQ ID NO: 1510457 - RNA, 13 nt, Homo sapiens
aaaaaaguucaau

SEQ ID NO: 1510458 - RNA, 14 nt, Homo sapiens
aaaaaauccacuca

SEQ ID NO: 1510459 - RNA, 16 nt, Homo sapiens
aaaaagaaauuugaug

SEQ ID NO: 1510460 - RNA, 17 nt, Homo sapiens
aaaaaggcauaugcaau

SEQ ID NO: 1510461 - RNA, 15 nt, Homo sapiens
aaaaaguaugugaau

SEQ ID NO: 1510462 - RNA, 21 nt, Homo sapiens
aaaaagugaaaacaauguaag

SEQ ID NO: 1510463 - RNA, 22 nt, Homo sapiens
aaaaauauguaccaagaaucuu

SEQ ID NO: 1510464 - RNA, 20 nt, Homo sapiens
aaaacaauguaagagccuaa

SEQ ID NO: 1510465 - RNA, 21 nt, Homo sapiens
aaaacauagcacuagcauuca

SEQ ID NO: 1510466 - RNA, 21 nt, Homo sapiens
aaaaccgcaaggguagacugg

SEQ ID NO: 1510467 - RNA, 20 nt, Homo sapiens
aaaacuacagcaucauugca

SEQ ID NO: 1510468 - RNA, 20 nt, Homo sapiens
aaaacucauuacuuuuccau

SEQ ID NO: 1510469 - RNA, 19 nt, Homo sapiens
aaaacugaaaaucuaauau

SEQ ID NO: 1510470 - RNA, 13 nt, Homo sapiens
aaaagacauggaa

SEQ ID NO: 1510471 - RNA, 16 nt, Homo sapiens
aaaagauuuaacaaau

SEQ ID NO: 1510472 - RNA, 18 nt, Homo sapiens
aaaagcaagggaccuuca

SEQ ID NO: 1510473 - RNA, 19 nt, Homo sapiens
aaaagcaagggaccuucau

SEQ ID NO: 1510474 - RNA, 17 nt, Homo sapiens
aaaaggcauaugcaaua

SEQ ID NO: 1510475 - RNA, 13 nt, Homo sapiens
aaaaggcugagaa

SEQ ID NO: 1510476 - RNA, 18 nt, Homo sapiens
aaaagggaaguugugccu

SEQ ID NO: 1510477 - RNA, 22 nt, Homo sapiens
aaaaguaaguaccacucaggcc

SEQ ID NO: 1510478 - RNA, 12 nt, Homo sapiens
aaaaguacugaa

SEQ ID NO: 1510479 - RNA, 13 nt, Homo sapiens
aaaaguugugauu

SEQ ID NO: 1510480 - RNA, 20 nt, Homo sapiens
aaaauaaacuggggaguuau

SEQ ID NO: 1510481 - RNA, 13 nt, Homo sapiens
aaaauaacuauca

SEQ ID NO: 1510482 - RNA, 14 nt, Homo sapiens
aaaauaauuguucc

SEQ ID NO: 1510483 - RNA, 13 nt, Homo sapiens
aaaauacuaugaa

SEQ ID NO: 1510484 - RNA, 12 nt, Homo sapiens
aaaaugcugcuu

SEQ ID NO: 1510485 - RNA, 17 nt, Homo sapiens
aaaaugcugcuucuccu

SEQ ID NO: 1510486 - RNA, 16 nt, Homo sapiens
aaaauguaaagccaug

SEQ ID NO: 1510487 - RNA, 14 nt, Homo sapiens
aaaauguuguccuu

SEQ ID NO: 1510488 - RNA, 23 nt, Homo sapiens
aaaauuauuuaaaccgcuaaaag

SEQ ID NO: 1510489 - RNA, 20 nt, Homo sapiens
aaaauuuuucuagaagauau

SEQ ID NO: 1510490 - RNA, 18 nt, Homo sapiens
aaacaaaaaacccaagaa

SEQ ID NO: 1510491 - RNA, 21 nt, Homo sapiens
aaacaacuuguguucuauuaa

SEQ ID NO: 1510492 - RNA, 17 nt, Homo sapiens
aaacacucaacaauaaa

SEQ ID NO: 1510493 - RNA, 11 nt, Homo sapiens
aaacacuccac

SEQ ID NO: 1510494 - RNA, 22 nt, Homo sapiens
aaacagacuauuuaacuugagg

SEQ ID NO: 1510495 - RNA, 20 nt, Homo sapiens
aaacagugcaaggaagggca

SEQ ID NO: 1510496 - RNA, 16 nt, Homo sapiens
aaacaucauuacuaua

SEQ ID NO: 1510497 - RNA, 17 nt, Homo sapiens
aaacaucauuacuauaa

SEQ ID NO: 1510498 - RNA, 21 nt, Homo sapiens
aaacauucauuuuuaccuugu

SEQ ID NO: 1510499 - RNA, 19 nt, Homo sapiens
aaacauugguauauuucca

SEQ ID NO: 1510500 - RNA, 17 nt, Homo sapiens
aaaccaagauagaucca

SEQ ID NO: 1510501 - RNA, 23 nt, Homo sapiens
aaaccaagauagauccauuugga

SEQ ID NO: 1510502 - RNA, 21 nt, Homo sapiens
aaaccaagucuacuucacuaa

SEQ ID NO: 1510503 - RNA, 15 nt, Homo sapiens
aaacccccgcuccag

SEQ ID NO: 1510504 - RNA, 18 nt, Homo sapiens
aaacccccgcuccagauc

SEQ ID NO: 1510505 - RNA, 16 nt, Homo sapiens
aaaccuagcuaggcua

SEQ ID NO: 1510506 - RNA, 18 nt, Homo sapiens
aaaccuggagaugaugau

SEQ ID NO: 1510507 - RNA, 19 nt, Homo sapiens
aaacucauuacuuuuccau

SEQ ID NO: 1510508 - RNA, 16 nt, Homo sapiens
aaacugaaucaagaaa

SEQ ID NO: 1510509 - RNA, 11 nt, Homo sapiens
aaacugcugaa

SEQ ID NO: 1510510 - RNA, 13 nt, Homo sapiens
aaacuuuuucaca

SEQ ID NO: 1510511 - RNA, 18 nt, Homo sapiens
aaacuuuuuuuguuugcu

SEQ ID NO: 1510512 - RNA, 14 nt, Homo sapiens
aaagaaacacucaa

SEQ ID NO: 1510513 - RNA, 13 nt, Homo sapiens
aaagaaauuugau

SEQ ID NO: 1510514 - RNA, 15 nt, Homo sapiens
aaagaaggacacuug

SEQ ID NO: 1510515 - RNA, 17 nt, Homo sapiens
aaagaaggacacuugua

SEQ ID NO: 1510516 - RNA, 22 nt, Homo sapiens
aaagacaaaugggccugccaaa

SEQ ID NO: 1510517 - RNA, 16 nt, Homo sapiens
aaagagccuggagaag

SEQ ID NO: 1510518 - RNA, 15 nt, Homo sapiens
aaagagucagcccuu

SEQ ID NO: 1510519 - RNA, 20 nt, Homo sapiens
aaagauaacaagaucuuuca

SEQ ID NO: 1510520 - RNA, 15 nt, Homo sapiens
aaagauuugugaacu

SEQ ID NO: 1510521 - RNA, 13 nt, Homo sapiens
aaagcaaaagcaa

SEQ ID NO: 1510522 - RNA, 16 nt, Homo sapiens
aaagcaaaagcucugu

SEQ ID NO: 1510523 - RNA, 23 nt, Homo sapiens
aaagcaagacagauuaccaaaga

SEQ ID NO: 1510524 - RNA, 17 nt, Homo sapiens
aaagcagaugagcugug

SEQ ID NO: 1510525 - RNA, 13 nt, Homo sapiens
aaagcaguauuug

SEQ ID NO: 1510526 - RNA, 13 nt, Homo sapiens
aaagcaucaccuc

SEQ ID NO: 1510527 - RNA, 16 nt, Homo sapiens
aaagcaucaccucagg

SEQ ID NO: 1510528 - RNA, 14 nt, Homo sapiens
aaagcccuugaacc

SEQ ID NO: 1510529 - RNA, 19 nt, Homo sapiens
aaagcccuuuuauaccucc

SEQ ID NO: 1510530 - RNA, 13 nt, Homo sapiens
aaaggaaaaccag

SEQ ID NO: 1510531 - RNA, 15 nt, Homo sapiens
aaaggaaaccaaagg

SEQ ID NO: 1510532 - RNA, 18 nt, Homo sapiens
aaaggaaauaauugccaa

SEQ ID NO: 1510533 - RNA, 17 nt, Homo sapiens
aaaggaagucaccaaaa

SEQ ID NO: 1510534 - RNA, 15 nt, Homo sapiens
aaaggauugaucacu

SEQ ID NO: 1510535 - RNA, 18 nt, Homo sapiens
aaagggugcccacaaaau

SEQ ID NO: 1510536 - RNA, 10 nt, Homo sapiens
aaaggugagc

SEQ ID NO: 1510537 - RNA, 16 nt, Homo sapiens
aaggaaauaucaucgu

SEQ ID NO: 1510538 - RNA, 13 nt, Homo sapiens
aaggacaaugccu

SEQ ID NO: 1510539 - RNA, 13 nt, Homo sapiens
aaggauagccuca

SEQ ID NO: 1510540 - RNA, 20 nt, Homo sapiens
aaggauauuuacuacuuuug

SEQ ID NO: 1510541 - RNA, 11 nt, Homo sapiens
aaggaucucug

SEQ ID NO: 1510542 - RNA, 16 nt, Homo sapiens
cucccucugaccugca

SEQ ID NO: 1510543 - RNA, 14 nt, Homo sapiens
cuccgcacuuggaa

SEQ ID NO: 1510544 - RNA, 17 nt, Homo sapiens
cuccgcccuucccugac

SEQ ID NO: 1510545 - RNA, 15 nt, Homo sapiens
cuccuaaaacaugaa

SEQ ID NO: 1510546 - RNA, 13 nt, Homo sapiens
cuccugaaguuag

SEQ ID NO: 1510547 - RNA, 23 nt, Homo sapiens
cuccuggaaaggcucagucucag

SEQ ID NO: 1510548 - RNA, 15 nt, Homo sapiens
cuccuguguacaggg

SEQ ID NO: 1510549 - RNA, 20 nt, Homo sapiens
cuccuuaauagccauaugca

SEQ ID NO: 1510550 - RNA, 19 nt, Homo sapiens
cuccuugucacugaagauu

SEQ ID NO: 1510551 - RNA, 20 nt, Homo sapiens
cuccuuuuuaauacauuaag

SEQ ID NO: 1510552 - RNA, 18 nt, Homo sapiens
cuccuuuuucuaccuuuu

SEQ ID NO: 1510553 - RNA, 20 nt, Homo sapiens
cucgaauaaaggaugggacc

SEQ ID NO: 1510554 - RNA, 16 nt, Homo sapiens
cucgaccucccaaagu

SEQ ID NO: 1510555 - RNA, 16 nt, Homo sapiens
cucgaggcucuuccau

SEQ ID NO: 1510556 - RNA, 13 nt, Homo sapiens
cucuaacauuugc

SEQ ID NO: 1510557 - RNA, 22 nt, Homo sapiens
cucuaagccacucuuccaaagg

SEQ ID NO: 1510558 - RNA, 14 nt, Homo sapiens
cucuaaguuuagaa

SEQ ID NO: 1510559 - RNA, 16 nt, Homo sapiens
cucuaauacauuccaa

SEQ ID NO: 1510560 - RNA, 20 nt, Homo sapiens
cucuagugacuuccugguga

SEQ ID NO: 1510561 - RNA, 14 nt, Homo sapiens
cucuauugagccaa

SEQ ID NO: 1510562 - RNA, 13 nt, Homo sapiens
cucuauuucacaa

SEQ ID NO: 1510563 - RNA, 12 nt, Homo sapiens
cucucugcucca

SEQ ID NO: 1510564 - RNA, 23 nt, Homo sapiens
cucucuugcaggaaggacuauga

SEQ ID NO: 1510565 - RNA, 13 nt, Homo sapiens
cucugauauggcu

SEQ ID NO: 1510566 - RNA, 14 nt, Homo sapiens
cucugaugcacugu

SEQ ID NO: 1510567 - RNA, 14 nt, Homo sapiens
cucugcagcacuuu

SEQ ID NO: 1510568 - RNA, 13 nt, Homo sapiens
cucugcaucucau

SEQ ID NO: 1510569 - RNA, 19 nt, Homo sapiens
cucugccugagacuuucag

SEQ ID NO: 1510570 - RNA, 16 nt, Homo sapiens
cucuggacaugauuua

SEQ ID NO: 1510571 - RNA, 19 nt, Homo sapiens
cucuguuaugcaagcacaa

SEQ ID NO: 1510572 - RNA, 13 nt, Homo sapiens
cucuuaucuauga

SEQ ID NO: 1510573 - RNA, 20 nt, Homo sapiens
cucuucagagcaagcacugg

SEQ ID NO: 1510574 - RNA, 16 nt, Homo sapiens
cucuuccugcaaggac

SEQ ID NO: 1510575 - RNA, 15 nt, Homo sapiens
cucuuuccuuccuuc

SEQ ID NO: 1510576 - RNA, 17 nt, Homo sapiens
cucuuuucccacauuca

SEQ ID NO: 1510577 - RNA, 13 nt, Homo sapiens
cugaaacaaaagu

SEQ ID NO: 1510578 - RNA, 13 nt, Homo sapiens
cugaaacauauuu

SEQ ID NO: 1510579 - RNA, 21 nt, Homo sapiens
cugaaagaguccuuucaggaa

SEQ ID NO: 1510580 - RNA, 13 nt, Homo sapiens
cugaagaaaccuu

SEQ ID NO: 1510581 - RNA, 17 nt, Homo sapiens
cugaaggagauuuuccu

SEQ ID NO: 1510582 - RNA, 11 nt, Homo sapiens
cugaagggaaa

SEQ ID NO: 1510583 - RNA, 15 nt, Homo sapiens
cugaauggcaaugaa

SEQ ID NO: 1510584 - RNA, 13 nt, Homo sapiens
cugacaaauggaa

SEQ ID NO: 1510585 - RNA, 12 nt, Homo sapiens
cugacacugucu

SEQ ID NO: 1510586 - RNA, 13 nt, Homo sapiens
cugacaugucuca

SEQ ID NO: 1510587 - RNA, 13 nt, Homo sapiens
cugaccccaaaga

SEQ ID NO: 1510588 - RNA, 14 nt, Homo sapiens
cugacgacacugaa

SEQ ID NO: 1510589 - RNA, 18 nt, Homo sapiens
cugacuuugagacggugu

SEQ ID NO: 1510590 - RNA, 17 nt, Homo sapiens
cugagaaggaacaggga

SEQ ID NO: 1510591 - RNA, 16 nt, Homo sapiens
cugagaauagugucug

SEQ ID NO: 1510592 - RNA, 22 nt, Homo sapiens
cugagauauugggacacacauc

SEQ ID NO: 1510593 - RNA, 21 nt, Homo sapiens
cugagauccagcacaacucag

SEQ ID NO: 1510594 - RNA, 11 nt, Homo sapiens
cugagaucucc

SEQ ID NO: 1510595 - RNA, 13 nt, Homo sapiens
cugagaucucccu

SEQ ID NO: 1510596 - RNA, 18 nt, Homo sapiens
cugagauuacagguguga

SEQ ID NO: 1510597 - RNA, 14 nt, Homo sapiens
cugaguggaucucc

SEQ ID NO: 1510598 - RNA, 23 nt, Homo sapiens
cugauacaauuugcccaagguaa

SEQ ID NO: 1510599 - RNA, 16 nt, Homo sapiens
cugaucauuacauggc

SEQ ID NO: 1510600 - RNA, 22 nt, Homo sapiens
cugaugaaaaauaugugcuuga

SEQ ID NO: 1510601 - RNA, 13 nt, Homo sapiens
cugauucaagaaa

SEQ ID NO: 1510602 - RNA, 22 nt, Homo sapiens
cugauucagccuggccaucccc

SEQ ID NO: 1510603 - RNA, 16 nt, Homo sapiens
cugauucuccugucag

SEQ ID NO: 1510604 - RNA, 17 nt, Homo sapiens
cugauuucacucagggu

SEQ ID NO: 1510605 - RNA, 14 nt, Homo sapiens
cugcaaauuucaaa

SEQ ID NO: 1510606 - RNA, 20 nt, Homo sapiens
cugcaccgagagagauggaa

SEQ ID NO: 1510607 - RNA, 24 nt, Homo sapiens
cugcaccgagagagauggaauaaa

SEQ ID NO: 1510608 - RNA, 17 nt, Homo sapiens
cugcacuaaaacccauc

SEQ ID NO: 1510609 - RNA, 13 nt, Homo sapiens
cugcagaucuucc

SEQ ID NO: 1510610 - RNA, 21 nt, Homo sapiens
cugcagccccgcgccuccuuc

SEQ ID NO: 1510611 - RNA, 13 nt, Homo sapiens
cugcaggccaaga

SEQ ID NO: 1510612 - RNA, 13 nt, Homo sapiens
cugccccaucucc

SEQ ID NO: 1510613 - RNA, 15 nt, Homo sapiens
cugccucuggucaag

SEQ ID NO: 1510614 - RNA, 23 nt, Homo sapiens
uccagaucugggauuauguagcu

SEQ ID NO: 1510615 - RNA, 17 nt, Homo sapiens
uccaggcagacacagcu

SEQ ID NO: 1510616 - RNA, 13 nt, Homo sapiens
uccagggcccaaa

SEQ ID NO: 1510617 - RNA, 21 nt, Homo sapiens
uccaguaggaaaucaggcagu

SEQ ID NO: 1510618 - RNA, 22 nt, Homo sapiens
uccagugggaggugagaccacc

SEQ ID NO: 1510619 - RNA, 15 nt, Homo sapiens
uccaguucugacaca

SEQ ID NO: 1510620 - RNA, 18 nt, Homo sapiens
uccauagugcacuagcau

SEQ ID NO: 1510621 - RNA, 18 nt, Homo sapiens
uccauccccaaacugugc

SEQ ID NO: 1510622 - RNA, 18 nt, Homo sapiens
uccauccggcuccuguca

SEQ ID NO: 1510623 - RNA, 16 nt, Homo sapiens
uccauccuaaucugaa

SEQ ID NO: 1510624 - RNA, 14 nt, Homo sapiens
uccaucuccaucca

SEQ ID NO: 1510625 - RNA, 14 nt, Homo sapiens
uccaugaagaccac

SEQ ID NO: 1510626 - RNA, 15 nt, Homo sapiens
uccauggaccuauga

SEQ ID NO: 1510627 - RNA, 18 nt, Homo sapiens
uccaugggaccacaacua

SEQ ID NO: 1510628 - RNA, 20 nt, Homo sapiens
uccaugucccuguauaauuc

SEQ ID NO: 1510629 - RNA, 22 nt, Homo sapiens
uccauucccaaaauaacugaga

SEQ ID NO: 1510630 - RNA, 15 nt, Homo sapiens
uccauuucaacucca

SEQ ID NO: 1510631 - RNA, 14 nt, Homo sapiens
uccauuuggacaaa

SEQ ID NO: 1510632 - RNA, 14 nt, Homo sapiens
uccauuuuacuucc

SEQ ID NO: 1510633 - RNA, 22 nt, Homo sapiens
uccauuuuacuuccaugauacu

SEQ ID NO: 1510634 - RNA, 23 nt, Homo sapiens
uccauuuuacuuccaugauacuu

SEQ ID NO: 1510635 - RNA, 18 nt, Homo sapiens
ucccaaaauaacugagaa

SEQ ID NO: 1510636 - RNA, 23 nt, Homo sapiens
ucccaaccuccccugguccugca

SEQ ID NO: 1510637 - RNA, 16 nt, Homo sapiens
ucccacgacuguugua

SEQ ID NO: 1510638 - RNA, 18 nt, Homo sapiens
ucccacuaagcuuucucc

SEQ ID NO: 1510639 - RNA, 20 nt, Homo sapiens
ucccacugucccccaagaaa

SEQ ID NO: 1510640 - RNA, 13 nt, Homo sapiens
ucccagcacuuug

SEQ ID NO: 1510641 - RNA, 20 nt, Homo sapiens
ucccagcugcagaugccaca

SEQ ID NO: 1510642 - RNA, 14 nt, Homo sapiens
ucccaguggucaaa

SEQ ID NO: 1510643 - RNA, 13 nt, Homo sapiens
ucccagugugugu

SEQ ID NO: 1510644 - RNA, 19 nt, Homo sapiens
ucccauaauugcuuugcca

SEQ ID NO: 1510645 - RNA, 21 nt, Homo sapiens
ucccauaauugcuuugccaaa

SEQ ID NO: 1510646 - RNA, 23 nt, Homo sapiens
ucccaugacauggagaccgugac

SEQ ID NO: 1510647 - RNA, 14 nt, Homo sapiens
ucccaugauccaga

SEQ ID NO: 1510648 - RNA, 14 nt, Homo sapiens
uccccaaacugugc

SEQ ID NO: 1510649 - RNA, 19 nt, Homo sapiens
uccccaacucuucuccaag

SEQ ID NO: 1510650 - RNA, 13 nt, Homo sapiens
uccccacaaucug

SEQ ID NO: 1510651 - RNA, 20 nt, Homo sapiens
uccccagcauugcaguaugg

SEQ ID NO: 1510652 - RNA, 14 nt, Homo sapiens
uccccgggggagga

SEQ ID NO: 1510653 - RNA, 21 nt, Homo sapiens
uccccucgugugacucucuug

SEQ ID NO: 1510654 - RNA, 21 nt, Homo sapiens
ucccgagcuacucucuugcca

SEQ ID NO: 1510655 - RNA, 14 nt, Homo sapiens
ucccggacugcaag

SEQ ID NO: 1510656 - RNA, 16 nt, Homo sapiens
ucccgguucaccuugc

SEQ ID NO: 1510657 - RNA, 16 nt, Homo sapiens
ucccucggagcugcca

SEQ ID NO: 1510658 - RNA, 21 nt, Homo sapiens
ucccucugagaauuccaagga

SEQ ID NO: 1510659 - RNA, 10 nt, Homo sapiens
ucccuggucg

SEQ ID NO: 1510660 - RNA, 18 nt, Homo sapiens
ucccugugcugacggaag

SEQ ID NO: 1510661 - RNA, 23 nt, Homo sapiens
ucccuucccuguccaccucacca

SEQ ID NO: 1510662 - RNA, 18 nt, Homo sapiens
uccgacucuaagcugugu

SEQ ID NO: 1510663 - RNA, 22 nt, Homo sapiens
uccgaggcaaagagaaaagcca

SEQ ID NO: 1510664 - RNA, 17 nt, Homo sapiens
uccgaugguaucugggu

SEQ ID NO: 1510665 - RNA, 21 nt, Homo sapiens
uccgccugcagaggacagagc

SEQ ID NO: 1510666 - RNA, 22 nt, Homo sapiens
uccggagggguugcgggggagc

SEQ ID NO: 1510667 - RNA, 11 nt, Homo sapiens
uccgugcuuuu

SEQ ID NO: 1510668 - RNA, 20 nt, Homo sapiens
uccguggucagagugccacu

SEQ ID NO: 1510669 - RNA, 16 nt, Homo sapiens
uccuacaaaauggagg

SEQ ID NO: 1510670 - RNA, 11 nt, Homo sapiens
uccuacaaggg

SEQ ID NO: 1510671 - RNA, 12 nt, Homo sapiens
uccuaccucagc

SEQ ID NO: 1510672 - RNA, 23 nt, Homo sapiens
uccuaggucacuugaagccaaac

SEQ ID NO: 1510673 - RNA, 21 nt, Homo sapiens
uccuauccuuggagagcagcu

SEQ ID NO: 1510674 - RNA, 19 nt, Homo sapiens
uccuaugcuuugaaacaga

SEQ ID NO: 1510675 - RNA, 15 nt, Homo sapiens
uccuauuauguguuc

SEQ ID NO: 1510676 - RNA, 22 nt, Homo sapiens
uccucaauucaauguggugaug

SEQ ID NO: 1510677 - RNA, 20 nt, Homo sapiens
uccucagagcaggggccaga

SEQ ID NO: 1510678 - RNA, 20 nt, Homo sapiens
uccucagguaguacugggaa

SEQ ID NO: 1510679 - RNA, 19 nt, Homo sapiens
uccucauccccacaaucug

SEQ ID NO: 1510680 - RNA, 15 nt, Homo sapiens
uccucugaagggaaa

SEQ ID NO: 1510681 - RNA, 15 nt, Homo sapiens
uccucuuugcaugga

SEQ ID NO: 1510682 - RNA, 17 nt, Homo sapiens
uccugagaaugaaugag

SEQ ID NO: 1510683 - RNA, 16 nt, Homo sapiens
uccugagcaguguaca

SEQ ID NO: 1510684 - RNA, 22 nt, Homo sapiens
uccugagugugggcuucugaaa

SEQ ID NO: 1510685 - RNA, 20 nt, Homo sapiens
uccugcacuccagaauccac

SEQ ID NO: 1510686 - RNA, 21 nt, Homo sapiens
uccuggcccucuucuuauuca

SEQ ID NO: 1510687 - RNA, 16 nt, Homo sapiens
uccuggugauucugau

SEQ ID NO: 1510688 - RNA, 18 nt, Homo sapiens
uccuguacauuucacaaa

SEQ ID NO: 1510689 - RNA, 14 nt, Homo sapiens
uccugugaauuucu

SEQ ID NO: 1510690 - RNA, 18 nt, Homo sapiens
uccuuaggaacagcucuu

SEQ ID NO: 1510691 - RNA, 19 nt, Homo sapiens
uccuugauacuaaaaguuc

SEQ ID NO: 1510692 - RNA, 22 nt, Homo sapiens
uccuuuaccuaccaccuucccu

SEQ ID NO: 1510693 - RNA, 21 nt, Homo sapiens
uccuuuaucaagaagucugaa

SEQ ID NO: 1510694 - RNA, 15 nt, Homo sapiens
uccuuuuguguacag

SEQ ID NO: 1510695 - RNA, 14 nt, Homo sapiens
ucgagucuaccucu

SEQ ID NO: 1510696 - RNA, 20 nt, Homo sapiens
ucggaagacuugccacuuuu

SEQ ID NO: 1510697 - RNA, 14 nt, Homo sapiens
ucggggugugauga

SEQ ID NO: 1510698 - RNA, 19 nt, Homo sapiens
ucggucaggagggugcagu

SEQ ID NO: 1510699 - RNA, 22 nt, Homo sapiens
ucguagagacgggguuucacca

SEQ ID NO: 1510700 - RNA, 14 nt, Homo sapiens
ucguagccaucucu

SEQ ID NO: 1510701 - RNA, 21 nt, Homo sapiens
ucgucuccugacaugucucac

SEQ ID NO: 1510702 - RNA, 21 nt, Homo sapiens
ucgucugggguggcucugcag

SEQ ID NO: 1510703 - RNA, 20 nt, Homo sapiens
ucuaacauuugcaaaaugga

SEQ ID NO: 1510704 - RNA, 21 nt, Homo sapiens
ucuaacuacaaggacaaugcc

SEQ ID NO: 1510705 - RNA, 19 nt, Homo sapiens
ucuaacuagaaaucugcca

SEQ ID NO: 1510706 - RNA, 20 nt, Homo sapiens
ucuaacuagaaaucugccaa

SEQ ID NO: 1510707 - RNA, 18 nt, Homo sapiens
ucuaagugguauauacau

SEQ ID NO: 1510708 - RNA, 17 nt, Homo sapiens
ucuaaguucaagaagac

SEQ ID NO: 1510709 - RNA, 17 nt, Homo sapiens
ucuacauguuuuagaca

SEQ ID NO: 1510710 - RNA, 13 nt, Homo sapiens
ucuaccauuugaa

SEQ ID NO: 1510711 - RNA, 18 nt, Homo sapiens
ucuacccggcccagagac

SEQ ID NO: 1510712 - RNA, 20 nt, Homo sapiens
ucuacccggcccagagaccc

SEQ ID NO: 1510713 - RNA, 16 nt, Homo sapiens
ucuaccuuuacuacau

SEQ ID NO: 1510714 - RNA, 17 nt, Homo sapiens
ucuacuccuaccucagc

SEQ ID NO: 1510715 - RNA, 16 nt, Homo sapiens
ucuaggcaacauagua

SEQ ID NO: 1510716 - RNA, 14 nt, Homo sapiens
ucuaguacaaccuu

SEQ ID NO: 1510717 - RNA, 14 nt, Homo sapiens
ucuagugacuuccu

SEQ ID NO: 1510718 - RNA, 15 nt, Homo sapiens
ucuauuaaauguaua

SEQ ID NO: 1510719 - RNA, 16 nt, Homo sapiens
ucuauuauaaaaccau

SEQ ID NO: 1510720 - RNA, 17 nt, Homo sapiens
ucucaaagaaagcauuu

SEQ ID NO: 1510721 - RNA, 14 nt, Homo sapiens
ucucaagacugaaa

SEQ ID NO: 1510722 - RNA, 14 nt, Homo sapiens
ucucaauaguaaaa

SEQ ID NO: 1510723 - RNA, 15 nt, Homo sapiens
ucucacagaggcagu

SEQ ID NO: 1510724 - RNA, 20 nt, Homo sapiens
cuagagugcgguggcgcgau

SEQ ID NO: 1510725 - RNA, 22 nt, Homo sapiens
cuagcauuuucuugaaccaaua

SEQ ID NO: 1510726 - RNA, 15 nt, Homo sapiens
cuagccuaagugugg

SEQ ID NO: 1510727 - RNA, 16 nt, Homo sapiens
cuagccuuuauuauua

SEQ ID NO: 1510728 - RNA, 21 nt, Homo sapiens
cuaggcugagcuggcauuggu

SEQ ID NO: 1510729 - RNA, 12 nt, Homo sapiens
cuaggucacuug

SEQ ID NO: 1510730 - RNA, 13 nt, Homo sapiens
cuaggucacuuga

SEQ ID NO: 1510731 - RNA, 17 nt, Homo sapiens
cuagguucuagguccug

SEQ ID NO: 1510732 - RNA, 22 nt, Homo sapiens
cuaguacaaccuuguugcuuua

SEQ ID NO: 1510733 - RNA, 16 nt, Homo sapiens
cuaguagcggaucuca

SEQ ID NO: 1510734 - RNA, 19 nt, Homo sapiens
cuagucacaaagacuccuu

SEQ ID NO: 1510735 - RNA, 18 nt, Homo sapiens
cuagugacuuccugguga

SEQ ID NO: 1510736 - RNA, 22 nt, Homo sapiens
cuaguuuaauuaacuaugugau

SEQ ID NO: 1510737 - RNA, 15 nt, Homo sapiens
cuaucacacaguggg

SEQ ID NO: 1510738 - RNA, 17 nt, Homo sapiens
cuaugaagacaucuucc

SEQ ID NO: 1510739 - RNA, 13 nt, Homo sapiens
cuaugacaugcaa

SEQ ID NO: 1510740 - RNA, 16 nt, Homo sapiens
cuaugauccacaaaaa

SEQ ID NO: 1510741 - RNA, 21 nt, Homo sapiens
cuaugauuuuaagauagaaca

SEQ ID NO: 1510742 - RNA, 22 nt, Homo sapiens
cuauguauggaugaaagcaauc

SEQ ID NO: 1510743 - RNA, 19 nt, Homo sapiens
cuaugucgucguuuucacc

SEQ ID NO: 1510744 - RNA, 17 nt, Homo sapiens
cuauguugaaugcuuaa

SEQ ID NO: 1510745 - RNA, 21 nt, Homo sapiens
cuauuauaaaaccauguugau

SEQ ID NO: 1510746 - RNA, 19 nt, Homo sapiens
cuauucaaaaggaaauaua

SEQ ID NO: 1510747 - RNA, 12 nt, Homo sapiens
cuauucaaugau

SEQ ID NO: 1510748 - RNA, 13 nt, Homo sapiens
cuauucuuugcca

SEQ ID NO: 1510749 - RNA, 13 nt, Homo sapiens
cuauugaauugga

SEQ ID NO: 1510750 - RNA, 15 nt, Homo sapiens
cuauuuacauauaau

SEQ ID NO: 1510751 - RNA, 21 nt, Homo sapiens
cuauuuggggcuugcaugcca

SEQ ID NO: 1510752 - RNA, 21 nt, Homo sapiens
cucaaaagaaaaaaaaaagca

SEQ ID NO: 1510753 - RNA, 19 nt, Homo sapiens
cucaaaagauuguuuuaua

SEQ ID NO: 1510754 - RNA, 20 nt, Homo sapiens
cucaaauccuugagcacuca

SEQ ID NO: 1510755 - RNA, 19 nt, Homo sapiens
cucaacaacaaaccaaaac

SEQ ID NO: 1510756 - RNA, 19 nt, Homo sapiens
cucaaguuuuuguuuugua

SEQ ID NO: 1510757 - RNA, 20 nt, Homo sapiens
cucaaucaugaguaccucaa

SEQ ID NO: 1510758 - RNA, 19 nt, Homo sapiens
cucacacgggguauuuuag

SEQ ID NO: 1510759 - RNA, 13 nt, Homo sapiens
cucacucugucac

SEQ ID NO: 1510760 - RNA, 21 nt, Homo sapiens
cucagagcaggggccagauga

SEQ ID NO: 1510761 - RNA, 23 nt, Homo sapiens
cucagauaagguaaaaugccaug

SEQ ID NO: 1510762 - RNA, 15 nt, Homo sapiens
cucagcaugcagaag

SEQ ID NO: 1510763 - RNA, 20 nt, Homo sapiens
cucagccucccaaguagcug

SEQ ID NO: 1510764 - RNA, 17 nt, Homo sapiens
cucaggcuuccuuggca

SEQ ID NO: 1510765 - RNA, 14 nt, Homo sapiens
cucaggggccagug

SEQ ID NO: 1510766 - RNA, 19 nt, Homo sapiens
cucaggguucugagucaga

SEQ ID NO: 1510767 - RNA, 13 nt, Homo sapiens
cucagugggacaa

SEQ ID NO: 1510768 - RNA, 22 nt, Homo sapiens
cucauauaaaaggugagcucag

SEQ ID NO: 1510769 - RNA, 13 nt, Homo sapiens
cucauaucaaucc

SEQ ID NO: 1510770 - RNA, 16 nt, Homo sapiens
cucauccccacaaucu

SEQ ID NO: 1510771 - RNA, 23 nt, Homo sapiens
cucaucccuggucgucuauccca

SEQ ID NO: 1510772 - RNA, 14 nt, Homo sapiens
cucaucccuguucc

SEQ ID NO: 1510773 - RNA, 18 nt, Homo sapiens
cucaucuacaagcauuug

SEQ ID NO: 1510774 - RNA, 11 nt, Homo sapiens
cucaugccacu

SEQ ID NO: 1510775 - RNA, 23 nt, Homo sapiens
cucauguuuaucugagcucuuau

SEQ ID NO: 1510776 - RNA, 13 nt, Homo sapiens
cuccagcccuuca

SEQ ID NO: 1510777 - RNA, 13 nt, Homo sapiens
cuccagcuccagu

SEQ ID NO: 1510778 - RNA, 17 nt, Homo sapiens
cuccagggucuaaagag

SEQ ID NO: 1510779 - RNA, 14 nt, Homo sapiens
cucccacuauggug

SEQ ID NO: 1510780 - RNA, 16 nt, Homo sapiens
cucccagcguguguau

SEQ ID NO: 1510781 - RNA, 18 nt, Homo sapiens
cucccagcguguguaucc

SEQ ID NO: 1510782 - RNA, 22 nt, Homo sapiens
cucccauaauugcuuugccaaa

SEQ ID NO: 1510783 - RNA, 23 nt, Homo sapiens
cucccauaauugcuuugccaaaa

SEQ ID NO: 1510784 - RNA, 18 nt, Homo sapiens
cuccccacaguccucaca

SEQ ID NO: 1510785 - RNA, 13 nt, Homo sapiens
cuccccaccuuca

SEQ ID NO: 1510786 - RNA, 16 nt, Homo sapiens
ucugaauaacauuugu

SEQ ID NO: 1510787 - RNA, 23 nt, Homo sapiens
ucugagaagacacaaggugauuu

SEQ ID NO: 1510788 - RNA, 12 nt, Homo sapiens
ucugagaucucc

SEQ ID NO: 1510789 - RNA, 15 nt, Homo sapiens
ucugagcacccccuc

SEQ ID NO: 1510790 - RNA, 12 nt, Homo sapiens
ucugcacccagg

SEQ ID NO: 1510791 - RNA, 12 nt, Homo sapiens
ucugcaucucau

SEQ ID NO: 1510792 - RNA, 16 nt, Homo sapiens
ucugcuauaugccuua

SEQ ID NO: 1510793 - RNA, 16 nt, Homo sapiens
ucugcuauauuuucau

SEQ ID NO: 1510794 - RNA, 14 nt, Homo sapiens
ucugcuccagagag

SEQ ID NO: 1510795 - RNA, 23 nt, Homo sapiens
ucugcuccccagugcuaccucuc

SEQ ID NO: 1510796 - RNA, 13 nt, Homo sapiens
ucuggaacaaagu

SEQ ID NO: 1510797 - RNA, 19 nt, Homo sapiens
ucuggacagcagcaggaau

SEQ ID NO: 1510798 - RNA, 21 nt, Homo sapiens
ucuggaggacacacagucuca

SEQ ID NO: 1510799 - RNA, 16 nt, Homo sapiens
ucuggaucuccugacc

SEQ ID NO: 1510800 - RNA, 21 nt, Homo sapiens
ucuggauggauuugaagcaaa

SEQ ID NO: 1510801 - RNA, 20 nt, Homo sapiens
ucuggcuaaauggacaucau

SEQ ID NO: 1510802 - RNA, 17 nt, Homo sapiens
ucuggcuguguggccaa

SEQ ID NO: 1510803 - RNA, 16 nt, Homo sapiens
ucuggcuuagugccac

SEQ ID NO: 1510804 - RNA, 17 nt, Homo sapiens
ucuggcuuagugccacc

SEQ ID NO: 1510805 - RNA, 19 nt, Homo sapiens
ucugggcagcgcuaucuag

SEQ ID NO: 1510806 - RNA, 17 nt, Homo sapiens
ucugggccacucaggcc

SEQ ID NO: 1510807 - RNA, 17 nt, Homo sapiens
ucugguuugagcaauuu

SEQ ID NO: 1510808 - RNA, 22 nt, Homo sapiens
ucuguaagaaaccuacugccca

SEQ ID NO: 1510809 - RNA, 10 nt, Homo sapiens
ucuguacaau

SEQ ID NO: 1510810 - RNA, 23 nt, Homo sapiens
ucugucaggcauugaaugacaag

SEQ ID NO: 1510811 - RNA, 14 nt, Homo sapiens
ucugucccaaagaa

SEQ ID NO: 1510812 - RNA, 16 nt, Homo sapiens
ucuguguuuacuuaag

SEQ ID NO: 1510813 - RNA, 14 nt, Homo sapiens
ucuguuuacugcaa

SEQ ID NO: 1510814 - RNA, 18 nt, Homo sapiens
ucuguuuuuucuguacac

SEQ ID NO: 1510815 - RNA, 15 nt, Homo sapiens
ucuuaaaauguuaac

SEQ ID NO: 1510816 - RNA, 22 nt, Homo sapiens
ucuuacauaauuuuuuauucaa

SEQ ID NO: 1510817 - RNA, 17 nt, Homo sapiens
ucuuagggcagucagua

SEQ ID NO: 1510818 - RNA, 17 nt, Homo sapiens
ucuuauagaaagcacua

SEQ ID NO: 1510819 - RNA, 15 nt, Homo sapiens
ucuuauguuugcuuu

SEQ ID NO: 1510820 - RNA, 13 nt, Homo sapiens
ucuuauuugcuca

SEQ ID NO: 1510821 - RNA, 14 nt, Homo sapiens
ucuucccuccuucc

SEQ ID NO: 1510822 - RNA, 13 nt, Homo sapiens
ucuuccugcaaag

SEQ ID NO: 1510823 - RNA, 16 nt, Homo sapiens
ucuucuaccauuugaa

SEQ ID NO: 1510824 - RNA, 18 nt, Homo sapiens
ucuucuggugcuacucca

SEQ ID NO: 1510825 - RNA, 19 nt, Homo sapiens
ucuucuuguguccugauga

SEQ ID NO: 1510826 - RNA, 13 nt, Homo sapiens
ucuugaccuggag

SEQ ID NO: 1510827 - RNA, 17 nt, Homo sapiens
ucuugccccuccagaga

SEQ ID NO: 1510828 - RNA, 24 nt, Homo sapiens
ucuugcuguaacucagacauucca

SEQ ID NO: 1510829 - RNA, 15 nt, Homo sapiens
ucuuggccucugcuu

SEQ ID NO: 1510830 - RNA, 24 nt, Homo sapiens
ucuugggggguuuuuacuccagug

SEQ ID NO: 1510831 - RNA, 17 nt, Homo sapiens
ucuuuaaccacuccuca

SEQ ID NO: 1510832 - RNA, 13 nt, Homo sapiens
ucuuuaaguauug

SEQ ID NO: 1510833 - RNA, 22 nt, Homo sapiens
ucuuuauucuuagggcagucag

SEQ ID NO: 1510834 - RNA, 14 nt, Homo sapiens
ucuuuccccaccuc

SEQ ID NO: 1510835 - RNA, 23 nt, Homo sapiens
ucuuugacugaaaaaaaaaaaga

SEQ ID NO: 1510836 - RNA, 16 nt, Homo sapiens
ucuuugcucauggcaa

SEQ ID NO: 1510837 - RNA, 19 nt, Homo sapiens
ugaaaaaaaguacauguau

SEQ ID NO: 1510838 - RNA, 18 nt, Homo sapiens
ugaaaauaauuguuccaa

SEQ ID NO: 1510839 - RNA, 14 nt, Homo sapiens
ugaaaaucuaauau

SEQ ID NO: 1510840 - RNA, 13 nt, Homo sapiens
ugaaaaugauuag

SEQ ID NO: 1510841 - RNA, 20 nt, Homo sapiens
ugaaacaagauaacugagaa

SEQ ID NO: 1510842 - RNA, 11 nt, Homo sapiens
ugaaaccaaag

SEQ ID NO: 1510843 - RNA, 22 nt, Homo sapiens
ugaaaccagaaggauauuuacu

SEQ ID NO: 1510844 - RNA, 19 nt, Homo sapiens
ugaaaccauuccaguagga

SEQ ID NO: 1510845 - RNA, 24 nt, Homo sapiens
ugaaacuuuagagauuaacgacaa

SEQ ID NO: 1510846 - RNA, 13 nt, Homo sapiens
ugaaagauggguc

SEQ ID NO: 1510847 - RNA, 21 nt, Homo sapiens
ugaaauuuucuagacuuucug

SEQ ID NO: 1510848 - RNA, 21 nt, Homo sapiens
ugaaauuuucucaucuaaaau

SEQ ID NO: 1510849 - RNA, 17 nt, Homo sapiens
ugaacaauucucucuua

SEQ ID NO: 1510850 - RNA, 11 nt, Homo sapiens
ugaacagccaa

SEQ ID NO: 1510851 - RNA, 13 nt, Homo sapiens
ugaaccacuuugc

SEQ ID NO: 1510852 - RNA, 23 nt, Homo sapiens
ugaaccccuggccucaagcaauc

SEQ ID NO: 1510853 - RNA, 19 nt, Homo sapiens
ugaaccugaugagcaagaa

SEQ ID NO: 1510854 - RNA, 23 nt, Homo sapiens
ugaacucccgaccucaagugauc

SEQ ID NO: 1510855 - RNA, 21 nt, Homo sapiens
ugaacucgaagcccacaaucc

SEQ ID NO: 1510856 - RNA, 19 nt, Homo sapiens
ugaacucuucacucuucaa

SEQ ID NO: 1510857 - RNA, 13 nt, Homo sapiens
ugaacugccaaag

SEQ ID NO: 1510858 - RNA, 11 nt, Homo sapiens
ugaacuggaag

SEQ ID NO: 1510859 - RNA, 15 nt, Homo sapiens
ugaagaaaagcacuu

SEQ ID NO: 1510860 - RNA, 15 nt, Homo sapiens
ugaagaccacaucca

SEQ ID NO: 1510861 - RNA, 21 nt, Homo sapiens
ugaagagauuucaacauauca

SEQ ID NO: 1510862 - RNA, 20 nt, Homo sapiens
ugaaggacagaacauugccu

SEQ ID NO: 1510863 - RNA, 23 nt, Homo sapiens
ugaaggaggugagggaugugaau

SEQ ID NO: 1510864 - RNA, 15 nt, Homo sapiens
ugaagucaaaccuua

SEQ ID NO: 1510865 - RNA, 13 nt, Homo sapiens
ugaagugccacau

SEQ ID NO: 1510866 - RNA, 12 nt, Homo sapiens
ugaaguuacaaa

SEQ ID NO: 1510867 - RNA, 16 nt, Homo sapiens
ugaaguuaugcuguca

SEQ ID NO: 1510868 - RNA, 22 nt, Homo sapiens
ugaauaacauuugugugguggg

SEQ ID NO: 1510869 - RNA, 12 nt, Homo sapiens
ugaauagcacag

SEQ ID NO: 1510870 - RNA, 15 nt, Homo sapiens
ugaauauauggucug

SEQ ID NO: 1510871 - RNA, 19 nt, Homo sapiens
ugaaucccauaucuaccca

SEQ ID NO: 1510872 - RNA, 17 nt, Homo sapiens
ugaaugaccugcaguca

SEQ ID NO: 1510873 - RNA, 15 nt, Homo sapiens
ugaaugcaaaccaua

SEQ ID NO: 1510874 - RNA, 22 nt, Homo sapiens
ugaaugguccaggguugaucac

SEQ ID NO: 1510875 - RNA, 13 nt, Homo sapiens
ugaauguuuccaa

SEQ ID NO: 1510876 - RNA, 21 nt, Homo sapiens
ugaauuagccaaaacacuuag

SEQ ID NO: 1510877 - RNA, 23 nt, Homo sapiens
ugacaacauugcauugugacuau

SEQ ID NO: 1510878 - RNA, 24 nt, Homo sapiens
ugacacaaauugaagcauguacaa

SEQ ID NO: 1510879 - RNA, 17 nt, Homo sapiens
ugacagcaggugggaaa

SEQ ID NO: 1510880 - RNA, 18 nt, Homo sapiens
ugacaggcugaaagccca

SEQ ID NO: 1510881 - RNA, 16 nt, Homo sapiens
ugacccuccaccgcag

SEQ ID NO: 1510882 - RNA, 21 nt, Homo sapiens
ugacccuccaccgcagaagga

SEQ ID NO: 1510883 - RNA, 20 nt, Homo sapiens
ugacggucccacacugguga

SEQ ID NO: 1510884 - RNA, 23 nt, Homo sapiens
ugacgugcaccuguacucaggag

SEQ ID NO: 1510885 - RNA, 20 nt, Homo sapiens
ugacuagaccccacccugag

SEQ ID NO: 1510886 - RNA, 13 nt, Homo sapiens
ugacucacuccau

SEQ ID NO: 1510887 - RNA, 16 nt, Homo sapiens
ugacucugacuuugag

SEQ ID NO: 1510888 - RNA, 13 nt, Homo sapiens
ugagaaaaucagu

SEQ ID NO: 1510889 - RNA, 18 nt, Homo sapiens
ugagaagcugggcaugaa

SEQ ID NO: 1510890 - RNA, 21 nt, Homo sapiens
ugagaauaauucuuuccaugc

SEQ ID NO: 1510891 - RNA, 22 nt, Homo sapiens
ugagagcauugggauaucuccu

SEQ ID NO: 1510892 - RNA, 19 nt, Homo sapiens
ugagagcugcucuggaaaa

SEQ ID NO: 1510893 - RNA, 14 nt, Homo sapiens
ugagauguguucag

SEQ ID NO: 1510894 - RNA, 17 nt, Homo sapiens
ugagcaaggacaaccug

SEQ ID NO: 1510895 - RNA, 13 nt, Homo sapiens
ugagggacguggu

SEQ ID NO: 1510896 - RNA, 16 nt, Homo sapiens
ugaggggcuccuggaa

SEQ ID NO: 1510897 - RNA, 22 nt, Homo sapiens
ugaggggcuccuggaaaggcuc

SEQ ID NO: 1510898 - RNA, 21 nt, Homo sapiens
ugaggucacuggguucuagaa

SEQ ID NO: 1510899 - RNA, 21 nt, Homo sapiens
ugaguuauaguuugcuuugcu

SEQ ID NO: 1510900 - RNA, 18 nt, Homo sapiens
ugaguuugcuguuugcaa

SEQ ID NO: 1510901 - RNA, 13 nt, Homo sapiens
ugauaagcaaauu

SEQ ID NO: 1510902 - RNA, 23 nt, Homo sapiens
agacuuuguguuuacaucugcau

SEQ ID NO: 1510903 - RNA, 22 nt, Homo sapiens
agagaacuuucggagccugccu

SEQ ID NO: 1510904 - RNA, 22 nt, Homo sapiens
agagaauuguaucauuugaaca

SEQ ID NO: 1510905 - RNA, 12 nt, Homo sapiens
agagacacugcu

SEQ ID NO: 1510906 - RNA, 22 nt, Homo sapiens
agagagauggaauaaagcccuu

SEQ ID NO: 1510907 - RNA, 21 nt, Homo sapiens
agagauggaauaaagcccuug

SEQ ID NO: 1510908 - RNA, 23 nt, Homo sapiens
agagauuuucuuggcaguauucc

SEQ ID NO: 1510909 - RNA, 16 nt, Homo sapiens
aguucuuuacugguga

SEQ ID NO: 1510910 - RNA, 20 nt, Homo sapiens
aagauaauuuguugggccau

SEQ ID NO: 1510911 - RNA, 17 nt, Homo sapiens
aagauugagaagccaug

SEQ ID NO: 1510912 - RNA, 18 nt, Homo sapiens
aagauuuaacaaauacau

SEQ ID NO: 1510913 - RNA, 19 nt, Homo sapiens
aagauuugugaacuggaag

SEQ ID NO: 1510914 - RNA, 17 nt, Homo sapiens
aagcaaaccugauacaa

SEQ ID NO: 1510915 - RNA, 18 nt, Homo sapiens
aagcaaaggaaaccaaag

SEQ ID NO: 1510916 - RNA, 18 nt, Homo sapiens
aagcaaauuaguaauugu

SEQ ID NO: 1510917 - RNA, 20 nt, Homo sapiens
aagcaauuauugugccucag

SEQ ID NO: 1510918 - RNA, 19 nt, Homo sapiens
aagcacuggacuacaaggg

SEQ ID NO: 1510919 - RNA, 14 nt, Homo sapiens
aagcagaauccuua

SEQ ID NO: 1510920 - RNA, 15 nt, Homo sapiens
aagcagagcuuccuc

SEQ ID NO: 1510921 - RNA, 23 nt, Homo sapiens
aagcaguuguuauuuagugauau

SEQ ID NO: 1510922 - RNA, 19 nt, Homo sapiens
aagcauucugagcugggcu

SEQ ID NO: 1510923 - RNA, 12 nt, Homo sapiens
aagcauuugccc

SEQ ID NO: 1510924 - RNA, 21 nt, Homo sapiens
aagccacggaccguugcacaa

SEQ ID NO: 1510925 - RNA, 13 nt, Homo sapiens
aagccaggaguug

SEQ ID NO: 1510926 - RNA, 20 nt, Homo sapiens
aagcgauucuucugccucag

SEQ ID NO: 1510927 - RNA, 17 nt, Homo sapiens
aagcugagcaaccucuu

SEQ ID NO: 1510928 - RNA, 14 nt, Homo sapiens
aagcugcugucacu

SEQ ID NO: 1510929 - RNA, 14 nt, Homo sapiens
aagcuggaagcaca

SEQ ID NO: 1510930 - RNA, 20 nt, Homo sapiens
aagcugggcaugaacgcacu

SEQ ID NO: 1510931 - RNA, 12 nt, Homo sapiens
aagcuucuugcu

SEQ ID NO: 1510932 - RNA, 14 nt, Homo sapiens
acaacacaguucuc

SEQ ID NO: 1510933 - RNA, 16 nt, Homo sapiens
acaacuuguauuucca

SEQ ID NO: 1510934 - RNA, 20 nt, Homo sapiens
acaacuuguguucuauuaau

SEQ ID NO: 1510935 - RNA, 18 nt, Homo sapiens
acaagaaggccacuggua

SEQ ID NO: 1510936 - RNA, 19 nt, Homo sapiens
acaagaaggccacugguag

SEQ ID NO: 1510937 - RNA, 21 nt, Homo sapiens
acaagaauuguccaugugcuu

SEQ ID NO: 1510938 - RNA, 19 nt, Homo sapiens
acaagcaucaguagcugag

SEQ ID NO: 1510939 - RNA, 14 nt, Homo sapiens
acaagcauuugccc

SEQ ID NO: 1510940 - RNA, 17 nt, Homo sapiens
acaagccagaacuugac

SEQ ID NO: 1510941 - RNA, 18 nt, Homo sapiens
acaaggaucagaauggaa

SEQ ID NO: 1510942 - RNA, 23 nt, Homo sapiens
acaagggaagcuucuugcugcca

SEQ ID NO: 1510943 - RNA, 21 nt, Homo sapiens
acaauaaaagaaacugugguc

SEQ ID NO: 1510944 - RNA, 22 nt, Homo sapiens
acaauauuaauuauaauaaagg

SEQ ID NO: 1510945 - RNA, 19 nt, Homo sapiens
acaaugaaggaaaaccuca

SEQ ID NO: 1510946 - RNA, 17 nt, Homo sapiens
acaaugccuugggagag

SEQ ID NO: 1510947 - RNA, 15 nt, Homo sapiens
acaauguaagagccu

SEQ ID NO: 1510948 - RNA, 16 nt, Homo sapiens
acaauugacaacaguu

SEQ ID NO: 1510949 - RNA, 22 nt, Homo sapiens
acaauugacaacaguuacauaa

SEQ ID NO: 1510950 - RNA, 14 nt, Homo sapiens
acaauuugcccaag

SEQ ID NO: 1510951 - RNA, 16 nt, Homo sapiens
acacaaagacacagga

SEQ ID NO: 1510952 - RNA, 15 nt, Homo sapiens
acacacuaucaccua

SEQ ID NO: 1510953 - RNA, 14 nt, Homo sapiens
acacaggaagaaug

SEQ ID NO: 1510954 - RNA, 20 nt, Homo sapiens
acacauaggaggcucauucu

SEQ ID NO: 1510955 - RNA, 17 nt, Homo sapiens
acacauguccaguggga

SEQ ID NO: 1510956 - RNA, 16 nt, Homo sapiens
acacauuagauguuac

SEQ ID NO: 1510957 - RNA, 21 nt, Homo sapiens
acacauucuuaacacaugucc

SEQ ID NO: 1510958 - RNA, 14 nt, Homo sapiens
acacccaagaagaa

SEQ ID NO: 1510959 - RNA, 16 nt, Homo sapiens
acacccgacuccucaa

SEQ ID NO: 1510960 - RNA, 23 nt, Homo sapiens
acaccucggccguacaucucugu

SEQ ID NO: 1510961 - RNA, 12 nt, Homo sapiens
acaccugacaaa

SEQ ID NO: 1510962 - RNA, 16 nt, Homo sapiens
acacuauccaaugaau

SEQ ID NO: 1510963 - RNA, 18 nt, Homo sapiens
acacuauuuuugauagca

SEQ ID NO: 1510964 - RNA, 15 nt, Homo sapiens
acacuugcaaccuac

SEQ ID NO: 1510965 - RNA, 17 nt, Homo sapiens
acacuugcaaccuaccu

SEQ ID NO: 1510966 - RNA, 18 nt, Homo sapiens
acagacauuaaaccugga

SEQ ID NO: 1510967 - RNA, 22 nt, Homo sapiens
acagacugugaguacagcagaa

SEQ ID NO: 1510968 - RNA, 15 nt, Homo sapiens
acagauaucaguguc

SEQ ID NO: 1510969 - RNA, 16 nt, Homo sapiens
acagcaauuguagaca

SEQ ID NO: 1510970 - RNA, 15 nt, Homo sapiens
acagcagcaggaaug

SEQ ID NO: 1510971 - RNA, 12 nt, Homo sapiens
acagcagguggg

SEQ ID NO: 1510972 - RNA, 16 nt, Homo sapiens
acagcauaauugccuu

SEQ ID NO: 1510973 - RNA, 16 nt, Homo sapiens
acagccaguuuucaca

SEQ ID NO: 1510974 - RNA, 19 nt, Homo sapiens
acagcccacggggaucaca

SEQ ID NO: 1510975 - RNA, 15 nt, Homo sapiens
acagcccagacuuua

SEQ ID NO: 1510976 - RNA, 21 nt, Homo sapiens
acagccuauaaccagacacau

SEQ ID NO: 1510977 - RNA, 23 nt, Homo sapiens
acagcgcguccuucccuaaagac

SEQ ID NO: 1510978 - RNA, 16 nt, Homo sapiens
acagcuuaacauuuac

SEQ ID NO: 1510979 - RNA, 13 nt, Homo sapiens
acaggaaaccacu

SEQ ID NO: 1510980 - RNA, 20 nt, Homo sapiens
acagggaacaagcauucucc

SEQ ID NO: 1510981 - RNA, 23 nt, Homo sapiens
acaggugguuuuugguuacaugg

SEQ ID NO: 1510982 - RNA, 17 nt, Homo sapiens
acaguauguuacaugca

SEQ ID NO: 1510983 - RNA, 11 nt, Homo sapiens
acagugaaugu

SEQ ID NO: 1510984 - RNA, 17 nt, Homo sapiens
acagugcagugcgcugu

SEQ ID NO: 1510985 - RNA, 15 nt, Homo sapiens
acauaaacacauaca

SEQ ID NO: 1510986 - RNA, 14 nt, Homo sapiens
acauaacuaguuua

SEQ ID NO: 1510987 - RNA, 13 nt, Homo sapiens
acauacacucaaa

SEQ ID NO: 1510988 - RNA, 19 nt, Homo sapiens
acauagacaaaaaauuuga

SEQ ID NO: 1510989 - RNA, 22 nt, Homo sapiens
acauaguucuuacuacuugcca

SEQ ID NO: 1510990 - RNA, 14 nt, Homo sapiens
acauaugugccaau

SEQ ID NO: 1510991 - RNA, 14 nt, Homo sapiens
acaucuuuccuguc

SEQ ID NO: 1510992 - RNA, 18 nt, Homo sapiens
acaugaacagaaacaaua

SEQ ID NO: 1510993 - RNA, 13 nt, Homo sapiens
acaugaaugcaca

SEQ ID NO: 1510994 - RNA, 22 nt, Homo sapiens
acaugauggagcgcaccugccc

SEQ ID NO: 1510995 - RNA, 14 nt, Homo sapiens
acaugaugugagau

SEQ ID NO: 1510996 - RNA, 21 nt, Homo sapiens
acaugcauucuaccacuacau

SEQ ID NO: 1510997 - RNA, 15 nt, Homo sapiens
acaugcgaccgugac

SEQ ID NO: 1510998 - RNA, 19 nt, Homo sapiens
acaugcgugaccagcagua

SEQ ID NO: 1510999 - RNA, 19 nt, Homo sapiens
acaugcuucagugcugcuc

SEQ ID NO: 1511000 - RNA, 23 nt, Homo sapiens
acauggaagguuagagguuuguc

SEQ ID NO: 1511001 - RNA, 13 nt, Homo sapiens
acauggaauuuaa

SEQ ID NO: 1511002 - RNA, 22 nt, Homo sapiens
acauggacaugcuucagugcug

SEQ ID NO: 1511003 - RNA, 20 nt, Homo sapiens
acauggccagugugauccca

SEQ ID NO: 1511004 - RNA, 15 nt, Homo sapiens
acauguacaugcauu

SEQ ID NO: 1511005 - RNA, 23 nt, Homo sapiens
acauguuauccacaagcaaugga

SEQ ID NO: 1511006 - RNA, 19 nt, Homo sapiens
acauguugcuaaugacagu

SEQ ID NO: 1511007 - RNA, 14 nt, Homo sapiens
acauuagauguuac

SEQ ID NO: 1511008 - RNA, 15 nt, Homo sapiens
acauugccucaggca

SEQ ID NO: 1511009 - RNA, 16 nt, Homo sapiens
acauuucccugugcug

SEQ ID NO: 1511010 - RNA, 15 nt, Homo sapiens
acauuuggagugugu

SEQ ID NO: 1511011 - RNA, 18 nt, Homo sapiens
acauuuucaauaauguga

SEQ ID NO: 1511012 - RNA, 13 nt, Homo sapiens
accaaaccccacu

SEQ ID NO: 1511013 - RNA, 17 nt, Homo sapiens
accaacuggagcacuga

SEQ ID NO: 1511014 - RNA, 17 nt, Homo sapiens
accaagggaucugccau

SEQ ID NO: 1511015 - RNA, 13 nt, Homo sapiens
accaauaauguau

SEQ ID NO: 1511016 - RNA, 15 nt, Homo sapiens
accacacuucuugaa

SEQ ID NO: 1511017 - RNA, 18 nt, Homo sapiens
accacuguggccuucuca

SEQ ID NO: 1511018 - RNA, 21 nt, Homo sapiens
accagagccuucaagugccaa

SEQ ID NO: 1511019 - RNA, 14 nt, Homo sapiens
accagaggugacag

SEQ ID NO: 1511020 - RNA, 17 nt, Homo sapiens
accagagucaaauuuga

SEQ ID NO: 1511021 - RNA, 14 nt, Homo sapiens
accagauaguuaua

SEQ ID NO: 1511022 - RNA, 19 nt, Homo sapiens
accaggauagagacuggaa

SEQ ID NO: 1511023 - RNA, 20 nt, Homo sapiens
accaggauagagacuggaac

SEQ ID NO: 1511024 - RNA, 15 nt, Homo sapiens
accaguacugggaag

SEQ ID NO: 1511025 - RNA, 13 nt, Homo sapiens
accagugcugcug

SEQ ID NO: 1511026 - RNA, 16 nt, Homo sapiens
accauaaacuguacaa

SEQ ID NO: 1511027 - RNA, 13 nt, Homo sapiens
accauaacagcca

SEQ ID NO: 1511028 - RNA, 12 nt, Homo sapiens
accauuaaugaa

SEQ ID NO: 1511029 - RNA, 23 nt, Homo sapiens
accauuuguguuuugaaagccca

SEQ ID NO: 1511030 - RNA, 13 nt, Homo sapiens
acccagcaaagag

SEQ ID NO: 1511031 - RNA, 15 nt, Homo sapiens
acccaguauaugcua

SEQ ID NO: 1511032 - RNA, 21 nt, Homo sapiens
acccauagugcacacuuguau

SEQ ID NO: 1511033 - RNA, 12 nt, Homo sapiens
accccaucucau

SEQ ID NO: 1511034 - RNA, 19 nt, Homo sapiens
accccuccaccucucucuc

SEQ ID NO: 1511035 - RNA, 18 nt, Homo sapiens
accccugauaagcaaauu

SEQ ID NO: 1511036 - RNA, 20 nt, Homo sapiens
accccuggccucaagcaauc

SEQ ID NO: 1511037 - RNA, 17 nt, Homo sapiens
accccuguuaagcaauu

SEQ ID NO: 1511038 - RNA, 15 nt, Homo sapiens
acccugcgauuuugc

SEQ ID NO: 1511039 - RNA, 19 nt, Homo sapiens
acccuguggggccugaugg

SEQ ID NO: 1511040 - RNA, 20 nt, Homo sapiens
accgagcgcuuucuggaaaa

SEQ ID NO: 1511041 - RNA, 17 nt, Homo sapiens
accguugcacaaaaagg

SEQ ID NO: 1511042 - RNA, 20 nt, Homo sapiens
accuaaaauuucaaguuuaa

SEQ ID NO: 1511043 - RNA, 16 nt, Homo sapiens
accuaaaccaccagug

SEQ ID NO: 1511044 - RNA, 17 nt, Homo sapiens
accuaugucccuucuca

SEQ ID NO: 1511045 - RNA, 14 nt, Homo sapiens
accucacuauucaa

SEQ ID NO: 1511046 - RNA, 17 nt, Homo sapiens
accucggccuccuaaag

SEQ ID NO: 1511047 - RNA, 22 nt, Homo sapiens
accucggcucacugcagccucc

SEQ ID NO: 1511048 - RNA, 15 nt, Homo sapiens
accucuucuuuucac

SEQ ID NO: 1511049 - RNA, 20 nt, Homo sapiens
accugaaaaaaaguuuacaa

SEQ ID NO: 1511050 - RNA, 14 nt, Homo sapiens
accugacaaaugga

SEQ ID NO: 1511051 - RNA, 15 nt, Homo sapiens
accugacaaauggaa

SEQ ID NO: 1511052 - RNA, 20 nt, Homo sapiens
accugaggcuccugugcuac

SEQ ID NO: 1511053 - RNA, 22 nt, Homo sapiens
ggccagugggccugguagcaca

SEQ ID NO: 1511054 - RNA, 21 nt, Homo sapiens
ggccauggaauaaaccauuuu

SEQ ID NO: 1511055 - RNA, 12 nt, Homo sapiens
ggcccauucuaa

SEQ ID NO: 1511056 - RNA, 15 nt, Homo sapiens
ggcccucuucuuauu

SEQ ID NO: 1511057 - RNA, 22 nt, Homo sapiens
ggccucagcaccccugucucua

SEQ ID NO: 1511058 - RNA, 15 nt, Homo sapiens
ggccucugcuuucuc

SEQ ID NO: 1511059 - RNA, 15 nt, Homo sapiens
ggccugcacucuuau

SEQ ID NO: 1511060 - RNA, 20 nt, Homo sapiens
ggccuuucagguccaggcca

SEQ ID NO: 1511061 - RNA, 23 nt, Homo sapiens
ggcuaccgugggucaaccuggga

SEQ ID NO: 1511062 - RNA, 22 nt, Homo sapiens
ggcucuguuaugcaagcacaaa

SEQ ID NO: 1511063 - RNA, 13 nt, Homo sapiens
ggcugcugcacug

SEQ ID NO: 1511064 - RNA, 16 nt, Homo sapiens
ggcugcugcacugccc

SEQ ID NO: 1511065 - RNA, 18 nt, Homo sapiens
ggcugggccugagccuaa

SEQ ID NO: 1511066 - RNA, 23 nt, Homo sapiens
ggcuggugcuguggccaggguga

SEQ ID NO: 1511067 - RNA, 15 nt, Homo sapiens
ggcuucccaggggaa

SEQ ID NO: 1511068 - RNA, 22 nt, Homo sapiens
ggcuuucuggagaggagggaug

SEQ ID NO: 1511069 - RNA, 22 nt, Homo sapiens
gggaaaccaguguagccuugcc

SEQ ID NO: 1511070 - RNA, 17 nt, Homo sapiens
gggaacaagcauucucc

SEQ ID NO: 1511071 - RNA, 22 nt, Homo sapiens
gggaagauacugacuagucaua

SEQ ID NO: 1511072 - RNA, 21 nt, Homo sapiens
gggaagcugggggaagggugg

SEQ ID NO: 1511073 - RNA, 22 nt, Homo sapiens
gggagcaugggacugugccuuu

SEQ ID NO: 1511074 - RNA, 15 nt, Homo sapiens
gggagccauguuuca

SEQ ID NO: 1511075 - RNA, 17 nt, Homo sapiens
gggaggaagcagguuga

SEQ ID NO: 1511076 - RNA, 11 nt, Homo sapiens
gggagggauga

SEQ ID NO: 1511077 - RNA, 20 nt, Homo sapiens
gggagguggagguugcagug

SEQ ID NO: 1511078 - RNA, 23 nt, Homo sapiens
gggaucagccuccgccauuccaa

SEQ ID NO: 1511079 - RNA, 16 nt, Homo sapiens
gggaucuugcauuccc

SEQ ID NO: 1511080 - RNA, 23 nt, Homo sapiens
gggcaaagaacugccccaucucc

SEQ ID NO: 1511081 - RNA, 17 nt, Homo sapiens
gggcaacgacgguuuca

SEQ ID NO: 1511082 - RNA, 21 nt, Homo sapiens
gggccacugcuugaagaagaa

SEQ ID NO: 1511083 - RNA, 15 nt, Homo sapiens
gggcucccuggccca

SEQ ID NO: 1511084 - RNA, 17 nt, Homo sapiens
ggggccaugggugcaug

SEQ ID NO: 1511085 - RNA, 16 nt, Homo sapiens
ggggcucugugcaggg

SEQ ID NO: 1511086 - RNA, 16 nt, Homo sapiens
ggguagacugagggau

SEQ ID NO: 1511087 - RNA, 16 nt, Homo sapiens
gggugauuucagagag

SEQ ID NO: 1511088 - RNA, 16 nt, Homo sapiens
gggugggccacucucc

SEQ ID NO: 1511089 - RNA, 14 nt, Homo sapiens
ggguuacuuucaca

SEQ ID NO: 1511090 - RNA, 21 nt, Homo sapiens
gguaaaaugccaugaugccuc

SEQ ID NO: 1511091 - RNA, 20 nt, Homo sapiens
gguaaccgaacuggugcuuu

SEQ ID NO: 1511092 - RNA, 23 nt, Homo sapiens
gguaauguuggaugaugaaacau

SEQ ID NO: 1511093 - RNA, 18 nt, Homo sapiens
gguaauuuguaucugaag

SEQ ID NO: 1511094 - RNA, 13 nt, Homo sapiens
gguacagcagggu

SEQ ID NO: 1511095 - RNA, 19 nt, Homo sapiens
gguacauuucccugugcug

SEQ ID NO: 1511096 - RNA, 18 nt, Homo sapiens
gguacuuguaaauuauua

SEQ ID NO: 1511097 - RNA, 18 nt, Homo sapiens
gguagcuauuuguuuaca

SEQ ID NO: 1511098 - RNA, 19 nt, Homo sapiens
gguaggggcacagugaaug

SEQ ID NO: 1511099 - RNA, 22 nt, Homo sapiens
gguauauuuccauucaugccaa

SEQ ID NO: 1511100 - RNA, 23 nt, Homo sapiens
gguauuucaaaacacaucuuucc

SEQ ID NO: 1511101 - RNA, 14 nt, Homo sapiens
ggucauaucagcuu

SEQ ID NO: 1511102 - RNA, 18 nt, Homo sapiens
ggucauuauuuuuuacaa

SEQ ID NO: 1511103 - RNA, 20 nt, Homo sapiens
gguccugcaaucuccagggc

SEQ ID NO: 1511104 - RNA, 15 nt, Homo sapiens
gguccugcacugucc

SEQ ID NO: 1511105 - RNA, 13 nt, Homo sapiens
gguccugcauuuc

SEQ ID NO: 1511106 - RNA, 18 nt, Homo sapiens
ggucuccgcacuuggaaa

SEQ ID NO: 1511107 - RNA, 16 nt, Homo sapiens
ggugcucacgacucuu

SEQ ID NO: 1511108 - RNA, 15 nt, Homo sapiens
ggugguagaaccacu

SEQ ID NO: 1511109 - RNA, 15 nt, Homo sapiens
gguguuggaagccag

SEQ ID NO: 1511110 - RNA, 15 nt, Homo sapiens
gguuagauaaugaau

SEQ ID NO: 1511111 - RNA, 14 nt, Homo sapiens
gccucaaugugacc

SEQ ID NO: 1511112 - RNA, 22 nt, Homo sapiens
gccuccacuuaguuuugggagg

SEQ ID NO: 1511113 - RNA, 13 nt, Homo sapiens
gccuccagcacuc

SEQ ID NO: 1511114 - RNA, 17 nt, Homo sapiens
gccuccuaaagugcuga

SEQ ID NO: 1511115 - RNA, 15 nt, Homo sapiens
gccuccugcaccgag

SEQ ID NO: 1511116 - RNA, 15 nt, Homo sapiens
gccucugcuacugag

SEQ ID NO: 1511117 - RNA, 15 nt, Homo sapiens
gccucuuaucacugg

SEQ ID NO: 1511118 - RNA, 22 nt, Homo sapiens
gccugacuagaccccacccuga

SEQ ID NO: 1511119 - RNA, 20 nt, Homo sapiens
gccugcacucuuauuucacu

SEQ ID NO: 1511120 - RNA, 11 nt, Homo sapiens
gccugccaaac

SEQ ID NO: 1511121 - RNA, 18 nt, Homo sapiens
gccugguagaauugggaa

SEQ ID NO: 1511122 - RNA, 22 nt, Homo sapiens
gccuguaaucccaacacuuuug

SEQ ID NO: 1511123 - RNA, 23 nt, Homo sapiens
gccuuaaaaaucaagacacuagu

SEQ ID NO: 1511124 - RNA, 15 nt, Homo sapiens
gccuucaagugccaa

SEQ ID NO: 1511125 - RNA, 16 nt, Homo sapiens
gccuucaagugccaaa

SEQ ID NO: 1511126 - RNA, 14 nt, Homo sapiens
gccuucauaagccu

SEQ ID NO: 1511127 - RNA, 16 nt, Homo sapiens
gccuucucccugggaa

SEQ ID NO: 1511128 - RNA, 23 nt, Homo sapiens
gccuucuuuucaaaacugcuaaa

SEQ ID NO: 1511129 - RNA, 12 nt, Homo sapiens
gccuuggcagcc

SEQ ID NO: 1511130 - RNA, 21 nt, Homo sapiens
gccuugucuucuuagcuguca

SEQ ID NO: 1511131 - RNA, 18 nt, Homo sapiens
gccuuucuguaaccaaaa

SEQ ID NO: 1511132 - RNA, 17 nt, Homo sapiens
gcgagcugcucugcuau

SEQ ID NO: 1511133 - RNA, 23 nt, Homo sapiens
gcgagcugcucugcuauaugccu

SEQ ID NO: 1511134 - RNA, 17 nt, Homo sapiens
gcgcagcgcgugcacag

SEQ ID NO: 1511135 - RNA, 17 nt, Homo sapiens
gcgccuccuuccuugcu

SEQ ID NO: 1511136 - RNA, 11 nt, Homo sapiens
gcgguggugcc

SEQ ID NO: 1511137 - RNA, 16 nt, Homo sapiens
gcgugaccagcaguac

SEQ ID NO: 1511138 - RNA, 18 nt, Homo sapiens
gcuacucagaagccugag

SEQ ID NO: 1511139 - RNA, 21 nt, Homo sapiens
gcuacucucuugccagcauuu

SEQ ID NO: 1511140 - RNA, 15 nt, Homo sapiens
gcuagaaauaagccc

SEQ ID NO: 1511141 - RNA, 20 nt, Homo sapiens
gcuagaaauaagcccaacag

SEQ ID NO: 1511142 - RNA, 15 nt, Homo sapiens
gcuagggaguggucu

SEQ ID NO: 1511143 - RNA, 20 nt, Homo sapiens
gcuauaugccuuaagccaau

SEQ ID NO: 1511144 - RNA, 16 nt, Homo sapiens
gcuaucacacaguggg

SEQ ID NO: 1511145 - RNA, 23 nt, Homo sapiens
gcuaucagacuguaggauuugaa

SEQ ID NO: 1511146 - RNA, 14 nt, Homo sapiens
gcuauuacugucug

SEQ ID NO: 1511147 - RNA, 21 nt, Homo sapiens
gcucaagucacuuuuauuuga

SEQ ID NO: 1511148 - RNA, 17 nt, Homo sapiens
gcucacugguccauuuc

SEQ ID NO: 1511149 - RNA, 21 nt, Homo sapiens
gcucagcaugcagaagugcau

SEQ ID NO: 1511150 - RNA, 21 nt, Homo sapiens
gcuccagagagaggaugcaga

SEQ ID NO: 1511151 - RNA, 18 nt, Homo sapiens
gcuccaucuccaguggga

SEQ ID NO: 1511152 - RNA, 17 nt, Homo sapiens
gcucucaucacuaccuu

SEQ ID NO: 1511153 - RNA, 15 nt, Homo sapiens
gcucuggcaccacua

SEQ ID NO: 1511154 - RNA, 15 nt, Homo sapiens
gcugacggaagccaa

SEQ ID NO: 1511155 - RNA, 21 nt, Homo sapiens
gcugagagaguuaagugaaug

SEQ ID NO: 1511156 - RNA, 23 nt, Homo sapiens
gcugaggcggguggaucaccuga

SEQ ID NO: 1511157 - RNA, 14 nt, Homo sapiens
gcugauucaagaaa

SEQ ID NO: 1511158 - RNA, 13 nt, Homo sapiens
gcugcacugcccu

SEQ ID NO: 1511159 - RNA, 23 nt, Homo sapiens
gcugcgucagaccaguacuggga

SEQ ID NO: 1511160 - RNA, 10 nt, Homo sapiens
gcugcugaga

SEQ ID NO: 1511161 - RNA, 16 nt, Homo sapiens
gcugggacuacaggug

SEQ ID NO: 1511162 - RNA, 23 nt, Homo sapiens
gcuguauauaggggucaauguga

SEQ ID NO: 1511163 - RNA, 16 nt, Homo sapiens
gcugucaacauucaaa

SEQ ID NO: 1511164 - RNA, 19 nt, Homo sapiens
gcuguguuugagcuuucau

SEQ ID NO: 1511165 - RNA, 19 nt, Homo sapiens
gacauuuucaauaauguga

SEQ ID NO: 1511166 - RNA, 16 nt, Homo sapiens
gaccaaauugggagau

SEQ ID NO: 1511167 - RNA, 22 nt, Homo sapiens
gaccaacauggugaaacccugu

SEQ ID NO: 1511168 - RNA, 19 nt, Homo sapiens
gaccaccucucaauauuca

SEQ ID NO: 1511169 - RNA, 20 nt, Homo sapiens
gaccacuggcccuggggcca

SEQ ID NO: 1511170 - RNA, 19 nt, Homo sapiens
gaccaggauugcacugaca

SEQ ID NO: 1511171 - RNA, 13 nt, Homo sapiens
gacccacacaugu

SEQ ID NO: 1511172 - RNA, 13 nt, Homo sapiens
gaccccacuggac

SEQ ID NO: 1511173 - RNA, 20 nt, Homo sapiens
gaccccgguggcaguggaaa

SEQ ID NO: 1511174 - RNA, 23 nt, Homo sapiens
gaccccuuucccccaccccagag

SEQ ID NO: 1511175 - RNA, 21 nt, Homo sapiens
gacccuaagaccggcggccau

SEQ ID NO: 1511176 - RNA, 21 nt, Homo sapiens
gacccucugaaugguccaggg

SEQ ID NO: 1511177 - RNA, 14 nt, Homo sapiens
gaccguugcacaaa

SEQ ID NO: 1511178 - RNA, 15 nt, Homo sapiens
gaccuauaaaacaaa

SEQ ID NO: 1511179 - RNA, 14 nt, Homo sapiens
gaccuccacauuaa

SEQ ID NO: 1511180 - RNA, 20 nt, Homo sapiens
gaccugaggcuccugugcua

SEQ ID NO: 1511181 - RNA, 14 nt, Homo sapiens
gaccugcaggccaa

SEQ ID NO: 1511182 - RNA, 20 nt, Homo sapiens
gaccugcuuugagauuuccu

SEQ ID NO: 1511183 - RNA, 20 nt, Homo sapiens
gaccugggcccacagagccu

SEQ ID NO: 1511184 - RNA, 22 nt, Homo sapiens
gaccuuuuuuaggaagcaagcu

SEQ ID NO: 1511185 - RNA, 21 nt, Homo sapiens
gacgagauccuguuucagcua

SEQ ID NO: 1511186 - RNA, 16 nt, Homo sapiens
gacggucccacacugg

SEQ ID NO: 1511187 - RNA, 21 nt, Homo sapiens
gacgguuucaaaccaggauuu

SEQ ID NO: 1511188 - RNA, 15 nt, Homo sapiens
gacguaaucuccaca

SEQ ID NO: 1511189 - RNA, 14 nt, Homo sapiens
gacuauggguacau

SEQ ID NO: 1511190 - RNA, 17 nt, Homo sapiens
gacuccgagaacaacag

SEQ ID NO: 1511191 - RNA, 13 nt, Homo sapiens
gacuccucaaaag

SEQ ID NO: 1511192 - RNA, 15 nt, Homo sapiens
gacuccucaaaagca

SEQ ID NO: 1511193 - RNA, 16 nt, Homo sapiens
gacuccucuaagccac

SEQ ID NO: 1511194 - RNA, 18 nt, Homo sapiens
gacucuucccccacuccu

SEQ ID NO: 1511195 - RNA, 18 nt, Homo sapiens
gacucuuuaugcuugcaa

SEQ ID NO: 1511196 - RNA, 19 nt, Homo sapiens
gacucuuuaugcuugcaaa

SEQ ID NO: 1511197 - RNA, 17 nt, Homo sapiens
gacugauguuacaucac

SEQ ID NO: 1511198 - RNA, 17 nt, Homo sapiens
gacugcuaccucugaga

SEQ ID NO: 1511199 - RNA, 17 nt, Homo sapiens
gacuucagucuugccua

SEQ ID NO: 1511200 - RNA, 13 nt, Homo sapiens
gacuucucuugaa

SEQ ID NO: 1511201 - RNA, 16 nt, Homo sapiens
gacuugagcuuggcag

SEQ ID NO: 1511202 - RNA, 15 nt, Homo sapiens
gacuugauacugcaa

SEQ ID NO: 1511203 - RNA, 22 nt, Homo sapiens
gacuuuguucacuagacugugc

SEQ ID NO: 1511204 - RNA, 22 nt, Homo sapiens
gagaaaacuuauuugagugauu

SEQ ID NO: 1511205 - RNA, 22 nt, Homo sapiens
gagaaaagaaaccagagucaaa

SEQ ID NO: 1511206 - RNA, 21 nt, Homo sapiens
gagaaacuuugaucucugcuu

SEQ ID NO: 1511207 - RNA, 13 nt, Homo sapiens
gagaaccucaggc

SEQ ID NO: 1511208 - RNA, 15 nt, Homo sapiens
gagaagcucacccaa

SEQ ID NO: 1511209 - RNA, 17 nt, Homo sapiens
gagaagcucacccaaua

SEQ ID NO: 1511210 - RNA, 16 nt, Homo sapiens
gagaaggcccacugag

SEQ ID NO: 1511211 - RNA, 14 nt, Homo sapiens
gagacugcgggaug

SEQ ID NO: 1511212 - RNA, 15 nt, Homo sapiens
gagacuuggggacca

SEQ ID NO: 1511213 - RNA, 17 nt, Homo sapiens
gagacuuggggaccaga

SEQ ID NO: 1511214 - RNA, 20 nt, Homo sapiens
gagagcagaugguccuccau

SEQ ID NO: 1511215 - RNA, 15 nt, Homo sapiens
gagagguuugucaac

SEQ ID NO: 1511216 - RNA, 18 nt, Homo sapiens
gagaucuucauggugaca

SEQ ID NO: 1511217 - RNA, 17 nt, Homo sapiens
gagauggaauaaagccc

SEQ ID NO: 1511218 - RNA, 19 nt, Homo sapiens
gagauggaauaaagcccuu

SEQ ID NO: 1511219 - RNA, 12 nt, Homo sapiens
gagauguguuca

SEQ ID NO: 1511220 - RNA, 20 nt, Homo sapiens
gagauuuugucgggacagag

SEQ ID NO: 1511221 - RNA, 17 nt, Homo sapiens
gagcaagacuccauuuc

SEQ ID NO: 1511222 - RNA, 20 nt, Homo sapiens
gagcaauucuccugccucag

SEQ ID NO: 1511223 - RNA, 18 nt, Homo sapiens
gagcacccccucauuccc

SEQ ID NO: 1511224 - RNA, 23 nt, Homo sapiens
gagcagagcugauggagaaggaa

SEQ ID NO: 1511225 - RNA, 23 nt, Homo sapiens
gagcagaugguccuccauuucaa

SEQ ID NO: 1511226 - RNA, 22 nt, Homo sapiens
gagcauaauaaauuauauuaaa

SEQ ID NO: 1511227 - RNA, 13 nt, Homo sapiens
gagccacuaccuu

SEQ ID NO: 1511228 - RNA, 21 nt, Homo sapiens
gagccgagauugcaccacugc

SEQ ID NO: 1511229 - RNA, 18 nt, Homo sapiens
gagccuucaagugccaaa

SEQ ID NO: 1511230 - RNA, 19 nt, Homo sapiens
gagccuucaagugccaaac

SEQ ID NO: 1511231 - RNA, 17 nt, Homo sapiens
gagcuauggugaggugu

SEQ ID NO: 1511232 - RNA, 21 nt, Homo sapiens
gagcuggggcugccagccuga

SEQ ID NO: 1511233 - RNA, 15 nt, Homo sapiens
gagcuuucuagccua

SEQ ID NO: 1511234 - RNA, 12 nt, Homo sapiens
gaggaucacuug

SEQ ID NO: 1511235 - RNA, 14 nt, Homo sapiens
gaggaucccuccau

SEQ ID NO: 1511236 - RNA, 20 nt, Homo sapiens
gaggcaggagaaucgcuuga

SEQ ID NO: 1511237 - RNA, 21 nt, Homo sapiens
gaggcccccuggugugucuga

SEQ ID NO: 1511238 - RNA, 20 nt, Homo sapiens
gaggccugcccucagggauc

SEQ ID NO: 1511239 - RNA, 15 nt, Homo sapiens
gagggacguggugcc

SEQ ID NO: 1511240 - RNA, 16 nt, Homo sapiens
gagggguugcggggga

SEQ ID NO: 1511241 - RNA, 16 nt, Homo sapiens
gaggucacauucagga

SEQ ID NO: 1511242 - RNA, 14 nt, Homo sapiens
gagguccugcauuu

SEQ ID NO: 1511243 - RNA, 14 nt, Homo sapiens
gaggugagaccaaa

SEQ ID NO: 1511244 - RNA, 16 nt, Homo sapiens
gaggugucuuaagccu

SEQ ID NO: 1511245 - RNA, 14 nt, Homo sapiens
gagguugcagggag

SEQ ID NO: 1511246 - RNA, 15 nt, Homo sapiens
gagguugugcugccu

SEQ ID NO: 1511247 - RNA, 23 nt, Homo sapiens
gaguacagauguaaaugccacaa

SEQ ID NO: 1511248 - RNA, 14 nt, Homo sapiens
gaguggaucuccaa

SEQ ID NO: 1511249 - RNA, 13 nt, Homo sapiens
gaguucuugcccu

SEQ ID NO: 1511250 - RNA, 21 nt, Homo sapiens
gauaaaggaagucaccaaaau

SEQ ID NO: 1511251 - RNA, 19 nt, Homo sapiens
gauaaauagaguuccaaau

SEQ ID NO: 1511252 - RNA, 16 nt, Homo sapiens
gauaaauuccacugga

SEQ ID NO: 1511253 - RNA, 18 nt, Homo sapiens
gauaacuauuuacauaua

SEQ ID NO: 1511254 - RNA, 19 nt, Homo sapiens
gauaacuauuuacauauaa

SEQ ID NO: 1511255 - RNA, 16 nt, Homo sapiens
gauacccagagcauua

SEQ ID NO: 1511256 - RNA, 11 nt, Homo sapiens
gauacgugugu

SEQ ID NO: 1511257 - RNA, 20 nt, Homo sapiens
gauagaacaaugcuauaaua

SEQ ID NO: 1511258 - RNA, 13 nt, Homo sapiens
gauagaacaggcu

SEQ ID NO: 1511259 - RNA, 13 nt, Homo sapiens
gauagcaggugaa

SEQ ID NO: 1511260 - RNA, 15 nt, Homo sapiens
gauagggaacacuca

SEQ ID NO: 1511261 - RNA, 15 nt, Homo sapiens
gaucaagugugcaua

SEQ ID NO: 1511262 - RNA, 20 nt, Homo sapiens
gaucacaccacugcacucca

SEQ ID NO: 1511263 - RNA, 18 nt, Homo sapiens
gaucacagcguuucagga

SEQ ID NO: 1511264 - RNA, 21 nt, Homo sapiens
gaucauuacauggcugugguu

SEQ ID NO: 1511265 - RNA, 21 nt, Homo sapiens
gaucauugaaaguaaaaaaua

SEQ ID NO: 1511266 - RNA, 17 nt, Homo sapiens
gauccacaaaaacaacu

SEQ ID NO: 1511267 - RNA, 12 nt, Homo sapiens
gauccagcacaa

SEQ ID NO: 1511268 - RNA, 18 nt, Homo sapiens
gaucccaagacaaugaaa

SEQ ID NO: 1511269 - RNA, 14 nt, Homo sapiens
gaucuaauuuacau

SEQ ID NO: 1511270 - RNA, 19 nt, Homo sapiens
gaucuccaaggaccagguu

SEQ ID NO: 1511271 - RNA, 14 nt, Homo sapiens
gaucugcacugggu

SEQ ID NO: 1511272 - RNA, 23 nt, Homo sapiens
gaucuuccguggucagagugcca

SEQ ID NO: 1511273 - RNA, 22 nt, Homo sapiens
gaugaaaaauaugugcuugaaa

SEQ ID NO: 1511274 - RNA, 22 nt, Homo sapiens
gaugaauagcgaaucaucucaa

SEQ ID NO: 1511275 - RNA, 20 nt, Homo sapiens
gaugacgugaagccacagga

SEQ ID NO: 1511276 - RNA, 14 nt, Homo sapiens
gaugacuggucucu

SEQ ID NO: 1511277 - RNA, 17 nt, Homo sapiens
gaugaguuaacugugaa

SEQ ID NO: 1511278 - RNA, 15 nt, Homo sapiens
gauggaaaaauaagg

SEQ ID NO: 1511279 - RNA, 16 nt, Homo sapiens
gauggaauaaagcccu

SEQ ID NO: 1511280 - RNA, 17 nt, Homo sapiens
gauggaauaaagcccuu

SEQ ID NO: 1511281 - RNA, 23 nt, Homo sapiens
gauggaauaaagcccuugaacca

SEQ ID NO: 1511282 - RNA, 16 nt, Homo sapiens
gauggagcgcaccugc

SEQ ID NO: 1511283 - RNA, 12 nt, Homo sapiens
gaugggaccaac

SEQ ID NO: 1511284 - RNA, 14 nt, Homo sapiens
gauguaaaugccac

SEQ ID NO: 1511285 - RNA, 14 nt, Homo sapiens
gauguuuguugcua

SEQ ID NO: 1511286 - RNA, 19 nt, Homo sapiens
gauuaccugccaauugcua

SEQ ID NO: 1511287 - RNA, 23 nt, Homo sapiens
gauuagagguuugucaacacaaa

SEQ ID NO: 1511288 - RNA, 18 nt, Homo sapiens
gauuagcuuuugcaacau

SEQ ID NO: 1511289 - RNA, 18 nt, Homo sapiens
gauuccauuuuacuucca

SEQ ID NO: 1511290 - RNA, 17 nt, Homo sapiens
gauuguucaucaugaca

SEQ ID NO: 1511291 - RNA, 13 nt, Homo sapiens
gauuucaggauac

SEQ ID NO: 1511292 - RNA, 18 nt, Homo sapiens
gauuugugaacuggaaga

SEQ ID NO: 1511293 - RNA, 13 nt, Homo sapiens
gauuuguguuaua

SEQ ID NO: 1511294 - RNA, 13 nt, Homo sapiens
gcaaaaacauagu

SEQ ID NO: 1511295 - RNA, 12 nt, Homo sapiens
gcaaaagcgcag

SEQ ID NO: 1511296 - RNA, 17 nt, Homo sapiens
gcaaaagcucuguguaa

SEQ ID NO: 1511297 - RNA, 19 nt, Homo sapiens
gcaaagggcugaaagccau

SEQ ID NO: 1511298 - RNA, 18 nt, Homo sapiens
gcaaaggucaagacugug

SEQ ID NO: 1511299 - RNA, 11 nt, Homo sapiens
gcaacauaaaa

SEQ ID NO: 1511300 - RNA, 19 nt, Homo sapiens
gcaagaaacaucauucuac

SEQ ID NO: 1511301 - RNA, 18 nt, Homo sapiens
gcaagagacucuggccuc

SEQ ID NO: 1511302 - RNA, 16 nt, Homo sapiens
gcaaggaaacauuaau

SEQ ID NO: 1511303 - RNA, 19 nt, Homo sapiens
cuuggcaaauuccuaguca

SEQ ID NO: 1511304 - RNA, 18 nt, Homo sapiens
cuugguuuugauguugaa

SEQ ID NO: 1511305 - RNA, 23 nt, Homo sapiens
cuuguguguguguguugauccca

SEQ ID NO: 1511306 - RNA, 18 nt, Homo sapiens
cuuuaaaauguaaagcca

SEQ ID NO: 1511307 - RNA, 15 nt, Homo sapiens
cuuuaaagugacuaa

SEQ ID NO: 1511308 - RNA, 14 nt, Homo sapiens
cuuuaaccacuccu

SEQ ID NO: 1511309 - RNA, 18 nt, Homo sapiens
cuuuaaccucaucuacaa

SEQ ID NO: 1511310 - RNA, 21 nt, Homo sapiens
cuuuaaccucaucuacaagca

SEQ ID NO: 1511311 - RNA, 23 nt, Homo sapiens
cuuuauaaauucauaacugguag

SEQ ID NO: 1511312 - RNA, 14 nt, Homo sapiens
cuuuauagcucuca

SEQ ID NO: 1511313 - RNA, 18 nt, Homo sapiens
cuuuaucaagaagucuga

SEQ ID NO: 1511314 - RNA, 14 nt, Homo sapiens
cuuucacucaggcu

SEQ ID NO: 1511315 - RNA, 16 nt, Homo sapiens
cuuucagcugugaaca

SEQ ID NO: 1511316 - RNA, 21 nt, Homo sapiens
cuuucaugaguuucccagaga

SEQ ID NO: 1511317 - RNA, 19 nt, Homo sapiens
cuuuccaugggaccacaac

SEQ ID NO: 1511318 - RNA, 22 nt, Homo sapiens
cuuucccagaaaaaaaaaaacu

SEQ ID NO: 1511319 - RNA, 21 nt, Homo sapiens
cuuucccggacugcaagcagg

SEQ ID NO: 1511320 - RNA, 17 nt, Homo sapiens
cuuuccuuuucuuccuu

SEQ ID NO: 1511321 - RNA, 22 nt, Homo sapiens
cuuucucacugcugucagccaa

SEQ ID NO: 1511322 - RNA, 19 nt, Homo sapiens
cuuucuccuguagcacaaa

SEQ ID NO: 1511323 - RNA, 23 nt, Homo sapiens
cuuucucgugguagaagccagua

SEQ ID NO: 1511324 - RNA, 15 nt, Homo sapiens
cuuucucuggcucca

SEQ ID NO: 1511325 - RNA, 22 nt, Homo sapiens
cuuucugacaagauaaaggaag

SEQ ID NO: 1511326 - RNA, 15 nt, Homo sapiens
cuuucuggaaaagag

SEQ ID NO: 1511327 - RNA, 23 nt, Homo sapiens
cuuucuggaaguuucuggugcca

SEQ ID NO: 1511328 - RNA, 13 nt, Homo sapiens
cuuugcaaugcaa

SEQ ID NO: 1511329 - RNA, 17 nt, Homo sapiens
cuuugccucugaaacuu

SEQ ID NO: 1511330 - RNA, 15 nt, Homo sapiens
cuuugggaucagccu

SEQ ID NO: 1511331 - RNA, 14 nt, Homo sapiens
cuuuguauccauga

SEQ ID NO: 1511332 - RNA, 16 nt, Homo sapiens
cuuuguuuugcacuga

SEQ ID NO: 1511333 - RNA, 17 nt, Homo sapiens
cuuuguuuugcacugac

SEQ ID NO: 1511334 - RNA, 22 nt, Homo sapiens
cuuuuaagcaaaguugggugua

SEQ ID NO: 1511335 - RNA, 19 nt, Homo sapiens
cuuuucaaaagucagaccc

SEQ ID NO: 1511336 - RNA, 22 nt, Homo sapiens
cuuuucaaggaaaaaugcugcu

SEQ ID NO: 1511337 - RNA, 18 nt, Homo sapiens
cuuuucaucuccagugug

SEQ ID NO: 1511338 - RNA, 21 nt, Homo sapiens
cuuuucccccaaagaugugua

SEQ ID NO: 1511339 - RNA, 20 nt, Homo sapiens
cuuuugcuugaaaccaaaga

SEQ ID NO: 1511340 - RNA, 14 nt, Homo sapiens
cuuuuucacacuga

SEQ ID NO: 1511341 - RNA, 14 nt, Homo sapiens
cuuuuucuaccuuu

SEQ ID NO: 1511342 - RNA, 21 nt, Homo sapiens
cuuuuuuccuccuguguacag

SEQ ID NO: 1511343 - RNA, 15 nt, Homo sapiens
gaaaaaaauucugau

SEQ ID NO: 1511344 - RNA, 19 nt, Homo sapiens
gaaaaaacuagagccugug

SEQ ID NO: 1511345 - RNA, 22 nt, Homo sapiens
gaaaaaugcugcuucuccuccc

SEQ ID NO: 1511346 - RNA, 16 nt, Homo sapiens
gaaaaccucacuugaa

SEQ ID NO: 1511347 - RNA, 21 nt, Homo sapiens
gaaaagaaaccagagucaaau

SEQ ID NO: 1511348 - RNA, 17 nt, Homo sapiens
gaaaagauuucugucca

SEQ ID NO: 1511349 - RNA, 12 nt, Homo sapiens
gaaaaguguuau

SEQ ID NO: 1511350 - RNA, 13 nt, Homo sapiens
gaaaaguguuauu

SEQ ID NO: 1511351 - RNA, 23 nt, Homo sapiens
gaaaaguucuuuacuggugauuu

SEQ ID NO: 1511352 - RNA, 17 nt, Homo sapiens
gaaaauaugauguuuca

SEQ ID NO: 1511353 - RNA, 17 nt, Homo sapiens
gaaaauuauuccuugcu

SEQ ID NO: 1511354 - RNA, 16 nt, Homo sapiens
gaaaauugaaugcaaa

SEQ ID NO: 1511355 - RNA, 16 nt, Homo sapiens
gaaacacucaacaaua

SEQ ID NO: 1511356 - RNA, 17 nt, Homo sapiens
gaaacagauuccauuaa

SEQ ID NO: 1511357 - RNA, 10 nt, Homo sapiens
gaaacauuca

SEQ ID NO: 1511358 - RNA, 23 nt, Homo sapiens
gaaacauucauuuuuaccuugug

SEQ ID NO: 1511359 - RNA, 16 nt, Homo sapiens
gaaacauuuauggaau

SEQ ID NO: 1511360 - RNA, 13 nt, Homo sapiens
gaaaccacagguu

SEQ ID NO: 1511361 - RNA, 20 nt, Homo sapiens
gaaaccaguuaagaauggaa

SEQ ID NO: 1511362 - RNA, 16 nt, Homo sapiens
gaaacccauuaggcau

SEQ ID NO: 1511363 - RNA, 12 nt, Homo sapiens
gaaaccuggcau

SEQ ID NO: 1511364 - RNA, 23 nt, Homo sapiens
gaaaccuucagauuuguguuaua

SEQ ID NO: 1511365 - RNA, 18 nt, Homo sapiens
gaaacggccccauugccu

SEQ ID NO: 1511366 - RNA, 16 nt, Homo sapiens
gaaacuuaauuacauc

SEQ ID NO: 1511367 - RNA, 15 nt, Homo sapiens
gaaagacaggcugag

SEQ ID NO: 1511368 - RNA, 20 nt, Homo sapiens
gaaagauuugugaacuggaa

SEQ ID NO: 1511369 - RNA, 18 nt, Homo sapiens
gaaagcccgccucugucc

SEQ ID NO: 1511370 - RNA, 16 nt, Homo sapiens
gaaaguucagccagaa

SEQ ID NO: 1511371 - RNA, 16 nt, Homo sapiens
gaaauaaaccuggaga

SEQ ID NO: 1511372 - RNA, 19 nt, Homo sapiens
gaaauaaguuuuuguuuca

SEQ ID NO: 1511373 - RNA, 17 nt, Homo sapiens
gaaauaccacaagccug

SEQ ID NO: 1511374 - RNA, 19 nt, Homo sapiens
gaaauaccacaagccugag

SEQ ID NO: 1511375 - RNA, 16 nt, Homo sapiens
gaaauaguaacuucua

SEQ ID NO: 1511376 - RNA, 19 nt, Homo sapiens
gaaaucaggcaguucccug

SEQ ID NO: 1511377 - RNA, 16 nt, Homo sapiens
gaaauccaguuuccca

SEQ ID NO: 1511378 - RNA, 15 nt, Homo sapiens
gaaauugaaccuggu

SEQ ID NO: 1511379 - RNA, 13 nt, Homo sapiens
gaacaacaacaac

SEQ ID NO: 1511380 - RNA, 14 nt, Homo sapiens
gaacacguggguau

SEQ ID NO: 1511381 - RNA, 22 nt, Homo sapiens
gaacacuaaacagacuauuuaa

SEQ ID NO: 1511382 - RNA, 12 nt, Homo sapiens
gaacaugacauu

SEQ ID NO: 1511383 - RNA, 12 nt, Homo sapiens
gaaccaauaaug

SEQ ID NO: 1511384 - RNA, 12 nt, Homo sapiens
gaaccacuuugc

SEQ ID NO: 1511385 - RNA, 18 nt, Homo sapiens
gaaccuggguugcagaca

SEQ ID NO: 1511386 - RNA, 19 nt, Homo sapiens
gaacuggaagaaagcaaca

SEQ ID NO: 1511387 - RNA, 15 nt, Homo sapiens
gaacuguaagcucaa

SEQ ID NO: 1511388 - RNA, 11 nt, Homo sapiens
gaacuguuaca

SEQ ID NO: 1511389 - RNA, 14 nt, Homo sapiens
gaacuuauuuacac

SEQ ID NO: 1511390 - RNA, 17 nt, Homo sapiens
gaacuuguucacagguu

SEQ ID NO: 1511391 - RNA, 23 nt, Homo sapiens
gaagaagguaggagaaagggcgg

SEQ ID NO: 1511392 - RNA, 20 nt, Homo sapiens
gaagaaguuuaaaaaaccau

SEQ ID NO: 1511393 - RNA, 14 nt, Homo sapiens
gaagagaaccucaa

SEQ ID NO: 1511394 - RNA, 13 nt, Homo sapiens
gaagagcauugca

SEQ ID NO: 1511395 - RNA, 16 nt, Homo sapiens
gaagccaacuuggcuu

SEQ ID NO: 1511396 - RNA, 14 nt, Homo sapiens
gaagccacaggagc

SEQ ID NO: 1511397 - RNA, 19 nt, Homo sapiens
gaagccuauuagcugggau

SEQ ID NO: 1511398 - RNA, 21 nt, Homo sapiens
gaagcuuuggugagaaccugg

SEQ ID NO: 1511399 - RNA, 19 nt, Homo sapiens
gaaggaacucuggcuucca

SEQ ID NO: 1511400 - RNA, 14 nt, Homo sapiens
gaaggaguucacug

SEQ ID NO: 1511401 - RNA, 13 nt, Homo sapiens
gaaggccacuggu

SEQ ID NO: 1511402 - RNA, 17 nt, Homo sapiens
gaaggcccacugaggca

SEQ ID NO: 1511403 - RNA, 18 nt, Homo sapiens
gaaggcuuugccaugggc

SEQ ID NO: 1511404 - RNA, 14 nt, Homo sapiens
gaagggaugggaga

SEQ ID NO: 1511405 - RNA, 20 nt, Homo sapiens
gaagguauuagcaaagcaaa

SEQ ID NO: 1511406 - RNA, 22 nt, Homo sapiens
gaagguauuccuuuuguguaca

SEQ ID NO: 1511407 - RNA, 20 nt, Homo sapiens
gaaguauuuuauuugucuga

SEQ ID NO: 1511408 - RNA, 16 nt, Homo sapiens
gaagugccacaugaca

SEQ ID NO: 1511409 - RNA, 21 nt, Homo sapiens
gaaguuagggaugacugugau

SEQ ID NO: 1511410 - RNA, 11 nt, Homo sapiens
gaaguuucauc

SEQ ID NO: 1511411 - RNA, 17 nt, Homo sapiens
gaauaaagcccuugaac

SEQ ID NO: 1511412 - RNA, 19 nt, Homo sapiens
gaauaaaggaugggaccaa

SEQ ID NO: 1511413 - RNA, 13 nt, Homo sapiens
gaauaagucccuu

SEQ ID NO: 1511414 - RNA, 16 nt, Homo sapiens
gaauaaucagauuucu

SEQ ID NO: 1511415 - RNA, 20 nt, Homo sapiens
gaauaucauuaaauuggaau

SEQ ID NO: 1511416 - RNA, 22 nt, Homo sapiens
gaaucaaagcaguuaacuuuaa

SEQ ID NO: 1511417 - RNA, 22 nt, Homo sapiens
gaauccgccugcagaggacaga

SEQ ID NO: 1511418 - RNA, 22 nt, Homo sapiens
gaaucggcuggggacugcuacc

SEQ ID NO: 1511419 - RNA, 14 nt, Homo sapiens
gaaugaaaauuaga

SEQ ID NO: 1511420 - RNA, 15 nt, Homo sapiens
gaaugacaacagaag

SEQ ID NO: 1511421 - RNA, 15 nt, Homo sapiens
gaaugauuuuugcua

SEQ ID NO: 1511422 - RNA, 20 nt, Homo sapiens
gaaugccgguuaaauuccau

SEQ ID NO: 1511423 - RNA, 17 nt, Homo sapiens
gaaugccucaaugugac

SEQ ID NO: 1511424 - RNA, 17 nt, Homo sapiens
gaauuaaacaacaaaca

SEQ ID NO: 1511425 - RNA, 13 nt, Homo sapiens
gaauuacuguaac

SEQ ID NO: 1511426 - RNA, 13 nt, Homo sapiens
gaauucuugaguu

SEQ ID NO: 1511427 - RNA, 15 nt, Homo sapiens
gaauucuuuacaaua

SEQ ID NO: 1511428 - RNA, 14 nt, Homo sapiens
gaauuuucagucau

SEQ ID NO: 1511429 - RNA, 19 nt, Homo sapiens
gaauuuucagucaucucau

SEQ ID NO: 1511430 - RNA, 21 nt, Homo sapiens
gaauuuugggacuucuaccca

SEQ ID NO: 1511431 - RNA, 14 nt, Homo sapiens
gacaaaccagagca

SEQ ID NO: 1511432 - RNA, 19 nt, Homo sapiens
gacaaaugggccugccaaa

SEQ ID NO: 1511433 - RNA, 13 nt, Homo sapiens
gacacugggagaa

SEQ ID NO: 1511434 - RNA, 23 nt, Homo sapiens
gacagaugaggcuuuccauggga

SEQ ID NO: 1511435 - RNA, 13 nt, Homo sapiens
gacaggauguguu

SEQ ID NO: 1511436 - RNA, 19 nt, Homo sapiens
gacagucaaggagaugagc

SEQ ID NO: 1511437 - RNA, 14 nt, Homo sapiens
gacagugcugcccu

SEQ ID NO: 1511438 - RNA, 16 nt, Homo sapiens
gacauuaaaccuggau

SEQ ID NO: 1511439 - RNA, 23 nt, Homo sapiens
gacauuucucuaacuccugccau

SEQ ID NO: 1511440 - RNA, 19 nt, Homo sapiens
cugaguggaucuccaagga

SEQ ID NO: 1511441 - RNA, 20 nt, Homo sapiens
cugaguuuuccauggcagga

SEQ ID NO: 1511442 - RNA, 13 nt, Homo sapiens
cugauaagcaaau

SEQ ID NO: 1511443 - RNA, 18 nt, Homo sapiens
cugauagacaaguaguua

SEQ ID NO: 1511444 - RNA, 13 nt, Homo sapiens
cugaugcacuguu

SEQ ID NO: 1511445 - RNA, 21 nt, Homo sapiens
cugauguaguuaaguauuuac

SEQ ID NO: 1511446 - RNA, 12 nt, Homo sapiens
cugcaagacaca

SEQ ID NO: 1511447 - RNA, 17 nt, Homo sapiens
cugcaccgagagagaug

SEQ ID NO: 1511448 - RNA, 15 nt, Homo sapiens
cugcagaaacagugc

SEQ ID NO: 1511449 - RNA, 14 nt, Homo sapiens
cugcagaggauuua

SEQ ID NO: 1511450 - RNA, 23 nt, Homo sapiens
cugcagaggggaaaccaguguag

SEQ ID NO: 1511451 - RNA, 20 nt, Homo sapiens
cugcaggggccgagccauuu

SEQ ID NO: 1511452 - RNA, 21 nt, Homo sapiens
cugcagugacgugcaccugua

SEQ ID NO: 1511453 - RNA, 21 nt, Homo sapiens
cugcauaaaauagagugcauu

SEQ ID NO: 1511454 - RNA, 15 nt, Homo sapiens
cugccauuacucugc

SEQ ID NO: 1511455 - RNA, 18 nt, Homo sapiens
cugcccaaucugagcaaa

SEQ ID NO: 1511456 - RNA, 20 nt, Homo sapiens
cugcccaggaaggacugugc

SEQ ID NO: 1511457 - RNA, 22 nt, Homo sapiens
cugccccagaacaauucugcag

SEQ ID NO: 1511458 - RNA, 18 nt, Homo sapiens
cugccccgaaagugcuga

SEQ ID NO: 1511459 - RNA, 18 nt, Homo sapiens
cugcccugccaccugucu

SEQ ID NO: 1511460 - RNA, 17 nt, Homo sapiens
cugccuauccucuguau

SEQ ID NO: 1511461 - RNA, 14 nt, Homo sapiens
cugccugugcauga

SEQ ID NO: 1511462 - RNA, 14 nt, Homo sapiens
cugccuguggugag

SEQ ID NO: 1511463 - RNA, 22 nt, Homo sapiens
cugcgucgaagcuuugaaggcc

SEQ ID NO: 1511464 - RNA, 14 nt, Homo sapiens
cugcuacacaaaag

SEQ ID NO: 1511465 - RNA, 12 nt, Homo sapiens
cugcuccagaga

SEQ ID NO: 1511466 - RNA, 18 nt, Homo sapiens
cugcucuggaaaauguga

SEQ ID NO: 1511467 - RNA, 14 nt, Homo sapiens
cugcugaucaauga

SEQ ID NO: 1511468 - RNA, 19 nt, Homo sapiens
cugcugaucaaugaaaugc

SEQ ID NO: 1511469 - RNA, 12 nt, Homo sapiens
cugcugcacacu

SEQ ID NO: 1511470 - RNA, 20 nt, Homo sapiens
cuggaaaggcucagucucag

SEQ ID NO: 1511471 - RNA, 16 nt, Homo sapiens
cuggaaauaaaccugg

SEQ ID NO: 1511472 - RNA, 20 nt, Homo sapiens
cuggaacacuagacaagcca

SEQ ID NO: 1511473 - RNA, 20 nt, Homo sapiens
cuggaagaaagcaacaaaga

SEQ ID NO: 1511474 - RNA, 22 nt, Homo sapiens
cuggaauuuucagucaucucau

SEQ ID NO: 1511475 - RNA, 21 nt, Homo sapiens
cuggacuggguuuugucucug

SEQ ID NO: 1511476 - RNA, 16 nt, Homo sapiens
cuggaggucacauuca

SEQ ID NO: 1511477 - RNA, 16 nt, Homo sapiens
cuggauucaaauguca

SEQ ID NO: 1511478 - RNA, 17 nt, Homo sapiens
cuggcccuccacuccuc

SEQ ID NO: 1511479 - RNA, 18 nt, Homo sapiens
cuggcgcaucauaugcag

SEQ ID NO: 1511480 - RNA, 15 nt, Homo sapiens
cuggcuccaaggugc

SEQ ID NO: 1511481 - RNA, 16 nt, Homo sapiens
cuggcucuuugcugug

SEQ ID NO: 1511482 - RNA, 13 nt, Homo sapiens
cuggcugggcaug

SEQ ID NO: 1511483 - RNA, 20 nt, Homo sapiens
cuggcuuagugccacccacc

SEQ ID NO: 1511484 - RNA, 14 nt, Homo sapiens
cuggcuuugucucu

SEQ ID NO: 1511485 - RNA, 16 nt, Homo sapiens
cugggaagauaccagc

SEQ ID NO: 1511486 - RNA, 17 nt, Homo sapiens
cugggaggcggagagua

SEQ ID NO: 1511487 - RNA, 19 nt, Homo sapiens
cugggaggucuccacugag

SEQ ID NO: 1511488 - RNA, 19 nt, Homo sapiens
cugggauucccaccaaggu

SEQ ID NO: 1511489 - RNA, 22 nt, Homo sapiens
cugggccaaguuccucuagugc

SEQ ID NO: 1511490 - RNA, 16 nt, Homo sapiens
cugggccugagccuaa

SEQ ID NO: 1511491 - RNA, 22 nt, Homo sapiens
cuggggccaugggugcauggac

SEQ ID NO: 1511492 - RNA, 18 nt, Homo sapiens
cugggggcagauauuucc

SEQ ID NO: 1511493 - RNA, 14 nt, Homo sapiens
cuggggucauauaa

SEQ ID NO: 1511494 - RNA, 14 nt, Homo sapiens
cuggguucuagaac

SEQ ID NO: 1511495 - RNA, 19 nt, Homo sapiens
cugguaauuuguaucugaa

SEQ ID NO: 1511496 - RNA, 15 nt, Homo sapiens
cugguauguugcacg

SEQ ID NO: 1511497 - RNA, 22 nt, Homo sapiens
cugguccuucucguuugcucua

SEQ ID NO: 1511498 - RNA, 14 nt, Homo sapiens
cuggucuucacugc

SEQ ID NO: 1511499 - RNA, 15 nt, Homo sapiens
cuggucuucacugcc

SEQ ID NO: 1511500 - RNA, 20 nt, Homo sapiens
cugguggaggcuucuugccc

SEQ ID NO: 1511501 - RNA, 12 nt, Homo sapiens
cugguguagcuc

SEQ ID NO: 1511502 - RNA, 13 nt, Homo sapiens
cugguuuucacau

SEQ ID NO: 1511503 - RNA, 12 nt, Homo sapiens
cuguaaaugcag

SEQ ID NO: 1511504 - RNA, 18 nt, Homo sapiens
cuguaacucagacauucc

SEQ ID NO: 1511505 - RNA, 13 nt, Homo sapiens
cuguaagcauucu

SEQ ID NO: 1511506 - RNA, 18 nt, Homo sapiens
cuguaaucccagcacuuu

SEQ ID NO: 1511507 - RNA, 21 nt, Homo sapiens
cuguaaucccagcacuuuggg

SEQ ID NO: 1511508 - RNA, 17 nt, Homo sapiens
cuguagguuaaaugcag

SEQ ID NO: 1511509 - RNA, 20 nt, Homo sapiens
cuguauacagauucuagcca

SEQ ID NO: 1511510 - RNA, 23 nt, Homo sapiens
cuguauaguuaggauagcauuuu

SEQ ID NO: 1511511 - RNA, 19 nt, Homo sapiens
cugucacuggcagagcaca

SEQ ID NO: 1511512 - RNA, 22 nt, Homo sapiens
cuguccugccucucugcuccag

SEQ ID NO: 1511513 - RNA, 13 nt, Homo sapiens
cugucgcaucuca

SEQ ID NO: 1511514 - RNA, 16 nt, Homo sapiens
cugucuacuugcucag

SEQ ID NO: 1511515 - RNA, 15 nt, Homo sapiens
cugugcaugaccuga

SEQ ID NO: 1511516 - RNA, 19 nt, Homo sapiens
cugugggaagagaagggaa

SEQ ID NO: 1511517 - RNA, 18 nt, Homo sapiens
cuguggugagguccuguc

SEQ ID NO: 1511518 - RNA, 17 nt, Homo sapiens
cuguguguacauguaca

SEQ ID NO: 1511519 - RNA, 19 nt, Homo sapiens
cugugugugcccgugguga

SEQ ID NO: 1511520 - RNA, 13 nt, Homo sapiens
cuguuaagcaauu

SEQ ID NO: 1511521 - RNA, 17 nt, Homo sapiens
cuguuaugcaagcacaa

SEQ ID NO: 1511522 - RNA, 18 nt, Homo sapiens
cuguuaugcaagcacaaa

SEQ ID NO: 1511523 - RNA, 18 nt, Homo sapiens
cuguuggaaguucacugg

SEQ ID NO: 1511524 - RNA, 23 nt, Homo sapiens
cuguuucagcuaaaugcagggaa

SEQ ID NO: 1511525 - RNA, 15 nt, Homo sapiens
cuguuuuuauaugca

SEQ ID NO: 1511526 - RNA, 15 nt, Homo sapiens
cuuaaaaacuuccau

SEQ ID NO: 1511527 - RNA, 17 nt, Homo sapiens
cuuaccaggcaccaaaa

SEQ ID NO: 1511528 - RNA, 22 nt, Homo sapiens
cuuaccuguggagaagccuauu

SEQ ID NO: 1511529 - RNA, 19 nt, Homo sapiens
cuuaccuuaaaaaguaauu

SEQ ID NO: 1511530 - RNA, 13 nt, Homo sapiens
cuuacuacuugcc

SEQ ID NO: 1511531 - RNA, 17 nt, Homo sapiens
cuuacuuuugugagucu

SEQ ID NO: 1511532 - RNA, 21 nt, Homo sapiens
cuuagacuaguugaacaucuc

SEQ ID NO: 1511533 - RNA, 22 nt, Homo sapiens
cuuagacuaguugaacaucuca

SEQ ID NO: 1511534 - RNA, 13 nt, Homo sapiens
cuuagcugucacc

SEQ ID NO: 1511535 - RNA, 23 nt, Homo sapiens
cuuaggaauuucuccuacuuuac

SEQ ID NO: 1511536 - RNA, 18 nt, Homo sapiens
cuuaguaaucccccuugc

SEQ ID NO: 1511537 - RNA, 17 nt, Homo sapiens
cuuauaaagcauugcaa

SEQ ID NO: 1511538 - RNA, 16 nt, Homo sapiens
cuuauagaaagcacua

SEQ ID NO: 1511539 - RNA, 20 nt, Homo sapiens
cuuauccaggacucugucaa

SEQ ID NO: 1511540 - RNA, 22 nt, Homo sapiens
cuuaugggguauuuuaagcauu

SEQ ID NO: 1511541 - RNA, 21 nt, Homo sapiens
cuuauuauauuucuuuuuaga

SEQ ID NO: 1511542 - RNA, 23 nt, Homo sapiens
cuuauuugagugauuauuuguua

SEQ ID NO: 1511543 - RNA, 17 nt, Homo sapiens
cuucaaacccucaagag

SEQ ID NO: 1511544 - RNA, 15 nt, Homo sapiens
cuucaagcucucugu

SEQ ID NO: 1511545 - RNA, 14 nt, Homo sapiens
cuucaagugccaaa

SEQ ID NO: 1511546 - RNA, 17 nt, Homo sapiens
cuucacaauucauggaa

SEQ ID NO: 1511547 - RNA, 15 nt, Homo sapiens
cuucagggugaguga

SEQ ID NO: 1511548 - RNA, 19 nt, Homo sapiens
cuucagggugagugaaugg

SEQ ID NO: 1511549 - RNA, 14 nt, Homo sapiens
cuucagugacaagu

SEQ ID NO: 1511550 - RNA, 13 nt, Homo sapiens
cuucagugcugcu

SEQ ID NO: 1511551 - RNA, 14 nt, Homo sapiens
cuuccagaaaacaa

SEQ ID NO: 1511552 - RNA, 17 nt, Homo sapiens
cuuccagaaaacaaaac

SEQ ID NO: 1511553 - RNA, 19 nt, Homo sapiens
cuuccagguaucuccagga

SEQ ID NO: 1511554 - RNA, 14 nt, Homo sapiens
cuuccaucuaguca

SEQ ID NO: 1511555 - RNA, 18 nt, Homo sapiens
cuuccaucuagucacaaa

SEQ ID NO: 1511556 - RNA, 23 nt, Homo sapiens
cuucccaaccuccccugguccug

SEQ ID NO: 1511557 - RNA, 18 nt, Homo sapiens
cuuccccaggagcucucu

SEQ ID NO: 1511558 - RNA, 15 nt, Homo sapiens
cuucccugacacugu

SEQ ID NO: 1511559 - RNA, 16 nt, Homo sapiens
cuucccugccuuuaag

SEQ ID NO: 1511560 - RNA, 19 nt, Homo sapiens
cuuccuuucuuucucucuc

SEQ ID NO: 1511561 - RNA, 14 nt, Homo sapiens
cuucuaaagagucu

SEQ ID NO: 1511562 - RNA, 20 nt, Homo sapiens
cuucuccaagucuagcuuuc

SEQ ID NO: 1511563 - RNA, 14 nt, Homo sapiens
cuucuccucccagc

SEQ ID NO: 1511564 - RNA, 18 nt, Homo sapiens
cuucucuacagacuucuc

SEQ ID NO: 1511565 - RNA, 12 nt, Homo sapiens
cuucugcuaaaa

SEQ ID NO: 1511566 - RNA, 14 nt, Homo sapiens
cuucuggccaggaa

SEQ ID NO: 1511567 - RNA, 14 nt, Homo sapiens
cuucuucagaagac

SEQ ID NO: 1511568 - RNA, 13 nt, Homo sapiens
cuugaaaccaaag

SEQ ID NO: 1511569 - RNA, 13 nt, Homo sapiens
cuugacauguaau

SEQ ID NO: 1511570 - RNA, 18 nt, Homo sapiens
cuugaccuggagccaucu

SEQ ID NO: 1511571 - RNA, 18 nt, Homo sapiens
cuugagcuuggcagcuga

SEQ ID NO: 1511572 - RNA, 18 nt, Homo sapiens
cuugcaucaagggcuuua

SEQ ID NO: 1511573 - RNA, 14 nt, Homo sapiens
cuugcuauauugcc

SEQ ID NO: 1511574 - RNA, 18 nt, Homo sapiens
cuugcucagguacuugua

SEQ ID NO: 1511575 - RNA, 20 nt, Homo sapiens
cuugcuuucaucacuaccuu

SEQ ID NO: 1511576 - RNA, 23 nt, Homo sapiens
cuuggaaagcaucaccucaggcc

SEQ ID NO: 1511577 - RNA, 21 nt, Homo sapiens
gugaaacccugucucuacuaa

SEQ ID NO: 1511578 - RNA, 20 nt, Homo sapiens
gugaaauaccacaagccuga

SEQ ID NO: 1511579 - RNA, 13 nt, Homo sapiens
gugacaacaugcg

SEQ ID NO: 1511580 - RNA, 16 nt, Homo sapiens
gugacuaauggcauga

SEQ ID NO: 1511581 - RNA, 19 nt, Homo sapiens
gugacuaauggcaugagaa

SEQ ID NO: 1511582 - RNA, 15 nt, Homo sapiens
gugagucacacucag

SEQ ID NO: 1511583 - RNA, 15 nt, Homo sapiens
gugauauaugccuau

SEQ ID NO: 1511584 - RNA, 13 nt, Homo sapiens
gugauuucagaga

SEQ ID NO: 1511585 - RNA, 15 nt, Homo sapiens
gugauuucagagagg

SEQ ID NO: 1511586 - RNA, 19 nt, Homo sapiens
gugauuucagagagggcag

SEQ ID NO: 1511587 - RNA, 21 nt, Homo sapiens
gugccaggcuguaagcauucu

SEQ ID NO: 1511588 - RNA, 21 nt, Homo sapiens
gugccuagacuguuacuuugg

SEQ ID NO: 1511589 - RNA, 18 nt, Homo sapiens
gugcucugucuacuugcu

SEQ ID NO: 1511590 - RNA, 16 nt, Homo sapiens
gugcugugcugugcua

SEQ ID NO: 1511591 - RNA, 17 nt, Homo sapiens
gugcuguggccugggca

SEQ ID NO: 1511592 - RNA, 18 nt, Homo sapiens
guggaggaaaauccaugg

SEQ ID NO: 1511593 - RNA, 23 nt, Homo sapiens
guggauuuuguccauucaucuca

SEQ ID NO: 1511594 - RNA, 13 nt, Homo sapiens
guggcucuugccu

SEQ ID NO: 1511595 - RNA, 18 nt, Homo sapiens
guggcuuuuuaacaugaa

SEQ ID NO: 1511596 - RNA, 14 nt, Homo sapiens
gugggcacugcuga

SEQ ID NO: 1511597 - RNA, 15 nt, Homo sapiens
gugggcuccuuacag

SEQ ID NO: 1511598 - RNA, 23 nt, Homo sapiens
guggguaacgugagaagauagaa

SEQ ID NO: 1511599 - RNA, 11 nt, Homo sapiens
guggguggugg

SEQ ID NO: 1511600 - RNA, 16 nt, Homo sapiens
gugguguuucuguaag

SEQ ID NO: 1511601 - RNA, 21 nt, Homo sapiens
guguauauauaguagcauuuc

SEQ ID NO: 1511602 - RNA, 19 nt, Homo sapiens
guguauccgacucuaagcu

SEQ ID NO: 1511603 - RNA, 20 nt, Homo sapiens
guguaugucuauuugcacaa

SEQ ID NO: 1511604 - RNA, 22 nt, Homo sapiens
guguauuuugagauaaugucaa

SEQ ID NO: 1511605 - RNA, 22 nt, Homo sapiens
gugucacucaaggcggugcuug

SEQ ID NO: 1511606 - RNA, 18 nt, Homo sapiens
guguguauccgacucuaa

SEQ ID NO: 1511607 - RNA, 13 nt, Homo sapiens
gugugugugauau

SEQ ID NO: 1511608 - RNA, 14 nt, Homo sapiens
guguguugauccca

SEQ ID NO: 1511609 - RNA, 18 nt, Homo sapiens
guguguuuggaagacuau

SEQ ID NO: 1511610 - RNA, 16 nt, Homo sapiens
guguuaguguauguga

SEQ ID NO: 1511611 - RNA, 23 nt, Homo sapiens
guguuauuauuuggcaugcuuaa

SEQ ID NO: 1511612 - RNA, 12 nt, Homo sapiens
guguugauccca

SEQ ID NO: 1511613 - RNA, 22 nt, Homo sapiens
guguuuuugcuaucacacagug

SEQ ID NO: 1511614 - RNA, 19 nt, Homo sapiens
guuaacugugaaauaccac

SEQ ID NO: 1511615 - RNA, 20 nt, Homo sapiens
guuaaguguuugaaaacguu

SEQ ID NO: 1511616 - RNA, 21 nt, Homo sapiens
guuacaucacaguguuugcaa

SEQ ID NO: 1511617 - RNA, 15 nt, Homo sapiens
guuacaugcauucua

SEQ ID NO: 1511618 - RNA, 18 nt, Homo sapiens
guuacuacuuacagguga

SEQ ID NO: 1511619 - RNA, 14 nt, Homo sapiens
guuagaugaggcac

SEQ ID NO: 1511620 - RNA, 18 nt, Homo sapiens
guuagggugugugccaca

SEQ ID NO: 1511621 - RNA, 14 nt, Homo sapiens
guuaugcaagcaca

SEQ ID NO: 1511622 - RNA, 15 nt, Homo sapiens
guuaugcaagcacaa

SEQ ID NO: 1511623 - RNA, 17 nt, Homo sapiens
guuaugcaagcacaaau

SEQ ID NO: 1511624 - RNA, 19 nt, Homo sapiens
guuauuuggaccacuccag

SEQ ID NO: 1511625 - RNA, 17 nt, Homo sapiens
guucaguggugugaucu

SEQ ID NO: 1511626 - RNA, 20 nt, Homo sapiens
guucauauuuauacuuugca

SEQ ID NO: 1511627 - RNA, 21 nt, Homo sapiens
guuccuaagccuguugcugaa

SEQ ID NO: 1511628 - RNA, 21 nt, Homo sapiens
guuccuauuuggggcuugcau

SEQ ID NO: 1511629 - RNA, 23 nt, Homo sapiens
guucuaugaauauggaaaggcca

SEQ ID NO: 1511630 - RNA, 17 nt, Homo sapiens
guucuuuaaaauguaaa

SEQ ID NO: 1511631 - RNA, 22 nt, Homo sapiens
guucuuuaaaauguaaagccau

SEQ ID NO: 1511632 - RNA, 20 nt, Homo sapiens
guugaacaucucacuuugcc

SEQ ID NO: 1511633 - RNA, 12 nt, Homo sapiens
guugcacaaaaa

SEQ ID NO: 1511634 - RNA, 20 nt, Homo sapiens
guugccacaccaaucagaga

SEQ ID NO: 1511635 - RNA, 14 nt, Homo sapiens
guuuacagacugug

SEQ ID NO: 1511636 - RNA, 21 nt, Homo sapiens
guuuauuuuuuuaaaacacaa

SEQ ID NO: 1511637 - RNA, 14 nt, Homo sapiens
guuucaaaccagga

SEQ ID NO: 1511638 - RNA, 22 nt, Homo sapiens
guuucacaaaauuaaguguugu

SEQ ID NO: 1511639 - RNA, 19 nt, Homo sapiens
guuucaccguguuagccag

SEQ ID NO: 1511640 - RNA, 12 nt, Homo sapiens
aaaaaaccacaa

SEQ ID NO: 1511641 - RNA, 22 nt, Homo sapiens
aaaaacuacagcaucauugcau

SEQ ID NO: 1511642 - RNA, 17 nt, Homo sapiens
aaaaagaggcauuccag

SEQ ID NO: 1511643 - RNA, 13 nt, Homo sapiens
aaaaaucuuugau

SEQ ID NO: 1511644 - RNA, 12 nt, Homo sapiens
aaaaaugcugcu

SEQ ID NO: 1511645 - RNA, 16 nt, Homo sapiens
aaaaaugcugcuucuc

SEQ ID NO: 1511646 - RNA, 14 nt, Homo sapiens
aaaacaaaaaaccc

SEQ ID NO: 1511647 - RNA, 15 nt, Homo sapiens
aaaacagaacaauua

SEQ ID NO: 1511648 - RNA, 14 nt, Homo sapiens
aaaaccauguugau

SEQ ID NO: 1511649 - RNA, 14 nt, Homo sapiens
aaaaccccaucucu

SEQ ID NO: 1511650 - RNA, 18 nt, Homo sapiens
aaaaccccaucucuacua

SEQ ID NO: 1511651 - RNA, 20 nt, Homo sapiens
aaaacuaugacccauuuaau

SEQ ID NO: 1511652 - RNA, 18 nt, Homo sapiens
aaaacugcugaacuugac

SEQ ID NO: 1511653 - RNA, 14 nt, Homo sapiens
aaaacuuuuucaca

SEQ ID NO: 1511654 - RNA, 13 nt, Homo sapiens
aaaagaaacugug

SEQ ID NO: 1511655 - RNA, 16 nt, Homo sapiens
aaaagauaacaagauc

SEQ ID NO: 1511656 - RNA, 18 nt, Homo sapiens
aaaagauuuguuuuguca

SEQ ID NO: 1511657 - RNA, 17 nt, Homo sapiens
aaaagcaaaagcucugu

SEQ ID NO: 1511658 - RNA, 18 nt, Homo sapiens
aaaagcugccucugguca

SEQ ID NO: 1511659 - RNA, 22 nt, Homo sapiens
aaaagcuuaggcugauagacaa

SEQ ID NO: 1511660 - RNA, 14 nt, Homo sapiens
aaaaguacauguau

SEQ ID NO: 1511661 - RNA, 16 nt, Homo sapiens
aaaaguuuacagauca

SEQ ID NO: 1511662 - RNA, 16 nt, Homo sapiens
aaaauagcaauuagca

SEQ ID NO: 1511663 - RNA, 15 nt, Homo sapiens
aaaauagcucuuuca

SEQ ID NO: 1511664 - RNA, 14 nt, Homo sapiens
aaaaucaacuguau

SEQ ID NO: 1511665 - RNA, 12 nt, Homo sapiens
aaaauccacuca

SEQ ID NO: 1511666 - RNA, 19 nt, Homo sapiens
aaaaugaaagcaugucuca

SEQ ID NO: 1511667 - RNA, 19 nt, Homo sapiens
aaaauggaagguuggagac

SEQ ID NO: 1511668 - RNA, 22 nt, Homo sapiens
aaaauggagggagccaucccuu

SEQ ID NO: 1511669 - RNA, 22 nt, Homo sapiens
aaaauggcuuuaaucaauucua

SEQ ID NO: 1511670 - RNA, 18 nt, Homo sapiens
aaaauguacauacuaugu

SEQ ID NO: 1511671 - RNA, 23 nt, Homo sapiens
aaaauguaucccauuggcuacua

SEQ ID NO: 1511672 - RNA, 19 nt, Homo sapiens
aaaaugugaaucucuuaau

SEQ ID NO: 1511673 - RNA, 13 nt, Homo sapiens
aaaauuccacuca

SEQ ID NO: 1511674 - RNA, 16 nt, Homo sapiens
aaaauugaacuacuug

SEQ ID NO: 1511675 - RNA, 16 nt, Homo sapiens
aaacaaagucugggaa

SEQ ID NO: 1511676 - RNA, 12 nt, Homo sapiens
aaacaacauauu

SEQ ID NO: 1511677 - RNA, 20 nt, Homo sapiens
aaacaauuguaaauuucuuu

SEQ ID NO: 1511678 - RNA, 23 nt, Homo sapiens
aaacaguuuagcccaucucucca

SEQ ID NO: 1511679 - RNA, 13 nt, Homo sapiens
aaacauagguaua

SEQ ID NO: 1511680 - RNA, 10 nt, Homo sapiens
aaacauucau

SEQ ID NO: 1511681 - RNA, 11 nt, Homo sapiens
aaacauucucu

SEQ ID NO: 1511682 - RNA, 24 nt, Homo sapiens
aaaccaccuggguucagccucucc

SEQ ID NO: 1511683 - RNA, 14 nt, Homo sapiens
aaaccagagucaaa

SEQ ID NO: 1511684 - RNA, 16 nt, Homo sapiens
aaaccgcacucaccca

SEQ ID NO: 1511685 - RNA, 16 nt, Homo sapiens
aaaccuggagaugaug

SEQ ID NO: 1511686 - RNA, 19 nt, Homo sapiens
aaaccuuucaaauuucaca

SEQ ID NO: 1511687 - RNA, 23 nt, Homo sapiens
aaacgccuuuuauucuauuuaca

SEQ ID NO: 1511688 - RNA, 21 nt, Homo sapiens
aaacuaggaggaaaagacaga

SEQ ID NO: 1511689 - RNA, 17 nt, Homo sapiens
aaacuccugacuuugug

SEQ ID NO: 1511690 - RNA, 15 nt, Homo sapiens
aaacuguacaguuuc

SEQ ID NO: 1511691 - RNA, 14 nt, Homo sapiens
aaacuuaacaugga

SEQ ID NO: 1511692 - RNA, 19 nt, Homo sapiens
aaagaaaauuaguaauugu

SEQ ID NO: 1511693 - RNA, 16 nt, Homo sapiens
aaagaaagaaacugau

SEQ ID NO: 1511694 - RNA, 21 nt, Homo sapiens
aaagaagacgcucagcacugu

SEQ ID NO: 1511695 - RNA, 14 nt, Homo sapiens
aaagaagauuuugc

SEQ ID NO: 1511696 - RNA, 24 nt, Homo sapiens
aaagaagauuuugccacauuugau

SEQ ID NO: 1511697 - RNA, 12 nt, Homo sapiens
aaagaagggaag

SEQ ID NO: 1511698 - RNA, 14 nt, Homo sapiens
aaagaaguaaaagc

SEQ ID NO: 1511699 - RNA, 23 nt, Homo sapiens
aaagaauuuuuuaagaacuguau

SEQ ID NO: 1511700 - RNA, 14 nt, Homo sapiens
aaagacuauugcaa

SEQ ID NO: 1511701 - RNA, 23 nt, Homo sapiens
aaagagagagauacaucuuauaa

SEQ ID NO: 1511702 - RNA, 22 nt, Homo sapiens
aaagagguggauuccugggcaa

SEQ ID NO: 1511703 - RNA, 19 nt, Homo sapiens
aaagauuuaacaaauacau

SEQ ID NO: 1511704 - RNA, 18 nt, Homo sapiens
aaagauuugugaacugga

SEQ ID NO: 1511705 - RNA, 17 nt, Homo sapiens
aaagauuuguuuuguca

SEQ ID NO: 1511706 - RNA, 16 nt, Homo sapiens
aaagcaagacagauua

SEQ ID NO: 1511707 - RNA, 21 nt, Homo sapiens
aaagcaaucugagagauuuga

SEQ ID NO: 1511708 - RNA, 21 nt, Homo sapiens
auuuucucuaaaauuucaaca

SEQ ID NO: 1511709 - RNA, 18 nt, Homo sapiens
auuuugagcaaaccacau

SEQ ID NO: 1511710 - RNA, 20 nt, Homo sapiens
auuuugggacuucuacccag

SEQ ID NO: 1511711 - RNA, 12 nt, Homo sapiens
auuuuugcaaug

SEQ ID NO: 1511712 - RNA, 22 nt, Homo sapiens
auuuuugucgaguuuacuucau

SEQ ID NO: 1511713 - RNA, 12 nt, Homo sapiens
auuuuuuccaca

SEQ ID NO: 1511714 - RNA, 15 nt, Homo sapiens
caaaaaacccaagaa

SEQ ID NO: 1511715 - RNA, 14 nt, Homo sapiens
caaaaagacugugg

SEQ ID NO: 1511716 - RNA, 21 nt, Homo sapiens
caaaaagaugccuuuuaccau

SEQ ID NO: 1511717 - RNA, 14 nt, Homo sapiens
caaaaauaguauuc

SEQ ID NO: 1511718 - RNA, 15 nt, Homo sapiens
caaaacucugucagg

SEQ ID NO: 1511719 - RNA, 15 nt, Homo sapiens
caaaacugcauuuca

SEQ ID NO: 1511720 - RNA, 14 nt, Homo sapiens
caaaacugugcuuu

SEQ ID NO: 1511721 - RNA, 23 nt, Homo sapiens
caaaacuuccuguuuguggaaca

SEQ ID NO: 1511722 - RNA, 22 nt, Homo sapiens
caaaagcaagggaccuucaugc

SEQ ID NO: 1511723 - RNA, 18 nt, Homo sapiens
caaaagguuaauggaugg

SEQ ID NO: 1511724 - RNA, 17 nt, Homo sapiens
caaaauaaagaauagca

SEQ ID NO: 1511725 - RNA, 22 nt, Homo sapiens
caaaauggagggagccaucccu

SEQ ID NO: 1511726 - RNA, 23 nt, Homo sapiens
caaacaaaacgcaaaacccagua

SEQ ID NO: 1511727 - RNA, 14 nt, Homo sapiens
caaacaccagugag

SEQ ID NO: 1511728 - RNA, 12 nt, Homo sapiens
caaacacuccac

SEQ ID NO: 1511729 - RNA, 16 nt, Homo sapiens
caaacagccccaaagu

SEQ ID NO: 1511730 - RNA, 13 nt, Homo sapiens
caaaccagagcag

SEQ ID NO: 1511731 - RNA, 22 nt, Homo sapiens
caaacggaguacagacgucuca

SEQ ID NO: 1511732 - RNA, 19 nt, Homo sapiens
caaacgggcugcccugcca

SEQ ID NO: 1511733 - RNA, 22 nt, Homo sapiens
caaacuguacaguuucuucccc

SEQ ID NO: 1511734 - RNA, 16 nt, Homo sapiens
caaacuuaacauggaa

SEQ ID NO: 1511735 - RNA, 21 nt, Homo sapiens
caaacuuggucuuacaucugu

SEQ ID NO: 1511736 - RNA, 21 nt, Homo sapiens
caaagaacugccccaucuccu

SEQ ID NO: 1511737 - RNA, 17 nt, Homo sapiens
caaagaagaaguuuaaa

SEQ ID NO: 1511738 - RNA, 14 nt, Homo sapiens
caaagaguaguuaa

SEQ ID NO: 1511739 - RNA, 13 nt, Homo sapiens
caaagcaccagcu

SEQ ID NO: 1511740 - RNA, 9 nt, Homo sapiens
caaagccuc

SEQ ID NO: 1511741 - RNA, 15 nt, Homo sapiens
caaaggaaaccaaag

SEQ ID NO: 1511742 - RNA, 16 nt, Homo sapiens
caaaggaaaccaaagg

SEQ ID NO: 1511743 - RNA, 12 nt, Homo sapiens
caaauacauuca

SEQ ID NO: 1511744 - RNA, 17 nt, Homo sapiens
caaauauauugcaaaaa

SEQ ID NO: 1511745 - RNA, 17 nt, Homo sapiens
caaauccacaagccauu

SEQ ID NO: 1511746 - RNA, 22 nt, Homo sapiens
caaauccuuagaucuggcaugu

SEQ ID NO: 1511747 - RNA, 21 nt, Homo sapiens
caaauguaauuaugaggugaa

SEQ ID NO: 1511748 - RNA, 16 nt, Homo sapiens
caaauucuuuuucaca

SEQ ID NO: 1511749 - RNA, 18 nt, Homo sapiens
caaauugaagcauguaca

SEQ ID NO: 1511750 - RNA, 19 nt, Homo sapiens
caaauuguaguucuugucu

SEQ ID NO: 1511751 - RNA, 11 nt, Homo sapiens
caaauuucaca

SEQ ID NO: 1511752 - RNA, 14 nt, Homo sapiens
caaauuucaucucc

SEQ ID NO: 1511753 - RNA, 15 nt, Homo sapiens
caaauuucaucuccu

SEQ ID NO: 1511754 - RNA, 15 nt, Homo sapiens
caacaaauccaugga

SEQ ID NO: 1511755 - RNA, 15 nt, Homo sapiens
caacaauaaagacug

SEQ ID NO: 1511756 - RNA, 16 nt, Homo sapiens
caacaauaaagacuga

SEQ ID NO: 1511757 - RNA, 17 nt, Homo sapiens
caacacaaagacaugga

SEQ ID NO: 1511758 - RNA, 20 nt, Homo sapiens
caacagccugacaacauuuc

SEQ ID NO: 1511759 - RNA, 12 nt, Homo sapiens
caacaguuuucc

SEQ ID NO: 1511760 - RNA, 12 nt, Homo sapiens
caacauaucauu

SEQ ID NO: 1511761 - RNA, 16 nt, Homo sapiens
caacauucaaagcagc

SEQ ID NO: 1511762 - RNA, 17 nt, Homo sapiens
caaccccccaccugcca

SEQ ID NO: 1511763 - RNA, 20 nt, Homo sapiens
caaccugggauguagcggug

SEQ ID NO: 1511764 - RNA, 22 nt, Homo sapiens
caaccugggauguagcggugaa

SEQ ID NO: 1511765 - RNA, 16 nt, Homo sapiens
caaccuuguugcuuua

SEQ ID NO: 1511766 - RNA, 17 nt, Homo sapiens
caacucacuuuuuuaca

SEQ ID NO: 1511767 - RNA, 15 nt, Homo sapiens
caacucuccacucca

SEQ ID NO: 1511768 - RNA, 20 nt, Homo sapiens
caacuuauuaacaauuaggc

SEQ ID NO: 1511769 - RNA, 18 nt, Homo sapiens
caacuucagaaggccuca

SEQ ID NO: 1511770 - RNA, 19 nt, Homo sapiens
caacuuccuaaauauuaug

SEQ ID NO: 1511771 - RNA, 19 nt, Homo sapiens
caagaaauccaguuuccca

SEQ ID NO: 1511772 - RNA, 18 nt, Homo sapiens
caagaauuguccaugugc

SEQ ID NO: 1511773 - RNA, 21 nt, Homo sapiens
caagacagauuaccaaagaag

SEQ ID NO: 1511774 - RNA, 22 nt, Homo sapiens
caagacauuucucuaacuccug

SEQ ID NO: 1511775 - RNA, 20 nt, Homo sapiens
caagagaucagcaguggcag

SEQ ID NO: 1511776 - RNA, 17 nt, Homo sapiens
caagagcuggcaaaggu

SEQ ID NO: 1511777 - RNA, 23 nt, Homo sapiens
caagauaaaggaagucaccaaaa

SEQ ID NO: 1511778 - RNA, 15 nt, Homo sapiens
caagcaacauaaaac

SEQ ID NO: 1511779 - RNA, 22 nt, Homo sapiens
caagccuguauagacagcacuu

SEQ ID NO: 1511780 - RNA, 16 nt, Homo sapiens
caagcuggaagcacau

SEQ ID NO: 1511781 - RNA, 17 nt, Homo sapiens
caagcuggaugcagugg

SEQ ID NO: 1511782 - RNA, 17 nt, Homo sapiens
caaggugaauagcacag

SEQ ID NO: 1511783 - RNA, 18 nt, Homo sapiens
caaguuccugcacuccag

SEQ ID NO: 1511784 - RNA, 16 nt, Homo sapiens
caaguuucuaaauuga

SEQ ID NO: 1511785 - RNA, 16 nt, Homo sapiens
caauaaaagaaacugu

SEQ ID NO: 1511786 - RNA, 18 nt, Homo sapiens
caauaaaaguugaucaua

SEQ ID NO: 1511787 - RNA, 19 nt, Homo sapiens
caauaaguuccauguuaaa

SEQ ID NO: 1511788 - RNA, 22 nt, Homo sapiens
caauaaguuccauguuaaaaua

SEQ ID NO: 1511789 - RNA, 13 nt, Homo sapiens
caauaauauuuca

SEQ ID NO: 1511790 - RNA, 16 nt, Homo sapiens
caauauaucaauguaa

SEQ ID NO: 1511791 - RNA, 15 nt, Homo sapiens
caauauuuacauuuu

SEQ ID NO: 1511792 - RNA, 16 nt, Homo sapiens
caauauuuacucauca

SEQ ID NO: 1511793 - RNA, 17 nt, Homo sapiens
caaucaugaguaccuca

SEQ ID NO: 1511794 - RNA, 18 nt, Homo sapiens
caaucuccccuugcacua

SEQ ID NO: 1511795 - RNA, 16 nt, Homo sapiens
caaucucgcaguacau

SEQ ID NO: 1511796 - RNA, 15 nt, Homo sapiens
caaugaaaccaaagc

SEQ ID NO: 1511797 - RNA, 18 nt, Homo sapiens
caaugcuggcuuucuccc

SEQ ID NO: 1511798 - RNA, 13 nt, Homo sapiens
caauggaauguga

SEQ ID NO: 1511799 - RNA, 18 nt, Homo sapiens
caauggagucugcaguga

SEQ ID NO: 1511800 - RNA, 20 nt, Homo sapiens
caauggccuguguguuacaa

SEQ ID NO: 1511801 - RNA, 15 nt, Homo sapiens
caaugugacaacaug

SEQ ID NO: 1511802 - RNA, 14 nt, Homo sapiens
caauugacaacagu

SEQ ID NO: 1511803 - RNA, 19 nt, Homo sapiens
caauugcuaccgagaaggu

SEQ ID NO: 1511804 - RNA, 12 nt, Homo sapiens
caauuuuuccau

SEQ ID NO: 1511805 - RNA, 21 nt, Homo sapiens
cacaaaaaggcauaugcaaua

SEQ ID NO: 1511806 - RNA, 11 nt, Homo sapiens
cacaacauuua

SEQ ID NO: 1511807 - RNA, 20 nt, Homo sapiens
cacaacccccaggaaacaca

SEQ ID NO: 1511808 - RNA, 16 nt, Homo sapiens
cacaacccuguuuuau

SEQ ID NO: 1511809 - RNA, 16 nt, Homo sapiens
cacaaggucacuagau

SEQ ID NO: 1511810 - RNA, 22 nt, Homo sapiens
cacaauaaaagaaacugugguc

SEQ ID NO: 1511811 - RNA, 17 nt, Homo sapiens
cacaaucugggacuuuc

SEQ ID NO: 1511812 - RNA, 13 nt, Homo sapiens
cacaauucaugga

SEQ ID NO: 1511813 - RNA, 12 nt, Homo sapiens
cacaccaucucc

SEQ ID NO: 1511814 - RNA, 17 nt, Homo sapiens
cacaccugacaaaugga

SEQ ID NO: 1511815 - RNA, 15 nt, Homo sapiens
cacacgcaggaacuc

SEQ ID NO: 1511816 - RNA, 15 nt, Homo sapiens
cacacuggugacugc

SEQ ID NO: 1511817 - RNA, 13 nt, Homo sapiens
cacacuucuugaa

SEQ ID NO: 1511818 - RNA, 20 nt, Homo sapiens
cacacuucuugaaacagccu

SEQ ID NO: 1511819 - RNA, 12 nt, Homo sapiens
cacagaauguga

SEQ ID NO: 1511820 - RNA, 22 nt, Homo sapiens
cacagaugauuaaacagacuuu

SEQ ID NO: 1511821 - RNA, 16 nt, Homo sapiens
cacagcccagaaccac

SEQ ID NO: 1511822 - RNA, 17 nt, Homo sapiens
cacagcccgggugugcc

SEQ ID NO: 1511823 - RNA, 15 nt, Homo sapiens
cacagcgugggaacu

SEQ ID NO: 1511824 - RNA, 16 nt, Homo sapiens
cacaguugagugaaau

SEQ ID NO: 1511825 - RNA, 21 nt, Homo sapiens
cacauaaacacauacauugcc

SEQ ID NO: 1511826 - RNA, 16 nt, Homo sapiens
cacauaaacuuuauaa

SEQ ID NO: 1511827 - RNA, 14 nt, Homo sapiens
cacaucagcccugu

SEQ ID NO: 1511828 - RNA, 23 nt, Homo sapiens
cacauguguucucuauuuugccu

SEQ ID NO: 1511829 - RNA, 23 nt, Homo sapiens
cacauuugauuauauacuaugua

SEQ ID NO: 1511830 - RNA, 24 nt, Homo sapiens
cacauuugauuauauacuauguau

SEQ ID NO: 1511831 - RNA, 19 nt, Homo sapiens
caucuacaagcauuugccc

SEQ ID NO: 1511832 - RNA, 20 nt, Homo sapiens
caucuagucacaaagacucc

SEQ ID NO: 1511833 - RNA, 19 nt, Homo sapiens
caugaaaauagcucuuuca

SEQ ID NO: 1511834 - RNA, 17 nt, Homo sapiens
caugaacagaaacaaua

SEQ ID NO: 1511835 - RNA, 13 nt, Homo sapiens
caugaaugcacac

SEQ ID NO: 1511836 - RNA, 16 nt, Homo sapiens
caugacacucuaguga

SEQ ID NO: 1511837 - RNA, 17 nt, Homo sapiens
caugacagcaguguuaa

SEQ ID NO: 1511838 - RNA, 17 nt, Homo sapiens
caugagaaaaucaguaa

SEQ ID NO: 1511839 - RNA, 20 nt, Homo sapiens
caugauuucugugaagcaaa

SEQ ID NO: 1511840 - RNA, 15 nt, Homo sapiens
caugcagaagugcau

SEQ ID NO: 1511841 - RNA, 13 nt, Homo sapiens
caugcagccucuu

SEQ ID NO: 1511842 - RNA, 22 nt, Homo sapiens
caugccacgagaucaacacaca

SEQ ID NO: 1511843 - RNA, 18 nt, Homo sapiens
caugcuucagugcugcuc

SEQ ID NO: 1511844 - RNA, 14 nt, Homo sapiens
caugcuucuucuca

SEQ ID NO: 1511845 - RNA, 13 nt, Homo sapiens
cauggacacagac

SEQ ID NO: 1511846 - RNA, 23 nt, Homo sapiens
cauggacaugcuucagugcugcu

SEQ ID NO: 1511847 - RNA, 17 nt, Homo sapiens
cauggagaccgugacca

SEQ ID NO: 1511848 - RNA, 14 nt, Homo sapiens
cauggagagguuug

SEQ ID NO: 1511849 - RNA, 15 nt, Homo sapiens
cauggcauugaacug

SEQ ID NO: 1511850 - RNA, 13 nt, Homo sapiens
caugggacugugc

SEQ ID NO: 1511851 - RNA, 14 nt, Homo sapiens
cauggugcuuucag

SEQ ID NO: 1511852 - RNA, 17 nt, Homo sapiens
cauguacuauaauguga

SEQ ID NO: 1511853 - RNA, 20 nt, Homo sapiens
cauguacucaaguaccacca

SEQ ID NO: 1511854 - RNA, 23 nt, Homo sapiens
cauguagaucaagugugcauaua

SEQ ID NO: 1511855 - RNA, 22 nt, Homo sapiens
cauguaucuaccucacuauuca

SEQ ID NO: 1511856 - RNA, 15 nt, Homo sapiens
caugucagacuguac

SEQ ID NO: 1511857 - RNA, 17 nt, Homo sapiens
cauguuauccacaagca

SEQ ID NO: 1511858 - RNA, 17 nt, Homo sapiens
cauguugcuaaugacag

SEQ ID NO: 1511859 - RNA, 20 nt, Homo sapiens
cauguuuaucugagcucuua

SEQ ID NO: 1511860 - RNA, 21 nt, Homo sapiens
cauguuugucugugugcugua

SEQ ID NO: 1511861 - RNA, 22 nt, Homo sapiens
cauguuuuguauguuaaauuca

SEQ ID NO: 1511862 - RNA, 22 nt, Homo sapiens
cauuaauguucuuuauaaaaag

SEQ ID NO: 1511863 - RNA, 13 nt, Homo sapiens
cauuacauggcug

SEQ ID NO: 1511864 - RNA, 19 nt, Homo sapiens
cauuagaacacugcauuag

SEQ ID NO: 1511865 - RNA, 13 nt, Homo sapiens
cauuagagucagc

SEQ ID NO: 1511866 - RNA, 15 nt, Homo sapiens
cauuauacauuugau

SEQ ID NO: 1511867 - RNA, 16 nt, Homo sapiens
cauuauguacaauaca

SEQ ID NO: 1511868 - RNA, 19 nt, Homo sapiens
cauuauuuuuuacaauggc

SEQ ID NO: 1511869 - RNA, 20 nt, Homo sapiens
cauucacagcccagaaccac

SEQ ID NO: 1511870 - RNA, 19 nt, Homo sapiens
cauucauuuauucauucau

SEQ ID NO: 1511871 - RNA, 14 nt, Homo sapiens
cauuccaguaggaa

SEQ ID NO: 1511872 - RNA, 15 nt, Homo sapiens
cauucccagugguca

SEQ ID NO: 1511873 - RNA, 15 nt, Homo sapiens
cauucccaucuguca

SEQ ID NO: 1511874 - RNA, 18 nt, Homo sapiens
cauucccuuuuccauaua

SEQ ID NO: 1511875 - RNA, 17 nt, Homo sapiens
cauuccuguagucaaaa

SEQ ID NO: 1511876 - RNA, 16 nt, Homo sapiens
cauucuauaagcuauu

SEQ ID NO: 1511877 - RNA, 16 nt, Homo sapiens
cauucucaucuacuca

SEQ ID NO: 1511878 - RNA, 23 nt, Homo sapiens
cauugcaacaagguuaccucuau

SEQ ID NO: 1511879 - RNA, 19 nt, Homo sapiens
cauugugacuauccaguga

SEQ ID NO: 1511880 - RNA, 23 nt, Homo sapiens
cauuguguguuagcagcagugag

SEQ ID NO: 1511881 - RNA, 22 nt, Homo sapiens
cauuuaccucgaggcucuucca

SEQ ID NO: 1511882 - RNA, 13 nt, Homo sapiens
cauuucaacucca

SEQ ID NO: 1511883 - RNA, 13 nt, Homo sapiens
cauuucccugugc

SEQ ID NO: 1511884 - RNA, 18 nt, Homo sapiens
cauuucuacugugacuga

SEQ ID NO: 1511885 - RNA, 23 nt, Homo sapiens
cauuucucuaacuccugccauuc

SEQ ID NO: 1511886 - RNA, 20 nt, Homo sapiens
cauuugguucaggcauaaau

SEQ ID NO: 1511887 - RNA, 14 nt, Homo sapiens
cauuuuacuuccau

SEQ ID NO: 1511888 - RNA, 17 nt, Homo sapiens
cauuuuacuuccaugau

SEQ ID NO: 1511889 - RNA, 12 nt, Homo sapiens
cauuuuccaaaa

SEQ ID NO: 1511890 - RNA, 13 nt, Homo sapiens
cauuuuuggugua

SEQ ID NO: 1511891 - RNA, 23 nt, Homo sapiens
ccaaaaaaaaauacaugcuaaga

SEQ ID NO: 1511892 - RNA, 18 nt, Homo sapiens
ccaaacuguacaguuucu

SEQ ID NO: 1511893 - RNA, 20 nt, Homo sapiens
ccaaagugccacucauuccu

SEQ ID NO: 1511894 - RNA, 16 nt, Homo sapiens
ccaaauaaaaccucag

SEQ ID NO: 1511895 - RNA, 22 nt, Homo sapiens
ccaaauugggagauaauuauca

SEQ ID NO: 1511896 - RNA, 19 nt, Homo sapiens
ccaagaaacuaguaucucu

SEQ ID NO: 1511897 - RNA, 21 nt, Homo sapiens
ccaagaacuuuucccccaaag

SEQ ID NO: 1511898 - RNA, 18 nt, Homo sapiens
ccaaggccuccugugacu

SEQ ID NO: 1511899 - RNA, 16 nt, Homo sapiens
ccaaggguaugggaag

SEQ ID NO: 1511900 - RNA, 20 nt, Homo sapiens
ccaaggguaugggaagccau

SEQ ID NO: 1511901 - RNA, 21 nt, Homo sapiens
ccaaggguaugggaagccaua

SEQ ID NO: 1511902 - RNA, 19 nt, Homo sapiens
ccaagguaaacaguuugaa

SEQ ID NO: 1511903 - RNA, 18 nt, Homo sapiens
ccaaggugaauagcacag

SEQ ID NO: 1511904 - RNA, 22 nt, Homo sapiens
ccaaggugcugaugucaaagug

SEQ ID NO: 1511905 - RNA, 16 nt, Homo sapiens
ccaagugccagucuug

SEQ ID NO: 1511906 - RNA, 19 nt, Homo sapiens
ccaaugacuuuuuauuuua

SEQ ID NO: 1511907 - RNA, 16 nt, Homo sapiens
ccaauggaaugugaug

SEQ ID NO: 1511908 - RNA, 18 nt, Homo sapiens
ccacaaagaguaguuaaa

SEQ ID NO: 1511909 - RNA, 18 nt, Homo sapiens
ccacaaucugggacuuuc

SEQ ID NO: 1511910 - RNA, 19 nt, Homo sapiens
ccacaaucugggacuuuca

SEQ ID NO: 1511911 - RNA, 14 nt, Homo sapiens
ccacacuucuugaa

SEQ ID NO: 1511912 - RNA, 20 nt, Homo sapiens
ccaccaagggaucugccauu

SEQ ID NO: 1511913 - RNA, 20 nt, Homo sapiens
ccaccccuaaccuggcuuau

SEQ ID NO: 1511914 - RNA, 12 nt, Homo sapiens
ccaccugccauu

SEQ ID NO: 1511915 - RNA, 20 nt, Homo sapiens
ccacgacuguuguacaagcu

SEQ ID NO: 1511916 - RNA, 15 nt, Homo sapiens
ccacucaggccaaca

SEQ ID NO: 1511917 - RNA, 22 nt, Homo sapiens
ccacucuaugaguuggacuuca

SEQ ID NO: 1511918 - RNA, 15 nt, Homo sapiens
ccacugcaaauuuca

SEQ ID NO: 1511919 - RNA, 21 nt, Homo sapiens
ccagaaagaaggacacuugua

SEQ ID NO: 1511920 - RNA, 20 nt, Homo sapiens
ccagagacaugcaagucaug

SEQ ID NO: 1511921 - RNA, 20 nt, Homo sapiens
ccagagccggggcacuuuca

SEQ ID NO: 1511922 - RNA, 14 nt, Homo sapiens
ccagaugaagcuuu

SEQ ID NO: 1511923 - RNA, 12 nt, Homo sapiens
ccagcacuuugg

SEQ ID NO: 1511924 - RNA, 20 nt, Homo sapiens
ccagccugggcgacagagca

SEQ ID NO: 1511925 - RNA, 16 nt, Homo sapiens
ccagcugcaccugcca

SEQ ID NO: 1511926 - RNA, 19 nt, Homo sapiens
ccaggaggguaacagaaga

SEQ ID NO: 1511927 - RNA, 16 nt, Homo sapiens
ccaguccgccaaacac

SEQ ID NO: 1511928 - RNA, 15 nt, Homo sapiens
ccagugcuaccucuc

SEQ ID NO: 1511929 - RNA, 21 nt, Homo sapiens
ccagugggccugguagcacau

SEQ ID NO: 1511930 - RNA, 17 nt, Homo sapiens
ccaguggguuaucuuuu

SEQ ID NO: 1511931 - RNA, 19 nt, Homo sapiens
ccaguuguuacugaaguua

SEQ ID NO: 1511932 - RNA, 13 nt, Homo sapiens
ccauaacagccaa

SEQ ID NO: 1511933 - RNA, 19 nt, Homo sapiens
ccauaauugcuuugccaaa

SEQ ID NO: 1511934 - RNA, 20 nt, Homo sapiens
ccauagugcacuagcauuuu

SEQ ID NO: 1511935 - RNA, 20 nt, Homo sapiens
ccauaguuauuuacuugaaa

SEQ ID NO: 1511936 - RNA, 20 nt, Homo sapiens
ccauauaucuuauguuaaag

SEQ ID NO: 1511937 - RNA, 15 nt, Homo sapiens
ccaucuuuugugaga

SEQ ID NO: 1511938 - RNA, 16 nt, Homo sapiens
ccaugcccucccugcu

SEQ ID NO: 1511939 - RNA, 12 nt, Homo sapiens
ccaugccucaag

SEQ ID NO: 1511940 - RNA, 23 nt, Homo sapiens
ccauggaccuaugacaggcugaa

SEQ ID NO: 1511941 - RNA, 17 nt, Homo sapiens
aacccgggcgcugccug

SEQ ID NO: 1511942 - RNA, 16 nt, Homo sapiens
aacccguuuuauucua

SEQ ID NO: 1511943 - RNA, 20 nt, Homo sapiens
aacccuguggggccugaugg

SEQ ID NO: 1511944 - RNA, 20 nt, Homo sapiens
aaccucaaacuaggaggaaa

SEQ ID NO: 1511945 - RNA, 14 nt, Homo sapiens
aaccucacuugaag

SEQ ID NO: 1511946 - RNA, 13 nt, Homo sapiens
aaccucagggaca

SEQ ID NO: 1511947 - RNA, 16 nt, Homo sapiens
aaccuggagaugauga

SEQ ID NO: 1511948 - RNA, 15 nt, Homo sapiens
aacggagagugcuug

SEQ ID NO: 1511949 - RNA, 21 nt, Homo sapiens
aacggaguacagacgucucaa

SEQ ID NO: 1511950 - RNA, 14 nt, Homo sapiens
aacuaaacacguga

SEQ ID NO: 1511951 - RNA, 16 nt, Homo sapiens
aacuagaaaucugcca

SEQ ID NO: 1511952 - RNA, 13 nt, Homo sapiens
aacuauaagcaag

SEQ ID NO: 1511953 - RNA, 16 nt, Homo sapiens
aacuauuuauuucacc

SEQ ID NO: 1511954 - RNA, 13 nt, Homo sapiens
aacucacuuuccc

SEQ ID NO: 1511955 - RNA, 14 nt, Homo sapiens
aacuccugccauuc

SEQ ID NO: 1511956 - RNA, 19 nt, Homo sapiens
aacuccuuuagcagguggu

SEQ ID NO: 1511957 - RNA, 16 nt, Homo sapiens
aacucugccagccaca

SEQ ID NO: 1511958 - RNA, 12 nt, Homo sapiens
aacucugucagg

SEQ ID NO: 1511959 - RNA, 20 nt, Homo sapiens
aacugaauuuugggacuucu

SEQ ID NO: 1511960 - RNA, 13 nt, Homo sapiens
aacugacuucuuu

SEQ ID NO: 1511961 - RNA, 15 nt, Homo sapiens
aacugacuucuuugu

SEQ ID NO: 1511962 - RNA, 17 nt, Homo sapiens
aacugaggucacugggu

SEQ ID NO: 1511963 - RNA, 15 nt, Homo sapiens
aacugccccaucucc

SEQ ID NO: 1511964 - RNA, 20 nt, Homo sapiens
aacugcucugcccacuguga

SEQ ID NO: 1511965 - RNA, 17 nt, Homo sapiens
aacuggaagaaagcaac

SEQ ID NO: 1511966 - RNA, 15 nt, Homo sapiens
aacugguucaugaaa

SEQ ID NO: 1511967 - RNA, 19 nt, Homo sapiens
aacuguacaguuucuuccc

SEQ ID NO: 1511968 - RNA, 14 nt, Homo sapiens
aacuguacauguga

SEQ ID NO: 1511969 - RNA, 15 nt, Homo sapiens
aacugugaaauacca

SEQ ID NO: 1511970 - RNA, 22 nt, Homo sapiens
aacugugcccugccuucagcuu

SEQ ID NO: 1511971 - RNA, 22 nt, Homo sapiens
aacuuaccaggcaccaaaagaa

SEQ ID NO: 1511972 - RNA, 16 nt, Homo sapiens
aacuugaaauauccug

SEQ ID NO: 1511973 - RNA, 19 nt, Homo sapiens
aacuugaggacacaugucc

SEQ ID NO: 1511974 - RNA, 12 nt, Homo sapiens
aacuuggcugca

SEQ ID NO: 1511975 - RNA, 12 nt, Homo sapiens
aagaaaaccauu

SEQ ID NO: 1511976 - RNA, 15 nt, Homo sapiens
aagaaaauuaguaau

SEQ ID NO: 1511977 - RNA, 12 nt, Homo sapiens
aagaaacaugau

SEQ ID NO: 1511978 - RNA, 22 nt, Homo sapiens
aagaaaccuucagauuuguguu

SEQ ID NO: 1511979 - RNA, 13 nt, Homo sapiens
aagaaagugcaga

SEQ ID NO: 1511980 - RNA, 12 nt, Homo sapiens
aagaagaaagca

SEQ ID NO: 1511981 - RNA, 15 nt, Homo sapiens
aagaagagaucagga

SEQ ID NO: 1511982 - RNA, 13 nt, Homo sapiens
aagaauggaagaa

SEQ ID NO: 1511983 - RNA, 20 nt, Homo sapiens
aagacaaaugggccugccaa

SEQ ID NO: 1511984 - RNA, 21 nt, Homo sapiens
aagacaggucuagacuuucuc

SEQ ID NO: 1511985 - RNA, 11 nt, Homo sapiens
aagacauuucu

SEQ ID NO: 1511986 - RNA, 11 nt, Homo sapiens
aagaccaaaaa

SEQ ID NO: 1511987 - RNA, 22 nt, Homo sapiens
aagaccauaacagccaacaggu

SEQ ID NO: 1511988 - RNA, 19 nt, Homo sapiens
aagacuguggccugcccag

SEQ ID NO: 1511989 - RNA, 14 nt, Homo sapiens
aagagacacugcuu

SEQ ID NO: 1511990 - RNA, 13 nt, Homo sapiens
aagagaguaccau

SEQ ID NO: 1511991 - RNA, 21 nt, Homo sapiens
aagaggcuauuuaaaaguaua

SEQ ID NO: 1511992 - RNA, 18 nt, Homo sapiens
aagaggugcuagcucuua

SEQ ID NO: 1511993 - RNA, 21 nt, Homo sapiens
aagauaccagcuuuuucucuc

SEQ ID NO: 1511994 - RNA, 20 nt, Homo sapiens
aagauacgguugucuagagg

SEQ ID NO: 1511995 - RNA, 18 nt, Homo sapiens
aagauagggaacacucau

SEQ ID NO: 1511996 - RNA, 21 nt, Homo sapiens
aagauagggaacacucauccc

SEQ ID NO: 1511997 - RNA, 22 nt, Homo sapiens
aagauagggaacacucaucccu

SEQ ID NO: 1511998 - RNA, 17 nt, Homo sapiens
aagauaguaucuuuuaa

SEQ ID NO: 1511999 - RNA, 15 nt, Homo sapiens
aagaucuauauugua

SEQ ID NO: 1512000 - RNA, 13 nt, Homo sapiens
aagaugcccucau

SEQ ID NO: 1512001 - RNA, 15 nt, Homo sapiens
aagaugccuuuuacc

SEQ ID NO: 1512002 - RNA, 21 nt, Homo sapiens
aagaugcuuuguuucuuucau

SEQ ID NO: 1512003 - RNA, 22 nt, Homo sapiens
aagauggagaauaaauuauuga

SEQ ID NO: 1512004 - RNA, 17 nt, Homo sapiens
aagauuuugccacauuu

SEQ ID NO: 1512005 - RNA, 16 nt, Homo sapiens
aagcaagggaccuuca

SEQ ID NO: 1512006 - RNA, 22 nt, Homo sapiens
aagcaauaaaaauacuaugaaa

SEQ ID NO: 1512007 - RNA, 19 nt, Homo sapiens
aagcacaaauuucaucucc

SEQ ID NO: 1512008 - RNA, 18 nt, Homo sapiens
aagcauguacaaauuaua

SEQ ID NO: 1512009 - RNA, 13 nt, Homo sapiens
aagcauuagcaca

SEQ ID NO: 1512010 - RNA, 22 nt, Homo sapiens
aagcauuagcacauauuucaca

SEQ ID NO: 1512011 - RNA, 16 nt, Homo sapiens
aagccaaacucugcca

SEQ ID NO: 1512012 - RNA, 17 nt, Homo sapiens
aagccaaacucugccag

SEQ ID NO: 1512013 - RNA, 11 nt, Homo sapiens
aagccacugaa

SEQ ID NO: 1512014 - RNA, 13 nt, Homo sapiens
aagcuaaguagaa

SEQ ID NO: 1512015 - RNA, 13 nt, Homo sapiens
aagcuaggauggu

SEQ ID NO: 1512016 - RNA, 20 nt, Homo sapiens
aagcucaggaggcgaauaaa

SEQ ID NO: 1512017 - RNA, 13 nt, Homo sapiens
aagcucuguguaa

SEQ ID NO: 1512018 - RNA, 19 nt, Homo sapiens
aagcugagacccucgccac

SEQ ID NO: 1512019 - RNA, 15 nt, Homo sapiens
aaggaaaaaugcugc

SEQ ID NO: 1512020 - RNA, 12 nt, Homo sapiens
aaggaaaaccag

SEQ ID NO: 1512021 - RNA, 15 nt, Homo sapiens
aaggaaaaccaguga

SEQ ID NO: 1512022 - RNA, 22 nt, Homo sapiens
aaggaaacuugaaucaaagcag

SEQ ID NO: 1512023 - RNA, 13 nt, Homo sapiens
aaggaaauaucau

SEQ ID NO: 1512024 - RNA, 18 nt, Homo sapiens
aaggaaggcuccaucucc

SEQ ID NO: 1512025 - RNA, 16 nt, Homo sapiens
aaggacuaugaaaagc

SEQ ID NO: 1512026 - RNA, 23 nt, Homo sapiens
aaggagauauggcuaguggcaau

SEQ ID NO: 1512027 - RNA, 14 nt, Homo sapiens
aaggaugggaccaa

SEQ ID NO: 1512028 - RNA, 18 nt, Homo sapiens
aaggauuguugggcuugg

SEQ ID NO: 1512029 - RNA, 14 nt, Homo sapiens
aaggcaacugugag

SEQ ID NO: 1512030 - RNA, 22 nt, Homo sapiens
aaggcaaggucaccugccucuu

SEQ ID NO: 1512031 - RNA, 19 nt, Homo sapiens
aaggcauuccucaucacca

SEQ ID NO: 1512032 - RNA, 21 nt, Homo sapiens
aaggccagcugacuagaucuc

SEQ ID NO: 1512033 - RNA, 13 nt, Homo sapiens
aaggcuccaucuc

SEQ ID NO: 1512034 - RNA, 15 nt, Homo sapiens
aaggcuuugccaugg

SEQ ID NO: 1512035 - RNA, 17 nt, Homo sapiens
aagggaagcuucuugcu

SEQ ID NO: 1512036 - RNA, 13 nt, Homo sapiens
aagguagagaugu

SEQ ID NO: 1512037 - RNA, 19 nt, Homo sapiens
aagguauuagcaaagcaaa

SEQ ID NO: 1512038 - RNA, 20 nt, Homo sapiens
aaggucccauaauaaaaaga

SEQ ID NO: 1512039 - RNA, 15 nt, Homo sapiens
aaggucuucagccau

SEQ ID NO: 1512040 - RNA, 15 nt, Homo sapiens
aagguuaccucuauu

SEQ ID NO: 1512041 - RNA, 17 nt, Homo sapiens
aagguuucauguagauu

SEQ ID NO: 1512042 - RNA, 14 nt, Homo sapiens
aaguaaugcuucaa

SEQ ID NO: 1512043 - RNA, 12 nt, Homo sapiens
aaguacauguau

SEQ ID NO: 1512044 - RNA, 15 nt, Homo sapiens
aaguaccacucaggc

SEQ ID NO: 1512045 - RNA, 12 nt, Homo sapiens
aaguauuugaaa

SEQ ID NO: 1512046 - RNA, 18 nt, Homo sapiens
aaguccaaccugccugug

SEQ ID NO: 1512047 - RNA, 23 nt, Homo sapiens
aaguccaaccugccugugcauga

SEQ ID NO: 1512048 - RNA, 13 nt, Homo sapiens
aagucuacuucac

SEQ ID NO: 1512049 - RNA, 17 nt, Homo sapiens
aagucuacuucacuaau

SEQ ID NO: 1512050 - RNA, 16 nt, Homo sapiens
aagucuguuuacugca

SEQ ID NO: 1512051 - RNA, 19 nt, Homo sapiens
aagucuguuuuaaugacaa

SEQ ID NO: 1512052 - RNA, 17 nt, Homo sapiens
aagugccacucauuccu

SEQ ID NO: 1512053 - RNA, 18 nt, Homo sapiens
aagugccuagacuguuac

SEQ ID NO: 1512054 - RNA, 14 nt, Homo sapiens
aaguggccaugcca

SEQ ID NO: 1512055 - RNA, 15 nt, Homo sapiens
aaguuauucuugaca

SEQ ID NO: 1512056 - RNA, 14 nt, Homo sapiens
aaguucaacuucca

SEQ ID NO: 1512057 - RNA, 17 nt, Homo sapiens
aaguuccugcacuccag

SEQ ID NO: 1512058 - RNA, 18 nt, Homo sapiens
aaguugacuuuaacaagg

SEQ ID NO: 1512059 - RNA, 13 nt, Homo sapiens
aaguuucacccaa

SEQ ID NO: 1512060 - RNA, 17 nt, Homo sapiens
aaguuucuggugccauu

SEQ ID NO: 1512061 - RNA, 18 nt, Homo sapiens
aaguuugggaagggaugg

SEQ ID NO: 1512062 - RNA, 14 nt, Homo sapiens
aauaaaaccucagg

SEQ ID NO: 1512063 - RNA, 16 nt, Homo sapiens
aauaaaaguacugaag

SEQ ID NO: 1512064 - RNA, 13 nt, Homo sapiens
aauaaagcccuug

SEQ ID NO: 1512065 - RNA, 20 nt, Homo sapiens
aauaaagcccuugaaccagc

SEQ ID NO: 1512066 - RNA, 21 nt, Homo sapiens
aauaaagcugcugagaaucua

SEQ ID NO: 1512067 - RNA, 19 nt, Homo sapiens
aauaaaucagcacauuuga

SEQ ID NO: 1512068 - RNA, 19 nt, Homo sapiens
aauaaaugauguacuacau

SEQ ID NO: 1512069 - RNA, 14 nt, Homo sapiens
aauaagaaacacaa

SEQ ID NO: 1512070 - RNA, 16 nt, Homo sapiens
aauaagaaacaugaug

SEQ ID NO: 1512071 - RNA, 17 nt, Homo sapiens
aauaagaaacaugaugu

SEQ ID NO: 1512072 - RNA, 16 nt, Homo sapiens
aauaagaguucuugcc

SEQ ID NO: 1512073 - RNA, 20 nt, Homo sapiens
aauaauaaaaagacuauuaa

SEQ ID NO: 1512074 - RNA, 15 nt, Homo sapiens
aauaauaaauccuca

SEQ ID NO: 1512075 - RNA, 14 nt, Homo sapiens
aauaauacacuaau

SEQ ID NO: 1512076 - RNA, 20 nt, Homo sapiens
aauaauuaaaaaccacugaa

SEQ ID NO: 1512077 - RNA, 19 nt, Homo sapiens
agaucgcgccacugcacuc

SEQ ID NO: 1512078 - RNA, 13 nt, Homo sapiens
agaucugcacugg

SEQ ID NO: 1512079 - RNA, 17 nt, Homo sapiens
agaucuggaaccuuacc

SEQ ID NO: 1512080 - RNA, 18 nt, Homo sapiens
agaugaggcuuuccaugg

SEQ ID NO: 1512081 - RNA, 20 nt, Homo sapiens
agaugauuaaacagacuuua

SEQ ID NO: 1512082 - RNA, 20 nt, Homo sapiens
agaugcccucauaaaccaau

SEQ ID NO: 1512083 - RNA, 22 nt, Homo sapiens
agaugguccuccauuucaacuc

SEQ ID NO: 1512084 - RNA, 18 nt, Homo sapiens
agauguuacugugugaag

SEQ ID NO: 1512085 - RNA, 21 nt, Homo sapiens
agauuaccaaagaagauuuug

SEQ ID NO: 1512086 - RNA, 17 nt, Homo sapiens
agauuagguacuaucug

SEQ ID NO: 1512087 - RNA, 21 nt, Homo sapiens
agcaaaccacauaaucucucu

SEQ ID NO: 1512088 - RNA, 17 nt, Homo sapiens
agcaaaggaaaccaaag

SEQ ID NO: 1512089 - RNA, 15 nt, Homo sapiens
agcaaauuaguaauu

SEQ ID NO: 1512090 - RNA, 16 nt, Homo sapiens
agcaaauuaguaauug

SEQ ID NO: 1512091 - RNA, 14 nt, Homo sapiens
agcaagaauuauaa

SEQ ID NO: 1512092 - RNA, 17 nt, Homo sapiens
agcaagacuccauuuca

SEQ ID NO: 1512093 - RNA, 23 nt, Homo sapiens
agcaagaggugguagaaccacuu

SEQ ID NO: 1512094 - RNA, 16 nt, Homo sapiens
agcaauuccagggugg

SEQ ID NO: 1512095 - RNA, 15 nt, Homo sapiens
agcacugccaccagu

SEQ ID NO: 1512096 - RNA, 15 nt, Homo sapiens
agcacugcuccagug

SEQ ID NO: 1512097 - RNA, 21 nt, Homo sapiens
agcagaugguccuccauuuca

SEQ ID NO: 1512098 - RNA, 11 nt, Homo sapiens
agcaggagcag

SEQ ID NO: 1512099 - RNA, 20 nt, Homo sapiens
agcaugucucaauaguaaaa

SEQ ID NO: 1512100 - RNA, 22 nt, Homo sapiens
agcauuacgugagccagguaau

SEQ ID NO: 1512101 - RNA, 15 nt, Homo sapiens
agcauucagaacuuc

SEQ ID NO: 1512102 - RNA, 14 nt, Homo sapiens
agccagaacuugac

SEQ ID NO: 1512103 - RNA, 16 nt, Homo sapiens
agccagcaguuguaaa

SEQ ID NO: 1512104 - RNA, 20 nt, Homo sapiens
agccaguacagagaaauucu

SEQ ID NO: 1512105 - RNA, 14 nt, Homo sapiens
agcccagaaccaca

SEQ ID NO: 1512106 - RNA, 14 nt, Homo sapiens
agcccagccauuac

SEQ ID NO: 1512107 - RNA, 15 nt, Homo sapiens
agcccauaaagcaag

SEQ ID NO: 1512108 - RNA, 21 nt, Homo sapiens
agcccauuggcucccaucuga

SEQ ID NO: 1512109 - RNA, 20 nt, Homo sapiens
agcccuguguauaaagccau

SEQ ID NO: 1512110 - RNA, 18 nt, Homo sapiens
agccggggguggugacau

SEQ ID NO: 1512111 - RNA, 22 nt, Homo sapiens
agccggggguggugacaugugc

SEQ ID NO: 1512112 - RNA, 14 nt, Homo sapiens
agccuagaacaucc

SEQ ID NO: 1512113 - RNA, 17 nt, Homo sapiens
agccucccgaguagcug

SEQ ID NO: 1512114 - RNA, 18 nt, Homo sapiens
agccucccgaguagcugg

SEQ ID NO: 1512115 - RNA, 19 nt, Homo sapiens
agccuccuagggcuuauca

SEQ ID NO: 1512116 - RNA, 14 nt, Homo sapiens
agccuccugaccug

SEQ ID NO: 1512117 - RNA, 14 nt, Homo sapiens
agccucuccaggaa

SEQ ID NO: 1512118 - RNA, 19 nt, Homo sapiens
agccugacugcacacagcu

SEQ ID NO: 1512119 - RNA, 20 nt, Homo sapiens
agccugauuauccuauaggc

SEQ ID NO: 1512120 - RNA, 22 nt, Homo sapiens
agccugccuccuucagugacaa

SEQ ID NO: 1512121 - RNA, 22 nt, Homo sapiens
agccuggagggaugccacccag

SEQ ID NO: 1512122 - RNA, 21 nt, Homo sapiens
agccuggcaaggcauuccuca

SEQ ID NO: 1512123 - RNA, 14 nt, Homo sapiens
agccuguauagaca

SEQ ID NO: 1512124 - RNA, 14 nt, Homo sapiens
agcgaaucaucuca

SEQ ID NO: 1512125 - RNA, 18 nt, Homo sapiens
agcgaugaauuuggagac

SEQ ID NO: 1512126 - RNA, 14 nt, Homo sapiens
agcgcgugcacagc

SEQ ID NO: 1512127 - RNA, 15 nt, Homo sapiens
agcggagcuugccug

SEQ ID NO: 1512128 - RNA, 21 nt, Homo sapiens
agcguguguauccgacucuaa

SEQ ID NO: 1512129 - RNA, 17 nt, Homo sapiens
agcuaaacauugugaug

SEQ ID NO: 1512130 - RNA, 15 nt, Homo sapiens
agcuaaaugcaggga

SEQ ID NO: 1512131 - RNA, 12 nt, Homo sapiens
agcuaaguagaa

SEQ ID NO: 1512132 - RNA, 22 nt, Homo sapiens
agcuaaucucgguagaugucau

SEQ ID NO: 1512133 - RNA, 19 nt, Homo sapiens
agcuacucagaagccugag

SEQ ID NO: 1512134 - RNA, 21 nt, Homo sapiens
agcuacugccgucagugcugu

SEQ ID NO: 1512135 - RNA, 19 nt, Homo sapiens
agcuaggaugguucuguga

SEQ ID NO: 1512136 - RNA, 21 nt, Homo sapiens
agcuaggaugguucugugacc

SEQ ID NO: 1512137 - RNA, 16 nt, Homo sapiens
agcuaugaucgcgcca

SEQ ID NO: 1512138 - RNA, 18 nt, Homo sapiens
agcucacugguccauuuc

SEQ ID NO: 1512139 - RNA, 14 nt, Homo sapiens
agcucaucacugug

SEQ ID NO: 1512140 - RNA, 18 nt, Homo sapiens
agcucccgagcuacucuc

SEQ ID NO: 1512141 - RNA, 16 nt, Homo sapiens
agcuccucugagccau

SEQ ID NO: 1512142 - RNA, 16 nt, Homo sapiens
agcuccucugcugcuc

SEQ ID NO: 1512143 - RNA, 13 nt, Homo sapiens
agcucucagggcu

SEQ ID NO: 1512144 - RNA, 17 nt, Homo sapiens
agcucucaucacuaccu

SEQ ID NO: 1512145 - RNA, 14 nt, Homo sapiens
agcucucuuuccca

SEQ ID NO: 1512146 - RNA, 18 nt, Homo sapiens
agcucuguauggucagga

SEQ ID NO: 1512147 - RNA, 21 nt, Homo sapiens
agcucuguauggucaggaugu

SEQ ID NO: 1512148 - RNA, 18 nt, Homo sapiens
agcugacuguucuuggua

SEQ ID NO: 1512149 - RNA, 20 nt, Homo sapiens
agcuggagggagguggggca

SEQ ID NO: 1512150 - RNA, 14 nt, Homo sapiens
agcugguaaacuau

SEQ ID NO: 1512151 - RNA, 19 nt, Homo sapiens
agcuugccguaggauuugg

SEQ ID NO: 1512152 - RNA, 15 nt, Homo sapiens
agcuugccugccugc

SEQ ID NO: 1512153 - RNA, 14 nt, Homo sapiens
aggaaaaaugcugc

SEQ ID NO: 1512154 - RNA, 15 nt, Homo sapiens
aggaaaaaugcugcu

SEQ ID NO: 1512155 - RNA, 15 nt, Homo sapiens
aggaaaaccagugaa

SEQ ID NO: 1512156 - RNA, 15 nt, Homo sapiens
aggaaaccuuuucau

SEQ ID NO: 1512157 - RNA, 21 nt, Homo sapiens
aggaaaccuuuucaugccuuu

SEQ ID NO: 1512158 - RNA, 12 nt, Homo sapiens
aggaaagacaca

SEQ ID NO: 1512159 - RNA, 15 nt, Homo sapiens
aggaaauaauugcca

SEQ ID NO: 1512160 - RNA, 15 nt, Homo sapiens
aggaacaagagaaaa

SEQ ID NO: 1512161 - RNA, 20 nt, Homo sapiens
aggaacguugccacaccaau

SEQ ID NO: 1512162 - RNA, 20 nt, Homo sapiens
aggaagauuaaaaccacaga

SEQ ID NO: 1512163 - RNA, 14 nt, Homo sapiens
aggaaggacugugc

SEQ ID NO: 1512164 - RNA, 15 nt, Homo sapiens
aggaagggcauccuu

SEQ ID NO: 1512165 - RNA, 15 nt, Homo sapiens
aggaagguggugcuu

SEQ ID NO: 1512166 - RNA, 17 nt, Homo sapiens
aggaaguucaacuucca

SEQ ID NO: 1512167 - RNA, 18 nt, Homo sapiens
aggaauaggcaaaauguu

SEQ ID NO: 1512168 - RNA, 14 nt, Homo sapiens
aggaaucugccauu

SEQ ID NO: 1512169 - RNA, 13 nt, Homo sapiens
aggacucaaaagu

SEQ ID NO: 1512170 - RNA, 19 nt, Homo sapiens
aggagacaagaaauccagu

SEQ ID NO: 1512171 - RNA, 19 nt, Homo sapiens
aggagauuuuccuuccuac

SEQ ID NO: 1512172 - RNA, 13 nt, Homo sapiens
aggagcagcuuca

SEQ ID NO: 1512173 - RNA, 20 nt, Homo sapiens
aggaggcggagguugcagug

SEQ ID NO: 1512174 - RNA, 22 nt, Homo sapiens
aggagggaugcugccugaguca

SEQ ID NO: 1512175 - RNA, 22 nt, Homo sapiens
aggaggggcccacaauggagug

SEQ ID NO: 1512176 - RNA, 13 nt, Homo sapiens
aggagggugcagu

SEQ ID NO: 1512177 - RNA, 13 nt, Homo sapiens
aggaugggaccaa

SEQ ID NO: 1512178 - RNA, 16 nt, Homo sapiens
aggauguuuuucauga

SEQ ID NO: 1512179 - RNA, 15 nt, Homo sapiens
aggauuacuacuuug

SEQ ID NO: 1512180 - RNA, 23 nt, Homo sapiens
aggauuuuugguauacagguggu

SEQ ID NO: 1512181 - RNA, 15 nt, Homo sapiens
aggcaccugcuggaa

SEQ ID NO: 1512182 - RNA, 23 nt, Homo sapiens
aggcacuguggcccuucugucca

SEQ ID NO: 1512183 - RNA, 15 nt, Homo sapiens
aggcaggaggaucac

SEQ ID NO: 1512184 - RNA, 15 nt, Homo sapiens
aggcaggcacugugg

SEQ ID NO: 1512185 - RNA, 13 nt, Homo sapiens
aggccacauugac

SEQ ID NO: 1512186 - RNA, 18 nt, Homo sapiens
aggccaggaaucugccau

SEQ ID NO: 1512187 - RNA, 20 nt, Homo sapiens
aggccaggugcaguggcuca

SEQ ID NO: 1512188 - RNA, 16 nt, Homo sapiens
aggccgcaagaggcau

SEQ ID NO: 1512189 - RNA, 22 nt, Homo sapiens
aggccuccugugacuggcagca

SEQ ID NO: 1512190 - RNA, 12 nt, Homo sapiens
aggcucuuccau

SEQ ID NO: 1512191 - RNA, 22 nt, Homo sapiens
aggcugagcuggcauuggucug

SEQ ID NO: 1512192 - RNA, 17 nt, Homo sapiens
aggcugaggcaggagaa

SEQ ID NO: 1512193 - RNA, 18 nt, Homo sapiens
agggaacgggguccuuca

SEQ ID NO: 1512194 - RNA, 20 nt, Homo sapiens
agggaagagugcauuuuccc

SEQ ID NO: 1512195 - RNA, 22 nt, Homo sapiens
agggaaggaacucuggcuucca

SEQ ID NO: 1512196 - RNA, 22 nt, Homo sapiens
agggaauauuuuagaaccacaa

SEQ ID NO: 1512197 - RNA, 17 nt, Homo sapiens
agggagaggaagcacac

SEQ ID NO: 1512198 - RNA, 21 nt, Homo sapiens
agggagcaacucuccacucca

SEQ ID NO: 1512199 - RNA, 20 nt, Homo sapiens
agggcagucaguaguauucu

SEQ ID NO: 1512200 - RNA, 19 nt, Homo sapiens
agggcggugaacucuggcu

SEQ ID NO: 1512201 - RNA, 21 nt, Homo sapiens
agggguaauauauugcugcug

SEQ ID NO: 1512202 - RNA, 19 nt, Homo sapiens
agggguacauuucccugug

SEQ ID NO: 1512203 - RNA, 22 nt, Homo sapiens
agggguacauuucccugugcug

SEQ ID NO: 1512204 - RNA, 23 nt, Homo sapiens
aggggugcuaugacaugcaagug

SEQ ID NO: 1512205 - RNA, 23 nt, Homo sapiens
agggucggggcuaggguaggggc

SEQ ID NO: 1512206 - RNA, 19 nt, Homo sapiens
agggugaauaaagcaggga

SEQ ID NO: 1512207 - RNA, 16 nt, Homo sapiens
agggugcuaacguauc

SEQ ID NO: 1512208 - RNA, 22 nt, Homo sapiens
aggguuuuaguuuuuaauuuau

SEQ ID NO: 1512209 - RNA, 22 nt, Homo sapiens
agguaaguggcaggacccuguc

SEQ ID NO: 1512210 - RNA, 17 nt, Homo sapiens
agguaauuuuucaccuu

SEQ ID NO: 1512211 - RNA, 16 nt, Homo sapiens
caagagaucagcagug

SEQ ID NO: 1512212 - RNA, 21 nt, Homo sapiens
caagaggugguagaaccacuu

SEQ ID NO: 1512213 - RNA, 14 nt, Homo sapiens
caagaucaacauuc

SEQ ID NO: 1512214 - RNA, 13 nt, Homo sapiens
caagaucuuucag

SEQ ID NO: 1512215 - RNA, 16 nt, Homo sapiens
caagauuuucuacuuu

SEQ ID NO: 1512216 - RNA, 14 nt, Homo sapiens
caagcaaggccaaa

SEQ ID NO: 1512217 - RNA, 22 nt, Homo sapiens
caagcacuggacuacaagggca

SEQ ID NO: 1512218 - RNA, 20 nt, Homo sapiens
caagcaucaguagcugagug

SEQ ID NO: 1512219 - RNA, 21 nt, Homo sapiens
caagcauucagaagaaaaaga

SEQ ID NO: 1512220 - RNA, 15 nt, Homo sapiens
caagccugcagcgag

SEQ ID NO: 1512221 - RNA, 24 nt, Homo sapiens
caagccugcagcgagcugagauca

SEQ ID NO: 1512222 - RNA, 14 nt, Homo sapiens
caagccuuacucac

SEQ ID NO: 1512223 - RNA, 15 nt, Homo sapiens
caagcuauuucucug

SEQ ID NO: 1512224 - RNA, 16 nt, Homo sapiens
caaggaaaaaugcugc

SEQ ID NO: 1512225 - RNA, 17 nt, Homo sapiens
caaggaaaaaugcugcu

SEQ ID NO: 1512226 - RNA, 18 nt, Homo sapiens
caaggaaaaaugcugcuu

SEQ ID NO: 1512227 - RNA, 23 nt, Homo sapiens
caaggaaaaaugcugcuucuccu

SEQ ID NO: 1512228 - RNA, 13 nt, Homo sapiens
caaggaaacucga

SEQ ID NO: 1512229 - RNA, 15 nt, Homo sapiens
caaggaaacucgaau

SEQ ID NO: 1512230 - RNA, 13 nt, Homo sapiens
caaggaauccuga

SEQ ID NO: 1512231 - RNA, 16 nt, Homo sapiens
caaggacaaccugccc

SEQ ID NO: 1512232 - RNA, 20 nt, Homo sapiens
caaggagucagauggcaaug

SEQ ID NO: 1512233 - RNA, 16 nt, Homo sapiens
caaggaucucaaagaa

SEQ ID NO: 1512234 - RNA, 15 nt, Homo sapiens
caagggaucugccau

SEQ ID NO: 1512235 - RNA, 16 nt, Homo sapiens
caaggugaauagcaca

SEQ ID NO: 1512236 - RNA, 19 nt, Homo sapiens
caaguacauggcuagcuuu

SEQ ID NO: 1512237 - RNA, 13 nt, Homo sapiens
caaguagggcaca

SEQ ID NO: 1512238 - RNA, 15 nt, Homo sapiens
caagucaacacucuu

SEQ ID NO: 1512239 - RNA, 17 nt, Homo sapiens
caagucaacacucuucu

SEQ ID NO: 1512240 - RNA, 12 nt, Homo sapiens
caaguccagagc

SEQ ID NO: 1512241 - RNA, 21 nt, Homo sapiens
caaguccugugaauuucuuca

SEQ ID NO: 1512242 - RNA, 13 nt, Homo sapiens
caagucuagcuuu

SEQ ID NO: 1512243 - RNA, 20 nt, Homo sapiens
caaguguaaccuugcaucuc

SEQ ID NO: 1512244 - RNA, 22 nt, Homo sapiens
caaguuggaaauauucaugcuu

SEQ ID NO: 1512245 - RNA, 19 nt, Homo sapiens
caauaccccuguuaagcaa

SEQ ID NO: 1512246 - RNA, 22 nt, Homo sapiens
caauagacugaagagaccacag

SEQ ID NO: 1512247 - RNA, 15 nt, Homo sapiens
caauaggugcaaaaa

SEQ ID NO: 1512248 - RNA, 18 nt, Homo sapiens
caauaugggcucaaguca

SEQ ID NO: 1512249 - RNA, 16 nt, Homo sapiens
caauccccaagcuggc

SEQ ID NO: 1512250 - RNA, 18 nt, Homo sapiens
caaucuggcuuagugcca

SEQ ID NO: 1512251 - RNA, 19 nt, Homo sapiens
caaucuucggggugugaug

SEQ ID NO: 1512252 - RNA, 22 nt, Homo sapiens
caaugaaaaaaaguacauguau

SEQ ID NO: 1512253 - RNA, 18 nt, Homo sapiens
caaugaaaccaaagccag

SEQ ID NO: 1512254 - RNA, 17 nt, Homo sapiens
caauggagucugcagug

SEQ ID NO: 1512255 - RNA, 18 nt, Homo sapiens
caaugguaaaaugaguga

SEQ ID NO: 1512256 - RNA, 20 nt, Homo sapiens
caauguucaguuuuccuuag

SEQ ID NO: 1512257 - RNA, 20 nt, Homo sapiens
caauuuaagggcucagcaua

SEQ ID NO: 1512258 - RNA, 19 nt, Homo sapiens
caauuuaauuccauaauca

SEQ ID NO: 1512259 - RNA, 18 nt, Homo sapiens
cacaaagaguaguuaaaa

SEQ ID NO: 1512260 - RNA, 17 nt, Homo sapiens
cacaaauuucaucuccu

SEQ ID NO: 1512261 - RNA, 19 nt, Homo sapiens
cacaaggucuuuaaaguga

SEQ ID NO: 1512262 - RNA, 14 nt, Homo sapiens
cacaaguccuguga

SEQ ID NO: 1512263 - RNA, 14 nt, Homo sapiens
cacacauguuuaca

SEQ ID NO: 1512264 - RNA, 20 nt, Homo sapiens
cacacccgccgccuccugca

SEQ ID NO: 1512265 - RNA, 18 nt, Homo sapiens
cacacuuguauauugaaa

SEQ ID NO: 1512266 - RNA, 16 nt, Homo sapiens
cacagaaacauuuuca

SEQ ID NO: 1512267 - RNA, 14 nt, Homo sapiens
cacagaaugugaua

SEQ ID NO: 1512268 - RNA, 19 nt, Homo sapiens
cacagagaugcaugcgcag

SEQ ID NO: 1512269 - RNA, 17 nt, Homo sapiens
cacagaggcaguaggaa

SEQ ID NO: 1512270 - RNA, 22 nt, Homo sapiens
cacagaggcaguaggaacccag

SEQ ID NO: 1512271 - RNA, 18 nt, Homo sapiens
cacagaugauaauaugcu

SEQ ID NO: 1512272 - RNA, 15 nt, Homo sapiens
cacagcagcugaaca

SEQ ID NO: 1512273 - RNA, 18 nt, Homo sapiens
cacagcccagaaccacag

SEQ ID NO: 1512274 - RNA, 17 nt, Homo sapiens
cacagccuuugcuucca

SEQ ID NO: 1512275 - RNA, 23 nt, Homo sapiens
cacagcugagagacuuuuaauca

SEQ ID NO: 1512276 - RNA, 14 nt, Homo sapiens
cacauaaacuuuau

SEQ ID NO: 1512277 - RNA, 18 nt, Homo sapiens
cacaucaaaaaccuggag

SEQ ID NO: 1512278 - RNA, 15 nt, Homo sapiens
cacaucccuuugaaa

SEQ ID NO: 1512279 - RNA, 17 nt, Homo sapiens
cacaugcaucaucagcc

SEQ ID NO: 1512280 - RNA, 14 nt, Homo sapiens
cacauggacacaga

SEQ ID NO: 1512281 - RNA, 15 nt, Homo sapiens
cacauggacacagac

SEQ ID NO: 1512282 - RNA, 16 nt, Homo sapiens
cacaugucuguccuca

SEQ ID NO: 1512283 - RNA, 20 nt, Homo sapiens
cacauguuauccacaagcaa

SEQ ID NO: 1512284 - RNA, 17 nt, Homo sapiens
cacauguugcuaaugac

SEQ ID NO: 1512285 - RNA, 18 nt, Homo sapiens
cacauucccaucugucac

SEQ ID NO: 1512286 - RNA, 23 nt, Homo sapiens
cacauucuuaacacauguccuug

SEQ ID NO: 1512287 - RNA, 20 nt, Homo sapiens
caccaagggaucugccauug

SEQ ID NO: 1512288 - RNA, 17 nt, Homo sapiens
caccacugcacuccagc

SEQ ID NO: 1512289 - RNA, 14 nt, Homo sapiens
caccagacccaccu

SEQ ID NO: 1512290 - RNA, 18 nt, Homo sapiens
caccauccacccugcagg

SEQ ID NO: 1512291 - RNA, 16 nt, Homo sapiens
cacccaccucaccaaa

SEQ ID NO: 1512292 - RNA, 22 nt, Homo sapiens
cacccauagugcacacuuguau

SEQ ID NO: 1512293 - RNA, 14 nt, Homo sapiens
cacccaugugccaa

SEQ ID NO: 1512294 - RNA, 16 nt, Homo sapiens
caccccuuauccagga

SEQ ID NO: 1512295 - RNA, 16 nt, Homo sapiens
cacccgacuccucaaa

SEQ ID NO: 1512296 - RNA, 14 nt, Homo sapiens
caccgcagaaggaa

SEQ ID NO: 1512297 - RNA, 13 nt, Homo sapiens
caccucuuccuuc

SEQ ID NO: 1512298 - RNA, 17 nt, Homo sapiens
caccucuuuaaccacuc

SEQ ID NO: 1512299 - RNA, 22 nt, Homo sapiens
caccugcuggaaaccacacuuc

SEQ ID NO: 1512300 - RNA, 16 nt, Homo sapiens
caccuuaguggcuuuu

SEQ ID NO: 1512301 - RNA, 22 nt, Homo sapiens
cacgccuguaaucccagcacuu

SEQ ID NO: 1512302 - RNA, 19 nt, Homo sapiens
cacggcagcuguagcuccc

SEQ ID NO: 1512303 - RNA, 20 nt, Homo sapiens
cacgggguauuuuaggcagg

SEQ ID NO: 1512304 - RNA, 21 nt, Homo sapiens
cacgucugcagaaacagugca

SEQ ID NO: 1512305 - RNA, 23 nt, Homo sapiens
cacuaaagaaaaacuaaugucag

SEQ ID NO: 1512306 - RNA, 12 nt, Homo sapiens
cacuaccuuuau

SEQ ID NO: 1512307 - RNA, 13 nt, Homo sapiens
cacuagacaagcc

SEQ ID NO: 1512308 - RNA, 21 nt, Homo sapiens
cacuccagaauccacaaagcc

SEQ ID NO: 1512309 - RNA, 20 nt, Homo sapiens
cacugaggcagguucgugcc

SEQ ID NO: 1512310 - RNA, 11 nt, Homo sapiens
cacugaucaau

SEQ ID NO: 1512311 - RNA, 19 nt, Homo sapiens
cacugcaggggccgagcca

SEQ ID NO: 1512312 - RNA, 24 nt, Homo sapiens
cacugccccugcaccugcuucuca

SEQ ID NO: 1512313 - RNA, 15 nt, Homo sapiens
cacuguuugccccag

SEQ ID NO: 1512314 - RNA, 13 nt, Homo sapiens
cacuugaagccaa

SEQ ID NO: 1512315 - RNA, 18 nt, Homo sapiens
cacuuggcugcucauucc

SEQ ID NO: 1512316 - RNA, 15 nt, Homo sapiens
cacuuuaaaaccucu

SEQ ID NO: 1512317 - RNA, 13 nt, Homo sapiens
cacuuuccuacaa

SEQ ID NO: 1512318 - RNA, 12 nt, Homo sapiens
cacuuuuuuaca

SEQ ID NO: 1512319 - RNA, 19 nt, Homo sapiens
cagaaaguggccaugccac

SEQ ID NO: 1512320 - RNA, 16 nt, Homo sapiens
cagaacaauucugcag

SEQ ID NO: 1512321 - RNA, 23 nt, Homo sapiens
cagaagagguugggcuuccaugc

SEQ ID NO: 1512322 - RNA, 14 nt, Homo sapiens
cagaagugaccaaa

SEQ ID NO: 1512323 - RNA, 22 nt, Homo sapiens
cagaauaauucuuccagugcaa

SEQ ID NO: 1512324 - RNA, 20 nt, Homo sapiens
cagaaucgcuaauagaacca

SEQ ID NO: 1512325 - RNA, 23 nt, Homo sapiens
cagaaucucauagguugccaaua

SEQ ID NO: 1512326 - RNA, 19 nt, Homo sapiens
cagaaugcgcaagggcaaa

SEQ ID NO: 1512327 - RNA, 22 nt, Homo sapiens
cagaauguuuuuaaaauaugag

SEQ ID NO: 1512328 - RNA, 22 nt, Homo sapiens
cagacauuuucaauaaugugaa

SEQ ID NO: 1512329 - RNA, 16 nt, Homo sapiens
cagaccaguacuggga

SEQ ID NO: 1512330 - RNA, 17 nt, Homo sapiens
cagaccaguacugggaa

SEQ ID NO: 1512331 - RNA, 15 nt, Homo sapiens
cagacgucucaagac

SEQ ID NO: 1512332 - RNA, 19 nt, Homo sapiens
cagacgucucaagacugaa

SEQ ID NO: 1512333 - RNA, 14 nt, Homo sapiens
cagacuuuaccacu

SEQ ID NO: 1512334 - RNA, 17 nt, Homo sapiens
cagagacuuggggacca

SEQ ID NO: 1512335 - RNA, 23 nt, Homo sapiens
cagagagggcagagggguaggca

SEQ ID NO: 1512336 - RNA, 16 nt, Homo sapiens
cagagauaauugccau

SEQ ID NO: 1512337 - RNA, 22 nt, Homo sapiens
cagagaugcaugcgcaggcuca

SEQ ID NO: 1512338 - RNA, 20 nt, Homo sapiens
cagagcaagacuccauuuca

SEQ ID NO: 1512339 - RNA, 19 nt, Homo sapiens
cagagccuucaagugccaa

SEQ ID NO: 1512340 - RNA, 20 nt, Homo sapiens
cagagccuucaagugccaaa

SEQ ID NO: 1512341 - RNA, 14 nt, Homo sapiens
cagagcuuccucag

SEQ ID NO: 1512342 - RNA, 19 nt, Homo sapiens
cagaggggaaagacuucca

SEQ ID NO: 1512343 - RNA, 20 nt, Homo sapiens
cagaggugacccaaugcucc

SEQ ID NO: 1512344 - RNA, 11 nt, Homo sapiens
cagagugugaa

SEQ ID NO: 1512345 - RNA, 20 nt, Homo sapiens
uagaaguaauaugcucucau

SEQ ID NO: 1512346 - RNA, 14 nt, Homo sapiens
uagacaagccagaa

SEQ ID NO: 1512347 - RNA, 12 nt, Homo sapiens
uagagcacugcc

SEQ ID NO: 1512348 - RNA, 20 nt, Homo sapiens
uagagggagaggaagcacac

SEQ ID NO: 1512349 - RNA, 15 nt, Homo sapiens
uagagguuugucaac

SEQ ID NO: 1512350 - RNA, 15 nt, Homo sapiens
uagauccauuuggac

SEQ ID NO: 1512351 - RNA, 11 nt, Homo sapiens
uagaucuggca

SEQ ID NO: 1512352 - RNA, 17 nt, Homo sapiens
uagauguuacuguguga

SEQ ID NO: 1512353 - RNA, 17 nt, Homo sapiens
uagauuaguauuuucca

SEQ ID NO: 1512354 - RNA, 13 nt, Homo sapiens
uagcaauuccagg

SEQ ID NO: 1512355 - RNA, 16 nt, Homo sapiens
uagcacagguuagggu

SEQ ID NO: 1512356 - RNA, 21 nt, Homo sapiens
uagcauuuucuugaaccaaua

SEQ ID NO: 1512357 - RNA, 15 nt, Homo sapiens
uagccauaugcaaua

SEQ ID NO: 1512358 - RNA, 16 nt, Homo sapiens
uagccuaauacaacau

SEQ ID NO: 1512359 - RNA, 20 nt, Homo sapiens
uagccuaauacaacauguag

SEQ ID NO: 1512360 - RNA, 21 nt, Homo sapiens
uagcuaacguguccgaaacca

SEQ ID NO: 1512361 - RNA, 19 nt, Homo sapiens
uagcucucaucacuaccuu

SEQ ID NO: 1512362 - RNA, 18 nt, Homo sapiens
uagcugggacuacaggug

SEQ ID NO: 1512363 - RNA, 11 nt, Homo sapiens
uagcugucacc

SEQ ID NO: 1512364 - RNA, 20 nt, Homo sapiens
uagcuuguauaguguaaaau

SEQ ID NO: 1512365 - RNA, 21 nt, Homo sapiens
uaggaaaccuggcauggugcu

SEQ ID NO: 1512366 - RNA, 19 nt, Homo sapiens
uaggaagaaaucacuuaaa

SEQ ID NO: 1512367 - RNA, 17 nt, Homo sapiens
uaggacauauaccuucu

SEQ ID NO: 1512368 - RNA, 16 nt, Homo sapiens
uaggaggaaaagacag

SEQ ID NO: 1512369 - RNA, 17 nt, Homo sapiens
uaggcaugccugggaau

SEQ ID NO: 1512370 - RNA, 17 nt, Homo sapiens
uagggaugacugugauu

SEQ ID NO: 1512371 - RNA, 22 nt, Homo sapiens
uaggucaagcuauuucucugga

SEQ ID NO: 1512372 - RNA, 20 nt, Homo sapiens
uagguuugucaacacaaaga

SEQ ID NO: 1512373 - RNA, 16 nt, Homo sapiens
uagguuuuuaugggaa

SEQ ID NO: 1512374 - RNA, 14 nt, Homo sapiens
uaguaacauagaca

SEQ ID NO: 1512375 - RNA, 22 nt, Homo sapiens
uaguaauuguaaguaccccuga

SEQ ID NO: 1512376 - RNA, 14 nt, Homo sapiens
uaguagcauuucaa

SEQ ID NO: 1512377 - RNA, 13 nt, Homo sapiens
uaguaucucuggc

SEQ ID NO: 1512378 - RNA, 13 nt, Homo sapiens
uagugaacuugaa

SEQ ID NO: 1512379 - RNA, 14 nt, Homo sapiens
uagugccacccacc

SEQ ID NO: 1512380 - RNA, 22 nt, Homo sapiens
uagugggccaccccuaaucacu

SEQ ID NO: 1512381 - RNA, 18 nt, Homo sapiens
uaguguccaaauucucac

SEQ ID NO: 1512382 - RNA, 15 nt, Homo sapiens
uaguuauuuacuuga

SEQ ID NO: 1512383 - RNA, 20 nt, Homo sapiens
uaguucagaggaagcacaua

SEQ ID NO: 1512384 - RNA, 22 nt, Homo sapiens
uaguuuaauuaacuaugugaug

SEQ ID NO: 1512385 - RNA, 17 nt, Homo sapiens
uaguuuugaaacuagaa

SEQ ID NO: 1512386 - RNA, 12 nt, Homo sapiens
uaguuuuuaccu

SEQ ID NO: 1512387 - RNA, 13 nt, Homo sapiens
uauaaaaagugaa

SEQ ID NO: 1512388 - RNA, 22 nt, Homo sapiens
uauaaacauugguauauuucca

SEQ ID NO: 1512389 - RNA, 21 nt, Homo sapiens
uauaaccagacacauacucau

SEQ ID NO: 1512390 - RNA, 20 nt, Homo sapiens
uauaagaggacuguaguuua

SEQ ID NO: 1512391 - RNA, 16 nt, Homo sapiens
uauaaucccacccacc

SEQ ID NO: 1512392 - RNA, 19 nt, Homo sapiens
uauaaucccacccaccuca

SEQ ID NO: 1512393 - RNA, 19 nt, Homo sapiens
uauaaugaacacgugggua

SEQ ID NO: 1512394 - RNA, 19 nt, Homo sapiens
uauacagauucuagccaaa

SEQ ID NO: 1512395 - RNA, 13 nt, Homo sapiens
uauacuuugcaau

SEQ ID NO: 1512396 - RNA, 14 nt, Homo sapiens
uauagucacaagag

SEQ ID NO: 1512397 - RNA, 13 nt, Homo sapiens
uauauaguagcau

SEQ ID NO: 1512398 - RNA, 14 nt, Homo sapiens
uauauauguauaua

SEQ ID NO: 1512399 - RNA, 15 nt, Homo sapiens
uauaugcuauucaau

SEQ ID NO: 1512400 - RNA, 14 nt, Homo sapiens
uauauugcaaaaac

SEQ ID NO: 1512401 - RNA, 15 nt, Homo sapiens
uauauugcaaaaaca

SEQ ID NO: 1512402 - RNA, 15 nt, Homo sapiens
uauauugcugcuggu

SEQ ID NO: 1512403 - RNA, 21 nt, Homo sapiens
uauauuggucauugccuugcc

SEQ ID NO: 1512404 - RNA, 17 nt, Homo sapiens
uauauuuccauucaugc

SEQ ID NO: 1512405 - RNA, 17 nt, Homo sapiens
uauauuugaauaucauu

SEQ ID NO: 1512406 - RNA, 20 nt, Homo sapiens
uauauuugugugugugauau

SEQ ID NO: 1512407 - RNA, 15 nt, Homo sapiens
uaucaaaaaguauua

SEQ ID NO: 1512408 - RNA, 19 nt, Homo sapiens
uauccaauaggcauuugau

SEQ ID NO: 1512409 - RNA, 21 nt, Homo sapiens
uauccacaucuuuaaguauug

SEQ ID NO: 1512410 - RNA, 17 nt, Homo sapiens
uauccaggacucuguca

SEQ ID NO: 1512411 - RNA, 22 nt, Homo sapiens
uauccguagaguagucaugaca

SEQ ID NO: 1512412 - RNA, 19 nt, Homo sapiens
uaucgucuuccuacacaua

SEQ ID NO: 1512413 - RNA, 16 nt, Homo sapiens
uaucucggaccuuuca

SEQ ID NO: 1512414 - RNA, 20 nt, Homo sapiens
uaucuucaggacuauuucac

SEQ ID NO: 1512415 - RNA, 14 nt, Homo sapiens
uaucuuuaucuuua

SEQ ID NO: 1512416 - RNA, 13 nt, Homo sapiens
uaugaacuugagg

SEQ ID NO: 1512417 - RNA, 15 nt, Homo sapiens
uaugaagucccucua

SEQ ID NO: 1512418 - RNA, 23 nt, Homo sapiens
uaugauaacuauuuacauauaau

SEQ ID NO: 1512419 - RNA, 14 nt, Homo sapiens
uaugcagaauguuu

SEQ ID NO: 1512420 - RNA, 15 nt, Homo sapiens
uaugccuuaagccaa

SEQ ID NO: 1512421 - RNA, 16 nt, Homo sapiens
uaugccuuaagccaau

SEQ ID NO: 1512422 - RNA, 13 nt, Homo sapiens
uaugcuaauugaa

SEQ ID NO: 1512423 - RNA, 14 nt, Homo sapiens
uauggcgaacacag

SEQ ID NO: 1512424 - RNA, 19 nt, Homo sapiens
uauggcuuuuagcauuuau

SEQ ID NO: 1512425 - RNA, 18 nt, Homo sapiens
uauguaccaagaaucuug

SEQ ID NO: 1512426 - RNA, 17 nt, Homo sapiens
uauguauauagaugugc

SEQ ID NO: 1512427 - RNA, 19 nt, Homo sapiens
uauuaugggaaugacucug

SEQ ID NO: 1512428 - RNA, 17 nt, Homo sapiens
uauucucuaagauauau

SEQ ID NO: 1512429 - RNA, 17 nt, Homo sapiens
uauucucuuaauuuuuc

SEQ ID NO: 1512430 - RNA, 14 nt, Homo sapiens
uauucuugucaaaa

SEQ ID NO: 1512431 - RNA, 18 nt, Homo sapiens
uauugacgcauauuuaac

SEQ ID NO: 1512432 - RNA, 15 nt, Homo sapiens
uauugcugcugguaa

SEQ ID NO: 1512433 - RNA, 21 nt, Homo sapiens
uauugucggaagacuugccac

SEQ ID NO: 1512434 - RNA, 14 nt, Homo sapiens
uauuuaaaaguaua

SEQ ID NO: 1512435 - RNA, 14 nt, Homo sapiens
uauuuacauauaau

SEQ ID NO: 1512436 - RNA, 22 nt, Homo sapiens
uauuuacuugaaagaugggucu

SEQ ID NO: 1512437 - RNA, 15 nt, Homo sapiens
uauuuagugaacuac

SEQ ID NO: 1512438 - RNA, 21 nt, Homo sapiens
uauuucaaaacacaucuuucc

SEQ ID NO: 1512439 - RNA, 20 nt, Homo sapiens
uauuucaaaugaacacgugc

SEQ ID NO: 1512440 - RNA, 21 nt, Homo sapiens
uauuugaacuuauuuacacau

SEQ ID NO: 1512441 - RNA, 15 nt, Homo sapiens
uauuugucugacaaa

SEQ ID NO: 1512442 - RNA, 20 nt, Homo sapiens
uauuugugugugugauauau

SEQ ID NO: 1512443 - RNA, 16 nt, Homo sapiens
uauuuuaaaacauaag

SEQ ID NO: 1512444 - RNA, 16 nt, Homo sapiens
uauuuuagaaccacaa

SEQ ID NO: 1512445 - RNA, 21 nt, Homo sapiens
uauuuuuuaaagucuauuguu

SEQ ID NO: 1512446 - RNA, 17 nt, Homo sapiens
uauuuuuuuaagcugua

SEQ ID NO: 1512447 - RNA, 15 nt, Homo sapiens
ucaaaaagacugugg

SEQ ID NO: 1512448 - RNA, 13 nt, Homo sapiens
ucaaaacaaucaa

SEQ ID NO: 1512449 - RNA, 14 nt, Homo sapiens
ucaaacccucaaga

SEQ ID NO: 1512450 - RNA, 19 nt, Homo sapiens
ucaaagaaaaagguccaug

SEQ ID NO: 1512451 - RNA, 14 nt, Homo sapiens
ucaaagcuugccgu

SEQ ID NO: 1512452 - RNA, 17 nt, Homo sapiens
ucaaauauuaccaaaaa

SEQ ID NO: 1512453 - RNA, 18 nt, Homo sapiens
ucaacaaaaagacaugga

SEQ ID NO: 1512454 - RNA, 21 nt, Homo sapiens
ucaacaaguaacuuuguagaa

SEQ ID NO: 1512455 - RNA, 16 nt, Homo sapiens
ucaacaauaaagacug

SEQ ID NO: 1512456 - RNA, 18 nt, Homo sapiens
ucaacaauaaagacugag

SEQ ID NO: 1512457 - RNA, 15 nt, Homo sapiens
ucaacacaaagacau

SEQ ID NO: 1512458 - RNA, 13 nt, Homo sapiens
ucaacgugcauuu

SEQ ID NO: 1512459 - RNA, 21 nt, Homo sapiens
ucaacuagcagaaaauauaaa

SEQ ID NO: 1512460 - RNA, 21 nt, Homo sapiens
ucaacuuaccaggcaccaaaa

SEQ ID NO: 1512461 - RNA, 17 nt, Homo sapiens
ucaacuuauuaacaauu

SEQ ID NO: 1512462 - RNA, 13 nt, Homo sapiens
ucaagacauuucu

SEQ ID NO: 1512463 - RNA, 21 nt, Homo sapiens
ucaagacuugauacugcaaua

SEQ ID NO: 1512464 - RNA, 14 nt, Homo sapiens
ucaagagugcaguu

SEQ ID NO: 1512465 - RNA, 13 nt, Homo sapiens
ucaagauacauag

SEQ ID NO: 1512466 - RNA, 16 nt, Homo sapiens
ucaaguaccaccaagg

SEQ ID NO: 1512467 - RNA, 20 nt, Homo sapiens
ucaaguauuagggguaauau

SEQ ID NO: 1512468 - RNA, 13 nt, Homo sapiens
ucaagugccaaac

SEQ ID NO: 1512469 - RNA, 21 nt, Homo sapiens
ucaagugccuagacuguuacu

SEQ ID NO: 1512470 - RNA, 15 nt, Homo sapiens
ucaauaaaagaauuc

SEQ ID NO: 1512471 - RNA, 15 nt, Homo sapiens
ucaauaaaaguugau

SEQ ID NO: 1512472 - RNA, 22 nt, Homo sapiens
ucaauaccccuguuaagcaauu

SEQ ID NO: 1512473 - RNA, 19 nt, Homo sapiens
ucaaucaucugugugaaaa

SEQ ID NO: 1512474 - RNA, 17 nt, Homo sapiens
ucaauuucccugacucc

SEQ ID NO: 1512475 - RNA, 17 nt, Homo sapiens
ucaauuuuuugcuaaac

SEQ ID NO: 1512476 - RNA, 19 nt, Homo sapiens
ucacaaaaaggcauaugca

SEQ ID NO: 1512477 - RNA, 20 nt, Homo sapiens
ucacaaaaaggcauaugcaa

SEQ ID NO: 1512478 - RNA, 22 nt, Homo sapiens
ucacacagcccauaaagcaaga

SEQ ID NO: 1512479 - RNA, 22 nt, Homo sapiens
ucacaccauuuuguuuagacaa

SEQ ID NO: 1512480 - RNA, 16 nt, Homo sapiens
uuagcugaagaaguua

SEQ ID NO: 1512481 - RNA, 13 nt, Homo sapiens
uuagcuuuugcaa

SEQ ID NO: 1512482 - RNA, 16 nt, Homo sapiens
uuagggaugacuguga

SEQ ID NO: 1512483 - RNA, 15 nt, Homo sapiens
uuaguuuguuuuaca

SEQ ID NO: 1512484 - RNA, 21 nt, Homo sapiens
uuauacaucacagcagugcau

SEQ ID NO: 1512485 - RNA, 13 nt, Homo sapiens
uuauacauuugau

SEQ ID NO: 1512486 - RNA, 17 nt, Homo sapiens
uuauagcucucaucacu

SEQ ID NO: 1512487 - RNA, 16 nt, Homo sapiens
uuauauguaguacuaa

SEQ ID NO: 1512488 - RNA, 21 nt, Homo sapiens
uuaucaacuuccuaaauauua

SEQ ID NO: 1512489 - RNA, 22 nt, Homo sapiens
uuaucuucuagccacaguucua

SEQ ID NO: 1512490 - RNA, 15 nt, Homo sapiens
uuaugcaagcacaaa

SEQ ID NO: 1512491 - RNA, 20 nt, Homo sapiens
uuaugguaccagaugcagcu

SEQ ID NO: 1512492 - RNA, 13 nt, Homo sapiens
uuauguaaucuca

SEQ ID NO: 1512493 - RNA, 14 nt, Homo sapiens
uuaugucucaaaau

SEQ ID NO: 1512494 - RNA, 16 nt, Homo sapiens
uuauuaagauguauaa

SEQ ID NO: 1512495 - RNA, 13 nt, Homo sapiens
uuauuaugucuca

SEQ ID NO: 1512496 - RNA, 23 nt, Homo sapiens
uuauucuuaaguaaggacaaaga

SEQ ID NO: 1512497 - RNA, 13 nt, Homo sapiens
uuauugugccuca

SEQ ID NO: 1512498 - RNA, 22 nt, Homo sapiens
uuauuuaguuggaggccuuuag

SEQ ID NO: 1512499 - RNA, 14 nt, Homo sapiens
uucaaauggacuca

SEQ ID NO: 1512500 - RNA, 21 nt, Homo sapiens
uucaaaugucaguucauaaua

SEQ ID NO: 1512501 - RNA, 12 nt, Homo sapiens
uucaacuccaga

SEQ ID NO: 1512502 - RNA, 12 nt, Homo sapiens
uucaagacuuga

SEQ ID NO: 1512503 - RNA, 15 nt, Homo sapiens
uucaagagugcaguu

SEQ ID NO: 1512504 - RNA, 17 nt, Homo sapiens
uucaaggaaaaaugcug

SEQ ID NO: 1512505 - RNA, 18 nt, Homo sapiens
uucaaggaaaaaugcugc

SEQ ID NO: 1512506 - RNA, 19 nt, Homo sapiens
uucaaggaaaaaugcugcu

SEQ ID NO: 1512507 - RNA, 13 nt, Homo sapiens
uucaagugccaaa

SEQ ID NO: 1512508 - RNA, 12 nt, Homo sapiens
uucaagugccua

SEQ ID NO: 1512509 - RNA, 20 nt, Homo sapiens
uucaagugccuagacuguua

SEQ ID NO: 1512510 - RNA, 18 nt, Homo sapiens
uucaaguuagcucaggag

SEQ ID NO: 1512511 - RNA, 13 nt, Homo sapiens
uucaauacuucau

SEQ ID NO: 1512512 - RNA, 20 nt, Homo sapiens
uucacaaaaaggcauaugca

SEQ ID NO: 1512513 - RNA, 16 nt, Homo sapiens
uucacacugaccaaga

SEQ ID NO: 1512514 - RNA, 18 nt, Homo sapiens
uucacagcccagaaccac

SEQ ID NO: 1512515 - RNA, 20 nt, Homo sapiens
uucacauaaacacauacauu

SEQ ID NO: 1512516 - RNA, 22 nt, Homo sapiens
uucaccaaaucuugguugaugc

SEQ ID NO: 1512517 - RNA, 22 nt, Homo sapiens
uucacuuuagaagguuguauua

SEQ ID NO: 1512518 - RNA, 18 nt, Homo sapiens
uucagaagaaaaagaagc

SEQ ID NO: 1512519 - RNA, 14 nt, Homo sapiens
uucagaagacacug

SEQ ID NO: 1512520 - RNA, 21 nt, Homo sapiens
uucaggaacguugccacacca

SEQ ID NO: 1512521 - RNA, 17 nt, Homo sapiens
uucaggaagaugaaaga

SEQ ID NO: 1512522 - RNA, 19 nt, Homo sapiens
uucaggguuauacacagaa

SEQ ID NO: 1512523 - RNA, 22 nt, Homo sapiens
uucaguuccucuuugcauggaa

SEQ ID NO: 1512524 - RNA, 23 nt, Homo sapiens
uucaguuccucuuugcauggaau

SEQ ID NO: 1512525 - RNA, 18 nt, Homo sapiens
uucauauuuauacuuugc

SEQ ID NO: 1512526 - RNA, 14 nt, Homo sapiens
uucaucagcauuua

SEQ ID NO: 1512527 - RNA, 16 nt, Homo sapiens
uucaucuggauuccag

SEQ ID NO: 1512528 - RNA, 20 nt, Homo sapiens
uuccaaaggcauaagacccu

SEQ ID NO: 1512529 - RNA, 17 nt, Homo sapiens
uuccaagucaacacucu

SEQ ID NO: 1512530 - RNA, 21 nt, Homo sapiens
uuccaaguuccugcacuccag

SEQ ID NO: 1512531 - RNA, 23 nt, Homo sapiens
uuccacuuugaguaccaaaucca

SEQ ID NO: 1512532 - RNA, 20 nt, Homo sapiens
uuccagaaaacaaaacugca

SEQ ID NO: 1512533 - RNA, 15 nt, Homo sapiens
uuccaugauacuuua

SEQ ID NO: 1512534 - RNA, 17 nt, Homo sapiens
uuccaugauacuuuaau

SEQ ID NO: 1512535 - RNA, 21 nt, Homo sapiens
uuccaugggauguuaagcaaa

SEQ ID NO: 1512536 - RNA, 16 nt, Homo sapiens
uuccauuuuacuucca

SEQ ID NO: 1512537 - RNA, 21 nt, Homo sapiens
uuccauuuuacuuccaugaua

SEQ ID NO: 1512538 - RNA, 20 nt, Homo sapiens
uucccaaauaaacucuaaac

SEQ ID NO: 1512539 - RNA, 18 nt, Homo sapiens
uucccgagggagcugcug

SEQ ID NO: 1512540 - RNA, 13 nt, Homo sapiens
uuccuaaccacaa

SEQ ID NO: 1512541 - RNA, 20 nt, Homo sapiens
uuccuaagccuguugcugaa

SEQ ID NO: 1512542 - RNA, 20 nt, Homo sapiens
uuccuaauaaguuugaucaa

SEQ ID NO: 1512543 - RNA, 18 nt, Homo sapiens
uuccuaggucacuugaag

SEQ ID NO: 1512544 - RNA, 18 nt, Homo sapiens
uuccucccugguuugcag

SEQ ID NO: 1512545 - RNA, 23 nt, Homo sapiens
uuccucucugaguggacuggccu

SEQ ID NO: 1512546 - RNA, 15 nt, Homo sapiens
uuccucugcaaaaag

SEQ ID NO: 1512547 - RNA, 18 nt, Homo sapiens
uuccugcuacacaaaagc

SEQ ID NO: 1512548 - RNA, 23 nt, Homo sapiens
uucgcgaauccguaucugcagaa

SEQ ID NO: 1512549 - RNA, 21 nt, Homo sapiens
uucuaacuagaaaucugccaa

SEQ ID NO: 1512550 - RNA, 15 nt, Homo sapiens
uucuaccauuugaau

SEQ ID NO: 1512551 - RNA, 20 nt, Homo sapiens
uucuagaucuggaaccuuac

SEQ ID NO: 1512552 - RNA, 21 nt, Homo sapiens
uucuaggcaguucaaagcagg

SEQ ID NO: 1512553 - RNA, 20 nt, Homo sapiens
uucuauggccauuacuaaca

SEQ ID NO: 1512554 - RNA, 12 nt, Homo sapiens
uucuauuccuau

SEQ ID NO: 1512555 - RNA, 17 nt, Homo sapiens
uucuauuuuaugaaccu

SEQ ID NO: 1512556 - RNA, 23 nt, Homo sapiens
uucuccagacccaccacaccgca

SEQ ID NO: 1512557 - RNA, 17 nt, Homo sapiens
uucuccuguagcacaaa

SEQ ID NO: 1512558 - RNA, 19 nt, Homo sapiens
uucucgugguagaagccag

SEQ ID NO: 1512559 - RNA, 22 nt, Homo sapiens
uucucuguaaccgcuucugggg

SEQ ID NO: 1512560 - RNA, 22 nt, Homo sapiens
uucugaauuauuaugucucaaa

SEQ ID NO: 1512561 - RNA, 22 nt, Homo sapiens
uucugccucacaucagcccugu

SEQ ID NO: 1512562 - RNA, 13 nt, Homo sapiens
uucuggaaaccac

SEQ ID NO: 1512563 - RNA, 13 nt, Homo sapiens
uucuggacaggau

SEQ ID NO: 1512564 - RNA, 19 nt, Homo sapiens
uucuggauuccccaucuca

SEQ ID NO: 1512565 - RNA, 17 nt, Homo sapiens
uucuggugcuacuccau

SEQ ID NO: 1512566 - RNA, 21 nt, Homo sapiens
uucuuaaaauguuaacuggca

SEQ ID NO: 1512567 - RNA, 18 nt, Homo sapiens
uucuuaaucaagaauauu

SEQ ID NO: 1512568 - RNA, 15 nt, Homo sapiens
uucuuacccauauau

SEQ ID NO: 1512569 - RNA, 17 nt, Homo sapiens
uucuuuacuggugauuu

SEQ ID NO: 1512570 - RNA, 13 nt, Homo sapiens
uucuuuucaccuc

SEQ ID NO: 1512571 - RNA, 17 nt, Homo sapiens
uucuuuuucacacugau

SEQ ID NO: 1512572 - RNA, 15 nt, Homo sapiens
uugaaaucugaaugc

SEQ ID NO: 1512573 - RNA, 22 nt, Homo sapiens
uugaacauacucuagugaaugu

SEQ ID NO: 1512574 - RNA, 12 nt, Homo sapiens
uugaacaucuca

SEQ ID NO: 1512575 - RNA, 22 nt, Homo sapiens
uugaacuucauaagguaauuca

SEQ ID NO: 1512576 - RNA, 18 nt, Homo sapiens
uugaagccaaacuguugg

SEQ ID NO: 1512577 - RNA, 14 nt, Homo sapiens
uugaaguaugguug

SEQ ID NO: 1512578 - RNA, 13 nt, Homo sapiens
uugacaacaguua

SEQ ID NO: 1512579 - RNA, 18 nt, Homo sapiens
uugaccggcagaauguuc

SEQ ID NO: 1512580 - RNA, 15 nt, Homo sapiens
uugacuuaaguagaa

SEQ ID NO: 1512581 - RNA, 18 nt, Homo sapiens
uugacuucucuugaauua

SEQ ID NO: 1512582 - RNA, 23 nt, Homo sapiens
uugagaguauauuauguauuuau

SEQ ID NO: 1512583 - RNA, 20 nt, Homo sapiens
uugagauaaugucaaaauca

SEQ ID NO: 1512584 - RNA, 11 nt, Homo sapiens
uugaguaccaa

SEQ ID NO: 1512585 - RNA, 16 nt, Homo sapiens
uugauacguguuccua

SEQ ID NO: 1512586 - RNA, 23 nt, Homo sapiens
uugauagaaaugccaagcacuuc

SEQ ID NO: 1512587 - RNA, 14 nt, Homo sapiens
uugaucucugcuua

SEQ ID NO: 1512588 - RNA, 16 nt, Homo sapiens
uugaugaacugccaaa

SEQ ID NO: 1512589 - RNA, 13 nt, Homo sapiens
uugcaaaauggaa

SEQ ID NO: 1512590 - RNA, 21 nt, Homo sapiens
uugcaaagguuaaaacaaaaa

SEQ ID NO: 1512591 - RNA, 14 nt, Homo sapiens
uugccacacacugu

SEQ ID NO: 1512592 - RNA, 19 nt, Homo sapiens
uugcccuggauuguugaca

SEQ ID NO: 1512593 - RNA, 22 nt, Homo sapiens
uugcuguaacucagacauucca

SEQ ID NO: 1512594 - RNA, 13 nt, Homo sapiens
uugcuuugccaaa

SEQ ID NO: 1512595 - RNA, 14 nt, Homo sapiens
uuggaaagcagucc

SEQ ID NO: 1512596 - RNA, 23 nt, Homo sapiens
uuggaaagcaucaccucaggcca

SEQ ID NO: 1512597 - RNA, 16 nt, Homo sapiens
uuggaaaguucagcca

SEQ ID NO: 1512598 - RNA, 16 nt, Homo sapiens
uuggacuugaggauuu

SEQ ID NO: 1512599 - RNA, 22 nt, Homo sapiens
uuggagagcagcuggcucucca

SEQ ID NO: 1512600 - RNA, 12 nt, Homo sapiens
uuggauuccagu

SEQ ID NO: 1512601 - RNA, 18 nt, Homo sapiens
uuggcugcaggaaucuuu

SEQ ID NO: 1512602 - RNA, 21 nt, Homo sapiens
uugggaugcggggcagagcca

SEQ ID NO: 1512603 - RNA, 22 nt, Homo sapiens
uugguugaacuaugcugaagag

SEQ ID NO: 1512604 - RNA, 17 nt, Homo sapiens
uuguaaguugaagcaaa

SEQ ID NO: 1512605 - RNA, 19 nt, Homo sapiens
uuguaaguuuaugucuaaa

SEQ ID NO: 1512606 - RNA, 19 nt, Homo sapiens
uuguaauaugucugccaca

SEQ ID NO: 1512607 - RNA, 16 nt, Homo sapiens
uuguaccauucaccgu

SEQ ID NO: 1512608 - RNA, 16 nt, Homo sapiens
uuguaggugaaagugu

SEQ ID NO: 1512609 - RNA, 17 nt, Homo sapiens
uugucaaagcuugccgu

SEQ ID NO: 1512610 - RNA, 19 nt, Homo sapiens
uugucaacaaaaagacaug

SEQ ID NO: 1512611 - RNA, 23 nt, Homo sapiens
uugucaacaaaaagacauggaag

SEQ ID NO: 1512612 - RNA, 19 nt, Homo sapiens
uugucaacacaaagacaug

SEQ ID NO: 1512613 - RNA, 17 nt, Homo sapiens
uugucucugcaucucau

SEQ ID NO: 1512614 - RNA, 16 nt, Homo sapiens
auuuuacuuccaugau

SEQ ID NO: 1512615 - RNA, 18 nt, Homo sapiens
auuuuacuuccaugauac

SEQ ID NO: 1512616 - RNA, 21 nt, Homo sapiens
auuuuaggcagggauuugagg

SEQ ID NO: 1512617 - RNA, 21 nt, Homo sapiens
auuuuaugugcuucacauaau

SEQ ID NO: 1512618 - RNA, 16 nt, Homo sapiens
auuuucagucaucuca

SEQ ID NO: 1512619 - RNA, 17 nt, Homo sapiens
auuuucuuuacagguau

SEQ ID NO: 1512620 - RNA, 21 nt, Homo sapiens
auuuuggcccuaccuguaacu

SEQ ID NO: 1512621 - RNA, 14 nt, Homo sapiens
auuuugucuaccau

SEQ ID NO: 1512622 - RNA, 15 nt, Homo sapiens
auuuuguuacacuaa

SEQ ID NO: 1512623 - RNA, 21 nt, Homo sapiens
auuuuuauaaauaugugaaaa

SEQ ID NO: 1512624 - RNA, 22 nt, Homo sapiens
auuuuugaaacccauuaggcau

SEQ ID NO: 1512625 - RNA, 19 nt, Homo sapiens
auuuuugugaaaaugucaa

SEQ ID NO: 1512626 - RNA, 13 nt, Homo sapiens
auuuuugugauuu

SEQ ID NO: 1512627 - RNA, 16 nt, Homo sapiens
auuuuuuuaaaacaca

SEQ ID NO: 1512628 - RNA, 13 nt, Homo sapiens
caaaaaauuugag

SEQ ID NO: 1512629 - RNA, 16 nt, Homo sapiens
caaaaacauaguuugu

SEQ ID NO: 1512630 - RNA, 13 nt, Homo sapiens
caaaacugugcuu

SEQ ID NO: 1512631 - RNA, 14 nt, Homo sapiens
caaaaucaugaaua

SEQ ID NO: 1512632 - RNA, 19 nt, Homo sapiens
caaaauggaaauguaauaa

SEQ ID NO: 1512633 - RNA, 21 nt, Homo sapiens
caaaauggacguacugguuua

SEQ ID NO: 1512634 - RNA, 11 nt, Homo sapiens
caaacaagcac

SEQ ID NO: 1512635 - RNA, 22 nt, Homo sapiens
caaacuaggaggaaaagacaga

SEQ ID NO: 1512636 - RNA, 18 nt, Homo sapiens
caaagaaaacauagcacu

SEQ ID NO: 1512637 - RNA, 17 nt, Homo sapiens
caaagaguaguuaaaag

SEQ ID NO: 1512638 - RNA, 19 nt, Homo sapiens
caaagauaauguuauacau

SEQ ID NO: 1512639 - RNA, 17 nt, Homo sapiens
caaagauauauacacag

SEQ ID NO: 1512640 - RNA, 17 nt, Homo sapiens
caaauaaacucuaaaca

SEQ ID NO: 1512641 - RNA, 16 nt, Homo sapiens
caaauaaagauaaccc

SEQ ID NO: 1512642 - RNA, 22 nt, Homo sapiens
caaaucuccaguauucuuguca

SEQ ID NO: 1512643 - RNA, 14 nt, Homo sapiens
caaaugaacacgug

SEQ ID NO: 1512644 - RNA, 17 nt, Homo sapiens
caaauggacuauacaua

SEQ ID NO: 1512645 - RNA, 15 nt, Homo sapiens
caacaaaaagacaug

SEQ ID NO: 1512646 - RNA, 16 nt, Homo sapiens
caacaaagauugagaa

SEQ ID NO: 1512647 - RNA, 18 nt, Homo sapiens
caacacaaagacauggaa

SEQ ID NO: 1512648 - RNA, 17 nt, Homo sapiens
caacagcugugugugcc

SEQ ID NO: 1512649 - RNA, 22 nt, Homo sapiens
caacagguggcaggaccaggac

SEQ ID NO: 1512650 - RNA, 18 nt, Homo sapiens
caacaguuacauaauuca

SEQ ID NO: 1512651 - RNA, 16 nt, Homo sapiens
caacauaguauucaug

SEQ ID NO: 1512652 - RNA, 21 nt, Homo sapiens
caacaugguaaaaccccaucu

SEQ ID NO: 1512653 - RNA, 16 nt, Homo sapiens
caaccugccugugcau

SEQ ID NO: 1512654 - RNA, 18 nt, Homo sapiens
caaccugccugugcauga

SEQ ID NO: 1512655 - RNA, 13 nt, Homo sapiens
caaccugggaugu

SEQ ID NO: 1512656 - RNA, 14 nt, Homo sapiens
caacgauuagcuuu

SEQ ID NO: 1512657 - RNA, 15 nt, Homo sapiens
caacuuaaugcucug

SEQ ID NO: 1512658 - RNA, 17 nt, Homo sapiens
caacuuauuaacaauua

SEQ ID NO: 1512659 - RNA, 19 nt, Homo sapiens
caacuuggaaaaagaaaga

SEQ ID NO: 1512660 - RNA, 16 nt, Homo sapiens
caacuuguauuuccaa

SEQ ID NO: 1512661 - RNA, 13 nt, Homo sapiens
caacuuucuguaa

SEQ ID NO: 1512662 - RNA, 17 nt, Homo sapiens
caagaaaguauuuggua

SEQ ID NO: 1512663 - RNA, 17 nt, Homo sapiens
caagaaggaaagauuug

SEQ ID NO: 1512664 - RNA, 19 nt, Homo sapiens
caagaauguuguuagcuuu

SEQ ID NO: 1512665 - RNA, 22 nt, Homo sapiens
caagaauuauaacagcaaggaa

SEQ ID NO: 1512666 - RNA, 19 nt, Homo sapiens
caagacuugauacugcaau

SEQ ID NO: 1512667 - RNA, 14 nt, Homo sapiens
caagagacacugcu

SEQ ID NO: 1512668 - RNA, 15 nt, Homo sapiens
caagaucaacauucc

SEQ ID NO: 1512669 - RNA, 20 nt, Homo sapiens
caagaucgcgccacugcacu

SEQ ID NO: 1512670 - RNA, 17 nt, Homo sapiens
caagcaauuauugugcc

SEQ ID NO: 1512671 - RNA, 20 nt, Homo sapiens
caagcacaaauuucaucucc

SEQ ID NO: 1512672 - RNA, 17 nt, Homo sapiens
caagcacuggacuacaa

SEQ ID NO: 1512673 - RNA, 18 nt, Homo sapiens
caagcagccgcagcgcag

SEQ ID NO: 1512674 - RNA, 13 nt, Homo sapiens
caaggaccaggau

SEQ ID NO: 1512675 - RNA, 15 nt, Homo sapiens
caaggcaacugugag

SEQ ID NO: 1512676 - RNA, 19 nt, Homo sapiens
caaggguaugggaagccau

SEQ ID NO: 1512677 - RNA, 21 nt, Homo sapiens
caaggugauuucagacugcag

SEQ ID NO: 1512678 - RNA, 16 nt, Homo sapiens
caaggugcugauguca

SEQ ID NO: 1512679 - RNA, 18 nt, Homo sapiens
caaguaagaauguuaaaa

SEQ ID NO: 1512680 - RNA, 16 nt, Homo sapiens
caaguagggcacaaaa

SEQ ID NO: 1512681 - RNA, 18 nt, Homo sapiens
caaguaguuaagagcuaa

SEQ ID NO: 1512682 - RNA, 13 nt, Homo sapiens
caagucuacuuca

SEQ ID NO: 1512683 - RNA, 21 nt, Homo sapiens
caagucuacuucacuaaugac

SEQ ID NO: 1512684 - RNA, 15 nt, Homo sapiens
caagugacaggguug

SEQ ID NO: 1512685 - RNA, 19 nt, Homo sapiens
caaguucuggaaaccacgu

SEQ ID NO: 1512686 - RNA, 21 nt, Homo sapiens
caaguuuaaaaauauuauuaa

SEQ ID NO: 1512687 - RNA, 18 nt, Homo sapiens
caauaaacauagcuugua

SEQ ID NO: 1512688 - RNA, 14 nt, Homo sapiens
caauaaauguugcu

SEQ ID NO: 1512689 - RNA, 23 nt, Homo sapiens
caauaauauuucaagugccuaga

SEQ ID NO: 1512690 - RNA, 14 nt, Homo sapiens
caauaggugcaaaa

SEQ ID NO: 1512691 - RNA, 16 nt, Homo sapiens
caauaggugcaaaaau

SEQ ID NO: 1512692 - RNA, 21 nt, Homo sapiens
caaucagagagccuagaacau

SEQ ID NO: 1512693 - RNA, 19 nt, Homo sapiens
caaucuggcuuagugccac

SEQ ID NO: 1512694 - RNA, 14 nt, Homo sapiens
caaugaaaccaaag

SEQ ID NO: 1512695 - RNA, 20 nt, Homo sapiens
caaugauccuguauucagac

SEQ ID NO: 1512696 - RNA, 21 nt, Homo sapiens
caauggagugggagaucagcc

SEQ ID NO: 1512697 - RNA, 17 nt, Homo sapiens
caaugguacucuaauca

SEQ ID NO: 1512698 - RNA, 19 nt, Homo sapiens
caauuaaacagccaaauaa

SEQ ID NO: 1512699 - RNA, 23 nt, Homo sapiens
caauucauggaagccaccaguga

SEQ ID NO: 1512700 - RNA, 16 nt, Homo sapiens
caauucuccugccuca

SEQ ID NO: 1512701 - RNA, 17 nt, Homo sapiens
caauucuccugccucag

SEQ ID NO: 1512702 - RNA, 14 nt, Homo sapiens
caauuucaguguau

SEQ ID NO: 1512703 - RNA, 19 nt, Homo sapiens
cacaaagaagaaguuuaaa

SEQ ID NO: 1512704 - RNA, 16 nt, Homo sapiens
cacaaagacuccuucg

SEQ ID NO: 1512705 - RNA, 15 nt, Homo sapiens
cacaacacaguucuc

SEQ ID NO: 1512706 - RNA, 17 nt, Homo sapiens
cacaacauuuacuuaac

SEQ ID NO: 1512707 - RNA, 16 nt, Homo sapiens
cacaagccugagaacu

SEQ ID NO: 1512708 - RNA, 18 nt, Homo sapiens
cacaagcuggaagcacau

SEQ ID NO: 1512709 - RNA, 21 nt, Homo sapiens
cacaaggugauuucagacugc

SEQ ID NO: 1512710 - RNA, 15 nt, Homo sapiens
cacacagcccauaaa

SEQ ID NO: 1512711 - RNA, 16 nt, Homo sapiens
cacacagugacaaaag

SEQ ID NO: 1512712 - RNA, 17 nt, Homo sapiens
cacacagugacaaaagg

SEQ ID NO: 1512713 - RNA, 22 nt, Homo sapiens
cacacugauguagauaacagcu

SEQ ID NO: 1512714 - RNA, 21 nt, Homo sapiens
cacagacccacacauguuuac

SEQ ID NO: 1512715 - RNA, 14 nt, Homo sapiens
cacagagaugcaug

SEQ ID NO: 1512716 - RNA, 12 nt, Homo sapiens
cacagaggcagu

SEQ ID NO: 1512717 - RNA, 20 nt, Homo sapiens
cacagcagcugaacagccaa

SEQ ID NO: 1512718 - RNA, 22 nt, Homo sapiens
cacagcccagaaccacagaugu

SEQ ID NO: 1512719 - RNA, 21 nt, Homo sapiens
cacaguccuaccucaguucaa

SEQ ID NO: 1512720 - RNA, 18 nt, Homo sapiens
cacaguuggcuggaugaa

SEQ ID NO: 1512721 - RNA, 18 nt, Homo sapiens
cacaguuguaccauucac

SEQ ID NO: 1512722 - RNA, 20 nt, Homo sapiens
cacaguuguaccauucaccg

SEQ ID NO: 1512723 - RNA, 12 nt, Homo sapiens
cacauacauugc

SEQ ID NO: 1512724 - RNA, 13 nt, Homo sapiens
cacauauuucaca

SEQ ID NO: 1512725 - RNA, 21 nt, Homo sapiens
cacauuugaaagaaaguguua

SEQ ID NO: 1512726 - RNA, 18 nt, Homo sapiens
caccaacuggagcacuga

SEQ ID NO: 1512727 - RNA, 21 nt, Homo sapiens
caccaaguucuggaaaccacg

SEQ ID NO: 1512728 - RNA, 16 nt, Homo sapiens
caccagaaugcuaaag

SEQ ID NO: 1512729 - RNA, 13 nt, Homo sapiens
caccagggagcag

SEQ ID NO: 1512730 - RNA, 16 nt, Homo sapiens
caccagggcacugucu

SEQ ID NO: 1512731 - RNA, 18 nt, Homo sapiens
caccaucguguuugcaaa

SEQ ID NO: 1512732 - RNA, 22 nt, Homo sapiens
caccaucuuuugugagauguaa

SEQ ID NO: 1512733 - RNA, 14 nt, Homo sapiens
cacccacaacaucu

SEQ ID NO: 1512734 - RNA, 13 nt, Homo sapiens
caccccaacaucu

SEQ ID NO: 1512735 - RNA, 19 nt, Homo sapiens
cacccccaugcagccucuu

SEQ ID NO: 1512736 - RNA, 21 nt, Homo sapiens
caccccuucuccaucuuuggg

SEQ ID NO: 1512737 - RNA, 14 nt, Homo sapiens
cacuaucaccuauu

SEQ ID NO: 1512738 - RNA, 20 nt, Homo sapiens
cacucagaaaagaaaaccau

SEQ ID NO: 1512739 - RNA, 21 nt, Homo sapiens
cacucaggccaacaagccaac

SEQ ID NO: 1512740 - RNA, 19 nt, Homo sapiens
cacuccucgguacucccau

SEQ ID NO: 1512741 - RNA, 14 nt, Homo sapiens
cacugccaugccuc

SEQ ID NO: 1512742 - RNA, 16 nt, Homo sapiens
cacuggcgcagacuuc

SEQ ID NO: 1512743 - RNA, 14 nt, Homo sapiens
cacuguaucuaggc

SEQ ID NO: 1512744 - RNA, 15 nt, Homo sapiens
cacugugaaaccacu

SEQ ID NO: 1512745 - RNA, 15 nt, Homo sapiens
cacuugguaauugua

SEQ ID NO: 1512746 - RNA, 22 nt, Homo sapiens
cacuuguauauugaaaagauag

SEQ ID NO: 1512747 - RNA, 20 nt, Homo sapiens
cacuuugggaggcugaggcg

SEQ ID NO: 1512748 - RNA, 16 nt, Homo sapiens
cagaaaagaaaaccau

SEQ ID NO: 1512749 - RNA, 20 nt, Homo sapiens
cagaaagaaggacacuugua

SEQ ID NO: 1512750 - RNA, 23 nt, Homo sapiens
cagaaagauuaaauaugaucacu

SEQ ID NO: 1512751 - RNA, 21 nt, Homo sapiens
cagaaggauauuuacuacuuu

SEQ ID NO: 1512752 - RNA, 14 nt, Homo sapiens
cagaagguauuccu

SEQ ID NO: 1512753 - RNA, 21 nt, Homo sapiens
cagaauuggccucaguguagu

SEQ ID NO: 1512754 - RNA, 17 nt, Homo sapiens
cagacaaaguaauuccu

SEQ ID NO: 1512755 - RNA, 21 nt, Homo sapiens
cagacaaaguaauuccucuca

SEQ ID NO: 1512756 - RNA, 16 nt, Homo sapiens
cagacaaguaaucacu

SEQ ID NO: 1512757 - RNA, 17 nt, Homo sapiens
cagacaaguaaucacua

SEQ ID NO: 1512758 - RNA, 11 nt, Homo sapiens
cagacacugug

SEQ ID NO: 1512759 - RNA, 12 nt, Homo sapiens
cagacauuccaa

SEQ ID NO: 1512760 - RNA, 18 nt, Homo sapiens
cagacgucucaagacuga

SEQ ID NO: 1512761 - RNA, 16 nt, Homo sapiens
cagacuguaggauuug

SEQ ID NO: 1512762 - RNA, 14 nt, Homo sapiens
cagacuucuccaga

SEQ ID NO: 1512763 - RNA, 17 nt, Homo sapiens
cagagacuuagaagcau

SEQ ID NO: 1512764 - RNA, 23 nt, Homo sapiens
cagagagaaccaggaggguaaca

SEQ ID NO: 1512765 - RNA, 23 nt, Homo sapiens
cagagauggaggccgagccaaua

SEQ ID NO: 1512766 - RNA, 19 nt, Homo sapiens
cagagcacugcuccagugg

SEQ ID NO: 1512767 - RNA, 20 nt, Homo sapiens
cagagccccuuaaagcugcu

SEQ ID NO: 1512768 - RNA, 20 nt, Homo sapiens
cagagcgagauuccgucuua

SEQ ID NO: 1512769 - RNA, 14 nt, Homo sapiens
cagaggacaccauc

SEQ ID NO: 1512770 - RNA, 22 nt, Homo sapiens
cagaggcagcgaguuguggaaa

SEQ ID NO: 1512771 - RNA, 14 nt, Homo sapiens
cagaggggaaacca

SEQ ID NO: 1512772 - RNA, 19 nt, Homo sapiens
cagaggggugcugcuccua

SEQ ID NO: 1512773 - RNA, 18 nt, Homo sapiens
cagagguaaaagugugag

SEQ ID NO: 1512774 - RNA, 19 nt, Homo sapiens
cagagugagacucgucuca

SEQ ID NO: 1512775 - RNA, 22 nt, Homo sapiens
cagauaagguaaaaugccauga

SEQ ID NO: 1512776 - RNA, 16 nt, Homo sapiens
cagauagacagugcug

SEQ ID NO: 1512777 - RNA, 12 nt, Homo sapiens
cagauaguguaa

SEQ ID NO: 1512778 - RNA, 21 nt, Homo sapiens
cagaucuauggcgaacacagg

SEQ ID NO: 1512779 - RNA, 15 nt, Homo sapiens
cagauguaaaugcca

SEQ ID NO: 1512780 - RNA, 19 nt, Homo sapiens
cagauguuuacagacugug

SEQ ID NO: 1512781 - RNA, 20 nt, Homo sapiens
cagauuccauuaagagugaa

SEQ ID NO: 1512782 - RNA, 19 nt, Homo sapiens
cagauuucggucauaaaga

SEQ ID NO: 1512783 - RNA, 14 nt, Homo sapiens
cagauuuguguuau

SEQ ID NO: 1512784 - RNA, 14 nt, Homo sapiens
cagcaaaccucagu

SEQ ID NO: 1512785 - RNA, 16 nt, Homo sapiens
cagcaaaccucaguca

SEQ ID NO: 1512786 - RNA, 15 nt, Homo sapiens
cagcaacuggugacu

SEQ ID NO: 1512787 - RNA, 18 nt, Homo sapiens
cagcaauagggugcaguu

SEQ ID NO: 1512788 - RNA, 15 nt, Homo sapiens
cagcacauguugcua

SEQ ID NO: 1512789 - RNA, 21 nt, Homo sapiens
cagcaccccugucucuagcca

SEQ ID NO: 1512790 - RNA, 16 nt, Homo sapiens
cagcagaaaaucuuuu

SEQ ID NO: 1512791 - RNA, 12 nt, Homo sapiens
cagcagcugaac

SEQ ID NO: 1512792 - RNA, 21 nt, Homo sapiens
cagcauuuucacauuuugccu

SEQ ID NO: 1512793 - RNA, 18 nt, Homo sapiens
cagccauuaccauggaga

SEQ ID NO: 1512794 - RNA, 16 nt, Homo sapiens
cagcccaggcagagau

SEQ ID NO: 1512795 - RNA, 22 nt, Homo sapiens
cagccugagcaacagagugaga

SEQ ID NO: 1512796 - RNA, 20 nt, Homo sapiens
cagccugguuuucacauaca

SEQ ID NO: 1512797 - RNA, 17 nt, Homo sapiens
cagccuugcaucaaggg

SEQ ID NO: 1512798 - RNA, 15 nt, Homo sapiens
cagcgcgugcacagc

SEQ ID NO: 1512799 - RNA, 16 nt, Homo sapiens
cagcgcgugcacagcg

SEQ ID NO: 1512800 - RNA, 21 nt, Homo sapiens
cagcguguguauccgacucua

SEQ ID NO: 1512801 - RNA, 19 nt, Homo sapiens
cagcuacucaggaggcuaa

SEQ ID NO: 1512802 - RNA, 20 nt, Homo sapiens
cagcuccagaauaccuucuu

SEQ ID NO: 1512803 - RNA, 14 nt, Homo sapiens
cagcugaacagcca

SEQ ID NO: 1512804 - RNA, 15 nt, Homo sapiens
cagcugaacagccaa

SEQ ID NO: 1512805 - RNA, 16 nt, Homo sapiens
cagcugaacagccaaa

SEQ ID NO: 1512806 - RNA, 21 nt, Homo sapiens
cagcuggacaauaugaaucuu

SEQ ID NO: 1512807 - RNA, 17 nt, Homo sapiens
cagcugggaaggccgca

SEQ ID NO: 1512808 - RNA, 23 nt, Homo sapiens
cagcugugugugcccguggugag

SEQ ID NO: 1512809 - RNA, 14 nt, Homo sapiens
cagcuugcugaggg

SEQ ID NO: 1512810 - RNA, 15 nt, Homo sapiens
caggaaggacugugc

SEQ ID NO: 1512811 - RNA, 20 nt, Homo sapiens
caggaggcggagguugcagu

SEQ ID NO: 1512812 - RNA, 22 nt, Homo sapiens
caggauuaaugguccugugaug

SEQ ID NO: 1512813 - RNA, 17 nt, Homo sapiens
caggcagaucacaaggu

SEQ ID NO: 1512814 - RNA, 14 nt, Homo sapiens
caggccaggccacc

SEQ ID NO: 1512815 - RNA, 17 nt, Homo sapiens
caggccaggugcagugg

SEQ ID NO: 1512816 - RNA, 17 nt, Homo sapiens
caggcucccacugcccc

SEQ ID NO: 1512817 - RNA, 19 nt, Homo sapiens
caggcucccagggacaccu

SEQ ID NO: 1512818 - RNA, 19 nt, Homo sapiens
cagggaacaagcauucucc

SEQ ID NO: 1512819 - RNA, 23 nt, Homo sapiens
cagggagcaacucuccacuccau

SEQ ID NO: 1512820 - RNA, 13 nt, Homo sapiens
cagggcucugccc

SEQ ID NO: 1512821 - RNA, 22 nt, Homo sapiens
caggggcaaagaacugccccau

SEQ ID NO: 1512822 - RNA, 21 nt, Homo sapiens
caggggcuucuuucuuuucga

SEQ ID NO: 1512823 - RNA, 23 nt, Homo sapiens
caggggucucccuggagugcagu

SEQ ID NO: 1512824 - RNA, 20 nt, Homo sapiens
caggggugcuaugacaugca

SEQ ID NO: 1512825 - RNA, 21 nt, Homo sapiens
cagggucuaaagagaacaaga

SEQ ID NO: 1512826 - RNA, 21 nt, Homo sapiens
cagggugauaaaucagacucu

SEQ ID NO: 1512827 - RNA, 21 nt, Homo sapiens
caggguuucaccauauuggcc

SEQ ID NO: 1512828 - RNA, 12 nt, Homo sapiens
cagguaaguggc

SEQ ID NO: 1512829 - RNA, 14 nt, Homo sapiens
caggucaacaucua

SEQ ID NO: 1512830 - RNA, 15 nt, Homo sapiens
caggucuagacuuuc

SEQ ID NO: 1512831 - RNA, 17 nt, Homo sapiens
caggucuagacuuucuc

SEQ ID NO: 1512832 - RNA, 15 nt, Homo sapiens
caggugaacucgaag

SEQ ID NO: 1512833 - RNA, 14 nt, Homo sapiens
caggugagcaauua

SEQ ID NO: 1512834 - RNA, 22 nt, Homo sapiens
caggugagcaauuagauuagua

SEQ ID NO: 1512835 - RNA, 17 nt, Homo sapiens
cagguuaccacucuggc

SEQ ID NO: 1512836 - RNA, 13 nt, Homo sapiens
cagguuugcugug

SEQ ID NO: 1512837 - RNA, 17 nt, Homo sapiens
caguagcugagugcacu

SEQ ID NO: 1512838 - RNA, 12 nt, Homo sapiens
caguaguauucu

SEQ ID NO: 1512839 - RNA, 17 nt, Homo sapiens
caguauauuuauaguca

SEQ ID NO: 1512840 - RNA, 14 nt, Homo sapiens
caguaucucuugcu

SEQ ID NO: 1512841 - RNA, 17 nt, Homo sapiens
caguauucuugucaaaa

SEQ ID NO: 1512842 - RNA, 19 nt, Homo sapiens
cagucagggcccagaguug

SEQ ID NO: 1512843 - RNA, 12 nt, Homo sapiens
cagucaucucau

SEQ ID NO: 1512844 - RNA, 22 nt, Homo sapiens
caguccagaugccuuccugucu

SEQ ID NO: 1512845 - RNA, 18 nt, Homo sapiens
cagucugugggagcucag

SEQ ID NO: 1512846 - RNA, 15 nt, Homo sapiens
cagugaaugugugua

SEQ ID NO: 1512847 - RNA, 21 nt, Homo sapiens
cagugaauuucugauuucacu

SEQ ID NO: 1512848 - RNA, 10 nt, Homo sapiens
cagugacacc

SEQ ID NO: 1512849 - RNA, 17 nt, Homo sapiens
cagugcuauuuugugcc

SEQ ID NO: 1512850 - RNA, 17 nt, Homo sapiens
cagugcuucagccugag

SEQ ID NO: 1512851 - RNA, 14 nt, Homo sapiens
caguggaucucaau

SEQ ID NO: 1512852 - RNA, 23 nt, Homo sapiens
caguggcccauaaguguaaaaua

SEQ ID NO: 1512853 - RNA, 15 nt, Homo sapiens
caguggugugaucuu

SEQ ID NO: 1512854 - RNA, 23 nt, Homo sapiens
cagugugaucccaagugccaguc

SEQ ID NO: 1512855 - RNA, 19 nt, Homo sapiens
caguguguguuuaacauuc

SEQ ID NO: 1512856 - RNA, 22 nt, Homo sapiens
caguuaacuuuaagacugagca

SEQ ID NO: 1512857 - RNA, 15 nt, Homo sapiens
caguuacauaauuca

SEQ ID NO: 1512858 - RNA, 16 nt, Homo sapiens
caguucaaagcaggau

SEQ ID NO: 1512859 - RNA, 21 nt, Homo sapiens
caguugaaugacaacagaagc

SEQ ID NO: 1512860 - RNA, 19 nt, Homo sapiens
caguugccgucuaggauug

SEQ ID NO: 1512861 - RNA, 22 nt, Homo sapiens
caguuguaccauucaccgugcc

SEQ ID NO: 1512862 - RNA, 12 nt, Homo sapiens
cauacagaauua

SEQ ID NO: 1512863 - RNA, 14 nt, Homo sapiens
cauagugcacacuu

SEQ ID NO: 1512864 - RNA, 18 nt, Homo sapiens
cauagugcacacuuguau

SEQ ID NO: 1512865 - RNA, 17 nt, Homo sapiens
cauaguuauuuacuuga

SEQ ID NO: 1512866 - RNA, 16 nt, Homo sapiens
cauauauauguauaua

SEQ ID NO: 1512867 - RNA, 18 nt, Homo sapiens
cauaugaaaaaaaugcau

SEQ ID NO: 1512868 - RNA, 16 nt, Homo sapiens
cauaugcagugauaua

SEQ ID NO: 1512869 - RNA, 18 nt, Homo sapiens
cauaugugccaaugugac

SEQ ID NO: 1512870 - RNA, 19 nt, Homo sapiens
caucaaauauuaccaaaaa

SEQ ID NO: 1512871 - RNA, 12 nt, Homo sapiens
caucacuaccuu

SEQ ID NO: 1512872 - RNA, 22 nt, Homo sapiens
caucagcauuuaauaaauguau

SEQ ID NO: 1512873 - RNA, 20 nt, Homo sapiens
caucaguagcugagugcacu

SEQ ID NO: 1512874 - RNA, 21 nt, Homo sapiens
caucauucauuuuuguuguug

SEQ ID NO: 1512875 - RNA, 19 nt, Homo sapiens
cauccauaaagcaagcuca

SEQ ID NO: 1512876 - RNA, 22 nt, Homo sapiens
cauccaucccuuaggugagcuu

SEQ ID NO: 1512877 - RNA, 15 nt, Homo sapiens
cauccccuuuccucc

SEQ ID NO: 1512878 - RNA, 20 nt, Homo sapiens
cauccuggccaacaugguga

SEQ ID NO: 1512879 - RNA, 16 nt, Homo sapiens
cauccuucaucuggau

SEQ ID NO: 1512880 - RNA, 13 nt, Homo sapiens
caucuacaagcau

SEQ ID NO: 1512881 - RNA, 14 nt, Homo sapiens
caucuagucacaaa

SEQ ID NO: 1512882 - RNA, 18 nt, Homo sapiens
caucuauuauaaaaccau

SEQ ID NO: 1512883 - RNA, 12 nt, Homo sapiens
caucuccagugg

SEQ ID NO: 1512884 - RNA, 16 nt, Homo sapiens
caucugcauuucuaca

SEQ ID NO: 1512885 - RNA, 18 nt, Homo sapiens
caugaauucuuaugcuua

SEQ ID NO: 1512886 - RNA, 20 nt, Homo sapiens
caugaggaggucagcccauu

SEQ ID NO: 1512887 - RNA, 13 nt, Homo sapiens
caugauacuuuaa

SEQ ID NO: 1512888 - RNA, 18 nt, Homo sapiens
caugauggugcugaccuc

SEQ ID NO: 1512889 - RNA, 14 nt, Homo sapiens
caugauuuaaucca

SEQ ID NO: 1512890 - RNA, 14 nt, Homo sapiens
caugcaagugagaa

SEQ ID NO: 1512891 - RNA, 15 nt, Homo sapiens
caugcugugugcugg

SEQ ID NO: 1512892 - RNA, 11 nt, Homo sapiens
caugcuuucuc

SEQ ID NO: 1512893 - RNA, 18 nt, Homo sapiens
cauggaagguuagguuug

SEQ ID NO: 1512894 - RNA, 15 nt, Homo sapiens
cauggcuuugcuuug

SEQ ID NO: 1512895 - RNA, 20 nt, Homo sapiens
caugguaaaaccccaucucu

SEQ ID NO: 1512896 - RNA, 22 nt, Homo sapiens
cauguaaggucuucuugugucc

SEQ ID NO: 1512897 - RNA, 17 nt, Homo sapiens
cauguagauuuuaguuc

SEQ ID NO: 1512898 - RNA, 21 nt, Homo sapiens
cauguguucucuauuuugccu

SEQ ID NO: 1512899 - RNA, 14 nt, Homo sapiens
cauguuccucaaaa

SEQ ID NO: 1512900 - RNA, 16 nt, Homo sapiens
cauguuccucaaaagc

SEQ ID NO: 1512901 - RNA, 17 nt, Homo sapiens
cauuaccauggagacaa

SEQ ID NO: 1512902 - RNA, 14 nt, Homo sapiens
cauuauacauuuga

SEQ ID NO: 1512903 - RNA, 17 nt, Homo sapiens
cauuauguaauguccuu

SEQ ID NO: 1512904 - RNA, 21 nt, Homo sapiens
cauuauucucugaugcacugu

SEQ ID NO: 1512905 - RNA, 15 nt, Homo sapiens
cauucacagcccaga

SEQ ID NO: 1512906 - RNA, 22 nt, Homo sapiens
cauucacagcccagaaccacag

SEQ ID NO: 1512907 - RNA, 12 nt, Homo sapiens
cauucaucucau

SEQ ID NO: 1512908 - RNA, 15 nt, Homo sapiens
cauuccaacucguau

SEQ ID NO: 1512909 - RNA, 14 nt, Homo sapiens
cauucccaagccau

SEQ ID NO: 1512910 - RNA, 22 nt, Homo sapiens
cauuccccucgugugacucucu

SEQ ID NO: 1512911 - RNA, 17 nt, Homo sapiens
cauucuccuccauacau

SEQ ID NO: 1512912 - RNA, 18 nt, Homo sapiens
cauugaugaacugccaaa

SEQ ID NO: 1512913 - RNA, 16 nt, Homo sapiens
cauuucccugugcuga

SEQ ID NO: 1512914 - RNA, 15 nt, Homo sapiens
cauuugccuaauucc

SEQ ID NO: 1512915 - RNA, 22 nt, Homo sapiens
cauuuguguuuugaaagcccaa

SEQ ID NO: 1512916 - RNA, 22 nt, Homo sapiens
cauuuuacugauuaacaaauaa

SEQ ID NO: 1512917 - RNA, 13 nt, Homo sapiens
cauuuuacuucca

SEQ ID NO: 1512918 - RNA, 17 nt, Homo sapiens
cauuuuccuaaccacaa

SEQ ID NO: 1512919 - RNA, 13 nt, Homo sapiens
ccaaaaacuaaau

SEQ ID NO: 1512920 - RNA, 9 nt, Homo sapiens
ccaaaaagg

SEQ ID NO: 1512921 - RNA, 20 nt, Homo sapiens
ccaaaauuaccaaaaaucuu

SEQ ID NO: 1512922 - RNA, 14 nt, Homo sapiens
ccaaacucugccag

SEQ ID NO: 1512923 - RNA, 18 nt, Homo sapiens
ccaaauccacaagccauu

SEQ ID NO: 1512924 - RNA, 13 nt, Homo sapiens
ccaaauuccaugu

SEQ ID NO: 1512925 - RNA, 17 nt, Homo sapiens
ccaacacuuuugggagg

SEQ ID NO: 1512926 - RNA, 14 nt, Homo sapiens
ccaaccuccugacc

SEQ ID NO: 1512927 - RNA, 15 nt, Homo sapiens
ccaacgacaaagcca

SEQ ID NO: 1512928 - RNA, 20 nt, Homo sapiens
ccaacuaaauaaaaaauuca

SEQ ID NO: 1512929 - RNA, 14 nt, Homo sapiens
ccaacugcucugcc

SEQ ID NO: 1512930 - RNA, 20 nt, Homo sapiens
ccaacugcugaucaaugaaa

SEQ ID NO: 1512931 - RNA, 17 nt, Homo sapiens
ccaagccccugccucca

SEQ ID NO: 1512932 - RNA, 13 nt, Homo sapiens
ccaaggagucaga

SEQ ID NO: 1512933 - RNA, 17 nt, Homo sapiens
ccaagggaucugccauu

SEQ ID NO: 1512934 - RNA, 16 nt, Homo sapiens
ccaagguaaacaguuu

SEQ ID NO: 1512935 - RNA, 16 nt, Homo sapiens
ccaaucagagagccua

SEQ ID NO: 1512936 - RNA, 23 nt, Homo sapiens
ccaaugucugauuuaacacuauc

SEQ ID NO: 1512937 - RNA, 15 nt, Homo sapiens
ccaauuuuaaauaca

SEQ ID NO: 1512938 - RNA, 14 nt, Homo sapiens
ccacaaacuguaau

SEQ ID NO: 1512939 - RNA, 13 nt, Homo sapiens
ccacaaaugccac

SEQ ID NO: 1512940 - RNA, 21 nt, Homo sapiens
ccacaaucuggcuuagugcca

SEQ ID NO: 1512941 - RNA, 13 nt, Homo sapiens
ccacaccccaaaa

SEQ ID NO: 1512942 - RNA, 14 nt, Homo sapiens
ccacagagaugcau

SEQ ID NO: 1512943 - RNA, 15 nt, Homo sapiens
ccacauaaucucucu

SEQ ID NO: 1512944 - RNA, 13 nt, Homo sapiens
ccacccucaauaa

SEQ ID NO: 1512945 - RNA, 14 nt, Homo sapiens
ccaccucaccaaaa

SEQ ID NO: 1512946 - RNA, 19 nt, Homo sapiens
ccaccuuugccacaaagcu

SEQ ID NO: 1512947 - RNA, 20 nt, Homo sapiens
ccacggaccguugcacaaaa

SEQ ID NO: 1512948 - RNA, 18 nt, Homo sapiens
ccacugaacauuugcuuu

SEQ ID NO: 1512949 - RNA, 21 nt, Homo sapiens
ccacugaggaugugagccuga

SEQ ID NO: 1512950 - RNA, 22 nt, Homo sapiens
ccacuuccauguugucuuauaa

SEQ ID NO: 1512951 - RNA, 16 nt, Homo sapiens
ccacuuugaguaccaa

SEQ ID NO: 1512952 - RNA, 23 nt, Homo sapiens
ccacuuuucaugucauuugacau

SEQ ID NO: 1512953 - RNA, 19 nt, Homo sapiens
ccagaaaaaaaaaaacuua

SEQ ID NO: 1512954 - RNA, 24 nt, Homo sapiens
ccagaaaaaagaccaauaggugca

SEQ ID NO: 1512955 - RNA, 21 nt, Homo sapiens
ccagaaaacaaaacugcauuu

SEQ ID NO: 1512956 - RNA, 19 nt, Homo sapiens
ccagaaccacagauguguc

SEQ ID NO: 1512957 - RNA, 16 nt, Homo sapiens
ccagaacuauuuauuu

SEQ ID NO: 1512958 - RNA, 15 nt, Homo sapiens
ccagacucagcucca

SEQ ID NO: 1512959 - RNA, 14 nt, Homo sapiens
ccagagaauucuua

SEQ ID NO: 1512960 - RNA, 21 nt, Homo sapiens
ccagagacuuggggaccagag

SEQ ID NO: 1512961 - RNA, 19 nt, Homo sapiens
ccagagcuguggacuuugu

SEQ ID NO: 1512962 - RNA, 12 nt, Homo sapiens
ccagcaaagagu

SEQ ID NO: 1512963 - RNA, 16 nt, Homo sapiens
ccagcaacacaagcug

SEQ ID NO: 1512964 - RNA, 19 nt, Homo sapiens
ccagcacaacccccaggaa

SEQ ID NO: 1512965 - RNA, 18 nt, Homo sapiens
ccagcagggccucaaagu

SEQ ID NO: 1512966 - RNA, 13 nt, Homo sapiens
ccagcaguuguaa

SEQ ID NO: 1512967 - RNA, 16 nt, Homo sapiens
ccagccuagcccacuu

SEQ ID NO: 1512968 - RNA, 19 nt, Homo sapiens
ccagcuccaguuuccaagu

SEQ ID NO: 1512969 - RNA, 23 nt, Homo sapiens
ccaggaagcuuuggugagaaccu

SEQ ID NO: 1512970 - RNA, 16 nt, Homo sapiens
ccaggaaggacugugc

SEQ ID NO: 1512971 - RNA, 23 nt, Homo sapiens
ccaggcaggggugggagagccag

SEQ ID NO: 1512972 - RNA, 12 nt, Homo sapiens
ccaggcucugcc

SEQ ID NO: 1512973 - RNA, 15 nt, Homo sapiens
ccaggucaacaucua

SEQ ID NO: 1512974 - RNA, 20 nt, Homo sapiens
ccaguccuggggagcuucac

SEQ ID NO: 1512975 - RNA, 21 nt, Homo sapiens
ccagugaagugccacaugaca

SEQ ID NO: 1512976 - RNA, 19 nt, Homo sapiens
ccagugagauuacagagga

SEQ ID NO: 1512977 - RNA, 21 nt, Homo sapiens
ccagugauccucaaacacaca

SEQ ID NO: 1512978 - RNA, 21 nt, Homo sapiens
ccaguguguguuuaacauuca

SEQ ID NO: 1512979 - RNA, 21 nt, Homo sapiens
ccauaaccaagaaauacuaau

SEQ ID NO: 1512980 - RNA, 18 nt, Homo sapiens
ccauagugcacacuugua

SEQ ID NO: 1512981 - RNA, 13 nt, Homo sapiens
ccaucaucacugg

SEQ ID NO: 1512982 - RNA, 14 nt, Homo sapiens
ccaucuagucacaa

SEQ ID NO: 1512983 - RNA, 15 nt, Homo sapiens
ccaucucauucaggu

SEQ ID NO: 1512984 - RNA, 13 nt, Homo sapiens
ccaucuccagugg

SEQ ID NO: 1512985 - RNA, 17 nt, Homo sapiens
ccaucuccuuucaggga

SEQ ID NO: 1512986 - RNA, 22 nt, Homo sapiens
ccaugaauucuugaguuuacau

SEQ ID NO: 1512987 - RNA, 12 nt, Homo sapiens
ccaugacaugga

SEQ ID NO: 1512988 - RNA, 15 nt, Homo sapiens
ccaugauacuuuaau

SEQ ID NO: 1512989 - RNA, 20 nt, Homo sapiens
ccaugcaccucagggccaag

SEQ ID NO: 1512990 - RNA, 10 nt, Homo sapiens
ccaugccacc

SEQ ID NO: 1512991 - RNA, 20 nt, Homo sapiens
ccaugccacccuguuuucag

SEQ ID NO: 1512992 - RNA, 20 nt, Homo sapiens
ccaugcccucccugcugcca

SEQ ID NO: 1512993 - RNA, 19 nt, Homo sapiens
ccaugggauguuaagcaaa

SEQ ID NO: 1512994 - RNA, 17 nt, Homo sapiens
ccauguaucuaccucac

SEQ ID NO: 1512995 - RNA, 13 nt, Homo sapiens
ccauguuucacaa

SEQ ID NO: 1512996 - RNA, 12 nt, Homo sapiens
ccauucaucuca

SEQ ID NO: 1512997 - RNA, 20 nt, Homo sapiens
ccauucuccuccauacaucc

SEQ ID NO: 1512998 - RNA, 22 nt, Homo sapiens
ccauucugaaaauagcaggaca

SEQ ID NO: 1512999 - RNA, 13 nt, Homo sapiens
ccauuuaauuucu

SEQ ID NO: 1513000 - RNA, 19 nt, Homo sapiens
ccauuucugaacuguuaca

SEQ ID NO: 1513001 - RNA, 21 nt, Homo sapiens
ccauuuguuggggcaguggua

SEQ ID NO: 1513002 - RNA, 14 nt, Homo sapiens
ccauuuuacuucca

SEQ ID NO: 1513003 - RNA, 18 nt, Homo sapiens
ccauuuuacuuccaugau

SEQ ID NO: 1513004 - RNA, 21 nt, Homo sapiens
ccauuuuacuuccaugauacu

SEQ ID NO: 1513005 - RNA, 18 nt, Homo sapiens
ccauuuuccuaaccacaa

SEQ ID NO: 1513006 - RNA, 19 nt, Homo sapiens
ccauuuuggaaguuuucag

SEQ ID NO: 1513007 - RNA, 14 nt, Homo sapiens
cccaaaggcaucca

SEQ ID NO: 1513008 - RNA, 14 nt, Homo sapiens
cccaacugcucugc

SEQ ID NO: 1513009 - RNA, 23 nt, Homo sapiens
cccacuaagcuuucuccuuugag

SEQ ID NO: 1513010 - RNA, 15 nt, Homo sapiens
cccagauacuuccca

SEQ ID NO: 1513011 - RNA, 11 nt, Homo sapiens
cccagcacuga

SEQ ID NO: 1513012 - RNA, 15 nt, Homo sapiens
cccagcagggccuca

SEQ ID NO: 1513013 - RNA, 16 nt, Homo sapiens
cccagcccugcagcaa

SEQ ID NO: 1513014 - RNA, 16 nt, Homo sapiens
cccagugcuaccucuc

SEQ ID NO: 1513015 - RNA, 21 nt, Homo sapiens
cccaucugaaccacuuugccu

SEQ ID NO: 1513016 - RNA, 20 nt, Homo sapiens
ccccaacuacccccagcugu

SEQ ID NO: 1513017 - RNA, 21 nt, Homo sapiens
ccccaccuuugggaucagccu

SEQ ID NO: 1513018 - RNA, 17 nt, Homo sapiens
ccccagaguugggaugc

SEQ ID NO: 1513019 - RNA, 15 nt, Homo sapiens
ccccagcaguugaau

SEQ ID NO: 1513020 - RNA, 14 nt, Homo sapiens
cccccgcuccagau

SEQ ID NO: 1513021 - RNA, 21 nt, Homo sapiens
cccccucuaacccccagugcc

SEQ ID NO: 1513022 - RNA, 13 nt, Homo sapiens
ccccgcuccagau

SEQ ID NO: 1513023 - RNA, 23 nt, Homo sapiens
ccccuuauccaggacucugucaa

SEQ ID NO: 1513024 - RNA, 18 nt, Homo sapiens
cccgcaguugugccaaag

SEQ ID NO: 1513025 - RNA, 14 nt, Homo sapiens
cccgucauguuccu

SEQ ID NO: 1513026 - RNA, 16 nt, Homo sapiens
cccgucauguuccuca

SEQ ID NO: 1513027 - RNA, 22 nt, Homo sapiens
cccgucauguuccucaaaagca

SEQ ID NO: 1513028 - RNA, 22 nt, Homo sapiens
cccguggugagguugugcugcc

SEQ ID NO: 1513029 - RNA, 15 nt, Homo sapiens
cccuauuuuugcaau

SEQ ID NO: 1513030 - RNA, 17 nt, Homo sapiens
cccucagggaucuugca

SEQ ID NO: 1513031 - RNA, 19 nt, Homo sapiens
cccuccagggccacugcuu

SEQ ID NO: 1513032 - RNA, 21 nt, Homo sapiens
cccuccauccggcuccuguca

SEQ ID NO: 1513033 - RNA, 19 nt, Homo sapiens
cccucuuuccccaccucuu

SEQ ID NO: 1513034 - RNA, 18 nt, Homo sapiens
cccugacgacacugaaga

SEQ ID NO: 1513035 - RNA, 23 nt, Homo sapiens
cccugagggcugggcaugcugag

SEQ ID NO: 1513036 - RNA, 15 nt, Homo sapiens
cccugagguccugca

SEQ ID NO: 1513037 - RNA, 18 nt, Homo sapiens
cccugaguggaucuccaa

SEQ ID NO: 1513038 - RNA, 19 nt, Homo sapiens
cccugcaagacacaggcuc

SEQ ID NO: 1513039 - RNA, 16 nt, Homo sapiens
cccugcuugcacuuug

SEQ ID NO: 1513040 - RNA, 17 nt, Homo sapiens
cccugggucaccuagcu

SEQ ID NO: 1513041 - RNA, 16 nt, Homo sapiens
cccugguccugcacug

SEQ ID NO: 1513042 - RNA, 18 nt, Homo sapiens
cccugucucuacuaaaaa

SEQ ID NO: 1513043 - RNA, 18 nt, Homo sapiens
cccugucucuagccacuu

SEQ ID NO: 1513044 - RNA, 11 nt, Homo sapiens
cccugugcuga

SEQ ID NO: 1513045 - RNA, 13 nt, Homo sapiens
cccuugaaccagc

SEQ ID NO: 1513046 - RNA, 17 nt, Homo sapiens
ccgacuccucaaaagca

SEQ ID NO: 1513047 - RNA, 21 nt, Homo sapiens
ccgacugcuagggaguggucu

SEQ ID NO: 1513048 - RNA, 16 nt, Homo sapiens
ccgagagagauggaau

SEQ ID NO: 1513049 - RNA, 18 nt, Homo sapiens
ccgccuccaaaugccaac

SEQ ID NO: 1513050 - RNA, 13 nt, Homo sapiens
ccgggugccauuc

SEQ ID NO: 1513051 - RNA, 16 nt, Homo sapiens
ccguugcacaaaaagg

SEQ ID NO: 1513052 - RNA, 19 nt, Homo sapiens
ccuaagaaagacaucacau

SEQ ID NO: 1513053 - RNA, 20 nt, Homo sapiens
ccuaaucaggcugagguguc

SEQ ID NO: 1513054 - RNA, 15 nt, Homo sapiens
ccuacaaaauggagg

SEQ ID NO: 1513055 - RNA, 18 nt, Homo sapiens
ccuacaaaauggagggag

SEQ ID NO: 1513056 - RNA, 20 nt, Homo sapiens
ccuaccaggcacgucugcag

SEQ ID NO: 1513057 - RNA, 14 nt, Homo sapiens
ccuaggauuccucc

SEQ ID NO: 1513058 - RNA, 22 nt, Homo sapiens
ccuauaaaacaaagucugggaa

SEQ ID NO: 1513059 - RNA, 20 nt, Homo sapiens
ccuauagucccagcuacuca

SEQ ID NO: 1513060 - RNA, 19 nt, Homo sapiens
ccucacgcucuggacauga

SEQ ID NO: 1513061 - RNA, 10 nt, Homo sapiens
ccucagccac

SEQ ID NO: 1513062 - RNA, 18 nt, Homo sapiens
ccucaugugugcugugcu

SEQ ID NO: 1513063 - RNA, 12 nt, Homo sapiens
ccuccaccaaac

SEQ ID NO: 1513064 - RNA, 21 nt, Homo sapiens
ccucccauaauugcuuugcca

SEQ ID NO: 1513065 - RNA, 17 nt, Homo sapiens
ccuccccacaguccuca

SEQ ID NO: 1513066 - RNA, 14 nt, Homo sapiens
ccuccucugugcuc

SEQ ID NO: 1513067 - RNA, 15 nt, Homo sapiens
ccuccugcaccgaga

SEQ ID NO: 1513068 - RNA, 19 nt, Homo sapiens
ccuccugccuccagcacuc

SEQ ID NO: 1513069 - RNA, 18 nt, Homo sapiens
ccuccuuccccugugguc

SEQ ID NO: 1513070 - RNA, 20 nt, Homo sapiens
ccuccuuuucuuucucucuc

SEQ ID NO: 1513071 - RNA, 14 nt, Homo sapiens
ccucgccacgggga

SEQ ID NO: 1513072 - RNA, 14 nt, Homo sapiens
ccucggagcugcca

SEQ ID NO: 1513073 - RNA, 17 nt, Homo sapiens
ccucgguacucccauaa

SEQ ID NO: 1513074 - RNA, 20 nt, Homo sapiens
ccucuaacauuugcaaaaug

SEQ ID NO: 1513075 - RNA, 18 nt, Homo sapiens
ccucuaagccacucuucc

SEQ ID NO: 1513076 - RNA, 15 nt, Homo sapiens
ccucuauuuugccac

SEQ ID NO: 1513077 - RNA, 15 nt, Homo sapiens
ccucugcagcacuuu

SEQ ID NO: 1513078 - RNA, 17 nt, Homo sapiens
ccucugcagcacuuuaa

SEQ ID NO: 1513079 - RNA, 19 nt, Homo sapiens
ccucuuaaagcugccugua

SEQ ID NO: 1513080 - RNA, 19 nt, Homo sapiens
ccucuucuuauucaugcuu

SEQ ID NO: 1513081 - RNA, 18 nt, Homo sapiens
ccugaaugaccugcaguc

SEQ ID NO: 1513082 - RNA, 14 nt, Homo sapiens
ccugacaaauggaa

SEQ ID NO: 1513083 - RNA, 15 nt, Homo sapiens
ccugacaaauggaag

SEQ ID NO: 1513084 - RNA, 14 nt, Homo sapiens
ccugacaugucuca

SEQ ID NO: 1513085 - RNA, 20 nt, Homo sapiens
ccugacccuccuccacucca

SEQ ID NO: 1513086 - RNA, 18 nt, Homo sapiens
ccugacgacacugaagaa

SEQ ID NO: 1513087 - RNA, 12 nt, Homo sapiens
ccugauaagcaa

SEQ ID NO: 1513088 - RNA, 17 nt, Homo sapiens
ccugcaaagggaacuga

SEQ ID NO: 1513089 - RNA, 16 nt, Homo sapiens
ccugccucucugcucc

SEQ ID NO: 1513090 - RNA, 23 nt, Homo sapiens
ccugcgaaguggcucucaggggc

SEQ ID NO: 1513091 - RNA, 20 nt, Homo sapiens
ccugcuacacaaaagccaaa

SEQ ID NO: 1513092 - RNA, 15 nt, Homo sapiens
ccugcuuuuugacau

SEQ ID NO: 1513093 - RNA, 16 nt, Homo sapiens
ccuggagggaggcucu

SEQ ID NO: 1513094 - RNA, 15 nt, Homo sapiens
ccuggaucaggguug

SEQ ID NO: 1513095 - RNA, 21 nt, Homo sapiens
ccuggaugaucacuaauacua

SEQ ID NO: 1513096 - RNA, 18 nt, Homo sapiens
ccuggcuugcuguggcua

SEQ ID NO: 1513097 - RNA, 19 nt, Homo sapiens
ccugggagaaccucaggcu

SEQ ID NO: 1513098 - RNA, 19 nt, Homo sapiens
ccugggaggcggagaguac

SEQ ID NO: 1513099 - RNA, 13 nt, Homo sapiens
ccuguagcacaaa

SEQ ID NO: 1513100 - RNA, 14 nt, Homo sapiens
ccuguagcacaaag

SEQ ID NO: 1513101 - RNA, 21 nt, Homo sapiens
ccuguagcacaaagagggagu

SEQ ID NO: 1513102 - RNA, 15 nt, Homo sapiens
ccugucagagaucug

SEQ ID NO: 1513103 - RNA, 16 nt, Homo sapiens
ccuguguauaaagcca

SEQ ID NO: 1513104 - RNA, 18 nt, Homo sapiens
ccuguugagcaucacaga

SEQ ID NO: 1513105 - RNA, 20 nt, Homo sapiens
ccuguuuguggaacaaaagu

SEQ ID NO: 1513106 - RNA, 19 nt, Homo sapiens
ccuuaauagccauaugcaa

SEQ ID NO: 1513107 - RNA, 19 nt, Homo sapiens
ccuuaauucacucccacac

SEQ ID NO: 1513108 - RNA, 14 nt, Homo sapiens
ccuucaagugccaa

SEQ ID NO: 1513109 - RNA, 19 nt, Homo sapiens
ccuucaaguuagcucagga

SEQ ID NO: 1513110 - RNA, 19 nt, Homo sapiens
ccuucccuccccacagucc

SEQ ID NO: 1513111 - RNA, 17 nt, Homo sapiens
ccuucccucuuucccca

SEQ ID NO: 1513112 - RNA, 23 nt, Homo sapiens
ccuucuuuugggggucaacaguu

SEQ ID NO: 1513113 - RNA, 19 nt, Homo sapiens
ccuuguguguuuugagagu

SEQ ID NO: 1513114 - RNA, 22 nt, Homo sapiens
ccuuuagauauuauucauucau

SEQ ID NO: 1513115 - RNA, 16 nt, Homo sapiens
ccuuucaaauuucaca

SEQ ID NO: 1513116 - RNA, 22 nt, Homo sapiens
ccuuucucgugguagaagccag

SEQ ID NO: 1513117 - RNA, 17 nt, Homo sapiens
ccuuucuuucuuccuuc

SEQ ID NO: 1513118 - RNA, 13 nt, Homo sapiens
ccuuugagggcag

SEQ ID NO: 1513119 - RNA, 21 nt, Homo sapiens
ccuuuuauucauauuuucaca

SEQ ID NO: 1513120 - RNA, 18 nt, Homo sapiens
ccuuuucaucuccagugu

SEQ ID NO: 1513121 - RNA, 18 nt, Homo sapiens
ccuuuuucaacuuggaaa

SEQ ID NO: 1513122 - RNA, 15 nt, Homo sapiens
ccuuuuucuaccuuu

SEQ ID NO: 1513123 - RNA, 22 nt, Homo sapiens
cgaacucaucccuguuccucaa

SEQ ID NO: 1513124 - RNA, 16 nt, Homo sapiens
cgaaguggcucucagg

SEQ ID NO: 1513125 - RNA, 14 nt, Homo sapiens
cgaaucaucucaaa

SEQ ID NO: 1513126 - RNA, 21 nt, Homo sapiens
cgaauggggcgaucaagucca

SEQ ID NO: 1513127 - RNA, 17 nt, Homo sapiens
cucuaaguucaagaaga

SEQ ID NO: 1513128 - RNA, 15 nt, Homo sapiens
cucuaauacauucca

SEQ ID NO: 1513129 - RNA, 16 nt, Homo sapiens
cucuacagacuucucc

SEQ ID NO: 1513130 - RNA, 21 nt, Homo sapiens
uaaacagacuuuagcuuacag

SEQ ID NO: 1513131 - RNA, 20 nt, Homo sapiens
uaaacauugguauauuucca

SEQ ID NO: 1513132 - RNA, 17 nt, Homo sapiens
uaaacuguacaaaugaa

SEQ ID NO: 1513133 - RNA, 21 nt, Homo sapiens
uaaagauaacccuuauuccau

SEQ ID NO: 1513134 - RNA, 19 nt, Homo sapiens
uaaagcacagauuucaaca

SEQ ID NO: 1513135 - RNA, 14 nt, Homo sapiens
uaaagcagggaaua

SEQ ID NO: 1513136 - RNA, 15 nt, Homo sapiens
uaaagcuacaacaaa

SEQ ID NO: 1513137 - RNA, 19 nt, Homo sapiens
uaaagcuuugucuuuuugu

SEQ ID NO: 1513138 - RNA, 23 nt, Homo sapiens
uaaagggcaggugguucuaauau

SEQ ID NO: 1513139 - RNA, 20 nt, Homo sapiens
uaaaguacauuauuuaugaa

SEQ ID NO: 1513140 - RNA, 16 nt, Homo sapiens
uaaaguacuacaucag

SEQ ID NO: 1513141 - RNA, 14 nt, Homo sapiens
uaaauacaguggau

SEQ ID NO: 1513142 - RNA, 19 nt, Homo sapiens
uaaauacaguggaucucaa

SEQ ID NO: 1513143 - RNA, 21 nt, Homo sapiens
uaaauagaaauuuuguuaaca

SEQ ID NO: 1513144 - RNA, 12 nt, Homo sapiens
uaaauagcuuuu

SEQ ID NO: 1513145 - RNA, 14 nt, Homo sapiens
uaaauagugcagaa

SEQ ID NO: 1513146 - RNA, 14 nt, Homo sapiens
uaaaucugagaucu

SEQ ID NO: 1513147 - RNA, 21 nt, Homo sapiens
uaaaucuuucuuuugauucuu

SEQ ID NO: 1513148 - RNA, 16 nt, Homo sapiens
uaaauguauaggcaga

SEQ ID NO: 1513149 - RNA, 19 nt, Homo sapiens
uaaauguauaugucauuua

SEQ ID NO: 1513150 - RNA, 16 nt, Homo sapiens
uaaauuuaacaaguga

SEQ ID NO: 1513151 - RNA, 23 nt, Homo sapiens
uaaauuuaacaagugacaggguu

SEQ ID NO: 1513152 - RNA, 23 nt, Homo sapiens
uaaauuuuaacauuuuccaaaau

SEQ ID NO: 1513153 - RNA, 20 nt, Homo sapiens
uaacaaaacuauacuuguac

SEQ ID NO: 1513154 - RNA, 19 nt, Homo sapiens
uaacacaaguccugugaau

SEQ ID NO: 1513155 - RNA, 19 nt, Homo sapiens
uaacagcauaauugccuuu

SEQ ID NO: 1513156 - RNA, 20 nt, Homo sapiens
uaacauaaaauaaucgucuc

SEQ ID NO: 1513157 - RNA, 15 nt, Homo sapiens
uaacauaucuuuauc

SEQ ID NO: 1513158 - RNA, 20 nt, Homo sapiens
uaacauggaagauauuccuu

SEQ ID NO: 1513159 - RNA, 14 nt, Homo sapiens
uaacauuuuccaaa

SEQ ID NO: 1513160 - RNA, 14 nt, Homo sapiens
uaacccuuauucca

SEQ ID NO: 1513161 - RNA, 22 nt, Homo sapiens
uaacuacaaggacaaugccuug

SEQ ID NO: 1513162 - RNA, 19 nt, Homo sapiens
uaacuagaaaucugccaau

SEQ ID NO: 1513163 - RNA, 17 nt, Homo sapiens
uaacuauuuacauauaa

SEQ ID NO: 1513164 - RNA, 20 nt, Homo sapiens
uaacucaggaugccaagugg

SEQ ID NO: 1513165 - RNA, 21 nt, Homo sapiens
uaacuuaaauuuuaagcuuga

SEQ ID NO: 1513166 - RNA, 12 nt, Homo sapiens
uaacuugagggu

SEQ ID NO: 1513167 - RNA, 18 nt, Homo sapiens
uaacuuggucagagccac

SEQ ID NO: 1513168 - RNA, 23 nt, Homo sapiens
uaagaacuuugagcuacugccgu

SEQ ID NO: 1513169 - RNA, 20 nt, Homo sapiens
uaagaagaaugcuuaaucag

SEQ ID NO: 1513170 - RNA, 15 nt, Homo sapiens
uaagaggcuauuuaa

SEQ ID NO: 1513171 - RNA, 12 nt, Homo sapiens
uaagcucuggcu

SEQ ID NO: 1513172 - RNA, 13 nt, Homo sapiens
uaagcuguaaaaa

SEQ ID NO: 1513173 - RNA, 15 nt, Homo sapiens
uaagcugugugcagg

SEQ ID NO: 1513174 - RNA, 22 nt, Homo sapiens
uaaggaaaaaauaauauccaua

SEQ ID NO: 1513175 - RNA, 12 nt, Homo sapiens
uaaggaaaugug

SEQ ID NO: 1513176 - RNA, 23 nt, Homo sapiens
uaaggacaaagaaggaaauauca

SEQ ID NO: 1513177 - RNA, 15 nt, Homo sapiens
uaagguaaaaugcca

SEQ ID NO: 1513178 - RNA, 20 nt, Homo sapiens
uaagguaauuucuguguauu

SEQ ID NO: 1513179 - RNA, 13 nt, Homo sapiens
uaaguaaacaaca

SEQ ID NO: 1513180 - RNA, 23 nt, Homo sapiens
uaaguauucuucaucagcauuua

SEQ ID NO: 1513181 - RNA, 12 nt, Homo sapiens
uaaguauuucca

SEQ ID NO: 1513182 - RNA, 19 nt, Homo sapiens
uaaguccuguauauguaug

SEQ ID NO: 1513183 - RNA, 20 nt, Homo sapiens
uaaguggcaggacccuguca

SEQ ID NO: 1513184 - RNA, 22 nt, Homo sapiens
uaaguggcaggacccugucagg

SEQ ID NO: 1513185 - RNA, 21 nt, Homo sapiens
uaaguucaagaagacuauggu

SEQ ID NO: 1513186 - RNA, 20 nt, Homo sapiens
uaauacauuggaggcuuuau

SEQ ID NO: 1513187 - RNA, 22 nt, Homo sapiens
uaauagccuaauacaacaugua

SEQ ID NO: 1513188 - RNA, 19 nt, Homo sapiens
uaauagcuuuuauuguaua

SEQ ID NO: 1513189 - RNA, 16 nt, Homo sapiens
uaauagugacauauau

SEQ ID NO: 1513190 - RNA, 15 nt, Homo sapiens
uaauauuuaggcaag

SEQ ID NO: 1513191 - RNA, 18 nt, Homo sapiens
uaaucccccuugccaaau

SEQ ID NO: 1513192 - RNA, 13 nt, Homo sapiens
uaaucgugucuuc

SEQ ID NO: 1513193 - RNA, 14 nt, Homo sapiens
uaaucuccacuguu

SEQ ID NO: 1513194 - RNA, 20 nt, Homo sapiens
uaaucuuugaaagcugaaua

SEQ ID NO: 1513195 - RNA, 14 nt, Homo sapiens
uaaugaaacaaaga

SEQ ID NO: 1513196 - RNA, 11 nt, Homo sapiens
uaaugagggac

SEQ ID NO: 1513197 - RNA, 21 nt, Homo sapiens
uaauuacauccagaaagaagg

SEQ ID NO: 1513198 - RNA, 16 nt, Homo sapiens
uaauucauggcauuga

SEQ ID NO: 1513199 - RNA, 13 nt, Homo sapiens
uaauucuacagga

SEQ ID NO: 1513200 - RNA, 13 nt, Homo sapiens
uaauucuuuccau

SEQ ID NO: 1513201 - RNA, 15 nt, Homo sapiens
uaauuuaguuucaua

SEQ ID NO: 1513202 - RNA, 18 nt, Homo sapiens
uaauuugaaaacauaauc

SEQ ID NO: 1513203 - RNA, 13 nt, Homo sapiens
uacaaacaagcac

SEQ ID NO: 1513204 - RNA, 16 nt, Homo sapiens
uacaaacaagcacaga

SEQ ID NO: 1513205 - RNA, 21 nt, Homo sapiens
uacaaccaauggaaugugaug

SEQ ID NO: 1513206 - RNA, 11 nt, Homo sapiens
uacaaccuggc

SEQ ID NO: 1513207 - RNA, 13 nt, Homo sapiens
uacaaguguauau

SEQ ID NO: 1513208 - RNA, 19 nt, Homo sapiens
uacacacccauagugcaca

SEQ ID NO: 1513209 - RNA, 20 nt, Homo sapiens
uacacacccauagugcacac

SEQ ID NO: 1513210 - RNA, 14 nt, Homo sapiens
uacagacgucucaa

SEQ ID NO: 1513211 - RNA, 13 nt, Homo sapiens
uacagacugugag

SEQ ID NO: 1513212 - RNA, 18 nt, Homo sapiens
uacagacuucuccagacc

SEQ ID NO: 1513213 - RNA, 17 nt, Homo sapiens
uacagauguaaaugcca

SEQ ID NO: 1513214 - RNA, 13 nt, Homo sapiens
uacaggugauaac

SEQ ID NO: 1513215 - RNA, 17 nt, Homo sapiens
uacaguaaauaaauugu

SEQ ID NO: 1513216 - RNA, 17 nt, Homo sapiens
uacagucaagauacaua

SEQ ID NO: 1513217 - RNA, 19 nt, Homo sapiens
uacagucaagauacauagu

SEQ ID NO: 1513218 - RNA, 15 nt, Homo sapiens
uacaguggaucucaa

SEQ ID NO: 1513219 - RNA, 19 nt, Homo sapiens
uacauaccacuuugaauag

SEQ ID NO: 1513220 - RNA, 18 nt, Homo sapiens
uacauguacaugcauuuu

SEQ ID NO: 1513221 - RNA, 14 nt, Homo sapiens
uacauguuacuugu

SEQ ID NO: 1513222 - RNA, 21 nt, Homo sapiens
uacauugucaaagcuugccgu

SEQ ID NO: 1513223 - RNA, 15 nt, Homo sapiens
uacauuucccugugc

SEQ ID NO: 1513224 - RNA, 17 nt, Homo sapiens
uacauuucccugugcug

SEQ ID NO: 1513225 - RNA, 18 nt, Homo sapiens
uacauuucccugugcuga

SEQ ID NO: 1513226 - RNA, 15 nt, Homo sapiens
uacauuuuuguacac

SEQ ID NO: 1513227 - RNA, 19 nt, Homo sapiens
uaccaaauccacaagccau

SEQ ID NO: 1513228 - RNA, 22 nt, Homo sapiens
uaccaccaagggaucugccauu

SEQ ID NO: 1513229 - RNA, 13 nt, Homo sapiens
uaccacucuggca

SEQ ID NO: 1513230 - RNA, 16 nt, Homo sapiens
uaccagauaguuauau

SEQ ID NO: 1513231 - RNA, 16 nt, Homo sapiens
uacccaauuuaauucc

SEQ ID NO: 1513232 - RNA, 22 nt, Homo sapiens
uacccauauaucuuauguuaaa

SEQ ID NO: 1513233 - RNA, 17 nt, Homo sapiens
uaccccaccucaugccu

SEQ ID NO: 1513234 - RNA, 16 nt, Homo sapiens
uacccggcccagagac

SEQ ID NO: 1513235 - RNA, 19 nt, Homo sapiens
uaccgugggucaaccuggg

SEQ ID NO: 1513236 - RNA, 12 nt, Homo sapiens
uaccucugagaa

SEQ ID NO: 1513237 - RNA, 16 nt, Homo sapiens
uaccucuucaguaggu

SEQ ID NO: 1513238 - RNA, 22 nt, Homo sapiens
uaccuuguggaugcuagugcug

SEQ ID NO: 1513239 - RNA, 22 nt, Homo sapiens
uaccuuuguguaaagaagggaa

SEQ ID NO: 1513240 - RNA, 23 nt, Homo sapiens
uacuaagccacaagaaauuugau

SEQ ID NO: 1513241 - RNA, 22 nt, Homo sapiens
uacuaaugugccccauguccaa

SEQ ID NO: 1513242 - RNA, 16 nt, Homo sapiens
uacuacaucagugugg

SEQ ID NO: 1513243 - RNA, 21 nt, Homo sapiens
uacuacuugccacacacuguu

SEQ ID NO: 1513244 - RNA, 22 nt, Homo sapiens
uacuaguguguguguguauaua

SEQ ID NO: 1513245 - RNA, 23 nt, Homo sapiens
uacuaguguguguguguauauau

SEQ ID NO: 1513246 - RNA, 19 nt, Homo sapiens
uacucaaguaccaccaagg

SEQ ID NO: 1513247 - RNA, 15 nt, Homo sapiens
uacuccuaccucagc

SEQ ID NO: 1513248 - RNA, 10 nt, Homo sapiens
uacucucuua

SEQ ID NO: 1513249 - RNA, 17 nt, Homo sapiens
uacugauucuccuguca

SEQ ID NO: 1513250 - RNA, 17 nt, Homo sapiens
uacugauuuuugugauu

SEQ ID NO: 1513251 - RNA, 16 nt, Homo sapiens
uacuggacuucuauca

SEQ ID NO: 1513252 - RNA, 13 nt, Homo sapiens
uacugugugaaga

SEQ ID NO: 1513253 - RNA, 19 nt, Homo sapiens
uacuuaauggguacaaugu

SEQ ID NO: 1513254 - RNA, 13 nt, Homo sapiens
uacuucaugagga

SEQ ID NO: 1513255 - RNA, 14 nt, Homo sapiens
uacuuccaugauac

SEQ ID NO: 1513256 - RNA, 18 nt, Homo sapiens
uacuuccaugauacuuua

SEQ ID NO: 1513257 - RNA, 18 nt, Homo sapiens
uacuucuaaaucagaaau

SEQ ID NO: 1513258 - RNA, 17 nt, Homo sapiens
uacuuucuguugccaca

SEQ ID NO: 1513259 - RNA, 11 nt, Homo sapiens
uagaaaccacc

SEQ ID NO: 1513260 - RNA, 15 nt, Homo sapiens
uagaaacgugauaaa

SEQ ID NO: 1513261 - RNA, 21 nt, Homo sapiens
uagaaauaagcccaacagaca

SEQ ID NO: 1513262 - RNA, 17 nt, Homo sapiens
uagaacaucccugggca

SEQ ID NO: 1513263 - RNA, 19 nt, Homo sapiens
uagaacaucccugggcaag

SEQ ID NO: 1513264 - RNA, 16 nt, Homo sapiens
uagaacuuugugccag

SEQ ID NO: 1513265 - RNA, 19 nt, Homo sapiens
ucaaugaaaacugaaucaa

SEQ ID NO: 1513266 - RNA, 15 nt, Homo sapiens
ucaaugguacucuaa

SEQ ID NO: 1513267 - RNA, 18 nt, Homo sapiens
ucaauuaaaggcuuucag

SEQ ID NO: 1513268 - RNA, 14 nt, Homo sapiens
ucaauucuagcauu

SEQ ID NO: 1513269 - RNA, 13 nt, Homo sapiens
ucacaaugccuag

SEQ ID NO: 1513270 - RNA, 19 nt, Homo sapiens
ucacaccugacaaauggaa

SEQ ID NO: 1513271 - RNA, 13 nt, Homo sapiens
ucacagaggcagu

SEQ ID NO: 1513272 - RNA, 17 nt, Homo sapiens
ucacagaggcaguagga

SEQ ID NO: 1513273 - RNA, 20 nt, Homo sapiens
ucacagaggcaguaggaacc

SEQ ID NO: 1513274 - RNA, 20 nt, Homo sapiens
ucacagcagugcauaggcca

SEQ ID NO: 1513275 - RNA, 14 nt, Homo sapiens
ucacagcguuucag

SEQ ID NO: 1513276 - RNA, 11 nt, Homo sapiens
ucaccaaaauu

SEQ ID NO: 1513277 - RNA, 17 nt, Homo sapiens
ucaccacaaacuguaau

SEQ ID NO: 1513278 - RNA, 14 nt, Homo sapiens
ucaccgacaacaug

SEQ ID NO: 1513279 - RNA, 12 nt, Homo sapiens
ucaccucaggcc

SEQ ID NO: 1513280 - RNA, 20 nt, Homo sapiens
ucacugcucccccgugugua

SEQ ID NO: 1513281 - RNA, 14 nt, Homo sapiens
ucacuuuguuaaaa

SEQ ID NO: 1513282 - RNA, 17 nt, Homo sapiens
ucagaaaagaaaaccau

SEQ ID NO: 1513283 - RNA, 12 nt, Homo sapiens
ucagaaaccaaa

SEQ ID NO: 1513284 - RNA, 22 nt, Homo sapiens
ucagaacucuguguugugaaug

SEQ ID NO: 1513285 - RNA, 15 nt, Homo sapiens
ucagaagacacugca

SEQ ID NO: 1513286 - RNA, 21 nt, Homo sapiens
ucagaagagguugggcuucca

SEQ ID NO: 1513287 - RNA, 15 nt, Homo sapiens
ucagaccaguacugg

SEQ ID NO: 1513288 - RNA, 22 nt, Homo sapiens
ucagagagccuagaacaucccu

SEQ ID NO: 1513289 - RNA, 14 nt, Homo sapiens
ucagaggaagcaca

SEQ ID NO: 1513290 - RNA, 20 nt, Homo sapiens
ucagaugcaccacccaugga

SEQ ID NO: 1513291 - RNA, 16 nt, Homo sapiens
ucagauggcaaugggu

SEQ ID NO: 1513292 - RNA, 16 nt, Homo sapiens
ucagauuacacuucuc

SEQ ID NO: 1513293 - RNA, 19 nt, Homo sapiens
ucagccuccgccauuccaa

SEQ ID NO: 1513294 - RNA, 15 nt, Homo sapiens
ucagcgugcuuagcc

SEQ ID NO: 1513295 - RNA, 15 nt, Homo sapiens
ucaggagggugcagu

SEQ ID NO: 1513296 - RNA, 15 nt, Homo sapiens
ucaggaucaucugag

SEQ ID NO: 1513297 - RNA, 21 nt, Homo sapiens
ucagggcccagaguugggacu

SEQ ID NO: 1513298 - RNA, 17 nt, Homo sapiens
ucagguaguacugggaa

SEQ ID NO: 1513299 - RNA, 14 nt, Homo sapiens
acgguggucuuuga

SEQ ID NO: 1513300 - RNA, 14 nt, Homo sapiens
acgucaagucuccu

SEQ ID NO: 1513301 - RNA, 15 nt, Homo sapiens
acgucucaagacuga

SEQ ID NO: 1513302 - RNA, 16 nt, Homo sapiens
acgugaagccacagga

SEQ ID NO: 1513303 - RNA, 15 nt, Homo sapiens
acguguuaggcuuua

SEQ ID NO: 1513304 - RNA, 15 nt, Homo sapiens
acuaaaaaaugucua

SEQ ID NO: 1513305 - RNA, 12 nt, Homo sapiens
acuaaaagaauu

SEQ ID NO: 1513306 - RNA, 18 nt, Homo sapiens
acuaaacagacuauuuaa

SEQ ID NO: 1513307 - RNA, 11 nt, Homo sapiens
acuaaccauag

SEQ ID NO: 1513308 - RNA, 13 nt, Homo sapiens
acuaagaggcuau

SEQ ID NO: 1513309 - RNA, 15 nt, Homo sapiens
acuaaugaagauacg

SEQ ID NO: 1513310 - RNA, 21 nt, Homo sapiens
acuacaaccaauggaauguga

SEQ ID NO: 1513311 - RNA, 15 nt, Homo sapiens
gucagagccacucua

SEQ ID NO: 1513312 - RNA, 21 nt, Homo sapiens
gucagcccuuggcuucugcuu

SEQ ID NO: 1513313 - RNA, 16 nt, Homo sapiens
gucaggagggugcagu

SEQ ID NO: 1513314 - RNA, 22 nt, Homo sapiens
gucaucaaauauuaccaaaaaa

SEQ ID NO: 1513315 - RNA, 17 nt, Homo sapiens
guccaccugccuaucca

SEQ ID NO: 1513316 - RNA, 13 nt, Homo sapiens
guccauucaucuc

SEQ ID NO: 1513317 - RNA, 14 nt, Homo sapiens
guccauucaucuca

SEQ ID NO: 1513318 - RNA, 20 nt, Homo sapiens
guccauuuuccuaaccacaa

SEQ ID NO: 1513319 - RNA, 21 nt, Homo sapiens
gucccaaguuggaaauauuca

SEQ ID NO: 1513320 - RNA, 14 nt, Homo sapiens
gucccacacuggug

SEQ ID NO: 1513321 - RNA, 16 nt, Homo sapiens
guccccagcauugcag

SEQ ID NO: 1513322 - RNA, 14 nt, Homo sapiens
gucccuugcugaca

SEQ ID NO: 1513323 - RNA, 21 nt, Homo sapiens
guccucagagcaggggccaga

SEQ ID NO: 1513324 - RNA, 21 nt, Homo sapiens
guccugggggcugcugcacug

SEQ ID NO: 1513325 - RNA, 20 nt, Homo sapiens
guccuuuuauaaacauuggu

SEQ ID NO: 1513326 - RNA, 16 nt, Homo sapiens
guccuuuuguaccaug

SEQ ID NO: 1513327 - RNA, 12 nt, Homo sapiens
gucuacauuucu

SEQ ID NO: 1513328 - RNA, 14 nt, Homo sapiens
gucuacuucacuaa

SEQ ID NO: 1513329 - RNA, 17 nt, Homo sapiens
gucucacagaggcagua

SEQ ID NO: 1513330 - RNA, 15 nt, Homo sapiens
gucucgaacuccuga

SEQ ID NO: 1513331 - RNA, 23 nt, Homo sapiens
gucucgucuccugacaugucuca

SEQ ID NO: 1513332 - RNA, 14 nt, Homo sapiens
gucucuacuaaaaa

SEQ ID NO: 1513333 - RNA, 11 nt, Homo sapiens
gucucuagcca

SEQ ID NO: 1513334 - RNA, 15 nt, Homo sapiens
gucucugcaucucau

SEQ ID NO: 1513335 - RNA, 15 nt, Homo sapiens
gucugauuggcucac

SEQ ID NO: 1513336 - RNA, 19 nt, Homo sapiens
gucugauuggcucacccaa

SEQ ID NO: 1513337 - RNA, 21 nt, Homo sapiens
gucugauuggcucacccaagc

SEQ ID NO: 1513338 - RNA, 11 nt, Homo sapiens
ucucucucuuu

SEQ ID NO: 1513339 - RNA, 9 nt, Homo sapiens
ucucucuuu

SEQ ID NO: 1513340 - RNA, 16 nt, Homo sapiens
ucucugagauguguuc

SEQ ID NO: 1513341 - RNA, 15 nt, Homo sapiens
ucucugaugcacugu

SEQ ID NO: 1513342 - RNA, 13 nt, Homo sapiens
ucucugcaucuca

SEQ ID NO: 1513343 - RNA, 22 nt, Homo sapiens
ucucugggggacagcagucucu

SEQ ID NO: 1513344 - RNA, 14 nt, Homo sapiens
ucucuuaauuuuuc

SEQ ID NO: 1513345 - RNA, 17 nt, Homo sapiens
ucucuuccuugugauug

SEQ ID NO: 1513346 - RNA, 18 nt, Homo sapiens
ucugaaacuuaauuacau

SEQ ID NO: 1513347 - RNA, 13 nt, Homo sapiens
ucugaaacuucau

SEQ ID NO: 1513348 - RNA, 14 nt, Homo sapiens
ucugaaggagauuu

SEQ ID NO: 1513349 - RNA, 22 nt, Homo sapiens
ucugaauggugcuguuucuaua

SEQ ID NO: 1513350 - RNA, 17 nt, Homo sapiens
ucugagaauuccaagga

SEQ ID NO: 1513351 - RNA, 16 nt, Homo sapiens
ucugaugggucccaaa

SEQ ID NO: 1513352 - RNA, 22 nt, Homo sapiens
ucugauuccccuccaccaaacc

SEQ ID NO: 1513353 - RNA, 18 nt, Homo sapiens
ucugcauuucuacauguu

SEQ ID NO: 1513354 - RNA, 16 nt, Homo sapiens
ucugccauuacucugc

SEQ ID NO: 1513355 - RNA, 14 nt, Homo sapiens
ucugcccacuguga

SEQ ID NO: 1513356 - RNA, 20 nt, Homo sapiens
ucugcccacugugaaaccac

SEQ ID NO: 1513357 - RNA, 20 nt, Homo sapiens
ucugccccagcucuggcuuc

SEQ ID NO: 1513358 - RNA, 15 nt, Homo sapiens
ucugcuaaauuuaau

SEQ ID NO: 1513359 - RNA, 22 nt, Homo sapiens
ucugcugagcagcccagcacaa

SEQ ID NO: 1513360 - RNA, 22 nt, Homo sapiens
ucugcuuucuccuguagcacaa

SEQ ID NO: 1513361 - RNA, 20 nt, Homo sapiens
ucuggauauggugcaaaaau

SEQ ID NO: 1513362 - RNA, 20 nt, Homo sapiens
ucuggauuagaaugccgguu

SEQ ID NO: 1513363 - RNA, 17 nt, Homo sapiens
ucuggauucaaauguca

SEQ ID NO: 1513364 - RNA, 20 nt, Homo sapiens
ucuggcuuugucucuagccg

SEQ ID NO: 1513365 - RNA, 18 nt, Homo sapiens
ucugggaguccugucagc

SEQ ID NO: 1513366 - RNA, 17 nt, Homo sapiens
ucugggccaaguuccuc

SEQ ID NO: 1513367 - RNA, 13 nt, Homo sapiens
ucuggugccauuu

SEQ ID NO: 1513368 - RNA, 20 nt, Homo sapiens
ucugguuuuaacaauuuccu

SEQ ID NO: 1513369 - RNA, 14 nt, Homo sapiens
ucuguagugucacu

SEQ ID NO: 1513370 - RNA, 18 nt, Homo sapiens
ucugugacccaucuguag

SEQ ID NO: 1513371 - RNA, 15 nt, Homo sapiens
ucuguguuuacuuaa

SEQ ID NO: 1513372 - RNA, 20 nt, Homo sapiens
ucuguuaugcaagcacaaau

SEQ ID NO: 1513373 - RNA, 18 nt, Homo sapiens
ucuguuuuuuuaagaaag

SEQ ID NO: 1513374 - RNA, 17 nt, Homo sapiens
ucuuaaguaaggacaaa

SEQ ID NO: 1513375 - RNA, 16 nt, Homo sapiens
ucuuacuuaucaaaag

SEQ ID NO: 1513376 - RNA, 18 nt, Homo sapiens
ucuuauucaugcuuucuc

SEQ ID NO: 1513377 - RNA, 17 nt, Homo sapiens
ucuucagagcaagcacu

SEQ ID NO: 1513378 - RNA, 16 nt, Homo sapiens
ucuucggggugugaug

SEQ ID NO: 1513379 - RNA, 13 nt, Homo sapiens
ucuucugccucag

SEQ ID NO: 1513380 - RNA, 16 nt, Homo sapiens
ucuucuggauuagaau

SEQ ID NO: 1513381 - RNA, 14 nt, Homo sapiens
ucuugcugccaggc

SEQ ID NO: 1513382 - RNA, 15 nt, Homo sapiens
ucuuggcaguauucc

SEQ ID NO: 1513383 - RNA, 14 nt, Homo sapiens
ucuuuaaaaccaua

SEQ ID NO: 1513384 - RNA, 21 nt, Homo sapiens
ucuuuaaccucaucuacaagc

SEQ ID NO: 1513385 - RNA, 15 nt, Homo sapiens
ucuuuaaggaucucu

SEQ ID NO: 1513386 - RNA, 20 nt, Homo sapiens
ucuuuacaauaaacauagcu

SEQ ID NO: 1513387 - RNA, 15 nt, Homo sapiens
ucuuuacuggugauu

SEQ ID NO: 1513388 - RNA, 19 nt, Homo sapiens
ucuuugaauuauaugucua

SEQ ID NO: 1513389 - RNA, 17 nt, Homo sapiens
ucuuuggggucagccag

SEQ ID NO: 1513390 - RNA, 14 nt, Homo sapiens
ucuuuguacauuuu

SEQ ID NO: 1513391 - RNA, 15 nt, Homo sapiens
ucuuuuucacacuga

SEQ ID NO: 1513392 - RNA, 17 nt, Homo sapiens
ugaaaaaaaaaagacaa

SEQ ID NO: 1513393 - RNA, 17 nt, Homo sapiens
ugaaaaaaaguacaugu

SEQ ID NO: 1513394 - RNA, 15 nt, Homo sapiens
ugaaaaaaaugcauu

SEQ ID NO: 1513395 - RNA, 14 nt, Homo sapiens
ugaaaacaauguaa

SEQ ID NO: 1513396 - RNA, 21 nt, Homo sapiens
ugaaaagcuagaauugagugu

SEQ ID NO: 1513397 - RNA, 22 nt, Homo sapiens
ugaaaauaauuguuccaaauga

SEQ ID NO: 1513398 - RNA, 15 nt, Homo sapiens
ugaaaauaugauguu

SEQ ID NO: 1513399 - RNA, 19 nt, Homo sapiens
ugaaaauuauuccuugcuu

SEQ ID NO: 1513400 - RNA, 12 nt, Homo sapiens
ugaaaccaaaga

SEQ ID NO: 1513401 - RNA, 11 nt, Homo sapiens
ugaaagcaauc

SEQ ID NO: 1513402 - RNA, 14 nt, Homo sapiens
ugaaagcagaugag

SEQ ID NO: 1513403 - RNA, 22 nt, Homo sapiens
ugaaauaaaaugcuaucucaaa

SEQ ID NO: 1513404 - RNA, 19 nt, Homo sapiens
ugaaauaauuaaaaaccac

SEQ ID NO: 1513405 - RNA, 18 nt, Homo sapiens
ugaaauaccacaagccug

SEQ ID NO: 1513406 - RNA, 19 nt, Homo sapiens
ugaaaugcuuguugaauca

SEQ ID NO: 1513407 - RNA, 21 nt, Homo sapiens
ugaaauuguguuugacauucu

SEQ ID NO: 1513408 - RNA, 15 nt, Homo sapiens
ugaacacacucagca

SEQ ID NO: 1513409 - RNA, 17 nt, Homo sapiens
ugaacaucucacuuugc

SEQ ID NO: 1513410 - RNA, 17 nt, Homo sapiens
ugaaccugaugagcaag

SEQ ID NO: 1513411 - RNA, 17 nt, Homo sapiens
ugaagacggauuacuaa

SEQ ID NO: 1513412 - RNA, 22 nt, Homo sapiens
ugaagauacgguugcuucaccu

SEQ ID NO: 1513413 - RNA, 18 nt, Homo sapiens
ugaagcaaccuacuuuug

SEQ ID NO: 1513414 - RNA, 20 nt, Homo sapiens
ugaaggaaaaccucacuuga

SEQ ID NO: 1513415 - RNA, 19 nt, Homo sapiens
ugaaggacagaacauugcc

SEQ ID NO: 1513416 - RNA, 22 nt, Homo sapiens
ugaaggaggugagggaugugaa

SEQ ID NO: 1513417 - RNA, 16 nt, Homo sapiens
ugaagguaacugagag

SEQ ID NO: 1513418 - RNA, 20 nt, Homo sapiens
ugaaguaaaggauugaucac

SEQ ID NO: 1513419 - RNA, 17 nt, Homo sapiens
ugaagucccucuauguc

SEQ ID NO: 1513420 - RNA, 17 nt, Homo sapiens
ugaagugccacaugaca

SEQ ID NO: 1513421 - RNA, 16 nt, Homo sapiens
ugaaguuuuuauuuag

SEQ ID NO: 1513422 - RNA, 17 nt, Homo sapiens
ugaauaaaguacuacau

SEQ ID NO: 1513423 - RNA, 17 nt, Homo sapiens
ugaauaaguauucuuca

SEQ ID NO: 1513424 - RNA, 20 nt, Homo sapiens
ugaauagaaaaaguaaucaa

SEQ ID NO: 1513425 - RNA, 15 nt, Homo sapiens
ugaaucuuuuccacu

SEQ ID NO: 1513426 - RNA, 15 nt, Homo sapiens
ugaauggccugccuu

SEQ ID NO: 1513427 - RNA, 20 nt, Homo sapiens
ugaauuagccaaaacacuua

SEQ ID NO: 1513428 - RNA, 15 nt, Homo sapiens
ugacaagauggaaaa

SEQ ID NO: 1513429 - RNA, 19 nt, Homo sapiens
ugacaaguagggcacaaaa

SEQ ID NO: 1513430 - RNA, 20 nt, Homo sapiens
ugacaaguagggcacaaaau

SEQ ID NO: 1513431 - RNA, 23 nt, Homo sapiens
ugacagcaguguuaaguguuuga

SEQ ID NO: 1513432 - RNA, 14 nt, Homo sapiens
ugacagggaaaaga

SEQ ID NO: 1513433 - RNA, 21 nt, Homo sapiens
ugacauggagaccgugaccag

SEQ ID NO: 1513434 - RNA, 15 nt, Homo sapiens
auuuaacaaauacau

SEQ ID NO: 1513435 - RNA, 13 nt, Homo sapiens
auuuaacacuaaa

SEQ ID NO: 1513436 - RNA, 17 nt, Homo sapiens
auuuaacacuauccaau

SEQ ID NO: 1513437 - RNA, 13 nt, Homo sapiens
auuuaacuugagg

SEQ ID NO: 1513438 - RNA, 16 nt, Homo sapiens
auuuacuaugccacag

SEQ ID NO: 1513439 - RNA, 11 nt, Homo sapiens
auuuacuuaac

SEQ ID NO: 1513440 - RNA, 24 nt, Homo sapiens
auuuaguugugcagucagugucaa

SEQ ID NO: 1513441 - RNA, 13 nt, Homo sapiens
auuuauaucuuau

SEQ ID NO: 1513442 - RNA, 13 nt, Homo sapiens
auuucaaaacaca

SEQ ID NO: 1513443 - RNA, 14 nt, Homo sapiens
auuucaagugccua

SEQ ID NO: 1513444 - RNA, 17 nt, Homo sapiens
auuucaucugagugugg

SEQ ID NO: 1513445 - RNA, 23 nt, Homo sapiens
auuuccugcuacacaaaagccaa

SEQ ID NO: 1513446 - RNA, 14 nt, Homo sapiens
auuucucaagaaua

SEQ ID NO: 1513447 - RNA, 17 nt, Homo sapiens
auuucugaaaugacaga

SEQ ID NO: 1513448 - RNA, 14 nt, Homo sapiens
auuugaaaugucau

SEQ ID NO: 1513449 - RNA, 17 nt, Homo sapiens
auuuguauuuugcuuaa

SEQ ID NO: 1513450 - RNA, 23 nt, Homo sapiens
auuuuacuuccaugauacuuuaa

SEQ ID NO: 1513451 - RNA, 21 nt, Homo sapiens
auuuuaucacaaacuuaacau

SEQ ID NO: 1513452 - RNA, 14 nt, Homo sapiens
auuuucauuucacu

SEQ ID NO: 1513453 - RNA, 19 nt, Homo sapiens
auuuuccuuauuguuugua

SEQ ID NO: 1513454 - RNA, 19 nt, Homo sapiens
auuuuccuuccuacacccu

SEQ ID NO: 1513455 - RNA, 15 nt, Homo sapiens
auuuucuagacuuuc

SEQ ID NO: 1513456 - RNA, 14 nt, Homo sapiens
auuuucuaguccau

SEQ ID NO: 1513457 - RNA, 19 nt, Homo sapiens
auuuucuuggcaguauucc

SEQ ID NO: 1513458 - RNA, 18 nt, Homo sapiens
auuuugggacuucuaccc

SEQ ID NO: 1513459 - RNA, 14 nt, Homo sapiens
auuuuguaugaaaa

SEQ ID NO: 1513460 - RNA, 16 nt, Homo sapiens
auuuuuuuaacacaua

SEQ ID NO: 1513461 - RNA, 13 nt, Homo sapiens
caaaaaaccacaa

SEQ ID NO: 1513462 - RNA, 14 nt, Homo sapiens
caaaaaaccacaaa

SEQ ID NO: 1513463 - RNA, 14 nt, Homo sapiens
caaaaaacccaaga

SEQ ID NO: 1513464 - RNA, 17 nt, Homo sapiens
caaaaacaaaaaaccac

SEQ ID NO: 1513465 - RNA, 15 nt, Homo sapiens
caaaaagacagugug

SEQ ID NO: 1513466 - RNA, 21 nt, Homo sapiens
caaaaauaaaaggaaaaccag

SEQ ID NO: 1513467 - RNA, 21 nt, Homo sapiens
caaaaaugaaagcaugucuca

SEQ ID NO: 1513468 - RNA, 17 nt, Homo sapiens
caaaacaaaacaacaac

SEQ ID NO: 1513469 - RNA, 12 nt, Homo sapiens
caaaacucuguc

SEQ ID NO: 1513470 - RNA, 12 nt, Homo sapiens
caaaagccaaaa

SEQ ID NO: 1513471 - RNA, 14 nt, Homo sapiens
caaaaggcugagaa

SEQ ID NO: 1513472 - RNA, 19 nt, Homo sapiens
agugcaagagacucuggcc

SEQ ID NO: 1513473 - RNA, 16 nt, Homo sapiens
agugccuagacuguua

SEQ ID NO: 1513474 - RNA, 19 nt, Homo sapiens
agugcugugcugugcuaug

SEQ ID NO: 1513475 - RNA, 21 nt, Homo sapiens
aguggaugacgugaagccaca

SEQ ID NO: 1513476 - RNA, 18 nt, Homo sapiens
agugggccugguagcaca

SEQ ID NO: 1513477 - RNA, 20 nt, Homo sapiens
agugggccugguagcacaug

SEQ ID NO: 1513478 - RNA, 22 nt, Homo sapiens
agugggggcggggaagggugca

SEQ ID NO: 1513479 - RNA, 16 nt, Homo sapiens
agugggugguggaucu

SEQ ID NO: 1513480 - RNA, 24 nt, Homo sapiens
agugggugguggaucuguccaagg

SEQ ID NO: 1513481 - RNA, 17 nt, Homo sapiens
aguguaacagauaucag

SEQ ID NO: 1513482 - RNA, 18 nt, Homo sapiens
agugucuccccguguccu

SEQ ID NO: 1513483 - RNA, 16 nt, Homo sapiens
aguguuugcaauggug

SEQ ID NO: 1513484 - RNA, 23 nt, Homo sapiens
aguuaacugugaaauaccacaag

SEQ ID NO: 1513485 - RNA, 16 nt, Homo sapiens
aguuauuaaacagugu

SEQ ID NO: 1513486 - RNA, 18 nt, Homo sapiens
aguucagaggaagcacau

SEQ ID NO: 1513487 - RNA, 18 nt, Homo sapiens
aguuccugcacuccagaa

SEQ ID NO: 1513488 - RNA, 16 nt, Homo sapiens
aguucuggaaaccacg

SEQ ID NO: 1513489 - RNA, 13 nt, Homo sapiens
aguugaacaucuc

SEQ ID NO: 1513490 - RNA, 15 nt, Homo sapiens
aguugacuuacuguu

SEQ ID NO: 1513491 - RNA, 23 nt, Homo sapiens
aguugggaugcggggcagagcca

SEQ ID NO: 1513492 - RNA, 15 nt, Homo sapiens
aguuuaaaaaaccau

SEQ ID NO: 1513493 - RNA, 22 nt, Homo sapiens
aguuuacagaauggaaccaaaa

SEQ ID NO: 1513494 - RNA, 23 nt, Homo sapiens
aguuuccaaguuccugcacucca

SEQ ID NO: 1513495 - RNA, 22 nt, Homo sapiens
aguuuccugguuuguaaggcag

SEQ ID NO: 1513496 - RNA, 15 nt, Homo sapiens
aguuucuggugccau

SEQ ID NO: 1513497 - RNA, 19 nt, Homo sapiens
aguuucuuccccaagagcu

SEQ ID NO: 1513498 - RNA, 23 nt, Homo sapiens
ggcucuguuaugcaagcacaaau

SEQ ID NO: 1513499 - RNA, 15 nt, Homo sapiens
ggcugucuuccccca

SEQ ID NO: 1513500 - RNA, 17 nt, Homo sapiens
ggcugucuugguggaug

SEQ ID NO: 1513501 - RNA, 13 nt, Homo sapiens
ggcuuagugccac

SEQ ID NO: 1513502 - RNA, 15 nt, Homo sapiens
gggaagagugcauuu

SEQ ID NO: 1513503 - RNA, 18 nt, Homo sapiens
gggaugccacccagcaac

SEQ ID NO: 1513504 - RNA, 19 nt, Homo sapiens
gggauucuaggaaacccaa

SEQ ID NO: 1513505 - RNA, 19 nt, Homo sapiens
gggauuggagggaagacag

SEQ ID NO: 1513506 - RNA, 16 nt, Homo sapiens
gggcaagucccugacu

SEQ ID NO: 1513507 - RNA, 15 nt, Homo sapiens
gggcagggguuccca

SEQ ID NO: 1513508 - RNA, 16 nt, Homo sapiens
gggccagggcccugca

SEQ ID NO: 1513509 - RNA, 20 nt, Homo sapiens
gggccgggaggcagugcuga

SEQ ID NO: 1513510 - RNA, 22 nt, Homo sapiens
gggcuaggguaggggcaaggaa

SEQ ID NO: 1513511 - RNA, 22 nt, Homo sapiens
gggcugagcccuggcaggauga

SEQ ID NO: 1513512 - RNA, 19 nt, Homo sapiens
gggcugugucguagccaag

SEQ ID NO: 1513513 - RNA, 13 nt, Homo sapiens
ggggaagggugca

SEQ ID NO: 1513514 - RNA, 22 nt, Homo sapiens
ggggacugcuaccucugagaag

SEQ ID NO: 1513515 - RNA, 15 nt, Homo sapiens
ggggagcaugggacu

SEQ ID NO: 1513516 - RNA, 15 nt, Homo sapiens
gggggccgugcccag

SEQ ID NO: 1513517 - RNA, 20 nt, Homo sapiens
ggguauaguucaugucugcu

SEQ ID NO: 1513518 - RNA, 20 nt, Homo sapiens
ggguccacccagcaaagagu

SEQ ID NO: 1513519 - RNA, 20 nt, Homo sapiens
gggucccucggagcugccag

SEQ ID NO: 1513520 - RNA, 11 nt, Homo sapiens
gggugugauga

SEQ ID NO: 1513521 - RNA, 21 nt, Homo sapiens
ggguuuugucucugcaucuca

SEQ ID NO: 1513522 - RNA, 16 nt, Homo sapiens
gguaagcauuagcaca

SEQ ID NO: 1513523 - RNA, 13 nt, Homo sapiens
gguaauaagccaa

SEQ ID NO: 1513524 - RNA, 23 nt, Homo sapiens
gguagaaccacuuggcugcucau

SEQ ID NO: 1513525 - RNA, 14 nt, Homo sapiens
gguagcgagcugcu

SEQ ID NO: 1513526 - RNA, 13 nt, Homo sapiens
gguaguacuggga

SEQ ID NO: 1513527 - RNA, 18 nt, Homo sapiens
gguauaguucaugucugc

SEQ ID NO: 1513528 - RNA, 12 nt, Homo sapiens
gguaugagcuga

SEQ ID NO: 1513529 - RNA, 17 nt, Homo sapiens
gguauuagcaaagcaaa

SEQ ID NO: 1513530 - RNA, 19 nt, Homo sapiens
gguauuugcuuuguaacuc

SEQ ID NO: 1513531 - RNA, 13 nt, Homo sapiens
ggucaaaugcugu

SEQ ID NO: 1513532 - RNA, 14 nt, Homo sapiens
ggucagagugccac

SEQ ID NO: 1513533 - RNA, 14 nt, Homo sapiens
ggucagcgugcuua

SEQ ID NO: 1513534 - RNA, 17 nt, Homo sapiens
ggucaggagggugcagu

SEQ ID NO: 1513535 - RNA, 18 nt, Homo sapiens
ggucaggagggugcagua

SEQ ID NO: 1513536 - RNA, 15 nt, Homo sapiens
ggugagaccaaagga

SEQ ID NO: 1513537 - RNA, 13 nt, Homo sapiens
ggugagguccugu

SEQ ID NO: 1513538 - RNA, 20 nt, Homo sapiens
ggugauaacuugcauacuau

SEQ ID NO: 1513539 - RNA, 21 nt, Homo sapiens
ggugccaggcuguaagcauuc

SEQ ID NO: 1513540 - RNA, 16 nt, Homo sapiens
gguggcucuccaguua

SEQ ID NO: 1513541 - RNA, 22 nt, Homo sapiens
gguggggacagguaaguggcag

SEQ ID NO: 1513542 - RNA, 16 nt, Homo sapiens
gguuaaaacaaaaaca

SEQ ID NO: 1513543 - RNA, 13 nt, Homo sapiens
gccuguugcugaa

SEQ ID NO: 1513544 - RNA, 20 nt, Homo sapiens
gccuucauaagccuaccaau

SEQ ID NO: 1513545 - RNA, 21 nt, Homo sapiens
gccuuccaggcagacacagcu

SEQ ID NO: 1513546 - RNA, 23 nt, Homo sapiens
gccuugucuucuuagcugucacc

SEQ ID NO: 1513547 - RNA, 22 nt, Homo sapiens
gccuuucugccucacaucagcc

SEQ ID NO: 1513548 - RNA, 19 nt, Homo sapiens
gccuuuuguggauugacag

SEQ ID NO: 1513549 - RNA, 18 nt, Homo sapiens
gcgaaggggcccuggucc

SEQ ID NO: 1513550 - RNA, 15 nt, Homo sapiens
gcgcagcgcgugcac

SEQ ID NO: 1513551 - RNA, 16 nt, Homo sapiens
gcgcagcgcgugcaca

SEQ ID NO: 1513552 - RNA, 24 nt, Homo sapiens
gcgcgcagcgcgugcacagcgcgg

SEQ ID NO: 1513553 - RNA, 19 nt, Homo sapiens
gcggccaugauggugcuga

SEQ ID NO: 1513554 - RNA, 13 nt, Homo sapiens
gcggcuccagguc

SEQ ID NO: 1513555 - RNA, 15 nt, Homo sapiens
gcggggaagggugca

SEQ ID NO: 1513556 - RNA, 19 nt, Homo sapiens
gcgugguggcgggcaccua

SEQ ID NO: 1513557 - RNA, 21 nt, Homo sapiens
gcguuucaggaacguugccac

SEQ ID NO: 1513558 - RNA, 21 nt, Homo sapiens
gcuaaacauugugaugauuau

SEQ ID NO: 1513559 - RNA, 15 nt, Homo sapiens
gcuacucucuugcca

SEQ ID NO: 1513560 - RNA, 15 nt, Homo sapiens
gcuaggaaagggaag

SEQ ID NO: 1513561 - RNA, 21 nt, Homo sapiens
gcuaggaaagggaagccugac

SEQ ID NO: 1513562 - RNA, 14 nt, Homo sapiens
gcuagggagugguc

SEQ ID NO: 1513563 - RNA, 21 nt, Homo sapiens
gcuagucuauggucaguugag

SEQ ID NO: 1513564 - RNA, 21 nt, Homo sapiens
gcucagcccugacuggugcua

SEQ ID NO: 1513565 - RNA, 15 nt, Homo sapiens
gcucagucucaggag

SEQ ID NO: 1513566 - RNA, 23 nt, Homo sapiens
gcucauuugucauuuacccuggu

SEQ ID NO: 1513567 - RNA, 20 nt, Homo sapiens
gcuccccagugcuaccucuc

SEQ ID NO: 1513568 - RNA, 20 nt, Homo sapiens
gcuccggaggggacccagcu

SEQ ID NO: 1513569 - RNA, 19 nt, Homo sapiens
gcuccuugaagaaucucuc

SEQ ID NO: 1513570 - RNA, 17 nt, Homo sapiens
gcuccuuuaccuaccac

SEQ ID NO: 1513571 - RNA, 23 nt, Homo sapiens
gcucugcccacugugaaaccacu

SEQ ID NO: 1513572 - RNA, 21 nt, Homo sapiens
gcucugggagggauguucuag

SEQ ID NO: 1513573 - RNA, 17 nt, Homo sapiens
gcucuguauggucagga

SEQ ID NO: 1513574 - RNA, 21 nt, Homo sapiens
gcugaggggaggaucacugga

SEQ ID NO: 1513575 - RNA, 15 nt, Homo sapiens
gcugaggggcaggga

SEQ ID NO: 1513576 - RNA, 16 nt, Homo sapiens
gcugaggggcagggag

SEQ ID NO: 1513577 - RNA, 16 nt, Homo sapiens
gcugauucaagaaaca

SEQ ID NO: 1513578 - RNA, 20 nt, Homo sapiens
gcugcagugacgugcaccug

SEQ ID NO: 1513579 - RNA, 19 nt, Homo sapiens
gcugccccuggugcacugg

SEQ ID NO: 1513580 - RNA, 13 nt, Homo sapiens
gcugcugcacacu

SEQ ID NO: 1513581 - RNA, 15 nt, Homo sapiens
gcugcugcacugccc

SEQ ID NO: 1513582 - RNA, 18 nt, Homo sapiens
gcuggaaauaaaccugga

SEQ ID NO: 1513583 - RNA, 21 nt, Homo sapiens
gcuggaaauaaaccuggagau

SEQ ID NO: 1513584 - RNA, 21 nt, Homo sapiens
gcuggagcaaaagucauuaca

SEQ ID NO: 1513585 - RNA, 19 nt, Homo sapiens
gcuggaguacagugacacg

SEQ ID NO: 1513586 - RNA, 14 nt, Homo sapiens
gcugguacuaagag

SEQ ID NO: 1513587 - RNA, 22 nt, Homo sapiens
gcuguagcucccgagcuacucu

SEQ ID NO: 1513588 - RNA, 14 nt, Homo sapiens
gcugucgcaucuca

SEQ ID NO: 1513589 - RNA, 15 nt, Homo sapiens
gcugucgcaucucag

SEQ ID NO: 1513590 - RNA, 15 nt, Homo sapiens
gcuguggccagggug

SEQ ID NO: 1513591 - RNA, 16 nt, Homo sapiens
gcuuaaaaugccagau

SEQ ID NO: 1513592 - RNA, 18 nt, Homo sapiens
gagugacucgaggguugg

SEQ ID NO: 1513593 - RNA, 17 nt, Homo sapiens
gagugagacucgucuca

SEQ ID NO: 1513594 - RNA, 18 nt, Homo sapiens
gaguguuuaaaguucaac

SEQ ID NO: 1513595 - RNA, 23 nt, Homo sapiens
gaguuccaugaagaccacaucca

SEQ ID NO: 1513596 - RNA, 23 nt, Homo sapiens
gaguuggacuucagucuugccua

SEQ ID NO: 1513597 - RNA, 14 nt, Homo sapiens
gaguuucgagguag

SEQ ID NO: 1513598 - RNA, 17 nt, Homo sapiens
gauaaacuaaaagcaua

SEQ ID NO: 1513599 - RNA, 16 nt, Homo sapiens
gauaaagcaguauuug

SEQ ID NO: 1513600 - RNA, 20 nt, Homo sapiens
gauaaucgagucuaccucuu

SEQ ID NO: 1513601 - RNA, 13 nt, Homo sapiens
gauacauacagaa

SEQ ID NO: 1513602 - RNA, 13 nt, Homo sapiens
gauagcugaauga

SEQ ID NO: 1513603 - RNA, 16 nt, Homo sapiens
gauauauacacaggau

SEQ ID NO: 1513604 - RNA, 15 nt, Homo sapiens
gauauauaccacuuu

SEQ ID NO: 1513605 - RNA, 17 nt, Homo sapiens
gauauauaccacuuucc

SEQ ID NO: 1513606 - RNA, 20 nt, Homo sapiens
gauaucaguuaucaauguua

SEQ ID NO: 1513607 - RNA, 12 nt, Homo sapiens
gauauggcuuuu

SEQ ID NO: 1513608 - RNA, 22 nt, Homo sapiens
gauauuucccaauacauaccac

SEQ ID NO: 1513609 - RNA, 12 nt, Homo sapiens
gaucaacauucc

SEQ ID NO: 1513610 - RNA, 15 nt, Homo sapiens
gaucacuuuguuaaa

SEQ ID NO: 1513611 - RNA, 19 nt, Homo sapiens
gaucacuuuguuaaaaaua

SEQ ID NO: 1513612 - RNA, 18 nt, Homo sapiens
gaucauagguauuucaaa

SEQ ID NO: 1513613 - RNA, 14 nt, Homo sapiens
gauccuacucuucc

SEQ ID NO: 1513614 - RNA, 21 nt, Homo sapiens
gauccuugauaaaugccucau

SEQ ID NO: 1513615 - RNA, 13 nt, Homo sapiens
gaucuaguucuca

SEQ ID NO: 1513616 - RNA, 17 nt, Homo sapiens
gaucuguguuuacuuaa

SEQ ID NO: 1513617 - RNA, 17 nt, Homo sapiens
gaucuuucuauuccaaa

SEQ ID NO: 1513618 - RNA, 13 nt, Homo sapiens
gaugaaacauuca

SEQ ID NO: 1513619 - RNA, 18 nt, Homo sapiens
gaugaguuuaucauguca

SEQ ID NO: 1513620 - RNA, 21 nt, Homo sapiens
gauggaauaaagcccuugaac

SEQ ID NO: 1513621 - RNA, 17 nt, Homo sapiens
gaugggcccugcaagac

SEQ ID NO: 1513622 - RNA, 18 nt, Homo sapiens
gaugugcaagucuuguca

SEQ ID NO: 1513623 - RNA, 20 nt, Homo sapiens
gaugugugucucaccccuca

SEQ ID NO: 1513624 - RNA, 18 nt, Homo sapiens
gauguuaagcaaaggaaa

SEQ ID NO: 1513625 - RNA, 17 nt, Homo sapiens
gauguuacaucacagug

SEQ ID NO: 1513626 - RNA, 19 nt, Homo sapiens
gauguuuacagacugugag

SEQ ID NO: 1513627 - RNA, 16 nt, Homo sapiens
gauucuucugccucag

SEQ ID NO: 1513628 - RNA, 15 nt, Homo sapiens
gauuuaacacuaucc

SEQ ID NO: 1513629 - RNA, 17 nt, Homo sapiens
gauuuaacacuauccaa

SEQ ID NO: 1513630 - RNA, 22 nt, Homo sapiens
gauuucaggauacucugucaga

SEQ ID NO: 1513631 - RNA, 13 nt, Homo sapiens
gauuuuccuuccu

SEQ ID NO: 1513632 - RNA, 12 nt, Homo sapiens
gcaaaagucauu

SEQ ID NO: 1513633 - RNA, 21 nt, Homo sapiens
gcaaaaguggaaucacuguau

SEQ ID NO: 1513634 - RNA, 11 nt, Homo sapiens
gcaaaccucag

SEQ ID NO: 1513635 - RNA, 23 nt, Homo sapiens
gcaaacggaguacagacgucuca

SEQ ID NO: 1513636 - RNA, 18 nt, Homo sapiens
gcaaagcaaaaggcugag

SEQ ID NO: 1513637 - RNA, 18 nt, Homo sapiens
gcaaagguggcucuccag

SEQ ID NO: 1513638 - RNA, 18 nt, Homo sapiens
gcaagagaaaauaaacca

SEQ ID NO: 1513639 - RNA, 22 nt, Homo sapiens
gcaagaggugguagaaccacuu

SEQ ID NO: 1513640 - RNA, 20 nt, Homo sapiens
gcacacuagccucuccagga

SEQ ID NO: 1513641 - RNA, 16 nt, Homo sapiens
gcacagucugaugaca

SEQ ID NO: 1513642 - RNA, 20 nt, Homo sapiens
gcaccacugcacuccagccu

SEQ ID NO: 1513643 - RNA, 19 nt, Homo sapiens
gcaccgagagagauggaau

SEQ ID NO: 1513644 - RNA, 22 nt, Homo sapiens
gcaccgagagagauggaauaaa

SEQ ID NO: 1513645 - RNA, 17 nt, Homo sapiens
gcaccuguacucaggag

SEQ ID NO: 1513646 - RNA, 12 nt, Homo sapiens
gcaccuucaaua

SEQ ID NO: 1513647 - RNA, 14 nt, Homo sapiens
cuugugcucaagga

SEQ ID NO: 1513648 - RNA, 15 nt, Homo sapiens
cuuguguccugauga

SEQ ID NO: 1513649 - RNA, 21 nt, Homo sapiens
cuuuaaaaccauaaacuguac

SEQ ID NO: 1513650 - RNA, 21 nt, Homo sapiens
cuuuaaggagaagagaucuuc

SEQ ID NO: 1513651 - RNA, 18 nt, Homo sapiens
cuuuaauuuuuauaaaua

SEQ ID NO: 1513652 - RNA, 17 nt, Homo sapiens
cuuuacuggugauuucu

SEQ ID NO: 1513653 - RNA, 23 nt, Homo sapiens
cuuuagaguagcaugagagaauu

SEQ ID NO: 1513654 - RNA, 15 nt, Homo sapiens
cuuuaggcagguuac

SEQ ID NO: 1513655 - RNA, 17 nt, Homo sapiens
cuuuauaaaagcaaaag

SEQ ID NO: 1513656 - RNA, 15 nt, Homo sapiens
cuuuauagcucauca

SEQ ID NO: 1513657 - RNA, 22 nt, Homo sapiens
cuuuaucaaaaaguacaauaau

SEQ ID NO: 1513658 - RNA, 15 nt, Homo sapiens
cuuucaucacuaccu

SEQ ID NO: 1513659 - RNA, 18 nt, Homo sapiens
cuuucaugaguuucccag

SEQ ID NO: 1513660 - RNA, 19 nt, Homo sapiens
cuuucccaugauccagaac

SEQ ID NO: 1513661 - RNA, 22 nt, Homo sapiens
cuuuccccagugacaccucagc

SEQ ID NO: 1513662 - RNA, 21 nt, Homo sapiens
cuuucccccaccccagaguug

SEQ ID NO: 1513663 - RNA, 21 nt, Homo sapiens
cuuucucgugguagaagccag

SEQ ID NO: 1513664 - RNA, 16 nt, Homo sapiens
cuuucuguaaccaaaa

SEQ ID NO: 1513665 - RNA, 15 nt, Homo sapiens
cuuucuguugccaca

SEQ ID NO: 1513666 - RNA, 16 nt, Homo sapiens
cuuucuucaccaaauc

SEQ ID NO: 1513667 - RNA, 16 nt, Homo sapiens
cuuugagaacaaugga

SEQ ID NO: 1513668 - RNA, 20 nt, Homo sapiens
cuuugcaaugcaagcccuuu

SEQ ID NO: 1513669 - RNA, 16 nt, Homo sapiens
cuuugcaggcccagca

SEQ ID NO: 1513670 - RNA, 16 nt, Homo sapiens
cuuugccaaaauacca

SEQ ID NO: 1513671 - RNA, 14 nt, Homo sapiens
cuuugcuuugugua

SEQ ID NO: 1513672 - RNA, 12 nt, Homo sapiens
cuuuguguaaag

SEQ ID NO: 1513673 - RNA, 14 nt, Homo sapiens
cuuuguucaguuga

SEQ ID NO: 1513674 - RNA, 21 nt, Homo sapiens
cuuuuaguauuuuagugaacu

SEQ ID NO: 1513675 - RNA, 21 nt, Homo sapiens
cuuuucaaggaaaaaugcugc

SEQ ID NO: 1513676 - RNA, 15 nt, Homo sapiens
cuuuucaugucauuu

SEQ ID NO: 1513677 - RNA, 11 nt, Homo sapiens
cuuuuucacag

SEQ ID NO: 1513678 - RNA, 22 nt, Homo sapiens
gaaaaaaauucugauacauuag

SEQ ID NO: 1513679 - RNA, 22 nt, Homo sapiens
gaaaaaacuagagccugugcua

SEQ ID NO: 1513680 - RNA, 23 nt, Homo sapiens
gaaaaaugcugcuucuccuccca

SEQ ID NO: 1513681 - RNA, 15 nt, Homo sapiens
gaaaacuuauuugag

SEQ ID NO: 1513682 - RNA, 23 nt, Homo sapiens
gaaaagaacacuagagucuguca

SEQ ID NO: 1513683 - RNA, 18 nt, Homo sapiens
gaaaauacauaagaccau

SEQ ID NO: 1513684 - RNA, 14 nt, Homo sapiens
gaaaauccauggau

SEQ ID NO: 1513685 - RNA, 15 nt, Homo sapiens
gaaaaugugacccag

SEQ ID NO: 1513686 - RNA, 22 nt, Homo sapiens
gaaacaacuuguguucuauuaa

SEQ ID NO: 1513687 - RNA, 14 nt, Homo sapiens
gaaacaucauucua

SEQ ID NO: 1513688 - RNA, 16 nt, Homo sapiens
gaaacuaguaucucug

SEQ ID NO: 1513689 - RNA, 18 nt, Homo sapiens
gaaacucacgaugaaauu

SEQ ID NO: 1513690 - RNA, 21 nt, Homo sapiens
gaaagaaauucuuuucaaaag

SEQ ID NO: 1513691 - RNA, 17 nt, Homo sapiens
gaaagaaggacacuugu

SEQ ID NO: 1513692 - RNA, 19 nt, Homo sapiens
gaaagccucugcugccaug

SEQ ID NO: 1513693 - RNA, 13 nt, Homo sapiens
gaaaggcucaguc

SEQ ID NO: 1513694 - RNA, 12 nt, Homo sapiens
gaaagguggugu

SEQ ID NO: 1513695 - RNA, 20 nt, Homo sapiens
gaaaguaaaaguuauaucua

SEQ ID NO: 1513696 - RNA, 13 nt, Homo sapiens
gaaagugcugacu

SEQ ID NO: 1513697 - RNA, 17 nt, Homo sapiens
gaaagugguucuaugau

SEQ ID NO: 1513698 - RNA, 13 nt, Homo sapiens
gaaauaaaccugg

SEQ ID NO: 1513699 - RNA, 14 nt, Homo sapiens
gaaauaaaccugga

SEQ ID NO: 1513700 - RNA, 20 nt, Homo sapiens
gaaauaauugccaaauaccu

SEQ ID NO: 1513701 - RNA, 15 nt, Homo sapiens
gaaauagacaguaua

SEQ ID NO: 1513702 - RNA, 15 nt, Homo sapiens
gaaaucaaagcgcca

SEQ ID NO: 1513703 - RNA, 20 nt, Homo sapiens
gaaaucaacuugcuuaucaa

SEQ ID NO: 1513704 - RNA, 19 nt, Homo sapiens
gaaaucuggcuucuggcca

SEQ ID NO: 1513705 - RNA, 21 nt, Homo sapiens
gaaauguguguuguaacaaau

SEQ ID NO: 1513706 - RNA, 21 nt, Homo sapiens
gaaauucuauaugauccugaa

SEQ ID NO: 1513707 - RNA, 14 nt, Homo sapiens
gaaauugaaccugg

SEQ ID NO: 1513708 - RNA, 20 nt, Homo sapiens
gaaauuguguuugacauucu

SEQ ID NO: 1513709 - RNA, 21 nt, Homo sapiens
gaaauuguguuugacauucug

SEQ ID NO: 1513710 - RNA, 22 nt, Homo sapiens
gaaauuuaaacuauaagcaaga

SEQ ID NO: 1513711 - RNA, 23 nt, Homo sapiens
gaaauuuuucaauauuuguuucu

SEQ ID NO: 1513712 - RNA, 21 nt, Homo sapiens
gaacacccgacuccucaaaag

SEQ ID NO: 1513713 - RNA, 19 nt, Homo sapiens
gaacccugcuugcacuuug

SEQ ID NO: 1513714 - RNA, 21 nt, Homo sapiens
gaacucaucccuguuccucaa

SEQ ID NO: 1513715 - RNA, 14 nt, Homo sapiens
gaacugaacuuauu

SEQ ID NO: 1513716 - RNA, 21 nt, Homo sapiens
gaagaaaucacuuaaauaccu

SEQ ID NO: 1513717 - RNA, 23 nt, Homo sapiens
gaagaagaugcugugaacaccag

SEQ ID NO: 1513718 - RNA, 11 nt, Homo sapiens
guggacaugcg

SEQ ID NO: 1513719 - RNA, 17 nt, Homo sapiens
guggacaugcgugacca

SEQ ID NO: 1513720 - RNA, 17 nt, Homo sapiens
guggagaugcagaggua

SEQ ID NO: 1513721 - RNA, 23 nt, Homo sapiens
guggcuucuccauccucauuugc

SEQ ID NO: 1513722 - RNA, 19 nt, Homo sapiens
gugggaacucacuuucccu

SEQ ID NO: 1513723 - RNA, 21 nt, Homo sapiens
gugggaaggucccuuguuucc

SEQ ID NO: 1513724 - RNA, 20 nt, Homo sapiens
gugggagagagacguguaca

SEQ ID NO: 1513725 - RNA, 18 nt, Homo sapiens
gugggggguggacacaga

SEQ ID NO: 1513726 - RNA, 16 nt, Homo sapiens
gugggugugaagggau

SEQ ID NO: 1513727 - RNA, 16 nt, Homo sapiens
guggucagagugccac

SEQ ID NO: 1513728 - RNA, 22 nt, Homo sapiens
guguaaauacaguggaucucaa

SEQ ID NO: 1513729 - RNA, 15 nt, Homo sapiens
guguaacagauauca

SEQ ID NO: 1513730 - RNA, 11 nt, Homo sapiens
guguacaggga

SEQ ID NO: 1513731 - RNA, 19 nt, Homo sapiens
guguagaggguguuugcag

SEQ ID NO: 1513732 - RNA, 20 nt, Homo sapiens
guguauccgacucuaagcug

SEQ ID NO: 1513733 - RNA, 23 nt, Homo sapiens
guguauccgacucuaagcugugu

SEQ ID NO: 1513734 - RNA, 14 nt, Homo sapiens
gugucacccugcag

SEQ ID NO: 1513735 - RNA, 23 nt, Homo sapiens
gugucugcacccaggggugggga

SEQ ID NO: 1513736 - RNA, 20 nt, Homo sapiens
gugugccauagaguuuaaca

SEQ ID NO: 1513737 - RNA, 14 nt, Homo sapiens
gugugucucgucuc

SEQ ID NO: 1513738 - RNA, 16 nt, Homo sapiens
guguuguaacaaauau

SEQ ID NO: 1513739 - RNA, 13 nt, Homo sapiens
guguuucuuacag

SEQ ID NO: 1513740 - RNA, 17 nt, Homo sapiens
guuaaaaauauuuucug

SEQ ID NO: 1513741 - RNA, 21 nt, Homo sapiens
guuacagcuaugcacuguaaa

SEQ ID NO: 1513742 - RNA, 16 nt, Homo sapiens
guuacaucacaguguu

SEQ ID NO: 1513743 - RNA, 22 nt, Homo sapiens
guuagauaaugaaugauaagca

SEQ ID NO: 1513744 - RNA, 12 nt, Homo sapiens
guuaucugcuag

SEQ ID NO: 1513745 - RNA, 13 nt, Homo sapiens
guucaccuugccg

SEQ ID NO: 1513746 - RNA, 11 nt, Homo sapiens
guucacuggag

SEQ ID NO: 1513747 - RNA, 15 nt, Homo sapiens
guuccaguugcuuga

SEQ ID NO: 1513748 - RNA, 23 nt, Homo sapiens
guucccgcucugcauugccugaa

SEQ ID NO: 1513749 - RNA, 17 nt, Homo sapiens
guuccucuuugcaugga

SEQ ID NO: 1513750 - RNA, 17 nt, Homo sapiens
guuccugcacuccagaa

SEQ ID NO: 1513751 - RNA, 18 nt, Homo sapiens
guucucggggcucaggag

SEQ ID NO: 1513752 - RNA, 16 nt, Homo sapiens
guucucuauuuugccu

SEQ ID NO: 1513753 - RNA, 21 nt, Homo sapiens
guucucucuuaguaacauaga

SEQ ID NO: 1513754 - RNA, 15 nt, Homo sapiens
guucuggaaaccacg

SEQ ID NO: 1513755 - RNA, 16 nt, Homo sapiens
guucuugggagggaau

SEQ ID NO: 1513756 - RNA, 18 nt, Homo sapiens
guucuuuaagaauuacag

SEQ ID NO: 1513757 - RNA, 21 nt, Homo sapiens
guucuuuauaaaaagugaaau

SEQ ID NO: 1513758 - RNA, 14 nt, Homo sapiens
uuucaacauaucau

SEQ ID NO: 1513759 - RNA, 21 nt, Homo sapiens
uuucaagacuugauacugcaa

SEQ ID NO: 1513760 - RNA, 21 nt, Homo sapiens
uuucaaggaaaaaugcugcuu

SEQ ID NO: 1513761 - RNA, 17 nt, Homo sapiens
uuucacauaaacacaua

SEQ ID NO: 1513762 - RNA, 19 nt, Homo sapiens
uuucacauacacucaaaca

SEQ ID NO: 1513763 - RNA, 19 nt, Homo sapiens
uuucagaugugaaccauua

SEQ ID NO: 1513764 - RNA, 15 nt, Homo sapiens
uuucaucuccagugu

SEQ ID NO: 1513765 - RNA, 11 nt, Homo sapiens
uuucaucuccu

SEQ ID NO: 1513766 - RNA, 17 nt, Homo sapiens
uuucauguaaauuuugu

SEQ ID NO: 1513767 - RNA, 17 nt, Homo sapiens
uuucaugucauuugaca

SEQ ID NO: 1513768 - RNA, 18 nt, Homo sapiens
uuuccaaccaaguggaaa

SEQ ID NO: 1513769 - RNA, 23 nt, Homo sapiens
uuuccaugggaccacaacuauuu

SEQ ID NO: 1513770 - RNA, 20 nt, Homo sapiens
uuuccauguaucuaccucac

SEQ ID NO: 1513771 - RNA, 12 nt, Homo sapiens
uuucccaccacc

SEQ ID NO: 1513772 - RNA, 14 nt, Homo sapiens
uuucccccaaagau

SEQ ID NO: 1513773 - RNA, 13 nt, Homo sapiens
uuuccuccccacc

SEQ ID NO: 1513774 - RNA, 13 nt, Homo sapiens
uuuccuuuugcca

SEQ ID NO: 1513775 - RNA, 15 nt, Homo sapiens
uuucuauagccaaaa

SEQ ID NO: 1513776 - RNA, 18 nt, Homo sapiens
uuucucuggcuccagaau

SEQ ID NO: 1513777 - RNA, 19 nt, Homo sapiens
uuucugaacuguuacaacu

SEQ ID NO: 1513778 - RNA, 18 nt, Homo sapiens
uuucugccucacaucagc

SEQ ID NO: 1513779 - RNA, 21 nt, Homo sapiens
uuucuggauaucaagauguua

SEQ ID NO: 1513780 - RNA, 15 nt, Homo sapiens
uuucuggugccauuu

SEQ ID NO: 1513781 - RNA, 15 nt, Homo sapiens
uuugaaacugaaugu

SEQ ID NO: 1513782 - RNA, 17 nt, Homo sapiens
uuugaagguaacugaga

SEQ ID NO: 1513783 - RNA, 12 nt, Homo sapiens
uuugaaguagga

SEQ ID NO: 1513784 - RNA, 18 nt, Homo sapiens
uuugaaguggccagauga

SEQ ID NO: 1513785 - RNA, 14 nt, Homo sapiens
uuugaauaucauua

SEQ ID NO: 1513786 - RNA, 21 nt, Homo sapiens
uuugagacgguguaccagcag

SEQ ID NO: 1513787 - RNA, 13 nt, Homo sapiens
uuugauacaaaau

SEQ ID NO: 1513788 - RNA, 18 nt, Homo sapiens
uuugauacuaagcauuga

SEQ ID NO: 1513789 - RNA, 20 nt, Homo sapiens
uuugccccuuccacuuugag

SEQ ID NO: 1513790 - RNA, 17 nt, Homo sapiens
uuugcuaucacacagug

SEQ ID NO: 1513791 - RNA, 13 nt, Homo sapiens
uuugcucauggca

SEQ ID NO: 1513792 - RNA, 19 nt, Homo sapiens
uuugcuuuguguaaauaca

SEQ ID NO: 1513793 - RNA, 15 nt, Homo sapiens
uuuggggugaaugaa

SEQ ID NO: 1513794 - RNA, 17 nt, Homo sapiens
uuugguuaccaauuuaa

SEQ ID NO: 1513795 - RNA, 20 nt, Homo sapiens
uuugucaacacaaagacaug

SEQ ID NO: 1513796 - RNA, 23 nt, Homo sapiens
uuugucaacacaaagacauggaa

SEQ ID NO: 1513797 - RNA, 15 nt, Homo sapiens
uuugugugugugaua

SEQ ID NO: 1513798 - RNA, 12 nt, Homo sapiens
uuuguuugaaaa

SEQ ID NO: 1513799 - RNA, 15 nt, Homo sapiens
uuuguuuugcacuga

SEQ ID NO: 1513800 - RNA, 16 nt, Homo sapiens
uuuguuuugcacugac

SEQ ID NO: 1513801 - RNA, 14 nt, Homo sapiens
uuuuaagcuguaaa

SEQ ID NO: 1513802 - RNA, 13 nt, Homo sapiens
uuuuacagugaau

SEQ ID NO: 1513803 - RNA, 21 nt, Homo sapiens
uuuuacuuccaugauacuuua

SEQ ID NO: 1513804 - RNA, 17 nt, Homo sapiens
uuuucaaaacugcuaaa

SEQ ID NO: 1513805 - RNA, 23 nt, Homo sapiens
uuuucaauaaugugaacugcuga

SEQ ID NO: 1513806 - RNA, 19 nt, Homo sapiens
uuuucaauauuuguuucuu

SEQ ID NO: 1513807 - RNA, 15 nt, Homo sapiens
uuuucagucaucuca

SEQ ID NO: 1513808 - RNA, 12 nt, Homo sapiens
uuuucauuucac

SEQ ID NO: 1513809 - RNA, 13 nt, Homo sapiens
uuuucucucaggg

SEQ ID NO: 1513810 - RNA, 21 nt, Homo sapiens
uuuucuuaaauauuaugugaa

SEQ ID NO: 1513811 - RNA, 18 nt, Homo sapiens
uuuugaaaaagcgaaaaa

SEQ ID NO: 1513812 - RNA, 14 nt, Homo sapiens
uuuugagaguauau

SEQ ID NO: 1513813 - RNA, 14 nt, Homo sapiens
uuuugaguaucucg

SEQ ID NO: 1513814 - RNA, 16 nt, Homo sapiens
uuuuuaaaaaaguaag

SEQ ID NO: 1513815 - RNA, 18 nt, Homo sapiens
uuuuuuaaaaaagcuuaa

SEQ ID NO: 1513816 - RNA, 23 nt, Homo sapiens
aguucuuuacuggugauuucuga

SEQ ID NO: 1513817 - RNA, 20 nt, Homo sapiens
aguuggacuucagucuugcc

SEQ ID NO: 1513818 - RNA, 19 nt, Homo sapiens
aguuguuuucccgagcaaa

SEQ ID NO: 1513819 - RNA, 22 nt, Homo sapiens
aguuuagaugcuuugugacuua

SEQ ID NO: 1513820 - RNA, 17 nt, Homo sapiens
aguuuauuuuguuacac

SEQ ID NO: 1513821 - RNA, 19 nt, Homo sapiens
aguuucaggagauuguuaa

SEQ ID NO: 1513822 - RNA, 19 nt, Homo sapiens
aguuuccaaucccauagau

SEQ ID NO: 1513823 - RNA, 22 nt, Homo sapiens
aguuuguuuuuaaaaaaaucua

SEQ ID NO: 1513824 - RNA, 19 nt, Homo sapiens
aguuuucacaaugccuaga

SEQ ID NO: 1513825 - RNA, 13 nt, Homo sapiens
aguuuucaccugg

SEQ ID NO: 1513826 - RNA, 15 nt, Homo sapiens
aguuuuccaggaaua

SEQ ID NO: 1513827 - RNA, 16 nt, Homo sapiens
auaaaaauacuaugaa

SEQ ID NO: 1513828 - RNA, 13 nt, Homo sapiens
auaaaacaaugaa

SEQ ID NO: 1513829 - RNA, 14 nt, Homo sapiens
auaaaaguacugaa

SEQ ID NO: 1513830 - RNA, 21 nt, Homo sapiens
auaaacuuuauaaauucauaa

SEQ ID NO: 1513831 - RNA, 16 nt, Homo sapiens
auaaagccaguggaaa

SEQ ID NO: 1513832 - RNA, 14 nt, Homo sapiens
auaaagcccuugaa

SEQ ID NO: 1513833 - RNA, 18 nt, Homo sapiens
auaaagcccuugaaccag

SEQ ID NO: 1513834 - RNA, 21 nt, Homo sapiens
auaaagcuuauucuuugucca

SEQ ID NO: 1513835 - RNA, 23 nt, Homo sapiens
auaaaguuuuuauuuuccucuga

SEQ ID NO: 1513836 - RNA, 15 nt, Homo sapiens
auaaauagaguucca

SEQ ID NO: 1513837 - RNA, 12 nt, Homo sapiens
auaaauauguga

SEQ ID NO: 1513838 - RNA, 13 nt, Homo sapiens
auaaaugccucau

SEQ ID NO: 1513839 - RNA, 22 nt, Homo sapiens
auaaauguuauguuugcuaaaa

SEQ ID NO: 1513840 - RNA, 17 nt, Homo sapiens
auaaauucagauauauu

SEQ ID NO: 1513841 - RNA, 18 nt, Homo sapiens
auaacuauuuacauauaa

SEQ ID NO: 1513842 - RNA, 14 nt, Homo sapiens
auaagaacgucauu

SEQ ID NO: 1513843 - RNA, 16 nt, Homo sapiens
auaagauuaaaggaag

SEQ ID NO: 1513844 - RNA, 14 nt, Homo sapiens
auaauauaagccau

SEQ ID NO: 1513845 - RNA, 15 nt, Homo sapiens
auaauauauuaggca

SEQ ID NO: 1513846 - RNA, 14 nt, Homo sapiens
auaaugaacacgug

SEQ ID NO: 1513847 - RNA, 15 nt, Homo sapiens
auaauucuacaggau

SEQ ID NO: 1513848 - RNA, 16 nt, Homo sapiens
auaauuuuucuuacac

SEQ ID NO: 1513849 - RNA, 14 nt, Homo sapiens
auacaaacaagcac

SEQ ID NO: 1513850 - RNA, 17 nt, Homo sapiens
auacaaacaagcacaga

SEQ ID NO: 1513851 - RNA, 20 nt, Homo sapiens
auacacagaugauaauaugc

SEQ ID NO: 1513852 - RNA, 17 nt, Homo sapiens
auacagaauuacuguaa

SEQ ID NO: 1513853 - RNA, 20 nt, Homo sapiens
auacagugcugcuggcuuuu

SEQ ID NO: 1513854 - RNA, 16 nt, Homo sapiens
auacaguggaucucaa

SEQ ID NO: 1513855 - RNA, 22 nt, Homo sapiens
auacauccccaucccucuacuu

SEQ ID NO: 1513856 - RNA, 12 nt, Homo sapiens
auacauugccaa

SEQ ID NO: 1513857 - RNA, 18 nt, Homo sapiens
auaccccuguuaagcaau

SEQ ID NO: 1513858 - RNA, 13 nt, Homo sapiens
auagaaagcacua

SEQ ID NO: 1513859 - RNA, 12 nt, Homo sapiens
auagaaaugcca

SEQ ID NO: 1513860 - RNA, 15 nt, Homo sapiens
auagagugcauuuga

SEQ ID NO: 1513861 - RNA, 23 nt, Homo sapiens
auagauauuccuauugugcaaug

SEQ ID NO: 1513862 - RNA, 21 nt, Homo sapiens
auagauuuucugcuacuuugc

SEQ ID NO: 1513863 - RNA, 17 nt, Homo sapiens
auagccauguacuauaa

SEQ ID NO: 1513864 - RNA, 21 nt, Homo sapiens
auagcucacuguaaccucaaa

SEQ ID NO: 1513865 - RNA, 20 nt, Homo sapiens
auaggaagauuaaaaccaca

SEQ ID NO: 1513866 - RNA, 18 nt, Homo sapiens
auaguaacuucuaaagag

SEQ ID NO: 1513867 - RNA, 20 nt, Homo sapiens
auaguauucaggugagcaau

SEQ ID NO: 1513868 - RNA, 20 nt, Homo sapiens
auaguauucaugacuaugga

SEQ ID NO: 1513869 - RNA, 17 nt, Homo sapiens
auagugcacuagcauuu

SEQ ID NO: 1513870 - RNA, 16 nt, Homo sapiens
auaguuauuuacuuga

SEQ ID NO: 1513871 - RNA, 18 nt, Homo sapiens
auaguuauuuacuugaaa

SEQ ID NO: 1513872 - RNA, 16 nt, Homo sapiens
auauacauaugacaua

SEQ ID NO: 1513873 - RNA, 16 nt, Homo sapiens
auauauaguagcauuu

SEQ ID NO: 1513874 - RNA, 18 nt, Homo sapiens
auauaugcucaaccagaa

SEQ ID NO: 1513875 - RNA, 15 nt, Homo sapiens
auaucaagauguuaa

SEQ ID NO: 1513876 - RNA, 22 nt, Homo sapiens
auaucaauuaauuugaaaacau

SEQ ID NO: 1513877 - RNA, 23 nt, Homo sapiens
auaucuucaggacuauuucacua

SEQ ID NO: 1513878 - RNA, 14 nt, Homo sapiens
auaugaaguguuag

SEQ ID NO: 1513879 - RNA, 16 nt, Homo sapiens
auaugauuguauaaug

SEQ ID NO: 1513880 - RNA, 14 nt, Homo sapiens
auaugcagugauau

SEQ ID NO: 1513881 - RNA, 20 nt, Homo sapiens
auauucaaggaucucaaaga

SEQ ID NO: 1513882 - RNA, 19 nt, Homo sapiens
auauugggacacacaucaa

SEQ ID NO: 1513883 - RNA, 12 nt, Homo sapiens
auauuuacuacu

SEQ ID NO: 1513884 - RNA, 14 nt, Homo sapiens
auauuuccauucau

SEQ ID NO: 1513885 - RNA, 13 nt, Homo sapiens
auauuuucacaug

SEQ ID NO: 1513886 - RNA, 19 nt, Homo sapiens
auauuuucuauuacacaag

SEQ ID NO: 1513887 - RNA, 18 nt, Homo sapiens
aucaaauauuaccaaaaa

SEQ ID NO: 1513888 - RNA, 18 nt, Homo sapiens
aucaagacacuaguucag

SEQ ID NO: 1513889 - RNA, 14 nt, Homo sapiens
aucaagggcuuuau

SEQ ID NO: 1513890 - RNA, 20 nt, Homo sapiens
aucaaugggugguauuugcu

SEQ ID NO: 1513891 - RNA, 15 nt, Homo sapiens
aucaccucaggccag

SEQ ID NO: 1513892 - RNA, 21 nt, Homo sapiens
aucacgccacugcacuccagc

SEQ ID NO: 1513893 - RNA, 17 nt, Homo sapiens
aucacuaagagcuuuau

SEQ ID NO: 1513894 - RNA, 20 nt, Homo sapiens
aucacuaccuuuauagcuca

SEQ ID NO: 1513895 - RNA, 16 nt, Homo sapiens
aucagaaaugucauca

SEQ ID NO: 1513896 - RNA, 13 nt, Homo sapiens
aucagaagcacaa

SEQ ID NO: 1513897 - RNA, 15 nt, Homo sapiens
aucagaagcacaaag

SEQ ID NO: 1513898 - RNA, 13 nt, Homo sapiens
aucagccacggag

SEQ ID NO: 1513899 - RNA, 20 nt, Homo sapiens
aucagccuccgccauuccaa

SEQ ID NO: 1513900 - RNA, 15 nt, Homo sapiens
aucagcgcccuggag

SEQ ID NO: 1513901 - RNA, 15 nt, Homo sapiens
aucaggucauuauuu

SEQ ID NO: 1513902 - RNA, 22 nt, Homo sapiens
aucaggucauuauuuuuuacaa

SEQ ID NO: 1513903 - RNA, 12 nt, Homo sapiens
aucaugaauauu

SEQ ID NO: 1513904 - RNA, 19 nt, Homo sapiens
aucauguuaccauuacaaa

SEQ ID NO: 1513905 - RNA, 17 nt, Homo sapiens
auccagagauaauugcc

SEQ ID NO: 1513906 - RNA, 21 nt, Homo sapiens
auccaguuucccaccaccuug

SEQ ID NO: 1513907 - RNA, 20 nt, Homo sapiens
auccccagaggugacccaau

SEQ ID NO: 1513908 - RNA, 22 nt, Homo sapiens
aucccgccucuucuucuucaga

SEQ ID NO: 1513909 - RNA, 20 nt, Homo sapiens
aucccugcagccugguagaa

SEQ ID NO: 1513910 - RNA, 14 nt, Homo sapiens
auccgacucuaagc

SEQ ID NO: 1513911 - RNA, 16 nt, Homo sapiens
auccggcuccugucau

SEQ ID NO: 1513912 - RNA, 22 nt, Homo sapiens
auccucaaacacacaaacuauu

SEQ ID NO: 1513913 - RNA, 20 nt, Homo sapiens
auccucaacaacaaaccaaa

SEQ ID NO: 1513914 - RNA, 21 nt, Homo sapiens
auccucaacaacaaaccaaaa

SEQ ID NO: 1513915 - RNA, 15 nt, Homo sapiens
auccucacaaccacc

SEQ ID NO: 1513916 - RNA, 21 nt, Homo sapiens
auccucagguaguacugggaa

SEQ ID NO: 1513917 - RNA, 16 nt, Homo sapiens
auccugcgagcuccuu

SEQ ID NO: 1513918 - RNA, 20 nt, Homo sapiens
auccuugauaaaugccucau

SEQ ID NO: 1513919 - RNA, 19 nt, Homo sapiens
aucggcuggggacugcuac

SEQ ID NO: 1513920 - RNA, 18 nt, Homo sapiens
aucuaacuacaaggacaa

SEQ ID NO: 1513921 - RNA, 20 nt, Homo sapiens
aucuaguucucaaucacugc

SEQ ID NO: 1513922 - RNA, 14 nt, Homo sapiens
aucucaaauccacu

SEQ ID NO: 1513923 - RNA, 17 nt, Homo sapiens
aucucauagguugccaa

SEQ ID NO: 1513924 - RNA, 13 nt, Homo sapiens
aucuccacuguua

SEQ ID NO: 1513925 - RNA, 20 nt, Homo sapiens
aucuccaguauucuugucaa

SEQ ID NO: 1513926 - RNA, 13 nt, Homo sapiens
aucucucuacucc

SEQ ID NO: 1513927 - RNA, 15 nt, Homo sapiens
aucugagcaaugacu

SEQ ID NO: 1513928 - RNA, 22 nt, Homo sapiens
aucugcagggagcaacucucca

SEQ ID NO: 1513929 - RNA, 17 nt, Homo sapiens
aucuggauuccagagca

SEQ ID NO: 1513930 - RNA, 15 nt, Homo sapiens
aucuguguuuacuua

SEQ ID NO: 1513931 - RNA, 23 nt, Homo sapiens
aucuuagcuucuauuauagccac

SEQ ID NO: 1513932 - RNA, 23 nt, Homo sapiens
aucuuccguggucagagugccac

SEQ ID NO: 1513933 - RNA, 18 nt, Homo sapiens
aucuuccugccucaggcu

SEQ ID NO: 1513934 - RNA, 14 nt, Homo sapiens
aucuuuugugagau

SEQ ID NO: 1513935 - RNA, 20 nt, Homo sapiens
augaaaaaaaguacauguau

SEQ ID NO: 1513936 - RNA, 19 nt, Homo sapiens
augaaaacugaaucaagaa

SEQ ID NO: 1513937 - RNA, 18 nt, Homo sapiens
augaaaacuuuuucacag

SEQ ID NO: 1513938 - RNA, 15 nt, Homo sapiens
augaaacaaacugga

SEQ ID NO: 1513939 - RNA, 12 nt, Homo sapiens
augaaacauuca

SEQ ID NO: 1513940 - RNA, 12 nt, Homo sapiens
augaaaccaaag

SEQ ID NO: 1513941 - RNA, 12 nt, Homo sapiens
augaaagcaauc

SEQ ID NO: 1513942 - RNA, 14 nt, Homo sapiens
augaacugccaaag

SEQ ID NO: 1513943 - RNA, 22 nt, Homo sapiens
augaagcuuuggcccucagugg

SEQ ID NO: 1513944 - RNA, 21 nt, Homo sapiens
augaagucccucuaugucguc

SEQ ID NO: 1513945 - RNA, 18 nt, Homo sapiens
augaauauggaaaggcca

SEQ ID NO: 1513946 - RNA, 21 nt, Homo sapiens
augaauuccaacucacuuuuu

SEQ ID NO: 1513947 - RNA, 18 nt, Homo sapiens
augaauugacagacuguu

SEQ ID NO: 1513948 - RNA, 13 nt, Homo sapiens
augacaacauugc

SEQ ID NO: 1513949 - RNA, 20 nt, Homo sapiens
augacagaaugcuguuuuaa

SEQ ID NO: 1513950 - RNA, 14 nt, Homo sapiens
augacucacuccau

SEQ ID NO: 1513951 - RNA, 22 nt, Homo sapiens
augacuguuuuuauaugcacau

SEQ ID NO: 1513952 - RNA, 18 nt, Homo sapiens
augagcaaggacaaccug

SEQ ID NO: 1513953 - RNA, 19 nt, Homo sapiens
aggaagauuaaaaccacag

SEQ ID NO: 1513954 - RNA, 11 nt, Homo sapiens
aggaagcaagc

SEQ ID NO: 1513955 - RNA, 24 nt, Homo sapiens
aauuuuggcccuaccuguaacuua

SEQ ID NO: 1513956 - RNA, 13 nt, Homo sapiens
aauuuuguuaaca

SEQ ID NO: 1513957 - RNA, 19 nt, Homo sapiens
aauuuuuauaaauauguga

SEQ ID NO: 1513958 - RNA, 14 nt, Homo sapiens
aauuuuuccaugaa

SEQ ID NO: 1513959 - RNA, 21 nt, Homo sapiens
acaaaaaaaacaaaaaaccca

SEQ ID NO: 1513960 - RNA, 13 nt, Homo sapiens
acaaaaaacccaa

SEQ ID NO: 1513961 - RNA, 14 nt, Homo sapiens
acaaaaagacaugg

SEQ ID NO: 1513962 - RNA, 15 nt, Homo sapiens
acaaaaagacaugga

SEQ ID NO: 1513963 - RNA, 14 nt, Homo sapiens
acaaagauugagaa

SEQ ID NO: 1513964 - RNA, 18 nt, Homo sapiens
acaaagauugagaagcca

SEQ ID NO: 1513965 - RNA, 19 nt, Homo sapiens
acaaagauugagaagccau

SEQ ID NO: 1513966 - RNA, 13 nt, Homo sapiens
acaaauacauuca

SEQ ID NO: 1513967 - RNA, 14 nt, Homo sapiens
acaaauacauucau

SEQ ID NO: 1513968 - RNA, 13 nt, Homo sapiens
acaaauacuacag

SEQ ID NO: 1513969 - RNA, 21 nt, Homo sapiens
acaaaugcuggggucauauaa

SEQ ID NO: 1513970 - RNA, 17 nt, Homo sapiens
acaaauggacuauacau

SEQ ID NO: 1513971 - RNA, 21 nt, Homo sapiens
acaaauucuuuuucacacuga

SEQ ID NO: 1513972 - RNA, 17 nt, Homo sapiens
acgaaucguacuucuuu

SEQ ID NO: 1513973 - RNA, 22 nt, Homo sapiens
acgacaagauuuucuacuuuuu

SEQ ID NO: 1513974 - RNA, 20 nt, Homo sapiens
acgaugaaauugaaccuggu

SEQ ID NO: 1513975 - RNA, 15 nt, Homo sapiens
acgccuguaauccca

SEQ ID NO: 1513976 - RNA, 19 nt, Homo sapiens
acguuacugcauacugauc

SEQ ID NO: 1513977 - RNA, 14 nt, Homo sapiens
acuaaaagaauuug

SEQ ID NO: 1513978 - RNA, 16 nt, Homo sapiens
acuaaaauuccacuca

SEQ ID NO: 1513979 - RNA, 18 nt, Homo sapiens
acuaaacacgugacacaa

SEQ ID NO: 1513980 - RNA, 13 nt, Homo sapiens
acuacaagggcau

SEQ ID NO: 1513981 - RNA, 21 nt, Homo sapiens
acuacacacuguguacugcag

SEQ ID NO: 1513982 - RNA, 13 nt, Homo sapiens
acuacacuccagc

SEQ ID NO: 1513983 - RNA, 17 nt, Homo sapiens
acuacaggcucaugcca

SEQ ID NO: 1513984 - RNA, 20 nt, Homo sapiens
acuaccuuuauagcucucau

SEQ ID NO: 1513985 - RNA, 15 nt, Homo sapiens
acuacgcuugcucau

SEQ ID NO: 1513986 - RNA, 16 nt, Homo sapiens
acuacuacucaauggc

SEQ ID NO: 1513987 - RNA, 16 nt, Homo sapiens
acuacucuacuuccuc

SEQ ID NO: 1513988 - RNA, 19 nt, Homo sapiens
acuacuugccacacacugu

SEQ ID NO: 1513989 - RNA, 15 nt, Homo sapiens
acuagaauagugcau

SEQ ID NO: 1513990 - RNA, 20 nt, Homo sapiens
acuagaauagugcauuguau

SEQ ID NO: 1513991 - RNA, 18 nt, Homo sapiens
acuaggcuauaugcauuu

SEQ ID NO: 1513992 - RNA, 17 nt, Homo sapiens
acuaucaccuauuacau

SEQ ID NO: 1513993 - RNA, 19 nt, Homo sapiens
acuaucaccuauuacauuu

SEQ ID NO: 1513994 - RNA, 22 nt, Homo sapiens
acuauuaaaaagguuuacagaa

SEQ ID NO: 1513995 - RNA, 17 nt, Homo sapiens
acuauuaagagcaauaa

SEQ ID NO: 1513996 - RNA, 11 nt, Homo sapiens
acucacuccau

SEQ ID NO: 1513997 - RNA, 17 nt, Homo sapiens
acucacuccauuccuag

SEQ ID NO: 1513998 - RNA, 21 nt, Homo sapiens
acucacuuucccuugugucaa

SEQ ID NO: 1513999 - RNA, 15 nt, Homo sapiens
acucagacauuccaa

SEQ ID NO: 1514000 - RNA, 16 nt, Homo sapiens
acucagacauuccaag

SEQ ID NO: 1514001 - RNA, 17 nt, Homo sapiens
acucagucuagugaaga

SEQ ID NO: 1514002 - RNA, 23 nt, Homo sapiens
acucaucccuguuccucaaggcc

SEQ ID NO: 1514003 - RNA, 19 nt, Homo sapiens
acucaucuuuugaaacaga

SEQ ID NO: 1514004 - RNA, 13 nt, Homo sapiens
acuccugccauuc

SEQ ID NO: 1514005 - RNA, 19 nt, Homo sapiens
acucgaggagcucaggguu

SEQ ID NO: 1514006 - RNA, 19 nt, Homo sapiens
acucuaagcugugugcagg

SEQ ID NO: 1514007 - RNA, 21 nt, Homo sapiens
acucuaugaguuggacuucag

SEQ ID NO: 1514008 - RNA, 13 nt, Homo sapiens
acucugacuuuga

SEQ ID NO: 1514009 - RNA, 11 nt, Homo sapiens
acucugucagg

SEQ ID NO: 1514010 - RNA, 23 nt, Homo sapiens
acucuucuccaagucuagcuuuc

SEQ ID NO: 1514011 - RNA, 23 nt, Homo sapiens
acugaagagaccacagcaauugg

SEQ ID NO: 1514012 - RNA, 20 nt, Homo sapiens
acugagccuccacagcagug

SEQ ID NO: 1514013 - RNA, 22 nt, Homo sapiens
acugcacaucuagagaaaaaca

SEQ ID NO: 1514014 - RNA, 15 nt, Homo sapiens
acugcagcuuuacau

SEQ ID NO: 1514015 - RNA, 18 nt, Homo sapiens
acugcgaucuucagagca

SEQ ID NO: 1514016 - RNA, 20 nt, Homo sapiens
acuggacuugagcuuggcag

SEQ ID NO: 1514017 - RNA, 22 nt, Homo sapiens
acuggagcacugaucaauccuu

SEQ ID NO: 1514018 - RNA, 17 nt, Homo sapiens
acuggcuccuuugccuc

SEQ ID NO: 1514019 - RNA, 21 nt, Homo sapiens
acuguacaguuucuuccccaa

SEQ ID NO: 1514020 - RNA, 23 nt, Homo sapiens
acuguuacaacuuguauuuccaa

SEQ ID NO: 1514021 - RNA, 21 nt, Homo sapiens
acuguucccaauauguagccu

SEQ ID NO: 1514022 - RNA, 17 nt, Homo sapiens
acuguuguacaagcuca

SEQ ID NO: 1514023 - RNA, 20 nt, Homo sapiens
acuguuuucucucucuaugg

SEQ ID NO: 1514024 - RNA, 22 nt, Homo sapiens
acuuaggaagaaaucacuuaaa

SEQ ID NO: 1514025 - RNA, 14 nt, Homo sapiens
acuuaucacaugga

SEQ ID NO: 1514026 - RNA, 16 nt, Homo sapiens
acuuauuaacaauuag

SEQ ID NO: 1514027 - RNA, 12 nt, Homo sapiens
acuuauuaccua

SEQ ID NO: 1514028 - RNA, 16 nt, Homo sapiens
acuucacaauguauau

SEQ ID NO: 1514029 - RNA, 15 nt, Homo sapiens
acuuccaugauacuu

SEQ ID NO: 1514030 - RNA, 19 nt, Homo sapiens
acuuccaugauacuuuaau

SEQ ID NO: 1514031 - RNA, 23 nt, Homo sapiens
acuucuaacuagaaaucugccaa

SEQ ID NO: 1514032 - RNA, 23 nt, Homo sapiens
acuucucauuuuuuaaaaaagcu

SEQ ID NO: 1514033 - RNA, 19 nt, Homo sapiens
acuucuccagauagcugaa

SEQ ID NO: 1514034 - RNA, 18 nt, Homo sapiens
acuugaaaaauauucaug

SEQ ID NO: 1514035 - RNA, 20 nt, Homo sapiens
acuugaauaaaguacuacau

SEQ ID NO: 1514036 - RNA, 22 nt, Homo sapiens
acuugaauaaaguacuacauca

SEQ ID NO: 1514037 - RNA, 21 nt, Homo sapiens
acuugaaucaaagcaguuaac

SEQ ID NO: 1514038 - RNA, 23 nt, Homo sapiens
acuugaggacacauguccagugg

SEQ ID NO: 1514039 - RNA, 13 nt, Homo sapiens
acuugauuccuug

SEQ ID NO: 1514040 - RNA, 19 nt, Homo sapiens
acuugcucagguacuugua

SEQ ID NO: 1514041 - RNA, 16 nt, Homo sapiens
acuugugucuguccaa

SEQ ID NO: 1514042 - RNA, 18 nt, Homo sapiens
acuuuaacccucucuucc

SEQ ID NO: 1514043 - RNA, 20 nt, Homo sapiens
acuuuagaguagcaugagag

SEQ ID NO: 1514044 - RNA, 16 nt, Homo sapiens
acuuuauaaauucaua

SEQ ID NO: 1514045 - RNA, 15 nt, Homo sapiens
acuuucagaguuuga

SEQ ID NO: 1514046 - RNA, 19 nt, Homo sapiens
acuuucccuugugucaaga

SEQ ID NO: 1514047 - RNA, 20 nt, Homo sapiens
acuuucucacugcugucagc

SEQ ID NO: 1514048 - RNA, 22 nt, Homo sapiens
acuuucuguugccacaacccug

SEQ ID NO: 1514049 - RNA, 17 nt, Homo sapiens
acuuuugcaugaaaaua

SEQ ID NO: 1514050 - RNA, 15 nt, Homo sapiens
agaaaaccauuuuag

SEQ ID NO: 1514051 - RNA, 16 nt, Homo sapiens
agaaaaucaguaauug

SEQ ID NO: 1514052 - RNA, 19 nt, Homo sapiens
agaaacugggcagcccuga

SEQ ID NO: 1514053 - RNA, 14 nt, Homo sapiens
agaaacuuaaacaa

SEQ ID NO: 1514054 - RNA, 22 nt, Homo sapiens
agaaagagagagauacaucuua

SEQ ID NO: 1514055 - RNA, 19 nt, Homo sapiens
agaaagcuuuauauguaau

SEQ ID NO: 1514056 - RNA, 12 nt, Homo sapiens
agaaaguauuug

SEQ ID NO: 1514057 - RNA, 14 nt, Homo sapiens
agaaagugcagaau

SEQ ID NO: 1514058 - RNA, 12 nt, Homo sapiens
agaaauaagccc

SEQ ID NO: 1514059 - RNA, 17 nt, Homo sapiens
agaaaucuuuauucuua

SEQ ID NO: 1514060 - RNA, 21 nt, Homo sapiens
agaaaugcuuuccaaaaccgc

SEQ ID NO: 1514061 - RNA, 21 nt, Homo sapiens
agaacaaaugcuggggucaua

SEQ ID NO: 1514062 - RNA, 23 nt, Homo sapiens
agaacaaugcuauaauauauaau

SEQ ID NO: 1514063 - RNA, 20 nt, Homo sapiens
agaacaauuaaacagccaaa

SEQ ID NO: 1514064 - RNA, 21 nt, Homo sapiens
agaacaccuuuguuuugcacu

SEQ ID NO: 1514065 - RNA, 23 nt, Homo sapiens
agaacaggcugguucugaguucu

SEQ ID NO: 1514066 - RNA, 18 nt, Homo sapiens
agaaccucaaacuaggag

SEQ ID NO: 1514067 - RNA, 23 nt, Homo sapiens
agaaccucaaacuaggaggaaaa

SEQ ID NO: 1514068 - RNA, 23 nt, Homo sapiens
agaacggaagaagagaucaggaa

SEQ ID NO: 1514069 - RNA, 18 nt, Homo sapiens
agaacugccccaucuccu

SEQ ID NO: 1514070 - RNA, 14 nt, Homo sapiens
agaagaagaaggag

SEQ ID NO: 1514071 - RNA, 21 nt, Homo sapiens
agaagaaguuuaaaaaaccau

SEQ ID NO: 1514072 - RNA, 21 nt, Homo sapiens
agaagaauauguauguuucua

SEQ ID NO: 1514073 - RNA, 19 nt, Homo sapiens
agaagaggcuggugcugug

SEQ ID NO: 1514074 - RNA, 18 nt, Homo sapiens
agaagauagggaacacuc

SEQ ID NO: 1514075 - RNA, 13 nt, Homo sapiens
agaagauuuugcc

SEQ ID NO: 1514076 - RNA, 19 nt, Homo sapiens
agaaguuuaaaaaaccaug

SEQ ID NO: 1514077 - RNA, 20 nt, Homo sapiens
agaaguuuaaaaaaccaugc

SEQ ID NO: 1514078 - RNA, 23 nt, Homo sapiens
agaauccacaaagccgugccuuu

SEQ ID NO: 1514079 - RNA, 13 nt, Homo sapiens
agaaucuagccuc

SEQ ID NO: 1514080 - RNA, 15 nt, Homo sapiens
agaaugaagacuguu

SEQ ID NO: 1514081 - RNA, 20 nt, Homo sapiens
agaauguucuccuaaaagac

SEQ ID NO: 1514082 - RNA, 14 nt, Homo sapiens
agacaaauuugcaa

SEQ ID NO: 1514083 - RNA, 18 nt, Homo sapiens
agacaaguaaucacuaac

SEQ ID NO: 1514084 - RNA, 15 nt, Homo sapiens
agacacaaggugauu

SEQ ID NO: 1514085 - RNA, 19 nt, Homo sapiens
agacaggucuagacuuucu

SEQ ID NO: 1514086 - RNA, 18 nt, Homo sapiens
agacauaaguaaaugagc

SEQ ID NO: 1514087 - RNA, 14 nt, Homo sapiens
agacaugaaugcac

SEQ ID NO: 1514088 - RNA, 16 nt, Homo sapiens
agacaugaaugcacac

SEQ ID NO: 1514089 - RNA, 12 nt, Homo sapiens
agacauuccaag

SEQ ID NO: 1514090 - RNA, 17 nt, Homo sapiens
agacauuucucuaacuc

SEQ ID NO: 1514091 - RNA, 20 nt, Homo sapiens
agaccgugaccagugcugcu

SEQ ID NO: 1514092 - RNA, 15 nt, Homo sapiens
agaccugacaagcac

SEQ ID NO: 1514093 - RNA, 16 nt, Homo sapiens
agacuaugguccugca

SEQ ID NO: 1514094 - RNA, 23 nt, Homo sapiens
agacuguguaugucuauuugcac

SEQ ID NO: 1514095 - RNA, 16 nt, Homo sapiens
agacuuggggaccaga

SEQ ID NO: 1514096 - RNA, 14 nt, Homo sapiens
uuuaaaaaaccaug

SEQ ID NO: 1514097 - RNA, 12 nt, Homo sapiens
uuuaaaaaccaa

SEQ ID NO: 1514098 - RNA, 20 nt, Homo sapiens
uuuaaaaccauaaacuguac

SEQ ID NO: 1514099 - RNA, 15 nt, Homo sapiens
uuuaaaccgcuaaaa

SEQ ID NO: 1514100 - RNA, 16 nt, Homo sapiens
uuuaaacuauaagcaa

SEQ ID NO: 1514101 - RNA, 20 nt, Homo sapiens
uuuaaaugaugauuccuuga

SEQ ID NO: 1514102 - RNA, 20 nt, Homo sapiens
uuuaaaugugcaguacacau

SEQ ID NO: 1514103 - RNA, 12 nt, Homo sapiens
uuuaaauucucu

SEQ ID NO: 1514104 - RNA, 14 nt, Homo sapiens
uuuaacacuaaaaa

SEQ ID NO: 1514105 - RNA, 12 nt, Homo sapiens
uuuaacauucac

SEQ ID NO: 1514106 - RNA, 18 nt, Homo sapiens
uuuacacucucuguacaa

SEQ ID NO: 1514107 - RNA, 16 nt, Homo sapiens
uuuacagaacuguugu

SEQ ID NO: 1514108 - RNA, 14 nt, Homo sapiens
uuuaccacuaugca

SEQ ID NO: 1514109 - RNA, 17 nt, Homo sapiens
uuuaccuaccaccuucc

SEQ ID NO: 1514110 - RNA, 23 nt, Homo sapiens
uuuaccuuguggaugcuagugcu

SEQ ID NO: 1514111 - RNA, 13 nt, Homo sapiens
uuuaggaagcaag

SEQ ID NO: 1514112 - RNA, 19 nt, Homo sapiens
uuuauauauuugaauauca

SEQ ID NO: 1514113 - RNA, 23 nt, Homo sapiens
uuuauauguaauuaacauaucuu

SEQ ID NO: 1514114 - RNA, 19 nt, Homo sapiens
uuuaucaggcuuucucugg

SEQ ID NO: 1514115 - RNA, 14 nt, Homo sapiens
uuuauguucucaga

SEQ ID NO: 1514116 - RNA, 22 nt, Homo sapiens
uuuauuaguuaauauaucccag

SEQ ID NO: 1514117 - RNA, 21 nt, Homo sapiens
uuuauugucugucuacauuuc

SEQ ID NO: 1514118 - RNA, 12 nt, Homo sapiens
uuucaaaacaca

SEQ ID NO: 1514119 - RNA, 20 nt, Homo sapiens
uuucaaagaaaaagguccau

SEQ ID NO: 1514120 - RNA, 16 nt, Homo sapiens
uuucaacaaguaacuu

SEQ ID NO: 1514121 - RNA, 13 nt, Homo sapiens
uuucaacuccaga

SEQ ID NO: 1514122 - RNA, 13 nt, Homo sapiens
uuucaagugccua

SEQ ID NO: 1514123 - RNA, 22 nt, Homo sapiens
uuucacucagggugauaaauca

SEQ ID NO: 1514124 - RNA, 12 nt, Homo sapiens
uuucagcuaaag

SEQ ID NO: 1514125 - RNA, 23 nt, Homo sapiens
uuucaguguaugauauacuuuau

SEQ ID NO: 1514126 - RNA, 21 nt, Homo sapiens
uuucaugauaaugaacagaac

SEQ ID NO: 1514127 - RNA, 15 nt, Homo sapiens
uuucccaauacauac

SEQ ID NO: 1514128 - RNA, 23 nt, Homo sapiens
uuucccaugauccagaacugagg

SEQ ID NO: 1514129 - RNA, 19 nt, Homo sapiens
uuuccccagugacaccuca

SEQ ID NO: 1514130 - RNA, 19 nt, Homo sapiens
uuucccccaaagaugugua

SEQ ID NO: 1514131 - RNA, 16 nt, Homo sapiens
uuuccucugaagggaa

SEQ ID NO: 1514132 - RNA, 16 nt, Homo sapiens
uuuccugugccuaaca

SEQ ID NO: 1514133 - RNA, 16 nt, Homo sapiens
uuucuaccuuuacuac

SEQ ID NO: 1514134 - RNA, 15 nt, Homo sapiens
uuucuauaccugucu

SEQ ID NO: 1514135 - RNA, 21 nt, Homo sapiens
uuucucaagaauaagucccuu

SEQ ID NO: 1514136 - RNA, 14 nt, Homo sapiens
uuucuggugccauu

SEQ ID NO: 1514137 - RNA, 20 nt, Homo sapiens
uuucuuaaauauuaugugaa

SEQ ID NO: 1514138 - RNA, 14 nt, Homo sapiens
uuucuuaauauaca

SEQ ID NO: 1514139 - RNA, 16 nt, Homo sapiens
uuugaaaacauaaucu

SEQ ID NO: 1514140 - RNA, 17 nt, Homo sapiens
uuugaaacugaauguuu

SEQ ID NO: 1514141 - RNA, 22 nt, Homo sapiens
uuugagaacaauggagauauca

SEQ ID NO: 1514142 - RNA, 17 nt, Homo sapiens
uuugagcccucccagca

SEQ ID NO: 1514143 - RNA, 18 nt, Homo sapiens
uuugaggagcagcuucag

SEQ ID NO: 1514144 - RNA, 14 nt, Homo sapiens
uuugauaaagcagu

SEQ ID NO: 1514145 - RNA, 18 nt, Homo sapiens
uuugauaugaaguguuag

SEQ ID NO: 1514146 - RNA, 21 nt, Homo sapiens
uuugcaauggcuauauggcaa

SEQ ID NO: 1514147 - RNA, 13 nt, Homo sapiens
uuugcacugacaa

SEQ ID NO: 1514148 - RNA, 17 nt, Homo sapiens
uuugcccuguggauucc

SEQ ID NO: 1514149 - RNA, 13 nt, Homo sapiens
uuugcuauuacau

SEQ ID NO: 1514150 - RNA, 12 nt, Homo sapiens
uuuggcaauuuc

SEQ ID NO: 1514151 - RNA, 18 nt, Homo sapiens
uuugguaggcuuaucaaa

SEQ ID NO: 1514152 - RNA, 12 nt, Homo sapiens
uuuguacagaga

SEQ ID NO: 1514153 - RNA, 23 nt, Homo sapiens
uuugucaacaaaaagacauggaa

SEQ ID NO: 1514154 - RNA, 18 nt, Homo sapiens
uuugucucugcaucucau

SEQ ID NO: 1514155 - RNA, 13 nt, Homo sapiens
uuugucugacaaa

SEQ ID NO: 1514156 - RNA, 15 nt, Homo sapiens
uuuguucacaugcau

SEQ ID NO: 1514157 - RNA, 18 nt, Homo sapiens
uuuguuucuuucauauga

SEQ ID NO: 1514158 - RNA, 11 nt, Homo sapiens
uuuuaauuucu

SEQ ID NO: 1514159 - RNA, 19 nt, Homo sapiens
uuuuagaggaagaccaaaa

SEQ ID NO: 1514160 - RNA, 16 nt, Homo sapiens
uuuuauaaauauguga

SEQ ID NO: 1514161 - RNA, 17 nt, Homo sapiens
uuuuauaaauaugugaa

SEQ ID NO: 1514162 - RNA, 20 nt, Homo sapiens
uuuuaugggaauucuuuaca

SEQ ID NO: 1514163 - RNA, 13 nt, Homo sapiens
uuuucacacugau

SEQ ID NO: 1514164 - RNA, 14 nt, Homo sapiens
uuuucagaugugaa

SEQ ID NO: 1514165 - RNA, 12 nt, Homo sapiens
uuuucaguauga

SEQ ID NO: 1514166 - RNA, 12 nt, Homo sapiens
uuuuccaaccaa

SEQ ID NO: 1514167 - RNA, 17 nt, Homo sapiens
uuuuccaacuuggcugc

SEQ ID NO: 1514168 - RNA, 12 nt, Homo sapiens
uuuuccaggaau

SEQ ID NO: 1514169 - RNA, 15 nt, Homo sapiens
uuuucuagacugucu

SEQ ID NO: 1514170 - RNA, 23 nt, Homo sapiens
uuuucucuccuaagacaccugca

SEQ ID NO: 1514171 - RNA, 14 nt, Homo sapiens
uuuugauagauauc

SEQ ID NO: 1514172 - RNA, 13 nt, Homo sapiens
uuuugcacugaca

SEQ ID NO: 1514173 - RNA, 16 nt, Homo sapiens
uuuuguauguggcaug

SEQ ID NO: 1514174 - RNA, 17 nt, Homo sapiens
uuuuuacaguuaugcau

SEQ ID NO: 1514175 - RNA, 10 nt, Homo sapiens
uuuuuaguuu

SEQ ID NO: 1514176 - RNA, 12 nt, Homo sapiens
uuuuugcuauau

SEQ ID NO: 1514177 - RNA, 14 nt, Homo sapiens
uuuuuguacacauc

SEQ ID NO: 1514178 - RNA, 21 nt, Homo sapiens
uuuuuuaggaagcaagcuuaa

SEQ ID NO: 1514179 - RNA, 14 nt, Homo sapiens
uuaugcaagcacaa

SEQ ID NO: 1514180 - RNA, 14 nt, Homo sapiens
uuauguaaucucac

SEQ ID NO: 1514181 - RNA, 18 nt, Homo sapiens
uuauuauuguucuuuaag

SEQ ID NO: 1514182 - RNA, 14 nt, Homo sapiens
uucaaaagucagac

SEQ ID NO: 1514183 - RNA, 12 nt, Homo sapiens
uucaaaccaauu

SEQ ID NO: 1514184 - RNA, 18 nt, Homo sapiens
uucaaguauuagggguaa

SEQ ID NO: 1514185 - RNA, 11 nt, Homo sapiens
uucaagugauu

SEQ ID NO: 1514186 - RNA, 20 nt, Homo sapiens
uucaauaaagcugcugagaa

SEQ ID NO: 1514187 - RNA, 15 nt, Homo sapiens
uucaauucucaaaag

SEQ ID NO: 1514188 - RNA, 23 nt, Homo sapiens
uucacaaaaaggcauaugcaaua

SEQ ID NO: 1514189 - RNA, 21 nt, Homo sapiens
uucacaaggucuuuaaaguga

SEQ ID NO: 1514190 - RNA, 20 nt, Homo sapiens
uucacagcccagaaccacag

SEQ ID NO: 1514191 - RNA, 18 nt, Homo sapiens
uucacauaaaaccucauu

SEQ ID NO: 1514192 - RNA, 22 nt, Homo sapiens
uucacauauauguaauuuagca

SEQ ID NO: 1514193 - RNA, 14 nt, Homo sapiens
uucaccugaucaua

SEQ ID NO: 1514194 - RNA, 17 nt, Homo sapiens
uucaccugguauccauu

SEQ ID NO: 1514195 - RNA, 14 nt, Homo sapiens
uucacuaaugacga

SEQ ID NO: 1514196 - RNA, 15 nt, Homo sapiens
uucacuagacugugc

SEQ ID NO: 1514197 - RNA, 15 nt, Homo sapiens
uucacugccaugccu

SEQ ID NO: 1514198 - RNA, 14 nt, Homo sapiens
uucacuguugaaaa

SEQ ID NO: 1514199 - RNA, 15 nt, Homo sapiens
uucagaagacacugc

SEQ ID NO: 1514200 - RNA, 15 nt, Homo sapiens
uucagaggaagcaca

SEQ ID NO: 1514201 - RNA, 19 nt, Homo sapiens
uucagauauauuuuucaca

SEQ ID NO: 1514202 - RNA, 22 nt, Homo sapiens
uucagcaguaacaggaaaccac

SEQ ID NO: 1514203 - RNA, 15 nt, Homo sapiens
uucagccugaggcug

SEQ ID NO: 1514204 - RNA, 16 nt, Homo sapiens
uucagcuucagacuuu

SEQ ID NO: 1514205 - RNA, 23 nt, Homo sapiens
uucagcuucagacuuuuaucaaa

SEQ ID NO: 1514206 - RNA, 23 nt, Homo sapiens
uucaguggugugaucuuggcuca

SEQ ID NO: 1514207 - RNA, 14 nt, Homo sapiens
uucaucaugacaac

SEQ ID NO: 1514208 - RNA, 20 nt, Homo sapiens
uucaugacuuuuccauguau

SEQ ID NO: 1514209 - RNA, 22 nt, Homo sapiens
uuccaaguuccugcacuccaga

SEQ ID NO: 1514210 - RNA, 18 nt, Homo sapiens
uuccacuuugaguaccaa

SEQ ID NO: 1514211 - RNA, 14 nt, Homo sapiens
uuccagcauuugcc

SEQ ID NO: 1514212 - RNA, 12 nt, Homo sapiens
uuccaguaggaa

SEQ ID NO: 1514213 - RNA, 17 nt, Homo sapiens
uuccauccccaaacugu

SEQ ID NO: 1514214 - RNA, 15 nt, Homo sapiens
uuccaugacaacaga

SEQ ID NO: 1514215 - RNA, 16 nt, Homo sapiens
uuccaugauacuuuaa

SEQ ID NO: 1514216 - RNA, 16 nt, Homo sapiens
uuccaugggaccacaa

SEQ ID NO: 1514217 - RNA, 12 nt, Homo sapiens
uuccauguuaaa

SEQ ID NO: 1514218 - RNA, 15 nt, Homo sapiens
uuccauguugucuua

SEQ ID NO: 1514219 - RNA, 15 nt, Homo sapiens
uuccauuuuacuucc

SEQ ID NO: 1514220 - RNA, 20 nt, Homo sapiens
uucccaagcucuagugggaa

SEQ ID NO: 1514221 - RNA, 14 nt, Homo sapiens
uucccaauacauac

SEQ ID NO: 1514222 - RNA, 17 nt, Homo sapiens
uuccccaaaggcaucca

SEQ ID NO: 1514223 - RNA, 11 nt, Homo sapiens
uuccccaguga

SEQ ID NO: 1514224 - RNA, 21 nt, Homo sapiens
uucccuaggcugagcuggcau

SEQ ID NO: 1514225 - RNA, 17 nt, Homo sapiens
uuccuaacauuuugaag

SEQ ID NO: 1514226 - RNA, 21 nt, Homo sapiens
uuccuacacccuuggacuuga

SEQ ID NO: 1514227 - RNA, 21 nt, Homo sapiens
uuccuaugcuuugaaacagaa

SEQ ID NO: 1514228 - RNA, 15 nt, Homo sapiens
uuccucaucaccauc

SEQ ID NO: 1514229 - RNA, 17 nt, Homo sapiens
uuccuuuccuucuggcu

SEQ ID NO: 1514230 - RNA, 12 nt, Homo sapiens
uuccuuuugcca

SEQ ID NO: 1514231 - RNA, 19 nt, Homo sapiens
uucgagaccagccugacca

SEQ ID NO: 1514232 - RNA, 15 nt, Homo sapiens
uucgugacaacaugc

SEQ ID NO: 1514233 - RNA, 20 nt, Homo sapiens
uucuaaagagucuggaacaa

SEQ ID NO: 1514234 - RNA, 21 nt, Homo sapiens
uucuaaaucagaaauaggaag

SEQ ID NO: 1514235 - RNA, 16 nt, Homo sapiens
uucuaaauugagauuc

SEQ ID NO: 1514236 - RNA, 19 nt, Homo sapiens
uucuaaggguuuucuuuga

SEQ ID NO: 1514237 - RNA, 22 nt, Homo sapiens
uucuaaguaagaacacugagau

SEQ ID NO: 1514238 - RNA, 12 nt, Homo sapiens
uucuaaguauuu

SEQ ID NO: 1514239 - RNA, 22 nt, Homo sapiens
uucuaagugguauauacauaug

SEQ ID NO: 1514240 - RNA, 15 nt, Homo sapiens
uucuacugugacuga

SEQ ID NO: 1514241 - RNA, 12 nt, Homo sapiens
uucuauuuacaa

SEQ ID NO: 1514242 - RNA, 17 nt, Homo sapiens
uucucagccacaaaaua

SEQ ID NO: 1514243 - RNA, 20 nt, Homo sapiens
uucucagcgcaacagcugug

SEQ ID NO: 1514244 - RNA, 23 nt, Homo sapiens
uucuccaccaacuggagcacuga

SEQ ID NO: 1514245 - RNA, 20 nt, Homo sapiens
uucucgugguagaagccagu

SEQ ID NO: 1514246 - RNA, 15 nt, Homo sapiens
uucucuauuuugccu

SEQ ID NO: 1514247 - RNA, 17 nt, Homo sapiens
uucucucuuaguaacau

SEQ ID NO: 1514248 - RNA, 23 nt, Homo sapiens
uucucuggacacacuaucaccua

SEQ ID NO: 1514249 - RNA, 23 nt, Homo sapiens
uucugacaagauaaaggaaguca

SEQ ID NO: 1514250 - RNA, 15 nt, Homo sapiens
uucuggcacugguug

SEQ ID NO: 1514251 - RNA, 15 nt, Homo sapiens
uucuguaaccaaaaa

SEQ ID NO: 1514252 - RNA, 22 nt, Homo sapiens
uucuguagcuuguucccugucu

SEQ ID NO: 1514253 - RNA, 22 nt, Homo sapiens
uucuuaaaaguugugauuccag

SEQ ID NO: 1514254 - RNA, 15 nt, Homo sapiens
uucuuaaauaagaaa

SEQ ID NO: 1514255 - RNA, 18 nt, Homo sapiens
uucuuacagacugcaugu

SEQ ID NO: 1514256 - RNA, 16 nt, Homo sapiens
uucuucaucuugacau

SEQ ID NO: 1514257 - RNA, 16 nt, Homo sapiens
uucuugaaccaauaau

SEQ ID NO: 1514258 - RNA, 19 nt, Homo sapiens
uucuuuucaaaacugcuaa

SEQ ID NO: 1514259 - RNA, 16 nt, Homo sapiens
uucuuuuucacacuga

SEQ ID NO: 1514260 - RNA, 17 nt, Homo sapiens
uugaaaaaaauauauga

SEQ ID NO: 1514261 - RNA, 17 nt, Homo sapiens
uugaaaaauauucaugu

SEQ ID NO: 1514262 - RNA, 17 nt, Homo sapiens
uugaaaauaauuguucc

SEQ ID NO: 1514263 - RNA, 13 nt, Homo sapiens
uugaaccaauaau

SEQ ID NO: 1514264 - RNA, 21 nt, Homo sapiens
uugaagagauuucaacauauc

SEQ ID NO: 1514265 - RNA, 18 nt, Homo sapiens
uugaagagcauugcaugg

SEQ ID NO: 1514266 - RNA, 17 nt, Homo sapiens
uugaagaucccuauuau

SEQ ID NO: 1514267 - RNA, 12 nt, Homo sapiens
uugaagccaaac

SEQ ID NO: 1514268 - RNA, 18 nt, Homo sapiens
uugaauagaaaaaguaau

SEQ ID NO: 1514269 - RNA, 12 nt, Homo sapiens
uugaauaucauu

SEQ ID NO: 1514270 - RNA, 19 nt, Homo sapiens
uugaauuugccuuccucau

SEQ ID NO: 1514271 - RNA, 13 nt, Homo sapiens
uugacaacuggca

SEQ ID NO: 1514272 - RNA, 22 nt, Homo sapiens
uugacuugugucuguccaagaa

SEQ ID NO: 1514273 - RNA, 13 nt, Homo sapiens
uugagaucauguc

SEQ ID NO: 1514274 - RNA, 22 nt, Homo sapiens
uugagcuuucaugaguuuccca

SEQ ID NO: 1514275 - RNA, 14 nt, Homo sapiens
uugaguagaucugc

SEQ ID NO: 1514276 - RNA, 17 nt, Homo sapiens
uugaucaaaucuaaugu

SEQ ID NO: 1514277 - RNA, 18 nt, Homo sapiens
uugaugaguuaacuguga

SEQ ID NO: 1514278 - RNA, 22 nt, Homo sapiens
uugcaagacaaaguugaaugua

SEQ ID NO: 1514279 - RNA, 19 nt, Homo sapiens
uugcaauuuuuccaugaag

SEQ ID NO: 1514280 - RNA, 13 nt, Homo sapiens
uugcacaaaaagg

SEQ ID NO: 1514281 - RNA, 18 nt, Homo sapiens
uugcacuaucuuucagcu

SEQ ID NO: 1514282 - RNA, 13 nt, Homo sapiens
uugcagacaggaa

SEQ ID NO: 1514283 - RNA, 18 nt, Homo sapiens
uugcagacaggaaucuua

SEQ ID NO: 1514284 - RNA, 20 nt, Homo sapiens
uugcagugagcugagaucac

SEQ ID NO: 1514285 - RNA, 14 nt, Homo sapiens
uugcauugugacua

SEQ ID NO: 1514286 - RNA, 20 nt, Homo sapiens
uugcauugugacuauccagu

SEQ ID NO: 1514287 - RNA, 12 nt, Homo sapiens
uugccacaaagc

SEQ ID NO: 1514288 - RNA, 18 nt, Homo sapiens
uugccccuuccacuuuga

SEQ ID NO: 1514289 - RNA, 19 nt, Homo sapiens
uugcccugaguggaucucc

SEQ ID NO: 1514290 - RNA, 15 nt, Homo sapiens
uugcugguacuaaga

SEQ ID NO: 1514291 - RNA, 18 nt, Homo sapiens
uugcuguaacucagacau

SEQ ID NO: 1514292 - RNA, 17 nt, Homo sapiens
uugcuuauguaaucuca

SEQ ID NO: 1514293 - RNA, 19 nt, Homo sapiens
uuggaaaagcuaaguagaa

SEQ ID NO: 1514294 - RNA, 17 nt, Homo sapiens
uuggaaagcaucaccuc

SEQ ID NO: 1514295 - RNA, 23 nt, Homo sapiens
uuggagaaggcccacugaggcag

SEQ ID NO: 1514296 - RNA, 20 nt, Homo sapiens
uuggaugaugaaacauucau

SEQ ID NO: 1514297 - RNA, 13 nt, Homo sapiens
uuggcaacagaag

SEQ ID NO: 1514298 - RNA, 20 nt, Homo sapiens
uuggcaacagaagcaguuga

SEQ ID NO: 1514299 - RNA, 20 nt, Homo sapiens
uugggauucuaggaaaccca

SEQ ID NO: 1514300 - RNA, 14 nt, Homo sapiens
uugguauauuucca

SEQ ID NO: 1514301 - RNA, 16 nt, Homo sapiens
uuggucccgugcagcu

SEQ ID NO: 1514302 - RNA, 19 nt, Homo sapiens
uuguauaaucccacccacc

SEQ ID NO: 1514303 - RNA, 17 nt, Homo sapiens
uugucaacacaaagaca

SEQ ID NO: 1514304 - RNA, 22 nt, Homo sapiens
uugucaacacaaagacauggaa

SEQ ID NO: 1514305 - RNA, 15 nt, Homo sapiens
uugucgaguuuacuu

SEQ ID NO: 1514306 - RNA, 16 nt, Homo sapiens
uugucgggacagagag

SEQ ID NO: 1514307 - RNA, 20 nt, Homo sapiens
uugucuguuuuuguaacuua

SEQ ID NO: 1514308 - RNA, 20 nt, Homo sapiens
uuguggguuuuuucacauaa

SEQ ID NO: 1514309 - RNA, 23 nt, Homo sapiens
uuguguaaauacaguggaucuca

SEQ ID NO: 1514310 - RNA, 12 nt, Homo sapiens
uugugucagaga

SEQ ID NO: 1514311 - RNA, 15 nt, Homo sapiens
uuguuauuuguacag

SEQ ID NO: 1514312 - RNA, 15 nt, Homo sapiens
uuguucaguugacuu

SEQ ID NO: 1514313 - RNA, 20 nt, Homo sapiens
uuguuuuauauguaguacua

SEQ ID NO: 1514314 - RNA, 23 nt, Homo sapiens
uuguuuucccgagcaaagucuaa

SEQ ID NO: 1514315 - RNA, 12 nt, Homo sapiens
uuguuuugcacu

SEQ ID NO: 1514316 - RNA, 20 nt, Homo sapiens
uuguuuuuaaguccuguaua

SEQ ID NO: 1514317 - RNA, 18 nt, Homo sapiens
uggucauugccuugccaa

SEQ ID NO: 1514318 - RNA, 14 nt, Homo sapiens
ugguccaggguuga

SEQ ID NO: 1514319 - RNA, 20 nt, Homo sapiens
uggucuuuccuaucauggag

SEQ ID NO: 1514320 - RNA, 16 nt, Homo sapiens
ugguggaucuguccaa

SEQ ID NO: 1514321 - RNA, 21 nt, Homo sapiens
ugguggaugggcccugcaaga

SEQ ID NO: 1514322 - RNA, 15 nt, Homo sapiens
ugguggccaagccug

SEQ ID NO: 1514323 - RNA, 20 nt, Homo sapiens
ugguucaggccaagccccuu

SEQ ID NO: 1514324 - RNA, 17 nt, Homo sapiens
ugguuugggagcaauac

SEQ ID NO: 1514325 - RNA, 19 nt, Homo sapiens
ugguuugggagcaauacuu

SEQ ID NO: 1514326 - RNA, 21 nt, Homo sapiens
ugguuuucacauacacucaaa

SEQ ID NO: 1514327 - RNA, 19 nt, Homo sapiens
ugguuuucucuuacugcag

SEQ ID NO: 1514328 - RNA, 11 nt, Homo sapiens
uguaaaaccaa

SEQ ID NO: 1514329 - RNA, 19 nt, Homo sapiens
uguaaaauaaguauuucca

SEQ ID NO: 1514330 - RNA, 18 nt, Homo sapiens
uguaaaauuguuaguaaa

SEQ ID NO: 1514331 - RNA, 13 nt, Homo sapiens
uguaaagaaggga

SEQ ID NO: 1514332 - RNA, 22 nt, Homo sapiens
uguaaaggaaauaauugccaaa

SEQ ID NO: 1514333 - RNA, 16 nt, Homo sapiens
uguaagacucauuccc

SEQ ID NO: 1514334 - RNA, 15 nt, Homo sapiens
uguaagguaauuucu

SEQ ID NO: 1514335 - RNA, 18 nt, Homo sapiens
uguaaguuuaugucuaaa

SEQ ID NO: 1514336 - RNA, 16 nt, Homo sapiens
uguaauagugacauau

SEQ ID NO: 1514337 - RNA, 15 nt, Homo sapiens
uguacacuguuccca

SEQ ID NO: 1514338 - RNA, 19 nt, Homo sapiens
uguacaguguguaaagugu

SEQ ID NO: 1514339 - RNA, 10 nt, Homo sapiens
uguacauuuc

SEQ ID NO: 1514340 - RNA, 12 nt, Homo sapiens
uguacauuucac

SEQ ID NO: 1514341 - RNA, 12 nt, Homo sapiens
uguacguaaugu

SEQ ID NO: 1514342 - RNA, 14 nt, Homo sapiens
uguagacagccuuc

SEQ ID NO: 1514343 - RNA, 21 nt, Homo sapiens
uguagcggugaagaguacaga

SEQ ID NO: 1514344 - RNA, 18 nt, Homo sapiens
uguauaaagccauuauuc

SEQ ID NO: 1514345 - RNA, 22 nt, Homo sapiens
uguauaauuuaacagugcccuu

SEQ ID NO: 1514346 - RNA, 21 nt, Homo sapiens
uguauacagauucuagccaaa

SEQ ID NO: 1514347 - RNA, 16 nt, Homo sapiens
uguauagacagcacuu

SEQ ID NO: 1514348 - RNA, 23 nt, Homo sapiens
uguauccccccccuguauaguua

SEQ ID NO: 1514349 - RNA, 23 nt, Homo sapiens
uguaucuucugcagacacugugg

SEQ ID NO: 1514350 - RNA, 18 nt, Homo sapiens
uguaugacuucugcugaa

SEQ ID NO: 1514351 - RNA, 21 nt, Homo sapiens
uguaugcuaauugaacaugca

SEQ ID NO: 1514352 - RNA, 17 nt, Homo sapiens
ugucaacaaaaagacau

SEQ ID NO: 1514353 - RNA, 14 nt, Homo sapiens
ugucaacacaaaga

SEQ ID NO: 1514354 - RNA, 17 nt, Homo sapiens
ugucaacacaaagacac

SEQ ID NO: 1514355 - RNA, 17 nt, Homo sapiens
ugucaacacaaagacau

SEQ ID NO: 1514356 - RNA, 20 nt, Homo sapiens
ugucaacacaaagacaugga

SEQ ID NO: 1514357 - RNA, 19 nt, Homo sapiens
ugucauuauguacaauaca

SEQ ID NO: 1514358 - RNA, 20 nt, Homo sapiens
ugucauuuacccugguggag

SEQ ID NO: 1514359 - RNA, 13 nt, Homo sapiens
uguccauguguau

SEQ ID NO: 1514360 - RNA, 12 nt, Homo sapiens
ugucccaaagaa

SEQ ID NO: 1514361 - RNA, 15 nt, Homo sapiens
ugucgcaucucagcg

SEQ ID NO: 1514362 - RNA, 13 nt, Homo sapiens
ugucguagccaag

SEQ ID NO: 1514363 - RNA, 17 nt, Homo sapiens
ugucuuagcuguauaca

SEQ ID NO: 1514364 - RNA, 13 nt, Homo sapiens
ugucuugguggau

SEQ ID NO: 1514365 - RNA, 12 nt, Homo sapiens
ugugaaagucag

SEQ ID NO: 1514366 - RNA, 23 nt, Homo sapiens
ugugaagaauaaugccuuguaug

SEQ ID NO: 1514367 - RNA, 14 nt, Homo sapiens
ugugacugggaccu

SEQ ID NO: 1514368 - RNA, 12 nt, Homo sapiens
ugugauuuucag

SEQ ID NO: 1514369 - RNA, 22 nt, Homo sapiens
ugugauuuugagcaaaccacau

SEQ ID NO: 1514370 - RNA, 17 nt, Homo sapiens
ugugccaaagugcauag

SEQ ID NO: 1514371 - RNA, 16 nt, Homo sapiens
ugugccaaugugacaa

SEQ ID NO: 1514372 - RNA, 19 nt, Homo sapiens
ugugccacaccccaugcac

SEQ ID NO: 1514373 - RNA, 22 nt, Homo sapiens
ugugccccauguccaaguccaa

SEQ ID NO: 1514374 - RNA, 23 nt, Homo sapiens
ugugcugccuguggugagguccu

SEQ ID NO: 1514375 - RNA, 14 nt, Homo sapiens
uguggagaaggaua

SEQ ID NO: 1514376 - RNA, 12 nt, Homo sapiens
uguggaugcuag

SEQ ID NO: 1514377 - RNA, 22 nt, Homo sapiens
ugugggacugacauuucucaau

SEQ ID NO: 1514378 - RNA, 22 nt, Homo sapiens
uguguaaauacaguggaucuca

SEQ ID NO: 1514379 - RNA, 13 nt, Homo sapiens
uguguacaaagug

SEQ ID NO: 1514380 - RNA, 16 nt, Homo sapiens
uguguacugcaguugg

SEQ ID NO: 1514381 - RNA, 18 nt, Homo sapiens
uguguaugucuauuugca

SEQ ID NO: 1514382 - RNA, 15 nt, Homo sapiens
uguguggcaguucuc

SEQ ID NO: 1514383 - RNA, 13 nt, Homo sapiens
uguguguagccaa

SEQ ID NO: 1514384 - RNA, 17 nt, Homo sapiens
uguguguuuaacauuca

SEQ ID NO: 1514385 - RNA, 20 nt, Homo sapiens
uguguuauaguaggauuaau

SEQ ID NO: 1514386 - RNA, 19 nt, Homo sapiens
uguguuccuaacauaaaau

SEQ ID NO: 1514387 - RNA, 13 nt, Homo sapiens
uguguuguagucg

SEQ ID NO: 1514388 - RNA, 16 nt, Homo sapiens
uguguuuaacauucac

SEQ ID NO: 1514389 - RNA, 12 nt, Homo sapiens
uguguuucacaa

SEQ ID NO: 1514390 - RNA, 17 nt, Homo sapiens
uguguuuggaagacuau

SEQ ID NO: 1514391 - RNA, 18 nt, Homo sapiens
uguguuuugaaagcccaa

SEQ ID NO: 1514392 - RNA, 12 nt, Homo sapiens
uguuacaauggu

SEQ ID NO: 1514393 - RNA, 15 nt, Homo sapiens
uguuauccacaagca

SEQ ID NO: 1514394 - RNA, 18 nt, Homo sapiens
uguucagcuggacaauau

SEQ ID NO: 1514395 - RNA, 13 nt, Homo sapiens
uguucucacuuau

SEQ ID NO: 1514396 - RNA, 14 nt, Homo sapiens
uguucucuucuaua

SEQ ID NO: 1514397 - RNA, 21 nt, Homo sapiens
uguucugggaguccugucagc

SEQ ID NO: 1514398 - RNA, 15 nt, Homo sapiens
uguugagugcaacaa

SEQ ID NO: 1514399 - RNA, 12 nt, Homo sapiens
uguugaucccaa

SEQ ID NO: 1514400 - RNA, 15 nt, Homo sapiens
uguugguuuccaaaa

SEQ ID NO: 1514401 - RNA, 22 nt, Homo sapiens
uguuucaaaaauaaaagaacac

SEQ ID NO: 1514402 - RNA, 14 nt, Homo sapiens
uguuucccaccuca

SEQ ID NO: 1514403 - RNA, 16 nt, Homo sapiens
uguuucuuucauauga

SEQ ID NO: 1514404 - RNA, 17 nt, Homo sapiens
uguuucuuucauaugaa

SEQ ID NO: 1514405 - RNA, 13 nt, Homo sapiens
uguuugcucuugc

SEQ ID NO: 1514406 - RNA, 21 nt, Homo sapiens
uguuuucuaaaguuguucaca

SEQ ID NO: 1514407 - RNA, 17 nt, Homo sapiens
uuaaaacauaagaacgu

SEQ ID NO: 1514408 - RNA, 17 nt, Homo sapiens
uuaaaaccacagaacag

SEQ ID NO: 1514409 - RNA, 14 nt, Homo sapiens
uuaaaauagcaaaa

SEQ ID NO: 1514410 - RNA, 15 nt, Homo sapiens
uuaaagcugcuguca

SEQ ID NO: 1514411 - RNA, 17 nt, Homo sapiens
uuaaaguuggagacagc

SEQ ID NO: 1514412 - RNA, 17 nt, Homo sapiens
uuaaauuguaucuaauc

SEQ ID NO: 1514413 - RNA, 15 nt, Homo sapiens
uuaacaaaauuagcu

SEQ ID NO: 1514414 - RNA, 11 nt, Homo sapiens
uuaacaaucua

SEQ ID NO: 1514415 - RNA, 20 nt, Homo sapiens
uuaacaucuugaacugguug

SEQ ID NO: 1514416 - RNA, 17 nt, Homo sapiens
uuaagcaaaggaaacca

SEQ ID NO: 1514417 - RNA, 16 nt, Homo sapiens
uuaagggaaggaacuc

SEQ ID NO: 1514418 - RNA, 21 nt, Homo sapiens
uuaagguuuuacuuuucugaa

SEQ ID NO: 1514419 - RNA, 21 nt, Homo sapiens
uuaauaagaaacaugauguga

SEQ ID NO: 1514420 - RNA, 21 nt, Homo sapiens
uuaauaauaccaagacuaagc

SEQ ID NO: 1514421 - RNA, 14 nt, Homo sapiens
uuaauauacaaucu

SEQ ID NO: 1514422 - RNA, 18 nt, Homo sapiens
uuaauggguacaauguac

SEQ ID NO: 1514423 - RNA, 23 nt, Homo sapiens
uuaauuugaaaacauaaucugca

SEQ ID NO: 1514424 - RNA, 18 nt, Homo sapiens
uuacaaugauaugaucau

SEQ ID NO: 1514425 - RNA, 19 nt, Homo sapiens
uuaccaacuuucuguaaac

SEQ ID NO: 1514426 - RNA, 22 nt, Homo sapiens
uuaccacguuacugcauacuga

SEQ ID NO: 1514427 - RNA, 20 nt, Homo sapiens
uuaccaggcaccaaaagaag

SEQ ID NO: 1514428 - RNA, 12 nt, Homo sapiens
uuacccauauau

SEQ ID NO: 1514429 - RNA, 18 nt, Homo sapiens
uuaccuaaaacugcugaa

SEQ ID NO: 1514430 - RNA, 17 nt, Homo sapiens
uuaccucuauuuugcca

SEQ ID NO: 1514431 - RNA, 15 nt, Homo sapiens
uuaccuuguggaugc

SEQ ID NO: 1514432 - RNA, 14 nt, Homo sapiens
uuacgacagguuug

SEQ ID NO: 1514433 - RNA, 22 nt, Homo sapiens
uuacguccacaccgagcccagu

SEQ ID NO: 1514434 - RNA, 14 nt, Homo sapiens
uuacuuccaugaua

SEQ ID NO: 1514435 - RNA, 15 nt, Homo sapiens
uuagaauucugagau

SEQ ID NO: 1514436 - RNA, 13 nt, Homo sapiens
uuagagaguauaa

SEQ ID NO: 1514437 - RNA, 22 nt, Homo sapiens
uuagauaaucgagucuaccucu

SEQ ID NO: 1514438 - RNA, 20 nt, Homo sapiens
uuagauugaaaccauuccag

SEQ ID NO: 1514439 - RNA, 18 nt, Homo sapiens
uuagcacauauuucacau

SEQ ID NO: 1514440 - RNA, 22 nt, Homo sapiens
uuagcucuguucuuuauaacaa

SEQ ID NO: 1514441 - RNA, 12 nt, Homo sapiens
uuagcugucacc

SEQ ID NO: 1514442 - RNA, 12 nt, Homo sapiens
uuaggaacagcu

SEQ ID NO: 1514443 - RNA, 17 nt, Homo sapiens
uuaguaacauagacaaa

SEQ ID NO: 1514444 - RNA, 13 nt, Homo sapiens
uuaguaauuguaa

SEQ ID NO: 1514445 - RNA, 13 nt, Homo sapiens
uuaguaauuguca

SEQ ID NO: 1514446 - RNA, 19 nt, Homo sapiens
uuauaaaaauacaacuaga

SEQ ID NO: 1514447 - RNA, 20 nt, Homo sapiens
uuauacgacuuuuaagcaaa

SEQ ID NO: 1514448 - RNA, 15 nt, Homo sapiens
uuauagcucaucacu

SEQ ID NO: 1514449 - RNA, 22 nt, Homo sapiens
uuauaguuucagauauauauca

SEQ ID NO: 1514450 - RNA, 18 nt, Homo sapiens
uuauauagguugugcaaa

SEQ ID NO: 1514451 - RNA, 18 nt, Homo sapiens
uuauauuuugugcuauca

SEQ ID NO: 1514452 - RNA, 23 nt, Homo sapiens
uuaucaaaaucuuucagcacuca

SEQ ID NO: 1514453 - RNA, 19 nt, Homo sapiens
uuaucagaauaucaaggaa

SEQ ID NO: 1514454 - RNA, 13 nt, Homo sapiens
uuauccacaagca

SEQ ID NO: 1514455 - RNA, 20 nt, Homo sapiens
guuugaaggaggugagggau

SEQ ID NO: 1514456 - RNA, 23 nt, Homo sapiens
guuugcucuugcauugcaaaaau

SEQ ID NO: 1514457 - RNA, 23 nt, Homo sapiens
guuuggccgggugcgguggcuca

SEQ ID NO: 1514458 - RNA, 18 nt, Homo sapiens
guuugggagcaauacuuu

SEQ ID NO: 1514459 - RNA, 15 nt, Homo sapiens
guuuguaaaugccuc

SEQ ID NO: 1514460 - RNA, 15 nt, Homo sapiens
guuugucaacacaaa

SEQ ID NO: 1514461 - RNA, 12 nt, Homo sapiens
guuuguguggau

SEQ ID NO: 1514462 - RNA, 23 nt, Homo sapiens
guuuguugugcuugcugguacua

SEQ ID NO: 1514463 - RNA, 18 nt, Homo sapiens
guuuuauauguaguacua

SEQ ID NO: 1514464 - RNA, 18 nt, Homo sapiens
guuuuauguucuagugau

SEQ ID NO: 1514465 - RNA, 20 nt, Homo sapiens
guuuuuaauuuaucagagac

SEQ ID NO: 1514466 - RNA, 14 nt, Homo sapiens
uaaaaaaguuuaca

SEQ ID NO: 1514467 - RNA, 23 nt, Homo sapiens
uaaaaaggaccagagaauucuua

SEQ ID NO: 1514468 - RNA, 20 nt, Homo sapiens
uaaaaagguuuacagaauuu

SEQ ID NO: 1514469 - RNA, 16 nt, Homo sapiens
uaaaaaucaagacacu

SEQ ID NO: 1514470 - RNA, 15 nt, Homo sapiens
uaaaaccauaaacug

SEQ ID NO: 1514471 - RNA, 20 nt, Homo sapiens
uaaaaccauaaacuguacaa

SEQ ID NO: 1514472 - RNA, 21 nt, Homo sapiens
uaaaaccauaaacuguacaaa

SEQ ID NO: 1514473 - RNA, 22 nt, Homo sapiens
uaaaagaaaaaguaugugaaua

SEQ ID NO: 1514474 - RNA, 17 nt, Homo sapiens
uaaaagaauuugugaca

SEQ ID NO: 1514475 - RNA, 17 nt, Homo sapiens
uaaaauaaaaguuuaca

SEQ ID NO: 1514476 - RNA, 17 nt, Homo sapiens
uaaaauaaguauuucca

SEQ ID NO: 1514477 - RNA, 20 nt, Homo sapiens
uaaaauagacaacucuucca

SEQ ID NO: 1514478 - RNA, 21 nt, Homo sapiens
uaaaaugauuguaguaaucug

SEQ ID NO: 1514479 - RNA, 17 nt, Homo sapiens
uaaaauguaaagccaug

SEQ ID NO: 1514480 - RNA, 18 nt, Homo sapiens
uaaaauugaacuacuugg

SEQ ID NO: 1514481 - RNA, 22 nt, Homo sapiens
uaaacaguuugaaaagacaaau

SEQ ID NO: 1514482 - RNA, 17 nt, Homo sapiens
uaaaccaauguggcaag

SEQ ID NO: 1514483 - RNA, 15 nt, Homo sapiens
uaaacuaaaagcaua

SEQ ID NO: 1514484 - RNA, 15 nt, Homo sapiens
uaaacuguacaaaug

SEQ ID NO: 1514485 - RNA, 18 nt, Homo sapiens
uaaacuguacaaaugaaa

SEQ ID NO: 1514486 - RNA, 13 nt, Homo sapiens
uaaagcauugcaa

SEQ ID NO: 1514487 - RNA, 16 nt, Homo sapiens
uaaagccaaacauaua

SEQ ID NO: 1514488 - RNA, 13 nt, Homo sapiens
uaaagcccuugaa

SEQ ID NO: 1514489 - RNA, 18 nt, Homo sapiens
uaaagcuuauucuuuguc

SEQ ID NO: 1514490 - RNA, 15 nt, Homo sapiens
uaaaggaugggacca

SEQ ID NO: 1514491 - RNA, 17 nt, Homo sapiens
uaaagguagagaugugu

SEQ ID NO: 1514492 - RNA, 23 nt, Homo sapiens
uaaaguagcaggacucggaauuc

SEQ ID NO: 1514493 - RNA, 15 nt, Homo sapiens
uaaaguugauaaaga

SEQ ID NO: 1514494 - RNA, 18 nt, Homo sapiens
uaaauaauguauacacau

SEQ ID NO: 1514495 - RNA, 21 nt, Homo sapiens
uaaauacaguggaucucaauc

SEQ ID NO: 1514496 - RNA, 17 nt, Homo sapiens
uaaauaugugaaaauga

SEQ ID NO: 1514497 - RNA, 21 nt, Homo sapiens
uaaauaugugaaaaugauuag

SEQ ID NO: 1514498 - RNA, 23 nt, Homo sapiens
uaaauauucccugacgacacuga

SEQ ID NO: 1514499 - RNA, 16 nt, Homo sapiens
uaaaucugagaucucc

SEQ ID NO: 1514500 - RNA, 19 nt, Homo sapiens
uaaauuauggcucuucacc

SEQ ID NO: 1514501 - RNA, 17 nt, Homo sapiens
uaaauuguuugaccaug

SEQ ID NO: 1514502 - RNA, 19 nt, Homo sapiens
uaacaagguucuucuaaaa

SEQ ID NO: 1514503 - RNA, 15 nt, Homo sapiens
uaacagaacagucac

SEQ ID NO: 1514504 - RNA, 19 nt, Homo sapiens
uaacauaucuuuaucuuua

SEQ ID NO: 1514505 - RNA, 21 nt, Homo sapiens
uaacaucuauuauaaaaccau

SEQ ID NO: 1514506 - RNA, 18 nt, Homo sapiens
uaaccucaucuacaagca

SEQ ID NO: 1514507 - RNA, 18 nt, Homo sapiens
uaacuagaaaucugccaa

SEQ ID NO: 1514508 - RNA, 14 nt, Homo sapiens
uaacuccugccauu

SEQ ID NO: 1514509 - RNA, 18 nt, Homo sapiens
uaacugugaaauaccaca

SEQ ID NO: 1514510 - RNA, 19 nt, Homo sapiens
uaacugugaaauaccacaa

SEQ ID NO: 1514511 - RNA, 20 nt, Homo sapiens
uaacugugaaauaccacaag

SEQ ID NO: 1514512 - RNA, 17 nt, Homo sapiens
uaagaaaucauggcauu

SEQ ID NO: 1514513 - RNA, 22 nt, Homo sapiens
uaagaaaucauggcauucacac

SEQ ID NO: 1514514 - RNA, 20 nt, Homo sapiens
uaagaaauuaaggcauuugu

SEQ ID NO: 1514515 - RNA, 17 nt, Homo sapiens
uaagaacacugagauau

SEQ ID NO: 1514516 - RNA, 17 nt, Homo sapiens
uaagaccauaacagcca

SEQ ID NO: 1514517 - RNA, 14 nt, Homo sapiens
uaagacucauuccc

SEQ ID NO: 1514518 - RNA, 24 nt, Homo sapiens
uaagaguagcaaguucuagagaag

SEQ ID NO: 1514519 - RNA, 19 nt, Homo sapiens
uaagauaaauagaguucca

SEQ ID NO: 1514520 - RNA, 14 nt, Homo sapiens
uaagcacauguuua

SEQ ID NO: 1514521 - RNA, 20 nt, Homo sapiens
uaagccacucuuccaaaggc

SEQ ID NO: 1514522 - RNA, 17 nt, Homo sapiens
uaagccuuuugcucaca

SEQ ID NO: 1514523 - RNA, 18 nt, Homo sapiens
uaaggcaguugaaccuga

SEQ ID NO: 1514524 - RNA, 20 nt, Homo sapiens
uaagggaaggaacucuggcu

SEQ ID NO: 1514525 - RNA, 17 nt, Homo sapiens
uaagguaauucauggca

SEQ ID NO: 1514526 - RNA, 16 nt, Homo sapiens
uaaguaaaccaaaaag

SEQ ID NO: 1514527 - RNA, 17 nt, Homo sapiens
uaaguaaaugagccuuu

SEQ ID NO: 1514528 - RNA, 17 nt, Homo sapiens
uaaguaccacucaggcc

SEQ ID NO: 1514529 - RNA, 22 nt, Homo sapiens
uaaguaccccugauaagcaaau

SEQ ID NO: 1514530 - RNA, 21 nt, Homo sapiens
uaagucaagaucaacauucca

SEQ ID NO: 1514531 - RNA, 21 nt, Homo sapiens
uaagugggguagacugaggga

SEQ ID NO: 1514532 - RNA, 15 nt, Homo sapiens
uaauaccuguccaca

SEQ ID NO: 1514533 - RNA, 14 nt, Homo sapiens
uaauagacacugga

SEQ ID NO: 1514534 - RNA, 17 nt, Homo sapiens
uaauagccauaugcaau

SEQ ID NO: 1514535 - RNA, 17 nt, Homo sapiens
uaauauaaaguguaaua

SEQ ID NO: 1514536 - RNA, 15 nt, Homo sapiens
uaauauaugcucaac

SEQ ID NO: 1514537 - RNA, 21 nt, Homo sapiens
uaauauccuaaacaucauuca

SEQ ID NO: 1514538 - RNA, 14 nt, Homo sapiens
uaauaugcucucau

SEQ ID NO: 1514539 - RNA, 13 nt, Homo sapiens
uaauauggcaaaa

SEQ ID NO: 1514540 - RNA, 22 nt, Homo sapiens
uaauaugugaugauuaauacaa

SEQ ID NO: 1514541 - RNA, 17 nt, Homo sapiens
uaauauuucaagugccu

SEQ ID NO: 1514542 - RNA, 21 nt, Homo sapiens
uaaucauguuaccauuacaaa

SEQ ID NO: 1514543 - RNA, 20 nt, Homo sapiens
uaauccagagauaauugcca

SEQ ID NO: 1514544 - RNA, 16 nt, Homo sapiens
uaaucuagauuuuccu

SEQ ID NO: 1514545 - RNA, 15 nt, Homo sapiens
uaaugcucugauaug

SEQ ID NO: 1514546 - RNA, 17 nt, Homo sapiens
uaauguaauaauagaaa

SEQ ID NO: 1514547 - RNA, 17 nt, Homo sapiens
uaauguauacacaugga

SEQ ID NO: 1514548 - RNA, 19 nt, Homo sapiens
uaauuaaguaaaccaaaaa

SEQ ID NO: 1514549 - RNA, 20 nt, Homo sapiens
uaauuauaauaaaggucaca

SEQ ID NO: 1514550 - RNA, 13 nt, Homo sapiens
uaauucauggcau

SEQ ID NO: 1514551 - RNA, 13 nt, Homo sapiens
uaauugcuuugcc

SEQ ID NO: 1514552 - RNA, 14 nt, Homo sapiens
uaauuuaugcagaa

SEQ ID NO: 1514553 - RNA, 21 nt, Homo sapiens
uaauuuuccuggaaagacuga

SEQ ID NO: 1514554 - RNA, 14 nt, Homo sapiens
uaauuuugaccaaa

SEQ ID NO: 1514555 - RNA, 12 nt, Homo sapiens
uacaacauguag

SEQ ID NO: 1514556 - RNA, 15 nt, Homo sapiens
uacaagcauuugccc

SEQ ID NO: 1514557 - RNA, 14 nt, Homo sapiens
uacaaggacaaugc

SEQ ID NO: 1514558 - RNA, 20 nt, Homo sapiens
uacaauauuaauuauaauaa

SEQ ID NO: 1514559 - RNA, 20 nt, Homo sapiens
uacaaucuaucuuuuccaca

SEQ ID NO: 1514560 - RNA, 17 nt, Homo sapiens
uacacaaaagccaaaag

SEQ ID NO: 1514561 - RNA, 23 nt, Homo sapiens
uacacuaagcgaauguguacaaa

SEQ ID NO: 1514562 - RNA, 18 nt, Homo sapiens
uacagauguaaaugccac

SEQ ID NO: 1514563 - RNA, 19 nt, Homo sapiens
uacagauguaaaugccaca

SEQ ID NO: 1514564 - RNA, 23 nt, Homo sapiens
uacagcagaaaaucuuuuacuag

SEQ ID NO: 1514565 - RNA, 18 nt, Homo sapiens
uacagccaguaagugaua

SEQ ID NO: 1514566 - RNA, 13 nt, Homo sapiens
uacauaagaccau

SEQ ID NO: 1514567 - RNA, 16 nt, Homo sapiens
uacauacagaauuacu

SEQ ID NO: 1514568 - RNA, 14 nt, Homo sapiens
uacaugcaauuuau

SEQ ID NO: 1514569 - RNA, 19 nt, Homo sapiens
uacauguuuuagacagaga

SEQ ID NO: 1514570 - RNA, 18 nt, Homo sapiens
uacauugccaauuuucca

SEQ ID NO: 1514571 - RNA, 14 nt, Homo sapiens
uacauuucugcaga

SEQ ID NO: 1514572 - RNA, 15 nt, Homo sapiens
uacauuucuguucau

SEQ ID NO: 1514573 - RNA, 22 nt, Homo sapiens
uacauuuugccugacuuaccuu

SEQ ID NO: 1514574 - RNA, 17 nt, Homo sapiens
uaccacaagccugagaa

SEQ ID NO: 1514575 - RNA, 14 nt, Homo sapiens
uaccauggugccau

SEQ ID NO: 1514576 - RNA, 18 nt, Homo sapiens
uaccccuguuaagcaauu

SEQ ID NO: 1514577 - RNA, 20 nt, Homo sapiens
uacccucccucuagccuuua

SEQ ID NO: 1514578 - RNA, 17 nt, Homo sapiens
uaccuaaaacugcugaa

SEQ ID NO: 1514579 - RNA, 20 nt, Homo sapiens
uaccuagagcaggcacuuga

SEQ ID NO: 1514580 - RNA, 13 nt, Homo sapiens
uaccucugagaag

SEQ ID NO: 1514581 - RNA, 20 nt, Homo sapiens
uaccucugagaagacacaag

SEQ ID NO: 1514582 - RNA, 12 nt, Homo sapiens
uacuaaagccaa

SEQ ID NO: 1514583 - RNA, 18 nt, Homo sapiens
uacuauacaacaauguuc

SEQ ID NO: 1514584 - RNA, 17 nt, Homo sapiens
uacucuuucacucaggc

SEQ ID NO: 1514585 - RNA, 14 nt, Homo sapiens
uacugauauuucau

SEQ ID NO: 1514586 - RNA, 11 nt, Homo sapiens
uacugauucuc

SEQ ID NO: 1514587 - RNA, 22 nt, Homo sapiens
uacugcaagguucaacuuauua

SEQ ID NO: 1514588 - RNA, 19 nt, Homo sapiens
uacugcugagauacauaca

SEQ ID NO: 1514589 - RNA, 12 nt, Homo sapiens
uacuguacuuaa

SEQ ID NO: 1514590 - RNA, 14 nt, Homo sapiens
uacuuaagugcugc

SEQ ID NO: 1514591 - RNA, 15 nt, Homo sapiens
uacuucacuaaugac

SEQ ID NO: 1514592 - RNA, 18 nt, Homo sapiens
gguugaucacacucuggg

SEQ ID NO: 1514593 - RNA, 19 nt, Homo sapiens
gguugcgggggagcuggaa

SEQ ID NO: 1514594 - RNA, 22 nt, Homo sapiens
guaaacaguuugaaaagacaaa

SEQ ID NO: 1514595 - RNA, 15 nt, Homo sapiens
guaaacauagguaua

SEQ ID NO: 1514596 - RNA, 16 nt, Homo sapiens
guaaacauagguauaa

SEQ ID NO: 1514597 - RNA, 12 nt, Homo sapiens
guaaagccaugc

SEQ ID NO: 1514598 - RNA, 22 nt, Homo sapiens
guaaaggaaauaauugccaaau

SEQ ID NO: 1514599 - RNA, 14 nt, Homo sapiens
guaaauacaucaaa

SEQ ID NO: 1514600 - RNA, 17 nt, Homo sapiens
guaaauagcauucucua

SEQ ID NO: 1514601 - RNA, 11 nt, Homo sapiens
guaaaugccuc

SEQ ID NO: 1514602 - RNA, 17 nt, Homo sapiens
guaacacuggccuuccc

SEQ ID NO: 1514603 - RNA, 14 nt, Homo sapiens
guaagcauucugag

SEQ ID NO: 1514604 - RNA, 21 nt, Homo sapiens
guaagcucaagcuuuugcuca

SEQ ID NO: 1514605 - RNA, 17 nt, Homo sapiens
guaaucccagcuacuca

SEQ ID NO: 1514606 - RNA, 14 nt, Homo sapiens
guaaugaaacaaag

SEQ ID NO: 1514607 - RNA, 20 nt, Homo sapiens
guaauuuagcaguccaaaga

SEQ ID NO: 1514608 - RNA, 11 nt, Homo sapiens
guacaauaaua

SEQ ID NO: 1514609 - RNA, 23 nt, Homo sapiens
guacacuguucccaauauguagc

SEQ ID NO: 1514610 - RNA, 15 nt, Homo sapiens
guacagacgucucaa

SEQ ID NO: 1514611 - RNA, 18 nt, Homo sapiens
guacagagaaauucugug

SEQ ID NO: 1514612 - RNA, 19 nt, Homo sapiens
guacagcagggucuugcug

SEQ ID NO: 1514613 - RNA, 17 nt, Homo sapiens
guacauacguguucuau

SEQ ID NO: 1514614 - RNA, 18 nt, Homo sapiens
guacauuucccugugcug

SEQ ID NO: 1514615 - RNA, 21 nt, Homo sapiens
guacauuucccugugcugacg

SEQ ID NO: 1514616 - RNA, 17 nt, Homo sapiens
guaccagaacuauuuau

SEQ ID NO: 1514617 - RNA, 12 nt, Homo sapiens
guaccagccagg

SEQ ID NO: 1514618 - RNA, 17 nt, Homo sapiens
guacuccuuaaauuuau

SEQ ID NO: 1514619 - RNA, 20 nt, Homo sapiens
guagcugggacuacaggugc

SEQ ID NO: 1514620 - RNA, 19 nt, Homo sapiens
guaggauuuggggugaaug

SEQ ID NO: 1514621 - RNA, 20 nt, Homo sapiens
guaggauuuggggugaauga

SEQ ID NO: 1514622 - RNA, 18 nt, Homo sapiens
guaggggcacagugaaug

SEQ ID NO: 1514623 - RNA, 13 nt, Homo sapiens
guagguaagggcc

SEQ ID NO: 1514624 - RNA, 20 nt, Homo sapiens
guagguacuucacauugcaa

SEQ ID NO: 1514625 - RNA, 22 nt, Homo sapiens
guaggucagaagaagaugcugu

SEQ ID NO: 1514626 - RNA, 15 nt, Homo sapiens
guaggugucugcacc

SEQ ID NO: 1514627 - RNA, 16 nt, Homo sapiens
guagucccagccacuc

SEQ ID NO: 1514628 - RNA, 23 nt, Homo sapiens
guagugucacucaaggcggugcu

SEQ ID NO: 1514629 - RNA, 12 nt, Homo sapiens
guauacaggugg

SEQ ID NO: 1514630 - RNA, 15 nt, Homo sapiens
guauauagaagucua

SEQ ID NO: 1514631 - RNA, 16 nt, Homo sapiens
guauaugcuauucaau

SEQ ID NO: 1514632 - RNA, 21 nt, Homo sapiens
guauccgacucuaagcugugu

SEQ ID NO: 1514633 - RNA, 15 nt, Homo sapiens
guaugggaagccaua

SEQ ID NO: 1514634 - RNA, 19 nt, Homo sapiens
guauucaugacuauggaua

SEQ ID NO: 1514635 - RNA, 18 nt, Homo sapiens
guauuccuuuuguguaca

SEQ ID NO: 1514636 - RNA, 19 nt, Homo sapiens
guauuuuagcaggguacau

SEQ ID NO: 1514637 - RNA, 14 nt, Homo sapiens
gucaacacaaagac

SEQ ID NO: 1514638 - RNA, 19 nt, Homo sapiens
gucaagaucaacauuccag

SEQ ID NO: 1514639 - RNA, 16 nt, Homo sapiens
gucaagcgugcagcuu

SEQ ID NO: 1514640 - RNA, 11 nt, Homo sapiens
gucaccaaaau

SEQ ID NO: 1514641 - RNA, 14 nt, Homo sapiens
gucaccagccugac

SEQ ID NO: 1514642 - RNA, 14 nt, Homo sapiens
gucagcacauguug

SEQ ID NO: 1514643 - RNA, 16 nt, Homo sapiens
gucagccuugcaucaa

SEQ ID NO: 1514644 - RNA, 20 nt, Homo sapiens
gucagccuugcaucaagggc

SEQ ID NO: 1514645 - RNA, 20 nt, Homo sapiens
gucauccccuugugucagag

SEQ ID NO: 1514646 - RNA, 17 nt, Homo sapiens
guccaaagaacaagaaa

SEQ ID NO: 1514647 - RNA, 16 nt, Homo sapiens
guccaaguccaaccug

SEQ ID NO: 1514648 - RNA, 20 nt, Homo sapiens
guccaggucaccagccugac

SEQ ID NO: 1514649 - RNA, 17 nt, Homo sapiens
guccccucuugacccau

SEQ ID NO: 1514650 - RNA, 12 nt, Homo sapiens
gucccucggagc

SEQ ID NO: 1514651 - RNA, 22 nt, Homo sapiens
guccuccauuucaacuccagaa

SEQ ID NO: 1514652 - RNA, 17 nt, Homo sapiens
guccuuggaaguuucau

SEQ ID NO: 1514653 - RNA, 13 nt, Homo sapiens
gucgaagcuuuga

SEQ ID NO: 1514654 - RNA, 12 nt, Homo sapiens
gucgcaucucag

SEQ ID NO: 1514655 - RNA, 13 nt, Homo sapiens
gucgguguguaau

SEQ ID NO: 1514656 - RNA, 21 nt, Homo sapiens
gucuacuugcucagguacuug

SEQ ID NO: 1514657 - RNA, 21 nt, Homo sapiens
gucuagacuuucucaguggga

SEQ ID NO: 1514658 - RNA, 22 nt, Homo sapiens
gucuaggugggagagagugcau

SEQ ID NO: 1514659 - RNA, 16 nt, Homo sapiens
gucucacagaggcagu

SEQ ID NO: 1514660 - RNA, 17 nt, Homo sapiens
gucucuccugaugcuca

SEQ ID NO: 1514661 - RNA, 16 nt, Homo sapiens
gucugagcuucaguau

SEQ ID NO: 1514662 - RNA, 22 nt, Homo sapiens
gucugagcuucaguauaaaaga

SEQ ID NO: 1514663 - RNA, 15 nt, Homo sapiens
gucugccccacccuc

SEQ ID NO: 1514664 - RNA, 15 nt, Homo sapiens
gucuggggcuuuuag

SEQ ID NO: 1514665 - RNA, 22 nt, Homo sapiens
gucuuuaacaucuugaacuggu

SEQ ID NO: 1514666 - RNA, 17 nt, Homo sapiens
gcuuaaauauugaauaa

SEQ ID NO: 1514667 - RNA, 14 nt, Homo sapiens
gcuuagccuccuga

SEQ ID NO: 1514668 - RNA, 18 nt, Homo sapiens
gcuuauauauauuugauu

SEQ ID NO: 1514669 - RNA, 18 nt, Homo sapiens
gcuucagguccaggcugu

SEQ ID NO: 1514670 - RNA, 17 nt, Homo sapiens
gcuucccagaggccagg

SEQ ID NO: 1514671 - RNA, 12 nt, Homo sapiens
gcuuccucaguu

SEQ ID NO: 1514672 - RNA, 16 nt, Homo sapiens
gcuucuggccaggaag

SEQ ID NO: 1514673 - RNA, 17 nt, Homo sapiens
gcuucugggccacucag

SEQ ID NO: 1514674 - RNA, 18 nt, Homo sapiens
gcuucugggccacucagg

SEQ ID NO: 1514675 - RNA, 18 nt, Homo sapiens
gcuugauagaaaugccaa

SEQ ID NO: 1514676 - RNA, 15 nt, Homo sapiens
gcuuggcccuauuaa

SEQ ID NO: 1514677 - RNA, 22 nt, Homo sapiens
gcuuguuguuuuuaaguccugu

SEQ ID NO: 1514678 - RNA, 19 nt, Homo sapiens
gcuuuacagaugacucacu

SEQ ID NO: 1514679 - RNA, 19 nt, Homo sapiens
gcuuuacccucaggugcua

SEQ ID NO: 1514680 - RNA, 15 nt, Homo sapiens
gcuuuaguaaugugg

SEQ ID NO: 1514681 - RNA, 22 nt, Homo sapiens
gcuuuaucaaaaaguacaauaa

SEQ ID NO: 1514682 - RNA, 16 nt, Homo sapiens
gcuuucaucacuaccu

SEQ ID NO: 1514683 - RNA, 18 nt, Homo sapiens
gcuuucaucacuaccuuu

SEQ ID NO: 1514684 - RNA, 18 nt, Homo sapiens
gcuuugcuucaaauccau

SEQ ID NO: 1514685 - RNA, 22 nt, Homo sapiens
gcuuuuggugguccccacagcc

SEQ ID NO: 1514686 - RNA, 21 nt, Homo sapiens
ggaaaaaaauucugauacauu

SEQ ID NO: 1514687 - RNA, 21 nt, Homo sapiens
ggaaaaaugcugcuucuccuc

SEQ ID NO: 1514688 - RNA, 18 nt, Homo sapiens
ggaaaagauuucugucca

SEQ ID NO: 1514689 - RNA, 17 nt, Homo sapiens
ggaaaaugugacccaga

SEQ ID NO: 1514690 - RNA, 23 nt, Homo sapiens
ggaaagaaaacuaacaaccaacc

SEQ ID NO: 1514691 - RNA, 16 nt, Homo sapiens
ggaaaguucagccaga

SEQ ID NO: 1514692 - RNA, 21 nt, Homo sapiens
ggaacacuagacaagccagaa

SEQ ID NO: 1514693 - RNA, 19 nt, Homo sapiens
ggaacguugccacaccaau

SEQ ID NO: 1514694 - RNA, 21 nt, Homo sapiens
ggaagaagcaaaccugauaca

SEQ ID NO: 1514695 - RNA, 16 nt, Homo sapiens
ggaagcacauguuuau

SEQ ID NO: 1514696 - RNA, 14 nt, Homo sapiens
ggaaggcagggaca

SEQ ID NO: 1514697 - RNA, 18 nt, Homo sapiens
ggaauaaagcccuugaac

SEQ ID NO: 1514698 - RNA, 23 nt, Homo sapiens
ggaauauauuugugugugugaua

SEQ ID NO: 1514699 - RNA, 21 nt, Homo sapiens
ggaauccgccugcagaggaca

SEQ ID NO: 1514700 - RNA, 19 nt, Homo sapiens
ggaauuuucagucaucuca

SEQ ID NO: 1514701 - RNA, 19 nt, Homo sapiens
ggacaaugccuugggagag

SEQ ID NO: 1514702 - RNA, 11 nt, Homo sapiens
ggacacagacc

SEQ ID NO: 1514703 - RNA, 12 nt, Homo sapiens
ggacacuuguau

SEQ ID NO: 1514704 - RNA, 13 nt, Homo sapiens
ggacacuuguaug

SEQ ID NO: 1514705 - RNA, 14 nt, Homo sapiens
ggaccagaggugac

SEQ ID NO: 1514706 - RNA, 19 nt, Homo sapiens
ggacgagacccuacaggag

SEQ ID NO: 1514707 - RNA, 22 nt, Homo sapiens
ggacuaggcuauaugcauuugc

SEQ ID NO: 1514708 - RNA, 16 nt, Homo sapiens
ggacuaugaaaagcua

SEQ ID NO: 1514709 - RNA, 19 nt, Homo sapiens
ggagaaugaagacuguuaa

SEQ ID NO: 1514710 - RNA, 22 nt, Homo sapiens
ggagacaauaacuccagugaug

SEQ ID NO: 1514711 - RNA, 14 nt, Homo sapiens
ggagagaaguuucu

SEQ ID NO: 1514712 - RNA, 15 nt, Homo sapiens
ggagagcccagccau

SEQ ID NO: 1514713 - RNA, 23 nt, Homo sapiens
ggagagguuugucaacacaaaga

SEQ ID NO: 1514714 - RNA, 21 nt, Homo sapiens
ggagcaguugcccucaggccu

SEQ ID NO: 1514715 - RNA, 21 nt, Homo sapiens
ggagccugaacaugacauuuc

SEQ ID NO: 1514716 - RNA, 16 nt, Homo sapiens
ggagcggagcuugccu

SEQ ID NO: 1514717 - RNA, 19 nt, Homo sapiens
ggagcuggaaauaaaccug

SEQ ID NO: 1514718 - RNA, 20 nt, Homo sapiens
ggaggcggagguugcaguga

SEQ ID NO: 1514719 - RNA, 16 nt, Homo sapiens
ggaggcggcuccaggu

SEQ ID NO: 1514720 - RNA, 21 nt, Homo sapiens
ggagggccccucaugugugcu

SEQ ID NO: 1514721 - RNA, 16 nt, Homo sapiens
ggauagagacuggaac

SEQ ID NO: 1514722 - RNA, 14 nt, Homo sapiens
ggauauggugcaaa

SEQ ID NO: 1514723 - RNA, 11 nt, Homo sapiens
ggauauguagu

SEQ ID NO: 1514724 - RNA, 16 nt, Homo sapiens
ggaucuguccaaggaa

SEQ ID NO: 1514725 - RNA, 14 nt, Homo sapiens
ggaugacugugauu

SEQ ID NO: 1514726 - RNA, 12 nt, Homo sapiens
ggaugggaccaa

SEQ ID NO: 1514727 - RNA, 15 nt, Homo sapiens
ggaugguucugugac

SEQ ID NO: 1514728 - RNA, 20 nt, Homo sapiens
ggauucaaaugucaguucau

SEQ ID NO: 1514729 - RNA, 15 nt, Homo sapiens
ggauuccagcauuug

SEQ ID NO: 1514730 - RNA, 23 nt, Homo sapiens
ggauuccccaucucaggccagag

SEQ ID NO: 1514731 - RNA, 17 nt, Homo sapiens
ggcaaaugagugacaau

SEQ ID NO: 1514732 - RNA, 21 nt, Homo sapiens
ggcaauaaguuccauguuaaa

SEQ ID NO: 1514733 - RNA, 22 nt, Homo sapiens
ggcacaaaauucuagaagcaga

SEQ ID NO: 1514734 - RNA, 15 nt, Homo sapiens
ggcagaaugaaaauu

SEQ ID NO: 1514735 - RNA, 18 nt, Homo sapiens
ggcagcaucagggacaca

SEQ ID NO: 1514736 - RNA, 15 nt, Homo sapiens
ggcaggcacuguggc

SEQ ID NO: 1514737 - RNA, 16 nt, Homo sapiens
ggcaggcucccaggga

SEQ ID NO: 1514738 - RNA, 19 nt, Homo sapiens
ggcaugccuuucuguaacc

SEQ ID NO: 1514739 - RNA, 14 nt, Homo sapiens
ggcauguugggaua

SEQ ID NO: 1514740 - RNA, 13 nt, Homo sapiens
ggcauugaaugac

SEQ ID NO: 1514741 - RNA, 11 nt, Homo sapiens
ggcauuugccu

SEQ ID NO: 1514742 - RNA, 16 nt, Homo sapiens
ggccagcugacuagau

SEQ ID NO: 1514743 - RNA, 20 nt, Homo sapiens
ggccagcugucgcaucucag

SEQ ID NO: 1514744 - RNA, 22 nt, Homo sapiens
gcaauaacguuuaagccaaaac

SEQ ID NO: 1514745 - RNA, 19 nt, Homo sapiens
gcaauuagauuaguauuuu

SEQ ID NO: 1514746 - RNA, 17 nt, Homo sapiens
gcaauucuccugccuca

SEQ ID NO: 1514747 - RNA, 17 nt, Homo sapiens
gcaauuuucgaacauuc

SEQ ID NO: 1514748 - RNA, 22 nt, Homo sapiens
gcacaacucagucugugggagc

SEQ ID NO: 1514749 - RNA, 18 nt, Homo sapiens
gcacagggaacaagcauu

SEQ ID NO: 1514750 - RNA, 21 nt, Homo sapiens
gcacauguuauccacaagcaa

SEQ ID NO: 1514751 - RNA, 15 nt, Homo sapiens
gcacccccuggagag

SEQ ID NO: 1514752 - RNA, 16 nt, Homo sapiens
gcaccccugucucuag

SEQ ID NO: 1514753 - RNA, 18 nt, Homo sapiens
gcaccgagagagauggaa

SEQ ID NO: 1514754 - RNA, 16 nt, Homo sapiens
gcacgcgccuguaauc

SEQ ID NO: 1514755 - RNA, 13 nt, Homo sapiens
gcacuagaacuuu

SEQ ID NO: 1514756 - RNA, 18 nt, Homo sapiens
gcacucacccaugugcca

SEQ ID NO: 1514757 - RNA, 17 nt, Homo sapiens
gcacucccucccagaga

SEQ ID NO: 1514758 - RNA, 15 nt, Homo sapiens
gcacugauguuguua

SEQ ID NO: 1514759 - RNA, 21 nt, Homo sapiens
gcacugcuaggcgagugccag

SEQ ID NO: 1514760 - RNA, 14 nt, Homo sapiens
gcacugcuccagug

SEQ ID NO: 1514761 - RNA, 19 nt, Homo sapiens
gcacuuuauaaaagcaaaa

SEQ ID NO: 1514762 - RNA, 22 nt, Homo sapiens
gcagaacugaacuuauuaccua

SEQ ID NO: 1514763 - RNA, 12 nt, Homo sapiens
gcagagccacca

SEQ ID NO: 1514764 - RNA, 23 nt, Homo sapiens
gcagagccaccagggcacugucu

SEQ ID NO: 1514765 - RNA, 18 nt, Homo sapiens
gcagaugcugucacuggc

SEQ ID NO: 1514766 - RNA, 22 nt, Homo sapiens
gcagcacuuuaacccucucuuc

SEQ ID NO: 1514767 - RNA, 21 nt, Homo sapiens
gcagcagugagcuucuauuaa

SEQ ID NO: 1514768 - RNA, 12 nt, Homo sapiens
gcaggaccagga

SEQ ID NO: 1514769 - RNA, 20 nt, Homo sapiens
gcaggcagccccacacccgc

SEQ ID NO: 1514770 - RNA, 21 nt, Homo sapiens
gcaggguauugcgaaacaacu

SEQ ID NO: 1514771 - RNA, 16 nt, Homo sapiens
gcagugagcugagauc

SEQ ID NO: 1514772 - RNA, 15 nt, Homo sapiens
gcagugagcuucuau

SEQ ID NO: 1514773 - RNA, 18 nt, Homo sapiens
gcagugagcuucuauuaa

SEQ ID NO: 1514774 - RNA, 19 nt, Homo sapiens
gcaguucucgcagauguua

SEQ ID NO: 1514775 - RNA, 19 nt, Homo sapiens
gcauauauacuacaugaga

SEQ ID NO: 1514776 - RNA, 18 nt, Homo sapiens
gcauaucaaaaaguauua

SEQ ID NO: 1514777 - RNA, 12 nt, Homo sapiens
gcauaugcaaua

SEQ ID NO: 1514778 - RNA, 22 nt, Homo sapiens
gcauccucuuuuuccaacuugg

SEQ ID NO: 1514779 - RNA, 23 nt, Homo sapiens
gcaugaauuccaacucacuuuuu

SEQ ID NO: 1514780 - RNA, 13 nt, Homo sapiens
gcaugacacucua

SEQ ID NO: 1514781 - RNA, 14 nt, Homo sapiens
gcaugaccugauca

SEQ ID NO: 1514782 - RNA, 17 nt, Homo sapiens
gcaugccuggucuuucc

SEQ ID NO: 1514783 - RNA, 15 nt, Homo sapiens
gcauggugcuuucag

SEQ ID NO: 1514784 - RNA, 14 nt, Homo sapiens
gcaugugugugaug

SEQ ID NO: 1514785 - RNA, 14 nt, Homo sapiens
gcauuccucaucac

SEQ ID NO: 1514786 - RNA, 14 nt, Homo sapiens
gcauugcauggaca

SEQ ID NO: 1514787 - RNA, 19 nt, Homo sapiens
gcauuuucacauuuugccu

SEQ ID NO: 1514788 - RNA, 15 nt, Homo sapiens
gcauuuucauuucac

SEQ ID NO: 1514789 - RNA, 14 nt, Homo sapiens
gccaaaaauagcua

SEQ ID NO: 1514790 - RNA, 21 nt, Homo sapiens
gccaaaacacuuaggaagaaa

SEQ ID NO: 1514791 - RNA, 13 nt, Homo sapiens
gccaaaauaccag

SEQ ID NO: 1514792 - RNA, 13 nt, Homo sapiens
gccaacugcugau

SEQ ID NO: 1514793 - RNA, 13 nt, Homo sapiens
gccaaugugacaa

SEQ ID NO: 1514794 - RNA, 14 nt, Homo sapiens
gccacaacccuguu

SEQ ID NO: 1514795 - RNA, 21 nt, Homo sapiens
gccacaccaaucagagagccu

SEQ ID NO: 1514796 - RNA, 15 nt, Homo sapiens
gccacauuugauuau

SEQ ID NO: 1514797 - RNA, 19 nt, Homo sapiens
gccagcugucgcaucucag

SEQ ID NO: 1514798 - RNA, 19 nt, Homo sapiens
gccaggcucccacugcccc

SEQ ID NO: 1514799 - RNA, 17 nt, Homo sapiens
gccaggcuguaagcauu

SEQ ID NO: 1514800 - RNA, 22 nt, Homo sapiens
gccagggaacccacagagucac

SEQ ID NO: 1514801 - RNA, 13 nt, Homo sapiens
gccaggugcagug

SEQ ID NO: 1514802 - RNA, 22 nt, Homo sapiens
gccaguacagagaaauucugug

SEQ ID NO: 1514803 - RNA, 18 nt, Homo sapiens
gccauauucacaccucac

SEQ ID NO: 1514804 - RNA, 22 nt, Homo sapiens
gccaucagggugggccacucuc

SEQ ID NO: 1514805 - RNA, 10 nt, Homo sapiens
gccaugccuc

SEQ ID NO: 1514806 - RNA, 13 nt, Homo sapiens
gccauuccuggaa

SEQ ID NO: 1514807 - RNA, 17 nt, Homo sapiens
gcccagcaggcaggcac

SEQ ID NO: 1514808 - RNA, 20 nt, Homo sapiens
gcccagccaacugccccggg

SEQ ID NO: 1514809 - RNA, 20 nt, Homo sapiens
gcccagccauuaccauggag

SEQ ID NO: 1514810 - RNA, 15 nt, Homo sapiens
gcccagcugcaccug

SEQ ID NO: 1514811 - RNA, 17 nt, Homo sapiens
gcccaggcuggucuuga

SEQ ID NO: 1514812 - RNA, 20 nt, Homo sapiens
gcccaggggcccacagggaa

SEQ ID NO: 1514813 - RNA, 19 nt, Homo sapiens
gcccaggucaacaucuaag

SEQ ID NO: 1514814 - RNA, 17 nt, Homo sapiens
gcccagucgauaucuca

SEQ ID NO: 1514815 - RNA, 16 nt, Homo sapiens
gcccaguguccccuuu

SEQ ID NO: 1514816 - RNA, 21 nt, Homo sapiens
gcccauuggcucccaucugaa

SEQ ID NO: 1514817 - RNA, 21 nt, Homo sapiens
gcccccagcagauggaaagaa

SEQ ID NO: 1514818 - RNA, 23 nt, Homo sapiens
gcccuccuuaauagccauaugca

SEQ ID NO: 1514819 - RNA, 13 nt, Homo sapiens
gcccugaacaaaa

SEQ ID NO: 1514820 - RNA, 19 nt, Homo sapiens
gcccugcaagacacaggcu

SEQ ID NO: 1514821 - RNA, 18 nt, Homo sapiens
gcccugcgaaguggcucu

SEQ ID NO: 1514822 - RNA, 16 nt, Homo sapiens
gcccuucccugacacu

SEQ ID NO: 1514823 - RNA, 19 nt, Homo sapiens
gccuaacaugauuauuuga

SEQ ID NO: 1514824 - RNA, 17 nt, Homo sapiens
gccuaauucuuguuguu

SEQ ID NO: 1514825 - RNA, 15 nt, Homo sapiens
gccuagacuguuacu

SEQ ID NO: 1514826 - RNA, 12 nt, Homo sapiens
gccucaagaaca

SEQ ID NO: 1514827 - RNA, 16 nt, Homo sapiens
augaguuggacuucag

SEQ ID NO: 1514828 - RNA, 15 nt, Homo sapiens
augauagugugauuu

SEQ ID NO: 1514829 - RNA, 14 nt, Homo sapiens
augaugaaacauuc

SEQ ID NO: 1514830 - RNA, 17 nt, Homo sapiens
augauggugcugaccuc

SEQ ID NO: 1514831 - RNA, 22 nt, Homo sapiens
augauucagaaauuuucauuca

SEQ ID NO: 1514832 - RNA, 21 nt, Homo sapiens
augauuccuugagcauuuuau

SEQ ID NO: 1514833 - RNA, 14 nt, Homo sapiens
augcagaagugcau

SEQ ID NO: 1514834 - RNA, 19 nt, Homo sapiens
augcagaggggugcugcuc

SEQ ID NO: 1514835 - RNA, 16 nt, Homo sapiens
augcaguggcucaugc

SEQ ID NO: 1514836 - RNA, 17 nt, Homo sapiens
augccacccuguuuuca

SEQ ID NO: 1514837 - RNA, 16 nt, Homo sapiens
augccauucuccaguu

SEQ ID NO: 1514838 - RNA, 18 nt, Homo sapiens
augcccucauaaaccaau

SEQ ID NO: 1514839 - RNA, 10 nt, Homo sapiens
augcccuccc

SEQ ID NO: 1514840 - RNA, 21 nt, Homo sapiens
augccugacuagggagccaug

SEQ ID NO: 1514841 - RNA, 17 nt, Homo sapiens
augcuaagggcagcccu

SEQ ID NO: 1514842 - RNA, 13 nt, Homo sapiens
augcuaucucaaa

SEQ ID NO: 1514843 - RNA, 20 nt, Homo sapiens
augcuggacggcauuccugc

SEQ ID NO: 1514844 - RNA, 21 nt, Homo sapiens
augcuuuccuuuucuuccuuc

SEQ ID NO: 1514845 - RNA, 22 nt, Homo sapiens
auggaagauuagagguuuguca

SEQ ID NO: 1514846 - RNA, 23 nt, Homo sapiens
auggaagauuagagguuugucaa

SEQ ID NO: 1514847 - RNA, 22 nt, Homo sapiens
auggaagguuagagguuuguca

SEQ ID NO: 1514848 - RNA, 23 nt, Homo sapiens
auggaagguuagagguuugucaa

SEQ ID NO: 1514849 - RNA, 17 nt, Homo sapiens
auggaagguuagguuug

SEQ ID NO: 1514850 - RNA, 20 nt, Homo sapiens
auggaagguuagguuuguca

SEQ ID NO: 1514851 - RNA, 22 nt, Homo sapiens
auggacucuucccccacuccuc

SEQ ID NO: 1514852 - RNA, 14 nt, Homo sapiens
auggagagguuugu

SEQ ID NO: 1514853 - RNA, 19 nt, Homo sapiens
auggcagaaugaaaauuag

SEQ ID NO: 1514854 - RNA, 14 nt, Homo sapiens
auggcauugaacug

SEQ ID NO: 1514855 - RNA, 20 nt, Homo sapiens
auggccagugugaucccaag

SEQ ID NO: 1514856 - RNA, 23 nt, Homo sapiens
auggcucuucaccugggcgccaa

SEQ ID NO: 1514857 - RNA, 18 nt, Homo sapiens
auggcuuuuagcauuuau

SEQ ID NO: 1514858 - RNA, 15 nt, Homo sapiens
augggccugccaaac

SEQ ID NO: 1514859 - RNA, 21 nt, Homo sapiens
augguaaaaugagugaucuca

SEQ ID NO: 1514860 - RNA, 16 nt, Homo sapiens
augguccuuucuggaa

SEQ ID NO: 1514861 - RNA, 23 nt, Homo sapiens
auggugcaaaaaugaguuuucac

SEQ ID NO: 1514862 - RNA, 19 nt, Homo sapiens
auggugguaaacauucucu

SEQ ID NO: 1514863 - RNA, 23 nt, Homo sapiens
augguguugauacgugugugaag

SEQ ID NO: 1514864 - RNA, 17 nt, Homo sapiens
auguaacuuuuuaauca

SEQ ID NO: 1514865 - RNA, 16 nt, Homo sapiens
auguaaucucaccuca

SEQ ID NO: 1514866 - RNA, 18 nt, Homo sapiens
auguaguacuaacuaagg

SEQ ID NO: 1514867 - RNA, 14 nt, Homo sapiens
augucagacuggcu

SEQ ID NO: 1514868 - RNA, 14 nt, Homo sapiens
augucagagccagg

SEQ ID NO: 1514869 - RNA, 23 nt, Homo sapiens
augucaucaaauauuaccaaaaa

SEQ ID NO: 1514870 - RNA, 20 nt, Homo sapiens
augucauuuugguacuuugg

SEQ ID NO: 1514871 - RNA, 22 nt, Homo sapiens
auguccuucuuuaucugugaua

SEQ ID NO: 1514872 - RNA, 17 nt, Homo sapiens
augucugccacagagag

SEQ ID NO: 1514873 - RNA, 16 nt, Homo sapiens
augugaaagaguucug

SEQ ID NO: 1514874 - RNA, 15 nt, Homo sapiens
augugacaacaugug

SEQ ID NO: 1514875 - RNA, 18 nt, Homo sapiens
augugagauuacuuuguc

SEQ ID NO: 1514876 - RNA, 16 nt, Homo sapiens
auguuaaaaagugaaa

SEQ ID NO: 1514877 - RNA, 17 nt, Homo sapiens
auguuauccacaagcaa

SEQ ID NO: 1514878 - RNA, 22 nt, Homo sapiens
auguuauccacaagcaauggac

SEQ ID NO: 1514879 - RNA, 13 nt, Homo sapiens
auguuguguuguu

SEQ ID NO: 1514880 - RNA, 20 nt, Homo sapiens
auguuucacauaaaaccuca

SEQ ID NO: 1514881 - RNA, 18 nt, Homo sapiens
auuaaaagugacauuugu

SEQ ID NO: 1514882 - RNA, 17 nt, Homo sapiens
auuaaaauuccuaaugg

SEQ ID NO: 1514883 - RNA, 18 nt, Homo sapiens
auuaaacagacuuuagcu

SEQ ID NO: 1514884 - RNA, 13 nt, Homo sapiens
auuaaacagccaa

SEQ ID NO: 1514885 - RNA, 15 nt, Homo sapiens
auuaaacagccaaau

SEQ ID NO: 1514886 - RNA, 15 nt, Homo sapiens
auuacauccagaaag

SEQ ID NO: 1514887 - RNA, 16 nt, Homo sapiens
auuacauggcuguggu

SEQ ID NO: 1514888 - RNA, 17 nt, Homo sapiens
auuacauggcugugguu

SEQ ID NO: 1514889 - RNA, 17 nt, Homo sapiens
auuaccagcauuuacua

SEQ ID NO: 1514890 - RNA, 14 nt, Homo sapiens
auuagaaugcaugu

SEQ ID NO: 1514891 - RNA, 17 nt, Homo sapiens
auuagaaugcauguaag

SEQ ID NO: 1514892 - RNA, 14 nt, Homo sapiens
auuagcaaagcaaa

SEQ ID NO: 1514893 - RNA, 11 nt, Homo sapiens
auuagccaaaa

SEQ ID NO: 1514894 - RNA, 14 nt, Homo sapiens
auuaggcaugccua

SEQ ID NO: 1514895 - RNA, 23 nt, Homo sapiens
auuauaaaaauaauauaugcuca

SEQ ID NO: 1514896 - RNA, 20 nt, Homo sapiens
auuauaaacaaucaggaaga

SEQ ID NO: 1514897 - RNA, 17 nt, Homo sapiens
auucaaaugucaguuca

SEQ ID NO: 1514898 - RNA, 21 nt, Homo sapiens
auucaauaaagcugcugagaa

SEQ ID NO: 1514899 - RNA, 21 nt, Homo sapiens
auucacagcccagaaccacag

SEQ ID NO: 1514900 - RNA, 19 nt, Homo sapiens
auucaucccuuuucaaaag

SEQ ID NO: 1514901 - RNA, 15 nt, Homo sapiens
auucaugacuaugga

SEQ ID NO: 1514902 - RNA, 19 nt, Homo sapiens
auuccaaggaguuccauga

SEQ ID NO: 1514903 - RNA, 22 nt, Homo sapiens
auuccccucgugugacucucuu

SEQ ID NO: 1514904 - RNA, 13 nt, Homo sapiens
auuccgucuuaaa

SEQ ID NO: 1514905 - RNA, 14 nt, Homo sapiens
auuccucaucacca

SEQ ID NO: 1514906 - RNA, 13 nt, Homo sapiens
auucgccuguggg

SEQ ID NO: 1514907 - RNA, 13 nt, Homo sapiens
auucucaccagga

SEQ ID NO: 1514908 - RNA, 17 nt, Homo sapiens
auucucagugcucuccu

SEQ ID NO: 1514909 - RNA, 21 nt, Homo sapiens
auucucaucuacucauugucu

SEQ ID NO: 1514910 - RNA, 21 nt, Homo sapiens
auucugaaaauaccagugugu

SEQ ID NO: 1514911 - RNA, 19 nt, Homo sapiens
auucuggucuucacugcca

SEQ ID NO: 1514912 - RNA, 17 nt, Homo sapiens
auucuucaucagcauuu

SEQ ID NO: 1514913 - RNA, 14 nt, Homo sapiens
auugaaaauaugau

SEQ ID NO: 1514914 - RNA, 12 nt, Homo sapiens
auugaauacaca

SEQ ID NO: 1514915 - RNA, 20 nt, Homo sapiens
auugaauuugccuuccucau

SEQ ID NO: 1514916 - RNA, 14 nt, Homo sapiens
auugacaguggugg

SEQ ID NO: 1514917 - RNA, 14 nt, Homo sapiens
auugacuucucuug

SEQ ID NO: 1514918 - RNA, 23 nt, Homo sapiens
auugagaaguuuuguacagagaa

SEQ ID NO: 1514919 - RNA, 11 nt, Homo sapiens
auugcacucag

SEQ ID NO: 1514920 - RNA, 14 nt, Homo sapiens
auugccauucugau

SEQ ID NO: 1514921 - RNA, 18 nt, Homo sapiens
auugccuuccucgugcag

SEQ ID NO: 1514922 - RNA, 15 nt, Homo sapiens
auugcuuugccaaaa

SEQ ID NO: 1514923 - RNA, 23 nt, Homo sapiens
auugcuuugccaaaauaccagag

SEQ ID NO: 1514924 - RNA, 19 nt, Homo sapiens
auuggccucaguguaguua

SEQ ID NO: 1514925 - RNA, 15 nt, Homo sapiens
auugguuucuaggca

SEQ ID NO: 1514926 - RNA, 16 nt, Homo sapiens
auuguacuaaagccaa

SEQ ID NO: 1514927 - RNA, 17 nt, Homo sapiens
auugucaaagcuugccg

SEQ ID NO: 1514928 - RNA, 14 nt, Homo sapiens
auuguuaccaugaa

SEQ ID NO: 1514929 - RNA, 22 nt, Homo sapiens
auuguuagagaguauaacuuaa

SEQ ID NO: 1514930 - RNA, 16 nt, Homo sapiens
auuguucaucaugaca

SEQ ID NO: 1514931 - RNA, 19 nt, Homo sapiens
auuuaauggcaaugcaaaa

SEQ ID NO: 1514932 - RNA, 19 nt, Homo sapiens
auuuacuuaacagaacagu

SEQ ID NO: 1514933 - RNA, 20 nt, Homo sapiens
auuuacuuaauggguacaau

SEQ ID NO: 1514934 - RNA, 18 nt, Homo sapiens
auuuagaacuguauguca

SEQ ID NO: 1514935 - RNA, 19 nt, Homo sapiens
auuuaggcaagagaaaaua

SEQ ID NO: 1514936 - RNA, 21 nt, Homo sapiens
auuuauacuuugcaauccaaa

SEQ ID NO: 1514937 - RNA, 12 nt, Homo sapiens
auuuauauucaa

SEQ ID NO: 1514938 - RNA, 23 nt, Homo sapiens
auuuauugucggaagacuugcca

SEQ ID NO: 1514939 - RNA, 15 nt, Homo sapiens
auuucaacauaucau

SEQ ID NO: 1514940 - RNA, 15 nt, Homo sapiens
auuucacucagggug

SEQ ID NO: 1514941 - RNA, 15 nt, Homo sapiens
auuuccauaacucau

SEQ ID NO: 1514942 - RNA, 16 nt, Homo sapiens
auuucccugugcugac

SEQ ID NO: 1514943 - RNA, 16 nt, Homo sapiens
auuucuauagccaaaa

SEQ ID NO: 1514944 - RNA, 14 nt, Homo sapiens
auuucuccuuggau

SEQ ID NO: 1514945 - RNA, 16 nt, Homo sapiens
auuucugaacuguuac

SEQ ID NO: 1514946 - RNA, 17 nt, Homo sapiens
auuucugaacuguuaca

SEQ ID NO: 1514947 - RNA, 22 nt, Homo sapiens
auuucugauuucacucagggug

SEQ ID NO: 1514948 - RNA, 16 nt, Homo sapiens
auuucugugaagcaaa

SEQ ID NO: 1514949 - RNA, 20 nt, Homo sapiens
auuugaaaacauaaucugca

SEQ ID NO: 1514950 - RNA, 21 nt, Homo sapiens
auuugauaaacuaaaagcaua

SEQ ID NO: 1514951 - RNA, 15 nt, Homo sapiens
auuugauuuugccca

SEQ ID NO: 1514952 - RNA, 12 nt, Homo sapiens
auuuggacaaaa

SEQ ID NO: 1514953 - RNA, 14 nt, Homo sapiens
aaagguugacucau

SEQ ID NO: 1514954 - RNA, 17 nt, Homo sapiens
aaagguuuacagaauuu

SEQ ID NO: 1514955 - RNA, 16 nt, Homo sapiens
aaaguaaugcuucaau

SEQ ID NO: 1514956 - RNA, 14 nt, Homo sapiens
aaaguuuucuccca

SEQ ID NO: 1514957 - RNA, 20 nt, Homo sapiens
aaauaauugccaaauaccua

SEQ ID NO: 1514958 - RNA, 22 nt, Homo sapiens
aaauacauucuccuuuuugccc

SEQ ID NO: 1514959 - RNA, 16 nt, Homo sapiens
aaauaccucauucgcc

SEQ ID NO: 1514960 - RNA, 18 nt, Homo sapiens
aaauagagugcauuugaa

SEQ ID NO: 1514961 - RNA, 14 nt, Homo sapiens
aaauagcaaaagaa

SEQ ID NO: 1514962 - RNA, 17 nt, Homo sapiens
aaauagcaaaagaagaa

SEQ ID NO: 1514963 - RNA, 16 nt, Homo sapiens
aaauaguauaugcauu

SEQ ID NO: 1514964 - RNA, 19 nt, Homo sapiens
aaauaugugaaaaugauua

SEQ ID NO: 1514965 - RNA, 13 nt, Homo sapiens
aaauauuaugaga

SEQ ID NO: 1514966 - RNA, 19 nt, Homo sapiens
aaaucacaaggcaacugug

SEQ ID NO: 1514967 - RNA, 16 nt, Homo sapiens
aaaucugguuagauaa

SEQ ID NO: 1514968 - RNA, 23 nt, Homo sapiens
aaaucuuugauucagacagcuua

SEQ ID NO: 1514969 - RNA, 14 nt, Homo sapiens
aaaugaauguuguc

SEQ ID NO: 1514970 - RNA, 18 nt, Homo sapiens
aaaugcagucuuaccaau

SEQ ID NO: 1514971 - RNA, 20 nt, Homo sapiens
aaaugcagucuuaccaauga

SEQ ID NO: 1514972 - RNA, 15 nt, Homo sapiens
aaaugcugcuucucc

SEQ ID NO: 1514973 - RNA, 21 nt, Homo sapiens
aaauggagggagccaucccuu

SEQ ID NO: 1514974 - RNA, 14 nt, Homo sapiens
aaauggaguauuuu

SEQ ID NO: 1514975 - RNA, 15 nt, Homo sapiens
aaauucuuuuucaca

SEQ ID NO: 1514976 - RNA, 20 nt, Homo sapiens
aaauuggaauuuucuuaccc

SEQ ID NO: 1514977 - RNA, 20 nt, Homo sapiens
aaauugggagauaauuauca

SEQ ID NO: 1514978 - RNA, 22 nt, Homo sapiens
aacaaaugcuggggucauauaa

SEQ ID NO: 1514979 - RNA, 18 nt, Homo sapiens
aacaacaauaacaacaau

SEQ ID NO: 1514980 - RNA, 21 nt, Homo sapiens
aacaaguauuuguuaauuuag

SEQ ID NO: 1514981 - RNA, 17 nt, Homo sapiens
aacacaaagacauggaa

SEQ ID NO: 1514982 - RNA, 19 nt, Homo sapiens
aacacgugacacaaacaca

SEQ ID NO: 1514983 - RNA, 16 nt, Homo sapiens
aacacuagacaagcca

SEQ ID NO: 1514984 - RNA, 16 nt, Homo sapiens
aacacuauccaaugaa

SEQ ID NO: 1514985 - RNA, 22 nt, Homo sapiens
aacacuauccaaugaaugauca

SEQ ID NO: 1514986 - RNA, 17 nt, Homo sapiens
aacacucuucuugagca

SEQ ID NO: 1514987 - RNA, 22 nt, Homo sapiens
aacagauaaaguuuuuauuuuc

SEQ ID NO: 1514988 - RNA, 15 nt, Homo sapiens
aacagccaaaugcau

SEQ ID NO: 1514989 - RNA, 18 nt, Homo sapiens
aacagccccaaagucaau

SEQ ID NO: 1514990 - RNA, 19 nt, Homo sapiens
aacaguuuagcccaucucu

SEQ ID NO: 1514991 - RNA, 19 nt, Homo sapiens
aacauaaaacaaugaagga

SEQ ID NO: 1514992 - RNA, 12 nt, Homo sapiens
aacauaucuuua

SEQ ID NO: 1514993 - RNA, 22 nt, Homo sapiens
aacaugguaaaaccccaucucu

SEQ ID NO: 1514994 - RNA, 21 nt, Homo sapiens
aacauuuauuucaaacuauug

SEQ ID NO: 1514995 - RNA, 15 nt, Homo sapiens
aaccaaauaggcuuu

SEQ ID NO: 1514996 - RNA, 14 nt, Homo sapiens
aaccaagucuacuu

SEQ ID NO: 1514997 - RNA, 19 nt, Homo sapiens
aaccaagucuacuucacua

SEQ ID NO: 1514998 - RNA, 15 nt, Homo sapiens
aaccacaaaccaccc

SEQ ID NO: 1514999 - RNA, 14 nt, Homo sapiens
aaccacagaugugu

SEQ ID NO: 1515000 - RNA, 17 nt, Homo sapiens
aaccauaaacuguacaa

SEQ ID NO: 1515001 - RNA, 12 nt, Homo sapiens
aaccauaguuau

SEQ ID NO: 1515002 - RNA, 21 nt, Homo sapiens
aaccauaguuauuuacuugaa

SEQ ID NO: 1515003 - RNA, 15 nt, Homo sapiens
aacccucucuucccu

SEQ ID NO: 1515004 - RNA, 21 nt, Homo sapiens
aaccucaucuacaagcauuug

SEQ ID NO: 1515005 - RNA, 19 nt, Homo sapiens
aaccucuucagcugggaag

SEQ ID NO: 1515006 - RNA, 14 nt, Homo sapiens
aaccuggagaugau

SEQ ID NO: 1515007 - RNA, 18 nt, Homo sapiens
aaccuggaguauaauauu

SEQ ID NO: 1515008 - RNA, 17 nt, Homo sapiens
aaccuggcuuauuccca

SEQ ID NO: 1515009 - RNA, 16 nt, Homo sapiens
aaccuuucaaauuuca

SEQ ID NO: 1515010 - RNA, 18 nt, Homo sapiens
aaccuuuucaugccuuua

SEQ ID NO: 1515011 - RNA, 12 nt, Homo sapiens
aacgaaauuucc

SEQ ID NO: 1515012 - RNA, 23 nt, Homo sapiens
aacgacaaagccaaacucugcca

SEQ ID NO: 1515013 - RNA, 22 nt, Homo sapiens
aacguggguauuuccugcuaca

SEQ ID NO: 1515014 - RNA, 18 nt, Homo sapiens
aacuaaaguuuacagucu

SEQ ID NO: 1515015 - RNA, 20 nt, Homo sapiens
aacuaaugucagcacauguu

SEQ ID NO: 1515016 - RNA, 19 nt, Homo sapiens
aacuacccccagcugugcu

SEQ ID NO: 1515017 - RNA, 13 nt, Homo sapiens
aacuaugugaugu

SEQ ID NO: 1515018 - RNA, 18 nt, Homo sapiens
aacucauuacuuuuccau

SEQ ID NO: 1515019 - RNA, 22 nt, Homo sapiens
aacucugucaggcauugaauga

SEQ ID NO: 1515020 - RNA, 23 nt, Homo sapiens
aacugaaucaagaaaugaaugcu

SEQ ID NO: 1515021 - RNA, 13 nt, Homo sapiens
aacugagagcaga

SEQ ID NO: 1515022 - RNA, 16 nt, Homo sapiens
aacuggaagaaagcaa

SEQ ID NO: 1515023 - RNA, 23 nt, Homo sapiens
aacuguacaguuucuuccccaag

SEQ ID NO: 1515024 - RNA, 14 nt, Homo sapiens
aacuguuguuuacu

SEQ ID NO: 1515025 - RNA, 23 nt, Homo sapiens
aacuugaggacacauguccagug

SEQ ID NO: 1515026 - RNA, 20 nt, Homo sapiens
aacuugcacgacgccugcca

SEQ ID NO: 1515027 - RNA, 19 nt, Homo sapiens
aacuuggucuuacaucugu

SEQ ID NO: 1515028 - RNA, 21 nt, Homo sapiens
aacuuucucacugcugucagc

SEQ ID NO: 1515029 - RNA, 16 nt, Homo sapiens
aagaaaaacauuuccu

SEQ ID NO: 1515030 - RNA, 22 nt, Homo sapiens
aagaaaacuaacaaccaaccaa

SEQ ID NO: 1515031 - RNA, 13 nt, Homo sapiens
aagaaaagcaauc

SEQ ID NO: 1515032 - RNA, 18 nt, Homo sapiens
aagaaauccaguuuccca

SEQ ID NO: 1515033 - RNA, 18 nt, Homo sapiens
aagaacugccccaucucc

SEQ ID NO: 1515034 - RNA, 15 nt, Homo sapiens
aagaagaauauguau

SEQ ID NO: 1515035 - RNA, 14 nt, Homo sapiens
aagaagaaucucau

SEQ ID NO: 1515036 - RNA, 17 nt, Homo sapiens
aagaaggacacuuguau

SEQ ID NO: 1515037 - RNA, 15 nt, Homo sapiens
aagaaggccacuggu

SEQ ID NO: 1515038 - RNA, 15 nt, Homo sapiens
aagaauacuucucau

SEQ ID NO: 1515039 - RNA, 19 nt, Homo sapiens
aagaauguuguuagcuuuu

SEQ ID NO: 1515040 - RNA, 13 nt, Homo sapiens
aagacaaaugggc

SEQ ID NO: 1515041 - RNA, 21 nt, Homo sapiens
aagacaaaugggccugccaaa

SEQ ID NO: 1515042 - RNA, 22 nt, Homo sapiens
aagacaaaugggccugccaaac

SEQ ID NO: 1515043 - RNA, 16 nt, Homo sapiens
aagacaucacaucccu

SEQ ID NO: 1515044 - RNA, 18 nt, Homo sapiens
aagacucuggagccaagg

SEQ ID NO: 1515045 - RNA, 23 nt, Homo sapiens
aagacuguuaaaugaaaccagaa

SEQ ID NO: 1515046 - RNA, 18 nt, Homo sapiens
aagacuugauacugcaau

SEQ ID NO: 1515047 - RNA, 18 nt, Homo sapiens
aagacuugccacuuuuca

SEQ ID NO: 1515048 - RNA, 22 nt, Homo sapiens
aagagaucccaaguagaaucuc

SEQ ID NO: 1515049 - RNA, 22 nt, Homo sapiens
aagagcuggcaaagguggcucu

SEQ ID NO: 1515050 - RNA, 23 nt, Homo sapiens
aagaggcccugucuguaccuaac

SEQ ID NO: 1515051 - RNA, 21 nt, Homo sapiens
aagauaaauagaguuccaaau

SEQ ID NO: 1515052 - RNA, 19 nt, Homo sapiens
aagauaacaagaucuuuca

SEQ ID NO: 1515053 - RNA, 15 nt, Homo sapiens
aagauaacugagaau

SEQ ID NO: 1515054 - RNA, 14 nt, Homo sapiens
aagaucccuauuau

SEQ ID NO: 1515055 - RNA, 23 nt, Homo sapiens
aagauuaaauaugaucacuucau

SEQ ID NO: 1515056 - RNA, 18 nt, Homo sapiens
aagauuagagguuuguca

SEQ ID NO: 1515057 - RNA, 16 nt, Homo sapiens
aagauugagaagccau

SEQ ID NO: 1515058 - RNA, 20 nt, Homo sapiens
aagauuuugccacauuugau

SEQ ID NO: 1515059 - RNA, 17 nt, Homo sapiens
aagcaaaggaaaccaaa

SEQ ID NO: 1515060 - RNA, 20 nt, Homo sapiens
aagcaacauaaaacaaugaa

SEQ ID NO: 1515061 - RNA, 13 nt, Homo sapiens
aagcaaggccaaa

SEQ ID NO: 1515062 - RNA, 17 nt, Homo sapiens
aagcacauaugugccaa

SEQ ID NO: 1515063 - RNA, 14 nt, Homo sapiens
aagcacuacugcac

SEQ ID NO: 1515064 - RNA, 23 nt, Homo sapiens
aagcaggggucguaccuugcuuu

SEQ ID NO: 1515065 - RNA, 17 nt, Homo sapiens
aagcaucaguagcugag

SEQ ID NO: 1515066 - RNA, 13 nt, Homo sapiens
aagccacaggagc

SEQ ID NO: 1515067 - RNA, 15 nt, Homo sapiens
aagccacucuuccaa

SEQ ID NO: 1515068 - RNA, 16 nt, Homo sapiens
aagccauuauucacua

SEQ ID NO: 1515069 - RNA, 12 nt, Homo sapiens
aagcccuugaac

SEQ ID NO: 1515070 - RNA, 18 nt, Homo sapiens
aagccgugccuuucucug

SEQ ID NO: 1515071 - RNA, 15 nt, Homo sapiens
aagccuaccaaugua

SEQ ID NO: 1515072 - RNA, 21 nt, Homo sapiens
aagccucaggagagagucuaa

SEQ ID NO: 1515073 - RNA, 22 nt, Homo sapiens
aagccucuggaaaacucaggau

SEQ ID NO: 1515074 - RNA, 12 nt, Homo sapiens
aagccugagaac

SEQ ID NO: 1515075 - RNA, 13 nt, Homo sapiens
aagccugaggcug

SEQ ID NO: 1515076 - RNA, 15 nt, Homo sapiens
aagccuguugcugaa

SEQ ID NO: 1515077 - RNA, 18 nt, Homo sapiens
aagccuuuugcucacaaa

SEQ ID NO: 1515078 - RNA, 17 nt, Homo sapiens
aagcgaauguguacaaa

SEQ ID NO: 1515079 - RNA, 18 nt, Homo sapiens
aagcggagguugcaggga

SEQ ID NO: 1515080 - RNA, 11 nt, Homo sapiens
aagcucucuuu

SEQ ID NO: 1515081 - RNA, 20 nt, Homo sapiens
aagcuggaugcaguggcuca

SEQ ID NO: 1515082 - RNA, 16 nt, Homo sapiens
aaggaaaaaugcugcu

SEQ ID NO: 1515083 - RNA, 20 nt, Homo sapiens
aaggaaaaaugcugcuucuc

SEQ ID NO: 1515084 - RNA, 16 nt, Homo sapiens
aaggaaacucgaauaa

SEQ ID NO: 1515085 - RNA, 17 nt, Homo sapiens
ucucauagguugccaau

SEQ ID NO: 1515086 - RNA, 15 nt, Homo sapiens
ucucaucacuaccuu

SEQ ID NO: 1515087 - RNA, 21 nt, Homo sapiens
ucucaucacuaccuuuauagc

SEQ ID NO: 1515088 - RNA, 22 nt, Homo sapiens
ucuccaccaacuggagcacuga

SEQ ID NO: 1515089 - RNA, 17 nt, Homo sapiens
ucuccagacccaccaca

SEQ ID NO: 1515090 - RNA, 17 nt, Homo sapiens
ucucccccugggcucug

SEQ ID NO: 1515091 - RNA, 13 nt, Homo sapiens
ucuccuacuuuac

SEQ ID NO: 1515092 - RNA, 21 nt, Homo sapiens
ucuccugucagagaucuggga

SEQ ID NO: 1515093 - RNA, 13 nt, Homo sapiens
ucuccuuugaggg

SEQ ID NO: 1515094 - RNA, 16 nt, Homo sapiens
ucucgcagauguuacc

SEQ ID NO: 1515095 - RNA, 19 nt, Homo sapiens
ucucgcaguacauguuacu

SEQ ID NO: 1515096 - RNA, 18 nt, Homo sapiens
ucucgucuccugacaugu

SEQ ID NO: 1515097 - RNA, 19 nt, Homo sapiens
ucucuaacuccugccauuc

SEQ ID NO: 1515098 - RNA, 15 nt, Homo sapiens
ucucuagccacuuug

SEQ ID NO: 1515099 - RNA, 14 nt, Homo sapiens
ucucuagguccauu

SEQ ID NO: 1515100 - RNA, 12 nt, Homo sapiens
ucucucaggguu

SEQ ID NO: 1515101 - RNA, 21 nt, Homo sapiens
ucucugauguaguuaaguauu

SEQ ID NO: 1515102 - RNA, 21 nt, Homo sapiens
ucucuugccagcauuuucaca

SEQ ID NO: 1515103 - RNA, 23 nt, Homo sapiens
ucucuugcugggaacacagccag

SEQ ID NO: 1515104 - RNA, 19 nt, Homo sapiens
ucucuuuuuaccuuuaaca

SEQ ID NO: 1515105 - RNA, 20 nt, Homo sapiens
ucugaagacuaucuuugaag

SEQ ID NO: 1515106 - RNA, 21 nt, Homo sapiens
aaggcaggagaaucgcuuaaa

SEQ ID NO: 1515107 - RNA, 18 nt, Homo sapiens
aaggcauuccucaucacc

SEQ ID NO: 1515108 - RNA, 16 nt, Homo sapiens
aaggccuccugugacu

SEQ ID NO: 1515109 - RNA, 16 nt, Homo sapiens
aagguaaaaugccaug

SEQ ID NO: 1515110 - RNA, 15 nt, Homo sapiens
aagguaaacaguuug

SEQ ID NO: 1515111 - RNA, 22 nt, Homo sapiens
aaggucacacaguauuaaguga

SEQ ID NO: 1515112 - RNA, 17 nt, Homo sapiens
aaggucccuuguuucca

SEQ ID NO: 1515113 - RNA, 16 nt, Homo sapiens
aaggucugcuuuucau

SEQ ID NO: 1515114 - RNA, 22 nt, Homo sapiens
aagguuagguuugucaacacaa

SEQ ID NO: 1515115 - RNA, 18 nt, Homo sapiens
aagguucccucugagaau

SEQ ID NO: 1515116 - RNA, 16 nt, Homo sapiens
aaguaaaugagccuuu

SEQ ID NO: 1515117 - RNA, 19 nt, Homo sapiens
aaguaacugugguuuacua

SEQ ID NO: 1515118 - RNA, 17 nt, Homo sapiens
aaguaagaacacugaga

SEQ ID NO: 1515119 - RNA, 15 nt, Homo sapiens
aaguaaguaccacuc

SEQ ID NO: 1515120 - RNA, 19 nt, Homo sapiens
aaguaccccugauaagcaa

SEQ ID NO: 1515121 - RNA, 13 nt, Homo sapiens
aaguacuacauca

SEQ ID NO: 1515122 - RNA, 15 nt, Homo sapiens
aaguaguucuaugaa

SEQ ID NO: 1515123 - RNA, 18 nt, Homo sapiens
aaguaucuaacucuucug

SEQ ID NO: 1515124 - RNA, 22 nt, Homo sapiens
aagugcugggauuacaggugua

SEQ ID NO: 1515125 - RNA, 23 nt, Homo sapiens
aagugggggguggacacagaagu

SEQ ID NO: 1515126 - RNA, 15 nt, Homo sapiens
aaguguagcacccug

SEQ ID NO: 1515127 - RNA, 21 nt, Homo sapiens
aaguguuuuaauuucuacaca

SEQ ID NO: 1515128 - RNA, 21 nt, Homo sapiens
aaguuagggaugacugugauu

SEQ ID NO: 1515129 - RNA, 22 nt, Homo sapiens
aaguucacuggagucuuguaca

SEQ ID NO: 1515130 - RNA, 14 nt, Homo sapiens
aaguucacuucccc

SEQ ID NO: 1515131 - RNA, 19 nt, Homo sapiens
aaguucugguaugaacuug

SEQ ID NO: 1515132 - RNA, 16 nt, Homo sapiens
aaguuuaaaaaaccau

SEQ ID NO: 1515133 - RNA, 19 nt, Homo sapiens
aaguuucuggugccauuuc

SEQ ID NO: 1515134 - RNA, 16 nt, Homo sapiens
aauaaaaguuuacaga

SEQ ID NO: 1515135 - RNA, 18 nt, Homo sapiens
aauaaacauuuggcauag

SEQ ID NO: 1515136 - RNA, 21 nt, Homo sapiens
aauaaaccaagauagauccau

SEQ ID NO: 1515137 - RNA, 12 nt, Homo sapiens
aauaacuaucaa

SEQ ID NO: 1515138 - RNA, 15 nt, Homo sapiens
aauaagcccaacaga

SEQ ID NO: 1515139 - RNA, 15 nt, Homo sapiens
aauaagguacaagaa

SEQ ID NO: 1515140 - RNA, 22 nt, Homo sapiens
aauaaugaaguuauucuugaca

SEQ ID NO: 1515141 - RNA, 15 nt, Homo sapiens
aauaauguauacaca

SEQ ID NO: 1515142 - RNA, 15 nt, Homo sapiens
aauacaaacaagcac

SEQ ID NO: 1515143 - RNA, 13 nt, Homo sapiens
aauacaacaugua

SEQ ID NO: 1515144 - RNA, 14 nt, Homo sapiens
aauacaacauguag

SEQ ID NO: 1515145 - RNA, 18 nt, Homo sapiens
aauaccccuguuaagcaa

SEQ ID NO: 1515146 - RNA, 19 nt, Homo sapiens
aauaccccuguuaagcaau

SEQ ID NO: 1515147 - RNA, 21 nt, Homo sapiens
aauacugcugagauacauaca

SEQ ID NO: 1515148 - RNA, 17 nt, Homo sapiens
aauagcaggacauuuac

SEQ ID NO: 1515149 - RNA, 12 nt, Homo sapiens
aauagggagaaa

SEQ ID NO: 1515150 - RNA, 15 nt, Homo sapiens
aauauaaaaauguga

SEQ ID NO: 1515151 - RNA, 16 nt, Homo sapiens
aauauaaaguguaaua

SEQ ID NO: 1515152 - RNA, 17 nt, Homo sapiens
aauauccauacagucaa

SEQ ID NO: 1515153 - RNA, 17 nt, Homo sapiens
aauaugggcucaaguca

SEQ ID NO: 1515154 - RNA, 23 nt, Homo sapiens
aauaugugaugauuaauacaaua

SEQ ID NO: 1515155 - RNA, 14 nt, Homo sapiens
aauauuaccaaaaa

SEQ ID NO: 1515156 - RNA, 23 nt, Homo sapiens
aauauucaauaaagcugcugaga

SEQ ID NO: 1515157 - RNA, 19 nt, Homo sapiens
aauauugacuucucuugaa

SEQ ID NO: 1515158 - RNA, 18 nt, Homo sapiens
aaucaacuugcuuaucaa

SEQ ID NO: 1515159 - RNA, 21 nt, Homo sapiens
aaucaagacccuuuucuguau

SEQ ID NO: 1515160 - RNA, 19 nt, Homo sapiens
aaucacuauugcuuccuaa

SEQ ID NO: 1515161 - RNA, 16 nt, Homo sapiens
aaucaggcaguucccu

SEQ ID NO: 1515162 - RNA, 16 nt, Homo sapiens
aaucaugaguaccuca

SEQ ID NO: 1515163 - RNA, 19 nt, Homo sapiens
aauccagagauaauugcca

SEQ ID NO: 1515164 - RNA, 16 nt, Homo sapiens
aaucccaacacuuuug

SEQ ID NO: 1515165 - RNA, 15 nt, Homo sapiens
aauccuuacuuuugu

SEQ ID NO: 1515166 - RNA, 17 nt, Homo sapiens
aaucgagucuaccucuu

SEQ ID NO: 1515167 - RNA, 19 nt, Homo sapiens
aaucuaacuacaaggacaa

SEQ ID NO: 1515168 - RNA, 19 nt, Homo sapiens
aaucuccacuguuauucua

SEQ ID NO: 1515169 - RNA, 12 nt, Homo sapiens
aaucugagcaaa

SEQ ID NO: 1515170 - RNA, 17 nt, Homo sapiens
aaucuggcuuagugcca

SEQ ID NO: 1515171 - RNA, 18 nt, Homo sapiens
aaucuggcuuagugccac

SEQ ID NO: 1515172 - RNA, 14 nt, Homo sapiens
aaugaaaccaaagc

SEQ ID NO: 1515173 - RNA, 19 nt, Homo sapiens
aaugaaaccaaagccagga

SEQ ID NO: 1515174 - RNA, 15 nt, Homo sapiens
aaugacaacauugca

SEQ ID NO: 1515175 - RNA, 22 nt, Homo sapiens
aaugacagaaugcuguuuuaaa

SEQ ID NO: 1515176 - RNA, 16 nt, Homo sapiens
aaugaguuuucaccug

SEQ ID NO: 1515177 - RNA, 21 nt, Homo sapiens
aaugauaagcaggaaggaugg

SEQ ID NO: 1515178 - RNA, 20 nt, Homo sapiens
aaugcgaacuuggagauaau

SEQ ID NO: 1515179 - RNA, 15 nt, Homo sapiens
aaugcuaucucaaag

SEQ ID NO: 1515180 - RNA, 14 nt, Homo sapiens
aaugcuccaugaaa

SEQ ID NO: 1515181 - RNA, 14 nt, Homo sapiens
aaugcugcuucucc

SEQ ID NO: 1515182 - RNA, 21 nt, Homo sapiens
aaugcuuaaaaauguauccca

SEQ ID NO: 1515183 - RNA, 18 nt, Homo sapiens
aauggacuauacauacua

SEQ ID NO: 1515184 - RNA, 19 nt, Homo sapiens
aauggagugggagaucagc

SEQ ID NO: 1515185 - RNA, 14 nt, Homo sapiens
aauggguacuccag

SEQ ID NO: 1515186 - RNA, 13 nt, Homo sapiens
aaugguaagcauu

SEQ ID NO: 1515187 - RNA, 17 nt, Homo sapiens
aaugguacucuaaucag

SEQ ID NO: 1515188 - RNA, 15 nt, Homo sapiens
aauguaaagccaugc

SEQ ID NO: 1515189 - RNA, 23 nt, Homo sapiens
aauguaauaauaaugaaugucau

SEQ ID NO: 1515190 - RNA, 22 nt, Homo sapiens
aauguccuucuuuaucugugau

SEQ ID NO: 1515191 - RNA, 23 nt, Homo sapiens
aauguccuucuuuaucugugaua

SEQ ID NO: 1515192 - RNA, 17 nt, Homo sapiens
aaugugugucugaagac

SEQ ID NO: 1515193 - RNA, 23 nt, Homo sapiens
aauguuuuuauuuucucuaucaa

SEQ ID NO: 1515194 - RNA, 12 nt, Homo sapiens
aauuaacauauc

SEQ ID NO: 1515195 - RNA, 13 nt, Homo sapiens
aauuaacuaugug

SEQ ID NO: 1515196 - RNA, 18 nt, Homo sapiens
aauuaaguaaaccaaaaa

SEQ ID NO: 1515197 - RNA, 22 nt, Homo sapiens
aauuaccagaguuguucugucu

SEQ ID NO: 1515198 - RNA, 20 nt, Homo sapiens
aauuagcagaagugaccaaa

SEQ ID NO: 1515199 - RNA, 16 nt, Homo sapiens
aauuaguaauugucaa

SEQ ID NO: 1515200 - RNA, 18 nt, Homo sapiens
aauuauaauaaaggucac

SEQ ID NO: 1515201 - RNA, 19 nt, Homo sapiens
aauuauuaugacucaauaa

SEQ ID NO: 1515202 - RNA, 19 nt, Homo sapiens
aauuauugugccucagccu

SEQ ID NO: 1515203 - RNA, 21 nt, Homo sapiens
aauucacucugaguguuuuau

SEQ ID NO: 1515204 - RNA, 21 nt, Homo sapiens
aauucauaacugguagcuaua

SEQ ID NO: 1515205 - RNA, 23 nt, Homo sapiens
aauucauggaagccaccagugag

SEQ ID NO: 1515206 - RNA, 14 nt, Homo sapiens
aauuccuggcauga

SEQ ID NO: 1515207 - RNA, 19 nt, Homo sapiens
aauucuauaugauccugaa

SEQ ID NO: 1515208 - RNA, 20 nt, Homo sapiens
aauucugagauccagcacaa

SEQ ID NO: 1515209 - RNA, 16 nt, Homo sapiens
aauucuuuacaauaaa

SEQ ID NO: 1515210 - RNA, 13 nt, Homo sapiens
aauugaacuacuu

SEQ ID NO: 1515211 - RNA, 14 nt, Homo sapiens
aauugcuacauucu

SEQ ID NO: 1515212 - RNA, 21 nt, Homo sapiens
aauugcuuugccaaaauacca

SEQ ID NO: 1515213 - RNA, 17 nt, Homo sapiens
aauuguacuaaagccaa

SEQ ID NO: 1515214 - RNA, 22 nt, Homo sapiens
aauugucaauaccccuguuaag

SEQ ID NO: 1515215 - RNA, 12 nt, Homo sapiens
aauuguuugacc

SEQ ID NO: 1515216 - RNA, 23 nt, Homo sapiens
aauuuaaaaauaagaaaauacau

SEQ ID NO: 1515217 - RNA, 20 nt, Homo sapiens
aauuuaaggccugcacucuu

SEQ ID NO: 1515218 - RNA, 20 nt, Homo sapiens
aauuuaugugaaagaguucu

SEQ ID NO: 1515219 - RNA, 23 nt, Homo sapiens
aauuuauugucugucuacauuuc

SEQ ID NO: 1515220 - RNA, 14 nt, Homo sapiens
aauuuuaacauuuu

SEQ ID NO: 1515221 - RNA, 18 nt, Homo sapiens
aauuuuaugugcuucaca

SEQ ID NO: 1515222 - RNA, 20 nt, Homo sapiens
aauuuuccagggcucaaaaa

SEQ ID NO: 1515223 - RNA, 23 nt, Homo sapiens
aauuuuuucaugcacacuguugg

SEQ ID NO: 1515224 - RNA, 21 nt, Homo sapiens
acaaaaaauuugagaaagccu

SEQ ID NO: 1515225 - RNA, 17 nt, Homo sapiens
acaaaaacaaaaaacca

SEQ ID NO: 1515226 - RNA, 14 nt, Homo sapiens
acaaaaacaacuua

SEQ ID NO: 1515227 - RNA, 17 nt, Homo sapiens
acaaaaaggcauaugca

SEQ ID NO: 1515228 - RNA, 22 nt, Homo sapiens
acaaaaaugaaagcaugucuca

SEQ ID NO: 1515229 - RNA, 19 nt, Homo sapiens
acaaaauggagggagccau

SEQ ID NO: 1515230 - RNA, 16 nt, Homo sapiens
acaaacucuuguguac

SEQ ID NO: 1515231 - RNA, 18 nt, Homo sapiens
acaaagccgugccuuucu

SEQ ID NO: 1515232 - RNA, 15 nt, Homo sapiens
acaaauucuacagca

SEQ ID NO: 1515233 - RNA, 14 nt, Homo sapiens
ucaucuugacaugu

SEQ ID NO: 1515234 - RNA, 16 nt, Homo sapiens
ucaugacacuauacag

SEQ ID NO: 1515235 - RNA, 16 nt, Homo sapiens
ucaugacauguuauau

SEQ ID NO: 1515236 - RNA, 22 nt, Homo sapiens
ucaugacuuuuccauguaucua

SEQ ID NO: 1515237 - RNA, 18 nt, Homo sapiens
ucaugaguuucccagaga

SEQ ID NO: 1515238 - RNA, 21 nt, Homo sapiens
ucauggaagccaccagugaga

SEQ ID NO: 1515239 - RNA, 20 nt, Homo sapiens
ucauggacagauagacagug

SEQ ID NO: 1515240 - RNA, 13 nt, Homo sapiens
ucauggcauucac

SEQ ID NO: 1515241 - RNA, 15 nt, Homo sapiens
ucauuacuaaccaua

SEQ ID NO: 1515242 - RNA, 17 nt, Homo sapiens
ucauucgccugugggaa

SEQ ID NO: 1515243 - RNA, 19 nt, Homo sapiens
ucauugucgcucagcaaua

SEQ ID NO: 1515244 - RNA, 12 nt, Homo sapiens
ucauuugaacaa

SEQ ID NO: 1515245 - RNA, 21 nt, Homo sapiens
uccaaaaaggaacacuggaaa

SEQ ID NO: 1515246 - RNA, 19 nt, Homo sapiens
uccaaaggcauaagacccu

SEQ ID NO: 1515247 - RNA, 18 nt, Homo sapiens
uccaaagugccacucauu

SEQ ID NO: 1515248 - RNA, 13 nt, Homo sapiens
uccaaaugccaac

SEQ ID NO: 1515249 - RNA, 16 nt, Homo sapiens
uccaacgauuagcuuu

SEQ ID NO: 1515250 - RNA, 17 nt, Homo sapiens
uccaacgauuagcuuuu

SEQ ID NO: 1515251 - RNA, 21 nt, Homo sapiens
uccaagaauguuguuagcuuu

SEQ ID NO: 1515252 - RNA, 16 nt, Homo sapiens
uccaagucaacacucu

SEQ ID NO: 1515253 - RNA, 19 nt, Homo sapiens
uccacauuauacauuugau

SEQ ID NO: 1515254 - RNA, 17 nt, Homo sapiens
uccacccacaacaucua

SEQ ID NO: 1515255 - RNA, 16 nt, Homo sapiens
uccacgcacacaugga

SEQ ID NO: 1515256 - RNA, 18 nt, Homo sapiens
uccacuuccauguugucu

SEQ ID NO: 1515257 - RNA, 14 nt, Homo sapiens
uccagaacugaggu

SEQ ID NO: 1515258 - RNA, 17 nt, Homo sapiens
uccagagacaggaaaga

SEQ ID NO: 1515259 - RNA, 19 nt, Homo sapiens
uccagauagcugaaugagu

SEQ ID NO: 1515260 - RNA, 11 nt, Homo sapiens
ccuuuuugccc

SEQ ID NO: 1515261 - RNA, 15 nt, Homo sapiens
cgaacauucuuugcc

SEQ ID NO: 1515262 - RNA, 13 nt, Homo sapiens
cgaaucaucucaa

SEQ ID NO: 1515263 - RNA, 23 nt, Homo sapiens
cgacagagcaagacuccauuuca

SEQ ID NO: 1515264 - RNA, 17 nt, Homo sapiens
cgacguccccaaaccua

SEQ ID NO: 1515265 - RNA, 15 nt, Homo sapiens
cgacuuuuaagcaaa

SEQ ID NO: 1515266 - RNA, 22 nt, Homo sapiens
cgagagaggcgcgucugcccca

SEQ ID NO: 1515267 - RNA, 20 nt, Homo sapiens
cgagauugcaccacugcacu

SEQ ID NO: 1515268 - RNA, 20 nt, Homo sapiens
cgagggcuacucagcaguaa

SEQ ID NO: 1515269 - RNA, 22 nt, Homo sapiens
cgaugccgugugucucgucucc

SEQ ID NO: 1515270 - RNA, 23 nt, Homo sapiens
cgauuucucucucucccccucag

SEQ ID NO: 1515271 - RNA, 13 nt, Homo sapiens
cgcacacauggac

SEQ ID NO: 1515272 - RNA, 14 nt, Homo sapiens
cgcauauuuaacuc

SEQ ID NO: 1515273 - RNA, 14 nt, Homo sapiens
cgccauuccaaguc

SEQ ID NO: 1515274 - RNA, 23 nt, Homo sapiens
cgccauuccaagucaacacucuu

SEQ ID NO: 1515275 - RNA, 16 nt, Homo sapiens
cggacccaucuuugcu

SEQ ID NO: 1515276 - RNA, 14 nt, Homo sapiens
cggagaguacagug

SEQ ID NO: 1515277 - RNA, 16 nt, Homo sapiens
cggagguugcagugag

SEQ ID NO: 1515278 - RNA, 14 nt, Homo sapiens
cggccucccaaagu

SEQ ID NO: 1515279 - RNA, 20 nt, Homo sapiens
cgggagcucuguauggucag

SEQ ID NO: 1515280 - RNA, 17 nt, Homo sapiens
cgggauuugaagcugua

SEQ ID NO: 1515281 - RNA, 14 nt, Homo sapiens
cggggcacugcagg

SEQ ID NO: 1515282 - RNA, 17 nt, Homo sapiens
cgggggagcuggaaaua

SEQ ID NO: 1515283 - RNA, 13 nt, Homo sapiens
cggguguguacac

SEQ ID NO: 1515284 - RNA, 19 nt, Homo sapiens
cggguguguacaccaaggu

SEQ ID NO: 1515285 - RNA, 22 nt, Homo sapiens
cguaauguauuuauauguuaau

SEQ ID NO: 1515286 - RNA, 17 nt, Homo sapiens
cguaccuugcuuuagag

SEQ ID NO: 1515287 - RNA, 20 nt, Homo sapiens
cguaggauuuggggugaaug

SEQ ID NO: 1515288 - RNA, 20 nt, Homo sapiens
cgucagaccaguacugggaa

SEQ ID NO: 1515289 - RNA, 22 nt, Homo sapiens
cgucagggucggggcuagggua

SEQ ID NO: 1515290 - RNA, 18 nt, Homo sapiens
cgucagugcugugcugug

SEQ ID NO: 1515291 - RNA, 19 nt, Homo sapiens
cgucuccugacaugucuca

SEQ ID NO: 1515292 - RNA, 17 nt, Homo sapiens
cgugacacaaacacaca

SEQ ID NO: 1515293 - RNA, 14 nt, Homo sapiens
cgugaccagcagua

SEQ ID NO: 1515294 - RNA, 15 nt, Homo sapiens
cgugguagaagccag

SEQ ID NO: 1515295 - RNA, 14 nt, Homo sapiens
cguguggcuuacaa

SEQ ID NO: 1515296 - RNA, 22 nt, Homo sapiens
cguguguauuagaaugcaugua

SEQ ID NO: 1515297 - RNA, 22 nt, Homo sapiens
cguuaagggaaggaacucuggc

SEQ ID NO: 1515298 - RNA, 17 nt, Homo sapiens
cuaaaaaauggugggag

SEQ ID NO: 1515299 - RNA, 19 nt, Homo sapiens
cuaaaauacaaacaagcac

SEQ ID NO: 1515300 - RNA, 18 nt, Homo sapiens
cuaaauaaaaaauucaaa

SEQ ID NO: 1515301 - RNA, 15 nt, Homo sapiens
cuaaaucucuaauau

SEQ ID NO: 1515302 - RNA, 19 nt, Homo sapiens
cuaaauugaauacacaaau

SEQ ID NO: 1515303 - RNA, 23 nt, Homo sapiens
cuaaauugaauacacaaauuucc

SEQ ID NO: 1515304 - RNA, 15 nt, Homo sapiens
cuaacagcugaagua

SEQ ID NO: 1515305 - RNA, 23 nt, Homo sapiens
cuaaccauaguuauuuacuugaa

SEQ ID NO: 1515306 - RNA, 23 nt, Homo sapiens
cuaacccccagugccacagagaa

SEQ ID NO: 1515307 - RNA, 15 nt, Homo sapiens
cuaacuccugccauu

SEQ ID NO: 1515308 - RNA, 18 nt, Homo sapiens
cuaagaaagacaucacau

SEQ ID NO: 1515309 - RNA, 20 nt, Homo sapiens
cuaagaaaucauggcauuca

SEQ ID NO: 1515310 - RNA, 18 nt, Homo sapiens
cuaagccuguugagacuu

SEQ ID NO: 1515311 - RNA, 16 nt, Homo sapiens
cuaagccuguugcuga

SEQ ID NO: 1515312 - RNA, 21 nt, Homo sapiens
cuaagccuguugcugaaguca

SEQ ID NO: 1515313 - RNA, 18 nt, Homo sapiens
cuaaguaagaacacugag

SEQ ID NO: 1515314 - RNA, 23 nt, Homo sapiens
cuaagugacacaaauugaagcau

SEQ ID NO: 1515315 - RNA, 15 nt, Homo sapiens
cuaaguucaagaaga

SEQ ID NO: 1515316 - RNA, 16 nt, Homo sapiens
cuaauacaacauguag

SEQ ID NO: 1515317 - RNA, 23 nt, Homo sapiens
cuaauuccuggcaugacacucua

SEQ ID NO: 1515318 - RNA, 13 nt, Homo sapiens
cuaauuucuuaga

SEQ ID NO: 1515319 - RNA, 13 nt, Homo sapiens
cuacaaaauggag

SEQ ID NO: 1515320 - RNA, 21 nt, Homo sapiens
cuacacacccauagugcacac

SEQ ID NO: 1515321 - RNA, 15 nt, Homo sapiens
cuacacccucugccc

SEQ ID NO: 1515322 - RNA, 20 nt, Homo sapiens
cuacacccuuggacuugagg

SEQ ID NO: 1515323 - RNA, 19 nt, Homo sapiens
cuaccaggcacgucugcag

SEQ ID NO: 1515324 - RNA, 23 nt, Homo sapiens
cuacccggcccagagaccccuuc

SEQ ID NO: 1515325 - RNA, 12 nt, Homo sapiens
cuacuugccaca

SEQ ID NO: 1515326 - RNA, 17 nt, Homo sapiens
cuacuugggagcuauga

SEQ ID NO: 1515327 - RNA, 15 nt, Homo sapiens
cuagaaaucugccaa

SEQ ID NO: 1515328 - RNA, 20 nt, Homo sapiens
cuagaacccccacauuuacc

SEQ ID NO: 1515329 - RNA, 17 nt, Homo sapiens
cuagaacuuugugccag

SEQ ID NO: 1515330 - RNA, 12 nt, Homo sapiens
cuagacuuucug

SEQ ID NO: 1515331 - RNA, 14 nt, Homo sapiens
cuagagaugacuga

SEQ ID NO: 1515332 - RNA, 14 nt, Homo sapiens
cuagagcacugcca

SEQ ID NO: 1515333 - RNA, 15 nt, Homo sapiens
cuagagcacugccac

SEQ ID NO: 1515334 - RNA, 19 nt, Homo sapiens
cuagagccugugcuaaaga

SEQ ID NO: 1515335 - RNA, 17 nt, Homo sapiens
cugcuacacaaaagcca

SEQ ID NO: 1515336 - RNA, 22 nt, Homo sapiens
cugcuauaugccuuaagccaau

SEQ ID NO: 1515337 - RNA, 17 nt, Homo sapiens
cugcuccuacaagggaa

SEQ ID NO: 1515338 - RNA, 18 nt, Homo sapiens
cugcucugcccacuguga

SEQ ID NO: 1515339 - RNA, 13 nt, Homo sapiens
cugcucugcuaua

SEQ ID NO: 1515340 - RNA, 14 nt, Homo sapiens
cugcucugcuauau

SEQ ID NO: 1515341 - RNA, 11 nt, Homo sapiens
cugcugaagag

SEQ ID NO: 1515342 - RNA, 22 nt, Homo sapiens
cugcugagcagcccagcacaac

SEQ ID NO: 1515343 - RNA, 18 nt, Homo sapiens
cugcugcugaccugauca

SEQ ID NO: 1515344 - RNA, 20 nt, Homo sapiens
cugcugguaauuuguaucug

SEQ ID NO: 1515345 - RNA, 16 nt, Homo sapiens
cugcuuacuaaugugc

SEQ ID NO: 1515346 - RNA, 13 nt, Homo sapiens
cugcuucucagcg

SEQ ID NO: 1515347 - RNA, 18 nt, Homo sapiens
cugcuuuguauccaugag

SEQ ID NO: 1515348 - RNA, 19 nt, Homo sapiens
cugcuuuuugacaugaaca

SEQ ID NO: 1515349 - RNA, 22 nt, Homo sapiens
cuggaaaacucaggauucucac

SEQ ID NO: 1515350 - RNA, 14 nt, Homo sapiens
cuggaaaccaaaua

SEQ ID NO: 1515351 - RNA, 20 nt, Homo sapiens
cuggaaaccacacuucuuga

SEQ ID NO: 1515352 - RNA, 22 nt, Homo sapiens
cuggaaaccacacuucuugaaa

SEQ ID NO: 1515353 - RNA, 16 nt, Homo sapiens
cuggaaaccacguggu

SEQ ID NO: 1515354 - RNA, 23 nt, Homo sapiens
cuggaaaggcucagucucaggag

SEQ ID NO: 1515355 - RNA, 23 nt, Homo sapiens
cuggaaggucaauuucaguguau

SEQ ID NO: 1515356 - RNA, 20 nt, Homo sapiens
cuggaaguuucuggugccau

SEQ ID NO: 1515357 - RNA, 21 nt, Homo sapiens
cuggagaaagggaaguggaag

SEQ ID NO: 1515358 - RNA, 17 nt, Homo sapiens
cuggaggcaaauuucag

SEQ ID NO: 1515359 - RNA, 14 nt, Homo sapiens
cuggauauggugca

SEQ ID NO: 1515360 - RNA, 15 nt, Homo sapiens
cuggauucgugacaa

SEQ ID NO: 1515361 - RNA, 14 nt, Homo sapiens
cuggcauggugcuu

SEQ ID NO: 1515362 - RNA, 18 nt, Homo sapiens
cuggccauccccagaggu

SEQ ID NO: 1515363 - RNA, 14 nt, Homo sapiens
cuggcucucagaag

SEQ ID NO: 1515364 - RNA, 13 nt, Homo sapiens
cuggcugcaguga

SEQ ID NO: 1515365 - RNA, 18 nt, Homo sapiens
cuggcuguguggccaagg

SEQ ID NO: 1515366 - RNA, 23 nt, Homo sapiens
cuggcuuccagguaucuccagga

SEQ ID NO: 1515367 - RNA, 16 nt, Homo sapiens
cugggaccugaaugac

SEQ ID NO: 1515368 - RNA, 17 nt, Homo sapiens
cugggagaaccucaggc

SEQ ID NO: 1515369 - RNA, 23 nt, Homo sapiens
cugggauuacagguguaagccac

SEQ ID NO: 1515370 - RNA, 19 nt, Homo sapiens
cugggcuuguuguuuuuaa

SEQ ID NO: 1515371 - RNA, 20 nt, Homo sapiens
cuggguaagaagaaagcaaa

SEQ ID NO: 1515372 - RNA, 17 nt, Homo sapiens
cugguccugcacugucc

SEQ ID NO: 1515373 - RNA, 17 nt, Homo sapiens
cuggugaugcccaaaga

SEQ ID NO: 1515374 - RNA, 12 nt, Homo sapiens
cuggugccauuu

SEQ ID NO: 1515375 - RNA, 15 nt, Homo sapiens
cugguuuaaccuccu

SEQ ID NO: 1515376 - RNA, 21 nt, Homo sapiens
cuguaacuuaauuuugugacc

SEQ ID NO: 1515377 - RNA, 20 nt, Homo sapiens
cuguaaucccagcacuuugg

SEQ ID NO: 1515378 - RNA, 19 nt, Homo sapiens
cuguaaucccagcuacuca

SEQ ID NO: 1515379 - RNA, 23 nt, Homo sapiens
cuguacaguuucuuccccaagag

SEQ ID NO: 1515380 - RNA, 13 nt, Homo sapiens
cuguacucaggag

SEQ ID NO: 1515381 - RNA, 15 nt, Homo sapiens
cuguaguagcccuuu

SEQ ID NO: 1515382 - RNA, 21 nt, Homo sapiens
cuguagucccagccacucggg

SEQ ID NO: 1515383 - RNA, 22 nt, Homo sapiens
cugucccggagcucaggcccug

SEQ ID NO: 1515384 - RNA, 21 nt, Homo sapiens
cuguccuuucuagagcacugc

SEQ ID NO: 1515385 - RNA, 14 nt, Homo sapiens
cugucuacauuucu

SEQ ID NO: 1515386 - RNA, 16 nt, Homo sapiens
cugucugucccaaaga

SEQ ID NO: 1515387 - RNA, 24 nt, Homo sapiens
cugugacuggcagcauugacucug

SEQ ID NO: 1515388 - RNA, 15 nt, Homo sapiens
cugugcccagcaugc

SEQ ID NO: 1515389 - RNA, 22 nt, Homo sapiens
cugugccccuugacaacuggca

SEQ ID NO: 1515390 - RNA, 15 nt, Homo sapiens
cugugccuaacagca

SEQ ID NO: 1515391 - RNA, 15 nt, Homo sapiens
cugugcuauggugcu

SEQ ID NO: 1515392 - RNA, 15 nt, Homo sapiens
cugugucguagccaa

SEQ ID NO: 1515393 - RNA, 15 nt, Homo sapiens
cuguuaucugcuaga

SEQ ID NO: 1515394 - RNA, 11 nt, Homo sapiens
cuguuccucaa

SEQ ID NO: 1515395 - RNA, 18 nt, Homo sapiens
cuguucugccuuccgcag

SEQ ID NO: 1515396 - RNA, 22 nt, Homo sapiens
cuguugaaaauuauuuuaaaca

SEQ ID NO: 1515397 - RNA, 16 nt, Homo sapiens
cuguuuuagcugaggg

SEQ ID NO: 1515398 - RNA, 17 nt, Homo sapiens
cuguuuuagcugaggga

SEQ ID NO: 1515399 - RNA, 21 nt, Homo sapiens
cuguuuuuucuguacacagaa

SEQ ID NO: 1515400 - RNA, 14 nt, Homo sapiens
cuuaaaauguuaac

SEQ ID NO: 1515401 - RNA, 22 nt, Homo sapiens
ccaucuuuugugagauguaauu

SEQ ID NO: 1515402 - RNA, 23 nt, Homo sapiens
ccaucuuuugugagauguaauug

SEQ ID NO: 1515403 - RNA, 20 nt, Homo sapiens
ccaugaauucuugaguuuac

SEQ ID NO: 1515404 - RNA, 14 nt, Homo sapiens
ccaugauacuuuaa

SEQ ID NO: 1515405 - RNA, 23 nt, Homo sapiens
ccaugauacuuuaauuuuuauaa

SEQ ID NO: 1515406 - RNA, 22 nt, Homo sapiens
ccaugauggugcugaccucugg

SEQ ID NO: 1515407 - RNA, 22 nt, Homo sapiens
ccaugcaggggucagugcagca

SEQ ID NO: 1515408 - RNA, 23 nt, Homo sapiens
ccaugcuuuccuuuucuuccuuc

SEQ ID NO: 1515409 - RNA, 15 nt, Homo sapiens
ccaugggaccacaac

SEQ ID NO: 1515410 - RNA, 13 nt, Homo sapiens
ccauggugccauc

SEQ ID NO: 1515411 - RNA, 12 nt, Homo sapiens
ccauuacugcau

SEQ ID NO: 1515412 - RNA, 15 nt, Homo sapiens
ccauuaggcaugccu

SEQ ID NO: 1515413 - RNA, 20 nt, Homo sapiens
ccauuccuaggucacuugaa

SEQ ID NO: 1515414 - RNA, 12 nt, Homo sapiens
ccauuuccaugg

SEQ ID NO: 1515415 - RNA, 15 nt, Homo sapiens
ccauuuuacuuccau

SEQ ID NO: 1515416 - RNA, 20 nt, Homo sapiens
cccaaauccuuagaucuggc

SEQ ID NO: 1515417 - RNA, 23 nt, Homo sapiens
cccaaauccuuagaucuggcaug

SEQ ID NO: 1515418 - RNA, 21 nt, Homo sapiens
cccaauacauaccacuuugaa

SEQ ID NO: 1515419 - RNA, 13 nt, Homo sapiens
cccacaauggagu

SEQ ID NO: 1515420 - RNA, 20 nt, Homo sapiens
cccaccacgugcucaaucau

SEQ ID NO: 1515421 - RNA, 23 nt, Homo sapiens
cccacggggaucacagcguuuca

SEQ ID NO: 1515422 - RNA, 22 nt, Homo sapiens
cccacucccuggcucucagaag

SEQ ID NO: 1515423 - RNA, 22 nt, Homo sapiens
cccacugaguuugcuguuugca

SEQ ID NO: 1515424 - RNA, 23 nt, Homo sapiens
cccacuuuccuacaaaauggagg

SEQ ID NO: 1515425 - RNA, 14 nt, Homo sapiens
cccagagaccccuu

SEQ ID NO: 1515426 - RNA, 21 nt, Homo sapiens
cccagagugugaaacuuccua

SEQ ID NO: 1515427 - RNA, 12 nt, Homo sapiens
cccagauccuca

SEQ ID NO: 1515428 - RNA, 14 nt, Homo sapiens
cccagcaacacaga

SEQ ID NO: 1515429 - RNA, 16 nt, Homo sapiens
cccagcacugauguug

SEQ ID NO: 1515430 - RNA, 12 nt, Homo sapiens
cccagcacuuug

SEQ ID NO: 1515431 - RNA, 15 nt, Homo sapiens
cccagcagacuugag

SEQ ID NO: 1515432 - RNA, 23 nt, Homo sapiens
cccaggaggucgaccccaaagcc

SEQ ID NO: 1515433 - RNA, 14 nt, Homo sapiens
cccaggaguuugag

SEQ ID NO: 1515434 - RNA, 15 nt, Homo sapiens
cccaggcacugcaaa

SEQ ID NO: 1515435 - RNA, 21 nt, Homo sapiens
cccaggcccuaggauuccucc

SEQ ID NO: 1515436 - RNA, 19 nt, Homo sapiens
cccaggcuggaguacagug

SEQ ID NO: 1515437 - RNA, 23 nt, Homo sapiens
cccaguauaugcuauucaaugau

SEQ ID NO: 1515438 - RNA, 22 nt, Homo sapiens
cccaguccgccaaacacuccac

SEQ ID NO: 1515439 - RNA, 23 nt, Homo sapiens
cccaguguguguuuaacauucac

SEQ ID NO: 1515440 - RNA, 16 nt, Homo sapiens
cccauccccuuuccuc

SEQ ID NO: 1515441 - RNA, 22 nt, Homo sapiens
cccauguuuauuaagaaucauu

SEQ ID NO: 1515442 - RNA, 16 nt, Homo sapiens
cccauuaccagcauuu

SEQ ID NO: 1515443 - RNA, 23 nt, Homo sapiens
ccccaacaucucccucccacauu

SEQ ID NO: 1515444 - RNA, 19 nt, Homo sapiens
ccccagaggccucucucuc

SEQ ID NO: 1515445 - RNA, 22 nt, Homo sapiens
ccccagcucuggcuuccagaaa

SEQ ID NO: 1515446 - RNA, 16 nt, Homo sapiens
ccccggccucagcacc

SEQ ID NO: 1515447 - RNA, 22 nt, Homo sapiens
ccccguguccucucccugccaa

SEQ ID NO: 1515448 - RNA, 22 nt, Homo sapiens
cccgcaggcagccccacacccg

SEQ ID NO: 1515449 - RNA, 22 nt, Homo sapiens
cccgccucuucuucuucagaag

SEQ ID NO: 1515450 - RNA, 22 nt, Homo sapiens
cccgccuguccugccucucugc

SEQ ID NO: 1515451 - RNA, 21 nt, Homo sapiens
cccuacuuccucugcaaaaag

SEQ ID NO: 1515452 - RNA, 14 nt, Homo sapiens
cccuccacuccuca

SEQ ID NO: 1515453 - RNA, 13 nt, Homo sapiens
cccucccagagaa

SEQ ID NO: 1515454 - RNA, 15 nt, Homo sapiens
cccucccugcugcca

SEQ ID NO: 1515455 - RNA, 17 nt, Homo sapiens
cccucccuggcauguca

SEQ ID NO: 1515456 - RNA, 12 nt, Homo sapiens
cccugacacugu

SEQ ID NO: 1515457 - RNA, 22 nt, Homo sapiens
cccugacucucugugaccugcc

SEQ ID NO: 1515458 - RNA, 13 nt, Homo sapiens
cccugagguccug

SEQ ID NO: 1515459 - RNA, 14 nt, Homo sapiens
cccugauaagcaaa

SEQ ID NO: 1515460 - RNA, 11 nt, Homo sapiens
cccugccuuua

SEQ ID NO: 1515461 - RNA, 21 nt, Homo sapiens
cccuggcugaccccaaagagc

SEQ ID NO: 1515462 - RNA, 15 nt, Homo sapiens
cccugucucuagcca

SEQ ID NO: 1515463 - RNA, 14 nt, Homo sapiens
cccuguuaagcaau

SEQ ID NO: 1515464 - RNA, 22 nt, Homo sapiens
cccuuauccaggacucugucaa

SEQ ID NO: 1515465 - RNA, 14 nt, Homo sapiens
cccuuuaaagccuu

SEQ ID NO: 1515466 - RNA, 14 nt, Homo sapiens
ccgaccccaucuca

SEQ ID NO: 1515467 - RNA, 19 nt, Homo sapiens
ccgacuaacagcugaagua

SEQ ID NO: 1515468 - RNA, 21 nt, Homo sapiens
ccgauaucaaaaagacugugg

SEQ ID NO: 1515469 - RNA, 16 nt, Homo sapiens
ccgccaaacacuccac

SEQ ID NO: 1515470 - RNA, 14 nt, Homo sapiens
ccggcuccugucau

SEQ ID NO: 1515471 - RNA, 11 nt, Homo sapiens
ccgugccugua

SEQ ID NO: 1515472 - RNA, 18 nt, Homo sapiens
ccguucgcccccauguga

SEQ ID NO: 1515473 - RNA, 19 nt, Homo sapiens
ccuacugaacccagaguca

SEQ ID NO: 1515474 - RNA, 19 nt, Homo sapiens
ccuagcugguuaauggcag

SEQ ID NO: 1515475 - RNA, 20 nt, Homo sapiens
ccuauuuggggcuugcaugc

SEQ ID NO: 1515476 - RNA, 16 nt, Homo sapiens
ccucaaacacacaaac

SEQ ID NO: 1515477 - RNA, 15 nt, Homo sapiens
ccucaaagcaccuga

SEQ ID NO: 1515478 - RNA, 19 nt, Homo sapiens
ccucaacaacaaaccaaaa

SEQ ID NO: 1515479 - RNA, 13 nt, Homo sapiens
ccucaaugugacc

SEQ ID NO: 1515480 - RNA, 21 nt, Homo sapiens
cauauaaaaggugagcucagc

SEQ ID NO: 1515481 - RNA, 15 nt, Homo sapiens
cauauauacuacaug

SEQ ID NO: 1515482 - RNA, 13 nt, Homo sapiens
cauauauauguau

SEQ ID NO: 1515483 - RNA, 13 nt, Homo sapiens
cauaucaaaaagu

SEQ ID NO: 1515484 - RNA, 22 nt, Homo sapiens
cauauugacuuaauugcagcuu

SEQ ID NO: 1515485 - RNA, 23 nt, Homo sapiens
cauauuuuaggacagguaaaaua

SEQ ID NO: 1515486 - RNA, 13 nt, Homo sapiens
cauauuuucacau

SEQ ID NO: 1515487 - RNA, 20 nt, Homo sapiens
caucaaauauuaccaaaaaa

SEQ ID NO: 1515488 - RNA, 23 nt, Homo sapiens
caucaacaagaguugucuugucc

SEQ ID NO: 1515489 - RNA, 16 nt, Homo sapiens
caucacagcagugcau

SEQ ID NO: 1515490 - RNA, 21 nt, Homo sapiens
cauccuaaucugaauggugcu

SEQ ID NO: 1515491 - RNA, 18 nt, Homo sapiens
caucuacucauugucuca

SEQ ID NO: 1515492 - RNA, 19 nt, Homo sapiens
caucuauuauaaaaccaug

SEQ ID NO: 1515493 - RNA, 14 nt, Homo sapiens
caucucacuuugcc

SEQ ID NO: 1515494 - RNA, 20 nt, Homo sapiens
caucucacuuugccccaguu

SEQ ID NO: 1515495 - RNA, 16 nt, Homo sapiens
caucucagugaagaau

SEQ ID NO: 1515496 - RNA, 16 nt, Homo sapiens
caucucccucccacau

SEQ ID NO: 1515497 - RNA, 17 nt, Homo sapiens
caucugaaccacuuugc

SEQ ID NO: 1515498 - RNA, 22 nt, Homo sapiens
caucugaaccacuuugccucug

SEQ ID NO: 1515499 - RNA, 23 nt, Homo sapiens
caucugcacuaauugacccaaaa

SEQ ID NO: 1515500 - RNA, 13 nt, Homo sapiens
caucugcauuucu

SEQ ID NO: 1515501 - RNA, 20 nt, Homo sapiens
caucuugucaagaaauaucc

SEQ ID NO: 1515502 - RNA, 15 nt, Homo sapiens
caugaaaaacacggc

SEQ ID NO: 1515503 - RNA, 13 nt, Homo sapiens
caugaacaggguc

SEQ ID NO: 1515504 - RNA, 15 nt, Homo sapiens
caugaacgcacuuua

SEQ ID NO: 1515505 - RNA, 18 nt, Homo sapiens
caugacacucuagugacu

SEQ ID NO: 1515506 - RNA, 17 nt, Homo sapiens
caugacuuuuccaugua

SEQ ID NO: 1515507 - RNA, 14 nt, Homo sapiens
caugagaggacuga

SEQ ID NO: 1515508 - RNA, 22 nt, Homo sapiens
caugauacaccuacuacucaau

SEQ ID NO: 1515509 - RNA, 19 nt, Homo sapiens
caugauggagcgcaccugc

SEQ ID NO: 1515510 - RNA, 20 nt, Homo sapiens
caugauggagcgcaccugcc

SEQ ID NO: 1515511 - RNA, 12 nt, Homo sapiens
caugcaagucau

SEQ ID NO: 1515512 - RNA, 20 nt, Homo sapiens
caugcaccucagggccaagc

SEQ ID NO: 1515513 - RNA, 16 nt, Homo sapiens
caugccuggucuuucc

SEQ ID NO: 1515514 - RNA, 17 nt, Homo sapiens
caugcgggccaccaagu

SEQ ID NO: 1515515 - RNA, 14 nt, Homo sapiens
caugcuggggcaag

SEQ ID NO: 1515516 - RNA, 21 nt, Homo sapiens
caugcugugugcuggagacac

SEQ ID NO: 1515517 - RNA, 17 nt, Homo sapiens
caugcuuaaauauugaa

SEQ ID NO: 1515518 - RNA, 20 nt, Homo sapiens
cauggaagguuagagguuug

SEQ ID NO: 1515519 - RNA, 17 nt, Homo sapiens
cauggaauaaaccauuu

SEQ ID NO: 1515520 - RNA, 19 nt, Homo sapiens
cauggacaccccuuaucca

SEQ ID NO: 1515521 - RNA, 21 nt, Homo sapiens
cauggacagauagacagugcu

SEQ ID NO: 1515522 - RNA, 21 nt, Homo sapiens
cauggacaugcuucagugcug

SEQ ID NO: 1515523 - RNA, 15 nt, Homo sapiens
cauggccuucccucc

SEQ ID NO: 1515524 - RNA, 12 nt, Homo sapiens
caugugccugua

SEQ ID NO: 1515525 - RNA, 19 nt, Homo sapiens
cauguggaaagccucagga

SEQ ID NO: 1515526 - RNA, 10 nt, Homo sapiens
cauguguuag

SEQ ID NO: 1515527 - RNA, 18 nt, Homo sapiens
cauguuuuguauguuaaa

SEQ ID NO: 1515528 - RNA, 13 nt, Homo sapiens
cauuaaaccugga

SEQ ID NO: 1515529 - RNA, 14 nt, Homo sapiens
cauuaagagugaau

SEQ ID NO: 1515530 - RNA, 17 nt, Homo sapiens
cauuacugcauaaaaua

SEQ ID NO: 1515531 - RNA, 15 nt, Homo sapiens
cauuaggcaugccua

SEQ ID NO: 1515532 - RNA, 22 nt, Homo sapiens
cauuauucucugaugcacuguu

SEQ ID NO: 1515533 - RNA, 18 nt, Homo sapiens
cauucaggguuauacaca

SEQ ID NO: 1515534 - RNA, 17 nt, Homo sapiens
cauucauuuauucauuc

SEQ ID NO: 1515535 - RNA, 23 nt, Homo sapiens
cauuccuguagucaaaaucuggu

SEQ ID NO: 1515536 - RNA, 14 nt, Homo sapiens
cauucgagguguca

SEQ ID NO: 1515537 - RNA, 16 nt, Homo sapiens
cauucuuagacuaguu

SEQ ID NO: 1515538 - RNA, 15 nt, Homo sapiens
cauugaauuugccuu

SEQ ID NO: 1515539 - RNA, 14 nt, Homo sapiens
cauugccuugccaa

SEQ ID NO: 1515540 - RNA, 16 nt, Homo sapiens
cauugcuucugcuaaa

SEQ ID NO: 1515541 - RNA, 14 nt, Homo sapiens
cauuguacuccagc

SEQ ID NO: 1515542 - RNA, 19 nt, Homo sapiens
cauugucgcucagcaauag

SEQ ID NO: 1515543 - RNA, 23 nt, Homo sapiens
cauuuacuuaacagaacagucac

SEQ ID NO: 1515544 - RNA, 14 nt, Homo sapiens
cauuucuacuguga

SEQ ID NO: 1515545 - RNA, 16 nt, Homo sapiens
cauuugcaaaauggaa

SEQ ID NO: 1515546 - RNA, 17 nt, Homo sapiens
cauuugcaaaauggaaa

SEQ ID NO: 1515547 - RNA, 23 nt, Homo sapiens
cauuugcaaaauggaaauguaau

SEQ ID NO: 1515548 - RNA, 20 nt, Homo sapiens
cauuuguuuaauuuauacug

SEQ ID NO: 1515549 - RNA, 17 nt, Homo sapiens
cauuuuacauauggaaa

SEQ ID NO: 1515550 - RNA, 16 nt, Homo sapiens
cauuuuacuuccauga

SEQ ID NO: 1515551 - RNA, 15 nt, Homo sapiens
cauuuuauaaauuca

SEQ ID NO: 1515552 - RNA, 17 nt, Homo sapiens
cauuuucaauaauguga

SEQ ID NO: 1515553 - RNA, 22 nt, Homo sapiens
cauuuuggaaguuuucaggacu

SEQ ID NO: 1515554 - RNA, 22 nt, Homo sapiens
cauuuugggaccuauaucucag

SEQ ID NO: 1515555 - RNA, 21 nt, Homo sapiens
cauuuuguaaguugaagcaaa

SEQ ID NO: 1515556 - RNA, 17 nt, Homo sapiens
ccaaaauaccagagccu

SEQ ID NO: 1515557 - RNA, 17 nt, Homo sapiens
ccaaaauuaccaaaaau

SEQ ID NO: 1515558 - RNA, 15 nt, Homo sapiens
ccaaacucugccagc

SEQ ID NO: 1515559 - RNA, 14 nt, Homo sapiens
ccaaagaaguuuaa

SEQ ID NO: 1515560 - RNA, 16 nt, Homo sapiens
ccaaauccacaagcca

SEQ ID NO: 1515561 - RNA, 19 nt, Homo sapiens
ccaaaugcauggugcaguu

SEQ ID NO: 1515562 - RNA, 22 nt, Homo sapiens
ccaaccuggaguauaauauuca

SEQ ID NO: 1515563 - RNA, 14 nt, Homo sapiens
ccaacugcugauca

SEQ ID NO: 1515564 - RNA, 23 nt, Homo sapiens
ccaagaacuuuucccccaaagau

SEQ ID NO: 1515565 - RNA, 22 nt, Homo sapiens
accuggaugaucacuaauacua

SEQ ID NO: 1515566 - RNA, 20 nt, Homo sapiens
accugggcccacagagccug

SEQ ID NO: 1515567 - RNA, 19 nt, Homo sapiens
accuucagauuuguguuau

SEQ ID NO: 1515568 - RNA, 15 nt, Homo sapiens
accuuggacuccucc

SEQ ID NO: 1515569 - RNA, 14 nt, Homo sapiens
accuuuauagcuca

SEQ ID NO: 1515570 - RNA, 21 nt, Homo sapiens
accuuuguguaaagaagggaa

SEQ ID NO: 1515571 - RNA, 11 nt, Homo sapiens
acgacucuucc

SEQ ID NO: 1515572 - RNA, 13 nt, Homo sapiens
acgauuagcuuuu

SEQ ID NO: 1515573 - RNA, 14 nt, Homo sapiens
acgcacacauggac

SEQ ID NO: 1515574 - RNA, 15 nt, Homo sapiens
acgccuaugauccca

SEQ ID NO: 1515575 - RNA, 22 nt, Homo sapiens
acggaccugcuuugagauuucc

SEQ ID NO: 1515576 - RNA, 21 nt, Homo sapiens
acggcuggaccugcacgccac

SEQ ID NO: 1515577 - RNA, 16 nt, Homo sapiens
acgucucaagacugaa

SEQ ID NO: 1515578 - RNA, 17 nt, Homo sapiens
acgugaagccacaggag

SEQ ID NO: 1515579 - RNA, 14 nt, Homo sapiens
acgugagccaggua

SEQ ID NO: 1515580 - RNA, 13 nt, Homo sapiens
acguuuaagccaa

SEQ ID NO: 1515581 - RNA, 15 nt, Homo sapiens
acuaaaauuccacuc

SEQ ID NO: 1515582 - RNA, 17 nt, Homo sapiens
acuaauauccugucucu

SEQ ID NO: 1515583 - RNA, 22 nt, Homo sapiens
acuaauggcaugagaaauacaa

SEQ ID NO: 1515584 - RNA, 13 nt, Homo sapiens
acuaccuuuauag

SEQ ID NO: 1515585 - RNA, 16 nt, Homo sapiens
acuacuggacuucuau

SEQ ID NO: 1515586 - RNA, 16 nt, Homo sapiens
acuagcaggcaugccg

SEQ ID NO: 1515587 - RNA, 18 nt, Homo sapiens
acuagucauagaaauacc

SEQ ID NO: 1515588 - RNA, 22 nt, Homo sapiens
acuaguguguguguguauauau

SEQ ID NO: 1515589 - RNA, 17 nt, Homo sapiens
acuaguugaacaucuca

SEQ ID NO: 1515590 - RNA, 13 nt, Homo sapiens
acuauacaacaau

SEQ ID NO: 1515591 - RNA, 15 nt, Homo sapiens
acucaaguaccacca

SEQ ID NO: 1515592 - RNA, 20 nt, Homo sapiens
acucaaguaccaccaaggga

SEQ ID NO: 1515593 - RNA, 15 nt, Homo sapiens
acucaccucucucua

SEQ ID NO: 1515594 - RNA, 20 nt, Homo sapiens
acucagccgcagacaaguaa

SEQ ID NO: 1515595 - RNA, 22 nt, Homo sapiens
acucagucuagugaagauguug

SEQ ID NO: 1515596 - RNA, 21 nt, Homo sapiens
acucagucugugggagcucag

SEQ ID NO: 1515597 - RNA, 23 nt, Homo sapiens
acucauauaaaaggugagcucag

SEQ ID NO: 1515598 - RNA, 14 nt, Homo sapiens
acucauugucucag

SEQ ID NO: 1515599 - RNA, 18 nt, Homo sapiens
acuccacccccuccagcu

SEQ ID NO: 1515600 - RNA, 13 nt, Homo sapiens
acuccagugguga

SEQ ID NO: 1515601 - RNA, 21 nt, Homo sapiens
acuccucauccccacaaucug

SEQ ID NO: 1515602 - RNA, 18 nt, Homo sapiens
acuccucuuauuugcuca

SEQ ID NO: 1515603 - RNA, 21 nt, Homo sapiens
acucguauagcaugcaucugu

SEQ ID NO: 1515604 - RNA, 15 nt, Homo sapiens
acucuaagcugugug

SEQ ID NO: 1515605 - RNA, 21 nt, Homo sapiens
acucuaaucaguccuuauuau

SEQ ID NO: 1515606 - RNA, 20 nt, Homo sapiens
acucuacuuccucuuaccua

SEQ ID NO: 1515607 - RNA, 22 nt, Homo sapiens
acucuccccucccucuuccuuc

SEQ ID NO: 1515608 - RNA, 23 nt, Homo sapiens
acucugaggcucuuucugggcca

SEQ ID NO: 1515609 - RNA, 17 nt, Homo sapiens
acucuuguguaccuuug

SEQ ID NO: 1515610 - RNA, 13 nt, Homo sapiens
acugaagaccucc

SEQ ID NO: 1515611 - RNA, 12 nt, Homo sapiens
acugagagcaga

SEQ ID NO: 1515612 - RNA, 15 nt, Homo sapiens
acugaggucacuggg

SEQ ID NO: 1515613 - RNA, 18 nt, Homo sapiens
acugaguccucguagcca

SEQ ID NO: 1515614 - RNA, 21 nt, Homo sapiens
acugauguuacaucacagugu

SEQ ID NO: 1515615 - RNA, 17 nt, Homo sapiens
acugauuaccugccaau

SEQ ID NO: 1515616 - RNA, 20 nt, Homo sapiens
acugcaagcagggcucugcc

SEQ ID NO: 1515617 - RNA, 20 nt, Homo sapiens
acugcacuccagccugggug

SEQ ID NO: 1515618 - RNA, 17 nt, Homo sapiens
acugcauaauagccuaa

SEQ ID NO: 1515619 - RNA, 18 nt, Homo sapiens
acugccaugccucaagaa

SEQ ID NO: 1515620 - RNA, 20 nt, Homo sapiens
acugcuaggcgagugccagg

SEQ ID NO: 1515621 - RNA, 13 nt, Homo sapiens
acugcucugccca

SEQ ID NO: 1515622 - RNA, 18 nt, Homo sapiens
acugcugagauacauaca

SEQ ID NO: 1515623 - RNA, 15 nt, Homo sapiens
acugcugaucaauga

SEQ ID NO: 1515624 - RNA, 14 nt, Homo sapiens
acuggaaccaggga

SEQ ID NO: 1515625 - RNA, 17 nt, Homo sapiens
acuggaagaaagcaaca

SEQ ID NO: 1515626 - RNA, 21 nt, Homo sapiens
acuggagacuuggaagaguug

SEQ ID NO: 1515627 - RNA, 18 nt, Homo sapiens
acuggaggcaaauuucag

SEQ ID NO: 1515628 - RNA, 17 nt, Homo sapiens
acuggcgcagacuucac

SEQ ID NO: 1515629 - RNA, 23 nt, Homo sapiens
acuggcgcagacuucacaauuca

SEQ ID NO: 1515630 - RNA, 21 nt, Homo sapiens
acugggagaagagaaccucaa

SEQ ID NO: 1515631 - RNA, 13 nt, Homo sapiens
acugguccauuuc

SEQ ID NO: 1515632 - RNA, 18 nt, Homo sapiens
acuguauauagaagucua

SEQ ID NO: 1515633 - RNA, 13 nt, Homo sapiens
acuguuacuuugg

SEQ ID NO: 1515634 - RNA, 13 nt, Homo sapiens
acuguuugcccca

SEQ ID NO: 1515635 - RNA, 22 nt, Homo sapiens
acuguuuuuauaugcacaugua

SEQ ID NO: 1515636 - RNA, 15 nt, Homo sapiens
acuuagaagcaucag

SEQ ID NO: 1515637 - RNA, 19 nt, Homo sapiens
acuuaguagcuaugugauu

SEQ ID NO: 1515638 - RNA, 13 nt, Homo sapiens
acuucaaauugca

SEQ ID NO: 1515639 - RNA, 19 nt, Homo sapiens
acuucaaguucucuugauu

SEQ ID NO: 1515640 - RNA, 14 nt, Homo sapiens
acuucacaauguau

SEQ ID NO: 1515641 - RNA, 17 nt, Homo sapiens
acuucacuaaugacgau

SEQ ID NO: 1515642 - RNA, 15 nt, Homo sapiens
acuucagucuugccu

SEQ ID NO: 1515643 - RNA, 18 nt, Homo sapiens
acuuccaugauacuuuaa

SEQ ID NO: 1515644 - RNA, 23 nt, Homo sapiens
acuuccugguugagcuucugcua

SEQ ID NO: 1515645 - RNA, 16 nt, Homo sapiens
acuugccacacacugu

SEQ ID NO: 1515646 - RNA, 13 nt, Homo sapiens
acuuggggaccag

SEQ ID NO: 1515647 - RNA, 17 nt, Homo sapiens
acuuggucuuacaucug

SEQ ID NO: 1515648 - RNA, 19 nt, Homo sapiens
acuuguugcugauucaaga

SEQ ID NO: 1515649 - RNA, 19 nt, Homo sapiens
acuuuaaagcguuugcaca

SEQ ID NO: 1515650 - RNA, 13 nt, Homo sapiens
acuuuaacccucu

SEQ ID NO: 1515651 - RNA, 15 nt, Homo sapiens
acuuuaccacuaugc

SEQ ID NO: 1515652 - RNA, 17 nt, Homo sapiens
acuuuaccacuaugcaa

SEQ ID NO: 1515653 - RNA, 13 nt, Homo sapiens
acuuucacuuuuu

SEQ ID NO: 1515654 - RNA, 23 nt, Homo sapiens
acuuucccagaaaaaaaaaaacu

SEQ ID NO: 1515655 - RNA, 20 nt, Homo sapiens
acuuuccccagaggaccaca

SEQ ID NO: 1515656 - RNA, 16 nt, Homo sapiens
acuuugaucucugcuu

SEQ ID NO: 1515657 - RNA, 16 nt, Homo sapiens
acuuuggcaauuuccu

SEQ ID NO: 1515658 - RNA, 12 nt, Homo sapiens
acuuuuuuacaa

SEQ ID NO: 1515659 - RNA, 20 nt, Homo sapiens
agaaaaacuacagcaucauu

SEQ ID NO: 1515660 - RNA, 15 nt, Homo sapiens
agaaaaucaguaauu

SEQ ID NO: 1515661 - RNA, 12 nt, Homo sapiens
agaaacacucaa

SEQ ID NO: 1515662 - RNA, 20 nt, Homo sapiens
agaaaccaagagaaguuuug

SEQ ID NO: 1515663 - RNA, 15 nt, Homo sapiens
agaaagaaacacuca

SEQ ID NO: 1515664 - RNA, 19 nt, Homo sapiens
agaaagccuucauaagccu

SEQ ID NO: 1515665 - RNA, 21 nt, Homo sapiens
agaaagggcggugaacucugg

SEQ ID NO: 1515666 - RNA, 20 nt, Homo sapiens
agaaagucauagauuucuga

SEQ ID NO: 1515667 - RNA, 12 nt, Homo sapiens
agaaaguguuaa

SEQ ID NO: 1515668 - RNA, 17 nt, Homo sapiens
agaaauagacaguauau

SEQ ID NO: 1515669 - RNA, 14 nt, Homo sapiens
agaaauucuguggu

SEQ ID NO: 1515670 - RNA, 12 nt, Homo sapiens
agaacacugaga

SEQ ID NO: 1515671 - RNA, 21 nt, Homo sapiens
agaaccacuuggcugcucauu

SEQ ID NO: 1515672 - RNA, 15 nt, Homo sapiens
agaaccuaaaguagc

SEQ ID NO: 1515673 - RNA, 11 nt, Homo sapiens
agaaccucagg

SEQ ID NO: 1515674 - RNA, 13 nt, Homo sapiens
agaacuagguuua

SEQ ID NO: 1515675 - RNA, 19 nt, Homo sapiens
agaacugaacuuauuaccu

SEQ ID NO: 1515676 - RNA, 16 nt, Homo sapiens
agaagaggcuggugcu

SEQ ID NO: 1515677 - RNA, 18 nt, Homo sapiens
agaagcaaaccugauaca

SEQ ID NO: 1515678 - RNA, 16 nt, Homo sapiens
agaaggccucacucaa

SEQ ID NO: 1515679 - RNA, 22 nt, Homo sapiens
agaaggguuuuccacccuggaa

SEQ ID NO: 1515680 - RNA, 17 nt, Homo sapiens
agaaguaaaagcuaauu

SEQ ID NO: 1515681 - RNA, 18 nt, Homo sapiens
agaaguggggcucuggga

SEQ ID NO: 1515682 - RNA, 16 nt, Homo sapiens
agaauaaugccuugua

SEQ ID NO: 1515683 - RNA, 13 nt, Homo sapiens
agaauagugcauu

SEQ ID NO: 1515684 - RNA, 22 nt, Homo sapiens
agaauauggacuuaaauguuaa

SEQ ID NO: 1515685 - RNA, 22 nt, Homo sapiens
agaauccacaaagccgugccuu

SEQ ID NO: 1515686 - RNA, 19 nt, Homo sapiens
agaaucgcuuaaacccagg

SEQ ID NO: 1515687 - RNA, 16 nt, Homo sapiens
agaaugggccacugua

SEQ ID NO: 1515688 - RNA, 18 nt, Homo sapiens
agaaugggccacuguagg

SEQ ID NO: 1515689 - RNA, 19 nt, Homo sapiens
agaauguuaaaaagugaaa

SEQ ID NO: 1515690 - RNA, 13 nt, Homo sapiens
agaauuguaucau

SEQ ID NO: 1515691 - RNA, 17 nt, Homo sapiens
agaauuguccaugugcu

SEQ ID NO: 1515692 - RNA, 20 nt, Homo sapiens
agacaagaaggccacuggua

SEQ ID NO: 1515693 - RNA, 13 nt, Homo sapiens
agacacaagguga

SEQ ID NO: 1515694 - RNA, 15 nt, Homo sapiens
agacacgcucuucua

SEQ ID NO: 1515695 - RNA, 13 nt, Homo sapiens
agacagagacaau

SEQ ID NO: 1515696 - RNA, 21 nt, Homo sapiens
agacagcacuacagauaucau

SEQ ID NO: 1515697 - RNA, 18 nt, Homo sapiens
agacaggucuagacuuuc

SEQ ID NO: 1515698 - RNA, 21 nt, Homo sapiens
agacauaaguaaaugagccuu

SEQ ID NO: 1515699 - RNA, 17 nt, Homo sapiens
agacauuaaaccuggau

SEQ ID NO: 1515700 - RNA, 13 nt, Homo sapiens
agaccaccucuca

SEQ ID NO: 1515701 - RNA, 24 nt, Homo sapiens
agaccagccugaccaacaugguga

SEQ ID NO: 1515702 - RNA, 22 nt, Homo sapiens
agacccaacuuucucacugcug

SEQ ID NO: 1515703 - RNA, 23 nt, Homo sapiens
agagcuaagagcaguacucugaa

SEQ ID NO: 1515704 - RNA, 23 nt, Homo sapiens
agagcuauggugagguguggaua

SEQ ID NO: 1515705 - RNA, 18 nt, Homo sapiens
agagcugauggagaagga

SEQ ID NO: 1515706 - RNA, 13 nt, Homo sapiens
agaggaagcacau

SEQ ID NO: 1515707 - RNA, 14 nt, Homo sapiens
agagggcccaggca

SEQ ID NO: 1515708 - RNA, 18 nt, Homo sapiens
agagguagcgagcugcuc

SEQ ID NO: 1515709 - RNA, 19 nt, Homo sapiens
agaggugacaguggaugac

SEQ ID NO: 1515710 - RNA, 20 nt, Homo sapiens
agaggugacccaaugcuccu

SEQ ID NO: 1515711 - RNA, 17 nt, Homo sapiens
agaguccuuucaggaag

SEQ ID NO: 1515712 - RNA, 19 nt, Homo sapiens
agagugagacucgucucaa

SEQ ID NO: 1515713 - RNA, 10 nt, Homo sapiens
agagugccac

SEQ ID NO: 1515714 - RNA, 13 nt, Homo sapiens
agaguuuagcacg

SEQ ID NO: 1515715 - RNA, 17 nt, Homo sapiens
agauacauacagaauua

SEQ ID NO: 1515716 - RNA, 12 nt, Homo sapiens
agauaguaucuu

SEQ ID NO: 1515717 - RNA, 18 nt, Homo sapiens
agauauaaaauaggcuua

SEQ ID NO: 1515718 - RNA, 17 nt, Homo sapiens
agauaucaguuaucaau

SEQ ID NO: 1515719 - RNA, 17 nt, Homo sapiens
agauauuauucauucau

SEQ ID NO: 1515720 - RNA, 18 nt, Homo sapiens
agaucaacauuccagggu

SEQ ID NO: 1515721 - RNA, 17 nt, Homo sapiens
agaucauuuucuuaucu

SEQ ID NO: 1515722 - RNA, 16 nt, Homo sapiens
agauccuacucuuccu

SEQ ID NO: 1515723 - RNA, 15 nt, Homo sapiens
agaucuucaugguga

SEQ ID NO: 1515724 - RNA, 19 nt, Homo sapiens
agaugauuaaacagacuuu

SEQ ID NO: 1515725 - RNA, 17 nt, Homo sapiens
agaugauuuuccucccu

SEQ ID NO: 1515726 - RNA, 20 nt, Homo sapiens
agaugccuuccugucuuucu

SEQ ID NO: 1515727 - RNA, 17 nt, Homo sapiens
agauggaauaaagcccu

SEQ ID NO: 1515728 - RNA, 15 nt, Homo sapiens
agauguaaaugccac

SEQ ID NO: 1515729 - RNA, 13 nt, Homo sapiens
agaugucauuaca

SEQ ID NO: 1515730 - RNA, 14 nt, Homo sapiens
agaugucauuacaa

SEQ ID NO: 1515731 - RNA, 22 nt, Homo sapiens
agauguuacugugugaagaaua

SEQ ID NO: 1515732 - RNA, 16 nt, Homo sapiens
agauguuuuccauuug

SEQ ID NO: 1515733 - RNA, 22 nt, Homo sapiens
agauugagaagccauguacuca

SEQ ID NO: 1515734 - RNA, 15 nt, Homo sapiens
agauugcaccacugc

SEQ ID NO: 1515735 - RNA, 20 nt, Homo sapiens
agauuuaaaaaccaacuuau

SEQ ID NO: 1515736 - RNA, 14 nt, Homo sapiens
agauuuaacacuaa

SEQ ID NO: 1515737 - RNA, 15 nt, Homo sapiens
agauuuaacacuaaa

SEQ ID NO: 1515738 - RNA, 16 nt, Homo sapiens
agauuucaacauauca

SEQ ID NO: 1515739 - RNA, 18 nt, Homo sapiens
agauuuugucgggacaga

SEQ ID NO: 1515740 - RNA, 18 nt, Homo sapiens
agcaacuggugacugucc

SEQ ID NO: 1515741 - RNA, 22 nt, Homo sapiens
agcaacuggugacugucccuuc

SEQ ID NO: 1515742 - RNA, 18 nt, Homo sapiens
agcaagacuccauuucaa

SEQ ID NO: 1515743 - RNA, 18 nt, Homo sapiens
agcaaggacaaccugccc

SEQ ID NO: 1515744 - RNA, 23 nt, Homo sapiens
agcacaaaggaaaacucuuggcc

SEQ ID NO: 1515745 - RNA, 16 nt, Homo sapiens
agcacugcuccagugg

SEQ ID NO: 1515746 - RNA, 22 nt, Homo sapiens
agcagaaaccaagucuacuuca

SEQ ID NO: 1515747 - RNA, 15 nt, Homo sapiens
agcagaccgugauuu

SEQ ID NO: 1515748 - RNA, 16 nt, Homo sapiens
agcagagcuuccucag

SEQ ID NO: 1515749 - RNA, 21 nt, Homo sapiens
agcagcuucaguuguuuuccc

SEQ ID NO: 1515750 - RNA, 14 nt, Homo sapiens
agcagggcucugcc

SEQ ID NO: 1515751 - RNA, 19 nt, Homo sapiens
agcaggugguccugagacc

SEQ ID NO: 1515752 - RNA, 19 nt, Homo sapiens
agcagguuaccacucuggc

SEQ ID NO: 1515753 - RNA, 21 nt, Homo sapiens
agcagugugucaggugcugca

SEQ ID NO: 1515754 - RNA, 14 nt, Homo sapiens
agcauaugaaacca

SEQ ID NO: 1515755 - RNA, 16 nt, Homo sapiens
agcaucaccucaggcc

SEQ ID NO: 1515756 - RNA, 19 nt, Homo sapiens
agcauuuacuaugccacag

SEQ ID NO: 1515757 - RNA, 14 nt, Homo sapiens
agcauuuucuugaa

SEQ ID NO: 1515758 - RNA, 21 nt, Homo sapiens
agcauuuucuugaaccaauaa

SEQ ID NO: 1515759 - RNA, 17 nt, Homo sapiens
agccacccugcccaguc

SEQ ID NO: 1515760 - RNA, 17 nt, Homo sapiens
agccagcaguuguaaaa

SEQ ID NO: 1515761 - RNA, 11 nt, Homo sapiens
agccauaugca

SEQ ID NO: 1515762 - RNA, 13 nt, Homo sapiens
agccauaugcaau

SEQ ID NO: 1515763 - RNA, 14 nt, Homo sapiens
agccauaugcaaua

SEQ ID NO: 1515764 - RNA, 18 nt, Homo sapiens
agccauauucacaccuca

SEQ ID NO: 1515765 - RNA, 21 nt, Homo sapiens
agccauuauucucugaugcac

SEQ ID NO: 1515766 - RNA, 21 nt, Homo sapiens
agccauuuccauggcucuguu

SEQ ID NO: 1515767 - RNA, 22 nt, Homo sapiens
agccauuuguuggggcaguggu

SEQ ID NO: 1515768 - RNA, 20 nt, Homo sapiens
agcccaacagacaccaucuu

SEQ ID NO: 1515769 - RNA, 22 nt, Homo sapiens
agcccauuggcucccaucugaa

SEQ ID NO: 1515770 - RNA, 13 nt, Homo sapiens
agcccucacagcu

SEQ ID NO: 1515771 - RNA, 20 nt, Homo sapiens
agccgacaccuuuuuucaac

SEQ ID NO: 1515772 - RNA, 19 nt, Homo sapiens
agccuaacaugauuauuug

SEQ ID NO: 1515773 - RNA, 18 nt, Homo sapiens
agccuagcccacuuguca

SEQ ID NO: 1515774 - RNA, 17 nt, Homo sapiens
agccucccaaguagcug

SEQ ID NO: 1515775 - RNA, 17 nt, Homo sapiens
agccucccucugaccug

SEQ ID NO: 1515776 - RNA, 14 nt, Homo sapiens
agccucugcugcca

SEQ ID NO: 1515777 - RNA, 22 nt, Homo sapiens
agccugauuauccuauaggcag

SEQ ID NO: 1515778 - RNA, 20 nt, Homo sapiens
agccuggcccuuaaacaacu

SEQ ID NO: 1515779 - RNA, 16 nt, Homo sapiens
agccugugcuaaagaa

SEQ ID NO: 1515780 - RNA, 17 nt, Homo sapiens
agccuucaagugccaaa

SEQ ID NO: 1515781 - RNA, 16 nt, Homo sapiens
agcgagcuaugaucgc

SEQ ID NO: 1515782 - RNA, 19 nt, Homo sapiens
agcgcagguuuaguuuacu

SEQ ID NO: 1515783 - RNA, 14 nt, Homo sapiens
agcgcuuucuggaa

SEQ ID NO: 1515784 - RNA, 18 nt, Homo sapiens
agcgguugcuucuggcuc

SEQ ID NO: 1515785 - RNA, 15 nt, Homo sapiens
agcgugaaagcagau

SEQ ID NO: 1515786 - RNA, 20 nt, Homo sapiens
agcuaugaucgcgccacuac

SEQ ID NO: 1515787 - RNA, 18 nt, Homo sapiens
agcucaggcccuggugag

SEQ ID NO: 1515788 - RNA, 14 nt, Homo sapiens
agcuccaguuucca

SEQ ID NO: 1515789 - RNA, 22 nt, Homo sapiens
agcuccaguuuccaaguuccug

SEQ ID NO: 1515790 - RNA, 19 nt, Homo sapiens
agcucuuuguucaguugac

SEQ ID NO: 1515791 - RNA, 13 nt, Homo sapiens
agcugacuguucu

SEQ ID NO: 1515792 - RNA, 16 nt, Homo sapiens
agcugagugcacuccu

SEQ ID NO: 1515793 - RNA, 18 nt, Homo sapiens
agcugaguuuaacaugug

SEQ ID NO: 1515794 - RNA, 13 nt, Homo sapiens
agcugcugucacu

SEQ ID NO: 1515795 - RNA, 16 nt, Homo sapiens
agcugcugucacuaga

SEQ ID NO: 1515796 - RNA, 20 nt, Homo sapiens
agcuggaaauaaaccuggag

SEQ ID NO: 1515797 - RNA, 14 nt, Homo sapiens
agcuggaagcacau

SEQ ID NO: 1515798 - RNA, 18 nt, Homo sapiens
agcugguaaacuauuugu

SEQ ID NO: 1515799 - RNA, 15 nt, Homo sapiens
agcugucgcaucuca

SEQ ID NO: 1515800 - RNA, 16 nt, Homo sapiens
agcuuaaaacaagcaa

SEQ ID NO: 1515801 - RNA, 21 nt, Homo sapiens
agcuucagaaguuuggcaaua

SEQ ID NO: 1515802 - RNA, 20 nt, Homo sapiens
agcuuccccaggagcucucu

SEQ ID NO: 1515803 - RNA, 22 nt, Homo sapiens
agcuuccccaggagcucucugc

SEQ ID NO: 1515804 - RNA, 18 nt, Homo sapiens
aggaaaaaauaauaucca

SEQ ID NO: 1515805 - RNA, 15 nt, Homo sapiens
aggaaaaacaaacua

SEQ ID NO: 1515806 - RNA, 12 nt, Homo sapiens
aggaaaccaaag

SEQ ID NO: 1515807 - RNA, 22 nt, Homo sapiens
aggaaaccuggcauggugcuuu

SEQ ID NO: 1515808 - RNA, 20 nt, Homo sapiens
aggaaagaauuugccuucuc

SEQ ID NO: 1515809 - RNA, 12 nt, Homo sapiens
aggaaaugugug

SEQ ID NO: 1515810 - RNA, 16 nt, Homo sapiens
aggaacccagcucuca

SEQ ID NO: 1515811 - RNA, 12 nt, Homo sapiens
aggaacucuggc

SEQ ID NO: 1515812 - RNA, 16 nt, Homo sapiens
aggaagaaaucacuua

SEQ ID NO: 1515813 - RNA, 16 nt, Homo sapiens
auaacugguagcuaua

SEQ ID NO: 1515814 - RNA, 19 nt, Homo sapiens
auaagguaaaaugccauga

SEQ ID NO: 1515815 - RNA, 16 nt, Homo sapiens
auaaguaaacaacaua

SEQ ID NO: 1515816 - RNA, 18 nt, Homo sapiens
auaaguaaaugagccuuu

SEQ ID NO: 1515817 - RNA, 13 nt, Homo sapiens
auaaguauuucca

SEQ ID NO: 1515818 - RNA, 22 nt, Homo sapiens
auaaguauuuccauaacucaua

SEQ ID NO: 1515819 - RNA, 19 nt, Homo sapiens
auaauaaaggucacauaaa

SEQ ID NO: 1515820 - RNA, 23 nt, Homo sapiens
auaauaugugaugauuaauacaa

SEQ ID NO: 1515821 - RNA, 15 nt, Homo sapiens
auaaucccacccacc

SEQ ID NO: 1515822 - RNA, 13 nt, Homo sapiens
auaaucgcucuuu

SEQ ID NO: 1515823 - RNA, 13 nt, Homo sapiens
auaaugaauguca

SEQ ID NO: 1515824 - RNA, 14 nt, Homo sapiens
auaaugaaugucau

SEQ ID NO: 1515825 - RNA, 17 nt, Homo sapiens
auaaugaaugucaugca

SEQ ID NO: 1515826 - RNA, 12 nt, Homo sapiens
auaaugugauuu

SEQ ID NO: 1515827 - RNA, 15 nt, Homo sapiens
auaauuaaaaaccac

SEQ ID NO: 1515828 - RNA, 16 nt, Homo sapiens
auaauuaaaaaccacu

SEQ ID NO: 1515829 - RNA, 13 nt, Homo sapiens
auaauuaaugugu

SEQ ID NO: 1515830 - RNA, 17 nt, Homo sapiens
auaauuaucagucauga

SEQ ID NO: 1515831 - RNA, 14 nt, Homo sapiens
auaauugccaaaua

SEQ ID NO: 1515832 - RNA, 19 nt, Homo sapiens
auaauugcuuugccaaaau

SEQ ID NO: 1515833 - RNA, 17 nt, Homo sapiens
auacaaaaauacucaga

SEQ ID NO: 1515834 - RNA, 13 nt, Homo sapiens
gaagcucacccaa

SEQ ID NO: 1515835 - RNA, 20 nt, Homo sapiens
gaaggaacucuggcuuccag

SEQ ID NO: 1515836 - RNA, 15 nt, Homo sapiens
gaaggacacuuguau

SEQ ID NO: 1515837 - RNA, 23 nt, Homo sapiens
gaaggaugucccggguguguaca

SEQ ID NO: 1515838 - RNA, 21 nt, Homo sapiens
gaaggcccaggucaacaucua

SEQ ID NO: 1515839 - RNA, 19 nt, Homo sapiens
gaaguuaggucauuacuaa

SEQ ID NO: 1515840 - RNA, 16 nt, Homo sapiens
gaaguuaugcugucau

SEQ ID NO: 1515841 - RNA, 20 nt, Homo sapiens
gaaguuauuuagaaauaucc

SEQ ID NO: 1515842 - RNA, 14 nt, Homo sapiens
gaaguucacuuccc

SEQ ID NO: 1515843 - RNA, 16 nt, Homo sapiens
gaauaaaccauuuuua

SEQ ID NO: 1515844 - RNA, 19 nt, Homo sapiens
gaauaaaguacuacaucag

SEQ ID NO: 1515845 - RNA, 16 nt, Homo sapiens
gaauaaggauguuguu

SEQ ID NO: 1515846 - RNA, 12 nt, Homo sapiens
gaauaagucccu

SEQ ID NO: 1515847 - RNA, 19 nt, Homo sapiens
gcuaaaauugaacuacuug

SEQ ID NO: 1515848 - RNA, 22 nt, Homo sapiens
gcuacucucuugccagcauuuu

SEQ ID NO: 1515849 - RNA, 20 nt, Homo sapiens
gcuacugccgucagugcugu

SEQ ID NO: 1515850 - RNA, 23 nt, Homo sapiens
gcuacugccgucagugcugugcu

SEQ ID NO: 1515851 - RNA, 19 nt, Homo sapiens
gcuagagugcaguggcaug

SEQ ID NO: 1515852 - RNA, 17 nt, Homo sapiens
gcuaggguaggggcaag

SEQ ID NO: 1515853 - RNA, 19 nt, Homo sapiens
gcuagugcuguagaguuca

SEQ ID NO: 1515854 - RNA, 18 nt, Homo sapiens
gcuaguucguagcuuucc

SEQ ID NO: 1515855 - RNA, 23 nt, Homo sapiens
gcuaugguuuucuccaagagcua

SEQ ID NO: 1515856 - RNA, 18 nt, Homo sapiens
gcuauugugauaugacaa

SEQ ID NO: 1515857 - RNA, 17 nt, Homo sapiens
gcuauuucuaguagaaa

SEQ ID NO: 1515858 - RNA, 21 nt, Homo sapiens
gcucacccaagcaaggccaaa

SEQ ID NO: 1515859 - RNA, 22 nt, Homo sapiens
gcucagcaugcagaagugcaug

SEQ ID NO: 1515860 - RNA, 19 nt, Homo sapiens
gcucagcccugacuggugc

SEQ ID NO: 1515861 - RNA, 16 nt, Homo sapiens
gcucaugccuguaauc

SEQ ID NO: 1515862 - RNA, 17 nt, Homo sapiens
gcuccagaauaugcaua

SEQ ID NO: 1515863 - RNA, 17 nt, Homo sapiens
gcuccagaucugcacug

SEQ ID NO: 1515864 - RNA, 22 nt, Homo sapiens
gcuccaggaucuuugacugaaa

SEQ ID NO: 1515865 - RNA, 16 nt, Homo sapiens
gcuccaucuccagugg

SEQ ID NO: 1515866 - RNA, 22 nt, Homo sapiens
gcucccgagcuacucucuugcc

SEQ ID NO: 1515867 - RNA, 15 nt, Homo sapiens
gcuccugugcuacuu

SEQ ID NO: 1515868 - RNA, 19 nt, Homo sapiens
gcucucagaagguauuccu

SEQ ID NO: 1515869 - RNA, 14 nt, Homo sapiens
gcucugcaggcacc

SEQ ID NO: 1515870 - RNA, 18 nt, Homo sapiens
gcucuggaaaaugugacc

SEQ ID NO: 1515871 - RNA, 22 nt, Homo sapiens
gcucuggcaccacuaggguccu

SEQ ID NO: 1515872 - RNA, 15 nt, Homo sapiens
gcucuucacucagcc

SEQ ID NO: 1515873 - RNA, 18 nt, Homo sapiens
gcucuucuaccauuugaa

SEQ ID NO: 1515874 - RNA, 19 nt, Homo sapiens
gcucuucuaccauuugaau

SEQ ID NO: 1515875 - RNA, 15 nt, Homo sapiens
gcucuuuggggucag

SEQ ID NO: 1515876 - RNA, 13 nt, Homo sapiens
gcugaagucauug

SEQ ID NO: 1515877 - RNA, 13 nt, Homo sapiens
gcugacauggcuu

SEQ ID NO: 1515878 - RNA, 20 nt, Homo sapiens
gcugagaucacaccacugca

SEQ ID NO: 1515879 - RNA, 20 nt, Homo sapiens
gcugagaucacgccauugua

SEQ ID NO: 1515880 - RNA, 21 nt, Homo sapiens
gcugagugcacuccuggugau

SEQ ID NO: 1515881 - RNA, 13 nt, Homo sapiens
gcugaucaaugaa

SEQ ID NO: 1515882 - RNA, 19 nt, Homo sapiens
gcugauucaagaaacagaa

SEQ ID NO: 1515883 - RNA, 21 nt, Homo sapiens
gcugcacaucacaacauuuac

SEQ ID NO: 1515884 - RNA, 13 nt, Homo sapiens
gcugccuguggug

SEQ ID NO: 1515885 - RNA, 15 nt, Homo sapiens
gcugccuguggugag

SEQ ID NO: 1515886 - RNA, 16 nt, Homo sapiens
gcugcuccugagagag

SEQ ID NO: 1515887 - RNA, 13 nt, Homo sapiens
gcugcucugcuau

SEQ ID NO: 1515888 - RNA, 18 nt, Homo sapiens
gcugcugagaaucuagcc

SEQ ID NO: 1515889 - RNA, 20 nt, Homo sapiens
gcugcugagaaucuagccuc

SEQ ID NO: 1515890 - RNA, 13 nt, Homo sapiens
gcugcugcacugc

SEQ ID NO: 1515891 - RNA, 22 nt, Homo sapiens
gcugcuucuccucccagcgugu

SEQ ID NO: 1515892 - RNA, 12 nt, Homo sapiens
gcuggaagcaca

SEQ ID NO: 1515893 - RNA, 20 nt, Homo sapiens
gcuggaucuuuugguggagu

SEQ ID NO: 1515894 - RNA, 19 nt, Homo sapiens
gcuggcccgucauguuccu

SEQ ID NO: 1515895 - RNA, 14 nt, Homo sapiens
gcuggcugcaguga

SEQ ID NO: 1515896 - RNA, 15 nt, Homo sapiens
gcugggacuggccag

SEQ ID NO: 1515897 - RNA, 22 nt, Homo sapiens
gcugguacuaagaggcuauuua

SEQ ID NO: 1515898 - RNA, 21 nt, Homo sapiens
gcugguccuucucguuugcuc

SEQ ID NO: 1515899 - RNA, 20 nt, Homo sapiens
gcugugguuccuaagccugu

SEQ ID NO: 1515900 - RNA, 22 nt, Homo sapiens
gcuguuuccaguuguuacugaa

SEQ ID NO: 1515901 - RNA, 20 nt, Homo sapiens
gcuguuuuaaaaacaaagaa

SEQ ID NO: 1515902 - RNA, 14 nt, Homo sapiens
gcuuacuaaugugc

SEQ ID NO: 1515903 - RNA, 18 nt, Homo sapiens
gcuuagccuccugaccug

SEQ ID NO: 1515904 - RNA, 13 nt, Homo sapiens
gcuucagugcugc

SEQ ID NO: 1515905 - RNA, 16 nt, Homo sapiens
gcuucuggagcccuug

SEQ ID NO: 1515906 - RNA, 20 nt, Homo sapiens
gcuucugggccacucaggcc

SEQ ID NO: 1515907 - RNA, 14 nt, Homo sapiens
gcuuguaaaaccaa

SEQ ID NO: 1515908 - RNA, 22 nt, Homo sapiens
gcuuuagaguagauguuuggaa

SEQ ID NO: 1515909 - RNA, 18 nt, Homo sapiens
gcuuuaguaauguggauu

SEQ ID NO: 1515910 - RNA, 14 nt, Homo sapiens
gcuuucuagccuaa

SEQ ID NO: 1515911 - RNA, 19 nt, Homo sapiens
gcuuugcuuacaauggagu

SEQ ID NO: 1515912 - RNA, 20 nt, Homo sapiens
gcuuuggugagaaccugggu

SEQ ID NO: 1515913 - RNA, 14 nt, Homo sapiens
gcuuuuuaauugag

SEQ ID NO: 1515914 - RNA, 20 nt, Homo sapiens
ggaaaaagaaagaaacacuc

SEQ ID NO: 1515915 - RNA, 14 nt, Homo sapiens
ggaaaaaugcugcu

SEQ ID NO: 1515916 - RNA, 14 nt, Homo sapiens
ggaaaacucaggau

SEQ ID NO: 1515917 - RNA, 19 nt, Homo sapiens
ggaaaauaaauuauauuaa

SEQ ID NO: 1515918 - RNA, 12 nt, Homo sapiens
ggaaaaugugac

SEQ ID NO: 1515919 - RNA, 16 nt, Homo sapiens
ggaaagauuugugaac

SEQ ID NO: 1515920 - RNA, 22 nt, Homo sapiens
ggaaagcaucaccucaggccag

SEQ ID NO: 1515921 - RNA, 16 nt, Homo sapiens
ggaaauaaaccuggag

SEQ ID NO: 1515922 - RNA, 22 nt, Homo sapiens
ggaacacccgacuccucaaaag

SEQ ID NO: 1515923 - RNA, 21 nt, Homo sapiens
ggaacauuggagcugacuguu

SEQ ID NO: 1515924 - RNA, 17 nt, Homo sapiens
ggaaccaaaauguauaa

SEQ ID NO: 1515925 - RNA, 19 nt, Homo sapiens
ggaacucuggcuuccaggu

SEQ ID NO: 1515926 - RNA, 20 nt, Homo sapiens
ggaacucuggcuuccaggua

SEQ ID NO: 1515927 - RNA, 16 nt, Homo sapiens
ggaacugguucaagag

SEQ ID NO: 1515928 - RNA, 17 nt, Homo sapiens
ggaacugguucaagaga

SEQ ID NO: 1515929 - RNA, 11 nt, Homo sapiens
ggaagaagcaa

SEQ ID NO: 1515930 - RNA, 14 nt, Homo sapiens
ggaagacuugccac

SEQ ID NO: 1515931 - RNA, 20 nt, Homo sapiens
ggaagauacugacuagucau

SEQ ID NO: 1515932 - RNA, 15 nt, Homo sapiens
ggaagaugaaagagg

SEQ ID NO: 1515933 - RNA, 19 nt, Homo sapiens
ggaagcuuuguuugaaaau

SEQ ID NO: 1515934 - RNA, 14 nt, Homo sapiens
ggaauaaagcccuu

SEQ ID NO: 1515935 - RNA, 18 nt, Homo sapiens
ggaauucuuuacaauaaa

SEQ ID NO: 1515936 - RNA, 14 nt, Homo sapiens
ggacacacaucaaa

SEQ ID NO: 1515937 - RNA, 19 nt, Homo sapiens
ggacaccccuuauccagga

SEQ ID NO: 1515938 - RNA, 22 nt, Homo sapiens
ggacaggauguguuugcuuucu

SEQ ID NO: 1515939 - RNA, 12 nt, Homo sapiens
ggaccacuccag

SEQ ID NO: 1515940 - RNA, 22 nt, Homo sapiens
ggaccaggacuauagcccaggu

SEQ ID NO: 1515941 - RNA, 16 nt, Homo sapiens
ggacuauacauacuau

SEQ ID NO: 1515942 - RNA, 23 nt, Homo sapiens
ggagaaccucaggcuuccuuggc

SEQ ID NO: 1515943 - RNA, 24 nt, Homo sapiens
ggagaauuauauagguugugcaaa

SEQ ID NO: 1515944 - RNA, 13 nt, Homo sapiens
ggagagaaguuuc

SEQ ID NO: 1515945 - RNA, 12 nt, Homo sapiens
ggagcuugccug

SEQ ID NO: 1515946 - RNA, 14 nt, Homo sapiens
ggagucugcaguga

SEQ ID NO: 1515947 - RNA, 17 nt, Homo sapiens
ggagucuuguacacuua

SEQ ID NO: 1515948 - RNA, 20 nt, Homo sapiens
ggagugacggucccacacug

SEQ ID NO: 1515949 - RNA, 23 nt, Homo sapiens
ggaguuccucuaacauuugcaaa

SEQ ID NO: 1515950 - RNA, 13 nt, Homo sapiens
ggauauuuacuac

SEQ ID NO: 1515951 - RNA, 21 nt, Homo sapiens
ggauccuauucucaccaggaa

SEQ ID NO: 1515952 - RNA, 19 nt, Homo sapiens
ggaucuccaaggaccaggu

SEQ ID NO: 1515953 - RNA, 18 nt, Homo sapiens
ggaugaugaaacauucau

SEQ ID NO: 1515954 - RNA, 20 nt, Homo sapiens
ggauuaaugguccugugaug

SEQ ID NO: 1515955 - RNA, 15 nt, Homo sapiens
ggauuuauauucaag

SEQ ID NO: 1515956 - RNA, 23 nt, Homo sapiens
ggcaaggaaacucgaauaaagga

SEQ ID NO: 1515957 - RNA, 15 nt, Homo sapiens
ggcaagggguuucca

SEQ ID NO: 1515958 - RNA, 13 nt, Homo sapiens
ggcagagcacagc

SEQ ID NO: 1515959 - RNA, 13 nt, Homo sapiens
ggcagagccuuug

SEQ ID NO: 1515960 - RNA, 16 nt, Homo sapiens
uugaaagaaaguguua

SEQ ID NO: 1515961 - RNA, 12 nt, Homo sapiens
uugaaaguaaaa

SEQ ID NO: 1515962 - RNA, 20 nt, Homo sapiens
uugaaaugagaaacuuugau

SEQ ID NO: 1515963 - RNA, 23 nt, Homo sapiens
uugaaaugagaaacuuugaucuc

SEQ ID NO: 1515964 - RNA, 23 nt, Homo sapiens
uugaacaacuaggcuucagcaua

SEQ ID NO: 1515965 - RNA, 21 nt, Homo sapiens
uugaaccuugguaaauuguaa

SEQ ID NO: 1515966 - RNA, 15 nt, Homo sapiens
uugaacuacuuggga

SEQ ID NO: 1515967 - RNA, 14 nt, Homo sapiens
uugaagaaaagcac

SEQ ID NO: 1515968 - RNA, 14 nt, Homo sapiens
uugaagaaucucuc

SEQ ID NO: 1515969 - RNA, 21 nt, Homo sapiens
uugaagaucccuauuauggga

SEQ ID NO: 1515970 - RNA, 23 nt, Homo sapiens
uugaaggcccaggucaacaucua

SEQ ID NO: 1515971 - RNA, 19 nt, Homo sapiens
uugaauguuuauguucuca

SEQ ID NO: 1515972 - RNA, 15 nt, Homo sapiens
uugacuucucuugaa

SEQ ID NO: 1515973 - RNA, 21 nt, Homo sapiens
uugagcaaaccacauaaucuc

SEQ ID NO: 1515974 - RNA, 20 nt, Homo sapiens
uugagcaucacagaauguga

SEQ ID NO: 1515975 - RNA, 18 nt, Homo sapiens
uugagccaagaccaaguc

SEQ ID NO: 1515976 - RNA, 17 nt, Homo sapiens
uugaggacacaugucca

SEQ ID NO: 1515977 - RNA, 18 nt, Homo sapiens
uugaggaguuguaccucc

SEQ ID NO: 1515978 - RNA, 15 nt, Homo sapiens
uugcaaaaacuacaa

SEQ ID NO: 1515979 - RNA, 23 nt, Homo sapiens
uugcaaaaauuauaaaguaauuu

SEQ ID NO: 1515980 - RNA, 16 nt, Homo sapiens
uugcaaugcaagcccu

SEQ ID NO: 1515981 - RNA, 11 nt, Homo sapiens
uugcacuuugu

SEQ ID NO: 1515982 - RNA, 16 nt, Homo sapiens
uugccacaacccuguu

SEQ ID NO: 1515983 - RNA, 19 nt, Homo sapiens
uugcccccuccccacuuuu

SEQ ID NO: 1515984 - RNA, 16 nt, Homo sapiens
uugccgccccgugccu

SEQ ID NO: 1515985 - RNA, 19 nt, Homo sapiens
uugccgccccgugccugua

SEQ ID NO: 1515986 - RNA, 16 nt, Homo sapiens
uuggaaagguuucaag

SEQ ID NO: 1515987 - RNA, 18 nt, Homo sapiens
uuggaaaguucagccaga

SEQ ID NO: 1515988 - RNA, 21 nt, Homo sapiens
uugggaugagaaugaaagcuu

SEQ ID NO: 1515989 - RNA, 13 nt, Homo sapiens
uugguauauuucc

SEQ ID NO: 1515990 - RNA, 23 nt, Homo sapiens
uuguaaacagcuaauaaugaagu

SEQ ID NO: 1515991 - RNA, 23 nt, Homo sapiens
uuguaaucauguuaccauuacaa

SEQ ID NO: 1515992 - RNA, 12 nt, Homo sapiens
uuguauugcaag

SEQ ID NO: 1515993 - RNA, 11 nt, Homo sapiens
uugucaugaau

SEQ ID NO: 1515994 - RNA, 20 nt, Homo sapiens
uugucauuauguacaauaca

SEQ ID NO: 1515995 - RNA, 22 nt, Homo sapiens
uugucuagaggugagaccaaag

SEQ ID NO: 1515996 - RNA, 12 nt, Homo sapiens
uugugaacugga

SEQ ID NO: 1515997 - RNA, 12 nt, Homo sapiens
uuguuagcuuuu

SEQ ID NO: 1515998 - RNA, 14 nt, Homo sapiens
uuguuaguaaacau

SEQ ID NO: 1515999 - RNA, 21 nt, Homo sapiens
uuguuuccuccuugucacuga

SEQ ID NO: 1516000 - RNA, 14 nt, Homo sapiens
uuguuuuauauucu

SEQ ID NO: 1516001 - RNA, 14 nt, Homo sapiens
uuuaaaauagcaaa

SEQ ID NO: 1516002 - RNA, 18 nt, Homo sapiens
uuuaaacuauaagcaaga

SEQ ID NO: 1516003 - RNA, 17 nt, Homo sapiens
uuuaacauucacagccc

SEQ ID NO: 1516004 - RNA, 18 nt, Homo sapiens
uuuaacugugaaccugga

SEQ ID NO: 1516005 - RNA, 16 nt, Homo sapiens
uuuaacuugaggguaa

SEQ ID NO: 1516006 - RNA, 17 nt, Homo sapiens
uuuaauaaaaguacuga

SEQ ID NO: 1516007 - RNA, 12 nt, Homo sapiens
uuuaauagcaaa

SEQ ID NO: 1516008 - RNA, 19 nt, Homo sapiens
uuuaauuaacuaugugaug

SEQ ID NO: 1516009 - RNA, 17 nt, Homo sapiens
uuuacucaucaggucau

SEQ ID NO: 1516010 - RNA, 16 nt, Homo sapiens
uuuacuuccaugauac

SEQ ID NO: 1516011 - RNA, 17 nt, Homo sapiens
uuuagaacuguauguca

SEQ ID NO: 1516012 - RNA, 19 nt, Homo sapiens
uuuagagauggggucuugc

SEQ ID NO: 1516013 - RNA, 19 nt, Homo sapiens
uuuaggaagcaagcuuaau

SEQ ID NO: 1516014 - RNA, 12 nt, Homo sapiens
uuuauacuuugc

SEQ ID NO: 1516015 - RNA, 15 nt, Homo sapiens
uuuauacuuugcaau

SEQ ID NO: 1516016 - RNA, 13 nt, Homo sapiens
ccuccaaaugcca

SEQ ID NO: 1516017 - RNA, 19 nt, Homo sapiens
ccuccaacgauuagcuuuu

SEQ ID NO: 1516018 - RNA, 21 nt, Homo sapiens
ccuccuuuuuaauacauuaag

SEQ ID NO: 1516019 - RNA, 16 nt, Homo sapiens
ccucguagccaucucu

SEQ ID NO: 1516020 - RNA, 20 nt, Homo sapiens
ccucuccaggaaugccuccu

SEQ ID NO: 1516021 - RNA, 15 nt, Homo sapiens
ccucucccugccaag

SEQ ID NO: 1516022 - RNA, 19 nt, Homo sapiens
ccucugauacccagagcau

SEQ ID NO: 1516023 - RNA, 21 nt, Homo sapiens
ccucugcaaaaagauuuaaca

SEQ ID NO: 1516024 - RNA, 14 nt, Homo sapiens
ccucugcagcacuu

SEQ ID NO: 1516025 - RNA, 14 nt, Homo sapiens
ccucugcugccaug

SEQ ID NO: 1516026 - RNA, 22 nt, Homo sapiens
ccucugucaaugaaaaaaagua

SEQ ID NO: 1516027 - RNA, 18 nt, Homo sapiens
ccucuguugccaggcuag

SEQ ID NO: 1516028 - RNA, 15 nt, Homo sapiens
ccucuucccucugau

SEQ ID NO: 1516029 - RNA, 15 nt, Homo sapiens
ccucuuucuacauuc

SEQ ID NO: 1516030 - RNA, 19 nt, Homo sapiens
ccugaccaacauggugaaa

SEQ ID NO: 1516031 - RNA, 12 nt, Homo sapiens
ccugaccuguca

SEQ ID NO: 1516032 - RNA, 16 nt, Homo sapiens
ccugaccuugugaucu

SEQ ID NO: 1516033 - RNA, 14 nt, Homo sapiens
ccugaguuucucuc

SEQ ID NO: 1516034 - RNA, 13 nt, Homo sapiens
ccugauaagcaaa

SEQ ID NO: 1516035 - RNA, 21 nt, Homo sapiens
ccugaugacagagcgagauuc

SEQ ID NO: 1516036 - RNA, 24 nt, Homo sapiens
ccugcaccgagagagauggaauaa

SEQ ID NO: 1516037 - RNA, 17 nt, Homo sapiens
ccugccacccauuccau

SEQ ID NO: 1516038 - RNA, 10 nt, Homo sapiens
ccugccauuc

SEQ ID NO: 1516039 - RNA, 13 nt, Homo sapiens
ccugccucaggcu

SEQ ID NO: 1516040 - RNA, 17 nt, Homo sapiens
ccugccucucugcucca

SEQ ID NO: 1516041 - RNA, 21 nt, Homo sapiens
ccugcggcugcugugugccuu

SEQ ID NO: 1516042 - RNA, 23 nt, Homo sapiens
ccugcgugccgggagaggacucu

SEQ ID NO: 1516043 - RNA, 14 nt, Homo sapiens
ccugcuacacaaaa

SEQ ID NO: 1516044 - RNA, 23 nt, Homo sapiens
ccugcuggaaaccacacuucuug

SEQ ID NO: 1516045 - RNA, 16 nt, Homo sapiens
ccugcuugcacuuugu

SEQ ID NO: 1516046 - RNA, 21 nt, Homo sapiens
ccuggagugcucaauuggaag

SEQ ID NO: 1516047 - RNA, 20 nt, Homo sapiens
ccuggcaaggcauuccucau

SEQ ID NO: 1516048 - RNA, 13 nt, Homo sapiens
ccuggcaugucag

SEQ ID NO: 1516049 - RNA, 16 nt, Homo sapiens
ccugggugacgguccu

SEQ ID NO: 1516050 - RNA, 20 nt, Homo sapiens
ccugguggaggcuucuugcc

SEQ ID NO: 1516051 - RNA, 23 nt, Homo sapiens
ccugguuuucucuuacugcagua

SEQ ID NO: 1516052 - RNA, 23 nt, Homo sapiens
ccuguagcaaccuucugcauuca

SEQ ID NO: 1516053 - RNA, 22 nt, Homo sapiens
ccugucauccccuacacuuugg

SEQ ID NO: 1516054 - RNA, 13 nt, Homo sapiens
ccugugacuggca

SEQ ID NO: 1516055 - RNA, 23 nt, Homo sapiens
ccugugaugcuuugaaguacaau

SEQ ID NO: 1516056 - RNA, 21 nt, Homo sapiens
ccuguggggccugauggugcu

SEQ ID NO: 1516057 - RNA, 22 nt, Homo sapiens
ccuuaaaaaucaagacacuagu

SEQ ID NO: 1516058 - RNA, 14 nt, Homo sapiens
ccuuacucaccucu

SEQ ID NO: 1516059 - RNA, 13 nt, Homo sapiens
ccuucaagugcca

SEQ ID NO: 1516060 - RNA, 20 nt, Homo sapiens
ccuucaaguuagcucaggag

SEQ ID NO: 1516061 - RNA, 12 nt, Homo sapiens
ccuucucaaaag

SEQ ID NO: 1516062 - RNA, 15 nt, Homo sapiens
ccuucuuucucuucc

SEQ ID NO: 1516063 - RNA, 22 nt, Homo sapiens
ccuucuuuucaaaacugcuaaa

SEQ ID NO: 1516064 - RNA, 11 nt, Homo sapiens
ccuugaaccag

SEQ ID NO: 1516065 - RNA, 19 nt, Homo sapiens
ccuugaaggucacucuucc

SEQ ID NO: 1516066 - RNA, 20 nt, Homo sapiens
ccuugcaucaagggcuuuau

SEQ ID NO: 1516067 - RNA, 17 nt, Homo sapiens
ccuugguaauuauaucu

SEQ ID NO: 1516068 - RNA, 16 nt, Homo sapiens
ccuuucuucaccaaau

SEQ ID NO: 1516069 - RNA, 22 nt, Homo sapiens
ccuuugcaggcccagcagacuu

SEQ ID NO: 1516070 - RNA, 18 nt, Homo sapiens
ccuuuggaacaauuauuu

SEQ ID NO: 1516071 - RNA, 21 nt, Homo sapiens
cgaauaaaggaugggaccaac

SEQ ID NO: 1516072 - RNA, 22 nt, Homo sapiens
cgacaaagccaaacucugccag

SEQ ID NO: 1516073 - RNA, 18 nt, Homo sapiens
cgaccugcggcugcugug

SEQ ID NO: 1516074 - RNA, 18 nt, Homo sapiens
cgacuaacagcugaagua

SEQ ID NO: 1516075 - RNA, 17 nt, Homo sapiens
cgagaucacgccacugc

SEQ ID NO: 1516076 - RNA, 13 nt, Homo sapiens
cgagggagcugcu

SEQ ID NO: 1516077 - RNA, 16 nt, Homo sapiens
cgaguuuacuucauga

SEQ ID NO: 1516078 - RNA, 20 nt, Homo sapiens
cgcaaagggcugaaagccau

SEQ ID NO: 1516079 - RNA, 12 nt, Homo sapiens
cgcagauguuac

SEQ ID NO: 1516080 - RNA, 14 nt, Homo sapiens
cgcaucauaugcag

SEQ ID NO: 1516081 - RNA, 18 nt, Homo sapiens
cgccaacugcugaucaau

SEQ ID NO: 1516082 - RNA, 20 nt, Homo sapiens
cgccagacagauugcugaua

SEQ ID NO: 1516083 - RNA, 21 nt, Homo sapiens
cgccuaugaucccagcacuuu

SEQ ID NO: 1516084 - RNA, 17 nt, Homo sapiens
cgcgcagcgcgugcaca

SEQ ID NO: 1516085 - RNA, 16 nt, Homo sapiens
cgcugccugcucugcg

SEQ ID NO: 1516086 - RNA, 16 nt, Homo sapiens
cggaagccaacuuggc

SEQ ID NO: 1516087 - RNA, 15 nt, Homo sapiens
cggaggcggcuccag

SEQ ID NO: 1516088 - RNA, 21 nt, Homo sapiens
cgggaagcgaugaauuuggag

SEQ ID NO: 1516089 - RNA, 18 nt, Homo sapiens
cggggcuaggguaggggc

SEQ ID NO: 1516090 - RNA, 17 nt, Homo sapiens
cggucccacacugguga

SEQ ID NO: 1516091 - RNA, 22 nt, Homo sapiens
cggugcuugauagaaaugccaa

SEQ ID NO: 1516092 - RNA, 18 nt, Homo sapiens
cguagcuuucccaaauaa

SEQ ID NO: 1516093 - RNA, 16 nt, Homo sapiens
cgucagaccaguacug

SEQ ID NO: 1516094 - RNA, 14 nt, Homo sapiens
cgucucaagacuga

SEQ ID NO: 1516095 - RNA, 19 nt, Homo sapiens
cgucugggguggcucugca

SEQ ID NO: 1516096 - RNA, 14 nt, Homo sapiens
cgugaccagugcug

SEQ ID NO: 1516097 - RNA, 19 nt, Homo sapiens
cgugcugcaugccuggucu

SEQ ID NO: 1516098 - RNA, 20 nt, Homo sapiens
cguguccucucccugccaag

SEQ ID NO: 1516099 - RNA, 21 nt, Homo sapiens
cguguguauuagaaugcaugu

SEQ ID NO: 1516100 - RNA, 15 nt, Homo sapiens
cuaaaacugcugaac

SEQ ID NO: 1516101 - RNA, 20 nt, Homo sapiens
cuaaagaaaaacuaauguca

SEQ ID NO: 1516102 - RNA, 13 nt, Homo sapiens
cuaaagagcuuua

SEQ ID NO: 1516103 - RNA, 19 nt, Homo sapiens
cuaaagggugcccacaaaa

SEQ ID NO: 1516104 - RNA, 23 nt, Homo sapiens
cuaacucuucuggaaaccaaaua

SEQ ID NO: 1516105 - RNA, 15 nt, Homo sapiens
cuaagaaagacauca

SEQ ID NO: 1516106 - RNA, 23 nt, Homo sapiens
cuaagaaaucauggcauucacac

SEQ ID NO: 1516107 - RNA, 14 nt, Homo sapiens
cuaagacccaaagu

SEQ ID NO: 1516108 - RNA, 12 nt, Homo sapiens
cuaagccuccuu

SEQ ID NO: 1516109 - RNA, 13 nt, Homo sapiens
cuaagccuguugc

SEQ ID NO: 1516110 - RNA, 22 nt, Homo sapiens
cuaagucaagaucaacauucca

SEQ ID NO: 1516111 - RNA, 12 nt, Homo sapiens
cuaagugacaca

SEQ ID NO: 1516112 - RNA, 18 nt, Homo sapiens
cuaauagaaccaagaauu

SEQ ID NO: 1516113 - RNA, 14 nt, Homo sapiens
cuaaucaguccuua

SEQ ID NO: 1516114 - RNA, 14 nt, Homo sapiens
cuaaugucagcaca

SEQ ID NO: 1516115 - RNA, 17 nt, Homo sapiens
cuaaugucagcacaugu

SEQ ID NO: 1516116 - RNA, 20 nt, Homo sapiens
cuaauguuaggucaagcuau

SEQ ID NO: 1516117 - RNA, 18 nt, Homo sapiens
cuaauucccagaguguga

SEQ ID NO: 1516118 - RNA, 20 nt, Homo sapiens
cuaauuccccuuccauuccc

SEQ ID NO: 1516119 - RNA, 21 nt, Homo sapiens
cuaauuccccuuccauuccca

SEQ ID NO: 1516120 - RNA, 18 nt, Homo sapiens
cuaauugaacaugcaauu

SEQ ID NO: 1516121 - RNA, 17 nt, Homo sapiens
cuaauuuuuuguuguuu

SEQ ID NO: 1516122 - RNA, 21 nt, Homo sapiens
cuacaagcauuugcccugugg

SEQ ID NO: 1516123 - RNA, 18 nt, Homo sapiens
cuacacaaaagccaaaag

SEQ ID NO: 1516124 - RNA, 14 nt, Homo sapiens
cuaccaauguagac

SEQ ID NO: 1516125 - RNA, 20 nt, Homo sapiens
cuacccaggaggcugaggca

SEQ ID NO: 1516126 - RNA, 13 nt, Homo sapiens
cuacucagcagua

SEQ ID NO: 1516127 - RNA, 18 nt, Homo sapiens
cuacugaacccagaguca

SEQ ID NO: 1516128 - RNA, 21 nt, Homo sapiens
cuacugauuuuuuaguuaaau

SEQ ID NO: 1516129 - RNA, 18 nt, Homo sapiens
cuacuuccucugcaaaaa

SEQ ID NO: 1516130 - RNA, 20 nt, Homo sapiens
cuagaaaccaccuggguuca

SEQ ID NO: 1516131 - RNA, 20 nt, Homo sapiens
cuagaaauaagcccaacaga

SEQ ID NO: 1516132 - RNA, 16 nt, Homo sapiens
cuagaaaucugccaau

SEQ ID NO: 1516133 - RNA, 15 nt, Homo sapiens
cuagauuagaagugu

SEQ ID NO: 1516134 - RNA, 15 nt, Homo sapiens
cuagcccacuuguca

SEQ ID NO: 1516135 - RNA, 12 nt, Homo sapiens
cuaggacauaua

SEQ ID NO: 1516136 - RNA, 15 nt, Homo sapiens
cuaggguaggggcaa

SEQ ID NO: 1516137 - RNA, 13 nt, Homo sapiens
cuagugaaugugc

SEQ ID NO: 1516138 - RNA, 20 nt, Homo sapiens
cuaguucagaggaagcacau

SEQ ID NO: 1516139 - RNA, 16 nt, Homo sapiens
cuaguugaacaucuca

SEQ ID NO: 1516140 - RNA, 22 nt, Homo sapiens
cuaguugaacaucucacuuugc

SEQ ID NO: 1516141 - RNA, 22 nt, Homo sapiens
cuauaggugacuuuugcaauuc

SEQ ID NO: 1516142 - RNA, 21 nt, Homo sapiens
cuauagucccagcuacucaga

SEQ ID NO: 1516143 - RNA, 23 nt, Homo sapiens
cuauaguuauuaaguucuuuaaa

SEQ ID NO: 1516144 - RNA, 17 nt, Homo sapiens
cuauauuggucauugcc

SEQ ID NO: 1516145 - RNA, 20 nt, Homo sapiens
cuaugaguuggacuucaguc

SEQ ID NO: 1516146 - RNA, 16 nt, Homo sapiens
cuauguaauguaaaua

SEQ ID NO: 1516147 - RNA, 20 nt, Homo sapiens
cuauguauggaugaaagcaa

SEQ ID NO: 1516148 - RNA, 23 nt, Homo sapiens
cuaugucgucguuuucaccagca

SEQ ID NO: 1516149 - RNA, 11 nt, Homo sapiens
cuauuacaugu

SEQ ID NO: 1516150 - RNA, 17 nt, Homo sapiens
cuggggaguuauaaaaa

SEQ ID NO: 1516151 - RNA, 18 nt, Homo sapiens
cuggggccaugggugcau

SEQ ID NO: 1516152 - RNA, 20 nt, Homo sapiens
cuggggucauauaaaauaua

SEQ ID NO: 1516153 - RNA, 22 nt, Homo sapiens
cuggguaagaagaaagcaaaag

SEQ ID NO: 1516154 - RNA, 23 nt, Homo sapiens
cuggguuuugucucugcaucuca

SEQ ID NO: 1516155 - RNA, 14 nt, Homo sapiens
cugguacaauccuu

SEQ ID NO: 1516156 - RNA, 15 nt, Homo sapiens
cugguccugcacugu

SEQ ID NO: 1516157 - RNA, 13 nt, Homo sapiens
cugguccuuccag

SEQ ID NO: 1516158 - RNA, 13 nt, Homo sapiens
cuggugccauuuc

SEQ ID NO: 1516159 - RNA, 17 nt, Homo sapiens
cuggugcuacuccaugc

SEQ ID NO: 1516160 - RNA, 12 nt, Homo sapiens
cugguggccgau

SEQ ID NO: 1516161 - RNA, 23 nt, Homo sapiens
cuguaaccgcuucuggggccaca

SEQ ID NO: 1516162 - RNA, 12 nt, Homo sapiens
cuguacacagaa

SEQ ID NO: 1516163 - RNA, 21 nt, Homo sapiens
cuguacccaauuuaauuccau

SEQ ID NO: 1516164 - RNA, 18 nt, Homo sapiens
cuguagguuaaaugcagg

SEQ ID NO: 1516165 - RNA, 13 nt, Homo sapiens
cuguagguuugua

SEQ ID NO: 1516166 - RNA, 20 nt, Homo sapiens
cugucacacuaaacuucuua

SEQ ID NO: 1516167 - RNA, 21 nt, Homo sapiens
cugucacuggcagagcacagc

SEQ ID NO: 1516168 - RNA, 12 nt, Homo sapiens
cugucccaaaga

SEQ ID NO: 1516169 - RNA, 14 nt, Homo sapiens
cugucugucugucu

SEQ ID NO: 1516170 - RNA, 16 nt, Homo sapiens
cugugaaauaccacaa

SEQ ID NO: 1516171 - RNA, 17 nt, Homo sapiens
cugugaaauaccacaag

SEQ ID NO: 1516172 - RNA, 16 nt, Homo sapiens
cugugacccaucugua

SEQ ID NO: 1516173 - RNA, 21 nt, Homo sapiens
cugugacugggaccugaauga

SEQ ID NO: 1516174 - RNA, 24 nt, Homo sapiens
cugugauuuuuuuuaaaugugcag

SEQ ID NO: 1516175 - RNA, 11 nt, Homo sapiens
cugugccuaac

SEQ ID NO: 1516176 - RNA, 19 nt, Homo sapiens
cugugcuauggugcucugu

SEQ ID NO: 1516177 - RNA, 16 nt, Homo sapiens
cugugcugugucugca

SEQ ID NO: 1516178 - RNA, 14 nt, Homo sapiens
cuguggccugggca

SEQ ID NO: 1516179 - RNA, 12 nt, Homo sapiens
cuguuaagcaau

SEQ ID NO: 1516180 - RNA, 22 nt, Homo sapiens
cuguucccaauauguagccuuu

SEQ ID NO: 1516181 - RNA, 14 nt, Homo sapiens
cuguugagugcaac

SEQ ID NO: 1516182 - RNA, 19 nt, Homo sapiens
cuguuggaaguucacugga

SEQ ID NO: 1516183 - RNA, 21 nt, Homo sapiens
cuguuuuuuuaagaaagugca

SEQ ID NO: 1516184 - RNA, 24 nt, Homo sapiens
cuuaaauuuuaagcuugaagauua

SEQ ID NO: 1516185 - RNA, 16 nt, Homo sapiens
cuuaagccuuuugcuc

SEQ ID NO: 1516186 - RNA, 21 nt, Homo sapiens
cuuaagccuuuugcucacaaa

SEQ ID NO: 1516187 - RNA, 18 nt, Homo sapiens
cuuaauagccauaugcaa

SEQ ID NO: 1516188 - RNA, 20 nt, Homo sapiens
cuuaaucaagaauauucaaa

SEQ ID NO: 1516189 - RNA, 11 nt, Homo sapiens
cuuacauggcc

SEQ ID NO: 1516190 - RNA, 18 nt, Homo sapiens
cuuacauggccacaaagg

SEQ ID NO: 1516191 - RNA, 15 nt, Homo sapiens
cuuaccaacuuucug

SEQ ID NO: 1516192 - RNA, 17 nt, Homo sapiens
cuuacuaaugugcccca

SEQ ID NO: 1516193 - RNA, 21 nt, Homo sapiens
cuuacugcaaccuuugccucc

SEQ ID NO: 1516194 - RNA, 21 nt, Homo sapiens
cuuagccccagggcacucaga

SEQ ID NO: 1516195 - RNA, 22 nt, Homo sapiens
cuuaggaacagcucuucacuca

SEQ ID NO: 1516196 - RNA, 19 nt, Homo sapiens
cuuaggaagaaaucacuua

SEQ ID NO: 1516197 - RNA, 23 nt, Homo sapiens
cuuagggcagucaguaguauucu

SEQ ID NO: 1516198 - RNA, 20 nt, Homo sapiens
cuuaugguaccagaugcagc

SEQ ID NO: 1516199 - RNA, 14 nt, Homo sapiens
cuucaaaucagaag

SEQ ID NO: 1516200 - RNA, 18 nt, Homo sapiens
cuucaaaugccugacuag

SEQ ID NO: 1516201 - RNA, 22 nt, Homo sapiens
cuucaaguucucuugauuucuu

SEQ ID NO: 1516202 - RNA, 16 nt, Homo sapiens
cuucagccaaacacaa

SEQ ID NO: 1516203 - RNA, 14 nt, Homo sapiens
cuucagugcugcuc

SEQ ID NO: 1516204 - RNA, 16 nt, Homo sapiens
cuucaugcccuucuga

SEQ ID NO: 1516205 - RNA, 17 nt, Homo sapiens
cuucauuuaacaaguaa

SEQ ID NO: 1516206 - RNA, 13 nt, Homo sapiens
cuuccaugauacu

SEQ ID NO: 1516207 - RNA, 16 nt, Homo sapiens
cuuccaugauacuuua

SEQ ID NO: 1516208 - RNA, 17 nt, Homo sapiens
cuuccaugauacuuuaa

SEQ ID NO: 1516209 - RNA, 18 nt, Homo sapiens
cuuccaugauacuuuaau

SEQ ID NO: 1516210 - RNA, 17 nt, Homo sapiens
cuuccccagacucagcu

SEQ ID NO: 1516211 - RNA, 12 nt, Homo sapiens
cuuccccugugg

SEQ ID NO: 1516212 - RNA, 22 nt, Homo sapiens
cuucccuucucuccuucccucu

SEQ ID NO: 1516213 - RNA, 21 nt, Homo sapiens
cuuccguggucagagugccac

SEQ ID NO: 1516214 - RNA, 21 nt, Homo sapiens
cuuccuaaauauuaugagaug

SEQ ID NO: 1516215 - RNA, 15 nt, Homo sapiens
cuuccucugcaaaaa

SEQ ID NO: 1516216 - RNA, 16 nt, Homo sapiens
cuuccucugcaaaaag

SEQ ID NO: 1516217 - RNA, 15 nt, Homo sapiens
cuucuuagcugucac

SEQ ID NO: 1516218 - RNA, 16 nt, Homo sapiens
cuucuugaaacagccu

SEQ ID NO: 1516219 - RNA, 22 nt, Homo sapiens
cuugaagauuagguacuaucug

SEQ ID NO: 1516220 - RNA, 22 nt, Homo sapiens
cuugaggguaauaaacuuagaa

SEQ ID NO: 1516221 - RNA, 16 nt, Homo sapiens
cuugauaaaugccuca

SEQ ID NO: 1516222 - RNA, 16 nt, Homo sapiens
cuugauagaaaugcca

SEQ ID NO: 1516223 - RNA, 21 nt, Homo sapiens
cuugauagaaaugccaagcac

SEQ ID NO: 1516224 - RNA, 10 nt, Homo sapiens
cuugcugaug

SEQ ID NO: 1516225 - RNA, 15 nt, Homo sapiens
cuugcuuuccccggg

SEQ ID NO: 1516226 - RNA, 22 nt, Homo sapiens
cuuggaaagcaucaccucaggc

SEQ ID NO: 1516227 - RNA, 15 nt, Homo sapiens
cuuggaaagguuuca

SEQ ID NO: 1516228 - RNA, 15 nt, Homo sapiens
cuuggcagcccugau

SEQ ID NO: 1516229 - RNA, 16 nt, Homo sapiens
cuuggcaguauuccau

SEQ ID NO: 1516230 - RNA, 22 nt, Homo sapiens
cuuggcaguauuccaugggaug

SEQ ID NO: 1516231 - RNA, 15 nt, Homo sapiens
cuugguaaauuguaa

SEQ ID NO: 1516232 - RNA, 15 nt, Homo sapiens
cuugguaauuguacu

SEQ ID NO: 1516233 - RNA, 23 nt, Homo sapiens
cuugguaauuguacuaaagccaa

SEQ ID NO: 1516234 - RNA, 17 nt, Homo sapiens
cuuguauuuccaaaccu

SEQ ID NO: 1516235 - RNA, 20 nt, Homo sapiens
cuugucaaacuugucaagaa

SEQ ID NO: 1516236 - RNA, 15 nt, Homo sapiens
cuuguccaugugguu

SEQ ID NO: 1516237 - RNA, 22 nt, Homo sapiens
cuuguuggauuccagugcaggu

SEQ ID NO: 1516238 - RNA, 19 nt, Homo sapiens
cuuuaaaauguaaagccau

SEQ ID NO: 1516239 - RNA, 20 nt, Homo sapiens
cuuuaaagcguuugcacaga

SEQ ID NO: 1516240 - RNA, 20 nt, Homo sapiens
cuuuaaccacuccucaggaa

SEQ ID NO: 1516241 - RNA, 22 nt, Homo sapiens
cuuuauaaaaagugaaauaaga

SEQ ID NO: 1516242 - RNA, 14 nt, Homo sapiens
cuuuauagcucauc

SEQ ID NO: 1516243 - RNA, 14 nt, Homo sapiens
cuuuaucugugaua

SEQ ID NO: 1516244 - RNA, 21 nt, Homo sapiens
cuuuauuuugaacuaauuucu

SEQ ID NO: 1516245 - RNA, 21 nt, Homo sapiens
cuuucacugagccuccacagc

SEQ ID NO: 1516246 - RNA, 13 nt, Homo sapiens
cuuucagcuguga

SEQ ID NO: 1516247 - RNA, 19 nt, Homo sapiens
cuuucagguccaggccagu

SEQ ID NO: 1516248 - RNA, 22 nt, Homo sapiens
cuuuccaugccacgagaucaac

SEQ ID NO: 1516249 - RNA, 13 nt, Homo sapiens
cuuucccaaauaa

SEQ ID NO: 1516250 - RNA, 14 nt, Homo sapiens
cuuuccccagugac

SEQ ID NO: 1516251 - RNA, 13 nt, Homo sapiens
cuuucccuugugu

SEQ ID NO: 1516252 - RNA, 19 nt, Homo sapiens
cuuuccuaagaaagacauc

SEQ ID NO: 1516253 - RNA, 18 nt, Homo sapiens
cuuucuccuguagcacaa

SEQ ID NO: 1516254 - RNA, 16 nt, Homo sapiens
cuuucuggaaaagagg

SEQ ID NO: 1516255 - RNA, 23 nt, Homo sapiens
cuuucuggaccagauccuacucu

SEQ ID NO: 1516256 - RNA, 13 nt, Homo sapiens
cuuugaguaccaa

SEQ ID NO: 1516257 - RNA, 14 nt, Homo sapiens
cuuugcaauccaaa

SEQ ID NO: 1516258 - RNA, 14 nt, Homo sapiens
cuuugccacaaagc

SEQ ID NO: 1516259 - RNA, 17 nt, Homo sapiens
cuuugcugucuggugua

SEQ ID NO: 1516260 - RNA, 20 nt, Homo sapiens
cuuuggaaacaggaccacaa

SEQ ID NO: 1516261 - RNA, 19 nt, Homo sapiens
cuuuguucacuagacugug

SEQ ID NO: 1516262 - RNA, 22 nt, Homo sapiens
cuuuuacuuuuugccccuucca

SEQ ID NO: 1516263 - RNA, 17 nt, Homo sapiens
cuuuuaucuucuagcca

SEQ ID NO: 1516264 - RNA, 19 nt, Homo sapiens
cuuuuauuugaaaugucau

SEQ ID NO: 1516265 - RNA, 19 nt, Homo sapiens
cuuuucaaaacugcuaaau

SEQ ID NO: 1516266 - RNA, 18 nt, Homo sapiens
cuuuucaucaauucuuaa

SEQ ID NO: 1516267 - RNA, 16 nt, Homo sapiens
cuuuucccacauucau

SEQ ID NO: 1516268 - RNA, 15 nt, Homo sapiens
cuuuucccauauaca

SEQ ID NO: 1516269 - RNA, 22 nt, Homo sapiens
cuuuugacaaauucuuuuucac

SEQ ID NO: 1516270 - RNA, 18 nt, Homo sapiens
cuuuugcaauucagggaa

SEQ ID NO: 1516271 - RNA, 13 nt, Homo sapiens
gaaaaaugcugcu

SEQ ID NO: 1516272 - RNA, 14 nt, Homo sapiens
gaaaaaugcugcuu

SEQ ID NO: 1516273 - RNA, 15 nt, Homo sapiens
gaaaaaugcugcuuc

SEQ ID NO: 1516274 - RNA, 21 nt, Homo sapiens
gaaaacauagcacuagcauuc

SEQ ID NO: 1516275 - RNA, 16 nt, Homo sapiens
gaaaauagcucuuuca

SEQ ID NO: 1516276 - RNA, 17 nt, Homo sapiens
gaaaauccauggauauc

SEQ ID NO: 1516277 - RNA, 15 nt, Homo sapiens
gaaaauguacauacu

SEQ ID NO: 1516278 - RNA, 18 nt, Homo sapiens
gaaaaugucuguuuucca

SEQ ID NO: 1516279 - RNA, 14 nt, Homo sapiens
gaaacaaacuggag

SEQ ID NO: 1516280 - RNA, 19 nt, Homo sapiens
gaaacaacuuguguucuau

SEQ ID NO: 1516281 - RNA, 18 nt, Homo sapiens
gaaacacucaacaauaaa

SEQ ID NO: 1516282 - RNA, 14 nt, Homo sapiens
gaaacaugauguga

SEQ ID NO: 1516283 - RNA, 22 nt, Homo sapiens
gaaaccagagucaaauuugaaa

SEQ ID NO: 1516284 - RNA, 13 nt, Homo sapiens
gcagaaugaaaau

SEQ ID NO: 1516285 - RNA, 12 nt, Homo sapiens
gcagagcacagc

SEQ ID NO: 1516286 - RNA, 16 nt, Homo sapiens
gcagagccaccagggc

SEQ ID NO: 1516287 - RNA, 15 nt, Homo sapiens
gcagagcuuccucag

SEQ ID NO: 1516288 - RNA, 21 nt, Homo sapiens
gcagagugagacucgucucaa

SEQ ID NO: 1516289 - RNA, 9 nt, Homo sapiens
gcagcacuu

SEQ ID NO: 1516290 - RNA, 17 nt, Homo sapiens
gcagcaguuccaugaag

SEQ ID NO: 1516291 - RNA, 17 nt, Homo sapiens
gcagccccacacccgcc

SEQ ID NO: 1516292 - RNA, 18 nt, Homo sapiens
gcagcgagcugagaucac

SEQ ID NO: 1516293 - RNA, 17 nt, Homo sapiens
gcaggagaaucgcuuga

SEQ ID NO: 1516294 - RNA, 22 nt, Homo sapiens
gcaggcaccuuaguggcuuuuu

SEQ ID NO: 1516295 - RNA, 22 nt, Homo sapiens
gcagguaggggcacagugaaug

SEQ ID NO: 1516296 - RNA, 13 nt, Homo sapiens
gcaguacauguua

SEQ ID NO: 1516297 - RNA, 23 nt, Homo sapiens
gcaguauccaauaggcauuugau

SEQ ID NO: 1516298 - RNA, 18 nt, Homo sapiens
gcagugacgugcaccugu

SEQ ID NO: 1516299 - RNA, 17 nt, Homo sapiens
gcagugcaagagacucu

SEQ ID NO: 1516300 - RNA, 16 nt, Homo sapiens
gcaguguaggcuuuac

SEQ ID NO: 1516301 - RNA, 20 nt, Homo sapiens
gcaguucucgcagauguuac

SEQ ID NO: 1516302 - RNA, 23 nt, Homo sapiens
gcauagcuguuuuagcugaggga

SEQ ID NO: 1516303 - RNA, 15 nt, Homo sapiens
gcaucaguagcugag

SEQ ID NO: 1516304 - RNA, 21 nt, Homo sapiens
gcaucaguagcugagugcacu

SEQ ID NO: 1516305 - RNA, 16 nt, Homo sapiens
gcaucaucagccuauu

SEQ ID NO: 1516306 - RNA, 13 nt, Homo sapiens
gcaucccuguguu

SEQ ID NO: 1516307 - RNA, 14 nt, Homo sapiens
gcauccuggccaac

SEQ ID NO: 1516308 - RNA, 20 nt, Homo sapiens
gcauccuggccaacauggug

SEQ ID NO: 1516309 - RNA, 15 nt, Homo sapiens
gcaugcgcaggcuca

SEQ ID NO: 1516310 - RNA, 21 nt, Homo sapiens
gcaugcuuaaauauugaauaa

SEQ ID NO: 1516311 - RNA, 21 nt, Homo sapiens
gcauggacaccccuuauccag

SEQ ID NO: 1516312 - RNA, 18 nt, Homo sapiens
gcaugucucaauaguaaa

SEQ ID NO: 1516313 - RNA, 22 nt, Homo sapiens
gcauucagaacuucaaguucuc

SEQ ID NO: 1516314 - RNA, 21 nt, Homo sapiens
gcauucaggguuauacacaga

SEQ ID NO: 1516315 - RNA, 19 nt, Homo sapiens
gcauuuacuaugccacaga

SEQ ID NO: 1516316 - RNA, 16 nt, Homo sapiens
gcauuugauuuugccc

SEQ ID NO: 1516317 - RNA, 14 nt, Homo sapiens
gccaacauggugaa

SEQ ID NO: 1516318 - RNA, 11 nt, Homo sapiens
gccacaaagaa

SEQ ID NO: 1516319 - RNA, 14 nt, Homo sapiens
gccacccagcaaca

SEQ ID NO: 1516320 - RNA, 13 nt, Homo sapiens
gccacuaccuuug

SEQ ID NO: 1516321 - RNA, 11 nt, Homo sapiens
gccagcauuuu

SEQ ID NO: 1516322 - RNA, 15 nt, Homo sapiens
gccagcucucucuac

SEQ ID NO: 1516323 - RNA, 23 nt, Homo sapiens
gccagcugacuagaucucuggau

SEQ ID NO: 1516324 - RNA, 22 nt, Homo sapiens
gccaggaacuggcuccuuugcc

SEQ ID NO: 1516325 - RNA, 17 nt, Homo sapiens
gccaugauggugcugac

SEQ ID NO: 1516326 - RNA, 19 nt, Homo sapiens
gccaugauggugcugaccu

SEQ ID NO: 1516327 - RNA, 20 nt, Homo sapiens
gccaugauggugcugaccuc

SEQ ID NO: 1516328 - RNA, 16 nt, Homo sapiens
gccauggaauaaacca

SEQ ID NO: 1516329 - RNA, 14 nt, Homo sapiens
gccaugggugcaug

SEQ ID NO: 1516330 - RNA, 11 nt, Homo sapiens
gccauucugau

SEQ ID NO: 1516331 - RNA, 16 nt, Homo sapiens
gcccaaggugcugaug

SEQ ID NO: 1516332 - RNA, 14 nt, Homo sapiens
gcccacggggauca

SEQ ID NO: 1516333 - RNA, 20 nt, Homo sapiens
gcccagcagggccucaaagu

SEQ ID NO: 1516334 - RNA, 17 nt, Homo sapiens
gcccaggucaacaucua

SEQ ID NO: 1516335 - RNA, 18 nt, Homo sapiens
gccccccguguggcuuac

SEQ ID NO: 1516336 - RNA, 19 nt, Homo sapiens
gcccucccccagcaguuga

SEQ ID NO: 1516337 - RNA, 15 nt, Homo sapiens
gcccugcccugccac

SEQ ID NO: 1516338 - RNA, 16 nt, Homo sapiens
gccgcagggacgggga

SEQ ID NO: 1516339 - RNA, 14 nt, Homo sapiens
gccgccccgugccu

SEQ ID NO: 1516340 - RNA, 18 nt, Homo sapiens
gccgggaggcagugcuga

SEQ ID NO: 1516341 - RNA, 22 nt, Homo sapiens
gccguaggauuuggggugaaug

SEQ ID NO: 1516342 - RNA, 19 nt, Homo sapiens
gccuacacccgucuugggg

SEQ ID NO: 1516343 - RNA, 19 nt, Homo sapiens
gccucaaugugaccagggg

SEQ ID NO: 1516344 - RNA, 22 nt, Homo sapiens
gccuccucccugggcagaaagu

SEQ ID NO: 1516345 - RNA, 20 nt, Homo sapiens
gccuccugugacuggcagca

SEQ ID NO: 1516346 - RNA, 18 nt, Homo sapiens
gccuccuuuugcuugaaa

SEQ ID NO: 1516347 - RNA, 13 nt, Homo sapiens
gccucucugcucc

SEQ ID NO: 1516348 - RNA, 20 nt, Homo sapiens
gccugcagcgagcugagauc

SEQ ID NO: 1516349 - RNA, 18 nt, Homo sapiens
gccuggaccgcuucccag

SEQ ID NO: 1516350 - RNA, 18 nt, Homo sapiens
gccugggcuguggacaga

SEQ ID NO: 1516351 - RNA, 17 nt, Homo sapiens
gccugguagaauuggga

SEQ ID NO: 1516352 - RNA, 11 nt, Homo sapiens
gccuggugggc

SEQ ID NO: 1516353 - RNA, 21 nt, Homo sapiens
gccuucacuccggugugccug

SEQ ID NO: 1516354 - RNA, 18 nt, Homo sapiens
gccuuccagaaaacaaaa

SEQ ID NO: 1516355 - RNA, 14 nt, Homo sapiens
gccuuggaauucua

SEQ ID NO: 1516356 - RNA, 15 nt, Homo sapiens
gccuuuuccuaugua

SEQ ID NO: 1516357 - RNA, 14 nt, Homo sapiens
gcgaaucaucucaa

SEQ ID NO: 1516358 - RNA, 23 nt, Homo sapiens
gcgaccgccgcagggacggggac

SEQ ID NO: 1516359 - RNA, 13 nt, Homo sapiens
gcgcgugcacagc

SEQ ID NO: 1516360 - RNA, 20 nt, Homo sapiens
gcgucccugagggcccuucc

SEQ ID NO: 1516361 - RNA, 14 nt, Homo sapiens
gcuaaacauuguga

SEQ ID NO: 1516362 - RNA, 17 nt, Homo sapiens
gcuaaaugcagggaaac

SEQ ID NO: 1516363 - RNA, 20 nt, Homo sapiens
gcuaaucauuaagguauuau

SEQ ID NO: 1516364 - RNA, 18 nt, Homo sapiens
gcuacacaaaagccaaaa

SEQ ID NO: 1516365 - RNA, 18 nt, Homo sapiens
gcuagaucuaguucucaa

SEQ ID NO: 1516366 - RNA, 19 nt, Homo sapiens
gcuaggaugguucugugac

SEQ ID NO: 1516367 - RNA, 21 nt, Homo sapiens
gcuauaugcauuugccuucau

SEQ ID NO: 1516368 - RNA, 18 nt, Homo sapiens
gcuauaugccuuaagcca

SEQ ID NO: 1516369 - RNA, 18 nt, Homo sapiens
gcuauuuaaaaagcucuu

SEQ ID NO: 1516370 - RNA, 19 nt, Homo sapiens
gcucaaucaugaguaccuc

SEQ ID NO: 1516371 - RNA, 21 nt, Homo sapiens
gcucagcauaaguaaacaaca

SEQ ID NO: 1516372 - RNA, 22 nt, Homo sapiens
gcucaggaggcuuggaaagcau

SEQ ID NO: 1516373 - RNA, 17 nt, Homo sapiens
gcucauuuuuucuuaca

SEQ ID NO: 1516374 - RNA, 14 nt, Homo sapiens
gcucccaagcugcc

SEQ ID NO: 1516375 - RNA, 21 nt, Homo sapiens
gcucccacuauggugggagac

SEQ ID NO: 1516376 - RNA, 15 nt, Homo sapiens
gcuccccagugcuac

SEQ ID NO: 1516377 - RNA, 16 nt, Homo sapiens
gcucugcccacuguga

SEQ ID NO: 1516378 - RNA, 22 nt, Homo sapiens
gcucuguuaugcaagcacaaau

SEQ ID NO: 1516379 - RNA, 20 nt, Homo sapiens
gcugaagugaaaaaaaaaga

SEQ ID NO: 1516380 - RNA, 16 nt, Homo sapiens
gcugagcugaacccau

SEQ ID NO: 1516381 - RNA, 18 nt, Homo sapiens
gcugagggacguggugcc

SEQ ID NO: 1516382 - RNA, 22 nt, Homo sapiens
gcugauccggcugcuccuccag

SEQ ID NO: 1516383 - RNA, 14 nt, Homo sapiens
gcugcucuggaaaa

SEQ ID NO: 1516384 - RNA, 19 nt, Homo sapiens
gcugcugagaaucuagccu

SEQ ID NO: 1516385 - RNA, 17 nt, Homo sapiens
gcugcugcacacuucuc

SEQ ID NO: 1516386 - RNA, 14 nt, Homo sapiens
gcugcugcacugcc

SEQ ID NO: 1516387 - RNA, 16 nt, Homo sapiens
gcugcugugugccuuc

SEQ ID NO: 1516388 - RNA, 13 nt, Homo sapiens
gcuggcugcagug

SEQ ID NO: 1516389 - RNA, 13 nt, Homo sapiens
gcugggauuacag

SEQ ID NO: 1516390 - RNA, 17 nt, Homo sapiens
gcugggucccgggugcc

SEQ ID NO: 1516391 - RNA, 21 nt, Homo sapiens
gcuggugucugagcuucagua

SEQ ID NO: 1516392 - RNA, 16 nt, Homo sapiens
gcugugaacauggacu

SEQ ID NO: 1516393 - RNA, 17 nt, Homo sapiens
gcuguggcuaugggaau

SEQ ID NO: 1516394 - RNA, 21 nt, Homo sapiens
gcuguuuccaguuguuacuga

SEQ ID NO: 1516395 - RNA, 14 nt, Homo sapiens
gcuguuuuagcuga

SEQ ID NO: 1516396 - RNA, 18 nt, Homo sapiens
gcuguuuuagcugaggga

SEQ ID NO: 1516397 - RNA, 16 nt, Homo sapiens
gcuuagccuccugacc

SEQ ID NO: 1516398 - RNA, 18 nt, Homo sapiens
gcuuaggugccaggcugu

SEQ ID NO: 1516399 - RNA, 16 nt, Homo sapiens
gcuuccagaaaacccc

SEQ ID NO: 1516400 - RNA, 15 nt, Homo sapiens
gcuucuagaucugga

SEQ ID NO: 1516401 - RNA, 23 nt, Homo sapiens
gcuugcaaaaacuacaaccaaug

SEQ ID NO: 1516402 - RNA, 17 nt, Homo sapiens
gcuugggaaagguggug

SEQ ID NO: 1516403 - RNA, 15 nt, Homo sapiens
gcuuguaaaaccaac

SEQ ID NO: 1516404 - RNA, 16 nt, Homo sapiens
gcuuguugugcuuuua

SEQ ID NO: 1516405 - RNA, 19 nt, Homo sapiens
gcuuucccggacugcaagc

SEQ ID NO: 1516406 - RNA, 20 nt, Homo sapiens
gcuuucuccuguagcacaaa

SEQ ID NO: 1516407 - RNA, 12 nt, Homo sapiens
gcuuugccaaaa

SEQ ID NO: 1516408 - RNA, 21 nt, Homo sapiens
gcuuuguuucuuucauaugaa

SEQ ID NO: 1516409 - RNA, 20 nt, Homo sapiens
gcuuuuuuccuccuguguac

SEQ ID NO: 1516410 - RNA, 22 nt, Homo sapiens
gcuuuuuucuugaguacuagaa

SEQ ID NO: 1516411 - RNA, 20 nt, Homo sapiens
ggaaaagaaucccugcagcc

SEQ ID NO: 1516412 - RNA, 16 nt, Homo sapiens
ggaaaagaggaguuuc

SEQ ID NO: 1516413 - RNA, 13 nt, Homo sapiens
ggaaaagauuucu

SEQ ID NO: 1516414 - RNA, 15 nt, Homo sapiens
ggaaaccacacuucu

SEQ ID NO: 1516415 - RNA, 15 nt, Homo sapiens
ggaaacucgaauaaa

SEQ ID NO: 1516416 - RNA, 19 nt, Homo sapiens
ggaaacucgaauaaaggau

SEQ ID NO: 1516417 - RNA, 17 nt, Homo sapiens
ggaaaggugguguuucu

SEQ ID NO: 1516418 - RNA, 12 nt, Homo sapiens
ggaaaguucagc

SEQ ID NO: 1516419 - RNA, 15 nt, Homo sapiens
caccaaaacgaugaa

SEQ ID NO: 1516420 - RNA, 24 nt, Homo sapiens
caccaacccuucauuuaacaagua

SEQ ID NO: 1516421 - RNA, 15 nt, Homo sapiens
caccagaaugcuaaa

SEQ ID NO: 1516422 - RNA, 21 nt, Homo sapiens
caccaggauagagacuggaac

SEQ ID NO: 1516423 - RNA, 13 nt, Homo sapiens
cacccagcaaaga

SEQ ID NO: 1516424 - RNA, 15 nt, Homo sapiens
caccgacaacaugcu

SEQ ID NO: 1516425 - RNA, 14 nt, Homo sapiens
caccguguuagcca

SEQ ID NO: 1516426 - RNA, 14 nt, Homo sapiens
caccucaccaaaac

SEQ ID NO: 1516427 - RNA, 22 nt, Homo sapiens
caccucacgcucuggacaugau

SEQ ID NO: 1516428 - RNA, 18 nt, Homo sapiens
caccugaccagaaugcgc

SEQ ID NO: 1516429 - RNA, 16 nt, Homo sapiens
caccugccauuugcac

SEQ ID NO: 1516430 - RNA, 17 nt, Homo sapiens
caccuucaauacuucau

SEQ ID NO: 1516431 - RNA, 12 nt, Homo sapiens
caccuuugccac

SEQ ID NO: 1516432 - RNA, 17 nt, Homo sapiens
caccuuugccacaaagc

SEQ ID NO: 1516433 - RNA, 17 nt, Homo sapiens
cacgacucuuccugcaa

SEQ ID NO: 1516434 - RNA, 15 nt, Homo sapiens
caguugggagugagu

SEQ ID NO: 1516435 - RNA, 17 nt, Homo sapiens
caguuugaaaagacaaa

SEQ ID NO: 1516436 - RNA, 15 nt, Homo sapiens
caguuugugauuucu

SEQ ID NO: 1516437 - RNA, 13 nt, Homo sapiens
cauaaagccucug

SEQ ID NO: 1516438 - RNA, 14 nt, Homo sapiens
cauaauaaaguguu

SEQ ID NO: 1516439 - RNA, 20 nt, Homo sapiens
cauaauggaaaacauuuaca

SEQ ID NO: 1516440 - RNA, 19 nt, Homo sapiens
cauacacucaaacaaucau

SEQ ID NO: 1516441 - RNA, 19 nt, Homo sapiens
cauaguaaaugguaucauu

SEQ ID NO: 1516442 - RNA, 13 nt, Homo sapiens
cauagugcacuag

SEQ ID NO: 1516443 - RNA, 22 nt, Homo sapiens
cauaucauuuuuuuaacacaua

SEQ ID NO: 1516444 - RNA, 14 nt, Homo sapiens
caucaacuuuaugu

SEQ ID NO: 1516445 - RNA, 16 nt, Homo sapiens
caucacagaaugugau

SEQ ID NO: 1516446 - RNA, 14 nt, Homo sapiens
caucacuaccuuua

SEQ ID NO: 1516447 - RNA, 21 nt, Homo sapiens
caucagguuccaguugcuuga

SEQ ID NO: 1516448 - RNA, 16 nt, Homo sapiens
caucauaaccauuccc

SEQ ID NO: 1516449 - RNA, 16 nt, Homo sapiens
caucccccagcacuga

SEQ ID NO: 1516450 - RNA, 15 nt, Homo sapiens
cauccccuuguguca

SEQ ID NO: 1516451 - RNA, 16 nt, Homo sapiens
caucccuacuuuucaa

SEQ ID NO: 1516452 - RNA, 15 nt, Homo sapiens
caucccucuacuuuc

SEQ ID NO: 1516453 - RNA, 20 nt, Homo sapiens
cauccuuuuacuuuuugccc

SEQ ID NO: 1516454 - RNA, 18 nt, Homo sapiens
caucuacaagcauuugcc

SEQ ID NO: 1516455 - RNA, 19 nt, Homo sapiens
ucacaauaaaagaaacugu

SEQ ID NO: 1516456 - RNA, 23 nt, Homo sapiens
ucacaaugccuagacuguguaug

SEQ ID NO: 1516457 - RNA, 14 nt, Homo sapiens
ucacaccugacaaa

SEQ ID NO: 1516458 - RNA, 18 nt, Homo sapiens
ucacaccugacaaaugga

SEQ ID NO: 1516459 - RNA, 20 nt, Homo sapiens
ucacagcccagaaccacaga

SEQ ID NO: 1516460 - RNA, 15 nt, Homo sapiens
ucacaucccuaugaa

SEQ ID NO: 1516461 - RNA, 14 nt, Homo sapiens
ucacauucaggaag

SEQ ID NO: 1516462 - RNA, 15 nt, Homo sapiens
ucaccacaaacugua

SEQ ID NO: 1516463 - RNA, 16 nt, Homo sapiens
ucaccgacaacaugcu

SEQ ID NO: 1516464 - RNA, 22 nt, Homo sapiens
ucacgacucuaccauguccaau

SEQ ID NO: 1516465 - RNA, 14 nt, Homo sapiens
ucacgacucuuccu

SEQ ID NO: 1516466 - RNA, 23 nt, Homo sapiens
ucacuaaagaaaaacuaauguca

SEQ ID NO: 1516467 - RNA, 17 nt, Homo sapiens
ucacuaauacuaauuca

SEQ ID NO: 1516468 - RNA, 18 nt, Homo sapiens
ucacuaccuuuauagcuc

SEQ ID NO: 1516469 - RNA, 21 nt, Homo sapiens
ucacuaccuuuauagcucauc

SEQ ID NO: 1516470 - RNA, 18 nt, Homo sapiens
ucacucuucaaaugccug

SEQ ID NO: 1516471 - RNA, 18 nt, Homo sapiens
ucacucuuccugcaagga

SEQ ID NO: 1516472 - RNA, 17 nt, Homo sapiens
ucacugcugucagccaa

SEQ ID NO: 1516473 - RNA, 14 nt, Homo sapiens
ucacuggguucuag

SEQ ID NO: 1516474 - RNA, 13 nt, Homo sapiens
ucagaaagucaua

SEQ ID NO: 1516475 - RNA, 13 nt, Homo sapiens
ucagaagcacaaa

SEQ ID NO: 1516476 - RNA, 14 nt, Homo sapiens
ucagaagcacaaag

SEQ ID NO: 1516477 - RNA, 18 nt, Homo sapiens
ucagaccaguacugggaa

SEQ ID NO: 1516478 - RNA, 18 nt, Homo sapiens
ucagagaauaaacaucau

SEQ ID NO: 1516479 - RNA, 16 nt, Homo sapiens
ucagagcaagcacugg

SEQ ID NO: 1516480 - RNA, 18 nt, Homo sapiens
ucagagcaagcacuggac

SEQ ID NO: 1516481 - RNA, 18 nt, Homo sapiens
ucagagggcguguuguuu

SEQ ID NO: 1516482 - RNA, 13 nt, Homo sapiens
ucagagugccacu

SEQ ID NO: 1516483 - RNA, 21 nt, Homo sapiens
ucagauaagguaaaaugccau

SEQ ID NO: 1516484 - RNA, 15 nt, Homo sapiens
ucagcaaaccucagu

SEQ ID NO: 1516485 - RNA, 19 nt, Homo sapiens
ucagcaugcagaagugcau

SEQ ID NO: 1516486 - RNA, 17 nt, Homo sapiens
ucagcuuugcuuuuccu

SEQ ID NO: 1516487 - RNA, 23 nt, Homo sapiens
ucaggauuaaugguccugugaug

SEQ ID NO: 1516488 - RNA, 18 nt, Homo sapiens
ucaggccaggugcagugg

SEQ ID NO: 1516489 - RNA, 19 nt, Homo sapiens
ucaggugcauuccaccaca

SEQ ID NO: 1516490 - RNA, 14 nt, Homo sapiens
ucaggugcuacaca

SEQ ID NO: 1516491 - RNA, 18 nt, Homo sapiens
ucaguagcugagugcacu

SEQ ID NO: 1516492 - RNA, 20 nt, Homo sapiens
ucagucaugaggaaagacac

SEQ ID NO: 1516493 - RNA, 12 nt, Homo sapiens
ucagugcugcuc

SEQ ID NO: 1516494 - RNA, 17 nt, Homo sapiens
ucaguuccucuuugcau

SEQ ID NO: 1516495 - RNA, 18 nt, Homo sapiens
ucaguuguguuuggcagg

SEQ ID NO: 1516496 - RNA, 20 nt, Homo sapiens
ucauaaaccaauguggcaag

SEQ ID NO: 1516497 - RNA, 23 nt, Homo sapiens
ucauagaaauaccucauucgccu

SEQ ID NO: 1516498 - RNA, 16 nt, Homo sapiens
ucauagcucacuguaa

SEQ ID NO: 1516499 - RNA, 14 nt, Homo sapiens
ucauauuuuguaua

SEQ ID NO: 1516500 - RNA, 20 nt, Homo sapiens
ucaucaaauauuaccaaaaa

SEQ ID NO: 1516501 - RNA, 14 nt, Homo sapiens
ucaucagcauuuaa

SEQ ID NO: 1516502 - RNA, 18 nt, Homo sapiens
ucaugaguaccucaaagg

SEQ ID NO: 1516503 - RNA, 19 nt, Homo sapiens
ucaugaguaccucaaagga

SEQ ID NO: 1516504 - RNA, 23 nt, Homo sapiens
ucaugcucagcccugacuggugc

SEQ ID NO: 1516505 - RNA, 20 nt, Homo sapiens
ucauggcuuagaaaucuuua

SEQ ID NO: 1516506 - RNA, 23 nt, Homo sapiens
ucauggggugggguuggggcaaa

SEQ ID NO: 1516507 - RNA, 15 nt, Homo sapiens
ucauguuccucaaaa

SEQ ID NO: 1516508 - RNA, 17 nt, Homo sapiens
ucauuggccuucuuaaa

SEQ ID NO: 1516509 - RNA, 23 nt, Homo sapiens
ucauuuugggaccuauaucucag

SEQ ID NO: 1516510 - RNA, 23 nt, Homo sapiens
ucauuuuugguaggcuuaucaaa

SEQ ID NO: 1516511 - RNA, 20 nt, Homo sapiens
uccaaauaaggauuuguuca

SEQ ID NO: 1516512 - RNA, 19 nt, Homo sapiens
uccaaccccccaccugcca

SEQ ID NO: 1516513 - RNA, 14 nt, Homo sapiens
ugcaucccccagca

SEQ ID NO: 1516514 - RNA, 11 nt, Homo sapiens
ugcaucucauu

SEQ ID NO: 1516515 - RNA, 14 nt, Homo sapiens
ugcauuguauuuag

SEQ ID NO: 1516516 - RNA, 22 nt, Homo sapiens
ugcauuugccuucauccaccca

SEQ ID NO: 1516517 - RNA, 21 nt, Homo sapiens
ugcauuuucccagauacuucc

SEQ ID NO: 1516518 - RNA, 14 nt, Homo sapiens
ugccacucauuccu

SEQ ID NO: 1516519 - RNA, 18 nt, Homo sapiens
ugccaggcuguaagcauu

SEQ ID NO: 1516520 - RNA, 20 nt, Homo sapiens
ugccauucuucuggugcuac

SEQ ID NO: 1516521 - RNA, 15 nt, Homo sapiens
ugcccaggcacugca

SEQ ID NO: 1516522 - RNA, 18 nt, Homo sapiens
ugcccgaccccaucucau

SEQ ID NO: 1516523 - RNA, 19 nt, Homo sapiens
ugccgccccgugccuguac

SEQ ID NO: 1516524 - RNA, 15 nt, Homo sapiens
ugccuagacuguuac

SEQ ID NO: 1516525 - RNA, 14 nt, Homo sapiens
ugccuccagcacuc

SEQ ID NO: 1516526 - RNA, 21 nt, Homo sapiens
ugccugugcaugaccugauca

SEQ ID NO: 1516527 - RNA, 13 nt, Homo sapiens
ugccuguggugag

SEQ ID NO: 1516528 - RNA, 15 nt, Homo sapiens
ugccuuaagccaaua

SEQ ID NO: 1516529 - RNA, 21 nt, Homo sapiens
ugccuuugggaggcagcauca

SEQ ID NO: 1516530 - RNA, 16 nt, Homo sapiens
ugccuuuuaccaugaa

SEQ ID NO: 1516531 - RNA, 18 nt, Homo sapiens
ugccuuuuccuauguaaa

SEQ ID NO: 1516532 - RNA, 18 nt, Homo sapiens
ugccuuuugcaaacuuua

SEQ ID NO: 1516533 - RNA, 17 nt, Homo sapiens
ugcgaccgugaccagga

SEQ ID NO: 1516534 - RNA, 13 nt, Homo sapiens
ugcuacacaaaag

SEQ ID NO: 1516535 - RNA, 23 nt, Homo sapiens
ugcuauaggcuggagaagcucac

SEQ ID NO: 1516536 - RNA, 22 nt, Homo sapiens
ugcuauuuaaggugugcaauuu

SEQ ID NO: 1516537 - RNA, 17 nt, Homo sapiens
ugcuccaggaucuuuga

SEQ ID NO: 1516538 - RNA, 18 nt, Homo sapiens
ugcucuggaaaaugugac

SEQ ID NO: 1516539 - RNA, 19 nt, Homo sapiens
ugcucugguuugagcaauu

SEQ ID NO: 1516540 - RNA, 16 nt, Homo sapiens
ugcucuugcauugcaa

SEQ ID NO: 1516541 - RNA, 22 nt, Homo sapiens
ugcugaaggacagaacauugcc

SEQ ID NO: 1516542 - RNA, 13 nt, Homo sapiens
ugcugaccucugg

SEQ ID NO: 1516543 - RNA, 14 nt, Homo sapiens
ugcuggagacacuc

SEQ ID NO: 1516544 - RNA, 17 nt, Homo sapiens
ugcuguaacucagacau

SEQ ID NO: 1516545 - RNA, 22 nt, Homo sapiens
ugcuguaacucagacauuccaa

SEQ ID NO: 1516546 - RNA, 13 nt, Homo sapiens
ugcuuacaaaguc

SEQ ID NO: 1516547 - RNA, 13 nt, Homo sapiens
ugcuucaaacccu

SEQ ID NO: 1516548 - RNA, 15 nt, Homo sapiens
ugcuucagugcugcu

SEQ ID NO: 1516549 - RNA, 16 nt, Homo sapiens
ugcuucagugcugcuc

SEQ ID NO: 1516550 - RNA, 20 nt, Homo sapiens
ugcuucauuugggaaauuca

SEQ ID NO: 1516551 - RNA, 13 nt, Homo sapiens
ugcuucugcuaaa

SEQ ID NO: 1516552 - RNA, 23 nt, Homo sapiens
ugcuugaaaugagaaacuuugau

SEQ ID NO: 1516553 - RNA, 13 nt, Homo sapiens
ugcuugcacuuug

SEQ ID NO: 1516554 - RNA, 18 nt, Homo sapiens
ugcuuggagcugagcaaa

SEQ ID NO: 1516555 - RNA, 16 nt, Homo sapiens
ugcuuguaaaaccaac

SEQ ID NO: 1516556 - RNA, 14 nt, Homo sapiens
uggaaaaugugacc

SEQ ID NO: 1516557 - RNA, 18 nt, Homo sapiens
uggaaacuagaucgucuc

SEQ ID NO: 1516558 - RNA, 19 nt, Homo sapiens
uggaaagcaucaccucagg

SEQ ID NO: 1516559 - RNA, 22 nt, Homo sapiens
uggaaaggcucagucucaggag

SEQ ID NO: 1516560 - RNA, 13 nt, Homo sapiens
uggaaagguuuca

SEQ ID NO: 1516561 - RNA, 21 nt, Homo sapiens
uggaacacuagacaagccaga

SEQ ID NO: 1516562 - RNA, 20 nt, Homo sapiens
uggaagaaagcaacaaagau

SEQ ID NO: 1516563 - RNA, 20 nt, Homo sapiens
uggaagaagaggaggaagac

SEQ ID NO: 1516564 - RNA, 14 nt, Homo sapiens
uggaagauauuccu

SEQ ID NO: 1516565 - RNA, 21 nt, Homo sapiens
uggaagguuagagguuuguca

SEQ ID NO: 1516566 - RNA, 19 nt, Homo sapiens
uggaagguuagguuuguca

SEQ ID NO: 1516567 - RNA, 17 nt, Homo sapiens
uggaauuuguaaguuua

SEQ ID NO: 1516568 - RNA, 20 nt, Homo sapiens
uggaauuuucagucaucuca

SEQ ID NO: 1516569 - RNA, 15 nt, Homo sapiens
uggacaaaauggaag

SEQ ID NO: 1516570 - RNA, 22 nt, Homo sapiens
uggacaugcuucagugcugcuc

SEQ ID NO: 1516571 - RNA, 22 nt, Homo sapiens
uggacugguuuucacauuagaa

SEQ ID NO: 1516572 - RNA, 18 nt, Homo sapiens
uggacuugaggauuuuga

SEQ ID NO: 1516573 - RNA, 22 nt, Homo sapiens
uggaugggcccugcaagacaca

SEQ ID NO: 1516574 - RNA, 16 nt, Homo sapiens
uggauucaaaugucag

SEQ ID NO: 1516575 - RNA, 19 nt, Homo sapiens
uggauuccagcauuugcca

SEQ ID NO: 1516576 - RNA, 19 nt, Homo sapiens
uggcaaaagguugacucau

SEQ ID NO: 1516577 - RNA, 15 nt, Homo sapiens
uggcaaugaaacaaa

SEQ ID NO: 1516578 - RNA, 20 nt, Homo sapiens
uggcaggccccagcccugca

SEQ ID NO: 1516579 - RNA, 21 nt, Homo sapiens
uggcaguucucgcagauguua

SEQ ID NO: 1516580 - RNA, 22 nt, Homo sapiens
uggccgaucggggcacugcagg

SEQ ID NO: 1516581 - RNA, 17 nt, Homo sapiens
uggcggcgcagagggaa

SEQ ID NO: 1516582 - RNA, 14 nt, Homo sapiens
uggcuaauucccag

SEQ ID NO: 1516583 - RNA, 16 nt, Homo sapiens
uggcucuugccuguaa

SEQ ID NO: 1516584 - RNA, 16 nt, Homo sapiens
ugggagaaaucuggcu

SEQ ID NO: 1516585 - RNA, 15 nt, Homo sapiens
ugggagaucagccac

SEQ ID NO: 1516586 - RNA, 17 nt, Homo sapiens
ugggauagccauuucca

SEQ ID NO: 1516587 - RNA, 22 nt, Homo sapiens
ugggaugcggggcagagccacc

SEQ ID NO: 1516588 - RNA, 18 nt, Homo sapiens
ugggcauuuucccagaug

SEQ ID NO: 1516589 - RNA, 13 nt, Homo sapiens
ugggccugccaaa

SEQ ID NO: 1516590 - RNA, 23 nt, Homo sapiens
uggggcaugguuuuacagugaau

SEQ ID NO: 1516591 - RNA, 21 nt, Homo sapiens
ugggguauuuaccacagcagc

SEQ ID NO: 1516592 - RNA, 19 nt, Homo sapiens
uggguaagaagaaagcaaa

SEQ ID NO: 1516593 - RNA, 19 nt, Homo sapiens
uggguacaauguacauuau

SEQ ID NO: 1516594 - RNA, 22 nt, Homo sapiens
uggguugcagacaggaaucuua

SEQ ID NO: 1516595 - RNA, 23 nt, Homo sapiens
ugguaacacaaauuuucaccugc

SEQ ID NO: 1516596 - RNA, 13 nt, Homo sapiens
ugguaaguaacug

SEQ ID NO: 1516597 - RNA, 13 nt, Homo sapiens
ugguacaauccuu

SEQ ID NO: 1516598 - RNA, 12 nt, Homo sapiens
ugguagaaccac

SEQ ID NO: 1516599 - RNA, 14 nt, Homo sapiens
ugguauacaggugg

SEQ ID NO: 1516600 - RNA, 17 nt, Homo sapiens
uauaucuuuuuccauca

SEQ ID NO: 1516601 - RNA, 14 nt, Homo sapiens
uauauguaacugaa

SEQ ID NO: 1516602 - RNA, 21 nt, Homo sapiens
uauauuaaauuuauaucuuau

SEQ ID NO: 1516603 - RNA, 16 nt, Homo sapiens
uauauuuaauggcaau

SEQ ID NO: 1516604 - RNA, 19 nt, Homo sapiens
uauauuuauauauauccag

SEQ ID NO: 1516605 - RNA, 17 nt, Homo sapiens
uaucaaaaagacugugg

SEQ ID NO: 1516606 - RNA, 19 nt, Homo sapiens
uaucaaaaaguacaauaau

SEQ ID NO: 1516607 - RNA, 18 nt, Homo sapiens
uauccaauaggcauuuga

SEQ ID NO: 1516608 - RNA, 13 nt, Homo sapiens
uauccgacucuaa

SEQ ID NO: 1516609 - RNA, 22 nt, Homo sapiens
uaucucaaaguuuaacacaauu

SEQ ID NO: 1516610 - RNA, 20 nt, Homo sapiens
uaucugagcucuuaucuaug

SEQ ID NO: 1516611 - RNA, 18 nt, Homo sapiens
uaucuguguuauuuggac

SEQ ID NO: 1516612 - RNA, 13 nt, Homo sapiens
uaucuucuagcca

SEQ ID NO: 1516613 - RNA, 19 nt, Homo sapiens
uaugaaaaaucaaugucaa

SEQ ID NO: 1516614 - RNA, 22 nt, Homo sapiens
uaugacuguuuuuauaugcaca

SEQ ID NO: 1516615 - RNA, 21 nt, Homo sapiens
uaugaucgccuguggauuuug

SEQ ID NO: 1516616 - RNA, 20 nt, Homo sapiens
uaugaugguggaucaagaca

SEQ ID NO: 1516617 - RNA, 14 nt, Homo sapiens
uaugcaagcacaaa

SEQ ID NO: 1516618 - RNA, 14 nt, Homo sapiens
uaugcagaauguug

SEQ ID NO: 1516619 - RNA, 14 nt, Homo sapiens
uaugggaagccaua

SEQ ID NO: 1516620 - RNA, 14 nt, Homo sapiens
uauggugcaaaaau

SEQ ID NO: 1516621 - RNA, 15 nt, Homo sapiens
uaugugcuucacaua

SEQ ID NO: 1516622 - RNA, 15 nt, Homo sapiens
uauguuacaugcauu

SEQ ID NO: 1516623 - RNA, 23 nt, Homo sapiens
uauguuuaaaaacuucgugcauu

SEQ ID NO: 1516624 - RNA, 14 nt, Homo sapiens
uauuaaagaugugu

SEQ ID NO: 1516625 - RNA, 17 nt, Homo sapiens
uauuaagaaucauugug

SEQ ID NO: 1516626 - RNA, 15 nt, Homo sapiens
uauuaagauguauaa

SEQ ID NO: 1516627 - RNA, 15 nt, Homo sapiens
uauuaccuuccacuu

SEQ ID NO: 1516628 - RNA, 23 nt, Homo sapiens
uauuaucccagcuugcugagggg

SEQ ID NO: 1516629 - RNA, 17 nt, Homo sapiens
uauuauuaacuuguauu

SEQ ID NO: 1516630 - RNA, 20 nt, Homo sapiens
uauuauuuggcaugcuuaaa

SEQ ID NO: 1516631 - RNA, 15 nt, Homo sapiens
uauucaaggaucuca

SEQ ID NO: 1516632 - RNA, 22 nt, Homo sapiens
uauucaaggaucucaaagaaag

SEQ ID NO: 1516633 - RNA, 21 nt, Homo sapiens
uauucagauauaaaacaguuu

SEQ ID NO: 1516634 - RNA, 15 nt, Homo sapiens
uauucagcacuaaaa

SEQ ID NO: 1516635 - RNA, 19 nt, Homo sapiens
uauuccaugggauguuaag

SEQ ID NO: 1516636 - RNA, 23 nt, Homo sapiens
uauuccaugggauguuaagcaaa

SEQ ID NO: 1516637 - RNA, 14 nt, Homo sapiens
uauucucuaagaua

SEQ ID NO: 1516638 - RNA, 16 nt, Homo sapiens
uauucuugacaugaga

SEQ ID NO: 1516639 - RNA, 12 nt, Homo sapiens
uauucuugucaa

SEQ ID NO: 1516640 - RNA, 19 nt, Homo sapiens
uauugaagaaaagcacuuu

SEQ ID NO: 1516641 - RNA, 18 nt, Homo sapiens
uauugaggauuaauuuau

SEQ ID NO: 1516642 - RNA, 13 nt, Homo sapiens
uauuuaaacaauu

SEQ ID NO: 1516643 - RNA, 22 nt, Homo sapiens
uauuuagaucuagaaacagauc

SEQ ID NO: 1516644 - RNA, 15 nt, Homo sapiens
uauuuauacuuugca

SEQ ID NO: 1516645 - RNA, 15 nt, Homo sapiens
uauuuauagucacaa

SEQ ID NO: 1516646 - RNA, 22 nt, Homo sapiens
uauuucaagugccuagacuguu

SEQ ID NO: 1516647 - RNA, 20 nt, Homo sapiens
uauuucuccuuggauggcac

SEQ ID NO: 1516648 - RNA, 14 nt, Homo sapiens
uauuugaauaucau

SEQ ID NO: 1516649 - RNA, 17 nt, Homo sapiens
uauuuuaaaacauaaga

SEQ ID NO: 1516650 - RNA, 14 nt, Homo sapiens
uauuuuccucagag

SEQ ID NO: 1516651 - RNA, 21 nt, Homo sapiens
uauuuuuuuaagcuguaaaaa

SEQ ID NO: 1516652 - RNA, 14 nt, Homo sapiens
ucaaaaaguacaau

SEQ ID NO: 1516653 - RNA, 20 nt, Homo sapiens
ucaaaaucuuucagcacuca

SEQ ID NO: 1516654 - RNA, 20 nt, Homo sapiens
ucaaagaaaaagguccaugc

SEQ ID NO: 1516655 - RNA, 17 nt, Homo sapiens
ucaaagaaaacauagca

SEQ ID NO: 1516656 - RNA, 15 nt, Homo sapiens
ucaaagcacauaugu

SEQ ID NO: 1516657 - RNA, 16 nt, Homo sapiens
ucaaaguguaacagau

SEQ ID NO: 1516658 - RNA, 20 nt, Homo sapiens
ucaaauauuaccaaaaaagu

SEQ ID NO: 1516659 - RNA, 12 nt, Homo sapiens
ucaaaucuccag

SEQ ID NO: 1516660 - RNA, 20 nt, Homo sapiens
ucaaauggacucauggcuua

SEQ ID NO: 1516661 - RNA, 20 nt, Homo sapiens
ucaacaaaaagacauggaag

SEQ ID NO: 1516662 - RNA, 18 nt, Homo sapiens
ucaacaacaaaccaaaac

SEQ ID NO: 1516663 - RNA, 20 nt, Homo sapiens
ucaacaauaaagacugagac

SEQ ID NO: 1516664 - RNA, 20 nt, Homo sapiens
ucaacacaaagacauggaag

SEQ ID NO: 1516665 - RNA, 16 nt, Homo sapiens
ucaacacucuucuuga

SEQ ID NO: 1516666 - RNA, 16 nt, Homo sapiens
ucaacuugcuuaucaa

SEQ ID NO: 1516667 - RNA, 20 nt, Homo sapiens
ucaagacccuuuucuguaug

SEQ ID NO: 1516668 - RNA, 18 nt, Homo sapiens
ucaaggaaaaaugcugcu

SEQ ID NO: 1516669 - RNA, 20 nt, Homo sapiens
ucaauaccccuguuaagcaa

SEQ ID NO: 1516670 - RNA, 15 nt, Homo sapiens
ucaauuucaguguau

SEQ ID NO: 1516671 - RNA, 17 nt, Homo sapiens
ucacaacauuuacuuaa

SEQ ID NO: 1516672 - RNA, 18 nt, Homo sapiens
ucacaaggcaacugugag

SEQ ID NO: 1516673 - RNA, 13 nt, Homo sapiens
ucacaaguucaau

SEQ ID NO: 1516674 - RNA, 20 nt, Homo sapiens
ccuugcuuucaucacuaccu

SEQ ID NO: 1516675 - RNA, 14 nt, Homo sapiens
ccuuguuacacauu

SEQ ID NO: 1516676 - RNA, 19 nt, Homo sapiens
ccuuuccuccccaccuucc

SEQ ID NO: 1516677 - RNA, 22 nt, Homo sapiens
ccuuuccucugcagcacuuuaa

SEQ ID NO: 1516678 - RNA, 17 nt, Homo sapiens
ccuuucuaaaucugaga

SEQ ID NO: 1516679 - RNA, 21 nt, Homo sapiens
ccuuucuaaaucugagaucuc

SEQ ID NO: 1516680 - RNA, 21 nt, Homo sapiens
ccuuucucagccacaaaauaa

SEQ ID NO: 1516681 - RNA, 22 nt, Homo sapiens
ccuuugggaggcagcaucaggg

SEQ ID NO: 1516682 - RNA, 22 nt, Homo sapiens
ccuuuuauucauauuuucacau

SEQ ID NO: 1516683 - RNA, 15 nt, Homo sapiens
ccuuuucaucuccag

SEQ ID NO: 1516684 - RNA, 10 nt, Homo sapiens
ccuuuugcca

SEQ ID NO: 1516685 - RNA, 21 nt, Homo sapiens
cgaaaccaguuaagaauggaa

SEQ ID NO: 1516686 - RNA, 20 nt, Homo sapiens
cgagauaccauggugccauc

SEQ ID NO: 1516687 - RNA, 17 nt, Homo sapiens
cgaguuguggaaagccu

SEQ ID NO: 1516688 - RNA, 19 nt, Homo sapiens
cgaugaaguuaugcuguca

SEQ ID NO: 1516689 - RNA, 11 nt, Homo sapiens
cgcaccugccc

SEQ ID NO: 1516690 - RNA, 20 nt, Homo sapiens
cgcagcgcgugcacagcgcg

SEQ ID NO: 1516691 - RNA, 15 nt, Homo sapiens
cgccaaacacuccac

SEQ ID NO: 1516692 - RNA, 22 nt, Homo sapiens
cgccaacugcugaucaaugaaa

SEQ ID NO: 1516693 - RNA, 19 nt, Homo sapiens
cgcccagcugcaccugcca

SEQ ID NO: 1516694 - RNA, 18 nt, Homo sapiens
cgcuauagaauaaugcau

SEQ ID NO: 1516695 - RNA, 14 nt, Homo sapiens
cgcuccagaucugc

SEQ ID NO: 1516696 - RNA, 15 nt, Homo sapiens
cggaccugcuuugag

SEQ ID NO: 1516697 - RNA, 12 nt, Homo sapiens
cggagcugccag

SEQ ID NO: 1516698 - RNA, 18 nt, Homo sapiens
cggaguacagacgucuca

SEQ ID NO: 1516699 - RNA, 18 nt, Homo sapiens
cgggccaccaaguucugg

SEQ ID NO: 1516700 - RNA, 15 nt, Homo sapiens
cggguggaucaccug

SEQ ID NO: 1516701 - RNA, 14 nt, Homo sapiens
cggugaacucuggc

SEQ ID NO: 1516702 - RNA, 21 nt, Homo sapiens
cguaggauuuggggugaauga

SEQ ID NO: 1516703 - RNA, 17 nt, Homo sapiens
cgucagaccaguacugg

SEQ ID NO: 1516704 - RNA, 15 nt, Homo sapiens
cgucucaagacugaa

SEQ ID NO: 1516705 - RNA, 12 nt, Homo sapiens
aaaaaauuccgg

SEQ ID NO: 1516706 - RNA, 24 nt, Homo sapiens
aaaaacuuccaucccuacuuuuca

SEQ ID NO: 1516707 - RNA, 17 nt, Homo sapiens
aaaaaggaacacuggaa

SEQ ID NO: 1516708 - RNA, 16 nt, Homo sapiens
aaaaaggcauaugcaa

SEQ ID NO: 1516709 - RNA, 13 nt, Homo sapiens
aaaaaguaaucaa

SEQ ID NO: 1516710 - RNA, 12 nt, Homo sapiens
aaaaaguuuaca

SEQ ID NO: 1516711 - RNA, 23 nt, Homo sapiens
aaaaauagaaaauuuucuagucc

SEQ ID NO: 1516712 - RNA, 20 nt, Homo sapiens
aaaaauauauuuaauggcaa

SEQ ID NO: 1516713 - RNA, 12 nt, Homo sapiens
aaaaauccacuc

SEQ ID NO: 1516714 - RNA, 14 nt, Homo sapiens
aaaaaugcugcuuc

SEQ ID NO: 1516715 - RNA, 18 nt, Homo sapiens
aaaaccuuucaaauuuca

SEQ ID NO: 1516716 - RNA, 21 nt, Homo sapiens
aaaacgaugaaguuaugcugu

SEQ ID NO: 1516717 - RNA, 20 nt, Homo sapiens
aaaacucuacacccucugcc

SEQ ID NO: 1516718 - RNA, 22 nt, Homo sapiens
aaaacugaaggccucacuuaau

SEQ ID NO: 1516719 - RNA, 21 nt, Homo sapiens
aaaagacagcacuacagauau

SEQ ID NO: 1516720 - RNA, 14 nt, Homo sapiens
aaaaggaacacugg

SEQ ID NO: 1516721 - RNA, 20 nt, Homo sapiens
aaaaguguuauuauuuggca

SEQ ID NO: 1516722 - RNA, 15 nt, Homo sapiens
aaaauaguagaacaa

SEQ ID NO: 1516723 - RNA, 21 nt, Homo sapiens
aaaauaugugcuugaaaugag

SEQ ID NO: 1516724 - RNA, 19 nt, Homo sapiens
aaaauauucauguagauca

SEQ ID NO: 1516725 - RNA, 15 nt, Homo sapiens
aaaaucacuauaucu

SEQ ID NO: 1516726 - RNA, 14 nt, Homo sapiens
aaaaucaugaauau

SEQ ID NO: 1516727 - RNA, 11 nt, Homo sapiens
aaaaugcugcu

SEQ ID NO: 1516728 - RNA, 13 nt, Homo sapiens
aaaaugcugcuuc

SEQ ID NO: 1516729 - RNA, 18 nt, Homo sapiens
aaaauggaaauguaauaa

SEQ ID NO: 1516730 - RNA, 18 nt, Homo sapiens
aaaauguuauuaugucaa

SEQ ID NO: 1516731 - RNA, 18 nt, Homo sapiens
aaaauucuagaagcagaa

SEQ ID NO: 1516732 - RNA, 18 nt, Homo sapiens
aaacaaaaaaccacaaaa

SEQ ID NO: 1516733 - RNA, 14 nt, Homo sapiens
aaacaaguauuugu

SEQ ID NO: 1516734 - RNA, 21 nt, Homo sapiens
aaacaccggcagaaaacggag

SEQ ID NO: 1516735 - RNA, 18 nt, Homo sapiens
aaacacucaacaauaaag

SEQ ID NO: 1516736 - RNA, 23 nt, Homo sapiens
aaacacuuaggaagaaaucacuu

SEQ ID NO: 1516737 - RNA, 16 nt, Homo sapiens
aaacaggaccacaaaa

SEQ ID NO: 1516738 - RNA, 14 nt, Homo sapiens
aaaccacaaaaaua

SEQ ID NO: 1516739 - RNA, 14 nt, Homo sapiens
aaaccccacuuccc

SEQ ID NO: 1516740 - RNA, 22 nt, Homo sapiens
aaaccugauacaauuugcccaa

SEQ ID NO: 1516741 - RNA, 16 nt, Homo sapiens
aaacuaaaucucuaau

SEQ ID NO: 1516742 - RNA, 18 nt, Homo sapiens
aaacuacacaucccuaau

SEQ ID NO: 1516743 - RNA, 15 nt, Homo sapiens
aaacucgaauaaagg

SEQ ID NO: 1516744 - RNA, 14 nt, Homo sapiens
aaagaaaauuagua

SEQ ID NO: 1516745 - RNA, 15 nt, Homo sapiens
aaagaagauuuugcc

SEQ ID NO: 1516746 - RNA, 18 nt, Homo sapiens
aaagacaggcugagcuuu

SEQ ID NO: 1516747 - RNA, 18 nt, Homo sapiens
aaagauguguuguugguu

SEQ ID NO: 1516748 - RNA, 13 nt, Homo sapiens
aaagauugagaag

SEQ ID NO: 1516749 - RNA, 20 nt, Homo sapiens
aaagauuugugaacuggaag

SEQ ID NO: 1516750 - RNA, 21 nt, Homo sapiens
aaagcaacaaagauugagaag

SEQ ID NO: 1516751 - RNA, 20 nt, Homo sapiens
aaagcaagcauucagaagaa

SEQ ID NO: 1516752 - RNA, 18 nt, Homo sapiens
aaagcaagggaccuucau

SEQ ID NO: 1516753 - RNA, 19 nt, Homo sapiens
aaagcacagauuucaacag

SEQ ID NO: 1516754 - RNA, 19 nt, Homo sapiens
aaagcauuuucauuucacu

SEQ ID NO: 1516755 - RNA, 13 nt, Homo sapiens
aaagccaaaaggu

SEQ ID NO: 1516756 - RNA, 18 nt, Homo sapiens
aaagccaaacucugccag

SEQ ID NO: 1516757 - RNA, 16 nt, Homo sapiens
aaagccauuauucucu

SEQ ID NO: 1516758 - RNA, 14 nt, Homo sapiens
aaagcccaaggugc

SEQ ID NO: 1516759 - RNA, 13 nt, Homo sapiens
aaagcugccugua

SEQ ID NO: 1516760 - RNA, 14 nt, Homo sapiens
aaaggaacacugga

SEQ ID NO: 1516761 - RNA, 22 nt, Homo sapiens
aaaggcauccauagugcacuag

SEQ ID NO: 1516762 - RNA, 19 nt, Homo sapiens
aaaggccagcugacuagau

SEQ ID NO: 1516763 - RNA, 17 nt, Homo sapiens
aaagggcugaaagccau

SEQ ID NO: 1516764 - RNA, 14 nt, Homo sapiens
aaagguauuuucac

SEQ ID NO: 1516765 - RNA, 19 nt, Homo sapiens
aaaggugguguuucuguaa

SEQ ID NO: 1516766 - RNA, 18 nt, Homo sapiens
aaagguuuaugaaaaaga

SEQ ID NO: 1516767 - RNA, 23 nt, Homo sapiens
aaaguacucuuuaagagugaaau

SEQ ID NO: 1516768 - RNA, 21 nt, Homo sapiens
aaagugacuaauggcaugaga

SEQ ID NO: 1516769 - RNA, 14 nt, Homo sapiens
aaaguggccaugcc

SEQ ID NO: 1516770 - RNA, 17 nt, Homo sapiens
aaaguuugggaagggau

SEQ ID NO: 1516771 - RNA, 15 nt, Homo sapiens
aaauaaaagaacaca

SEQ ID NO: 1516772 - RNA, 13 nt, Homo sapiens
aaauaacugagaa

SEQ ID NO: 1516773 - RNA, 20 nt, Homo sapiens
aaauacaucaaaaaugggua

SEQ ID NO: 1516774 - RNA, 17 nt, Homo sapiens
aaauaccacaagccuga

SEQ ID NO: 1516775 - RNA, 18 nt, Homo sapiens
aaauaccagagccuucaa

SEQ ID NO: 1516776 - RNA, 12 nt, Homo sapiens
aaauauucccug

SEQ ID NO: 1516777 - RNA, 20 nt, Homo sapiens
aaauauugacuucucuugaa

SEQ ID NO: 1516778 - RNA, 13 nt, Homo sapiens
aaaucaacuugcu

SEQ ID NO: 1516779 - RNA, 15 nt, Homo sapiens
aaaucagaagcacaa

SEQ ID NO: 1516780 - RNA, 17 nt, Homo sapiens
aaaucaugaauauuuca

SEQ ID NO: 1516781 - RNA, 16 nt, Homo sapiens
aaauccacaagccauu

SEQ ID NO: 1516782 - RNA, 23 nt, Homo sapiens
aaauccucagguaguacugggaa

SEQ ID NO: 1516783 - RNA, 19 nt, Homo sapiens
aaaucuaacuacaaggaca

SEQ ID NO: 1516784 - RNA, 15 nt, Homo sapiens
aaaucugagaucucc

SEQ ID NO: 1516785 - RNA, 22 nt, Homo sapiens
aaaucuugguugaugccaaaaa

SEQ ID NO: 1516786 - RNA, 14 nt, Homo sapiens
aaaugccaagcacu

SEQ ID NO: 1516787 - RNA, 11 nt, Homo sapiens
aaaugcugcuu

SEQ ID NO: 1516788 - RNA, 20 nt, Homo sapiens
aaaugcugcuucuccuccca

SEQ ID NO: 1516789 - RNA, 22 nt, Homo sapiens
aaauguaaaauaaguauuucca

SEQ ID NO: 1516790 - RNA, 14 nt, Homo sapiens
aaaugucaguucau

SEQ ID NO: 1516791 - RNA, 22 nt, Homo sapiens
aaaugugacccagauccucaca

SEQ ID NO: 1516792 - RNA, 16 nt, Homo sapiens
aaauuauuguauuaca

SEQ ID NO: 1516793 - RNA, 18 nt, Homo sapiens
aaauucaaaccaauucac

SEQ ID NO: 1516794 - RNA, 20 nt, Homo sapiens
aaauucaaaccaauucaccc

SEQ ID NO: 1516795 - RNA, 18 nt, Homo sapiens
aaauucucucucuugcag

SEQ ID NO: 1516796 - RNA, 16 nt, Homo sapiens
aaauuugaauaaucag

SEQ ID NO: 1516797 - RNA, 11 nt, Homo sapiens
aaauuuuccaa

SEQ ID NO: 1516798 - RNA, 14 nt, Homo sapiens
aacaaauacauuca

SEQ ID NO: 1516799 - RNA, 12 nt, Homo sapiens
aacaacauauuu

SEQ ID NO: 1516800 - RNA, 19 nt, Homo sapiens
aacaagaguugucuugucc

SEQ ID NO: 1516801 - RNA, 22 nt, Homo sapiens
aacaagccaacgacaaagccaa

SEQ ID NO: 1516802 - RNA, 20 nt, Homo sapiens
aacaagguucccucugagaa

SEQ ID NO: 1516803 - RNA, 17 nt, Homo sapiens
aacaauaaagacugaga

SEQ ID NO: 1516804 - RNA, 16 nt, Homo sapiens
aacaauggagauauca

SEQ ID NO: 1516805 - RNA, 15 nt, Homo sapiens
aacacuauccaauga

SEQ ID NO: 1516806 - RNA, 16 nt, Homo sapiens
aacacucaacaauaaa

SEQ ID NO: 1516807 - RNA, 22 nt, Homo sapiens
aacacucaacaauaaagacuga

SEQ ID NO: 1516808 - RNA, 14 nt, Homo sapiens
aacagaagcaguug

SEQ ID NO: 1516809 - RNA, 12 nt, Homo sapiens
aacauagacaga

SEQ ID NO: 1516810 - RNA, 16 nt, Homo sapiens
aacauagacagaagaa

SEQ ID NO: 1516811 - RNA, 18 nt, Homo sapiens
aacauauauauacuauua

SEQ ID NO: 1516812 - RNA, 16 nt, Homo sapiens
aacaucauucuugaga

SEQ ID NO: 1516813 - RNA, 20 nt, Homo sapiens
aacaugaaaaacacggcagc

SEQ ID NO: 1516814 - RNA, 16 nt, Homo sapiens
aacaugguaaaacccc

SEQ ID NO: 1516815 - RNA, 17 nt, Homo sapiens
aacauucacagcccaga

SEQ ID NO: 1516816 - RNA, 20 nt, Homo sapiens
aacauuucuauagccaaaaa

SEQ ID NO: 1516817 - RNA, 14 nt, Homo sapiens
aaccaaccaaccaa

SEQ ID NO: 1516818 - RNA, 23 nt, Homo sapiens
aaccaagucuacuucacuaauga

SEQ ID NO: 1516819 - RNA, 21 nt, Homo sapiens
aaccaauuuuaaauacauucu

SEQ ID NO: 1516820 - RNA, 15 nt, Homo sapiens
aaccacacuucuuga

SEQ ID NO: 1516821 - RNA, 18 nt, Homo sapiens
aaccagugaagugccaca

SEQ ID NO: 1516822 - RNA, 19 nt, Homo sapiens
aacccaaggaacaagagaa

SEQ ID NO: 1516823 - RNA, 22 nt, Homo sapiens
aacccagcucuaauacauucca

SEQ ID NO: 1516824 - RNA, 20 nt, Homo sapiens
aacccaggaggcggagguug

SEQ ID NO: 1516825 - RNA, 15 nt, Homo sapiens
aacccaguauaugcu

SEQ ID NO: 1516826 - RNA, 21 nt, Homo sapiens
aacccauuaggcaugccuaau

SEQ ID NO: 1516827 - RNA, 20 nt, Homo sapiens
acugagagcagaugguccuc

SEQ ID NO: 1516828 - RNA, 23 nt, Homo sapiens
acugaguccucguagccaucucu

SEQ ID NO: 1516829 - RNA, 14 nt, Homo sapiens
acugcaaaccgcca

SEQ ID NO: 1516830 - RNA, 14 nt, Homo sapiens
acugcaaauuucaa

SEQ ID NO: 1516831 - RNA, 13 nt, Homo sapiens
acugccaugccuc

SEQ ID NO: 1516832 - RNA, 15 nt, Homo sapiens
acugccaugccucaa

SEQ ID NO: 1516833 - RNA, 13 nt, Homo sapiens
acugccccugcac

SEQ ID NO: 1516834 - RNA, 15 nt, Homo sapiens
acugcgguauacauu

SEQ ID NO: 1516835 - RNA, 13 nt, Homo sapiens
acugcuccagugg

SEQ ID NO: 1516836 - RNA, 18 nt, Homo sapiens
acugcugaucaaugaaau

SEQ ID NO: 1516837 - RNA, 20 nt, Homo sapiens
acugcugucagccaagucau

SEQ ID NO: 1516838 - RNA, 21 nt, Homo sapiens
acuggaagaaagcaacaaaga

SEQ ID NO: 1516839 - RNA, 14 nt, Homo sapiens
acugguagcuauaa

SEQ ID NO: 1516840 - RNA, 14 nt, Homo sapiens
acuggucucuggcu

SEQ ID NO: 1516841 - RNA, 20 nt, Homo sapiens
acuguaauuaaguaaaccaa

SEQ ID NO: 1516842 - RNA, 21 nt, Homo sapiens
acuguaauuaaguaaaccaaa

SEQ ID NO: 1516843 - RNA, 20 nt, Homo sapiens
acugugaaauaccacaagcc

SEQ ID NO: 1516844 - RNA, 21 nt, Homo sapiens
acugugaaauaccacaagccu

SEQ ID NO: 1516845 - RNA, 22 nt, Homo sapiens
acuguuauucuauuauaucaga

SEQ ID NO: 1516846 - RNA, 15 nt, Homo sapiens
acuguucugucucau

SEQ ID NO: 1516847 - RNA, 16 nt, Homo sapiens
acuguuguacaagcuc

SEQ ID NO: 1516848 - RNA, 12 nt, Homo sapiens
acuuaaguagaa

SEQ ID NO: 1516849 - RNA, 20 nt, Homo sapiens
acuuaauuuugugaccacag

SEQ ID NO: 1516850 - RNA, 21 nt, Homo sapiens
acuuaauuuugugaccacagu

SEQ ID NO: 1516851 - RNA, 21 nt, Homo sapiens
acuuacaaacugcgguauaca

SEQ ID NO: 1516852 - RNA, 14 nt, Homo sapiens
acuuaucuugcucu

SEQ ID NO: 1516853 - RNA, 14 nt, Homo sapiens
acuucaaguucucu

SEQ ID NO: 1516854 - RNA, 18 nt, Homo sapiens
acuucaugaggaggucag

SEQ ID NO: 1516855 - RNA, 21 nt, Homo sapiens
acuuccaucuagucacaaaga

SEQ ID NO: 1516856 - RNA, 15 nt, Homo sapiens
acuuccucugcaaaa

SEQ ID NO: 1516857 - RNA, 22 nt, Homo sapiens
acuucuccagauagcugaauga

SEQ ID NO: 1516858 - RNA, 23 nt, Homo sapiens
acuucuuaaaaguugugauucca

SEQ ID NO: 1516859 - RNA, 19 nt, Homo sapiens
acuugcuuaucaacuuccu

SEQ ID NO: 1516860 - RNA, 17 nt, Homo sapiens
acuuggucagagccacu

SEQ ID NO: 1516861 - RNA, 21 nt, Homo sapiens
acuuggucagagccacucuau

SEQ ID NO: 1516862 - RNA, 22 nt, Homo sapiens
acuuuaaaaaaaucauaugcua

SEQ ID NO: 1516863 - RNA, 17 nt, Homo sapiens
acuuuaacccucucuuc

SEQ ID NO: 1516864 - RNA, 21 nt, Homo sapiens
acuuuauaaauucauaacugg

SEQ ID NO: 1516865 - RNA, 16 nt, Homo sapiens
acuuugagcuacugcc

SEQ ID NO: 1516866 - RNA, 14 nt, Homo sapiens
acuuugaguaccaa

SEQ ID NO: 1516867 - RNA, 17 nt, Homo sapiens
acuuugggaggccaagg

SEQ ID NO: 1516868 - RNA, 11 nt, Homo sapiens
acuuuuugccc

SEQ ID NO: 1516869 - RNA, 13 nt, Homo sapiens
agaaaagcacuuu

SEQ ID NO: 1516870 - RNA, 12 nt, Homo sapiens
agaaaagccacg

SEQ ID NO: 1516871 - RNA, 18 nt, Homo sapiens
agaaaaucaguaauugga

SEQ ID NO: 1516872 - RNA, 16 nt, Homo sapiens
agaaaaucuuuuacua

SEQ ID NO: 1516873 - RNA, 15 nt, Homo sapiens
agaaaauuaguaauu

SEQ ID NO: 1516874 - RNA, 16 nt, Homo sapiens
agaaaauuaguaauug

SEQ ID NO: 1516875 - RNA, 18 nt, Homo sapiens
agaaaauuaguaauugua

SEQ ID NO: 1516876 - RNA, 13 nt, Homo sapiens
agaaacagugcaa

SEQ ID NO: 1516877 - RNA, 19 nt, Homo sapiens
agaaaccaagucuacuuca

SEQ ID NO: 1516878 - RNA, 16 nt, Homo sapiens
agaaaccagagucaaa

SEQ ID NO: 1516879 - RNA, 16 nt, Homo sapiens
agaaagaaacacucaa

SEQ ID NO: 1516880 - RNA, 12 nt, Homo sapiens
agaaagcaaaag

SEQ ID NO: 1516881 - RNA, 20 nt, Homo sapiens
agaaagccuucauaagccua

SEQ ID NO: 1516882 - RNA, 20 nt, Homo sapiens
agaaaucauggcauucacac

SEQ ID NO: 1516883 - RNA, 23 nt, Homo sapiens
agaaauuuucauucagguauuug

SEQ ID NO: 1516884 - RNA, 20 nt, Homo sapiens
agaacaagcaacauaaaaca

SEQ ID NO: 1516885 - RNA, 15 nt, Homo sapiens
agaaccacaagagau

SEQ ID NO: 1516886 - RNA, 17 nt, Homo sapiens
agaaccacuuggcugcu

SEQ ID NO: 1516887 - RNA, 14 nt, Homo sapiens
agaacuagguuuaa

SEQ ID NO: 1516888 - RNA, 14 nt, Homo sapiens
agaacuuugugcca

SEQ ID NO: 1516889 - RNA, 14 nt, Homo sapiens
agaagaggaggaag

SEQ ID NO: 1516890 - RNA, 20 nt, Homo sapiens
agaagagguugggcuuccau

SEQ ID NO: 1516891 - RNA, 21 nt, Homo sapiens
agaagaugcugugaacaccag

SEQ ID NO: 1516892 - RNA, 21 nt, Homo sapiens
agaagauuuugccacauuuga

SEQ ID NO: 1516893 - RNA, 18 nt, Homo sapiens
agaaggaaggcuccaucu

SEQ ID NO: 1516894 - RNA, 15 nt, Homo sapiens
agaaggauagccuca

SEQ ID NO: 1516895 - RNA, 15 nt, Homo sapiens
agaagguuguauuac

SEQ ID NO: 1516896 - RNA, 13 nt, Homo sapiens
agaauaguuauau

SEQ ID NO: 1516897 - RNA, 12 nt, Homo sapiens
agaaucaauaaa

SEQ ID NO: 1516898 - RNA, 16 nt, Homo sapiens
agaauccuuacuuuug

SEQ ID NO: 1516899 - RNA, 17 nt, Homo sapiens
agaaucuugguuugccu

SEQ ID NO: 1516900 - RNA, 12 nt, Homo sapiens
agaaugcaugua

SEQ ID NO: 1516901 - RNA, 23 nt, Homo sapiens
agaauuugccuucucccugggaa

SEQ ID NO: 1516902 - RNA, 17 nt, Homo sapiens
agacaaaguaauuccuc

SEQ ID NO: 1516903 - RNA, 21 nt, Homo sapiens
agacaaaugggccugccaaac

SEQ ID NO: 1516904 - RNA, 14 nt, Homo sapiens
agacagaaugauau

SEQ ID NO: 1516905 - RNA, 14 nt, Homo sapiens
agacagauugcuga

SEQ ID NO: 1516906 - RNA, 13 nt, Homo sapiens
agacagugcugcc

SEQ ID NO: 1516907 - RNA, 14 nt, Homo sapiens
agacauccauguuu

SEQ ID NO: 1516908 - RNA, 21 nt, Homo sapiens
agacauuucucuaacuccugc

SEQ ID NO: 1516909 - RNA, 19 nt, Homo sapiens
agaccaaaggauccagaga

SEQ ID NO: 1516910 - RNA, 18 nt, Homo sapiens
agaccaccucucaauauu

SEQ ID NO: 1516911 - RNA, 17 nt, Homo sapiens
agaccaguacugggaag

SEQ ID NO: 1516912 - RNA, 17 nt, Homo sapiens
agacccaccacaccgca

SEQ ID NO: 1516913 - RNA, 19 nt, Homo sapiens
agaccccacccugaggucc

SEQ ID NO: 1516914 - RNA, 21 nt, Homo sapiens
agaccgugaccagugcugcug

SEQ ID NO: 1516915 - RNA, 12 nt, Homo sapiens
agacguguacau

SEQ ID NO: 1516916 - RNA, 14 nt, Homo sapiens
agacguguacauag

SEQ ID NO: 1516917 - RNA, 21 nt, Homo sapiens
agacucgucucaaaaaaaaga

SEQ ID NO: 1516918 - RNA, 18 nt, Homo sapiens
agacucuuuaugcuugca

SEQ ID NO: 1516919 - RNA, 18 nt, Homo sapiens
agacuguuacuuuggcaa

SEQ ID NO: 1516920 - RNA, 15 nt, Homo sapiens
agacuugauacugca

SEQ ID NO: 1516921 - RNA, 15 nt, Homo sapiens
agacuuggggaccag

SEQ ID NO: 1516922 - RNA, 15 nt, Homo sapiens
agacuuuuaucaaaa

SEQ ID NO: 1516923 - RNA, 15 nt, Homo sapiens
agagaacaggggcuu

SEQ ID NO: 1516924 - RNA, 17 nt, Homo sapiens
agagacaugcaagucau

SEQ ID NO: 1516925 - RNA, 15 nt, Homo sapiens
agagagauacaucuu

SEQ ID NO: 1516926 - RNA, 19 nt, Homo sapiens
agagagauacaucuuauaa

SEQ ID NO: 1516927 - RNA, 21 nt, Homo sapiens
agagagccuagaacaucccug

SEQ ID NO: 1516928 - RNA, 17 nt, Homo sapiens
agagaguuaagugaaug

SEQ ID NO: 1516929 - RNA, 23 nt, Homo sapiens
agagauguguguguguguaggua

SEQ ID NO: 1516930 - RNA, 18 nt, Homo sapiens
agagcaagacuccauuuc

SEQ ID NO: 1516931 - RNA, 14 nt, Homo sapiens
agagcagcuggcuc

SEQ ID NO: 1516932 - RNA, 16 nt, Homo sapiens
agagcaguacucugaa

SEQ ID NO: 1516933 - RNA, 19 nt, Homo sapiens
agagccccuuaaagcugcu

SEQ ID NO: 1516934 - RNA, 14 nt, Homo sapiens
agagcuauggugag

SEQ ID NO: 1516935 - RNA, 16 nt, Homo sapiens
agaggauuuaacugug

SEQ ID NO: 1516936 - RNA, 13 nt, Homo sapiens
agaggcaccugcu

SEQ ID NO: 1516937 - RNA, 20 nt, Homo sapiens
agaggccaggaaucugccau

SEQ ID NO: 1516938 - RNA, 14 nt, Homo sapiens
agaggguguuugca

SEQ ID NO: 1516939 - RNA, 21 nt, Homo sapiens
agagguaaaagugugagcagu

SEQ ID NO: 1516940 - RNA, 14 nt, Homo sapiens
agaggugagaccaa

SEQ ID NO: 1516941 - RNA, 18 nt, Homo sapiens
agagguuugucaacaaaa

SEQ ID NO: 1516942 - RNA, 13 nt, Homo sapiens
agaguacagaugu

SEQ ID NO: 1516943 - RNA, 17 nt, Homo sapiens
agagucagcccuuggcu

SEQ ID NO: 1516944 - RNA, 16 nt, Homo sapiens
agagugaaauaauuaa

SEQ ID NO: 1516945 - RNA, 17 nt, Homo sapiens
agagugugaaacuuccu

SEQ ID NO: 1516946 - RNA, 19 nt, Homo sapiens
agaguuaagugaaugucua

SEQ ID NO: 1516947 - RNA, 21 nt, Homo sapiens
agaguugggaugcggggcaga

SEQ ID NO: 1516948 - RNA, 23 nt, Homo sapiens
agauaaacaguuuagcccaucuc

SEQ ID NO: 1516949 - RNA, 21 nt, Homo sapiens
agauaaagauguuacauuguc

SEQ ID NO: 1516950 - RNA, 21 nt, Homo sapiens
agauaaaggaagucaccaaaa

SEQ ID NO: 1516951 - RNA, 19 nt, Homo sapiens
agauaaauagaguuccaaa

SEQ ID NO: 1516952 - RNA, 22 nt, Homo sapiens
agauaacagcuuaacauuuaca

SEQ ID NO: 1516953 - RNA, 21 nt, Homo sapiens
agauaaucgagucuaccucuu

SEQ ID NO: 1516954 - RNA, 14 nt, Homo sapiens
agauacauacagaa

SEQ ID NO: 1516955 - RNA, 22 nt, Homo sapiens
agauagauccauuuggacaaaa

SEQ ID NO: 1516956 - RNA, 23 nt, Homo sapiens
agauauugggacacacaucaaaa

SEQ ID NO: 1516957 - RNA, 20 nt, Homo sapiens
agauauuucccaauacauac

SEQ ID NO: 1516958 - RNA, 17 nt, Homo sapiens
agaucacaccacugcac

SEQ ID NO: 1516959 - RNA, 22 nt, Homo sapiens
agaucacaccacugcacuccag

SEQ ID NO: 1516960 - RNA, 17 nt, Homo sapiens
agaucacgccacugcac

SEQ ID NO: 1516961 - RNA, 18 nt, Homo sapiens
agaucacgccacugcacu

SEQ ID NO: 1516962 - RNA, 17 nt, Homo sapiens
auuacacuuugaaguau

SEQ ID NO: 1516963 - RNA, 22 nt, Homo sapiens
auuacaguccguccaccaccuc

SEQ ID NO: 1516964 - RNA, 22 nt, Homo sapiens
auuaccagcauuuacuaugcca

SEQ ID NO: 1516965 - RNA, 23 nt, Homo sapiens
auuagagguuugucaacacaaag

SEQ ID NO: 1516966 - RNA, 15 nt, Homo sapiens
auuagcaaagcaaaa

SEQ ID NO: 1516967 - RNA, 18 nt, Homo sapiens
auuaggcagacucuuuau

SEQ ID NO: 1516968 - RNA, 16 nt, Homo sapiens
auuaggcaugccuaau

SEQ ID NO: 1516969 - RNA, 16 nt, Homo sapiens
auuauaucuucaggac

SEQ ID NO: 1516970 - RNA, 22 nt, Homo sapiens
auuaugggaaugacucugacuu

SEQ ID NO: 1516971 - RNA, 14 nt, Homo sapiens
auuauuaugucuca

SEQ ID NO: 1516972 - RNA, 20 nt, Homo sapiens
auuauugaggggacuaggcu

SEQ ID NO: 1516973 - RNA, 15 nt, Homo sapiens
auuauugugccucag

SEQ ID NO: 1516974 - RNA, 14 nt, Homo sapiens
auucacagcccaga

SEQ ID NO: 1516975 - RNA, 20 nt, Homo sapiens
auucacucccacacccaaga

SEQ ID NO: 1516976 - RNA, 19 nt, Homo sapiens
auucaggguuauacacaga

SEQ ID NO: 1516977 - RNA, 13 nt, Homo sapiens
auuccaagucaac

SEQ ID NO: 1516978 - RNA, 23 nt, Homo sapiens
auuccagagcacugcuccagugg

SEQ ID NO: 1516979 - RNA, 13 nt, Homo sapiens
auuccagcauuug

SEQ ID NO: 1516980 - RNA, 16 nt, Homo sapiens
auuccagucucugcau

SEQ ID NO: 1516981 - RNA, 12 nt, Homo sapiens
auuccagugcag

SEQ ID NO: 1516982 - RNA, 21 nt, Homo sapiens
auuccauuuuacuuccaugau

SEQ ID NO: 1516983 - RNA, 15 nt, Homo sapiens
auuccccaucucagg

SEQ ID NO: 1516984 - RNA, 16 nt, Homo sapiens
auuccuaggucacuug

SEQ ID NO: 1516985 - RNA, 19 nt, Homo sapiens
auuccuugcuuucaucacu

SEQ ID NO: 1516986 - RNA, 13 nt, Homo sapiens
auucuauaagcua

SEQ ID NO: 1516987 - RNA, 18 nt, Homo sapiens
auucuauaagcuauuuau

SEQ ID NO: 1516988 - RNA, 14 nt, Homo sapiens
auucucaccaggaa

SEQ ID NO: 1516989 - RNA, 15 nt, Homo sapiens
auucuccugccucag

SEQ ID NO: 1516990 - RNA, 19 nt, Homo sapiens
auucuuaagggaacuucca

SEQ ID NO: 1516991 - RNA, 15 nt, Homo sapiens
auucuucugccucag

SEQ ID NO: 1516992 - RNA, 17 nt, Homo sapiens
auucuugacaugagaaa

SEQ ID NO: 1516993 - RNA, 15 nt, Homo sapiens
auugagaagccaugu

SEQ ID NO: 1516994 - RNA, 21 nt, Homo sapiens
auugagaagccauguacucaa

SEQ ID NO: 1516995 - RNA, 18 nt, Homo sapiens
auugaucacuuuguuaaa

SEQ ID NO: 1516996 - RNA, 15 nt, Homo sapiens
auugaugaacugcca

SEQ ID NO: 1516997 - RNA, 12 nt, Homo sapiens
auugcuuugcca

SEQ ID NO: 1516998 - RNA, 22 nt, Homo sapiens
auuggacuuccuugguuuggac

SEQ ID NO: 1516999 - RNA, 12 nt, Homo sapiens
auuggugcauuu

SEQ ID NO: 1517000 - RNA, 22 nt, Homo sapiens
auuguaaacagcuaauaaugaa

SEQ ID NO: 1517001 - RNA, 15 nt, Homo sapiens
auuguacacuaucua

SEQ ID NO: 1517002 - RNA, 14 nt, Homo sapiens
auuguguuugacuu

SEQ ID NO: 1517003 - RNA, 21 nt, Homo sapiens
auuguuccaaaugaauguugu

SEQ ID NO: 1517004 - RNA, 16 nt, Homo sapiens
auuuaaaaagcucuuu

SEQ ID NO: 1517005 - RNA, 13 nt, Homo sapiens
auuuaacaaauac

SEQ ID NO: 1517006 - RNA, 12 nt, Homo sapiens
auuuaacuugag

SEQ ID NO: 1517007 - RNA, 18 nt, Homo sapiens
auuuaaggugugcaauuu

SEQ ID NO: 1517008 - RNA, 17 nt, Homo sapiens
auuuaauggcaaugcaa

SEQ ID NO: 1517009 - RNA, 20 nt, Homo sapiens
auuuacauuuuuaauuuagu

SEQ ID NO: 1517010 - RNA, 14 nt, Homo sapiens
auuuauauguuaau

SEQ ID NO: 1517011 - RNA, 16 nt, Homo sapiens
auuuauauucaaggau

SEQ ID NO: 1517012 - RNA, 16 nt, Homo sapiens
auuucaagugccuaga

SEQ ID NO: 1517013 - RNA, 15 nt, Homo sapiens
auuucccaauacaua

SEQ ID NO: 1517014 - RNA, 12 nt, Homo sapiens
auuucuauucaa

SEQ ID NO: 1517015 - RNA, 19 nt, Homo sapiens
auuucucuaacuccugcca

SEQ ID NO: 1517016 - RNA, 23 nt, Homo sapiens
auuugugugugugauauaugcau

SEQ ID NO: 1517017 - RNA, 17 nt, Homo sapiens
auuuuaaauguuuuaca

SEQ ID NO: 1517018 - RNA, 18 nt, Homo sapiens
auuuuaacauuuuccaaa

SEQ ID NO: 1517019 - RNA, 17 nt, Homo sapiens
auuuuacuuccaugaua

SEQ ID NO: 1517020 - RNA, 20 nt, Homo sapiens
auuuuacuuccaugauacuu

SEQ ID NO: 1517021 - RNA, 22 nt, Homo sapiens
auuuuauguaaagucucucaau

SEQ ID NO: 1517022 - RNA, 14 nt, Homo sapiens
auuuuauucccaag

SEQ ID NO: 1517023 - RNA, 19 nt, Homo sapiens
auuuuauucccaagcucua

SEQ ID NO: 1517024 - RNA, 14 nt, Homo sapiens
auuuucuuugacuc

SEQ ID NO: 1517025 - RNA, 17 nt, Homo sapiens
auuuugagcaaaccaca

SEQ ID NO: 1517026 - RNA, 24 nt, Homo sapiens
auuuuguaugaaaaaucaauguca

SEQ ID NO: 1517027 - RNA, 20 nt, Homo sapiens
auuuuguccauucaucucau

SEQ ID NO: 1517028 - RNA, 12 nt, Homo sapiens
auuuuucaccuu

SEQ ID NO: 1517029 - RNA, 16 nt, Homo sapiens
caaaaaaccacaaaaa

SEQ ID NO: 1517030 - RNA, 20 nt, Homo sapiens
caaaaacaaaaaaccacaaa

SEQ ID NO: 1517031 - RNA, 21 nt, Homo sapiens
caaaaaccuggagugcucaau

SEQ ID NO: 1517032 - RNA, 15 nt, Homo sapiens
caaaaagacauggaa

SEQ ID NO: 1517033 - RNA, 16 nt, Homo sapiens
caaaaaggcauaugca

SEQ ID NO: 1517034 - RNA, 23 nt, Homo sapiens
caaaaaugaaagcaugucucaau

SEQ ID NO: 1517035 - RNA, 19 nt, Homo sapiens
caaaacgcaaaacccagua

SEQ ID NO: 1517036 - RNA, 21 nt, Homo sapiens
caaaacguggguauuuccugc

SEQ ID NO: 1517037 - RNA, 14 nt, Homo sapiens
caaaacugcuaaau

SEQ ID NO: 1517038 - RNA, 16 nt, Homo sapiens
caaaacugugcuuuua

SEQ ID NO: 1517039 - RNA, 13 nt, Homo sapiens
caaaagcaaggga

SEQ ID NO: 1517040 - RNA, 20 nt, Homo sapiens
caaaagguuucauguagauu

SEQ ID NO: 1517041 - RNA, 19 nt, Homo sapiens
caaaauaggugcugauccu

SEQ ID NO: 1517042 - RNA, 22 nt, Homo sapiens
caaaaucaauuuuuugcuaaac

SEQ ID NO: 1517043 - RNA, 17 nt, Homo sapiens
caaaaucccuauuuaau

SEQ ID NO: 1517044 - RNA, 23 nt, Homo sapiens
caaaaugcagucuuaccaaugac

SEQ ID NO: 1517045 - RNA, 18 nt, Homo sapiens
caaaauggaagguuggag

SEQ ID NO: 1517046 - RNA, 20 nt, Homo sapiens
caaaauguuguccuuucccc

SEQ ID NO: 1517047 - RNA, 10 nt, Homo sapiens
caaaccacau

SEQ ID NO: 1517048 - RNA, 17 nt, Homo sapiens
caaaccugauacaauuu

SEQ ID NO: 1517049 - RNA, 23 nt, Homo sapiens
caaacuaggaggaaaagacagag

SEQ ID NO: 1517050 - RNA, 15 nt, Homo sapiens
caaacucuuguguac

SEQ ID NO: 1517051 - RNA, 23 nt, Homo sapiens
caaagaaccuucucuauggggca

SEQ ID NO: 1517052 - RNA, 24 nt, Homo sapiens
caaagaagauuuugccacauuuga

SEQ ID NO: 1517053 - RNA, 16 nt, Homo sapiens
caaagagaaaagccac

SEQ ID NO: 1517054 - RNA, 15 nt, Homo sapiens
caaagcaagcauuca

SEQ ID NO: 1517055 - RNA, 19 nt, Homo sapiens
caaagcaccugaaccacug

SEQ ID NO: 1517056 - RNA, 23 nt, Homo sapiens
caaagcaccugaaccacuguggc

SEQ ID NO: 1517057 - RNA, 18 nt, Homo sapiens
caaagccaaacucugcca

SEQ ID NO: 1517058 - RNA, 21 nt, Homo sapiens
caaaggcauccauagugcacu

SEQ ID NO: 1517059 - RNA, 23 nt, Homo sapiens
caaagggaacugaagaccuccac

SEQ ID NO: 1517060 - RNA, 17 nt, Homo sapiens
caaagggacacacagug

SEQ ID NO: 1517061 - RNA, 18 nt, Homo sapiens
caaagggcccacagugac

SEQ ID NO: 1517062 - RNA, 23 nt, Homo sapiens
caaagucaauuaaaggcuuucag

SEQ ID NO: 1517063 - RNA, 16 nt, Homo sapiens
caaaguggugauuaaa

SEQ ID NO: 1517064 - RNA, 14 nt, Homo sapiens
caaaucaccacaaa

SEQ ID NO: 1517065 - RNA, 19 nt, Homo sapiens
caaauccauggaccuauga

SEQ ID NO: 1517066 - RNA, 20 nt, Homo sapiens
caaaugcuggggucauauaa

SEQ ID NO: 1517067 - RNA, 17 nt, Homo sapiens
caaaugggccugccaaa

SEQ ID NO: 1517068 - RNA, 17 nt, Homo sapiens
caaauucuuuuucacac

SEQ ID NO: 1517069 - RNA, 20 nt, Homo sapiens
caaauucuuuuucacacuga

SEQ ID NO: 1517070 - RNA, 17 nt, Homo sapiens
caacaaaaagacaugga

SEQ ID NO: 1517071 - RNA, 17 nt, Homo sapiens
caacaaacaaaacgcaa

SEQ ID NO: 1517072 - RNA, 17 nt, Homo sapiens
caacaauaaagacugag

SEQ ID NO: 1517073 - RNA, 23 nt, Homo sapiens
caacacaagcuggaagcacaugu

SEQ ID NO: 1517074 - RNA, 17 nt, Homo sapiens
caacagugagucuguca

SEQ ID NO: 1517075 - RNA, 18 nt, Homo sapiens
caacagugagucugucag

SEQ ID NO: 1517076 - RNA, 16 nt, Homo sapiens
caacaugcgaccguga

SEQ ID NO: 1517077 - RNA, 17 nt, Homo sapiens
caacaugcgaccgugac

SEQ ID NO: 1517078 - RNA, 15 nt, Homo sapiens
caacauguuauuugu

SEQ ID NO: 1517079 - RNA, 16 nt, Homo sapiens
caacauuuuuggugua

SEQ ID NO: 1517080 - RNA, 17 nt, Homo sapiens
caaccaauggaauguga

SEQ ID NO: 1517081 - RNA, 18 nt, Homo sapiens
caaccaauggaaugugau

SEQ ID NO: 1517082 - RNA, 19 nt, Homo sapiens
caaccaauggaaugugaug

SEQ ID NO: 1517083 - RNA, 17 nt, Homo sapiens
caaccuaaaauuucaag

SEQ ID NO: 1517084 - RNA, 22 nt, Homo sapiens
caaccuccccugguccugcacu

SEQ ID NO: 1517085 - RNA, 23 nt, Homo sapiens
caaccuccccugguccugcacug

SEQ ID NO: 1517086 - RNA, 17 nt, Homo sapiens
caacuaccuagacugga

SEQ ID NO: 1517087 - RNA, 16 nt, Homo sapiens
caacucguauagcaug

SEQ ID NO: 1517088 - RNA, 15 nt, Homo sapiens
caacugcucugccca

SEQ ID NO: 1517089 - RNA, 15 nt, Homo sapiens
caacuggagcacuga

SEQ ID NO: 1517090 - RNA, 18 nt, Homo sapiens
caacuuguguucuauuaa

SEQ ID NO: 1517091 - RNA, 19 nt, Homo sapiens
caacuuguguucuauuaau

SEQ ID NO: 1517092 - RNA, 21 nt, Homo sapiens
caagaacuuuucccccaaaga

SEQ ID NO: 1517093 - RNA, 11 nt, Homo sapiens
caagacauuuc

SEQ ID NO: 1517094 - RNA, 18 nt, Homo sapiens
caagacuugauacugcaa

SEQ ID NO: 1517095 - RNA, 20 nt, Homo sapiens
caagacuuggcaacagaagc

SEQ ID NO: 1517096 - RNA, 12 nt, Homo sapiens
guuucuugacuc

SEQ ID NO: 1517097 - RNA, 16 nt, Homo sapiens
guuugcaauuuuucca

SEQ ID NO: 1517098 - RNA, 15 nt, Homo sapiens
guuuggggacauaaa

SEQ ID NO: 1517099 - RNA, 18 nt, Homo sapiens
guuuuaauuuuugugauu

SEQ ID NO: 1517100 - RNA, 15 nt, Homo sapiens
guuuuguaccaacac

SEQ ID NO: 1517101 - RNA, 13 nt, Homo sapiens
guuuuuucacaua

SEQ ID NO: 1517102 - RNA, 13 nt, Homo sapiens
uaaaaaaugucua

SEQ ID NO: 1517103 - RNA, 13 nt, Homo sapiens
uaaaaagaggcau

SEQ ID NO: 1517104 - RNA, 15 nt, Homo sapiens
uaaaacaaugaagga

SEQ ID NO: 1517105 - RNA, 17 nt, Homo sapiens
uaaaaccucucuuucca

SEQ ID NO: 1517106 - RNA, 23 nt, Homo sapiens
uaaaagaaaaaguaugugaauau

SEQ ID NO: 1517107 - RNA, 14 nt, Homo sapiens
uaaaagaccacaga

SEQ ID NO: 1517108 - RNA, 16 nt, Homo sapiens
uaaaaguugaucauaa

SEQ ID NO: 1517109 - RNA, 13 nt, Homo sapiens
uaaaauacaaaca

SEQ ID NO: 1517110 - RNA, 14 nt, Homo sapiens
uaaaauuguaaaau

SEQ ID NO: 1517111 - RNA, 13 nt, Homo sapiens
uaaaauuucaaca

SEQ ID NO: 1517112 - RNA, 18 nt, Homo sapiens
uaaacacauacauugcca

SEQ ID NO: 1517113 - RNA, 16 nt, Homo sapiens
uaaacacuuaucuucu

SEQ ID NO: 1517114 - RNA, 19 nt, Homo sapiens
uaaacaguuugaaaagaca

SEQ ID NO: 1517115 - RNA, 15 nt, Homo sapiens
uaaacauagcuugua

SEQ ID NO: 1517116 - RNA, 12 nt, Homo sapiens
uaaacauucucu

SEQ ID NO: 1517117 - RNA, 18 nt, Homo sapiens
uaaacauugugaugauua

SEQ ID NO: 1517118 - RNA, 13 nt, Homo sapiens
uaaaccaaaaagg

SEQ ID NO: 1517119 - RNA, 11 nt, Homo sapiens
uaaaccuggag

SEQ ID NO: 1517120 - RNA, 22 nt, Homo sapiens
uaaagauuuuuuaauaauuuag

SEQ ID NO: 1517121 - RNA, 14 nt, Homo sapiens
uaaagcauugcaac

SEQ ID NO: 1517122 - RNA, 16 nt, Homo sapiens
uaaagcugcugucacu

SEQ ID NO: 1517123 - RNA, 16 nt, Homo sapiens
uaaaggaugggaccaa

SEQ ID NO: 1517124 - RNA, 17 nt, Homo sapiens
uaaauagaguuccaaau

SEQ ID NO: 1517125 - RNA, 17 nt, Homo sapiens
uaaaugauguacuacau

SEQ ID NO: 1517126 - RNA, 12 nt, Homo sapiens
uaaaugcauuag

SEQ ID NO: 1517127 - RNA, 14 nt, Homo sapiens
uaaaugccacaaag

SEQ ID NO: 1517128 - RNA, 16 nt, Homo sapiens
uaaauguauaugucau

SEQ ID NO: 1517129 - RNA, 17 nt, Homo sapiens
uaaauguuuuacaagaa

SEQ ID NO: 1517130 - RNA, 20 nt, Homo sapiens
uaaauuuuccaaccaagugg

SEQ ID NO: 1517131 - RNA, 13 nt, Homo sapiens
uaacacuauccaa

SEQ ID NO: 1517132 - RNA, 16 nt, Homo sapiens
uaacacucaccaucag

SEQ ID NO: 1517133 - RNA, 19 nt, Homo sapiens
uaacauuugcaaaauggaa

SEQ ID NO: 1517134 - RNA, 13 nt, Homo sapiens
uaacccucucuuc

SEQ ID NO: 1517135 - RNA, 15 nt, Homo sapiens
uaacccucucuuccc

SEQ ID NO: 1517136 - RNA, 13 nt, Homo sapiens
uaaccucaucuac

SEQ ID NO: 1517137 - RNA, 21 nt, Homo sapiens
uaaccuucuggcuuccuucuc

SEQ ID NO: 1517138 - RNA, 22 nt, Homo sapiens
uaacuggguaaugaaacaaaga

SEQ ID NO: 1517139 - RNA, 17 nt, Homo sapiens
uaacuuggucagagcca

SEQ ID NO: 1517140 - RNA, 16 nt, Homo sapiens
uaagaaaauacauaag

SEQ ID NO: 1517141 - RNA, 15 nt, Homo sapiens
uaagaacacugagau

SEQ ID NO: 1517142 - RNA, 19 nt, Homo sapiens
uaagagccuaacuccaucc

SEQ ID NO: 1517143 - RNA, 14 nt, Homo sapiens
uaagaggcuauuua

SEQ ID NO: 1517144 - RNA, 18 nt, Homo sapiens
uaagaguaaaaauaugug

SEQ ID NO: 1517145 - RNA, 19 nt, Homo sapiens
uaagaguucuugcccuuca

SEQ ID NO: 1517146 - RNA, 16 nt, Homo sapiens
uaagcauuagcacaua

SEQ ID NO: 1517147 - RNA, 14 nt, Homo sapiens
uaagccacucuucc

SEQ ID NO: 1517148 - RNA, 16 nt, Homo sapiens
uaaggcuuaggugcca

SEQ ID NO: 1517149 - RNA, 16 nt, Homo sapiens
uaagguguagccacac

SEQ ID NO: 1517150 - RNA, 18 nt, Homo sapiens
uaagugacacaaauugaa

SEQ ID NO: 1517151 - RNA, 22 nt, Homo sapiens
uaaguggcuuuuuaacaugaaa

SEQ ID NO: 1517152 - RNA, 18 nt, Homo sapiens
uaagugguauauacauau

SEQ ID NO: 1517153 - RNA, 15 nt, Homo sapiens
uaauaaaggucacau

SEQ ID NO: 1517154 - RNA, 21 nt, Homo sapiens
uaauaauagaaaaauacucau

SEQ ID NO: 1517155 - RNA, 18 nt, Homo sapiens
uaauagauguuacucaaa

SEQ ID NO: 1517156 - RNA, 20 nt, Homo sapiens
uaauagggagaaaccaagag

SEQ ID NO: 1517157 - RNA, 14 nt, Homo sapiens
uaauauaagccaua

SEQ ID NO: 1517158 - RNA, 14 nt, Homo sapiens
uaauauacaaucua

SEQ ID NO: 1517159 - RNA, 14 nt, Homo sapiens
uaauauaugcucaa

SEQ ID NO: 1517160 - RNA, 12 nt, Homo sapiens
uaauauauugcu

SEQ ID NO: 1517161 - RNA, 15 nt, Homo sapiens
uaauauauugcugcu

SEQ ID NO: 1517162 - RNA, 16 nt, Homo sapiens
uaauauuuuuagcucu

SEQ ID NO: 1517163 - RNA, 19 nt, Homo sapiens
uaaucaauucuagcauuuu

SEQ ID NO: 1517164 - RNA, 12 nt, Homo sapiens
uaaucacuauug

SEQ ID NO: 1517165 - RNA, 22 nt, Homo sapiens
uaaucccccuugccaaauucca

SEQ ID NO: 1517166 - RNA, 23 nt, Homo sapiens
uaauccucaacaacaaaccaaaa

SEQ ID NO: 1517167 - RNA, 16 nt, Homo sapiens
uaaucgcucuuuucca

SEQ ID NO: 1517168 - RNA, 17 nt, Homo sapiens
uaaugacaaggugauau

SEQ ID NO: 1517169 - RNA, 22 nt, Homo sapiens
uaaugagaacuucaaucacugu

SEQ ID NO: 1517170 - RNA, 14 nt, Homo sapiens
uaauguuggaugau

SEQ ID NO: 1517171 - RNA, 13 nt, Homo sapiens
uaauuaacauauc

SEQ ID NO: 1517172 - RNA, 22 nt, Homo sapiens
uaauuacauccagaaagaagga

SEQ ID NO: 1517173 - RNA, 20 nt, Homo sapiens
uaauuaugaguuugcuuaug

SEQ ID NO: 1517174 - RNA, 15 nt, Homo sapiens
uaauuccccuuccau

SEQ ID NO: 1517175 - RNA, 15 nt, Homo sapiens
uaauugccaaauacc

SEQ ID NO: 1517176 - RNA, 14 nt, Homo sapiens
uaauugcuuugcca

SEQ ID NO: 1517177 - RNA, 16 nt, Homo sapiens
uaauugcuuugccaaa

SEQ ID NO: 1517178 - RNA, 19 nt, Homo sapiens
uaauuuaaaaaauaacuac

SEQ ID NO: 1517179 - RNA, 21 nt, Homo sapiens
uaauuucuauuguguuucaca

SEQ ID NO: 1517180 - RNA, 18 nt, Homo sapiens
uaauuuguaucugaagga

SEQ ID NO: 1517181 - RNA, 14 nt, Homo sapiens
uaauuuuucaccuu

SEQ ID NO: 1517182 - RNA, 20 nt, Homo sapiens
uacaaacaagcacagacauu

SEQ ID NO: 1517183 - RNA, 16 nt, Homo sapiens
uacaaauuuuuccugc

SEQ ID NO: 1517184 - RNA, 23 nt, Homo sapiens
uacaacuccaacuucuauguuua

SEQ ID NO: 1517185 - RNA, 13 nt, Homo sapiens
uacaagcauuugc

SEQ ID NO: 1517186 - RNA, 23 nt, Homo sapiens
uacaauccuuugaguuauaguuu

SEQ ID NO: 1517187 - RNA, 14 nt, Homo sapiens
uacaauuugcccaa

SEQ ID NO: 1517188 - RNA, 21 nt, Homo sapiens
uacacagaaaagggagcuaaa

SEQ ID NO: 1517189 - RNA, 20 nt, Homo sapiens
uacacuccagccugagcaac

SEQ ID NO: 1517190 - RNA, 15 nt, Homo sapiens
uacagacgucucaag

SEQ ID NO: 1517191 - RNA, 23 nt, Homo sapiens
uacagaugacucacuccauuccu

SEQ ID NO: 1517192 - RNA, 16 nt, Homo sapiens
uacagugagccaagau

SEQ ID NO: 1517193 - RNA, 18 nt, Homo sapiens
uacauaguucuuacuacu

SEQ ID NO: 1517194 - RNA, 17 nt, Homo sapiens
uacauccagaaagaagg

SEQ ID NO: 1517195 - RNA, 14 nt, Homo sapiens
uacaucucugugag

SEQ ID NO: 1517196 - RNA, 20 nt, Homo sapiens
uacaugagaggacugaugaa

SEQ ID NO: 1517197 - RNA, 21 nt, Homo sapiens
uacauuccaacucguauagca

SEQ ID NO: 1517198 - RNA, 20 nt, Homo sapiens
uacauuucugcagaucuucc

SEQ ID NO: 1517199 - RNA, 20 nt, Homo sapiens
uaccaaauccacaagccauu

SEQ ID NO: 1517200 - RNA, 13 nt, Homo sapiens
uaccaacuuuuag

SEQ ID NO: 1517201 - RNA, 20 nt, Homo sapiens
uaccaccaagggaucugcca

SEQ ID NO: 1517202 - RNA, 23 nt, Homo sapiens
uaccaccaagggaucugccauug

SEQ ID NO: 1517203 - RNA, 21 nt, Homo sapiens
uaccacguuacugcauacuga

SEQ ID NO: 1517204 - RNA, 21 nt, Homo sapiens
uaccagagccuucaagugcca

SEQ ID NO: 1517205 - RNA, 22 nt, Homo sapiens
uaccagagccuucaagugccaa

SEQ ID NO: 1517206 - RNA, 18 nt, Homo sapiens
uaccagcauuuacuaugc

SEQ ID NO: 1517207 - RNA, 20 nt, Homo sapiens
uaccaggcacgucugcagaa

SEQ ID NO: 1517208 - RNA, 13 nt, Homo sapiens
uaccagugugcuu

SEQ ID NO: 1517209 - RNA, 17 nt, Homo sapiens
uaccccugauaagcaaa

SEQ ID NO: 1517210 - RNA, 16 nt, Homo sapiens
uacccucccucuagcc

SEQ ID NO: 1517211 - RNA, 13 nt, Homo sapiens
uaccuaccaccuu

SEQ ID NO: 1517212 - RNA, 13 nt, Homo sapiens
uaccucucucuuc

SEQ ID NO: 1517213 - RNA, 15 nt, Homo sapiens
uaccuguaacuuaau

SEQ ID NO: 1517214 - RNA, 15 nt, Homo sapiens
uacuaaaaauacaaa

SEQ ID NO: 1517215 - RNA, 16 nt, Homo sapiens
uacuaaaaauacagaa

SEQ ID NO: 1517216 - RNA, 16 nt, Homo sapiens
uacuagcaggaauauu

SEQ ID NO: 1517217 - RNA, 19 nt, Homo sapiens
uacuauaaugugaugauuc

SEQ ID NO: 1517218 - RNA, 21 nt, Homo sapiens
uacugcaagguucaacuuauu

SEQ ID NO: 1517219 - RNA, 17 nt, Homo sapiens
uacugcugagauacaua

SEQ ID NO: 1517220 - RNA, 14 nt, Homo sapiens
uacuggugauuucu

SEQ ID NO: 1517221 - RNA, 15 nt, Homo sapiens
uacuuaggaauuucu

SEQ ID NO: 1517222 - RNA, 13 nt, Homo sapiens
uacuuccaugaua

SEQ ID NO: 1517223 - RNA, 18 nt, Homo sapiens
uacuuccucugcaaaaag

SEQ ID NO: 1517224 - RNA, 19 nt, Homo sapiens
uacuuugccuuuugcaaac

SEQ ID NO: 1517225 - RNA, 12 nt, Homo sapiens
uagaaacaaagg

SEQ ID NO: 1517226 - RNA, 13 nt, Homo sapiens
uagaaaccaccug

SEQ ID NO: 1517227 - RNA, 13 nt, Homo sapiens
uagaaagcacuac

SEQ ID NO: 1517228 - RNA, 12 nt, Homo sapiens
uagaaauaagcc

SEQ ID NO: 1517229 - RNA, 17 nt, Homo sapiens
uagaacacugcauuaga

SEQ ID NO: 1517230 - RNA, 23 nt, Homo sapiens
uagaacgcaacuuaggauggcua

SEQ ID NO: 1517231 - RNA, 16 nt, Homo sapiens
uagaagcaucagaguu

SEQ ID NO: 1517232 - RNA, 14 nt, Homo sapiens
ugacucugacuuug

SEQ ID NO: 1517233 - RNA, 18 nt, Homo sapiens
ugacugauguuacaucac

SEQ ID NO: 1517234 - RNA, 15 nt, Homo sapiens
ugacuuuuaucugua

SEQ ID NO: 1517235 - RNA, 18 nt, Homo sapiens
ugagaaauuuaaacuaua

SEQ ID NO: 1517236 - RNA, 19 nt, Homo sapiens
ugagaaugaaugaguagga

SEQ ID NO: 1517237 - RNA, 14 nt, Homo sapiens
ugagauacauacag

SEQ ID NO: 1517238 - RNA, 21 nt, Homo sapiens
ugagauauugggacacacauc

SEQ ID NO: 1517239 - RNA, 13 nt, Homo sapiens
ugagaucauguca

SEQ ID NO: 1517240 - RNA, 17 nt, Homo sapiens
ugagcagaugggacaag

SEQ ID NO: 1517241 - RNA, 13 nt, Homo sapiens
ugagcaggagcag

SEQ ID NO: 1517242 - RNA, 14 nt, Homo sapiens
ugaggucacugggu

SEQ ID NO: 1517243 - RNA, 15 nt, Homo sapiens
ugagguugugcugcc

SEQ ID NO: 1517244 - RNA, 16 nt, Homo sapiens
ugaguaccucaaagga

SEQ ID NO: 1517245 - RNA, 18 nt, Homo sapiens
ugaguaccucuuuuccca

SEQ ID NO: 1517246 - RNA, 22 nt, Homo sapiens
ugagucugcuuucacugugacu

SEQ ID NO: 1517247 - RNA, 23 nt, Homo sapiens
ugagucugcuuucacugugacug

SEQ ID NO: 1517248 - RNA, 23 nt, Homo sapiens
ugagucugggcaaugaaaccaaa

SEQ ID NO: 1517249 - RNA, 14 nt, Homo sapiens
ugaguucuggugag

SEQ ID NO: 1517250 - RNA, 14 nt, Homo sapiens
ugauaaagagggau

SEQ ID NO: 1517251 - RNA, 15 nt, Homo sapiens
ugauacgugugugaa

SEQ ID NO: 1517252 - RNA, 12 nt, Homo sapiens
ugaucaauccuu

SEQ ID NO: 1517253 - RNA, 21 nt, Homo sapiens
ugauccacaaaaacaacuuau

SEQ ID NO: 1517254 - RNA, 16 nt, Homo sapiens
ugauccucaaacacac

SEQ ID NO: 1517255 - RNA, 21 nt, Homo sapiens
ugaucgcgccacuacacucca

SEQ ID NO: 1517256 - RNA, 15 nt, Homo sapiens
ugaugaaacauucau

SEQ ID NO: 1517257 - RNA, 14 nt, Homo sapiens
ugaugaacugccaa

SEQ ID NO: 1517258 - RNA, 13 nt, Homo sapiens
ugaugccaagaaa

SEQ ID NO: 1517259 - RNA, 16 nt, Homo sapiens
ugaugggucccaaaag

SEQ ID NO: 1517260 - RNA, 13 nt, Homo sapiens
ugauggugcugac

SEQ ID NO: 1517261 - RNA, 17 nt, Homo sapiens
ugauguuucacauaaaa

SEQ ID NO: 1517262 - RNA, 15 nt, Homo sapiens
ugauuaccugccaau

SEQ ID NO: 1517263 - RNA, 14 nt, Homo sapiens
ugauucagacagcu

SEQ ID NO: 1517264 - RNA, 18 nt, Homo sapiens
ugauuccauuuuacuucc

SEQ ID NO: 1517265 - RNA, 17 nt, Homo sapiens
ugauuucagacugcaga

SEQ ID NO: 1517266 - RNA, 14 nt, Homo sapiens
ugauuuuugcuauu

SEQ ID NO: 1517267 - RNA, 15 nt, Homo sapiens
ugcaaaaguggaauc

SEQ ID NO: 1517268 - RNA, 19 nt, Homo sapiens
ugcaagacaaaguugaaug

SEQ ID NO: 1517269 - RNA, 18 nt, Homo sapiens
ugcaagcagggcucugcc

SEQ ID NO: 1517270 - RNA, 16 nt, Homo sapiens
ugcaagucauacuuag

SEQ ID NO: 1517271 - RNA, 14 nt, Homo sapiens
ugcaauauuuacau

SEQ ID NO: 1517272 - RNA, 16 nt, Homo sapiens
ugcaccugccagccug

SEQ ID NO: 1517273 - RNA, 14 nt, Homo sapiens
ugcacugacaagau

SEQ ID NO: 1517274 - RNA, 13 nt, Homo sapiens
ugcagaagugcau

SEQ ID NO: 1517275 - RNA, 19 nt, Homo sapiens
ugcagagguaaaaguguga

SEQ ID NO: 1517276 - RNA, 23 nt, Homo sapiens
ugcagcaacucccacgacuguug

SEQ ID NO: 1517277 - RNA, 20 nt, Homo sapiens
ugcagcuuaaaacaagcaaa

SEQ ID NO: 1517278 - RNA, 18 nt, Homo sapiens
ugcaguaacacuggccuu

SEQ ID NO: 1517279 - RNA, 18 nt, Homo sapiens
ugcagugagcugagauca

SEQ ID NO: 1517280 - RNA, 11 nt, Homo sapiens
ugcaugccaaa

SEQ ID NO: 1517281 - RNA, 22 nt, Homo sapiens
ugcaugcccuccccacuucccc

SEQ ID NO: 1517282 - RNA, 13 nt, Homo sapiens
ugcauguaugugu

SEQ ID NO: 1517283 - RNA, 18 nt, Homo sapiens
ugccaagaaaguauuugg

SEQ ID NO: 1517284 - RNA, 11 nt, Homo sapiens
ugccacaaaga

SEQ ID NO: 1517285 - RNA, 18 nt, Homo sapiens
ugccacccaccuuugcca

SEQ ID NO: 1517286 - RNA, 15 nt, Homo sapiens
ugccaccugucuguc

SEQ ID NO: 1517287 - RNA, 15 nt, Homo sapiens
ugccacuauaguuua

SEQ ID NO: 1517288 - RNA, 13 nt, Homo sapiens
ugccaugccucaa

SEQ ID NO: 1517289 - RNA, 18 nt, Homo sapiens
ugccccuuccacuuugag

SEQ ID NO: 1517290 - RNA, 14 nt, Homo sapiens
ugccccuugacaac

SEQ ID NO: 1517291 - RNA, 19 nt, Homo sapiens
ugccccuugacaacuggca

SEQ ID NO: 1517292 - RNA, 13 nt, Homo sapiens
ugcccguggugag

SEQ ID NO: 1517293 - RNA, 23 nt, Homo sapiens
ugcccugaguggaucuccaagga

SEQ ID NO: 1517294 - RNA, 20 nt, Homo sapiens
ugccuagacuguuacuuugg

SEQ ID NO: 1517295 - RNA, 15 nt, Homo sapiens
ugccuauccucugua

SEQ ID NO: 1517296 - RNA, 17 nt, Homo sapiens
ugccucaaugugaccag

SEQ ID NO: 1517297 - RNA, 14 nt, Homo sapiens
ugccucagccuccc

SEQ ID NO: 1517298 - RNA, 23 nt, Homo sapiens
ugccuccucccugggcagaaagu

SEQ ID NO: 1517299 - RNA, 18 nt, Homo sapiens
ugccucucugcuccagag

SEQ ID NO: 1517300 - RNA, 21 nt, Homo sapiens
ugccuguggugagguccuguc

SEQ ID NO: 1517301 - RNA, 22 nt, Homo sapiens
ugccuuccaggcagacacagcu

SEQ ID NO: 1517302 - RNA, 20 nt, Homo sapiens
ugccuuucucuggcuccaga

SEQ ID NO: 1517303 - RNA, 17 nt, Homo sapiens
ugccuuuuccuauguaa

SEQ ID NO: 1517304 - RNA, 15 nt, Homo sapiens
ugcgucgaagcuuug

SEQ ID NO: 1517305 - RNA, 19 nt, Homo sapiens
ugcuauaauauauaaugaa

SEQ ID NO: 1517306 - RNA, 17 nt, Homo sapiens
ugcucagguacuuguaa

SEQ ID NO: 1517307 - RNA, 20 nt, Homo sapiens
ugcuccccagugcuaccucu

SEQ ID NO: 1517308 - RNA, 21 nt, Homo sapiens
ugcugacggaagccaacuugg

SEQ ID NO: 1517309 - RNA, 21 nt, Homo sapiens
ugcugcggccagccugacuag

SEQ ID NO: 1517310 - RNA, 15 nt, Homo sapiens
ugcuuacaauggagu

SEQ ID NO: 1517311 - RNA, 16 nt, Homo sapiens
ugcuuacaauggaguc

SEQ ID NO: 1517312 - RNA, 12 nt, Homo sapiens
ugcuucacauaa

SEQ ID NO: 1517313 - RNA, 21 nt, Homo sapiens
ugcuuccgugcugaacuuuag

SEQ ID NO: 1517314 - RNA, 14 nt, Homo sapiens
ugcuugaauugcaa

SEQ ID NO: 1517315 - RNA, 19 nt, Homo sapiens
ugcuugaauugcaaggcua

SEQ ID NO: 1517316 - RNA, 22 nt, Homo sapiens
ugcuuuaggugagucacacuca

SEQ ID NO: 1517317 - RNA, 16 nt, Homo sapiens
ugcuuuuugacaugaa

SEQ ID NO: 1517318 - RNA, 17 nt, Homo sapiens
uggaaaaugugacccag

SEQ ID NO: 1517319 - RNA, 14 nt, Homo sapiens
uggaaacaggacca

SEQ ID NO: 1517320 - RNA, 14 nt, Homo sapiens
uggaaauaaaccug

SEQ ID NO: 1517321 - RNA, 19 nt, Homo sapiens
uggaaauaaaccuggagau

SEQ ID NO: 1517322 - RNA, 16 nt, Homo sapiens
uggaaauuauguggaa

SEQ ID NO: 1517323 - RNA, 15 nt, Homo sapiens
uggaacuucuaauau

SEQ ID NO: 1517324 - RNA, 21 nt, Homo sapiens
uggaagauuagagguuuguca

SEQ ID NO: 1517325 - RNA, 22 nt, Homo sapiens
uggaagauuagagguuugucaa

SEQ ID NO: 1517326 - RNA, 19 nt, Homo sapiens
uggaagccaggacugugau

SEQ ID NO: 1517327 - RNA, 22 nt, Homo sapiens
uggaagguuagguuugucaaca

SEQ ID NO: 1517328 - RNA, 18 nt, Homo sapiens
uggaaguucacuggaguc

SEQ ID NO: 1517329 - RNA, 19 nt, Homo sapiens
uggaaucaaggaauccuga

SEQ ID NO: 1517330 - RNA, 21 nt, Homo sapiens
uggaaucagucguuggcaccu

SEQ ID NO: 1517331 - RNA, 19 nt, Homo sapiens
uggaauuuucagucaucuc

SEQ ID NO: 1517332 - RNA, 22 nt, Homo sapiens
uggacaauaugaaucuuuucca

SEQ ID NO: 1517333 - RNA, 22 nt, Homo sapiens
uggacguacugguuuaaccucc

SEQ ID NO: 1517334 - RNA, 22 nt, Homo sapiens
uggacugguaaguaacuguggu

SEQ ID NO: 1517335 - RNA, 22 nt, Homo sapiens
uggagcccgcuucaagcucucu

SEQ ID NO: 1517336 - RNA, 14 nt, Homo sapiens
uggagcuacuuuaa

SEQ ID NO: 1517337 - RNA, 15 nt, Homo sapiens
uggagcugacuguuc

SEQ ID NO: 1517338 - RNA, 18 nt, Homo sapiens
uggaggaaaauccaugga

SEQ ID NO: 1517339 - RNA, 13 nt, Homo sapiens
uggaguucagaga

SEQ ID NO: 1517340 - RNA, 17 nt, Homo sapiens
uggauauccacgcagca

SEQ ID NO: 1517341 - RNA, 17 nt, Homo sapiens
uggaucuuuugguggag

SEQ ID NO: 1517342 - RNA, 17 nt, Homo sapiens
uggaugaugaaacauuc

SEQ ID NO: 1517343 - RNA, 15 nt, Homo sapiens
uggauucgugacaac

SEQ ID NO: 1517344 - RNA, 22 nt, Homo sapiens
uggauuuuguccauucaucuca

SEQ ID NO: 1517345 - RNA, 22 nt, Homo sapiens
uggcagagaggaccccacugga

SEQ ID NO: 1517346 - RNA, 14 nt, Homo sapiens
uggcaggaccagga

SEQ ID NO: 1517347 - RNA, 18 nt, Homo sapiens
uggcaggacccugucagg

SEQ ID NO: 1517348 - RNA, 16 nt, Homo sapiens
uggcauucacacagcc

SEQ ID NO: 1517349 - RNA, 19 nt, Homo sapiens
uggccaagccuggcccuua

SEQ ID NO: 1517350 - RNA, 17 nt, Homo sapiens
uggccagugugauccca

SEQ ID NO: 1517351 - RNA, 23 nt, Homo sapiens
uggcccagcaggcaggcacugug

SEQ ID NO: 1517352 - RNA, 22 nt, Homo sapiens
uggccgggugcgguggcucacg

SEQ ID NO: 1517353 - RNA, 22 nt, Homo sapiens
uggccuugggagagaugccuuc

SEQ ID NO: 1517354 - RNA, 22 nt, Homo sapiens
uggcucacaaaagguuaaugga

SEQ ID NO: 1517355 - RNA, 21 nt, Homo sapiens
uggcuccaaggugcucugugu

SEQ ID NO: 1517356 - RNA, 16 nt, Homo sapiens
uggcucccaggguccu

SEQ ID NO: 1517357 - RNA, 19 nt, Homo sapiens
uggcuccuuaggaacagcu

SEQ ID NO: 1517358 - RNA, 15 nt, Homo sapiens
uggcucuugccugua

SEQ ID NO: 1517359 - RNA, 15 nt, Homo sapiens
uggcugaccccaaag

SEQ ID NO: 1517360 - RNA, 21 nt, Homo sapiens
uggcugaccugggcccacaga

SEQ ID NO: 1517361 - RNA, 23 nt, Homo sapiens
uggcuggaucuuuugguggaguc

SEQ ID NO: 1517362 - RNA, 19 nt, Homo sapiens
uggcuuaagcaacagauaa

SEQ ID NO: 1517363 - RNA, 17 nt, Homo sapiens
uggcuuagaaaucuuua

SEQ ID NO: 1517364 - RNA, 21 nt, Homo sapiens
uggcuuuuuuccuccugugua

SEQ ID NO: 1517365 - RNA, 23 nt, Homo sapiens
uggcuuuuuuccuccuguguaca

SEQ ID NO: 1517366 - RNA, 23 nt, Homo sapiens
caaaaguauuuaacgacccaguc

SEQ ID NO: 1517367 - RNA, 14 nt, Homo sapiens
caaaagucagaccc

SEQ ID NO: 1517368 - RNA, 16 nt, Homo sapiens
caaaagucuggccuuu

SEQ ID NO: 1517369 - RNA, 22 nt, Homo sapiens
caaaaugcagucuuaccaauga

SEQ ID NO: 1517370 - RNA, 18 nt, Homo sapiens
caaacuauuacuuacaaa

SEQ ID NO: 1517371 - RNA, 20 nt, Homo sapiens
caaacugaauggcaaugaaa

SEQ ID NO: 1517372 - RNA, 15 nt, Homo sapiens
caaacuguacaguuu

SEQ ID NO: 1517373 - RNA, 20 nt, Homo sapiens
caaacuguacaguuucuucc

SEQ ID NO: 1517374 - RNA, 18 nt, Homo sapiens
caaagaaaugcugaugga

SEQ ID NO: 1517375 - RNA, 20 nt, Homo sapiens
caaagaacugccccaucucc

SEQ ID NO: 1517376 - RNA, 13 nt, Homo sapiens
caaagaaguuuaa

SEQ ID NO: 1517377 - RNA, 14 nt, Homo sapiens
caaagacacaggaa

SEQ ID NO: 1517378 - RNA, 16 nt, Homo sapiens
caaagacacaggaaga

SEQ ID NO: 1517379 - RNA, 15 nt, Homo sapiens
caaagagaaaagcca

SEQ ID NO: 1517380 - RNA, 10 nt, Homo sapiens
caaagccaaa

SEQ ID NO: 1517381 - RNA, 18 nt, Homo sapiens
caaagcuaggaugguucu

SEQ ID NO: 1517382 - RNA, 19 nt, Homo sapiens
caaagggacacacagugac

SEQ ID NO: 1517383 - RNA, 18 nt, Homo sapiens
caaaggggaugcccagug

SEQ ID NO: 1517384 - RNA, 18 nt, Homo sapiens
caaagucugugugaugaa

SEQ ID NO: 1517385 - RNA, 15 nt, Homo sapiens
caaaguuuaacacaa

SEQ ID NO: 1517386 - RNA, 14 nt, Homo sapiens
caaauauauugcaa

SEQ ID NO: 1517387 - RNA, 16 nt, Homo sapiens
caaauauuaccaaaaa

SEQ ID NO: 1517388 - RNA, 21 nt, Homo sapiens
caaaucuugguugaugccaaa

SEQ ID NO: 1517389 - RNA, 19 nt, Homo sapiens
caaaugcuggggucauaua

SEQ ID NO: 1517390 - RNA, 21 nt, Homo sapiens
caaaugcuggggucauauaaa

SEQ ID NO: 1517391 - RNA, 15 nt, Homo sapiens
caaauggacuauaca

SEQ ID NO: 1517392 - RNA, 23 nt, Homo sapiens
caaauguaaaauaaguauuucca

SEQ ID NO: 1517393 - RNA, 17 nt, Homo sapiens
caaaugucaguucauaa

SEQ ID NO: 1517394 - RNA, 21 nt, Homo sapiens
caaaugucaguucauaauaua

SEQ ID NO: 1517395 - RNA, 22 nt, Homo sapiens
caacaaaaucaauuuuuugcua

SEQ ID NO: 1517396 - RNA, 13 nt, Homo sapiens
caacaaaccaaaa

SEQ ID NO: 1517397 - RNA, 19 nt, Homo sapiens
caacaaacuuggucuuaca

SEQ ID NO: 1517398 - RNA, 21 nt, Homo sapiens
caacaaagauugagaagccau

SEQ ID NO: 1517399 - RNA, 23 nt, Homo sapiens
caacaaagauugagaagccaugu

SEQ ID NO: 1517400 - RNA, 16 nt, Homo sapiens
caacaacaaaccaaaa

SEQ ID NO: 1517401 - RNA, 15 nt, Homo sapiens
caacauuuauuucaa

SEQ ID NO: 1517402 - RNA, 13 nt, Homo sapiens
caaccaaccacaa

SEQ ID NO: 1517403 - RNA, 15 nt, Homo sapiens
caacccuucauuuaa

SEQ ID NO: 1517404 - RNA, 19 nt, Homo sapiens
caaccuccccugguccugc

SEQ ID NO: 1517405 - RNA, 15 nt, Homo sapiens
caacgauuagcuuuu

SEQ ID NO: 1517406 - RNA, 23 nt, Homo sapiens
caacugcccaggaaggacugugc

SEQ ID NO: 1517407 - RNA, 19 nt, Homo sapiens
caacugcugaucaaugaaa

SEQ ID NO: 1517408 - RNA, 20 nt, Homo sapiens
caacuuauaaagcauugcaa

SEQ ID NO: 1517409 - RNA, 13 nt, Homo sapiens
caacuuggcuuuc

SEQ ID NO: 1517410 - RNA, 12 nt, Homo sapiens
caacuuucugua

SEQ ID NO: 1517411 - RNA, 12 nt, Homo sapiens
caagaaacagaa

SEQ ID NO: 1517412 - RNA, 15 nt, Homo sapiens
caagacacuaguuca

SEQ ID NO: 1517413 - RNA, 22 nt, Homo sapiens
caagacuacuggacuucuauca

SEQ ID NO: 1517414 - RNA, 15 nt, Homo sapiens
caagacuccauuuca

SEQ ID NO: 1517415 - RNA, 17 nt, Homo sapiens
caagacuugauacugca

SEQ ID NO: 1517416 - RNA, 21 nt, Homo sapiens
caagaguuuauuuccaaauaa

SEQ ID NO: 1517417 - RNA, 16 nt, Homo sapiens
caagaucuuucaggaa

SEQ ID NO: 1517418 - RNA, 17 nt, Homo sapiens
caagaucuuucaggaaa

SEQ ID NO: 1517419 - RNA, 22 nt, Homo sapiens
caagcaagaggugguagaacca

SEQ ID NO: 1517420 - RNA, 16 nt, Homo sapiens
caagccccugccucca

SEQ ID NO: 1517421 - RNA, 14 nt, Homo sapiens
caagccugcagcga

SEQ ID NO: 1517422 - RNA, 22 nt, Homo sapiens
caaggaaacucgaauaaaggau

SEQ ID NO: 1517423 - RNA, 13 nt, Homo sapiens
caaggcauaccug

SEQ ID NO: 1517424 - RNA, 18 nt, Homo sapiens
caaggcauaccuguccua

SEQ ID NO: 1517425 - RNA, 18 nt, Homo sapiens
caagguggggggaucaca

SEQ ID NO: 1517426 - RNA, 15 nt, Homo sapiens
caagucuacuucacu

SEQ ID NO: 1517427 - RNA, 16 nt, Homo sapiens
caagucuacuucacua

SEQ ID NO: 1517428 - RNA, 17 nt, Homo sapiens
caagucuguuuacugca

SEQ ID NO: 1517429 - RNA, 14 nt, Homo sapiens
caagugccaaacag

SEQ ID NO: 1517430 - RNA, 23 nt, Homo sapiens
caaguuaaaaccugcaaagcuaa

SEQ ID NO: 1517431 - RNA, 16 nt, Homo sapiens
caaguuagcucaggag

SEQ ID NO: 1517432 - RNA, 20 nt, Homo sapiens
caaguuccugcacuccagaa

SEQ ID NO: 1517433 - RNA, 20 nt, Homo sapiens
caauaaaagaaacugugguc

SEQ ID NO: 1517434 - RNA, 14 nt, Homo sapiens
caauaaagacugag

SEQ ID NO: 1517435 - RNA, 16 nt, Homo sapiens
caauaauaaauccuca

SEQ ID NO: 1517436 - RNA, 15 nt, Homo sapiens
caauaggcauuugau

SEQ ID NO: 1517437 - RNA, 20 nt, Homo sapiens
caauagggugcaguuuucca

SEQ ID NO: 1517438 - RNA, 14 nt, Homo sapiens
caauaguaaaagau

SEQ ID NO: 1517439 - RNA, 14 nt, Homo sapiens
caauaguuugcaua

SEQ ID NO: 1517440 - RNA, 15 nt, Homo sapiens
caaugaaugaucauu

SEQ ID NO: 1517441 - RNA, 20 nt, Homo sapiens
caaugcaccuaaagaaaaac

SEQ ID NO: 1517442 - RNA, 11 nt, Homo sapiens
caaugcuauaa

SEQ ID NO: 1517443 - RNA, 23 nt, Homo sapiens
caauguaagagccuaacuccauc

SEQ ID NO: 1517444 - RNA, 21 nt, Homo sapiens
caauuauauuuuuguaaauag

SEQ ID NO: 1517445 - RNA, 13 nt, Homo sapiens
caauucuagcauu

SEQ ID NO: 1517446 - RNA, 20 nt, Homo sapiens
caauucucaaaagaaaaggc

SEQ ID NO: 1517447 - RNA, 14 nt, Homo sapiens
caauuucuaccuuu

SEQ ID NO: 1517448 - RNA, 16 nt, Homo sapiens
caauuuuuugcuaaac

SEQ ID NO: 1517449 - RNA, 18 nt, Homo sapiens
cacaaaaaggcauaugca

SEQ ID NO: 1517450 - RNA, 19 nt, Homo sapiens
cacaaaaaggcauaugcaa

SEQ ID NO: 1517451 - RNA, 16 nt, Homo sapiens
cacaaacuauuacuua

SEQ ID NO: 1517452 - RNA, 14 nt, Homo sapiens
cacaaacuuaacau

SEQ ID NO: 1517453 - RNA, 20 nt, Homo sapiens
cacaaagaagaaguuuaaaa

SEQ ID NO: 1517454 - RNA, 14 nt, Homo sapiens
cacaacacaguucu

SEQ ID NO: 1517455 - RNA, 14 nt, Homo sapiens
cacaagccugagaa

SEQ ID NO: 1517456 - RNA, 17 nt, Homo sapiens
cacaagcuggaagcaca

SEQ ID NO: 1517457 - RNA, 15 nt, Homo sapiens
cacaaggugauuuca

SEQ ID NO: 1517458 - RNA, 15 nt, Homo sapiens
cacaaguccugugaa

SEQ ID NO: 1517459 - RNA, 15 nt, Homo sapiens
cacaaguguguaaag

SEQ ID NO: 1517460 - RNA, 17 nt, Homo sapiens
cacacaaaagggaaccc

SEQ ID NO: 1517461 - RNA, 20 nt, Homo sapiens
cacacagucucaguccagau

SEQ ID NO: 1517462 - RNA, 20 nt, Homo sapiens
cacaccucacgcucuggaca

SEQ ID NO: 1517463 - RNA, 18 nt, Homo sapiens
cacaccugacaaauggaa

SEQ ID NO: 1517464 - RNA, 22 nt, Homo sapiens
cacagacccacacauguuuaca

SEQ ID NO: 1517465 - RNA, 23 nt, Homo sapiens
cacagccgcagccucccucugac

SEQ ID NO: 1517466 - RNA, 18 nt, Homo sapiens
cacaggauccuauucuca

SEQ ID NO: 1517467 - RNA, 13 nt, Homo sapiens
cacagucucaguc

SEQ ID NO: 1517468 - RNA, 16 nt, Homo sapiens
cacauauuucacaugu

SEQ ID NO: 1517469 - RNA, 20 nt, Homo sapiens
cacaucagcccuguguauaa

SEQ ID NO: 1517470 - RNA, 22 nt, Homo sapiens
cacauccaaccccccaccugcc

SEQ ID NO: 1517471 - RNA, 18 nt, Homo sapiens
cacauguugcuaaugaca

SEQ ID NO: 1517472 - RNA, 17 nt, Homo sapiens
cacauuaaguggcuuuu

SEQ ID NO: 1517473 - RNA, 17 nt, Homo sapiens
cacauucccaucuguca

SEQ ID NO: 1517474 - RNA, 14 nt, Homo sapiens
cacauugacagugg

SEQ ID NO: 1517475 - RNA, 22 nt, Homo sapiens
caccaaguucuggaaaccacgu

SEQ ID NO: 1517476 - RNA, 13 nt, Homo sapiens
caccacaaacugu

SEQ ID NO: 1517477 - RNA, 16 nt, Homo sapiens
caccacugcacuccag

SEQ ID NO: 1517478 - RNA, 15 nt, Homo sapiens
caccaugaaacuuua

SEQ ID NO: 1517479 - RNA, 21 nt, Homo sapiens
caccauuuuguuuagacaauu

SEQ ID NO: 1517480 - RNA, 23 nt, Homo sapiens
cacccauggagagguuugucaac

SEQ ID NO: 1517481 - RNA, 17 nt, Homo sapiens
cacccgacuccucaaaa

SEQ ID NO: 1517482 - RNA, 21 nt, Homo sapiens
cacccucaauaaauguugcuu

SEQ ID NO: 1517483 - RNA, 23 nt, Homo sapiens
cacccuggaaucaagaugucaga

SEQ ID NO: 1517484 - RNA, 16 nt, Homo sapiens
cacccuucucauucca

SEQ ID NO: 1517485 - RNA, 17 nt, Homo sapiens
caccgcgcccagcccua

SEQ ID NO: 1517486 - RNA, 18 nt, Homo sapiens
caccgguaauaagccaag

SEQ ID NO: 1517487 - RNA, 14 nt, Homo sapiens
caccugaaccacug

SEQ ID NO: 1517488 - RNA, 23 nt, Homo sapiens
caccugcucuucuaccauuugaa

SEQ ID NO: 1517489 - RNA, 19 nt, Homo sapiens
caccugggagaaaucuggc

SEQ ID NO: 1517490 - RNA, 18 nt, Homo sapiens
caccuuguuacacauuau

SEQ ID NO: 1517491 - RNA, 19 nt, Homo sapiens
caccuuuuuucaacaguga

SEQ ID NO: 1517492 - RNA, 22 nt, Homo sapiens
cacgucugcagaaacagugcaa

SEQ ID NO: 1517493 - RNA, 18 nt, Homo sapiens
cacuaaaauuccacucau

SEQ ID NO: 1517494 - RNA, 19 nt, Homo sapiens
cacuaacccguuuuauucu

SEQ ID NO: 1517495 - RNA, 11 nt, Homo sapiens
cacuaauuccu

SEQ ID NO: 1517496 - RNA, 16 nt, Homo sapiens
cacuagacaagccaga

SEQ ID NO: 1517497 - RNA, 14 nt, Homo sapiens
cacuagacugugcc

SEQ ID NO: 1517498 - RNA, 22 nt, Homo sapiens
cacuaguucagaggaagcacau

SEQ ID NO: 1517499 - RNA, 19 nt, Homo sapiens
cacucaaggcggugcuuga

SEQ ID NO: 1517500 - RNA, 18 nt, Homo sapiens
cacucuucaaaugccuga

SEQ ID NO: 1517501 - RNA, 15 nt, Homo sapiens
cacucuucuugagca

SEQ ID NO: 1517502 - RNA, 16 nt, Homo sapiens
cacugaauuagccaaa

SEQ ID NO: 1517503 - RNA, 22 nt, Homo sapiens
uuuauuuuuuuaaaacacaaau

SEQ ID NO: 1517504 - RNA, 15 nt, Homo sapiens
uuucaaaagucagac

SEQ ID NO: 1517505 - RNA, 13 nt, Homo sapiens
uuucaacauauca

SEQ ID NO: 1517506 - RNA, 20 nt, Homo sapiens
uuagccaggauggucuggau

SEQ ID NO: 1517507 - RNA, 20 nt, Homo sapiens
uuaggaagaaaucacuuaaa

SEQ ID NO: 1517508 - RNA, 14 nt, Homo sapiens
uuaggcagggauuu

SEQ ID NO: 1517509 - RNA, 16 nt, Homo sapiens
uuaggccacauugaca

SEQ ID NO: 1517510 - RNA, 18 nt, Homo sapiens
uuagggaugacugugauu

SEQ ID NO: 1517511 - RNA, 13 nt, Homo sapiens
uuauaaacugacu

SEQ ID NO: 1517512 - RNA, 21 nt, Homo sapiens
uuauaaacuuuagaguagcau

SEQ ID NO: 1517513 - RNA, 17 nt, Homo sapiens
uuauaaauaugugaaaa

SEQ ID NO: 1517514 - RNA, 20 nt, Homo sapiens
uaucaaaaaguacaauaaua

SEQ ID NO: 1517515 - RNA, 16 nt, Homo sapiens
uaucaaaaaguauuaa

SEQ ID NO: 1517516 - RNA, 19 nt, Homo sapiens
uaucaaaauguuguccuuu

SEQ ID NO: 1517517 - RNA, 20 nt, Homo sapiens
uaucagacuguaggauuuga

SEQ ID NO: 1517518 - RNA, 22 nt, Homo sapiens
uauccuguacauuucacaaaaa

SEQ ID NO: 1517519 - RNA, 18 nt, Homo sapiens
uaucuaccucacuauuca

SEQ ID NO: 1517520 - RNA, 11 nt, Homo sapiens
uaucugugaua

SEQ ID NO: 1517521 - RNA, 17 nt, Homo sapiens
uaucuuuuugcuuacag

SEQ ID NO: 1517522 - RNA, 21 nt, Homo sapiens
uaugaaaaagaagaaucucau

SEQ ID NO: 1517523 - RNA, 14 nt, Homo sapiens
uaugaacuugagga

SEQ ID NO: 1517524 - RNA, 18 nt, Homo sapiens
uaugaauugacagacugu

SEQ ID NO: 1517525 - RNA, 14 nt, Homo sapiens
uaugacaauccuga

SEQ ID NO: 1517526 - RNA, 23 nt, Homo sapiens
uaugacuguuuuuauaugcacau

SEQ ID NO: 1517527 - RNA, 16 nt, Homo sapiens
uaugauccaggauugg

SEQ ID NO: 1517528 - RNA, 23 nt, Homo sapiens
uaugaugguggaucaagacauaa

SEQ ID NO: 1517529 - RNA, 18 nt, Homo sapiens
uauggaagauaauuuuau

SEQ ID NO: 1517530 - RNA, 19 nt, Homo sapiens
uauggcucuggcaccacua

SEQ ID NO: 1517531 - RNA, 13 nt, Homo sapiens
uaugggaagccau

SEQ ID NO: 1517532 - RNA, 14 nt, Homo sapiens
uauggguacauucc

SEQ ID NO: 1517533 - RNA, 14 nt, Homo sapiens
uauguaaucucacc

SEQ ID NO: 1517534 - RNA, 22 nt, Homo sapiens
uauguaaucucaccucaccugg

SEQ ID NO: 1517535 - RNA, 23 nt, Homo sapiens
uauguaauuuagcaguccaaaga

SEQ ID NO: 1517536 - RNA, 16 nt, Homo sapiens
uauguaccaagaaucu

SEQ ID NO: 1517537 - RNA, 17 nt, Homo sapiens
uauguagcuaaacauug

SEQ ID NO: 1517538 - RNA, 18 nt, Homo sapiens
uauguagcuaaacauugu

SEQ ID NO: 1517539 - RNA, 18 nt, Homo sapiens
uauguauauagaugugca

SEQ ID NO: 1517540 - RNA, 17 nt, Homo sapiens
uauguccgaugguaucu

SEQ ID NO: 1517541 - RNA, 17 nt, Homo sapiens
uaugugaaaaugauuag

SEQ ID NO: 1517542 - RNA, 14 nt, Homo sapiens
uaugugauguuaac

SEQ ID NO: 1517543 - RNA, 21 nt, Homo sapiens
uauuaaaauuuuuugauguca

SEQ ID NO: 1517544 - RNA, 19 nt, Homo sapiens
uauuaauuuuugaaaccca

SEQ ID NO: 1517545 - RNA, 21 nt, Homo sapiens
cagguaggggcacagugaaug

SEQ ID NO: 1517546 - RNA, 21 nt, Homo sapiens
cagguaguuggugaacagaga

SEQ ID NO: 1517547 - RNA, 19 nt, Homo sapiens
caggucauuauuuuuuaca

SEQ ID NO: 1517548 - RNA, 15 nt, Homo sapiens
caggugccuaccacc

SEQ ID NO: 1517549 - RNA, 15 nt, Homo sapiens
caggugggaaauggu

SEQ ID NO: 1517550 - RNA, 17 nt, Homo sapiens
caggugguccugagacc

SEQ ID NO: 1517551 - RNA, 18 nt, Homo sapiens
caggugguuuuugguuac

SEQ ID NO: 1517552 - RNA, 19 nt, Homo sapiens
cagguguaagccaccgugc

SEQ ID NO: 1517553 - RNA, 20 nt, Homo sapiens
cagguguaagccaccgugcc

SEQ ID NO: 1517554 - RNA, 15 nt, Homo sapiens
cagguuggaguguaa

SEQ ID NO: 1517555 - RNA, 12 nt, Homo sapiens
caguaacacugg

SEQ ID NO: 1517556 - RNA, 21 nt, Homo sapiens
caguaacauuuggagugugua

SEQ ID NO: 1517557 - RNA, 19 nt, Homo sapiens
caguaggaaaucaggcagu

SEQ ID NO: 1517558 - RNA, 14 nt, Homo sapiens
caguauguuacaug

SEQ ID NO: 1517559 - RNA, 17 nt, Homo sapiens
caguauuccaugggaug

SEQ ID NO: 1517560 - RNA, 20 nt, Homo sapiens
caguccgccaaacacuccac

SEQ ID NO: 1517561 - RNA, 20 nt, Homo sapiens
cagugaggcucuauugagcc

SEQ ID NO: 1517562 - RNA, 23 nt, Homo sapiens
cagugauauaugccuauaauaua

SEQ ID NO: 1517563 - RNA, 11 nt, Homo sapiens
cagugcaagag

SEQ ID NO: 1517564 - RNA, 16 nt, Homo sapiens
cagugcacuguauaua

SEQ ID NO: 1517565 - RNA, 19 nt, Homo sapiens
cagugcccuuuucaucucc

SEQ ID NO: 1517566 - RNA, 21 nt, Homo sapiens
cagugcuguggccugggcaag

SEQ ID NO: 1517567 - RNA, 22 nt, Homo sapiens
caguggaaaaaucagaagcaca

SEQ ID NO: 1517568 - RNA, 20 nt, Homo sapiens
caguggugaagaaaacuccu

SEQ ID NO: 1517569 - RNA, 22 nt, Homo sapiens
caguguacacuguucccaauau

SEQ ID NO: 1517570 - RNA, 20 nt, Homo sapiens
caguguguguuuaacauuca

SEQ ID NO: 1517571 - RNA, 21 nt, Homo sapiens
caguguguguuuaacauucac

SEQ ID NO: 1517572 - RNA, 18 nt, Homo sapiens
caguuagcaacaaaucca

SEQ ID NO: 1517573 - RNA, 14 nt, Homo sapiens
caguucugacacac

SEQ ID NO: 1517574 - RNA, 15 nt, Homo sapiens
caguugacaaaaagc

SEQ ID NO: 1517575 - RNA, 14 nt, Homo sapiens
caguugacagcagg

SEQ ID NO: 1517576 - RNA, 13 nt, Homo sapiens
caguugacuuacu

SEQ ID NO: 1517577 - RNA, 19 nt, Homo sapiens
caguugauucugaaucuga

SEQ ID NO: 1517578 - RNA, 16 nt, Homo sapiens
caguugcccucaggcc

SEQ ID NO: 1517579 - RNA, 16 nt, Homo sapiens
caguuguuacugaagu

SEQ ID NO: 1517580 - RNA, 18 nt, Homo sapiens
cauaaacuguacaaauga

SEQ ID NO: 1517581 - RNA, 22 nt, Homo sapiens
cauaaaucuuguaaucauguua

SEQ ID NO: 1517582 - RNA, 18 nt, Homo sapiens
cauaacugguagcuauaa

SEQ ID NO: 1517583 - RNA, 14 nt, Homo sapiens
cauaagaacgucau

SEQ ID NO: 1517584 - RNA, 11 nt, Homo sapiens
cauaagccuac

SEQ ID NO: 1517585 - RNA, 21 nt, Homo sapiens
cauaauccagagauaauugcc

SEQ ID NO: 1517586 - RNA, 15 nt, Homo sapiens
cauacccucuaccug

SEQ ID NO: 1517587 - RNA, 18 nt, Homo sapiens
cauacugaucccuuuccc

SEQ ID NO: 1517588 - RNA, 22 nt, Homo sapiens
cauagagggagaggaagcacac

SEQ ID NO: 1517589 - RNA, 18 nt, Homo sapiens
cauaguuauuuacuugaa

SEQ ID NO: 1517590 - RNA, 19 nt, Homo sapiens
cauaguuauuuacuugaaa

SEQ ID NO: 1517591 - RNA, 20 nt, Homo sapiens
cauaguucuuacuacuugcc

SEQ ID NO: 1517592 - RNA, 12 nt, Homo sapiens
agagcaggcuca

SEQ ID NO: 1517593 - RNA, 14 nt, Homo sapiens
agagccagcucucu

SEQ ID NO: 1517594 - RNA, 18 nt, Homo sapiens
agagccuucaagugccaa

SEQ ID NO: 1517595 - RNA, 15 nt, Homo sapiens
agagcuggggcugcc

SEQ ID NO: 1517596 - RNA, 15 nt, Homo sapiens
agagcuuucaaguac

SEQ ID NO: 1517597 - RNA, 16 nt, Homo sapiens
agaggaagcacacugc

SEQ ID NO: 1517598 - RNA, 16 nt, Homo sapiens
agaggacaccauccaa

SEQ ID NO: 1517599 - RNA, 22 nt, Homo sapiens
agaggacagagcuggcugucuu

SEQ ID NO: 1517600 - RNA, 13 nt, Homo sapiens
agaggcagagaaa

SEQ ID NO: 1517601 - RNA, 21 nt, Homo sapiens
agagggcagcccccacuuucc

SEQ ID NO: 1517602 - RNA, 19 nt, Homo sapiens
agagguuugucaacaaaaa

SEQ ID NO: 1517603 - RNA, 19 nt, Homo sapiens
agaguaaauagcauucucu

SEQ ID NO: 1517604 - RNA, 12 nt, Homo sapiens
agaguagucaug

SEQ ID NO: 1517605 - RNA, 23 nt, Homo sapiens
agagugaaauaauuaaaaaccac

SEQ ID NO: 1517606 - RNA, 15 nt, Homo sapiens
agagugaauguguac

SEQ ID NO: 1517607 - RNA, 18 nt, Homo sapiens
agagugagacucgucuca

SEQ ID NO: 1517608 - RNA, 23 nt, Homo sapiens
agauaacaagaucuuucaggaaa

SEQ ID NO: 1517609 - RNA, 23 nt, Homo sapiens
agauaacagcuuaacauuuacau

SEQ ID NO: 1517610 - RNA, 13 nt, Homo sapiens
agauaacugagaa

SEQ ID NO: 1517611 - RNA, 13 nt, Homo sapiens
agauaauugccau

SEQ ID NO: 1517612 - RNA, 19 nt, Homo sapiens
agauaauuuuauguguuau

SEQ ID NO: 1517613 - RNA, 11 nt, Homo sapiens
agauaccaugg

SEQ ID NO: 1517614 - RNA, 15 nt, Homo sapiens
agauaucagugucuc

SEQ ID NO: 1517615 - RNA, 22 nt, Homo sapiens
agauauugggacacacaucaaa

SEQ ID NO: 1517616 - RNA, 16 nt, Homo sapiens
agaucagcaguggcag

SEQ ID NO: 1517617 - RNA, 23 nt, Homo sapiens
agaucaugucauugaugaacugc

SEQ ID NO: 1517618 - RNA, 17 nt, Homo sapiens
agaucgcgccacugcac

SEQ ID NO: 1517619 - RNA, 15 nt, Homo sapiens
agaucugcacugggu

SEQ ID NO: 1517620 - RNA, 13 nt, Homo sapiens
agaugccuuccag

SEQ ID NO: 1517621 - RNA, 17 nt, Homo sapiens
agaugcugggauagcca

SEQ ID NO: 1517622 - RNA, 16 nt, Homo sapiens
agaugcuuugugacuu

SEQ ID NO: 1517623 - RNA, 17 nt, Homo sapiens
agauguaaaugccacaa

SEQ ID NO: 1517624 - RNA, 22 nt, Homo sapiens
agauguaagguaauuucugugu

SEQ ID NO: 1517625 - RNA, 18 nt, Homo sapiens
agauguauaaaucuuucu

SEQ ID NO: 1517626 - RNA, 22 nt, Homo sapiens
agauuauccuauauuccuauca

SEQ ID NO: 1517627 - RNA, 15 nt, Homo sapiens
agauuucaacauauc

SEQ ID NO: 1517628 - RNA, 20 nt, Homo sapiens
agauuuugucgggacagaga

SEQ ID NO: 1517629 - RNA, 13 nt, Homo sapiens
agcaaacaccagu

SEQ ID NO: 1517630 - RNA, 12 nt, Homo sapiens
agcaaaccacau

SEQ ID NO: 1517631 - RNA, 20 nt, Homo sapiens
agcaaaggaaaccaaaggaa

SEQ ID NO: 1517632 - RNA, 14 nt, Homo sapiens
agcaaauuaguaau

SEQ ID NO: 1517633 - RNA, 13 nt, Homo sapiens
agcaacacagagc

SEQ ID NO: 1517634 - RNA, 14 nt, Homo sapiens
agcaagacuccauu

SEQ ID NO: 1517635 - RNA, 16 nt, Homo sapiens
agcaagacuccauuuc

SEQ ID NO: 1517636 - RNA, 21 nt, Homo sapiens
agcaaggguugggcccagugu

SEQ ID NO: 1517637 - RNA, 13 nt, Homo sapiens
agcaaguuucacc

SEQ ID NO: 1517638 - RNA, 17 nt, Homo sapiens
agcaauagggugcaguu

SEQ ID NO: 1517639 - RNA, 21 nt, Homo sapiens
agcaaucucgcaguacauguu

SEQ ID NO: 1517640 - RNA, 18 nt, Homo sapiens
agcaaucugagagauuug

SEQ ID NO: 1517641 - RNA, 23 nt, Homo sapiens
agcacauguugcuaaugacagug

SEQ ID NO: 1517642 - RNA, 19 nt, Homo sapiens
agcaccccugucucuagcc

SEQ ID NO: 1517643 - RNA, 17 nt, Homo sapiens
agcaccugaaccacugu

SEQ ID NO: 1517644 - RNA, 22 nt, Homo sapiens
agcacucagaaaagaaaaccau

SEQ ID NO: 1517645 - RNA, 18 nt, Homo sapiens
agcacugcuccagugggg

SEQ ID NO: 1517646 - RNA, 22 nt, Homo sapiens
agcacuuuaacccucucuuccc

SEQ ID NO: 1517647 - RNA, 20 nt, Homo sapiens
agcagagacgggguuucacc

SEQ ID NO: 1517648 - RNA, 23 nt, Homo sapiens
agcagagcugauggagaaggaag

SEQ ID NO: 1517649 - RNA, 22 nt, Homo sapiens
agcagcagugagcuucuauuaa

SEQ ID NO: 1517650 - RNA, 22 nt, Homo sapiens
agcagcaucuacucuaggcaua

SEQ ID NO: 1517651 - RNA, 12 nt, Homo sapiens
agcaggcucaga

SEQ ID NO: 1517652 - RNA, 13 nt, Homo sapiens
agcagggacaccc

SEQ ID NO: 1517653 - RNA, 18 nt, Homo sapiens
agcagguuaccacucugg

SEQ ID NO: 1517654 - RNA, 20 nt, Homo sapiens
agcagguuaccacucuggca

SEQ ID NO: 1517655 - RNA, 19 nt, Homo sapiens
agcaguuguuauuuaguga

SEQ ID NO: 1517656 - RNA, 17 nt, Homo sapiens
agcaucaccucaggcca

SEQ ID NO: 1517657 - RNA, 20 nt, Homo sapiens
agcaugggacugugccuuug

SEQ ID NO: 1517658 - RNA, 15 nt, Homo sapiens
agcauugcaguaugg

SEQ ID NO: 1517659 - RNA, 17 nt, Homo sapiens
agcauuucaaaauggac

SEQ ID NO: 1517660 - RNA, 14 nt, Homo sapiens
agccaaacucugcc

SEQ ID NO: 1517661 - RNA, 15 nt, Homo sapiens
agccaaacucugcca

SEQ ID NO: 1517662 - RNA, 16 nt, Homo sapiens
agccaaacucugccag

SEQ ID NO: 1517663 - RNA, 21 nt, Homo sapiens
agccaaacucugccagccaca

SEQ ID NO: 1517664 - RNA, 21 nt, Homo sapiens
agccaacugccccgggugccu

SEQ ID NO: 1517665 - RNA, 16 nt, Homo sapiens
agccaacuuggcuuuc

SEQ ID NO: 1517666 - RNA, 20 nt, Homo sapiens
agccaagaucgcgccacugc

SEQ ID NO: 1517667 - RNA, 14 nt, Homo sapiens
agccaauagacuga

SEQ ID NO: 1517668 - RNA, 15 nt, Homo sapiens
agccacaccaggaua

SEQ ID NO: 1517669 - RNA, 13 nt, Homo sapiens
agccacucuucca

SEQ ID NO: 1517670 - RNA, 13 nt, Homo sapiens
agccagaacuuga

SEQ ID NO: 1517671 - RNA, 16 nt, Homo sapiens
agccagccggugccug

SEQ ID NO: 1517672 - RNA, 14 nt, Homo sapiens
agccagcuguuucc

SEQ ID NO: 1517673 - RNA, 15 nt, Homo sapiens
agccaguacagagaa

SEQ ID NO: 1517674 - RNA, 17 nt, Homo sapiens
agccauuuccauggcuc

SEQ ID NO: 1517675 - RNA, 15 nt, Homo sapiens
agcccagaaccacag

SEQ ID NO: 1517676 - RNA, 13 nt, Homo sapiens
agcccagcacaac

SEQ ID NO: 1517677 - RNA, 15 nt, Homo sapiens
agcccagccuagccc

SEQ ID NO: 1517678 - RNA, 18 nt, Homo sapiens
agcccagugugggacuga

SEQ ID NO: 1517679 - RNA, 19 nt, Homo sapiens
agcccgcuucaagcucucu

SEQ ID NO: 1517680 - RNA, 15 nt, Homo sapiens
agcccgggugugccu

SEQ ID NO: 1517681 - RNA, 13 nt, Homo sapiens
agcccugacuggu

SEQ ID NO: 1517682 - RNA, 19 nt, Homo sapiens
agccgcagacaaguaauca

SEQ ID NO: 1517683 - RNA, 16 nt, Homo sapiens
agccgcugcacaucac

SEQ ID NO: 1517684 - RNA, 19 nt, Homo sapiens
agccuaauacaacauguag

SEQ ID NO: 1517685 - RNA, 16 nt, Homo sapiens
agccuaccaauguaga

SEQ ID NO: 1517686 - RNA, 18 nt, Homo sapiens
agccucccaaguagcugg

SEQ ID NO: 1517687 - RNA, 19 nt, Homo sapiens
agccucccgaguagcugag

SEQ ID NO: 1517688 - RNA, 17 nt, Homo sapiens
agccuccgccauuccaa

SEQ ID NO: 1517689 - RNA, 15 nt, Homo sapiens
agccuggagggaugc

SEQ ID NO: 1517690 - RNA, 15 nt, Homo sapiens
agccuguauagacag

SEQ ID NO: 1517691 - RNA, 21 nt, Homo sapiens
agccuguccugguacagcagg

SEQ ID NO: 1517692 - RNA, 15 nt, Homo sapiens
agccuguugcugaag

SEQ ID NO: 1517693 - RNA, 22 nt, Homo sapiens
agccuuccugaguuucucucuc

SEQ ID NO: 1517694 - RNA, 18 nt, Homo sapiens
agccuugcaucaagggcu

SEQ ID NO: 1517695 - RNA, 22 nt, Homo sapiens
agccuugucuucuuagcuguca

SEQ ID NO: 1517696 - RNA, 14 nt, Homo sapiens
agccuuugcuucca

SEQ ID NO: 1517697 - RNA, 15 nt, Homo sapiens
agcgaaucaucucaa

SEQ ID NO: 1517698 - RNA, 19 nt, Homo sapiens
agcgaauguguacaaagug

SEQ ID NO: 1517699 - RNA, 17 nt, Homo sapiens
agcgagagucugucuca

SEQ ID NO: 1517700 - RNA, 13 nt, Homo sapiens
agcgcgugcacag

SEQ ID NO: 1517701 - RNA, 14 nt, Homo sapiens
agcggaucucacuc

SEQ ID NO: 1517702 - RNA, 18 nt, Homo sapiens
agcggaucucacucagcc

SEQ ID NO: 1517703 - RNA, 16 nt, Homo sapiens
agcuaaacauugugau

SEQ ID NO: 1517704 - RNA, 20 nt, Homo sapiens
agcuaagagcaguacucuga

SEQ ID NO: 1517705 - RNA, 21 nt, Homo sapiens
agcuaagagcaguacucugaa

SEQ ID NO: 1517706 - RNA, 17 nt, Homo sapiens
agcuacucucuugccag

SEQ ID NO: 1517707 - RNA, 16 nt, Homo sapiens
agcuaggcuaagucaa

SEQ ID NO: 1517708 - RNA, 18 nt, Homo sapiens
agcucaagcuuuugcuca

SEQ ID NO: 1517709 - RNA, 16 nt, Homo sapiens
aucucuaauauggcaa

SEQ ID NO: 1517710 - RNA, 16 nt, Homo sapiens
aucucugcuuacuaau

SEQ ID NO: 1517711 - RNA, 13 nt, Homo sapiens
aucugcacugggu

SEQ ID NO: 1517712 - RNA, 16 nt, Homo sapiens
aucuggcuuagugcca

SEQ ID NO: 1517713 - RNA, 17 nt, Homo sapiens
aucuggcuuagugccac

SEQ ID NO: 1517714 - RNA, 18 nt, Homo sapiens
aucuggcuuagugccacc

SEQ ID NO: 1517715 - RNA, 22 nt, Homo sapiens
aucuggcuuagugccacccacc

SEQ ID NO: 1517716 - RNA, 15 nt, Homo sapiens
aucugggauucccac

SEQ ID NO: 1517717 - RNA, 11 nt, Homo sapiens
aucuguacaau

SEQ ID NO: 1517718 - RNA, 15 nt, Homo sapiens
aucuguaguaauuua

SEQ ID NO: 1517719 - RNA, 22 nt, Homo sapiens
aucuguaguuuguauagccuca

SEQ ID NO: 1517720 - RNA, 16 nt, Homo sapiens
aucuguauuuuuuaca

SEQ ID NO: 1517721 - RNA, 18 nt, Homo sapiens
aucuucggggugugauga

SEQ ID NO: 1517722 - RNA, 17 nt, Homo sapiens
aucuugacauguaauga

SEQ ID NO: 1517723 - RNA, 12 nt, Homo sapiens
aucuuucaggaa

SEQ ID NO: 1517724 - RNA, 23 nt, Homo sapiens
augaaaacucauuacuuuuccau

SEQ ID NO: 1517725 - RNA, 15 nt, Homo sapiens
augaaaacugaauca

SEQ ID NO: 1517726 - RNA, 13 nt, Homo sapiens
augaacugccaaa

SEQ ID NO: 1517727 - RNA, 12 nt, Homo sapiens
augaaggccaca

SEQ ID NO: 1517728 - RNA, 18 nt, Homo sapiens
augaaguuaugcugucau

SEQ ID NO: 1517729 - RNA, 18 nt, Homo sapiens
augaaguuauucuugaca

SEQ ID NO: 1517730 - RNA, 20 nt, Homo sapiens
augaauagagaguauguaau

SEQ ID NO: 1517731 - RNA, 21 nt, Homo sapiens
augaauagcgaaucaucucaa

SEQ ID NO: 1517732 - RNA, 12 nt, Homo sapiens
augaaugcacac

SEQ ID NO: 1517733 - RNA, 11 nt, Homo sapiens
augaaugucau

SEQ ID NO: 1517734 - RNA, 20 nt, Homo sapiens
augacagcaguguuaagugu

SEQ ID NO: 1517735 - RNA, 17 nt, Homo sapiens
augacuggucucuggcu

SEQ ID NO: 1517736 - RNA, 15 nt, Homo sapiens
augacuucugcugaa

SEQ ID NO: 1517737 - RNA, 18 nt, Homo sapiens
augagaaaauggcuuuaa

SEQ ID NO: 1517738 - RNA, 22 nt, Homo sapiens
augagaaacuuugaucucugcu

SEQ ID NO: 1517739 - RNA, 18 nt, Homo sapiens
augagccaccaugcccag

SEQ ID NO: 1517740 - RNA, 22 nt, Homo sapiens
augagcuguggacuagcaauau

SEQ ID NO: 1517741 - RNA, 22 nt, Homo sapiens
aaaaaagauuuguagagucaau

SEQ ID NO: 1517742 - RNA, 20 nt, Homo sapiens
aaaaaaguaaguaccacuca

SEQ ID NO: 1517743 - RNA, 15 nt, Homo sapiens
aaaaagaaauuugau

SEQ ID NO: 1517744 - RNA, 17 nt, Homo sapiens
aaaaagaagcaaccuca

SEQ ID NO: 1517745 - RNA, 22 nt, Homo sapiens
aaaaaugcugcuucuccuccca

SEQ ID NO: 1517746 - RNA, 15 nt, Homo sapiens
aaaacaaaaaaccac

SEQ ID NO: 1517747 - RNA, 15 nt, Homo sapiens
aaaacacaucuuucc

SEQ ID NO: 1517748 - RNA, 23 nt, Homo sapiens
aaaacaguuuugucagucuuucu

SEQ ID NO: 1517749 - RNA, 13 nt, Homo sapiens
aaaaccucacuug

SEQ ID NO: 1517750 - RNA, 16 nt, Homo sapiens
aaaaccucacuugaag

SEQ ID NO: 1517751 - RNA, 21 nt, Homo sapiens
aaaacggugcauccacgcaca

SEQ ID NO: 1517752 - RNA, 19 nt, Homo sapiens
aaaacuacaaccaauggaa

SEQ ID NO: 1517753 - RNA, 16 nt, Homo sapiens
aaaacugcauuucacu

SEQ ID NO: 1517754 - RNA, 16 nt, Homo sapiens
aaaagaagcaaccuca

SEQ ID NO: 1517755 - RNA, 22 nt, Homo sapiens
aaaagacagagccuccacuuag

SEQ ID NO: 1517756 - RNA, 22 nt, Homo sapiens
aaaagauuguuuuauauguagu

SEQ ID NO: 1517757 - RNA, 13 nt, Homo sapiens
aaaagcucuuuca

SEQ ID NO: 1517758 - RNA, 13 nt, Homo sapiens
aaaagcuuagcag

SEQ ID NO: 1517759 - RNA, 15 nt, Homo sapiens
aaaagguuuacagaa

SEQ ID NO: 1517760 - RNA, 18 nt, Homo sapiens
aaaaguaaguaccacuca

SEQ ID NO: 1517761 - RNA, 22 nt, Homo sapiens
aaaaguaauuguagauggaaau

SEQ ID NO: 1517762 - RNA, 16 nt, Homo sapiens
aaaagugugagcagug

SEQ ID NO: 1517763 - RNA, 22 nt, Homo sapiens
aaaaguuuggccgggugcggug

SEQ ID NO: 1517764 - RNA, 16 nt, Homo sapiens
aaaauaaguauuucca

SEQ ID NO: 1517765 - RNA, 13 nt, Homo sapiens
aaaauagcaaaag

SEQ ID NO: 1517766 - RNA, 20 nt, Homo sapiens
aaaauagcuaaauaccucaa

SEQ ID NO: 1517767 - RNA, 21 nt, Homo sapiens
aaaauauauuuaugauaacua

SEQ ID NO: 1517768 - RNA, 20 nt, Homo sapiens
aaaaucaaagaaaacauagc

SEQ ID NO: 1517769 - RNA, 22 nt, Homo sapiens
aaaaucacaaggcaacugugag

SEQ ID NO: 1517770 - RNA, 17 nt, Homo sapiens
aaaaucagaagcacaaa

SEQ ID NO: 1517771 - RNA, 20 nt, Homo sapiens
aaaaugcugcuucuccuccc

SEQ ID NO: 1517772 - RNA, 21 nt, Homo sapiens
aaaaugcugcuucuccuccca

SEQ ID NO: 1517773 - RNA, 14 nt, Homo sapiens
aaaauguacauacu

SEQ ID NO: 1517774 - RNA, 22 nt, Homo sapiens
aaaauguucguauucuauucaa

SEQ ID NO: 1517775 - RNA, 18 nt, Homo sapiens
aaaauucugauacauuag

SEQ ID NO: 1517776 - RNA, 20 nt, Homo sapiens
aaaauuguuaguaaacauag

SEQ ID NO: 1517777 - RNA, 23 nt, Homo sapiens
aaacaacaaacuuggucuuacau

SEQ ID NO: 1517778 - RNA, 21 nt, Homo sapiens
aaacacacaaacuauuacuua

SEQ ID NO: 1517779 - RNA, 13 nt, Homo sapiens
aaacacuugcaac

SEQ ID NO: 1517780 - RNA, 15 nt, Homo sapiens
aaacagacuauuuaa

SEQ ID NO: 1517781 - RNA, 14 nt, Homo sapiens
aaacagaguauguc

SEQ ID NO: 1517782 - RNA, 11 nt, Homo sapiens
aaacaguuuag

SEQ ID NO: 1517783 - RNA, 18 nt, Homo sapiens
aaacaucauaguuucuug

SEQ ID NO: 1517784 - RNA, 14 nt, Homo sapiens
aaacaucauucuac

SEQ ID NO: 1517785 - RNA, 15 nt, Homo sapiens
aaacauuuauggaau

SEQ ID NO: 1517786 - RNA, 11 nt, Homo sapiens
aaaccaaagau

SEQ ID NO: 1517787 - RNA, 13 nt, Homo sapiens
aaaccccaucucu

SEQ ID NO: 1517788 - RNA, 14 nt, Homo sapiens
aaacccugucucua

SEQ ID NO: 1517789 - RNA, 18 nt, Homo sapiens
aaaccuagcuaggcuaag

SEQ ID NO: 1517790 - RNA, 22 nt, Homo sapiens
aaaccucccccaagcagagcuu

SEQ ID NO: 1517791 - RNA, 17 nt, Homo sapiens
aaaccuggagaugauga

SEQ ID NO: 1517792 - RNA, 17 nt, Homo sapiens
aaacuaaaucucuaaua

SEQ ID NO: 1517793 - RNA, 17 nt, Homo sapiens
aaacugaaaaucuaaua

SEQ ID NO: 1517794 - RNA, 14 nt, Homo sapiens
aaacugacuucuuu

SEQ ID NO: 1517795 - RNA, 11 nt, Homo sapiens
aaacuguacag

SEQ ID NO: 1517796 - RNA, 23 nt, Homo sapiens
aaacuguacaguuucuuccccaa

SEQ ID NO: 1517797 - RNA, 22 nt, Homo sapiens
aaacuguuggaaguucacugga

SEQ ID NO: 1517798 - RNA, 19 nt, Homo sapiens
aaacuuauuugagugauua

SEQ ID NO: 1517799 - RNA, 20 nt, Homo sapiens
aaacuugaaucaaagcaguu

SEQ ID NO: 1517800 - RNA, 17 nt, Homo sapiens
aaacuuuagaguagcau

SEQ ID NO: 1517801 - RNA, 21 nt, Homo sapiens
aaacuuuagaguagcaugaga

SEQ ID NO: 1517802 - RNA, 12 nt, Homo sapiens
aaagaaaaccau

SEQ ID NO: 1517803 - RNA, 15 nt, Homo sapiens
aaagaaaacuaacaa

SEQ ID NO: 1517804 - RNA, 19 nt, Homo sapiens
aaagaacugccccaucucc

SEQ ID NO: 1517805 - RNA, 22 nt, Homo sapiens
aaagaagauuuugccacauuug

SEQ ID NO: 1517806 - RNA, 21 nt, Homo sapiens
aaauccuuagaucuggcaugu

SEQ ID NO: 1517807 - RNA, 20 nt, Homo sapiens
aaaucuaggugauuguucau

SEQ ID NO: 1517808 - RNA, 20 nt, Homo sapiens
aaaugagccuuucugccuca

SEQ ID NO: 1517809 - RNA, 15 nt, Homo sapiens
aaaugagugaucuca

SEQ ID NO: 1517810 - RNA, 19 nt, Homo sapiens
aaaugauauauaccacuuu

SEQ ID NO: 1517811 - RNA, 22 nt, Homo sapiens
aaaugcagucuuaccaaugacu

SEQ ID NO: 1517812 - RNA, 11 nt, Homo sapiens
aaaugccucau

SEQ ID NO: 1517813 - RNA, 19 nt, Homo sapiens
aaaugcuggggucauauaa

SEQ ID NO: 1517814 - RNA, 14 nt, Homo sapiens
aaauguaaagccau

SEQ ID NO: 1517815 - RNA, 19 nt, Homo sapiens
aaauguaauuaugagguga

SEQ ID NO: 1517816 - RNA, 21 nt, Homo sapiens
aaauguucagcuucagacuuu

SEQ ID NO: 1517817 - RNA, 17 nt, Homo sapiens
aaauuaacaguccuaac

SEQ ID NO: 1517818 - RNA, 20 nt, Homo sapiens
aaauuguuaguaaacauagg

SEQ ID NO: 1517819 - RNA, 12 nt, Homo sapiens
aaauuuuacuuu

SEQ ID NO: 1517820 - RNA, 12 nt, Homo sapiens
aacaaacuggag

SEQ ID NO: 1517821 - RNA, 17 nt, Homo sapiens
aacaacaauacaacaag

SEQ ID NO: 1517822 - RNA, 18 nt, Homo sapiens
aacaagaaauuguuucuu

SEQ ID NO: 1517823 - RNA, 12 nt, Homo sapiens
aacacaaagaca

SEQ ID NO: 1517824 - RNA, 17 nt, Homo sapiens
aacacagccaguuuuca

SEQ ID NO: 1517825 - RNA, 21 nt, Homo sapiens
aacacagguguuggaagccag

SEQ ID NO: 1517826 - RNA, 20 nt, Homo sapiens
aacacauuagauguuacugu

SEQ ID NO: 1517827 - RNA, 19 nt, Homo sapiens
aacacccgacuccucaaaa

SEQ ID NO: 1517828 - RNA, 18 nt, Homo sapiens
aacacguggguauuuaau

SEQ ID NO: 1517829 - RNA, 16 nt, Homo sapiens
aacagaaaaauaugua

SEQ ID NO: 1517830 - RNA, 20 nt, Homo sapiens
aacagaacauagacagaaga

SEQ ID NO: 1517831 - RNA, 12 nt, Homo sapiens
aacagaguaaau

SEQ ID NO: 1517832 - RNA, 18 nt, Homo sapiens
aacagauaucagugucuc

SEQ ID NO: 1517833 - RNA, 16 nt, Homo sapiens
aacagaucuugaaauc

SEQ ID NO: 1517834 - RNA, 17 nt, Homo sapiens
aacagccaacagguggc

SEQ ID NO: 1517835 - RNA, 15 nt, Homo sapiens
aacagccccaaaguc

SEQ ID NO: 1517836 - RNA, 16 nt, Homo sapiens
aacagccugacaacau

SEQ ID NO: 1517837 - RNA, 16 nt, Homo sapiens
aacaggaaaccacuua

SEQ ID NO: 1517838 - RNA, 15 nt, Homo sapiens
aacaguuugaaaaga

SEQ ID NO: 1517839 - RNA, 20 nt, Homo sapiens
aacaucuauuauaaaaccau

SEQ ID NO: 1517840 - RNA, 15 nt, Homo sapiens
aacaucucacuuugc

SEQ ID NO: 1517841 - RNA, 20 nt, Homo sapiens
aacauguuuuguauguuaaa

SEQ ID NO: 1517842 - RNA, 14 nt, Homo sapiens
aacauucacagccc

SEQ ID NO: 1517843 - RNA, 18 nt, Homo sapiens
aacauugcauugugacua

SEQ ID NO: 1517844 - RNA, 23 nt, Homo sapiens
aacauuuucuguguguacaugua

SEQ ID NO: 1517845 - RNA, 20 nt, Homo sapiens
aaccaaaggaaucguuucaa

SEQ ID NO: 1517846 - RNA, 17 nt, Homo sapiens
aaccaaccaaccaacca

SEQ ID NO: 1517847 - RNA, 18 nt, Homo sapiens
aaccaguuaagaauggaa

SEQ ID NO: 1517848 - RNA, 18 nt, Homo sapiens
aaccauaaacuguacaaa

SEQ ID NO: 1517849 - RNA, 14 nt, Homo sapiens
aacccuuauuccau

SEQ ID NO: 1517850 - RNA, 20 nt, Homo sapiens
aaccucaggcuuccuuggca

SEQ ID NO: 1517851 - RNA, 12 nt, Homo sapiens
aaccucauucuc

SEQ ID NO: 1517852 - RNA, 17 nt, Homo sapiens
aaccuggagaugaugau

SEQ ID NO: 1517853 - RNA, 22 nt, Homo sapiens
aacgcaaagggcugaaagccau

SEQ ID NO: 1517854 - RNA, 16 nt, Homo sapiens
aacggagagugcuugg

SEQ ID NO: 1517855 - RNA, 21 nt, Homo sapiens
aacguuucaaagcacauaugu

SEQ ID NO: 1517856 - RNA, 14 nt, Homo sapiens
aacuaaaagcauag

SEQ ID NO: 1517857 - RNA, 22 nt, Homo sapiens
aacuaaugucagcacauguugc

SEQ ID NO: 1517858 - RNA, 14 nt, Homo sapiens
aacuaucuuuuugc

SEQ ID NO: 1517859 - RNA, 22 nt, Homo sapiens
aacuaugugauguuaacuauua

SEQ ID NO: 1517860 - RNA, 21 nt, Homo sapiens
aacuauuggagggugggagag

SEQ ID NO: 1517861 - RNA, 23 nt, Homo sapiens
aacucacuuucccuugugucaag

SEQ ID NO: 1517862 - RNA, 14 nt, Homo sapiens
aacucagagccucc

SEQ ID NO: 1517863 - RNA, 17 nt, Homo sapiens
aacucaggaugccaagu

SEQ ID NO: 1517864 - RNA, 16 nt, Homo sapiens
aacucgaauaaaggau

SEQ ID NO: 1517865 - RNA, 19 nt, Homo sapiens
aacucucugagauguguuc

SEQ ID NO: 1517866 - RNA, 21 nt, Homo sapiens
aacucugccugagacuuucag

SEQ ID NO: 1517867 - RNA, 13 nt, Homo sapiens
aacucuucacucu

SEQ ID NO: 1517868 - RNA, 18 nt, Homo sapiens
aacucuuggccucugcuu

SEQ ID NO: 1517869 - RNA, 11 nt, Homo sapiens
aacugaacuua

SEQ ID NO: 1517870 - RNA, 15 nt, Homo sapiens
aacugcugauuugau

SEQ ID NO: 1517871 - RNA, 14 nt, Homo sapiens
aacuguaagcucaa

SEQ ID NO: 1517872 - RNA, 14 nt, Homo sapiens
aacuguacaguuuc

SEQ ID NO: 1517873 - RNA, 22 nt, Homo sapiens
aacugugaaauaccacaagccu

SEQ ID NO: 1517874 - RNA, 18 nt, Homo sapiens
aacuuaaguuacugggua

SEQ ID NO: 1517875 - RNA, 14 nt, Homo sapiens
aacuuagcauuuag

SEQ ID NO: 1517876 - RNA, 23 nt, Homo sapiens
aacuuccacauuauacauuugau

SEQ ID NO: 1517877 - RNA, 15 nt, Homo sapiens
aacuuguauuuccaa

SEQ ID NO: 1517878 - RNA, 14 nt, Homo sapiens
aacuugugcugaga

SEQ ID NO: 1517879 - RNA, 20 nt, Homo sapiens
aacuuucucacugcugucag

SEQ ID NO: 1517880 - RNA, 23 nt, Homo sapiens
aagaaaaccuuucuucaccaaau

SEQ ID NO: 1517881 - RNA, 23 nt, Homo sapiens
aagaaagaaacacucaacaauaa

SEQ ID NO: 1517882 - RNA, 11 nt, Homo sapiens
aagaaagcaaa

SEQ ID NO: 1517883 - RNA, 18 nt, Homo sapiens
aagaaaucauggcauuca

SEQ ID NO: 1517884 - RNA, 22 nt, Homo sapiens
aagaaaucauggcauucacaca

SEQ ID NO: 1517885 - RNA, 16 nt, Homo sapiens
aagaaccuaaaguagc

SEQ ID NO: 1517886 - RNA, 14 nt, Homo sapiens
aagaacgucauuuu

SEQ ID NO: 1517887 - RNA, 19 nt, Homo sapiens
aagaacugccccaucuccu

SEQ ID NO: 1517888 - RNA, 16 nt, Homo sapiens
aagaagagaucaggaa

SEQ ID NO: 1517889 - RNA, 20 nt, Homo sapiens
aagaagcccugcugggccca

SEQ ID NO: 1517890 - RNA, 15 nt, Homo sapiens
aagaaggacacuugu

SEQ ID NO: 1517891 - RNA, 17 nt, Homo sapiens
aagacagaaguuugcac

SEQ ID NO: 1517892 - RNA, 14 nt, Homo sapiens
aagacagauuacca

SEQ ID NO: 1517893 - RNA, 15 nt, Homo sapiens
aagacuaagcaccau

SEQ ID NO: 1517894 - RNA, 21 nt, Homo sapiens
aagacuacuggacuucuauca

SEQ ID NO: 1517895 - RNA, 21 nt, Homo sapiens
aagacuugauacugcaauaaa

SEQ ID NO: 1517896 - RNA, 19 nt, Homo sapiens
aagagaaaauaaaccaaga

SEQ ID NO: 1517897 - RNA, 14 nt, Homo sapiens
aagagaucaggaag

SEQ ID NO: 1517898 - RNA, 21 nt, Homo sapiens
aagagauuucaacauaucauu

SEQ ID NO: 1517899 - RNA, 11 nt, Homo sapiens
aagagggaugu

SEQ ID NO: 1517900 - RNA, 14 nt, Homo sapiens
aagagugaaugugu

SEQ ID NO: 1517901 - RNA, 12 nt, Homo sapiens
aagauaaagguu

SEQ ID NO: 1517902 - RNA, 14 nt, Homo sapiens
aagaucaacauucc

SEQ ID NO: 1517903 - RNA, 21 nt, Homo sapiens
aagauuuaacaaauacauuca

SEQ ID NO: 1517904 - RNA, 17 nt, Homo sapiens
aagauuugugaacugga

SEQ ID NO: 1517905 - RNA, 19 nt, Homo sapiens
aauuguauuuuuuguugaa

SEQ ID NO: 1517906 - RNA, 21 nt, Homo sapiens
aauuuauauaaaaauaccuua

SEQ ID NO: 1517907 - RNA, 20 nt, Homo sapiens
aauuugauacaaaaugcuga

SEQ ID NO: 1517908 - RNA, 18 nt, Homo sapiens
aauuuguuuuauauucuc

SEQ ID NO: 1517909 - RNA, 16 nt, Homo sapiens
aauuuuauguguuaua

SEQ ID NO: 1517910 - RNA, 14 nt, Homo sapiens
acaaaaaaccacaa

SEQ ID NO: 1517911 - RNA, 22 nt, Homo sapiens
acaaacucuuguguaccuuugu

SEQ ID NO: 1517912 - RNA, 14 nt, Homo sapiens
acaaagacauggaa

SEQ ID NO: 1517913 - RNA, 19 nt, Homo sapiens
acaaaggaaaacucuuggc

SEQ ID NO: 1517914 - RNA, 19 nt, Homo sapiens
acaaagggacacacaguga

SEQ ID NO: 1517915 - RNA, 16 nt, Homo sapiens
acaaauacauucauaa

SEQ ID NO: 1517916 - RNA, 20 nt, Homo sapiens
acaaauggacuauacauacu

SEQ ID NO: 1517917 - RNA, 18 nt, Homo sapiens
acaaaugggccugccaaa

SEQ ID NO: 1517918 - RNA, 20 nt, Homo sapiens
acaaauugaagcauguacaa

SEQ ID NO: 1517919 - RNA, 14 nt, Homo sapiens
acaacaaaccaaaa

SEQ ID NO: 1517920 - RNA, 20 nt, Homo sapiens
acaacaaacuuggucuuaca

SEQ ID NO: 1517921 - RNA, 19 nt, Homo sapiens
acaacaugcgaccgugacc

SEQ ID NO: 1517922 - RNA, 21 nt, Homo sapiens
acaacauugcauugugacuau

SEQ ID NO: 1517923 - RNA, 20 nt, Homo sapiens
acaacuauuuucagauguga

SEQ ID NO: 1517924 - RNA, 12 nt, Homo sapiens
acaagcaaugga

SEQ ID NO: 1517925 - RNA, 20 nt, Homo sapiens
acaagccaacgacaaagcca

SEQ ID NO: 1517926 - RNA, 17 nt, Homo sapiens
acaagcuggaagcacau

SEQ ID NO: 1517927 - RNA, 15 nt, Homo sapiens
acaaguaaucacuaa

SEQ ID NO: 1517928 - RNA, 11 nt, Homo sapiens
acaagugacag

SEQ ID NO: 1517929 - RNA, 12 nt, Homo sapiens
acaauacaacaa

SEQ ID NO: 1517930 - RNA, 22 nt, Homo sapiens
acaaucaugagucagacauuug

SEQ ID NO: 1517931 - RNA, 19 nt, Homo sapiens
acaauccucgucugaauca

SEQ ID NO: 1517932 - RNA, 21 nt, Homo sapiens
acaaugaaggaaaaccucacu

SEQ ID NO: 1517933 - RNA, 22 nt, Homo sapiens
acaaugccuagacuguguaugu

SEQ ID NO: 1517934 - RNA, 18 nt, Homo sapiens
acaauggcuaauucccag

SEQ ID NO: 1517935 - RNA, 22 nt, Homo sapiens
acaauucucucuuauaugugua

SEQ ID NO: 1517936 - RNA, 13 nt, Homo sapiens
acacaaagacaca

SEQ ID NO: 1517937 - RNA, 14 nt, Homo sapiens
acacaaagacaugg

SEQ ID NO: 1517938 - RNA, 15 nt, Homo sapiens
acacaaagacaugga

SEQ ID NO: 1517939 - RNA, 14 nt, Homo sapiens
aagcaaaagcaagg

SEQ ID NO: 1517940 - RNA, 22 nt, Homo sapiens
aagcaaucugagagauuugaau

SEQ ID NO: 1517941 - RNA, 15 nt, Homo sapiens
aagcagggcucugcc

SEQ ID NO: 1517942 - RNA, 20 nt, Homo sapiens
aagcaggggucguaccuugc

SEQ ID NO: 1517943 - RNA, 15 nt, Homo sapiens
aagcaucaccucagg

SEQ ID NO: 1517944 - RNA, 16 nt, Homo sapiens
aagcaucaccucaggc

SEQ ID NO: 1517945 - RNA, 23 nt, Homo sapiens
aagcaugucucaauaguaaaaga

SEQ ID NO: 1517946 - RNA, 14 nt, Homo sapiens
aagccaccagugag

SEQ ID NO: 1517947 - RNA, 13 nt, Homo sapiens
aagcccuugaacc

SEQ ID NO: 1517948 - RNA, 16 nt, Homo sapiens
aagccugagaacugaa

SEQ ID NO: 1517949 - RNA, 16 nt, Homo sapiens
aagccuuuugcucaca

SEQ ID NO: 1517950 - RNA, 17 nt, Homo sapiens
aagcgauucuucugccu

SEQ ID NO: 1517951 - RNA, 18 nt, Homo sapiens
aagcgggugguggcucug

SEQ ID NO: 1517952 - RNA, 15 nt, Homo sapiens
aagcguuugcacaga

SEQ ID NO: 1517953 - RNA, 19 nt, Homo sapiens
aagcugaacuuacugcuua

SEQ ID NO: 1517954 - RNA, 21 nt, Homo sapiens
aagcugcugagaaucuagccu

SEQ ID NO: 1517955 - RNA, 21 nt, Homo sapiens
aagcuggauuauuuagaucua

SEQ ID NO: 1517956 - RNA, 22 nt, Homo sapiens
aagcugguaaacuauuugucuu

SEQ ID NO: 1517957 - RNA, 14 nt, Homo sapiens
aaggaaaaaauaau

SEQ ID NO: 1517958 - RNA, 20 nt, Homo sapiens
aaggaaaaaauaauauccau

SEQ ID NO: 1517959 - RNA, 23 nt, Homo sapiens
aaggaaacuuuuuuuguuugcuc

SEQ ID NO: 1517960 - RNA, 19 nt, Homo sapiens
aaggaaagauuugugaacu

SEQ ID NO: 1517961 - RNA, 22 nt, Homo sapiens
aaggaaggcuccaucuccagug

SEQ ID NO: 1517962 - RNA, 14 nt, Homo sapiens
aaggacacuuguau

SEQ ID NO: 1517963 - RNA, 18 nt, Homo sapiens
aaggacagaacauugccu

SEQ ID NO: 1517964 - RNA, 13 nt, Homo sapiens
aaggaccagguua

SEQ ID NO: 1517965 - RNA, 22 nt, Homo sapiens
aaggagauauggcuaguggcaa

SEQ ID NO: 1517966 - RNA, 14 nt, Homo sapiens
aaggauagccucag

SEQ ID NO: 1517967 - RNA, 14 nt, Homo sapiens
aaggauauuuacua

SEQ ID NO: 1517968 - RNA, 18 nt, Homo sapiens
aaggauauuuacuacuuu

SEQ ID NO: 1517969 - RNA, 18 nt, Homo sapiens
aaggauccagagacuugg

SEQ ID NO: 1517970 - RNA, 20 nt, Homo sapiens
aaggcagugaacacacucag

SEQ ID NO: 1517971 - RNA, 18 nt, Homo sapiens
aaggcuuugccaugggcc

SEQ ID NO: 1517972 - RNA, 20 nt, Homo sapiens
aaggcuuuguauaaucccac

SEQ ID NO: 1517973 - RNA, 13 nt, Homo sapiens
aagggaacuucca

SEQ ID NO: 1517974 - RNA, 17 nt, Homo sapiens
aagguauaccugggaag

SEQ ID NO: 1517975 - RNA, 17 nt, Homo sapiens
augacaagcaucaguag

SEQ ID NO: 1517976 - RNA, 18 nt, Homo sapiens
augaccugaucauuacau

SEQ ID NO: 1517977 - RNA, 15 nt, Homo sapiens
augaccugcagucag

SEQ ID NO: 1517978 - RNA, 17 nt, Homo sapiens
augagaggacugaugaa

SEQ ID NO: 1517979 - RNA, 20 nt, Homo sapiens
augagcaaggacaaccugcc

SEQ ID NO: 1517980 - RNA, 20 nt, Homo sapiens
augaguuggacuucagucuu

SEQ ID NO: 1517981 - RNA, 15 nt, Homo sapiens
augauaaagagggau

SEQ ID NO: 1517982 - RNA, 16 nt, Homo sapiens
augauaauuuacuuaa

SEQ ID NO: 1517983 - RNA, 20 nt, Homo sapiens
augauacaccuacuacucaa

SEQ ID NO: 1517984 - RNA, 12 nt, Homo sapiens
augauacuuuaa

SEQ ID NO: 1517985 - RNA, 14 nt, Homo sapiens
augauggugcugac

SEQ ID NO: 1517986 - RNA, 15 nt, Homo sapiens
augauuccuugagca

SEQ ID NO: 1517987 - RNA, 18 nt, Homo sapiens
augauuuagggaagcagg

SEQ ID NO: 1517988 - RNA, 12 nt, Homo sapiens
augcaagcacaa

SEQ ID NO: 1517989 - RNA, 13 nt, Homo sapiens
augcaagcccuuu

SEQ ID NO: 1517990 - RNA, 15 nt, Homo sapiens
augcagaggggugcu

SEQ ID NO: 1517991 - RNA, 18 nt, Homo sapiens
augcagccuucuuuucaa

SEQ ID NO: 1517992 - RNA, 19 nt, Homo sapiens
augccacgagaucaacaca

SEQ ID NO: 1517993 - RNA, 13 nt, Homo sapiens
auuuaguuucaua

SEQ ID NO: 1517994 - RNA, 20 nt, Homo sapiens
auuuaguuuuuaacaaucua

SEQ ID NO: 1517995 - RNA, 22 nt, Homo sapiens
auuuauacuuugcaauccaaau

SEQ ID NO: 1517996 - RNA, 17 nt, Homo sapiens
auuuccauggcucuguu

SEQ ID NO: 1517997 - RNA, 22 nt, Homo sapiens
auuuccucuuauaacuucugaa

SEQ ID NO: 1517998 - RNA, 18 nt, Homo sapiens
auuuccugcuacacaaaa

SEQ ID NO: 1517999 - RNA, 19 nt, Homo sapiens
auuuccuggugauucugau

SEQ ID NO: 1518000 - RNA, 16 nt, Homo sapiens
auuucucaugcuucuu

SEQ ID NO: 1518001 - RNA, 17 nt, Homo sapiens
auuucugugaagcaaaa

SEQ ID NO: 1518002 - RNA, 20 nt, Homo sapiens
auuucuuaaacacuugcaac

SEQ ID NO: 1518003 - RNA, 15 nt, Homo sapiens
auuuggggugaauga

SEQ ID NO: 1518004 - RNA, 18 nt, Homo sapiens
auuugggguuugcuugua

SEQ ID NO: 1518005 - RNA, 18 nt, Homo sapiens
auuugugaacuggaagaa

SEQ ID NO: 1518006 - RNA, 16 nt, Homo sapiens
auuuuaaaacauaaga

SEQ ID NO: 1518007 - RNA, 19 nt, Homo sapiens
cuguuaucugcuagaucua

SEQ ID NO: 1518008 - RNA, 16 nt, Homo sapiens
cuguuaugcaagcaca

SEQ ID NO: 1518009 - RNA, 16 nt, Homo sapiens
cuguuuuaaugacaag

SEQ ID NO: 1518010 - RNA, 18 nt, Homo sapiens
cuuaaaaaucaagacacu

SEQ ID NO: 1518011 - RNA, 19 nt, Homo sapiens
cuuaaagcacagucugaug

SEQ ID NO: 1518012 - RNA, 12 nt, Homo sapiens
cuuaaagcugcu

SEQ ID NO: 1518013 - RNA, 17 nt, Homo sapiens
cuuaaagcugcugucac

SEQ ID NO: 1518014 - RNA, 20 nt, Homo sapiens
cuuaaucuccacuguuauuc

SEQ ID NO: 1518015 - RNA, 14 nt, Homo sapiens
cuuaauggguacaa

SEQ ID NO: 1518016 - RNA, 16 nt, Homo sapiens
cuuaauucacucccac

SEQ ID NO: 1518017 - RNA, 13 nt, Homo sapiens
cuuaauugugauu

SEQ ID NO: 1518018 - RNA, 12 nt, Homo sapiens
cuuagcugucac

SEQ ID NO: 1518019 - RNA, 20 nt, Homo sapiens
cuuaggaagaaaucacuuaa

SEQ ID NO: 1518020 - RNA, 11 nt, Homo sapiens
cuuaggugcca

SEQ ID NO: 1518021 - RNA, 21 nt, Homo sapiens
cuuagugccacccaccuuugc

SEQ ID NO: 1518022 - RNA, 20 nt, Homo sapiens
cuuauaacuucugaaguaau

SEQ ID NO: 1518023 - RNA, 21 nt, Homo sapiens
cuuauuaacaauuaggcagac

SEQ ID NO: 1518024 - RNA, 16 nt, Homo sapiens
cuucaaguuagcucag

SEQ ID NO: 1518025 - RNA, 19 nt, Homo sapiens
cuucacucuucaaaugccu

SEQ ID NO: 1518026 - RNA, 18 nt, Homo sapiens
cuucacugccaugccuca

SEQ ID NO: 1518027 - RNA, 17 nt, Homo sapiens
cuucagaagacacugca

SEQ ID NO: 1518028 - RNA, 23 nt, Homo sapiens
cuucagaagacacugcaaaggcg

SEQ ID NO: 1518029 - RNA, 18 nt, Homo sapiens
cuucagagcaagcacugg

SEQ ID NO: 1518030 - RNA, 19 nt, Homo sapiens
cuucagccaucaacaagag

SEQ ID NO: 1518031 - RNA, 16 nt, Homo sapiens
cuucaguuguuuuccc

SEQ ID NO: 1518032 - RNA, 17 nt, Homo sapiens
cuucaucuggauuccag

SEQ ID NO: 1518033 - RNA, 13 nt, Homo sapiens
cuuccacuuugag

SEQ ID NO: 1518034 - RNA, 19 nt, Homo sapiens
cuuccacuuugaguaccaa

SEQ ID NO: 1518035 - RNA, 18 nt, Homo sapiens
cuucccagaggccaggaa

SEQ ID NO: 1518036 - RNA, 16 nt, Homo sapiens
cuucccugacacuguc

SEQ ID NO: 1518037 - RNA, 14 nt, Homo sapiens
cuuccgugcugaac

SEQ ID NO: 1518038 - RNA, 20 nt, Homo sapiens
cuuccguggucagagugcca

SEQ ID NO: 1518039 - RNA, 13 nt, Homo sapiens
cuucuagaucugg

SEQ ID NO: 1518040 - RNA, 11 nt, Homo sapiens
cuucucaaaag

SEQ ID NO: 1518041 - RNA, 16 nt, Homo sapiens
cuucuccucccagcgu

SEQ ID NO: 1518042 - RNA, 23 nt, Homo sapiens
cuucugaaguaauuuguaaaaaa

SEQ ID NO: 1518043 - RNA, 13 nt, Homo sapiens
cuucugcuucaaa

SEQ ID NO: 1518044 - RNA, 21 nt, Homo sapiens
cuucuggacugguuuucacau

SEQ ID NO: 1518045 - RNA, 19 nt, Homo sapiens
cuucuggaggacacacagu

SEQ ID NO: 1518046 - RNA, 11 nt, Homo sapiens
cuucuugccca

SEQ ID NO: 1518047 - RNA, 23 nt, Homo sapiens
cuugaaaaauauucauguagauc

SEQ ID NO: 1518048 - RNA, 15 nt, Homo sapiens
cuugaaggcccaggu

SEQ ID NO: 1518049 - RNA, 19 nt, Homo sapiens
cuugacccugagcugacca

SEQ ID NO: 1518050 - RNA, 21 nt, Homo sapiens
cuugagcagaccgugauuugg

SEQ ID NO: 1518051 - RNA, 21 nt, Homo sapiens
cuugaggauuuugaguaucuc

SEQ ID NO: 1518052 - RNA, 14 nt, Homo sapiens
cuugaguagaucug

SEQ ID NO: 1518053 - RNA, 15 nt, Homo sapiens
cuugccaaauuccau

SEQ ID NO: 1518054 - RNA, 11 nt, Homo sapiens
cuugcucugca

SEQ ID NO: 1518055 - RNA, 16 nt, Homo sapiens
cuuggaaaaagaaaga

SEQ ID NO: 1518056 - RNA, 13 nt, Homo sapiens
cuuggacuccucc

SEQ ID NO: 1518057 - RNA, 16 nt, Homo sapiens
cuuggccacugaauua

SEQ ID NO: 1518058 - RNA, 22 nt, Homo sapiens
cuuggcugcaggaaucuuuaaa

SEQ ID NO: 1518059 - RNA, 20 nt, Homo sapiens
cuugggaacuguaagcucaa

SEQ ID NO: 1518060 - RNA, 16 nt, Homo sapiens
cuuguaaaaccaacua

SEQ ID NO: 1518061 - RNA, 14 nt, Homo sapiens
cuugucacugaaga

SEQ ID NO: 1518062 - RNA, 19 nt, Homo sapiens
cuugugucaagacauuucu

SEQ ID NO: 1518063 - RNA, 15 nt, Homo sapiens
cuuguguguuuugag

SEQ ID NO: 1518064 - RNA, 18 nt, Homo sapiens
cuuguuguuuuuaagucc

SEQ ID NO: 1518065 - RNA, 15 nt, Homo sapiens
cuuguuuugacuuaa

SEQ ID NO: 1518066 - RNA, 13 nt, Homo sapiens
cuuuaaccucauc

SEQ ID NO: 1518067 - RNA, 12 nt, Homo sapiens
cuuuacaauaaa

SEQ ID NO: 1518068 - RNA, 15 nt, Homo sapiens
cuuuaccacuaugca

SEQ ID NO: 1518069 - RNA, 13 nt, Homo sapiens
cuuuaccuaccac

SEQ ID NO: 1518070 - RNA, 15 nt, Homo sapiens
cuuucaggaccuuuu

SEQ ID NO: 1518071 - RNA, 19 nt, Homo sapiens
cuuuccccaccucuuccuu

SEQ ID NO: 1518072 - RNA, 21 nt, Homo sapiens
cuuuccugucugcacaaguga

SEQ ID NO: 1518073 - RNA, 15 nt, Homo sapiens
cuuucucagccacaa

SEQ ID NO: 1518074 - RNA, 15 nt, Homo sapiens
cuuucugggccaagu

SEQ ID NO: 1518075 - RNA, 21 nt, Homo sapiens
cuuugguccccagcauugcag

SEQ ID NO: 1518076 - RNA, 20 nt, Homo sapiens
cuuuguguaaagaagggaag

SEQ ID NO: 1518077 - RNA, 18 nt, Homo sapiens
cuuuucaaaacugcuaaa

SEQ ID NO: 1518078 - RNA, 23 nt, Homo sapiens
cuuuucaaggaaaaaugcugcuu

SEQ ID NO: 1518079 - RNA, 14 nt, Homo sapiens
cuuuucaucuccag

SEQ ID NO: 1518080 - RNA, 16 nt, Homo sapiens
cuuuuccauguaucua

SEQ ID NO: 1518081 - RNA, 16 nt, Homo sapiens
cuuuucuuuuucuccc

SEQ ID NO: 1518082 - RNA, 21 nt, Homo sapiens
cuuuuguggauugacaguagu

SEQ ID NO: 1518083 - RNA, 13 nt, Homo sapiens
cuuuuguguacag

SEQ ID NO: 1518084 - RNA, 11 nt, Homo sapiens
cuuuuucacac

SEQ ID NO: 1518085 - RNA, 19 nt, Homo sapiens
cuuuuuuccaccugccaau

SEQ ID NO: 1518086 - RNA, 17 nt, Homo sapiens
gaaaaaaaguacaugua

SEQ ID NO: 1518087 - RNA, 17 nt, Homo sapiens
gaaaaaauaauauccau

SEQ ID NO: 1518088 - RNA, 17 nt, Homo sapiens
gaaaaauaugugcuuga

SEQ ID NO: 1518089 - RNA, 18 nt, Homo sapiens
gaaaaaucagaagcacaa

SEQ ID NO: 1518090 - RNA, 17 nt, Homo sapiens
gaaaaaugcugcuucuc

SEQ ID NO: 1518091 - RNA, 20 nt, Homo sapiens
gaaaaaugcugcuucuccuc

SEQ ID NO: 1518092 - RNA, 21 nt, Homo sapiens
gaaaaccagugaagugccaca

SEQ ID NO: 1518093 - RNA, 15 nt, Homo sapiens
gaaaagaaaccagag

SEQ ID NO: 1518094 - RNA, 20 nt, Homo sapiens
gaaaagaaaccagagucaaa

SEQ ID NO: 1518095 - RNA, 17 nt, Homo sapiens
gaaaauaaaaacuuuag

SEQ ID NO: 1518096 - RNA, 14 nt, Homo sapiens
gaaaauaaaccaag

SEQ ID NO: 1518097 - RNA, 17 nt, Homo sapiens
gaaaauaauuguuccaa

SEQ ID NO: 1518098 - RNA, 16 nt, Homo sapiens
gaaaauguacauacua

SEQ ID NO: 1518099 - RNA, 15 nt, Homo sapiens
gaaacaagguuuuca

SEQ ID NO: 1518100 - RNA, 19 nt, Homo sapiens
gaaacaauuauuguacacu

SEQ ID NO: 1518101 - RNA, 16 nt, Homo sapiens
gaaacaugaugugaga

SEQ ID NO: 1518102 - RNA, 23 nt, Homo sapiens
gaaaccagaaggauauuuacuac

SEQ ID NO: 1518103 - RNA, 15 nt, Homo sapiens
gaaaccagagucaaa

SEQ ID NO: 1518104 - RNA, 20 nt, Homo sapiens
gaaacccauuaggcaugccu

SEQ ID NO: 1518105 - RNA, 14 nt, Homo sapiens
gaaacucgaauaaa

SEQ ID NO: 1518106 - RNA, 15 nt, Homo sapiens
gaaagagaguaccau

SEQ ID NO: 1518107 - RNA, 22 nt, Homo sapiens
gaaagauuaaauaugaucacuu

SEQ ID NO: 1518108 - RNA, 15 nt, Homo sapiens
gaaagauuugugaac

SEQ ID NO: 1518109 - RNA, 19 nt, Homo sapiens
gaaagcaacaaagauugag

SEQ ID NO: 1518110 - RNA, 17 nt, Homo sapiens
gaaagcaaucugagaga

SEQ ID NO: 1518111 - RNA, 13 nt, Homo sapiens
gaaaggccaauaa

SEQ ID NO: 1518112 - RNA, 23 nt, Homo sapiens
gaaaguggccaugccacccuguu

SEQ ID NO: 1518113 - RNA, 15 nt, Homo sapiens
gaaaguuugcacugu

SEQ ID NO: 1518114 - RNA, 17 nt, Homo sapiens
gaaaucaggcaguuccc

SEQ ID NO: 1518115 - RNA, 14 nt, Homo sapiens
gaaauucuguggug

SEQ ID NO: 1518116 - RNA, 23 nt, Homo sapiens
gaaauuuuuucaugcacacuguu

SEQ ID NO: 1518117 - RNA, 22 nt, Homo sapiens
gaacaaaugcuggggucauaua

SEQ ID NO: 1518118 - RNA, 22 nt, Homo sapiens
gaacaacuaggcuucagcauau

SEQ ID NO: 1518119 - RNA, 14 nt, Homo sapiens
gaacaagacccugu

SEQ ID NO: 1518120 - RNA, 18 nt, Homo sapiens
gaacaagacccugucuca

SEQ ID NO: 1518121 - RNA, 23 nt, Homo sapiens
gaacacagguguuggaagccagg

SEQ ID NO: 1518122 - RNA, 21 nt, Homo sapiens
gaacaccuuuguuuugcacug

SEQ ID NO: 1518123 - RNA, 11 nt, Homo sapiens
gaacacugaga

SEQ ID NO: 1518124 - RNA, 15 nt, Homo sapiens
gaacauucgaggugu

SEQ ID NO: 1518125 - RNA, 12 nt, Homo sapiens
gaaccacaagag

SEQ ID NO: 1518126 - RNA, 21 nt, Homo sapiens
gaacccugcuugcacuuugua

SEQ ID NO: 1518127 - RNA, 22 nt, Homo sapiens
gaacgcacuuuauaaaagcaaa

SEQ ID NO: 1518128 - RNA, 17 nt, Homo sapiens
gaacugccccaucuccu

SEQ ID NO: 1518129 - RNA, 23 nt, Homo sapiens
gaacuggugcuuuaguaaugugg

SEQ ID NO: 1518130 - RNA, 14 nt, Homo sapiens
gaacuuugagcuac

SEQ ID NO: 1518131 - RNA, 12 nt, Homo sapiens
gaagaaagcaaa

SEQ ID NO: 1518132 - RNA, 14 nt, Homo sapiens
gaagaaagcaacaa

SEQ ID NO: 1518133 - RNA, 12 nt, Homo sapiens
gaagaagcaaac

SEQ ID NO: 1518134 - RNA, 18 nt, Homo sapiens
gaagagauuucaacauau

SEQ ID NO: 1518135 - RNA, 17 nt, Homo sapiens
gaagauagaacaaugcu

SEQ ID NO: 1518136 - RNA, 17 nt, Homo sapiens
gaagauuagagguuugu

SEQ ID NO: 1518137 - RNA, 22 nt, Homo sapiens
gaagauuagagguuugucaaca

SEQ ID NO: 1518138 - RNA, 23 nt, Homo sapiens
gaagccauguacucaaguaccac

SEQ ID NO: 1518139 - RNA, 23 nt, Homo sapiens
gaagcgacuauaaagguuuuuga

SEQ ID NO: 1518140 - RNA, 14 nt, Homo sapiens
gucugcgugacuau

SEQ ID NO: 1518141 - RNA, 22 nt, Homo sapiens
gucugggcaaugaaaccaaagc

SEQ ID NO: 1518142 - RNA, 12 nt, Homo sapiens
gucugucccaaa

SEQ ID NO: 1518143 - RNA, 20 nt, Homo sapiens
gucugugugaugaacuuucu

SEQ ID NO: 1518144 - RNA, 20 nt, Homo sapiens
gucuuaagccuuuugcucac

SEQ ID NO: 1518145 - RNA, 19 nt, Homo sapiens
gucuugucagaauuggccu

SEQ ID NO: 1518146 - RNA, 12 nt, Homo sapiens
gugaaaccacua

SEQ ID NO: 1518147 - RNA, 19 nt, Homo sapiens
gugaaggacuuguuuugac

SEQ ID NO: 1518148 - RNA, 20 nt, Homo sapiens
gugacaaguagggcacaaaa

SEQ ID NO: 1518149 - RNA, 14 nt, Homo sapiens
gugaccagggguga

SEQ ID NO: 1518150 - RNA, 16 nt, Homo sapiens
gugaccagugcugcug

SEQ ID NO: 1518151 - RNA, 12 nt, Homo sapiens
gugacucucuug

SEQ ID NO: 1518152 - RNA, 19 nt, Homo sapiens
gugaguccgggaaucucuu

SEQ ID NO: 1518153 - RNA, 21 nt, Homo sapiens
gugaguuacagcgagaggcag

SEQ ID NO: 1518154 - RNA, 13 nt, Homo sapiens
gugauauaugcau

SEQ ID NO: 1518155 - RNA, 15 nt, Homo sapiens
gugauuccauuuuac

SEQ ID NO: 1518156 - RNA, 20 nt, Homo sapiens
gugauuccauuuuacuucca

SEQ ID NO: 1518157 - RNA, 15 nt, Homo sapiens
gugcaagucuuguca

SEQ ID NO: 1518158 - RNA, 15 nt, Homo sapiens
gugcacuagcauuuu

SEQ ID NO: 1518159 - RNA, 16 nt, Homo sapiens
gugcacuccuggugau

SEQ ID NO: 1518160 - RNA, 17 nt, Homo sapiens
gugcaguugacagcagg

SEQ ID NO: 1518161 - RNA, 17 nt, Homo sapiens
gugccacaccccaugca

SEQ ID NO: 1518162 - RNA, 19 nt, Homo sapiens
gugccauucccacuaagcu

SEQ ID NO: 1518163 - RNA, 13 nt, Homo sapiens
gugcccacaaaau

SEQ ID NO: 1518164 - RNA, 21 nt, Homo sapiens
gugcccaggggcccacaggga

SEQ ID NO: 1518165 - RNA, 12 nt, Homo sapiens
gugcuaccucuc

SEQ ID NO: 1518166 - RNA, 23 nt, Homo sapiens
gugcuacuuugccuuuugcaaac

SEQ ID NO: 1518167 - RNA, 19 nt, Homo sapiens
gugcugagauuacaggugu

SEQ ID NO: 1518168 - RNA, 19 nt, Homo sapiens
gugcuggagcaaaagucau

SEQ ID NO: 1518169 - RNA, 16 nt, Homo sapiens
gugcuggauuugauga

SEQ ID NO: 1518170 - RNA, 20 nt, Homo sapiens
gugcugggauuacaggugua

SEQ ID NO: 1518171 - RNA, 18 nt, Homo sapiens
gugcuguggccugggcaa

SEQ ID NO: 1518172 - RNA, 15 nt, Homo sapiens
gugcugugucugcac

SEQ ID NO: 1518173 - RNA, 19 nt, Homo sapiens
gugcuuagccuccugaccu

SEQ ID NO: 1518174 - RNA, 17 nt, Homo sapiens
guggaaggcagugaaca

SEQ ID NO: 1518175 - RNA, 12 nt, Homo sapiens
guggacaccugc

SEQ ID NO: 1518176 - RNA, 17 nt, Homo sapiens
guggaugcuagugcugu

SEQ ID NO: 1518177 - RNA, 24 nt, Homo sapiens
guggaugggcccugcaagacacag

SEQ ID NO: 1518178 - RNA, 20 nt, Homo sapiens
guggauuccagcauuugcca

SEQ ID NO: 1518179 - RNA, 22 nt, Homo sapiens
guggcucuugccuguaauccca

SEQ ID NO: 1518180 - RNA, 18 nt, Homo sapiens
gugggacaaaccagagca

SEQ ID NO: 1518181 - RNA, 12 nt, Homo sapiens
guggguggugga

SEQ ID NO: 1518182 - RNA, 23 nt, Homo sapiens
gugguagaagccaguacagagaa

SEQ ID NO: 1518183 - RNA, 15 nt, Homo sapiens
gugguuguuuuguca

SEQ ID NO: 1518184 - RNA, 17 nt, Homo sapiens
gugucuggcaguuuaua

SEQ ID NO: 1518185 - RNA, 20 nt, Homo sapiens
gugucugggagagccuggca

SEQ ID NO: 1518186 - RNA, 15 nt, Homo sapiens
gugugugccacaccc

SEQ ID NO: 1518187 - RNA, 14 nt, Homo sapiens
guguguguguauau

SEQ ID NO: 1518188 - RNA, 21 nt, Homo sapiens
guguucccucucucccuccag

SEQ ID NO: 1518189 - RNA, 18 nt, Homo sapiens
guguucucuauuuugccu

SEQ ID NO: 1518190 - RNA, 20 nt, Homo sapiens
guguuuaacauucacagccc

SEQ ID NO: 1518191 - RNA, 20 nt, Homo sapiens
guuaaagggcagaaggggaa

SEQ ID NO: 1518192 - RNA, 14 nt, Homo sapiens
guuaagaauggaag

SEQ ID NO: 1518193 - RNA, 14 nt, Homo sapiens
guuaagcaaaggaa

SEQ ID NO: 1518194 - RNA, 16 nt, Homo sapiens
guuaagugaaugucua

SEQ ID NO: 1518195 - RNA, 23 nt, Homo sapiens
guuacagcucauguuuucuauau

SEQ ID NO: 1518196 - RNA, 15 nt, Homo sapiens
guuaccaacuaccua

SEQ ID NO: 1518197 - RNA, 16 nt, Homo sapiens
guuacuuucacuuuuu

SEQ ID NO: 1518198 - RNA, 18 nt, Homo sapiens
guuaggaaauaaaaccuu

SEQ ID NO: 1518199 - RNA, 14 nt, Homo sapiens
guuaucaguuaaca

SEQ ID NO: 1518200 - RNA, 13 nt, Homo sapiens
guuauucuugaca

SEQ ID NO: 1518201 - RNA, 18 nt, Homo sapiens
guucacaugcaucauaac

SEQ ID NO: 1518202 - RNA, 18 nt, Homo sapiens
guucacuggagucuugua

SEQ ID NO: 1518203 - RNA, 19 nt, Homo sapiens
guucagagaucguuccuau

SEQ ID NO: 1518204 - RNA, 17 nt, Homo sapiens
guucagaggaagcacau

SEQ ID NO: 1518205 - RNA, 21 nt, Homo sapiens
guucauauuuauacuuugcaa

SEQ ID NO: 1518206 - RNA, 14 nt, Homo sapiens
guuccauguuaaaa

SEQ ID NO: 1518207 - RNA, 12 nt, Homo sapiens
guuccucaaaag

SEQ ID NO: 1518208 - RNA, 12 nt, Homo sapiens
guuccugcacuc

SEQ ID NO: 1518209 - RNA, 20 nt, Homo sapiens
guucgagaccagccuggcca

SEQ ID NO: 1518210 - RNA, 18 nt, Homo sapiens
guucucucguaacugguu

SEQ ID NO: 1518211 - RNA, 16 nt, Homo sapiens
guucuggaaaccacgu

SEQ ID NO: 1518212 - RNA, 15 nt, Homo sapiens
guucuuuacugguga

SEQ ID NO: 1518213 - RNA, 16 nt, Homo sapiens
guugagacuuagauaa

SEQ ID NO: 1518214 - RNA, 19 nt, Homo sapiens
guugagucgucaucacuuu

SEQ ID NO: 1518215 - RNA, 18 nt, Homo sapiens
guugcuaaugacagugga

SEQ ID NO: 1518216 - RNA, 20 nt, Homo sapiens
guuggaugaugaaacauuca

SEQ ID NO: 1518217 - RNA, 17 nt, Homo sapiens
guugggcuuccaugccu

SEQ ID NO: 1518218 - RNA, 22 nt, Homo sapiens
guugguuuggccacucuugacc

SEQ ID NO: 1518219 - RNA, 15 nt, Homo sapiens
guuguacaagcucag

SEQ ID NO: 1518220 - RNA, 16 nt, Homo sapiens
guuguacacagucugu

SEQ ID NO: 1518221 - RNA, 19 nt, Homo sapiens
guugugccaaagugcauag

SEQ ID NO: 1518222 - RNA, 13 nt, Homo sapiens
guuguuguuguug

SEQ ID NO: 1518223 - RNA, 21 nt, Homo sapiens
guuuaauuaacuaugugaugu

SEQ ID NO: 1518224 - RNA, 13 nt, Homo sapiens
guuuacagaauuu

SEQ ID NO: 1518225 - RNA, 18 nt, Homo sapiens
guuuaguauuaugucuua

SEQ ID NO: 1518226 - RNA, 18 nt, Homo sapiens
guuucacagccuauaacc

SEQ ID NO: 1518227 - RNA, 21 nt, Homo sapiens
guuucagcuaaaugcagggaa

SEQ ID NO: 1518228 - RNA, 15 nt, Homo sapiens
guuuccaaaaaggaa

SEQ ID NO: 1518229 - RNA, 18 nt, Homo sapiens
guuucuuggccacugaau

SEQ ID NO: 1518230 - RNA, 15 nt, Homo sapiens
guuugcuguuugcaa

SEQ ID NO: 1518231 - RNA, 17 nt, Homo sapiens
guuuguaaaggcauucu

SEQ ID NO: 1518232 - RNA, 17 nt, Homo sapiens
guuugucaacacaaaga

SEQ ID NO: 1518233 - RNA, 23 nt, Homo sapiens
guuuuaaauuauaagaugucauc

SEQ ID NO: 1518234 - RNA, 12 nt, Homo sapiens
guuuuccauuug

SEQ ID NO: 1518235 - RNA, 18 nt, Homo sapiens
guuuuguaccaacacaca

SEQ ID NO: 1518236 - RNA, 17 nt, Homo sapiens
guuuugucucugcaucu

SEQ ID NO: 1518237 - RNA, 18 nt, Homo sapiens
uaaaaaauaacuaucaac

SEQ ID NO: 1518238 - RNA, 20 nt, Homo sapiens
uaaaaacuucgugcauuugu

SEQ ID NO: 1518239 - RNA, 20 nt, Homo sapiens
uaaaaccacagaacaguuug

SEQ ID NO: 1518240 - RNA, 17 nt, Homo sapiens
uaaaaccauaaacugua

SEQ ID NO: 1518241 - RNA, 15 nt, Homo sapiens
uaaaaccccaucucu

SEQ ID NO: 1518242 - RNA, 17 nt, Homo sapiens
uaaaacuacacaucccu

SEQ ID NO: 1518243 - RNA, 18 nt, Homo sapiens
uaaaauaaaguacauuau

SEQ ID NO: 1518244 - RNA, 18 nt, Homo sapiens
uaaaauagagugcauuug

SEQ ID NO: 1518245 - RNA, 21 nt, Homo sapiens
uaaaauauauuuaugauaacu

SEQ ID NO: 1518246 - RNA, 22 nt, Homo sapiens
uaaaauauauuuaugauaacua

SEQ ID NO: 1518247 - RNA, 14 nt, Homo sapiens
uaaaauguuauuau

SEQ ID NO: 1518248 - RNA, 16 nt, Homo sapiens
uaaaauuguuaguaaa

SEQ ID NO: 1518249 - RNA, 15 nt, Homo sapiens
uagaagcaagcugga

SEQ ID NO: 1518250 - RNA, 20 nt, Homo sapiens
uagaagccaguacagagaaa

SEQ ID NO: 1518251 - RNA, 21 nt, Homo sapiens
uagaagcuguaguagcccuuu

SEQ ID NO: 1518252 - RNA, 19 nt, Homo sapiens
uagaauaaaauuguaaaau

SEQ ID NO: 1518253 - RNA, 14 nt, Homo sapiens
uagacagagacaau

SEQ ID NO: 1518254 - RNA, 16 nt, Homo sapiens
uagacagagacaauuu

SEQ ID NO: 1518255 - RNA, 15 nt, Homo sapiens
uagacucaucuuuug

SEQ ID NO: 1518256 - RNA, 20 nt, Homo sapiens
uagacugaagagaccacagc

SEQ ID NO: 1518257 - RNA, 21 nt, Homo sapiens
uagagaaaugguucuggauau

SEQ ID NO: 1518258 - RNA, 16 nt, Homo sapiens
uagauauuauucauuc

SEQ ID NO: 1518259 - RNA, 19 nt, Homo sapiens
uagauguauaaaucuuucu

SEQ ID NO: 1518260 - RNA, 13 nt, Homo sapiens
uagcaacaaaucc

SEQ ID NO: 1518261 - RNA, 22 nt, Homo sapiens
uagcacauauuucacauguuua

SEQ ID NO: 1518262 - RNA, 22 nt, Homo sapiens
uagcagcuauguaaaugaccua

SEQ ID NO: 1518263 - RNA, 22 nt, Homo sapiens
uagcaggugaacucgaagccca

SEQ ID NO: 1518264 - RNA, 15 nt, Homo sapiens
uagcagucaaaucua

SEQ ID NO: 1518265 - RNA, 18 nt, Homo sapiens
uagccaucucucuacucc

SEQ ID NO: 1518266 - RNA, 19 nt, Homo sapiens
uagccuaugaugauaaaca

SEQ ID NO: 1518267 - RNA, 16 nt, Homo sapiens
uagcgaaucaucucaa

SEQ ID NO: 1518268 - RNA, 16 nt, Homo sapiens
uagcggaucucacuca

SEQ ID NO: 1518269 - RNA, 17 nt, Homo sapiens
uagcggaucucacucag

SEQ ID NO: 1518270 - RNA, 19 nt, Homo sapiens
uagcggugaagaguacaga

SEQ ID NO: 1518271 - RNA, 21 nt, Homo sapiens
uagcuauauuuauauauaucc

SEQ ID NO: 1518272 - RNA, 14 nt, Homo sapiens
uagcugaaugaguc

SEQ ID NO: 1518273 - RNA, 17 nt, Homo sapiens
uagcugagcgugguggc

SEQ ID NO: 1518274 - RNA, 14 nt, Homo sapiens
uagcugagugcacu

SEQ ID NO: 1518275 - RNA, 20 nt, Homo sapiens
uagcuuucccaaauaaacuc

SEQ ID NO: 1518276 - RNA, 12 nt, Homo sapiens
uaggaacagcuc

SEQ ID NO: 1518277 - RNA, 17 nt, Homo sapiens
uaggaacccagcucuca

SEQ ID NO: 1518278 - RNA, 16 nt, Homo sapiens
uaggaaucuaguacaa

SEQ ID NO: 1518279 - RNA, 21 nt, Homo sapiens
uaggacuauggguacauucca

SEQ ID NO: 1518280 - RNA, 22 nt, Homo sapiens
ucaguaguauucuaaagcuuuc

SEQ ID NO: 1518281 - RNA, 20 nt, Homo sapiens
ucagucgguguguaaucacg

SEQ ID NO: 1518282 - RNA, 21 nt, Homo sapiens
ucagugaagaauacuucucau

SEQ ID NO: 1518283 - RNA, 22 nt, Homo sapiens
ucaguguagaaccuaauucaau

SEQ ID NO: 1518284 - RNA, 14 nt, Homo sapiens
ucauaaccauuccc

SEQ ID NO: 1518285 - RNA, 23 nt, Homo sapiens
ucauaagccuaccaauguagaca

SEQ ID NO: 1518286 - RNA, 15 nt, Homo sapiens
ucauauugaauguuu

SEQ ID NO: 1518287 - RNA, 13 nt, Homo sapiens
ucaucacuaccuu

SEQ ID NO: 1518288 - RNA, 15 nt, Homo sapiens
ucaucacuaccuuua

SEQ ID NO: 1518289 - RNA, 16 nt, Homo sapiens
ucaucacuaccuuuau

SEQ ID NO: 1518290 - RNA, 18 nt, Homo sapiens
ucaucuacaagcauuugc

SEQ ID NO: 1518291 - RNA, 19 nt, Homo sapiens
ucaucuacaagcauuugcc

SEQ ID NO: 1518292 - RNA, 13 nt, Homo sapiens
ucaucuguuguuu

SEQ ID NO: 1518293 - RNA, 18 nt, Homo sapiens
ucaucuugacauguaaug

SEQ ID NO: 1518294 - RNA, 14 nt, Homo sapiens
ucaugacuuuucca

SEQ ID NO: 1518295 - RNA, 14 nt, Homo sapiens
ucauguuccucaaa

SEQ ID NO: 1518296 - RNA, 19 nt, Homo sapiens
ucauucccuagaucuuucu

SEQ ID NO: 1518297 - RNA, 20 nt, Homo sapiens
uccaaaaaggaacacuggaa

SEQ ID NO: 1518298 - RNA, 21 nt, Homo sapiens
uccaaccccccaccugccauu

SEQ ID NO: 1518299 - RNA, 15 nt, Homo sapiens
uccaaucagagaaua

SEQ ID NO: 1518300 - RNA, 19 nt, Homo sapiens
uccaaugaaugaucauuga

SEQ ID NO: 1518301 - RNA, 13 nt, Homo sapiens
uccacaagccauu

SEQ ID NO: 1518302 - RNA, 14 nt, Homo sapiens
uccacauuauacau

SEQ ID NO: 1518303 - RNA, 18 nt, Homo sapiens
uccacauuauacauuuga

SEQ ID NO: 1518304 - RNA, 20 nt, Homo sapiens
uccaccuuguuacacauuau

SEQ ID NO: 1518305 - RNA, 22 nt, Homo sapiens
uccacugaggaugugagccuga

SEQ ID NO: 1518306 - RNA, 17 nt, Homo sapiens
uccacuuugaguaccaa

SEQ ID NO: 1518307 - RNA, 19 nt, Homo sapiens
uccagaacugaggucacug

SEQ ID NO: 1518308 - RNA, 16 nt, Homo sapiens
uccagaauaaaacgca

SEQ ID NO: 1518309 - RNA, 20 nt, Homo sapiens
uccagagagcaaacauagga

SEQ ID NO: 1518310 - RNA, 19 nt, Homo sapiens
uccagaugccuuccugucu

SEQ ID NO: 1518311 - RNA, 19 nt, Homo sapiens
uccagcagguaggggcaca

SEQ ID NO: 1518312 - RNA, 11 nt, Homo sapiens
uccagcauuug

SEQ ID NO: 1518313 - RNA, 14 nt, Homo sapiens
uccagcauuugcca

SEQ ID NO: 1518314 - RNA, 14 nt, Homo sapiens
uccaggaucuuuga

SEQ ID NO: 1518315 - RNA, 12 nt, Homo sapiens
uccaggccagug

SEQ ID NO: 1518316 - RNA, 14 nt, Homo sapiens
uccaguaggaaauc

SEQ ID NO: 1518317 - RNA, 17 nt, Homo sapiens
uccaguauucuugucaa

SEQ ID NO: 1518318 - RNA, 17 nt, Homo sapiens
uccaguuuagcccuucc

SEQ ID NO: 1518319 - RNA, 18 nt, Homo sapiens
uccauauuuauuuaaaca

SEQ ID NO: 1518320 - RNA, 19 nt, Homo sapiens
uccaucccccguggccauu

SEQ ID NO: 1518321 - RNA, 23 nt, Homo sapiens
uccaucuagagauuuucuuggca

SEQ ID NO: 1518322 - RNA, 18 nt, Homo sapiens
uccaucuagucacaaaga

SEQ ID NO: 1518323 - RNA, 14 nt, Homo sapiens
uccaucuccagugg

SEQ ID NO: 1518324 - RNA, 16 nt, Homo sapiens
uccauggcucuguuau

SEQ ID NO: 1518325 - RNA, 16 nt, Homo sapiens
uccaugggaccacaac

SEQ ID NO: 1518326 - RNA, 12 nt, Homo sapiens
uccauguaucua

SEQ ID NO: 1518327 - RNA, 15 nt, Homo sapiens
uccauucaucucaug

SEQ ID NO: 1518328 - RNA, 12 nt, Homo sapiens
ucccaagcugcc

SEQ ID NO: 1518329 - RNA, 17 nt, Homo sapiens
ucccacaaucugggacu

SEQ ID NO: 1518330 - RNA, 15 nt, Homo sapiens
ucccacgacuguugu

SEQ ID NO: 1518331 - RNA, 18 nt, Homo sapiens
ucccagaugccccagcaa

SEQ ID NO: 1518332 - RNA, 17 nt, Homo sapiens
ucccagcguguguaucc

SEQ ID NO: 1518333 - RNA, 11 nt, Homo sapiens
ucccagugugu

SEQ ID NO: 1518334 - RNA, 20 nt, Homo sapiens
ucccauaauugcuuugccaa

SEQ ID NO: 1518335 - RNA, 18 nt, Homo sapiens
ucccaucugucaccaauu

SEQ ID NO: 1518336 - RNA, 16 nt, Homo sapiens
uccccaagagcuguua

SEQ ID NO: 1518337 - RNA, 16 nt, Homo sapiens
uccccagagacaugca

SEQ ID NO: 1518338 - RNA, 18 nt, Homo sapiens
uccccagugcuaccucuc

SEQ ID NO: 1518339 - RNA, 16 nt, Homo sapiens
ucccccaccccagagu

SEQ ID NO: 1518340 - RNA, 13 nt, Homo sapiens
ucccccgcuguaa

SEQ ID NO: 1518341 - RNA, 15 nt, Homo sapiens
uccccugguccugca

SEQ ID NO: 1518342 - RNA, 20 nt, Homo sapiens
uccccugguccugcacuguc

SEQ ID NO: 1518343 - RNA, 18 nt, Homo sapiens
uccccuguggucuuggaa

SEQ ID NO: 1518344 - RNA, 14 nt, Homo sapiens
ucccgagcuacucu

SEQ ID NO: 1518345 - RNA, 19 nt, Homo sapiens
ucccgagcuacucucuugc

SEQ ID NO: 1518346 - RNA, 15 nt, Homo sapiens
ucccgccacccucaa

SEQ ID NO: 1518347 - RNA, 22 nt, Homo sapiens
ucccuccagggccacugcuuga

SEQ ID NO: 1518348 - RNA, 13 nt, Homo sapiens
ucccucuaugucg

SEQ ID NO: 1518349 - RNA, 13 nt, Homo sapiens
ucccugcugccag

SEQ ID NO: 1518350 - RNA, 18 nt, Homo sapiens
ucccugggaacugguuca

SEQ ID NO: 1518351 - RNA, 13 nt, Homo sapiens
ucccuugaaauuu

SEQ ID NO: 1518352 - RNA, 16 nt, Homo sapiens
uccgccaaacacucca

SEQ ID NO: 1518353 - RNA, 18 nt, Homo sapiens
uccgccaaacacuccacc

SEQ ID NO: 1518354 - RNA, 23 nt, Homo sapiens
uccggagggguugcgggggagcu

SEQ ID NO: 1518355 - RNA, 23 nt, Homo sapiens
uccggguggaaaagaaucccugc

SEQ ID NO: 1518356 - RNA, 19 nt, Homo sapiens
uccuaggccacaccaucuc

SEQ ID NO: 1518357 - RNA, 20 nt, Homo sapiens
uccuaggccacaccaucucc

SEQ ID NO: 1518358 - RNA, 20 nt, Homo sapiens
uccucaacaacaaaccaaaa

SEQ ID NO: 1518359 - RNA, 18 nt, Homo sapiens
uccucaggaacagaacac

SEQ ID NO: 1518360 - RNA, 17 nt, Homo sapiens
uccucauccccacaauc

SEQ ID NO: 1518361 - RNA, 13 nt, Homo sapiens
uccuccacuccac

SEQ ID NO: 1518362 - RNA, 18 nt, Homo sapiens
uccuccacuccaccucca

SEQ ID NO: 1518363 - RNA, 15 nt, Homo sapiens
uccuccaucuagaga

SEQ ID NO: 1518364 - RNA, 16 nt, Homo sapiens
uccucuaacauuugca

SEQ ID NO: 1518365 - RNA, 19 nt, Homo sapiens
uccugcaaaaguggaauca

SEQ ID NO: 1518366 - RNA, 13 nt, Homo sapiens
uccugcacugucc

SEQ ID NO: 1518367 - RNA, 17 nt, Homo sapiens
uccuggcaugacacucu

SEQ ID NO: 1518368 - RNA, 19 nt, Homo sapiens
uccuggccaacauggugaa

SEQ ID NO: 1518369 - RNA, 21 nt, Homo sapiens
uccuggcccuccacuccucau

SEQ ID NO: 1518370 - RNA, 21 nt, Homo sapiens
uccuggcuucuagaucuggaa

SEQ ID NO: 1518371 - RNA, 18 nt, Homo sapiens
uccugggagaaccucagg

SEQ ID NO: 1518372 - RNA, 21 nt, Homo sapiens
uccugggggcugcugcacugc

SEQ ID NO: 1518373 - RNA, 16 nt, Homo sapiens
uccuguacauuucaca

SEQ ID NO: 1518374 - RNA, 14 nt, Homo sapiens
uccuguagcacaaa

SEQ ID NO: 1518375 - RNA, 17 nt, Homo sapiens
uccuguauaaauacuga

SEQ ID NO: 1518376 - RNA, 22 nt, Homo sapiens
uccugucuuggaaggacuacua

SEQ ID NO: 1518377 - RNA, 12 nt, Homo sapiens
uccugugcuacu

SEQ ID NO: 1518378 - RNA, 18 nt, Homo sapiens
uccugugcuacuuugccu

SEQ ID NO: 1518379 - RNA, 20 nt, Homo sapiens
uccuuaauagccauaugcaa

SEQ ID NO: 1518380 - RNA, 20 nt, Homo sapiens
ugcaagguucaacuuauuaa

SEQ ID NO: 1518381 - RNA, 11 nt, Homo sapiens
ugcacacuugu

SEQ ID NO: 1518382 - RNA, 19 nt, Homo sapiens
ugcacacuuguauauugaa

SEQ ID NO: 1518383 - RNA, 20 nt, Homo sapiens
ugcaccgagagagauggaau

SEQ ID NO: 1518384 - RNA, 18 nt, Homo sapiens
ugcaccuguacucaggag

SEQ ID NO: 1518385 - RNA, 20 nt, Homo sapiens
ugcaccuuaccaacuuucug

SEQ ID NO: 1518386 - RNA, 17 nt, Homo sapiens
ugcacugacaagaugga

SEQ ID NO: 1518387 - RNA, 14 nt, Homo sapiens
ugcagaagugcaug

SEQ ID NO: 1518388 - RNA, 23 nt, Homo sapiens
ugcaguauauuucugaaaugaca

SEQ ID NO: 1518389 - RNA, 12 nt, Homo sapiens
ugcaguaucucu

SEQ ID NO: 1518390 - RNA, 15 nt, Homo sapiens
ugcagucagugucaa

SEQ ID NO: 1518391 - RNA, 17 nt, Homo sapiens
ugcagugagcugagauc

SEQ ID NO: 1518392 - RNA, 16 nt, Homo sapiens
ugcaguugacagcagg

SEQ ID NO: 1518393 - RNA, 20 nt, Homo sapiens
ugcauaauucuugaugguaa

SEQ ID NO: 1518394 - RNA, 20 nt, Homo sapiens
ugcauauauacuacaugaga

SEQ ID NO: 1518395 - RNA, 21 nt, Homo sapiens
ugcaucaagggcuuuaucaaa

SEQ ID NO: 1518396 - RNA, 23 nt, Homo sapiens
ugcaucuguuuauucuauaguua

SEQ ID NO: 1518397 - RNA, 15 nt, Homo sapiens
ugcaugaccugauca

SEQ ID NO: 1518398 - RNA, 14 nt, Homo sapiens
ugcauggaauuugu

SEQ ID NO: 1518399 - RNA, 14 nt, Homo sapiens
ugcauggacucgua

SEQ ID NO: 1518400 - RNA, 19 nt, Homo sapiens
ugcauuuucccagauacuu

SEQ ID NO: 1518401 - RNA, 22 nt, Homo sapiens
ugccaaaauaccagagccuuca

SEQ ID NO: 1518402 - RNA, 12 nt, Homo sapiens
ugccaaguggcc

SEQ ID NO: 1518403 - RNA, 23 nt, Homo sapiens
ugccacccaccuuugccacaaag

SEQ ID NO: 1518404 - RNA, 18 nt, Homo sapiens
ugccaucguuuccaugac

SEQ ID NO: 1518405 - RNA, 15 nt, Homo sapiens
ugccaugccucaaga

SEQ ID NO: 1518406 - RNA, 18 nt, Homo sapiens
ugccauucccacuaagcu

SEQ ID NO: 1518407 - RNA, 17 nt, Homo sapiens
ugccauuucugaacugu

SEQ ID NO: 1518408 - RNA, 21 nt, Homo sapiens
ugccccaguaacucacuuuaa

SEQ ID NO: 1518409 - RNA, 17 nt, Homo sapiens
ugcccgaccccaucuca

SEQ ID NO: 1518410 - RNA, 21 nt, Homo sapiens
ugcccucauaaaccaaugugg

SEQ ID NO: 1518411 - RNA, 23 nt, Homo sapiens
ugcccugcgaaguggcucucagg

SEQ ID NO: 1518412 - RNA, 24 nt, Homo sapiens
ugcccuggagggaggcucuucagu

SEQ ID NO: 1518413 - RNA, 16 nt, Homo sapiens
ugccgccccgugccug

SEQ ID NO: 1518414 - RNA, 16 nt, Homo sapiens
ugccuauccucuguau

SEQ ID NO: 1518415 - RNA, 22 nt, Homo sapiens
ugccucacaucagcccugugua

SEQ ID NO: 1518416 - RNA, 15 nt, Homo sapiens
ugccuccagcacucc

SEQ ID NO: 1518417 - RNA, 19 nt, Homo sapiens
ugccugaaaaaacugguau

SEQ ID NO: 1518418 - RNA, 11 nt, Homo sapiens
ugccuggucua

SEQ ID NO: 1518419 - RNA, 12 nt, Homo sapiens
ugccuuccucau

SEQ ID NO: 1518420 - RNA, 17 nt, Homo sapiens
ugccuucucccugggaa

SEQ ID NO: 1518421 - RNA, 23 nt, Homo sapiens
ugccuuuuccuauguaaauauua

SEQ ID NO: 1518422 - RNA, 17 nt, Homo sapiens
ugcgaaguggcucucag

SEQ ID NO: 1518423 - RNA, 16 nt, Homo sapiens
ugcgcuguaguaggca

SEQ ID NO: 1518424 - RNA, 17 nt, Homo sapiens
ugcgggggagcuggaaa

SEQ ID NO: 1518425 - RNA, 21 nt, Homo sapiens
ugcgucagaccaguacuggga

SEQ ID NO: 1518426 - RNA, 23 nt, Homo sapiens
ugcuagggccccuagaaaccacc

SEQ ID NO: 1518427 - RNA, 14 nt, Homo sapiens
ugcuaugacaugca

SEQ ID NO: 1518428 - RNA, 23 nt, Homo sapiens
ugcucagguacuuguaaauuauu

SEQ ID NO: 1518429 - RNA, 16 nt, Homo sapiens
ugcuccccagugcuac

SEQ ID NO: 1518430 - RNA, 21 nt, Homo sapiens
ugcuccccagugcuaccucuc

SEQ ID NO: 1518431 - RNA, 19 nt, Homo sapiens
ugcucugcccacugugaaa

SEQ ID NO: 1518432 - RNA, 11 nt, Homo sapiens
ugcucugcuau

SEQ ID NO: 1518433 - RNA, 14 nt, Homo sapiens
ugcucugucuucca

SEQ ID NO: 1518434 - RNA, 19 nt, Homo sapiens
ugcugaagagggaaaguga

SEQ ID NO: 1518435 - RNA, 11 nt, Homo sapiens
ugcugaccucu

SEQ ID NO: 1518436 - RNA, 20 nt, Homo sapiens
ugcugaccugaucaccucug

SEQ ID NO: 1518437 - RNA, 17 nt, Homo sapiens
ugcugaggcucugaccc

SEQ ID NO: 1518438 - RNA, 11 nt, Homo sapiens
ugcugcacugc

SEQ ID NO: 1518439 - RNA, 21 nt, Homo sapiens
ugcugccaggcucccacugcc

SEQ ID NO: 1518440 - RNA, 15 nt, Homo sapiens
ugcugcgucagacca

SEQ ID NO: 1518441 - RNA, 17 nt, Homo sapiens
ugcugcucccaucugca

SEQ ID NO: 1518442 - RNA, 11 nt, Homo sapiens
ugcugcuccua

SEQ ID NO: 1518443 - RNA, 22 nt, Homo sapiens
ugcugugucucacagaggcagu

SEQ ID NO: 1518444 - RNA, 14 nt, Homo sapiens
ugcugugugccuuc

SEQ ID NO: 1518445 - RNA, 12 nt, Homo sapiens
ugcuucagccug

SEQ ID NO: 1518446 - RNA, 17 nt, Homo sapiens
ugcuuguaaaaccaacu

SEQ ID NO: 1518447 - RNA, 24 nt, Homo sapiens
ugcuuucaucacuaccuuuauagc

SEQ ID NO: 1518448 - RNA, 15 nt, Homo sapiens
ugcuuugccaaaaua

SEQ ID NO: 1518449 - RNA, 23 nt, Homo sapiens
uggaaaaguucuuuacuggugau

SEQ ID NO: 1518450 - RNA, 12 nt, Homo sapiens
uggaaaccaaau

SEQ ID NO: 1518451 - RNA, 22 nt, Homo sapiens
uggaaagcaucaccucaggcca

SEQ ID NO: 1518452 - RNA, 20 nt, Homo sapiens
uggaaagccucugcugccau

SEQ ID NO: 1518453 - RNA, 17 nt, Homo sapiens
uggaagacuaucuuacu

SEQ ID NO: 1518454 - RNA, 22 nt, Homo sapiens
uggaagguuagagguuugucaa

SEQ ID NO: 1518455 - RNA, 21 nt, Homo sapiens
uggaagguuagguuugucaac

SEQ ID NO: 1518456 - RNA, 20 nt, Homo sapiens
uggaaguuucuggugccauu

SEQ ID NO: 1518457 - RNA, 17 nt, Homo sapiens
uggaauaaagcccuuga

SEQ ID NO: 1518458 - RNA, 19 nt, Homo sapiens
uggaauaaagcccuugaac

SEQ ID NO: 1518459 - RNA, 15 nt, Homo sapiens
uggaaucaaggaauc

SEQ ID NO: 1518460 - RNA, 21 nt, Homo sapiens
uggaauuuucagucaucucau

SEQ ID NO: 1518461 - RNA, 16 nt, Homo sapiens
uggacaaagaaccuuc

SEQ ID NO: 1518462 - RNA, 24 nt, Homo sapiens
uggacaucauguuuucuggugaug

SEQ ID NO: 1518463 - RNA, 13 nt, Homo sapiens
uggacaugauuua

SEQ ID NO: 1518464 - RNA, 14 nt, Homo sapiens
uggacccugcugaa

SEQ ID NO: 1518465 - RNA, 14 nt, Homo sapiens
uggacugguuuuca

SEQ ID NO: 1518466 - RNA, 18 nt, Homo sapiens
uggacuucagucuugccu

SEQ ID NO: 1518467 - RNA, 21 nt, Homo sapiens
uggagaaggaaggcuccaucu

SEQ ID NO: 1518468 - RNA, 14 nt, Homo sapiens
uggagaaggcccac

SEQ ID NO: 1518469 - RNA, 17 nt, Homo sapiens
uggagaccgugaccagu

SEQ ID NO: 1518470 - RNA, 22 nt, Homo sapiens
uggagagaucauagcucacugu

SEQ ID NO: 1518471 - RNA, 14 nt, Homo sapiens
ugguccugcacugu

SEQ ID NO: 1518472 - RNA, 21 nt, Homo sapiens
uggucuucacugccaugccuc

SEQ ID NO: 1518473 - RNA, 19 nt, Homo sapiens
uggugacaugugccuguaa

SEQ ID NO: 1518474 - RNA, 13 nt, Homo sapiens
uggugacauuuga

SEQ ID NO: 1518475 - RNA, 14 nt, Homo sapiens
uggugggaagcaag

SEQ ID NO: 1518476 - RNA, 23 nt, Homo sapiens
ugguucauauuuauacuuugcaa

SEQ ID NO: 1518477 - RNA, 20 nt, Homo sapiens
ugguucguguucauacugca

SEQ ID NO: 1518478 - RNA, 14 nt, Homo sapiens
ugguugaauaaagc

SEQ ID NO: 1518479 - RNA, 16 nt, Homo sapiens
ugguugaugccaaaaa

SEQ ID NO: 1518480 - RNA, 14 nt, Homo sapiens
ugguuuuacaguga

SEQ ID NO: 1518481 - RNA, 19 nt, Homo sapiens
ugguuuuugguuacaugga

SEQ ID NO: 1518482 - RNA, 22 nt, Homo sapiens
uguaaaauuguuaguaaacaua

SEQ ID NO: 1518483 - RNA, 15 nt, Homo sapiens
uguaaauacaucaaa

SEQ ID NO: 1518484 - RNA, 18 nt, Homo sapiens
uguaaauauacacuauuu

SEQ ID NO: 1518485 - RNA, 14 nt, Homo sapiens
uguaaaugcauuag

SEQ ID NO: 1518486 - RNA, 13 nt, Homo sapiens
uguaaaugccaca

SEQ ID NO: 1518487 - RNA, 23 nt, Homo sapiens
uguaacaaauauauugcaaaaac

SEQ ID NO: 1518488 - RNA, 12 nt, Homo sapiens
uguaaccaaaaa

SEQ ID NO: 1518489 - RNA, 19 nt, Homo sapiens
uguaaucccagcacuuugg

SEQ ID NO: 1518490 - RNA, 15 nt, Homo sapiens
uguaauguaaauaca

SEQ ID NO: 1518491 - RNA, 17 nt, Homo sapiens
uguaauguaaauacauc

SEQ ID NO: 1518492 - RNA, 15 nt, Homo sapiens
uguaccuaugugaca

SEQ ID NO: 1518493 - RNA, 19 nt, Homo sapiens
uguagaucaagugugcaua

SEQ ID NO: 1518494 - RNA, 12 nt, Homo sapiens
uguagcacaaag

SEQ ID NO: 1518495 - RNA, 16 nt, Homo sapiens
uguagcagaaaccaag

SEQ ID NO: 1518496 - RNA, 15 nt, Homo sapiens
uguaggugaaagugu

SEQ ID NO: 1518497 - RNA, 20 nt, Homo sapiens
uguagucguacuuaccaagc

SEQ ID NO: 1518498 - RNA, 15 nt, Homo sapiens
uguauaaugugauuu

SEQ ID NO: 1518499 - RNA, 15 nt, Homo sapiens
uguauccgacucuaa

SEQ ID NO: 1518500 - RNA, 15 nt, Homo sapiens
uguaucuaauccuca

SEQ ID NO: 1518501 - RNA, 22 nt, Homo sapiens
uguaugaaaauuccugugauuu

SEQ ID NO: 1518502 - RNA, 22 nt, Homo sapiens
uguaugguguugauacgugugu

SEQ ID NO: 1518503 - RNA, 20 nt, Homo sapiens
ugucaacaaaaagacaugga

SEQ ID NO: 1518504 - RNA, 13 nt, Homo sapiens
ugucaacacaaag

SEQ ID NO: 1518505 - RNA, 20 nt, Homo sapiens
ugucacuggcagagcacagc

SEQ ID NO: 1518506 - RNA, 21 nt, Homo sapiens
ugucagcuuccccaggagcuc

SEQ ID NO: 1518507 - RNA, 21 nt, Homo sapiens
uguccaccagacccaccugga

SEQ ID NO: 1518508 - RNA, 18 nt, Homo sapiens
uguccuaaaauacaaaca

SEQ ID NO: 1518509 - RNA, 22 nt, Homo sapiens
uguccuaaaauacaaacaagca

SEQ ID NO: 1518510 - RNA, 22 nt, Homo sapiens
uguccuuucuagagcacugcca

SEQ ID NO: 1518511 - RNA, 12 nt, Homo sapiens
ugucgcaucuca

SEQ ID NO: 1518512 - RNA, 15 nt, Homo sapiens
ugucuauuugcacaa

SEQ ID NO: 1518513 - RNA, 18 nt, Homo sapiens
ugucuauuugcacaagau

SEQ ID NO: 1518514 - RNA, 17 nt, Homo sapiens
ugucucuagccacuuug

SEQ ID NO: 1518515 - RNA, 16 nt, Homo sapiens
ugucucugcaucucau

SEQ ID NO: 1518516 - RNA, 14 nt, Homo sapiens
ugucugcacccagg

SEQ ID NO: 1518517 - RNA, 15 nt, Homo sapiens
ugucuggcuuuuugc

SEQ ID NO: 1518518 - RNA, 12 nt, Homo sapiens
ugugaaaccacu

SEQ ID NO: 1518519 - RNA, 22 nt, Homo sapiens
ugugaaagaguucuggauucaa

SEQ ID NO: 1518520 - RNA, 12 nt, Homo sapiens
ugugaagcaaaa

SEQ ID NO: 1518521 - RNA, 16 nt, Homo sapiens
ugugaccacaguugua

SEQ ID NO: 1518522 - RNA, 14 nt, Homo sapiens
ugugauauaugcau

SEQ ID NO: 1518523 - RNA, 17 nt, Homo sapiens
ugugauguuaacuauua

SEQ ID NO: 1518524 - RNA, 23 nt, Homo sapiens
ugugauuuugagcaaaccacaua

SEQ ID NO: 1518525 - RNA, 21 nt, Homo sapiens
ugugccccuugacaacuggca

SEQ ID NO: 1518526 - RNA, 21 nt, Homo sapiens
ugugcuuaauaauaccaagac

SEQ ID NO: 1518527 - RNA, 14 nt, Homo sapiens
uguggauuccagca

SEQ ID NO: 1518528 - RNA, 23 nt, Homo sapiens
uguguaaauacaguggaucucaa

SEQ ID NO: 1518529 - RNA, 13 nt, Homo sapiens
uguguacagggaa

SEQ ID NO: 1518530 - RNA, 20 nt, Homo sapiens
uguguauaaagccauuauuc

SEQ ID NO: 1518531 - RNA, 18 nt, Homo sapiens
uguguauccgacucuaag

SEQ ID NO: 1518532 - RNA, 23 nt, Homo sapiens
uguguauuuugagauaaugucaa

SEQ ID NO: 1518533 - RNA, 13 nt, Homo sapiens
uguguccugauga

SEQ ID NO: 1518534 - RNA, 14 nt, Homo sapiens
uguguguuguaaca

SEQ ID NO: 1518535 - RNA, 22 nt, Homo sapiens
uguuaagcaaaggaaaccaaag

SEQ ID NO: 1518536 - RNA, 12 nt, Homo sapiens
uguuaagcaauu

SEQ ID NO: 1518537 - RNA, 22 nt, Homo sapiens
uguuaaguaacacucaccauca

SEQ ID NO: 1518538 - RNA, 15 nt, Homo sapiens
uguuacugugugaag

SEQ ID NO: 1518539 - RNA, 19 nt, Homo sapiens
uguuagauagaauuuccaa

SEQ ID NO: 1518540 - RNA, 20 nt, Homo sapiens
uguuauccacaagcaaugga

SEQ ID NO: 1518541 - RNA, 15 nt, Homo sapiens
uguuaugcaagcaca

SEQ ID NO: 1518542 - RNA, 18 nt, Homo sapiens
uguuauuuguacaguuca

SEQ ID NO: 1518543 - RNA, 12 nt, Homo sapiens
uguucacauaua

SEQ ID NO: 1518544 - RNA, 12 nt, Homo sapiens
uguucacaugca

SEQ ID NO: 1518545 - RNA, 20 nt, Homo sapiens
uguucaugauagugugauuu

SEQ ID NO: 1518546 - RNA, 22 nt, Homo sapiens
uguucccucucucccuccaggg

SEQ ID NO: 1518547 - RNA, 14 nt, Homo sapiens
uguucuaaguauuu

SEQ ID NO: 1518548 - RNA, 21 nt, Homo sapiens
uguucuagcccucccuggcau

SEQ ID NO: 1518549 - RNA, 23 nt, Homo sapiens
uguuguaaauaaaaguauuuaau

SEQ ID NO: 1518550 - RNA, 21 nt, Homo sapiens
uguuguggguuuuuucacaua

SEQ ID NO: 1518551 - RNA, 14 nt, Homo sapiens
uguuuacuaaagag

SEQ ID NO: 1518552 - RNA, 17 nt, Homo sapiens
uguuucagcuaaaugca

SEQ ID NO: 1518553 - RNA, 20 nt, Homo sapiens
uguuuccaguuguuacugaa

SEQ ID NO: 1518554 - RNA, 14 nt, Homo sapiens
uguuugcucuugca

SEQ ID NO: 1518555 - RNA, 15 nt, Homo sapiens
uguuuugcacugaca

SEQ ID NO: 1518556 - RNA, 20 nt, Homo sapiens
uuaaaacguagaggauuuau

SEQ ID NO: 1518557 - RNA, 19 nt, Homo sapiens
uuaaaagugacauuugucu

SEQ ID NO: 1518558 - RNA, 16 nt, Homo sapiens
acaacuaugauuugga

SEQ ID NO: 1518559 - RNA, 21 nt, Homo sapiens
acaacuucauauaacugagau

SEQ ID NO: 1518560 - RNA, 19 nt, Homo sapiens
acaccauucuccugccuca

SEQ ID NO: 1518561 - RNA, 16 nt, Homo sapiens
acaccuguuauugcca

SEQ ID NO: 1518562 - RNA, 22 nt, Homo sapiens
acacuaacgaaauaucaaaguc

SEQ ID NO: 1518563 - RNA, 24 nt, Homo sapiens
acagacuaugucacccaaugcaua

SEQ ID NO: 1518564 - RNA, 15 nt, Homo sapiens
acagagcagaacuuu

SEQ ID NO: 1518565 - RNA, 17 nt, Homo sapiens
acagagcagaacuuuca

SEQ ID NO: 1518566 - RNA, 20 nt, Homo sapiens
acagcuugguguacuuaaua

SEQ ID NO: 1518567 - RNA, 13 nt, Homo sapiens
acaguccuuuaaa

SEQ ID NO: 1518568 - RNA, 20 nt, Homo sapiens
acaguuuaauaaauagcauc

SEQ ID NO: 1518569 - RNA, 22 nt, Homo sapiens
acauauucuuggagaacuuucc

SEQ ID NO: 1518570 - RNA, 23 nt, Homo sapiens
acauauucuuggagaacuuucca

SEQ ID NO: 1518571 - RNA, 15 nt, Homo sapiens
acauccauguuccga

SEQ ID NO: 1518572 - RNA, 24 nt, Homo sapiens
acauggcaaaaccccaucucuacu

SEQ ID NO: 1518573 - RNA, 21 nt, Homo sapiens
acauggcuaaagaagguuuca

SEQ ID NO: 1518574 - RNA, 15 nt, Homo sapiens
acauuagccuaugug

SEQ ID NO: 1518575 - RNA, 23 nt, Homo sapiens
acauuggagacaucacuugccaa

SEQ ID NO: 1518576 - RNA, 22 nt, Homo sapiens
acauuugaaaucuaugaaauau

SEQ ID NO: 1518577 - RNA, 13 nt, Homo sapiens
accaaaacacaga

SEQ ID NO: 1518578 - RNA, 16 nt, Homo sapiens
accaccucaacauugg

SEQ ID NO: 1518579 - RNA, 14 nt, Homo sapiens
accaggucagggag

SEQ ID NO: 1518580 - RNA, 9 nt, Homo sapiens
accaugcug

SEQ ID NO: 1518581 - RNA, 23 nt, Homo sapiens
accuuacauuugaaaucuaugaa

SEQ ID NO: 1518582 - RNA, 17 nt, Homo sapiens
accuuuuucacuguggc

SEQ ID NO: 1518583 - RNA, 14 nt, Homo sapiens
acgaugcacuuugg

SEQ ID NO: 1518584 - RNA, 17 nt, Homo sapiens
acgauggugcaguguaa

SEQ ID NO: 1518585 - RNA, 16 nt, Homo sapiens
acgcgacuuccacaaa

SEQ ID NO: 1518586 - RNA, 14 nt, Homo sapiens
acuaaaauguucua

SEQ ID NO: 1518587 - RNA, 13 nt, Homo sapiens
acuacagccagaa

SEQ ID NO: 1518588 - RNA, 16 nt, Homo sapiens
acuagaagaaagggca

SEQ ID NO: 1518589 - RNA, 19 nt, Homo sapiens
acuauggcucuacuuucag

SEQ ID NO: 1518590 - RNA, 14 nt, Homo sapiens
acucaaucauuucu

SEQ ID NO: 1518591 - RNA, 13 nt, Homo sapiens
acucaaucucuga

SEQ ID NO: 1518592 - RNA, 23 nt, Homo sapiens
acuccaauucauaaaucuauuca

SEQ ID NO: 1518593 - RNA, 13 nt, Homo sapiens
acuccuaaaucaa

SEQ ID NO: 1518594 - RNA, 13 nt, Homo sapiens
acucuaaguucua

SEQ ID NO: 1518595 - RNA, 20 nt, Homo sapiens
acugccuuccaggagcaauu

SEQ ID NO: 1518596 - RNA, 15 nt, Homo sapiens
acugcucaauucugu

SEQ ID NO: 1518597 - RNA, 16 nt, Homo sapiens
acuuauuaagagcaaa

SEQ ID NO: 1518598 - RNA, 16 nt, Homo sapiens
acuucauauaacugag

SEQ ID NO: 1518599 - RNA, 18 nt, Homo sapiens
acuucauauaacugagau

SEQ ID NO: 1518600 - RNA, 16 nt, Homo sapiens
acuuuccaaucucagu

SEQ ID NO: 1518601 - RNA, 20 nt, Homo sapiens
acuuuuaaugccuuccacau

SEQ ID NO: 1518602 - RNA, 13 nt, Homo sapiens
agaaacacugggc

SEQ ID NO: 1518603 - RNA, 14 nt, Homo sapiens
agaaagcucaucuc

SEQ ID NO: 1518604 - RNA, 15 nt, Homo sapiens
agaaagcucaucuca

SEQ ID NO: 1518605 - RNA, 13 nt, Homo sapiens
agaaaugugauuu

SEQ ID NO: 1518606 - RNA, 22 nt, Homo sapiens
agaaaugugauuugucuucccu

SEQ ID NO: 1518607 - RNA, 14 nt, Homo sapiens
agaaauugcaauau

SEQ ID NO: 1518608 - RNA, 19 nt, Homo sapiens
agaacgcgacuuccacaaa

SEQ ID NO: 1518609 - RNA, 21 nt, Homo sapiens
agaacuauugugcucagagac

SEQ ID NO: 1518610 - RNA, 15 nt, Homo sapiens
agaagaaagggcaag

SEQ ID NO: 1518611 - RNA, 18 nt, Homo sapiens
agaaggagggagacauga

SEQ ID NO: 1518612 - RNA, 17 nt, Homo sapiens
agaauauuauuaugugc

SEQ ID NO: 1518613 - RNA, 23 nt, Homo sapiens
agaauguucuuauguugcccagu

SEQ ID NO: 1518614 - RNA, 17 nt, Homo sapiens
agacaucacuugccaau

SEQ ID NO: 1518615 - RNA, 18 nt, Homo sapiens
agaccagcccagccaaca

SEQ ID NO: 1518616 - RNA, 13 nt, Homo sapiens
agaccugaacugg

SEQ ID NO: 1518617 - RNA, 16 nt, Homo sapiens
agacucccaagcugga

SEQ ID NO: 1518618 - RNA, 16 nt, Homo sapiens
agagaucauauccuca

SEQ ID NO: 1518619 - RNA, 17 nt, Homo sapiens
agagaucauauccucag

SEQ ID NO: 1518620 - RNA, 12 nt, Homo sapiens
agagucacugac

SEQ ID NO: 1518621 - RNA, 14 nt, Homo sapiens
agaguucauggaau

SEQ ID NO: 1518622 - RNA, 23 nt, Homo sapiens
agauaaccauauucacaauggaa

SEQ ID NO: 1518623 - RNA, 17 nt, Homo sapiens
agauaauucuagcuuug

SEQ ID NO: 1518624 - RNA, 12 nt, Homo sapiens
agauugucuguu

SEQ ID NO: 1518625 - RNA, 21 nt, Homo sapiens
agauuuauggaaaauacucug

SEQ ID NO: 1518626 - RNA, 19 nt, Homo sapiens
agauuuauguaaugcuuua

SEQ ID NO: 1518627 - RNA, 17 nt, Homo sapiens
agcaagccaauuuggaa

SEQ ID NO: 1518628 - RNA, 14 nt, Homo sapiens
agcacaucugggag

SEQ ID NO: 1518629 - RNA, 14 nt, Homo sapiens
agcagaacuuucac

SEQ ID NO: 1518630 - RNA, 14 nt, Homo sapiens
agcagaagccaaau

SEQ ID NO: 1518631 - RNA, 17 nt, Homo sapiens
agcagacuuuugugaac

SEQ ID NO: 1518632 - RNA, 15 nt, Homo sapiens
agcagauguggugau

SEQ ID NO: 1518633 - RNA, 17 nt, Homo sapiens
agcaucuuuaacacaac

SEQ ID NO: 1518634 - RNA, 21 nt, Homo sapiens
agcucugguguaguuucugca

SEQ ID NO: 1518635 - RNA, 23 nt, Homo sapiens
agcuggaauuuaaggagggacaa

SEQ ID NO: 1518636 - RNA, 14 nt, Homo sapiens
aggagcaauuugca

SEQ ID NO: 1518637 - RNA, 19 nt, Homo sapiens
aggauuccaaaguuuugaa

SEQ ID NO: 1518638 - RNA, 15 nt, Homo sapiens
aggcgccugccacaa

SEQ ID NO: 1518639 - RNA, 23 nt, Homo sapiens
agggaagaacuauugugcucaga

SEQ ID NO: 1518640 - RNA, 23 nt, Homo sapiens
agggccuagcuuucauuugacac

SEQ ID NO: 1518641 - RNA, 20 nt, Homo sapiens
aggguaaucugacuucucac

SEQ ID NO: 1518642 - RNA, 22 nt, Homo sapiens
aggguucaccaggucagggaga

SEQ ID NO: 1518643 - RNA, 17 nt, Homo sapiens
agguauuuacacauaca

SEQ ID NO: 1518644 - RNA, 18 nt, Homo sapiens
agguauuuacacauacaa

SEQ ID NO: 1518645 - RNA, 20 nt, Homo sapiens
agguggaaaaggaacccaau

SEQ ID NO: 1518646 - RNA, 19 nt, Homo sapiens
agguuagauucucauucac

SEQ ID NO: 1518647 - RNA, 13 nt, Homo sapiens
aguaaugaugucg

SEQ ID NO: 1518648 - RNA, 20 nt, Homo sapiens
aguauuuaucuccugucuac

SEQ ID NO: 1518649 - RNA, 22 nt, Homo sapiens
agucauccacagcccaagggcg

SEQ ID NO: 1518650 - RNA, 17 nt, Homo sapiens
agucaucuuagcuuucc

SEQ ID NO: 1518651 - RNA, 16 nt, Homo sapiens
agucauuaaagacagg

SEQ ID NO: 1518652 - RNA, 15 nt, Homo sapiens
agucugguguucuga

SEQ ID NO: 1518653 - RNA, 16 nt, Homo sapiens
agucugucauccagaa

SEQ ID NO: 1518654 - RNA, 22 nt, Homo sapiens
agugcuaagaaagcaagccaau

SEQ ID NO: 1518655 - RNA, 21 nt, Homo sapiens
aguguugaagaagaguuugca

SEQ ID NO: 1518656 - RNA, 16 nt, Homo sapiens
aguuaacacagaucaa

SEQ ID NO: 1518657 - RNA, 16 nt, Homo sapiens
aguuaucuuugaauau

SEQ ID NO: 1518658 - RNA, 18 nt, Homo sapiens
aguuauuccccaucuucc

SEQ ID NO: 1518659 - RNA, 19 nt, Homo sapiens
aguuauuccccaucuucca

SEQ ID NO: 1518660 - RNA, 20 nt, Homo sapiens
aguugaagaaaaaauggcaa

SEQ ID NO: 1518661 - RNA, 12 nt, Homo sapiens
auaaaaucucgg

SEQ ID NO: 1518662 - RNA, 14 nt, Homo sapiens
auaaaggauaaaga

SEQ ID NO: 1518663 - RNA, 22 nt, Homo sapiens
auaacauuuacuuuugcucccu

SEQ ID NO: 1518664 - RNA, 13 nt, Homo sapiens
auaaccauauuca

SEQ ID NO: 1518665 - RNA, 18 nt, Homo sapiens
auaauaaaaguuauuacc

SEQ ID NO: 1518666 - RNA, 14 nt, Homo sapiens
auaauaauuuuccu

SEQ ID NO: 1518667 - RNA, 13 nt, Homo sapiens
auaauucaaacac

SEQ ID NO: 1518668 - RNA, 23 nt, Homo sapiens
auacaacuucauauaacugagau

SEQ ID NO: 1518669 - RNA, 15 nt, Homo sapiens
auacacagugcugac

SEQ ID NO: 1518670 - RNA, 21 nt, Homo sapiens
auacccuccuuccaccaaguu

SEQ ID NO: 1518671 - RNA, 20 nt, Homo sapiens
auacugagauugucuguuca

SEQ ID NO: 1518672 - RNA, 13 nt, Homo sapiens
auagguuagauuc

SEQ ID NO: 1518673 - RNA, 18 nt, Homo sapiens
auauauuugauacauaua

SEQ ID NO: 1518674 - RNA, 23 nt, Homo sapiens
auauauuuuuuucaacugccaau

SEQ ID NO: 1518675 - RNA, 18 nt, Homo sapiens
auaugcagauacuuauua

SEQ ID NO: 1518676 - RNA, 15 nt, Homo sapiens
auauuaaagcaccaa

SEQ ID NO: 1518677 - RNA, 20 nt, Homo sapiens
auauuagauaaccauauuca

SEQ ID NO: 1518678 - RNA, 18 nt, Homo sapiens
cauauuaucaugucuauu

SEQ ID NO: 1518679 - RNA, 16 nt, Homo sapiens
cauauucacaauggaa

SEQ ID NO: 1518680 - RNA, 20 nt, Homo sapiens
guuuucuuuuucagauuuau

SEQ ID NO: 1518681 - RNA, 23 nt, Homo sapiens
uaaaagaugcauuaucuaugaua

SEQ ID NO: 1518682 - RNA, 18 nt, Homo sapiens
uaaagaacgcgacuucca

SEQ ID NO: 1518683 - RNA, 22 nt, Homo sapiens
uaaagacuuguauagcaugaaa

SEQ ID NO: 1518684 - RNA, 16 nt, Homo sapiens
uaaagcugaaaacugc

SEQ ID NO: 1518685 - RNA, 22 nt, Homo sapiens
gggagagaacuuaaaaaagcaa

SEQ ID NO: 1518686 - RNA, 19 nt, Homo sapiens
gguucaccaggucagggag

SEQ ID NO: 1518687 - RNA, 23 nt, Homo sapiens
gguuucacuguggucucaaucuc

SEQ ID NO: 1518688 - RNA, 18 nt, Homo sapiens
guaacgaugcacuuugga

SEQ ID NO: 1518689 - RNA, 23 nt, Homo sapiens
guaacuguuuagaugaaugucag

SEQ ID NO: 1518690 - RNA, 23 nt, Homo sapiens
guaaucugacuucucacuuccua

SEQ ID NO: 1518691 - RNA, 14 nt, Homo sapiens
guaaugaaauggag

SEQ ID NO: 1518692 - RNA, 22 nt, Homo sapiens
guagaaaugucuauguuuucua

SEQ ID NO: 1518693 - RNA, 17 nt, Homo sapiens
guagcugggacuacagg

SEQ ID NO: 1518694 - RNA, 19 nt, Homo sapiens
guaguuucugcauuucaag

SEQ ID NO: 1518695 - RNA, 13 nt, Homo sapiens
guauuuaucuccu

SEQ ID NO: 1518696 - RNA, 22 nt, Homo sapiens
gucaaccccaaguuaguucaau

SEQ ID NO: 1518697 - RNA, 22 nt, Homo sapiens
gucccagggcugaugcuguaca

SEQ ID NO: 1518698 - RNA, 19 nt, Homo sapiens
gucucaaaaaaagggcaau

SEQ ID NO: 1518699 - RNA, 22 nt, Homo sapiens
gucucuaaguuaugacugugaa

SEQ ID NO: 1518700 - RNA, 23 nt, Homo sapiens
gucuucccuucuuugcacuuuug

SEQ ID NO: 1518701 - RNA, 15 nt, Homo sapiens
gucuugaaaagccua

SEQ ID NO: 1518702 - RNA, 18 nt, Homo sapiens
gucuuuauaaugggauau

SEQ ID NO: 1518703 - RNA, 19 nt, Homo sapiens
gugaacauuacauugccau

SEQ ID NO: 1518704 - RNA, 16 nt, Homo sapiens
gugagcaaagggcuca

SEQ ID NO: 1518705 - RNA, 21 nt, Homo sapiens
gugauacugagauugucuguu

SEQ ID NO: 1518706 - RNA, 20 nt, Homo sapiens
gugcaugcagcaucuaagua

SEQ ID NO: 1518707 - RNA, 23 nt, Homo sapiens
guguauuuaaccuugaaggguuc

SEQ ID NO: 1518708 - RNA, 15 nt, Homo sapiens
gugucaaccccaaau

SEQ ID NO: 1518709 - RNA, 15 nt, Homo sapiens
auaaaucaaucuuau

SEQ ID NO: 1518710 - RNA, 20 nt, Homo sapiens
auaaaucauucuuacuaaaa

SEQ ID NO: 1518711 - RNA, 13 nt, Homo sapiens
auaaaucuauuca

SEQ ID NO: 1518712 - RNA, 14 nt, Homo sapiens
auaacauuuacuuu

SEQ ID NO: 1518713 - RNA, 15 nt, Homo sapiens
auaacauuuacuuuu

SEQ ID NO: 1518714 - RNA, 15 nt, Homo sapiens
auaacuauguugaua

SEQ ID NO: 1518715 - RNA, 16 nt, Homo sapiens
auacaacuucauauaa

SEQ ID NO: 1518716 - RNA, 20 nt, Homo sapiens
auacacauccccagccagaa

SEQ ID NO: 1518717 - RNA, 13 nt, Homo sapiens
auacauaugcaga

SEQ ID NO: 1518718 - RNA, 22 nt, Homo sapiens
auaccaaccugaagacaccguu

SEQ ID NO: 1518719 - RNA, 23 nt, Homo sapiens
auacugagauugucuguucaguu

SEQ ID NO: 1518720 - RNA, 22 nt, Homo sapiens
auagacuguaacuuccaaauaa

SEQ ID NO: 1518721 - RNA, 22 nt, Homo sapiens
auaguuaacacagaucaaguga

SEQ ID NO: 1518722 - RNA, 19 nt, Homo sapiens
auauauuugauacauauaa

SEQ ID NO: 1518723 - RNA, 13 nt, Homo sapiens
auaucaugcucca

SEQ ID NO: 1518724 - RNA, 16 nt, Homo sapiens
auaugaucggccauca

SEQ ID NO: 1518725 - RNA, 16 nt, Homo sapiens
auaugcagacauguau

SEQ ID NO: 1518726 - RNA, 21 nt, Homo sapiens
auauuagauaaccauauucac

SEQ ID NO: 1518727 - RNA, 20 nt, Homo sapiens
auauuccuuuuucuaugaaa

SEQ ID NO: 1518728 - RNA, 19 nt, Homo sapiens
auauuuauaaaauugcuau

SEQ ID NO: 1518729 - RNA, 17 nt, Homo sapiens
auauuugauacauauaa

SEQ ID NO: 1518730 - RNA, 20 nt, Homo sapiens
auauuuucccucucuugccu

SEQ ID NO: 1518731 - RNA, 15 nt, Homo sapiens
aucauuaugaaguca

SEQ ID NO: 1518732 - RNA, 17 nt, Homo sapiens
auccaacaugugcucag

SEQ ID NO: 1518733 - RNA, 12 nt, Homo sapiens
aucccagcacuu

SEQ ID NO: 1518734 - RNA, 24 nt, Homo sapiens
auccuuggaaauuggaagagcaca

SEQ ID NO: 1518735 - RNA, 16 nt, Homo sapiens
aucuaugauaugcuaa

SEQ ID NO: 1518736 - RNA, 18 nt, Homo sapiens
aucuccaaacuaaacccu

SEQ ID NO: 1518737 - RNA, 17 nt, Homo sapiens
aucuccugucuacaguu

SEQ ID NO: 1518738 - RNA, 20 nt, Homo sapiens
aucugacuucucacuuccua

SEQ ID NO: 1518739 - RNA, 15 nt, Homo sapiens
aucugccacguguau

SEQ ID NO: 1518740 - RNA, 22 nt, Homo sapiens
aucuuauuuaauuuuugcaauu

SEQ ID NO: 1518741 - RNA, 16 nt, Homo sapiens
augaaauaucaugcuc

SEQ ID NO: 1518742 - RNA, 14 nt, Homo sapiens
augaaaugcauauu

SEQ ID NO: 1518743 - RNA, 21 nt, Homo sapiens
augaagguggaacaagcacag

SEQ ID NO: 1518744 - RNA, 16 nt, Homo sapiens
augaauguaauuuuga

SEQ ID NO: 1518745 - RNA, 13 nt, Homo sapiens
augagagcauaau

SEQ ID NO: 1518746 - RNA, 16 nt, Homo sapiens
augcagcaucuaagua

SEQ ID NO: 1518747 - RNA, 15 nt, Homo sapiens
augcguuuaaucaca

SEQ ID NO: 1518748 - RNA, 16 nt, Homo sapiens
auggcucuacuuucag

SEQ ID NO: 1518749 - RNA, 19 nt, Homo sapiens
augguaguuuuacaguguu

SEQ ID NO: 1518750 - RNA, 13 nt, Homo sapiens
auguaaauacugu

SEQ ID NO: 1518751 - RNA, 23 nt, Homo sapiens
auguacauaccuuguuauaugca

SEQ ID NO: 1518752 - RNA, 22 nt, Homo sapiens
augucuauguuuucuacuccaa

SEQ ID NO: 1518753 - RNA, 15 nt, Homo sapiens
augugauuugucuuc

SEQ ID NO: 1518754 - RNA, 14 nt, Homo sapiens
auuaaaaauuacug

SEQ ID NO: 1518755 - RNA, 14 nt, Homo sapiens
auuaccuuuacaua

SEQ ID NO: 1518756 - RNA, 19 nt, Homo sapiens
auucacuuuauuauuuugc

SEQ ID NO: 1518757 - RNA, 20 nt, Homo sapiens
auucauucuggucuuugaaa

SEQ ID NO: 1518758 - RNA, 23 nt, Homo sapiens
auucauucuuuuugaaaugucaa

SEQ ID NO: 1518759 - RNA, 16 nt, Homo sapiens
auucugucaaugucuu

SEQ ID NO: 1518760 - RNA, 22 nt, Homo sapiens
auucuuccucaaagcauuugca

SEQ ID NO: 1518761 - RNA, 21 nt, Homo sapiens
auucuuuugcacaccuguuau

SEQ ID NO: 1518762 - RNA, 16 nt, Homo sapiens
auugaaaugauuucac

SEQ ID NO: 1518763 - RNA, 22 nt, Homo sapiens
auugcuucuucuucaagauuua

SEQ ID NO: 1518764 - RNA, 22 nt, Homo sapiens
auuggagacaucacuugccaau

SEQ ID NO: 1518765 - RNA, 17 nt, Homo sapiens
auuuauugaaaugauuu

SEQ ID NO: 1518766 - RNA, 21 nt, Homo sapiens
auuuauugaaaugauuucaca

SEQ ID NO: 1518767 - RNA, 13 nt, Homo sapiens
auuucacagugug

SEQ ID NO: 1518768 - RNA, 22 nt, Homo sapiens
auuucugaggagccugcaacau

SEQ ID NO: 1518769 - RNA, 19 nt, Homo sapiens
auuucuucacucaaucucu

SEQ ID NO: 1518770 - RNA, 23 nt, Homo sapiens
auuuuaaagccugaaaauuccaa

SEQ ID NO: 1518771 - RNA, 14 nt, Homo sapiens
auuuugcagcagaa

SEQ ID NO: 1518772 - RNA, 23 nt, Homo sapiens
auuuugcuucaggauccaaguga

SEQ ID NO: 1518773 - RNA, 18 nt, Homo sapiens
auuuuugaugacucauca

SEQ ID NO: 1518774 - RNA, 14 nt, Homo sapiens
caaaaaacuuuuaa

SEQ ID NO: 1518775 - RNA, 22 nt, Homo sapiens
caaaaauuauaacauuuacuuu

SEQ ID NO: 1518776 - RNA, 17 nt, Homo sapiens
caaaguuuugaagucau

SEQ ID NO: 1518777 - RNA, 22 nt, Homo sapiens
caaaugauccuuccuacuuugc

SEQ ID NO: 1518778 - RNA, 23 nt, Homo sapiens
caacauuggagacaucacuugcc

SEQ ID NO: 1518779 - RNA, 14 nt, Homo sapiens
caaccugaagacac

SEQ ID NO: 1518780 - RNA, 12 nt, Homo sapiens
caacugccaauc

SEQ ID NO: 1518781 - RNA, 16 nt, Homo sapiens
caagaccucugugcac

SEQ ID NO: 1518782 - RNA, 14 nt, Homo sapiens
caagcaaauggcca

SEQ ID NO: 1518783 - RNA, 16 nt, Homo sapiens
caagcuggacuauggc

SEQ ID NO: 1518784 - RNA, 17 nt, Homo sapiens
caaggccagaugcacau

SEQ ID NO: 1518785 - RNA, 16 nt, Homo sapiens
caaggguuuguugaac

SEQ ID NO: 1518786 - RNA, 19 nt, Homo sapiens
caagguauuuacacauaca

SEQ ID NO: 1518787 - RNA, 23 nt, Homo sapiens
caauagacuguacuuauuuucca

SEQ ID NO: 1518788 - RNA, 22 nt, Homo sapiens
caaugcuauaacuauguugaua

SEQ ID NO: 1518789 - RNA, 23 nt, Homo sapiens
caaugcuauaacuauguugauaa

SEQ ID NO: 1518790 - RNA, 21 nt, Homo sapiens
caauuguaaacagaaauugca

SEQ ID NO: 1518791 - RNA, 20 nt, Homo sapiens
cacagaacacagcaauuccu

SEQ ID NO: 1518792 - RNA, 15 nt, Homo sapiens
cacagacacuaacga

SEQ ID NO: 1518793 - RNA, 21 nt, Homo sapiens
cacagagauaauucuagcuuu

SEQ ID NO: 1518794 - RNA, 17 nt, Homo sapiens
cacagaucaagugaaca

SEQ ID NO: 1518795 - RNA, 15 nt, Homo sapiens
cacagucucugggag

SEQ ID NO: 1518796 - RNA, 16 nt, Homo sapiens
cacauuaauuagauuu

SEQ ID NO: 1518797 - RNA, 14 nt, Homo sapiens
cacccaaugcauau

SEQ ID NO: 1518798 - RNA, 22 nt, Homo sapiens
caccgauugcaggacacaagca

SEQ ID NO: 1518799 - RNA, 21 nt, Homo sapiens
caccuguuauugccaauguuc

SEQ ID NO: 1518800 - RNA, 18 nt, Homo sapiens
cacggaucaauagacugu

SEQ ID NO: 1518801 - RNA, 21 nt, Homo sapiens
cacucuaggacucugcacuga

SEQ ID NO: 1518802 - RNA, 14 nt, Homo sapiens
cacuggacugucua

SEQ ID NO: 1518803 - RNA, 22 nt, Homo sapiens
cacugggcuucuagaaccaggc

SEQ ID NO: 1518804 - RNA, 20 nt, Homo sapiens
cacuguacuucugugugcaa

SEQ ID NO: 1518805 - RNA, 17 nt, Homo sapiens
cacuugccaauguacau

SEQ ID NO: 1518806 - RNA, 14 nt, Homo sapiens
cagaaaaacugugg

SEQ ID NO: 1518807 - RNA, 17 nt, Homo sapiens
cagaagaccucccuuca

SEQ ID NO: 1518808 - RNA, 20 nt, Homo sapiens
cagaaggaaaaaaacaugaa

SEQ ID NO: 1518809 - RNA, 17 nt, Homo sapiens
cagagcagaacuuucac

SEQ ID NO: 1518810 - RNA, 20 nt, Homo sapiens
cagauguccuugaugcucau

SEQ ID NO: 1518811 - RNA, 16 nt, Homo sapiens
cagcaugauucuucca

SEQ ID NO: 1518812 - RNA, 16 nt, Homo sapiens
cagcuugguguacuua

SEQ ID NO: 1518813 - RNA, 22 nt, Homo sapiens
cagcuuuugccuugguucuucc

SEQ ID NO: 1518814 - RNA, 17 nt, Homo sapiens
caggagcugaagcccau

SEQ ID NO: 1518815 - RNA, 20 nt, Homo sapiens
caggugugagccaccgcgcc

SEQ ID NO: 1518816 - RNA, 21 nt, Homo sapiens
caguuugauuguuguuuauaa

SEQ ID NO: 1518817 - RNA, 13 nt, Homo sapiens
cauaaaucuauuc

SEQ ID NO: 1518818 - RNA, 18 nt, Homo sapiens
cauaauuucuucacucaa

SEQ ID NO: 1518819 - RNA, 22 nt, Homo sapiens
cauacaacuucauauaacugag

SEQ ID NO: 1518820 - RNA, 17 nt, Homo sapiens
cauagaguucagacuuu

SEQ ID NO: 1518821 - RNA, 15 nt, Homo sapiens
cauauauuuguauga

SEQ ID NO: 1518822 - RNA, 14 nt, Homo sapiens
cauauccaacaugu

SEQ ID NO: 1518823 - RNA, 18 nt, Homo sapiens
cauauccaacaugugcuc

SEQ ID NO: 1518824 - RNA, 24 nt, Homo sapiens
cauccauguuccgagaagaacaga

SEQ ID NO: 1518825 - RNA, 15 nt, Homo sapiens
cauccccagccagaa

SEQ ID NO: 1518826 - RNA, 15 nt, Homo sapiens
caucccuggaaggac

SEQ ID NO: 1518827 - RNA, 19 nt, Homo sapiens
caucugcuuguauuuucca

SEQ ID NO: 1518828 - RNA, 14 nt, Homo sapiens
uaagagaugugacu

SEQ ID NO: 1518829 - RNA, 16 nt, Homo sapiens
uaagaggcgacuuccu

SEQ ID NO: 1518830 - RNA, 15 nt, Homo sapiens
uaagaguuguaugaa

SEQ ID NO: 1518831 - RNA, 15 nt, Homo sapiens
uaaguaaugaugucg

SEQ ID NO: 1518832 - RNA, 14 nt, Homo sapiens
uaagugcaugacau

SEQ ID NO: 1518833 - RNA, 16 nt, Homo sapiens
uaaguuaugacuguga

SEQ ID NO: 1518834 - RNA, 18 nt, Homo sapiens
uaaguucccuucuauauc

SEQ ID NO: 1518835 - RNA, 14 nt, Homo sapiens
uaaguucuauugaa

SEQ ID NO: 1518836 - RNA, 19 nt, Homo sapiens
uaaguugauggugaugaaa

SEQ ID NO: 1518837 - RNA, 14 nt, Homo sapiens
uaauaauuugccau

SEQ ID NO: 1518838 - RNA, 20 nt, Homo sapiens
uaauaauuugccauuaucug

SEQ ID NO: 1518839 - RNA, 13 nt, Homo sapiens
uaauaauuuuccu

SEQ ID NO: 1518840 - RNA, 18 nt, Homo sapiens
uaauacagacuaugucac

SEQ ID NO: 1518841 - RNA, 18 nt, Homo sapiens
uaauccagaaaaacugug

SEQ ID NO: 1518842 - RNA, 23 nt, Homo sapiens
uaaugaugucguuugaaucacag

SEQ ID NO: 1518843 - RNA, 16 nt, Homo sapiens
uaauucuagcuuugag

SEQ ID NO: 1518844 - RNA, 22 nt, Homo sapiens
uaauuuugcagcagaagccaaa

SEQ ID NO: 1518845 - RNA, 13 nt, Homo sapiens
uaauuuuugcaau

SEQ ID NO: 1518846 - RNA, 20 nt, Homo sapiens
uacaaaaaugagcuaggcau

SEQ ID NO: 1518847 - RNA, 22 nt, Homo sapiens
uacacauacaacuucauauaac

SEQ ID NO: 1518848 - RNA, 20 nt, Homo sapiens
uacaggcauagaguucagac

SEQ ID NO: 1518849 - RNA, 17 nt, Homo sapiens
uacaggcgccugccaca

SEQ ID NO: 1518850 - RNA, 14 nt, Homo sapiens
uaccugcacacugu

SEQ ID NO: 1518851 - RNA, 15 nt, Homo sapiens
uaccuuuacauauua

SEQ ID NO: 1518852 - RNA, 14 nt, Homo sapiens
uacuaucaugucaa

SEQ ID NO: 1518853 - RNA, 15 nt, Homo sapiens
uacuaucaugucaaa

SEQ ID NO: 1518854 - RNA, 22 nt, Homo sapiens
uacucaugcauucuuuugcaca

SEQ ID NO: 1518855 - RNA, 14 nt, Homo sapiens
uacuuaauacucau

SEQ ID NO: 1518856 - RNA, 21 nt, Homo sapiens
uacuuucaucuauucuuuccc

SEQ ID NO: 1518857 - RNA, 15 nt, Homo sapiens
uacuuuccaaucuca

SEQ ID NO: 1518858 - RNA, 15 nt, Homo sapiens
uagaaaugucuaugu

SEQ ID NO: 1518859 - RNA, 17 nt, Homo sapiens
uagaagaaagggcaaga

SEQ ID NO: 1518860 - RNA, 22 nt, Homo sapiens
uagacuguacuuauuuuccaau

SEQ ID NO: 1518861 - RNA, 20 nt, Homo sapiens
uagagacgggguuucacugu

SEQ ID NO: 1518862 - RNA, 20 nt, Homo sapiens
uagauaauaaaauugcuccc

SEQ ID NO: 1518863 - RNA, 18 nt, Homo sapiens
uagcuuuaagcacccuag

SEQ ID NO: 1518864 - RNA, 22 nt, Homo sapiens
uagucacagagauaauucuagc

SEQ ID NO: 1518865 - RNA, 22 nt, Homo sapiens
uauauuuuuuucaacugccaau

SEQ ID NO: 1518866 - RNA, 22 nt, Homo sapiens
uaucaaaauagucuaaggccau

SEQ ID NO: 1518867 - RNA, 15 nt, Homo sapiens
uaugcagauacuuau

SEQ ID NO: 1518868 - RNA, 12 nt, Homo sapiens
uaugugcacauc

SEQ ID NO: 1518869 - RNA, 15 nt, Homo sapiens
uaugugcacaucugu

SEQ ID NO: 1518870 - RNA, 19 nt, Homo sapiens
uauuaagagcaaacuuuag

SEQ ID NO: 1518871 - RNA, 18 nt, Homo sapiens
uauuccuuugcauauuau

SEQ ID NO: 1518872 - RNA, 18 nt, Homo sapiens
uauuuacacauacaacuu

SEQ ID NO: 1518873 - RNA, 11 nt, Homo sapiens
uauuuaucucc

SEQ ID NO: 1518874 - RNA, 18 nt, Homo sapiens
uauuuuguuggaguauua

SEQ ID NO: 1518875 - RNA, 20 nt, Homo sapiens
ucaaaauagucuaaggccau

SEQ ID NO: 1518876 - RNA, 15 nt, Homo sapiens
ucaaacaccucugua

SEQ ID NO: 1518877 - RNA, 13 nt, Homo sapiens
ucaaaugauccuu

SEQ ID NO: 1518878 - RNA, 18 nt, Homo sapiens
ucaaauguucuccaguca

SEQ ID NO: 1518879 - RNA, 18 nt, Homo sapiens
ucaaggcagaggcaggaa

SEQ ID NO: 1518880 - RNA, 22 nt, Homo sapiens
ucaaugcuauaacuauguugau

SEQ ID NO: 1518881 - RNA, 22 nt, Homo sapiens
ucacucaaucucugauucuguc

SEQ ID NO: 1518882 - RNA, 14 nt, Homo sapiens
ucagcuggaucucc

SEQ ID NO: 1518883 - RNA, 16 nt, Homo sapiens
ucaggacuuucccuga

SEQ ID NO: 1518884 - RNA, 18 nt, Homo sapiens
ucagggcugagaggagaa

SEQ ID NO: 1518885 - RNA, 23 nt, Homo sapiens
ucagucacucuaggacucugcac

SEQ ID NO: 1518886 - RNA, 19 nt, Homo sapiens
ucauaagucuuugguacaa

SEQ ID NO: 1518887 - RNA, 22 nt, Homo sapiens
ucaucccacccucucacaguuc

SEQ ID NO: 1518888 - RNA, 17 nt, Homo sapiens
ucaucuuagcuuuccac

SEQ ID NO: 1518889 - RNA, 24 nt, Homo sapiens
ucaugucuauuuuugaugacucau

SEQ ID NO: 1518890 - RNA, 21 nt, Homo sapiens
ucauuaaaaaugaaagccaaa

SEQ ID NO: 1518891 - RNA, 18 nt, Homo sapiens
ucauucacgggacuaguu

SEQ ID NO: 1518892 - RNA, 19 nt, Homo sapiens
uccaaacuaccuuccaguu

SEQ ID NO: 1518893 - RNA, 16 nt, Homo sapiens
uccaacaugugcucag

SEQ ID NO: 1518894 - RNA, 20 nt, Homo sapiens
uccaaggaaauacauaugca

SEQ ID NO: 1518895 - RNA, 20 nt, Homo sapiens
uccacuucuuaaugcuuucc

SEQ ID NO: 1518896 - RNA, 20 nt, Homo sapiens
uccagccagccaaauccauc

SEQ ID NO: 1518897 - RNA, 21 nt, Homo sapiens
uccaucugcuuguauuuucca

SEQ ID NO: 1518898 - RNA, 18 nt, Homo sapiens
ucccaaauucacuuuauu

SEQ ID NO: 1518899 - RNA, 19 nt, Homo sapiens
ucccuaccugacugccaca

SEQ ID NO: 1518900 - RNA, 17 nt, Homo sapiens
ucccuucuauauccuca

SEQ ID NO: 1518901 - RNA, 17 nt, Homo sapiens
ucccuucuuugcacuuu

SEQ ID NO: 1518902 - RNA, 13 nt, Homo sapiens
ucccuuggacauu

SEQ ID NO: 1518903 - RNA, 14 nt, Homo sapiens
uccgccugccucag

SEQ ID NO: 1518904 - RNA, 19 nt, Homo sapiens
uccuaaugaaugcauaaaa

SEQ ID NO: 1518905 - RNA, 14 nt, Homo sapiens
uccuguaagaccuu

SEQ ID NO: 1518906 - RNA, 15 nt, Homo sapiens
uccuuggaaauugga

SEQ ID NO: 1518907 - RNA, 12 nt, Homo sapiens
ucgaguguuuca

SEQ ID NO: 1518908 - RNA, 18 nt, Homo sapiens
ucuaaaaauaguuaacac

SEQ ID NO: 1518909 - RNA, 16 nt, Homo sapiens
ucuacuccaauucaua

SEQ ID NO: 1518910 - RNA, 20 nt, Homo sapiens
ucuagaaccaggcaacuugg

SEQ ID NO: 1518911 - RNA, 17 nt, Homo sapiens
ucuauaccuuacugcaa

SEQ ID NO: 1518912 - RNA, 18 nt, Homo sapiens
ucuauggcacccaugcac

SEQ ID NO: 1518913 - RNA, 20 nt, Homo sapiens
ucuauggcacccaugcaccu

SEQ ID NO: 1518914 - RNA, 11 nt, Homo sapiens
ucuauguuaau

SEQ ID NO: 1518915 - RNA, 15 nt, Homo sapiens
ucuauuaaagauauu

SEQ ID NO: 1518916 - RNA, 15 nt, Homo sapiens
ucucaacucacugca

SEQ ID NO: 1518917 - RNA, 21 nt, Homo sapiens
ucucagcuggaucuccauucu

SEQ ID NO: 1518918 - RNA, 15 nt, Homo sapiens
ucucugcucuugccu

SEQ ID NO: 1518919 - RNA, 20 nt, Homo sapiens
ucucugggagacuuucccua

SEQ ID NO: 1518920 - RNA, 16 nt, Homo sapiens
ucugaugcaagcaaga

SEQ ID NO: 1518921 - RNA, 21 nt, Homo sapiens
ucugaugcaagcaagaaacac

SEQ ID NO: 1518922 - RNA, 22 nt, Homo sapiens
ucugcugucuuuauaaugggau

SEQ ID NO: 1518923 - RNA, 16 nt, Homo sapiens
ucugggagacuuuccc

SEQ ID NO: 1518924 - RNA, 14 nt, Homo sapiens
ucuuacuaaaaagu

SEQ ID NO: 1518925 - RNA, 20 nt, Homo sapiens
ucuuaggcuaagagauguga

SEQ ID NO: 1518926 - RNA, 14 nt, Homo sapiens
ucuuauuugcaaua

SEQ ID NO: 1518927 - RNA, 21 nt, Homo sapiens
ucuucauaauuucuucacuca

SEQ ID NO: 1518928 - RNA, 21 nt, Homo sapiens
ucuuccaaggaaauacauaug

SEQ ID NO: 1518929 - RNA, 12 nt, Homo sapiens
ucuuugcacuuu

SEQ ID NO: 1518930 - RNA, 15 nt, Homo sapiens
ucuuugguacaaguu

SEQ ID NO: 1518931 - RNA, 11 nt, Homo sapiens
ucuuuguucaa

SEQ ID NO: 1518932 - RNA, 18 nt, Homo sapiens
ucuuuguucaaauguacu

SEQ ID NO: 1518933 - RNA, 15 nt, Homo sapiens
ucuuuugauaguauu

SEQ ID NO: 1518934 - RNA, 18 nt, Homo sapiens
ucuuuuucagauuuauga

SEQ ID NO: 1518935 - RNA, 12 nt, Homo sapiens
ugaaaaaugccu

SEQ ID NO: 1518936 - RNA, 13 nt, Homo sapiens
ugaaaaaugccuc

SEQ ID NO: 1518937 - RNA, 19 nt, Homo sapiens
ugaaaagauuauuggaaag

SEQ ID NO: 1518938 - RNA, 19 nt, Homo sapiens
ugaaacuugcaacuuugag

SEQ ID NO: 1518939 - RNA, 14 nt, Homo sapiens
ugaaauaauucaaa

SEQ ID NO: 1518940 - RNA, 23 nt, Homo sapiens
ugaaauaccaaccugaagacacc

SEQ ID NO: 1518941 - RNA, 13 nt, Homo sapiens
ugaaaucuaugaa

SEQ ID NO: 1518942 - RNA, 19 nt, Homo sapiens
ugaacacaaguuccugaua

SEQ ID NO: 1518943 - RNA, 22 nt, Homo sapiens
ugaacccagaaacaacacaauc

SEQ ID NO: 1518944 - RNA, 23 nt, Homo sapiens
ugaagaaaaaauggcaagagauc

SEQ ID NO: 1518945 - RNA, 20 nt, Homo sapiens
ugaagaagaguuugcaaaug

SEQ ID NO: 1518946 - RNA, 15 nt, Homo sapiens
ugaagcagauguggu

SEQ ID NO: 1518947 - RNA, 21 nt, Homo sapiens
ugaagcagauguggugauacu

SEQ ID NO: 1518948 - RNA, 17 nt, Homo sapiens
ucuuauuuaauuuuugc

SEQ ID NO: 1518949 - RNA, 13 nt, Homo sapiens
ucuucaagauuua

SEQ ID NO: 1518950 - RNA, 18 nt, Homo sapiens
ucuucacucaaucucuga

SEQ ID NO: 1518951 - RNA, 16 nt, Homo sapiens
ucuucauaauuucuuc

SEQ ID NO: 1518952 - RNA, 19 nt, Homo sapiens
ucuuucuaagagaccugaa

SEQ ID NO: 1518953 - RNA, 22 nt, Homo sapiens
ugaaauggaggaucucuaaaga

SEQ ID NO: 1518954 - RNA, 16 nt, Homo sapiens
ugaacauuacauugcc

SEQ ID NO: 1518955 - RNA, 18 nt, Homo sapiens
ugaacauuacauugccau

SEQ ID NO: 1518956 - RNA, 19 nt, Homo sapiens
ugaagaagagaaugugaca

SEQ ID NO: 1518957 - RNA, 14 nt, Homo sapiens
ugaagcagaugugg

SEQ ID NO: 1518958 - RNA, 19 nt, Homo sapiens
ugaagguggaacaagcaca

SEQ ID NO: 1518959 - RNA, 14 nt, Homo sapiens
ugaaguaagcaaag

SEQ ID NO: 1518960 - RNA, 17 nt, Homo sapiens
ugaaucuuggugucuac

SEQ ID NO: 1518961 - RNA, 16 nt, Homo sapiens
ugaauggcugaccuga

SEQ ID NO: 1518962 - RNA, 16 nt, Homo sapiens
ugaccuuuuucacugu

SEQ ID NO: 1518963 - RNA, 20 nt, Homo sapiens
ugacucuccagaaagcucau

SEQ ID NO: 1518964 - RNA, 14 nt, Homo sapiens
ugacuucucacuuc

SEQ ID NO: 1518965 - RNA, 12 nt, Homo sapiens
ugagaugaaugu

SEQ ID NO: 1518966 - RNA, 21 nt, Homo sapiens
ugagcuuaagaauuuugagca

SEQ ID NO: 1518967 - RNA, 16 nt, Homo sapiens
ugaggucaccuggaau

SEQ ID NO: 1518968 - RNA, 20 nt, Homo sapiens
ugauaaaaagaaaugugauu

SEQ ID NO: 1518969 - RNA, 17 nt, Homo sapiens
ugauccuuccuacuuug

SEQ ID NO: 1518970 - RNA, 14 nt, Homo sapiens
ugaugaccaagaau

SEQ ID NO: 1518971 - RNA, 13 nt, Homo sapiens
ugaugauacuucc

SEQ ID NO: 1518972 - RNA, 12 nt, Homo sapiens
ugaugcuguaca

SEQ ID NO: 1518973 - RNA, 17 nt, Homo sapiens
ugaugucguuugaauca

SEQ ID NO: 1518974 - RNA, 15 nt, Homo sapiens
ugauuucacagugug

SEQ ID NO: 1518975 - RNA, 17 nt, Homo sapiens
ugcaaaguguauuagga

SEQ ID NO: 1518976 - RNA, 18 nt, Homo sapiens
ugcaaucagcuaccauuc

SEQ ID NO: 1518977 - RNA, 17 nt, Homo sapiens
ugcacuuuugaaauaaa

SEQ ID NO: 1518978 - RNA, 23 nt, Homo sapiens
ugcacuuuugaaauaaaguauuu

SEQ ID NO: 1518979 - RNA, 20 nt, Homo sapiens
ugcagaaucagcaugauucu

SEQ ID NO: 1518980 - RNA, 22 nt, Homo sapiens
ugcaggcaaacuuggcucucaa

SEQ ID NO: 1518981 - RNA, 20 nt, Homo sapiens
ugcauaagugcaugacauau

SEQ ID NO: 1518982 - RNA, 16 nt, Homo sapiens
ugcaugcagcaucuaa

SEQ ID NO: 1518983 - RNA, 17 nt, Homo sapiens
ugcauucuuuugcacac

SEQ ID NO: 1518984 - RNA, 16 nt, Homo sapiens
ugccagccacugugau

SEQ ID NO: 1518985 - RNA, 16 nt, Homo sapiens
ugcccaguguguuucu

SEQ ID NO: 1518986 - RNA, 16 nt, Homo sapiens
ugccgggcgcaggaac

SEQ ID NO: 1518987 - RNA, 16 nt, Homo sapiens
ugccuaggaggccuuc

SEQ ID NO: 1518988 - RNA, 23 nt, Homo sapiens
ugcuauuuuugaagcagaugugg

SEQ ID NO: 1518989 - RNA, 16 nt, Homo sapiens
ugcuucgcagaugucc

SEQ ID NO: 1518990 - RNA, 13 nt, Homo sapiens
ugcuuggcacuua

SEQ ID NO: 1518991 - RNA, 16 nt, Homo sapiens
ugcuuuggaaaucaca

SEQ ID NO: 1518992 - RNA, 16 nt, Homo sapiens
uggaacaagcacagau

SEQ ID NO: 1518993 - RNA, 15 nt, Homo sapiens
uggaagugugugauc

SEQ ID NO: 1518994 - RNA, 21 nt, Homo sapiens
uggacuauggcucuacuuuca

SEQ ID NO: 1518995 - RNA, 13 nt, Homo sapiens
uggagaagcuccc

SEQ ID NO: 1518996 - RNA, 17 nt, Homo sapiens
uggagacaucacuugcc

SEQ ID NO: 1518997 - RNA, 19 nt, Homo sapiens
uggagacaucacuugccaa

SEQ ID NO: 1518998 - RNA, 18 nt, Homo sapiens
uggaguccgaugauucuc

SEQ ID NO: 1518999 - RNA, 23 nt, Homo sapiens
uggauugugccuaauguguuuga

SEQ ID NO: 1519000 - RNA, 14 nt, Homo sapiens
uggcacaaagucuu

SEQ ID NO: 1519001 - RNA, 21 nt, Homo sapiens
uggccaaugagaucauuguga

SEQ ID NO: 1519002 - RNA, 12 nt, Homo sapiens
uggccuuugaau

SEQ ID NO: 1519003 - RNA, 21 nt, Homo sapiens
uggcuuugaaacuugcaacuu

SEQ ID NO: 1519004 - RNA, 14 nt, Homo sapiens
ugggaaaaccagac

SEQ ID NO: 1519005 - RNA, 18 nt, Homo sapiens
ugggaacuagacucccaa

SEQ ID NO: 1519006 - RNA, 23 nt, Homo sapiens
uggggacagagcagaacuuucac

SEQ ID NO: 1519007 - RNA, 19 nt, Homo sapiens
uggguuggaaaacaguauu

SEQ ID NO: 1519008 - RNA, 19 nt, Homo sapiens
ugguacaaguuuacaugau

SEQ ID NO: 1519009 - RNA, 18 nt, Homo sapiens
ugguaggaaauagaauga

SEQ ID NO: 1519010 - RNA, 13 nt, Homo sapiens
uguaauacacaua

SEQ ID NO: 1519011 - RNA, 13 nt, Homo sapiens
uguacauaccuug

SEQ ID NO: 1519012 - RNA, 19 nt, Homo sapiens
uguaguuucugcauuucaa

SEQ ID NO: 1519013 - RNA, 21 nt, Homo sapiens
ugucaucucagcuggaucucc

SEQ ID NO: 1519014 - RNA, 12 nt, Homo sapiens
uguccuacacaa

SEQ ID NO: 1519015 - RNA, 22 nt, Homo sapiens
ugucuucccuucuuugcacuuu

SEQ ID NO: 1519016 - RNA, 23 nt, Homo sapiens
ugucuucccuucuuugcacuuuu

SEQ ID NO: 1519017 - RNA, 19 nt, Homo sapiens
ugugaaauaccaaccugaa

SEQ ID NO: 1519018 - RNA, 17 nt, Homo sapiens
ugugauucacaguguga

SEQ ID NO: 1519019 - RNA, 19 nt, Homo sapiens
uguguuuuguuuuguauca

SEQ ID NO: 1519020 - RNA, 17 nt, Homo sapiens
uguuaaacuuuuuacca

SEQ ID NO: 1519021 - RNA, 15 nt, Homo sapiens
uguucccuauuuugc

SEQ ID NO: 1519022 - RNA, 13 nt, Homo sapiens
uguuuaauugaca

SEQ ID NO: 1519023 - RNA, 18 nt, Homo sapiens
uguuucugaucugaugca

SEQ ID NO: 1519024 - RNA, 23 nt, Homo sapiens
uuaaacuuuuuaccaaguacaaa

SEQ ID NO: 1519025 - RNA, 19 nt, Homo sapiens
uuaaagcugaaaacugcaa

SEQ ID NO: 1519026 - RNA, 19 nt, Homo sapiens
uuaacccuauuuuaccuag

SEQ ID NO: 1519027 - RNA, 12 nt, Homo sapiens
uuaagacuaaaa

SEQ ID NO: 1519028 - RNA, 17 nt, Homo sapiens
uuaaguugauggugaug

SEQ ID NO: 1519029 - RNA, 19 nt, Homo sapiens
uuaaguugauggugaugaa

SEQ ID NO: 1519030 - RNA, 14 nt, Homo sapiens
uuaaugcuugaaua

SEQ ID NO: 1519031 - RNA, 14 nt, Homo sapiens
uuacaaauuuaauu

SEQ ID NO: 1519032 - RNA, 12 nt, Homo sapiens
uuacauugccau

SEQ ID NO: 1519033 - RNA, 14 nt, Homo sapiens
uuacuaucauguca

SEQ ID NO: 1519034 - RNA, 16 nt, Homo sapiens
uuacuaucaugucaaa

SEQ ID NO: 1519035 - RNA, 15 nt, Homo sapiens
uuagucgagccaagu

SEQ ID NO: 1519036 - RNA, 15 nt, Homo sapiens
uuauaaaagaugcau

SEQ ID NO: 1519037 - RNA, 23 nt, Homo sapiens
uuauaaagggagauaacaaucug

SEQ ID NO: 1519038 - RNA, 13 nt, Homo sapiens
uuauaaugggaua

SEQ ID NO: 1519039 - RNA, 15 nt, Homo sapiens
uuaugacugugaaau

SEQ ID NO: 1519040 - RNA, 20 nt, Homo sapiens
uuauuaagagcaaacuuuag

SEQ ID NO: 1519041 - RNA, 19 nt, Homo sapiens
uuauuacugagagugcaaa

SEQ ID NO: 1519042 - RNA, 18 nt, Homo sapiens
uuauugaagaugugauca

SEQ ID NO: 1519043 - RNA, 22 nt, Homo sapiens
uucaaaauugcuucuucuucaa

SEQ ID NO: 1519044 - RNA, 16 nt, Homo sapiens
uucaaucuggauucau

SEQ ID NO: 1519045 - RNA, 13 nt, Homo sapiens
agcuuaagaauuu

SEQ ID NO: 1519046 - RNA, 16 nt, Homo sapiens
agcuuuaagcacccua

SEQ ID NO: 1519047 - RNA, 21 nt, Homo sapiens
agcuuugagcuuaagaauuuu

SEQ ID NO: 1519048 - RNA, 18 nt, Homo sapiens
aggaacccaauuuucuua

SEQ ID NO: 1519049 - RNA, 14 nt, Homo sapiens
aggaaccucagggc

SEQ ID NO: 1519050 - RNA, 13 nt, Homo sapiens
aggcacagaugaa

SEQ ID NO: 1519051 - RNA, 20 nt, Homo sapiens
aggcagaggcaggaaacuaa

SEQ ID NO: 1519052 - RNA, 21 nt, Homo sapiens
aggcaggaaacuaacuggugu

SEQ ID NO: 1519053 - RNA, 16 nt, Homo sapiens
aggcaggggaauguau

SEQ ID NO: 1519054 - RNA, 20 nt, Homo sapiens
aggcauacugccuuguuuaa

SEQ ID NO: 1519055 - RNA, 15 nt, Homo sapiens
aggccagaugcacau

SEQ ID NO: 1519056 - RNA, 21 nt, Homo sapiens
aggccauugggauauucugaa

SEQ ID NO: 1519057 - RNA, 19 nt, Homo sapiens
aggcuaagagaugugacua

SEQ ID NO: 1519058 - RNA, 15 nt, Homo sapiens
agggaauaauccaga

SEQ ID NO: 1519059 - RNA, 16 nt, Homo sapiens
agggaguuggugugcu

SEQ ID NO: 1519060 - RNA, 19 nt, Homo sapiens
agggaugucacgucuugaa

SEQ ID NO: 1519061 - RNA, 16 nt, Homo sapiens
agggcaauaaaugccc

SEQ ID NO: 1519062 - RNA, 22 nt, Homo sapiens
aggugcccaggaaccucagggc

SEQ ID NO: 1519063 - RNA, 22 nt, Homo sapiens
agguucuucagaagucacacau

SEQ ID NO: 1519064 - RNA, 21 nt, Homo sapiens
aguaggcccggugugguggcu

SEQ ID NO: 1519065 - RNA, 14 nt, Homo sapiens
aguauuuaucuccu

SEQ ID NO: 1519066 - RNA, 20 nt, Homo sapiens
agucaugcguuuaaucacau

SEQ ID NO: 1519067 - RNA, 21 nt, Homo sapiens
agugacaaaguuauauauuua

SEQ ID NO: 1519068 - RNA, 14 nt, Homo sapiens
aguggggucagggc

SEQ ID NO: 1519069 - RNA, 19 nt, Homo sapiens
aguguaacgaugcacuuug

SEQ ID NO: 1519070 - RNA, 15 nt, Homo sapiens
aguuaugacugugaa

SEQ ID NO: 1519071 - RNA, 13 nt, Homo sapiens
aguucagacuuuu

SEQ ID NO: 1519072 - RNA, 23 nt, Homo sapiens
aguuccucauuuuugaauacagg

SEQ ID NO: 1519073 - RNA, 15 nt, Homo sapiens
aguuuaagucucuga

SEQ ID NO: 1519074 - RNA, 20 nt, Homo sapiens
aguuuaauaaauagcaucua

SEQ ID NO: 1519075 - RNA, 22 nt, Homo sapiens
auaaaagaaauaaaccaaagga

SEQ ID NO: 1519076 - RNA, 13 nt, Homo sapiens
auaaaauugcuau

SEQ ID NO: 1519077 - RNA, 15 nt, Homo sapiens
auaagugcaugacau

SEQ ID NO: 1519078 - RNA, 13 nt, Homo sapiens
auacaugcauaua

SEQ ID NO: 1519079 - RNA, 14 nt, Homo sapiens
auacaugcauauaa

SEQ ID NO: 1519080 - RNA, 21 nt, Homo sapiens
auagacuguacuuauuuucca

SEQ ID NO: 1519081 - RNA, 16 nt, Homo sapiens
auagauuguaauacac

SEQ ID NO: 1519082 - RNA, 19 nt, Homo sapiens
auagauuguaauacacaua

SEQ ID NO: 1519083 - RNA, 18 nt, Homo sapiens
auaguaugaaaauggaaa

SEQ ID NO: 1519084 - RNA, 13 nt, Homo sapiens
auauaacugagau

SEQ ID NO: 1519085 - RNA, 11 nt, Homo sapiens
auaugcaauau

SEQ ID NO: 1519086 - RNA, 18 nt, Homo sapiens
auaugcuaauauauguau

SEQ ID NO: 1519087 - RNA, 10 nt, Homo sapiens
auauucuugg

SEQ ID NO: 1519088 - RNA, 15 nt, Homo sapiens
auauuugauacauau

SEQ ID NO: 1519089 - RNA, 16 nt, Homo sapiens
aucaaucuuauuacug

SEQ ID NO: 1519090 - RNA, 15 nt, Homo sapiens
aucaauuuugucuau

SEQ ID NO: 1519091 - RNA, 23 nt, Homo sapiens
aucacacgucuggcuucacagau

SEQ ID NO: 1519092 - RNA, 22 nt, Homo sapiens
aucaugucuauuuuugaugacu

SEQ ID NO: 1519093 - RNA, 14 nt, Homo sapiens
aucccagcacuuug

SEQ ID NO: 1519094 - RNA, 18 nt, Homo sapiens
aucggccaucaagggaag

SEQ ID NO: 1519095 - RNA, 22 nt, Homo sapiens
aucuaugaaauaucaugcucca

SEQ ID NO: 1519096 - RNA, 18 nt, Homo sapiens
aucucaacucacugcaag

SEQ ID NO: 1519097 - RNA, 13 nt, Homo sapiens
aaaacaugaauuu

SEQ ID NO: 1519098 - RNA, 14 nt, Homo sapiens
aaaacuucacucca

SEQ ID NO: 1519099 - RNA, 22 nt, Homo sapiens
aaaagaugcauuaucuaugaua

SEQ ID NO: 1519100 - RNA, 12 nt, Homo sapiens
aaaagggcaaua

SEQ ID NO: 1519101 - RNA, 23 nt, Homo sapiens
aaaaugagcuaggcaugguggca

SEQ ID NO: 1519102 - RNA, 18 nt, Homo sapiens
aaaauggcaagagaucau

SEQ ID NO: 1519103 - RNA, 23 nt, Homo sapiens
aaacaacacaauccguugcaaac

SEQ ID NO: 1519104 - RNA, 20 nt, Homo sapiens
aaacaggcugauaccuuugu

SEQ ID NO: 1519105 - RNA, 21 nt, Homo sapiens
aaagaacgcgacuuccacaaa

SEQ ID NO: 1519106 - RNA, 16 nt, Homo sapiens
aaagcauuugcaauca

SEQ ID NO: 1519107 - RNA, 13 nt, Homo sapiens
aaagcucaucuca

SEQ ID NO: 1519108 - RNA, 23 nt, Homo sapiens
aaaguauuuaucuccugucuaca

SEQ ID NO: 1519109 - RNA, 16 nt, Homo sapiens
aaaguggaaguaugua

SEQ ID NO: 1519110 - RNA, 23 nt, Homo sapiens
aaaguuauuaccuuuacauauua

SEQ ID NO: 1519111 - RNA, 22 nt, Homo sapiens
aaauacacagugcugaccagac

SEQ ID NO: 1519112 - RNA, 14 nt, Homo sapiens
aaauccauccugcu

SEQ ID NO: 1519113 - RNA, 12 nt, Homo sapiens
aaaucuaugaaa

SEQ ID NO: 1519114 - RNA, 18 nt, Homo sapiens
aaaugauuucacagugug

SEQ ID NO: 1519115 - RNA, 22 nt, Homo sapiens
aaaugcuguauuagucacagag

SEQ ID NO: 1519116 - RNA, 16 nt, Homo sapiens
aaauggccaaugagau

SEQ ID NO: 1519117 - RNA, 17 nt, Homo sapiens
aaauguacuacuaaaga

SEQ ID NO: 1519118 - RNA, 20 nt, Homo sapiens
aaaugugauuugucuucccu

SEQ ID NO: 1519119 - RNA, 13 nt, Homo sapiens
aaauugcucccua

SEQ ID NO: 1519120 - RNA, 21 nt, Homo sapiens
aacagaaauugcaauauggau

SEQ ID NO: 1519121 - RNA, 21 nt, Homo sapiens
aacagauauuuuuaacuuaau

SEQ ID NO: 1519122 - RNA, 20 nt, Homo sapiens
aacaugccagccacugugau

SEQ ID NO: 1519123 - RNA, 16 nt, Homo sapiens
aacaugugcucaggga

SEQ ID NO: 1519124 - RNA, 16 nt, Homo sapiens
aacauuacauugccau

SEQ ID NO: 1519125 - RNA, 17 nt, Homo sapiens
aacauuacauugccauu

SEQ ID NO: 1519126 - RNA, 13 nt, Homo sapiens
aacgaugcacuuu

SEQ ID NO: 1519127 - RNA, 14 nt, Homo sapiens
aacgaugcacuuug

SEQ ID NO: 1519128 - RNA, 16 nt, Homo sapiens
aacgaugcacuuugga

SEQ ID NO: 1519129 - RNA, 13 nt, Homo sapiens
aacgcgacuucca

SEQ ID NO: 1519130 - RNA, 15 nt, Homo sapiens
aacuaaaauguucua

SEQ ID NO: 1519131 - RNA, 19 nt, Homo sapiens
aacuucauauaacugagau

SEQ ID NO: 1519132 - RNA, 14 nt, Homo sapiens
aagaaaaaauggca

SEQ ID NO: 1519133 - RNA, 23 nt, Homo sapiens
aagaaaugugauuugucuucccu

SEQ ID NO: 1519134 - RNA, 20 nt, Homo sapiens
aagaagaguuugcaaaugca

SEQ ID NO: 1519135 - RNA, 16 nt, Homo sapiens
aagacaccaaauucca

SEQ ID NO: 1519136 - RNA, 21 nt, Homo sapiens
aagagcacuaguugugaauuu

SEQ ID NO: 1519137 - RNA, 16 nt, Homo sapiens
aagaggcgacuuccuc

SEQ ID NO: 1519138 - RNA, 16 nt, Homo sapiens
aagauucuauguuaau

SEQ ID NO: 1519139 - RNA, 18 nt, Homo sapiens
aagcucaucucagcuccu

SEQ ID NO: 1519140 - RNA, 17 nt, Homo sapiens
aagcugccgguucuuaa

SEQ ID NO: 1519141 - RNA, 19 nt, Homo sapiens
aagggaguuggugugcuau

SEQ ID NO: 1519142 - RNA, 17 nt, Homo sapiens
aagggcaauaaaugccc

SEQ ID NO: 1519143 - RNA, 17 nt, Homo sapiens
aaguacuuuccaaucuc

SEQ ID NO: 1519144 - RNA, 16 nt, Homo sapiens
aagucaucaucuccaa

SEQ ID NO: 1519145 - RNA, 19 nt, Homo sapiens
aagucucugacucuugccu

SEQ ID NO: 1519146 - RNA, 19 nt, Homo sapiens
cugacuucucacuuccuaa

SEQ ID NO: 1519147 - RNA, 17 nt, Homo sapiens
cugagauugucuguuca

SEQ ID NO: 1519148 - RNA, 14 nt, Homo sapiens
cugauguccauuca

SEQ ID NO: 1519149 - RNA, 22 nt, Homo sapiens
cugauucugucaaugucuugaa

SEQ ID NO: 1519150 - RNA, 23 nt, Homo sapiens
cugcaacaugccagccacuguga

SEQ ID NO: 1519151 - RNA, 17 nt, Homo sapiens
cugcuaauaauuugcca

SEQ ID NO: 1519152 - RNA, 22 nt, Homo sapiens
cuggaggaagaagacacauucc

SEQ ID NO: 1519153 - RNA, 20 nt, Homo sapiens
cuggcuucacagauguguga

SEQ ID NO: 1519154 - RNA, 20 nt, Homo sapiens
cuguaacuuccaaauaaaua

SEQ ID NO: 1519155 - RNA, 20 nt, Homo sapiens
cuguacuucugugugcaauu

SEQ ID NO: 1519156 - RNA, 14 nt, Homo sapiens
cuguauuagucaca

SEQ ID NO: 1519157 - RNA, 16 nt, Homo sapiens
cugugucaaacaccuc

SEQ ID NO: 1519158 - RNA, 14 nt, Homo sapiens
cuguuuaauugaca

SEQ ID NO: 1519159 - RNA, 19 nt, Homo sapiens
cuguuuagaugaaugucag

SEQ ID NO: 1519160 - RNA, 19 nt, Homo sapiens
cuguuuuugucuacacucu

SEQ ID NO: 1519161 - RNA, 18 nt, Homo sapiens
cuuaaauuuuaaagccug

SEQ ID NO: 1519162 - RNA, 15 nt, Homo sapiens
cuuaauacucaugca

SEQ ID NO: 1519163 - RNA, 22 nt, Homo sapiens
cuuaugaacagauauuuuuaac

SEQ ID NO: 1519164 - RNA, 21 nt, Homo sapiens
cuuauuaagagcaaacuuuag

SEQ ID NO: 1519165 - RNA, 18 nt, Homo sapiens
cuucaaaugauccuuccu

SEQ ID NO: 1519166 - RNA, 17 nt, Homo sapiens
cuucacucaaucucuga

SEQ ID NO: 1519167 - RNA, 21 nt, Homo sapiens
cuuccacgauggugcagugua

SEQ ID NO: 1519168 - RNA, 19 nt, Homo sapiens
cuucccuucuuugcacuuu

SEQ ID NO: 1519169 - RNA, 23 nt, Homo sapiens
cuucguugcugcauuuucuucac

SEQ ID NO: 1519170 - RNA, 15 nt, Homo sapiens
cuucuuugcacuuuu

SEQ ID NO: 1519171 - RNA, 16 nt, Homo sapiens
cuugguacaagcuccu

SEQ ID NO: 1519172 - RNA, 20 nt, Homo sapiens
cacuggacugucuaugaacu

SEQ ID NO: 1519173 - RNA, 15 nt, Homo sapiens
cacuugccaauguac

SEQ ID NO: 1519174 - RNA, 18 nt, Homo sapiens
cacuugccaauguacaua

SEQ ID NO: 1519175 - RNA, 17 nt, Homo sapiens
cagaaaaacugugggua

SEQ ID NO: 1519176 - RNA, 16 nt, Homo sapiens
cagaaagcucaucuca

SEQ ID NO: 1519177 - RNA, 12 nt, Homo sapiens
cagaagaccucc

SEQ ID NO: 1519178 - RNA, 23 nt, Homo sapiens
cagaaggaaaaaaacaugaauuu

SEQ ID NO: 1519179 - RNA, 20 nt, Homo sapiens
cagacacuaacgaaauauca

SEQ ID NO: 1519180 - RNA, 11 nt, Homo sapiens
cagacauguau

SEQ ID NO: 1519181 - RNA, 21 nt, Homo sapiens
cagaccagguggaauuacuua

SEQ ID NO: 1519182 - RNA, 23 nt, Homo sapiens
cagacuaugucacccaaugcaua

SEQ ID NO: 1519183 - RNA, 17 nt, Homo sapiens
cagagacacuguugaua

SEQ ID NO: 1519184 - RNA, 19 nt, Homo sapiens
cagagauaauucuagcuuu

SEQ ID NO: 1519185 - RNA, 16 nt, Homo sapiens
cagauguggugauacu

SEQ ID NO: 1519186 - RNA, 15 nt, Homo sapiens
cagauuuaugaauuu

SEQ ID NO: 1519187 - RNA, 23 nt, Homo sapiens
cagcaaggccagaugcacauccc

SEQ ID NO: 1519188 - RNA, 14 nt, Homo sapiens
cagcagaagccaaa

SEQ ID NO: 1519189 - RNA, 18 nt, Homo sapiens
cagccucccaaaguucug

SEQ ID NO: 1519190 - RNA, 18 nt, Homo sapiens
cagccuccugaguagcug

SEQ ID NO: 1519191 - RNA, 15 nt, Homo sapiens
caggaaccucagggc

SEQ ID NO: 1519192 - RNA, 23 nt, Homo sapiens
caggaaccucagggcugugugua

SEQ ID NO: 1519193 - RNA, 14 nt, Homo sapiens
caggcaacgcacaa

SEQ ID NO: 1519194 - RNA, 15 nt, Homo sapiens
caggcaacgcacaaa

SEQ ID NO: 1519195 - RNA, 18 nt, Homo sapiens
cagguacaggcuggagau

SEQ ID NO: 1519196 - RNA, 22 nt, Homo sapiens
caguauuuuccaaacuaccuuc

SEQ ID NO: 1519197 - RNA, 21 nt, Homo sapiens
caguguaacgaugcacuuugg

SEQ ID NO: 1519198 - RNA, 21 nt, Homo sapiens
caguuuaauaaauagcaucua

SEQ ID NO: 1519199 - RNA, 14 nt, Homo sapiens
cauaaaauguuaag

SEQ ID NO: 1519200 - RNA, 15 nt, Homo sapiens
cauaagucuuuggua

SEQ ID NO: 1519201 - RNA, 18 nt, Homo sapiens
cauaagugcaugacauau

SEQ ID NO: 1519202 - RNA, 15 nt, Homo sapiens
cauaauuuaaaaaua

SEQ ID NO: 1519203 - RNA, 23 nt, Homo sapiens
cauaauuucuucacucaaucucu

SEQ ID NO: 1519204 - RNA, 19 nt, Homo sapiens
cauaugcagauacuuauua

SEQ ID NO: 1519205 - RNA, 15 nt, Homo sapiens
caucacuugccaaug

SEQ ID NO: 1519206 - RNA, 18 nt, Homo sapiens
caucacuugccaauguac

SEQ ID NO: 1519207 - RNA, 23 nt, Homo sapiens
caucaggacuuucccugacagcu

SEQ ID NO: 1519208 - RNA, 15 nt, Homo sapiens
caucccacccucuca

SEQ ID NO: 1519209 - RNA, 24 nt, Homo sapiens
cauccuuggaaauuggaagagcac

SEQ ID NO: 1519210 - RNA, 19 nt, Homo sapiens
caucuccaaacuaaacccu

SEQ ID NO: 1519211 - RNA, 21 nt, Homo sapiens
caugaaauaaaauauaucuua

SEQ ID NO: 1519212 - RNA, 20 nt, Homo sapiens
cauuaaaaaugaaagccaaa

SEQ ID NO: 1519213 - RNA, 15 nt, Homo sapiens
cauuacauugccauu

SEQ ID NO: 1519214 - RNA, 16 nt, Homo sapiens
cauuaccuugugcuaa

SEQ ID NO: 1519215 - RNA, 12 nt, Homo sapiens
cauuaucuauga

SEQ ID NO: 1519216 - RNA, 13 nt, Homo sapiens
cauuaucuaugau

SEQ ID NO: 1519217 - RNA, 15 nt, Homo sapiens
cauucuuuugcacac

SEQ ID NO: 1519218 - RNA, 22 nt, Homo sapiens
cauugaagaauguuagaguaau

SEQ ID NO: 1519219 - RNA, 19 nt, Homo sapiens
cauuggagacaucacuugc

SEQ ID NO: 1519220 - RNA, 16 nt, Homo sapiens
cauuucucauguugaa

SEQ ID NO: 1519221 - RNA, 23 nt, Homo sapiens
ccaaacuaaacccucacaaguaa

SEQ ID NO: 1519222 - RNA, 13 nt, Homo sapiens
ccaaauccauccu

SEQ ID NO: 1519223 - RNA, 20 nt, Homo sapiens
ccaaguacuuuccaaucuca

SEQ ID NO: 1519224 - RNA, 19 nt, Homo sapiens
ccaaugagaucauugugaa

SEQ ID NO: 1519225 - RNA, 18 nt, Homo sapiens
ccacuucuuaaugcuuuc

SEQ ID NO: 1519226 - RNA, 14 nt, Homo sapiens
ccagccaacauggc

SEQ ID NO: 1519227 - RNA, 14 nt, Homo sapiens
ccagccacugugau

SEQ ID NO: 1519228 - RNA, 15 nt, Homo sapiens
ccaggcaugcaaugc

SEQ ID NO: 1519229 - RNA, 18 nt, Homo sapiens
ccaggcuggagugcagug

SEQ ID NO: 1519230 - RNA, 20 nt, Homo sapiens
ccaguguguuucugaucuga

SEQ ID NO: 1519231 - RNA, 13 nt, Homo sapiens
ccaucaggacuuu

SEQ ID NO: 1519232 - RNA, 21 nt, Homo sapiens
ccauuaucuguauuaaugcuu

SEQ ID NO: 1519233 - RNA, 20 nt, Homo sapiens
ccauucaucccacccucuca

SEQ ID NO: 1519234 - RNA, 16 nt, Homo sapiens
ccauucuccugccuca

SEQ ID NO: 1519235 - RNA, 16 nt, Homo sapiens
ccauuuguuugugcuu

SEQ ID NO: 1519236 - RNA, 18 nt, Homo sapiens
ccauuuuuaauucauucu

SEQ ID NO: 1519237 - RNA, 15 nt, Homo sapiens
cccagaaacaacaca

SEQ ID NO: 1519238 - RNA, 14 nt, Homo sapiens
cccaguguguuucu

SEQ ID NO: 1519239 - RNA, 17 nt, Homo sapiens
ccccaaguuaguucaau

SEQ ID NO: 1519240 - RNA, 13 nt, Homo sapiens
cccugacagcugu

SEQ ID NO: 1519241 - RNA, 15 nt, Homo sapiens
cccuuggacauuuua

SEQ ID NO: 1519242 - RNA, 16 nt, Homo sapiens
cccuugguacaagcuc

SEQ ID NO: 1519243 - RNA, 22 nt, Homo sapiens
ccucuguauuuuuuaaaacauc

SEQ ID NO: 1519244 - RNA, 20 nt, Homo sapiens
ccucuuuuucuagucuucau

SEQ ID NO: 1519245 - RNA, 17 nt, Homo sapiens
ccuguagagucacugac

SEQ ID NO: 1519246 - RNA, 12 nt, Homo sapiens
ccuuuacauauu

SEQ ID NO: 1519247 - RNA, 12 nt, Homo sapiens
cgaugcacuuug

SEQ ID NO: 1519248 - RNA, 14 nt, Homo sapiens
cgaugcacuuugga

SEQ ID NO: 1519249 - RNA, 13 nt, Homo sapiens
cgcccuccacaaa

SEQ ID NO: 1519250 - RNA, 16 nt, Homo sapiens
cguacacuguacuucu

SEQ ID NO: 1519251 - RNA, 20 nt, Homo sapiens
cguaugagauccuuuagucc

SEQ ID NO: 1519252 - RNA, 12 nt, Homo sapiens
cguuuaaucaca

SEQ ID NO: 1519253 - RNA, 15 nt, Homo sapiens
cuaaagaagguuuca

SEQ ID NO: 1519254 - RNA, 17 nt, Homo sapiens
cuaagagaugugacuac

SEQ ID NO: 1519255 - RNA, 15 nt, Homo sapiens
cuaauaauuugccau

SEQ ID NO: 1519256 - RNA, 17 nt, Homo sapiens
cuacagccugccccuga

SEQ ID NO: 1519257 - RNA, 22 nt, Homo sapiens
cuaccauucaaaauugcuucuu

SEQ ID NO: 1519258 - RNA, 14 nt, Homo sapiens
cuaccugacugcca

SEQ ID NO: 1519259 - RNA, 15 nt, Homo sapiens
cuaccugacugccac

SEQ ID NO: 1519260 - RNA, 15 nt, Homo sapiens
cuacuccaauucaua

SEQ ID NO: 1519261 - RNA, 19 nt, Homo sapiens
cuaggacucugcacugaau

SEQ ID NO: 1519262 - RNA, 13 nt, Homo sapiens
cuaucgugucaac

SEQ ID NO: 1519263 - RNA, 13 nt, Homo sapiens
cuaugaaauauca

SEQ ID NO: 1519264 - RNA, 20 nt, Homo sapiens
cuaugaaauaucaugcucca

SEQ ID NO: 1519265 - RNA, 21 nt, Homo sapiens
cuaugaaauaucaugcuccau

SEQ ID NO: 1519266 - RNA, 15 nt, Homo sapiens
cuaugauaugcuaau

SEQ ID NO: 1519267 - RNA, 13 nt, Homo sapiens
cuaugugcaugca

SEQ ID NO: 1519268 - RNA, 21 nt, Homo sapiens
cuaugugcaugcagcaucuaa

SEQ ID NO: 1519269 - RNA, 23 nt, Homo sapiens
cuauuaagucaucaucuccaaac

SEQ ID NO: 1519270 - RNA, 13 nt, Homo sapiens
cuauuauauucau

SEQ ID NO: 1519271 - RNA, 14 nt, Homo sapiens
cuauuauauucauu

SEQ ID NO: 1519272 - RNA, 15 nt, Homo sapiens
cuauuauauucauuc

SEQ ID NO: 1519273 - RNA, 16 nt, Homo sapiens
cucaacucacugcaag

SEQ ID NO: 1519274 - RNA, 20 nt, Homo sapiens
cucagccucccaaaguucug

SEQ ID NO: 1519275 - RNA, 22 nt, Homo sapiens
cucaggcaaagaaaaugaaaug

SEQ ID NO: 1519276 - RNA, 23 nt, Homo sapiens
cucaggcaaagaaaaugaaaugc

SEQ ID NO: 1519277 - RNA, 13 nt, Homo sapiens
cucauacacagaa

SEQ ID NO: 1519278 - RNA, 15 nt, Homo sapiens
cucauauaagacaaa

SEQ ID NO: 1519279 - RNA, 18 nt, Homo sapiens
cuccaaagagaaaccuau

SEQ ID NO: 1519280 - RNA, 14 nt, Homo sapiens
cuccaauuccacag

SEQ ID NO: 1519281 - RNA, 20 nt, Homo sapiens
cuccacaaaugggaaaacca

SEQ ID NO: 1519282 - RNA, 23 nt, Homo sapiens
cucccuaccugacugccacagaa

SEQ ID NO: 1519283 - RNA, 22 nt, Homo sapiens
cuccugaguagcugggacuaca

SEQ ID NO: 1519284 - RNA, 16 nt, Homo sapiens
cuccugucuacaguuu

SEQ ID NO: 1519285 - RNA, 14 nt, Homo sapiens
cucgaccaccucaa

SEQ ID NO: 1519286 - RNA, 13 nt, Homo sapiens
cucuaaagagcau

SEQ ID NO: 1519287 - RNA, 23 nt, Homo sapiens
cucugacgaguacucuugaacac

SEQ ID NO: 1519288 - RNA, 22 nt, Homo sapiens
cucuuaggcuaagagaugugac

SEQ ID NO: 1519289 - RNA, 15 nt, Homo sapiens
cucuuuuucuagucu

SEQ ID NO: 1519290 - RNA, 19 nt, Homo sapiens
cugaaggcugaaagacagg

SEQ ID NO: 1519291 - RNA, 12 nt, Homo sapiens
cugacucuugcc

SEQ ID NO: 1519292 - RNA, 13 nt, Homo sapiens
cugacuucucacu

SEQ ID NO: 1519293 - RNA, 20 nt, Homo sapiens
agugcaguggcacgaucuca

SEQ ID NO: 1519294 - RNA, 22 nt, Homo sapiens
aguguaacgaugcacuuuggaa

SEQ ID NO: 1519295 - RNA, 17 nt, Homo sapiens
aguuaacacagaucaag

SEQ ID NO: 1519296 - RNA, 20 nt, Homo sapiens
aguuauuaccuuuacauauu

SEQ ID NO: 1519297 - RNA, 17 nt, Homo sapiens
aguugauggugaugaaa

SEQ ID NO: 1519298 - RNA, 21 nt, Homo sapiens
aguugcccaccaaaacacaga

SEQ ID NO: 1519299 - RNA, 17 nt, Homo sapiens
aguuguuuuuauucuuc

SEQ ID NO: 1519300 - RNA, 23 nt, Homo sapiens
aguuugaguuacuaucaugucaa

SEQ ID NO: 1519301 - RNA, 21 nt, Homo sapiens
auaaaauuaaagcugaaaacu

SEQ ID NO: 1519302 - RNA, 16 nt, Homo sapiens
auaaaccaaaggaaaa

SEQ ID NO: 1519303 - RNA, 22 nt, Homo sapiens
auaaauggaaugaaauaauuca

SEQ ID NO: 1519304 - RNA, 15 nt, Homo sapiens
auaaccauauucaca

SEQ ID NO: 1519305 - RNA, 23 nt, Homo sapiens
auacucaugcauucuuuugcaca

SEQ ID NO: 1519306 - RNA, 18 nt, Homo sapiens
auacuuauuaagagcaaa

SEQ ID NO: 1519307 - RNA, 17 nt, Homo sapiens
auagauuguaauacaca

SEQ ID NO: 1519308 - RNA, 11 nt, Homo sapiens
auaguauuuau

SEQ ID NO: 1519309 - RNA, 17 nt, Homo sapiens
auaguggggucagggcu

SEQ ID NO: 1519310 - RNA, 19 nt, Homo sapiens
auauaaaaauaaagcacuu

SEQ ID NO: 1519311 - RNA, 17 nt, Homo sapiens
auauauuuauaaggaaa

SEQ ID NO: 1519312 - RNA, 14 nt, Homo sapiens
auauauuugauaca

SEQ ID NO: 1519313 - RNA, 14 nt, Homo sapiens
auaucaugcuccau

SEQ ID NO: 1519314 - RNA, 17 nt, Homo sapiens
auauccaacaugugcuc

SEQ ID NO: 1519315 - RNA, 22 nt, Homo sapiens
auauccaacaugugcucaggga

SEQ ID NO: 1519316 - RNA, 15 nt, Homo sapiens
auaugcagauacuua

SEQ ID NO: 1519317 - RNA, 16 nt, Homo sapiens
auauuaucaugucuau

SEQ ID NO: 1519318 - RNA, 16 nt, Homo sapiens
auauuugauacauaua

SEQ ID NO: 1519319 - RNA, 22 nt, Homo sapiens
auauuuguaugauccuaaugaa

SEQ ID NO: 1519320 - RNA, 19 nt, Homo sapiens
auauuuucccucucuugcc

SEQ ID NO: 1519321 - RNA, 18 nt, Homo sapiens
auauuuuguuuugugcag

SEQ ID NO: 1519322 - RNA, 15 nt, Homo sapiens
aucaauugauauuaa

SEQ ID NO: 1519323 - RNA, 19 nt, Homo sapiens
aucacauucgaguguuuca

SEQ ID NO: 1519324 - RNA, 20 nt, Homo sapiens
auccaacaugugcucaggga

SEQ ID NO: 1519325 - RNA, 15 nt, Homo sapiens
aucccaaauucacuu

SEQ ID NO: 1519326 - RNA, 20 nt, Homo sapiens
aucccaaauucacuuuauua

SEQ ID NO: 1519327 - RNA, 14 nt, Homo sapiens
auccccagccagaa

SEQ ID NO: 1519328 - RNA, 15 nt, Homo sapiens
aucccuggaaggaca

SEQ ID NO: 1519329 - RNA, 16 nt, Homo sapiens
auccuuccuacuuugc

SEQ ID NO: 1519330 - RNA, 22 nt, Homo sapiens
aucgcugucaucucagcuggau

SEQ ID NO: 1519331 - RNA, 15 nt, Homo sapiens
aucuccauucucuca

SEQ ID NO: 1519332 - RNA, 15 nt, Homo sapiens
aucucuaaagagcau

SEQ ID NO: 1519333 - RNA, 15 nt, Homo sapiens
aucugcugucuuuau

SEQ ID NO: 1519334 - RNA, 18 nt, Homo sapiens
aucugcuuguauuuucca

SEQ ID NO: 1519335 - RNA, 20 nt, Homo sapiens
aucuuagcuuuccacaggag

SEQ ID NO: 1519336 - RNA, 16 nt, Homo sapiens
augaaaaguuuagugu

SEQ ID NO: 1519337 - RNA, 13 nt, Homo sapiens
augaaauaauuca

SEQ ID NO: 1519338 - RNA, 14 nt, Homo sapiens
augaaauaauucaa

SEQ ID NO: 1519339 - RNA, 16 nt, Homo sapiens
augaaauguaaauacu

SEQ ID NO: 1519340 - RNA, 16 nt, Homo sapiens
augacauuuuugauaa

SEQ ID NO: 1519341 - RNA, 19 nt, Homo sapiens
augaccuuuuucacugugg

SEQ ID NO: 1519342 - RNA, 19 nt, Homo sapiens
augauaaaaagaaauguga

SEQ ID NO: 1519343 - RNA, 18 nt, Homo sapiens
augauccuaaugaaugca

SEQ ID NO: 1519344 - RNA, 19 nt, Homo sapiens
augaugucguuugaaucac

SEQ ID NO: 1519345 - RNA, 16 nt, Homo sapiens
augauuucacagugug

SEQ ID NO: 1519346 - RNA, 16 nt, Homo sapiens
augcguuuaaucacau

SEQ ID NO: 1519347 - RNA, 21 nt, Homo sapiens
auggaggaucucuaaagagca

SEQ ID NO: 1519348 - RNA, 19 nt, Homo sapiens
augggaaaacuucacucca

SEQ ID NO: 1519349 - RNA, 20 nt, Homo sapiens
augggaaaacuucacuccaa

SEQ ID NO: 1519350 - RNA, 18 nt, Homo sapiens
augguccgccugccucag

SEQ ID NO: 1519351 - RNA, 23 nt, Homo sapiens
augguccgccugccucagccucc

SEQ ID NO: 1519352 - RNA, 14 nt, Homo sapiens
auggugaugaaaug

SEQ ID NO: 1519353 - RNA, 17 nt, Homo sapiens
augguggugagcacauc

SEQ ID NO: 1519354 - RNA, 21 nt, Homo sapiens
augucuauuuuugaugacuca

SEQ ID NO: 1519355 - RNA, 14 nt, Homo sapiens
auguggugauacug

SEQ ID NO: 1519356 - RNA, 17 nt, Homo sapiens
auguuccgagaagaaca

SEQ ID NO: 1519357 - RNA, 14 nt, Homo sapiens
auguugcccagugu

SEQ ID NO: 1519358 - RNA, 17 nt, Homo sapiens
auguuuaaaaacauucc

SEQ ID NO: 1519359 - RNA, 19 nt, Homo sapiens
auuaagucaucaucuccaa

SEQ ID NO: 1519360 - RNA, 21 nt, Homo sapiens
auuaaugcuugaauauuacug

SEQ ID NO: 1519361 - RNA, 20 nt, Homo sapiens
auuaauuagauuuucuugca

SEQ ID NO: 1519362 - RNA, 14 nt, Homo sapiens
auuacuguuuaauu

SEQ ID NO: 1519363 - RNA, 16 nt, Homo sapiens
auuagauguuuuacaa

SEQ ID NO: 1519364 - RNA, 19 nt, Homo sapiens
auuagccuaugugcaugca

SEQ ID NO: 1519365 - RNA, 17 nt, Homo sapiens
auuauuuuagucuguca

SEQ ID NO: 1519366 - RNA, 17 nt, Homo sapiens
auucagugguccaggau

SEQ ID NO: 1519367 - RNA, 18 nt, Homo sapiens
auuccuuuuucuaugaaa

SEQ ID NO: 1519368 - RNA, 19 nt, Homo sapiens
auugaagaugugaucaaua

SEQ ID NO: 1519369 - RNA, 20 nt, Homo sapiens
auugccauuuuuaauucauu

SEQ ID NO: 1519370 - RNA, 14 nt, Homo sapiens
auuggaagagcaca

SEQ ID NO: 1519371 - RNA, 19 nt, Homo sapiens
auuguaauacacauaucua

SEQ ID NO: 1519372 - RNA, 20 nt, Homo sapiens
auugucuuccuguaagaccu

SEQ ID NO: 1519373 - RNA, 16 nt, Homo sapiens
auuuaauuuuugcaau

SEQ ID NO: 1519374 - RNA, 13 nt, Homo sapiens
auuuacacauaca

SEQ ID NO: 1519375 - RNA, 14 nt, Homo sapiens
auuuauuuauucau

SEQ ID NO: 1519376 - RNA, 14 nt, Homo sapiens
auuuguuugugcuu

SEQ ID NO: 1519377 - RNA, 16 nt, Homo sapiens
auuuuacaagggcaua

SEQ ID NO: 1519378 - RNA, 20 nt, Homo sapiens
auuuuccaauaaaauuuuca

SEQ ID NO: 1519379 - RNA, 14 nt, Homo sapiens
auuuucuucacuug

SEQ ID NO: 1519380 - RNA, 16 nt, Homo sapiens
auuuucuucacuugca

SEQ ID NO: 1519381 - RNA, 17 nt, Homo sapiens
auuuugcacugaggaua

SEQ ID NO: 1519382 - RNA, 17 nt, Homo sapiens
auuuuguuggaguauua

SEQ ID NO: 1519383 - RNA, 17 nt, Homo sapiens
caaaauaaaaucucggu

SEQ ID NO: 1519384 - RNA, 13 nt, Homo sapiens
caaacuaaacccu

SEQ ID NO: 1519385 - RNA, 14 nt, Homo sapiens
caaacuaccuucca

SEQ ID NO: 1519386 - RNA, 16 nt, Homo sapiens
caaagacaaaggugag

SEQ ID NO: 1519387 - RNA, 13 nt, Homo sapiens
caaagacuuuccu

SEQ ID NO: 1519388 - RNA, 14 nt, Homo sapiens
caaagcauuugcaa

SEQ ID NO: 1519389 - RNA, 18 nt, Homo sapiens
caacaugccagccacugu

SEQ ID NO: 1519390 - RNA, 18 nt, Homo sapiens
caacaugugcucagggaa

SEQ ID NO: 1519391 - RNA, 20 nt, Homo sapiens
caacuugggaacuagacucc

SEQ ID NO: 1519392 - RNA, 16 nt, Homo sapiens
caacuuugagaacaaa

SEQ ID NO: 1519393 - RNA, 18 nt, Homo sapiens
caagaccucugugcacuu

SEQ ID NO: 1519394 - RNA, 14 nt, Homo sapiens
caagauuuauggaa

SEQ ID NO: 1519395 - RNA, 21 nt, Homo sapiens
caagggccagcuggaggugaa

SEQ ID NO: 1519396 - RNA, 19 nt, Homo sapiens
caagguagaaaugucuaug

SEQ ID NO: 1519397 - RNA, 23 nt, Homo sapiens
caaguacuuuccaaucucaguca

SEQ ID NO: 1519398 - RNA, 17 nt, Homo sapiens
caagugacaaaguuaua

SEQ ID NO: 1519399 - RNA, 20 nt, Homo sapiens
caaguuggcuucuaaucaaa

SEQ ID NO: 1519400 - RNA, 18 nt, Homo sapiens
caaucucugauucuguca

SEQ ID NO: 1519401 - RNA, 18 nt, Homo sapiens
caaucuuauuacugagag

SEQ ID NO: 1519402 - RNA, 17 nt, Homo sapiens
caaugagaucauuguga

SEQ ID NO: 1519403 - RNA, 16 nt, Homo sapiens
cacaacucuuuguuca

SEQ ID NO: 1519404 - RNA, 18 nt, Homo sapiens
cacaacucuuuguucaaa

SEQ ID NO: 1519405 - RNA, 18 nt, Homo sapiens
cacaauuuauauuuuccc

SEQ ID NO: 1519406 - RNA, 18 nt, Homo sapiens
cacaccuguuauugccaa

SEQ ID NO: 1519407 - RNA, 17 nt, Homo sapiens
cacagucucugggagac

SEQ ID NO: 1519408 - RNA, 21 nt, Homo sapiens
cacauagguuagauucucauu

SEQ ID NO: 1519409 - RNA, 12 nt, Homo sapiens
cacaucugggag

SEQ ID NO: 1519410 - RNA, 18 nt, Homo sapiens
cacauguaacauagauuu

SEQ ID NO: 1519411 - RNA, 17 nt, Homo sapiens
cacauucgaguguuuca

SEQ ID NO: 1519412 - RNA, 13 nt, Homo sapiens
cacccaugcaccu

SEQ ID NO: 1519413 - RNA, 22 nt, Homo sapiens
cacgaucucaacucacugcaag

SEQ ID NO: 1519414 - RNA, 21 nt, Homo sapiens
aagugaacauuacauugccau

SEQ ID NO: 1519415 - RNA, 11 nt, Homo sapiens
aaguucaguga

SEQ ID NO: 1519416 - RNA, 22 nt, Homo sapiens
aaguugcccaccaaaacacaga

SEQ ID NO: 1519417 - RNA, 14 nt, Homo sapiens
aauaaauagcaucu

SEQ ID NO: 1519418 - RNA, 14 nt, Homo sapiens
aauacacauaucua

SEQ ID NO: 1519419 - RNA, 14 nt, Homo sapiens
aauagcaucuagua

SEQ ID NO: 1519420 - RNA, 22 nt, Homo sapiens
aauauuacuggauaaauuguau

SEQ ID NO: 1519421 - RNA, 18 nt, Homo sapiens
aaucaaguuggcuucuaa

SEQ ID NO: 1519422 - RNA, 14 nt, Homo sapiens
aaucaaucuuauua

SEQ ID NO: 1519423 - RNA, 20 nt, Homo sapiens
aaucacacgucuggcuucac

SEQ ID NO: 1519424 - RNA, 17 nt, Homo sapiens
aauccauccugcucuuc

SEQ ID NO: 1519425 - RNA, 15 nt, Homo sapiens
aauccugaagagcau

SEQ ID NO: 1519426 - RNA, 14 nt, Homo sapiens
aaugaaagccaaau

SEQ ID NO: 1519427 - RNA, 17 nt, Homo sapiens
aaugauuucacagugug

SEQ ID NO: 1519428 - RNA, 19 nt, Homo sapiens
aauggaaugaaauaauuca

SEQ ID NO: 1519429 - RNA, 19 nt, Homo sapiens
aauggcaagagaucauauc

SEQ ID NO: 1519430 - RNA, 22 nt, Homo sapiens
aauggcaagagaucauauccuc

SEQ ID NO: 1519431 - RNA, 15 nt, Homo sapiens
aaugggaaaaccaga

SEQ ID NO: 1519432 - RNA, 14 nt, Homo sapiens
aauguaugugcaca

SEQ ID NO: 1519433 - RNA, 17 nt, Homo sapiens
aaugugauuugucuucc

SEQ ID NO: 1519434 - RNA, 19 nt, Homo sapiens
aaugugauuugucuucccu

SEQ ID NO: 1519435 - RNA, 21 nt, Homo sapiens
aauguucuccagucauuaugu

SEQ ID NO: 1519436 - RNA, 16 nt, Homo sapiens
aauguuuuuaagauuu

SEQ ID NO: 1519437 - RNA, 16 nt, Homo sapiens
aauuauugauguuuuc

SEQ ID NO: 1519438 - RNA, 17 nt, Homo sapiens
aauucaguuauuugcac

SEQ ID NO: 1519439 - RNA, 20 nt, Homo sapiens
aauucuagcuuugagcuuaa

SEQ ID NO: 1519440 - RNA, 15 nt, Homo sapiens
aauugcuucuucuuc

SEQ ID NO: 1519441 - RNA, 14 nt, Homo sapiens
aauuuauauuuucc

SEQ ID NO: 1519442 - RNA, 18 nt, Homo sapiens
acaaaugggaaaaccaga

SEQ ID NO: 1519443 - RNA, 16 nt, Homo sapiens
acaaguuuacaugaua

SEQ ID NO: 1519444 - RNA, 15 nt, Homo sapiens
acaaucuguauauaa

SEQ ID NO: 1519445 - RNA, 17 nt, Homo sapiens
acaccuguuauugccaa

SEQ ID NO: 1519446 - RNA, 21 nt, Homo sapiens
acagaaggaaaaaaacaugaa

SEQ ID NO: 1519447 - RNA, 20 nt, Homo sapiens
acagagauaauucuagcuuu

SEQ ID NO: 1519448 - RNA, 18 nt, Homo sapiens
acagagcagaacuuucac

SEQ ID NO: 1519449 - RNA, 12 nt, Homo sapiens
acagcuguguac

SEQ ID NO: 1519450 - RNA, 17 nt, Homo sapiens
acaguauacgcuccauc

SEQ ID NO: 1519451 - RNA, 22 nt, Homo sapiens
acagucucugggagacuuuccc

SEQ ID NO: 1519452 - RNA, 16 nt, Homo sapiens
acagugccuauugaua

SEQ ID NO: 1519453 - RNA, 15 nt, Homo sapiens
acauacaacuucaua

SEQ ID NO: 1519454 - RNA, 22 nt, Homo sapiens
acauagguuagauucucauuca

SEQ ID NO: 1519455 - RNA, 16 nt, Homo sapiens
acauccccagccagaa

SEQ ID NO: 1519456 - RNA, 22 nt, Homo sapiens
acauuggagacaucacuugcca

SEQ ID NO: 1519457 - RNA, 21 nt, Homo sapiens
acauuucuuaaaauguuucau

SEQ ID NO: 1519458 - RNA, 19 nt, Homo sapiens
acccagaaacaacacaauc

SEQ ID NO: 1519459 - RNA, 15 nt, Homo sapiens
acccaggcaugcaau

SEQ ID NO: 1519460 - RNA, 14 nt, Homo sapiens
acccucauacacag

SEQ ID NO: 1519461 - RNA, 15 nt, Homo sapiens
accugaaaaugugga

SEQ ID NO: 1519462 - RNA, 23 nt, Homo sapiens
accugaacugggcagacugcaaa

SEQ ID NO: 1519463 - RNA, 13 nt, Homo sapiens
accugaagacacc

SEQ ID NO: 1519464 - RNA, 15 nt, Homo sapiens
accugaccugauguc

SEQ ID NO: 1519465 - RNA, 22 nt, Homo sapiens
accuggauuuuuuauguacaac

SEQ ID NO: 1519466 - RNA, 14 nt, Homo sapiens
acuaaagagcacua

SEQ ID NO: 1519467 - RNA, 17 nt, Homo sapiens
acuaaagagcacuaguu

SEQ ID NO: 1519468 - RNA, 20 nt, Homo sapiens
acuaacgaaauaucaaaguc

SEQ ID NO: 1519469 - RNA, 16 nt, Homo sapiens
acuaauacagacuaug

SEQ ID NO: 1519470 - RNA, 19 nt, Homo sapiens
acuacagccugccccugac

SEQ ID NO: 1519471 - RNA, 19 nt, Homo sapiens
acuacaggcgccugccaca

SEQ ID NO: 1519472 - RNA, 17 nt, Homo sapiens
acuagaagaaagggcaa

SEQ ID NO: 1519473 - RNA, 22 nt, Homo sapiens
acuaggguaaucugacuucuca

SEQ ID NO: 1519474 - RNA, 17 nt, Homo sapiens
acucaucaauuuugucu

SEQ ID NO: 1519475 - RNA, 16 nt, Homo sapiens
acucuaggacucugca

SEQ ID NO: 1519476 - RNA, 22 nt, Homo sapiens
acucuccagaaagcucaucuca

SEQ ID NO: 1519477 - RNA, 16 nt, Homo sapiens
acucuugccuuuccac

SEQ ID NO: 1519478 - RNA, 13 nt, Homo sapiens
acugacccuggag

SEQ ID NO: 1519479 - RNA, 18 nt, Homo sapiens
acugcaaaauaaaaucuc

SEQ ID NO: 1519480 - RNA, 17 nt, Homo sapiens
acuggacugucuaugaa

SEQ ID NO: 1519481 - RNA, 13 nt, Homo sapiens
acugggcuucuag

SEQ ID NO: 1519482 - RNA, 20 nt, Homo sapiens
acuguuuaauugacauacuc

SEQ ID NO: 1519483 - RNA, 20 nt, Homo sapiens
acuguuuagaugaaugucag

SEQ ID NO: 1519484 - RNA, 12 nt, Homo sapiens
acuuaauggcac

SEQ ID NO: 1519485 - RNA, 15 nt, Homo sapiens
acuuauauauuugau

SEQ ID NO: 1519486 - RNA, 13 nt, Homo sapiens
acuucaaggguuu

SEQ ID NO: 1519487 - RNA, 13 nt, Homo sapiens
acuucacuccaaa

SEQ ID NO: 1519488 - RNA, 14 nt, Homo sapiens
acuuggcucucaau

SEQ ID NO: 1519489 - RNA, 22 nt, Homo sapiens
acuuucccugacagcuguguac

SEQ ID NO: 1519490 - RNA, 21 nt, Homo sapiens
agaaaugugauuugucuuccc

SEQ ID NO: 1519491 - RNA, 18 nt, Homo sapiens
agaauauaaaaauaaagc

SEQ ID NO: 1519492 - RNA, 13 nt, Homo sapiens
agaauguuuucaa

SEQ ID NO: 1519493 - RNA, 13 nt, Homo sapiens
agacaucacuugc

SEQ ID NO: 1519494 - RNA, 19 nt, Homo sapiens
agaccagguggaauuacuu

SEQ ID NO: 1519495 - RNA, 20 nt, Homo sapiens
agaccagguggaauuacuua

SEQ ID NO: 1519496 - RNA, 15 nt, Homo sapiens
agacuacagccagaa

SEQ ID NO: 1519497 - RNA, 12 nt, Homo sapiens
agacuuugacuc

SEQ ID NO: 1519498 - RNA, 17 nt, Homo sapiens
agagaccugaacugggc

SEQ ID NO: 1519499 - RNA, 19 nt, Homo sapiens
agagacuuugacucuccag

SEQ ID NO: 1519500 - RNA, 15 nt, Homo sapiens
agaggagaaggaggg

SEQ ID NO: 1519501 - RNA, 14 nt, Homo sapiens
agagucacugaccc

SEQ ID NO: 1519502 - RNA, 14 nt, Homo sapiens
agaucauauccuca

SEQ ID NO: 1519503 - RNA, 20 nt, Homo sapiens
agaugcauuaucuaugauau

SEQ ID NO: 1519504 - RNA, 16 nt, Homo sapiens
agauuauuaagggaau

SEQ ID NO: 1519505 - RNA, 20 nt, Homo sapiens
agauuuauguaaugcuuuau

SEQ ID NO: 1519506 - RNA, 13 nt, Homo sapiens
agauuuucuugca

SEQ ID NO: 1519507 - RNA, 19 nt, Homo sapiens
agcagggaauugauccacu

SEQ ID NO: 1519508 - RNA, 19 nt, Homo sapiens
agccauuuuuuaaaugaca

SEQ ID NO: 1519509 - RNA, 16 nt, Homo sapiens
agcccaugcuuuccca

SEQ ID NO: 1519510 - RNA, 16 nt, Homo sapiens
agccugaaaauuccaa

SEQ ID NO: 1519511 - RNA, 17 nt, Homo sapiens
agccugaaaauuccaau

SEQ ID NO: 1519512 - RNA, 16 nt, Homo sapiens
agcuaucuauaccuua

SEQ ID NO: 1519513 - RNA, 12 nt, Homo sapiens
agcucaucucag

SEQ ID NO: 1519514 - RNA, 22 nt, Homo sapiens
agcuggguuggaaaacaguauu

SEQ ID NO: 1519515 - RNA, 16 nt, Homo sapiens
agcuugaaaacucacu

SEQ ID NO: 1519516 - RNA, 16 nt, Homo sapiens
aggaaauacauaugca

SEQ ID NO: 1519517 - RNA, 15 nt, Homo sapiens
aggccagaagaccuc

SEQ ID NO: 1519518 - RNA, 16 nt, Homo sapiens
aggccagaagaccucc

SEQ ID NO: 1519519 - RNA, 16 nt, Homo sapiens
aggcuaagagauguga

SEQ ID NO: 1519520 - RNA, 19 nt, Homo sapiens
aggcuggagauuuucacau

SEQ ID NO: 1519521 - RNA, 17 nt, Homo sapiens
agggaauaauccagaaa

SEQ ID NO: 1519522 - RNA, 23 nt, Homo sapiens
aggggcuguugaauuucccacau

SEQ ID NO: 1519523 - RNA, 21 nt, Homo sapiens
aggguucaccaggucagggag

SEQ ID NO: 1519524 - RNA, 15 nt, Homo sapiens
aggucaggaguucga

SEQ ID NO: 1519525 - RNA, 20 nt, Homo sapiens
aggugguauguuugggagac

SEQ ID NO: 1519526 - RNA, 14 nt, Homo sapiens
agguuagauucuca

SEQ ID NO: 1519527 - RNA, 17 nt, Homo sapiens
agguuagauucucauuc

SEQ ID NO: 1519528 - RNA, 21 nt, Homo sapiens
agucagacuccuagacucacu

SEQ ID NO: 1519529 - RNA, 15 nt, Homo sapiens
agucaucaucuccaa

SEQ ID NO: 1519530 - RNA, 17 nt, Homo sapiens
aguccuuuaaauuuugc

SEQ ID NO: 1519531 - RNA, 22 nt, Homo sapiens
agucuucauaauuucuucacuc

SEQ ID NO: 1519532 - RNA, 14 nt, Homo sapiens
agucuucuauuuau

SEQ ID NO: 1519533 - RNA, 20 nt, Homo sapiens
agugaacauuacauugccau

SEQ ID NO: 1519534 - RNA, 18 nt, Homo sapiens
agugcaaaguuauucccc

SEQ ID NO: 1519535 - RNA, 18 nt, Homo sapiens
aaaaacucaggcaaagaa

SEQ ID NO: 1519536 - RNA, 13 nt, Homo sapiens
aaaauacucugac

SEQ ID NO: 1519537 - RNA, 21 nt, Homo sapiens
aaaaucccaaauucacuuuau

SEQ ID NO: 1519538 - RNA, 14 nt, Homo sapiens
aaaauugcuauaaa

SEQ ID NO: 1519539 - RNA, 13 nt, Homo sapiens
aaacagaaauugc

SEQ ID NO: 1519540 - RNA, 13 nt, Homo sapiens
aaacuucacucca

SEQ ID NO: 1519541 - RNA, 17 nt, Homo sapiens
aaacuucacuccaaaga

SEQ ID NO: 1519542 - RNA, 23 nt, Homo sapiens
aaacuugcaacuuugagaacaaa

SEQ ID NO: 1519543 - RNA, 15 nt, Homo sapiens
aaacuuggcucucaa

SEQ ID NO: 1519544 - RNA, 19 nt, Homo sapiens
aaacuuggcucucaauaaa

SEQ ID NO: 1519545 - RNA, 19 nt, Homo sapiens
aaagaaauaaaccaaagga

SEQ ID NO: 1519546 - RNA, 13 nt, Homo sapiens
aaagaagguuuca

SEQ ID NO: 1519547 - RNA, 19 nt, Homo sapiens
aaagacuuuccucuuaguc

SEQ ID NO: 1519548 - RNA, 22 nt, Homo sapiens
aaagaugcauuaucuaugauau

SEQ ID NO: 1519549 - RNA, 17 nt, Homo sapiens
aaaguaaauacaugcau

SEQ ID NO: 1519550 - RNA, 23 nt, Homo sapiens
aaauacacagugcugaccagaca

SEQ ID NO: 1519551 - RNA, 13 nt, Homo sapiens
aaauacauaugca

SEQ ID NO: 1519552 - RNA, 21 nt, Homo sapiens
aaauaucaaagucauuaaaga

SEQ ID NO: 1519553 - RNA, 22 nt, Homo sapiens
aaaucaaucuuauuacugagag

SEQ ID NO: 1519554 - RNA, 18 nt, Homo sapiens
aaaucuaugaaauaucau

SEQ ID NO: 1519555 - RNA, 16 nt, Homo sapiens
aaaugaaaaucaauuu

SEQ ID NO: 1519556 - RNA, 14 nt, Homo sapiens
aaaugauccuuccu

SEQ ID NO: 1519557 - RNA, 16 nt, Homo sapiens
aaaugauccuuccuac

SEQ ID NO: 1519558 - RNA, 20 nt, Homo sapiens
aaauggaggaucucuaaaga

SEQ ID NO: 1519559 - RNA, 15 nt, Homo sapiens
aaauuuugcacugcu

SEQ ID NO: 1519560 - RNA, 23 nt, Homo sapiens
aacagcucccuaguggcuuccuc

SEQ ID NO: 1519561 - RNA, 23 nt, Homo sapiens
aaccuguaaagcaggugcccagg

SEQ ID NO: 1519562 - RNA, 14 nt, Homo sapiens
aacgcgacuuccac

SEQ ID NO: 1519563 - RNA, 23 nt, Homo sapiens
aacgcgacuuccacaaaccugga

SEQ ID NO: 1519564 - RNA, 14 nt, Homo sapiens
aacuauugugcuca

SEQ ID NO: 1519565 - RNA, 16 nt, Homo sapiens
aacucuaccugcacac

SEQ ID NO: 1519566 - RNA, 18 nt, Homo sapiens
aacuuagguuagugacaa

SEQ ID NO: 1519567 - RNA, 16 nt, Homo sapiens
aacuugcaacuuugag

SEQ ID NO: 1519568 - RNA, 12 nt, Homo sapiens
aagaaaugugau

SEQ ID NO: 1519569 - RNA, 19 nt, Homo sapiens
aagaaaugugauuugucuu

SEQ ID NO: 1519570 - RNA, 16 nt, Homo sapiens
aagaagaguuugcaaa

SEQ ID NO: 1519571 - RNA, 18 nt, Homo sapiens
aagaauuacaaguagaau

SEQ ID NO: 1519572 - RNA, 15 nt, Homo sapiens
aagagaucauauccu

SEQ ID NO: 1519573 - RNA, 16 nt, Homo sapiens
aagauauuucuuuaaa

SEQ ID NO: 1519574 - RNA, 22 nt, Homo sapiens
aagcucaucucagcuccugaaa

SEQ ID NO: 1519575 - RNA, 22 nt, Homo sapiens
aagggccagcuggaggugaaga

SEQ ID NO: 1519576 - RNA, 15 nt, Homo sapiens
aagugugugaucugu

SEQ ID NO: 1519577 - RNA, 18 nt, Homo sapiens
aaguuauuaccuuuacau

SEQ ID NO: 1519578 - RNA, 20 nt, Homo sapiens
aaguuauuaccuuuacauau

SEQ ID NO: 1519579 - RNA, 20 nt, Homo sapiens
aaguuauuccccaucuucca

SEQ ID NO: 1519580 - RNA, 18 nt, Homo sapiens
aauaaauagcaucuagua

SEQ ID NO: 1519581 - RNA, 13 nt, Homo sapiens
aauaauccagaaa

SEQ ID NO: 1519582 - RNA, 14 nt, Homo sapiens
aauaaugugaauga

SEQ ID NO: 1519583 - RNA, 13 nt, Homo sapiens
aauaauuugccau

SEQ ID NO: 1519584 - RNA, 19 nt, Homo sapiens
aauauuuuguuuugugcag

SEQ ID NO: 1519585 - RNA, 23 nt, Homo sapiens
aaucacacgucuggcuucacaga

SEQ ID NO: 1519586 - RNA, 20 nt, Homo sapiens
aaucagauuauuaagggaau

SEQ ID NO: 1519587 - RNA, 15 nt, Homo sapiens
aaugaaauaauucaa

SEQ ID NO: 1519588 - RNA, 19 nt, Homo sapiens
aaugaaauaauucaaacac

SEQ ID NO: 1519589 - RNA, 16 nt, Homo sapiens
aaugagaucauuguga

SEQ ID NO: 1519590 - RNA, 19 nt, Homo sapiens
aaugaugucguuugaauca

SEQ ID NO: 1519591 - RNA, 21 nt, Homo sapiens
aaugaugucguuugaaucaca

SEQ ID NO: 1519592 - RNA, 22 nt, Homo sapiens
aaugcauauuugcaaaguguau

SEQ ID NO: 1519593 - RNA, 17 nt, Homo sapiens
aaugcccccugagugac

SEQ ID NO: 1519594 - RNA, 20 nt, Homo sapiens
aaugguaguuuuacaguguu

SEQ ID NO: 1519595 - RNA, 17 nt, Homo sapiens
aaugguugaugauacuu

SEQ ID NO: 1519596 - RNA, 21 nt, Homo sapiens
aauguuagugauccaccugcc

SEQ ID NO: 1519597 - RNA, 17 nt, Homo sapiens
aauguucuccagucauu

SEQ ID NO: 1519598 - RNA, 22 nt, Homo sapiens
aauuaaggguaugauuaacucu

SEQ ID NO: 1519599 - RNA, 16 nt, Homo sapiens
aauucagaacauccuc

SEQ ID NO: 1519600 - RNA, 15 nt, Homo sapiens
aauuucauugaacua

SEQ ID NO: 1519601 - RNA, 20 nt, Homo sapiens
aauuugggagagccauacau

SEQ ID NO: 1519602 - RNA, 24 nt, Homo sapiens
uaaaguauuuaucuccugucuaca

SEQ ID NO: 1519603 - RNA, 15 nt, Homo sapiens
uaaauacaugcauau

SEQ ID NO: 1519604 - RNA, 12 nt, Homo sapiens
uaaauacuguuu

SEQ ID NO: 1519605 - RNA, 21 nt, Homo sapiens
uaaauggaaugaaauaauuca

SEQ ID NO: 1519606 - RNA, 14 nt, Homo sapiens
uaaccauauucaca

SEQ ID NO: 1519607 - RNA, 22 nt, Homo sapiens
uaaccuguuuauauaauuuugc

SEQ ID NO: 1519608 - RNA, 13 nt, Homo sapiens
uaacgaugcacuu

SEQ ID NO: 1519609 - RNA, 14 nt, Homo sapiens
uaacgaugcacuuu

SEQ ID NO: 1519610 - RNA, 18 nt, Homo sapiens
uaacucuaccugcacacu

SEQ ID NO: 1519611 - RNA, 16 nt, Homo sapiens
uaagaaagcaagccaa

SEQ ID NO: 1519612 - RNA, 12 nt, Homo sapiens
uaagagauguga

SEQ ID NO: 1519613 - RNA, 16 nt, Homo sapiens
uaagagaugugacuac

SEQ ID NO: 1519614 - RNA, 14 nt, Homo sapiens
uaagucaucaucuc

SEQ ID NO: 1519615 - RNA, 21 nt, Homo sapiens
uaaugguaguuuuacaguguu

SEQ ID NO: 1519616 - RNA, 20 nt, Homo sapiens
uaauucaguuauuugcacaa

SEQ ID NO: 1519617 - RNA, 22 nt, Homo sapiens
uaauuuaacccaggcaugcaau

SEQ ID NO: 1519618 - RNA, 16 nt, Homo sapiens
uacaaaaaucccaaau

SEQ ID NO: 1519619 - RNA, 16 nt, Homo sapiens
uacaaaaaugagcuag

SEQ ID NO: 1519620 - RNA, 15 nt, Homo sapiens
uacaacuucauauaa

SEQ ID NO: 1519621 - RNA, 22 nt, Homo sapiens
uacaguuuaauaaauagcaucu

SEQ ID NO: 1519622 - RNA, 14 nt, Homo sapiens
uacaguuuaucuau

SEQ ID NO: 1519623 - RNA, 14 nt, Homo sapiens
uacaugcauauaau

SEQ ID NO: 1519624 - RNA, 17 nt, Homo sapiens
uaccuuacugcaauuug

SEQ ID NO: 1519625 - RNA, 15 nt, Homo sapiens
uacuaauugagccau

SEQ ID NO: 1519626 - RNA, 21 nt, Homo sapiens
uacuccaauucauaaaucuau

SEQ ID NO: 1519627 - RNA, 16 nt, Homo sapiens
uacuuaauacucaugc

SEQ ID NO: 1519628 - RNA, 20 nt, Homo sapiens
uacuuauuaagagcaaacuu

SEQ ID NO: 1519629 - RNA, 18 nt, Homo sapiens
uacuuauuuuccaauaaa

SEQ ID NO: 1519630 - RNA, 20 nt, Homo sapiens
uacuuucaucuauucuuucc

SEQ ID NO: 1519631 - RNA, 15 nt, Homo sapiens
uacuuuugcucccua

SEQ ID NO: 1519632 - RNA, 13 nt, Homo sapiens
uagaaccaggcaa

SEQ ID NO: 1519633 - RNA, 18 nt, Homo sapiens
uagauguggccuuugaau

SEQ ID NO: 1519634 - RNA, 18 nt, Homo sapiens
uagauuaacggagugucu

SEQ ID NO: 1519635 - RNA, 18 nt, Homo sapiens
uagauuguaauacacaua

SEQ ID NO: 1519636 - RNA, 21 nt, Homo sapiens
uagcacaauuuauauuuuccc

SEQ ID NO: 1519637 - RNA, 22 nt, Homo sapiens
uagcaugaaauaaaauauaucu

SEQ ID NO: 1519638 - RNA, 17 nt, Homo sapiens
uaggacucugcacugaa

SEQ ID NO: 1519639 - RNA, 16 nt, Homo sapiens
uagguuagauucucau

SEQ ID NO: 1519640 - RNA, 23 nt, Homo sapiens
uaguggcuuccuccgucugcaau

SEQ ID NO: 1519641 - RNA, 19 nt, Homo sapiens
uaguucaaucuggauucau

SEQ ID NO: 1519642 - RNA, 13 nt, Homo sapiens
uauaaaggauaaa

SEQ ID NO: 1519643 - RNA, 18 nt, Homo sapiens
uauaacuauguugauaaa

SEQ ID NO: 1519644 - RNA, 13 nt, Homo sapiens
uauaccuuacugc

SEQ ID NO: 1519645 - RNA, 12 nt, Homo sapiens
uauaugcaauau

SEQ ID NO: 1519646 - RNA, 21 nt, Homo sapiens
uauauuagauaaccauauuca

SEQ ID NO: 1519647 - RNA, 20 nt, Homo sapiens
uauauuuauaaaauugcuau

SEQ ID NO: 1519648 - RNA, 22 nt, Homo sapiens
uauauuugauacauauaauucu

SEQ ID NO: 1519649 - RNA, 21 nt, Homo sapiens
uauauuuuuuucaacugccaa

SEQ ID NO: 1519650 - RNA, 12 nt, Homo sapiens
uaucaaagucau

SEQ ID NO: 1519651 - RNA, 13 nt, Homo sapiens
uaugaacauggag

SEQ ID NO: 1519652 - RNA, 23 nt, Homo sapiens
uaugaccucgcccuccacaaaug

SEQ ID NO: 1519653 - RNA, 16 nt, Homo sapiens
uauggcacccaugcac

SEQ ID NO: 1519654 - RNA, 17 nt, Homo sapiens
uauggcucuacuuucag

SEQ ID NO: 1519655 - RNA, 19 nt, Homo sapiens
uaugucacccaaugcauau

SEQ ID NO: 1519656 - RNA, 14 nt, Homo sapiens
uauuaaagcaccaa

SEQ ID NO: 1519657 - RNA, 19 nt, Homo sapiens
uauuaccuuuacauauuau

SEQ ID NO: 1519658 - RNA, 21 nt, Homo sapiens
uauucacaauggaaacuuuag

SEQ ID NO: 1519659 - RNA, 18 nt, Homo sapiens
uauuuaucuccugucuac

SEQ ID NO: 1519660 - RNA, 22 nt, Homo sapiens
uauuugcacaaguucagugaga

SEQ ID NO: 1519661 - RNA, 21 nt, Homo sapiens
uauuuggaauaauaauuuucc

SEQ ID NO: 1519662 - RNA, 18 nt, Homo sapiens
uauuuucccucucuugcc

SEQ ID NO: 1519663 - RNA, 14 nt, Homo sapiens
ucaaagcauuugca

SEQ ID NO: 1519664 - RNA, 15 nt, Homo sapiens
ucaaaugauccuucc

SEQ ID NO: 1519665 - RNA, 19 nt, Homo sapiens
ucaacuguuuuugucuaca

SEQ ID NO: 1519666 - RNA, 18 nt, Homo sapiens
ucaaucucugauucuguc

SEQ ID NO: 1519667 - RNA, 17 nt, Homo sapiens
ucaaucuggauucauau

SEQ ID NO: 1519668 - RNA, 12 nt, Homo sapiens
ucaaugcuauaa

SEQ ID NO: 1519669 - RNA, 18 nt, Homo sapiens
ucacacagacacuaacga

SEQ ID NO: 1519670 - RNA, 16 nt, Homo sapiens
ucacacauuacaaagu

SEQ ID NO: 1519671 - RNA, 16 nt, Homo sapiens
ucacagaugugugauu

SEQ ID NO: 1519672 - RNA, 16 nt, Homo sapiens
ucacuccaaagagaaa

SEQ ID NO: 1519673 - RNA, 18 nt, Homo sapiens
ucacucuaggacucugca

SEQ ID NO: 1519674 - RNA, 18 nt, Homo sapiens
ucacuuguucucacuguc

SEQ ID NO: 1519675 - RNA, 19 nt, Homo sapiens
ucacuuguucucacugucu

SEQ ID NO: 1519676 - RNA, 17 nt, Homo sapiens
ucagacuccuagacuca

SEQ ID NO: 1519677 - RNA, 14 nt, Homo sapiens
ucagccucccaaag

SEQ ID NO: 1519678 - RNA, 15 nt, Homo sapiens
ucaggauaacagaga

SEQ ID NO: 1519679 - RNA, 15 nt, Homo sapiens
ucaggcaacgcacaa

SEQ ID NO: 1519680 - RNA, 23 nt, Homo sapiens
ucaggccacauggcuaaagaagg

SEQ ID NO: 1519681 - RNA, 20 nt, Homo sapiens
ucagggagaguuugggaacu

SEQ ID NO: 1519682 - RNA, 20 nt, Homo sapiens
ucaggugccgggcgcaggaa

SEQ ID NO: 1519683 - RNA, 21 nt, Homo sapiens
ucagugcuucgcagauguccu

SEQ ID NO: 1519684 - RNA, 19 nt, Homo sapiens
ucauaauuucuucacucaa

SEQ ID NO: 1519685 - RNA, 15 nt, Homo sapiens
ucauauaacugagau

SEQ ID NO: 1519686 - RNA, 19 nt, Homo sapiens
ucaucccacccucucacag

SEQ ID NO: 1519687 - RNA, 20 nt, Homo sapiens
uccaacaugugcucagggaa

SEQ ID NO: 1519688 - RNA, 21 nt, Homo sapiens
uccagccagccaaauccaucc

SEQ ID NO: 1519689 - RNA, 18 nt, Homo sapiens
uccaucgcugucaucuca

SEQ ID NO: 1519690 - RNA, 22 nt, Homo sapiens
uccccaauuaucuuauuuaauu

SEQ ID NO: 1519691 - RNA, 15 nt, Homo sapiens
uccccccucacucca

SEQ ID NO: 1519692 - RNA, 20 nt, Homo sapiens
uccuacuuugcuucucucca

SEQ ID NO: 1519693 - RNA, 22 nt, Homo sapiens
uccuagugccuacaaugggaaa

SEQ ID NO: 1519694 - RNA, 22 nt, Homo sapiens
uccucauuuuugaauacaggca

SEQ ID NO: 1519695 - RNA, 14 nt, Homo sapiens
uccuccuuugccua

SEQ ID NO: 1519696 - RNA, 19 nt, Homo sapiens
uccugcuaauaauuugcca

SEQ ID NO: 1519697 - RNA, 18 nt, Homo sapiens
uccuguaagaccuucggg

SEQ ID NO: 1519698 - RNA, 22 nt, Homo sapiens
uccuguaagaccuucgggucaa

SEQ ID NO: 1519699 - RNA, 12 nt, Homo sapiens
uccugucuacag

SEQ ID NO: 1519700 - RNA, 23 nt, Homo sapiens
uccuuccuacuuugcuucucucc

SEQ ID NO: 1519701 - RNA, 17 nt, Homo sapiens
uccuuugguccuucaaa

SEQ ID NO: 1519702 - RNA, 15 nt, Homo sapiens
ucgcugucaucucag

SEQ ID NO: 1519703 - RNA, 19 nt, Homo sapiens
ucguuugaaucacaguaua

SEQ ID NO: 1519704 - RNA, 17 nt, Homo sapiens
ucuaaguaaugaugucg

SEQ ID NO: 1519705 - RNA, 17 nt, Homo sapiens
ucuaugaaauaucaugc

SEQ ID NO: 1519706 - RNA, 16 nt, Homo sapiens
ucucaaucuccugacu

SEQ ID NO: 1519707 - RNA, 20 nt, Homo sapiens
ucucagucacucuaggacuc

SEQ ID NO: 1519708 - RNA, 18 nt, Homo sapiens
ucucauauaagacaaaua

SEQ ID NO: 1519709 - RNA, 15 nt, Homo sapiens
ucucugacucuugcc

SEQ ID NO: 1519710 - RNA, 21 nt, Homo sapiens
ucucugcuuuggaaaucacac

SEQ ID NO: 1519711 - RNA, 19 nt, Homo sapiens
ucugacucuugccuuucca

SEQ ID NO: 1519712 - RNA, 16 nt, Homo sapiens
ucugaucugaugcaag

SEQ ID NO: 1519713 - RNA, 18 nt, Homo sapiens
ucuguaaugcuuuacaca

SEQ ID NO: 1519714 - RNA, 13 nt, Homo sapiens
caucacuugccaa

SEQ ID NO: 1519715 - RNA, 20 nt, Homo sapiens
caugacauauuuuugcuuua

SEQ ID NO: 1519716 - RNA, 21 nt, Homo sapiens
caugaccuuuuucacuguggc

SEQ ID NO: 1519717 - RNA, 22 nt, Homo sapiens
caugauaaaaagaaaugugauu

SEQ ID NO: 1519718 - RNA, 21 nt, Homo sapiens
caugaugccgcucuucuguca

SEQ ID NO: 1519719 - RNA, 18 nt, Homo sapiens
caugcacccucauacaca

SEQ ID NO: 1519720 - RNA, 23 nt, Homo sapiens
caugcuuucccaccagcauguca

SEQ ID NO: 1519721 - RNA, 22 nt, Homo sapiens
cauguauuucuuacguacacug

SEQ ID NO: 1519722 - RNA, 22 nt, Homo sapiens
caugucuauuuuugaugacuca

SEQ ID NO: 1519723 - RNA, 20 nt, Homo sapiens
cauuagccuaugugcaugca

SEQ ID NO: 1519724 - RNA, 19 nt, Homo sapiens
cauucaggcaacgcacaaa

SEQ ID NO: 1519725 - RNA, 23 nt, Homo sapiens
cauuggagacaucacuugccaau

SEQ ID NO: 1519726 - RNA, 14 nt, Homo sapiens
cauugggauauucu

SEQ ID NO: 1519727 - RNA, 17 nt, Homo sapiens
cauuuucuucacuugca

SEQ ID NO: 1519728 - RNA, 11 nt, Homo sapiens
ccaaaacacag

SEQ ID NO: 1519729 - RNA, 12 nt, Homo sapiens
ccaaaacacaga

SEQ ID NO: 1519730 - RNA, 19 nt, Homo sapiens
ccaaaggacccaaguacuu

SEQ ID NO: 1519731 - RNA, 16 nt, Homo sapiens
ccaaccugaagacacc

SEQ ID NO: 1519732 - RNA, 17 nt, Homo sapiens
ccaaggaaauacauaug

SEQ ID NO: 1519733 - RNA, 20 nt, Homo sapiens
ccaaugagaucauugugaag

SEQ ID NO: 1519734 - RNA, 16 nt, Homo sapiens
ccacagucucugggag

SEQ ID NO: 1519735 - RNA, 19 nt, Homo sapiens
ccacuggacugucuaugaa

SEQ ID NO: 1519736 - RNA, 16 nt, Homo sapiens
ccaggaaccucagggc

SEQ ID NO: 1519737 - RNA, 19 nt, Homo sapiens
ccaggcuggagugcagugg

SEQ ID NO: 1519738 - RNA, 20 nt, Homo sapiens
ccaucagcaaauauuauucu

SEQ ID NO: 1519739 - RNA, 16 nt, Homo sapiens
ccauccugcucuucca

SEQ ID NO: 1519740 - RNA, 16 nt, Homo sapiens
ccaugaccuuuuucac

SEQ ID NO: 1519741 - RNA, 23 nt, Homo sapiens
ccaugcacccucauacacagaaa

SEQ ID NO: 1519742 - RNA, 12 nt, Homo sapiens
cccagcacuuug

SEQ ID NO: 1519743 - RNA, 18 nt, Homo sapiens
cccaggccagaagaccuc

SEQ ID NO: 1519744 - RNA, 22 nt, Homo sapiens
ccccgcucccagauguaaagaa

SEQ ID NO: 1519745 - RNA, 13 nt, Homo sapiens
ccccugacugugu

SEQ ID NO: 1519746 - RNA, 22 nt, Homo sapiens
cccugaaguaagcaaagacuuu

SEQ ID NO: 1519747 - RNA, 18 nt, Homo sapiens
cccugacagcuguguacu

SEQ ID NO: 1519748 - RNA, 13 nt, Homo sapiens
cccugcucccaca

SEQ ID NO: 1519749 - RNA, 21 nt, Homo sapiens
cccuucuucacacagacacua

SEQ ID NO: 1519750 - RNA, 13 nt, Homo sapiens
ccgggcgcaggaa

SEQ ID NO: 1519751 - RNA, 22 nt, Homo sapiens
ccuaaaucaaguuggcuucuaa

SEQ ID NO: 1519752 - RNA, 13 nt, Homo sapiens
ccuaccugacugc

SEQ ID NO: 1519753 - RNA, 14 nt, Homo sapiens
ccucauacacagaa

SEQ ID NO: 1519754 - RNA, 11 nt, Homo sapiens
ccucucuugcc

SEQ ID NO: 1519755 - RNA, 21 nt, Homo sapiens
ccucugucucugcucuugccu

SEQ ID NO: 1519756 - RNA, 16 nt, Homo sapiens
ccucuuuuucuagucu

SEQ ID NO: 1519757 - RNA, 21 nt, Homo sapiens
ccugaaguaagcaaagacuuu

SEQ ID NO: 1519758 - RNA, 20 nt, Homo sapiens
ccugcuaauaauuugccauu

SEQ ID NO: 1519759 - RNA, 14 nt, Homo sapiens
ccugcucccacaga

SEQ ID NO: 1519760 - RNA, 22 nt, Homo sapiens
ccuuacauuugaaaucuaugaa

SEQ ID NO: 1519761 - RNA, 15 nt, Homo sapiens
ccuucuuugcacuuu

SEQ ID NO: 1519762 - RNA, 16 nt, Homo sapiens
ccuucuuugcacuuuu

SEQ ID NO: 1519763 - RNA, 14 nt, Homo sapiens
cgaguacucuugaa

SEQ ID NO: 1519764 - RNA, 19 nt, Homo sapiens
cgaguacucuugaacacaa

SEQ ID NO: 1519765 - RNA, 20 nt, Homo sapiens
cgaucucaacucacugcaag

SEQ ID NO: 1519766 - RNA, 16 nt, Homo sapiens
cgccacuggacugucu

SEQ ID NO: 1519767 - RNA, 11 nt, Homo sapiens
cgcgacuucca

SEQ ID NO: 1519768 - RNA, 23 nt, Homo sapiens
cgggggagaggggagaauggagu

SEQ ID NO: 1519769 - RNA, 14 nt, Homo sapiens
cuaagagaugugac

SEQ ID NO: 1519770 - RNA, 19 nt, Homo sapiens
cuaaguuaugacugugaaa

SEQ ID NO: 1519771 - RNA, 19 nt, Homo sapiens
cuaauacagacuaugucac

SEQ ID NO: 1519772 - RNA, 21 nt, Homo sapiens
cuaauccucuuuuucuagucu

SEQ ID NO: 1519773 - RNA, 18 nt, Homo sapiens
cuaccauucaaaauugcu

SEQ ID NO: 1519774 - RNA, 21 nt, Homo sapiens
cuaucuauaccuuacugcaau

SEQ ID NO: 1519775 - RNA, 18 nt, Homo sapiens
cuauggcucuacuuucag

SEQ ID NO: 1519776 - RNA, 20 nt, Homo sapiens
cuauuaagucaucaucucca

SEQ ID NO: 1519777 - RNA, 22 nt, Homo sapiens
cuauuuauuuauuuauucauua

SEQ ID NO: 1519778 - RNA, 17 nt, Homo sapiens
cucaaaaaaagggcaau

SEQ ID NO: 1519779 - RNA, 21 nt, Homo sapiens
cucaugcauucuuuugcacac

SEQ ID NO: 1519780 - RNA, 13 nt, Homo sapiens
cuccacccaugac

SEQ ID NO: 1519781 - RNA, 17 nt, Homo sapiens
cucccugaaguaagcaa

SEQ ID NO: 1519782 - RNA, 19 nt, Homo sapiens
cucccugaaguaagcaaag

SEQ ID NO: 1519783 - RNA, 17 nt, Homo sapiens
cucuaccugcacacugu

SEQ ID NO: 1519784 - RNA, 24 nt, Homo sapiens
cucuaugaccucgcccuccacaaa

SEQ ID NO: 1519785 - RNA, 16 nt, Homo sapiens
cucuccacccaugacc

SEQ ID NO: 1519786 - RNA, 13 nt, Homo sapiens
cucuugaacacaa

SEQ ID NO: 1519787 - RNA, 20 nt, Homo sapiens
cucuuuucccaccaacuccu

SEQ ID NO: 1519788 - RNA, 18 nt, Homo sapiens
cugaacccagaaacaaca

SEQ ID NO: 1519789 - RNA, 19 nt, Homo sapiens
cugacaguaacagcaucuu

SEQ ID NO: 1519790 - RNA, 17 nt, Homo sapiens
cugacuucucacuuccu

SEQ ID NO: 1519791 - RNA, 19 nt, Homo sapiens
cugaguagcugggacuaca

SEQ ID NO: 1519792 - RNA, 13 nt, Homo sapiens
cugaucugaugca

SEQ ID NO: 1519793 - RNA, 12 nt, Homo sapiens
cugcacacuguc

SEQ ID NO: 1519794 - RNA, 22 nt, Homo sapiens
cugcacugaauggcugaccuga

SEQ ID NO: 1519795 - RNA, 10 nt, Homo sapiens
cugcauuuca

SEQ ID NO: 1519796 - RNA, 22 nt, Homo sapiens
cugcauuucaagaagacuggca

SEQ ID NO: 1519797 - RNA, 17 nt, Homo sapiens
cugcccugcucccacag

SEQ ID NO: 1519798 - RNA, 16 nt, Homo sapiens
cugcucuuccauuucu

SEQ ID NO: 1519799 - RNA, 11 nt, Homo sapiens
cugcucuugcc

SEQ ID NO: 1519800 - RNA, 16 nt, Homo sapiens
cugcuuguauuuucca

SEQ ID NO: 1519801 - RNA, 22 nt, Homo sapiens
cuggagugcaguggcacgaucu

SEQ ID NO: 1519802 - RNA, 18 nt, Homo sapiens
cuggucaggcccacugca

SEQ ID NO: 1519803 - RNA, 17 nt, Homo sapiens
cuguacuucugugugca

SEQ ID NO: 1519804 - RNA, 24 nt, Homo sapiens
cuguacuucugugugcaauuguaa

SEQ ID NO: 1519805 - RNA, 17 nt, Homo sapiens
cuguauuucaagaccuc

SEQ ID NO: 1519806 - RNA, 17 nt, Homo sapiens
cuguccuauuauauuca

SEQ ID NO: 1519807 - RNA, 17 nt, Homo sapiens
cugucucugcucuugcc

SEQ ID NO: 1519808 - RNA, 20 nt, Homo sapiens
cuuacauuugaaaucuauga

SEQ ID NO: 1519809 - RNA, 12 nt, Homo sapiens
cuuagaacaaag

SEQ ID NO: 1519810 - RNA, 20 nt, Homo sapiens
cuuaggcuaagagaugugac

SEQ ID NO: 1519811 - RNA, 21 nt, Homo sapiens
cuuauauauuugauacauaua

SEQ ID NO: 1519812 - RNA, 14 nt, Homo sapiens
cuuauuacugagag

SEQ ID NO: 1519813 - RNA, 20 nt, Homo sapiens
cuuauuacugagagugcaaa

SEQ ID NO: 1519814 - RNA, 12 nt, Homo sapiens
cuuauuugcaau

SEQ ID NO: 1519815 - RNA, 20 nt, Homo sapiens
cuucauaauuucuucacuca

SEQ ID NO: 1519816 - RNA, 13 nt, Homo sapiens
cuucuagaaccag

SEQ ID NO: 1519817 - RNA, 15 nt, Homo sapiens
cuugaaaucaagggc

SEQ ID NO: 1519818 - RNA, 15 nt, Homo sapiens
cuugauuucagguca

SEQ ID NO: 1519819 - RNA, 17 nt, Homo sapiens
cuuguaaaugugguaaa

SEQ ID NO: 1519820 - RNA, 23 nt, Homo sapiens
cuuguaaaugugguaaagaguua

SEQ ID NO: 1519821 - RNA, 13 nt, Homo sapiens
cuuguuauaugca

SEQ ID NO: 1519822 - RNA, 18 nt, Homo sapiens
cuuguucucacugucugu

SEQ ID NO: 1519823 - RNA, 16 nt, Homo sapiens
cuuuaaauuuugcacu

SEQ ID NO: 1519824 - RNA, 15 nt, Homo sapiens
cuuuaagaacuaaaa

SEQ ID NO: 1519825 - RNA, 21 nt, Homo sapiens
cuuucaggccacauggcuaaa

SEQ ID NO: 1519826 - RNA, 24 nt, Homo sapiens
cuuucaggccacauggcuaaagaa

SEQ ID NO: 1519827 - RNA, 16 nt, Homo sapiens
cuuugcauauuauaaa

SEQ ID NO: 1519828 - RNA, 16 nt, Homo sapiens
cuuugcuucucuccac

SEQ ID NO: 1519829 - RNA, 15 nt, Homo sapiens
cuuuggaaaucacac

SEQ ID NO: 1519830 - RNA, 19 nt, Homo sapiens
cuuuguucaaauguacuau

SEQ ID NO: 1519831 - RNA, 22 nt, Homo sapiens
cuuuuccaugcacccucauaca

SEQ ID NO: 1519832 - RNA, 17 nt, Homo sapiens
cucacuccacacuggca

SEQ ID NO: 1519833 - RNA, 16 nt, Homo sapiens
cucagcuggaucucca

SEQ ID NO: 1519834 - RNA, 17 nt, Homo sapiens
cucagcuggaucuccau

SEQ ID NO: 1519835 - RNA, 14 nt, Homo sapiens
cucauacacagaaa

SEQ ID NO: 1519836 - RNA, 22 nt, Homo sapiens
cucaucaauuuugucuauuaaa

SEQ ID NO: 1519837 - RNA, 18 nt, Homo sapiens
cuccagaaggaaaggagg

SEQ ID NO: 1519838 - RNA, 12 nt, Homo sapiens
cucccacagaac

SEQ ID NO: 1519839 - RNA, 19 nt, Homo sapiens
cucucauauaagacaaaua

SEQ ID NO: 1519840 - RNA, 14 nt, Homo sapiens
cucugcucuugccu

SEQ ID NO: 1519841 - RNA, 22 nt, Homo sapiens
cucugguguaguuucugcauuu

SEQ ID NO: 1519842 - RNA, 22 nt, Homo sapiens
cucuguauuuuuuaaaacauca

SEQ ID NO: 1519843 - RNA, 13 nt, Homo sapiens
cucugucccucac

SEQ ID NO: 1519844 - RNA, 23 nt, Homo sapiens
cugaacccagaaacaacacaauc

SEQ ID NO: 1519845 - RNA, 16 nt, Homo sapiens
cugacaccucacugag

SEQ ID NO: 1519846 - RNA, 23 nt, Homo sapiens
cugcaggcaaagugagacugaca

SEQ ID NO: 1519847 - RNA, 16 nt, Homo sapiens
cugcauuuucuucacu

SEQ ID NO: 1519848 - RNA, 16 nt, Homo sapiens
cuggacugucuaugaa

SEQ ID NO: 1519849 - RNA, 16 nt, Homo sapiens
cuggguucacaccauu

SEQ ID NO: 1519850 - RNA, 19 nt, Homo sapiens
cuguaaugcuuuacacagg

SEQ ID NO: 1519851 - RNA, 19 nt, Homo sapiens
cuguacuucugugugcaau

SEQ ID NO: 1519852 - RNA, 15 nt, Homo sapiens
cuguauuaaugcuug

SEQ ID NO: 1519853 - RNA, 17 nt, Homo sapiens
cuguauuagucacagag

SEQ ID NO: 1519854 - RNA, 19 nt, Homo sapiens
cugucuaugaacuugcaaa

SEQ ID NO: 1519855 - RNA, 22 nt, Homo sapiens
cugucuguuuuaauuuaaccca

SEQ ID NO: 1519856 - RNA, 17 nt, Homo sapiens
cuguguguacuaauaca

SEQ ID NO: 1519857 - RNA, 20 nt, Homo sapiens
cuguuauugccaauguuccu

SEQ ID NO: 1519858 - RNA, 14 nt, Homo sapiens
cuuaaauccauccu

SEQ ID NO: 1519859 - RNA, 15 nt, Homo sapiens
cuuagcuuuccacag

SEQ ID NO: 1519860 - RNA, 22 nt, Homo sapiens
cuuaggcuaagagaugugacua

SEQ ID NO: 1519861 - RNA, 23 nt, Homo sapiens
cuucacagaugugugauucacag

SEQ ID NO: 1519862 - RNA, 15 nt, Homo sapiens
cuucacucaaucucu

SEQ ID NO: 1519863 - RNA, 21 nt, Homo sapiens
cuucaggauccaagugacaaa

SEQ ID NO: 1519864 - RNA, 15 nt, Homo sapiens
cuucccuucuuugca

SEQ ID NO: 1519865 - RNA, 20 nt, Homo sapiens
cuucccuucuuugcacuuuu

SEQ ID NO: 1519866 - RNA, 20 nt, Homo sapiens
cuuccuagugccuacaaugg

SEQ ID NO: 1519867 - RNA, 12 nt, Homo sapiens
cuucuauauccu

SEQ ID NO: 1519868 - RNA, 13 nt, Homo sapiens
cuucucacuuccu

SEQ ID NO: 1519869 - RNA, 21 nt, Homo sapiens
cuucuucaagauuuauggaaa

SEQ ID NO: 1519870 - RNA, 12 nt, Homo sapiens
cuugcugccaaa

SEQ ID NO: 1519871 - RNA, 18 nt, Homo sapiens
cuugcugccaaaagccuu

SEQ ID NO: 1519872 - RNA, 15 nt, Homo sapiens
cuuggagaacuuucc

SEQ ID NO: 1519873 - RNA, 23 nt, Homo sapiens
cuuguauagcaugaaauaaaaua

SEQ ID NO: 1519874 - RNA, 16 nt, Homo sapiens
cuuguauuuuccauac

SEQ ID NO: 1519875 - RNA, 16 nt, Homo sapiens
cuuguucucacugucu

SEQ ID NO: 1519876 - RNA, 15 nt, Homo sapiens
cuuuaaauuuugcac

SEQ ID NO: 1519877 - RNA, 21 nt, Homo sapiens
cuuuaacacaacucuuuguuc

SEQ ID NO: 1519878 - RNA, 15 nt, Homo sapiens
cuuuauuauuuugcu

SEQ ID NO: 1519879 - RNA, 17 nt, Homo sapiens
cuuucuaagagaccuga

SEQ ID NO: 1519880 - RNA, 15 nt, Homo sapiens
cuuugcuucucucca

SEQ ID NO: 1519881 - RNA, 19 nt, Homo sapiens
cuuuuaaugccuuccacau

SEQ ID NO: 1519882 - RNA, 18 nt, Homo sapiens
cuuuuagagucagacucc

SEQ ID NO: 1519883 - RNA, 13 nt, Homo sapiens
gcugcucucugag

SEQ ID NO: 1519884 - RNA, 20 nt, Homo sapiens
gcuggagugcaguggcacga

SEQ ID NO: 1519885 - RNA, 21 nt, Homo sapiens
gcugggauuacaggcuugaaa

SEQ ID NO: 1519886 - RNA, 16 nt, Homo sapiens
gcuucuucuucaagau

SEQ ID NO: 1519887 - RNA, 17 nt, Homo sapiens
ggaaggacauccauguu

SEQ ID NO: 1519888 - RNA, 20 nt, Homo sapiens
ggagacaucacuugccaaug

SEQ ID NO: 1519889 - RNA, 14 nt, Homo sapiens
ggagccugcaacau

SEQ ID NO: 1519890 - RNA, 16 nt, Homo sapiens
ggcaauaaaugcccuc

SEQ ID NO: 1519891 - RNA, 17 nt, Homo sapiens
ggccagaugcacauccc

SEQ ID NO: 1519892 - RNA, 23 nt, Homo sapiens
ggccaucaggacuuucccugaca

SEQ ID NO: 1519893 - RNA, 12 nt, Homo sapiens
ggcuaugccuug

SEQ ID NO: 1519894 - RNA, 21 nt, Homo sapiens
ggcuugaaagucuaacuuuuu

SEQ ID NO: 1519895 - RNA, 18 nt, Homo sapiens
gggaguuggugugcuauu

SEQ ID NO: 1519896 - RNA, 16 nt, Homo sapiens
gggcaacuauucauga

SEQ ID NO: 1519897 - RNA, 19 nt, Homo sapiens
gggcuucuagaaccaggca

SEQ ID NO: 1519898 - RNA, 19 nt, Homo sapiens
gguacaaguuuacaugaua

SEQ ID NO: 1519899 - RNA, 17 nt, Homo sapiens
guaaacagaaauugcaa

SEQ ID NO: 1519900 - RNA, 18 nt, Homo sapiens
guaaacagaaauugcaau

SEQ ID NO: 1519901 - RNA, 14 nt, Homo sapiens
guaauucaguuauu

SEQ ID NO: 1519902 - RNA, 23 nt, Homo sapiens
guacaaaaaucccaaauucacuu

SEQ ID NO: 1519903 - RNA, 13 nt, Homo sapiens
guacaaguuuaca

SEQ ID NO: 1519904 - RNA, 23 nt, Homo sapiens
guacacuguacuucugugugcaa

SEQ ID NO: 1519905 - RNA, 14 nt, Homo sapiens
guagagucacugac

SEQ ID NO: 1519906 - RNA, 13 nt, Homo sapiens
guauaugcaauau

SEQ ID NO: 1519907 - RNA, 19 nt, Homo sapiens
guaugauccuaaugaaugc

SEQ ID NO: 1519908 - RNA, 23 nt, Homo sapiens
guaugauccuaaugaaugcauaa

SEQ ID NO: 1519909 - RNA, 15 nt, Homo sapiens
guauguuugggagac

SEQ ID NO: 1519910 - RNA, 23 nt, Homo sapiens
guauguuugggagacugcugagu

SEQ ID NO: 1519911 - RNA, 12 nt, Homo sapiens
guauuagucaca

SEQ ID NO: 1519912 - RNA, 17 nt, Homo sapiens
guauucauauguuuaug

SEQ ID NO: 1519913 - RNA, 22 nt, Homo sapiens
gucaaaugcccccugagugacu

SEQ ID NO: 1519914 - RNA, 22 nt, Homo sapiens
gucaacccaauaguuguugauu

SEQ ID NO: 1519915 - RNA, 18 nt, Homo sapiens
gucaugcguuuaaucaca

SEQ ID NO: 1519916 - RNA, 17 nt, Homo sapiens
gucccagggcugaugcu

SEQ ID NO: 1519917 - RNA, 16 nt, Homo sapiens
guccuauuauauucau

SEQ ID NO: 1519918 - RNA, 17 nt, Homo sapiens
guccuuuaaauuuugca

SEQ ID NO: 1519919 - RNA, 17 nt, Homo sapiens
gugcaugcagcaucuaa

SEQ ID NO: 1519920 - RNA, 18 nt, Homo sapiens
gugcuauuuuugaagcag

SEQ ID NO: 1519921 - RNA, 15 nt, Homo sapiens
guggaacaagcacag

SEQ ID NO: 1519922 - RNA, 19 nt, Homo sapiens
guguccuacacaauggugc

SEQ ID NO: 1519923 - RNA, 13 nt, Homo sapiens
guucaccagguca

SEQ ID NO: 1519924 - RNA, 14 nt, Homo sapiens
guucagaugcuucu

SEQ ID NO: 1519925 - RNA, 15 nt, Homo sapiens
guuccgagaagaaca

SEQ ID NO: 1519926 - RNA, 21 nt, Homo sapiens
guucuccagucauuauguuaa

SEQ ID NO: 1519927 - RNA, 16 nt, Homo sapiens
guugaauuucccacau

SEQ ID NO: 1519928 - RNA, 12 nt, Homo sapiens
guuggcuucuaa

SEQ ID NO: 1519929 - RNA, 21 nt, Homo sapiens
guugucccagggcugaugcug

SEQ ID NO: 1519930 - RNA, 17 nt, Homo sapiens
guuugaaucacaguaua

SEQ ID NO: 1519931 - RNA, 14 nt, Homo sapiens
guuugaguuacuau

SEQ ID NO: 1519932 - RNA, 19 nt, Homo sapiens
guuugcauugucuuuaaua

SEQ ID NO: 1519933 - RNA, 22 nt, Homo sapiens
guuuuacaaauuuaauuuugca

SEQ ID NO: 1519934 - RNA, 13 nt, Homo sapiens
guuuucuacucca

SEQ ID NO: 1519935 - RNA, 13 nt, Homo sapiens
uaaaaacauuccc

SEQ ID NO: 1519936 - RNA, 15 nt, Homo sapiens
uaaaaagaaauguga

SEQ ID NO: 1519937 - RNA, 16 nt, Homo sapiens
uaaaaguuauuaccuu

SEQ ID NO: 1519938 - RNA, 15 nt, Homo sapiens
uaaaauaguaugaaa

SEQ ID NO: 1519939 - RNA, 18 nt, Homo sapiens
uaaagacuuguauagcau

SEQ ID NO: 1519940 - RNA, 17 nt, Homo sapiens
uaaagauauuucuuuaa

SEQ ID NO: 1519941 - RNA, 22 nt, Homo sapiens
uaaagggagauaacaaucugua

SEQ ID NO: 1519942 - RNA, 17 nt, Homo sapiens
uaaaguggaaguaugua

SEQ ID NO: 1519943 - RNA, 14 nt, Homo sapiens
uaacagcaucuuua

SEQ ID NO: 1519944 - RNA, 18 nt, Homo sapiens
uaacuauaucauccuuua

SEQ ID NO: 1519945 - RNA, 14 nt, Homo sapiens
uaacuauguugaua

SEQ ID NO: 1519946 - RNA, 17 nt, Homo sapiens
uaacuuuuuuuuacuua

SEQ ID NO: 1519947 - RNA, 14 nt, Homo sapiens
uaagaauaguagau

SEQ ID NO: 1519948 - RNA, 15 nt, Homo sapiens
uaagcaaagacuuuc

SEQ ID NO: 1519949 - RNA, 16 nt, Homo sapiens
uaaguuaucuuugaau

SEQ ID NO: 1519950 - RNA, 14 nt, Homo sapiens
uaaguuaugacugu

SEQ ID NO: 1519951 - RNA, 17 nt, Homo sapiens
uaaguuaugacugugaa

SEQ ID NO: 1519952 - RNA, 14 nt, Homo sapiens
uaauaaauagcauc

SEQ ID NO: 1519953 - RNA, 18 nt, Homo sapiens
uaauauaaaucaaucuua

SEQ ID NO: 1519954 - RNA, 21 nt, Homo sapiens
uaauauaauaaaaguuauuac

SEQ ID NO: 1519955 - RNA, 19 nt, Homo sapiens
uaauccucuuuuucuaguc

SEQ ID NO: 1519956 - RNA, 17 nt, Homo sapiens
uaaugcuugaauauuac

SEQ ID NO: 1519957 - RNA, 12 nt, Homo sapiens
uaauucaaacac

SEQ ID NO: 1519958 - RNA, 14 nt, Homo sapiens
uaauuuuugcaauu

SEQ ID NO: 1519959 - RNA, 14 nt, Homo sapiens
uacaagguauuuac

SEQ ID NO: 1519960 - RNA, 21 nt, Homo sapiens
uacaagguauuuacacauaca

SEQ ID NO: 1519961 - RNA, 17 nt, Homo sapiens
uacacaauggugcuauu

SEQ ID NO: 1519962 - RNA, 20 nt, Homo sapiens
uacaccugaggcugaggcag

SEQ ID NO: 1519963 - RNA, 22 nt, Homo sapiens
uacaggcuggagauuuucacau

SEQ ID NO: 1519964 - RNA, 14 nt, Homo sapiens
uacauaugcagaua

SEQ ID NO: 1519965 - RNA, 17 nt, Homo sapiens
uacauauuaucaugucu

SEQ ID NO: 1519966 - RNA, 17 nt, Homo sapiens
uaccaaccugaagacac

SEQ ID NO: 1519967 - RNA, 14 nt, Homo sapiens
uaccuuacugcaau

SEQ ID NO: 1519968 - RNA, 20 nt, Homo sapiens
uacgcuccaucgcugucauc

SEQ ID NO: 1519969 - RNA, 18 nt, Homo sapiens
uacguaugagauccuuua

SEQ ID NO: 1519970 - RNA, 17 nt, Homo sapiens
uacuagauugugauccc

SEQ ID NO: 1519971 - RNA, 12 nt, Homo sapiens
uacuuaauacuc

SEQ ID NO: 1519972 - RNA, 13 nt, Homo sapiens
uacuuauuuucca

SEQ ID NO: 1519973 - RNA, 18 nt, Homo sapiens
uacuucugugugcaauug

SEQ ID NO: 1519974 - RNA, 15 nt, Homo sapiens
uagaguucagacuuu

SEQ ID NO: 1519975 - RNA, 16 nt, Homo sapiens
uagaguucagacuuuu

SEQ ID NO: 1519976 - RNA, 21 nt, Homo sapiens
uagauuguaauacacauaucu

SEQ ID NO: 1519977 - RNA, 19 nt, Homo sapiens
uaguagauguggccuuuga

SEQ ID NO: 1519978 - RNA, 16 nt, Homo sapiens
uaguggggucagggcu

SEQ ID NO: 1519979 - RNA, 23 nt, Homo sapiens
uauaaaauaguaugaaaauggaa

SEQ ID NO: 1519980 - RNA, 16 nt, Homo sapiens
uauauaacaacaaacu

SEQ ID NO: 1519981 - RNA, 23 nt, Homo sapiens
uauauuagauaaccauauucaca

SEQ ID NO: 1519982 - RNA, 12 nt, Homo sapiens
uaucaggagaaa

SEQ ID NO: 1519983 - RNA, 21 nt, Homo sapiens
uauccaacaugugcucaggga

SEQ ID NO: 1519984 - RNA, 24 nt, Homo sapiens
uauccucaagguagaaaugucuau

SEQ ID NO: 1519985 - RNA, 21 nt, Homo sapiens
uaucuaaaaauaguuaacaca

SEQ ID NO: 1519986 - RNA, 21 nt, Homo sapiens
uaucuauggcacccaugcacc

SEQ ID NO: 1519987 - RNA, 18 nt, Homo sapiens
uauggcacccaugcaccu

SEQ ID NO: 1519988 - RNA, 14 nt, Homo sapiens
uauguaaugcuuua

SEQ ID NO: 1519989 - RNA, 20 nt, Homo sapiens
uauguuuaaaaacauucccc

SEQ ID NO: 1519990 - RNA, 19 nt, Homo sapiens
uauuaagucaucaucucca

SEQ ID NO: 1519991 - RNA, 22 nt, Homo sapiens
uauuacaguuuaucuauggcac

SEQ ID NO: 1519992 - RNA, 17 nt, Homo sapiens
uauuaccuuuacauauu

SEQ ID NO: 1519993 - RNA, 21 nt, Homo sapiens
uauuaccuuuacauauuauca

SEQ ID NO: 1519994 - RNA, 12 nt, Homo sapiens
uauucagaugua

SEQ ID NO: 1519995 - RNA, 14 nt, Homo sapiens
uauucauauguuua

SEQ ID NO: 1519996 - RNA, 11 nt, Homo sapiens
uauucaugagu

SEQ ID NO: 1519997 - RNA, 15 nt, Homo sapiens
uauucaugaguauuc

SEQ ID NO: 1519998 - RNA, 21 nt, Homo sapiens
uauucuuggagaacuuuccau

SEQ ID NO: 1519999 - RNA, 22 nt, Homo sapiens
uauugaaaugauuucacagugu

SEQ ID NO: 1520000 - RNA, 12 nt, Homo sapiens
uauuuacacaua

SEQ ID NO: 1520001 - RNA, 22 nt, Homo sapiens
uauuuaucuccugucuacaguu

SEQ ID NO: 1520002 - RNA, 19 nt, Homo sapiens
uauuucccuaccaaccaag

SEQ ID NO: 1520003 - RNA, 16 nt, Homo sapiens
uauuugaaaaauugcc

SEQ ID NO: 1520004 - RNA, 21 nt, Homo sapiens
ugguguaguuucugcauuuca

SEQ ID NO: 1520005 - RNA, 18 nt, Homo sapiens
uguaaacagaaauugcaa

SEQ ID NO: 1520006 - RNA, 20 nt, Homo sapiens
uguaaacagaaauugcaaua

SEQ ID NO: 1520007 - RNA, 15 nt, Homo sapiens
uguaaagcaggugcc

SEQ ID NO: 1520008 - RNA, 16 nt, Homo sapiens
uguaauacacauaucu

SEQ ID NO: 1520009 - RNA, 16 nt, Homo sapiens
uguacagguacaggcu

SEQ ID NO: 1520010 - RNA, 20 nt, Homo sapiens
uguacuucugugugcaauug

SEQ ID NO: 1520011 - RNA, 12 nt, Homo sapiens
ugucaaugucuu

SEQ ID NO: 1520012 - RNA, 11 nt, Homo sapiens
ugucaucucag

SEQ ID NO: 1520013 - RNA, 18 nt, Homo sapiens
ugucccagggcugaugcu

SEQ ID NO: 1520014 - RNA, 20 nt, Homo sapiens
ugucccagggcugaugcugu

SEQ ID NO: 1520015 - RNA, 23 nt, Homo sapiens
ugucuacaguuuaauaaauagca

SEQ ID NO: 1520016 - RNA, 16 nt, Homo sapiens
ugucucugcucuugcc

SEQ ID NO: 1520017 - RNA, 14 nt, Homo sapiens
ugucuuuaauauaa

SEQ ID NO: 1520018 - RNA, 15 nt, Homo sapiens
ugucuuuaauauaau

SEQ ID NO: 1520019 - RNA, 20 nt, Homo sapiens
ugugaaguugcccaccaaaa

SEQ ID NO: 1520020 - RNA, 12 nt, Homo sapiens
ugugcucaggga

SEQ ID NO: 1520021 - RNA, 13 nt, Homo sapiens
uguuaaguugaug

SEQ ID NO: 1520022 - RNA, 13 nt, Homo sapiens
uguuauugccaau

SEQ ID NO: 1520023 - RNA, 17 nt, Homo sapiens
uguuauugccaauguuc

SEQ ID NO: 1520024 - RNA, 23 nt, Homo sapiens
uguucccuauuuugccaguggga

SEQ ID NO: 1520025 - RNA, 21 nt, Homo sapiens
uuaaacccuauugguaaagaa

SEQ ID NO: 1520026 - RNA, 20 nt, Homo sapiens
uuaagaauguucuuauguug

SEQ ID NO: 1520027 - RNA, 19 nt, Homo sapiens
uuaagacuaaaaguugcau

SEQ ID NO: 1520028 - RNA, 19 nt, Homo sapiens
uuaagaguuguaugaacau

SEQ ID NO: 1520029 - RNA, 16 nt, Homo sapiens
uuaagggaauaagcca

SEQ ID NO: 1520030 - RNA, 14 nt, Homo sapiens
uuaauacucaugca

SEQ ID NO: 1520031 - RNA, 19 nt, Homo sapiens
uuacaguuuaucuauggca

SEQ ID NO: 1520032 - RNA, 19 nt, Homo sapiens
uuacauuugaaaucuauga

SEQ ID NO: 1520033 - RNA, 16 nt, Homo sapiens
uuaccuuuacauauua

SEQ ID NO: 1520034 - RNA, 13 nt, Homo sapiens
uuagauaaccaua

SEQ ID NO: 1520035 - RNA, 12 nt, Homo sapiens
uuagauucucau

SEQ ID NO: 1520036 - RNA, 18 nt, Homo sapiens
uuagucugucauccagaa

SEQ ID NO: 1520037 - RNA, 24 nt, Homo sapiens
uuauaaaagaugcauuaucuauga

SEQ ID NO: 1520038 - RNA, 14 nt, Homo sapiens
uuauauaauuuugc

SEQ ID NO: 1520039 - RNA, 19 nt, Homo sapiens
uuauauauuugauacauau

SEQ ID NO: 1520040 - RNA, 14 nt, Homo sapiens
uuauauucauucuu

SEQ ID NO: 1520041 - RNA, 13 nt, Homo sapiens
uuauuacugagag

SEQ ID NO: 1520042 - RNA, 20 nt, Homo sapiens
uuauugaagaugugaucaau

SEQ ID NO: 1520043 - RNA, 16 nt, Homo sapiens
uuauuuauuuauucau

SEQ ID NO: 1520044 - RNA, 12 nt, Homo sapiens
uucaaugaacaa

SEQ ID NO: 1520045 - RNA, 19 nt, Homo sapiens
uucacaauggaaacuuuag

SEQ ID NO: 1520046 - RNA, 16 nt, Homo sapiens
uucacuccaaagagaa

SEQ ID NO: 1520047 - RNA, 17 nt, Homo sapiens
uucauaaaucuauucau

SEQ ID NO: 1520048 - RNA, 15 nt, Homo sapiens
uucauaagucuuugg

SEQ ID NO: 1520049 - RNA, 23 nt, Homo sapiens
uucauaagucuuugguacaaguu

SEQ ID NO: 1520050 - RNA, 20 nt, Homo sapiens
uucauauauuuguaugaucc

SEQ ID NO: 1520051 - RNA, 15 nt, Homo sapiens
uucaucuauucuuuc

SEQ ID NO: 1520052 - RNA, 20 nt, Homo sapiens
uucaugguccgccugccuca

SEQ ID NO: 1520053 - RNA, 21 nt, Homo sapiens
uucauucaggcaacgcacaaa

SEQ ID NO: 1520054 - RNA, 22 nt, Homo sapiens
auauucacaauggaaacuuuag

SEQ ID NO: 1520055 - RNA, 13 nt, Homo sapiens
caucuuuaacaca

SEQ ID NO: 1520056 - RNA, 14 nt, Homo sapiens
caucuuuaacacaa

SEQ ID NO: 1520057 - RNA, 14 nt, Homo sapiens
caugaaauaaaaua

SEQ ID NO: 1520058 - RNA, 20 nt, Homo sapiens
cauguauuucuuacguacac

SEQ ID NO: 1520059 - RNA, 15 nt, Homo sapiens
caugugcucagggaa

SEQ ID NO: 1520060 - RNA, 14 nt, Homo sapiens
cauuaucuguauua

SEQ ID NO: 1520061 - RNA, 15 nt, Homo sapiens
cauucacgggacuag

SEQ ID NO: 1520062 - RNA, 20 nt, Homo sapiens
cauucuuuuugaaaugucaa

SEQ ID NO: 1520063 - RNA, 19 nt, Homo sapiens
cauuguucagaugcuucuu

SEQ ID NO: 1520064 - RNA, 12 nt, Homo sapiens
cauuucuuccac

SEQ ID NO: 1520065 - RNA, 23 nt, Homo sapiens
cauuugaaaucuaugaaauauca

SEQ ID NO: 1520066 - RNA, 20 nt, Homo sapiens
ccaaaggacccaaguacuuu

SEQ ID NO: 1520067 - RNA, 14 nt, Homo sapiens
ccaacaugugcuca

SEQ ID NO: 1520068 - RNA, 21 nt, Homo sapiens
ccacaaaugggaaaaccagac

SEQ ID NO: 1520069 - RNA, 12 nt, Homo sapiens
ccacccaugacc

SEQ ID NO: 1520070 - RNA, 16 nt, Homo sapiens
ccagcaugucacuccc

SEQ ID NO: 1520071 - RNA, 13 nt, Homo sapiens
ccaggcaugcaau

SEQ ID NO: 1520072 - RNA, 14 nt, Homo sapiens
ccaggcaugcaaug

SEQ ID NO: 1520073 - RNA, 20 nt, Homo sapiens
ccaggcuggagugcaguggc

SEQ ID NO: 1520074 - RNA, 13 nt, Homo sapiens
ccaggucagggag

SEQ ID NO: 1520075 - RNA, 13 nt, Homo sapiens
ccauuucuuccac

SEQ ID NO: 1520076 - RNA, 18 nt, Homo sapiens
cccagaaacaacacaauc

SEQ ID NO: 1520077 - RNA, 10 nt, Homo sapiens
cccagugugu

SEQ ID NO: 1520078 - RNA, 21 nt, Homo sapiens
cccaguguguuucugaucuga

SEQ ID NO: 1520079 - RNA, 20 nt, Homo sapiens
ccccaucugccacguguauu

SEQ ID NO: 1520080 - RNA, 19 nt, Homo sapiens
cccuauugguaaagaaugg

SEQ ID NO: 1520081 - RNA, 23 nt, Homo sapiens
cccucucuuucuaagagaccuga

SEQ ID NO: 1520082 - RNA, 12 nt, Homo sapiens
cccuguucuucg

SEQ ID NO: 1520083 - RNA, 22 nt, Homo sapiens
ccuauuucccuaccaaccaagg

SEQ ID NO: 1520084 - RNA, 17 nt, Homo sapiens
ccucaaagcauuugcaa

SEQ ID NO: 1520085 - RNA, 10 nt, Homo sapiens
ccucagggcu

SEQ ID NO: 1520086 - RNA, 16 nt, Homo sapiens
ccugccccugacugug

SEQ ID NO: 1520087 - RNA, 16 nt, Homo sapiens
ccugucuaaaaauuca

SEQ ID NO: 1520088 - RNA, 16 nt, Homo sapiens
ccuucuauauccucaa

SEQ ID NO: 1520089 - RNA, 14 nt, Homo sapiens
ccuugaugcucaua

SEQ ID NO: 1520090 - RNA, 15 nt, Homo sapiens
ccuuuuucacugugg

SEQ ID NO: 1520091 - RNA, 19 nt, Homo sapiens
cgagccaaguuaagaaugu

SEQ ID NO: 1520092 - RNA, 20 nt, Homo sapiens
cgcccaggcuggagugcagu

SEQ ID NO: 1520093 - RNA, 16 nt, Homo sapiens
cgugaaaaugcuguau

SEQ ID NO: 1520094 - RNA, 13 nt, Homo sapiens
cguuuaaucacau

SEQ ID NO: 1520095 - RNA, 12 nt, Homo sapiens
cguuugcuauau

SEQ ID NO: 1520096 - RNA, 22 nt, Homo sapiens
cuaaagaagguuucagaaagaa

SEQ ID NO: 1520097 - RNA, 22 nt, Homo sapiens
cuaaguucccuucuauauccuc

SEQ ID NO: 1520098 - RNA, 17 nt, Homo sapiens
cuagaagaaagggcaag

SEQ ID NO: 1520099 - RNA, 18 nt, Homo sapiens
cuaggacucugcacugaa

SEQ ID NO: 1520100 - RNA, 16 nt, Homo sapiens
cuauaacuauguugau

SEQ ID NO: 1520101 - RNA, 20 nt, Homo sapiens
cuauaacuauguugauaaaa

SEQ ID NO: 1520102 - RNA, 17 nt, Homo sapiens
cuauaccuuacugcaau

SEQ ID NO: 1520103 - RNA, 22 nt, Homo sapiens
cuauauuccuuuuucuaugaaa

SEQ ID NO: 1520104 - RNA, 16 nt, Homo sapiens
cuaugauaugcuaaua

SEQ ID NO: 1520105 - RNA, 16 nt, Homo sapiens
cuauggcacccaugca

SEQ ID NO: 1520106 - RNA, 20 nt, Homo sapiens
cuauggcacccaugcaccuu

SEQ ID NO: 1520107 - RNA, 16 nt, Homo sapiens
cucaaaaaaagggcaa

SEQ ID NO: 1520108 - RNA, 20 nt, Homo sapiens
cucaacauuggagacaucac

SEQ ID NO: 1520109 - RNA, 13 nt, Homo sapiens
cucaaucuccuga

SEQ ID NO: 1520110 - RNA, 12 nt, Homo sapiens
cucaaucucuga

SEQ ID NO: 1520111 - RNA, 23 nt, Homo sapiens
cucacuuguucucacugucuguu

SEQ ID NO: 1520112 - RNA, 20 nt, Homo sapiens
cucagccuccugaguagcug

SEQ ID NO: 1520113 - RNA, 18 nt, Homo sapiens
cucauuaccuugugcuaa

SEQ ID NO: 1520114 - RNA, 16 nt, Homo sapiens
cuccaaacuaaacccu

SEQ ID NO: 1520115 - RNA, 15 nt, Homo sapiens
cuccacccaugaccu

SEQ ID NO: 1520116 - RNA, 19 nt, Homo sapiens
cuccagaaagcucaucuca

SEQ ID NO: 1520117 - RNA, 21 nt, Homo sapiens
cuccagccagccaaauccauc

SEQ ID NO: 1520118 - RNA, 20 nt, Homo sapiens
cuccauuguucagaugcuuc

SEQ ID NO: 1520119 - RNA, 12 nt, Homo sapiens
cucccuaccuga

SEQ ID NO: 1520120 - RNA, 20 nt, Homo sapiens
cuccuaaacaaaaacacauu

SEQ ID NO: 1520121 - RNA, 22 nt, Homo sapiens
cuccuagacucacuuguucuca

SEQ ID NO: 1520122 - RNA, 19 nt, Homo sapiens
cucuaggacucugcacuga

SEQ ID NO: 1520123 - RNA, 11 nt, Homo sapiens
cucucuugccu

SEQ ID NO: 1520124 - RNA, 15 nt, Homo sapiens
cucugacucuugccu

SEQ ID NO: 1520125 - RNA, 11 nt, Homo sapiens
cucugcacuga

SEQ ID NO: 1520126 - RNA, 21 nt, Homo sapiens
cucuuaggcuaagagauguga

SEQ ID NO: 1520127 - RNA, 18 nt, Homo sapiens
cucuuuucccaccaacuc

SEQ ID NO: 1520128 - RNA, 16 nt, Homo sapiens
cugaaguaagcaaaga

SEQ ID NO: 1520129 - RNA, 17 nt, Homo sapiens
cugaaguaagcaaagac

SEQ ID NO: 1520130 - RNA, 16 nt, Homo sapiens
cugacuucucacuucc

SEQ ID NO: 1520131 - RNA, 19 nt, Homo sapiens
cugaggagccugcaacaug

SEQ ID NO: 1520132 - RNA, 22 nt, Homo sapiens
cugaggagccugcaacaugcca

SEQ ID NO: 1520133 - RNA, 13 nt, Homo sapiens
cugaugcaagcaa

SEQ ID NO: 1520134 - RNA, 13 nt, Homo sapiens
cugaugcuguaca

SEQ ID NO: 1520135 - RNA, 21 nt, Homo sapiens
cugcacacuguccuauuauau

SEQ ID NO: 1520136 - RNA, 22 nt, Homo sapiens
cugcaggcaaagugagacugac

SEQ ID NO: 1520137 - RNA, 17 nt, Homo sapiens
cugccucagccucccaa

SEQ ID NO: 1520138 - RNA, 20 nt, Homo sapiens
cugccuuccaggagcaauuu

SEQ ID NO: 1520139 - RNA, 14 nt, Homo sapiens
cugcucccacagaa

SEQ ID NO: 1520140 - RNA, 18 nt, Homo sapiens
cugcugugugaauuccca

SEQ ID NO: 1520141 - RNA, 17 nt, Homo sapiens
cugcuuuggaaaucaca

SEQ ID NO: 1520142 - RNA, 20 nt, Homo sapiens
cuggagugcaguggcacgau

SEQ ID NO: 1520143 - RNA, 16 nt, Homo sapiens
cugggcagacugcaaa

SEQ ID NO: 1520144 - RNA, 16 nt, Homo sapiens
cuguagagucacugac

SEQ ID NO: 1520145 - RNA, 17 nt, Homo sapiens
cuguagagucacugacc

SEQ ID NO: 1520146 - RNA, 12 nt, Homo sapiens
cuguuauugcca

SEQ ID NO: 1520147 - RNA, 18 nt, Homo sapiens
cuguugaauuucccacau

SEQ ID NO: 1520148 - RNA, 19 nt, Homo sapiens
cuuaauacucaugcauucu

SEQ ID NO: 1520149 - RNA, 21 nt, Homo sapiens
cuuaauuauugauguuuucau

SEQ ID NO: 1520150 - RNA, 21 nt, Homo sapiens
cuuacuaaaaaguauaaaaua

SEQ ID NO: 1520151 - RNA, 23 nt, Homo sapiens
cuucagaagucacacauuacaaa

SEQ ID NO: 1520152 - RNA, 11 nt, Homo sapiens
cuucauauaac

SEQ ID NO: 1520153 - RNA, 21 nt, Homo sapiens
cuucaugguccgccugccuca

SEQ ID NO: 1520154 - RNA, 18 nt, Homo sapiens
cuucccuucuuugcacuu

SEQ ID NO: 1520155 - RNA, 13 nt, Homo sapiens
cuuccuacuuugc

SEQ ID NO: 1520156 - RNA, 14 nt, Homo sapiens
cuucuaaucaaagc

SEQ ID NO: 1520157 - RNA, 17 nt, Homo sapiens
cuucuaaucaaagcuuu

SEQ ID NO: 1520158 - RNA, 21 nt, Homo sapiens
cuuggaaauuggaagagcaca

SEQ ID NO: 1520159 - RNA, 17 nt, Homo sapiens
cuugggagcaccgccug

SEQ ID NO: 1520160 - RNA, 16 nt, Homo sapiens
cuuuaggugccuccug

SEQ ID NO: 1520161 - RNA, 20 nt, Homo sapiens
cuuuaucuuuuaagcuaucu

SEQ ID NO: 1520162 - RNA, 22 nt, Homo sapiens
cuuuauuacaguuuaucuaugg

SEQ ID NO: 1520163 - RNA, 22 nt, Homo sapiens
cuuucuaagagaccugaacugg

SEQ ID NO: 1520164 - RNA, 14 nt, Homo sapiens
cuuugcuucucucc

SEQ ID NO: 1520165 - RNA, 21 nt, Homo sapiens
cuuugguacaaguuuacauga

SEQ ID NO: 1520166 - RNA, 14 nt, Homo sapiens
cuuuugcucccuac

SEQ ID NO: 1520167 - RNA, 13 nt, Homo sapiens
cuuuugugaacaa

SEQ ID NO: 1520168 - RNA, 18 nt, Homo sapiens
cuuuuuaccaaguacaaa

SEQ ID NO: 1520169 - RNA, 14 nt, Homo sapiens
cuuuuuuauacuca

SEQ ID NO: 1520170 - RNA, 19 nt, Homo sapiens
gaaaacuucacuccaaaga

SEQ ID NO: 1520171 - RNA, 21 nt, Homo sapiens
gaaaaugcuguauuagucaca

SEQ ID NO: 1520172 - RNA, 15 nt, Homo sapiens
gaaagucuaacuuuu

SEQ ID NO: 1520173 - RNA, 12 nt, Homo sapiens
gaaauaauguga

SEQ ID NO: 1520174 - RNA, 23 nt, Homo sapiens
gaaauacacagugcugaccagac

SEQ ID NO: 1520175 - RNA, 19 nt, Homo sapiens
cuuguaaggcauacugccu

SEQ ID NO: 1520176 - RNA, 18 nt, Homo sapiens
cuuguauagcaugaaaua

SEQ ID NO: 1520177 - RNA, 18 nt, Homo sapiens
cuuucuaagagaccugaa

SEQ ID NO: 1520178 - RNA, 22 nt, Homo sapiens
cuuugaaagaaauguacuacua

SEQ ID NO: 1520179 - RNA, 22 nt, Homo sapiens
cuuugaauauguaguaucuaua

SEQ ID NO: 1520180 - RNA, 16 nt, Homo sapiens
cuuuggaaauacacag

SEQ ID NO: 1520181 - RNA, 21 nt, Homo sapiens
cuuuuaaacccuauugguaaa

SEQ ID NO: 1520182 - RNA, 19 nt, Homo sapiens
cuuuugcauaagugcauga

SEQ ID NO: 1520183 - RNA, 18 nt, Homo sapiens
gaaacacugggcuucuag

SEQ ID NO: 1520184 - RNA, 21 nt, Homo sapiens
gaaacuaacuggugugaguca

SEQ ID NO: 1520185 - RNA, 14 nt, Homo sapiens
gaaagaagugggga

SEQ ID NO: 1520186 - RNA, 14 nt, Homo sapiens
gaaauaauucaaac

SEQ ID NO: 1520187 - RNA, 16 nt, Homo sapiens
gaaauaauucaaacac

SEQ ID NO: 1520188 - RNA, 14 nt, Homo sapiens
gaaauacauaugca

SEQ ID NO: 1520189 - RNA, 16 nt, Homo sapiens
gaaccaggcaacuugg

SEQ ID NO: 1520190 - RNA, 18 nt, Homo sapiens
gaaccugcccugcuccca

SEQ ID NO: 1520191 - RNA, 19 nt, Homo sapiens
gaacuguuuaacacuuuuu

SEQ ID NO: 1520192 - RNA, 21 nt, Homo sapiens
gaagaccucccuucaggugcc

SEQ ID NO: 1520193 - RNA, 16 nt, Homo sapiens
gaagagaaugugacag

SEQ ID NO: 1520194 - RNA, 18 nt, Homo sapiens
gaagaugugaucaauaga

SEQ ID NO: 1520195 - RNA, 17 nt, Homo sapiens
gaagcagauguggugau

SEQ ID NO: 1520196 - RNA, 19 nt, Homo sapiens
gaaguaagcaaagacuuuc

SEQ ID NO: 1520197 - RNA, 21 nt, Homo sapiens
gaaguaagcaaagacuuuccu

SEQ ID NO: 1520198 - RNA, 21 nt, Homo sapiens
gaagucaucuuagcuuuccac

SEQ ID NO: 1520199 - RNA, 13 nt, Homo sapiens
gaagugugugauc

SEQ ID NO: 1520200 - RNA, 16 nt, Homo sapiens
gaagugugugaucugu

SEQ ID NO: 1520201 - RNA, 14 nt, Homo sapiens
gaauaauccagaaa

SEQ ID NO: 1520202 - RNA, 20 nt, Homo sapiens
gaauguuuucaaauguucuc

SEQ ID NO: 1520203 - RNA, 22 nt, Homo sapiens
gaauuuaggguguuaaacuuuu

SEQ ID NO: 1520204 - RNA, 13 nt, Homo sapiens
gaauuucccacau

SEQ ID NO: 1520205 - RNA, 19 nt, Homo sapiens
gacagggccuagcuuucau

SEQ ID NO: 1520206 - RNA, 20 nt, Homo sapiens
gaccgugaccguuugcuaua

SEQ ID NO: 1520207 - RNA, 16 nt, Homo sapiens
gaccguuugcuauauu

SEQ ID NO: 1520208 - RNA, 20 nt, Homo sapiens
gaccguuugcuauauuccuu

SEQ ID NO: 1520209 - RNA, 14 nt, Homo sapiens
gacuacagccagaa

SEQ ID NO: 1520210 - RNA, 21 nt, Homo sapiens
gacuacaggcgccugccacaa

SEQ ID NO: 1520211 - RNA, 16 nt, Homo sapiens
gacucacuuguucuca

SEQ ID NO: 1520212 - RNA, 17 nt, Homo sapiens
gacucaucaauuuuguc

SEQ ID NO: 1520213 - RNA, 13 nt, Homo sapiens
gacucugcacuga

SEQ ID NO: 1520214 - RNA, 13 nt, Homo sapiens
gagaacuuuccau

SEQ ID NO: 1520215 - RNA, 20 nt, Homo sapiens
gagacugacaccucacugag

SEQ ID NO: 1520216 - RNA, 14 nt, Homo sapiens
gagcaauuugcaca

SEQ ID NO: 1520217 - RNA, 16 nt, Homo sapiens
gagcaccgccugugaa

SEQ ID NO: 1520218 - RNA, 16 nt, Homo sapiens
gaggagccugcaacau

SEQ ID NO: 1520219 - RNA, 11 nt, Homo sapiens
gagucacugac

SEQ ID NO: 1520220 - RNA, 16 nt, Homo sapiens
gaguuaguuugaguua

SEQ ID NO: 1520221 - RNA, 21 nt, Homo sapiens
gaguuugggaacugcaauaac

SEQ ID NO: 1520222 - RNA, 18 nt, Homo sapiens
gauaaaaagaaaugugau

SEQ ID NO: 1520223 - RNA, 17 nt, Homo sapiens
gauaguggggucagggc

SEQ ID NO: 1520224 - RNA, 16 nt, Homo sapiens
gauauauaggcuauuu

SEQ ID NO: 1520225 - RNA, 19 nt, Homo sapiens
gaucagaauuuuaccaaaa

SEQ ID NO: 1520226 - RNA, 22 nt, Homo sapiens
gaucucugcuuuggaaaucaca

SEQ ID NO: 1520227 - RNA, 17 nt, Homo sapiens
gaucugaugcaagcaag

SEQ ID NO: 1520228 - RNA, 16 nt, Homo sapiens
gcaaagacuuuccucu

SEQ ID NO: 1520229 - RNA, 20 nt, Homo sapiens
gcaacaugccagccacugug

SEQ ID NO: 1520230 - RNA, 21 nt, Homo sapiens
gcaacaugccagccacuguga

SEQ ID NO: 1520231 - RNA, 18 nt, Homo sapiens
gcaaucagcuaccauuca

SEQ ID NO: 1520232 - RNA, 13 nt, Homo sapiens
gcaauuugcacau

SEQ ID NO: 1520233 - RNA, 19 nt, Homo sapiens
gcacagcccacacaugaac

SEQ ID NO: 1520234 - RNA, 22 nt, Homo sapiens
gcacauuagccuaugugcaugc

SEQ ID NO: 1520235 - RNA, 15 nt, Homo sapiens
gcacuuauugaauau

SEQ ID NO: 1520236 - RNA, 23 nt, Homo sapiens
gcacuuuugaaauaaaguauuua

SEQ ID NO: 1520237 - RNA, 13 nt, Homo sapiens
gcagaacuuucac

SEQ ID NO: 1520238 - RNA, 22 nt, Homo sapiens
gcagauguggugauacugagau

SEQ ID NO: 1520239 - RNA, 23 nt, Homo sapiens
gcauaaaguaaauacaugcauau

SEQ ID NO: 1520240 - RNA, 19 nt, Homo sapiens
gcauacugccuuguuuaau

SEQ ID NO: 1520241 - RNA, 19 nt, Homo sapiens
gcauagaguucagacuuuu

SEQ ID NO: 1520242 - RNA, 22 nt, Homo sapiens
gcauuaucuaugauaugcuaau

SEQ ID NO: 1520243 - RNA, 17 nt, Homo sapiens
gcauuuucuucacuugc

SEQ ID NO: 1520244 - RNA, 15 nt, Homo sapiens
gccaauguacauacc

SEQ ID NO: 1520245 - RNA, 19 nt, Homo sapiens
gcccaggcuggagugcagu

SEQ ID NO: 1520246 - RNA, 20 nt, Homo sapiens
gcccaggcuggagugcagug

SEQ ID NO: 1520247 - RNA, 15 nt, Homo sapiens
gcccaguguguuucu

SEQ ID NO: 1520248 - RNA, 21 nt, Homo sapiens
gccucaugcugacuugcagag

SEQ ID NO: 1520249 - RNA, 14 nt, Homo sapiens
gccugccccugacu

SEQ ID NO: 1520250 - RNA, 14 nt, Homo sapiens
gccuguaaucccag

SEQ ID NO: 1520251 - RNA, 18 nt, Homo sapiens
gcuaagaaagcaagccaa

SEQ ID NO: 1520252 - RNA, 18 nt, Homo sapiens
gcucauauuguucccuau

SEQ ID NO: 1520253 - RNA, 20 nt, Homo sapiens
gcuccaucgcugucaucuca

SEQ ID NO: 1520254 - RNA, 13 nt, Homo sapiens
gcugucaucucag

SEQ ID NO: 1520255 - RNA, 16 nt, Homo sapiens
gcugugugaauuccca

SEQ ID NO: 1520256 - RNA, 14 nt, Homo sapiens
gcuuagaacaaagg

SEQ ID NO: 1520257 - RNA, 19 nt, Homo sapiens
gcuucacagaugugugauu

SEQ ID NO: 1520258 - RNA, 17 nt, Homo sapiens
gcuucuagaaccaggca

SEQ ID NO: 1520259 - RNA, 22 nt, Homo sapiens
gcuucucuccacccaugaccuu

SEQ ID NO: 1520260 - RNA, 21 nt, Homo sapiens
gcuucuucuucaagauuuaug

SEQ ID NO: 1520261 - RNA, 15 nt, Homo sapiens
ggaaaaaaacaugaa

SEQ ID NO: 1520262 - RNA, 13 nt, Homo sapiens
ggaaaacaguauu

SEQ ID NO: 1520263 - RNA, 13 nt, Homo sapiens
ggaacugcaauaa

SEQ ID NO: 1520264 - RNA, 18 nt, Homo sapiens
ggacuaggguaaucugac

SEQ ID NO: 1520265 - RNA, 21 nt, Homo sapiens
ggacuauggcucuacuuucag

SEQ ID NO: 1520266 - RNA, 16 nt, Homo sapiens
ggcaacgcacaaaaca

SEQ ID NO: 1520267 - RNA, 13 nt, Homo sapiens
gggaaaaccagac

SEQ ID NO: 1520268 - RNA, 20 nt, Homo sapiens
gggagacggagguugcagug

SEQ ID NO: 1520269 - RNA, 21 nt, Homo sapiens
guguugaagaagaguuugcaa

SEQ ID NO: 1520270 - RNA, 16 nt, Homo sapiens
guuagauucucauuca

SEQ ID NO: 1520271 - RNA, 13 nt, Homo sapiens
guuaugacuguga

SEQ ID NO: 1520272 - RNA, 18 nt, Homo sapiens
guuauuaccuuuacauau

SEQ ID NO: 1520273 - RNA, 12 nt, Homo sapiens
guuauugccaau

SEQ ID NO: 1520274 - RNA, 21 nt, Homo sapiens
guucaaucuggauucauauuu

SEQ ID NO: 1520275 - RNA, 14 nt, Homo sapiens
guucacaccauucu

SEQ ID NO: 1520276 - RNA, 23 nt, Homo sapiens
guugaauuucccacauacccucc

SEQ ID NO: 1520277 - RNA, 22 nt, Homo sapiens
guugcaaacccaaaggacccaa

SEQ ID NO: 1520278 - RNA, 20 nt, Homo sapiens
guuucugaucugaugcaagc

SEQ ID NO: 1520279 - RNA, 21 nt, Homo sapiens
guuuuacaguguuucuggcuu

SEQ ID NO: 1520280 - RNA, 21 nt, Homo sapiens
guuuucuuuuucagauuuaug

SEQ ID NO: 1520281 - RNA, 17 nt, Homo sapiens
uaaaaagaaaugugauu

SEQ ID NO: 1520282 - RNA, 20 nt, Homo sapiens
uaaaacauugguuauauuac

SEQ ID NO: 1520283 - RNA, 14 nt, Homo sapiens
uaaaagguauugag

SEQ ID NO: 1520284 - RNA, 18 nt, Homo sapiens
uaaacuuuuuaccaagua

SEQ ID NO: 1520285 - RNA, 22 nt, Homo sapiens
uaaagaugcccuaaguguugaa

SEQ ID NO: 1520286 - RNA, 16 nt, Homo sapiens
uaaagcaggugcccag

SEQ ID NO: 1520287 - RNA, 20 nt, Homo sapiens
uaaaguaaauacaugcauau

SEQ ID NO: 1520288 - RNA, 23 nt, Homo sapiens
uaaaucaaucuuauuacugagag

SEQ ID NO: 1520289 - RNA, 14 nt, Homo sapiens
uaaaucaaugcuau

SEQ ID NO: 1520290 - RNA, 15 nt, Homo sapiens
uaaaucaaugcuaua

SEQ ID NO: 1520291 - RNA, 19 nt, Homo sapiens
uaaaucauucuuacuaaaa

SEQ ID NO: 1520292 - RNA, 19 nt, Homo sapiens
uaaaucuauucauaagucu

SEQ ID NO: 1520293 - RNA, 20 nt, Homo sapiens
uaacauuuacuuuugcuccc

SEQ ID NO: 1520294 - RNA, 19 nt, Homo sapiens
uaagaacuaaaauguucua

SEQ ID NO: 1520295 - RNA, 22 nt, Homo sapiens
uaagacaaauauuccuuugcau

SEQ ID NO: 1520296 - RNA, 15 nt, Homo sapiens
uaauacacauaucua

SEQ ID NO: 1520297 - RNA, 22 nt, Homo sapiens
uaauauauguauaugcaauaua

SEQ ID NO: 1520298 - RNA, 15 nt, Homo sapiens
uaaugaaauggagga

SEQ ID NO: 1520299 - RNA, 13 nt, Homo sapiens
uaaugaaugcaua

SEQ ID NO: 1520300 - RNA, 10 nt, Homo sapiens
uaaugccuuc

SEQ ID NO: 1520301 - RNA, 21 nt, Homo sapiens
uaaugcuuuccucccuggcau

SEQ ID NO: 1520302 - RNA, 19 nt, Homo sapiens
uaauugacauacucaggau

SEQ ID NO: 1520303 - RNA, 17 nt, Homo sapiens
uaauuuugaacuguuua

SEQ ID NO: 1520304 - RNA, 19 nt, Homo sapiens
uacaagguauuuacacaua

SEQ ID NO: 1520305 - RNA, 17 nt, Homo sapiens
uacagccagaagcccau

SEQ ID NO: 1520306 - RNA, 21 nt, Homo sapiens
uacagccugccccugacugug

SEQ ID NO: 1520307 - RNA, 22 nt, Homo sapiens
uacagccugccccugacugugu

SEQ ID NO: 1520308 - RNA, 22 nt, Homo sapiens
uacauaugcagauacuuauuaa

SEQ ID NO: 1520309 - RNA, 12 nt, Homo sapiens
uaccaugcugaa

SEQ ID NO: 1520310 - RNA, 14 nt, Homo sapiens
uaccugacugccac

SEQ ID NO: 1520311 - RNA, 13 nt, Homo sapiens
uaccuugugcuaa

SEQ ID NO: 1520312 - RNA, 15 nt, Homo sapiens
uacguuaccaggcag

SEQ ID NO: 1520313 - RNA, 19 nt, Homo sapiens
uacuaaaaaguauaaaaua

SEQ ID NO: 1520314 - RNA, 12 nt, Homo sapiens
uacuuauuuucc

SEQ ID NO: 1520315 - RNA, 13 nt, Homo sapiens
uagagucacugac

SEQ ID NO: 1520316 - RNA, 17 nt, Homo sapiens
uagauaauaaaauugcu

SEQ ID NO: 1520317 - RNA, 14 nt, Homo sapiens
uagaugaaugucag

SEQ ID NO: 1520318 - RNA, 23 nt, Homo sapiens
uaggaagugaccgagucuaggaa

SEQ ID NO: 1520319 - RNA, 21 nt, Homo sapiens
uaggaggcucgaccaccucaa

SEQ ID NO: 1520320 - RNA, 23 nt, Homo sapiens
uaggcuaagagaugugacuacag

SEQ ID NO: 1520321 - RNA, 16 nt, Homo sapiens
uaguguccgaagaccg

SEQ ID NO: 1520322 - RNA, 16 nt, Homo sapiens
uauaacuauguugaua

SEQ ID NO: 1520323 - RNA, 19 nt, Homo sapiens
uauaaugggauauaguuua

SEQ ID NO: 1520324 - RNA, 16 nt, Homo sapiens
uauauguauaugcaau

SEQ ID NO: 1520325 - RNA, 15 nt, Homo sapiens
uauauuugauacaua

SEQ ID NO: 1520326 - RNA, 21 nt, Homo sapiens
uauauuuucccucucuugccu

SEQ ID NO: 1520327 - RNA, 14 nt, Homo sapiens
uauccaacaugugc

SEQ ID NO: 1520328 - RNA, 18 nt, Homo sapiens
uaucuccugucuacaguu

SEQ ID NO: 1520329 - RNA, 15 nt, Homo sapiens
uaugaacuugcaaac

SEQ ID NO: 1520330 - RNA, 13 nt, Homo sapiens
uaugcagauacuu

SEQ ID NO: 1520331 - RNA, 20 nt, Homo sapiens
uaugucacccaaugcauauc

SEQ ID NO: 1520332 - RNA, 17 nt, Homo sapiens
uauguugcccagugugu

SEQ ID NO: 1520333 - RNA, 20 nt, Homo sapiens
uauuacaguuuaucuauggc

SEQ ID NO: 1520334 - RNA, 17 nt, Homo sapiens
uauuauugaagauguga

SEQ ID NO: 1520335 - RNA, 18 nt, Homo sapiens
uauucagugguccaggau

SEQ ID NO: 1520336 - RNA, 22 nt, Homo sapiens
uauugucuuccuguaagaccuu

SEQ ID NO: 1520337 - RNA, 22 nt, Homo sapiens
uauuuauugucuuccuguaaga

SEQ ID NO: 1520338 - RNA, 15 nt, Homo sapiens
uauuugauacauaua

SEQ ID NO: 1520339 - RNA, 20 nt, Homo sapiens
uauuugcacaaguucaguga

SEQ ID NO: 1520340 - RNA, 19 nt, Homo sapiens
uauuuuguuggaguauuau

SEQ ID NO: 1520341 - RNA, 16 nt, Homo sapiens
ucaaagucauuaaaga

SEQ ID NO: 1520342 - RNA, 16 nt, Homo sapiens
ucaaguuggcuucuaa

SEQ ID NO: 1520343 - RNA, 20 nt, Homo sapiens
ucaaguuggcuucuaaucaa

SEQ ID NO: 1520344 - RNA, 16 nt, Homo sapiens
ucaaucucugauucug

SEQ ID NO: 1520345 - RNA, 17 nt, Homo sapiens
ucacacauuacaaaguu

SEQ ID NO: 1520346 - RNA, 21 nt, Homo sapiens
ucacagagauaauucuagcuu

SEQ ID NO: 1520347 - RNA, 18 nt, Homo sapiens
ucacauucgaguguuuca

SEQ ID NO: 1520348 - RNA, 16 nt, Homo sapiens
ucaccaggucagggag

SEQ ID NO: 1520349 - RNA, 14 nt, Homo sapiens
ucacccaaugcaua

SEQ ID NO: 1520350 - RNA, 13 nt, Homo sapiens
ucacuugccaaug

SEQ ID NO: 1520351 - RNA, 20 nt, Homo sapiens
ucacuuguucucacugucug

SEQ ID NO: 1520352 - RNA, 15 nt, Homo sapiens
ucagcuaccauucaa

SEQ ID NO: 1520353 - RNA, 18 nt, Homo sapiens
ucagcuggaucuccauuc

SEQ ID NO: 1520354 - RNA, 17 nt, Homo sapiens
ucaggaguucgagacca

SEQ ID NO: 1520355 - RNA, 23 nt, Homo sapiens
ucaggugccgggcgcaggaacug

SEQ ID NO: 1520356 - RNA, 15 nt, Homo sapiens
ucauaaaucuauuca

SEQ ID NO: 1520357 - RNA, 21 nt, Homo sapiens
ucauaagucuuugguacaagu

SEQ ID NO: 1520358 - RNA, 14 nt, Homo sapiens
ucauuauguuaaua

SEQ ID NO: 1520359 - RNA, 15 nt, Homo sapiens
uccaacagacagggc

SEQ ID NO: 1520360 - RNA, 14 nt, Homo sapiens
uccaacaugugcuc

SEQ ID NO: 1520361 - RNA, 15 nt, Homo sapiens
uccacagucucuggg

SEQ ID NO: 1520362 - RNA, 16 nt, Homo sapiens
uccagggcaaggccau

SEQ ID NO: 1520363 - RNA, 17 nt, Homo sapiens
ucccagggcugaugcug

SEQ ID NO: 1520364 - RNA, 13 nt, Homo sapiens
ucccccagcacuu

SEQ ID NO: 1520365 - RNA, 17 nt, Homo sapiens
aaaaauaaagcacuuau

SEQ ID NO: 1520366 - RNA, 22 nt, Homo sapiens
aaaaauuacuguuuaauugaca

SEQ ID NO: 1520367 - RNA, 14 nt, Homo sapiens
aaaacauuccccaa

SEQ ID NO: 1520368 - RNA, 22 nt, Homo sapiens
aaaacuguggguagagacuuug

SEQ ID NO: 1520369 - RNA, 17 nt, Homo sapiens
aaaacuucacuccaaag

SEQ ID NO: 1520370 - RNA, 15 nt, Homo sapiens
aaaaugaaagccaaa

SEQ ID NO: 1520371 - RNA, 23 nt, Homo sapiens
aaaaugaagguggaacaagcaca

SEQ ID NO: 1520372 - RNA, 15 nt, Homo sapiens
aaacagaaauugcaa

SEQ ID NO: 1520373 - RNA, 16 nt, Homo sapiens
aaacagaaauugcaau

SEQ ID NO: 1520374 - RNA, 17 nt, Homo sapiens
aaacuaccuuccaguuc

SEQ ID NO: 1520375 - RNA, 22 nt, Homo sapiens
aaagaccuuuuccaugcacccu

SEQ ID NO: 1520376 - RNA, 15 nt, Homo sapiens
aaagcaggugcccag

SEQ ID NO: 1520377 - RNA, 16 nt, Homo sapiens
aaaguauaaaauagua

SEQ ID NO: 1520378 - RNA, 18 nt, Homo sapiens
aaaugggaaaaccagacu

SEQ ID NO: 1520379 - RNA, 16 nt, Homo sapiens
aaauuuuuguuuauaa

SEQ ID NO: 1520380 - RNA, 19 nt, Homo sapiens
aacagauauuuuuaacuua

SEQ ID NO: 1520381 - RNA, 21 nt, Homo sapiens
aacaggcugauaccuuuguga

SEQ ID NO: 1520382 - RNA, 15 nt, Homo sapiens
caaagagaaaccuau

SEQ ID NO: 1520383 - RNA, 17 nt, Homo sapiens
caaauauuauucuuaau

SEQ ID NO: 1520384 - RNA, 14 nt, Homo sapiens
caaauucacuuuau

SEQ ID NO: 1520385 - RNA, 16 nt, Homo sapiens
caaauucacuuuauua

SEQ ID NO: 1520386 - RNA, 17 nt, Homo sapiens
caaauuguacaagguau

SEQ ID NO: 1520387 - RNA, 23 nt, Homo sapiens
caaauuguacaagguauuuacac

SEQ ID NO: 1520388 - RNA, 19 nt, Homo sapiens
caacaugccagccacugug

SEQ ID NO: 1520389 - RNA, 17 nt, Homo sapiens
caacaugugcucaggga

SEQ ID NO: 1520390 - RNA, 20 nt, Homo sapiens
caacccaauaguuguugauu

SEQ ID NO: 1520391 - RNA, 15 nt, Homo sapiens
caacugccaaucaag

SEQ ID NO: 1520392 - RNA, 11 nt, Homo sapiens
caaguacaaaa

SEQ ID NO: 1520393 - RNA, 19 nt, Homo sapiens
caaguacuuuccaaucuca

SEQ ID NO: 1520394 - RNA, 15 nt, Homo sapiens
caagugaacauuaca

SEQ ID NO: 1520395 - RNA, 22 nt, Homo sapiens
caagugaacauuacauugccau

SEQ ID NO: 1520396 - RNA, 15 nt, Homo sapiens
caauaguuguugauu

SEQ ID NO: 1520397 - RNA, 16 nt, Homo sapiens
caaugagaucauugug

SEQ ID NO: 1520398 - RNA, 21 nt, Homo sapiens
caaugggaaaacuucacucca

SEQ ID NO: 1520399 - RNA, 19 nt, Homo sapiens
caaugguugaugauacuuc

SEQ ID NO: 1520400 - RNA, 23 nt, Homo sapiens
caauuuucuuuuuuauacucaau

SEQ ID NO: 1520401 - RNA, 14 nt, Homo sapiens
caauuuugucuauu

SEQ ID NO: 1520402 - RNA, 15 nt, Homo sapiens
caauuuugucuauua

SEQ ID NO: 1520403 - RNA, 17 nt, Homo sapiens
cacaauggaaacuuuag

SEQ ID NO: 1520404 - RNA, 16 nt, Homo sapiens
cacaccacaaauggga

SEQ ID NO: 1520405 - RNA, 16 nt, Homo sapiens
cacacuguccuauuau

SEQ ID NO: 1520406 - RNA, 16 nt, Homo sapiens
cacagaugugugauuc

SEQ ID NO: 1520407 - RNA, 20 nt, Homo sapiens
cacagucucugggagacuuu

SEQ ID NO: 1520408 - RNA, 12 nt, Homo sapiens
cacagugugaau

SEQ ID NO: 1520409 - RNA, 15 nt, Homo sapiens
cacauguaacauaga

SEQ ID NO: 1520410 - RNA, 18 nt, Homo sapiens
cacgucuggcuucacaga

SEQ ID NO: 1520411 - RNA, 14 nt, Homo sapiens
cacugggcuucuag

SEQ ID NO: 1520412 - RNA, 11 nt, Homo sapiens
cagaaacaaca

SEQ ID NO: 1520413 - RNA, 15 nt, Homo sapiens
cagaaggaaaggagg

SEQ ID NO: 1520414 - RNA, 18 nt, Homo sapiens
cagacuccuagacucacu

SEQ ID NO: 1520415 - RNA, 16 nt, Homo sapiens
cagacuuuugugaaca

SEQ ID NO: 1520416 - RNA, 21 nt, Homo sapiens
cagagauaauucuagcuuuga

SEQ ID NO: 1520417 - RNA, 21 nt, Homo sapiens
cagcaugauucuuccaaggaa

SEQ ID NO: 1520418 - RNA, 14 nt, Homo sapiens
cagccaacauggca

SEQ ID NO: 1520419 - RNA, 13 nt, Homo sapiens
caggaaacuaacu

SEQ ID NO: 1520420 - RNA, 16 nt, Homo sapiens
caggaaacuaacuggu

SEQ ID NO: 1520421 - RNA, 15 nt, Homo sapiens
caggacuuucccuga

SEQ ID NO: 1520422 - RNA, 17 nt, Homo sapiens
caggacuuucccugaca

SEQ ID NO: 1520423 - RNA, 17 nt, Homo sapiens
caggagacaaaagagca

SEQ ID NO: 1520424 - RNA, 23 nt, Homo sapiens
caggaguuggaagugugugaucu

SEQ ID NO: 1520425 - RNA, 18 nt, Homo sapiens
caggcaacgcacaaaaca

SEQ ID NO: 1520426 - RNA, 15 nt, Homo sapiens
caggccacauggcua

SEQ ID NO: 1520427 - RNA, 14 nt, Homo sapiens
caggcgccugccac

SEQ ID NO: 1520428 - RNA, 20 nt, Homo sapiens
caggcuggagugcaguggca

SEQ ID NO: 1520429 - RNA, 21 nt, Homo sapiens
caguccuuuaaauuuugcacu

SEQ ID NO: 1520430 - RNA, 15 nt, Homo sapiens
cagugccuauugaua

SEQ ID NO: 1520431 - RNA, 21 nt, Homo sapiens
caguggcacgaucucaacuca

SEQ ID NO: 1520432 - RNA, 12 nt, Homo sapiens
caguguguuucu

SEQ ID NO: 1520433 - RNA, 20 nt, Homo sapiens
caguguguuucugaucugau

SEQ ID NO: 1520434 - RNA, 13 nt, Homo sapiens
uucagaaagaagu

SEQ ID NO: 1520435 - RNA, 18 nt, Homo sapiens
uucaggcaacgcacaaaa

SEQ ID NO: 1520436 - RNA, 17 nt, Homo sapiens
uucagugagaaucugcu

SEQ ID NO: 1520437 - RNA, 17 nt, Homo sapiens
uucaguuauuugcacaa

SEQ ID NO: 1520438 - RNA, 19 nt, Homo sapiens
uucauaauuucuucacuca

SEQ ID NO: 1520439 - RNA, 16 nt, Homo sapiens
uucauauaacugagau

SEQ ID NO: 1520440 - RNA, 18 nt, Homo sapiens
uucauauauuuguaugau

SEQ ID NO: 1520441 - RNA, 16 nt, Homo sapiens
uuccucaaagcauuug

SEQ ID NO: 1520442 - RNA, 13 nt, Homo sapiens
uucuaaucaaagc

SEQ ID NO: 1520443 - RNA, 16 nt, Homo sapiens
uucugaucugaugcaa

SEQ ID NO: 1520444 - RNA, 14 nt, Homo sapiens
uucuuauuugcaau

SEQ ID NO: 1520445 - RNA, 17 nt, Homo sapiens
uucuucacucaaucucu

SEQ ID NO: 1520446 - RNA, 21 nt, Homo sapiens
uugaacugccaagaaaaggca

SEQ ID NO: 1520447 - RNA, 15 nt, Homo sapiens
uugaacuguuuaaca

SEQ ID NO: 1520448 - RNA, 15 nt, Homo sapiens
uugaauauuacugga

SEQ ID NO: 1520449 - RNA, 19 nt, Homo sapiens
uugagcuuaagaauuuuga

SEQ ID NO: 1520450 - RNA, 15 nt, Homo sapiens
uugaugacucaucaa

SEQ ID NO: 1520451 - RNA, 22 nt, Homo sapiens
uugcacagcccacacaugaacc

SEQ ID NO: 1520452 - RNA, 15 nt, Homo sapiens
uugcagcagaagcca

SEQ ID NO: 1520453 - RNA, 21 nt, Homo sapiens
uugcauugucuuuaauauaau

SEQ ID NO: 1520454 - RNA, 12 nt, Homo sapiens
uugcuauauucc

SEQ ID NO: 1520455 - RNA, 17 nt, Homo sapiens
uuggaaaauaaaucaau

SEQ ID NO: 1520456 - RNA, 21 nt, Homo sapiens
uuggaagggaguuggugugcu

SEQ ID NO: 1520457 - RNA, 19 nt, Homo sapiens
uuggaagugugugaucugu

SEQ ID NO: 1520458 - RNA, 13 nt, Homo sapiens
uugucuacacucu

SEQ ID NO: 1520459 - RNA, 21 nt, Homo sapiens
uugugaaguugcccaccaaaa

SEQ ID NO: 1520460 - RNA, 15 nt, Homo sapiens
uuguucagaugcuuc

SEQ ID NO: 1520461 - RNA, 17 nt, Homo sapiens
uuuaacuuaauggcaca

SEQ ID NO: 1520462 - RNA, 20 nt, Homo sapiens
uuuaagaucacgccacugga

SEQ ID NO: 1520463 - RNA, 21 nt, Homo sapiens
uuuaagcacccuagaggacua

SEQ ID NO: 1520464 - RNA, 21 nt, Homo sapiens
uuuaagcuaucuauaccuuac

SEQ ID NO: 1520465 - RNA, 15 nt, Homo sapiens
uuuaauuuugcagau

SEQ ID NO: 1520466 - RNA, 11 nt, Homo sapiens
uuuacaguguu

SEQ ID NO: 1520467 - RNA, 15 nt, Homo sapiens
uuuagaugaauguca

SEQ ID NO: 1520468 - RNA, 14 nt, Homo sapiens
uuuagugucucuaa

SEQ ID NO: 1520469 - RNA, 18 nt, Homo sapiens
uuuauaaaauugcuauaa

SEQ ID NO: 1520470 - RNA, 21 nt, Homo sapiens
uuuaucuauggcacccaugca

SEQ ID NO: 1520471 - RNA, 14 nt, Homo sapiens
uuucaccuucauau

SEQ ID NO: 1520472 - RNA, 16 nt, Homo sapiens
uuucaggccacauggc

SEQ ID NO: 1520473 - RNA, 22 nt, Homo sapiens
uuuccaugcacccucauacaca

SEQ ID NO: 1520474 - RNA, 20 nt, Homo sapiens
uuucguuugcauugucuuua

SEQ ID NO: 1520475 - RNA, 19 nt, Homo sapiens
uuugaauacaggcauagag

SEQ ID NO: 1520476 - RNA, 17 nt, Homo sapiens
uuugauacauauaauuc

SEQ ID NO: 1520477 - RNA, 19 nt, Homo sapiens
uuugcauaagugcaugaca

SEQ ID NO: 1520478 - RNA, 15 nt, Homo sapiens
uuugcuucucuccac

SEQ ID NO: 1520479 - RNA, 20 nt, Homo sapiens
uuuguaucauuaugaaguca

SEQ ID NO: 1520480 - RNA, 16 nt, Homo sapiens
uuugugcuucaaauga

SEQ ID NO: 1520481 - RNA, 20 nt, Homo sapiens
uuuguuuuguaucauuauga

SEQ ID NO: 1520482 - RNA, 17 nt, Homo sapiens
uuuuaacaacuaugauu

SEQ ID NO: 1520483 - RNA, 23 nt, Homo sapiens
uuuuggcaaugacucaaagucug

SEQ ID NO: 1520484 - RNA, 13 nt, Homo sapiens
ucccuaccugacu

SEQ ID NO: 1520485 - RNA, 19 nt, Homo sapiens
uccgucucaaaaaaagggc

SEQ ID NO: 1520486 - RNA, 21 nt, Homo sapiens
uccgucucaaaaaaagggcaa

SEQ ID NO: 1520487 - RNA, 17 nt, Homo sapiens
uccuacacaauggugcu

SEQ ID NO: 1520488 - RNA, 16 nt, Homo sapiens
uccuccgucugcaaug

SEQ ID NO: 1520489 - RNA, 17 nt, Homo sapiens
uccugaagagcauuugg

SEQ ID NO: 1520490 - RNA, 22 nt, Homo sapiens
uccuuugacuuauuguccccac

SEQ ID NO: 1520491 - RNA, 15 nt, Homo sapiens
ucguuugaaucacag

SEQ ID NO: 1520492 - RNA, 20 nt, Homo sapiens
ucuaaguuaugacugugaaa

SEQ ID NO: 1520493 - RNA, 14 nt, Homo sapiens
ucuacuccaauuca

SEQ ID NO: 1520494 - RNA, 19 nt, Homo sapiens
ucuagccuggcaacagagc

SEQ ID NO: 1520495 - RNA, 18 nt, Homo sapiens
ucuauaccuuacugcaau

SEQ ID NO: 1520496 - RNA, 23 nt, Homo sapiens
ucuaugaccucgcccuccacaaa

SEQ ID NO: 1520497 - RNA, 15 nt, Homo sapiens
ucuauucuuucccua

SEQ ID NO: 1520498 - RNA, 23 nt, Homo sapiens
ucucaauaaacuuuuaccacaaa

SEQ ID NO: 1520499 - RNA, 20 nt, Homo sapiens
ucuccagaaagcucaucuca

SEQ ID NO: 1520500 - RNA, 20 nt, Homo sapiens
ucucuagcugaucagaauuu

SEQ ID NO: 1520501 - RNA, 14 nt, Homo sapiens
ucucugcucuugcc

SEQ ID NO: 1520502 - RNA, 15 nt, Homo sapiens
ucucugggagacuuu

SEQ ID NO: 1520503 - RNA, 14 nt, Homo sapiens
ucugacucuugccu

SEQ ID NO: 1520504 - RNA, 13 nt, Homo sapiens
ucugaugcaagca

SEQ ID NO: 1520505 - RNA, 13 nt, Homo sapiens
ucuuaaugcuuuc

SEQ ID NO: 1520506 - RNA, 22 nt, Homo sapiens
ucuuacguacacuguacuucug

SEQ ID NO: 1520507 - RNA, 16 nt, Homo sapiens
ucuuagucgagccaag

SEQ ID NO: 1520508 - RNA, 15 nt, Homo sapiens
acaggagacaaaaga

SEQ ID NO: 1520509 - RNA, 23 nt, Homo sapiens
acaggcugauaccuuugugaagu

SEQ ID NO: 1520510 - RNA, 13 nt, Homo sapiens
acagguacaggcu

SEQ ID NO: 1520511 - RNA, 18 nt, Homo sapiens
acagucucugggagacuu

SEQ ID NO: 1520512 - RNA, 19 nt, Homo sapiens
acauagguuagauucucau

SEQ ID NO: 1520513 - RNA, 23 nt, Homo sapiens
acauccuccaauuccacagucuc

SEQ ID NO: 1520514 - RNA, 19 nt, Homo sapiens
acaugaauuucauugaacu

SEQ ID NO: 1520515 - RNA, 22 nt, Homo sapiens
acaugauaaaaagaaaugugau

SEQ ID NO: 1520516 - RNA, 14 nt, Homo sapiens
accagcaugucacu

SEQ ID NO: 1520517 - RNA, 19 nt, Homo sapiens
accgugaccguuugcuaua

SEQ ID NO: 1520518 - RNA, 23 nt, Homo sapiens
accguucauucaggcaacgcaca

SEQ ID NO: 1520519 - RNA, 19 nt, Homo sapiens
accucacugaggaagggag

SEQ ID NO: 1520520 - RNA, 13 nt, Homo sapiens
accugacugccac

SEQ ID NO: 1520521 - RNA, 16 nt, Homo sapiens
accuguuauugccaau

SEQ ID NO: 1520522 - RNA, 22 nt, Homo sapiens
accuuacauuugaaaucuauga

SEQ ID NO: 1520523 - RNA, 16 nt, Homo sapiens
accuuguuauaugcag

SEQ ID NO: 1520524 - RNA, 14 nt, Homo sapiens
accuuuacauauua

SEQ ID NO: 1520525 - RNA, 18 nt, Homo sapiens
acuauggcucuacuuuca

SEQ ID NO: 1520526 - RNA, 21 nt, Homo sapiens
acucaaucucugauucuguca

SEQ ID NO: 1520527 - RNA, 14 nt, Homo sapiens
acuccuaaaucaag

SEQ ID NO: 1520528 - RNA, 14 nt, Homo sapiens
acucuugaacacaa

SEQ ID NO: 1520529 - RNA, 13 nt, Homo sapiens
acucuuuguucaa

SEQ ID NO: 1520530 - RNA, 19 nt, Homo sapiens
acugaauggcugaccugac

SEQ ID NO: 1520531 - RNA, 12 nt, Homo sapiens
acugcaagcucc

SEQ ID NO: 1520532 - RNA, 10 nt, Homo sapiens
acugcaauaa

SEQ ID NO: 1520533 - RNA, 16 nt, Homo sapiens
acugccacagaacugg

SEQ ID NO: 1520534 - RNA, 20 nt, Homo sapiens
acuguccuauuauauucauu

SEQ ID NO: 1520535 - RNA, 22 nt, Homo sapiens
acuguguguguccuacacaaug

SEQ ID NO: 1520536 - RNA, 12 nt, Homo sapiens
acuuaauacuca

SEQ ID NO: 1520537 - RNA, 22 nt, Homo sapiens
acuucauauaacugagaugaau

SEQ ID NO: 1520538 - RNA, 17 nt, Homo sapiens
acuuugcuucucuccac

SEQ ID NO: 1520539 - RNA, 18 nt, Homo sapiens
acuuuuaaugccuuccac

SEQ ID NO: 1520540 - RNA, 19 nt, Homo sapiens
agaaaaugaaaugcauauu

SEQ ID NO: 1520541 - RNA, 21 nt, Homo sapiens
agaaaccuauuaagucaucau

SEQ ID NO: 1520542 - RNA, 15 nt, Homo sapiens
agaaauugcaauaug

SEQ ID NO: 1520543 - RNA, 17 nt, Homo sapiens
agaacugggcaacuauu

SEQ ID NO: 1520544 - RNA, 22 nt, Homo sapiens
agaacugggcaacuauucauga

SEQ ID NO: 1520545 - RNA, 14 nt, Homo sapiens
agaagaguuugcaa

SEQ ID NO: 1520546 - RNA, 15 nt, Homo sapiens
agaauggaaggugga

SEQ ID NO: 1520547 - RNA, 15 nt, Homo sapiens
agaaugugacaggca

SEQ ID NO: 1520548 - RNA, 19 nt, Homo sapiens
agacaucacuugccaaugu

SEQ ID NO: 1520549 - RNA, 18 nt, Homo sapiens
agacaugagcauggcuga

SEQ ID NO: 1520550 - RNA, 16 nt, Homo sapiens
agaccucugugcacuu

SEQ ID NO: 1520551 - RNA, 15 nt, Homo sapiens
agacuaugucaccca

SEQ ID NO: 1520552 - RNA, 22 nt, Homo sapiens
agacucacuuguucucacuguc

SEQ ID NO: 1520553 - RNA, 17 nt, Homo sapiens
agacucccaagcuggac

SEQ ID NO: 1520554 - RNA, 14 nt, Homo sapiens
agagcaaacuuuag

SEQ ID NO: 1520555 - RNA, 21 nt, Homo sapiens
agaggagagagacuccagcug

SEQ ID NO: 1520556 - RNA, 16 nt, Homo sapiens
agaggcugugguggcu

SEQ ID NO: 1520557 - RNA, 19 nt, Homo sapiens
agagugcaaauuguacaag

SEQ ID NO: 1520558 - RNA, 12 nt, Homo sapiens
agaguuugcaaa

SEQ ID NO: 1520559 - RNA, 20 nt, Homo sapiens
agauaacaaucuguauauaa

SEQ ID NO: 1520560 - RNA, 12 nt, Homo sapiens
agaucacgccac

SEQ ID NO: 1520561 - RNA, 19 nt, Homo sapiens
agauccuuuaguccaccca

SEQ ID NO: 1520562 - RNA, 19 nt, Homo sapiens
agaucuuuuaaaaaggcag

SEQ ID NO: 1520563 - RNA, 13 nt, Homo sapiens
agaugaaugucag

SEQ ID NO: 1520564 - RNA, 19 nt, Homo sapiens
agaugcauuaucuaugaua

SEQ ID NO: 1520565 - RNA, 18 nt, Homo sapiens
agaugguggugagcacau

SEQ ID NO: 1520566 - RNA, 21 nt, Homo sapiens
agaugguggugagcacaucug

SEQ ID NO: 1520567 - RNA, 19 nt, Homo sapiens
agauguccuugaugcucau

SEQ ID NO: 1520568 - RNA, 22 nt, Homo sapiens
agaugugugauucacaguguga

SEQ ID NO: 1520569 - RNA, 12 nt, Homo sapiens
agcaaagacuuu

SEQ ID NO: 1520570 - RNA, 13 nt, Homo sapiens
agcaaagggcuca

SEQ ID NO: 1520571 - RNA, 19 nt, Homo sapiens
agcacaauuuauauuuucc

SEQ ID NO: 1520572 - RNA, 15 nt, Homo sapiens
agccaaguuaagaau

SEQ ID NO: 1520573 - RNA, 16 nt, Homo sapiens
agcccagggcacuuca

SEQ ID NO: 1520574 - RNA, 13 nt, Homo sapiens
agcucaucucagc

SEQ ID NO: 1520575 - RNA, 22 nt, Homo sapiens
agcugaagcccaugcuuuccca

SEQ ID NO: 1520576 - RNA, 21 nt, Homo sapiens
agcuggguuggaaaacaguau

SEQ ID NO: 1520577 - RNA, 22 nt, Homo sapiens
uucuacuuucaucuauucuuuc

SEQ ID NO: 1520578 - RNA, 22 nt, Homo sapiens
uucuccccucucuuucuaagag

SEQ ID NO: 1520579 - RNA, 13 nt, Homo sapiens
uucuccugccuca

SEQ ID NO: 1520580 - RNA, 14 nt, Homo sapiens
uucuccugccucag

SEQ ID NO: 1520581 - RNA, 16 nt, Homo sapiens
uucuuacuaaaaagua

SEQ ID NO: 1520582 - RNA, 17 nt, Homo sapiens
uucuuauguugcccagu

SEQ ID NO: 1520583 - RNA, 20 nt, Homo sapiens
uucuucaagauuuauggaaa

SEQ ID NO: 1520584 - RNA, 13 nt, Homo sapiens
uucuuuguauuau

SEQ ID NO: 1520585 - RNA, 13 nt, Homo sapiens
uugaaaaauugcc

SEQ ID NO: 1520586 - RNA, 16 nt, Homo sapiens
uugaauauuacuggau

SEQ ID NO: 1520587 - RNA, 14 nt, Homo sapiens
uugauacauauaau

SEQ ID NO: 1520588 - RNA, 14 nt, Homo sapiens
uugauaguauuuau

SEQ ID NO: 1520589 - RNA, 18 nt, Homo sapiens
uugcacugaggauauuca

SEQ ID NO: 1520590 - RNA, 20 nt, Homo sapiens
aagucuuugguacaaguuua

SEQ ID NO: 1520591 - RNA, 12 nt, Homo sapiens
aagugugugauc

SEQ ID NO: 1520592 - RNA, 19 nt, Homo sapiens
aaguucagugagaaucugc

SEQ ID NO: 1520593 - RNA, 22 nt, Homo sapiens
aaguucccuucuauauccucaa

SEQ ID NO: 1520594 - RNA, 14 nt, Homo sapiens
aaguuggcuucuaa

SEQ ID NO: 1520595 - RNA, 22 nt, Homo sapiens
aauaaauggaaugaaauaauuc

SEQ ID NO: 1520596 - RNA, 14 nt, Homo sapiens
aauaauaauuuucc

SEQ ID NO: 1520597 - RNA, 20 nt, Homo sapiens
aauaauccagaaaaacugug

SEQ ID NO: 1520598 - RNA, 14 nt, Homo sapiens
aauaauucaaacac

SEQ ID NO: 1520599 - RNA, 14 nt, Homo sapiens
aauaauuugccauu

SEQ ID NO: 1520600 - RNA, 21 nt, Homo sapiens
aauagauuguaauacacauau

SEQ ID NO: 1520601 - RNA, 14 nt, Homo sapiens
aauaucaaagucau

SEQ ID NO: 1520602 - RNA, 23 nt, Homo sapiens
aauaucccuuggacauuuuaugu

SEQ ID NO: 1520603 - RNA, 22 nt, Homo sapiens
aaucaaguuggcuucuaaucaa

SEQ ID NO: 1520604 - RNA, 19 nt, Homo sapiens
aauccauccugcucuucca

SEQ ID NO: 1520605 - RNA, 15 nt, Homo sapiens
aaucuaauguugucu

SEQ ID NO: 1520606 - RNA, 15 nt, Homo sapiens
aaucuccugacuuca

SEQ ID NO: 1520607 - RNA, 13 nt, Homo sapiens
aaucuggauucau

SEQ ID NO: 1520608 - RNA, 17 nt, Homo sapiens
aaucuuauuacugagag

SEQ ID NO: 1520609 - RNA, 13 nt, Homo sapiens
aaugaaagccaaa

SEQ ID NO: 1520610 - RNA, 14 nt, Homo sapiens
aaugacucaaaguc

SEQ ID NO: 1520611 - RNA, 15 nt, Homo sapiens
aaugauuucacagug

SEQ ID NO: 1520612 - RNA, 19 nt, Homo sapiens
aaugcauauccaacaugug

SEQ ID NO: 1520613 - RNA, 20 nt, Homo sapiens
aaugcauauccaacaugugc

SEQ ID NO: 1520614 - RNA, 22 nt, Homo sapiens
aaugcuugaauauuacuggaua

SEQ ID NO: 1520615 - RNA, 16 nt, Homo sapiens
aauguaauuuugaacu

SEQ ID NO: 1520616 - RNA, 14 nt, Homo sapiens
aauguacauaccuu

SEQ ID NO: 1520617 - RNA, 23 nt, Homo sapiens
aauguuaaguugauggugaugaa

SEQ ID NO: 1520618 - RNA, 13 nt, Homo sapiens
aauuacuguuuaa

SEQ ID NO: 1520619 - RNA, 12 nt, Homo sapiens
aauucacuuuau

SEQ ID NO: 1520620 - RNA, 15 nt, Homo sapiens
aauucauucuggucu

SEQ ID NO: 1520621 - RNA, 20 nt, Homo sapiens
aauuccacagucucugggag

SEQ ID NO: 1520622 - RNA, 17 nt, Homo sapiens
aauuugggagagccaua

SEQ ID NO: 1520623 - RNA, 13 nt, Homo sapiens
aauuuuaccaaaa

SEQ ID NO: 1520624 - RNA, 21 nt, Homo sapiens
aauuuugcagcagaagccaaa

SEQ ID NO: 1520625 - RNA, 17 nt, Homo sapiens
aauuuuuccgcucuuaa

SEQ ID NO: 1520626 - RNA, 18 nt, Homo sapiens
acaaaguuauauauuuau

SEQ ID NO: 1520627 - RNA, 12 nt, Homo sapiens
acaacucuuugu

SEQ ID NO: 1520628 - RNA, 13 nt, Homo sapiens
acaagguauuuac

SEQ ID NO: 1520629 - RNA, 15 nt, Homo sapiens
acaauagaaaccugu

SEQ ID NO: 1520630 - RNA, 22 nt, Homo sapiens
acacaugaaccauccuucccau

SEQ ID NO: 1520631 - RNA, 21 nt, Homo sapiens
acacugggcuucuagaaccag

SEQ ID NO: 1520632 - RNA, 19 nt, Homo sapiens
acagacagggccuagcuuu

SEQ ID NO: 1520633 - RNA, 17 nt, Homo sapiens
acagacuacagccagaa

SEQ ID NO: 1520634 - RNA, 17 nt, Homo sapiens
acagacuaugucaccca

SEQ ID NO: 1520635 - RNA, 22 nt, Homo sapiens
acagaucaagugaacauuacau

SEQ ID NO: 1520636 - RNA, 13 nt, Homo sapiens
acagcuguguacu

SEQ ID NO: 1520637 - RNA, 14 nt, Homo sapiens
acagucucugggag

SEQ ID NO: 1520638 - RNA, 15 nt, Homo sapiens
acaguguuucuggcu

SEQ ID NO: 1520639 - RNA, 18 nt, Homo sapiens
acauagguuagauucuca

SEQ ID NO: 1520640 - RNA, 18 nt, Homo sapiens
acaugccagccacuguga

SEQ ID NO: 1520641 - RNA, 16 nt, Homo sapiens
acauucgaguguuuca

SEQ ID NO: 1520642 - RNA, 11 nt, Homo sapiens
accaccucaac

SEQ ID NO: 1520643 - RNA, 13 nt, Homo sapiens
accaggucaggga

SEQ ID NO: 1520644 - RNA, 21 nt, Homo sapiens
accagguggaauuacuuaaau

SEQ ID NO: 1520645 - RNA, 18 nt, Homo sapiens
acccaauaguuguugauu

SEQ ID NO: 1520646 - RNA, 11 nt, Homo sapiens
accucagggcu

SEQ ID NO: 1520647 - RNA, 22 nt, Homo sapiens
accucagggcuguguguacuaa

SEQ ID NO: 1520648 - RNA, 16 nt, Homo sapiens
accugauguccauuca

SEQ ID NO: 1520649 - RNA, 15 nt, Homo sapiens
accuguuauugccaa

SEQ ID NO: 1520650 - RNA, 18 nt, Homo sapiens
acuaaaaguugcauuuua

SEQ ID NO: 1520651 - RNA, 16 nt, Homo sapiens
acuaggguaaucugac

SEQ ID NO: 1520652 - RNA, 23 nt, Homo sapiens
acuaggguaaucugacuucucac

SEQ ID NO: 1520653 - RNA, 15 nt, Homo sapiens
acucacuuguucuca

SEQ ID NO: 1520654 - RNA, 19 nt, Homo sapiens
acuccaaagagaaaccuau

SEQ ID NO: 1520655 - RNA, 14 nt, Homo sapiens
acucugcacugaau

SEQ ID NO: 1520656 - RNA, 17 nt, Homo sapiens
acugacaccucacugag

SEQ ID NO: 1520657 - RNA, 14 nt, Homo sapiens
acugcacucuagcc

SEQ ID NO: 1520658 - RNA, 16 nt, Homo sapiens
acugucuaugaacuug

SEQ ID NO: 1520659 - RNA, 22 nt, Homo sapiens
acuguggccaucaggacuuucc

SEQ ID NO: 1520660 - RNA, 15 nt, Homo sapiens
acuguguguguccua

SEQ ID NO: 1520661 - RNA, 17 nt, Homo sapiens
acuguguguguccuaca

SEQ ID NO: 1520662 - RNA, 13 nt, Homo sapiens
acuuaauacucau

SEQ ID NO: 1520663 - RNA, 22 nt, Homo sapiens
acuucaaggguuuguugaacaa

SEQ ID NO: 1520664 - RNA, 13 nt, Homo sapiens
acuugggaacuag

SEQ ID NO: 1520665 - RNA, 18 nt, Homo sapiens
acuuguauagcaugaaau

SEQ ID NO: 1520666 - RNA, 12 nt, Homo sapiens
acuuucccugac

SEQ ID NO: 1520667 - RNA, 17 nt, Homo sapiens
agaaagcucaucucagc

SEQ ID NO: 1520668 - RNA, 19 nt, Homo sapiens
agaaauguacuacuaaaga

SEQ ID NO: 1520669 - RNA, 10 nt, Homo sapiens
agaagaccuc

SEQ ID NO: 1520670 - RNA, 13 nt, Homo sapiens
agaaggagggaga

SEQ ID NO: 1520671 - RNA, 21 nt, Homo sapiens
agaauguuuucaaauguucuc

SEQ ID NO: 1520672 - RNA, 21 nt, Homo sapiens
agacauauucuuggagaacuu

SEQ ID NO: 1520673 - RNA, 18 nt, Homo sapiens
agacgggguuucacugug

SEQ ID NO: 1520674 - RNA, 20 nt, Homo sapiens
agacuccuagacucacuugu

SEQ ID NO: 1520675 - RNA, 16 nt, Homo sapiens
agacugacaccucacu

SEQ ID NO: 1520676 - RNA, 20 nt, Homo sapiens
agacuuugacucuccagaaa

SEQ ID NO: 1520677 - RNA, 13 nt, Homo sapiens
agauaaagaccuu

SEQ ID NO: 1520678 - RNA, 15 nt, Homo sapiens
agauaaccauauuca

SEQ ID NO: 1520679 - RNA, 21 nt, Homo sapiens
agauauuuuuaacuuaauggc

SEQ ID NO: 1520680 - RNA, 14 nt, Homo sapiens
agaugaaugggagu

SEQ ID NO: 1520681 - RNA, 10 nt, Homo sapiens
agaugcauua

SEQ ID NO: 1520682 - RNA, 15 nt, Homo sapiens
agcaaacuuuagugu

SEQ ID NO: 1520683 - RNA, 12 nt, Homo sapiens
agcacuucccac

SEQ ID NO: 1520684 - RNA, 17 nt, Homo sapiens
agcagcccagggcacuu

SEQ ID NO: 1520685 - RNA, 18 nt, Homo sapiens
agccaaauccauccugcu

SEQ ID NO: 1520686 - RNA, 19 nt, Homo sapiens
agccaugacgucaauagca

SEQ ID NO: 1520687 - RNA, 21 nt, Homo sapiens
agcccacacaugaaccauccu

SEQ ID NO: 1520688 - RNA, 13 nt, Homo sapiens
agcccaugcuuuc

SEQ ID NO: 1520689 - RNA, 17 nt, Homo sapiens
agccuggcaacagagca

SEQ ID NO: 1520690 - RNA, 18 nt, Homo sapiens
aggagggacaagaaucaa

SEQ ID NO: 1520691 - RNA, 18 nt, Homo sapiens
aggagggagagaacuuaa

SEQ ID NO: 1520692 - RNA, 15 nt, Homo sapiens
aggcugaaagacagg

SEQ ID NO: 1520693 - RNA, 15 nt, Homo sapiens
aggcugauaccuuug

SEQ ID NO: 1520694 - RNA, 20 nt, Homo sapiens
aggcuggagugcaguggcac

SEQ ID NO: 1520695 - RNA, 21 nt, Homo sapiens
agggcaagaaggaaauagcca

SEQ ID NO: 1520696 - RNA, 18 nt, Homo sapiens
agguggaacaagcacaga

SEQ ID NO: 1520697 - RNA, 17 nt, Homo sapiens
aguaagcaaagacuuuc

SEQ ID NO: 1520698 - RNA, 13 nt, Homo sapiens
aguagcagggaau

SEQ ID NO: 1520699 - RNA, 13 nt, Homo sapiens
agucacagagaua

SEQ ID NO: 1520700 - RNA, 20 nt, Homo sapiens
agucacagagauaauucuag

SEQ ID NO: 1520701 - RNA, 18 nt, Homo sapiens
agucucugacucuugccu

SEQ ID NO: 1520702 - RNA, 13 nt, Homo sapiens
agucuucuauuua

SEQ ID NO: 1520703 - RNA, 17 nt, Homo sapiens
agugccuauugauacuu

SEQ ID NO: 1520704 - RNA, 15 nt, Homo sapiens
agugcugaccagaca

SEQ ID NO: 1520705 - RNA, 21 nt, Homo sapiens
aguguaacgaugcacuuugga

SEQ ID NO: 1520706 - RNA, 19 nt, Homo sapiens
aguuagcuuuaagcacccu

SEQ ID NO: 1520707 - RNA, 18 nt, Homo sapiens
aguuggaagugugugauc

SEQ ID NO: 1520708 - RNA, 19 nt, Homo sapiens
aguuucugcauuucaagaa

SEQ ID NO: 1520709 - RNA, 12 nt, Homo sapiens
auaaaaguuauu

SEQ ID NO: 1520710 - RNA, 20 nt, Homo sapiens
auaaaaucucgguguucuau

SEQ ID NO: 1520711 - RNA, 13 nt, Homo sapiens
uugaaaucuauga

SEQ ID NO: 1520712 - RNA, 14 nt, Homo sapiens
uugaacacaaguuc

SEQ ID NO: 1520713 - RNA, 13 nt, Homo sapiens
uugaagaugugau

SEQ ID NO: 1520714 - RNA, 13 nt, Homo sapiens
uugaagauucuau

SEQ ID NO: 1520715 - RNA, 16 nt, Homo sapiens
uugacauacucaggau

SEQ ID NO: 1520716 - RNA, 12 nt, Homo sapiens
uugauugggaug

SEQ ID NO: 1520717 - RNA, 20 nt, Homo sapiens
uugcacaaguucagugagaa

SEQ ID NO: 1520718 - RNA, 11 nt, Homo sapiens
uugcucccuau

SEQ ID NO: 1520719 - RNA, 14 nt, Homo sapiens
uugcuucucuccac

SEQ ID NO: 1520720 - RNA, 12 nt, Homo sapiens
uuggaaaucaca

SEQ ID NO: 1520721 - RNA, 16 nt, Homo sapiens
uuggcuucuaaucaaa

SEQ ID NO: 1520722 - RNA, 15 nt, Homo sapiens
uugggaacugcaaua

SEQ ID NO: 1520723 - RNA, 21 nt, Homo sapiens
uugggagcaccgccugugaaa

SEQ ID NO: 1520724 - RNA, 21 nt, Homo sapiens
uugggauauucugaaacuuga

SEQ ID NO: 1520725 - RNA, 20 nt, Homo sapiens
uuuaagucucugacucuugc

SEQ ID NO: 1520726 - RNA, 23 nt, Homo sapiens
uuuacacauacaacuucauauaa

SEQ ID NO: 1520727 - RNA, 20 nt, Homo sapiens
uuuaccaaaauucagaacau

SEQ ID NO: 1520728 - RNA, 21 nt, Homo sapiens
uuuauaauauaaaucaaucuu

SEQ ID NO: 1520729 - RNA, 17 nt, Homo sapiens
uuuauuaaaauauuuca

SEQ ID NO: 1520730 - RNA, 21 nt, Homo sapiens
uuuauuacaguuuaucuaugg

SEQ ID NO: 1520731 - RNA, 23 nt, Homo sapiens
uuucacauagguuagauucucau

SEQ ID NO: 1520732 - RNA, 16 nt, Homo sapiens
uuucuaaagacuugua

SEQ ID NO: 1520733 - RNA, 16 nt, Homo sapiens
uuucugaucugaugca

SEQ ID NO: 1520734 - RNA, 13 nt, Homo sapiens
uuucugcauuuca

SEQ ID NO: 1520735 - RNA, 14 nt, Homo sapiens
uuucugcauuucaa

SEQ ID NO: 1520736 - RNA, 15 nt, Homo sapiens
uuugaaaucuaugaa

SEQ ID NO: 1520737 - RNA, 20 nt, Homo sapiens
uuugaagcagauguggugau

SEQ ID NO: 1520738 - RNA, 16 nt, Homo sapiens
uuugaaucacaguaua

SEQ ID NO: 1520739 - RNA, 15 nt, Homo sapiens
uuugauacauauaau

SEQ ID NO: 1520740 - RNA, 16 nt, Homo sapiens
uuugcagcagaagcca

SEQ ID NO: 1520741 - RNA, 20 nt, Homo sapiens
uuugggaacugcaauaaccu

SEQ ID NO: 1520742 - RNA, 20 nt, Homo sapiens
uuuuacaaauuuaauuuugc

SEQ ID NO: 1520743 - RNA, 15 nt, Homo sapiens
uuuucuagucuucau

SEQ ID NO: 1520744 - RNA, 15 nt, Homo sapiens
uuuucucugcauuua

SEQ ID NO: 1520745 - RNA, 20 nt, Homo sapiens
uuuugaaauaaaguauuuau

SEQ ID NO: 1520746 - RNA, 14 nt, Homo sapiens
uuuugaaaugucaa

SEQ ID NO: 1520747 - RNA, 15 nt, Homo sapiens
uuuugauaguauuua

SEQ ID NO: 1520748 - RNA, 21 nt, Homo sapiens
cuuuugcauaagugcaugaca

SEQ ID NO: 1520749 - RNA, 17 nt, Homo sapiens
gaaaacaguauuuucca

SEQ ID NO: 1520750 - RNA, 10 nt, Homo sapiens
gaaaauggaa

SEQ ID NO: 1520751 - RNA, 12 nt, Homo sapiens
gaaaauuccaau

SEQ ID NO: 1520752 - RNA, 12 nt, Homo sapiens
gaaauacauaug

SEQ ID NO: 1520753 - RNA, 21 nt, Homo sapiens
gaaauagccaccgucuacaga

SEQ ID NO: 1520754 - RNA, 12 nt, Homo sapiens
gaaaucaagggc

SEQ ID NO: 1520755 - RNA, 19 nt, Homo sapiens
gaaaucuaugaaauaucau

SEQ ID NO: 1520756 - RNA, 14 nt, Homo sapiens
gaaaugucuauguu

SEQ ID NO: 1520757 - RNA, 16 nt, Homo sapiens
gaacauuacauugcca

SEQ ID NO: 1520758 - RNA, 21 nt, Homo sapiens
gaaccugcccugcucccacag

SEQ ID NO: 1520759 - RNA, 15 nt, Homo sapiens
gaacgcgacuuccac

SEQ ID NO: 1520760 - RNA, 19 nt, Homo sapiens
gaacgcgacuuccacaaac

SEQ ID NO: 1520761 - RNA, 20 nt, Homo sapiens
gaacuagaagaaagggcaag

SEQ ID NO: 1520762 - RNA, 10 nt, Homo sapiens
gaacuuccuu

SEQ ID NO: 1520763 - RNA, 22 nt, Homo sapiens
gaagaacagauaaucccuguau

SEQ ID NO: 1520764 - RNA, 18 nt, Homo sapiens
gaagcccaugcuuuccca

SEQ ID NO: 1520765 - RNA, 12 nt, Homo sapiens
gaaggagggaga

SEQ ID NO: 1520766 - RNA, 18 nt, Homo sapiens
gaagggaguuggugugcu

SEQ ID NO: 1520767 - RNA, 21 nt, Homo sapiens
gaagggaguuggugugcuauu

SEQ ID NO: 1520768 - RNA, 22 nt, Homo sapiens
gaaggguucaccaggucaggga

SEQ ID NO: 1520769 - RNA, 14 nt, Homo sapiens
gaaguauguauauu

SEQ ID NO: 1520770 - RNA, 22 nt, Homo sapiens
gaaguugcccaccaaaacacag

SEQ ID NO: 1520771 - RNA, 13 nt, Homo sapiens
gaauaauccagaa

SEQ ID NO: 1520772 - RNA, 20 nt, Homo sapiens
gaaucagcaugauucuucca

SEQ ID NO: 1520773 - RNA, 15 nt, Homo sapiens
gaauguaugugcaca

SEQ ID NO: 1520774 - RNA, 23 nt, Homo sapiens
gacaggcacagaugaaugggagu

SEQ ID NO: 1520775 - RNA, 23 nt, Homo sapiens
gacccaaguacuuuccaaucuca

SEQ ID NO: 1520776 - RNA, 21 nt, Homo sapiens
gacuacagccugccccugacu

SEQ ID NO: 1520777 - RNA, 22 nt, Homo sapiens
gacuaugucacccaaugcauau

SEQ ID NO: 1520778 - RNA, 23 nt, Homo sapiens
gacucuccagaaagcucaucuca

SEQ ID NO: 1520779 - RNA, 17 nt, Homo sapiens
gacucuugccuuuccac

SEQ ID NO: 1520780 - RNA, 18 nt, Homo sapiens
gacuuucccugacagcug

SEQ ID NO: 1520781 - RNA, 20 nt, Homo sapiens
gacuuuuuuuaaauaguaaa

SEQ ID NO: 1520782 - RNA, 12 nt, Homo sapiens
gagaaagugacc

SEQ ID NO: 1520783 - RNA, 23 nt, Homo sapiens
gagaacaaaacaguccuuuaaau

SEQ ID NO: 1520784 - RNA, 15 nt, Homo sapiens
gagcagaacuuucac

SEQ ID NO: 1520785 - RNA, 12 nt, Homo sapiens
gagccuggacaa

SEQ ID NO: 1520786 - RNA, 19 nt, Homo sapiens
gaguacucuugaacacaag

SEQ ID NO: 1520787 - RNA, 14 nt, Homo sapiens
gaguuggugugcua

SEQ ID NO: 1520788 - RNA, 15 nt, Homo sapiens
gaguuggugugcuau

SEQ ID NO: 1520789 - RNA, 15 nt, Homo sapiens
gaugcuguacaggua

SEQ ID NO: 1520790 - RNA, 19 nt, Homo sapiens
gaugucacgucuugaaaag

SEQ ID NO: 1520791 - RNA, 14 nt, Homo sapiens
gauguggugauacu

SEQ ID NO: 1520792 - RNA, 13 nt, Homo sapiens
gauugucuguuca

SEQ ID NO: 1520793 - RNA, 14 nt, Homo sapiens
gcaagaaacacugg

SEQ ID NO: 1520794 - RNA, 21 nt, Homo sapiens
gcaagcaagaaacacugggcu

SEQ ID NO: 1520795 - RNA, 21 nt, Homo sapiens
gcaauaaaugcccucucugaa

SEQ ID NO: 1520796 - RNA, 17 nt, Homo sapiens
gcaccaaauucauguac

SEQ ID NO: 1520797 - RNA, 18 nt, Homo sapiens
gcagacauguauuucuua

SEQ ID NO: 1520798 - RNA, 14 nt, Homo sapiens
gcagcagaagccaa

SEQ ID NO: 1520799 - RNA, 21 nt, Homo sapiens
gcaguguaacgaugcacuuug

SEQ ID NO: 1520800 - RNA, 18 nt, Homo sapiens
gcauagaguucagacuuu

SEQ ID NO: 1520801 - RNA, 16 nt, Homo sapiens
gcauucagccaggaga

SEQ ID NO: 1520802 - RNA, 21 nt, Homo sapiens
gccacuggacugucuaugaac

SEQ ID NO: 1520803 - RNA, 16 nt, Homo sapiens
gccuaggaggccuucu

SEQ ID NO: 1520804 - RNA, 14 nt, Homo sapiens
gccuauaaucccag

SEQ ID NO: 1520805 - RNA, 14 nt, Homo sapiens
gccuaugugcaugc

SEQ ID NO: 1520806 - RNA, 19 nt, Homo sapiens
gccugcccccagcacuccu

SEQ ID NO: 1520807 - RNA, 13 nt, Homo sapiens
gccuguaauccca

SEQ ID NO: 1520808 - RNA, 21 nt, Homo sapiens
gccuuccaggagcaauuugca

SEQ ID NO: 1520809 - RNA, 19 nt, Homo sapiens
gccuuuccaccugcuuucu

SEQ ID NO: 1520810 - RNA, 19 nt, Homo sapiens
gccuuucuuauuugcaaua

SEQ ID NO: 1520811 - RNA, 17 nt, Homo sapiens
gcggauccaagcaaaug

SEQ ID NO: 1520812 - RNA, 14 nt, Homo sapiens
gcuaggaagugacc

SEQ ID NO: 1520813 - RNA, 17 nt, Homo sapiens
gcuauaacuauguugau

SEQ ID NO: 1520814 - RNA, 23 nt, Homo sapiens
gcuauucugugucaaacaccucu

SEQ ID NO: 1520815 - RNA, 19 nt, Homo sapiens
gcucagggaauaauccaga

SEQ ID NO: 1520816 - RNA, 10 nt, Homo sapiens
gcucuugccu

SEQ ID NO: 1520817 - RNA, 20 nt, Homo sapiens
gcugaaaacugcaacuugua

SEQ ID NO: 1520818 - RNA, 14 nt, Homo sapiens
uauuugcacaaguu

SEQ ID NO: 1520819 - RNA, 19 nt, Homo sapiens
uauuuucccucucuugccu

SEQ ID NO: 1520820 - RNA, 22 nt, Homo sapiens
uauuuugccagugggaacuccu

SEQ ID NO: 1520821 - RNA, 22 nt, Homo sapiens
ucaaacgugaaaaugcuguauu

SEQ ID NO: 1520822 - RNA, 12 nt, Homo sapiens
ucaaauguucuc

SEQ ID NO: 1520823 - RNA, 21 nt, Homo sapiens
ucaaccccaaauuuuuacgua

SEQ ID NO: 1520824 - RNA, 13 nt, Homo sapiens
ucaacugccaauc

SEQ ID NO: 1520825 - RNA, 13 nt, Homo sapiens
ucaagacaccaaa

SEQ ID NO: 1520826 - RNA, 23 nt, Homo sapiens
ucaagugaacauuacauugccau

SEQ ID NO: 1520827 - RNA, 22 nt, Homo sapiens
ucaaguuggcuucuaaucaaag

SEQ ID NO: 1520828 - RNA, 15 nt, Homo sapiens
ucaauagauuguaau

SEQ ID NO: 1520829 - RNA, 19 nt, Homo sapiens
ucaaucuuauuacugagag

SEQ ID NO: 1520830 - RNA, 18 nt, Homo sapiens
ucacagaugugugauuca

SEQ ID NO: 1520831 - RNA, 19 nt, Homo sapiens
ucacauucgaguguuucag

SEQ ID NO: 1520832 - RNA, 18 nt, Homo sapiens
ucacucaaucucugauuc

SEQ ID NO: 1520833 - RNA, 16 nt, Homo sapiens
ucacuugccaauguac

SEQ ID NO: 1520834 - RNA, 15 nt, Homo sapiens
ucagaacauccucca

SEQ ID NO: 1520835 - RNA, 22 nt, Homo sapiens
ucagaccagguggaauuacuua

SEQ ID NO: 1520836 - RNA, 15 nt, Homo sapiens
ucagcuggaucucca

SEQ ID NO: 1520837 - RNA, 21 nt, Homo sapiens
ucagcuggaucuccauucucu

SEQ ID NO: 1520838 - RNA, 13 nt, Homo sapiens
ucaguuauuugca

SEQ ID NO: 1520839 - RNA, 23 nt, Homo sapiens
ucaguuguuauuuauugaaauga

SEQ ID NO: 1520840 - RNA, 16 nt, Homo sapiens
ucaguuuccccauuug

SEQ ID NO: 1520841 - RNA, 18 nt, Homo sapiens
ucauaauuucuucacuca

SEQ ID NO: 1520842 - RNA, 18 nt, Homo sapiens
ucauauguuuaugguaau

SEQ ID NO: 1520843 - RNA, 15 nt, Homo sapiens
ucaucuuagcuuucc

SEQ ID NO: 1520844 - RNA, 20 nt, Homo sapiens
ucaugguccgccugccucag

SEQ ID NO: 1520845 - RNA, 15 nt, Homo sapiens
ucauucacgggacua

SEQ ID NO: 1520846 - RNA, 18 nt, Homo sapiens
ucauucuggucuuugaaa

SEQ ID NO: 1520847 - RNA, 21 nt, Homo sapiens
ucauucuuuuugaaaugucaa

SEQ ID NO: 1520848 - RNA, 14 nt, Homo sapiens
ucauuuugcacuga

SEQ ID NO: 1520849 - RNA, 18 nt, Homo sapiens
uccaaacagaaaagugca

SEQ ID NO: 1520850 - RNA, 15 nt, Homo sapiens
uccaacaugugcuca

SEQ ID NO: 1520851 - RNA, 21 nt, Homo sapiens
uccaggagcaauuugcacaug

SEQ ID NO: 1520852 - RNA, 14 nt, Homo sapiens
uccauccugcucuu

SEQ ID NO: 1520853 - RNA, 14 nt, Homo sapiens
ucccagauguaaag

SEQ ID NO: 1520854 - RNA, 14 nt, Homo sapiens
ucccucucuugccu

SEQ ID NO: 1520855 - RNA, 23 nt, Homo sapiens
ucccugaaguaagcaaagacuuu

SEQ ID NO: 1520856 - RNA, 14 nt, Homo sapiens
ucccuucaggugcc

SEQ ID NO: 1520857 - RNA, 18 nt, Homo sapiens
ucccuucuuugcacuuuu

SEQ ID NO: 1520858 - RNA, 13 nt, Homo sapiens
uccgccugccuca

SEQ ID NO: 1520859 - RNA, 20 nt, Homo sapiens
uccuagacucacuuguucuc

SEQ ID NO: 1520860 - RNA, 15 nt, Homo sapiens
uccucaaagcauuug

SEQ ID NO: 1520861 - RNA, 23 nt, Homo sapiens
uccugagaggugcugcaggcaaa

SEQ ID NO: 1520862 - RNA, 13 nt, Homo sapiens
uccugcucuucca

SEQ ID NO: 1520863 - RNA, 19 nt, Homo sapiens
ucuaaaaauaguuaacaca

SEQ ID NO: 1520864 - RNA, 16 nt, Homo sapiens
ucuaaagagcaucuga

SEQ ID NO: 1520865 - RNA, 19 nt, Homo sapiens
ucuaugaaauaucaugcuc

SEQ ID NO: 1520866 - RNA, 14 nt, Homo sapiens
ucuaugaacuugca

SEQ ID NO: 1520867 - RNA, 15 nt, Homo sapiens
ucuaugaacuugcaa

SEQ ID NO: 1520868 - RNA, 16 nt, Homo sapiens
ucuauggcacccaugc

SEQ ID NO: 1520869 - RNA, 18 nt, Homo sapiens
ucuauuuuugaugacuca

SEQ ID NO: 1520870 - RNA, 16 nt, Homo sapiens
ucucaaaaaaagggca

SEQ ID NO: 1520871 - RNA, 22 nt, Homo sapiens
ucuccaaacuaaacccucacaa

SEQ ID NO: 1520872 - RNA, 16 nt, Homo sapiens
ucuccagaaagcucau

SEQ ID NO: 1520873 - RNA, 20 nt, Homo sapiens
ucuccagucauuauguuaau

SEQ ID NO: 1520874 - RNA, 22 nt, Homo sapiens
ucuccugggcccgcuuugccug

SEQ ID NO: 1520875 - RNA, 13 nt, Homo sapiens
ucuccugucuaca

SEQ ID NO: 1520876 - RNA, 19 nt, Homo sapiens
ucucgcauuuucucuagcu

SEQ ID NO: 1520877 - RNA, 20 nt, Homo sapiens
ucucuaaguuaugacuguga

SEQ ID NO: 1520878 - RNA, 16 nt, Homo sapiens
ucucugacucuugccu

SEQ ID NO: 1520879 - RNA, 16 nt, Homo sapiens
ucugcucucauauaag

SEQ ID NO: 1520880 - RNA, 15 nt, Homo sapiens
ucugucaaugucuug

SEQ ID NO: 1520881 - RNA, 17 nt, Homo sapiens
ucugucauccagaaaau

SEQ ID NO: 1520882 - RNA, 22 nt, Homo sapiens
ucuuauuuaauuuuugcaauua

SEQ ID NO: 1520883 - RNA, 18 nt, Homo sapiens
ucuuccuagugccuacaa

SEQ ID NO: 1520884 - RNA, 16 nt, Homo sapiens
ucuuuauaaugggaua

SEQ ID NO: 1520885 - RNA, 21 nt, Homo sapiens
ucuuuauaaugggauauaguu

SEQ ID NO: 1520886 - RNA, 18 nt, Homo sapiens
ucuuucuaagagaccuga

SEQ ID NO: 1520887 - RNA, 17 nt, Homo sapiens
ucuuugguacaaguuua

SEQ ID NO: 1520888 - RNA, 16 nt, Homo sapiens
ucuuuuaagcuaucua

SEQ ID NO: 1520889 - RNA, 14 nt, Homo sapiens
ugaaaauguggaca

SEQ ID NO: 1520890 - RNA, 13 nt, Homo sapiens
ugaaauaauucaa

SEQ ID NO: 1520891 - RNA, 16 nt, Homo sapiens
ugaaauaucaugcucc

SEQ ID NO: 1520892 - RNA, 12 nt, Homo sapiens
ugaaaugcauau

SEQ ID NO: 1520893 - RNA, 13 nt, Homo sapiens
ugaacauuacauu

SEQ ID NO: 1520894 - RNA, 14 nt, Homo sapiens
ugaagaugugauca

SEQ ID NO: 1520895 - RNA, 23 nt, Homo sapiens
ugaagucaugcguuuaaucacau

SEQ ID NO: 1520896 - RNA, 13 nt, Homo sapiens
ugaauauguagua

SEQ ID NO: 1520897 - RNA, 22 nt, Homo sapiens
ugaauguuugaacugccaagaa

SEQ ID NO: 1520898 - RNA, 15 nt, Homo sapiens
ugacaccucacugag

SEQ ID NO: 1520899 - RNA, 12 nt, Homo sapiens
ugacagaucucu

SEQ ID NO: 1520900 - RNA, 22 nt, Homo sapiens
ugacuugcagaguucauggaau

SEQ ID NO: 1520901 - RNA, 19 nt, Homo sapiens
ugagaggagagagacucca

SEQ ID NO: 1520902 - RNA, 23 nt, Homo sapiens
ugagaggagagagacuccagcug

SEQ ID NO: 1520903 - RNA, 14 nt, Homo sapiens
ugagagugcaaauu

SEQ ID NO: 1520904 - RNA, 15 nt, Homo sapiens
ugagaucauugugaa

SEQ ID NO: 1520905 - RNA, 16 nt, Homo sapiens
ugagcacaucugggag

SEQ ID NO: 1520906 - RNA, 12 nt, Homo sapiens
ugauacauauaa

SEQ ID NO: 1520907 - RNA, 20 nt, Homo sapiens
ugaucagaauuuuaccaaaa

SEQ ID NO: 1520908 - RNA, 20 nt, Homo sapiens
ugaugcaagcaagaaacacu

SEQ ID NO: 1520909 - RNA, 15 nt, Homo sapiens
ugaugcuguacaggu

SEQ ID NO: 1520910 - RNA, 13 nt, Homo sapiens
ugauucacagugu

SEQ ID NO: 1520911 - RNA, 19 nt, Homo sapiens
ugcaagcaagaaacacugg

SEQ ID NO: 1520912 - RNA, 19 nt, Homo sapiens
ugcaaucagcuaccauuca

SEQ ID NO: 1520913 - RNA, 21 nt, Homo sapiens
ugcaguguaacgaugcacuuu

SEQ ID NO: 1520914 - RNA, 22 nt, Homo sapiens
ugcaguguaacgaugcacuuug

SEQ ID NO: 1520915 - RNA, 20 nt, Homo sapiens
ugcauaaaauguuaaguuga

SEQ ID NO: 1520916 - RNA, 18 nt, Homo sapiens
ugcauaagugcaugacau

SEQ ID NO: 1520917 - RNA, 21 nt, Homo sapiens
ugcauauccaacaugugcuca

SEQ ID NO: 1520918 - RNA, 15 nt, Homo sapiens
ugcccuguccuccag

SEQ ID NO: 1520919 - RNA, 21 nt, Homo sapiens
ugccucauuaccuugugcuaa

SEQ ID NO: 1520920 - RNA, 22 nt, Homo sapiens
ugcuaauccucuuuuucuaguc

SEQ ID NO: 1520921 - RNA, 15 nt, Homo sapiens
ugcuucaaaugaucc

SEQ ID NO: 1520922 - RNA, 17 nt, Homo sapiens
ugcuucaggauccaagu

SEQ ID NO: 1520923 - RNA, 13 nt, Homo sapiens
uggaacaagcaca

SEQ ID NO: 1520924 - RNA, 16 nt, Homo sapiens
uggaagagcacaagag

SEQ ID NO: 1520925 - RNA, 19 nt, Homo sapiens
uggauaaauuguaugaaga

SEQ ID NO: 1520926 - RNA, 18 nt, Homo sapiens
uggaucuccauucucuca

SEQ ID NO: 1520927 - RNA, 15 nt, Homo sapiens
uggcacccaugcacc

SEQ ID NO: 1520928 - RNA, 23 nt, Homo sapiens
uggcuucacagaugugugauuca

SEQ ID NO: 1520929 - RNA, 11 nt, Homo sapiens
uggcuuugaaa

SEQ ID NO: 1520930 - RNA, 17 nt, Homo sapiens
ugggaacuccuaaauca

SEQ ID NO: 1520931 - RNA, 15 nt, Homo sapiens
ugggagcaccgccug

SEQ ID NO: 1520932 - RNA, 14 nt, Homo sapiens
ugggagugagggau

SEQ ID NO: 1520933 - RNA, 17 nt, Homo sapiens
ugggcaacuauucauga

SEQ ID NO: 1520934 - RNA, 11 nt, Homo sapiens
ugggcuucuag

SEQ ID NO: 1520935 - RNA, 22 nt, Homo sapiens
uggggacagagcagaacuuuca

SEQ ID NO: 1520936 - RNA, 15 nt, Homo sapiens
ugguacaaguuuaca

SEQ ID NO: 1520937 - RNA, 20 nt, Homo sapiens
ugguccuuagccccaucugc

SEQ ID NO: 1520938 - RNA, 22 nt, Homo sapiens
uggucucaaucuccugacuuca

SEQ ID NO: 1520939 - RNA, 17 nt, Homo sapiens
uggucuuugaaagaaau

SEQ ID NO: 1520940 - RNA, 14 nt, Homo sapiens
gaaaaauugccaau

SEQ ID NO: 1520941 - RNA, 19 nt, Homo sapiens
gaaaaauugccaauucuuu

SEQ ID NO: 1520942 - RNA, 15 nt, Homo sapiens
gaaaacugcaacuug

SEQ ID NO: 1520943 - RNA, 17 nt, Homo sapiens
gaaaaugaaaugcauau

SEQ ID NO: 1520944 - RNA, 23 nt, Homo sapiens
gaaauaaaguauuuaucuccugu

SEQ ID NO: 1520945 - RNA, 17 nt, Homo sapiens
gaaauaucaugcuccau

SEQ ID NO: 1520946 - RNA, 17 nt, Homo sapiens
gaaaugcauauuugcaa

SEQ ID NO: 1520947 - RNA, 19 nt, Homo sapiens
gaaaugugauuugucuucc

SEQ ID NO: 1520948 - RNA, 22 nt, Homo sapiens
gaacacaaguuccugauaacuu

SEQ ID NO: 1520949 - RNA, 15 nt, Homo sapiens
gaaccaggcaacuug

SEQ ID NO: 1520950 - RNA, 12 nt, Homo sapiens
gaaccucagggc

SEQ ID NO: 1520951 - RNA, 13 nt, Homo sapiens
gaacuagacuccc

SEQ ID NO: 1520952 - RNA, 17 nt, Homo sapiens
gaagagaaugugacagg

SEQ ID NO: 1520953 - RNA, 15 nt, Homo sapiens
gaagaugugaucaau

SEQ ID NO: 1520954 - RNA, 17 nt, Homo sapiens
gaagauucuauguuaau

SEQ ID NO: 1520955 - RNA, 19 nt, Homo sapiens
gaagggaguuggugugcua

SEQ ID NO: 1520956 - RNA, 15 nt, Homo sapiens
gaagucaugcguuua

SEQ ID NO: 1520957 - RNA, 22 nt, Homo sapiens
gacaaauauuccuuugcauauu

SEQ ID NO: 1520958 - RNA, 19 nt, Homo sapiens
gacagagcagaacuuucac

SEQ ID NO: 1520959 - RNA, 18 nt, Homo sapiens
gacauuuuaugucuuucu

SEQ ID NO: 1520960 - RNA, 17 nt, Homo sapiens
gaccagcccagccaaca

SEQ ID NO: 1520961 - RNA, 20 nt, Homo sapiens
gaccugauguccauucaucc

SEQ ID NO: 1520962 - RNA, 16 nt, Homo sapiens
gaccuuuuucacugug

SEQ ID NO: 1520963 - RNA, 22 nt, Homo sapiens
gacgaguacucuugaacacaag

SEQ ID NO: 1520964 - RNA, 20 nt, Homo sapiens
gacuaggguaaucugacuuc

SEQ ID NO: 1520965 - RNA, 22 nt, Homo sapiens
gacucacuuguucucacugucu

SEQ ID NO: 1520966 - RNA, 16 nt, Homo sapiens
gacugucuaugaacuu

SEQ ID NO: 1520967 - RNA, 17 nt, Homo sapiens
gacuuccacaaaccugg

SEQ ID NO: 1520968 - RNA, 12 nt, Homo sapiens
gacuuucccuga

SEQ ID NO: 1520969 - RNA, 18 nt, Homo sapiens
gagacaucacuugccaau

SEQ ID NO: 1520970 - RNA, 18 nt, Homo sapiens
gagaccagcccagccaac

SEQ ID NO: 1520971 - RNA, 15 nt, Homo sapiens
gagacugcugaguca

SEQ ID NO: 1520972 - RNA, 19 nt, Homo sapiens
gagagaacuuaaaaaagca

SEQ ID NO: 1520973 - RNA, 18 nt, Homo sapiens
gagaggggagaauggagu

SEQ ID NO: 1520974 - RNA, 18 nt, Homo sapiens
gagauaauucuagcuuug

SEQ ID NO: 1520975 - RNA, 19 nt, Homo sapiens
gagcaauuugcacauguaa

SEQ ID NO: 1520976 - RNA, 15 nt, Homo sapiens
gagcacaucugggag

SEQ ID NO: 1520977 - RNA, 14 nt, Homo sapiens
gaggacuaggguaa

SEQ ID NO: 1520978 - RNA, 17 nt, Homo sapiens
gaguuuaagucucugac

SEQ ID NO: 1520979 - RNA, 17 nt, Homo sapiens
gaucacgccacuggacu

SEQ ID NO: 1520980 - RNA, 13 nt, Homo sapiens
gaugcaagcaaga

SEQ ID NO: 1520981 - RNA, 18 nt, Homo sapiens
gaugucguuugaaucaca

SEQ ID NO: 1520982 - RNA, 14 nt, Homo sapiens
gauucacaguguga

SEQ ID NO: 1520983 - RNA, 18 nt, Homo sapiens
gauuggcaggaguuggaa

SEQ ID NO: 1520984 - RNA, 16 nt, Homo sapiens
gcaaugacucaaaguc

SEQ ID NO: 1520985 - RNA, 18 nt, Homo sapiens
gcaaugucccuugcacag

SEQ ID NO: 1520986 - RNA, 15 nt, Homo sapiens
gcacaaguucaguga

SEQ ID NO: 1520987 - RNA, 19 nt, Homo sapiens
gcacaccuguuauugccaa

SEQ ID NO: 1520988 - RNA, 20 nt, Homo sapiens
gcacaccuguuauugccaau

SEQ ID NO: 1520989 - RNA, 19 nt, Homo sapiens
gcacuccucugucucugcu

SEQ ID NO: 1520990 - RNA, 20 nt, Homo sapiens
gcacugaauggcugaccuga

SEQ ID NO: 1520991 - RNA, 12 nt, Homo sapiens
gcacugcucaau

SEQ ID NO: 1520992 - RNA, 14 nt, Homo sapiens
gcagauguggugau

SEQ ID NO: 1520993 - RNA, 15 nt, Homo sapiens
gcagcagaagccaaa

SEQ ID NO: 1520994 - RNA, 14 nt, Homo sapiens
gcaggaaacuaacu

SEQ ID NO: 1520995 - RNA, 23 nt, Homo sapiens
gcaguguaacgaugcacuuugga

SEQ ID NO: 1520996 - RNA, 13 nt, Homo sapiens
gcaugaccauccu

SEQ ID NO: 1520997 - RNA, 16 nt, Homo sapiens
gcauucuuuugcacac

SEQ ID NO: 1520998 - RNA, 23 nt, Homo sapiens
gccaaauccauccugcucuucca

SEQ ID NO: 1520999 - RNA, 21 nt, Homo sapiens
gccagaagaccucccuucagg

SEQ ID NO: 1521000 - RNA, 13 nt, Homo sapiens
gccuagcuuucau

SEQ ID NO: 1521001 - RNA, 14 nt, Homo sapiens
gccuuuuguguuuu

SEQ ID NO: 1521002 - RNA, 16 nt, Homo sapiens
gcuaauaauuugccau

SEQ ID NO: 1521003 - RNA, 23 nt, Homo sapiens
gcuauauuccuuuuucuaugaaa

SEQ ID NO: 1521004 - RNA, 14 nt, Homo sapiens
gcucuuccauuucu

SEQ ID NO: 1521005 - RNA, 15 nt, Homo sapiens
gcuucaaaugauccu

SEQ ID NO: 1521006 - RNA, 20 nt, Homo sapiens
gcuucucuccacccaugacc

SEQ ID NO: 1521007 - RNA, 14 nt, Homo sapiens
gcuuugccugcuug

SEQ ID NO: 1521008 - RNA, 11 nt, Homo sapiens
ggaaaucacac

SEQ ID NO: 1521009 - RNA, 21 nt, Homo sapiens
ggaagggaguuggugugcuau

SEQ ID NO: 1521010 - RNA, 17 nt, Homo sapiens
ggaagugugugaucugu

SEQ ID NO: 1521011 - RNA, 14 nt, Homo sapiens
ggaauaauccagaa

SEQ ID NO: 1521012 - RNA, 14 nt, Homo sapiens
ggagagagacucca

SEQ ID NO: 1521013 - RNA, 17 nt, Homo sapiens
ggagcaauuugcacaug

SEQ ID NO: 1521014 - RNA, 19 nt, Homo sapiens
ggaggcucgaccaccucaa

SEQ ID NO: 1521015 - RNA, 23 nt, Homo sapiens
ggcaacuugggaacuagacuccc

SEQ ID NO: 1521016 - RNA, 19 nt, Homo sapiens
ggccaucaggacuuucccu

SEQ ID NO: 1521017 - RNA, 14 nt, Homo sapiens
gggacaagaaucaa

SEQ ID NO: 1521018 - RNA, 15 nt, Homo sapiens
gguagaaaugucuau

SEQ ID NO: 1521019 - RNA, 16 nt, Homo sapiens
gguagaaaugucuaug

SEQ ID NO: 1521020 - RNA, 19 nt, Homo sapiens
gguagagacuuugacucuc

SEQ ID NO: 1521021 - RNA, 15 nt, Homo sapiens
gguggaacaagcaca

SEQ ID NO: 1521022 - RNA, 16 nt, Homo sapiens
gguucacaccauucuc

SEQ ID NO: 1521023 - RNA, 22 nt, Homo sapiens
gguuggaaaacaguauuuucca

SEQ ID NO: 1521024 - RNA, 19 nt, Homo sapiens
guaaacagaaauugcaaua

SEQ ID NO: 1521025 - RNA, 17 nt, Homo sapiens
guaacgaugcacuuugg

SEQ ID NO: 1521026 - RNA, 18 nt, Homo sapiens
guaagcaaagacuuuccu

SEQ ID NO: 1521027 - RNA, 16 nt, Homo sapiens
guaaguuaucuuugaa

SEQ ID NO: 1521028 - RNA, 17 nt, Homo sapiens
guaauuuugaacuguuu

SEQ ID NO: 1521029 - RNA, 21 nt, Homo sapiens
guacuaauacagacuauguca

SEQ ID NO: 1521030 - RNA, 21 nt, Homo sapiens
guauguuugggagacugcuga

SEQ ID NO: 1521031 - RNA, 19 nt, Homo sapiens
guauuuacacauacaacuu

SEQ ID NO: 1521032 - RNA, 12 nt, Homo sapiens
gucaacauuucu

SEQ ID NO: 1521033 - RNA, 18 nt, Homo sapiens
gucagacuccuagacuca

SEQ ID NO: 1521034 - RNA, 16 nt, Homo sapiens
gucauccacagcccaa

SEQ ID NO: 1521035 - RNA, 14 nt, Homo sapiens
gucauuauguuaau

SEQ ID NO: 1521036 - RNA, 20 nt, Homo sapiens
guccuuagccccaucugcca

SEQ ID NO: 1521037 - RNA, 14 nt, Homo sapiens
guccuugaugcuca

SEQ ID NO: 1521038 - RNA, 22 nt, Homo sapiens
gucugcaaugucccuugcacag

SEQ ID NO: 1521039 - RNA, 16 nt, Homo sapiens
gucuguuuuaauuuaa

SEQ ID NO: 1521040 - RNA, 16 nt, Homo sapiens
gucuucccuucuuugc

SEQ ID NO: 1521041 - RNA, 23 nt, Homo sapiens
gugagggauaguggggucagggc

SEQ ID NO: 1521042 - RNA, 19 nt, Homo sapiens
gugcaguggcacgaucuca

SEQ ID NO: 1521043 - RNA, 21 nt, Homo sapiens
gugcuaagaaagcaagccaau

SEQ ID NO: 1521044 - RNA, 13 nt, Homo sapiens
guguaacgaugca

SEQ ID NO: 1521045 - RNA, 23 nt, Homo sapiens
guguugucccagggcugaugcug

SEQ ID NO: 1521046 - RNA, 13 nt, Homo sapiens
guuaugccucaug

SEQ ID NO: 1521047 - RNA, 19 nt, Homo sapiens
guucaguuuccccauuugu

SEQ ID NO: 1521048 - RNA, 16 nt, Homo sapiens
guucccuauuuugcca

SEQ ID NO: 1521049 - RNA, 19 nt, Homo sapiens
guugaagaaaaaauggcaa

SEQ ID NO: 1521050 - RNA, 21 nt, Homo sapiens
guugaagaagaguuugcaaau

SEQ ID NO: 1521051 - RNA, 14 nt, Homo sapiens
guugcccagugugu

SEQ ID NO: 1521052 - RNA, 13 nt, Homo sapiens
guuggaacauccu

SEQ ID NO: 1521053 - RNA, 15 nt, Homo sapiens
guuggccugguggcc

SEQ ID NO: 1521054 - RNA, 17 nt, Homo sapiens
guuuagaugaaugucag

SEQ ID NO: 1521055 - RNA, 18 nt, Homo sapiens
guuucuuuaucuacuaau

SEQ ID NO: 1521056 - RNA, 15 nt, Homo sapiens
ucuuauuacugagag

SEQ ID NO: 1521057 - RNA, 24 nt, Homo sapiens
ucuuuaauauaauaaaaguuauua

SEQ ID NO: 1521058 - RNA, 18 nt, Homo sapiens
ucuuuuaagcuaucuaua

SEQ ID NO: 1521059 - RNA, 18 nt, Homo sapiens
ugaaaacucacuucaaug

SEQ ID NO: 1521060 - RNA, 20 nt, Homo sapiens
ugaaaaugcuguauuaguca

SEQ ID NO: 1521061 - RNA, 22 nt, Homo sapiens
ugaaaaugcuguauuagucaca

SEQ ID NO: 1521062 - RNA, 12 nt, Homo sapiens
ugaaagccaaau

SEQ ID NO: 1521063 - RNA, 20 nt, Homo sapiens
ugaacugggcagacugcaaa

SEQ ID NO: 1521064 - RNA, 19 nt, Homo sapiens
auauuuuuuucaacugcca

SEQ ID NO: 1521065 - RNA, 20 nt, Homo sapiens
aucaaucuuauuacugagag

SEQ ID NO: 1521066 - RNA, 11 nt, Homo sapiens
aucaauuuugu

SEQ ID NO: 1521067 - RNA, 16 nt, Homo sapiens
aucacgccacuggacu

SEQ ID NO: 1521068 - RNA, 22 nt, Homo sapiens
aucaggacuuucccugacagcu

SEQ ID NO: 1521069 - RNA, 21 nt, Homo sapiens
auccauccugcucuuccauuu

SEQ ID NO: 1521070 - RNA, 15 nt, Homo sapiens
auccuuccuacuuug

SEQ ID NO: 1521071 - RNA, 15 nt, Homo sapiens
aucgcugucaucuca

SEQ ID NO: 1521072 - RNA, 16 nt, Homo sapiens
aucgcugucaucucag

SEQ ID NO: 1521073 - RNA, 12 nt, Homo sapiens
aucuaauguugu

SEQ ID NO: 1521074 - RNA, 23 nt, Homo sapiens
aucuacuaauugagccauuuaau

SEQ ID NO: 1521075 - RNA, 19 nt, Homo sapiens
aucuauaccuuacugcaau

SEQ ID NO: 1521076 - RNA, 19 nt, Homo sapiens
aucuccugucuacaguuua

SEQ ID NO: 1521077 - RNA, 23 nt, Homo sapiens
aucuccugucuacaguuuaauaa

SEQ ID NO: 1521078 - RNA, 12 nt, Homo sapiens
aucugcugucuu

SEQ ID NO: 1521079 - RNA, 20 nt, Homo sapiens
augaaccugcccugcuccca

SEQ ID NO: 1521080 - RNA, 23 nt, Homo sapiens
augaacuugcaaacaggcugaua

SEQ ID NO: 1521081 - RNA, 18 nt, Homo sapiens
augaagguggaacaagca

SEQ ID NO: 1521082 - RNA, 14 nt, Homo sapiens
augacucaucaauu

SEQ ID NO: 1521083 - RNA, 21 nt, Homo sapiens
augcaagcaagaaacacuggg

SEQ ID NO: 1521084 - RNA, 14 nt, Homo sapiens
augcagacauguau

SEQ ID NO: 1521085 - RNA, 14 nt, Homo sapiens
augcagauacuuau

SEQ ID NO: 1521086 - RNA, 13 nt, Homo sapiens
augcagcaucuaa

SEQ ID NO: 1521087 - RNA, 23 nt, Homo sapiens
augcauauccaacaugugcucag

SEQ ID NO: 1521088 - RNA, 22 nt, Homo sapiens
augccucauuaccuugugcuaa

SEQ ID NO: 1521089 - RNA, 11 nt, Homo sapiens
auggugcagug

SEQ ID NO: 1521090 - RNA, 15 nt, Homo sapiens
auguauaugcaauau

SEQ ID NO: 1521091 - RNA, 17 nt, Homo sapiens
augucguuugaaucaca

SEQ ID NO: 1521092 - RNA, 19 nt, Homo sapiens
augucguuugaaucacagu

SEQ ID NO: 1521093 - RNA, 21 nt, Homo sapiens
augucguuugaaucacaguau

SEQ ID NO: 1521094 - RNA, 20 nt, Homo sapiens
augucuauguuuucuacucc

SEQ ID NO: 1521095 - RNA, 14 nt, Homo sapiens
augugacuacagcc

SEQ ID NO: 1521096 - RNA, 14 nt, Homo sapiens
augugcucagggaa

SEQ ID NO: 1521097 - RNA, 21 nt, Homo sapiens
augugcucagggaauaaucca

SEQ ID NO: 1521098 - RNA, 13 nt, Homo sapiens
augugugauucac

SEQ ID NO: 1521099 - RNA, 16 nt, Homo sapiens
augugugauucacagu

SEQ ID NO: 1521100 - RNA, 16 nt, Homo sapiens
auguugcccagugugu

SEQ ID NO: 1521101 - RNA, 15 nt, Homo sapiens
auguuucauuuucau

SEQ ID NO: 1521102 - RNA, 18 nt, Homo sapiens
auuaaaaaugaaagccaa

SEQ ID NO: 1521103 - RNA, 16 nt, Homo sapiens
auuaacggagugucua

SEQ ID NO: 1521104 - RNA, 18 nt, Homo sapiens
auuaagagcaaacuuuag

SEQ ID NO: 1521105 - RNA, 22 nt, Homo sapiens
auuaccuugugcuaauccucuu

SEQ ID NO: 1521106 - RNA, 14 nt, Homo sapiens
auuauauucauucu

SEQ ID NO: 1521107 - RNA, 19 nt, Homo sapiens
auucacaauggaaacuuua

SEQ ID NO: 1521108 - RNA, 16 nt, Homo sapiens
auucagccaggagaug

SEQ ID NO: 1521109 - RNA, 12 nt, Homo sapiens
auucuuccucaa

SEQ ID NO: 1521110 - RNA, 21 nt, Homo sapiens
auugcaauauggauguuucuu

SEQ ID NO: 1521111 - RNA, 15 nt, Homo sapiens
auuguaauacacaua

SEQ ID NO: 1521112 - RNA, 19 nt, Homo sapiens
auuuacacauacaacuuca

SEQ ID NO: 1521113 - RNA, 21 nt, Homo sapiens
auuuacacauacaacuucaua

SEQ ID NO: 1521114 - RNA, 23 nt, Homo sapiens
auuuaucuccugucuacaguuua

SEQ ID NO: 1521115 - RNA, 15 nt, Homo sapiens
auuucucaccugaaa

SEQ ID NO: 1521116 - RNA, 13 nt, Homo sapiens
auuucuucacuca

SEQ ID NO: 1521117 - RNA, 14 nt, Homo sapiens
auuucuucacucaa

SEQ ID NO: 1521118 - RNA, 14 nt, Homo sapiens
auuugcacaaguuc

SEQ ID NO: 1521119 - RNA, 21 nt, Homo sapiens
auuuuagucugucauccagaa

SEQ ID NO: 1521120 - RNA, 13 nt, Homo sapiens
auuuuugaauaca

SEQ ID NO: 1521121 - RNA, 19 nt, Homo sapiens
auuuuugaauacaggcaua

SEQ ID NO: 1521122 - RNA, 17 nt, Homo sapiens
caaaaaucccaaauuca

SEQ ID NO: 1521123 - RNA, 20 nt, Homo sapiens
caaaaaucccaaauucacuu

SEQ ID NO: 1521124 - RNA, 20 nt, Homo sapiens
caaaauugcuucuucuucaa

SEQ ID NO: 1521125 - RNA, 14 nt, Homo sapiens
caaacaggcugaua

SEQ ID NO: 1521126 - RNA, 22 nt, Homo sapiens
caaaccuggauuuuuuauguac

SEQ ID NO: 1521127 - RNA, 23 nt, Homo sapiens
caaacuaccuuccaguuccucau

SEQ ID NO: 1521128 - RNA, 14 nt, Homo sapiens
caaacuucaagggu

SEQ ID NO: 1521129 - RNA, 22 nt, Homo sapiens
caaagaaaaugaaaugcauauu

SEQ ID NO: 1521130 - RNA, 22 nt, Homo sapiens
caaauccauccugcucuuccau

SEQ ID NO: 1521131 - RNA, 18 nt, Homo sapiens
caaaugcccccugaguga

SEQ ID NO: 1521132 - RNA, 18 nt, Homo sapiens
caaaugggaaaaccagac

SEQ ID NO: 1521133 - RNA, 11 nt, Homo sapiens
caaauguucuc

SEQ ID NO: 1521134 - RNA, 19 nt, Homo sapiens
caacaaacuucaaggguuu

SEQ ID NO: 1521135 - RNA, 18 nt, Homo sapiens
caacauuggagacaucac

SEQ ID NO: 1521136 - RNA, 17 nt, Homo sapiens
caacuugggaacuagac

SEQ ID NO: 1521137 - RNA, 12 nt, Homo sapiens
caaggaaauaca

SEQ ID NO: 1521138 - RNA, 17 nt, Homo sapiens
caaggcagaggcaggaa

SEQ ID NO: 1521139 - RNA, 21 nt, Homo sapiens
caagugaacauuacauugcca

SEQ ID NO: 1521140 - RNA, 15 nt, Homo sapiens
caaguuaguucaauc

SEQ ID NO: 1521141 - RNA, 13 nt, Homo sapiens
caaguuccugaua

SEQ ID NO: 1521142 - RNA, 22 nt, Homo sapiens
caaugggaaaacuucacuccaa

SEQ ID NO: 1521143 - RNA, 15 nt, Homo sapiens
caaugguugaugaua

SEQ ID NO: 1521144 - RNA, 21 nt, Homo sapiens
caauuuucuuaugaacagaua

SEQ ID NO: 1521145 - RNA, 12 nt, Homo sapiens
cacaaaacagaa

SEQ ID NO: 1521146 - RNA, 21 nt, Homo sapiens
cacacgucuggcuucacagau

SEQ ID NO: 1521147 - RNA, 20 nt, Homo sapiens
cacagaucaagugaacauua

SEQ ID NO: 1521148 - RNA, 21 nt, Homo sapiens
cacagucucugggagacuuuc

SEQ ID NO: 1521149 - RNA, 17 nt, Homo sapiens
cacagugcugaccagac

SEQ ID NO: 1521150 - RNA, 23 nt, Homo sapiens
cacagugugaaucuuggugucua

SEQ ID NO: 1521151 - RNA, 23 nt, Homo sapiens
cacaucccuggaaggacauccau

SEQ ID NO: 1521152 - RNA, 15 nt, Homo sapiens
caccaggucagggag

SEQ ID NO: 1521153 - RNA, 17 nt, Homo sapiens
cacgaucucaacucacu

SEQ ID NO: 1521154 - RNA, 17 nt, Homo sapiens
cacuaguugugaauuua

SEQ ID NO: 1521155 - RNA, 20 nt, Homo sapiens
cacuccaaagagaaaccuau

SEQ ID NO: 1521156 - RNA, 21 nt, Homo sapiens
cacuguggccaucaggacuuu

SEQ ID NO: 1521157 - RNA, 14 nt, Homo sapiens
cagaaauugcaaua

SEQ ID NO: 1521158 - RNA, 21 nt, Homo sapiens
cagaacacagcaauuccucag

SEQ ID NO: 1521159 - RNA, 16 nt, Homo sapiens
cagacuacagccagaa

SEQ ID NO: 1521160 - RNA, 22 nt, Homo sapiens
cagacuacagccagaagcccau

SEQ ID NO: 1521161 - RNA, 16 nt, Homo sapiens
cagagauaaagaccuu

SEQ ID NO: 1521162 - RNA, 16 nt, Homo sapiens
cagagcagaacuuuca

SEQ ID NO: 1521163 - RNA, 13 nt, Homo sapiens
cagaucaagugaa

SEQ ID NO: 1521164 - RNA, 14 nt, Homo sapiens
cagaugaaugggag

SEQ ID NO: 1521165 - RNA, 13 nt, Homo sapiens
cagaugugugauu

SEQ ID NO: 1521166 - RNA, 14 nt, Homo sapiens
cagcaucuaaguaa

SEQ ID NO: 1521167 - RNA, 15 nt, Homo sapiens
cagcuggaucuccau

SEQ ID NO: 1521168 - RNA, 23 nt, Homo sapiens
cagcuggguuggaaaacaguauu

SEQ ID NO: 1521169 - RNA, 12 nt, Homo sapiens
caggaacugugu

SEQ ID NO: 1521170 - RNA, 18 nt, Homo sapiens
caggaguuggaagugugu

SEQ ID NO: 1521171 - RNA, 19 nt, Homo sapiens
caggauccaagugacaaag

SEQ ID NO: 1521172 - RNA, 20 nt, Homo sapiens
caggcaacgcacaaaacaga

SEQ ID NO: 1521173 - RNA, 15 nt, Homo sapiens
cagggcuguguguac

SEQ ID NO: 1521174 - RNA, 19 nt, Homo sapiens
caguccuuuaaauuuugca

SEQ ID NO: 1521175 - RNA, 13 nt, Homo sapiens
cagucucugggag

SEQ ID NO: 1521176 - RNA, 19 nt, Homo sapiens
caguguaacgaugcacuuu

SEQ ID NO: 1521177 - RNA, 20 nt, Homo sapiens
caguguaacgaugcacuuug

SEQ ID NO: 1521178 - RNA, 19 nt, Homo sapiens
caguguguuucugaucuga

SEQ ID NO: 1521179 - RNA, 14 nt, Homo sapiens
cauaaaucuauuca

SEQ ID NO: 1521180 - RNA, 15 nt, Homo sapiens
cauacacagaaacca

SEQ ID NO: 1521181 - RNA, 22 nt, Homo sapiens
cauagagaauauaaaaauaaag

SEQ ID NO: 1521182 - RNA, 20 nt, Homo sapiens
cauauccaacaugugcucag

SEQ ID NO: 1521183 - RNA, 18 nt, Homo sapiens
cuuuuuuauacucaauca

SEQ ID NO: 1521184 - RNA, 13 nt, Homo sapiens
gaaaaaauggcaa

SEQ ID NO: 1521185 - RNA, 15 nt, Homo sapiens
aaaaaucccaaauuc

SEQ ID NO: 1521186 - RNA, 17 nt, Homo sapiens
aaaaauggcaagagauc

SEQ ID NO: 1521187 - RNA, 22 nt, Homo sapiens
aaaacaguccuuuaaauuuugc

SEQ ID NO: 1521188 - RNA, 18 nt, Homo sapiens
aaaacucuucuacuuuca

SEQ ID NO: 1521189 - RNA, 13 nt, Homo sapiens
aaaauugcucccu

SEQ ID NO: 1521190 - RNA, 15 nt, Homo sapiens
aaacaguccuuuaaa

SEQ ID NO: 1521191 - RNA, 16 nt, Homo sapiens
aaacuaaacccucaca

SEQ ID NO: 1521192 - RNA, 18 nt, Homo sapiens
aaacugguuuagcacaau

SEQ ID NO: 1521193 - RNA, 13 nt, Homo sapiens
aaacuucaagggu

SEQ ID NO: 1521194 - RNA, 14 nt, Homo sapiens
aaacuucacuccaa

SEQ ID NO: 1521195 - RNA, 14 nt, Homo sapiens
aaagaaaugugauu

SEQ ID NO: 1521196 - RNA, 14 nt, Homo sapiens
aaagaaguggggac

SEQ ID NO: 1521197 - RNA, 17 nt, Homo sapiens
aaagauauuucuuuaaa

SEQ ID NO: 1521198 - RNA, 19 nt, Homo sapiens
aaagcagacuuuugugaac

SEQ ID NO: 1521199 - RNA, 15 nt, Homo sapiens
aaauaauucaaacac

SEQ ID NO: 1521200 - RNA, 12 nt, Homo sapiens
aaauacauaugc

SEQ ID NO: 1521201 - RNA, 22 nt, Homo sapiens
aaauacauaugcagauacuuau

SEQ ID NO: 1521202 - RNA, 16 nt, Homo sapiens
aaauagcaucuaguac

SEQ ID NO: 1521203 - RNA, 18 nt, Homo sapiens
aaauaucaaagucauuaa

SEQ ID NO: 1521204 - RNA, 21 nt, Homo sapiens
aaaucaaguuggcuucuaauc

SEQ ID NO: 1521205 - RNA, 20 nt, Homo sapiens
aaauccauccugcucuucca

SEQ ID NO: 1521206 - RNA, 22 nt, Homo sapiens
aaaugcauauuugcaaagugua

SEQ ID NO: 1521207 - RNA, 20 nt, Homo sapiens
aaaugcuguauuagucacag

SEQ ID NO: 1521208 - RNA, 13 nt, Homo sapiens
aaauggcaagaga

SEQ ID NO: 1521209 - RNA, 17 nt, Homo sapiens
aaaugggaaaaccagac

SEQ ID NO: 1521210 - RNA, 19 nt, Homo sapiens
aaaugucuauguuuucuac

SEQ ID NO: 1521211 - RNA, 22 nt, Homo sapiens
aaaugucuauguuuucuacucc

SEQ ID NO: 1521212 - RNA, 19 nt, Homo sapiens
aaaugugauuugucuuccc

SEQ ID NO: 1521213 - RNA, 13 nt, Homo sapiens
aaauuaaagcuga

SEQ ID NO: 1521214 - RNA, 13 nt, Homo sapiens
aacagauaauccc

SEQ ID NO: 1521215 - RNA, 22 nt, Homo sapiens
aacagauaaucccuguauuuca

SEQ ID NO: 1521216 - RNA, 14 nt, Homo sapiens
aacagugcuguucu

SEQ ID NO: 1521217 - RNA, 20 nt, Homo sapiens
aacauccuccaauuccacag

SEQ ID NO: 1521218 - RNA, 13 nt, Homo sapiens
aacaugaauuuca

SEQ ID NO: 1521219 - RNA, 16 nt, Homo sapiens
aacauggagaggacuu

SEQ ID NO: 1521220 - RNA, 14 nt, Homo sapiens
aacaugugcucagg

SEQ ID NO: 1521221 - RNA, 17 nt, Homo sapiens
aacauuggagacaucac

SEQ ID NO: 1521222 - RNA, 22 nt, Homo sapiens
aacauuggagacaucacuugcc

SEQ ID NO: 1521223 - RNA, 21 nt, Homo sapiens
aacauuuacuuuugcucccua

SEQ ID NO: 1521224 - RNA, 16 nt, Homo sapiens
aaccacauugaagaau

SEQ ID NO: 1521225 - RNA, 11 nt, Homo sapiens
aaccucagggc

SEQ ID NO: 1521226 - RNA, 12 nt, Homo sapiens
aacgcacaaaac

SEQ ID NO: 1521227 - RNA, 17 nt, Homo sapiens
aacucuucuacuuucau

SEQ ID NO: 1521228 - RNA, 17 nt, Homo sapiens
aacugguuuagcacaau

SEQ ID NO: 1521229 - RNA, 13 nt, Homo sapiens
aacuucacuccaa

SEQ ID NO: 1521230 - RNA, 13 nt, Homo sapiens
aagaaaugugauu

SEQ ID NO: 1521231 - RNA, 22 nt, Homo sapiens
aagaacuauugugcucagagac

SEQ ID NO: 1521232 - RNA, 16 nt, Homo sapiens
aagaaggaaauagcca

SEQ ID NO: 1521233 - RNA, 14 nt, Homo sapiens
aagagaucauaucc

SEQ ID NO: 1521234 - RNA, 18 nt, Homo sapiens
aagaucacgccacuggac

SEQ ID NO: 1521235 - RNA, 19 nt, Homo sapiens
aagaucacgccacuggacu

SEQ ID NO: 1521236 - RNA, 20 nt, Homo sapiens
aagaugcauuaucuaugaua

SEQ ID NO: 1521237 - RNA, 14 nt, Homo sapiens
aagcaaauggccaa

SEQ ID NO: 1521238 - RNA, 18 nt, Homo sapiens
aagcaaugguugaugaua

SEQ ID NO: 1521239 - RNA, 19 nt, Homo sapiens
aagccaaauuuauaugcca

SEQ ID NO: 1521240 - RNA, 20 nt, Homo sapiens
aagggccagcuggaggugaa

SEQ ID NO: 1521241 - RNA, 18 nt, Homo sapiens
aaggguucaccaggucag

SEQ ID NO: 1521242 - RNA, 22 nt, Homo sapiens
aaggguucaccaggucagggag

SEQ ID NO: 1521243 - RNA, 17 nt, Homo sapiens
aaggugagcaaagggcu

SEQ ID NO: 1521244 - RNA, 18 nt, Homo sapiens
aaguacuuuccaaucuca

SEQ ID NO: 1521245 - RNA, 15 nt, Homo sapiens
aaguauuuaucuccu

SEQ ID NO: 1521246 - RNA, 13 nt, Homo sapiens
aagucaucaucuc

SEQ ID NO: 1521247 - RNA, 18 nt, Homo sapiens
aagucucugacucuugcc

SEQ ID NO: 1521248 - RNA, 13 nt, Homo sapiens
gaaaucuaugaaa

SEQ ID NO: 1521249 - RNA, 23 nt, Homo sapiens
gaaaugauugguaggaaauagaa

SEQ ID NO: 1521250 - RNA, 14 nt, Homo sapiens
gaaaugauuucaca

SEQ ID NO: 1521251 - RNA, 13 nt, Homo sapiens
gaaaugucuaugu

SEQ ID NO: 1521252 - RNA, 18 nt, Homo sapiens
gaaaugugauuugucuuc

SEQ ID NO: 1521253 - RNA, 18 nt, Homo sapiens
gaaccaggcaacuuggga

SEQ ID NO: 1521254 - RNA, 15 nt, Homo sapiens
gaaccauccuuccca

SEQ ID NO: 1521255 - RNA, 18 nt, Homo sapiens
gaacccagaaacaacaca

SEQ ID NO: 1521256 - RNA, 16 nt, Homo sapiens
gaacuuucaccuucau

SEQ ID NO: 1521257 - RNA, 15 nt, Homo sapiens
gaagauucuauguua

SEQ ID NO: 1521258 - RNA, 22 nt, Homo sapiens
gaagcucccugaaguaagcaaa

SEQ ID NO: 1521259 - RNA, 15 nt, Homo sapiens
gaagucuucuauuua

SEQ ID NO: 1521260 - RNA, 14 nt, Homo sapiens
gaauauuacuggau

SEQ ID NO: 1521261 - RNA, 15 nt, Homo sapiens
gaaugaaauaauuca

SEQ ID NO: 1521262 - RNA, 16 nt, Homo sapiens
gaaugaaauaauucaa

SEQ ID NO: 1521263 - RNA, 16 nt, Homo sapiens
gaauggcagcuggaau

SEQ ID NO: 1521264 - RNA, 14 nt, Homo sapiens
gacaccucacugag

SEQ ID NO: 1521265 - RNA, 14 nt, Homo sapiens
gacagcuguguacu

SEQ ID NO: 1521266 - RNA, 20 nt, Homo sapiens
gacuauggcucuacuuucag

SEQ ID NO: 1521267 - RNA, 19 nt, Homo sapiens
gacucuccagaaagcucau

SEQ ID NO: 1521268 - RNA, 11 nt, Homo sapiens
gacugccacag

SEQ ID NO: 1521269 - RNA, 14 nt, Homo sapiens
gacugcugagucaa

SEQ ID NO: 1521270 - RNA, 15 nt, Homo sapiens
gacuuucccugacag

SEQ ID NO: 1521271 - RNA, 12 nt, Homo sapiens
gacuuuucuccc

SEQ ID NO: 1521272 - RNA, 20 nt, Homo sapiens
gagacagcgaacuagaagaa

SEQ ID NO: 1521273 - RNA, 13 nt, Homo sapiens
gagacaucacuug

SEQ ID NO: 1521274 - RNA, 19 nt, Homo sapiens
gagacaugagcauggcuga

SEQ ID NO: 1521275 - RNA, 20 nt, Homo sapiens
gagacuuugacucuccagaa

SEQ ID NO: 1521276 - RNA, 23 nt, Homo sapiens
gagaggagaaggagggagacaug

SEQ ID NO: 1521277 - RNA, 17 nt, Homo sapiens
gagcacaucugggaggc

SEQ ID NO: 1521278 - RNA, 22 nt, Homo sapiens
gagggauaguggggucagggcu

SEQ ID NO: 1521279 - RNA, 13 nt, Homo sapiens
gagucacugaccc

SEQ ID NO: 1521280 - RNA, 16 nt, Homo sapiens
gagugcaguggcacga

SEQ ID NO: 1521281 - RNA, 16 nt, Homo sapiens
gaucaauagacuguac

SEQ ID NO: 1521282 - RNA, 13 nt, Homo sapiens
gaucauugugaag

SEQ ID NO: 1521283 - RNA, 23 nt, Homo sapiens
gauccaaacagaaaagugcaaag

SEQ ID NO: 1521284 - RNA, 17 nt, Homo sapiens
gaugcuguacagguaca

SEQ ID NO: 1521285 - RNA, 13 nt, Homo sapiens
gauucuauguuaa

SEQ ID NO: 1521286 - RNA, 16 nt, Homo sapiens
gcaaauggccaaugag

SEQ ID NO: 1521287 - RNA, 17 nt, Homo sapiens
gcaaauggccaaugaga

SEQ ID NO: 1521288 - RNA, 20 nt, Homo sapiens
gcaaucagcuaccauucaaa

SEQ ID NO: 1521289 - RNA, 18 nt, Homo sapiens
gcacaccuguuauugcca

SEQ ID NO: 1521290 - RNA, 22 nt, Homo sapiens
gcacagcccacacaugaaccau

SEQ ID NO: 1521291 - RNA, 15 nt, Homo sapiens
gcagaggcaggaaac

SEQ ID NO: 1521292 - RNA, 23 nt, Homo sapiens
gcaggacacaagcacaguuuuaa

SEQ ID NO: 1521293 - RNA, 24 nt, Homo sapiens
gcagggaauugauccacuucuuaa

SEQ ID NO: 1521294 - RNA, 14 nt, Homo sapiens
gcaugucacuccca

SEQ ID NO: 1521295 - RNA, 13 nt, Homo sapiens
gccaaaagccuuu

SEQ ID NO: 1521296 - RNA, 21 nt, Homo sapiens
gccaucaggacuuucccugac

SEQ ID NO: 1521297 - RNA, 20 nt, Homo sapiens
gccuauaaucccagcacuuu

SEQ ID NO: 1521298 - RNA, 23 nt, Homo sapiens
gccuccuggguucacaccauucu

SEQ ID NO: 1521299 - RNA, 17 nt, Homo sapiens
gccuuucuuauuugcaa

SEQ ID NO: 1521300 - RNA, 22 nt, Homo sapiens
gcuacaccugaggcugaggcag

SEQ ID NO: 1521301 - RNA, 21 nt, Homo sapiens
gcuccaucgcugucaucucag

SEQ ID NO: 1521302 - RNA, 14 nt, Homo sapiens
gcucccacagaaca

SEQ ID NO: 1521303 - RNA, 17 nt, Homo sapiens
gcucuucugucaucccg

SEQ ID NO: 1521304 - RNA, 19 nt, Homo sapiens
gcuguguacucuuaggcua

SEQ ID NO: 1521305 - RNA, 21 nt, Homo sapiens
gcuuaauuauugauguuuuca

SEQ ID NO: 1521306 - RNA, 21 nt, Homo sapiens
gcuuaguuaagucauccacag

SEQ ID NO: 1521307 - RNA, 12 nt, Homo sapiens
gcuucuucuuca

SEQ ID NO: 1521308 - RNA, 17 nt, Homo sapiens
gcuugguguacuuaaua

SEQ ID NO: 1521309 - RNA, 20 nt, Homo sapiens
ggaaaauaaaucaaugcuau

SEQ ID NO: 1521310 - RNA, 17 nt, Homo sapiens
ggaaugaaauaauucaa

SEQ ID NO: 1521311 - RNA, 17 nt, Homo sapiens
ggaauguaugugcacau

SEQ ID NO: 1521312 - RNA, 13 nt, Homo sapiens
ggagacugcugag

SEQ ID NO: 1521313 - RNA, 24 nt, Homo sapiens
ggcaaagaaaaugaaaugcauauu

SEQ ID NO: 1521314 - RNA, 18 nt, Homo sapiens
ggcaaagugagacugaca

SEQ ID NO: 1521315 - RNA, 19 nt, Homo sapiens
ggcacgaucucaacucacu

SEQ ID NO: 1521316 - RNA, 16 nt, Homo sapiens
ggccagguuaugccuc

SEQ ID NO: 1521317 - RNA, 13 nt, Homo sapiens
ggcuugcugccaa

SEQ ID NO: 1521318 - RNA, 20 nt, Homo sapiens
gggacagagcagaacuuuca

SEQ ID NO: 1521319 - RNA, 13 nt, Homo sapiens
gggcaagaaggaa

SEQ ID NO: 1521320 - RNA, 20 nt, Homo sapiens
gggguuucacuguggucuca

SEQ ID NO: 1521321 - RNA, 20 nt, Homo sapiens
ggguucaccaggucagggag

SEQ ID NO: 1521322 - RNA, 22 nt, Homo sapiens
gguaaucugacuucucacuucc

SEQ ID NO: 1521323 - RNA, 12 nt, Homo sapiens
gguaugauuaac

SEQ ID NO: 1521324 - RNA, 18 nt, Homo sapiens
guaaagaguuaguuugag

SEQ ID NO: 1521325 - RNA, 16 nt, Homo sapiens
guaaauacaugcauau

SEQ ID NO: 1521326 - RNA, 16 nt, Homo sapiens
guaauacacauaucua

SEQ ID NO: 1521327 - RNA, 18 nt, Homo sapiens
guagauguggccuuugaa

SEQ ID NO: 1521328 - RNA, 18 nt, Homo sapiens
guauauuaaagcaccaaa

SEQ ID NO: 1521329 - RNA, 23 nt, Homo sapiens
guauuuuccauacacauccccag

SEQ ID NO: 1521330 - RNA, 18 nt, Homo sapiens
gucacucuaggacucugc

SEQ ID NO: 1521331 - RNA, 21 nt, Homo sapiens
guccugcugugugaauuccca

SEQ ID NO: 1521332 - RNA, 13 nt, Homo sapiens
gucuacaguuuaa

SEQ ID NO: 1521333 - RNA, 17 nt, Homo sapiens
gucuacguuaccaggca

SEQ ID NO: 1521334 - RNA, 17 nt, Homo sapiens
gucucaaucuccugacu

SEQ ID NO: 1521335 - RNA, 14 nt, Homo sapiens
gucucuaaguuaug

SEQ ID NO: 1521336 - RNA, 16 nt, Homo sapiens
gucucugcucuugccu

SEQ ID NO: 1521337 - RNA, 22 nt, Homo sapiens
gucuucauaauuucuucacuca

SEQ ID NO: 1521338 - RNA, 16 nt, Homo sapiens
gugaccguuugcuaua

SEQ ID NO: 1521339 - RNA, 16 nt, Homo sapiens
gugagaagaaaugaca

SEQ ID NO: 1521340 - RNA, 22 nt, Homo sapiens
gugcaguguaacgaugcacuuu

SEQ ID NO: 1521341 - RNA, 21 nt, Homo sapiens
gugcuucaaaugauccuuccu

SEQ ID NO: 1521342 - RNA, 16 nt, Homo sapiens
guguacuuaauacuca

SEQ ID NO: 1521343 - RNA, 19 nt, Homo sapiens
guguugucccagggcugau

SEQ ID NO: 1521344 - RNA, 22 nt, Homo sapiens
guuccugcuaauaauuugccau

SEQ ID NO: 1521345 - RNA, 19 nt, Homo sapiens
guucugggauuacaggugu

SEQ ID NO: 1521346 - RNA, 20 nt, Homo sapiens
guugcccaccaaaacacaga

SEQ ID NO: 1521347 - RNA, 20 nt, Homo sapiens
guugucccagggcugaugcu

SEQ ID NO: 1521348 - RNA, 23 nt, Homo sapiens
guuguuaaaacugguuuagcaca

SEQ ID NO: 1521349 - RNA, 20 nt, Homo sapiens
guuuaagucucugacucuug

SEQ ID NO: 1521350 - RNA, 18 nt, Homo sapiens
guuuauaaaagaugcauu

SEQ ID NO: 1521351 - RNA, 17 nt, Homo sapiens
guuuauauaauuuugca

SEQ ID NO: 1521352 - RNA, 14 nt, Homo sapiens
uaaaaaagagacau

SEQ ID NO: 1521353 - RNA, 15 nt, Homo sapiens
uaaaaaugaaagcca

SEQ ID NO: 1521354 - RNA, 21 nt, Homo sapiens
uaaaagaugcauuaucuauga

SEQ ID NO: 1521355 - RNA, 18 nt, Homo sapiens
uaaaaucucgguguucua

SEQ ID NO: 1521356 - RNA, 16 nt, Homo sapiens
uaaacagaaauugcaa

SEQ ID NO: 1521357 - RNA, 18 nt, Homo sapiens
uaaagccugaaaauucca

SEQ ID NO: 1521358 - RNA, 17 nt, Homo sapiens
uaaaguaaauacaugca

SEQ ID NO: 1521359 - RNA, 18 nt, Homo sapiens
uaaauagcaucuaguaca

SEQ ID NO: 1521360 - RNA, 16 nt, Homo sapiens
uaaaugcccucucuga

SEQ ID NO: 1521361 - RNA, 16 nt, Homo sapiens
uaaauuuugcacugcu

SEQ ID NO: 1521362 - RNA, 14 nt, Homo sapiens
uaacaacuaugauu

SEQ ID NO: 1521363 - RNA, 20 nt, Homo sapiens
uaacauagauuuauguaaug

SEQ ID NO: 1521364 - RNA, 23 nt, Homo sapiens
uaaccuguuuauauaauuuugca

SEQ ID NO: 1521365 - RNA, 21 nt, Homo sapiens
uaacugagaugaauguaauuu

SEQ ID NO: 1521366 - RNA, 17 nt, Homo sapiens
uaacuggugugagucaa

SEQ ID NO: 1521367 - RNA, 18 nt, Homo sapiens
uaagacuaaaaguugcau

SEQ ID NO: 1521368 - RNA, 22 nt, Homo sapiens
ugaagucaugcguuuaaucaca

SEQ ID NO: 1521369 - RNA, 12 nt, Homo sapiens
ugaaucacagua

SEQ ID NO: 1521370 - RNA, 14 nt, Homo sapiens
ugaaucacaguaua

SEQ ID NO: 1521371 - RNA, 22 nt, Homo sapiens
ugaaucacaguauacgcuccau

SEQ ID NO: 1521372 - RNA, 16 nt, Homo sapiens
ugacaaaauuggccag

SEQ ID NO: 1521373 - RNA, 14 nt, Homo sapiens
ugacaccucacuga

SEQ ID NO: 1521374 - RNA, 20 nt, Homo sapiens
ugacagcuguguacucuuag

SEQ ID NO: 1521375 - RNA, 23 nt, Homo sapiens
ugaccgagucuaggaaugcuuuu

SEQ ID NO: 1521376 - RNA, 19 nt, Homo sapiens
ugaccuuuuucacuguggc

SEQ ID NO: 1521377 - RNA, 14 nt, Homo sapiens
ugacucuccagaaa

SEQ ID NO: 1521378 - RNA, 12 nt, Homo sapiens
ugacucuugccu

SEQ ID NO: 1521379 - RNA, 15 nt, Homo sapiens
ugagaagaaaugaca

SEQ ID NO: 1521380 - RNA, 18 nt, Homo sapiens
ugauccuaaugaaugcau

SEQ ID NO: 1521381 - RNA, 20 nt, Homo sapiens
ugauccuaaugaaugcauaa

SEQ ID NO: 1521382 - RNA, 16 nt, Homo sapiens
ugauccuuccuacuuu

SEQ ID NO: 1521383 - RNA, 19 nt, Homo sapiens
ugauccuuccuacuuugcu

SEQ ID NO: 1521384 - RNA, 12 nt, Homo sapiens
ugaucugaugca

SEQ ID NO: 1521385 - RNA, 18 nt, Homo sapiens
ugaugaaauguaaauacu

SEQ ID NO: 1521386 - RNA, 16 nt, Homo sapiens
ugauucugucaauguc

SEQ ID NO: 1521387 - RNA, 23 nt, Homo sapiens
ugcaacaugccagccacugugau

SEQ ID NO: 1521388 - RNA, 13 nt, Homo sapiens
ugcaacuuguaaa

SEQ ID NO: 1521389 - RNA, 23 nt, Homo sapiens
ugcaauaaaagguauugagccau

SEQ ID NO: 1521390 - RNA, 17 nt, Homo sapiens
ugcagcagaagccaaau

SEQ ID NO: 1521391 - RNA, 17 nt, Homo sapiens
ugcaguggcacgaucuc

SEQ ID NO: 1521392 - RNA, 20 nt, Homo sapiens
ugcaguguaacgaugcacuu

SEQ ID NO: 1521393 - RNA, 23 nt, Homo sapiens
ugcaguguaacgaugcacuuugg

SEQ ID NO: 1521394 - RNA, 17 nt, Homo sapiens
ugcauagugcuaagaaa

SEQ ID NO: 1521395 - RNA, 20 nt, Homo sapiens
ugcauauccaacaugugcuc

SEQ ID NO: 1521396 - RNA, 12 nt, Homo sapiens
ugcauuaucuau

SEQ ID NO: 1521397 - RNA, 14 nt, Homo sapiens
ugcauuaucuauga

SEQ ID NO: 1521398 - RNA, 17 nt, Homo sapiens
ugcauuaucuaugauau

SEQ ID NO: 1521399 - RNA, 18 nt, Homo sapiens
ugccacaacgcccggcua

SEQ ID NO: 1521400 - RNA, 19 nt, Homo sapiens
ugcccaggaaccucagggc

SEQ ID NO: 1521401 - RNA, 17 nt, Homo sapiens
ugcuaauaauuugccau

SEQ ID NO: 1521402 - RNA, 23 nt, Homo sapiens
ugcuaauauauguauaugcaaua

SEQ ID NO: 1521403 - RNA, 17 nt, Homo sapiens
ugcuauaacuauguuga

SEQ ID NO: 1521404 - RNA, 11 nt, Homo sapiens
ugcuauauucc

SEQ ID NO: 1521405 - RNA, 15 nt, Homo sapiens
ugcucagagacacug

SEQ ID NO: 1521406 - RNA, 22 nt, Homo sapiens
ugcucagggaauaauccagaaa

SEQ ID NO: 1521407 - RNA, 14 nt, Homo sapiens
ugcucccacagaac

SEQ ID NO: 1521408 - RNA, 18 nt, Homo sapiens
ugcugaccagacagccuc

SEQ ID NO: 1521409 - RNA, 14 nt, Homo sapiens
ugcuguacaaaagc

SEQ ID NO: 1521410 - RNA, 22 nt, Homo sapiens
ugcuuauuuuguuggaguauua

SEQ ID NO: 1521411 - RNA, 17 nt, Homo sapiens
ugcuucaaaugauccuu

SEQ ID NO: 1521412 - RNA, 19 nt, Homo sapiens
ugcuucaggauccaaguga

SEQ ID NO: 1521413 - RNA, 13 nt, Homo sapiens
ugcuugaauauua

SEQ ID NO: 1521414 - RNA, 19 nt, Homo sapiens
uggaaaacaguauuuucca

SEQ ID NO: 1521415 - RNA, 20 nt, Homo sapiens
uggaaauuugggagagccau

SEQ ID NO: 1521416 - RNA, 18 nt, Homo sapiens
uggaaugaaauaauucaa

SEQ ID NO: 1521417 - RNA, 21 nt, Homo sapiens
uggacugucuaugaacuugca

SEQ ID NO: 1521418 - RNA, 21 nt, Homo sapiens
uggagacaucacuugccaaug

SEQ ID NO: 1521419 - RNA, 13 nt, Homo sapiens
uggccaaugagau

SEQ ID NO: 1521420 - RNA, 15 nt, Homo sapiens
uggcucuacuuucag

SEQ ID NO: 1521421 - RNA, 21 nt, Homo sapiens
uggcugacaguaacagcaucu

SEQ ID NO: 1521422 - RNA, 17 nt, Homo sapiens
uggcuuugaaacuugca

SEQ ID NO: 1521423 - RNA, 15 nt, Homo sapiens
ugggaaaaccagacu

SEQ ID NO: 1521424 - RNA, 18 nt, Homo sapiens
ugggagacugcugaguca

SEQ ID NO: 1521425 - RNA, 13 nt, Homo sapiens
ugggcuucuagaa

SEQ ID NO: 1521426 - RNA, 21 nt, Homo sapiens
ugguaguuuuacaguguuucu

SEQ ID NO: 1521427 - RNA, 22 nt, Homo sapiens
uggucugucaaugagagcauaa

SEQ ID NO: 1521428 - RNA, 12 nt, Homo sapiens
uggucuuugaaa

SEQ ID NO: 1521429 - RNA, 13 nt, Homo sapiens
uggugguauucag

SEQ ID NO: 1521430 - RNA, 17 nt, Homo sapiens
uguaacgaugcacuuug

SEQ ID NO: 1521431 - RNA, 18 nt, Homo sapiens
uguaauacacauaucuaa

SEQ ID NO: 1521432 - RNA, 11 nt, Homo sapiens
uguaauuuuga

SEQ ID NO: 1521433 - RNA, 19 nt, Homo sapiens
uguacaagguauuuacaca

SEQ ID NO: 1521434 - RNA, 16 nt, Homo sapiens
uguacuauggucucuu

SEQ ID NO: 1521435 - RNA, 18 nt, Homo sapiens
uguaucauuaugaaguca

SEQ ID NO: 1521436 - RNA, 16 nt, Homo sapiens
uguauuucaagaccuc

SEQ ID NO: 1521437 - RNA, 14 nt, Homo sapiens
ugucaaccccaaau

SEQ ID NO: 1521438 - RNA, 13 nt, Homo sapiens
ugucauccagaaa

SEQ ID NO: 1521439 - RNA, 18 nt, Homo sapiens
ugucuacguuaccaggca

SEQ ID NO: 1521440 - RNA, 20 nt, Homo sapiens
ugugaaggcaggggaaugua

SEQ ID NO: 1521441 - RNA, 17 nt, Homo sapiens
uguguacucuuaggcua

SEQ ID NO: 1521442 - RNA, 12 nt, Homo sapiens
ugugugaucugu

SEQ ID NO: 1521443 - RNA, 18 nt, Homo sapiens
ugugugaucugugggcac

SEQ ID NO: 1521444 - RNA, 21 nt, Homo sapiens
ugugugaucugugggcacauu

SEQ ID NO: 1521445 - RNA, 19 nt, Homo sapiens
uguguggucaacauuucuc

SEQ ID NO: 1521446 - RNA, 20 nt, Homo sapiens
uguuccugcuaauaauuugc

SEQ ID NO: 1521447 - RNA, 13 nt, Homo sapiens
uguugaacaauag

SEQ ID NO: 1521448 - RNA, 17 nt, Homo sapiens
uuaaaaaugaaagccaa

SEQ ID NO: 1521449 - RNA, 16 nt, Homo sapiens
uuaaaacaucaauuga

SEQ ID NO: 1521450 - RNA, 21 nt, Homo sapiens
uuaaagacaggagacaaaaga

SEQ ID NO: 1521451 - RNA, 12 nt, Homo sapiens
uuaaauaguaaa

SEQ ID NO: 1521452 - RNA, 13 nt, Homo sapiens
uuaacacagauca

SEQ ID NO: 1521453 - RNA, 20 nt, Homo sapiens
uuaagucauccacagcccaa

SEQ ID NO: 1521454 - RNA, 17 nt, Homo sapiens
uuacauuugaaaucuau

SEQ ID NO: 1521455 - RNA, 16 nt, Homo sapiens
uuaccuugugcuaauc

SEQ ID NO: 1521456 - RNA, 23 nt, Homo sapiens
uuaccuuuacauauuaucauguc

SEQ ID NO: 1521457 - RNA, 15 nt, Homo sapiens
uuacuaucaugucaa

SEQ ID NO: 1521458 - RNA, 16 nt, Homo sapiens
uuagaguaaugaaaug

SEQ ID NO: 1521459 - RNA, 15 nt, Homo sapiens
uuagaugaaugucag

SEQ ID NO: 1521460 - RNA, 17 nt, Homo sapiens
uuaguuaagucauccac

SEQ ID NO: 1521461 - RNA, 20 nt, Homo sapiens
uuaucuuauuuaauuuuugc

SEQ ID NO: 1521462 - RNA, 16 nt, Homo sapiens
uuauugauguuuucau

SEQ ID NO: 1521463 - RNA, 12 nt, Homo sapiens
uucaaaauugcu

SEQ ID NO: 1521464 - RNA, 22 nt, Homo sapiens
uucacaccauucuccugccuca

SEQ ID NO: 1521465 - RNA, 16 nt, Homo sapiens
uucacagaugugugau

SEQ ID NO: 1521466 - RNA, 15 nt, Homo sapiens
uucacuguggucuca

SEQ ID NO: 1521467 - RNA, 23 nt, Homo sapiens
uucacuuuuggcaaugacucaaa

SEQ ID NO: 1521468 - RNA, 17 nt, Homo sapiens
uucagaacauccuccaa

SEQ ID NO: 1521469 - RNA, 14 nt, Homo sapiens
uucagccaggagau

SEQ ID NO: 1521470 - RNA, 16 nt, Homo sapiens
uucagugguccaggau

SEQ ID NO: 1521471 - RNA, 14 nt, Homo sapiens
uucaguuuccccau

SEQ ID NO: 1521472 - RNA, 15 nt, Homo sapiens
uucaugaguauucau

SEQ ID NO: 1521473 - RNA, 19 nt, Homo sapiens
uucauucuuuuugaaaugu

SEQ ID NO: 1521474 - RNA, 21 nt, Homo sapiens
uuccaaggaaauacauaugca

SEQ ID NO: 1521475 - RNA, 15 nt, Homo sapiens
uuccacaaaccugga

SEQ ID NO: 1521476 - RNA, 15 nt, Homo sapiens
uuccauuucuuccac

SEQ ID NO: 1521477 - RNA, 16 nt, Homo sapiens
uuccugauaacuuuaa

SEQ ID NO: 1521478 - RNA, 23 nt, Homo sapiens
uuccugcuaauaauuugccauua

SEQ ID NO: 1521479 - RNA, 13 nt, Homo sapiens
uucucucucuggu

SEQ ID NO: 1521480 - RNA, 12 nt, Homo sapiens
uucugcauuuca

SEQ ID NO: 1521481 - RNA, 18 nt, Homo sapiens
uucuggaggaagaagaca

SEQ ID NO: 1521482 - RNA, 19 nt, Homo sapiens
uucuuaaugcuuuccuccc

SEQ ID NO: 1521483 - RNA, 18 nt, Homo sapiens
uucuuacguacacuguac

SEQ ID NO: 1521484 - RNA, 24 nt, Homo sapiens
uucuuccaaggaaauacauaugca

SEQ ID NO: 1521485 - RNA, 21 nt, Homo sapiens
uucuuccucaaagcauuugca

SEQ ID NO: 1521486 - RNA, 22 nt, Homo sapiens
uucuuucccuagaggcaaacau

SEQ ID NO: 1521487 - RNA, 20 nt, Homo sapiens
uugaaagaaauguacuacua

SEQ ID NO: 1521488 - RNA, 13 nt, Homo sapiens
uuccacauuaauu

SEQ ID NO: 1521489 - RNA, 15 nt, Homo sapiens
uucccacagugccua

SEQ ID NO: 1521490 - RNA, 20 nt, Homo sapiens
uucccuauuuugccaguggg

SEQ ID NO: 1521491 - RNA, 22 nt, Homo sapiens
uuccuagugccuacaaugggaa

SEQ ID NO: 1521492 - RNA, 12 nt, Homo sapiens
uuccuguaagac

SEQ ID NO: 1521493 - RNA, 19 nt, Homo sapiens
uuccuuuuucuaugaaaua

SEQ ID NO: 1521494 - RNA, 20 nt, Homo sapiens
uucucuuuuccuuugguccu

SEQ ID NO: 1521495 - RNA, 14 nt, Homo sapiens
uucuuaggccacau

SEQ ID NO: 1521496 - RNA, 17 nt, Homo sapiens
uucuucacuugcaggca

SEQ ID NO: 1521497 - RNA, 15 nt, Homo sapiens
uucuuguaaggcaua

SEQ ID NO: 1521498 - RNA, 13 nt, Homo sapiens
uucuuugcacuuu

SEQ ID NO: 1521499 - RNA, 15 nt, Homo sapiens
uucuuuuggcuuuga

SEQ ID NO: 1521500 - RNA, 18 nt, Homo sapiens
uucuuuuugaaaugucaa

SEQ ID NO: 1521501 - RNA, 11 nt, Homo sapiens
uugaaaagccu

SEQ ID NO: 1521502 - RNA, 12 nt, Homo sapiens
uugaaaugucaa

SEQ ID NO: 1521503 - RNA, 15 nt, Homo sapiens
uugacucuccagaaa

SEQ ID NO: 1521504 - RNA, 14 nt, Homo sapiens
uugaugacucauca

SEQ ID NO: 1521505 - RNA, 14 nt, Homo sapiens
uugauggugaugaa

SEQ ID NO: 1521506 - RNA, 17 nt, Homo sapiens
uugccaauguacauacc

SEQ ID NO: 1521507 - RNA, 14 nt, Homo sapiens
uuguaauacacaua

SEQ ID NO: 1521508 - RNA, 20 nt, Homo sapiens
uuguacaagguauuuacaca

SEQ ID NO: 1521509 - RNA, 22 nt, Homo sapiens
uuguacaagguauuuacacaua

SEQ ID NO: 1521510 - RNA, 20 nt, Homo sapiens
uugucccagggcugaugcug

SEQ ID NO: 1521511 - RNA, 10 nt, Homo sapiens
uugucuuccc

SEQ ID NO: 1521512 - RNA, 20 nt, Homo sapiens
uuguguuuuguuuuguauca

SEQ ID NO: 1521513 - RNA, 20 nt, Homo sapiens
uuguucuuuggaaauacaca

SEQ ID NO: 1521514 - RNA, 19 nt, Homo sapiens
uuguuguuuauaaagggag

SEQ ID NO: 1521515 - RNA, 15 nt, Homo sapiens
uuuaacaacuaugau

SEQ ID NO: 1521516 - RNA, 15 nt, Homo sapiens
uuuaauuuuugcaau

SEQ ID NO: 1521517 - RNA, 19 nt, Homo sapiens
uuuacaagggcauaaagua

SEQ ID NO: 1521518 - RNA, 23 nt, Homo sapiens
uuuauaaagggagauaacaaucu

SEQ ID NO: 1521519 - RNA, 18 nt, Homo sapiens
uuuccuuugguccuucaa

SEQ ID NO: 1521520 - RNA, 13 nt, Homo sapiens
uuucuuacguaca

SEQ ID NO: 1521521 - RNA, 23 nt, Homo sapiens
uuucuuguaaggcauacugccuu

SEQ ID NO: 1521522 - RNA, 17 nt, Homo sapiens
uuucuuuuuuauacuca

SEQ ID NO: 1521523 - RNA, 22 nt, Homo sapiens
uuuggaaaucacacgucuggcu

SEQ ID NO: 1521524 - RNA, 18 nt, Homo sapiens
uuugggguaauacuucca

SEQ ID NO: 1521525 - RNA, 17 nt, Homo sapiens
uuugucuuggauauaua

SEQ ID NO: 1521526 - RNA, 15 nt, Homo sapiens
uuuuacguaugagau

SEQ ID NO: 1521527 - RNA, 15 nt, Homo sapiens
uuuucguuugcauug

SEQ ID NO: 1521528 - RNA, 23 nt, Homo sapiens
uuuugcacaccuguuauugccaa

SEQ ID NO: 1521529 - RNA, 19 nt, Homo sapiens
uuuuuaaaacaucaauuga

SEQ ID NO: 1521530 - RNA, 16 nt, Homo sapiens
uuuuugagauggaauc

SEQ ID NO: 1521531 - RNA, 16 nt, Homo sapiens
ugaagaaaaaauggca

SEQ ID NO: 1521532 - RNA, 23 nt, Homo sapiens
ugaaggguucaccaggucaggga

SEQ ID NO: 1521533 - RNA, 19 nt, Homo sapiens
ugaagguagaauguuuuca

SEQ ID NO: 1521534 - RNA, 14 nt, Homo sapiens
ugaauacaggcaua

SEQ ID NO: 1521535 - RNA, 16 nt, Homo sapiens
ugaauuucccacauac

SEQ ID NO: 1521536 - RNA, 20 nt, Homo sapiens
ugaccucgcccuccacaaau

SEQ ID NO: 1521537 - RNA, 16 nt, Homo sapiens
ugaccugauguccauu

SEQ ID NO: 1521538 - RNA, 13 nt, Homo sapiens
ugacuacagccug

SEQ ID NO: 1521539 - RNA, 22 nt, Homo sapiens
ugacuacagccugccccugacu

SEQ ID NO: 1521540 - RNA, 23 nt, Homo sapiens
ugacucuccagaaagcucaucuc

SEQ ID NO: 1521541 - RNA, 19 nt, Homo sapiens
ugaguuacuaucaugucaa

SEQ ID NO: 1521542 - RNA, 17 nt, Homo sapiens
ugauaacuuuaagauca

SEQ ID NO: 1521543 - RNA, 15 nt, Homo sapiens
ugauucacaguguga

SEQ ID NO: 1521544 - RNA, 22 nt, Homo sapiens
ugauucuuccaaggaaauacau

SEQ ID NO: 1521545 - RNA, 16 nt, Homo sapiens
ugcauaagugcaugac

SEQ ID NO: 1521546 - RNA, 22 nt, Homo sapiens
ugcauauuauaaaggauaaaga

SEQ ID NO: 1521547 - RNA, 14 nt, Homo sapiens
ugcauauuugcaaa

SEQ ID NO: 1521548 - RNA, 17 nt, Homo sapiens
ugccagugggaacuccu

SEQ ID NO: 1521549 - RNA, 12 nt, Homo sapiens
ugcccagugugu

SEQ ID NO: 1521550 - RNA, 22 nt, Homo sapiens
ugccucauuaccuugugcuaau

SEQ ID NO: 1521551 - RNA, 22 nt, Homo sapiens
ugccuuuuuuucucugcauuua

SEQ ID NO: 1521552 - RNA, 20 nt, Homo sapiens
ugcuagauaauaaaauugcu

SEQ ID NO: 1521553 - RNA, 21 nt, Homo sapiens
ugcuauaacuauguugauaaa

SEQ ID NO: 1521554 - RNA, 13 nt, Homo sapiens
ugcucccacagaa

SEQ ID NO: 1521555 - RNA, 22 nt, Homo sapiens
ugcucuuccauuucuuccacga

SEQ ID NO: 1521556 - RNA, 11 nt, Homo sapiens
ugcucuugccu

SEQ ID NO: 1521557 - RNA, 22 nt, Homo sapiens
ugcugcauuuucuucacuugca

SEQ ID NO: 1521558 - RNA, 21 nt, Homo sapiens
ugcuuauuuuguuggaguauu

SEQ ID NO: 1521559 - RNA, 22 nt, Homo sapiens
ugcuucaggauccaagugacaa

SEQ ID NO: 1521560 - RNA, 14 nt, Homo sapiens
uggaaaauaaauca

SEQ ID NO: 1521561 - RNA, 14 nt, Homo sapiens
uggaacaagcacag

SEQ ID NO: 1521562 - RNA, 17 nt, Homo sapiens
uggaacaagcacagaug

SEQ ID NO: 1521563 - RNA, 22 nt, Homo sapiens
uggaagggaguuggugugcuau

SEQ ID NO: 1521564 - RNA, 16 nt, Homo sapiens
uggaaugaaauaauuc

SEQ ID NO: 1521565 - RNA, 19 nt, Homo sapiens
uggaauugcugcucucuga

SEQ ID NO: 1521566 - RNA, 19 nt, Homo sapiens
uggaucuccauucucucag

SEQ ID NO: 1521567 - RNA, 16 nt, Homo sapiens
uggcacccaugcaccu

SEQ ID NO: 1521568 - RNA, 17 nt, Homo sapiens
uggccaucaggacuuuc

SEQ ID NO: 1521569 - RNA, 21 nt, Homo sapiens
uggcuucacagaugugugauu

SEQ ID NO: 1521570 - RNA, 13 nt, Homo sapiens
ugggaacuccuaa

SEQ ID NO: 1521571 - RNA, 15 nt, Homo sapiens
ugggaacugcaauaa

SEQ ID NO: 1521572 - RNA, 20 nt, Homo sapiens
ugggauguuauauuugagaa

SEQ ID NO: 1521573 - RNA, 15 nt, Homo sapiens
ugggguaauacuucc

SEQ ID NO: 1521574 - RNA, 21 nt, Homo sapiens
ugggugaacaccaacuuuuau

SEQ ID NO: 1521575 - RNA, 16 nt, Homo sapiens
uggguucacaccauuc

SEQ ID NO: 1521576 - RNA, 20 nt, Homo sapiens
ugguggcacacgccuguaau

SEQ ID NO: 1521577 - RNA, 21 nt, Homo sapiens
uguaaagcaggugcccaggaa

SEQ ID NO: 1521578 - RNA, 20 nt, Homo sapiens
uguaaauacuguuuuuaaca

SEQ ID NO: 1521579 - RNA, 15 nt, Homo sapiens
uguaauacacauauc

SEQ ID NO: 1521580 - RNA, 23 nt, Homo sapiens
uguaauuuugaacuguuuaacac

SEQ ID NO: 1521581 - RNA, 20 nt, Homo sapiens
uguacaagguauuuacacau

SEQ ID NO: 1521582 - RNA, 21 nt, Homo sapiens
uguaugauccuaaugaaugca

SEQ ID NO: 1521583 - RNA, 17 nt, Homo sapiens
uguauuagucacagaga

SEQ ID NO: 1521584 - RNA, 15 nt, Homo sapiens
ugucacccaaugcau

SEQ ID NO: 1521585 - RNA, 17 nt, Homo sapiens
ugucccucacugccuuc

SEQ ID NO: 1521586 - RNA, 16 nt, Homo sapiens
ugucuauuaaagauau

SEQ ID NO: 1521587 - RNA, 21 nt, Homo sapiens
ugucuguaauaauagacugua

SEQ ID NO: 1521588 - RNA, 17 nt, Homo sapiens
ugugccccguguucccu

SEQ ID NO: 1521589 - RNA, 13 nt, Homo sapiens
ugugcucagggaa

SEQ ID NO: 1521590 - RNA, 20 nt, Homo sapiens
uguuaaacuuuuuaccaagu

SEQ ID NO: 1521591 - RNA, 13 nt, Homo sapiens
uguucagaugcuu

SEQ ID NO: 1521592 - RNA, 15 nt, Homo sapiens
uguuccugcuaauaa

SEQ ID NO: 1521593 - RNA, 14 nt, Homo sapiens
uguuucugaucuga

SEQ ID NO: 1521594 - RNA, 16 nt, Homo sapiens
uuaaaaauuacuguuu

SEQ ID NO: 1521595 - RNA, 17 nt, Homo sapiens
uuaaaacauugguuaua

SEQ ID NO: 1521596 - RNA, 18 nt, Homo sapiens
uuaaauccugaagagcau

SEQ ID NO: 1521597 - RNA, 21 nt, Homo sapiens
uuaagauuuuuuauuugaaaa

SEQ ID NO: 1521598 - RNA, 19 nt, Homo sapiens
uuaagucucugacucuugc

SEQ ID NO: 1521599 - RNA, 16 nt, Homo sapiens
uuaaguugauggugau

SEQ ID NO: 1521600 - RNA, 20 nt, Homo sapiens
uuaaguugauggugaugaaa

SEQ ID NO: 1521601 - RNA, 15 nt, Homo sapiens
uuaauauuucugagg

SEQ ID NO: 1521602 - RNA, 18 nt, Homo sapiens
uuaauuagauuuucuugc

SEQ ID NO: 1521603 - RNA, 21 nt, Homo sapiens
uuaauucauucuggucuuuga

SEQ ID NO: 1521604 - RNA, 13 nt, Homo sapiens
uuaauuuuugcaa

SEQ ID NO: 1521605 - RNA, 14 nt, Homo sapiens
uuaccaaguacaaa

SEQ ID NO: 1521606 - RNA, 17 nt, Homo sapiens
uuacuaucaugucaaac

SEQ ID NO: 1521607 - RNA, 12 nt, Homo sapiens
uuacuuauauau

SEQ ID NO: 1521608 - RNA, 17 nt, Homo sapiens
uuagaguaaugaaaugg

SEQ ID NO: 1521609 - RNA, 19 nt, Homo sapiens
uuagaguaaugaaauggag

SEQ ID NO: 1521610 - RNA, 17 nt, Homo sapiens
uuagauaaccauauuca

SEQ ID NO: 1521611 - RNA, 17 nt, Homo sapiens
uuauaaaagaugcauua

SEQ ID NO: 1521612 - RNA, 20 nt, Homo sapiens
uuauaaaggauaaagaagga

SEQ ID NO: 1521613 - RNA, 21 nt, Homo sapiens
uuauauaauuuugcagcagaa

SEQ ID NO: 1521614 - RNA, 13 nt, Homo sapiens
uuauccugcauuu

SEQ ID NO: 1521615 - RNA, 13 nt, Homo sapiens
uuaucuauggcac

SEQ ID NO: 1521616 - RNA, 16 nt, Homo sapiens
uuaucuccugucuaca

SEQ ID NO: 1521617 - RNA, 13 nt, Homo sapiens
uuaugacugugaa

SEQ ID NO: 1521618 - RNA, 18 nt, Homo sapiens
uuauuaccuuuacauauu

SEQ ID NO: 1521619 - RNA, 13 nt, Homo sapiens
uuauucuuccuca

SEQ ID NO: 1521620 - RNA, 15 nt, Homo sapiens
uucaaauguucucca

SEQ ID NO: 1521621 - RNA, 17 nt, Homo sapiens
uucacagaugugugauu

SEQ ID NO: 1521622 - RNA, 12 nt, Homo sapiens
uucacaguguga

SEQ ID NO: 1521623 - RNA, 14 nt, Homo sapiens
uucacucaaucucu

SEQ ID NO: 1521624 - RNA, 11 nt, Homo sapiens
uucacuguggc

SEQ ID NO: 1521625 - RNA, 18 nt, Homo sapiens
uucaggagcugaagccca

SEQ ID NO: 1521626 - RNA, 15 nt, Homo sapiens
uucagugagaaucug

SEQ ID NO: 1521627 - RNA, 16 nt, Homo sapiens
uucagugcuucgcaga

SEQ ID NO: 1521628 - RNA, 18 nt, Homo sapiens
uucaucccacccucucac

SEQ ID NO: 1521629 - RNA, 17 nt, Homo sapiens
uucauucuggucuuuga

SEQ ID NO: 1521630 - RNA, 18 nt, Homo sapiens
uuccaaggaaauacauau

SEQ ID NO: 1521631 - RNA, 21 nt, Homo sapiens
uucccuauuuugccaguggga

SEQ ID NO: 1521632 - RNA, 14 nt, Homo sapiens
uucccucucuugcc

SEQ ID NO: 1521633 - RNA, 22 nt, Homo sapiens
uucccuguucuucguugcugca

SEQ ID NO: 1521634 - RNA, 17 nt, Homo sapiens
uuccucaaagcauuugc

SEQ ID NO: 1521635 - RNA, 18 nt, Homo sapiens
uuccucaaagcauuugca

SEQ ID NO: 1521636 - RNA, 13 nt, Homo sapiens
uuccucuccagcc

SEQ ID NO: 1521637 - RNA, 21 nt, Homo sapiens
uuccugcuaauaauuugccau

SEQ ID NO: 1521638 - RNA, 21 nt, Homo sapiens
uucuaaagacuuguauagcau

SEQ ID NO: 1521639 - RNA, 13 nt, Homo sapiens
uugcccagugugu

SEQ ID NO: 1521640 - RNA, 15 nt, Homo sapiens
uugcucccuaccuga

SEQ ID NO: 1521641 - RNA, 22 nt, Homo sapiens
uugcugcauuuucuucacuugc

SEQ ID NO: 1521642 - RNA, 22 nt, Homo sapiens
uuggaagggaguuggugugcua

SEQ ID NO: 1521643 - RNA, 16 nt, Homo sapiens
uugggauauucugaaa

SEQ ID NO: 1521644 - RNA, 13 nt, Homo sapiens
uuguaauacacau

SEQ ID NO: 1521645 - RNA, 20 nt, Homo sapiens
uuguaguuuuggcuaguccu

SEQ ID NO: 1521646 - RNA, 18 nt, Homo sapiens
uuguaugauccuaaugaa

SEQ ID NO: 1521647 - RNA, 16 nt, Homo sapiens
uugucuucccuucuuu

SEQ ID NO: 1521648 - RNA, 14 nt, Homo sapiens
uuguuugugcuuca

SEQ ID NO: 1521649 - RNA, 22 nt, Homo sapiens
uuuaagcacccuagaggacuag

SEQ ID NO: 1521650 - RNA, 14 nt, Homo sapiens
uuuaaucacauucg

SEQ ID NO: 1521651 - RNA, 17 nt, Homo sapiens
uuuaaugccuuccacau

SEQ ID NO: 1521652 - RNA, 18 nt, Homo sapiens
uuuaauguuagugaucca

SEQ ID NO: 1521653 - RNA, 17 nt, Homo sapiens
uuuaauugacauacuca

SEQ ID NO: 1521654 - RNA, 23 nt, Homo sapiens
uuuacuuuugcucccuaccugac

SEQ ID NO: 1521655 - RNA, 19 nt, Homo sapiens
uuuaguccacccaauggcu

SEQ ID NO: 1521656 - RNA, 16 nt, Homo sapiens
uuuauaaaauugcuau

SEQ ID NO: 1521657 - RNA, 18 nt, Homo sapiens
uuuaucuauggcacccau

SEQ ID NO: 1521658 - RNA, 15 nt, Homo sapiens
uuuauucuuccucaa

SEQ ID NO: 1521659 - RNA, 17 nt, Homo sapiens
uuucaagaagacuggca

SEQ ID NO: 1521660 - RNA, 21 nt, Homo sapiens
uuucaggccacauggcuaaag

SEQ ID NO: 1521661 - RNA, 14 nt, Homo sapiens
uuucuucacuugca

SEQ ID NO: 1521662 - RNA, 18 nt, Homo sapiens
uuucuuuuuuauacucaa

SEQ ID NO: 1521663 - RNA, 14 nt, Homo sapiens
uuugaaaucuauga

SEQ ID NO: 1521664 - RNA, 18 nt, Homo sapiens
uuugaagguagaauguuu

SEQ ID NO: 1521665 - RNA, 18 nt, Homo sapiens
uuugccagugggaacucc

SEQ ID NO: 1521666 - RNA, 22 nt, Homo sapiens
uuugcucccuaccugacugcca

SEQ ID NO: 1521667 - RNA, 16 nt, Homo sapiens
uuuguaucauuaugaa

SEQ ID NO: 1521668 - RNA, 22 nt, Homo sapiens
uuugugcagagauaaagaccuu

SEQ ID NO: 1521669 - RNA, 12 nt, Homo sapiens
uuuucuacucca

SEQ ID NO: 1521670 - RNA, 20 nt, Homo sapiens
uuuugaagauucuauguuaa

SEQ ID NO: 1521671 - RNA, 14 nt, Homo sapiens
uuuuuaauucauuc

SEQ ID NO: 1521672 - RNA, 23 nt, Homo sapiens
aucucagcuccugaaaaaugccu

SEQ ID NO: 1521673 - RNA, 19 nt, Homo sapiens
aucucagcuggaucuccau

SEQ ID NO: 1521674 - RNA, 21 nt, Homo sapiens
aucuccaaacuaaacccucac

SEQ ID NO: 1521675 - RNA, 22 nt, Homo sapiens
aucucugauucugucaaugucu

SEQ ID NO: 1521676 - RNA, 22 nt, Homo sapiens
aucucugcuuuggaaaucacac

SEQ ID NO: 1521677 - RNA, 18 nt, Homo sapiens
aucuguauuaaugcuuga

SEQ ID NO: 1521678 - RNA, 14 nt, Homo sapiens
aucuuagcuuucca

SEQ ID NO: 1521679 - RNA, 17 nt, Homo sapiens
aucuuagcuuuccacag

SEQ ID NO: 1521680 - RNA, 21 nt, Homo sapiens
aucuuauuacugagagugcaa

SEQ ID NO: 1521681 - RNA, 22 nt, Homo sapiens
aucuuauuacugagagugcaaa

SEQ ID NO: 1521682 - RNA, 15 nt, Homo sapiens
aucuuuaacacaacu

SEQ ID NO: 1521683 - RNA, 17 nt, Homo sapiens
aucuuuuaagcuaucua

SEQ ID NO: 1521684 - RNA, 17 nt, Homo sapiens
augaaauaucaugcucc

SEQ ID NO: 1521685 - RNA, 19 nt, Homo sapiens
augaaauggaggaucucua

SEQ ID NO: 1521686 - RNA, 23 nt, Homo sapiens
augaaccugcccugcucccacag

SEQ ID NO: 1521687 - RNA, 17 nt, Homo sapiens
augaacuugcaaacagg

SEQ ID NO: 1521688 - RNA, 17 nt, Homo sapiens
augaaugggagugaggg

SEQ ID NO: 1521689 - RNA, 22 nt, Homo sapiens
augaauguaauuuugaacuguu

SEQ ID NO: 1521690 - RNA, 14 nt, Homo sapiens
augauacuucccac

SEQ ID NO: 1521691 - RNA, 16 nt, Homo sapiens
augauccuaaugaaug

SEQ ID NO: 1521692 - RNA, 22 nt, Homo sapiens
augauccuaaugaaugcauaaa

SEQ ID NO: 1521693 - RNA, 18 nt, Homo sapiens
augaugaccaagaauuac

SEQ ID NO: 1521694 - RNA, 16 nt, Homo sapiens
augauucuuccaagga

SEQ ID NO: 1521695 - RNA, 14 nt, Homo sapiens
augcagcaucuaag

SEQ ID NO: 1521696 - RNA, 15 nt, Homo sapiens
augcauaaaauguua

SEQ ID NO: 1521697 - RNA, 22 nt, Homo sapiens
augcauucuuuugcacaccugu

SEQ ID NO: 1521698 - RNA, 19 nt, Homo sapiens
augccagccacugugauag

SEQ ID NO: 1521699 - RNA, 19 nt, Homo sapiens
augccucauuaccuugugc

SEQ ID NO: 1521700 - RNA, 18 nt, Homo sapiens
augcuauaacuauguuga

SEQ ID NO: 1521701 - RNA, 16 nt, Homo sapiens
auggcacccaugcacc

SEQ ID NO: 1521702 - RNA, 17 nt, Homo sapiens
auggcacccaugcaccu

SEQ ID NO: 1521703 - RNA, 24 nt, Homo sapiens
augguaauucaguuauuugcacaa

SEQ ID NO: 1521704 - RNA, 22 nt, Homo sapiens
auguaaagaacgcgacuuccac

SEQ ID NO: 1521705 - RNA, 15 nt, Homo sapiens
auguggugauacuga

SEQ ID NO: 1521706 - RNA, 12 nt, Homo sapiens
augugugauuca

SEQ ID NO: 1521707 - RNA, 20 nt, Homo sapiens
auguugcccaguguguuucu

SEQ ID NO: 1521708 - RNA, 12 nt, Homo sapiens
auuaagagcaaa

SEQ ID NO: 1521709 - RNA, 16 nt, Homo sapiens
auuaagagcaaacuuu

SEQ ID NO: 1521710 - RNA, 19 nt, Homo sapiens
auuaagggaauaagccaug

SEQ ID NO: 1521711 - RNA, 18 nt, Homo sapiens
auuaagucaucaucucca

SEQ ID NO: 1521712 - RNA, 15 nt, Homo sapiens
auuacaggcuugaaa

SEQ ID NO: 1521713 - RNA, 14 nt, Homo sapiens
auuaccuugugcua

SEQ ID NO: 1521714 - RNA, 11 nt, Homo sapiens
auuacugagag

SEQ ID NO: 1521715 - RNA, 18 nt, Homo sapiens
auuaucuaugauaugcua

SEQ ID NO: 1521716 - RNA, 13 nt, Homo sapiens
auuaugaagucau

SEQ ID NO: 1521717 - RNA, 13 nt, Homo sapiens
auucacaguguga

SEQ ID NO: 1521718 - RNA, 20 nt, Homo sapiens
auucacuuuauuauuuugcu

SEQ ID NO: 1521719 - RNA, 17 nt, Homo sapiens
auucaggcaacgcacaa

SEQ ID NO: 1521720 - RNA, 18 nt, Homo sapiens
auucauaaaucuauucau

SEQ ID NO: 1521721 - RNA, 15 nt, Homo sapiens
auuccaaaguuuuga

SEQ ID NO: 1521722 - RNA, 15 nt, Homo sapiens
auuccuuugcauauu

SEQ ID NO: 1521723 - RNA, 15 nt, Homo sapiens
auucuccugccucag

SEQ ID NO: 1521724 - RNA, 21 nt, Homo sapiens
auucucucaggcuugcugcca

SEQ ID NO: 1521725 - RNA, 18 nt, Homo sapiens
auucugugucaaacaccu

SEQ ID NO: 1521726 - RNA, 20 nt, Homo sapiens
auucuguuuuucguuugcau

SEQ ID NO: 1521727 - RNA, 19 nt, Homo sapiens
auucuuccucaaagcauuu

SEQ ID NO: 1521728 - RNA, 19 nt, Homo sapiens
auucuuuuugaaaugucaa

SEQ ID NO: 1521729 - RNA, 21 nt, Homo sapiens
auuguacaagguauuuacaca

SEQ ID NO: 1521730 - RNA, 19 nt, Homo sapiens
auuuaauaugggugaacac

SEQ ID NO: 1521731 - RNA, 20 nt, Homo sapiens
auuuauggaaaauacucuga

SEQ ID NO: 1521732 - RNA, 13 nt, Homo sapiens
auuucaagaccuc

SEQ ID NO: 1521733 - RNA, 18 nt, Homo sapiens
auuuggaaaauaaaucaa

SEQ ID NO: 1521734 - RNA, 22 nt, Homo sapiens
auuugucuucccuucuuugcac

SEQ ID NO: 1521735 - RNA, 17 nt, Homo sapiens
auuuguuugugcuucaa

SEQ ID NO: 1521736 - RNA, 14 nt, Homo sapiens
auuuucacauaggu

SEQ ID NO: 1521737 - RNA, 15 nt, Homo sapiens
auuuucuucacuugc

SEQ ID NO: 1521738 - RNA, 22 nt, Homo sapiens
auuuuuaacuuaauggcacaaa

SEQ ID NO: 1521739 - RNA, 17 nt, Homo sapiens
caaaacagaaaaugaag

SEQ ID NO: 1521740 - RNA, 15 nt, Homo sapiens
caaacuaaacccuca

SEQ ID NO: 1521741 - RNA, 16 nt, Homo sapiens
aacaguagcagggaau

SEQ ID NO: 1521742 - RNA, 19 nt, Homo sapiens
aacaugccagccacuguga

SEQ ID NO: 1521743 - RNA, 13 nt, Homo sapiens
aacaugugcucag

SEQ ID NO: 1521744 - RNA, 19 nt, Homo sapiens
aacccuauugguaaagaau

SEQ ID NO: 1521745 - RNA, 13 nt, Homo sapiens
aacuaaaauguuc

SEQ ID NO: 1521746 - RNA, 15 nt, Homo sapiens
aacuugcaacuuuga

SEQ ID NO: 1521747 - RNA, 15 nt, Homo sapiens
aacuuuuaccacaaa

SEQ ID NO: 1521748 - RNA, 12 nt, Homo sapiens
aagaaagggcaa

SEQ ID NO: 1521749 - RNA, 16 nt, Homo sapiens
aagaacgcgacuucca

SEQ ID NO: 1521750 - RNA, 17 nt, Homo sapiens
aagaacgcgacuuccac

SEQ ID NO: 1521751 - RNA, 16 nt, Homo sapiens
aagaagacacauuccu

SEQ ID NO: 1521752 - RNA, 17 nt, Homo sapiens
aagacaccguucauuca

SEQ ID NO: 1521753 - RNA, 19 nt, Homo sapiens
aagagaugugacuacagcc

SEQ ID NO: 1521754 - RNA, 22 nt, Homo sapiens
aagagcagugguaagaauagua

SEQ ID NO: 1521755 - RNA, 17 nt, Homo sapiens
aagcaaugguugaugau

SEQ ID NO: 1521756 - RNA, 19 nt, Homo sapiens
aagcacagauguucuucaa

SEQ ID NO: 1521757 - RNA, 13 nt, Homo sapiens
aagcucaucucag

SEQ ID NO: 1521758 - RNA, 20 nt, Homo sapiens
aagggaguuggugugcuauu

SEQ ID NO: 1521759 - RNA, 18 nt, Homo sapiens
aagggcucacgcauucag

SEQ ID NO: 1521760 - RNA, 18 nt, Homo sapiens
aagguagaaaugucuaug

SEQ ID NO: 1521761 - RNA, 19 nt, Homo sapiens
aagguggaacaagcacaga

SEQ ID NO: 1521762 - RNA, 22 nt, Homo sapiens
aaguacuuuccaaucucaguca

SEQ ID NO: 1521763 - RNA, 15 nt, Homo sapiens
aagucaucaucucca

SEQ ID NO: 1521764 - RNA, 17 nt, Homo sapiens
aagucuuugguacaagu

SEQ ID NO: 1521765 - RNA, 14 nt, Homo sapiens
aagugagacugaca

SEQ ID NO: 1521766 - RNA, 21 nt, Homo sapiens
aaguucccuucuauauccuca

SEQ ID NO: 1521767 - RNA, 21 nt, Homo sapiens
aauagucuaaggccauggcau

SEQ ID NO: 1521768 - RNA, 15 nt, Homo sapiens
aauaucaugcuccau

SEQ ID NO: 1521769 - RNA, 15 nt, Homo sapiens
aauauuccuuugcau

SEQ ID NO: 1521770 - RNA, 15 nt, Homo sapiens
aaucaaugcuauaac

SEQ ID NO: 1521771 - RNA, 12 nt, Homo sapiens
aaucacaguaua

SEQ ID NO: 1521772 - RNA, 18 nt, Homo sapiens
aauccauccugcucuucc

SEQ ID NO: 1521773 - RNA, 19 nt, Homo sapiens
aaucccaaauucacuuuau

SEQ ID NO: 1521774 - RNA, 16 nt, Homo sapiens
aaucccccagcacuuc

SEQ ID NO: 1521775 - RNA, 21 nt, Homo sapiens
aaucuaucgugucaaccccaa

SEQ ID NO: 1521776 - RNA, 20 nt, Homo sapiens
aaucugacuucucacuuccu

SEQ ID NO: 1521777 - RNA, 15 nt, Homo sapiens
aaugauccuuccuac

SEQ ID NO: 1521778 - RNA, 23 nt, Homo sapiens
aaugauuucacagugugugguca

SEQ ID NO: 1521779 - RNA, 23 nt, Homo sapiens
aaugcauauccaacaugugcuca

SEQ ID NO: 1521780 - RNA, 20 nt, Homo sapiens
aaugcccccugagugacugc

SEQ ID NO: 1521781 - RNA, 17 nt, Homo sapiens
aaugcuauaacuauguu

SEQ ID NO: 1521782 - RNA, 15 nt, Homo sapiens
aauguaugugcacau

SEQ ID NO: 1521783 - RNA, 18 nt, Homo sapiens
aaugugauuugucuuccc

SEQ ID NO: 1521784 - RNA, 22 nt, Homo sapiens
aauugcuucuucuucaagauuu

SEQ ID NO: 1521785 - RNA, 16 nt, Homo sapiens
acaaguuccugauaac

SEQ ID NO: 1521786 - RNA, 11 nt, Homo sapiens
acaauggugcu

SEQ ID NO: 1521787 - RNA, 15 nt, Homo sapiens
acacaaguuccugau

SEQ ID NO: 1521788 - RNA, 14 nt, Homo sapiens
acacauacaacuuc

SEQ ID NO: 1521789 - RNA, 14 nt, Homo sapiens
acaccguucauuca

SEQ ID NO: 1521790 - RNA, 21 nt, Homo sapiens
acagacagggccuagcuuuca

SEQ ID NO: 1521791 - RNA, 22 nt, Homo sapiens
acagaugugugauucacagugu

SEQ ID NO: 1521792 - RNA, 19 nt, Homo sapiens
acagcuugguguacuuaau

SEQ ID NO: 1521793 - RNA, 20 nt, Homo sapiens
caguuauuugcacaaguuca

SEQ ID NO: 1521794 - RNA, 21 nt, Homo sapiens
cauagguuagauucucauuca

SEQ ID NO: 1521795 - RNA, 23 nt, Homo sapiens
cauauucacaauggaaacuuuag

SEQ ID NO: 1521796 - RNA, 17 nt, Homo sapiens
caugcguuuaaucacau

SEQ ID NO: 1521797 - RNA, 18 nt, Homo sapiens
caugucuauuuuugauga

SEQ ID NO: 1521798 - RNA, 21 nt, Homo sapiens
cauuaaaaaugaaagccaaau

SEQ ID NO: 1521799 - RNA, 16 nt, Homo sapiens
cauuacauugccauuu

SEQ ID NO: 1521800 - RNA, 15 nt, Homo sapiens
cauucgaguguuuca

SEQ ID NO: 1521801 - RNA, 21 nt, Homo sapiens
cauucuccugccucagccucc

SEQ ID NO: 1521802 - RNA, 12 nt, Homo sapiens
cauucuuuugca

SEQ ID NO: 1521803 - RNA, 13 nt, Homo sapiens
cauucuuuugcac

SEQ ID NO: 1521804 - RNA, 13 nt, Homo sapiens
cauugucuuuaau

SEQ ID NO: 1521805 - RNA, 16 nt, Homo sapiens
cauuugaaaucuauga

SEQ ID NO: 1521806 - RNA, 22 nt, Homo sapiens
ccaaauccauccugcucuucca

SEQ ID NO: 1521807 - RNA, 18 nt, Homo sapiens
ccaacaugugcucaggga

SEQ ID NO: 1521808 - RNA, 23 nt, Homo sapiens
ccacagaacacagcaauuccuca

SEQ ID NO: 1521809 - RNA, 17 nt, Homo sapiens
ccagaaagcucaucuca

SEQ ID NO: 1521810 - RNA, 18 nt, Homo sapiens
ccaggcaacuugggaacu

SEQ ID NO: 1521811 - RNA, 17 nt, Homo sapiens
ccagggcugaugcugua

SEQ ID NO: 1521812 - RNA, 17 nt, Homo sapiens
ccagucauuauguuaau

SEQ ID NO: 1521813 - RNA, 14 nt, Homo sapiens
ccaucaggacuuuc

SEQ ID NO: 1521814 - RNA, 21 nt, Homo sapiens
cccaaguacuuuccaaucuca

SEQ ID NO: 1521815 - RNA, 15 nt, Homo sapiens
cccaggcaugcaaug

SEQ ID NO: 1521816 - RNA, 16 nt, Homo sapiens
cccaggcaugcaaugc

SEQ ID NO: 1521817 - RNA, 19 nt, Homo sapiens
cccaggcuggagugcagug

SEQ ID NO: 1521818 - RNA, 20 nt, Homo sapiens
cccaggcuggagugcagugg

SEQ ID NO: 1521819 - RNA, 13 nt, Homo sapiens
cccagggcacuuc

SEQ ID NO: 1521820 - RNA, 16 nt, Homo sapiens
cccucucuugccuuuc

SEQ ID NO: 1521821 - RNA, 12 nt, Homo sapiens
cccugacugugu

SEQ ID NO: 1521822 - RNA, 18 nt, Homo sapiens
cccuggaaggacauccau

SEQ ID NO: 1521823 - RNA, 17 nt, Homo sapiens
cccugucuaaaaauuca

SEQ ID NO: 1521824 - RNA, 17 nt, Homo sapiens
cccuucuuugcacuuuu

SEQ ID NO: 1521825 - RNA, 21 nt, Homo sapiens
cccuucuuugcacuuuugaaa

SEQ ID NO: 1521826 - RNA, 12 nt, Homo sapiens
ccgagaagaaca

SEQ ID NO: 1521827 - RNA, 17 nt, Homo sapiens
ccgguucuuaaauccau

SEQ ID NO: 1521828 - RNA, 18 nt, Homo sapiens
ccuaaugaaugcauaaaa

SEQ ID NO: 1521829 - RNA, 16 nt, Homo sapiens
ccucaaagcauuugca

SEQ ID NO: 1521830 - RNA, 14 nt, Homo sapiens
ccucagccuccuga

SEQ ID NO: 1521831 - RNA, 20 nt, Homo sapiens
ccucauuaccuugugcuaau
